United States Patent 7,314,750 (ADDRESSABLE OLIGONUCLEOTIDE ARRAY OF THE RAT GENOME) - sequence listing, part 18

SEQ ID NO: 641752 - DNA, 25 bp, Rattus norvegicus
tggttccccggctagggttgctcga

SEQ ID NO: 641753 - DNA, 25 bp, Rattus norvegicus
tggttccccttcagagggatgcaag

SEQ ID NO: 641754 - DNA, 25 bp, Rattus norvegicus
tggttccccttctgagggatgcaag

SEQ ID NO: 641755 - DNA, 25 bp, Rattus norvegicus
tggttcccggcacacatgttgggca

SEQ ID NO: 641756 - DNA, 25 bp, Rattus norvegicus
tggttcccggcagacatgttgggca

SEQ ID NO: 641757 - DNA, 25 bp, Rattus norvegicus
tggttcccggccatatgtggtaaca

SEQ ID NO: 641758 - DNA, 25 bp, Rattus norvegicus
tggttcccggccttatgtggtaaca

SEQ ID NO: 641759 - DNA, 25 bp, Rattus norvegicus
tggttccctcttctgaagctggaag

SEQ ID NO: 641760 - DNA, 25 bp, Rattus norvegicus
tggttccctcttgtgaagctggaag

SEQ ID NO: 641761 - DNA, 25 bp, Rattus norvegicus
tggttccctttgctcacgtgagttg

SEQ ID NO: 641762 - DNA, 25 bp, Rattus norvegicus
tggttccctttggtcacgtgagttg

SEQ ID NO: 641763 - DNA, 25 bp, Rattus norvegicus
tggttcctaatccagtgtcctgaga

SEQ ID NO: 641764 - DNA, 25 bp, Rattus norvegicus
tggttcctaatcgagtgtcctgaga

SEQ ID NO: 641765 - DNA, 25 bp, Rattus norvegicus
tggttcctacaaacactgtcctgca

SEQ ID NO: 641766 - DNA, 25 bp, Rattus norvegicus
tggttcctacaatcactgtcctgca

SEQ ID NO: 641767 - DNA, 25 bp, Rattus norvegicus
tggttcctaccaattctgtattttt

SEQ ID NO: 641768 - DNA, 25 bp, Rattus norvegicus
tggttcctaccatttctgtattttt

SEQ ID NO: 641769 - DNA, 25 bp, Rattus norvegicus
tggttcctacccacaagtcttgcca

SEQ ID NO: 641770 - DNA, 25 bp, Rattus norvegicus
tggttcctaccctcaagtcttgcca

SEQ ID NO: 641771 - DNA, 25 bp, Rattus norvegicus
tggttcctataaaaacctgccactt

SEQ ID NO: 641772 - DNA, 25 bp, Rattus norvegicus
tggttcctataataacctgccactt

SEQ ID NO: 641773 - DNA, 25 bp, Rattus norvegicus
tggttcctcctgactcctattgctt

SEQ ID NO: 641774 - DNA, 25 bp, Rattus norvegicus
tggttcctcctgtctcctattgctt

SEQ ID NO: 641775 - DNA, 25 bp, Rattus norvegicus
tggttcctctgcaggagcagccagt

SEQ ID NO: 641776 - DNA, 25 bp, Rattus norvegicus
tggttcctctgctggagcagccagt

SEQ ID NO: 641777 - DNA, 25 bp, Rattus norvegicus
tggttcctgaggatcctgccttggc

SEQ ID NO: 641778 - DNA, 25 bp, Rattus norvegicus
tggttcctgaggttcctgccttggc

SEQ ID NO: 641779 - DNA, 25 bp, Rattus norvegicus
tggttcctggaccaggcagctgcac

SEQ ID NO: 641780 - DNA, 25 bp, Rattus norvegicus
tggttcctggacgaggcagctgcac

SEQ ID NO: 641781 - DNA, 25 bp, Rattus norvegicus
tggttcctggctccaagctgaggca

SEQ ID NO: 641782 - DNA, 25 bp, Rattus norvegicus
tggttcctggctgcaagctgaggca

SEQ ID NO: 641783 - DNA, 25 bp, Rattus norvegicus
tggttcctggttcctagatgtctgc

SEQ ID NO: 641784 - DNA, 25 bp, Rattus norvegicus
tggttcctggttgctagatgtctgc

SEQ ID NO: 641785 - DNA, 25 bp, Rattus norvegicus
tggttcctgtacctctatccgggtg

SEQ ID NO: 641786 - DNA, 25 bp, Rattus norvegicus
tggttcctgtacgtctatccgggtg

SEQ ID NO: 641787 - DNA, 25 bp, Rattus norvegicus
tggttcctgttgagctcttgtaaaa

SEQ ID NO: 641788 - DNA, 25 bp, Rattus norvegicus
tggttcctgttgtgctcttgtaaaa

SEQ ID NO: 641789 - DNA, 25 bp, Rattus norvegicus
tggttcctttgtccttaagaggttg

SEQ ID NO: 641790 - DNA, 25 bp, Rattus norvegicus
tggttcctttgtgcttaagaggttg

SEQ ID NO: 641791 - DNA, 25 bp, Rattus norvegicus
tggttcgagattctccctggcctcg

SEQ ID NO: 641792 - DNA, 25 bp, Rattus norvegicus
tggttcgagattgtccctggcctcg

SEQ ID NO: 641793 - DNA, 25 bp, Rattus norvegicus
tggttcgaggagacccaagggctat

SEQ ID NO: 641794 - DNA, 25 bp, Rattus norvegicus
tggttcgaggagtcccaagggctat

SEQ ID NO: 641795 - DNA, 25 bp, Rattus norvegicus
tggttcgccggtattgtgttttcag

SEQ ID NO: 641796 - DNA, 25 bp, Rattus norvegicus
tggttcgccggttttgtgttttcag

SEQ ID NO: 641797 - DNA, 25 bp, Rattus norvegicus
tggttcgctaaccacaagtcacact

SEQ ID NO: 641798 - DNA, 25 bp, Rattus norvegicus
tggttcgctaacgacaagtcacact

SEQ ID NO: 641799 - DNA, 25 bp, Rattus norvegicus
tggttcgctggtcttgatttcttga

SEQ ID NO: 641800 - DNA, 25 bp, Rattus norvegicus
tggttcgctggtgttgatttcttga

SEQ ID NO: 641801 - DNA, 25 bp, Rattus norvegicus
tggttcggatcccactgtgactgca

SEQ ID NO: 641802 - DNA, 25 bp, Rattus norvegicus
tggttcggatccgactgtgactgca

SEQ ID NO: 641803 - DNA, 25 bp, Rattus norvegicus
tggttcggctctcctacaattctaa

SEQ ID NO: 641804 - DNA, 25 bp, Rattus norvegicus
tggttcggctctgctacaattctaa

SEQ ID NO: 641805 - DNA, 25 bp, Rattus norvegicus
tggttcgggtcactgcatactgaga

SEQ ID NO: 641806 - DNA, 25 bp, Rattus norvegicus
tggttcgggtcagtgcatactgaga

SEQ ID NO: 641807 - DNA, 25 bp, Rattus norvegicus
tggttcgttcataggttggttggtt

SEQ ID NO: 641808 - DNA, 25 bp, Rattus norvegicus
tggttcgttcattggttggttggtt

SEQ ID NO: 641809 - DNA, 25 bp, Rattus norvegicus
tggttctaatttaccaacacttaat

SEQ ID NO: 641810 - DNA, 25 bp, Rattus norvegicus
tggttctaattttccaacacttaat

SEQ ID NO: 641811 - DNA, 25 bp, Rattus norvegicus
tggttctaccacagacccagaaatg

SEQ ID NO: 641812 - DNA, 25 bp, Rattus norvegicus
tggttctaccactgacccagaaatg

SEQ ID NO: 641813 - DNA, 25 bp, Rattus norvegicus
tggttctactctcattctctgataa

SEQ ID NO: 641814 - DNA, 25 bp, Rattus norvegicus
tggttctactctgattctctgataa

SEQ ID NO: 641815 - DNA, 25 bp, Rattus norvegicus
tggttctagattccagggccaccct

SEQ ID NO: 641816 - DNA, 25 bp, Rattus norvegicus
tggttctagattgcagggccaccct

SEQ ID NO: 641817 - DNA, 25 bp, Rattus norvegicus
tggttctatttcagccaaactcgcc

SEQ ID NO: 641818 - DNA, 25 bp, Rattus norvegicus
tggttctatttctgccaaactcgcc

SEQ ID NO: 641819 - DNA, 25 bp, Rattus norvegicus
tggttctcaacccacaaacagttcg

SEQ ID NO: 641820 - DNA, 25 bp, Rattus norvegicus
tggttctcaaccgacaaacagttcg

SEQ ID NO: 641821 - DNA, 25 bp, Rattus norvegicus
tggttctcacctcgatatagccagc

SEQ ID NO: 641822 - DNA, 25 bp, Rattus norvegicus
tggttctcacctggatatagccagc

SEQ ID NO: 641823 - DNA, 25 bp, Rattus norvegicus
tggttctcagaacagggccaatgat

SEQ ID NO: 641824 - DNA, 25 bp, Rattus norvegicus
tggttctcagaagagggccaatgat

SEQ ID NO: 641825 - DNA, 25 bp, Rattus norvegicus
tggttctcagagctcccttagccac

SEQ ID NO: 641826 - DNA, 25 bp, Rattus norvegicus
tggttctcagaggtcccttagccac

SEQ ID NO: 641827 - DNA, 25 bp, Rattus norvegicus
tggttctcatttagcagtgctgtaa

SEQ ID NO: 641828 - DNA, 25 bp, Rattus norvegicus
tggttctcattttgcagtgctgtaa

SEQ ID NO: 641829 - DNA, 25 bp, Rattus norvegicus
tggttctcctagcttcatccgtgaa

SEQ ID NO: 641830 - DNA, 25 bp, Rattus norvegicus
tggttctcctaggttcatccgtgaa

SEQ ID NO: 641831 - DNA, 25 bp, Rattus norvegicus
tggttctcgacccaaaccttatgac

SEQ ID NO: 641832 - DNA, 25 bp, Rattus norvegicus
tggttctcgaccgaaaccttatgac

SEQ ID NO: 641833 - DNA, 25 bp, Rattus norvegicus
tggttctcgactccttccagagaaa

SEQ ID NO: 641834 - DNA, 25 bp, Rattus norvegicus
tggttctcgactgcttccagagaaa

SEQ ID NO: 641835 - DNA, 25 bp, Rattus norvegicus
tggttctcgtttaattgacaacgct

SEQ ID NO: 641836 - DNA, 25 bp, Rattus norvegicus
tggttctcgttttattgacaacgct

SEQ ID NO: 641837 - DNA, 25 bp, Rattus norvegicus
tggttctctcagaccgacagtggac

SEQ ID NO: 641838 - DNA, 25 bp, Rattus norvegicus
tggttctctcagtccgacagtggac

SEQ ID NO: 641839 - DNA, 25 bp, Rattus norvegicus
tggttctcttggctctgggctgctc

SEQ ID NO: 641840 - DNA, 25 bp, Rattus norvegicus
tggttctcttgggtctgggctgctc

SEQ ID NO: 641841 - DNA, 25 bp, Rattus norvegicus
tggttctgaccgcagtatgggtact

SEQ ID NO: 641842 - DNA, 25 bp, Rattus norvegicus
tggttctgaccggagtatgggtact

SEQ ID NO: 641843 - DNA, 25 bp, Rattus norvegicus
tggttctgtaacaatccttccttga

SEQ ID NO: 641844 - DNA, 25 bp, Rattus norvegicus
tggttctgtaactatccttccttga

SEQ ID NO: 641845 - DNA, 25 bp, Rattus norvegicus
tggttctgtccgcaaacgacctggc

SEQ ID NO: 641846 - DNA, 25 bp, Rattus norvegicus
tggttctgtccggaaacgacctggc

SEQ ID NO: 641847 - DNA, 25 bp, Rattus norvegicus
tggttctgtggtaaagacacttgtc

SEQ ID NO: 641848 - DNA, 25 bp, Rattus norvegicus
tggttctgtggttaagacacttgtc

SEQ ID NO: 641849 - DNA, 25 bp, Rattus norvegicus
tggttcttaacacccaaatcctctg

SEQ ID NO: 641850 - DNA, 25 bp, Rattus norvegicus
tggttcttaacagccaaatcctctg

SEQ ID NO: 641851 - DNA, 25 bp, Rattus norvegicus
tggttcttacagcatggttcccagc

SEQ ID NO: 641852 - DNA, 25 bp, Rattus norvegicus
tggttcttacaggatggttcccagc

SEQ ID NO: 641853 - DNA, 25 bp, Rattus norvegicus
tggttcttacctattccaagcttct

SEQ ID NO: 641854 - DNA, 25 bp, Rattus norvegicus
tggttcttaccttttccaagcttct

SEQ ID NO: 641855 - DNA, 25 bp, Rattus norvegicus
tggttcttcaccagtcatcctagag

SEQ ID NO: 641856 - DNA, 25 bp, Rattus norvegicus
tggttcttcacctgtcatcctagag

SEQ ID NO: 641857 - DNA, 25 bp, Rattus norvegicus
tggttcttcataccatttgttggga

SEQ ID NO: 641858 - DNA, 25 bp, Rattus norvegicus
tggttcttcatagcatttgttggga

SEQ ID NO: 641859 - DNA, 25 bp, Rattus norvegicus
tggttcttccacctggactatgttt

SEQ ID NO: 641860 - DNA, 25 bp, Rattus norvegicus
tggttcttccacgtggactatgttt

SEQ ID NO: 641861 - DNA, 25 bp, Rattus norvegicus
tggttcttcccaataacctggtact

SEQ ID NO: 641862 - DNA, 25 bp, Rattus norvegicus
tggttcttcccattaacctggtact

SEQ ID NO: 641863 - DNA, 25 bp, Rattus norvegicus
tggttcttcctcaacagagactcgt

SEQ ID NO: 641864 - DNA, 25 bp, Rattus norvegicus
tggttcttcctctacagagactcgt

SEQ ID NO: 641865 - DNA, 25 bp, Rattus norvegicus
tggttcttctcaagatctcttcaag

SEQ ID NO: 641866 - DNA, 25 bp, Rattus norvegicus
tggttcttctcatgatctcttcaag

SEQ ID NO: 641867 - DNA, 25 bp, Rattus norvegicus
tggttcttctgtacctatgcacaaa

SEQ ID NO: 641868 - DNA, 25 bp, Rattus norvegicus
tggttcttctgttcctatgcacaaa

SEQ ID NO: 641869 - DNA, 25 bp, Rattus norvegicus
tggttcttctttcccttacagagga

SEQ ID NO: 641870 - DNA, 25 bp, Rattus norvegicus
tggttcttctttgccttacagagga

SEQ ID NO: 641871 - DNA, 25 bp, Rattus norvegicus
tggttcttgcccattctttaactat

SEQ ID NO: 641872 - DNA, 25 bp, Rattus norvegicus
tggttcttgccctttctttaactat

SEQ ID NO: 641873 - DNA, 25 bp, Rattus norvegicus
tggttcttgggaccctcactctagg

SEQ ID NO: 641874 - DNA, 25 bp, Rattus norvegicus
tggttcttgggagcctcactctagg

SEQ ID NO: 641875 - DNA, 25 bp, Rattus norvegicus
tggttcttgtccactgtaacgcagg

SEQ ID NO: 641876 - DNA, 25 bp, Rattus norvegicus
tggttcttgtcctctgtaacgcagg

SEQ ID NO: 641877 - DNA, 25 bp, Rattus norvegicus
tggttctttctacaactccatgatt

SEQ ID NO: 641878 - DNA, 25 bp, Rattus norvegicus
tggttctttctagaactccatgatt

SEQ ID NO: 641879 - DNA, 25 bp, Rattus norvegicus
tggttcttttctactcaagcacact

SEQ ID NO: 641880 - DNA, 25 bp, Rattus norvegicus
tggttcttttcttctcaagcacact

SEQ ID NO: 641881 - DNA, 25 bp, Rattus norvegicus
tggttgaaaggccattttgcacagt

SEQ ID NO: 641882 - DNA, 25 bp, Rattus norvegicus
tggttgaaaggcgattttgcacagt

SEQ ID NO: 641883 - DNA, 25 bp, Rattus norvegicus
tggttgaaagtccaagcagatcctt

SEQ ID NO: 641884 - DNA, 25 bp, Rattus norvegicus
tggttgaaagtcgaagcagatcctt

SEQ ID NO: 641885 - DNA, 25 bp, Rattus norvegicus
tggttgaacttgatgcgagcatagg

SEQ ID NO: 641886 - DNA, 25 bp, Rattus norvegicus
tggttgaacttgttgcgagcatagg

SEQ ID NO: 641887 - DNA, 25 bp, Rattus norvegicus
tggttgaagaatcctctcatacccc

SEQ ID NO: 641888 - DNA, 25 bp, Rattus norvegicus
tggttgaagaatgctctcatacccc

SEQ ID NO: 641889 - DNA, 25 bp, Rattus norvegicus
tggttgacacccactccaaaagaac

SEQ ID NO: 641890 - DNA, 25 bp, Rattus norvegicus
tggttgacaccctctccaaaagaac

SEQ ID NO: 641891 - DNA, 25 bp, Rattus norvegicus
tggttgacagtccatccagcagtgg

SEQ ID NO: 641892 - DNA, 25 bp, Rattus norvegicus
tggttgacagtcgatccagcagtgg

SEQ ID NO: 641893 - DNA, 25 bp, Rattus norvegicus
tggttgaccctaaaatgttcccttg

SEQ ID NO: 641894 - DNA, 25 bp, Rattus norvegicus
tggttgaccctataatgttcccttg

SEQ ID NO: 641895 - DNA, 25 bp, Rattus norvegicus
tggttgagaccacatttctcctggg

SEQ ID NO: 641896 - DNA, 25 bp, Rattus norvegicus
tggttgagaccagatttctcctggg

SEQ ID NO: 641897 - DNA, 25 bp, Rattus norvegicus
tggttgatcatgacctggtgccgca

SEQ ID NO: 641898 - DNA, 25 bp, Rattus norvegicus
tggttgatcatgtcctggtgccgca

SEQ ID NO: 641899 - DNA, 25 bp, Rattus norvegicus
tggttgcaaagcctggagataaatt

SEQ ID NO: 641900 - DNA, 25 bp, Rattus norvegicus
tggttgcaaagcgtggagataaatt

SEQ ID NO: 641901 - DNA, 25 bp, Rattus norvegicus
tggttgcaagtcagaccttcggaca

SEQ ID NO: 641902 - DNA, 25 bp, Rattus norvegicus
tggttgcaagtctgaccttcggaca

SEQ ID NO: 641903 - DNA, 25 bp, Rattus norvegicus
tggttgcacgtcacttcgatgcgca

SEQ ID NO: 641904 - DNA, 25 bp, Rattus norvegicus
tggttgcacgtctcttcgatgcgca

SEQ ID NO: 641905 - DNA, 25 bp, Rattus norvegicus
tggttgcagaaaaatcctccgtctt

SEQ ID NO: 641906 - DNA, 25 bp, Rattus norvegicus
tggttgcagaaatatcctccgtctt

SEQ ID NO: 641907 - DNA, 25 bp, Rattus norvegicus
tggttgcagccgctttattttggaa

SEQ ID NO: 641908 - DNA, 25 bp, Rattus norvegicus
tggttgcagccggtttattttggaa

SEQ ID NO: 641909 - DNA, 25 bp, Rattus norvegicus
tggttgccaaacacactctgcattg

SEQ ID NO: 641910 - DNA, 25 bp, Rattus norvegicus
tggttgccaaactcactctgcattg

SEQ ID NO: 641911 - DNA, 25 bp, Rattus norvegicus
tggttgccaccacctctttatatca

SEQ ID NO: 641912 - DNA, 25 bp, Rattus norvegicus
tggttgccaccagctctttatatca

SEQ ID NO: 641913 - DNA, 25 bp, Rattus norvegicus
tggttgcccaaaacttgacattgat

SEQ ID NO: 641914 - DNA, 25 bp, Rattus norvegicus
tggttgcccaaatcttgacattgat

SEQ ID NO: 641915 - DNA, 25 bp, Rattus norvegicus
tggttgccgaaacaccaagggcccg

SEQ ID NO: 641916 - DNA, 25 bp, Rattus norvegicus
tggttgccgaaagaccaagggcccg

SEQ ID NO: 641917 - DNA, 25 bp, Rattus norvegicus
tggttgcctacaaaacgccaaagga

SEQ ID NO: 641918 - DNA, 25 bp, Rattus norvegicus
tggttgcctacataacgccaaagga

SEQ ID NO: 641919 - DNA, 25 bp, Rattus norvegicus
tggttgcctcccaatgttgggcagg

SEQ ID NO: 641920 - DNA, 25 bp, Rattus norvegicus
tggttgcctccctatgttgggcagg

SEQ ID NO: 641921 - DNA, 25 bp, Rattus norvegicus
tggttgccttgtcggaaacccctgg

SEQ ID NO: 641922 - DNA, 25 bp, Rattus norvegicus
tggttgccttgtgggaaacccctgg

SEQ ID NO: 641923 - DNA, 25 bp, Rattus norvegicus
tggttgctcagtcccaactgcgcat

SEQ ID NO: 641924 - DNA, 25 bp, Rattus norvegicus
tggttgctcagtgccaactgcgcat

SEQ ID NO: 641925 - DNA, 25 bp, Rattus norvegicus
tggttgctgctcactaaagttcttc

SEQ ID NO: 641926 - DNA, 25 bp, Rattus norvegicus
tggttgctgctctctaaagttcttc

SEQ ID NO: 641927 - DNA, 25 bp, Rattus norvegicus
tggttgctgctgagggatcctgtca

SEQ ID NO: 641928 - DNA, 25 bp, Rattus norvegicus
tggttgctgctgtgggatcctgtca

SEQ ID NO: 641929 - DNA, 25 bp, Rattus norvegicus
tggttgctttttcttgttgctggaa

SEQ ID NO: 641930 - DNA, 25 bp, Rattus norvegicus
tggttgctttttgttgttgctggaa

SEQ ID NO: 641931 - DNA, 25 bp, Rattus norvegicus
tggttggaccctcttctaacatgct

SEQ ID NO: 641932 - DNA, 25 bp, Rattus norvegicus
tggttggaccctgttctaacatgct

SEQ ID NO: 641933 - DNA, 25 bp, Rattus norvegicus
tggttggactgcacatggatttggt

SEQ ID NO: 641934 - DNA, 25 bp, Rattus norvegicus
tggttggactgctcatggatttggt

SEQ ID NO: 641935 - DNA, 25 bp, Rattus norvegicus
tggttggacttcacaggtgtctgaa

SEQ ID NO: 641936 - DNA, 25 bp, Rattus norvegicus
tggttggacttctcaggtgtctgaa

SEQ ID NO: 641937 - DNA, 25 bp, Rattus norvegicus
tggttggatgaaagccaggctctcc

SEQ ID NO: 641938 - DNA, 25 bp, Rattus norvegicus
tggttggatgaatgccaggctctcc

SEQ ID NO: 641939 - DNA, 25 bp, Rattus norvegicus
tggttggattttcagggacctccct

SEQ ID NO: 641940 - DNA, 25 bp, Rattus norvegicus
tggttggattttgagggacctccct

SEQ ID NO: 641941 - DNA, 25 bp, Rattus norvegicus
tggttggcccctctggcagcagaac

SEQ ID NO: 641942 - DNA, 25 bp, Rattus norvegicus
tggttggcccctgtggcagcagaac

SEQ ID NO: 641943 - DNA, 25 bp, Rattus norvegicus
tggttggcctgaccttaaacattcc

SEQ ID NO: 641944 - DNA, 25 bp, Rattus norvegicus
tggttggcctgagcttaaacattcc

SEQ ID NO: 641945 - DNA, 25 bp, Rattus norvegicus
tggttggctttcacgccagtccctg

SEQ ID NO: 641946 - DNA, 25 bp, Rattus norvegicus
tggttggctttctcgccagtccctg

SEQ ID NO: 641947 - DNA, 25 bp, Rattus norvegicus
tggttgggcttccagtcacgtgaca

SEQ ID NO: 641948 - DNA, 25 bp, Rattus norvegicus
tggttgggcttcgagtcacgtgaca

SEQ ID NO: 641949 - DNA, 25 bp, Rattus norvegicus
tggttggtgaaaattgcccctcaat

SEQ ID NO: 641950 - DNA, 25 bp, Rattus norvegicus
tggttggtgaaatttgcccctcaat

SEQ ID NO: 641951 - DNA, 25 bp, Rattus norvegicus
tggttggttaaccttgtgcactttc

SEQ ID NO: 641952 - DNA, 25 bp, Rattus norvegicus
tggttggttaacgttgtgcactttc

SEQ ID NO: 641953 - DNA, 25 bp, Rattus norvegicus
tggttggttagacatgactggatcc

SEQ ID NO: 641954 - DNA, 25 bp, Rattus norvegicus
tggttggttagagatgactggatcc

SEQ ID NO: 641955 - DNA, 25 bp, Rattus norvegicus
tggttggttggcaggtttctctctt

SEQ ID NO: 641956 - DNA, 25 bp, Rattus norvegicus
tggttggttggctggtttctctctt

SEQ ID NO: 641957 - DNA, 25 bp, Rattus norvegicus
tggttggtttttcttctgtcagaca

SEQ ID NO: 641958 - DNA, 25 bp, Rattus norvegicus
tggttggtttttgttctgtcagaca

SEQ ID NO: 641959 - DNA, 25 bp, Rattus norvegicus
tggttgtaacaacttcagcagaagg

SEQ ID NO: 641960 - DNA, 25 bp, Rattus norvegicus
tggttgtaacaagttcagcagaagg

SEQ ID NO: 641961 - DNA, 25 bp, Rattus norvegicus
tggttgtaattcagtttgccctttt

SEQ ID NO: 641962 - DNA, 25 bp, Rattus norvegicus
tggttgtaattctgtttgccctttt

SEQ ID NO: 641963 - DNA, 25 bp, Rattus norvegicus
tggttgtaccatccatagccagcag

SEQ ID NO: 641964 - DNA, 25 bp, Rattus norvegicus
tggttgtaccatgcatagccagcag

SEQ ID NO: 641965 - DNA, 25 bp, Rattus norvegicus
tggttgtatagcctctgctcgtcaa

SEQ ID NO: 641966 - DNA, 25 bp, Rattus norvegicus
tggttgtatagcgtctgctcgtcaa

SEQ ID NO: 641967 - DNA, 25 bp, Rattus norvegicus
tggttgtatcctctggcatatccat

SEQ ID NO: 641968 - DNA, 25 bp, Rattus norvegicus
tggttgtatcctgtggcatatccat

SEQ ID NO: 641969 - DNA, 25 bp, Rattus norvegicus
tggttgtcagtgaagcaggcttact

SEQ ID NO: 641970 - DNA, 25 bp, Rattus norvegicus
tggttgtcagtgtagcaggcttact

SEQ ID NO: 641971 - DNA, 25 bp, Rattus norvegicus
tggttgtcatgcatgggagcccaca

SEQ ID NO: 641972 - DNA, 25 bp, Rattus norvegicus
tggttgtcatgcttgggagcccaca

SEQ ID NO: 641973 - DNA, 25 bp, Rattus norvegicus
tggttgtccaccatgatgcccaaat

SEQ ID NO: 641974 - DNA, 25 bp, Rattus norvegicus
tggttgtccaccttgatgcccaaat

SEQ ID NO: 641975 - DNA, 25 bp, Rattus norvegicus
tggttgtccccaagtcctgtaaagt

SEQ ID NO: 641976 - DNA, 25 bp, Rattus norvegicus
tggttgtccccatgtcctgtaaagt

SEQ ID NO: 641977 - DNA, 25 bp, Rattus norvegicus
tggttgtccctgctattttgtttct

SEQ ID NO: 641978 - DNA, 25 bp, Rattus norvegicus
tggttgtccctggtattttgtttct

SEQ ID NO: 641979 - DNA, 25 bp, Rattus norvegicus
tggttgtctctaccctgatcagata

SEQ ID NO: 641980 - DNA, 25 bp, Rattus norvegicus
tggttgtctctagcctgatcagata

SEQ ID NO: 641981 - DNA, 25 bp, Rattus norvegicus
tggttgtcttttccctaagatgcct

SEQ ID NO: 641982 - DNA, 25 bp, Rattus norvegicus
tggttgtcttttgcctaagatgcct

SEQ ID NO: 641983 - DNA, 25 bp, Rattus norvegicus
tggttgtgtatcaaggatcccctgt

SEQ ID NO: 641984 - DNA, 25 bp, Rattus norvegicus
tggttgtgtatctaggatcccctgt

SEQ ID NO: 641985 - DNA, 25 bp, Rattus norvegicus
tggttgttcggtaactttgccgtca

SEQ ID NO: 641986 - DNA, 25 bp, Rattus norvegicus
tggttgttcggttactttgccgtca

SEQ ID NO: 641987 - DNA, 25 bp, Rattus norvegicus
tggttgttcgtgctaccttagtcca

SEQ ID NO: 641988 - DNA, 25 bp, Rattus norvegicus
tggttgttcgtggtaccttagtcca

SEQ ID NO: 641989 - DNA, 25 bp, Rattus norvegicus
tggttgttgggacgccttccacatt

SEQ ID NO: 641990 - DNA, 25 bp, Rattus norvegicus
tggttgttgggaggccttccacatt

SEQ ID NO: 641991 - DNA, 25 bp, Rattus norvegicus
tggttgttgtgtatcgcttttttca

SEQ ID NO: 641992 - DNA, 25 bp, Rattus norvegicus
tggttgttgtgtttcgcttttttca

SEQ ID NO: 641993 - DNA, 25 bp, Rattus norvegicus
tggttgtttggaagaggactactac

SEQ ID NO: 641994 - DNA, 25 bp, Rattus norvegicus
tggttgtttggatgaggactactac

SEQ ID NO: 641995 - DNA, 25 bp, Rattus norvegicus
tggttgtttttacgaataactcaag

SEQ ID NO: 641996 - DNA, 25 bp, Rattus norvegicus
tggttgtttttaggaataactcaag

SEQ ID NO: 641997 - DNA, 25 bp, Rattus norvegicus
tggtttaaacctagagactcacaca

SEQ ID NO: 641998 - DNA, 25 bp, Rattus norvegicus
tggtttaaaccttgagactcacaca

SEQ ID NO: 641999 - DNA, 25 bp, Rattus norvegicus
tggtttacaaatatagatctatcct

SEQ ID NO: 642000 - DNA, 25 bp, Rattus norvegicus
tggtttacaaatttagatctatcct

SEQ ID NO: 642001 - DNA, 25 bp, Rattus norvegicus
tggtttacaaggagactcgacccct

SEQ ID NO: 642002 - DNA, 25 bp, Rattus norvegicus
tggtttacaaggtgactcgacccct

SEQ ID NO: 642003 - DNA, 25 bp, Rattus norvegicus
tggtttaccagcagccatgagcaac

SEQ ID NO: 642004 - DNA, 25 bp, Rattus norvegicus
tggtttaccagctgccatgagcaac

SEQ ID NO: 642005 - DNA, 25 bp, Rattus norvegicus
tggtttacctagagacacatcagat

SEQ ID NO: 642006 - DNA, 25 bp, Rattus norvegicus
tggtttacctagtgacacatcagat

SEQ ID NO: 642007 - DNA, 25 bp, Rattus norvegicus
tggtttactattaactgtcctcctt

SEQ ID NO: 642008 - DNA, 25 bp, Rattus norvegicus
tggtttactatttactgtcctcctt

SEQ ID NO: 642009 - DNA, 25 bp, Rattus norvegicus
tggtttagagctcaagtaactgtgc

SEQ ID NO: 642010 - DNA, 25 bp, Rattus norvegicus
tggtttagagctgaagtaactgtgc

SEQ ID NO: 642011 - DNA, 25 bp, Rattus norvegicus
tggtttaggcttaggttcttgttgt

SEQ ID NO: 642012 - DNA, 25 bp, Rattus norvegicus
tggtttaggctttggttcttgttgt

SEQ ID NO: 642013 - DNA, 25 bp, Rattus norvegicus
tggtttaggtttctaacatccggca

SEQ ID NO: 642014 - DNA, 25 bp, Rattus norvegicus
tggtttaggtttgtaacatccggca

SEQ ID NO: 642015 - DNA, 25 bp, Rattus norvegicus
tggtttagtgtcatactgccttaaa

SEQ ID NO: 642016 - DNA, 25 bp, Rattus norvegicus
tggtttagtgtcttactgccttaaa

SEQ ID NO: 642017 - DNA, 25 bp, Rattus norvegicus
tggtttataccaactgccaagccgc

SEQ ID NO: 642018 - DNA, 25 bp, Rattus norvegicus
tggtttataccatctgccaagccgc

SEQ ID NO: 642019 - DNA, 25 bp, Rattus norvegicus
tggtttatcaccaatacaagttctg

SEQ ID NO: 642020 - DNA, 25 bp, Rattus norvegicus
tggtttatcacctatacaagttctg

SEQ ID NO: 642021 - DNA, 25 bp, Rattus norvegicus
tggtttatccgaacacttctggctg

SEQ ID NO: 642022 - DNA, 25 bp, Rattus norvegicus
tggtttatccgacgtcctggctttc

SEQ ID NO: 642023 - DNA, 25 bp, Rattus norvegicus
tggtttatccgaggtcctggctttc

SEQ ID NO: 642024 - DNA, 25 bp, Rattus norvegicus
tggtttatccgatcacttctggctg

SEQ ID NO: 642025 - DNA, 25 bp, Rattus norvegicus
tggtttatgtctaacgctaccccag

SEQ ID NO: 642026 - DNA, 25 bp, Rattus norvegicus
tggtttatgtcttacgctaccccag

SEQ ID NO: 642027 - DNA, 25 bp, Rattus norvegicus
tggtttattcttactgacctggata

SEQ ID NO: 642028 - DNA, 25 bp, Rattus norvegicus
tggtttattctttctgacctggata

SEQ ID NO: 642029 - DNA, 25 bp, Rattus norvegicus
tggtttatttataggctcccgactc

SEQ ID NO: 642030 - DNA, 25 bp, Rattus norvegicus
tggtttatttattggctcccgactc

SEQ ID NO: 642031 - DNA, 25 bp, Rattus norvegicus
tggtttatttccacacactttccag

SEQ ID NO: 642032 - DNA, 25 bp, Rattus norvegicus
tggtttatttcctcacactttccag

SEQ ID NO: 642033 - DNA, 25 bp, Rattus norvegicus
tggtttcaaaagcattcctgcctcc

SEQ ID NO: 642034 - DNA, 25 bp, Rattus norvegicus
tggtttcaaaaggattcctgcctcc

SEQ ID NO: 642035 - DNA, 25 bp, Rattus norvegicus
tggtttcaaaccagccagaagcact

SEQ ID NO: 642036 - DNA, 25 bp, Rattus norvegicus
tggtttcaaacctgccagaagcact

SEQ ID NO: 642037 - DNA, 25 bp, Rattus norvegicus
tggtttcaagctcgtttcctgtact

SEQ ID NO: 642038 - DNA, 25 bp, Rattus norvegicus
tggtttcaagctggtttcctgtact

SEQ ID NO: 642039 - DNA, 25 bp, Rattus norvegicus
tggtttcaatcacaccagatctggg

SEQ ID NO: 642040 - DNA, 25 bp, Rattus norvegicus
tggtttcaatcagaccagatctggg

SEQ ID NO: 642041 - DNA, 25 bp, Rattus norvegicus
tggtttcaatttaagagcctctggc

SEQ ID NO: 642042 - DNA, 25 bp, Rattus norvegicus
tggtttcaattttagagcctctggc

SEQ ID NO: 642043 - DNA, 25 bp, Rattus norvegicus
tggtttcacctcagcaattctttat

SEQ ID NO: 642044 - DNA, 25 bp, Rattus norvegicus
tggtttcacctctgcaattctttat

SEQ ID NO: 642045 - DNA, 25 bp, Rattus norvegicus
tggtttcactgacttacagctgctt

SEQ ID NO: 642046 - DNA, 25 bp, Rattus norvegicus
tggtttcactgagttacagctgctt

SEQ ID NO: 642047 - DNA, 25 bp, Rattus norvegicus
tggtttcagactaggttgacccggc

SEQ ID NO: 642048 - DNA, 25 bp, Rattus norvegicus
tggtttcagacttggttgacccggc

SEQ ID NO: 642049 - DNA, 25 bp, Rattus norvegicus
tggtttcagtgacccgtgagtttat

SEQ ID NO: 642050 - DNA, 25 bp, Rattus norvegicus
tggtttcagtgagccgtgagtttat

SEQ ID NO: 642051 - DNA, 25 bp, Rattus norvegicus
tggtttcatctcatccgagcccctt

SEQ ID NO: 642052 - DNA, 25 bp, Rattus norvegicus
tggtttcatctcttccgagcccctt

SEQ ID NO: 642053 - DNA, 25 bp, Rattus norvegicus
tggtttcattcaccgtcaccttcca

SEQ ID NO: 642054 - DNA, 25 bp, Rattus norvegicus
tggtttcattcagcgtcaccttcca

SEQ ID NO: 642055 - DNA, 25 bp, Rattus norvegicus
tggtttccaaacatcagcctttagc

SEQ ID NO: 642056 - DNA, 25 bp, Rattus norvegicus
tggtttccaaacttcagcctttagc

SEQ ID NO: 642057 - DNA, 25 bp, Rattus norvegicus
tggtttccacagactttctacggac

SEQ ID NO: 642058 - DNA, 25 bp, Rattus norvegicus
tggtttccacagtctttctacggac

SEQ ID NO: 642059 - DNA, 25 bp, Rattus norvegicus
tggtttccacatctgtaagtcagga

SEQ ID NO: 642060 - DNA, 25 bp, Rattus norvegicus
tggtttccacatgtgtaagtcagga

SEQ ID NO: 642061 - DNA, 25 bp, Rattus norvegicus
tggtttccaccaagtgagttgcaga

SEQ ID NO: 642062 - DNA, 25 bp, Rattus norvegicus
tggtttccaccatgtgagttgcaga

SEQ ID NO: 642063 - DNA, 25 bp, Rattus norvegicus
tggtttccagatccttcttctcgag

SEQ ID NO: 642064 - DNA, 25 bp, Rattus norvegicus
tggtttccagatgcttcttctcgag

SEQ ID NO: 642065 - DNA, 25 bp, Rattus norvegicus
tggtttccatttcgcctcaggcagt

SEQ ID NO: 642066 - DNA, 25 bp, Rattus norvegicus
tggtttccatttggcctcaggcagt

SEQ ID NO: 642067 - DNA, 25 bp, Rattus norvegicus
tggtttcccaagacaagttttctct

SEQ ID NO: 642068 - DNA, 25 bp, Rattus norvegicus
tggtttcccaagtcaagttttctct

SEQ ID NO: 642069 - DNA, 25 bp, Rattus norvegicus
tggtttcccacacaggatgtccgtg

SEQ ID NO: 642070 - DNA, 25 bp, Rattus norvegicus
tggtttcccacagaggatgtccgtg

SEQ ID NO: 642071 - DNA, 25 bp, Rattus norvegicus
tggtttcccgaaccctcaggattgt

SEQ ID NO: 642072 - DNA, 25 bp, Rattus norvegicus
tggtttcccgaagcctcaggattgt

SEQ ID NO: 642073 - DNA, 25 bp, Rattus norvegicus
tggtttccctttaaacagtattgat

SEQ ID NO: 642074 - DNA, 25 bp, Rattus norvegicus
tggtttcccttttaacagtattgat

SEQ ID NO: 642075 - DNA, 25 bp, Rattus norvegicus
tggtttcctacacccctcaaatgtt

SEQ ID NO: 642076 - DNA, 25 bp, Rattus norvegicus
tggtttcctacagccctcaaatgtt

SEQ ID NO: 642077 - DNA, 25 bp, Rattus norvegicus
tggtttcctcctagacttcctgcta

SEQ ID NO: 642078 - DNA, 25 bp, Rattus norvegicus
tggtttcctccttgacttcctgcta

SEQ ID NO: 642079 - DNA, 25 bp, Rattus norvegicus
tggtttcctgaacttgactgagctg

SEQ ID NO: 642080 - DNA, 25 bp, Rattus norvegicus
tggtttcctgaagttgactgagctg

SEQ ID NO: 642081 - DNA, 25 bp, Rattus norvegicus
tggtttcctgagcttagcagccctg

SEQ ID NO: 642082 - DNA, 25 bp, Rattus norvegicus
tggtttcctgaggttagcagccctg

SEQ ID NO: 642083 - DNA, 25 bp, Rattus norvegicus
tggtttcctgttatctttaggatgt

SEQ ID NO: 642084 - DNA, 25 bp, Rattus norvegicus
tggtttcctgttttctttaggatgt

SEQ ID NO: 642085 - DNA, 25 bp, Rattus norvegicus
tggtttccttcccatttttctgcaa

SEQ ID NO: 642086 - DNA, 25 bp, Rattus norvegicus
tggtttccttccgatttttctgcaa

SEQ ID NO: 642087 - DNA, 25 bp, Rattus norvegicus
tggtttcgaaatcctgacttgtggg

SEQ ID NO: 642088 - DNA, 25 bp, Rattus norvegicus
tggtttcgaaatgctgacttgtggg

SEQ ID NO: 642089 - DNA, 25 bp, Rattus norvegicus
tggtttcgtatgactggatgccacc

SEQ ID NO: 642090 - DNA, 25 bp, Rattus norvegicus
tggtttcgtatgtctggatgccacc

SEQ ID NO: 642091 - DNA, 25 bp, Rattus norvegicus
tggtttcgtctactcattcctggga

SEQ ID NO: 642092 - DNA, 25 bp, Rattus norvegicus
tggtttcgtctagtcattcctggga

SEQ ID NO: 642093 - DNA, 25 bp, Rattus norvegicus
tggtttctactcaccacatgaaaat

SEQ ID NO: 642094 - DNA, 25 bp, Rattus norvegicus
tggtttctactcaccgcagtaaaac

SEQ ID NO: 642095 - DNA, 25 bp, Rattus norvegicus
tggtttctactctccacatgaaaat

SEQ ID NO: 642096 - DNA, 25 bp, Rattus norvegicus
tggtttctactctccgcagtaaaac

SEQ ID NO: 642097 - DNA, 25 bp, Rattus norvegicus
tggtttctatagagcctggcaccaa

SEQ ID NO: 642098 - DNA, 25 bp, Rattus norvegicus
tggtttctatagtgcctggcaccaa

SEQ ID NO: 642099 - DNA, 25 bp, Rattus norvegicus
tggtttctcagcaacaggtcactga

SEQ ID NO: 642100 - DNA, 25 bp, Rattus norvegicus
tggtttctcagctacaggtcactga

SEQ ID NO: 642101 - DNA, 25 bp, Rattus norvegicus
tggtttctccctacatggttgagag

SEQ ID NO: 642102 - DNA, 25 bp, Rattus norvegicus
tggtttctccctcactagaactgag

SEQ ID NO: 642103 - DNA, 25 bp, Rattus norvegicus
tggtttctccctgactagaactgag

SEQ ID NO: 642104 - DNA, 25 bp, Rattus norvegicus
tggtttctcccttcatggttgagag

SEQ ID NO: 642105 - DNA, 25 bp, Rattus norvegicus
tggtttctcgctcatggtgacattt

SEQ ID NO: 642106 - DNA, 25 bp, Rattus norvegicus
tggtttctcgctgatggtgacattt

SEQ ID NO: 642107 - DNA, 25 bp, Rattus norvegicus
tggtttctcttacccagtgtgagga

SEQ ID NO: 642108 - DNA, 25 bp, Rattus norvegicus
tggtttctcttagccagtgtgagga

SEQ ID NO: 642109 - DNA, 25 bp, Rattus norvegicus
tggtttctcttgattcctcttgaag

SEQ ID NO: 642110 - DNA, 25 bp, Rattus norvegicus
tggtttctcttgtttcctcttgaag

SEQ ID NO: 642111 - DNA, 25 bp, Rattus norvegicus
tggtttctgacacgagcctctccgt

SEQ ID NO: 642112 - DNA, 25 bp, Rattus norvegicus
tggtttctgacaggagcctctccgt

SEQ ID NO: 642113 - DNA, 25 bp, Rattus norvegicus
tggtttctgaggctcctggtcaaca

SEQ ID NO: 642114 - DNA, 25 bp, Rattus norvegicus
tggtttctgagggtcctggtcaaca

SEQ ID NO: 642115 - DNA, 25 bp, Rattus norvegicus
tggtttctgcttagttcgagttctt

SEQ ID NO: 642116 - DNA, 25 bp, Rattus norvegicus
tggtttctgctttgttcgagttctt

SEQ ID NO: 642117 - DNA, 25 bp, Rattus norvegicus
tggtttctggctcctctgatgatga

SEQ ID NO: 642118 - DNA, 25 bp, Rattus norvegicus
tggtttctggctgctctgatgatga

SEQ ID NO: 642119 - DNA, 25 bp, Rattus norvegicus
tggtttctggtaaggactcacacga

SEQ ID NO: 642120 - DNA, 25 bp, Rattus norvegicus
tggtttctggtatggactcacacga

SEQ ID NO: 642121 - DNA, 25 bp, Rattus norvegicus
tggtttctgtggcactattttagta

SEQ ID NO: 642122 - DNA, 25 bp, Rattus norvegicus
tggtttctgtgggactattttagta

SEQ ID NO: 642123 - DNA, 25 bp, Rattus norvegicus
tggtttctgttcagcactagggtca

SEQ ID NO: 642124 - DNA, 25 bp, Rattus norvegicus
tggtttctgttctgcactagggtca

SEQ ID NO: 642125 - DNA, 25 bp, Rattus norvegicus
tggtttcttcacagtgcccctcgaa

SEQ ID NO: 642126 - DNA, 25 bp, Rattus norvegicus
tggtttcttcactgtgcccctcgaa

SEQ ID NO: 642127 - DNA, 25 bp, Rattus norvegicus
tggtttcttctaatcaggcatcaat

SEQ ID NO: 642128 - DNA, 25 bp, Rattus norvegicus
tggtttcttctacccagctttaata

SEQ ID NO: 642129 - DNA, 25 bp, Rattus norvegicus
tggtttcttctagccagctttaata

SEQ ID NO: 642130 - DNA, 25 bp, Rattus norvegicus
tggtttcttctattcaggcatcaat

SEQ ID NO: 642131 - DNA, 25 bp, Rattus norvegicus
tggtttcttctgaagcagcttcttt

SEQ ID NO: 642132 - DNA, 25 bp, Rattus norvegicus
tggtttcttctgtagcagcttcttt

SEQ ID NO: 642133 - DNA, 25 bp, Rattus norvegicus
tggtttctttccaagcctgtaacaa

SEQ ID NO: 642134 - DNA, 25 bp, Rattus norvegicus
tggtttctttcctagcctgtaacaa

SEQ ID NO: 642135 - DNA, 25 bp, Rattus norvegicus
tggtttctttgaacactcgtcttcc

SEQ ID NO: 642136 - DNA, 25 bp, Rattus norvegicus
tggtttctttgatcactcgtcttcc

SEQ ID NO: 642137 - DNA, 25 bp, Rattus norvegicus
tggtttgaatgcatctacgtggccc

SEQ ID NO: 642138 - DNA, 25 bp, Rattus norvegicus
tggtttgaatgcttctacgtggccc

SEQ ID NO: 642139 - DNA, 25 bp, Rattus norvegicus
tggtttgacaacagcatccgtctat

SEQ ID NO: 642140 - DNA, 25 bp, Rattus norvegicus
tggtttgacaactgcatccgtctat

SEQ ID NO: 642141 - DNA, 25 bp, Rattus norvegicus
tggtttgacaccattggcaggcatt

SEQ ID NO: 642142 - DNA, 25 bp, Rattus norvegicus
tggtttgacacctttggcaggcatt

SEQ ID NO: 642143 - DNA, 25 bp, Rattus norvegicus
tggtttgaccaaacacgaagtccaa

SEQ ID NO: 642144 - DNA, 25 bp, Rattus norvegicus
tggtttgaccaatcacgaagtccaa

SEQ ID NO: 642145 - DNA, 25 bp, Rattus norvegicus
tggtttgacctccacgaacgtgtag

SEQ ID NO: 642146 - DNA, 25 bp, Rattus norvegicus
tggtttgacctcgacgaacgtgtag

SEQ ID NO: 642147 - DNA, 25 bp, Rattus norvegicus
tggtttgacgatagcattcctctat

SEQ ID NO: 642148 - DNA, 25 bp, Rattus norvegicus
tggtttgacgattgcattcctctat

SEQ ID NO: 642149 - DNA, 25 bp, Rattus norvegicus
tggtttgagcttcccctgacggttc

SEQ ID NO: 642150 - DNA, 25 bp, Rattus norvegicus
tggtttgagcttgccctgacggttc

SEQ ID NO: 642151 - DNA, 25 bp, Rattus norvegicus
tggtttgatagccacatgcctctat

SEQ ID NO: 642152 - DNA, 25 bp, Rattus norvegicus
tggtttgatagcgacatgcctctat

SEQ ID NO: 642153 - DNA, 25 bp, Rattus norvegicus
tggtttgcacaaattccctggagaa

SEQ ID NO: 642154 - DNA, 25 bp, Rattus norvegicus
tggtttgcacaatttccctggagaa

SEQ ID NO: 642155 - DNA, 25 bp, Rattus norvegicus
tggtttgcagctctcttcaaatccc

SEQ ID NO: 642156 - DNA, 25 bp, Rattus norvegicus
tggtttgcagctgtcttcaaatccc

SEQ ID NO: 642157 - DNA, 25 bp, Rattus norvegicus
tggtttgcatctccagtgccagcac

SEQ ID NO: 642158 - DNA, 25 bp, Rattus norvegicus
tggtttgcatctgcagtgccagcac

SEQ ID NO: 642159 - DNA, 25 bp, Rattus norvegicus
tggtttgcctaacattggccagaat

SEQ ID NO: 642160 - DNA, 25 bp, Rattus norvegicus
tggtttgcctaagattggccagaat

SEQ ID NO: 642161 - DNA, 25 bp, Rattus norvegicus
tggtttgcctttcactcagatttat

SEQ ID NO: 642162 - DNA, 25 bp, Rattus norvegicus
tggtttgcctttgactcagatttat

SEQ ID NO: 642163 - DNA, 25 bp, Rattus norvegicus
tggtttgctatgacggctgagatta

SEQ ID NO: 642164 - DNA, 25 bp, Rattus norvegicus
tggtttgctatgtcggctgagatta

SEQ ID NO: 642165 - DNA, 25 bp, Rattus norvegicus
tggtttgctgctattctatgaccca

SEQ ID NO: 642166 - DNA, 25 bp, Rattus norvegicus
tggtttgctgcttttctatgaccca

SEQ ID NO: 642167 - DNA, 25 bp, Rattus norvegicus
tggtttgcttttaactgctgggtca

SEQ ID NO: 642168 - DNA, 25 bp, Rattus norvegicus
tggtttgcttttcctccctcgatgt

SEQ ID NO: 642169 - DNA, 25 bp, Rattus norvegicus
tggtttgcttttgctccctcgatgt

SEQ ID NO: 642170 - DNA, 25 bp, Rattus norvegicus
tggtttgctttttactgctgggtca

SEQ ID NO: 642171 - DNA, 25 bp, Rattus norvegicus
tggtttgggactcgtctacttacct

SEQ ID NO: 642172 - DNA, 25 bp, Rattus norvegicus
tggtttgggactggtctacttacct

SEQ ID NO: 642173 - DNA, 25 bp, Rattus norvegicus
tggtttgggtcaacatgtggcagtt

SEQ ID NO: 642174 - DNA, 25 bp, Rattus norvegicus
tggtttgggtcatcatgtggcagtt

SEQ ID NO: 642175 - DNA, 25 bp, Rattus norvegicus
tggtttgtaataaaagaggccgcct

SEQ ID NO: 642176 - DNA, 25 bp, Rattus norvegicus
tggtttgtaatataagaggccgcct

SEQ ID NO: 642177 - DNA, 25 bp, Rattus norvegicus
tggtttgtatcccagaggctgctga

SEQ ID NO: 642178 - DNA, 25 bp, Rattus norvegicus
tggtttgtatccgagaggctgctga

SEQ ID NO: 642179 - DNA, 25 bp, Rattus norvegicus
tggtttgtatttcttgtgcgggata

SEQ ID NO: 642180 - DNA, 25 bp, Rattus norvegicus
tggtttgtatttgttgtgcgggata

SEQ ID NO: 642181 - DNA, 25 bp, Rattus norvegicus
tggtttgtcatcaagtacagcatta

SEQ ID NO: 642182 - DNA, 25 bp, Rattus norvegicus
tggtttgtcatctagtacagcatta

SEQ ID NO: 642183 - DNA, 25 bp, Rattus norvegicus
tggtttgtcccaaatgtgcctcgat

SEQ ID NO: 642184 - DNA, 25 bp, Rattus norvegicus
tggtttgtcccatatgtgcctcgat

SEQ ID NO: 642185 - DNA, 25 bp, Rattus norvegicus
tggtttgtcctgaatgttggatcct

SEQ ID NO: 642186 - DNA, 25 bp, Rattus norvegicus
tggtttgtcctgtatgttggatcct

SEQ ID NO: 642187 - DNA, 25 bp, Rattus norvegicus
tggtttgtgattaccctttaaacag

SEQ ID NO: 642188 - DNA, 25 bp, Rattus norvegicus
tggtttgtgatttccctttaaacag

SEQ ID NO: 642189 - DNA, 25 bp, Rattus norvegicus
tggtttgtgtgcctagtgcagcctt

SEQ ID NO: 642190 - DNA, 25 bp, Rattus norvegicus
tggtttgtgtgcgtagtgcagcctt

SEQ ID NO: 642191 - DNA, 25 bp, Rattus norvegicus
tggtttgtgtttcagtgccagtcac

SEQ ID NO: 642192 - DNA, 25 bp, Rattus norvegicus
tggtttgtgtttgagtgccagtcac

SEQ ID NO: 642193 - DNA, 25 bp, Rattus norvegicus
tggtttgttactcttccttcatttt

SEQ ID NO: 642194 - DNA, 25 bp, Rattus norvegicus
tggtttgttactgttccttcatttt

SEQ ID NO: 642195 - DNA, 25 bp, Rattus norvegicus
tggtttgttatcatccttgctagtg

SEQ ID NO: 642196 - DNA, 25 bp, Rattus norvegicus
tggtttgttatcttccttgctagtg

SEQ ID NO: 642197 - DNA, 25 bp, Rattus norvegicus
tggtttgttgcccttgccaagaatt

SEQ ID NO: 642198 - DNA, 25 bp, Rattus norvegicus
tggtttgttgccgttgccaagaatt

SEQ ID NO: 642199 - DNA, 25 bp, Rattus norvegicus
tggtttgtttgtaccttctaagaag

SEQ ID NO: 642200 - DNA, 25 bp, Rattus norvegicus
tggtttgtttgttccttctaagaag

SEQ ID NO: 642201 - DNA, 25 bp, Rattus norvegicus
tggttttaatgtatgacttccattt

SEQ ID NO: 642202 - DNA, 25 bp, Rattus norvegicus
tggttttaatgtttgacttccattt

SEQ ID NO: 642203 - DNA, 25 bp, Rattus norvegicus
tggttttaattcctgttgtagccga

SEQ ID NO: 642204 - DNA, 25 bp, Rattus norvegicus
tggttttaattcgtgttgtagccga

SEQ ID NO: 642205 - DNA, 25 bp, Rattus norvegicus
tggttttaccttatctagattgcac

SEQ ID NO: 642206 - DNA, 25 bp, Rattus norvegicus
tggttttaccttttctagattgcac

SEQ ID NO: 642207 - DNA, 25 bp, Rattus norvegicus
tggttttaggcactcctttgggaga

SEQ ID NO: 642208 - DNA, 25 bp, Rattus norvegicus
tggttttaggcagtcctttgggaga

SEQ ID NO: 642209 - DNA, 25 bp, Rattus norvegicus
tggttttcaatacagtccacggtat

SEQ ID NO: 642210 - DNA, 25 bp, Rattus norvegicus
tggttttcaatagagtccacggtat

SEQ ID NO: 642211 - DNA, 25 bp, Rattus norvegicus
tggttttcagatcttcagaccccgc

SEQ ID NO: 642212 - DNA, 25 bp, Rattus norvegicus
tggttttcagatgttcagaccccgc

SEQ ID NO: 642213 - DNA, 25 bp, Rattus norvegicus
tggttttcaggactcaggtttcact

SEQ ID NO: 642214 - DNA, 25 bp, Rattus norvegicus
tggttttcaggagtcaggtttcact

SEQ ID NO: 642215 - DNA, 25 bp, Rattus norvegicus
tggttttcagtcaccggcacagcaa

SEQ ID NO: 642216 - DNA, 25 bp, Rattus norvegicus
tggttttcagtctccggcacagcaa

SEQ ID NO: 642217 - DNA, 25 bp, Rattus norvegicus
tggttttccagcactccatatagac

SEQ ID NO: 642218 - DNA, 25 bp, Rattus norvegicus
tggttttccagctctccatatagac

SEQ ID NO: 642219 - DNA, 25 bp, Rattus norvegicus
tggttttcccgaatccagaagccag

SEQ ID NO: 642220 - DNA, 25 bp, Rattus norvegicus
tggttttcccgattccagaagccag

SEQ ID NO: 642221 - DNA, 25 bp, Rattus norvegicus
tggttttccctaaataagctcctgc

SEQ ID NO: 642222 - DNA, 25 bp, Rattus norvegicus
tggttttccctatataagctcctgc

SEQ ID NO: 642223 - DNA, 25 bp, Rattus norvegicus
tggttttccctgcagtgaaatccga

SEQ ID NO: 642224 - DNA, 25 bp, Rattus norvegicus
tggttttccctggagtgaaatccga

SEQ ID NO: 642225 - DNA, 25 bp, Rattus norvegicus
tggttttcccttattctgacagtgt

SEQ ID NO: 642226 - DNA, 25 bp, Rattus norvegicus
tggttttccctttttctgacagtgt

SEQ ID NO: 642227 - DNA, 25 bp, Rattus norvegicus
tggttttcctcaagcctacgtgtgt

SEQ ID NO: 642228 - DNA, 25 bp, Rattus norvegicus
tggttttcctcatgcctacgtgtgt

SEQ ID NO: 642229 - DNA, 25 bp, Rattus norvegicus
tggttttcctccctcgtcttggatc

SEQ ID NO: 642230 - DNA, 25 bp, Rattus norvegicus
tggttttcctccgtcgtcttggatc

SEQ ID NO: 642231 - DNA, 25 bp, Rattus norvegicus
tggttttcctgaacacttgtcatcc

SEQ ID NO: 642232 - DNA, 25 bp, Rattus norvegicus
tggttttcctgatcacttgtcatcc

SEQ ID NO: 642233 - DNA, 25 bp, Rattus norvegicus
tggttttccttgaggcctaaacaat

SEQ ID NO: 642234 - DNA, 25 bp, Rattus norvegicus
tggttttccttgtggcctaaacaat

SEQ ID NO: 642235 - DNA, 25 bp, Rattus norvegicus
tggttttcgtcgctccataggaaca

SEQ ID NO: 642236 - DNA, 25 bp, Rattus norvegicus
tggttttcgtcggtccataggaaca

SEQ ID NO: 642237 - DNA, 25 bp, Rattus norvegicus
tggttttcgtggatgatttacacaa

SEQ ID NO: 642238 - DNA, 25 bp, Rattus norvegicus
tggttttcgtggttgatttacacaa

SEQ ID NO: 642239 - DNA, 25 bp, Rattus norvegicus
tggttttctacccaatgcctattga

SEQ ID NO: 642240 - DNA, 25 bp, Rattus norvegicus
tggttttctaccgaatgcctattga

SEQ ID NO: 642241 - DNA, 25 bp, Rattus norvegicus
tggttttctcctaccaatatgtgag

SEQ ID NO: 642242 - DNA, 25 bp, Rattus norvegicus
tggttttctccttccaatatgtgag

SEQ ID NO: 642243 - DNA, 25 bp, Rattus norvegicus
tggttttctctgctgtgccactgca

SEQ ID NO: 642244 - DNA, 25 bp, Rattus norvegicus
tggttttctctggtgtgccactgca

SEQ ID NO: 642245 - DNA, 25 bp, Rattus norvegicus
tggttttctgccagtgaccagacag

SEQ ID NO: 642246 - DNA, 25 bp, Rattus norvegicus
tggttttctgcctgtgaccagacag

SEQ ID NO: 642247 - DNA, 25 bp, Rattus norvegicus
tggttttctttcagccttgttgcta

SEQ ID NO: 642248 - DNA, 25 bp, Rattus norvegicus
tggttttctttctgccttgttgcta

SEQ ID NO: 642249 - DNA, 25 bp, Rattus norvegicus
tggttttgaccaagagaagaagcct

SEQ ID NO: 642250 - DNA, 25 bp, Rattus norvegicus
tggttttgaccacgttttctaggct

SEQ ID NO: 642251 - DNA, 25 bp, Rattus norvegicus
tggttttgaccaggttttctaggct

SEQ ID NO: 642252 - DNA, 25 bp, Rattus norvegicus
tggttttgaccatgagaagaagcct

SEQ ID NO: 642253 - DNA, 25 bp, Rattus norvegicus
tggttttgagcaccaccaggcctga

SEQ ID NO: 642254 - DNA, 25 bp, Rattus norvegicus
tggttttgagcagcaccaggcctga

SEQ ID NO: 642255 - DNA, 25 bp, Rattus norvegicus
tggttttgatggcttcctatcaccc

SEQ ID NO: 642256 - DNA, 25 bp, Rattus norvegicus
tggttttgatgggttcctatcaccc

SEQ ID NO: 642257 - DNA, 25 bp, Rattus norvegicus
tggttttgctcacgtcttcagaaga

SEQ ID NO: 642258 - DNA, 25 bp, Rattus norvegicus
tggttttgctcaggtcttcagaaga

SEQ ID NO: 642259 - DNA, 25 bp, Rattus norvegicus
tggttttgctctcattcttgccaaa

SEQ ID NO: 642260 - DNA, 25 bp, Rattus norvegicus
tggttttgctctgattcttgccaaa

SEQ ID NO: 642261 - DNA, 25 bp, Rattus norvegicus
tggttttgcttacccagcgtgcatg

SEQ ID NO: 642262 - DNA, 25 bp, Rattus norvegicus
tggttttgcttagccagcgtgcatg

SEQ ID NO: 642263 - DNA, 25 bp, Rattus norvegicus
tggttttggcaccatccatatcaaa

SEQ ID NO: 642264 - DNA, 25 bp, Rattus norvegicus
tggttttggcacgatccatatcaaa

SEQ ID NO: 642265 - DNA, 25 bp, Rattus norvegicus
tggttttggttcatctctgtgatta

SEQ ID NO: 642266 - DNA, 25 bp, Rattus norvegicus
tggttttggttcttctctgtgatta

SEQ ID NO: 642267 - DNA, 25 bp, Rattus norvegicus
tggttttgttccaataagtctcctt

SEQ ID NO: 642268 - DNA, 25 bp, Rattus norvegicus
tggttttgttcctataagtctcctt

SEQ ID NO: 642269 - DNA, 25 bp, Rattus norvegicus
tggttttgtttgagaccctcttgtc

SEQ ID NO: 642270 - DNA, 25 bp, Rattus norvegicus
tggttttgtttgtgaccctcttgtc

SEQ ID NO: 642271 - DNA, 25 bp, Rattus norvegicus
tggtttttacagagtcttcgtttga

SEQ ID NO: 642272 - DNA, 25 bp, Rattus norvegicus
tggtttttacagtgtcttcgtttga

SEQ ID NO: 642273 - DNA, 25 bp, Rattus norvegicus
tggtttttatatactgctgcaggca

SEQ ID NO: 642274 - DNA, 25 bp, Rattus norvegicus
tggtttttatattctgctgcaggca

SEQ ID NO: 642275 - DNA, 25 bp, Rattus norvegicus
tggtttttcccaccagctacctgat

SEQ ID NO: 642276 - DNA, 25 bp, Rattus norvegicus
tggtttttcccagcagctacctgat

SEQ ID NO: 642277 - DNA, 25 bp, Rattus norvegicus
tggtttttccccacacttacataga

SEQ ID NO: 642278 - DNA, 25 bp, Rattus norvegicus
tggtttttcccctcacttacataga

SEQ ID NO: 642279 - DNA, 25 bp, Rattus norvegicus
tggtttttctctctgaatccgggtc

SEQ ID NO: 642280 - DNA, 25 bp, Rattus norvegicus
tggtttttctctgtgaatccgggtc

SEQ ID NO: 642281 - DNA, 25 bp, Rattus norvegicus
tggtttttctgtagctagcttacct

SEQ ID NO: 642282 - DNA, 25 bp, Rattus norvegicus
tggtttttctgttgctagcttacct

SEQ ID NO: 642283 - DNA, 25 bp, Rattus norvegicus
tggtttttggctatttgtcttacat

SEQ ID NO: 642284 - DNA, 25 bp, Rattus norvegicus
tggtttttggctttttgtcttacat

SEQ ID NO: 642285 - DNA, 25 bp, Rattus norvegicus
tggtttttgtaacccaggcttgctt

SEQ ID NO: 642286 - DNA, 25 bp, Rattus norvegicus
tggtttttgtaagccaggcttgctt

SEQ ID NO: 642287 - DNA, 25 bp, Rattus norvegicus
tgtaaaaagaacaccagtcccagtc

SEQ ID NO: 642288 - DNA, 25 bp, Rattus norvegicus
tgtaaaaagaactccagtcccagtc

SEQ ID NO: 642289 - DNA, 25 bp, Rattus norvegicus
tgtaaaacaaaacgcggattcagat

SEQ ID NO: 642290 - DNA, 25 bp, Rattus norvegicus
tgtaaaacaaaaggcggattcagat

SEQ ID NO: 642291 - DNA, 25 bp, Rattus norvegicus
tgtaaaacccctatgattgtaatga

SEQ ID NO: 642292 - DNA, 25 bp, Rattus norvegicus
tgtaaaacccctttgattgtaatga

SEQ ID NO: 642293 - DNA, 25 bp, Rattus norvegicus
tgtaaaaccctaaatttcatgcctt

SEQ ID NO: 642294 - DNA, 25 bp, Rattus norvegicus
tgtaaaaccctatatttcatgcctt

SEQ ID NO: 642295 - DNA, 25 bp, Rattus norvegicus
tgtaaaaccgttcaccaaaggtcat

SEQ ID NO: 642296 - DNA, 25 bp, Rattus norvegicus
tgtaaaaccgttgaccaaaggtcat

SEQ ID NO: 642297 - DNA, 25 bp, Rattus norvegicus
tgtaaaaccttacctcgctctgaaa

SEQ ID NO: 642298 - DNA, 25 bp, Rattus norvegicus
tgtaaaaccttagctcgctctgaaa

SEQ ID NO: 642299 - DNA, 25 bp, Rattus norvegicus
tgtaaaactgacacgcaactccatt

SEQ ID NO: 642300 - DNA, 25 bp, Rattus norvegicus
tgtaaaactgactcgcaactccatt

SEQ ID NO: 642301 - DNA, 25 bp, Rattus norvegicus
tgtaaaactgtgcaggccctgtcac

SEQ ID NO: 642302 - DNA, 25 bp, Rattus norvegicus
tgtaaaactgtggaggccctgtcac

SEQ ID NO: 642303 - DNA, 25 bp, Rattus norvegicus
tgtaaaaggacgcactctctggaac

SEQ ID NO: 642304 - DNA, 25 bp, Rattus norvegicus
tgtaaaaggacggactctctggaac

SEQ ID NO: 642305 - DNA, 25 bp, Rattus norvegicus
tgtaaaaggtctagccagtccgtga

SEQ ID NO: 642306 - DNA, 25 bp, Rattus norvegicus
tgtaaaaggtcttgccagtccgtga

SEQ ID NO: 642307 - DNA, 25 bp, Rattus norvegicus
tgtaaaatagccatcagactcccct

SEQ ID NO: 642308 - DNA, 25 bp, Rattus norvegicus
tgtaaaatagccttcagactcccct

SEQ ID NO: 642309 - DNA, 25 bp, Rattus norvegicus
tgtaaaatgcttaatctgtgcctaa

SEQ ID NO: 642310 - DNA, 25 bp, Rattus norvegicus
tgtaaaatgctttatctgtgcctaa

SEQ ID NO: 642311 - DNA, 25 bp, Rattus norvegicus
tgtaaaatttctagtgctcccctta

SEQ ID NO: 642312 - DNA, 25 bp, Rattus norvegicus
tgtaaaatttcttgtgctcccctta

SEQ ID NO: 642313 - DNA, 25 bp, Rattus norvegicus
tgtaaacaactcataaagcccctgc

SEQ ID NO: 642314 - DNA, 25 bp, Rattus norvegicus
tgtaaacaactcttaaagcccctgc

SEQ ID NO: 642315 - DNA, 25 bp, Rattus norvegicus
tgtaaacaagttctcagctctaggg

SEQ ID NO: 642316 - DNA, 25 bp, Rattus norvegicus
tgtaaacaagttgtcagctctaggg

SEQ ID NO: 642317 - DNA, 25 bp, Rattus norvegicus
tgtaaacacatgaagttttctccct

SEQ ID NO: 642318 - DNA, 25 bp, Rattus norvegicus
tgtaaacacatgtagttttctccct

SEQ ID NO: 642319 - DNA, 25 bp, Rattus norvegicus
tgtaaacactttcactgccaccaat

SEQ ID NO: 642320 - DNA, 25 bp, Rattus norvegicus
tgtaaacactttgactgccaccaat

SEQ ID NO: 642321 - DNA, 25 bp, Rattus norvegicus
tgtaaacagaaacttccccaaagca

SEQ ID NO: 642322 - DNA, 25 bp, Rattus norvegicus
tgtaaacagaaagttccccaaagca

SEQ ID NO: 642323 - DNA, 25 bp, Rattus norvegicus
tgtaaacagtgcatagccggctcca

SEQ ID NO: 642324 - DNA, 25 bp, Rattus norvegicus
tgtaaacagtgcttagccggctcca

SEQ ID NO: 642325 - DNA, 25 bp, Rattus norvegicus
tgtaaacatggtcacctccttgctc

SEQ ID NO: 642326 - DNA, 25 bp, Rattus norvegicus
tgtaaacatggtgacctccttgctc

SEQ ID NO: 642327 - DNA, 25 bp, Rattus norvegicus
tgtaaacccactaccattccagagg

SEQ ID NO: 642328 - DNA, 25 bp, Rattus norvegicus
tgtaaacccacttccattccagagg

SEQ ID NO: 642329 - DNA, 25 bp, Rattus norvegicus
tgtaaacccaggacattttcctcct

SEQ ID NO: 642330 - DNA, 25 bp, Rattus norvegicus
tgtaaacccaggtcattttcctcct

SEQ ID NO: 642331 - DNA, 25 bp, Rattus norvegicus
tgtaaacctgtcattaagcacctgc

SEQ ID NO: 642332 - DNA, 25 bp, Rattus norvegicus
tgtaaacctgtctttaagcacctgc

SEQ ID NO: 642333 - DNA, 25 bp, Rattus norvegicus
tgtaaactaagtcccgtttcaacgt

SEQ ID NO: 642334 - DNA, 25 bp, Rattus norvegicus
tgtaaactaagtgccgtttcaacgt

SEQ ID NO: 642335 - DNA, 25 bp, Rattus norvegicus
tgtaaactcacaaccatcaataatt

SEQ ID NO: 642336 - DNA, 25 bp, Rattus norvegicus
tgtaaactcacatccatcaataatt

SEQ ID NO: 642337 - DNA, 25 bp, Rattus norvegicus
tgtaaactcccaagcttttcacgtg

SEQ ID NO: 642338 - DNA, 25 bp, Rattus norvegicus
tgtaaactcccatgcttttcacgtg

SEQ ID NO: 642339 - DNA, 25 bp, Rattus norvegicus
tgtaaactctttaggtgacccatgt

SEQ ID NO: 642340 - DNA, 25 bp, Rattus norvegicus
tgtaaactcttttggtgacccatgt

SEQ ID NO: 642341 - DNA, 25 bp, Rattus norvegicus
tgtaaactgaacactgcccacagga

SEQ ID NO: 642342 - DNA, 25 bp, Rattus norvegicus
tgtaaactgaactctgcccacagga

SEQ ID NO: 642343 - DNA, 25 bp, Rattus norvegicus
tgtaaactgagaaagcccaccgtct

SEQ ID NO: 642344 - DNA, 25 bp, Rattus norvegicus
tgtaaactgagatagcccaccgtct

SEQ ID NO: 642345 - DNA, 25 bp, Rattus norvegicus
tgtaaactgtgtcgcattgctttca

SEQ ID NO: 642346 - DNA, 25 bp, Rattus norvegicus
tgtaaactgtgtggcattgctttca

SEQ ID NO: 642347 - DNA, 25 bp, Rattus norvegicus
tgtaaacttcacacctcagggctaa

SEQ ID NO: 642348 - DNA, 25 bp, Rattus norvegicus
tgtaaacttcactcctcagggctaa

SEQ ID NO: 642349 - DNA, 25 bp, Rattus norvegicus
tgtaaacttcccaccatggtcatca

SEQ ID NO: 642350 - DNA, 25 bp, Rattus norvegicus
tgtaaacttccctccatggtcatca

SEQ ID NO: 642351 - DNA, 25 bp, Rattus norvegicus
tgtaaactttaacctcctctttatg

SEQ ID NO: 642352 - DNA, 25 bp, Rattus norvegicus
tgtaaactttaagctcctctttatg

SEQ ID NO: 642353 - DNA, 25 bp, Rattus norvegicus
tgtaaactttggaaagccgtatgga

SEQ ID NO: 642354 - DNA, 25 bp, Rattus norvegicus
tgtaaactttggtaagccgtatgga

SEQ ID NO: 642355 - DNA, 25 bp, Rattus norvegicus
tgtaaagaacctcggtgctgctcca

SEQ ID NO: 642356 - DNA, 25 bp, Rattus norvegicus
tgtaaagaacctgggtgctgctcca

SEQ ID NO: 642357 - DNA, 25 bp, Rattus norvegicus
tgtaaagaactcaccattgaccctc

SEQ ID NO: 642358 - DNA, 25 bp, Rattus norvegicus
tgtaaagaactctccattgaccctc

SEQ ID NO: 642359 - DNA, 25 bp, Rattus norvegicus
tgtaaagaagtacagctcctgcagc

SEQ ID NO: 642360 - DNA, 25 bp, Rattus norvegicus
tgtaaagaagtagagctcctgcagc

SEQ ID NO: 642361 - DNA, 25 bp, Rattus norvegicus
tgtaaagaccacctcgcagctagcg

SEQ ID NO: 642362 - DNA, 25 bp, Rattus norvegicus
tgtaaagaccacgtcgcagctagcg

SEQ ID NO: 642363 - DNA, 25 bp, Rattus norvegicus
tgtaaagagagtcctcccagctggt

SEQ ID NO: 642364 - DNA, 25 bp, Rattus norvegicus
tgtaaagagagtgctcccagctggt

SEQ ID NO: 642365 - DNA, 25 bp, Rattus norvegicus
tgtaaagatcaccttcctgtctcat

SEQ ID NO: 642366 - DNA, 25 bp, Rattus norvegicus
tgtaaagatcacgttcctgtctcat

SEQ ID NO: 642367 - DNA, 25 bp, Rattus norvegicus
tgtaaagatctgatggctccaccct

SEQ ID NO: 642368 - DNA, 25 bp, Rattus norvegicus
tgtaaagatctgttggctccaccct

SEQ ID NO: 642369 - DNA, 25 bp, Rattus norvegicus
tgtaaagccaccatattgggcctga

SEQ ID NO: 642370 - DNA, 25 bp, Rattus norvegicus
tgtaaagccaccttattgggcctga

SEQ ID NO: 642371 - DNA, 25 bp, Rattus norvegicus
tgtaaagcgccacgtttctgcactg

SEQ ID NO: 642372 - DNA, 25 bp, Rattus norvegicus
tgtaaagcgccaggtttctgcactg

SEQ ID NO: 642373 - DNA, 25 bp, Rattus norvegicus
tgtaaagctattaatcaaccctcgg

SEQ ID NO: 642374 - DNA, 25 bp, Rattus norvegicus
tgtaaagctatttatcaaccctcgg

SEQ ID NO: 642375 - DNA, 25 bp, Rattus norvegicus
tgtaaagctgctacccaattggctt

SEQ ID NO: 642376 - DNA, 25 bp, Rattus norvegicus
tgtaaagctgcttcccaattggctt

SEQ ID NO: 642377 - DNA, 25 bp, Rattus norvegicus
tgtaaaggaactcccttacggacat

SEQ ID NO: 642378 - DNA, 25 bp, Rattus norvegicus
tgtaaaggaactgccttacggacat

SEQ ID NO: 642379 - DNA, 25 bp, Rattus norvegicus
tgtaaagtccaactggccttttcca

SEQ ID NO: 642380 - DNA, 25 bp, Rattus norvegicus
tgtaaagtccaagtggccttttcca

SEQ ID NO: 642381 - DNA, 25 bp, Rattus norvegicus
tgtaaagtcctccttgtcggctttc

SEQ ID NO: 642382 - DNA, 25 bp, Rattus norvegicus
tgtaaagtcctcgttgtcggctttc

SEQ ID NO: 642383 - DNA, 25 bp, Rattus norvegicus
tgtaaagtctaccagcacagggtta

SEQ ID NO: 642384 - DNA, 25 bp, Rattus norvegicus
tgtaaagtctacgagcacagggtta

SEQ ID NO: 642385 - DNA, 25 bp, Rattus norvegicus
tgtaaagtgttgattctcctcctcc

SEQ ID NO: 642386 - DNA, 25 bp, Rattus norvegicus
tgtaaagtgttgtttctcctcctcc

SEQ ID NO: 642387 - DNA, 25 bp, Rattus norvegicus
tgtaaagttcagcatattcccacat

SEQ ID NO: 642388 - DNA, 25 bp, Rattus norvegicus
tgtaaagttcaggatattcccacat

SEQ ID NO: 642389 - DNA, 25 bp, Rattus norvegicus
tgtaaagttgctctttgctctgcca

SEQ ID NO: 642390 - DNA, 25 bp, Rattus norvegicus
tgtaaagttgctgtttgctctgcca

SEQ ID NO: 642391 - DNA, 25 bp, Rattus norvegicus
tgtaaataaatgatgcccctggcag

SEQ ID NO: 642392 - DNA, 25 bp, Rattus norvegicus
tgtaaataaatgctaccaacgtcgc

SEQ ID NO: 642393 - DNA, 25 bp, Rattus norvegicus
tgtaaataaatggtaccaacgtcgc

SEQ ID NO: 642394 - DNA, 25 bp, Rattus norvegicus
tgtaaataaatgttgcccctggcag

SEQ ID NO: 642395 - DNA, 25 bp, Rattus norvegicus
tgtaaataatttccatgcctccctt

SEQ ID NO: 642396 - DNA, 25 bp, Rattus norvegicus
tgtaaataatttccggaccaactca

SEQ ID NO: 642397 - DNA, 25 bp, Rattus norvegicus
tgtaaataatttgcatgcctccctt

SEQ ID NO: 642398 - DNA, 25 bp, Rattus norvegicus
tgtaaataatttgcggaccaactca

SEQ ID NO: 642399 - DNA, 25 bp, Rattus norvegicus
tgtaaatacactctggctgcctctg

SEQ ID NO: 642400 - DNA, 25 bp, Rattus norvegicus
tgtaaatacactgtggctgcctctg

SEQ ID NO: 642401 - DNA, 25 bp, Rattus norvegicus
tgtaaatacccgattcacactaagt

SEQ ID NO: 642402 - DNA, 25 bp, Rattus norvegicus
tgtaaatacccgtttcacactaagt

SEQ ID NO: 642403 - DNA, 25 bp, Rattus norvegicus
tgtaaatactaacacgctatgcatg

SEQ ID NO: 642404 - DNA, 25 bp, Rattus norvegicus
tgtaaatactaagacgctatgcatg

SEQ ID NO: 642405 - DNA, 25 bp, Rattus norvegicus
tgtaaatatcagacttcgctcccag

SEQ ID NO: 642406 - DNA, 25 bp, Rattus norvegicus
tgtaaatatcagtcttcgctcccag

SEQ ID NO: 642407 - DNA, 25 bp, Rattus norvegicus
tgtaaatatccgactttgcacctag

SEQ ID NO: 642408 - DNA, 25 bp, Rattus norvegicus
tgtaaatatccgtctttgcacctag

SEQ ID NO: 642409 - DNA, 25 bp, Rattus norvegicus
tgtaaatattacactgtcctctggg

SEQ ID NO: 642410 - DNA, 25 bp, Rattus norvegicus
tgtaaatattactctgtcctctggg

SEQ ID NO: 642411 - DNA, 25 bp, Rattus norvegicus
tgtaaatatttcaactgggcccacc

SEQ ID NO: 642412 - DNA, 25 bp, Rattus norvegicus
tgtaaatatttctactgggcccacc

SEQ ID NO: 642413 - DNA, 25 bp, Rattus norvegicus
tgtaaatccacccttgcagctaatg

SEQ ID NO: 642414 - DNA, 25 bp, Rattus norvegicus
tgtaaatccaccgttgcagctaatg

SEQ ID NO: 642415 - DNA, 25 bp, Rattus norvegicus
tgtaaatccttaatgcaaacttttt

SEQ ID NO: 642416 - DNA, 25 bp, Rattus norvegicus
tgtaaatccttattgcaaacttttt

SEQ ID NO: 642417 - DNA, 25 bp, Rattus norvegicus
tgtaaatcgttaactgtccacacag

SEQ ID NO: 642418 - DNA, 25 bp, Rattus norvegicus
tgtaaatcgttatctgtccacacag

SEQ ID NO: 642419 - DNA, 25 bp, Rattus norvegicus
tgtaaatctcctatcgcagttttga

SEQ ID NO: 642420 - DNA, 25 bp, Rattus norvegicus
tgtaaatctcctttcgcagttttga

SEQ ID NO: 642421 - DNA, 25 bp, Rattus norvegicus
tgtaaatgcaccacccctttaaagg

SEQ ID NO: 642422 - DNA, 25 bp, Rattus norvegicus
tgtaaatgcacctcccctttaaagg

SEQ ID NO: 642423 - DNA, 25 bp, Rattus norvegicus
tgtaaatgctctcattacccactac

SEQ ID NO: 642424 - DNA, 25 bp, Rattus norvegicus
tgtaaatgctctgattacccactac

SEQ ID NO: 642425 - DNA, 25 bp, Rattus norvegicus
tgtaaatgtcctaaatgcacccaac

SEQ ID NO: 642426 - DNA, 25 bp, Rattus norvegicus
tgtaaatgtccttaatgcacccaac

SEQ ID NO: 642427 - DNA, 25 bp, Rattus norvegicus
tgtaaatgtgctagtgttgcccctc

SEQ ID NO: 642428 - DNA, 25 bp, Rattus norvegicus
tgtaaatgtgcttgtgttgcccctc

SEQ ID NO: 642429 - DNA, 25 bp, Rattus norvegicus
tgtaaatgtgttcctaatgctcctt

SEQ ID NO: 642430 - DNA, 25 bp, Rattus norvegicus
tgtaaatgtgttctcctctgcgcag

SEQ ID NO: 642431 - DNA, 25 bp, Rattus norvegicus
tgtaaatgtgttgctaatgctcctt

SEQ ID NO: 642432 - DNA, 25 bp, Rattus norvegicus
tgtaaatgtgttgtcctctgcgcag

SEQ ID NO: 642433 - DNA, 25 bp, Rattus norvegicus
tgtaaattaacccacacattatgtg

SEQ ID NO: 642434 - DNA, 25 bp, Rattus norvegicus
tgtaaattaaccgacacattatgtg

SEQ ID NO: 642435 - DNA, 25 bp, Rattus norvegicus
tgtaaattctccagtgagctgctcc

SEQ ID NO: 642436 - DNA, 25 bp, Rattus norvegicus
tgtaaattctcctgtgagctgctcc

SEQ ID NO: 642437 - DNA, 25 bp, Rattus norvegicus
tgtaaattcttcaactgcttgcgca

SEQ ID NO: 642438 - DNA, 25 bp, Rattus norvegicus
tgtaaattcttctactgcttgcgca

SEQ ID NO: 642439 - DNA, 25 bp, Rattus norvegicus
tgtaacaacgctacctgcgcagtgg

SEQ ID NO: 642440 - DNA, 25 bp, Rattus norvegicus
tgtaacaacgcttcctgcgcagtgg

SEQ ID NO: 642441 - DNA, 25 bp, Rattus norvegicus
tgtaacacaagcacagatttttatg

SEQ ID NO: 642442 - DNA, 25 bp, Rattus norvegicus
tgtaacacaagctcagatttttatg

SEQ ID NO: 642443 - DNA, 25 bp, Rattus norvegicus
tgtaacaccaccactgaagctgatc

SEQ ID NO: 642444 - DNA, 25 bp, Rattus norvegicus
tgtaacaccacctctgaagctgatc

SEQ ID NO: 642445 - DNA, 25 bp, Rattus norvegicus
tgtaacaccctgaagaagcccacgg

SEQ ID NO: 642446 - DNA, 25 bp, Rattus norvegicus
tgtaacaccctgctacattatctac

SEQ ID NO: 642447 - DNA, 25 bp, Rattus norvegicus
tgtaacaccctggtacattatctac

SEQ ID NO: 642448 - DNA, 25 bp, Rattus norvegicus
tgtaacaccctgtagaagcccacgg

SEQ ID NO: 642449 - DNA, 25 bp, Rattus norvegicus
tgtaacacccttctataaagcctaa

SEQ ID NO: 642450 - DNA, 25 bp, Rattus norvegicus
tgtaacacccttgtataaagcctaa

SEQ ID NO: 642451 - DNA, 25 bp, Rattus norvegicus
tgtaacactgacattatcctccata

SEQ ID NO: 642452 - DNA, 25 bp, Rattus norvegicus
tgtaacactgaccaccatcttgatg

SEQ ID NO: 642453 - DNA, 25 bp, Rattus norvegicus
tgtaacactgacgaccatcttgatg

SEQ ID NO: 642454 - DNA, 25 bp, Rattus norvegicus
tgtaacactgactttatcctccata

SEQ ID NO: 642455 - DNA, 25 bp, Rattus norvegicus
tgtaacagaatcatgcctctagcaa

SEQ ID NO: 642456 - DNA, 25 bp, Rattus norvegicus
tgtaacagaatcttgcctctagcaa

SEQ ID NO: 642457 - DNA, 25 bp, Rattus norvegicus
tgtaacagacacagccaaggcactg

SEQ ID NO: 642458 - DNA, 25 bp, Rattus norvegicus
tgtaacagacactgccaaggcactg

SEQ ID NO: 642459 - DNA, 25 bp, Rattus norvegicus
tgtaacagattccatcttcccactg

SEQ ID NO: 642460 - DNA, 25 bp, Rattus norvegicus
tgtaacagattcgatcttcccactg

SEQ ID NO: 642461 - DNA, 25 bp, Rattus norvegicus
tgtaacaggcttatatttccaggta

SEQ ID NO: 642462 - DNA, 25 bp, Rattus norvegicus
tgtaacaggcttttatttccaggta

SEQ ID NO: 642463 - DNA, 25 bp, Rattus norvegicus
tgtaacatttaaccctatttccgat

SEQ ID NO: 642464 - DNA, 25 bp, Rattus norvegicus
tgtaacatttaagcctatttccgat

SEQ ID NO: 642465 - DNA, 25 bp, Rattus norvegicus
tgtaaccaaacactgtgctccttgc

SEQ ID NO: 642466 - DNA, 25 bp, Rattus norvegicus
tgtaaccaaacagtgtgctccttgc

SEQ ID NO: 642467 - DNA, 25 bp, Rattus norvegicus
tgtaaccaaaccagtccttcccaat

SEQ ID NO: 642468 - DNA, 25 bp, Rattus norvegicus
tgtaaccaaacctgtccttcccaat

SEQ ID NO: 642469 - DNA, 25 bp, Rattus norvegicus
tgtaaccaaactctatcatccatta

SEQ ID NO: 642470 - DNA, 25 bp, Rattus norvegicus
tgtaaccaaactcttaatttttatg

SEQ ID NO: 642471 - DNA, 25 bp, Rattus norvegicus
tgtaaccaaactgtatcatccatta

SEQ ID NO: 642472 - DNA, 25 bp, Rattus norvegicus
tgtaaccaaactgttaatttttatg

SEQ ID NO: 642473 - DNA, 25 bp, Rattus norvegicus
tgtaaccaaggaattcccctggatt

SEQ ID NO: 642474 - DNA, 25 bp, Rattus norvegicus
tgtaaccaaggatttcccctggatt

SEQ ID NO: 642475 - DNA, 25 bp, Rattus norvegicus
tgtaaccaataaagctccctcgttt

SEQ ID NO: 642476 - DNA, 25 bp, Rattus norvegicus
tgtaaccaataatgctccctcgttt

SEQ ID NO: 642477 - DNA, 25 bp, Rattus norvegicus
tgtaaccacgagatccatgccaagt

SEQ ID NO: 642478 - DNA, 25 bp, Rattus norvegicus
tgtaaccacgagttccatgccaagt

SEQ ID NO: 642479 - DNA, 25 bp, Rattus norvegicus
tgtaaccactggagcaacacaacct

SEQ ID NO: 642480 - DNA, 25 bp, Rattus norvegicus
tgtaaccactggtgcaacacaacct

SEQ ID NO: 642481 - DNA, 25 bp, Rattus norvegicus
tgtaaccagcagaggctgcctttat

SEQ ID NO: 642482 - DNA, 25 bp, Rattus norvegicus
tgtaaccagcagtggctgcctttat

SEQ ID NO: 642483 - DNA, 25 bp, Rattus norvegicus
tgtaaccagggtatcataccgttct

SEQ ID NO: 642484 - DNA, 25 bp, Rattus norvegicus
tgtaaccagggtttcataccgttct

SEQ ID NO: 642485 - DNA, 25 bp, Rattus norvegicus
tgtaaccaggtactttgcacagccg

SEQ ID NO: 642486 - DNA, 25 bp, Rattus norvegicus
tgtaaccaggtagtttgcacagccg

SEQ ID NO: 642487 - DNA, 25 bp, Rattus norvegicus
tgtaaccatcatatactgagctcct

SEQ ID NO: 642488 - DNA, 25 bp, Rattus norvegicus
tgtaaccatcatttactgagctcct

SEQ ID NO: 642489 - DNA, 25 bp, Rattus norvegicus
tgtaaccatgccacagcagggtggt

SEQ ID NO: 642490 - DNA, 25 bp, Rattus norvegicus
tgtaaccatgcctcagcagggtggt

SEQ ID NO: 642491 - DNA, 25 bp, Rattus norvegicus
tgtaaccccaaacgtggcacggctg

SEQ ID NO: 642492 - DNA, 25 bp, Rattus norvegicus
tgtaaccccaaaggtggcacggctg

SEQ ID NO: 642493 - DNA, 25 bp, Rattus norvegicus
tgtaaccccggcacttgggaggcag

SEQ ID NO: 642494 - DNA, 25 bp, Rattus norvegicus
tgtaaccccggctcttgggaggcag

SEQ ID NO: 642495 - DNA, 25 bp, Rattus norvegicus
tgtaacccttgaaacctgaacatta

SEQ ID NO: 642496 - DNA, 25 bp, Rattus norvegicus
tgtaacccttgatacctgaacatta

SEQ ID NO: 642497 - DNA, 25 bp, Rattus norvegicus
tgtaaccggtaacactagtttggct

SEQ ID NO: 642498 - DNA, 25 bp, Rattus norvegicus
tgtaaccggtaagactagtttggct

SEQ ID NO: 642499 - DNA, 25 bp, Rattus norvegicus
tgtaaccggtggctttgatgtcccc

SEQ ID NO: 642500 - DNA, 25 bp, Rattus norvegicus
tgtaaccggtgggtttgatgtcccc

SEQ ID NO: 642501 - DNA, 25 bp, Rattus norvegicus
tgtaaccgtgctaccatgattatgt

SEQ ID NO: 642502 - DNA, 25 bp, Rattus norvegicus
tgtaaccgtgcttccatgattatgt

SEQ ID NO: 642503 - DNA, 25 bp, Rattus norvegicus
tgtaacctaagacgccccatgaata

SEQ ID NO: 642504 - DNA, 25 bp, Rattus norvegicus
tgtaacctaagaggccccatgaata

SEQ ID NO: 642505 - DNA, 25 bp, Rattus norvegicus
tgtaacctagacagggacgcactat

SEQ ID NO: 642506 - DNA, 25 bp, Rattus norvegicus
tgtaacctagactgggacgcactat

SEQ ID NO: 642507 - DNA, 25 bp, Rattus norvegicus
tgtaacctcagtccctaggatggtc

SEQ ID NO: 642508 - DNA, 25 bp, Rattus norvegicus
tgtaacctcagtgcctaggatggtc

SEQ ID NO: 642509 - DNA, 25 bp, Rattus norvegicus
tgtaacctccttcttgtcacacatg

SEQ ID NO: 642510 - DNA, 25 bp, Rattus norvegicus
tgtaacctccttgttgtcacacatg

SEQ ID NO: 642511 - DNA, 25 bp, Rattus norvegicus
tgtaacctgcttctccctgcagtga

SEQ ID NO: 642512 - DNA, 25 bp, Rattus norvegicus
tgtaacctgcttgtccctgcagtga

SEQ ID NO: 642513 - DNA, 25 bp, Rattus norvegicus
tgtaacctgtcaaacatctggattc

SEQ ID NO: 642514 - DNA, 25 bp, Rattus norvegicus
tgtaacctgtcatacatctggattc

SEQ ID NO: 642515 - DNA, 25 bp, Rattus norvegicus
tgtaacctgtgtagcgcaaatgccg

SEQ ID NO: 642516 - DNA, 25 bp, Rattus norvegicus
tgtaacctgtgttgcgcaaatgccg

SEQ ID NO: 642517 - DNA, 25 bp, Rattus norvegicus
tgtaaccttcccaggaccaggagaa

SEQ ID NO: 642518 - DNA, 25 bp, Rattus norvegicus
tgtaaccttccctggaccaggagaa

SEQ ID NO: 642519 - DNA, 25 bp, Rattus norvegicus
tgtaaccttcttatcttgcatgtga

SEQ ID NO: 642520 - DNA, 25 bp, Rattus norvegicus
tgtaaccttcttttcttgcatgtga

SEQ ID NO: 642521 - DNA, 25 bp, Rattus norvegicus
tgtaacgcctttagtggatactcaa

SEQ ID NO: 642522 - DNA, 25 bp, Rattus norvegicus
tgtaacgccttttgtggatactcaa

SEQ ID NO: 642523 - DNA, 25 bp, Rattus norvegicus
tgtaacggagatactggcggcccac

SEQ ID NO: 642524 - DNA, 25 bp, Rattus norvegicus
tgtaacggagattctggcggcccac

SEQ ID NO: 642525 - DNA, 25 bp, Rattus norvegicus
tgtaacggcagtcggcaggtccacc

SEQ ID NO: 642526 - DNA, 25 bp, Rattus norvegicus
tgtaacggcagtgggcaggtccacc

SEQ ID NO: 642527 - DNA, 25 bp, Rattus norvegicus
tgtaacggccaacactttgttcgct

SEQ ID NO: 642528 - DNA, 25 bp, Rattus norvegicus
tgtaacggccaagactttgttcgct

SEQ ID NO: 642529 - DNA, 25 bp, Rattus norvegicus
tgtaacggtcacagctgccagagaa

SEQ ID NO: 642530 - DNA, 25 bp, Rattus norvegicus
tgtaacggtcactgctgccagagaa

SEQ ID NO: 642531 - DNA, 25 bp, Rattus norvegicus
tgtaactactgaatcatccagcccc

SEQ ID NO: 642532 - DNA, 25 bp, Rattus norvegicus
tgtaactactgattcatccagcccc

SEQ ID NO: 642533 - DNA, 25 bp, Rattus norvegicus
tgtaactatttaattgccttggcaa

SEQ ID NO: 642534 - DNA, 25 bp, Rattus norvegicus
tgtaactatttatttgccttggcaa

SEQ ID NO: 642535 - DNA, 25 bp, Rattus norvegicus
tgtaactcaagcatccaaggaattt

SEQ ID NO: 642536 - DNA, 25 bp, Rattus norvegicus
tgtaactcaagcttccaaggaattt

SEQ ID NO: 642537 - DNA, 25 bp, Rattus norvegicus
tgtaactcagtcacaaggcacttgg

SEQ ID NO: 642538 - DNA, 25 bp, Rattus norvegicus
tgtaactcagtctcaaggcacttgg

SEQ ID NO: 642539 - DNA, 25 bp, Rattus norvegicus
tgtaactccaaaattctccagtggg

SEQ ID NO: 642540 - DNA, 25 bp, Rattus norvegicus
tgtaactccaaatttctccagtggg

SEQ ID NO: 642541 - DNA, 25 bp, Rattus norvegicus
tgtaactccacaccgtttaacaaga

SEQ ID NO: 642542 - DNA, 25 bp, Rattus norvegicus
tgtaactccacagcgtttaacaaga

SEQ ID NO: 642543 - DNA, 25 bp, Rattus norvegicus
tgtaactccactccaaaggcatttg

SEQ ID NO: 642544 - DNA, 25 bp, Rattus norvegicus
tgtaactccactgcaaaggcatttg

SEQ ID NO: 642545 - DNA, 25 bp, Rattus norvegicus
tgtaactcccgtaccaaagacaact

SEQ ID NO: 642546 - DNA, 25 bp, Rattus norvegicus
tgtaactcccgttccaaagacaact

SEQ ID NO: 642547 - DNA, 25 bp, Rattus norvegicus
tgtaactcccttatggcacttgtgt

SEQ ID NO: 642548 - DNA, 25 bp, Rattus norvegicus
tgtaactcccttttggcacttgtgt

SEQ ID NO: 642549 - DNA, 25 bp, Rattus norvegicus
tgtaactcgtctactttatatgccc

SEQ ID NO: 642550 - DNA, 25 bp, Rattus norvegicus
tgtaactcgtcttctttatatgccc

SEQ ID NO: 642551 - DNA, 25 bp, Rattus norvegicus
tgtaactcttacatcatttcatgga

SEQ ID NO: 642552 - DNA, 25 bp, Rattus norvegicus
tgtaactcttacttcatttcatgga

SEQ ID NO: 642553 - DNA, 25 bp, Rattus norvegicus
tgtaactcttcaacttctgattcct

SEQ ID NO: 642554 - DNA, 25 bp, Rattus norvegicus
tgtaactcttcatcttctgattcct

SEQ ID NO: 642555 - DNA, 25 bp, Rattus norvegicus
tgtaactgatcaccagcctatgccc

SEQ ID NO: 642556 - DNA, 25 bp, Rattus norvegicus
tgtaactgatcagcagcctatgccc

SEQ ID NO: 642557 - DNA, 25 bp, Rattus norvegicus
tgtaactgcgctcacagaccttgta

SEQ ID NO: 642558 - DNA, 25 bp, Rattus norvegicus
tgtaactgcgctgacagaccttgta

SEQ ID NO: 642559 - DNA, 25 bp, Rattus norvegicus
tgtaactgtacacttctgatttctg

SEQ ID NO: 642560 - DNA, 25 bp, Rattus norvegicus
tgtaactgtacagttctgatttctg

SEQ ID NO: 642561 - DNA, 25 bp, Rattus norvegicus
tgtaactgtatcctggttttcccca

SEQ ID NO: 642562 - DNA, 25 bp, Rattus norvegicus
tgtaactgtatcgtggttttcccca

SEQ ID NO: 642563 - DNA, 25 bp, Rattus norvegicus
tgtaactgttttccattgtacctta

SEQ ID NO: 642564 - DNA, 25 bp, Rattus norvegicus
tgtaactgttttgcattgtacctta

SEQ ID NO: 642565 - DNA, 25 bp, Rattus norvegicus
tgtaacttctgtaagaaccccagcc

SEQ ID NO: 642566 - DNA, 25 bp, Rattus norvegicus
tgtaacttctgttagaaccccagcc

SEQ ID NO: 642567 - DNA, 25 bp, Rattus norvegicus
tgtaacttgctccacctggtagtaa

SEQ ID NO: 642568 - DNA, 25 bp, Rattus norvegicus
tgtaacttgctcgacctggtagtaa

SEQ ID NO: 642569 - DNA, 25 bp, Rattus norvegicus
tgtaacttgggtaccgattcctgaa

SEQ ID NO: 642570 - DNA, 25 bp, Rattus norvegicus
tgtaacttgggttccgattcctgaa

SEQ ID NO: 642571 - DNA, 25 bp, Rattus norvegicus
tgtaacttgtacacagcctgaaggt

SEQ ID NO: 642572 - DNA, 25 bp, Rattus norvegicus
tgtaacttgtacctgactcgatcct

SEQ ID NO: 642573 - DNA, 25 bp, Rattus norvegicus
tgtaacttgtacgtgactcgatcct

SEQ ID NO: 642574 - DNA, 25 bp, Rattus norvegicus
tgtaacttgtactcagcctgaaggt

SEQ ID NO: 642575 - DNA, 25 bp, Rattus norvegicus
tgtaactttacactccagatgggaa

SEQ ID NO: 642576 - DNA, 25 bp, Rattus norvegicus
tgtaactttacagtccagatgggaa

SEQ ID NO: 642577 - DNA, 25 bp, Rattus norvegicus
tgtaactttccaatccgagactgaa

SEQ ID NO: 642578 - DNA, 25 bp, Rattus norvegicus
tgtaactttccattccgagactgaa

SEQ ID NO: 642579 - DNA, 25 bp, Rattus norvegicus
tgtaactttgcaacgtgtaactttg

SEQ ID NO: 642580 - DNA, 25 bp, Rattus norvegicus
tgtaactttgcatcgtgtaactttg

SEQ ID NO: 642581 - DNA, 25 bp, Rattus norvegicus
tgtaagaaagtaacgcccacctcac

SEQ ID NO: 642582 - DNA, 25 bp, Rattus norvegicus
tgtaagaaagtatcgcccacctcac

SEQ ID NO: 642583 - DNA, 25 bp, Rattus norvegicus
tgtaagaagcccctgtctccagtca

SEQ ID NO: 642584 - DNA, 25 bp, Rattus norvegicus
tgtaagaagcccgtgtctccagtca

SEQ ID NO: 642585 - DNA, 25 bp, Rattus norvegicus
tgtaagaagcgtcctgatgcctcac

SEQ ID NO: 642586 - DNA, 25 bp, Rattus norvegicus
tgtaagaagcgtgctgatgcctcac

SEQ ID NO: 642587 - DNA, 25 bp, Rattus norvegicus
tgtaagaattccacctgtggtctct

SEQ ID NO: 642588 - DNA, 25 bp, Rattus norvegicus
tgtaagaattcctcctgtggtctct

SEQ ID NO: 642589 - DNA, 25 bp, Rattus norvegicus
tgtaagacaccccaactaggactgc

SEQ ID NO: 642590 - DNA, 25 bp, Rattus norvegicus
tgtaagacacccgaactaggactgc

SEQ ID NO: 642591 - DNA, 25 bp, Rattus norvegicus
tgtaagacagcactcccgtggaatg

SEQ ID NO: 642592 - DNA, 25 bp, Rattus norvegicus
tgtaagacagcagtcccgtggaatg

SEQ ID NO: 642593 - DNA, 25 bp, Rattus norvegicus
tgtaagaccacacaccactcaagac

SEQ ID NO: 642594 - DNA, 25 bp, Rattus norvegicus
tgtaagaccacagaccactcaagac

SEQ ID NO: 642595 - DNA, 25 bp, Rattus norvegicus
tgtaagactgcaccgtttgcatgcc

SEQ ID NO: 642596 - DNA, 25 bp, Rattus norvegicus
tgtaagactgcagcgtttgcatgcc

SEQ ID NO: 642597 - DNA, 25 bp, Rattus norvegicus
tgtaagacttggaagactaaccttt

SEQ ID NO: 642598 - DNA, 25 bp, Rattus norvegicus
tgtaagacttggtagactaaccttt

SEQ ID NO: 642599 - DNA, 25 bp, Rattus norvegicus
tgtaagagggctcccttcactccag

SEQ ID NO: 642600 - DNA, 25 bp, Rattus norvegicus
tgtaagagggctgccttcactccag

SEQ ID NO: 642601 - DNA, 25 bp, Rattus norvegicus
tgtaagattgcgcttcgtgcttcag

SEQ ID NO: 642602 - DNA, 25 bp, Rattus norvegicus
tgtaagattgcggttcgtgcttcag

SEQ ID NO: 642603 - DNA, 25 bp, Rattus norvegicus
tgtaagcattgcctgagggtcagta

SEQ ID NO: 642604 - DNA, 25 bp, Rattus norvegicus
tgtaagcattgcgtgagggtcagta

SEQ ID NO: 642605 - DNA, 25 bp, Rattus norvegicus
tgtaagccaacacgcaggctaccct

SEQ ID NO: 642606 - DNA, 25 bp, Rattus norvegicus
tgtaagccaacaggcaggctaccct

SEQ ID NO: 642607 - DNA, 25 bp, Rattus norvegicus
tgtaagccaggtccagccagtccaa

SEQ ID NO: 642608 - DNA, 25 bp, Rattus norvegicus
tgtaagccaggtgcagccagtccaa

SEQ ID NO: 642609 - DNA, 25 bp, Rattus norvegicus
tgtaagccccacctctagttagagg

SEQ ID NO: 642610 - DNA, 25 bp, Rattus norvegicus
tgtaagccccacgtctagttagagg

SEQ ID NO: 642611 - DNA, 25 bp, Rattus norvegicus
tgtaagcccttgcaattaccttcac

SEQ ID NO: 642612 - DNA, 25 bp, Rattus norvegicus
tgtaagcccttggaattaccttcac

SEQ ID NO: 642613 - DNA, 25 bp, Rattus norvegicus
tgtaagccgtttccagtggttctat

SEQ ID NO: 642614 - DNA, 25 bp, Rattus norvegicus
tgtaagccgtttgcagtggttctat

SEQ ID NO: 642615 - DNA, 25 bp, Rattus norvegicus
tgtaagccttgaatagactacgttc

SEQ ID NO: 642616 - DNA, 25 bp, Rattus norvegicus
tgtaagccttgattagactacgttc

SEQ ID NO: 642617 - DNA, 25 bp, Rattus norvegicus
tgtaagcgagctcggccttgtgaca

SEQ ID NO: 642618 - DNA, 25 bp, Rattus norvegicus
tgtaagcgagctgggccttgtgaca

SEQ ID NO: 642619 - DNA, 25 bp, Rattus norvegicus
tgtaagctactgaactgcttctcct

SEQ ID NO: 642620 - DNA, 25 bp, Rattus norvegicus
tgtaagctactgtactgcttctcct

SEQ ID NO: 642621 - DNA, 25 bp, Rattus norvegicus
tgtaagctcatcacaggtgtctcct

SEQ ID NO: 642622 - DNA, 25 bp, Rattus norvegicus
tgtaagctcatctcaggtgtctcct

SEQ ID NO: 642623 - DNA, 25 bp, Rattus norvegicus
tgtaagctgcagatttctgctgcct

SEQ ID NO: 642624 - DNA, 25 bp, Rattus norvegicus
tgtaagctgcagttttctgctgcct

SEQ ID NO: 642625 - DNA, 25 bp, Rattus norvegicus
tgtaagctgccaagtgtctgtctgt

SEQ ID NO: 642626 - DNA, 25 bp, Rattus norvegicus
tgtaagctgccatgtgtctgtctgt

SEQ ID NO: 642627 - DNA, 25 bp, Rattus norvegicus
tgtaaggacttgacctagcctgacc

SEQ ID NO: 642628 - DNA, 25 bp, Rattus norvegicus
tgtaaggacttgtcctagcctgacc

SEQ ID NO: 642629 - DNA, 25 bp, Rattus norvegicus
tgtaaggcttccagcatgtgcatcc

SEQ ID NO: 642630 - DNA, 25 bp, Rattus norvegicus
tgtaaggcttcctgcatgtgcatcc

SEQ ID NO: 642631 - DNA, 25 bp, Rattus norvegicus
tgtaagggaggcacccctgtttttg

SEQ ID NO: 642632 - DNA, 25 bp, Rattus norvegicus
tgtaagggaggctcccctgtttttg

SEQ ID NO: 642633 - DNA, 25 bp, Rattus norvegicus
tgtaaggtacctcctgctatctgaa

SEQ ID NO: 642634 - DNA, 25 bp, Rattus norvegicus
tgtaaggtacctgctgctatctgaa

SEQ ID NO: 642635 - DNA, 25 bp, Rattus norvegicus
tgtaaggtagaacccctgtttctag

SEQ ID NO: 642636 - DNA, 25 bp, Rattus norvegicus
tgtaaggtagaagccctgtttctag

SEQ ID NO: 642637 - DNA, 25 bp, Rattus norvegicus
tgtaaggtgtctctctcatctgcat

SEQ ID NO: 642638 - DNA, 25 bp, Rattus norvegicus
tgtaaggtgtctgtctcatctgcat

SEQ ID NO: 642639 - DNA, 25 bp, Rattus norvegicus
tgtaagtacaaacctccccaagact

SEQ ID NO: 642640 - DNA, 25 bp, Rattus norvegicus
tgtaagtacaaagctccccaagact

SEQ ID NO: 642641 - DNA, 25 bp, Rattus norvegicus
tgtaagtaccaacgagcgcactgct

SEQ ID NO: 642642 - DNA, 25 bp, Rattus norvegicus
tgtaagtaccaaggagcgcactgct

SEQ ID NO: 642643 - DNA, 25 bp, Rattus norvegicus
tgtaagtacccaccagagccctaac

SEQ ID NO: 642644 - DNA, 25 bp, Rattus norvegicus
tgtaagtacccagcagagccctaac

SEQ ID NO: 642645 - DNA, 25 bp, Rattus norvegicus
tgtaagtatgcaaaggcggctccta

SEQ ID NO: 642646 - DNA, 25 bp, Rattus norvegicus
tgtaagtatgcataggcggctccta

SEQ ID NO: 642647 - DNA, 25 bp, Rattus norvegicus
tgtaagtcaattaatttccttgcct

SEQ ID NO: 642648 - DNA, 25 bp, Rattus norvegicus
tgtaagtcaatttatttccttgcct

SEQ ID NO: 642649 - DNA, 25 bp, Rattus norvegicus
tgtaagtccctgagtccgcgctaag

SEQ ID NO: 642650 - DNA, 25 bp, Rattus norvegicus
tgtaagtccctgtgtccgcgctaag

SEQ ID NO: 642651 - DNA, 25 bp, Rattus norvegicus
tgtaagtctaagatgctcccagcaa

SEQ ID NO: 642652 - DNA, 25 bp, Rattus norvegicus
tgtaagtctaagttgctcccagcaa

SEQ ID NO: 642653 - DNA, 25 bp, Rattus norvegicus
tgtaagtctggaattgctcacctgc

SEQ ID NO: 642654 - DNA, 25 bp, Rattus norvegicus
tgtaagtctggatttgctcacctgc

SEQ ID NO: 642655 - DNA, 25 bp, Rattus norvegicus
tgtaagtgcagcatgcttggaggct

SEQ ID NO: 642656 - DNA, 25 bp, Rattus norvegicus
tgtaagtgcagcttgcttggaggct

SEQ ID NO: 642657 - DNA, 25 bp, Rattus norvegicus
tgtaagtgccaactaagcccctttc

SEQ ID NO: 642658 - DNA, 25 bp, Rattus norvegicus
tgtaagtgccaagtaagcccctttc

SEQ ID NO: 642659 - DNA, 25 bp, Rattus norvegicus
tgtaagtggattctcatcctctctc

SEQ ID NO: 642660 - DNA, 25 bp, Rattus norvegicus
tgtaagtggattgtcatcctctctc

SEQ ID NO: 642661 - DNA, 25 bp, Rattus norvegicus
tgtaagtggtccctgactacagcac

SEQ ID NO: 642662 - DNA, 25 bp, Rattus norvegicus
tgtaagtggtccgtgactacagcac

SEQ ID NO: 642663 - DNA, 25 bp, Rattus norvegicus
tgtaagtgtcttcccctggccttgg

SEQ ID NO: 642664 - DNA, 25 bp, Rattus norvegicus
tgtaagtgtcttgccctggccttgg

SEQ ID NO: 642665 - DNA, 25 bp, Rattus norvegicus
tgtaagttcaccacttttaataaag

SEQ ID NO: 642666 - DNA, 25 bp, Rattus norvegicus
tgtaagttcacctcttttaataaag

SEQ ID NO: 642667 - DNA, 25 bp, Rattus norvegicus
tgtaagtttcatagtcccaactcct

SEQ ID NO: 642668 - DNA, 25 bp, Rattus norvegicus
tgtaagtttcattgtcccaactcct

SEQ ID NO: 642669 - DNA, 25 bp, Rattus norvegicus
tgtaagtttccgaagcacactctgc

SEQ ID NO: 642670 - DNA, 25 bp, Rattus norvegicus
tgtaagtttccgtagcacactctgc

SEQ ID NO: 642671 - DNA, 25 bp, Rattus norvegicus
tgtaataaaatgcacatcaccctgt

SEQ ID NO: 642672 - DNA, 25 bp, Rattus norvegicus
tgtaataaaatggacatcaccctgt

SEQ ID NO: 642673 - DNA, 25 bp, Rattus norvegicus
tgtaataaatgtccctctgaggaac

SEQ ID NO: 642674 - DNA, 25 bp, Rattus norvegicus
tgtaataaatgtgcctctgaggaac

SEQ ID NO: 642675 - DNA, 25 bp, Rattus norvegicus
tgtaatacaaccattttggattagt

SEQ ID NO: 642676 - DNA, 25 bp, Rattus norvegicus
tgtaatacaacctttttggattagt

SEQ ID NO: 642677 - DNA, 25 bp, Rattus norvegicus
tgtaatacaactcctcacttccggc

SEQ ID NO: 642678 - DNA, 25 bp, Rattus norvegicus
tgtaatacaactgctcacttccggc

SEQ ID NO: 642679 - DNA, 25 bp, Rattus norvegicus
tgtaatactgcgatgttcatggagt

SEQ ID NO: 642680 - DNA, 25 bp, Rattus norvegicus
tgtaatactgcgttgttcatggagt

SEQ ID NO: 642681 - DNA, 25 bp, Rattus norvegicus
tgtaatagacccctgcatgcagcct

SEQ ID NO: 642682 - DNA, 25 bp, Rattus norvegicus
tgtaatagacccgtgcatgcagcct

SEQ ID NO: 642683 - DNA, 25 bp, Rattus norvegicus
tgtaatagcactcgcctgatgtcaa

SEQ ID NO: 642684 - DNA, 25 bp, Rattus norvegicus
tgtaatagcactggcctgatgtcaa

SEQ ID NO: 642685 - DNA, 25 bp, Rattus norvegicus
tgtaatatattcactggctcatcag

SEQ ID NO: 642686 - DNA, 25 bp, Rattus norvegicus
tgtaatatattctctggctcatcag

SEQ ID NO: 642687 - DNA, 25 bp, Rattus norvegicus
tgtaatatgggcactttggaggtag

SEQ ID NO: 642688 - DNA, 25 bp, Rattus norvegicus
tgtaatatgggctctttggaggtag

SEQ ID NO: 642689 - DNA, 25 bp, Rattus norvegicus
tgtaatattatgaaggcccagtcct

SEQ ID NO: 642690 - DNA, 25 bp, Rattus norvegicus
tgtaatattatgtaggcccagtcct

SEQ ID NO: 642691 - DNA, 25 bp, Rattus norvegicus
tgtaatcaagacacccatgcactgt

SEQ ID NO: 642692 - DNA, 25 bp, Rattus norvegicus
tgtaatcaagactcccatgcactgt

SEQ ID NO: 642693 - DNA, 25 bp, Rattus norvegicus
tgtaatcacatacccttaatctgca

SEQ ID NO: 642694 - DNA, 25 bp, Rattus norvegicus
tgtaatcacatagccttaatctgca

SEQ ID NO: 642695 - DNA, 25 bp, Rattus norvegicus
tgtaatcacatccagtccactaaag

SEQ ID NO: 642696 - DNA, 25 bp, Rattus norvegicus
tgtaatcacatcgagtccactaaag

SEQ ID NO: 642697 - DNA, 25 bp, Rattus norvegicus
tgtaatcatgttatgctaagcactg

SEQ ID NO: 642698 - DNA, 25 bp, Rattus norvegicus
tgtaatcatgttttgctaagcactg

SEQ ID NO: 642699 - DNA, 25 bp, Rattus norvegicus
tgtaatccatccaagcattctgcag

SEQ ID NO: 642700 - DNA, 25 bp, Rattus norvegicus
tgtaatccatcctagcattctgcag

SEQ ID NO: 642701 - DNA, 25 bp, Rattus norvegicus
tgtaatcccattctcatccagagct

SEQ ID NO: 642702 - DNA, 25 bp, Rattus norvegicus
tgtaatcccattgtcatccagagct

SEQ ID NO: 642703 - DNA, 25 bp, Rattus norvegicus
tgtaatcccttccatgcacactgag

SEQ ID NO: 642704 - DNA, 25 bp, Rattus norvegicus
tgtaatcccttcgatgcacactgag

SEQ ID NO: 642705 - DNA, 25 bp, Rattus norvegicus
tgtaatcccttgagactccgaactg

SEQ ID NO: 642706 - DNA, 25 bp, Rattus norvegicus
tgtaatcccttgtgactccgaactg

SEQ ID NO: 642707 - DNA, 25 bp, Rattus norvegicus
tgtaatcctagcatctggtaggtag

SEQ ID NO: 642708 - DNA, 25 bp, Rattus norvegicus
tgtaatcctagcttctggtaggtag

SEQ ID NO: 642709 - DNA, 25 bp, Rattus norvegicus
tgtaatcctcctcccgttctgttct

SEQ ID NO: 642710 - DNA, 25 bp, Rattus norvegicus
tgtaatcctcctgccgttctgttct

SEQ ID NO: 642711 - DNA, 25 bp, Rattus norvegicus
tgtaatcgccatcaccctgtgctat

SEQ ID NO: 642712 - DNA, 25 bp, Rattus norvegicus
tgtaatcgccatgaccctgtgctat

SEQ ID NO: 642713 - DNA, 25 bp, Rattus norvegicus
tgtaatcggctaactgtggatttga

SEQ ID NO: 642714 - DNA, 25 bp, Rattus norvegicus
tgtaatcggctatctgtggatttga

SEQ ID NO: 642715 - DNA, 25 bp, Rattus norvegicus
tgtaatctcaggattttgaggccaa

SEQ ID NO: 642716 - DNA, 25 bp, Rattus norvegicus
tgtaatctcaggtttttgaggccaa

SEQ ID NO: 642717 - DNA, 25 bp, Rattus norvegicus
tgtaatctcgccattttccaagtac

SEQ ID NO: 642718 - DNA, 25 bp, Rattus norvegicus
tgtaatctcgcctttttccaagtac

SEQ ID NO: 642719 - DNA, 25 bp, Rattus norvegicus
tgtaatctcttcatcaaaactgctg

SEQ ID NO: 642720 - DNA, 25 bp, Rattus norvegicus
tgtaatctcttcttcaaaactgctg

SEQ ID NO: 642721 - DNA, 25 bp, Rattus norvegicus
tgtaatctgggtctctttcctctaa

SEQ ID NO: 642722 - DNA, 25 bp, Rattus norvegicus
tgtaatctgggtgtctttcctctaa

SEQ ID NO: 642723 - DNA, 25 bp, Rattus norvegicus
tgtaatctgtatctaatccactcat

SEQ ID NO: 642724 - DNA, 25 bp, Rattus norvegicus
tgtaatctgtatgtaatccactcat

SEQ ID NO: 642725 - DNA, 25 bp, Rattus norvegicus
tgtaatctgtctctacccacagaag

SEQ ID NO: 642726 - DNA, 25 bp, Rattus norvegicus
tgtaatctgtctgtacccacagaag

SEQ ID NO: 642727 - DNA, 25 bp, Rattus norvegicus
tgtaatcttttccacttgcttctta

SEQ ID NO: 642728 - DNA, 25 bp, Rattus norvegicus
tgtaatcttttcgacttgcttctta

SEQ ID NO: 642729 - DNA, 25 bp, Rattus norvegicus
tgtaatgacctccagcagcagctga

SEQ ID NO: 642730 - DNA, 25 bp, Rattus norvegicus
tgtaatgacctcgagcagcagctga

SEQ ID NO: 642731 - DNA, 25 bp, Rattus norvegicus
tgtaatgagagaatttgcttctgtc

SEQ ID NO: 642732 - DNA, 25 bp, Rattus norvegicus
tgtaatgagagattttgcttctgtc

SEQ ID NO: 642733 - DNA, 25 bp, Rattus norvegicus
tgtaatgatgacatcctgggtgcct

SEQ ID NO: 642734 - DNA, 25 bp, Rattus norvegicus
tgtaatgatgacttcctgggtgcct

SEQ ID NO: 642735 - DNA, 25 bp, Rattus norvegicus
tgtaatgcagtgctatggactcagt

SEQ ID NO: 642736 - DNA, 25 bp, Rattus norvegicus
tgtaatgcagtggtatggactcagt

SEQ ID NO: 642737 - DNA, 25 bp, Rattus norvegicus
tgtaatgctattcaggaggccctag

SEQ ID NO: 642738 - DNA, 25 bp, Rattus norvegicus
tgtaatgctattgaggaggccctag

SEQ ID NO: 642739 - DNA, 25 bp, Rattus norvegicus
tgtaatggcaaaaggcccaagcccc

SEQ ID NO: 642740 - DNA, 25 bp, Rattus norvegicus
tgtaatggcaaatggcccaagcccc

SEQ ID NO: 642741 - DNA, 25 bp, Rattus norvegicus
tgtaatgtacagatcccttctcaag

SEQ ID NO: 642742 - DNA, 25 bp, Rattus norvegicus
tgtaatgtacagttcccttctcaag

SEQ ID NO: 642743 - DNA, 25 bp, Rattus norvegicus
tgtaatgtagacctagcccatccaa

SEQ ID NO: 642744 - DNA, 25 bp, Rattus norvegicus
tgtaatgtagacgtagcccatccaa

SEQ ID NO: 642745 - DNA, 25 bp, Rattus norvegicus
tgtaatgtcaggatctcaggccctt

SEQ ID NO: 642746 - DNA, 25 bp, Rattus norvegicus
tgtaatgtcaggttctcaggccctt

SEQ ID NO: 642747 - DNA, 25 bp, Rattus norvegicus
tgtaatgtctgtctggccagctaca

SEQ ID NO: 642748 - DNA, 25 bp, Rattus norvegicus
tgtaatgtctgtgtggccagctaca

SEQ ID NO: 642749 - DNA, 25 bp, Rattus norvegicus
tgtaatgtgcacactcctttccatg

SEQ ID NO: 642750 - DNA, 25 bp, Rattus norvegicus
tgtaatgtgcactctcctttccatg

SEQ ID NO: 642751 - DNA, 25 bp, Rattus norvegicus
tgtaatgtggtccaagcctcatcgc

SEQ ID NO: 642752 - DNA, 25 bp, Rattus norvegicus
tgtaatgtggtcgaagcctcatcgc

SEQ ID NO: 642753 - DNA, 25 bp, Rattus norvegicus
tgtaatgttcctaaaccagacctcc

SEQ ID NO: 642754 - DNA, 25 bp, Rattus norvegicus
tgtaatgttccttaaccagacctcc

SEQ ID NO: 642755 - DNA, 25 bp, Rattus norvegicus
tgtaatgttcttatccagtttttgg

SEQ ID NO: 642756 - DNA, 25 bp, Rattus norvegicus
tgtaatgttcttttccagtttttgg

SEQ ID NO: 642757 - DNA, 25 bp, Rattus norvegicus
tgtaattaaatgacacgcctgtgga

SEQ ID NO: 642758 - DNA, 25 bp, Rattus norvegicus
tgtaattaaatgtcacgcctgtgga

SEQ ID NO: 642759 - DNA, 25 bp, Rattus norvegicus
tgtaattacttcacattcgttgctg

SEQ ID NO: 642760 - DNA, 25 bp, Rattus norvegicus
tgtaattacttctcattcgttgctg

SEQ ID NO: 642761 - DNA, 25 bp, Rattus norvegicus
tgtaattagtccatggtgttccaca

SEQ ID NO: 642762 - DNA, 25 bp, Rattus norvegicus
tgtaattagtccttggtgttccaca

SEQ ID NO: 642763 - DNA, 25 bp, Rattus norvegicus
tgtaattccagtagccccagatccg

SEQ ID NO: 642764 - DNA, 25 bp, Rattus norvegicus
tgtaattccagttgccccagatccg

SEQ ID NO: 642765 - DNA, 25 bp, Rattus norvegicus
tgtaattcccgtctaaccttattca

SEQ ID NO: 642766 - DNA, 25 bp, Rattus norvegicus
tgtaattcccgtgtaaccttattca

SEQ ID NO: 642767 - DNA, 25 bp, Rattus norvegicus
tgtaattccgtgatttcgcgctcac

SEQ ID NO: 642768 - DNA, 25 bp, Rattus norvegicus
tgtaattccgtgttttcgcgctcac

SEQ ID NO: 642769 - DNA, 25 bp, Rattus norvegicus
tgtaattcctcccagagtgcctctg

SEQ ID NO: 642770 - DNA, 25 bp, Rattus norvegicus
tgtaattcctccgagagtgcctctg

SEQ ID NO: 642771 - DNA, 25 bp, Rattus norvegicus
tgtaattctacccagaccgctagta

SEQ ID NO: 642772 - DNA, 25 bp, Rattus norvegicus
tgtaattctaccgagaccgctagta

SEQ ID NO: 642773 - DNA, 25 bp, Rattus norvegicus
tgtaattctctcagttggctctgca

SEQ ID NO: 642774 - DNA, 25 bp, Rattus norvegicus
tgtaattctctctgttggctctgca

SEQ ID NO: 642775 - DNA, 25 bp, Rattus norvegicus
tgtaattgacacactggacactggt

SEQ ID NO: 642776 - DNA, 25 bp, Rattus norvegicus
tgtaattgacactctggacactggt

SEQ ID NO: 642777 - DNA, 25 bp, Rattus norvegicus
tgtaattgccttaccctaacgtaat

SEQ ID NO: 642778 - DNA, 25 bp, Rattus norvegicus
tgtaattgcctttccctaacgtaat

SEQ ID NO: 642779 - DNA, 25 bp, Rattus norvegicus
tgtaatttcccaaggcctaataggt

SEQ ID NO: 642780 - DNA, 25 bp, Rattus norvegicus
tgtaatttcccatggcctaataggt

SEQ ID NO: 642781 - DNA, 25 bp, Rattus norvegicus
tgtaattttctaaaggactccgtgt

SEQ ID NO: 642782 - DNA, 25 bp, Rattus norvegicus
tgtaattttctataggactccgtgt

SEQ ID NO: 642783 - DNA, 25 bp, Rattus norvegicus
tgtacaaaccgtcaagccctggcat

SEQ ID NO: 642784 - DNA, 25 bp, Rattus norvegicus
tgtacaaaccgtgaagccctggcat

SEQ ID NO: 642785 - DNA, 25 bp, Rattus norvegicus
tgtacaaacttgctgactcccagcg

SEQ ID NO: 642786 - DNA, 25 bp, Rattus norvegicus
tgtacaaacttggtgactcccagcg

SEQ ID NO: 642787 - DNA, 25 bp, Rattus norvegicus
tgtacaaaggccagaggctcgctct

SEQ ID NO: 642788 - DNA, 25 bp, Rattus norvegicus
tgtacaaaggcctgaggctcgctct

SEQ ID NO: 642789 - DNA, 25 bp, Rattus norvegicus
tgtacaaatcctctcccttcacaag

SEQ ID NO: 642790 - DNA, 25 bp, Rattus norvegicus
tgtacaaatcctgtcccttcacaag

SEQ ID NO: 642791 - DNA, 25 bp, Rattus norvegicus
tgtacaaattacatgcagcttcatt

SEQ ID NO: 642792 - DNA, 25 bp, Rattus norvegicus
tgtacaaattacttgcagcttcatt

SEQ ID NO: 642793 - DNA, 25 bp, Rattus norvegicus
tgtacaacaccaaaaaccccgaagc

SEQ ID NO: 642794 - DNA, 25 bp, Rattus norvegicus
tgtacaacaccataaaccccgaagc

SEQ ID NO: 642795 - DNA, 25 bp, Rattus norvegicus
tgtacaaccccaccacatttgagaa

SEQ ID NO: 642796 - DNA, 25 bp, Rattus norvegicus
tgtacaaccccagcacatttgagaa

SEQ ID NO: 642797 - DNA, 25 bp, Rattus norvegicus
tgtacaagcagaccggcgttttccc

SEQ ID NO: 642798 - DNA, 25 bp, Rattus norvegicus
tgtacaagcagagcggcgttttccc

SEQ ID NO: 642799 - DNA, 25 bp, Rattus norvegicus
tgtacaagcttcagatcccaacatc

SEQ ID NO: 642800 - DNA, 25 bp, Rattus norvegicus
tgtacaagcttctgatcccaacatc

SEQ ID NO: 642801 - DNA, 25 bp, Rattus norvegicus
tgtacaagtgtgatcctgcaggcta

SEQ ID NO: 642802 - DNA, 25 bp, Rattus norvegicus
tgtacaagtgtgttcctgcaggcta

SEQ ID NO: 642803 - DNA, 25 bp, Rattus norvegicus
tgtacaatcccaaaccccatggtgt

SEQ ID NO: 642804 - DNA, 25 bp, Rattus norvegicus
tgtacaatcccataccccatggtgt

SEQ ID NO: 642805 - DNA, 25 bp, Rattus norvegicus
tgtacaatgcacagctggaggcctt

SEQ ID NO: 642806 - DNA, 25 bp, Rattus norvegicus
tgtacaatgcactgctggaggcctt

SEQ ID NO: 642807 - DNA, 25 bp, Rattus norvegicus
tgtacaatgctccactaggctaagt

SEQ ID NO: 642808 - DNA, 25 bp, Rattus norvegicus
tgtacaatgctcgactaggctaagt

SEQ ID NO: 642809 - DNA, 25 bp, Rattus norvegicus
tgtacaatgtaaagtgctccacttt

SEQ ID NO: 642810 - DNA, 25 bp, Rattus norvegicus
tgtacaatgtaatgtgctccacttt

SEQ ID NO: 642811 - DNA, 25 bp, Rattus norvegicus
tgtacacaagtcacgaaatccactg

SEQ ID NO: 642812 - DNA, 25 bp, Rattus norvegicus
tgtacacaagtctcgaaatccactg

SEQ ID NO: 642813 - DNA, 25 bp, Rattus norvegicus
tgtacacacccaaacagatctgatg

SEQ ID NO: 642814 - DNA, 25 bp, Rattus norvegicus
tgtacacacccatacagatctgatg

SEQ ID NO: 642815 - DNA, 25 bp, Rattus norvegicus
tgtacacagacaaagggccagggcc

SEQ ID NO: 642816 - DNA, 25 bp, Rattus norvegicus
tgtacacagacatagggccagggcc

SEQ ID NO: 642817 - DNA, 25 bp, Rattus norvegicus
tgtacacatacgagcatgctgtttg

SEQ ID NO: 642818 - DNA, 25 bp, Rattus norvegicus
tgtacacatacgtgcatgctgtttg

SEQ ID NO: 642819 - DNA, 25 bp, Rattus norvegicus
tgtacacattctcccataacctaaa

SEQ ID NO: 642820 - DNA, 25 bp, Rattus norvegicus
tgtacacattctgccataacctaaa

SEQ ID NO: 642821 - DNA, 25 bp, Rattus norvegicus
tgtacacattttaaaacctggcaaa

SEQ ID NO: 642822 - DNA, 25 bp, Rattus norvegicus
tgtacacatttttaaacctggcaaa

SEQ ID NO: 642823 - DNA, 25 bp, Rattus norvegicus
tgtacaccaggtccatttgcagttc

SEQ ID NO: 642824 - DNA, 25 bp, Rattus norvegicus
tgtacaccaggtgcatttgcagttc

SEQ ID NO: 642825 - DNA, 25 bp, Rattus norvegicus
tgtacaccccagagtctattgagct

SEQ ID NO: 642826 - DNA, 25 bp, Rattus norvegicus
tgtacaccccagtgtctattgagct

SEQ ID NO: 642827 - DNA, 25 bp, Rattus norvegicus
tgtacacctgcaaatcgttggaagt

SEQ ID NO: 642828 - DNA, 25 bp, Rattus norvegicus
tgtacacctgcatatcgttggaagt

SEQ ID NO: 642829 - DNA, 25 bp, Rattus norvegicus
tgtacaccttgactgtggcccgaaa

SEQ ID NO: 642830 - DNA, 25 bp, Rattus norvegicus
tgtacaccttgagtgtggcccgaaa

SEQ ID NO: 642831 - DNA, 25 bp, Rattus norvegicus
tgtacacctttcattctacaaccta

SEQ ID NO: 642832 - DNA, 25 bp, Rattus norvegicus
tgtacacctttctttctacaaccta

SEQ ID NO: 642833 - DNA, 25 bp, Rattus norvegicus
tgtacacggccgcatctgtctgtag

SEQ ID NO: 642834 - DNA, 25 bp, Rattus norvegicus
tgtacacggccggatctgtctgtag

SEQ ID NO: 642835 - DNA, 25 bp, Rattus norvegicus
tgtacactacgtcgaaccctgggaa

SEQ ID NO: 642836 - DNA, 25 bp, Rattus norvegicus
tgtacactacgtggaaccctgggaa

SEQ ID NO: 642837 - DNA, 25 bp, Rattus norvegicus
tgtacactcaaacctgtgccctggc

SEQ ID NO: 642838 - DNA, 25 bp, Rattus norvegicus
tgtacactcaaagctgtgccctggc

SEQ ID NO: 642839 - DNA, 25 bp, Rattus norvegicus
tgtacactcacaaagggcgtctggc

SEQ ID NO: 642840 - DNA, 25 bp, Rattus norvegicus
tgtacactcacatagggcgtctggc

SEQ ID NO: 642841 - DNA, 25 bp, Rattus norvegicus
tgtacactctttactccaaggtgca

SEQ ID NO: 642842 - DNA, 25 bp, Rattus norvegicus
tgtacactcttttctccaaggtgca

SEQ ID NO: 642843 - DNA, 25 bp, Rattus norvegicus
tgtacactgagcctgtcgccagtta

SEQ ID NO: 642844 - DNA, 25 bp, Rattus norvegicus
tgtacactgagcgtgtcgccagtta

SEQ ID NO: 642845 - DNA, 25 bp, Rattus norvegicus
tgtacactgcttccagcatattgcg

SEQ ID NO: 642846 - DNA, 25 bp, Rattus norvegicus
tgtacactgcttgcagcatattgcg

SEQ ID NO: 642847 - DNA, 25 bp, Rattus norvegicus
tgtacactgtagatacccctatggt

SEQ ID NO: 642848 - DNA, 25 bp, Rattus norvegicus
tgtacactgtagttacccctatggt

SEQ ID NO: 642849 - DNA, 25 bp, Rattus norvegicus
tgtacactgtgaccagtcagctgat

SEQ ID NO: 642850 - DNA, 25 bp, Rattus norvegicus
tgtacactgtgagcagtcagctgat

SEQ ID NO: 642851 - DNA, 25 bp, Rattus norvegicus
tgtacacttcctctgttctccctga

SEQ ID NO: 642852 - DNA, 25 bp, Rattus norvegicus
tgtacacttcctgtgttctccctga

SEQ ID NO: 642853 - DNA, 25 bp, Rattus norvegicus
tgtacacttctgaacatactgaccc

SEQ ID NO: 642854 - DNA, 25 bp, Rattus norvegicus
tgtacacttctgtacatactgaccc

SEQ ID NO: 642855 - DNA, 25 bp, Rattus norvegicus
tgtacacttgctccccatgaatggg

SEQ ID NO: 642856 - DNA, 25 bp, Rattus norvegicus
tgtacacttgctgcccatgaatggg

SEQ ID NO: 642857 - DNA, 25 bp, Rattus norvegicus
tgtacagaaccccagtttcatctta

SEQ ID NO: 642858 - DNA, 25 bp, Rattus norvegicus
tgtacagaacccgagtttcatctta

SEQ ID NO: 642859 - DNA, 25 bp, Rattus norvegicus
tgtacagaagctagtttaggacccc

SEQ ID NO: 642860 - DNA, 25 bp, Rattus norvegicus
tgtacagaagcttgtttaggacccc

SEQ ID NO: 642861 - DNA, 25 bp, Rattus norvegicus
tgtacagacaacaaacccgtttccg

SEQ ID NO: 642862 - DNA, 25 bp, Rattus norvegicus
tgtacagacaactaacccgtttccg

SEQ ID NO: 642863 - DNA, 25 bp, Rattus norvegicus
tgtacagaccaaccagcttcacaag

SEQ ID NO: 642864 - DNA, 25 bp, Rattus norvegicus
tgtacagaccaagcagcttcacaag

SEQ ID NO: 642865 - DNA, 25 bp, Rattus norvegicus
tgtacagactctagtgattggcaga

SEQ ID NO: 642866 - DNA, 25 bp, Rattus norvegicus
tgtacagactcttgtgattggcaga

SEQ ID NO: 642867 - DNA, 25 bp, Rattus norvegicus
tgtacagaggccatcttggcatgca

SEQ ID NO: 642868 - DNA, 25 bp, Rattus norvegicus
tgtacagaggccttcttggcatgca

SEQ ID NO: 642869 - DNA, 25 bp, Rattus norvegicus
tgtacagagtcaacggtaggccgca

SEQ ID NO: 642870 - DNA, 25 bp, Rattus norvegicus
tgtacagagtcatcggtaggccgca

SEQ ID NO: 642871 - DNA, 25 bp, Rattus norvegicus
tgtacagagtccaccggcctcctgg

SEQ ID NO: 642872 - DNA, 25 bp, Rattus norvegicus
tgtacagagtcctccggcctcctgg

SEQ ID NO: 642873 - DNA, 25 bp, Rattus norvegicus
tgtacagataaaacagctcccctca

SEQ ID NO: 642874 - DNA, 25 bp, Rattus norvegicus
tgtacagataaatcagctcccctca

SEQ ID NO: 642875 - DNA, 25 bp, Rattus norvegicus
tgtacagattctcacatctccaagc

SEQ ID NO: 642876 - DNA, 25 bp, Rattus norvegicus
tgtacagattctgacatctccaagc

SEQ ID NO: 642877 - DNA, 25 bp, Rattus norvegicus
tgtacagcaccaccgggattggaga

SEQ ID NO: 642878 - DNA, 25 bp, Rattus norvegicus
tgtacagcaccagcgggattggaga

SEQ ID NO: 642879 - DNA, 25 bp, Rattus norvegicus
tgtacagcacctatggcctaggact

SEQ ID NO: 642880 - DNA, 25 bp, Rattus norvegicus
tgtacagcacctttggcctaggact

SEQ ID NO: 642881 - DNA, 25 bp, Rattus norvegicus
tgtacagcagcaaacgtcttcggca

SEQ ID NO: 642882 - DNA, 25 bp, Rattus norvegicus
tgtacagcagcatacgtcttcggca

SEQ ID NO: 642883 - DNA, 25 bp, Rattus norvegicus
tgtacagccttacagtcttcagcct

SEQ ID NO: 642884 - DNA, 25 bp, Rattus norvegicus
tgtacagccttagagtcttcagcct

SEQ ID NO: 642885 - DNA, 25 bp, Rattus norvegicus
tgtacagcgacccatacccagtaac

SEQ ID NO: 642886 - DNA, 25 bp, Rattus norvegicus
tgtacagcgaccgatacccagtaac

SEQ ID NO: 642887 - DNA, 25 bp, Rattus norvegicus
tgtacagctgtccaaaatcatccca

SEQ ID NO: 642888 - DNA, 25 bp, Rattus norvegicus
tgtacagctgtcgaaaatcatccca

SEQ ID NO: 642889 - DNA, 25 bp, Rattus norvegicus
tgtacaggacccctggaggcctctg

SEQ ID NO: 642890 - DNA, 25 bp, Rattus norvegicus
tgtacaggacccgtggaggcctctg

SEQ ID NO: 642891 - DNA, 25 bp, Rattus norvegicus
tgtacaggacgtccagcagcatgat

SEQ ID NO: 642892 - DNA, 25 bp, Rattus norvegicus
tgtacaggacgtgcagcagcatgat

SEQ ID NO: 642893 - DNA, 25 bp, Rattus norvegicus
tgtacaggacttagctatgcagctg

SEQ ID NO: 642894 - DNA, 25 bp, Rattus norvegicus
tgtacaggactttgctatgcagctg

SEQ ID NO: 642895 - DNA, 25 bp, Rattus norvegicus
tgtacaggcaacaggcgtccatcat

SEQ ID NO: 642896 - DNA, 25 bp, Rattus norvegicus
tgtacaggcaactggcgtccatcat

SEQ ID NO: 642897 - DNA, 25 bp, Rattus norvegicus
tgtacaggccctactcagcgcggga

SEQ ID NO: 642898 - DNA, 25 bp, Rattus norvegicus
tgtacaggcccttctcagcgcggga

SEQ ID NO: 642899 - DNA, 25 bp, Rattus norvegicus
tgtacaggctcacggaggaaagact

SEQ ID NO: 642900 - DNA, 25 bp, Rattus norvegicus
tgtacaggctcagggaggaaagact

SEQ ID NO: 642901 - DNA, 25 bp, Rattus norvegicus
tgtacagggctgaaattgccaacgt

SEQ ID NO: 642902 - DNA, 25 bp, Rattus norvegicus
tgtacagggctgtaattgccaacgt

SEQ ID NO: 642903 - DNA, 25 bp, Rattus norvegicus
tgtacagtaattatcctccaccgac

SEQ ID NO: 642904 - DNA, 25 bp, Rattus norvegicus
tgtacagtaattttcctccaccgac

SEQ ID NO: 642905 - DNA, 25 bp, Rattus norvegicus
tgtacagtactcacatcggctagtc

SEQ ID NO: 642906 - DNA, 25 bp, Rattus norvegicus
tgtacagtactctcatcggctagtc

SEQ ID NO: 642907 - DNA, 25 bp, Rattus norvegicus
tgtacagtacttacaccaccaacaa

SEQ ID NO: 642908 - DNA, 25 bp, Rattus norvegicus
tgtacagtactttcaccaccaacaa

SEQ ID NO: 642909 - DNA, 25 bp, Rattus norvegicus
tgtacagtagccagggagattagtt

SEQ ID NO: 642910 - DNA, 25 bp, Rattus norvegicus
tgtacagtagcctgggagattagtt

SEQ ID NO: 642911 - DNA, 25 bp, Rattus norvegicus
tgtacagtctcaactccgaagggtg

SEQ ID NO: 642912 - DNA, 25 bp, Rattus norvegicus
tgtacagtctcatctccgaagggtg

SEQ ID NO: 642913 - DNA, 25 bp, Rattus norvegicus
tgtacagtgactccctgtctgaaag

SEQ ID NO: 642914 - DNA, 25 bp, Rattus norvegicus
tgtacagtgactgcctgtctgaaag

SEQ ID NO: 642915 - DNA, 25 bp, Rattus norvegicus
tgtacagtgagcaccttgaaggtga

SEQ ID NO: 642916 - DNA, 25 bp, Rattus norvegicus
tgtacagtgagctccttgaaggtga

SEQ ID NO: 642917 - DNA, 25 bp, Rattus norvegicus
tgtacagtgcagcagcaacccacag

SEQ ID NO: 642918 - DNA, 25 bp, Rattus norvegicus
tgtacagtgcaggagcaacccacag

SEQ ID NO: 642919 - DNA, 25 bp, Rattus norvegicus
tgtacagtgctgatgtatctcccga

SEQ ID NO: 642920 - DNA, 25 bp, Rattus norvegicus
tgtacagtgctgttgtatctcccga

SEQ ID NO: 642921 - DNA, 25 bp, Rattus norvegicus
tgtacagtgtccagggttcagcacc

SEQ ID NO: 642922 - DNA, 25 bp, Rattus norvegicus
tgtacagtgtcctgggttcagcacc

SEQ ID NO: 642923 - DNA, 25 bp, Rattus norvegicus
tgtacagtgttcattctccactgcc

SEQ ID NO: 642924 - DNA, 25 bp, Rattus norvegicus
tgtacagtgttctttctccactgcc

SEQ ID NO: 642925 - DNA, 25 bp, Rattus norvegicus
tgtacagtttacagtagcctgcccc

SEQ ID NO: 642926 - DNA, 25 bp, Rattus norvegicus
tgtacagtttactgtagcctgcccc

SEQ ID NO: 642927 - DNA, 25 bp, Rattus norvegicus
tgtacagtttctatacctaccaagt

SEQ ID NO: 642928 - DNA, 25 bp, Rattus norvegicus
tgtacagtttctttacctaccaagt

SEQ ID NO: 642929 - DNA, 25 bp, Rattus norvegicus
tgtacatacccaagtcagctggaga

SEQ ID NO: 642930 - DNA, 25 bp, Rattus norvegicus
tgtacatacccatgtcagctggaga

SEQ ID NO: 642931 - DNA, 25 bp, Rattus norvegicus
tgtacatagccccaatgttggtctc

SEQ ID NO: 642932 - DNA, 25 bp, Rattus norvegicus
tgtacatagcccgaatgttggtctc

SEQ ID NO: 642933 - DNA, 25 bp, Rattus norvegicus
tgtacatagctcacatttccttgca

SEQ ID NO: 642934 - DNA, 25 bp, Rattus norvegicus
tgtacatagctctcatttccttgca

SEQ ID NO: 642935 - DNA, 25 bp, Rattus norvegicus
tgtacatagtaaaaacctcctgtct

SEQ ID NO: 642936 - DNA, 25 bp, Rattus norvegicus
tgtacatagtaataacctcctgtct

SEQ ID NO: 642937 - DNA, 25 bp, Rattus norvegicus
tgtacatagtctccatgaccttctg

SEQ ID NO: 642938 - DNA, 25 bp, Rattus norvegicus
tgtacatagtctgcatgaccttctg

SEQ ID NO: 642939 - DNA, 25 bp, Rattus norvegicus
tgtacatatgccacctctgaaatta

SEQ ID NO: 642940 - DNA, 25 bp, Rattus norvegicus
tgtacatatgcctcctctgaaatta

SEQ ID NO: 642941 - DNA, 25 bp, Rattus norvegicus
tgtacatattgaatggacctttctt

SEQ ID NO: 642942 - DNA, 25 bp, Rattus norvegicus
tgtacatattgattggacctttctt

SEQ ID NO: 642943 - DNA, 25 bp, Rattus norvegicus
tgtacatattgcatcagtacccgcc

SEQ ID NO: 642944 - DNA, 25 bp, Rattus norvegicus
tgtacatattgcttcagtacccgcc

SEQ ID NO: 642945 - DNA, 25 bp, Rattus norvegicus
tgtacatcagctatttcttctccat

SEQ ID NO: 642946 - DNA, 25 bp, Rattus norvegicus
tgtacatcagctttttcttctccat

SEQ ID NO: 642947 - DNA, 25 bp, Rattus norvegicus
tgtacatcattcctaattgaccgat

SEQ ID NO: 642948 - DNA, 25 bp, Rattus norvegicus
tgtacatcattcgtaattgaccgat

SEQ ID NO: 642949 - DNA, 25 bp, Rattus norvegicus
tgtacatcttatcgcgagtggccac

SEQ ID NO: 642950 - DNA, 25 bp, Rattus norvegicus
tgtacatcttatggcgagtggccac

SEQ ID NO: 642951 - DNA, 25 bp, Rattus norvegicus
tgtacatctttaagcctggcacgtg

SEQ ID NO: 642952 - DNA, 25 bp, Rattus norvegicus
tgtacatctttatgcctggcacgtg

SEQ ID NO: 642953 - DNA, 25 bp, Rattus norvegicus
tgtacatgccccagttttgatgacc

SEQ ID NO: 642954 - DNA, 25 bp, Rattus norvegicus
tgtacatgcccctgttttgatgacc

SEQ ID NO: 642955 - DNA, 25 bp, Rattus norvegicus
tgtacatggacacacatcactactg

SEQ ID NO: 642956 - DNA, 25 bp, Rattus norvegicus
tgtacatggacagacatcactactg

SEQ ID NO: 642957 - DNA, 25 bp, Rattus norvegicus
tgtacatggcccaaggttcgatctc

SEQ ID NO: 642958 - DNA, 25 bp, Rattus norvegicus
tgtacatggccctaggttcgatctc

SEQ ID NO: 642959 - DNA, 25 bp, Rattus norvegicus
tgtacatggtggaaacagactctgt

SEQ ID NO: 642960 - DNA, 25 bp, Rattus norvegicus
tgtacatggtggtaacagactctgt

SEQ ID NO: 642961 - DNA, 25 bp, Rattus norvegicus
tgtacatgtatcacttgctccaaga

SEQ ID NO: 642962 - DNA, 25 bp, Rattus norvegicus
tgtacatgtatctcttgctccaaga

SEQ ID NO: 642963 - DNA, 25 bp, Rattus norvegicus
tgtacatgtgtgactccttatctgt

SEQ ID NO: 642964 - DNA, 25 bp, Rattus norvegicus
tgtacatgtgtgtctccttatctgt

SEQ ID NO: 642965 - DNA, 25 bp, Rattus norvegicus
tgtacatgtttcacaccagtcagga

SEQ ID NO: 642966 - DNA, 25 bp, Rattus norvegicus
tgtacatgtttctcaccagtcagga

SEQ ID NO: 642967 - DNA, 25 bp, Rattus norvegicus
tgtacattcctgatgctgggtgcaa

SEQ ID NO: 642968 - DNA, 25 bp, Rattus norvegicus
tgtacattcctgttgctgggtgcaa

SEQ ID NO: 642969 - DNA, 25 bp, Rattus norvegicus
tgtacattcgaaaagcgtgaccctt

SEQ ID NO: 642970 - DNA, 25 bp, Rattus norvegicus
tgtacattcgaatagcgtgaccctt

SEQ ID NO: 642971 - DNA, 25 bp, Rattus norvegicus
tgtacattcggtccacatcaggctg

SEQ ID NO: 642972 - DNA, 25 bp, Rattus norvegicus
tgtacattcggtgcacatcaggctg

SEQ ID NO: 642973 - DNA, 25 bp, Rattus norvegicus
tgtacattgagccacccgcagatgt

SEQ ID NO: 642974 - DNA, 25 bp, Rattus norvegicus
tgtacattgagcgacccgcagatgt

SEQ ID NO: 642975 - DNA, 25 bp, Rattus norvegicus
tgtacattgggcaacactccgtgcg

SEQ ID NO: 642976 - DNA, 25 bp, Rattus norvegicus
tgtacattgggctacactccgtgcg

SEQ ID NO: 642977 - DNA, 25 bp, Rattus norvegicus
tgtacattgttcacaggcggtcttg

SEQ ID NO: 642978 - DNA, 25 bp, Rattus norvegicus
tgtacattgttctcaggcggtcttg

SEQ ID NO: 642979 - DNA, 25 bp, Rattus norvegicus
tgtacattttgcactaactccgggt

SEQ ID NO: 642980 - DNA, 25 bp, Rattus norvegicus
tgtacattttgctctaactccgggt

SEQ ID NO: 642981 - DNA, 25 bp, Rattus norvegicus
tgtaccaaaaccaaatgcctctgcc

SEQ ID NO: 642982 - DNA, 25 bp, Rattus norvegicus
tgtaccaaaacctaatgcctctgcc

SEQ ID NO: 642983 - DNA, 25 bp, Rattus norvegicus
tgtaccaaaaggctggtggccttat

SEQ ID NO: 642984 - DNA, 25 bp, Rattus norvegicus
tgtaccaaaagggtggtggccttat

SEQ ID NO: 642985 - DNA, 25 bp, Rattus norvegicus
tgtaccaaattaactgctctactgt

SEQ ID NO: 642986 - DNA, 25 bp, Rattus norvegicus
tgtaccaaattatctgctctactgt

SEQ ID NO: 642987 - DNA, 25 bp, Rattus norvegicus
tgtaccaacccaagcagattcagac

SEQ ID NO: 642988 - DNA, 25 bp, Rattus norvegicus
tgtaccaacccatgcagattcagac

SEQ ID NO: 642989 - DNA, 25 bp, Rattus norvegicus
tgtaccaagaccatatctccaaact

SEQ ID NO: 642990 - DNA, 25 bp, Rattus norvegicus
tgtaccaagaccttatctccaaact

SEQ ID NO: 642991 - DNA, 25 bp, Rattus norvegicus
tgtaccaagtttacttccaccatag

SEQ ID NO: 642992 - DNA, 25 bp, Rattus norvegicus
tgtaccaagttttcttccaccatag

SEQ ID NO: 642993 - DNA, 25 bp, Rattus norvegicus
tgtaccacaagcactagttcctcta

SEQ ID NO: 642994 - DNA, 25 bp, Rattus norvegicus
tgtaccacaagctctagttcctcta

SEQ ID NO: 642995 - DNA, 25 bp, Rattus norvegicus
tgtaccacatgcaccatccagaagg

SEQ ID NO: 642996 - DNA, 25 bp, Rattus norvegicus
tgtaccacatgctccatccagaagg

SEQ ID NO: 642997 - DNA, 25 bp, Rattus norvegicus
tgtaccacattgctatgcccaggaa

SEQ ID NO: 642998 - DNA, 25 bp, Rattus norvegicus
tgtaccacattggtatgcccaggaa

SEQ ID NO: 642999 - DNA, 25 bp, Rattus norvegicus
tgtaccacatttcttcccagcgttt

SEQ ID NO: 643000 - DNA, 25 bp, Rattus norvegicus
tgtaccacatttgttcccagcgttt

SEQ ID NO: 643001 - DNA, 25 bp, Rattus norvegicus
tgtaccaccacccagggcttgatgt

SEQ ID NO: 643002 - DNA, 25 bp, Rattus norvegicus
tgtaccaccaccgagggcttgatgt

SEQ ID NO: 643003 - DNA, 25 bp, Rattus norvegicus
tgtaccaccagaacccaagaagatt

SEQ ID NO: 643004 - DNA, 25 bp, Rattus norvegicus
tgtaccaccagatcccaagaagatt

SEQ ID NO: 643005 - DNA, 25 bp, Rattus norvegicus
tgtaccaccctgatagcggcagctg

SEQ ID NO: 643006 - DNA, 25 bp, Rattus norvegicus
tgtaccaccctgttagcggcagctg

SEQ ID NO: 643007 - DNA, 25 bp, Rattus norvegicus
tgtaccacgcatagagcaaggaccc

SEQ ID NO: 643008 - DNA, 25 bp, Rattus norvegicus
tgtaccacgcattgagcaaggaccc

SEQ ID NO: 643009 - DNA, 25 bp, Rattus norvegicus
tgtaccactgtgaaggcctctgcat

SEQ ID NO: 643010 - DNA, 25 bp, Rattus norvegicus
tgtaccactgtgcacatcgtggcaa

SEQ ID NO: 643011 - DNA, 25 bp, Rattus norvegicus
tgtaccactgtggacatcgtggcaa

SEQ ID NO: 643012 - DNA, 25 bp, Rattus norvegicus
tgtaccactgtgtaggcctctgcat

SEQ ID NO: 643013 - DNA, 25 bp, Rattus norvegicus
tgtaccacttggattctcagacagc

SEQ ID NO: 643014 - DNA, 25 bp, Rattus norvegicus
tgtaccacttggtttctcagacagc

SEQ ID NO: 643015 - DNA, 25 bp, Rattus norvegicus
tgtaccactttgaacacggtgcctg

SEQ ID NO: 643016 - DNA, 25 bp, Rattus norvegicus
tgtaccactttgtacacggtgcctg

SEQ ID NO: 643017 - DNA, 25 bp, Rattus norvegicus
tgtaccagacatagcttatttttag

SEQ ID NO: 643018 - DNA, 25 bp, Rattus norvegicus
tgtaccagacattgcttatttttag

SEQ ID NO: 643019 - DNA, 25 bp, Rattus norvegicus
tgtaccagatccagcaagtcaccat

SEQ ID NO: 643020 - DNA, 25 bp, Rattus norvegicus
tgtaccagatcctgcaagtcaccat

SEQ ID NO: 643021 - DNA, 25 bp, Rattus norvegicus
tgtaccagccaaagcatgccattgc

SEQ ID NO: 643022 - DNA, 25 bp, Rattus norvegicus
tgtaccagccaatgcatgccattgc

SEQ ID NO: 643023 - DNA, 25 bp, Rattus norvegicus
tgtaccagctgactgtgggatcctg

SEQ ID NO: 643024 - DNA, 25 bp, Rattus norvegicus
tgtaccagctgagtgtgggatcctg

SEQ ID NO: 643025 - DNA, 25 bp, Rattus norvegicus
tgtaccaggatcacagcattaccat

SEQ ID NO: 643026 - DNA, 25 bp, Rattus norvegicus
tgtaccaggatctcagcattaccat

SEQ ID NO: 643027 - DNA, 25 bp, Rattus norvegicus
tgtaccaggcacacaacgtggtata

SEQ ID NO: 643028 - DNA, 25 bp, Rattus norvegicus
tgtaccaggcactcaacgtggtata

SEQ ID NO: 643029 - DNA, 25 bp, Rattus norvegicus
tgtaccaggtagaatcgggcttcac

SEQ ID NO: 643030 - DNA, 25 bp, Rattus norvegicus
tgtaccaggtagtatcgggcttcac

SEQ ID NO: 643031 - DNA, 25 bp, Rattus norvegicus
tgtaccatacacacagctcaagact

SEQ ID NO: 643032 - DNA, 25 bp, Rattus norvegicus
tgtaccatacactcagctcaagact

SEQ ID NO: 643033 - DNA, 25 bp, Rattus norvegicus
tgtaccatatcaactttcccaaagc

SEQ ID NO: 643034 - DNA, 25 bp, Rattus norvegicus
tgtaccatatcatctttcccaaagc

SEQ ID NO: 643035 - DNA, 25 bp, Rattus norvegicus
tgtaccatcataacaagcatttttg

SEQ ID NO: 643036 - DNA, 25 bp, Rattus norvegicus
tgtaccatcatatcaagcatttttg

SEQ ID NO: 643037 - DNA, 25 bp, Rattus norvegicus
tgtaccatgacaacttcctgagcct

SEQ ID NO: 643038 - DNA, 25 bp, Rattus norvegicus
tgtaccatgacatcttcctgagcct

SEQ ID NO: 643039 - DNA, 25 bp, Rattus norvegicus
tgtaccatttaacccttcagagcac

SEQ ID NO: 643040 - DNA, 25 bp, Rattus norvegicus
tgtaccatttaagccttcagagcac

SEQ ID NO: 643041 - DNA, 25 bp, Rattus norvegicus
tgtaccatttgtatacctgaattta

SEQ ID NO: 643042 - DNA, 25 bp, Rattus norvegicus
tgtaccatttgtttacctgaattta

SEQ ID NO: 643043 - DNA, 25 bp, Rattus norvegicus
tgtacccacatcagctgcatttcaa

SEQ ID NO: 643044 - DNA, 25 bp, Rattus norvegicus
tgtacccacatctgctgcatttcaa

SEQ ID NO: 643045 - DNA, 25 bp, Rattus norvegicus
tgtacccagggaattataactcatg

SEQ ID NO: 643046 - DNA, 25 bp, Rattus norvegicus
tgtacccagggatttataactcatg

SEQ ID NO: 643047 - DNA, 25 bp, Rattus norvegicus
tgtacccagtgtaacccttgttatt

SEQ ID NO: 643048 - DNA, 25 bp, Rattus norvegicus
tgtacccagtgttacccttgttatt

SEQ ID NO: 643049 - DNA, 25 bp, Rattus norvegicus
tgtacccatggtatgagccaaatgt

SEQ ID NO: 643050 - DNA, 25 bp, Rattus norvegicus
tgtacccatggtttgagccaaatgt

SEQ ID NO: 643051 - DNA, 25 bp, Rattus norvegicus
tgtaccccaaggcttcttgttaggg

SEQ ID NO: 643052 - DNA, 25 bp, Rattus norvegicus
tgtaccccaagggttcttgttaggg

SEQ ID NO: 643053 - DNA, 25 bp, Rattus norvegicus
tgtaccccaggtcagcataaccttg

SEQ ID NO: 643054 - DNA, 25 bp, Rattus norvegicus
tgtaccccaggtgagcataaccttg

SEQ ID NO: 643055 - DNA, 25 bp, Rattus norvegicus
tgtaccccagtaccacgcagtgaag

SEQ ID NO: 643056 - DNA, 25 bp, Rattus norvegicus
tgtaccccagtagcacgcagtgaag

SEQ ID NO: 643057 - DNA, 25 bp, Rattus norvegicus
tgtaccccatggcacctgtaaataa

SEQ ID NO: 643058 - DNA, 25 bp, Rattus norvegicus
tgtaccccatgggacctgtaaataa

SEQ ID NO: 643059 - DNA, 25 bp, Rattus norvegicus
tgtaccccgaacacattgaacagga

SEQ ID NO: 643060 - DNA, 25 bp, Rattus norvegicus
tgtaccccgaactcattgaacagga

SEQ ID NO: 643061 - DNA, 25 bp, Rattus norvegicus
tgtaccccgaatcagctgctgagga

SEQ ID NO: 643062 - DNA, 25 bp, Rattus norvegicus
tgtaccccgaatgagctgctgagga

SEQ ID NO: 643063 - DNA, 25 bp, Rattus norvegicus
tgtaccccgtccctctctgggattt

SEQ ID NO: 643064 - DNA, 25 bp, Rattus norvegicus
tgtaccccgtccgtctctgggattt

SEQ ID NO: 643065 - DNA, 25 bp, Rattus norvegicus
tgtaccccttcactgcaactgagaa

SEQ ID NO: 643066 - DNA, 25 bp, Rattus norvegicus
tgtaccccttcagtgcaactgagaa

SEQ ID NO: 643067 - DNA, 25 bp, Rattus norvegicus
tgtaccccttgccagagttaaagag

SEQ ID NO: 643068 - DNA, 25 bp, Rattus norvegicus
tgtaccccttgcgagagttaaagag

SEQ ID NO: 643069 - DNA, 25 bp, Rattus norvegicus
tgtacccgatgtattctgtaactaa

SEQ ID NO: 643070 - DNA, 25 bp, Rattus norvegicus
tgtacccgatgttttctgtaactaa

SEQ ID NO: 643071 - DNA, 25 bp, Rattus norvegicus
tgtacccgcgcaacggtaacgtgat

SEQ ID NO: 643072 - DNA, 25 bp, Rattus norvegicus
tgtacccgcgcatcggtaacgtgat

SEQ ID NO: 643073 - DNA, 25 bp, Rattus norvegicus
tgtacccgggctacacgtacggcaa

SEQ ID NO: 643074 - DNA, 25 bp, Rattus norvegicus
tgtacccgggcttcacgtacggcaa

SEQ ID NO: 643075 - DNA, 25 bp, Rattus norvegicus
tgtacccgtcacactggagtgtata

SEQ ID NO: 643076 - DNA, 25 bp, Rattus norvegicus
tgtacccgtcactctggagtgtata

SEQ ID NO: 643077 - DNA, 25 bp, Rattus norvegicus
tgtaccctccacacaaacacgtaga

SEQ ID NO: 643078 - DNA, 25 bp, Rattus norvegicus
tgtaccctccactcaaacacgtaga

SEQ ID NO: 643079 - DNA, 25 bp, Rattus norvegicus
tgtaccctgctaccagatgccaggt

SEQ ID NO: 643080 - DNA, 25 bp, Rattus norvegicus
tgtaccctgctagcagatgccaggt

SEQ ID NO: 643081 - DNA, 25 bp, Rattus norvegicus
tgtaccctggaacctctcggagaat

SEQ ID NO: 643082 - DNA, 25 bp, Rattus norvegicus
tgtaccctggaagctctcggagaat

SEQ ID NO: 643083 - DNA, 25 bp, Rattus norvegicus
tgtaccctgggtcgatgcctacttg

SEQ ID NO: 643084 - DNA, 25 bp, Rattus norvegicus
tgtaccctgggtctagttcttacag

SEQ ID NO: 643085 - DNA, 25 bp, Rattus norvegicus
tgtaccctgggtggatgcctacttg

SEQ ID NO: 643086 - DNA, 25 bp, Rattus norvegicus
tgtaccctgggtgtagttcttacag

SEQ ID NO: 643087 - DNA, 25 bp, Rattus norvegicus
tgtacccttcaaaaatggcttgttt

SEQ ID NO: 643088 - DNA, 25 bp, Rattus norvegicus
tgtacccttcaataatggcttgttt

SEQ ID NO: 643089 - DNA, 25 bp, Rattus norvegicus
tgtacccttgcgacctgtgcggaaa

SEQ ID NO: 643090 - DNA, 25 bp, Rattus norvegicus
tgtacccttgcgtcctgtgcggaaa

SEQ ID NO: 643091 - DNA, 25 bp, Rattus norvegicus
tgtacccttttcacacttttctgga

SEQ ID NO: 643092 - DNA, 25 bp, Rattus norvegicus
tgtacccttttctcacttttctgga

SEQ ID NO: 643093 - DNA, 25 bp, Rattus norvegicus
tgtaccctttttacattcctggtct

SEQ ID NO: 643094 - DNA, 25 bp, Rattus norvegicus
tgtacccttttttcattcctggtct

SEQ ID NO: 643095 - DNA, 25 bp, Rattus norvegicus
tgtaccgactttacaatccctaagg

SEQ ID NO: 643096 - DNA, 25 bp, Rattus norvegicus
tgtaccgacttttcaatccctaagg

SEQ ID NO: 643097 - DNA, 25 bp, Rattus norvegicus
tgtaccgaggcactgtcaacagtaa

SEQ ID NO: 643098 - DNA, 25 bp, Rattus norvegicus
tgtaccgaggcagtgtcaacagtaa

SEQ ID NO: 643099 - DNA, 25 bp, Rattus norvegicus
tgtaccgatcaccagagaccatgat

SEQ ID NO: 643100 - DNA, 25 bp, Rattus norvegicus
tgtaccgatcacgagagaccatgat

SEQ ID NO: 643101 - DNA, 25 bp, Rattus norvegicus
tgtaccgcagtcctgtttacagatt

SEQ ID NO: 643102 - DNA, 25 bp, Rattus norvegicus
tgtaccgcagtcgtgtttacagatt

SEQ ID NO: 643103 - DNA, 25 bp, Rattus norvegicus
tgtaccgcctttccatcgcttgtgt

SEQ ID NO: 643104 - DNA, 25 bp, Rattus norvegicus
tgtaccgcctttgcatcgcttgtgt

SEQ ID NO: 643105 - DNA, 25 bp, Rattus norvegicus
tgtaccgcgaatcctgctgtggctg

SEQ ID NO: 643106 - DNA, 25 bp, Rattus norvegicus
tgtaccgcgaatgctgctgtggctg

SEQ ID NO: 643107 - DNA, 25 bp, Rattus norvegicus
tgtaccgctgcgatatctgccagat

SEQ ID NO: 643108 - DNA, 25 bp, Rattus norvegicus
tgtaccgctgcgttatctgccagat

SEQ ID NO: 643109 - DNA, 25 bp, Rattus norvegicus
tgtaccggcccgagccgtgaagaag

SEQ ID NO: 643110 - DNA, 25 bp, Rattus norvegicus
tgtaccggcccgtgccgtgaagaag

SEQ ID NO: 643111 - DNA, 25 bp, Rattus norvegicus
tgtaccgggaccctgttacagacat

SEQ ID NO: 643112 - DNA, 25 bp, Rattus norvegicus
tgtaccgggaccgtgttacagacat

SEQ ID NO: 643113 - DNA, 25 bp, Rattus norvegicus
tgtaccgttttacctttagagtctg

SEQ ID NO: 643114 - DNA, 25 bp, Rattus norvegicus
tgtaccgttttagctttagagtctg

SEQ ID NO: 643115 - DNA, 25 bp, Rattus norvegicus
tgtacctaggacaggagcagactaa

SEQ ID NO: 643116 - DNA, 25 bp, Rattus norvegicus
tgtacctaggactggagcagactaa

SEQ ID NO: 643117 - DNA, 25 bp, Rattus norvegicus
tgtacctagttcacagactcgagtg

SEQ ID NO: 643118 - DNA, 25 bp, Rattus norvegicus
tgtacctagttctcagactcgagtg

SEQ ID NO: 643119 - DNA, 25 bp, Rattus norvegicus
tgtacctattaacttcctctatcct

SEQ ID NO: 643120 - DNA, 25 bp, Rattus norvegicus
tgtacctattaagttcctctatcct

SEQ ID NO: 643121 - DNA, 25 bp, Rattus norvegicus
tgtacctcaaaccatcaaaccatat

SEQ ID NO: 643122 - DNA, 25 bp, Rattus norvegicus
tgtacctcaaacgatcaaaccatat

SEQ ID NO: 643123 - DNA, 25 bp, Rattus norvegicus
tgtacctcacagacaggatggcgta

SEQ ID NO: 643124 - DNA, 25 bp, Rattus norvegicus
tgtacctcacagtcaggatggcgta

SEQ ID NO: 643125 - DNA, 25 bp, Rattus norvegicus
tgtacctcactgaccactatgaaaa

SEQ ID NO: 643126 - DNA, 25 bp, Rattus norvegicus
tgtacctcactgtccactatgaaaa

SEQ ID NO: 643127 - DNA, 25 bp, Rattus norvegicus
tgtacctcatctcatcctttcattt

SEQ ID NO: 643128 - DNA, 25 bp, Rattus norvegicus
tgtacctcatctgatcctttcattt

SEQ ID NO: 643129 - DNA, 25 bp, Rattus norvegicus
tgtacctccaagatcttcttgagtt

SEQ ID NO: 643130 - DNA, 25 bp, Rattus norvegicus
tgtacctccaagttcttcttgagtt

SEQ ID NO: 643131 - DNA, 25 bp, Rattus norvegicus
tgtacctccggacaccattactaaa

SEQ ID NO: 643132 - DNA, 25 bp, Rattus norvegicus
tgtacctccggagaccattactaaa

SEQ ID NO: 643133 - DNA, 25 bp, Rattus norvegicus
tgtacctcctttaaagcctcaagta

SEQ ID NO: 643134 - DNA, 25 bp, Rattus norvegicus
tgtacctccttttaagcctcaagta

SEQ ID NO: 643135 - DNA, 25 bp, Rattus norvegicus
tgtacctcttgtaattccttcacat

SEQ ID NO: 643136 - DNA, 25 bp, Rattus norvegicus
tgtacctcttgttattccttcacat

SEQ ID NO: 643137 - DNA, 25 bp, Rattus norvegicus
tgtacctgacagcagatgcctggca

SEQ ID NO: 643138 - DNA, 25 bp, Rattus norvegicus
tgtacctgacaggagatgcctggca

SEQ ID NO: 643139 - DNA, 25 bp, Rattus norvegicus
tgtacctgcatcaagccctgagggt

SEQ ID NO: 643140 - DNA, 25 bp, Rattus norvegicus
tgtacctgcatctagccctgagggt

SEQ ID NO: 643141 - DNA, 25 bp, Rattus norvegicus
tgtacctgcattccggccaatcgtg

SEQ ID NO: 643142 - DNA, 25 bp, Rattus norvegicus
tgtacctgcattgcggccaatcgtg

SEQ ID NO: 643143 - DNA, 25 bp, Rattus norvegicus
tgtacctgccacactatgttagaat

SEQ ID NO: 643144 - DNA, 25 bp, Rattus norvegicus
tgtacctgccactctatgttagaat

SEQ ID NO: 643145 - DNA, 25 bp, Rattus norvegicus
tgtacctgccctatgggaatggacc

SEQ ID NO: 643146 - DNA, 25 bp, Rattus norvegicus
tgtacctgccctttgggaatggacc

SEQ ID NO: 643147 - DNA, 25 bp, Rattus norvegicus
tgtacctgccgcaagaggctcgctg

SEQ ID NO: 643148 - DNA, 25 bp, Rattus norvegicus
tgtacctgccgctagaggctcgctg

SEQ ID NO: 643149 - DNA, 25 bp, Rattus norvegicus
tgtacctggagcagtgccactgcag

SEQ ID NO: 643150 - DNA, 25 bp, Rattus norvegicus
tgtacctggagctgtgccactgcag

SEQ ID NO: 643151 - DNA, 25 bp, Rattus norvegicus
tgtacctgggaaatgagcgtcgtca

SEQ ID NO: 643152 - DNA, 25 bp, Rattus norvegicus
tgtacctgggaattgagcgtcgtca

SEQ ID NO: 643153 - DNA, 25 bp, Rattus norvegicus
tgtacctgggtcacgttttactaga

SEQ ID NO: 643154 - DNA, 25 bp, Rattus norvegicus
tgtacctgggtctcgttttactaga

SEQ ID NO: 643155 - DNA, 25 bp, Rattus norvegicus
tgtacctgtacacatctgactgttg

SEQ ID NO: 643156 - DNA, 25 bp, Rattus norvegicus
tgtacctgtacagatctgactgttg

SEQ ID NO: 643157 - DNA, 25 bp, Rattus norvegicus
tgtacctgtcttacaataactcctc

SEQ ID NO: 643158 - DNA, 25 bp, Rattus norvegicus
tgtacctgtctttcaataactcctc

SEQ ID NO: 643159 - DNA, 25 bp, Rattus norvegicus
tgtacctgtggaccacagatgccca

SEQ ID NO: 643160 - DNA, 25 bp, Rattus norvegicus
tgtacctgtggagcacagatgccca

SEQ ID NO: 643161 - DNA, 25 bp, Rattus norvegicus
tgtacctgtgtcaatcttaacgttt

SEQ ID NO: 643162 - DNA, 25 bp, Rattus norvegicus
tgtacctgtgtctatcttaacgttt

SEQ ID NO: 643163 - DNA, 25 bp, Rattus norvegicus
tgtacctgttggagggcacgctctt

SEQ ID NO: 643164 - DNA, 25 bp, Rattus norvegicus
tgtacctgttggtgggcacgctctt

SEQ ID NO: 643165 - DNA, 25 bp, Rattus norvegicus
tgtaccttacggcatgatcatcagt

SEQ ID NO: 643166 - DNA, 25 bp, Rattus norvegicus
tgtaccttacgggatgatcatcagt

SEQ ID NO: 643167 - DNA, 25 bp, Rattus norvegicus
tgtaccttcaacacctgctataccg

SEQ ID NO: 643168 - DNA, 25 bp, Rattus norvegicus
tgtaccttcaactcctgctataccg

SEQ ID NO: 643169 - DNA, 25 bp, Rattus norvegicus
tgtaccttccatccttagcttcact

SEQ ID NO: 643170 - DNA, 25 bp, Rattus norvegicus
tgtaccttccatgcttagcttcact

SEQ ID NO: 643171 - DNA, 25 bp, Rattus norvegicus
tgtaccttcgctattttagactcaa

SEQ ID NO: 643172 - DNA, 25 bp, Rattus norvegicus
tgtaccttcgcttttttagactcaa

SEQ ID NO: 643173 - DNA, 25 bp, Rattus norvegicus
tgtaccttctgaaccatccgttgaa

SEQ ID NO: 643174 - DNA, 25 bp, Rattus norvegicus
tgtaccttctgatccatccgttgaa

SEQ ID NO: 643175 - DNA, 25 bp, Rattus norvegicus
tgtaccttcttcctgatgctttagc

SEQ ID NO: 643176 - DNA, 25 bp, Rattus norvegicus
tgtaccttcttcgtgatgctttagc

SEQ ID NO: 643177 - DNA, 25 bp, Rattus norvegicus
tgtaccttgcagaaatttctcccaa

SEQ ID NO: 643178 - DNA, 25 bp, Rattus norvegicus
tgtaccttgcagtaatttctcccaa

SEQ ID NO: 643179 - DNA, 25 bp, Rattus norvegicus
tgtacctttgtcacatactttaaaa

SEQ ID NO: 643180 - DNA, 25 bp, Rattus norvegicus
tgtacctttgtctcatactttaaaa

SEQ ID NO: 643181 - DNA, 25 bp, Rattus norvegicus
tgtacctttgtgctagttctgacta

SEQ ID NO: 643182 - DNA, 25 bp, Rattus norvegicus
tgtacctttgtggtagttctgacta

SEQ ID NO: 643183 - DNA, 25 bp, Rattus norvegicus
tgtacctttttgagtgcatttttaa

SEQ ID NO: 643184 - DNA, 25 bp, Rattus norvegicus
tgtacctttttgatagtgaatttgg

SEQ ID NO: 643185 - DNA, 25 bp, Rattus norvegicus
tgtacctttttgtgtgcatttttaa

SEQ ID NO: 643186 - DNA, 25 bp, Rattus norvegicus
tgtacctttttgttagtgaatttgg

SEQ ID NO: 643187 - DNA, 25 bp, Rattus norvegicus
tgtacgaaattcagaggccttgatt

SEQ ID NO: 643188 - DNA, 25 bp, Rattus norvegicus
tgtacgaaattctgaggccttgatt

SEQ ID NO: 643189 - DNA, 25 bp, Rattus norvegicus
tgtacgaatgccagtagaccaccct

SEQ ID NO: 643190 - DNA, 25 bp, Rattus norvegicus
tgtacgaatgcctgtagaccaccct

SEQ ID NO: 643191 - DNA, 25 bp, Rattus norvegicus
tgtacgacctcaaccagtactggta

SEQ ID NO: 643192 - DNA, 25 bp, Rattus norvegicus
tgtacgacctcatccagtactggta

SEQ ID NO: 643193 - DNA, 25 bp, Rattus norvegicus
tgtacgagatccctggcctggaacc

SEQ ID NO: 643194 - DNA, 25 bp, Rattus norvegicus
tgtacgagatccgtggcctggaacc

SEQ ID NO: 643195 - DNA, 25 bp, Rattus norvegicus
tgtacgagctggagcaggccacacg

SEQ ID NO: 643196 - DNA, 25 bp, Rattus norvegicus
tgtacgagctggtgcaggccacacg

SEQ ID NO: 643197 - DNA, 25 bp, Rattus norvegicus
tgtacgatctttaataacctccctg

SEQ ID NO: 643198 - DNA, 25 bp, Rattus norvegicus
tgtacgatcttttataacctccctg

SEQ ID NO: 643199 - DNA, 25 bp, Rattus norvegicus
tgtacgatgtataccagtagtttcc

SEQ ID NO: 643200 - DNA, 25 bp, Rattus norvegicus
tgtacgatgtattccagtagtttcc

SEQ ID NO: 643201 - DNA, 25 bp, Rattus norvegicus
tgtacgcacacacccttattaatgt

SEQ ID NO: 643202 - DNA, 25 bp, Rattus norvegicus
tgtacgcacacagccttattaatgt

SEQ ID NO: 643203 - DNA, 25 bp, Rattus norvegicus
tgtacgccctttcgccagtcttgta

SEQ ID NO: 643204 - DNA, 25 bp, Rattus norvegicus
tgtacgccctttggccagtcttgta

SEQ ID NO: 643205 - DNA, 25 bp, Rattus norvegicus
tgtacgccttctagtccgacaactt

SEQ ID NO: 643206 - DNA, 25 bp, Rattus norvegicus
tgtacgccttcttgtccgacaactt

SEQ ID NO: 643207 - DNA, 25 bp, Rattus norvegicus
tgtacgcgagctctgcagagcccca

SEQ ID NO: 643208 - DNA, 25 bp, Rattus norvegicus
tgtacgcgagctgtgcagagcccca

SEQ ID NO: 643209 - DNA, 25 bp, Rattus norvegicus
tgtacgctatacatacttgtttttt

SEQ ID NO: 643210 - DNA, 25 bp, Rattus norvegicus
tgtacgctatacttacttgtttttt

SEQ ID NO: 643211 - DNA, 25 bp, Rattus norvegicus
tgtacgctgctaaccaagaccagtt

SEQ ID NO: 643212 - DNA, 25 bp, Rattus norvegicus
tgtacgctgctatccaagaccagtt

SEQ ID NO: 643213 - DNA, 25 bp, Rattus norvegicus
tgtacgctgctcacaacagagactt

SEQ ID NO: 643214 - DNA, 25 bp, Rattus norvegicus
tgtacgctgctctcaacagagactt

SEQ ID NO: 643215 - DNA, 25 bp, Rattus norvegicus
tgtacggaccctataccagtgccca

SEQ ID NO: 643216 - DNA, 25 bp, Rattus norvegicus
tgtacggaccctttaccagtgccca

SEQ ID NO: 643217 - DNA, 25 bp, Rattus norvegicus
tgtacggatgtacagacacctctga

SEQ ID NO: 643218 - DNA, 25 bp, Rattus norvegicus
tgtacggatgtagagacacctctga

SEQ ID NO: 643219 - DNA, 25 bp, Rattus norvegicus
tgtacggcctctccgatgagatgaa

SEQ ID NO: 643220 - DNA, 25 bp, Rattus norvegicus
tgtacggcctctgcgatgagatgaa

SEQ ID NO: 643221 - DNA, 25 bp, Rattus norvegicus
tgtacggtaagccagagggcccaaa

SEQ ID NO: 643222 - DNA, 25 bp, Rattus norvegicus
tgtacggtaagcgagagggcccaaa

SEQ ID NO: 643223 - DNA, 25 bp, Rattus norvegicus
tgtacggtgatgcaggacctgcctc

SEQ ID NO: 643224 - DNA, 25 bp, Rattus norvegicus
tgtacggtgatggaggacctgcctc

SEQ ID NO: 643225 - DNA, 25 bp, Rattus norvegicus
tgtacgtaacacatctgccctacat

SEQ ID NO: 643226 - DNA, 25 bp, Rattus norvegicus
tgtacgtaacacttctgccctacat

SEQ ID NO: 643227 - DNA, 25 bp, Rattus norvegicus
tgtacgtacttgacttcttgtgcac

SEQ ID NO: 643228 - DNA, 25 bp, Rattus norvegicus
tgtacgtacttgtcttcttgtgcac

SEQ ID NO: 643229 - DNA, 25 bp, Rattus norvegicus
tgtacgtagctcagctggtggttag

SEQ ID NO: 643230 - DNA, 25 bp, Rattus norvegicus
tgtacgtagctctgctggtggttag

SEQ ID NO: 643231 - DNA, 25 bp, Rattus norvegicus
tgtacgtatgtaagtgcccatgccg

SEQ ID NO: 643232 - DNA, 25 bp, Rattus norvegicus
tgtacgtatgtatgtgcccatgccg

SEQ ID NO: 643233 - DNA, 25 bp, Rattus norvegicus
tgtacgtgcactcagccatgtggct

SEQ ID NO: 643234 - DNA, 25 bp, Rattus norvegicus
tgtacgtgcactgagccatgtggct

SEQ ID NO: 643235 - DNA, 25 bp, Rattus norvegicus
tgtacgttaaaactgagcccctctt

SEQ ID NO: 643236 - DNA, 25 bp, Rattus norvegicus
tgtacgttaaaagtgagcccctctt

SEQ ID NO: 643237 - DNA, 25 bp, Rattus norvegicus
tgtacgttcgaccacatgggccgtg

SEQ ID NO: 643238 - DNA, 25 bp, Rattus norvegicus
tgtacgttcgacgacatgggccgtg

SEQ ID NO: 643239 - DNA, 25 bp, Rattus norvegicus
tgtactaaagccagttccattaccc

SEQ ID NO: 643240 - DNA, 25 bp, Rattus norvegicus
tgtactaaagcctgttccattaccc

SEQ ID NO: 643241 - DNA, 25 bp, Rattus norvegicus
tgtactaaccctcattcttttgctg

SEQ ID NO: 643242 - DNA, 25 bp, Rattus norvegicus
tgtactaaccctgattcttttgctg

SEQ ID NO: 643243 - DNA, 25 bp, Rattus norvegicus
tgtactaagctgaaaggccctcgca

SEQ ID NO: 643244 - DNA, 25 bp, Rattus norvegicus
tgtactaagctgtaaggccctcgca

SEQ ID NO: 643245 - DNA, 25 bp, Rattus norvegicus
tgtactaagtatccatcaagccatg

SEQ ID NO: 643246 - DNA, 25 bp, Rattus norvegicus
tgtactaagtatgcatcaagccatg

SEQ ID NO: 643247 - DNA, 25 bp, Rattus norvegicus
tgtactaccacactctggctaatac

SEQ ID NO: 643248 - DNA, 25 bp, Rattus norvegicus
tgtactaccacagtctggctaatac

SEQ ID NO: 643249 - DNA, 25 bp, Rattus norvegicus
tgtactaccgcaagctcaaaaccct

SEQ ID NO: 643250 - DNA, 25 bp, Rattus norvegicus
tgtactaccgcatgctcaaaaccct

SEQ ID NO: 643251 - DNA, 25 bp, Rattus norvegicus
tgtactacggcacctcggcaggctc

SEQ ID NO: 643252 - DNA, 25 bp, Rattus norvegicus
tgtactacggcagctcggcaggctc

SEQ ID NO: 643253 - DNA, 25 bp, Rattus norvegicus
tgtactagtggtcggcccagtccat

SEQ ID NO: 643254 - DNA, 25 bp, Rattus norvegicus
tgtactagtggtgggcccagtccat

SEQ ID NO: 643255 - DNA, 25 bp, Rattus norvegicus
tgtactatgccaattaaaccacttc

SEQ ID NO: 643256 - DNA, 25 bp, Rattus norvegicus
tgtactatgccatttaaaccacttc

SEQ ID NO: 643257 - DNA, 25 bp, Rattus norvegicus
tgtactcaacgtcatgtcctcacaa

SEQ ID NO: 643258 - DNA, 25 bp, Rattus norvegicus
tgtactcaacgtgatgtcctcacaa

SEQ ID NO: 643259 - DNA, 25 bp, Rattus norvegicus
tgtactcacaccagctgaacactgt

SEQ ID NO: 643260 - DNA, 25 bp, Rattus norvegicus
tgtactcacacctgctgaacactgt

SEQ ID NO: 643261 - DNA, 25 bp, Rattus norvegicus
tgtactcaccaacttccacactgaa

SEQ ID NO: 643262 - DNA, 25 bp, Rattus norvegicus
tgtactcaccaagttccacactgaa

SEQ ID NO: 643263 - DNA, 25 bp, Rattus norvegicus
tgtactcagactattgaaacttcat

SEQ ID NO: 643264 - DNA, 25 bp, Rattus norvegicus
tgtactcagacttttgaaacttcat

SEQ ID NO: 643265 - DNA, 25 bp, Rattus norvegicus
tgtactcagcgtctatggaccggac

SEQ ID NO: 643266 - DNA, 25 bp, Rattus norvegicus
tgtactcagcgtgtatggaccggac

SEQ ID NO: 643267 - DNA, 25 bp, Rattus norvegicus
tgtactcatagtcccttccaggatg

SEQ ID NO: 643268 - DNA, 25 bp, Rattus norvegicus
tgtactcatagtgccttccaggatg

SEQ ID NO: 643269 - DNA, 25 bp, Rattus norvegicus
tgtactcatgcgaggacacacacac

SEQ ID NO: 643270 - DNA, 25 bp, Rattus norvegicus
tgtactcatgcgtggacacacacac

SEQ ID NO: 643271 - DNA, 25 bp, Rattus norvegicus
tgtactcatgtacctttcaacttga

SEQ ID NO: 643272 - DNA, 25 bp, Rattus norvegicus
tgtactcatgtagctttcaacttga

SEQ ID NO: 643273 - DNA, 25 bp, Rattus norvegicus
tgtactccaggtaagttggcccaag

SEQ ID NO: 643274 - DNA, 25 bp, Rattus norvegicus
tgtactccaggttagttggcccaag

SEQ ID NO: 643275 - DNA, 25 bp, Rattus norvegicus
tgtactccctacctatggagatgct

SEQ ID NO: 643276 - DNA, 25 bp, Rattus norvegicus
tgtactccctacgtatggagatgct

SEQ ID NO: 643277 - DNA, 25 bp, Rattus norvegicus
tgtactccgggcactgatcacaggg

SEQ ID NO: 643278 - DNA, 25 bp, Rattus norvegicus
tgtactccgggctctgatcacaggg

SEQ ID NO: 643279 - DNA, 25 bp, Rattus norvegicus
tgtactccgtccagaaatgtccaag

SEQ ID NO: 643280 - DNA, 25 bp, Rattus norvegicus
tgtactccgtcctgaaatgtccaag

SEQ ID NO: 643281 - DNA, 25 bp, Rattus norvegicus
tgtactccgttcactaaggtgacaa

SEQ ID NO: 643282 - DNA, 25 bp, Rattus norvegicus
tgtactccgttctctaaggtgacaa

SEQ ID NO: 643283 - DNA, 25 bp, Rattus norvegicus
tgtactcctccacaaaggtgctgtt

SEQ ID NO: 643284 - DNA, 25 bp, Rattus norvegicus
tgtactcctccagaaaggtgctgtt

SEQ ID NO: 643285 - DNA, 25 bp, Rattus norvegicus
tgtactcctcctaagtctgaagcag

SEQ ID NO: 643286 - DNA, 25 bp, Rattus norvegicus
tgtactcctccttagtctgaagcag

SEQ ID NO: 643287 - DNA, 25 bp, Rattus norvegicus
tgtactcctctcaacttttggttat

SEQ ID NO: 643288 - DNA, 25 bp, Rattus norvegicus
tgtactcctctctacttttggttat

SEQ ID NO: 643289 - DNA, 25 bp, Rattus norvegicus
tgtactcgctgcagcgctcggagaa

SEQ ID NO: 643290 - DNA, 25 bp, Rattus norvegicus
tgtactcgctgctgcgctcggagaa

SEQ ID NO: 643291 - DNA, 25 bp, Rattus norvegicus
tgtactcgctgtactcagagactcg

SEQ ID NO: 643292 - DNA, 25 bp, Rattus norvegicus
tgtactcgctgttctcagagactcg

SEQ ID NO: 643293 - DNA, 25 bp, Rattus norvegicus
tgtactcgtccacctcgatgatgag

SEQ ID NO: 643294 - DNA, 25 bp, Rattus norvegicus
tgtactcgtccagctcgatgatgag

SEQ ID NO: 643295 - DNA, 25 bp, Rattus norvegicus
tgtactcgttggcaagcggactcct

SEQ ID NO: 643296 - DNA, 25 bp, Rattus norvegicus
tgtactcgttgggaagcggactcct

SEQ ID NO: 643297 - DNA, 25 bp, Rattus norvegicus
tgtactctagttatccggggctgga

SEQ ID NO: 643298 - DNA, 25 bp, Rattus norvegicus
tgtactctagttttccggggctgga

SEQ ID NO: 643299 - DNA, 25 bp, Rattus norvegicus
tgtactctcacgctgtgctggccag

SEQ ID NO: 643300 - DNA, 25 bp, Rattus norvegicus
tgtactctcacggtgtgctggccag

SEQ ID NO: 643301 - DNA, 25 bp, Rattus norvegicus
tgtactctcccgcaaagaggctttc

SEQ ID NO: 643302 - DNA, 25 bp, Rattus norvegicus
tgtactctcccggaaagaggctttc

SEQ ID NO: 643303 - DNA, 25 bp, Rattus norvegicus
tgtactctgcctagtccagatgtct

SEQ ID NO: 643304 - DNA, 25 bp, Rattus norvegicus
tgtactctgccttgtccagatgtct

SEQ ID NO: 643305 - DNA, 25 bp, Rattus norvegicus
tgtactctgtacctgcaaccaggat

SEQ ID NO: 643306 - DNA, 25 bp, Rattus norvegicus
tgtactctgtacgtgcaaccaggat

SEQ ID NO: 643307 - DNA, 25 bp, Rattus norvegicus
tgtactctgtcaccctacaggtgga

SEQ ID NO: 643308 - DNA, 25 bp, Rattus norvegicus
tgtactctgtcagcctacaggtgga

SEQ ID NO: 643309 - DNA, 25 bp, Rattus norvegicus
tgtactctgtctacttctctgctga

SEQ ID NO: 643310 - DNA, 25 bp, Rattus norvegicus
tgtactctgtcttcttctctgctga

SEQ ID NO: 643311 - DNA, 25 bp, Rattus norvegicus
tgtactcttctgatgcagagccagt

SEQ ID NO: 643312 - DNA, 25 bp, Rattus norvegicus
tgtactcttctgttgcagagccagt

SEQ ID NO: 643313 - DNA, 25 bp, Rattus norvegicus
tgtactcttgagacttctttgcaaa

SEQ ID NO: 643314 - DNA, 25 bp, Rattus norvegicus
tgtactcttgagtcttctttgcaaa

SEQ ID NO: 643315 - DNA, 25 bp, Rattus norvegicus
tgtactcttttgatgcccacatgtt

SEQ ID NO: 643316 - DNA, 25 bp, Rattus norvegicus
tgtactcttttgttgcccacatgtt

SEQ ID NO: 643317 - DNA, 25 bp, Rattus norvegicus
tgtactgaaggtctggccacacaag

SEQ ID NO: 643318 - DNA, 25 bp, Rattus norvegicus
tgtactgaaggtgtggccacacaag

SEQ ID NO: 643319 - DNA, 25 bp, Rattus norvegicus
tgtactgacggcactctttccactg

SEQ ID NO: 643320 - DNA, 25 bp, Rattus norvegicus
tgtactgacggctctctttccactg

SEQ ID NO: 643321 - DNA, 25 bp, Rattus norvegicus
tgtactgactcccatgacgcttggt

SEQ ID NO: 643322 - DNA, 25 bp, Rattus norvegicus
tgtactgactccgatgacgcttggt

SEQ ID NO: 643323 - DNA, 25 bp, Rattus norvegicus
tgtactgagccaacttagagcaaat

SEQ ID NO: 643324 - DNA, 25 bp, Rattus norvegicus
tgtactgagccatcttagagcaaat

SEQ ID NO: 643325 - DNA, 25 bp, Rattus norvegicus
tgtactgcagcaagtgtccctccgt

SEQ ID NO: 643326 - DNA, 25 bp, Rattus norvegicus
tgtactgcagcatgtgtccctccgt

SEQ ID NO: 643327 - DNA, 25 bp, Rattus norvegicus
tgtactgccctcacaacaagttagg

SEQ ID NO: 643328 - DNA, 25 bp, Rattus norvegicus
tgtactgccctctcaacaagttagg

SEQ ID NO: 643329 - DNA, 25 bp, Rattus norvegicus
tgtactgccctgacacaaacactta

SEQ ID NO: 643330 - DNA, 25 bp, Rattus norvegicus
tgtactgccctgtcacaaacactta

SEQ ID NO: 643331 - DNA, 25 bp, Rattus norvegicus
tgtactgcctcaactaatcttgaca

SEQ ID NO: 643332 - DNA, 25 bp, Rattus norvegicus
tgtactgcctcatctaatcttgaca

SEQ ID NO: 643333 - DNA, 25 bp, Rattus norvegicus
tgtactgcctggaatgtctgtgaaa

SEQ ID NO: 643334 - DNA, 25 bp, Rattus norvegicus
tgtactgcctggtatgtctgtgaaa

SEQ ID NO: 643335 - DNA, 25 bp, Rattus norvegicus
tgtactgcggcaagaaggcccagct

SEQ ID NO: 643336 - DNA, 25 bp, Rattus norvegicus
tgtactgcggcatgaaggcccagct

SEQ ID NO: 643337 - DNA, 25 bp, Rattus norvegicus
tgtactgcgttaacgtttctttctt

SEQ ID NO: 643338 - DNA, 25 bp, Rattus norvegicus
tgtactgcgttatcgtttctttctt

SEQ ID NO: 643339 - DNA, 25 bp, Rattus norvegicus
tgtactgctatgactgctgcctaga

SEQ ID NO: 643340 - DNA, 25 bp, Rattus norvegicus
tgtactgctatgtctgctgcctaga

SEQ ID NO: 643341 - DNA, 25 bp, Rattus norvegicus
tgtactgcttttctttgcatggctt

SEQ ID NO: 643342 - DNA, 25 bp, Rattus norvegicus
tgtactgcttttgtttgcatggctt

SEQ ID NO: 643343 - DNA, 25 bp, Rattus norvegicus
tgtactggacacctgccagggacat

SEQ ID NO: 643344 - DNA, 25 bp, Rattus norvegicus
tgtactggacacgtgccagggacat

SEQ ID NO: 643345 - DNA, 25 bp, Rattus norvegicus
tgtactggcccaccaaggttgtcat

SEQ ID NO: 643346 - DNA, 25 bp, Rattus norvegicus
tgtactggcccagcaaggttgtcat

SEQ ID NO: 643347 - DNA, 25 bp, Rattus norvegicus
tgtactggccgcaggagaacttctc

SEQ ID NO: 643348 - DNA, 25 bp, Rattus norvegicus
tgtactggccgctggagaacttctc

SEQ ID NO: 643349 - DNA, 25 bp, Rattus norvegicus
tgtactggcctaatgcatatataat

SEQ ID NO: 643350 - DNA, 25 bp, Rattus norvegicus
tgtactggcctattgcatatataat

SEQ ID NO: 643351 - DNA, 25 bp, Rattus norvegicus
tgtactggcgctccctcgacgacaa

SEQ ID NO: 643352 - DNA, 25 bp, Rattus norvegicus
tgtactggcgctgcctcgacgacaa

SEQ ID NO: 643353 - DNA, 25 bp, Rattus norvegicus
tgtactggcggcaatgctggaagct

SEQ ID NO: 643354 - DNA, 25 bp, Rattus norvegicus
tgtactggcggctatgctggaagct

SEQ ID NO: 643355 - DNA, 25 bp, Rattus norvegicus
tgtactggcttcaccccaactaaaa

SEQ ID NO: 643356 - DNA, 25 bp, Rattus norvegicus
tgtactggcttctccccaactaaaa

SEQ ID NO: 643357 - DNA, 25 bp, Rattus norvegicus
tgtactgggacaatctgggcgcctc

SEQ ID NO: 643358 - DNA, 25 bp, Rattus norvegicus
tgtactgggacattctgggcgcctc

SEQ ID NO: 643359 - DNA, 25 bp, Rattus norvegicus
tgtactggtacacctctccaggacc

SEQ ID NO: 643360 - DNA, 25 bp, Rattus norvegicus
tgtactggtacagctctccaggacc

SEQ ID NO: 643361 - DNA, 25 bp, Rattus norvegicus
tgtactggtgtactgccagggacca

SEQ ID NO: 643362 - DNA, 25 bp, Rattus norvegicus
tgtactggtgtagtgccagggacca

SEQ ID NO: 643363 - DNA, 25 bp, Rattus norvegicus
tgtactgtaacaagagccccagctt

SEQ ID NO: 643364 - DNA, 25 bp, Rattus norvegicus
tgtactgtaacatgagccccagctt

SEQ ID NO: 643365 - DNA, 25 bp, Rattus norvegicus
tgtactgtaagcatgttaggacgaa

SEQ ID NO: 643366 - DNA, 25 bp, Rattus norvegicus
tgtactgtaagcttgttaggacgaa

SEQ ID NO: 643367 - DNA, 25 bp, Rattus norvegicus
tgtactgtaccacccatggagtttt

SEQ ID NO: 643368 - DNA, 25 bp, Rattus norvegicus
tgtactgtaccagccatggagtttt

SEQ ID NO: 643369 - DNA, 25 bp, Rattus norvegicus
tgtactgtatgcattctgccaggcc

SEQ ID NO: 643370 - DNA, 25 bp, Rattus norvegicus
tgtactgtatgctttctgccaggcc

SEQ ID NO: 643371 - DNA, 25 bp, Rattus norvegicus
tgtactgtcacaccacctgggcaag

SEQ ID NO: 643372 - DNA, 25 bp, Rattus norvegicus
tgtactgtcacagcacctgggcaag

SEQ ID NO: 643373 - DNA, 25 bp, Rattus norvegicus
tgtactgtcccaaggtgtgcccgta

SEQ ID NO: 643374 - DNA, 25 bp, Rattus norvegicus
tgtactgtcccatggtgtgcccgta

SEQ ID NO: 643375 - DNA, 25 bp, Rattus norvegicus
tgtactgtcgtgctacccgtgtaaa

SEQ ID NO: 643376 - DNA, 25 bp, Rattus norvegicus
tgtactgtcgtggtacccgtgtaaa

SEQ ID NO: 643377 - DNA, 25 bp, Rattus norvegicus
tgtactgtctacaaagcacggctgc

SEQ ID NO: 643378 - DNA, 25 bp, Rattus norvegicus
tgtactgtctactaagcacggctgc

SEQ ID NO: 643379 - DNA, 25 bp, Rattus norvegicus
tgtactgtctcacccaagatctggt

SEQ ID NO: 643380 - DNA, 25 bp, Rattus norvegicus
tgtactgtctcagccaagatctggt

SEQ ID NO: 643381 - DNA, 25 bp, Rattus norvegicus
tgtactgtcttcactgtcttagcca

SEQ ID NO: 643382 - DNA, 25 bp, Rattus norvegicus
tgtactgtcttctctgtcttagcca

SEQ ID NO: 643383 - DNA, 25 bp, Rattus norvegicus
tgtactgtggtaatcagcaccgccc

SEQ ID NO: 643384 - DNA, 25 bp, Rattus norvegicus
tgtactgtggtattcagcaccgccc

SEQ ID NO: 643385 - DNA, 25 bp, Rattus norvegicus
tgtactgttcctatttggtctccac

SEQ ID NO: 643386 - DNA, 25 bp, Rattus norvegicus
tgtactgttcctttttggtctccac

SEQ ID NO: 643387 - DNA, 25 bp, Rattus norvegicus
tgtacttaaacacccctcctagcaa

SEQ ID NO: 643388 - DNA, 25 bp, Rattus norvegicus
tgtacttaaacagccctcctagcaa

SEQ ID NO: 643389 - DNA, 25 bp, Rattus norvegicus
tgtacttaaatcatctatcagcctc

SEQ ID NO: 643390 - DNA, 25 bp, Rattus norvegicus
tgtacttaaatcttctatcagcctc

SEQ ID NO: 643391 - DNA, 25 bp, Rattus norvegicus
tgtacttaagagctgctgtcagcat

SEQ ID NO: 643392 - DNA, 25 bp, Rattus norvegicus
tgtacttaagaggtgctgtcagcat

SEQ ID NO: 643393 - DNA, 25 bp, Rattus norvegicus
tgtacttaccgacactctgtaacct

SEQ ID NO: 643394 - DNA, 25 bp, Rattus norvegicus
tgtacttaccgagactctgtaacct

SEQ ID NO: 643395 - DNA, 25 bp, Rattus norvegicus
tgtacttagagcacggaagccccag

SEQ ID NO: 643396 - DNA, 25 bp, Rattus norvegicus
tgtacttagagctcggaagccccag

SEQ ID NO: 643397 - DNA, 25 bp, Rattus norvegicus
tgtacttcaaagaccctctggatgc

SEQ ID NO: 643398 - DNA, 25 bp, Rattus norvegicus
tgtacttcaaagtccctctggatgc

SEQ ID NO: 643399 - DNA, 25 bp, Rattus norvegicus
tgtacttcacatagatagctttgct

SEQ ID NO: 643400 - DNA, 25 bp, Rattus norvegicus
tgtacttcacattgatagctttgct

SEQ ID NO: 643401 - DNA, 25 bp, Rattus norvegicus
tgtacttcacccaaaggatatcgat

SEQ ID NO: 643402 - DNA, 25 bp, Rattus norvegicus
tgtacttcaccctaaggatatcgat

SEQ ID NO: 643403 - DNA, 25 bp, Rattus norvegicus
tgtacttcactacccagcaaagcct

SEQ ID NO: 643404 - DNA, 25 bp, Rattus norvegicus
tgtacttcactagccagcaaagcct

SEQ ID NO: 643405 - DNA, 25 bp, Rattus norvegicus
tgtacttcagagacttacccatccc

SEQ ID NO: 643406 - DNA, 25 bp, Rattus norvegicus
tgtacttcagagtcttacccatccc

SEQ ID NO: 643407 - DNA, 25 bp, Rattus norvegicus
tgtacttcagtgactttccgaggcc

SEQ ID NO: 643408 - DNA, 25 bp, Rattus norvegicus
tgtacttcagtgtctttccgaggcc

SEQ ID NO: 643409 - DNA, 25 bp, Rattus norvegicus
tgtacttcatacagtctccacagag

SEQ ID NO: 643410 - DNA, 25 bp, Rattus norvegicus
tgtacttcatactgtctccacagag

SEQ ID NO: 643411 - DNA, 25 bp, Rattus norvegicus
tgtacttccaagactgatctgagat

SEQ ID NO: 643412 - DNA, 25 bp, Rattus norvegicus
tgtacttccaagtctgatctgagat

SEQ ID NO: 643413 - DNA, 25 bp, Rattus norvegicus
tgtacttccataaccagtcccaggt

SEQ ID NO: 643414 - DNA, 25 bp, Rattus norvegicus
tgtacttccatatccagtcccaggt

SEQ ID NO: 643415 - DNA, 25 bp, Rattus norvegicus
tgtacttccctcaaatgcccatgat

SEQ ID NO: 643416 - DNA, 25 bp, Rattus norvegicus
tgtacttccctctaatgcccatgat

SEQ ID NO: 643417 - DNA, 25 bp, Rattus norvegicus
tgtacttcctccaaagcaagtcagc

SEQ ID NO: 643418 - DNA, 25 bp, Rattus norvegicus
tgtacttcctcctaagcaagtcagc

SEQ ID NO: 643419 - DNA, 25 bp, Rattus norvegicus
tgtacttctggactctcctcttggg

SEQ ID NO: 643420 - DNA, 25 bp, Rattus norvegicus
tgtacttctggagtctcctcttggg

SEQ ID NO: 643421 - DNA, 25 bp, Rattus norvegicus
tgtacttctgtaccaacattgcctc

SEQ ID NO: 643422 - DNA, 25 bp, Rattus norvegicus
tgtacttctgtagcaacattgcctc

SEQ ID NO: 643423 - DNA, 25 bp, Rattus norvegicus
tgtacttcttccaattaactttatg

SEQ ID NO: 643424 - DNA, 25 bp, Rattus norvegicus
tgtacttcttcctattaactttatg

SEQ ID NO: 643425 - DNA, 25 bp, Rattus norvegicus
tgtacttgaaacagctgctccggcc

SEQ ID NO: 643426 - DNA, 25 bp, Rattus norvegicus
tgtacttgaaactgctgctccggcc

SEQ ID NO: 643427 - DNA, 25 bp, Rattus norvegicus
tgtacttgataccttctccatgagc

SEQ ID NO: 643428 - DNA, 25 bp, Rattus norvegicus
tgtacttgatacgttctccatgagc

SEQ ID NO: 643429 - DNA, 25 bp, Rattus norvegicus
tgtacttgcctgcagggacctagaa

SEQ ID NO: 643430 - DNA, 25 bp, Rattus norvegicus
tgtacttgcctggagggacctagaa

SEQ ID NO: 643431 - DNA, 25 bp, Rattus norvegicus
tgtacttgctttcttagcaccccag

SEQ ID NO: 643432 - DNA, 25 bp, Rattus norvegicus
tgtacttgctttgttagcaccccag

SEQ ID NO: 643433 - DNA, 25 bp, Rattus norvegicus
tgtacttggtttactctaacgctgt

SEQ ID NO: 643434 - DNA, 25 bp, Rattus norvegicus
tgtacttggttttctctaacgctgt

SEQ ID NO: 643435 - DNA, 25 bp, Rattus norvegicus
tgtacttgtcctaaaacttgttctt

SEQ ID NO: 643436 - DNA, 25 bp, Rattus norvegicus
tgtacttgtccttaaacttgttctt

SEQ ID NO: 643437 - DNA, 25 bp, Rattus norvegicus
tgtacttgtgctcctttctaggaca

SEQ ID NO: 643438 - DNA, 25 bp, Rattus norvegicus
tgtacttgtgctgctttctaggaca

SEQ ID NO: 643439 - DNA, 25 bp, Rattus norvegicus
tgtactttaactccttttttcatgt

SEQ ID NO: 643440 - DNA, 25 bp, Rattus norvegicus
tgtactttaactgcttttttcatgt

SEQ ID NO: 643441 - DNA, 25 bp, Rattus norvegicus
tgtactttagctatgggaggtcacc

SEQ ID NO: 643442 - DNA, 25 bp, Rattus norvegicus
tgtactttagctttgggaggtcacc

SEQ ID NO: 643443 - DNA, 25 bp, Rattus norvegicus
tgtactttcccacaacttgattgga

SEQ ID NO: 643444 - DNA, 25 bp, Rattus norvegicus
tgtactttcccagaacttgattgga

SEQ ID NO: 643445 - DNA, 25 bp, Rattus norvegicus
tgtactttcctcctaagcaagaact

SEQ ID NO: 643446 - DNA, 25 bp, Rattus norvegicus
tgtactttcctcgtaagcaagaact

SEQ ID NO: 643447 - DNA, 25 bp, Rattus norvegicus
tgtactttctctacctagccttgct

SEQ ID NO: 643448 - DNA, 25 bp, Rattus norvegicus
tgtactttctcttcctagccttgct

SEQ ID NO: 643449 - DNA, 25 bp, Rattus norvegicus
tgtactttcttgacagcttgtataa

SEQ ID NO: 643450 - DNA, 25 bp, Rattus norvegicus
tgtactttcttgtcagcttgtataa

SEQ ID NO: 643451 - DNA, 25 bp, Rattus norvegicus
tgtactttctttcccatagcacatt

SEQ ID NO: 643452 - DNA, 25 bp, Rattus norvegicus
tgtactttctttgccatagcacatt

SEQ ID NO: 643453 - DNA, 25 bp, Rattus norvegicus
tgtactttgagtctaccagtttcct

SEQ ID NO: 643454 - DNA, 25 bp, Rattus norvegicus
tgtactttgagtgtaccagtttcct

SEQ ID NO: 643455 - DNA, 25 bp, Rattus norvegicus
tgtactttgcacctgttgggattct

SEQ ID NO: 643456 - DNA, 25 bp, Rattus norvegicus
tgtactttgcacgtgttgggattct

SEQ ID NO: 643457 - DNA, 25 bp, Rattus norvegicus
tgtactttggtacacgtgggtgcca

SEQ ID NO: 643458 - DNA, 25 bp, Rattus norvegicus
tgtactttggtagacgtgggtgcca

SEQ ID NO: 643459 - DNA, 25 bp, Rattus norvegicus
tgtactttgtacaggttcgtggagt

SEQ ID NO: 643460 - DNA, 25 bp, Rattus norvegicus
tgtactttgtacctaggaacctttg

SEQ ID NO: 643461 - DNA, 25 bp, Rattus norvegicus
tgtactttgtacgtaggaacctttg

SEQ ID NO: 643462 - DNA, 25 bp, Rattus norvegicus
tgtactttgtactggttcgtggagt

SEQ ID NO: 643463 - DNA, 25 bp, Rattus norvegicus
tgtacttttaaaacaaccattcaag

SEQ ID NO: 643464 - DNA, 25 bp, Rattus norvegicus
tgtacttttaaatcaaccattcaag

SEQ ID NO: 643465 - DNA, 25 bp, Rattus norvegicus
tgtagaaaactacttcatgacattt

SEQ ID NO: 643466 - DNA, 25 bp, Rattus norvegicus
tgtagaaaactagttcatgacattt

SEQ ID NO: 643467 - DNA, 25 bp, Rattus norvegicus
tgtagaaacaaactccgagccccag

SEQ ID NO: 643468 - DNA, 25 bp, Rattus norvegicus
tgtagaaacaaagtccgagccccag

SEQ ID NO: 643469 - DNA, 25 bp, Rattus norvegicus
tgtagaaacaagagcctctccgtgc

SEQ ID NO: 643470 - DNA, 25 bp, Rattus norvegicus
tgtagaaacaagtgcctctccgtgc

SEQ ID NO: 643471 - DNA, 25 bp, Rattus norvegicus
tgtagaaagcctatggtctttacct

SEQ ID NO: 643472 - DNA, 25 bp, Rattus norvegicus
tgtagaaagcctttggtctttacct

SEQ ID NO: 643473 - DNA, 25 bp, Rattus norvegicus
tgtagaaatgacagggtcttcacaa

SEQ ID NO: 643474 - DNA, 25 bp, Rattus norvegicus
tgtagaaatgactgggtcttcacaa

SEQ ID NO: 643475 - DNA, 25 bp, Rattus norvegicus
tgtagaacagtgcagtctgcccctg

SEQ ID NO: 643476 - DNA, 25 bp, Rattus norvegicus
tgtagaacagtggagtctgcccctg

SEQ ID NO: 643477 - DNA, 25 bp, Rattus norvegicus
tgtagaaccaacatgcctgttagtt

SEQ ID NO: 643478 - DNA, 25 bp, Rattus norvegicus
tgtagaaccaacttgcctgttagtt

SEQ ID NO: 643479 - DNA, 25 bp, Rattus norvegicus
tgtagaacgcctcggtatttctttt

SEQ ID NO: 643480 - DNA, 25 bp, Rattus norvegicus
tgtagaacgcctgggtatttctttt

SEQ ID NO: 643481 - DNA, 25 bp, Rattus norvegicus
tgtagaagaatcatcctagctttct

SEQ ID NO: 643482 - DNA, 25 bp, Rattus norvegicus
tgtagaagaatcttcctagctttct

SEQ ID NO: 643483 - DNA, 25 bp, Rattus norvegicus
tgtagaagacgaaaccacgcatggt

SEQ ID NO: 643484 - DNA, 25 bp, Rattus norvegicus
tgtagaagacgataccacgcatggt

SEQ ID NO: 643485 - DNA, 25 bp, Rattus norvegicus
tgtagaagtgagacccagcctcttt

SEQ ID NO: 643486 - DNA, 25 bp, Rattus norvegicus
tgtagaagtgagtcccagcctcttt

SEQ ID NO: 643487 - DNA, 25 bp, Rattus norvegicus
tgtagaagttttcttcttactccca

SEQ ID NO: 643488 - DNA, 25 bp, Rattus norvegicus
tgtagaagttttgttcttactccca

SEQ ID NO: 643489 - DNA, 25 bp, Rattus norvegicus
tgtagaatctacatcccaggctggg

SEQ ID NO: 643490 - DNA, 25 bp, Rattus norvegicus
tgtagaatctacttcccaggctggg

SEQ ID NO: 643491 - DNA, 25 bp, Rattus norvegicus
tgtagaatgctgatggtcccgtcgc

SEQ ID NO: 643492 - DNA, 25 bp, Rattus norvegicus
tgtagaatgctgttggtcccgtcgc

SEQ ID NO: 643493 - DNA, 25 bp, Rattus norvegicus
tgtagaatgtaaccgtctcctctct

SEQ ID NO: 643494 - DNA, 25 bp, Rattus norvegicus
tgtagaatgtaagcgtctcctctct

SEQ ID NO: 643495 - DNA, 25 bp, Rattus norvegicus
tgtagaattttccactcagtagatc

SEQ ID NO: 643496 - DNA, 25 bp, Rattus norvegicus
tgtagaattttcgactcagtagatc

SEQ ID NO: 643497 - DNA, 25 bp, Rattus norvegicus
tgtagacacctgcttccacggctgt

SEQ ID NO: 643498 - DNA, 25 bp, Rattus norvegicus
tgtagacacctggttccacggctgt

SEQ ID NO: 643499 - DNA, 25 bp, Rattus norvegicus
tgtagacagcttagcgaccgaacct

SEQ ID NO: 643500 - DNA, 25 bp, Rattus norvegicus
tgtagacagctttgcgaccgaacct

SEQ ID NO: 643501 - DNA, 25 bp, Rattus norvegicus
tgtagacaggaaacactcatcttgg

SEQ ID NO: 643502 - DNA, 25 bp, Rattus norvegicus
tgtagacaggaatcactcatcttgg

SEQ ID NO: 643503 - DNA, 25 bp, Rattus norvegicus
tgtagaccaaagatgttgcccctct

SEQ ID NO: 643504 - DNA, 25 bp, Rattus norvegicus
tgtagaccaaagttgttgcccctct

SEQ ID NO: 643505 - DNA, 25 bp, Rattus norvegicus
tgtagaccagatccatgcccgagtg

SEQ ID NO: 643506 - DNA, 25 bp, Rattus norvegicus
tgtagaccagatgcatgcccgagtg

SEQ ID NO: 643507 - DNA, 25 bp, Rattus norvegicus
tgtagaccaggcaaatgttgaagat

SEQ ID NO: 643508 - DNA, 25 bp, Rattus norvegicus
tgtagaccaggctaatgttgaagat

SEQ ID NO: 643509 - DNA, 25 bp, Rattus norvegicus
tgtagaccaggtaagtccccagcta

SEQ ID NO: 643510 - DNA, 25 bp, Rattus norvegicus
tgtagaccaggttagtccccagcta

SEQ ID NO: 643511 - DNA, 25 bp, Rattus norvegicus
tgtagaccagtcactgacctcaaat

SEQ ID NO: 643512 - DNA, 25 bp, Rattus norvegicus
tgtagaccagtctctgacctcaaat

SEQ ID NO: 643513 - DNA, 25 bp, Rattus norvegicus
tgtagaccatgccagcctcagactc

SEQ ID NO: 643514 - DNA, 25 bp, Rattus norvegicus
tgtagaccatgcgagcctcagactc

SEQ ID NO: 643515 - DNA, 25 bp, Rattus norvegicus
tgtagacctatcagagtcgcagcca

SEQ ID NO: 643516 - DNA, 25 bp, Rattus norvegicus
tgtagacctatctgagtcgcagcca

SEQ ID NO: 643517 - DNA, 25 bp, Rattus norvegicus
tgtagacctgccaagtgtaccttat

SEQ ID NO: 643518 - DNA, 25 bp, Rattus norvegicus
tgtagacctgcctagtgtaccttat

SEQ ID NO: 643519 - DNA, 25 bp, Rattus norvegicus
tgtagaccttcaatgctgctgactt

SEQ ID NO: 643520 - DNA, 25 bp, Rattus norvegicus
tgtagaccttcattgctgctgactt

SEQ ID NO: 643521 - DNA, 25 bp, Rattus norvegicus
tgtagacgcggtcccctgacctagg

SEQ ID NO: 643522 - DNA, 25 bp, Rattus norvegicus
tgtagacgcggtgccctgacctagg

SEQ ID NO: 643523 - DNA, 25 bp, Rattus norvegicus
tgtagacgtaccaggttttctctgt

SEQ ID NO: 643524 - DNA, 25 bp, Rattus norvegicus
tgtagacgtacctggttttctctgt

SEQ ID NO: 643525 - DNA, 25 bp, Rattus norvegicus
tgtagacgtgttacctgcttctgcc

SEQ ID NO: 643526 - DNA, 25 bp, Rattus norvegicus
tgtagacgtgtttcctgcttctgcc

SEQ ID NO: 643527 - DNA, 25 bp, Rattus norvegicus
tgtagactcagcacagacacacttc

SEQ ID NO: 643528 - DNA, 25 bp, Rattus norvegicus
tgtagactcagctcagacacacttc

SEQ ID NO: 643529 - DNA, 25 bp, Rattus norvegicus
tgtagactccacatgcaggttttgt

SEQ ID NO: 643530 - DNA, 25 bp, Rattus norvegicus
tgtagactccacttgcaggttttgt

SEQ ID NO: 643531 - DNA, 25 bp, Rattus norvegicus
tgtagactccataggaccctctgtc

SEQ ID NO: 643532 - DNA, 25 bp, Rattus norvegicus
tgtagactccattggaccctctgtc

SEQ ID NO: 643533 - DNA, 25 bp, Rattus norvegicus
tgtagactcggcatggtgatttgga

SEQ ID NO: 643534 - DNA, 25 bp, Rattus norvegicus
tgtagactcggcttggtgatttgga

SEQ ID NO: 643535 - DNA, 25 bp, Rattus norvegicus
tgtagactctggaagcctcaaactc

SEQ ID NO: 643536 - DNA, 25 bp, Rattus norvegicus
tgtagactctggtagcctcaaactc

SEQ ID NO: 643537 - DNA, 25 bp, Rattus norvegicus
tgtagactgcataggctttccacac

SEQ ID NO: 643538 - DNA, 25 bp, Rattus norvegicus
tgtagactgcattggctttccacac

SEQ ID NO: 643539 - DNA, 25 bp, Rattus norvegicus
tgtagactgctgctatttctcacgt

SEQ ID NO: 643540 - DNA, 25 bp, Rattus norvegicus
tgtagactgctggtatttctcacgt

SEQ ID NO: 643541 - DNA, 25 bp, Rattus norvegicus
tgtagacttgatcgcctgttcagaa

SEQ ID NO: 643542 - DNA, 25 bp, Rattus norvegicus
tgtagacttgatcgcgagctcctgg

SEQ ID NO: 643543 - DNA, 25 bp, Rattus norvegicus
tgtagacttgatggcctgttcagaa

SEQ ID NO: 643544 - DNA, 25 bp, Rattus norvegicus
tgtagacttgatggcgagctcctgg

SEQ ID NO: 643545 - DNA, 25 bp, Rattus norvegicus
tgtagactttatcttctttccccga

SEQ ID NO: 643546 - DNA, 25 bp, Rattus norvegicus
tgtagactttatgttctttccccga

SEQ ID NO: 643547 - DNA, 25 bp, Rattus norvegicus
tgtagactttgccataaaggcccgc

SEQ ID NO: 643548 - DNA, 25 bp, Rattus norvegicus
tgtagactttgcgataaaggcccgc

SEQ ID NO: 643549 - DNA, 25 bp, Rattus norvegicus
tgtagagaagtcctcacccttggtc

SEQ ID NO: 643550 - DNA, 25 bp, Rattus norvegicus
tgtagagaagtcgtcacccttggtc

SEQ ID NO: 643551 - DNA, 25 bp, Rattus norvegicus
tgtagagacagaccagcctggcact

SEQ ID NO: 643552 - DNA, 25 bp, Rattus norvegicus
tgtagagacagagcagcctggcact

SEQ ID NO: 643553 - DNA, 25 bp, Rattus norvegicus
tgtagagacgcaccaggacctgctg

SEQ ID NO: 643554 - DNA, 25 bp, Rattus norvegicus
tgtagagacgcagcaggacctgctg

SEQ ID NO: 643555 - DNA, 25 bp, Rattus norvegicus
tgtagagactatagtatggaaacat

SEQ ID NO: 643556 - DNA, 25 bp, Rattus norvegicus
tgtagagactattgtatggaaacat

SEQ ID NO: 643557 - DNA, 25 bp, Rattus norvegicus
tgtagagactttaacagctgcctgt

SEQ ID NO: 643558 - DNA, 25 bp, Rattus norvegicus
tgtagagacttttacagctgcctgt

SEQ ID NO: 643559 - DNA, 25 bp, Rattus norvegicus
tgtagagccaggacctgccgagagc

SEQ ID NO: 643560 - DNA, 25 bp, Rattus norvegicus
tgtagagccaggtcctgccgagagc

SEQ ID NO: 643561 - DNA, 25 bp, Rattus norvegicus
tgtagagccctcatgattgctgcct

SEQ ID NO: 643562 - DNA, 25 bp, Rattus norvegicus
tgtagagccctcttgattgctgcct

SEQ ID NO: 643563 - DNA, 25 bp, Rattus norvegicus
tgtagagcgaccagtgtgcaaggcc

SEQ ID NO: 643564 - DNA, 25 bp, Rattus norvegicus
tgtagagcgacctgtgtgcaaggcc

SEQ ID NO: 643565 - DNA, 25 bp, Rattus norvegicus
tgtagagcgcaaacctttgaccaca

SEQ ID NO: 643566 - DNA, 25 bp, Rattus norvegicus
tgtagagcgcaatcctttgaccaca

SEQ ID NO: 643567 - DNA, 25 bp, Rattus norvegicus
tgtagagcgctgatcactggtttct

SEQ ID NO: 643568 - DNA, 25 bp, Rattus norvegicus
tgtagagcgctgttcactggtttct

SEQ ID NO: 643569 - DNA, 25 bp, Rattus norvegicus
tgtagagctcccacacttggaagtt

SEQ ID NO: 643570 - DNA, 25 bp, Rattus norvegicus
tgtagagctccctcacttggaagtt

SEQ ID NO: 643571 - DNA, 25 bp, Rattus norvegicus
tgtagagctgttactttctgtggaa

SEQ ID NO: 643572 - DNA, 25 bp, Rattus norvegicus
tgtagagctgtttctttctgtggaa

SEQ ID NO: 643573 - DNA, 25 bp, Rattus norvegicus
tgtagagctttgagggcccttgcac

SEQ ID NO: 643574 - DNA, 25 bp, Rattus norvegicus
tgtagagctttgtgggcccttgcac

SEQ ID NO: 643575 - DNA, 25 bp, Rattus norvegicus
tgtagaggaaccaggcagtgccgat

SEQ ID NO: 643576 - DNA, 25 bp, Rattus norvegicus
tgtagaggaacctggcagtgccgat

SEQ ID NO: 643577 - DNA, 25 bp, Rattus norvegicus
tgtagagtccaaacaagcccaccca

SEQ ID NO: 643578 - DNA, 25 bp, Rattus norvegicus
tgtagagtccaatcaagcccaccca

SEQ ID NO: 643579 - DNA, 25 bp, Rattus norvegicus
tgtagagtctcaccattggaccttg

SEQ ID NO: 643580 - DNA, 25 bp, Rattus norvegicus
tgtagagtctcagcattggaccttg

SEQ ID NO: 643581 - DNA, 25 bp, Rattus norvegicus
tgtagagtgaaaatgcagtgccctt

SEQ ID NO: 643582 - DNA, 25 bp, Rattus norvegicus
tgtagagtgaaattgcagtgccctt

SEQ ID NO: 643583 - DNA, 25 bp, Rattus norvegicus
tgtagagtgagcaaccctggcctct

SEQ ID NO: 643584 - DNA, 25 bp, Rattus norvegicus
tgtagagtgagctaccctggcctct

SEQ ID NO: 643585 - DNA, 25 bp, Rattus norvegicus
tgtagagtggttacgattcaagaac

SEQ ID NO: 643586 - DNA, 25 bp, Rattus norvegicus
tgtagagtggtttcgattcaagaac

SEQ ID NO: 643587 - DNA, 25 bp, Rattus norvegicus
tgtagagttcagattgtacttgttt

SEQ ID NO: 643588 - DNA, 25 bp, Rattus norvegicus
tgtagagttcagtttgtacttgttt

SEQ ID NO: 643589 - DNA, 25 bp, Rattus norvegicus
tgtagatacactacgtgtcctcggt

SEQ ID NO: 643590 - DNA, 25 bp, Rattus norvegicus
tgtagatacacttcgtgtcctcggt

SEQ ID NO: 643591 - DNA, 25 bp, Rattus norvegicus
tgtagatactctatccatgactccc

SEQ ID NO: 643592 - DNA, 25 bp, Rattus norvegicus
tgtagatactctttccatgactccc

SEQ ID NO: 643593 - DNA, 25 bp, Rattus norvegicus
tgtagatcagggatccaggcgacct

SEQ ID NO: 643594 - DNA, 25 bp, Rattus norvegicus
tgtagatcagggttccaggcgacct

SEQ ID NO: 643595 - DNA, 25 bp, Rattus norvegicus
tgtagatcatctcattgcttttcct

SEQ ID NO: 643596 - DNA, 25 bp, Rattus norvegicus
tgtagatcatctgattgcttttcct

SEQ ID NO: 643597 - DNA, 25 bp, Rattus norvegicus
tgtagatccccgctgggagcctcag

SEQ ID NO: 643598 - DNA, 25 bp, Rattus norvegicus
tgtagatccccggtgggagcctcag

SEQ ID NO: 643599 - DNA, 25 bp, Rattus norvegicus
tgtagatcgatcatgttactctctt

SEQ ID NO: 643600 - DNA, 25 bp, Rattus norvegicus
tgtagatcgatcttgttactctctt

SEQ ID NO: 643601 - DNA, 25 bp, Rattus norvegicus
tgtagatgacccagaggcattcccc

SEQ ID NO: 643602 - DNA, 25 bp, Rattus norvegicus
tgtagatgaccctgaggcattcccc

SEQ ID NO: 643603 - DNA, 25 bp, Rattus norvegicus
tgtagatgactaccccgaggccatg

SEQ ID NO: 643604 - DNA, 25 bp, Rattus norvegicus
tgtagatgactagcccgaggccatg

SEQ ID NO: 643605 - DNA, 25 bp, Rattus norvegicus
tgtagatgagaacacctgctgcacc

SEQ ID NO: 643606 - DNA, 25 bp, Rattus norvegicus
tgtagatgagaagacctgctgcacc

SEQ ID NO: 643607 - DNA, 25 bp, Rattus norvegicus
tgtagatgatgcagccatggccaac

SEQ ID NO: 643608 - DNA, 25 bp, Rattus norvegicus
tgtagatgatgctgccatggccaac

SEQ ID NO: 643609 - DNA, 25 bp, Rattus norvegicus
tgtagatgcctgctgagttcttcca

SEQ ID NO: 643610 - DNA, 25 bp, Rattus norvegicus
tgtagatgcctggtgagttcttcca

SEQ ID NO: 643611 - DNA, 25 bp, Rattus norvegicus
tgtagatgctttccccagcatacct

SEQ ID NO: 643612 - DNA, 25 bp, Rattus norvegicus
tgtagatgctttgcccagcatacct

SEQ ID NO: 643613 - DNA, 25 bp, Rattus norvegicus
tgtagatggtgcaaccaacctccag

SEQ ID NO: 643614 - DNA, 25 bp, Rattus norvegicus
tgtagatggtgctaccaacctccag

SEQ ID NO: 643615 - DNA, 25 bp, Rattus norvegicus
tgtagatgtgagaccagggcagtat

SEQ ID NO: 643616 - DNA, 25 bp, Rattus norvegicus
tgtagatgtgagtccagggcagtat

SEQ ID NO: 643617 - DNA, 25 bp, Rattus norvegicus
tgtagatgtgtcagcctgcgcgagc

SEQ ID NO: 643618 - DNA, 25 bp, Rattus norvegicus
tgtagatgtgtctgcctgcgcgagc

SEQ ID NO: 643619 - DNA, 25 bp, Rattus norvegicus
tgtagattccaaaataagatcctcc

SEQ ID NO: 643620 - DNA, 25 bp, Rattus norvegicus
tgtagattccaatataagatcctcc

SEQ ID NO: 643621 - DNA, 25 bp, Rattus norvegicus
tgtagattgcaacgcccctccagtg

SEQ ID NO: 643622 - DNA, 25 bp, Rattus norvegicus
tgtagattgcaaggcccctccagtg

SEQ ID NO: 643623 - DNA, 25 bp, Rattus norvegicus
tgtagcaaacccacagtacacagtc

SEQ ID NO: 643624 - DNA, 25 bp, Rattus norvegicus
tgtagcaaaccctcagtacacagtc

SEQ ID NO: 643625 - DNA, 25 bp, Rattus norvegicus
tgtagcaaagtaagccaggcctggt

SEQ ID NO: 643626 - DNA, 25 bp, Rattus norvegicus
tgtagcaaagtatgccaggcctggt

SEQ ID NO: 643627 - DNA, 25 bp, Rattus norvegicus
tgtagcaacctgacggtgcaccgga

SEQ ID NO: 643628 - DNA, 25 bp, Rattus norvegicus
tgtagcaacctgtcggtgcaccgga

SEQ ID NO: 643629 - DNA, 25 bp, Rattus norvegicus
tgtagcaacgtgagtcggcatcagt

SEQ ID NO: 643630 - DNA, 25 bp, Rattus norvegicus
tgtagcaacgtgtgtcggcatcagt

SEQ ID NO: 643631 - DNA, 25 bp, Rattus norvegicus
tgtagcaagatgagactgtccccag

SEQ ID NO: 643632 - DNA, 25 bp, Rattus norvegicus
tgtagcaagatgtgactgtccccag

SEQ ID NO: 643633 - DNA, 25 bp, Rattus norvegicus
tgtagcaatcctaccaatgctgcct

SEQ ID NO: 643634 - DNA, 25 bp, Rattus norvegicus
tgtagcaatccttccaatgctgcct

SEQ ID NO: 643635 - DNA, 25 bp, Rattus norvegicus
tgtagcacagttcatctaggccgca

SEQ ID NO: 643636 - DNA, 25 bp, Rattus norvegicus
tgtagcacagttgatctaggccgca

SEQ ID NO: 643637 - DNA, 25 bp, Rattus norvegicus
tgtagcaccatcaccagtttcaagt

SEQ ID NO: 643638 - DNA, 25 bp, Rattus norvegicus
tgtagcaccatctccagtttcaagt

SEQ ID NO: 643639 - DNA, 25 bp, Rattus norvegicus
tgtagcagaccacggtcagttccca

SEQ ID NO: 643640 - DNA, 25 bp, Rattus norvegicus
tgtagcagaccagggtcagttccca

SEQ ID NO: 643641 - DNA, 25 bp, Rattus norvegicus
tgtagcagctatagattcctccttg

SEQ ID NO: 643642 - DNA, 25 bp, Rattus norvegicus
tgtagcagctattgattcctccttg

SEQ ID NO: 643643 - DNA, 25 bp, Rattus norvegicus
tgtagcagctttagattccctgcat

SEQ ID NO: 643644 - DNA, 25 bp, Rattus norvegicus
tgtagcagcttttgattccctgcat

SEQ ID NO: 643645 - DNA, 25 bp, Rattus norvegicus
tgtagcaggaggaagggccacccca

SEQ ID NO: 643646 - DNA, 25 bp, Rattus norvegicus
tgtagcaggaggtagggccacccca

SEQ ID NO: 643647 - DNA, 25 bp, Rattus norvegicus
tgtagcaggctccaaaatcgtcacc

SEQ ID NO: 643648 - DNA, 25 bp, Rattus norvegicus
tgtagcaggctcgaaaatcgtcacc

SEQ ID NO: 643649 - DNA, 25 bp, Rattus norvegicus
tgtagcagtgccctagaaatggtag

SEQ ID NO: 643650 - DNA, 25 bp, Rattus norvegicus
tgtagcagtgccgtagaaatggtag

SEQ ID NO: 643651 - DNA, 25 bp, Rattus norvegicus
tgtagcatagagcttggctgtcccc

SEQ ID NO: 643652 - DNA, 25 bp, Rattus norvegicus
tgtagcatagaggttggctgtcccc

SEQ ID NO: 643653 - DNA, 25 bp, Rattus norvegicus
tgtagcatagctactgtctcagatg

SEQ ID NO: 643654 - DNA, 25 bp, Rattus norvegicus
tgtagcatagcttctgtctcagatg

SEQ ID NO: 643655 - DNA, 25 bp, Rattus norvegicus
tgtagcatcatgcagtgccatactg

SEQ ID NO: 643656 - DNA, 25 bp, Rattus norvegicus
tgtagcatcatggagtgccatactg

SEQ ID NO: 643657 - DNA, 25 bp, Rattus norvegicus
tgtagcatccccagtgggtatcact

SEQ ID NO: 643658 - DNA, 25 bp, Rattus norvegicus
tgtagcatcccctgtgggtatcact

SEQ ID NO: 643659 - DNA, 25 bp, Rattus norvegicus
tgtagcatgcatcattccgtggctg

SEQ ID NO: 643660 - DNA, 25 bp, Rattus norvegicus
tgtagcatgcatgattccgtggctg

SEQ ID NO: 643661 - DNA, 25 bp, Rattus norvegicus
tgtagcatgcttaaggtccacccta

SEQ ID NO: 643662 - DNA, 25 bp, Rattus norvegicus
tgtagcatgctttaggtccacccta

SEQ ID NO: 643663 - DNA, 25 bp, Rattus norvegicus
tgtagcattcacaatgggccgctca

SEQ ID NO: 643664 - DNA, 25 bp, Rattus norvegicus
tgtagcattcactatgggccgctca

SEQ ID NO: 643665 - DNA, 25 bp, Rattus norvegicus
tgtagcattctgcagctctctagct

SEQ ID NO: 643666 - DNA, 25 bp, Rattus norvegicus
tgtagcattctggagctctctagct

SEQ ID NO: 643667 - DNA, 25 bp, Rattus norvegicus
tgtagccaacgtcggtggaacctta

SEQ ID NO: 643668 - DNA, 25 bp, Rattus norvegicus
tgtagccaacgtgggtggaacctta

SEQ ID NO: 643669 - DNA, 25 bp, Rattus norvegicus
tgtagccaatgacccacctgcagaa

SEQ ID NO: 643670 - DNA, 25 bp, Rattus norvegicus
tgtagccaatgagccacctgcagaa

SEQ ID NO: 643671 - DNA, 25 bp, Rattus norvegicus
tgtagccaccaacagactaataaag

SEQ ID NO: 643672 - DNA, 25 bp, Rattus norvegicus
tgtagccaccaagagactaataaag

SEQ ID NO: 643673 - DNA, 25 bp, Rattus norvegicus
tgtagccaccccaaatttcatttta

SEQ ID NO: 643674 - DNA, 25 bp, Rattus norvegicus
tgtagccacccctaatttcatttta

SEQ ID NO: 643675 - DNA, 25 bp, Rattus norvegicus
tgtagccagcacactgcgtgcacat

SEQ ID NO: 643676 - DNA, 25 bp, Rattus norvegicus
tgtagccagcactctgcgtgcacat

SEQ ID NO: 643677 - DNA, 25 bp, Rattus norvegicus
tgtagccagcttagagtcctcgtag

SEQ ID NO: 643678 - DNA, 25 bp, Rattus norvegicus
tgtagccagctttgagtcctcgtag

SEQ ID NO: 643679 - DNA, 25 bp, Rattus norvegicus
tgtagccaggttacccagtggtctc

SEQ ID NO: 643680 - DNA, 25 bp, Rattus norvegicus
tgtagccaggtttcccagtggtctc

SEQ ID NO: 643681 - DNA, 25 bp, Rattus norvegicus
tgtagccatgtgacagcctcccggc

SEQ ID NO: 643682 - DNA, 25 bp, Rattus norvegicus
tgtagccatgtgtcagcctcccggc

SEQ ID NO: 643683 - DNA, 25 bp, Rattus norvegicus
tgtagcccaccaccgtgaactgaag

SEQ ID NO: 643684 - DNA, 25 bp, Rattus norvegicus
tgtagcccaccagcgtgaactgaag

SEQ ID NO: 643685 - DNA, 25 bp, Rattus norvegicus
tgtagcccagaaagagcgctttgat

SEQ ID NO: 643686 - DNA, 25 bp, Rattus norvegicus
tgtagcccagaatgagcgctttgat

SEQ ID NO: 643687 - DNA, 25 bp, Rattus norvegicus
tgtagcccaggaaggcctaggactc

SEQ ID NO: 643688 - DNA, 25 bp, Rattus norvegicus
tgtagcccaggaccagacaggagat

SEQ ID NO: 643689 - DNA, 25 bp, Rattus norvegicus
tgtagcccaggagcagacaggagat

SEQ ID NO: 643690 - DNA, 25 bp, Rattus norvegicus
tgtagcccaggatggcctaggactc

SEQ ID NO: 643691 - DNA, 25 bp, Rattus norvegicus
tgtagcccagttccatcaagaagtt

SEQ ID NO: 643692 - DNA, 25 bp, Rattus norvegicus
tgtagcccagttgcatcaagaagtt

SEQ ID NO: 643693 - DNA, 25 bp, Rattus norvegicus
tgtagcccatacaagtccctaatgt

SEQ ID NO: 643694 - DNA, 25 bp, Rattus norvegicus
tgtagcccatactagtccctaatgt

SEQ ID NO: 643695 - DNA, 25 bp, Rattus norvegicus
tgtagccccacactgataacccagt

SEQ ID NO: 643696 - DNA, 25 bp, Rattus norvegicus
tgtagccccacagtgataacccagt

SEQ ID NO: 643697 - DNA, 25 bp, Rattus norvegicus
tgtagccccgcgcagccaatgagct

SEQ ID NO: 643698 - DNA, 25 bp, Rattus norvegicus
tgtagccccgcggagccaatgagct

SEQ ID NO: 643699 - DNA, 25 bp, Rattus norvegicus
tgtagcccctgcagtctgaaagtta

SEQ ID NO: 643700 - DNA, 25 bp, Rattus norvegicus
tgtagcccctgctgtctgaaagtta

SEQ ID NO: 643701 - DNA, 25 bp, Rattus norvegicus
tgtagcccggtaagtccagagacga

SEQ ID NO: 643702 - DNA, 25 bp, Rattus norvegicus
tgtagcccggtatgtccagagacga

SEQ ID NO: 643703 - DNA, 25 bp, Rattus norvegicus
tgtagccctcccctaatggttgaac

SEQ ID NO: 643704 - DNA, 25 bp, Rattus norvegicus
tgtagccctcccgtaatggttgaac

SEQ ID NO: 643705 - DNA, 25 bp, Rattus norvegicus
tgtagccctggtcggaatctggaaa

SEQ ID NO: 643706 - DNA, 25 bp, Rattus norvegicus
tgtagccctggtgggaatctggaaa

SEQ ID NO: 643707 - DNA, 25 bp, Rattus norvegicus
tgtagcccttgcactgttgcccgtt

SEQ ID NO: 643708 - DNA, 25 bp, Rattus norvegicus
tgtagcccttgctctgttgcccgtt

SEQ ID NO: 643709 - DNA, 25 bp, Rattus norvegicus
tgtagccgagtgcatcattaggatt

SEQ ID NO: 643710 - DNA, 25 bp, Rattus norvegicus
tgtagccgagtggatcattaggatt

SEQ ID NO: 643711 - DNA, 25 bp, Rattus norvegicus
tgtagccgcttcctaattattttgg

SEQ ID NO: 643712 - DNA, 25 bp, Rattus norvegicus
tgtagccgcttcgtaattattttgg

SEQ ID NO: 643713 - DNA, 25 bp, Rattus norvegicus
tgtagccggaagatctcgctcccag

SEQ ID NO: 643714 - DNA, 25 bp, Rattus norvegicus
tgtagccggaagttctcgctcccag

SEQ ID NO: 643715 - DNA, 25 bp, Rattus norvegicus
tgtagccggtcacctatcttttctt

SEQ ID NO: 643716 - DNA, 25 bp, Rattus norvegicus
tgtagccggtcagctatcttttctt

SEQ ID NO: 643717 - DNA, 25 bp, Rattus norvegicus
tgtagccgtcataagaactgttgtg

SEQ ID NO: 643718 - DNA, 25 bp, Rattus norvegicus
tgtagccgtcattagaactgttgtg

SEQ ID NO: 643719 - DNA, 25 bp, Rattus norvegicus
tgtagcctcaatactggagcagata

SEQ ID NO: 643720 - DNA, 25 bp, Rattus norvegicus
tgtagcctcaattctggagcagata

SEQ ID NO: 643721 - DNA, 25 bp, Rattus norvegicus
tgtagcctcctaaccaagagagcag

SEQ ID NO: 643722 - DNA, 25 bp, Rattus norvegicus
tgtagcctcctatccaagagagcag

SEQ ID NO: 643723 - DNA, 25 bp, Rattus norvegicus
tgtagcctcttactgtctgatctat

SEQ ID NO: 643724 - DNA, 25 bp, Rattus norvegicus
tgtagcctcttagtgtctgatctat

SEQ ID NO: 643725 - DNA, 25 bp, Rattus norvegicus
tgtagcctgaacctgtggactcgca

SEQ ID NO: 643726 - DNA, 25 bp, Rattus norvegicus
tgtagcctgaacgtgtggactcgca

SEQ ID NO: 643727 - DNA, 25 bp, Rattus norvegicus
tgtagcctgagaaaacctgtcccca

SEQ ID NO: 643728 - DNA, 25 bp, Rattus norvegicus
tgtagcctgagataacctgtcccca

SEQ ID NO: 643729 - DNA, 25 bp, Rattus norvegicus
tgtagcctgcccctgtatcatacac

SEQ ID NO: 643730 - DNA, 25 bp, Rattus norvegicus
tgtagcctgcccgtgtatcatacac

SEQ ID NO: 643731 - DNA, 25 bp, Rattus norvegicus
tgtagcctgcctattagccagatag

SEQ ID NO: 643732 - DNA, 25 bp, Rattus norvegicus
tgtagcctgccttttagccagatag

SEQ ID NO: 643733 - DNA, 25 bp, Rattus norvegicus
tgtagcctgggcaagttctggtcac

SEQ ID NO: 643734 - DNA, 25 bp, Rattus norvegicus
tgtagcctgggctagttctggtcac

SEQ ID NO: 643735 - DNA, 25 bp, Rattus norvegicus
tgtagccttcatctcaacagaaccc

SEQ ID NO: 643736 - DNA, 25 bp, Rattus norvegicus
tgtagccttcatgtcaacagaaccc

SEQ ID NO: 643737 - DNA, 25 bp, Rattus norvegicus
tgtagccttctgagctgctgtggaa

SEQ ID NO: 643738 - DNA, 25 bp, Rattus norvegicus
tgtagccttctgtgctgctgtggaa

SEQ ID NO: 643739 - DNA, 25 bp, Rattus norvegicus
tgtagccttttcacgagtcaagtgg

SEQ ID NO: 643740 - DNA, 25 bp, Rattus norvegicus
tgtagccttttcacttccaaatgga

SEQ ID NO: 643741 - DNA, 25 bp, Rattus norvegicus
tgtagccttttctcgagtcaagtgg

SEQ ID NO: 643742 - DNA, 25 bp, Rattus norvegicus
tgtagccttttctcttccaaatgga

SEQ ID NO: 643743 - DNA, 25 bp, Rattus norvegicus
tgtagcgactgtcgcctgaatctca

SEQ ID NO: 643744 - DNA, 25 bp, Rattus norvegicus
tgtagcgactgtggcctgaatctca

SEQ ID NO: 643745 - DNA, 25 bp, Rattus norvegicus
tgtagcgagatcacgtcccgagagc

SEQ ID NO: 643746 - DNA, 25 bp, Rattus norvegicus
tgtagcgagatctcgtcccgagagc

SEQ ID NO: 643747 - DNA, 25 bp, Rattus norvegicus
tgtagcgaggcacctgccacagagt

SEQ ID NO: 643748 - DNA, 25 bp, Rattus norvegicus
tgtagcgaggcagctgccacagagt

SEQ ID NO: 643749 - DNA, 25 bp, Rattus norvegicus
tgtagcgagtgaactgcaaaccagg

SEQ ID NO: 643750 - DNA, 25 bp, Rattus norvegicus
tgtagcgagtgatctgcaaaccagg

SEQ ID NO: 643751 - DNA, 25 bp, Rattus norvegicus
tgtagcgccccgagcaggtcgaagt

SEQ ID NO: 643752 - DNA, 25 bp, Rattus norvegicus
tgtagcgccccgtgcaggtcgaagt

SEQ ID NO: 643753 - DNA, 25 bp, Rattus norvegicus
tgtagcgctgtgacaccacatgaga

SEQ ID NO: 643754 - DNA, 25 bp, Rattus norvegicus
tgtagcgctgtgtcaccacatgaga

SEQ ID NO: 643755 - DNA, 25 bp, Rattus norvegicus
tgtagcggctctcctctgatgacaa

SEQ ID NO: 643756 - DNA, 25 bp, Rattus norvegicus
tgtagcggctctgctctgatgacaa

SEQ ID NO: 643757 - DNA, 25 bp, Rattus norvegicus
tgtagcggtagtatgcagttctagc

SEQ ID NO: 643758 - DNA, 25 bp, Rattus norvegicus
tgtagcggtagtttgcagttctagc

SEQ ID NO: 643759 - DNA, 25 bp, Rattus norvegicus
tgtagcgtaattctgcttcttacag

SEQ ID NO: 643760 - DNA, 25 bp, Rattus norvegicus
tgtagcgtaattgtgcttcttacag

SEQ ID NO: 643761 - DNA, 25 bp, Rattus norvegicus
tgtagcgttcggatctagtttccac

SEQ ID NO: 643762 - DNA, 25 bp, Rattus norvegicus
tgtagcgttcggttctagtttccac

SEQ ID NO: 643763 - DNA, 25 bp, Rattus norvegicus
tgtagctattagaggctcttcgccc

SEQ ID NO: 643764 - DNA, 25 bp, Rattus norvegicus
tgtagctattagtggctcttcgccc

SEQ ID NO: 643765 - DNA, 25 bp, Rattus norvegicus
tgtagctcagctcccttaattttaa

SEQ ID NO: 643766 - DNA, 25 bp, Rattus norvegicus
tgtagctcagctgccttaattttaa

SEQ ID NO: 643767 - DNA, 25 bp, Rattus norvegicus
tgtagctcatggcaagtccaccgtg

SEQ ID NO: 643768 - DNA, 25 bp, Rattus norvegicus
tgtagctcatgggaagtccaccgtg

SEQ ID NO: 643769 - DNA, 25 bp, Rattus norvegicus
tgtagctcctggcaaacgtttccgg

SEQ ID NO: 643770 - DNA, 25 bp, Rattus norvegicus
tgtagctcctgggaaacgtttccgg

SEQ ID NO: 643771 - DNA, 25 bp, Rattus norvegicus
tgtagctcgaggcattatccttcct

SEQ ID NO: 643772 - DNA, 25 bp, Rattus norvegicus
tgtagctcgagggattatccttcct

SEQ ID NO: 643773 - DNA, 25 bp, Rattus norvegicus
tgtagctctggtaacacgtccacgg

SEQ ID NO: 643774 - DNA, 25 bp, Rattus norvegicus
tgtagctctggtccctcagagataa

SEQ ID NO: 643775 - DNA, 25 bp, Rattus norvegicus
tgtagctctggtgcctcagagataa

SEQ ID NO: 643776 - DNA, 25 bp, Rattus norvegicus
tgtagctctggttacacgtccacgg

SEQ ID NO: 643777 - DNA, 25 bp, Rattus norvegicus
tgtagctgagaacgtggaaccccac

SEQ ID NO: 643778 - DNA, 25 bp, Rattus norvegicus
tgtagctgagaaggtggaaccccac

SEQ ID NO: 643779 - DNA, 25 bp, Rattus norvegicus
tgtagctgatgaaccgaataactac

SEQ ID NO: 643780 - DNA, 25 bp, Rattus norvegicus
tgtagctgatgatccgaataactac

SEQ ID NO: 643781 - DNA, 25 bp, Rattus norvegicus
tgtagctgctgtccagaggcatagc

SEQ ID NO: 643782 - DNA, 25 bp, Rattus norvegicus
tgtagctgctgtgcagaggcatagc

SEQ ID NO: 643783 - DNA, 25 bp, Rattus norvegicus
tgtagctgtgaactccattaaaaaa

SEQ ID NO: 643784 - DNA, 25 bp, Rattus norvegicus
tgtagctgtgaagtccattaaaaaa

SEQ ID NO: 643785 - DNA, 25 bp, Rattus norvegicus
tgtagctgtgctcccttaaactgaa

SEQ ID NO: 643786 - DNA, 25 bp, Rattus norvegicus
tgtagctgtgctgccttaaactgaa

SEQ ID NO: 643787 - DNA, 25 bp, Rattus norvegicus
tgtagcttatttacctgtcccctaa

SEQ ID NO: 643788 - DNA, 25 bp, Rattus norvegicus
tgtagcttattttcctgtcccctaa

SEQ ID NO: 643789 - DNA, 25 bp, Rattus norvegicus
tgtagcttcacgctgctcattcctt

SEQ ID NO: 643790 - DNA, 25 bp, Rattus norvegicus
tgtagcttcacggtgctcattcctt

SEQ ID NO: 643791 - DNA, 25 bp, Rattus norvegicus
tgtagcttcagtcccaggatatctg

SEQ ID NO: 643792 - DNA, 25 bp, Rattus norvegicus
tgtagcttcagtgccaggatatctg

SEQ ID NO: 643793 - DNA, 25 bp, Rattus norvegicus
tgtagcttcgtgatgcctgtcctga

SEQ ID NO: 643794 - DNA, 25 bp, Rattus norvegicus
tgtagcttcgtgttgcctgtcctga

SEQ ID NO: 643795 - DNA, 25 bp, Rattus norvegicus
tgtagcttctacattatgccaacct

SEQ ID NO: 643796 - DNA, 25 bp, Rattus norvegicus
tgtagcttctactttatgccaacct

SEQ ID NO: 643797 - DNA, 25 bp, Rattus norvegicus
tgtagcttgataaaccagggatggt

SEQ ID NO: 643798 - DNA, 25 bp, Rattus norvegicus
tgtagcttgatataccagggatggt

SEQ ID NO: 643799 - DNA, 25 bp, Rattus norvegicus
tgtagcttgctccattcctgcattc

SEQ ID NO: 643800 - DNA, 25 bp, Rattus norvegicus
tgtagcttgctcgattcctgcattc

SEQ ID NO: 643801 - DNA, 25 bp, Rattus norvegicus
tgtagctttagtagccctctgaggg

SEQ ID NO: 643802 - DNA, 25 bp, Rattus norvegicus
tgtagctttagttgccctctgaggg

SEQ ID NO: 643803 - DNA, 25 bp, Rattus norvegicus
tgtagctttattctgccttgcaata

SEQ ID NO: 643804 - DNA, 25 bp, Rattus norvegicus
tgtagctttattgtgccttgcaata

SEQ ID NO: 643805 - DNA, 25 bp, Rattus norvegicus
tgtagcttttctagtattcctttaa

SEQ ID NO: 643806 - DNA, 25 bp, Rattus norvegicus
tgtagcttttcttgtattcctttaa

SEQ ID NO: 643807 - DNA, 25 bp, Rattus norvegicus
tgtaggaaagtgaggcatctggtct

SEQ ID NO: 643808 - DNA, 25 bp, Rattus norvegicus
tgtaggaaagtgtggcatctggtct

SEQ ID NO: 643809 - DNA, 25 bp, Rattus norvegicus
tgtaggaacgcccactgcaggaaac

SEQ ID NO: 643810 - DNA, 25 bp, Rattus norvegicus
tgtaggaacgccgactgcaggaaac

SEQ ID NO: 643811 - DNA, 25 bp, Rattus norvegicus
tgtaggacagtcctcttcaagtgcc

SEQ ID NO: 643812 - DNA, 25 bp, Rattus norvegicus
tgtaggacagtcgtcttcaagtgcc

SEQ ID NO: 643813 - DNA, 25 bp, Rattus norvegicus
tgtaggaccctaagccttctccagg

SEQ ID NO: 643814 - DNA, 25 bp, Rattus norvegicus
tgtaggaccctatgccttctccagg

SEQ ID NO: 643815 - DNA, 25 bp, Rattus norvegicus
tgtaggactgccaattttacccttt

SEQ ID NO: 643816 - DNA, 25 bp, Rattus norvegicus
tgtaggactgcctattttacccttt

SEQ ID NO: 643817 - DNA, 25 bp, Rattus norvegicus
tgtaggataaacacttctcctcaga

SEQ ID NO: 643818 - DNA, 25 bp, Rattus norvegicus
tgtaggataaactcttctcctcaga

SEQ ID NO: 643819 - DNA, 25 bp, Rattus norvegicus
tgtaggatgctcctgggcctaatac

SEQ ID NO: 643820 - DNA, 25 bp, Rattus norvegicus
tgtaggatgctcgtgggcctaatac

SEQ ID NO: 643821 - DNA, 25 bp, Rattus norvegicus
tgtaggcaatgtacagcccagtctg

SEQ ID NO: 643822 - DNA, 25 bp, Rattus norvegicus
tgtaggcaatgttcagcccagtctg

SEQ ID NO: 643823 - DNA, 25 bp, Rattus norvegicus
tgtaggcacggcactcttggaatag

SEQ ID NO: 643824 - DNA, 25 bp, Rattus norvegicus
tgtaggcacggctctcttggaatag

SEQ ID NO: 643825 - DNA, 25 bp, Rattus norvegicus
tgtaggcagaatcgctgcagcctcc

SEQ ID NO: 643826 - DNA, 25 bp, Rattus norvegicus
tgtaggcagaatggctgcagcctcc

SEQ ID NO: 643827 - DNA, 25 bp, Rattus norvegicus
tgtaggcagacacgcagtaaccagt

SEQ ID NO: 643828 - DNA, 25 bp, Rattus norvegicus
tgtaggcagacaggcagtaaccagt

SEQ ID NO: 643829 - DNA, 25 bp, Rattus norvegicus
tgtaggcaggtacaaaggacccttt

SEQ ID NO: 643830 - DNA, 25 bp, Rattus norvegicus
tgtaggcaggtagaaaggacccttt

SEQ ID NO: 643831 - DNA, 25 bp, Rattus norvegicus
tgtaggcagtacacagagcccctgt

SEQ ID NO: 643832 - DNA, 25 bp, Rattus norvegicus
tgtaggcagtactcagagcccctgt

SEQ ID NO: 643833 - DNA, 25 bp, Rattus norvegicus
tgtaggccacgtcgcaaacctcaag

SEQ ID NO: 643834 - DNA, 25 bp, Rattus norvegicus
tgtaggccacgtggcaaacctcaag

SEQ ID NO: 643835 - DNA, 25 bp, Rattus norvegicus
tgtaggccagctaggatcacatagg

SEQ ID NO: 643836 - DNA, 25 bp, Rattus norvegicus
tgtaggccagcttggatcacatagg

SEQ ID NO: 643837 - DNA, 25 bp, Rattus norvegicus
tgtaggccccttatcaaggaatcaa

SEQ ID NO: 643838 - DNA, 25 bp, Rattus norvegicus
tgtaggccccttttcaaggaatcaa

SEQ ID NO: 643839 - DNA, 25 bp, Rattus norvegicus
tgtaggcccgacacgtggcacccag

SEQ ID NO: 643840 - DNA, 25 bp, Rattus norvegicus
tgtaggcccgactcgtggcacccag

SEQ ID NO: 643841 - DNA, 25 bp, Rattus norvegicus
tgtaggccggacatcatagcaaccc

SEQ ID NO: 643842 - DNA, 25 bp, Rattus norvegicus
tgtaggccggacttcatagcaaccc

SEQ ID NO: 643843 - DNA, 25 bp, Rattus norvegicus
tgtaggcctactatcccaacgtcaa

SEQ ID NO: 643844 - DNA, 25 bp, Rattus norvegicus
tgtaggcctactttcccaacgtcaa

SEQ ID NO: 643845 - DNA, 25 bp, Rattus norvegicus
tgtaggcctggcactcaggagactg

SEQ ID NO: 643846 - DNA, 25 bp, Rattus norvegicus
tgtaggcctggctctcaggagactg

SEQ ID NO: 643847 - DNA, 25 bp, Rattus norvegicus
tgtaggccttcgcttcgctcttgtc

SEQ ID NO: 643848 - DNA, 25 bp, Rattus norvegicus
tgtaggccttcggttcgctcttgtc

SEQ ID NO: 643849 - DNA, 25 bp, Rattus norvegicus
tgtaggcctttgctattcaaagccc

SEQ ID NO: 643850 - DNA, 25 bp, Rattus norvegicus
tgtaggcctttggtattcaaagccc

SEQ ID NO: 643851 - DNA, 25 bp, Rattus norvegicus
tgtaggcgatttcactaggctcctc

SEQ ID NO: 643852 - DNA, 25 bp, Rattus norvegicus
tgtaggcgatttgactaggctcctc

SEQ ID NO: 643853 - DNA, 25 bp, Rattus norvegicus
tgtaggctattaccgggaagaccac

SEQ ID NO: 643854 - DNA, 25 bp, Rattus norvegicus
tgtaggctattagcgggaagaccac

SEQ ID NO: 643855 - DNA, 25 bp, Rattus norvegicus
tgtaggctcgccctgctgcgtgcca

SEQ ID NO: 643856 - DNA, 25 bp, Rattus norvegicus
tgtaggctcgccgtgctgcgtgcca

SEQ ID NO: 643857 - DNA, 25 bp, Rattus norvegicus
tgtaggctggccactgagtcagact

SEQ ID NO: 643858 - DNA, 25 bp, Rattus norvegicus
tgtaggctggcctctgagtcagact

SEQ ID NO: 643859 - DNA, 25 bp, Rattus norvegicus
tgtaggctgtagactgtttctggat

SEQ ID NO: 643860 - DNA, 25 bp, Rattus norvegicus
tgtaggctgtagtctgtttctggat

SEQ ID NO: 643861 - DNA, 25 bp, Rattus norvegicus
tgtaggcttaacacttctatgcagt

SEQ ID NO: 643862 - DNA, 25 bp, Rattus norvegicus
tgtaggcttaactcttctatgcagt

SEQ ID NO: 643863 - DNA, 25 bp, Rattus norvegicus
tgtaggcttctgcatgtctggctgc

SEQ ID NO: 643864 - DNA, 25 bp, Rattus norvegicus
tgtaggcttctggatgtctggctgc

SEQ ID NO: 643865 - DNA, 25 bp, Rattus norvegicus
tgtagggattgaccgccagcctctg

SEQ ID NO: 643866 - DNA, 25 bp, Rattus norvegicus
tgtagggattgagcgccagcctctg

SEQ ID NO: 643867 - DNA, 25 bp, Rattus norvegicus
tgtagggcctttattcttagcgtat

SEQ ID NO: 643868 - DNA, 25 bp, Rattus norvegicus
tgtagggccttttttcttagcgtat

SEQ ID NO: 643869 - DNA, 25 bp, Rattus norvegicus
tgtagggcttgcatggcaggttcta

SEQ ID NO: 643870 - DNA, 25 bp, Rattus norvegicus
tgtagggcttgcttggcaggttcta

SEQ ID NO: 643871 - DNA, 25 bp, Rattus norvegicus
tgtagggtctgtactaaaccccaat

SEQ ID NO: 643872 - DNA, 25 bp, Rattus norvegicus
tgtagggtctgttctaaaccccaat

SEQ ID NO: 643873 - DNA, 25 bp, Rattus norvegicus
tgtagggttcctaccgcatcgccat

SEQ ID NO: 643874 - DNA, 25 bp, Rattus norvegicus
tgtagggttccttccgcatcgccat

SEQ ID NO: 643875 - DNA, 25 bp, Rattus norvegicus
tgtaggtaaagaccgctcaggttta

SEQ ID NO: 643876 - DNA, 25 bp, Rattus norvegicus
tgtaggtaaagagcgctcaggttta

SEQ ID NO: 643877 - DNA, 25 bp, Rattus norvegicus
tgtaggtaactcctggactaagact

SEQ ID NO: 643878 - DNA, 25 bp, Rattus norvegicus
tgtaggtaactcgtggactaagact

SEQ ID NO: 643879 - DNA, 25 bp, Rattus norvegicus
tgtaggtacagcatctcatcctgat

SEQ ID NO: 643880 - DNA, 25 bp, Rattus norvegicus
tgtaggtacagcttctcatcctgat

SEQ ID NO: 643881 - DNA, 25 bp, Rattus norvegicus
tgtaggtaccctcctatactcctag

SEQ ID NO: 643882 - DNA, 25 bp, Rattus norvegicus
tgtaggtaccctgctatactcctag

SEQ ID NO: 643883 - DNA, 25 bp, Rattus norvegicus
tgtaggtacttcatggtttggcggc

SEQ ID NO: 643884 - DNA, 25 bp, Rattus norvegicus
tgtaggtacttcttggtttggcggc

SEQ ID NO: 643885 - DNA, 25 bp, Rattus norvegicus
tgtaggtaggccagtgccgcaaaca

SEQ ID NO: 643886 - DNA, 25 bp, Rattus norvegicus
tgtaggtaggcctgtgccgcaaaca

SEQ ID NO: 643887 - DNA, 25 bp, Rattus norvegicus
tgtaggtcatctacctcagtgactc

SEQ ID NO: 643888 - DNA, 25 bp, Rattus norvegicus
tgtaggtcatcttcctcagtgactc

SEQ ID NO: 643889 - DNA, 25 bp, Rattus norvegicus
tgtaggtcattcctcaggtcctcca

SEQ ID NO: 643890 - DNA, 25 bp, Rattus norvegicus
tgtaggtcattcgtcaggtcctcca

SEQ ID NO: 643891 - DNA, 25 bp, Rattus norvegicus
tgtaggtccctcagggacagtcacc

SEQ ID NO: 643892 - DNA, 25 bp, Rattus norvegicus
tgtaggtccctctgggacagtcacc

SEQ ID NO: 643893 - DNA, 25 bp, Rattus norvegicus
tgtaggtcctggcattggtccaaga

SEQ ID NO: 643894 - DNA, 25 bp, Rattus norvegicus
tgtaggtcctgggattggtccaaga

SEQ ID NO: 643895 - DNA, 25 bp, Rattus norvegicus
tgtaggtggctccatgggcccaacc

SEQ ID NO: 643896 - DNA, 25 bp, Rattus norvegicus
tgtaggtggctcgatgggcccaacc

SEQ ID NO: 643897 - DNA, 25 bp, Rattus norvegicus
tgtaggttccctagtcgtgacaaat

SEQ ID NO: 643898 - DNA, 25 bp, Rattus norvegicus
tgtaggttcccttgtcgtgacaaat

SEQ ID NO: 643899 - DNA, 25 bp, Rattus norvegicus
tgtagtaaaggcaagctcgcgggct

SEQ ID NO: 643900 - DNA, 25 bp, Rattus norvegicus
tgtagtaaaggctagctcgcgggct

SEQ ID NO: 643901 - DNA, 25 bp, Rattus norvegicus
tgtagtaaatacacactccccaagc

SEQ ID NO: 643902 - DNA, 25 bp, Rattus norvegicus
tgtagtaaatactcactccccaagc

SEQ ID NO: 643903 - DNA, 25 bp, Rattus norvegicus
tgtagtaacttcaccatgctctgaa

SEQ ID NO: 643904 - DNA, 25 bp, Rattus norvegicus
tgtagtaacttctccatgctctgaa

SEQ ID NO: 643905 - DNA, 25 bp, Rattus norvegicus
tgtagtaatctgaacgtcctgctta

SEQ ID NO: 643906 - DNA, 25 bp, Rattus norvegicus
tgtagtaatctgtacgtcctgctta

SEQ ID NO: 643907 - DNA, 25 bp, Rattus norvegicus
tgtagtaccaacacgcccctgtatg

SEQ ID NO: 643908 - DNA, 25 bp, Rattus norvegicus
tgtagtaccaacagaagtgccgact

SEQ ID NO: 643909 - DNA, 25 bp, Rattus norvegicus
tgtagtaccaactcgcccctgtatg

SEQ ID NO: 643910 - DNA, 25 bp, Rattus norvegicus
tgtagtaccaactgaagtgccgact

SEQ ID NO: 643911 - DNA, 25 bp, Rattus norvegicus
tgtagtaccgaaaagtatgctgttt

SEQ ID NO: 643912 - DNA, 25 bp, Rattus norvegicus
tgtagtaccgaatagtatgctgttt

SEQ ID NO: 643913 - DNA, 25 bp, Rattus norvegicus
tgtagtagaagcctgccattccgct

SEQ ID NO: 643914 - DNA, 25 bp, Rattus norvegicus
tgtagtagaagcgtgccattccgct

SEQ ID NO: 643915 - DNA, 25 bp, Rattus norvegicus
tgtagtagatgacacagaccctgct

SEQ ID NO: 643916 - DNA, 25 bp, Rattus norvegicus
tgtagtagatgagacagaccctgct

SEQ ID NO: 643917 - DNA, 25 bp, Rattus norvegicus
tgtagtagcctaccagattcctcag

SEQ ID NO: 643918 - DNA, 25 bp, Rattus norvegicus
tgtagtagcctagcagattcctcag

SEQ ID NO: 643919 - DNA, 25 bp, Rattus norvegicus
tgtagtagccttacacttcctaaag

SEQ ID NO: 643920 - DNA, 25 bp, Rattus norvegicus
tgtagtagcctttcacttcctaaag

SEQ ID NO: 643921 - DNA, 25 bp, Rattus norvegicus
tgtagtaggagaccatgcagatgat

SEQ ID NO: 643922 - DNA, 25 bp, Rattus norvegicus
tgtagtaggagagcatgcagatgat

SEQ ID NO: 643923 - DNA, 25 bp, Rattus norvegicus
tgtagtatactcctgaagcgggaca

SEQ ID NO: 643924 - DNA, 25 bp, Rattus norvegicus
tgtagtatactcgtgaagcgggaca

SEQ ID NO: 643925 - DNA, 25 bp, Rattus norvegicus
tgtagtatccagatttccgcatgcc

SEQ ID NO: 643926 - DNA, 25 bp, Rattus norvegicus
tgtagtatccagttttccgcatgcc

SEQ ID NO: 643927 - DNA, 25 bp, Rattus norvegicus
tgtagtcaagatccactcgagttcc

SEQ ID NO: 643928 - DNA, 25 bp, Rattus norvegicus
tgtagtcaagatgcactcgagttcc

SEQ ID NO: 643929 - DNA, 25 bp, Rattus norvegicus
tgtagtcacagtaccaagtgttctg

SEQ ID NO: 643930 - DNA, 25 bp, Rattus norvegicus
tgtagtcacagttccaagtgttctg

SEQ ID NO: 643931 - DNA, 25 bp, Rattus norvegicus
tgtagtcaccataagcttttctgct

SEQ ID NO: 643932 - DNA, 25 bp, Rattus norvegicus
tgtagtcaccattagcttttctgct

SEQ ID NO: 643933 - DNA, 25 bp, Rattus norvegicus
tgtagtcactgcaaacggcccatga

SEQ ID NO: 643934 - DNA, 25 bp, Rattus norvegicus
tgtagtcactgctaacggcccatga

SEQ ID NO: 643935 - DNA, 25 bp, Rattus norvegicus
tgtagtcagaccctgcagacagcag

SEQ ID NO: 643936 - DNA, 25 bp, Rattus norvegicus
tgtagtcagaccgtgcagacagcag

SEQ ID NO: 643937 - DNA, 25 bp, Rattus norvegicus
tgtagtcagataagtcacccagaca

SEQ ID NO: 643938 - DNA, 25 bp, Rattus norvegicus
tgtagtcagatatgtcacccagaca

SEQ ID NO: 643939 - DNA, 25 bp, Rattus norvegicus
tgtagtcaggagcaggccaaccatc

SEQ ID NO: 643940 - DNA, 25 bp, Rattus norvegicus
tgtagtcaggaggaggccaaccatc

SEQ ID NO: 643941 - DNA, 25 bp, Rattus norvegicus
tgtagtcaggccatgtgacccagaa

SEQ ID NO: 643942 - DNA, 25 bp, Rattus norvegicus
tgtagtcaggccttgtgacccagaa

SEQ ID NO: 643943 - DNA, 25 bp, Rattus norvegicus
tgtagtcccagcctcaaggatcact

SEQ ID NO: 643944 - DNA, 25 bp, Rattus norvegicus
tgtagtcccagcgtcaaggatcact

SEQ ID NO: 643945 - DNA, 25 bp, Rattus norvegicus
tgtagtcccatgaagtactcactcc

SEQ ID NO: 643946 - DNA, 25 bp, Rattus norvegicus
tgtagtcccatgtagtactcactcc

SEQ ID NO: 643947 - DNA, 25 bp, Rattus norvegicus
tgtagtcccctcctgtgggagttta

SEQ ID NO: 643948 - DNA, 25 bp, Rattus norvegicus
tgtagtcccctcgtgtgggagttta

SEQ ID NO: 643949 - DNA, 25 bp, Rattus norvegicus
tgtagtcccggcagacctgaaattg

SEQ ID NO: 643950 - DNA, 25 bp, Rattus norvegicus
tgtagtcccggctgacctgaaattg

SEQ ID NO: 643951 - DNA, 25 bp, Rattus norvegicus
tgtagtccctgcaatgtcatgatgg

SEQ ID NO: 643952 - DNA, 25 bp, Rattus norvegicus
tgtagtccctgctatgtcatgatgg

SEQ ID NO: 643953 - DNA, 25 bp, Rattus norvegicus
tgtagtccgtagcatcttgtctgta

SEQ ID NO: 643954 - DNA, 25 bp, Rattus norvegicus
tgtagtccgtaggatcttgtctgta

SEQ ID NO: 643955 - DNA, 25 bp, Rattus norvegicus
tgtagtcctacaacgtaacacacgc

SEQ ID NO: 643956 - DNA, 25 bp, Rattus norvegicus
tgtagtcctacatcgtaacacacgc

SEQ ID NO: 643957 - DNA, 25 bp, Rattus norvegicus
tgtagtcctagaatccatctggcca

SEQ ID NO: 643958 - DNA, 25 bp, Rattus norvegicus
tgtagtcctagattccatctggcca

SEQ ID NO: 643959 - DNA, 25 bp, Rattus norvegicus
tgtagtcctcggaagaccttgtttc

SEQ ID NO: 643960 - DNA, 25 bp, Rattus norvegicus
tgtagtcctcggtagaccttgtttc

SEQ ID NO: 643961 - DNA, 25 bp, Rattus norvegicus
tgtagtcctgagcacagcttaccac

SEQ ID NO: 643962 - DNA, 25 bp, Rattus norvegicus
tgtagtcctgaggacagcttaccac

SEQ ID NO: 643963 - DNA, 25 bp, Rattus norvegicus
tgtagtcctgtcaccagtcacaatc

SEQ ID NO: 643964 - DNA, 25 bp, Rattus norvegicus
tgtagtcctgtctccagtcacaatc

SEQ ID NO: 643965 - DNA, 25 bp, Rattus norvegicus
tgtagtccttaactttcctgtccta

SEQ ID NO: 643966 - DNA, 25 bp, Rattus norvegicus
tgtagtccttaagtttcctgtccta

SEQ ID NO: 643967 - DNA, 25 bp, Rattus norvegicus
tgtagtcgccatcgcagccgtgtat

SEQ ID NO: 643968 - DNA, 25 bp, Rattus norvegicus
tgtagtcgccatggcagccgtgtat

SEQ ID NO: 643969 - DNA, 25 bp, Rattus norvegicus
tgtagtcgccgcacgggctcgactc

SEQ ID NO: 643970 - DNA, 25 bp, Rattus norvegicus
tgtagtcgccgctcgggctcgactc

SEQ ID NO: 643971 - DNA, 25 bp, Rattus norvegicus
tgtagtctattcacactcctaacaa

SEQ ID NO: 643972 - DNA, 25 bp, Rattus norvegicus
tgtagtctattctcactcctaacaa

SEQ ID NO: 643973 - DNA, 25 bp, Rattus norvegicus
tgtagtctgagcaccagggtggcca

SEQ ID NO: 643974 - DNA, 25 bp, Rattus norvegicus
tgtagtctgagctccagggtggcca

SEQ ID NO: 643975 - DNA, 25 bp, Rattus norvegicus
tgtagtctgttcctatttgtctcac

SEQ ID NO: 643976 - DNA, 25 bp, Rattus norvegicus
tgtagtctgttcgtatttgtctcac

SEQ ID NO: 643977 - DNA, 25 bp, Rattus norvegicus
tgtagtcttctgagtttccaaggac

SEQ ID NO: 643978 - DNA, 25 bp, Rattus norvegicus
tgtagtcttctgtgtttccaaggac

SEQ ID NO: 643979 - DNA, 25 bp, Rattus norvegicus
tgtagtcttgacagccctgaactca

SEQ ID NO: 643980 - DNA, 25 bp, Rattus norvegicus
tgtagtcttgactgccctgaactca

SEQ ID NO: 643981 - DNA, 25 bp, Rattus norvegicus
tgtagtcttgctcttcacctatgtc

SEQ ID NO: 643982 - DNA, 25 bp, Rattus norvegicus
tgtagtcttgctgttcacctatgtc

SEQ ID NO: 643983 - DNA, 25 bp, Rattus norvegicus
tgtagtgacaagacctccctaggag

SEQ ID NO: 643984 - DNA, 25 bp, Rattus norvegicus
tgtagtgacaagtcctccctaggag

SEQ ID NO: 643985 - DNA, 25 bp, Rattus norvegicus
tgtagtgacaccatcggactctaga

SEQ ID NO: 643986 - DNA, 25 bp, Rattus norvegicus
tgtagtgacaccttcggactctaga

SEQ ID NO: 643987 - DNA, 25 bp, Rattus norvegicus
tgtagtgagcctctcatgtgttgcc

SEQ ID NO: 643988 - DNA, 25 bp, Rattus norvegicus
tgtagtgagcctgtcatgtgttgcc

SEQ ID NO: 643989 - DNA, 25 bp, Rattus norvegicus
tgtagtgagtacaaggcctcctttt

SEQ ID NO: 643990 - DNA, 25 bp, Rattus norvegicus
tgtagtgagtactaggcctcctttt

SEQ ID NO: 643991 - DNA, 25 bp, Rattus norvegicus
tgtagtgatcaacccttacccctag

SEQ ID NO: 643992 - DNA, 25 bp, Rattus norvegicus
tgtagtgatcaagccttacccctag

SEQ ID NO: 643993 - DNA, 25 bp, Rattus norvegicus
tgtagtgcatgcactgtggaattca

SEQ ID NO: 643994 - DNA, 25 bp, Rattus norvegicus
tgtagtgcatgctctgtggaattca

SEQ ID NO: 643995 - DNA, 25 bp, Rattus norvegicus
tgtagtgccccacagcgtccggttt

SEQ ID NO: 643996 - DNA, 25 bp, Rattus norvegicus
tgtagtgccccagagcgtccggttt

SEQ ID NO: 643997 - DNA, 25 bp, Rattus norvegicus
tgtagtgccttgcacctggacaaaa

SEQ ID NO: 643998 - DNA, 25 bp, Rattus norvegicus
tgtagtgccttggacctggacaaaa

SEQ ID NO: 643999 - DNA, 25 bp, Rattus norvegicus
tgtagtgcgggtactggctctgtac

SEQ ID NO: 644000 - DNA, 25 bp, Rattus norvegicus
tgtagtgcgggttctggctctgtac

SEQ ID NO: 644001 - DNA, 25 bp, Rattus norvegicus
tgtagtgcgtttccctgtaacagac

SEQ ID NO: 644002 - DNA, 25 bp, Rattus norvegicus
tgtagtgcgtttgcctgtaacagac

SEQ ID NO: 644003 - DNA, 25 bp, Rattus norvegicus
tgtagtgctcacactgggccatagt

SEQ ID NO: 644004 - DNA, 25 bp, Rattus norvegicus
tgtagtgctcactctgggccatagt

SEQ ID NO: 644005 - DNA, 25 bp, Rattus norvegicus
tgtagtgctgacatgtctactgtta

SEQ ID NO: 644006 - DNA, 25 bp, Rattus norvegicus
tgtagtgctgacttgtctactgtta

SEQ ID NO: 644007 - DNA, 25 bp, Rattus norvegicus
tgtagtggaaaaatccggccctttg

SEQ ID NO: 644008 - DNA, 25 bp, Rattus norvegicus
tgtagtggaaaattccggccctttg

SEQ ID NO: 644009 - DNA, 25 bp, Rattus norvegicus
tgtagtggaacacacatttaatccc

SEQ ID NO: 644010 - DNA, 25 bp, Rattus norvegicus
tgtagtggaacagacatttaatccc

SEQ ID NO: 644011 - DNA, 25 bp, Rattus norvegicus
tgtagtgggtccacgatccaaagag

SEQ ID NO: 644012 - DNA, 25 bp, Rattus norvegicus
tgtagtgggtcctcgatccaaagag

SEQ ID NO: 644013 - DNA, 25 bp, Rattus norvegicus
tgtagtggtggaaacacggcccacg

SEQ ID NO: 644014 - DNA, 25 bp, Rattus norvegicus
tgtagtggtggatacacggcccacg

SEQ ID NO: 644015 - DNA, 25 bp, Rattus norvegicus
tgtagtgtaactccacgtcccagta

SEQ ID NO: 644016 - DNA, 25 bp, Rattus norvegicus
tgtagtgtaactgcacgtcccagta

SEQ ID NO: 644017 - DNA, 25 bp, Rattus norvegicus
tgtagtgtatcaaccaagtgacccc

SEQ ID NO: 644018 - DNA, 25 bp, Rattus norvegicus
tgtagtgtatcatccaagtgacccc

SEQ ID NO: 644019 - DNA, 25 bp, Rattus norvegicus
tgtagtgtcagaatgtcatccaact

SEQ ID NO: 644020 - DNA, 25 bp, Rattus norvegicus
tgtagtgtcagattgtcatccaact

SEQ ID NO: 644021 - DNA, 25 bp, Rattus norvegicus
tgtagtgtctctcatgttttcctca

SEQ ID NO: 644022 - DNA, 25 bp, Rattus norvegicus
tgtagtgtctctgatgttttcctca

SEQ ID NO: 644023 - DNA, 25 bp, Rattus norvegicus
tgtagtgtctgacagcgggaccttc

SEQ ID NO: 644024 - DNA, 25 bp, Rattus norvegicus
tgtagtgtctgagagcgggaccttc

SEQ ID NO: 644025 - DNA, 25 bp, Rattus norvegicus
tgtagtgtcttacacttccccgtgt

SEQ ID NO: 644026 - DNA, 25 bp, Rattus norvegicus
tgtagtgtcttagacttccccgtgt

SEQ ID NO: 644027 - DNA, 25 bp, Rattus norvegicus
tgtagtgtgccccaaatgcagcttc

SEQ ID NO: 644028 - DNA, 25 bp, Rattus norvegicus
tgtagtgtgcccgaaatgcagcttc

SEQ ID NO: 644029 - DNA, 25 bp, Rattus norvegicus
tgtagtgtgtcaagccttaggtcgt

SEQ ID NO: 644030 - DNA, 25 bp, Rattus norvegicus
tgtagtgtgtcatgccttaggtcgt

SEQ ID NO: 644031 - DNA, 25 bp, Rattus norvegicus
tgtagttacacacgatggagcaata

SEQ ID NO: 644032 - DNA, 25 bp, Rattus norvegicus
tgtagttacacaggatggagcaata

SEQ ID NO: 644033 - DNA, 25 bp, Rattus norvegicus
tgtagttaccagacattccttcacc

SEQ ID NO: 644034 - DNA, 25 bp, Rattus norvegicus
tgtagttaccagtcattccttcacc

SEQ ID NO: 644035 - DNA, 25 bp, Rattus norvegicus
tgtagttactcaagcagtcactccc

SEQ ID NO: 644036 - DNA, 25 bp, Rattus norvegicus
tgtagttactcatgcagtcactccc

SEQ ID NO: 644037 - DNA, 25 bp, Rattus norvegicus
tgtagttcacgaaccatccaatttc

SEQ ID NO: 644038 - DNA, 25 bp, Rattus norvegicus
tgtagttcacgatccatccaatttc

SEQ ID NO: 644039 - DNA, 25 bp, Rattus norvegicus
tgtagttccggtcattctccagaag

SEQ ID NO: 644040 - DNA, 25 bp, Rattus norvegicus
tgtagttccggtgattctccagaag

SEQ ID NO: 644041 - DNA, 25 bp, Rattus norvegicus
tgtagttcctacacatgtcatggct

SEQ ID NO: 644042 - DNA, 25 bp, Rattus norvegicus
tgtagttcctactcatgtcatggct

SEQ ID NO: 644043 - DNA, 25 bp, Rattus norvegicus
tgtagttcggatagcttagttttaa

SEQ ID NO: 644044 - DNA, 25 bp, Rattus norvegicus
tgtagttcggattgcttagttttaa

SEQ ID NO: 644045 - DNA, 25 bp, Rattus norvegicus
tgtagttcttgcatcctatactgga

SEQ ID NO: 644046 - DNA, 25 bp, Rattus norvegicus
tgtagttcttgcttcctatactgga

SEQ ID NO: 644047 - DNA, 25 bp, Rattus norvegicus
tgtagttcttgtagctccaggttcc

SEQ ID NO: 644048 - DNA, 25 bp, Rattus norvegicus
tgtagttcttgttgctccaggttcc

SEQ ID NO: 644049 - DNA, 25 bp, Rattus norvegicus
tgtagttctttaaggtacctgcctc

SEQ ID NO: 644050 - DNA, 25 bp, Rattus norvegicus
tgtagttctttatggtacctgcctc

SEQ ID NO: 644051 - DNA, 25 bp, Rattus norvegicus
tgtagttgtgggacttagcttcctt

SEQ ID NO: 644052 - DNA, 25 bp, Rattus norvegicus
tgtagttgtgggtcttagcttcctt

SEQ ID NO: 644053 - DNA, 25 bp, Rattus norvegicus
tgtagtttacagatccatggaatct

SEQ ID NO: 644054 - DNA, 25 bp, Rattus norvegicus
tgtagtttacagcacgcagaggaaa

SEQ ID NO: 644055 - DNA, 25 bp, Rattus norvegicus
tgtagtttacaggacgcagaggaaa

SEQ ID NO: 644056 - DNA, 25 bp, Rattus norvegicus
tgtagtttacagttccatggaatct

SEQ ID NO: 644057 - DNA, 25 bp, Rattus norvegicus
tgtagtttccaacatggtcccagca

SEQ ID NO: 644058 - DNA, 25 bp, Rattus norvegicus
tgtagtttccaagatggtcccagca

SEQ ID NO: 644059 - DNA, 25 bp, Rattus norvegicus
tgtagtttccccatagattctctgc

SEQ ID NO: 644060 - DNA, 25 bp, Rattus norvegicus
tgtagtttccccttagattctctgc

SEQ ID NO: 644061 - DNA, 25 bp, Rattus norvegicus
tgtagtttctcaattacccctaagc

SEQ ID NO: 644062 - DNA, 25 bp, Rattus norvegicus
tgtagtttctcactggtacccttat

SEQ ID NO: 644063 - DNA, 25 bp, Rattus norvegicus
tgtagtttctcagtggtacccttat

SEQ ID NO: 644064 - DNA, 25 bp, Rattus norvegicus
tgtagtttctcatttacccctaagc

SEQ ID NO: 644065 - DNA, 25 bp, Rattus norvegicus
tgtagttttataccagacggcgcct

SEQ ID NO: 644066 - DNA, 25 bp, Rattus norvegicus
tgtagttttatagcagacggcgcct

SEQ ID NO: 644067 - DNA, 25 bp, Rattus norvegicus
tgtagttttcacagttgggatgtat

SEQ ID NO: 644068 - DNA, 25 bp, Rattus norvegicus
tgtagttttcactgttgggatgtat

SEQ ID NO: 644069 - DNA, 25 bp, Rattus norvegicus
tgtagttttctgcataagtgtcaaa

SEQ ID NO: 644070 - DNA, 25 bp, Rattus norvegicus
tgtagttttctggataagtgtcaaa

SEQ ID NO: 644071 - DNA, 25 bp, Rattus norvegicus
tgtagtttttagcagggcagacctt

SEQ ID NO: 644072 - DNA, 25 bp, Rattus norvegicus
tgtagtttttaggagggcagacctt

SEQ ID NO: 644073 - DNA, 25 bp, Rattus norvegicus
tgtagttttttgatcctgcatctga

SEQ ID NO: 644074 - DNA, 25 bp, Rattus norvegicus
tgtagttttttgttcctgcatctga

SEQ ID NO: 644075 - DNA, 25 bp, Rattus norvegicus
tgtataaattaccagccctcctgag

SEQ ID NO: 644076 - DNA, 25 bp, Rattus norvegicus
tgtataaattacgagccctcctgag

SEQ ID NO: 644077 - DNA, 25 bp, Rattus norvegicus
tgtataacatacaccatggtccagg

SEQ ID NO: 644078 - DNA, 25 bp, Rattus norvegicus
tgtataacatactccatggtccagg

SEQ ID NO: 644079 - DNA, 25 bp, Rattus norvegicus
tgtataagaaaacgcctttcccctg

SEQ ID NO: 644080 - DNA, 25 bp, Rattus norvegicus
tgtataagaaaaggcctttcccctg

SEQ ID NO: 644081 - DNA, 25 bp, Rattus norvegicus
tgtataagcattacctagcgcatgg

SEQ ID NO: 644082 - DNA, 25 bp, Rattus norvegicus
tgtataagcatttcctagcgcatgg

SEQ ID NO: 644083 - DNA, 25 bp, Rattus norvegicus
tgtataagttccagccttcgggttc

SEQ ID NO: 644084 - DNA, 25 bp, Rattus norvegicus
tgtataagttcctgccttcgggttc

SEQ ID NO: 644085 - DNA, 25 bp, Rattus norvegicus
tgtataattacactgcacgcggcat

SEQ ID NO: 644086 - DNA, 25 bp, Rattus norvegicus
tgtataattacagtgcacgcggcat

SEQ ID NO: 644087 - DNA, 25 bp, Rattus norvegicus
tgtataattactatggtcccaagat

SEQ ID NO: 644088 - DNA, 25 bp, Rattus norvegicus
tgtataattactttggtcccaagat

SEQ ID NO: 644089 - DNA, 25 bp, Rattus norvegicus
tgtatacaaagccacacggacacgt

SEQ ID NO: 644090 - DNA, 25 bp, Rattus norvegicus
tgtatacaaagcgacacggacacgt

SEQ ID NO: 644091 - DNA, 25 bp, Rattus norvegicus
tgtataccaggtcgcattgtcagag

SEQ ID NO: 644092 - DNA, 25 bp, Rattus norvegicus
tgtataccaggtggcattgtcagag

SEQ ID NO: 644093 - DNA, 25 bp, Rattus norvegicus
tgtataccatgcatattcccagtgt

SEQ ID NO: 644094 - DNA, 25 bp, Rattus norvegicus
tgtataccatgcttattcccagtgt

SEQ ID NO: 644095 - DNA, 25 bp, Rattus norvegicus
tgtatacccggaaacgcgactcggt

SEQ ID NO: 644096 - DNA, 25 bp, Rattus norvegicus
tgtatacccggatacgcgactcggt

SEQ ID NO: 644097 - DNA, 25 bp, Rattus norvegicus
tgtatacctgccatgccaggcttcc

SEQ ID NO: 644098 - DNA, 25 bp, Rattus norvegicus
tgtatacctgccttgccaggcttcc

SEQ ID NO: 644099 - DNA, 25 bp, Rattus norvegicus
tgtatacgcgagagacagcctaccg

SEQ ID NO: 644100 - DNA, 25 bp, Rattus norvegicus
tgtatacgcgagtgacagcctaccg

SEQ ID NO: 644101 - DNA, 25 bp, Rattus norvegicus
tgtatactacttcatctcagcatat

SEQ ID NO: 644102 - DNA, 25 bp, Rattus norvegicus
tgtatactacttgatctcagcatat

SEQ ID NO: 644103 - DNA, 25 bp, Rattus norvegicus
tgtatactctcccaaggtgttcctt

SEQ ID NO: 644104 - DNA, 25 bp, Rattus norvegicus
tgtatactctccgaaggtgttcctt

SEQ ID NO: 644105 - DNA, 25 bp, Rattus norvegicus
tgtatactgaccactgcatgtttga

SEQ ID NO: 644106 - DNA, 25 bp, Rattus norvegicus
tgtatactgacctctgcatgtttga

SEQ ID NO: 644107 - DNA, 25 bp, Rattus norvegicus
tgtatacttgttacgcagagagagc

SEQ ID NO: 644108 - DNA, 25 bp, Rattus norvegicus
tgtatacttgtttcgcagagagagc

SEQ ID NO: 644109 - DNA, 25 bp, Rattus norvegicus
tgtatagactcgctttttcttttgt

SEQ ID NO: 644110 - DNA, 25 bp, Rattus norvegicus
tgtatagactcggtttttcttttgt

SEQ ID NO: 644111 - DNA, 25 bp, Rattus norvegicus
tgtatagactgcagattcgatcatg

SEQ ID NO: 644112 - DNA, 25 bp, Rattus norvegicus
tgtatagactgctgattcgatcatg

SEQ ID NO: 644113 - DNA, 25 bp, Rattus norvegicus
tgtatagatccaaagacattttcaa

SEQ ID NO: 644114 - DNA, 25 bp, Rattus norvegicus
tgtatagatccatagacattttcaa

SEQ ID NO: 644115 - DNA, 25 bp, Rattus norvegicus
tgtatagccaatacctctcttttat

SEQ ID NO: 644116 - DNA, 25 bp, Rattus norvegicus
tgtatagccaattcctctcttttat

SEQ ID NO: 644117 - DNA, 25 bp, Rattus norvegicus
tgtatagcctgtactcagcttccaa

SEQ ID NO: 644118 - DNA, 25 bp, Rattus norvegicus
tgtatagcctgttctcagcttccaa

SEQ ID NO: 644119 - DNA, 25 bp, Rattus norvegicus
tgtatagctctaacctggtggtggg

SEQ ID NO: 644120 - DNA, 25 bp, Rattus norvegicus
tgtatagctctatcctggtggtggg

SEQ ID NO: 644121 - DNA, 25 bp, Rattus norvegicus
tgtatagctgatcagattctttgta

SEQ ID NO: 644122 - DNA, 25 bp, Rattus norvegicus
tgtatagctgatgagattctttgta

SEQ ID NO: 644123 - DNA, 25 bp, Rattus norvegicus
tgtatagtacatctattcccttata

SEQ ID NO: 644124 - DNA, 25 bp, Rattus norvegicus
tgtatagtacatgtattcccttata

SEQ ID NO: 644125 - DNA, 25 bp, Rattus norvegicus
tgtatagtgctcaccgatgctgtga

SEQ ID NO: 644126 - DNA, 25 bp, Rattus norvegicus
tgtatagtgctctccgatgctgtga

SEQ ID NO: 644127 - DNA, 25 bp, Rattus norvegicus
tgtatataaaacctctttgtgcagt

SEQ ID NO: 644128 - DNA, 25 bp, Rattus norvegicus
tgtatataaaacgtctttgtgcagt

SEQ ID NO: 644129 - DNA, 25 bp, Rattus norvegicus
tgtatataacctccatgcctggtgc

SEQ ID NO: 644130 - DNA, 25 bp, Rattus norvegicus
tgtatataacctgcatgcctggtgc

SEQ ID NO: 644131 - DNA, 25 bp, Rattus norvegicus
tgtatataataccttcaccttcctg

SEQ ID NO: 644132 - DNA, 25 bp, Rattus norvegicus
tgtatataatacgttcaccttcctg

SEQ ID NO: 644133 - DNA, 25 bp, Rattus norvegicus
tgtatatacctcatgaccacgtaga

SEQ ID NO: 644134 - DNA, 25 bp, Rattus norvegicus
tgtatatacctcttgaccacgtaga

SEQ ID NO: 644135 - DNA, 25 bp, Rattus norvegicus
tgtatatagcaacctggcccagtga

SEQ ID NO: 644136 - DNA, 25 bp, Rattus norvegicus
tgtatatagcaagctggcccagtga

SEQ ID NO: 644137 - DNA, 25 bp, Rattus norvegicus
tgtatatatcacacagcaggcctgt

SEQ ID NO: 644138 - DNA, 25 bp, Rattus norvegicus
tgtatatatcactcagcaggcctgt

SEQ ID NO: 644139 - DNA, 25 bp, Rattus norvegicus
tgtatatatgtgacctgcccacact

SEQ ID NO: 644140 - DNA, 25 bp, Rattus norvegicus
tgtatatatgtgtcctgcccacact

SEQ ID NO: 644141 - DNA, 25 bp, Rattus norvegicus
tgtatatcacggacagacctggaac

SEQ ID NO: 644142 - DNA, 25 bp, Rattus norvegicus
tgtatatcacggtcagacctggaac

SEQ ID NO: 644143 - DNA, 25 bp, Rattus norvegicus
tgtatatcagatctgtgcgtgcgca

SEQ ID NO: 644144 - DNA, 25 bp, Rattus norvegicus
tgtatatcagatgtgtgcgtgcgca

SEQ ID NO: 644145 - DNA, 25 bp, Rattus norvegicus
tgtatatctctcagccacatttacc

SEQ ID NO: 644146 - DNA, 25 bp, Rattus norvegicus
tgtatatctctctgccacatttacc

SEQ ID NO: 644147 - DNA, 25 bp, Rattus norvegicus
tgtatatctttccatgctgcggctg

SEQ ID NO: 644148 - DNA, 25 bp, Rattus norvegicus
tgtatatctttcgatgctgcggctg

SEQ ID NO: 644149 - DNA, 25 bp, Rattus norvegicus
tgtatatcttttcacatcccttcag

SEQ ID NO: 644150 - DNA, 25 bp, Rattus norvegicus
tgtatatcttttgacatcccttcag

SEQ ID NO: 644151 - DNA, 25 bp, Rattus norvegicus
tgtatatgagtgctttttctacttg

SEQ ID NO: 644152 - DNA, 25 bp, Rattus norvegicus
tgtatatgagtggtttttctacttg

SEQ ID NO: 644153 - DNA, 25 bp, Rattus norvegicus
tgtatatgattaaccccttctctct

SEQ ID NO: 644154 - DNA, 25 bp, Rattus norvegicus
tgtatatgattatccccttctctct

SEQ ID NO: 644155 - DNA, 25 bp, Rattus norvegicus
tgtatatgctcaccccagggaagtg

SEQ ID NO: 644156 - DNA, 25 bp, Rattus norvegicus
tgtatatgctcagcccagggaagtg

SEQ ID NO: 644157 - DNA, 25 bp, Rattus norvegicus
tgtatatgctggctactgctgtctc

SEQ ID NO: 644158 - DNA, 25 bp, Rattus norvegicus
tgtatatgctgggtactgctgtctc

SEQ ID NO: 644159 - DNA, 25 bp, Rattus norvegicus
tgtatatgcttcctctcacagggag

SEQ ID NO: 644160 - DNA, 25 bp, Rattus norvegicus
tgtatatgcttcgtctcacagggag

SEQ ID NO: 644161 - DNA, 25 bp, Rattus norvegicus
tgtatattatacatcttcctcaaat

SEQ ID NO: 644162 - DNA, 25 bp, Rattus norvegicus
tgtatattatacttcttcctcaaat

SEQ ID NO: 644163 - DNA, 25 bp, Rattus norvegicus
tgtatattcacaccagtaattgcct

SEQ ID NO: 644164 - DNA, 25 bp, Rattus norvegicus
tgtatattcacagcagtaattgcct

SEQ ID NO: 644165 - DNA, 25 bp, Rattus norvegicus
tgtatattcacccttttaccacggc

SEQ ID NO: 644166 - DNA, 25 bp, Rattus norvegicus
tgtatattcaccgttttaccacggc

SEQ ID NO: 644167 - DNA, 25 bp, Rattus norvegicus
tgtatattccaccttttaaagctga

SEQ ID NO: 644168 - DNA, 25 bp, Rattus norvegicus
tgtatattccacgttttaaagctga

SEQ ID NO: 644169 - DNA, 25 bp, Rattus norvegicus
tgtatattctaactttccttgcaaa

SEQ ID NO: 644170 - DNA, 25 bp, Rattus norvegicus
tgtatattctaagtttccttgcaaa

SEQ ID NO: 644171 - DNA, 25 bp, Rattus norvegicus
tgtatattgacaaggtgcgcagctt

SEQ ID NO: 644172 - DNA, 25 bp, Rattus norvegicus
tgtatattgacatggtgcgcagctt

SEQ ID NO: 644173 - DNA, 25 bp, Rattus norvegicus
tgtatatttataagcacaatgccga

SEQ ID NO: 644174 - DNA, 25 bp, Rattus norvegicus
tgtatatttatatgcacaatgccga

SEQ ID NO: 644175 - DNA, 25 bp, Rattus norvegicus
tgtatatttcttctcccaaacacgg

SEQ ID NO: 644176 - DNA, 25 bp, Rattus norvegicus
tgtatatttcttgtcccaaacacgg

SEQ ID NO: 644177 - DNA, 25 bp, Rattus norvegicus
tgtatcaaaagtaattgccacattt

SEQ ID NO: 644178 - DNA, 25 bp, Rattus norvegicus
tgtatcaaaagttattgccacattt

SEQ ID NO: 644179 - DNA, 25 bp, Rattus norvegicus
tgtatcaaagccaagtgtccccttc

SEQ ID NO: 644180 - DNA, 25 bp, Rattus norvegicus
tgtatcaaagcctagtgtccccttc

SEQ ID NO: 644181 - DNA, 25 bp, Rattus norvegicus
tgtatcaaatggacaaatgccaaat

SEQ ID NO: 644182 - DNA, 25 bp, Rattus norvegicus
tgtatcaaatggtcaaatgccaaat

SEQ ID NO: 644183 - DNA, 25 bp, Rattus norvegicus
tgtatcaaccataggctgcctgaat

SEQ ID NO: 644184 - DNA, 25 bp, Rattus norvegicus
tgtatcaaccattggctgcctgaat

SEQ ID NO: 644185 - DNA, 25 bp, Rattus norvegicus
tgtatcaactttacaaggttttcta

SEQ ID NO: 644186 - DNA, 25 bp, Rattus norvegicus
tgtatcaacttttcaaggttttcta

SEQ ID NO: 644187 - DNA, 25 bp, Rattus norvegicus
tgtatcaagtgtattgtcccaacag

SEQ ID NO: 644188 - DNA, 25 bp, Rattus norvegicus
tgtatcaagtgttttgtcccaacag

SEQ ID NO: 644189 - DNA, 25 bp, Rattus norvegicus
tgtatcaatttcatctctcatctct

SEQ ID NO: 644190 - DNA, 25 bp, Rattus norvegicus
tgtatcaatttcttctctcatctct

SEQ ID NO: 644191 - DNA, 25 bp, Rattus norvegicus
tgtatcacagctccctacagatgag

SEQ ID NO: 644192 - DNA, 25 bp, Rattus norvegicus
tgtatcacagctgcctacagatgag

SEQ ID NO: 644193 - DNA, 25 bp, Rattus norvegicus
tgtatcaccagtaagtggcctcagc

SEQ ID NO: 644194 - DNA, 25 bp, Rattus norvegicus
tgtatcaccagttagtggcctcagc

SEQ ID NO: 644195 - DNA, 25 bp, Rattus norvegicus
tgtatcactaacaggtccacagccc

SEQ ID NO: 644196 - DNA, 25 bp, Rattus norvegicus
tgtatcactaactggtccacagccc

SEQ ID NO: 644197 - DNA, 25 bp, Rattus norvegicus
tgtatcactaccagcagtttgccta

SEQ ID NO: 644198 - DNA, 25 bp, Rattus norvegicus
tgtatcactacctgcagtttgccta

SEQ ID NO: 644199 - DNA, 25 bp, Rattus norvegicus
tgtatcagcctcatcgagatcgcga

SEQ ID NO: 644200 - DNA, 25 bp, Rattus norvegicus
tgtatcagcctcttcgagatcgcga

SEQ ID NO: 644201 - DNA, 25 bp, Rattus norvegicus
tgtatcatatgaacccttagccctg

SEQ ID NO: 644202 - DNA, 25 bp, Rattus norvegicus
tgtatcatatgatcccttagccctg

SEQ ID NO: 644203 - DNA, 25 bp, Rattus norvegicus
tgtatcatcaacaaggtaaccagga

SEQ ID NO: 644204 - DNA, 25 bp, Rattus norvegicus
tgtatcatcaactaggtaaccagga

SEQ ID NO: 644205 - DNA, 25 bp, Rattus norvegicus
tgtatcatgaagagcccaccacttg

SEQ ID NO: 644206 - DNA, 25 bp, Rattus norvegicus
tgtatcatgaagtgcccaccacttg

SEQ ID NO: 644207 - DNA, 25 bp, Rattus norvegicus
tgtatcatgcccaactacctaataa

SEQ ID NO: 644208 - DNA, 25 bp, Rattus norvegicus
tgtatcatgccctactacctaataa

SEQ ID NO: 644209 - DNA, 25 bp, Rattus norvegicus
tgtatcattcatctagtgtctacag

SEQ ID NO: 644210 - DNA, 25 bp, Rattus norvegicus
tgtatcattcatgtagtgtctacag

SEQ ID NO: 644211 - DNA, 25 bp, Rattus norvegicus
tgtatcattttgatcgcaggcctca

SEQ ID NO: 644212 - DNA, 25 bp, Rattus norvegicus
tgtatcattttgttcgcaggcctca

SEQ ID NO: 644213 - DNA, 25 bp, Rattus norvegicus
tgtatccaaacaagactgcagtgct

SEQ ID NO: 644214 - DNA, 25 bp, Rattus norvegicus
tgtatccaaacatgactgcagtgct

SEQ ID NO: 644215 - DNA, 25 bp, Rattus norvegicus
tgtatccaccacctgagttcccatt

SEQ ID NO: 644216 - DNA, 25 bp, Rattus norvegicus
tgtatccaccacgtgagttcccatt

SEQ ID NO: 644217 - DNA, 25 bp, Rattus norvegicus
tgtatccaccttcagcgagttcagg

SEQ ID NO: 644218 - DNA, 25 bp, Rattus norvegicus
tgtatccaccttgagcgagttcagg

SEQ ID NO: 644219 - DNA, 25 bp, Rattus norvegicus
tgtatccactgtccctgtgaggagg

SEQ ID NO: 644220 - DNA, 25 bp, Rattus norvegicus
tgtatccactgtgcctgtgaggagg

SEQ ID NO: 644221 - DNA, 25 bp, Rattus norvegicus
tgtatccatgagctgtttgccagtg

SEQ ID NO: 644222 - DNA, 25 bp, Rattus norvegicus
tgtatccatgaggtgtttgccagtg

SEQ ID NO: 644223 - DNA, 25 bp, Rattus norvegicus
tgtatccatgtaaacgtgctctctc

SEQ ID NO: 644224 - DNA, 25 bp, Rattus norvegicus
tgtatccatgtatacgtgctctctc

SEQ ID NO: 644225 - DNA, 25 bp, Rattus norvegicus
tgtatcccaagtcgcaacatgtcag

SEQ ID NO: 644226 - DNA, 25 bp, Rattus norvegicus
tgtatcccaagtggcaacatgtcag

SEQ ID NO: 644227 - DNA, 25 bp, Rattus norvegicus
tgtatcccactaataccagctgtga

SEQ ID NO: 644228 - DNA, 25 bp, Rattus norvegicus
tgtatcccactattaccagctgtga

SEQ ID NO: 644229 - DNA, 25 bp, Rattus norvegicus
tgtatcccagaaacgcagaggtagg

SEQ ID NO: 644230 - DNA, 25 bp, Rattus norvegicus
tgtatcccagaatcgcagaggtagg

SEQ ID NO: 644231 - DNA, 25 bp, Rattus norvegicus
tgtatccccaccactgcagaaaagg

SEQ ID NO: 644232 - DNA, 25 bp, Rattus norvegicus
tgtatccccacctctgcagaaaagg

SEQ ID NO: 644233 - DNA, 25 bp, Rattus norvegicus
tgtatccccggaattttggtaatat

SEQ ID NO: 644234 - DNA, 25 bp, Rattus norvegicus
tgtatccccggatttttggtaatat

SEQ ID NO: 644235 - DNA, 25 bp, Rattus norvegicus
tgtatcccctttctctcctggctaa

SEQ ID NO: 644236 - DNA, 25 bp, Rattus norvegicus
tgtatcccctttgtctcctggctaa

SEQ ID NO: 644237 - DNA, 25 bp, Rattus norvegicus
tgtatcccggagcactaaattgcct

SEQ ID NO: 644238 - DNA, 25 bp, Rattus norvegicus
tgtatcccggaggactaaattgcct

SEQ ID NO: 644239 - DNA, 25 bp, Rattus norvegicus
tgtatccctgcacacccaaaggaga

SEQ ID NO: 644240 - DNA, 25 bp, Rattus norvegicus
tgtatccctgcagacccaaaggaga

SEQ ID NO: 644241 - DNA, 25 bp, Rattus norvegicus
tgtatccctgccaattcctaaaggt

SEQ ID NO: 644242 - DNA, 25 bp, Rattus norvegicus
tgtatccctgcctattcctaaaggt

SEQ ID NO: 644243 - DNA, 25 bp, Rattus norvegicus
tgtatccctggcattgtggaactaa

SEQ ID NO: 644244 - DNA, 25 bp, Rattus norvegicus
tgtatccctggctttgtggaactaa

SEQ ID NO: 644245 - DNA, 25 bp, Rattus norvegicus
tgtatccctgggaactagctctgta

SEQ ID NO: 644246 - DNA, 25 bp, Rattus norvegicus
tgtatccctgggtactagctctgta

SEQ ID NO: 644247 - DNA, 25 bp, Rattus norvegicus
tgtatcccttgacctaccttgatgg

SEQ ID NO: 644248 - DNA, 25 bp, Rattus norvegicus
tgtatcccttgagctaccttgatgg

SEQ ID NO: 644249 - DNA, 25 bp, Rattus norvegicus
tgtatccgcgttctgcgactccgag

SEQ ID NO: 644250 - DNA, 25 bp, Rattus norvegicus
tgtatccgcgttgtgcgactccgag

SEQ ID NO: 644251 - DNA, 25 bp, Rattus norvegicus
tgtatccgctttctgctgtggatgc

SEQ ID NO: 644252 - DNA, 25 bp, Rattus norvegicus
tgtatccgctttgtgctgtggatgc

SEQ ID NO: 644253 - DNA, 25 bp, Rattus norvegicus
tgtatccggtatattgtcaaagcaa

SEQ ID NO: 644254 - DNA, 25 bp, Rattus norvegicus
tgtatccggtattttgtcaaagcaa

SEQ ID NO: 644255 - DNA, 25 bp, Rattus norvegicus
tgtatccgttcacgtgtgcagagcg

SEQ ID NO: 644256 - DNA, 25 bp, Rattus norvegicus
tgtatccgttcaggtgtgcagagcg

SEQ ID NO: 644257 - DNA, 25 bp, Rattus norvegicus
tgtatcctatttccccagggaactg

SEQ ID NO: 644258 - DNA, 25 bp, Rattus norvegicus
tgtatcctatttgcccagggaactg

SEQ ID NO: 644259 - DNA, 25 bp, Rattus norvegicus
tgtatcctccccaacggcggagctg

SEQ ID NO: 644260 - DNA, 25 bp, Rattus norvegicus
tgtatcctcccctacggcggagctg

SEQ ID NO: 644261 - DNA, 25 bp, Rattus norvegicus
tgtatcctctccatcaagcctatat

SEQ ID NO: 644262 - DNA, 25 bp, Rattus norvegicus
tgtatcctctccttcaagcctatat

SEQ ID NO: 644263 - DNA, 25 bp, Rattus norvegicus
tgtatcctgaaactaaaccctcttg

SEQ ID NO: 644264 - DNA, 25 bp, Rattus norvegicus
tgtatcctgaaagtaaaccctcttg

SEQ ID NO: 644265 - DNA, 25 bp, Rattus norvegicus
tgtatcctgataactgcattcccta

SEQ ID NO: 644266 - DNA, 25 bp, Rattus norvegicus
tgtatcctgatatctgcattcccta

SEQ ID NO: 644267 - DNA, 25 bp, Rattus norvegicus
tgtatcctgctcatcagcatctttt

SEQ ID NO: 644268 - DNA, 25 bp, Rattus norvegicus
tgtatcctgctcttcagcatctttt

SEQ ID NO: 644269 - DNA, 25 bp, Rattus norvegicus
tgtatcctggtgacattttctgtgg

SEQ ID NO: 644270 - DNA, 25 bp, Rattus norvegicus
tgtatcctggtgtcattttctgtgg

SEQ ID NO: 644271 - DNA, 25 bp, Rattus norvegicus
tgtatccttacaagatgcctcttct

SEQ ID NO: 644272 - DNA, 25 bp, Rattus norvegicus
tgtatccttacatgatgcctcttct

SEQ ID NO: 644273 - DNA, 25 bp, Rattus norvegicus
tgtatccttcctcttgggatccaga

SEQ ID NO: 644274 - DNA, 25 bp, Rattus norvegicus
tgtatccttcctgttgggatccaga

SEQ ID NO: 644275 - DNA, 25 bp, Rattus norvegicus
tgtatcctttctcctctaaattctc

SEQ ID NO: 644276 - DNA, 25 bp, Rattus norvegicus
tgtatcctttctgctctaaattctc

SEQ ID NO: 644277 - DNA, 25 bp, Rattus norvegicus
tgtatcctttgtcccatccaacatt

SEQ ID NO: 644278 - DNA, 25 bp, Rattus norvegicus
tgtatcctttgtgccatccaacatt

SEQ ID NO: 644279 - DNA, 25 bp, Rattus norvegicus
tgtatcgaagtcagtgtccctgtga

SEQ ID NO: 644280 - DNA, 25 bp, Rattus norvegicus
tgtatcgaagtctgtgtccctgtga

SEQ ID NO: 644281 - DNA, 25 bp, Rattus norvegicus
tgtatcgacactcggtggtagtttt

SEQ ID NO: 644282 - DNA, 25 bp, Rattus norvegicus
tgtatcgacactgggtggtagtttt

SEQ ID NO: 644283 - DNA, 25 bp, Rattus norvegicus
tgtatcgagtgtcaggccaaccagg

SEQ ID NO: 644284 - DNA, 25 bp, Rattus norvegicus
tgtatcgagtgtgaggccaaccagg

SEQ ID NO: 644285 - DNA, 25 bp, Rattus norvegicus
tgtatcgcaggtcggctctttttaa

SEQ ID NO: 644286 - DNA, 25 bp, Rattus norvegicus
tgtatcgcaggtgggctctttttaa

SEQ ID NO: 644287 - DNA, 25 bp, Rattus norvegicus
tgtatcgccttcaattgatttctcc

SEQ ID NO: 644288 - DNA, 25 bp, Rattus norvegicus
tgtatcgccttctattgatttctcc

SEQ ID NO: 644289 - DNA, 25 bp, Rattus norvegicus
tgtatcgcttgcacttaaccctgaa

SEQ ID NO: 644290 - DNA, 25 bp, Rattus norvegicus
tgtatcgcttgctcttaaccctgaa

SEQ ID NO: 644291 - DNA, 25 bp, Rattus norvegicus
tgtatcgggaaaccctgccagaatt

SEQ ID NO: 644292 - DNA, 25 bp, Rattus norvegicus
tgtatcgggaaagcctgccagaatt

SEQ ID NO: 644293 - DNA, 25 bp, Rattus norvegicus
tgtatctaagacaccgaggcaccgg

SEQ ID NO: 644294 - DNA, 25 bp, Rattus norvegicus
tgtatctaagactccgaggcaccgg

SEQ ID NO: 644295 - DNA, 25 bp, Rattus norvegicus
tgtatctaccaacacctgccagacg

SEQ ID NO: 644296 - DNA, 25 bp, Rattus norvegicus
tgtatctaccaagacctgccagacg

SEQ ID NO: 644297 - DNA, 25 bp, Rattus norvegicus
tgtatctaccctccacgtggagcaa

SEQ ID NO: 644298 - DNA, 25 bp, Rattus norvegicus
tgtatctaccctgcacgtggagcaa

SEQ ID NO: 644299 - DNA, 25 bp, Rattus norvegicus
tgtatctactgtatctcttctacca

SEQ ID NO: 644300 - DNA, 25 bp, Rattus norvegicus
tgtatctactgtttctcttctacca

SEQ ID NO: 644301 - DNA, 25 bp, Rattus norvegicus
tgtatctacttcaattttgccttta

SEQ ID NO: 644302 - DNA, 25 bp, Rattus norvegicus
tgtatctacttctattttgccttta

SEQ ID NO: 644303 - DNA, 25 bp, Rattus norvegicus
tgtatctattacatcacctgatccc

SEQ ID NO: 644304 - DNA, 25 bp, Rattus norvegicus
tgtatctattacttcacctgatccc

SEQ ID NO: 644305 - DNA, 25 bp, Rattus norvegicus
tgtatctattgactgccctttttga

SEQ ID NO: 644306 - DNA, 25 bp, Rattus norvegicus
tgtatctattgagtgccctttttga

SEQ ID NO: 644307 - DNA, 25 bp, Rattus norvegicus
tgtatctcatgcaggcttggagctt

SEQ ID NO: 644308 - DNA, 25 bp, Rattus norvegicus
tgtatctcatgctggcttggagctt

SEQ ID NO: 644309 - DNA, 25 bp, Rattus norvegicus
tgtatctcccaaccagatgttacaa

SEQ ID NO: 644310 - DNA, 25 bp, Rattus norvegicus
tgtatctcccaagcagatgttacaa

SEQ ID NO: 644311 - DNA, 25 bp, Rattus norvegicus
tgtatctcccctatccaagaaatgt

SEQ ID NO: 644312 - DNA, 25 bp, Rattus norvegicus
tgtatctcccctttccaagaaatgt

SEQ ID NO: 644313 - DNA, 25 bp, Rattus norvegicus
tgtatctctcacagcaagacttggc

SEQ ID NO: 644314 - DNA, 25 bp, Rattus norvegicus
tgtatctctcactgcaagacttggc

SEQ ID NO: 644315 - DNA, 25 bp, Rattus norvegicus
tgtatctctcctagtgtgcatcatc

SEQ ID NO: 644316 - DNA, 25 bp, Rattus norvegicus
tgtatctctccttgtgtgcatcatc

SEQ ID NO: 644317 - DNA, 25 bp, Rattus norvegicus
tgtatctctgtacttggtgttgtca

SEQ ID NO: 644318 - DNA, 25 bp, Rattus norvegicus
tgtatctctgtagttggtgttgtca

SEQ ID NO: 644319 - DNA, 25 bp, Rattus norvegicus
tgtatctgcacccaagttgtttcac

SEQ ID NO: 644320 - DNA, 25 bp, Rattus norvegicus
tgtatctgcaccgaagttgtttcac

SEQ ID NO: 644321 - DNA, 25 bp, Rattus norvegicus
tgtatctggtgactgggctggagcc

SEQ ID NO: 644322 - DNA, 25 bp, Rattus norvegicus
tgtatctggtgagtgggctggagcc

SEQ ID NO: 644323 - DNA, 25 bp, Rattus norvegicus
tgtatcttaaacagactgcatcgtc

SEQ ID NO: 644324 - DNA, 25 bp, Rattus norvegicus
tgtatcttaaactgactgcatcgtc

SEQ ID NO: 644325 - DNA, 25 bp, Rattus norvegicus
tgtatcttaactactgagtgcacca

SEQ ID NO: 644326 - DNA, 25 bp, Rattus norvegicus
tgtatcttaacttctgagtgcacca

SEQ ID NO: 644327 - DNA, 25 bp, Rattus norvegicus
tgtatcttcaggataaaacggccct

SEQ ID NO: 644328 - DNA, 25 bp, Rattus norvegicus
tgtatcttcaggttaaaacggccct

SEQ ID NO: 644329 - DNA, 25 bp, Rattus norvegicus
tgtatcttgaagctcctggtgctgc

SEQ ID NO: 644330 - DNA, 25 bp, Rattus norvegicus
tgtatcttgaaggtcctggtgctgc

SEQ ID NO: 644331 - DNA, 25 bp, Rattus norvegicus
tgtatcttgattataggcaggccta

SEQ ID NO: 644332 - DNA, 25 bp, Rattus norvegicus
tgtatcttgattttaggcaggccta

SEQ ID NO: 644333 - DNA, 25 bp, Rattus norvegicus
tgtatcttgtgaccagagcttctct

SEQ ID NO: 644334 - DNA, 25 bp, Rattus norvegicus
tgtatcttgtgagcagagcttctct

SEQ ID NO: 644335 - DNA, 25 bp, Rattus norvegicus
tgtatgaaatctccccagttccgag

SEQ ID NO: 644336 - DNA, 25 bp, Rattus norvegicus
tgtatgaaatctgcccagttccgag

SEQ ID NO: 644337 - DNA, 25 bp, Rattus norvegicus
tgtatgaaatggatctctctcccgg

SEQ ID NO: 644338 - DNA, 25 bp, Rattus norvegicus
tgtatgaaatggttctctctcccgg

SEQ ID NO: 644339 - DNA, 25 bp, Rattus norvegicus
tgtatgaagaccaactacagtgtac

SEQ ID NO: 644340 - DNA, 25 bp, Rattus norvegicus
tgtatgaagacctactacagtgtac

SEQ ID NO: 644341 - DNA, 25 bp, Rattus norvegicus
tgtatgaagtctcgcacactcctga

SEQ ID NO: 644342 - DNA, 25 bp, Rattus norvegicus
tgtatgaagtctggcacactcctga

SEQ ID NO: 644343 - DNA, 25 bp, Rattus norvegicus
tgtatgaattcaatgttgggcccaa

SEQ ID NO: 644344 - DNA, 25 bp, Rattus norvegicus
tgtatgaattcattgttgggcccaa

SEQ ID NO: 644345 - DNA, 25 bp, Rattus norvegicus
tgtatgacagctactggcggcagtt

SEQ ID NO: 644346 - DNA, 25 bp, Rattus norvegicus
tgtatgacagcttctggcggcagtt

SEQ ID NO: 644347 - DNA, 25 bp, Rattus norvegicus
tgtatgacccgtccctcaactgcta

SEQ ID NO: 644348 - DNA, 25 bp, Rattus norvegicus
tgtatgacccgtgcctcaactgcta

SEQ ID NO: 644349 - DNA, 25 bp, Rattus norvegicus
tgtatgacctgcagaaggttcgcct

SEQ ID NO: 644350 - DNA, 25 bp, Rattus norvegicus
tgtatgacctgctgaaggttcgcct

SEQ ID NO: 644351 - DNA, 25 bp, Rattus norvegicus
tgtatgacgctgcgcacgttgagtg

SEQ ID NO: 644352 - DNA, 25 bp, Rattus norvegicus
tgtatgacgctgggcacgttgagtg

SEQ ID NO: 644353 - DNA, 25 bp, Rattus norvegicus
tgtatgactcagcagggaccacctt

SEQ ID NO: 644354 - DNA, 25 bp, Rattus norvegicus
tgtatgactcaggagggaccacctt

SEQ ID NO: 644355 - DNA, 25 bp, Rattus norvegicus
tgtatgactgccatgtctctccatc

SEQ ID NO: 644356 - DNA, 25 bp, Rattus norvegicus
tgtatgactgccttgtctctccatc

SEQ ID NO: 644357 - DNA, 25 bp, Rattus norvegicus
tgtatgagcaggacttggcgccacg

SEQ ID NO: 644358 - DNA, 25 bp, Rattus norvegicus
tgtatgagcaggtcttggcgccacg

SEQ ID NO: 644359 - DNA, 25 bp, Rattus norvegicus
tgtatgagctctatgacccatgcac

SEQ ID NO: 644360 - DNA, 25 bp, Rattus norvegicus
tgtatgagctctttgacccatgcac

SEQ ID NO: 644361 - DNA, 25 bp, Rattus norvegicus
tgtatgaggctcatggcagccatgt

SEQ ID NO: 644362 - DNA, 25 bp, Rattus norvegicus
tgtatgaggctcttggcagccatgt

SEQ ID NO: 644363 - DNA, 25 bp, Rattus norvegicus
tgtatgagtcttcgatggttggatc

SEQ ID NO: 644364 - DNA, 25 bp, Rattus norvegicus
tgtatgagtcttggatggttggatc

SEQ ID NO: 644365 - DNA, 25 bp, Rattus norvegicus
tgtatgatccgaattcccatgcaga

SEQ ID NO: 644366 - DNA, 25 bp, Rattus norvegicus
tgtatgatccgatttcccatgcaga

SEQ ID NO: 644367 - DNA, 25 bp, Rattus norvegicus
tgtatgatgctgaaccatcctgcga

SEQ ID NO: 644368 - DNA, 25 bp, Rattus norvegicus
tgtatgatgctgtaccatcctgcga

SEQ ID NO: 644369 - DNA, 25 bp, Rattus norvegicus
tgtatgatggtcatcttcttgagca

SEQ ID NO: 644370 - DNA, 25 bp, Rattus norvegicus
tgtatgatggtcttcttcttgagca

SEQ ID NO: 644371 - DNA, 25 bp, Rattus norvegicus
tgtatgatttgtctctccttctgaa

SEQ ID NO: 644372 - DNA, 25 bp, Rattus norvegicus
tgtatgatttgtgtctccttctgaa

SEQ ID NO: 644373 - DNA, 25 bp, Rattus norvegicus
tgtatgcaaacaccggaagaactta

SEQ ID NO: 644374 - DNA, 25 bp, Rattus norvegicus
tgtatgcaaacagcggaagaactta

SEQ ID NO: 644375 - DNA, 25 bp, Rattus norvegicus
tgtatgcagtgccgtatggttcctc

SEQ ID NO: 644376 - DNA, 25 bp, Rattus norvegicus
tgtatgcagtgcggtatggttcctc

SEQ ID NO: 644377 - DNA, 25 bp, Rattus norvegicus
tgtatgccaaagatccccagaagtc

SEQ ID NO: 644378 - DNA, 25 bp, Rattus norvegicus
tgtatgccaaagttccccagaagtc

SEQ ID NO: 644379 - DNA, 25 bp, Rattus norvegicus
tgtatgccaacactaagtcttcctc

SEQ ID NO: 644380 - DNA, 25 bp, Rattus norvegicus
tgtatgccaacagtaagtcttcctc

SEQ ID NO: 644381 - DNA, 25 bp, Rattus norvegicus
tgtatgccaacccatctctgtgaac

SEQ ID NO: 644382 - DNA, 25 bp, Rattus norvegicus
tgtatgccaaccgatctctgtgaac

SEQ ID NO: 644383 - DNA, 25 bp, Rattus norvegicus
tgtatgccacatcctgtgccaataa

SEQ ID NO: 644384 - DNA, 25 bp, Rattus norvegicus
tgtatgccacatgctgtgccaataa

SEQ ID NO: 644385 - DNA, 25 bp, Rattus norvegicus
tgtatgccagtcactcacagttcat

SEQ ID NO: 644386 - DNA, 25 bp, Rattus norvegicus
tgtatgccagtctctcacagttcat

SEQ ID NO: 644387 - DNA, 25 bp, Rattus norvegicus
tgtatgccataaagcccctgaaagt

SEQ ID NO: 644388 - DNA, 25 bp, Rattus norvegicus
tgtatgccataatgcccctgaaagt

SEQ ID NO: 644389 - DNA, 25 bp, Rattus norvegicus
tgtatgcccgacaaaaccgaaaaag

SEQ ID NO: 644390 - DNA, 25 bp, Rattus norvegicus
tgtatgcccgactaaaccgaaaaag

SEQ ID NO: 644391 - DNA, 25 bp, Rattus norvegicus
tgtatgccgatgaccttcgtggatc

SEQ ID NO: 644392 - DNA, 25 bp, Rattus norvegicus
tgtatgccgatgtccttcgtggatc

SEQ ID NO: 644393 - DNA, 25 bp, Rattus norvegicus
tgtatgccgcgaatgtccaggcaag

SEQ ID NO: 644394 - DNA, 25 bp, Rattus norvegicus
tgtatgccgcgattgtccaggcaag

SEQ ID NO: 644395 - DNA, 25 bp, Rattus norvegicus
tgtatgcctcagattatatcccctt

SEQ ID NO: 644396 - DNA, 25 bp, Rattus norvegicus
tgtatgcctcagtttatatcccctt

SEQ ID NO: 644397 - DNA, 25 bp, Rattus norvegicus
tgtatgcctgaaccagatgacctca

SEQ ID NO: 644398 - DNA, 25 bp, Rattus norvegicus
tgtatgcctgaacgaagccttgctt

SEQ ID NO: 644399 - DNA, 25 bp, Rattus norvegicus
tgtatgcctgaagcagatgacctca

SEQ ID NO: 644400 - DNA, 25 bp, Rattus norvegicus
tgtatgcctgaaggaagccttgctt

SEQ ID NO: 644401 - DNA, 25 bp, Rattus norvegicus
tgtatgcgcgccaggcggagaaatt

SEQ ID NO: 644402 - DNA, 25 bp, Rattus norvegicus
tgtatgcgcgcctggcggagaaatt

SEQ ID NO: 644403 - DNA, 25 bp, Rattus norvegicus
tgtatgctaagtctggaccctcttc

SEQ ID NO: 644404 - DNA, 25 bp, Rattus norvegicus
tgtatgctaagtgtggaccctcttc

SEQ ID NO: 644405 - DNA, 25 bp, Rattus norvegicus
tgtatgctctttcgcacttacatga

SEQ ID NO: 644406 - DNA, 25 bp, Rattus norvegicus
tgtatgctctttggcacttacatga

SEQ ID NO: 644407 - DNA, 25 bp, Rattus norvegicus
tgtatgctgcacagggtttctcttt

SEQ ID NO: 644408 - DNA, 25 bp, Rattus norvegicus
tgtatgctgcactgggtttctcttt

SEQ ID NO: 644409 - DNA, 25 bp, Rattus norvegicus
tgtatgctgtgcaagtcagtgccct

SEQ ID NO: 644410 - DNA, 25 bp, Rattus norvegicus
tgtatgctgtgctagtcagtgccct

SEQ ID NO: 644411 - DNA, 25 bp, Rattus norvegicus
tgtatgctgttaaggttacctcacc

SEQ ID NO: 644412 - DNA, 25 bp, Rattus norvegicus
tgtatgctgttatggttacctcacc

SEQ ID NO: 644413 - DNA, 25 bp, Rattus norvegicus
tgtatgctttatattccatccgcga

SEQ ID NO: 644414 - DNA, 25 bp, Rattus norvegicus
tgtatgctttattttccatccgcga

SEQ ID NO: 644415 - DNA, 25 bp, Rattus norvegicus
tgtatggaagatctccaggtctccc

SEQ ID NO: 644416 - DNA, 25 bp, Rattus norvegicus
tgtatggaagatgtccaggtctccc

SEQ ID NO: 644417 - DNA, 25 bp, Rattus norvegicus
tgtatggacccacgcacaagagcat

SEQ ID NO: 644418 - DNA, 25 bp, Rattus norvegicus
tgtatggacccaggcacaagagcat

SEQ ID NO: 644419 - DNA, 25 bp, Rattus norvegicus
tgtatggagtgtaccgatgtccgat

SEQ ID NO: 644420 - DNA, 25 bp, Rattus norvegicus
tgtatggagtgttccgatgtccgat

SEQ ID NO: 644421 - DNA, 25 bp, Rattus norvegicus
tgtatggatccacgcttgtcaaact

SEQ ID NO: 644422 - DNA, 25 bp, Rattus norvegicus
tgtatggatccaggcttgtcaaact

SEQ ID NO: 644423 - DNA, 25 bp, Rattus norvegicus
tgtatggatctaatcacgggcccac

SEQ ID NO: 644424 - DNA, 25 bp, Rattus norvegicus
tgtatggatctattcacgggcccac

SEQ ID NO: 644425 - DNA, 25 bp, Rattus norvegicus
tgtatggcaaggatcggcatgcaga

SEQ ID NO: 644426 - DNA, 25 bp, Rattus norvegicus
tgtatggcaaggttcggcatgcaga

SEQ ID NO: 644427 - DNA, 25 bp, Rattus norvegicus
tgtatggcatctccctctcctggag

SEQ ID NO: 644428 - DNA, 25 bp, Rattus norvegicus
tgtatggcatctgcctctcctggag

SEQ ID NO: 644429 - DNA, 25 bp, Rattus norvegicus
tgtatggctcatccccactgttaaa

SEQ ID NO: 644430 - DNA, 25 bp, Rattus norvegicus
tgtatggctcatgcccactgttaaa

SEQ ID NO: 644431 - DNA, 25 bp, Rattus norvegicus
tgtatggctggcagtcactttctga

SEQ ID NO: 644432 - DNA, 25 bp, Rattus norvegicus
tgtatggctggctgtcactttctga

SEQ ID NO: 644433 - DNA, 25 bp, Rattus norvegicus
tgtatgggccacagacacctgggct

SEQ ID NO: 644434 - DNA, 25 bp, Rattus norvegicus
tgtatgggccactgacacctgggct

SEQ ID NO: 644435 - DNA, 25 bp, Rattus norvegicus
tgtatgggttaaaccggccgtgagc

SEQ ID NO: 644436 - DNA, 25 bp, Rattus norvegicus
tgtatgggttaatccggccgtgagc

SEQ ID NO: 644437 - DNA, 25 bp, Rattus norvegicus
tgtatgggttggcttacccacccag

SEQ ID NO: 644438 - DNA, 25 bp, Rattus norvegicus
tgtatgggttgggttacccacccag

SEQ ID NO: 644439 - DNA, 25 bp, Rattus norvegicus
tgtatggtccagactttcttaaccc

SEQ ID NO: 644440 - DNA, 25 bp, Rattus norvegicus
tgtatggtccagtctttcttaaccc

SEQ ID NO: 644441 - DNA, 25 bp, Rattus norvegicus
tgtatggtccatccccaatgctggt

SEQ ID NO: 644442 - DNA, 25 bp, Rattus norvegicus
tgtatggtccatgcccaatgctggt

SEQ ID NO: 644443 - DNA, 25 bp, Rattus norvegicus
tgtatggttatgcacttctcgggaa

SEQ ID NO: 644444 - DNA, 25 bp, Rattus norvegicus
tgtatggttatggacttctcgggaa

SEQ ID NO: 644445 - DNA, 25 bp, Rattus norvegicus
tgtatggttcccactatgaggccca

SEQ ID NO: 644446 - DNA, 25 bp, Rattus norvegicus
tgtatggttccctctatgaggccca

SEQ ID NO: 644447 - DNA, 25 bp, Rattus norvegicus
tgtatggttggtcgctcagtatctg

SEQ ID NO: 644448 - DNA, 25 bp, Rattus norvegicus
tgtatggttggtggctcagtatctg

SEQ ID NO: 644449 - DNA, 25 bp, Rattus norvegicus
tgtatgtaatatacctccttttcct

SEQ ID NO: 644450 - DNA, 25 bp, Rattus norvegicus
tgtatgtaatattcctccttttcct

SEQ ID NO: 644451 - DNA, 25 bp, Rattus norvegicus
tgtatgtatgttcaccacccttaga

SEQ ID NO: 644452 - DNA, 25 bp, Rattus norvegicus
tgtatgtatgttgaccacccttaga

SEQ ID NO: 644453 - DNA, 25 bp, Rattus norvegicus
tgtatgtcaacacggctgcctgcta

SEQ ID NO: 644454 - DNA, 25 bp, Rattus norvegicus
tgtatgtcaacagggctgcctgcta

SEQ ID NO: 644455 - DNA, 25 bp, Rattus norvegicus
tgtatgtccaaactcctgtgatttt

SEQ ID NO: 644456 - DNA, 25 bp, Rattus norvegicus
tgtatgtccaaagtcctgtgatttt

SEQ ID NO: 644457 - DNA, 25 bp, Rattus norvegicus
tgtatgtccacaacatgctcagagc

SEQ ID NO: 644458 - DNA, 25 bp, Rattus norvegicus
tgtatgtccacatcatgctcagagc

SEQ ID NO: 644459 - DNA, 25 bp, Rattus norvegicus
tgtatgtcctggatggagttggctt

SEQ ID NO: 644460 - DNA, 25 bp, Rattus norvegicus
tgtatgtcctggttggagttggctt

SEQ ID NO: 644461 - DNA, 25 bp, Rattus norvegicus
tgtatgtcttccctttatttctcac

SEQ ID NO: 644462 - DNA, 25 bp, Rattus norvegicus
tgtatgtcttccgtttatttctcac

SEQ ID NO: 644463 - DNA, 25 bp, Rattus norvegicus
tgtatgtcttctcatgctctgtgaa

SEQ ID NO: 644464 - DNA, 25 bp, Rattus norvegicus
tgtatgtcttctgatgctctgtgaa

SEQ ID NO: 644465 - DNA, 25 bp, Rattus norvegicus
tgtatgtgacagctgacactgcact

SEQ ID NO: 644466 - DNA, 25 bp, Rattus norvegicus
tgtatgtgacaggtgacactgcact

SEQ ID NO: 644467 - DNA, 25 bp, Rattus norvegicus
tgtatgtgactacttttcattctgc

SEQ ID NO: 644468 - DNA, 25 bp, Rattus norvegicus
tgtatgtgactagttttcattctgc

SEQ ID NO: 644469 - DNA, 25 bp, Rattus norvegicus
tgtatgtgccacactcatctgttta

SEQ ID NO: 644470 - DNA, 25 bp, Rattus norvegicus
tgtatgtgccactctcatctgttta

SEQ ID NO: 644471 - DNA, 25 bp, Rattus norvegicus
tgtatgtgccttcaaacatcccctg

SEQ ID NO: 644472 - DNA, 25 bp, Rattus norvegicus
tgtatgtgccttgaaacatcccctg

SEQ ID NO: 644473 - DNA, 25 bp, Rattus norvegicus
tgtatgtgctgtaatcgaagcctat

SEQ ID NO: 644474 - DNA, 25 bp, Rattus norvegicus
tgtatgtgctgttatcgaagcctat

SEQ ID NO: 644475 - DNA, 25 bp, Rattus norvegicus
tgtatgtggcctataacacccaact

SEQ ID NO: 644476 - DNA, 25 bp, Rattus norvegicus
tgtatgtggcctttaacacccaact

SEQ ID NO: 644477 - DNA, 25 bp, Rattus norvegicus
tgtatgtggcttattgaagtcttcc

SEQ ID NO: 644478 - DNA, 25 bp, Rattus norvegicus
tgtatgtggctttttgaagtcttcc

SEQ ID NO: 644479 - DNA, 25 bp, Rattus norvegicus
tgtatgtggtcgctttttggttttt

SEQ ID NO: 644480 - DNA, 25 bp, Rattus norvegicus
tgtatgtggtcggtttttggttttt

SEQ ID NO: 644481 - DNA, 25 bp, Rattus norvegicus
tgtatgtgtcagagcccgccgtgca

SEQ ID NO: 644482 - DNA, 25 bp, Rattus norvegicus
tgtatgtgtcagtgcccgccgtgca

SEQ ID NO: 644483 - DNA, 25 bp, Rattus norvegicus
tgtatgtgtcctaatctcagccttt

SEQ ID NO: 644484 - DNA, 25 bp, Rattus norvegicus
tgtatgtgtccttatctcagccttt

SEQ ID NO: 644485 - DNA, 25 bp, Rattus norvegicus
tgtatgtgtctgatctgctacctgt

SEQ ID NO: 644486 - DNA, 25 bp, Rattus norvegicus
tgtatgtgtctgttctgctacctgt

SEQ ID NO: 644487 - DNA, 25 bp, Rattus norvegicus
tgtatgtgtgacatctccaccaacc

SEQ ID NO: 644488 - DNA, 25 bp, Rattus norvegicus
tgtatgtgtgacttctccaccaacc

SEQ ID NO: 644489 - DNA, 25 bp, Rattus norvegicus
tgtatgttagccatcagtttcctca

SEQ ID NO: 644490 - DNA, 25 bp, Rattus norvegicus
tgtatgttagccttcagtttcctca

SEQ ID NO: 644491 - DNA, 25 bp, Rattus norvegicus
tgtatgttcagacgcaatcagttgt

SEQ ID NO: 644492 - DNA, 25 bp, Rattus norvegicus
tgtatgttcagaggcaatcagttgt

SEQ ID NO: 644493 - DNA, 25 bp, Rattus norvegicus
tgtatgttgcttacgaacccactga

SEQ ID NO: 644494 - DNA, 25 bp, Rattus norvegicus
tgtatgttgctttcgaacccactga

SEQ ID NO: 644495 - DNA, 25 bp, Rattus norvegicus
tgtatgtttaataacggcgaccccg

SEQ ID NO: 644496 - DNA, 25 bp, Rattus norvegicus
tgtatgtttaattacggcgaccccg

SEQ ID NO: 644497 - DNA, 25 bp, Rattus norvegicus
tgtatgtttctgagtgatccacttt

SEQ ID NO: 644498 - DNA, 25 bp, Rattus norvegicus
tgtatgtttctgtgtgatccacttt

SEQ ID NO: 644499 - DNA, 25 bp, Rattus norvegicus
tgtattaacggtagcctcatttttt

SEQ ID NO: 644500 - DNA, 25 bp, Rattus norvegicus
tgtattaacggttgcctcatttttt

SEQ ID NO: 644501 - DNA, 25 bp, Rattus norvegicus
tgtattaccaatcagtgcactcctt

SEQ ID NO: 644502 - DNA, 25 bp, Rattus norvegicus
tgtattaccaatgagtgcactcctt

SEQ ID NO: 644503 - DNA, 25 bp, Rattus norvegicus
tgtattagacatcgtccctgccatc

SEQ ID NO: 644504 - DNA, 25 bp, Rattus norvegicus
tgtattagacatggtccctgccatc

SEQ ID NO: 644505 - DNA, 25 bp, Rattus norvegicus
tgtattaggaaacacggctcctctt

SEQ ID NO: 644506 - DNA, 25 bp, Rattus norvegicus
tgtattaggaaagacggctcctctt

SEQ ID NO: 644507 - DNA, 25 bp, Rattus norvegicus
tgtattagtcacagatttatcataa

SEQ ID NO: 644508 - DNA, 25 bp, Rattus norvegicus
tgtattagtcactgatttatcataa

SEQ ID NO: 644509 - DNA, 25 bp, Rattus norvegicus
tgtattattcatagcctcaaccctt

SEQ ID NO: 644510 - DNA, 25 bp, Rattus norvegicus
tgtattattcattgcctcaaccctt

SEQ ID NO: 644511 - DNA, 25 bp, Rattus norvegicus
tgtattattcctatcaaaccttttg

SEQ ID NO: 644512 - DNA, 25 bp, Rattus norvegicus
tgtattattcctttcaaaccttttg

SEQ ID NO: 644513 - DNA, 25 bp, Rattus norvegicus
tgtattattctcaattacccttgga

SEQ ID NO: 644514 - DNA, 25 bp, Rattus norvegicus
tgtattattctctattacccttgga

SEQ ID NO: 644515 - DNA, 25 bp, Rattus norvegicus
tgtattcaaaagatcgatcccgcta

SEQ ID NO: 644516 - DNA, 25 bp, Rattus norvegicus
tgtattcaaaagttcgatcccgcta

SEQ ID NO: 644517 - DNA, 25 bp, Rattus norvegicus
tgtattcacagcaagtactccccag

SEQ ID NO: 644518 - DNA, 25 bp, Rattus norvegicus
tgtattcacagctagtactccccag

SEQ ID NO: 644519 - DNA, 25 bp, Rattus norvegicus
tgtattcagggcacattcagagcta

SEQ ID NO: 644520 - DNA, 25 bp, Rattus norvegicus
tgtattcagggctcattcagagcta

SEQ ID NO: 644521 - DNA, 25 bp, Rattus norvegicus
tgtattcatacactgggatttatct

SEQ ID NO: 644522 - DNA, 25 bp, Rattus norvegicus
tgtattcatacagtgggatttatct

SEQ ID NO: 644523 - DNA, 25 bp, Rattus norvegicus
tgtattcatactacacctcatcatg

SEQ ID NO: 644524 - DNA, 25 bp, Rattus norvegicus
tgtattcatacttcacctcatcatg

SEQ ID NO: 644525 - DNA, 25 bp, Rattus norvegicus
tgtattcatcaacataaccttgtct

SEQ ID NO: 644526 - DNA, 25 bp, Rattus norvegicus
tgtattcatcaagataaccttgtct

SEQ ID NO: 644527 - DNA, 25 bp, Rattus norvegicus
tgtattccagccatcttcagagcca

SEQ ID NO: 644528 - DNA, 25 bp, Rattus norvegicus
tgtattccagccttcttcagagcca

SEQ ID NO: 644529 - DNA, 25 bp, Rattus norvegicus
tgtattccatgcactctcagaggga

SEQ ID NO: 644530 - DNA, 25 bp, Rattus norvegicus
tgtattccatgctctctcagaggga

SEQ ID NO: 644531 - DNA, 25 bp, Rattus norvegicus
tgtattccgagacctcgcgctgcgc

SEQ ID NO: 644532 - DNA, 25 bp, Rattus norvegicus
tgtattccgagagctcgcgctgcgc

SEQ ID NO: 644533 - DNA, 25 bp, Rattus norvegicus
tgtattcctacacatattcccctac

SEQ ID NO: 644534 - DNA, 25 bp, Rattus norvegicus
tgtattcctacagatattcccctac

SEQ ID NO: 644535 - DNA, 25 bp, Rattus norvegicus
tgtattcctggcaccttaggttgga

SEQ ID NO: 644536 - DNA, 25 bp, Rattus norvegicus
tgtattcctggctccttaggttgga

SEQ ID NO: 644537 - DNA, 25 bp, Rattus norvegicus
tgtattctctttctaacctacctca

SEQ ID NO: 644538 - DNA, 25 bp, Rattus norvegicus
tgtattctctttgtaacctacctca

SEQ ID NO: 644539 - DNA, 25 bp, Rattus norvegicus
tgtattctgccaaaccactcactat

SEQ ID NO: 644540 - DNA, 25 bp, Rattus norvegicus
tgtattctgccataccactcactat

SEQ ID NO: 644541 - DNA, 25 bp, Rattus norvegicus
tgtattctgtagctgcgtgcactcc

SEQ ID NO: 644542 - DNA, 25 bp, Rattus norvegicus
tgtattctgtaggtgcgtgcactcc

SEQ ID NO: 644543 - DNA, 25 bp, Rattus norvegicus
tgtattcttacacctccggttattt

SEQ ID NO: 644544 - DNA, 25 bp, Rattus norvegicus
tgtattcttacagctccggttattt

SEQ ID NO: 644545 - DNA, 25 bp, Rattus norvegicus
tgtattgactagctctgcgcagaca

SEQ ID NO: 644546 - DNA, 25 bp, Rattus norvegicus
tgtattgactaggtctgcgcagaca

SEQ ID NO: 644547 - DNA, 25 bp, Rattus norvegicus
tgtattgagcatcgcctagatcgta

SEQ ID NO: 644548 - DNA, 25 bp, Rattus norvegicus
tgtattgagcatggcctagatcgta

SEQ ID NO: 644549 - DNA, 25 bp, Rattus norvegicus
tgtattgagctgctcttctgctttc

SEQ ID NO: 644550 - DNA, 25 bp, Rattus norvegicus
tgtattgagctggtcttctgctttc

SEQ ID NO: 644551 - DNA, 25 bp, Rattus norvegicus
tgtattgcaagcctcgagtgatctg

SEQ ID NO: 644552 - DNA, 25 bp, Rattus norvegicus
tgtattgcaagcgtcgagtgatctg

SEQ ID NO: 644553 - DNA, 25 bp, Rattus norvegicus
tgtattgcagccacagccctttgac

SEQ ID NO: 644554 - DNA, 25 bp, Rattus norvegicus
tgtattgcagcctcagccctttgac

SEQ ID NO: 644555 - DNA, 25 bp, Rattus norvegicus
tgtattgccggtcctggaggtctaa

SEQ ID NO: 644556 - DNA, 25 bp, Rattus norvegicus
tgtattgccggtgctggaggtctaa

SEQ ID NO: 644557 - DNA, 25 bp, Rattus norvegicus
tgtattgctcacactatcagaaggc

SEQ ID NO: 644558 - DNA, 25 bp, Rattus norvegicus
tgtattgctcactctatcagaaggc

SEQ ID NO: 644559 - DNA, 25 bp, Rattus norvegicus
tgtattggcataatcctctaatccc

SEQ ID NO: 644560 - DNA, 25 bp, Rattus norvegicus
tgtattggcatattcctctaatccc

SEQ ID NO: 644561 - DNA, 25 bp, Rattus norvegicus
tgtattggccccagctgtatgacgt

SEQ ID NO: 644562 - DNA, 25 bp, Rattus norvegicus
tgtattggcccctgctgtatgacgt

SEQ ID NO: 644563 - DNA, 25 bp, Rattus norvegicus
tgtattggcgcaagttggtggccct

SEQ ID NO: 644564 - DNA, 25 bp, Rattus norvegicus
tgtattggcgcatgttggtggccct

SEQ ID NO: 644565 - DNA, 25 bp, Rattus norvegicus
tgtattgtcattcgtgcctctgtca

SEQ ID NO: 644566 - DNA, 25 bp, Rattus norvegicus
tgtattgtcattggtgcctctgtca

SEQ ID NO: 644567 - DNA, 25 bp, Rattus norvegicus
tgtattgtggacagactttgcctca

SEQ ID NO: 644568 - DNA, 25 bp, Rattus norvegicus
tgtattgtggactgactttgcctca

SEQ ID NO: 644569 - DNA, 25 bp, Rattus norvegicus
tgtattgtggcactcagaatgcccc

SEQ ID NO: 644570 - DNA, 25 bp, Rattus norvegicus
tgtattgtggcagtcagaatgcccc

SEQ ID NO: 644571 - DNA, 25 bp, Rattus norvegicus
tgtattgtgtctccgtgaactgcat

SEQ ID NO: 644572 - DNA, 25 bp, Rattus norvegicus
tgtattgtgtctgcgtgaactgcat

SEQ ID NO: 644573 - DNA, 25 bp, Rattus norvegicus
tgtattgttttaacgtgggccttat

SEQ ID NO: 644574 - DNA, 25 bp, Rattus norvegicus
tgtattgttttatcgtgggccttat

SEQ ID NO: 644575 - DNA, 25 bp, Rattus norvegicus
tgtatttaatcaccgtgtattccat

SEQ ID NO: 644576 - DNA, 25 bp, Rattus norvegicus
tgtatttaatcagcgtgtattccat

SEQ ID NO: 644577 - DNA, 25 bp, Rattus norvegicus
tgtatttaatgcagacccagcccag

SEQ ID NO: 644578 - DNA, 25 bp, Rattus norvegicus
tgtatttaatgctgacccagcccag

SEQ ID NO: 644579 - DNA, 25 bp, Rattus norvegicus
tgtatttaggtacctcccacctggg

SEQ ID NO: 644580 - DNA, 25 bp, Rattus norvegicus
tgtatttaggtagctcccacctggg

SEQ ID NO: 644581 - DNA, 25 bp, Rattus norvegicus
tgtatttatatcagccttctaccgc

SEQ ID NO: 644582 - DNA, 25 bp, Rattus norvegicus
tgtatttatatctgccttctaccgc

SEQ ID NO: 644583 - DNA, 25 bp, Rattus norvegicus
tgtatttatcttaagggcacctggg

SEQ ID NO: 644584 - DNA, 25 bp, Rattus norvegicus
tgtatttatctttagggcacctggg

SEQ ID NO: 644585 - DNA, 25 bp, Rattus norvegicus
tgtatttattccaaagcctttcact

SEQ ID NO: 644586 - DNA, 25 bp, Rattus norvegicus
tgtatttattcctaagcctttcact

SEQ ID NO: 644587 - DNA, 25 bp, Rattus norvegicus
tgtatttatttcaatcccctttttg

SEQ ID NO: 644588 - DNA, 25 bp, Rattus norvegicus
tgtatttatttctatcccctttttg

SEQ ID NO: 644589 - DNA, 25 bp, Rattus norvegicus
tgtatttattttcctccccaggagc

SEQ ID NO: 644590 - DNA, 25 bp, Rattus norvegicus
tgtatttattttgctccccaggagc

SEQ ID NO: 644591 - DNA, 25 bp, Rattus norvegicus
tgtatttcaaagcttctcatcggtt

SEQ ID NO: 644592 - DNA, 25 bp, Rattus norvegicus
tgtatttcaaaggttctcatcggtt

SEQ ID NO: 644593 - DNA, 25 bp, Rattus norvegicus
tgtatttccattagcaacgtttttt

SEQ ID NO: 644594 - DNA, 25 bp, Rattus norvegicus
tgtatttccatttgcaacgtttttt

SEQ ID NO: 644595 - DNA, 25 bp, Rattus norvegicus
tgtatttccccaaagctttctctgt

SEQ ID NO: 644596 - DNA, 25 bp, Rattus norvegicus
tgtatttccccatagctttctctgt

SEQ ID NO: 644597 - DNA, 25 bp, Rattus norvegicus
tgtatttccgctactgtattttctt

SEQ ID NO: 644598 - DNA, 25 bp, Rattus norvegicus
tgtatttccgcttctgtattttctt

SEQ ID NO: 644599 - DNA, 25 bp, Rattus norvegicus
tgtatttcggcaacagttggagact

SEQ ID NO: 644600 - DNA, 25 bp, Rattus norvegicus
tgtatttcggcatcagttggagact

SEQ ID NO: 644601 - DNA, 25 bp, Rattus norvegicus
tgtatttcgtgcagacactaccctt

SEQ ID NO: 644602 - DNA, 25 bp, Rattus norvegicus
tgtatttcgtgctgacactaccctt

SEQ ID NO: 644603 - DNA, 25 bp, Rattus norvegicus
tgtatttctcttatggcagcgacca

SEQ ID NO: 644604 - DNA, 25 bp, Rattus norvegicus
tgtatttctcttttggcagcgacca

SEQ ID NO: 644605 - DNA, 25 bp, Rattus norvegicus
tgtatttctgtcatcgcagcgaggc

SEQ ID NO: 644606 - DNA, 25 bp, Rattus norvegicus
tgtatttctgtcttcgcagcgaggc

SEQ ID NO: 644607 - DNA, 25 bp, Rattus norvegicus
tgtatttcttccaccgtttatgtaa

SEQ ID NO: 644608 - DNA, 25 bp, Rattus norvegicus
tgtatttcttcctccgtttatgtaa

SEQ ID NO: 644609 - DNA, 25 bp, Rattus norvegicus
tgtatttcttgtagtttcgccagga

SEQ ID NO: 644610 - DNA, 25 bp, Rattus norvegicus
tgtatttcttgttgtttcgccagga

SEQ ID NO: 644611 - DNA, 25 bp, Rattus norvegicus
tgtatttctttcatgtgtaactgtg

SEQ ID NO: 644612 - DNA, 25 bp, Rattus norvegicus
tgtatttctttcttgtgtaactgtg

SEQ ID NO: 644613 - DNA, 25 bp, Rattus norvegicus
tgtatttgagtcaccctactgtctt

SEQ ID NO: 644614 - DNA, 25 bp, Rattus norvegicus
tgtatttgagtctccctactgtctt

SEQ ID NO: 644615 - DNA, 25 bp, Rattus norvegicus
tgtatttgccgtccgggatttgcac

SEQ ID NO: 644616 - DNA, 25 bp, Rattus norvegicus
tgtatttgccgtgcgggatttgcac

SEQ ID NO: 644617 - DNA, 25 bp, Rattus norvegicus
tgtatttgcctcatgtgatcctgtc

SEQ ID NO: 644618 - DNA, 25 bp, Rattus norvegicus
tgtatttgcctcttgtgatcctgtc

SEQ ID NO: 644619 - DNA, 25 bp, Rattus norvegicus
tgtatttgccttcgtctccactctt

SEQ ID NO: 644620 - DNA, 25 bp, Rattus norvegicus
tgtatttgccttggtctccactctt

SEQ ID NO: 644621 - DNA, 25 bp, Rattus norvegicus
tgtatttggttgctttgtgtcccct

SEQ ID NO: 644622 - DNA, 25 bp, Rattus norvegicus
tgtatttggttggtttgtgtcccct

SEQ ID NO: 644623 - DNA, 25 bp, Rattus norvegicus
tgtatttggtttccaggctcctgcc

SEQ ID NO: 644624 - DNA, 25 bp, Rattus norvegicus
tgtatttggtttgcaggctcctgcc

SEQ ID NO: 644625 - DNA, 25 bp, Rattus norvegicus
tgtatttgttgtagacagcagtcac

SEQ ID NO: 644626 - DNA, 25 bp, Rattus norvegicus
tgtatttgttgttgacagcagtcac

SEQ ID NO: 644627 - DNA, 25 bp, Rattus norvegicus
tgtattttaacactggtcctcctca

SEQ ID NO: 644628 - DNA, 25 bp, Rattus norvegicus
tgtattttaacagtggtcctcctca

SEQ ID NO: 644629 - DNA, 25 bp, Rattus norvegicus
tgtattttaccaactctgagcctaa

SEQ ID NO: 644630 - DNA, 25 bp, Rattus norvegicus
tgtattttaccatctctgagcctaa

SEQ ID NO: 644631 - DNA, 25 bp, Rattus norvegicus
tgtattttactcctgggtccatgca

SEQ ID NO: 644632 - DNA, 25 bp, Rattus norvegicus
tgtattttactcgtgggtccatgca

SEQ ID NO: 644633 - DNA, 25 bp, Rattus norvegicus
tgtattttcatcaaccttcgggcag

SEQ ID NO: 644634 - DNA, 25 bp, Rattus norvegicus
tgtattttcatctaccttcgggcag

SEQ ID NO: 644635 - DNA, 25 bp, Rattus norvegicus
tgtattttcttccttaccttggcca

SEQ ID NO: 644636 - DNA, 25 bp, Rattus norvegicus
tgtattttcttcgttaccttggcca

SEQ ID NO: 644637 - DNA, 25 bp, Rattus norvegicus
tgtattttctttagccttgcttggt

SEQ ID NO: 644638 - DNA, 25 bp, Rattus norvegicus
tgtattttcttttgccttgcttggt

SEQ ID NO: 644639 - DNA, 25 bp, Rattus norvegicus
tgtattttgtatcgtgtttccccac

SEQ ID NO: 644640 - DNA, 25 bp, Rattus norvegicus
tgtattttgtatggtgtttccccac

SEQ ID NO: 644641 - DNA, 25 bp, Rattus norvegicus
tgtattttgtggattctcctgtaaa

SEQ ID NO: 644642 - DNA, 25 bp, Rattus norvegicus
tgtattttgtggcagactgtaccca

SEQ ID NO: 644643 - DNA, 25 bp, Rattus norvegicus
tgtattttgtgggagactgtaccca

SEQ ID NO: 644644 - DNA, 25 bp, Rattus norvegicus
tgtattttgtggtttctcctgtaaa

SEQ ID NO: 644645 - DNA, 25 bp, Rattus norvegicus
tgtatttttacacccatatagtcta

SEQ ID NO: 644646 - DNA, 25 bp, Rattus norvegicus
tgtatttttacagccatatagtcta

SEQ ID NO: 644647 - DNA, 25 bp, Rattus norvegicus
tgtatttttctaagcactgggcgcc

SEQ ID NO: 644648 - DNA, 25 bp, Rattus norvegicus
tgtatttttctaatgggttagccag

SEQ ID NO: 644649 - DNA, 25 bp, Rattus norvegicus
tgtatttttctatgcactgggcgcc

SEQ ID NO: 644650 - DNA, 25 bp, Rattus norvegicus
tgtatttttctattgggttagccag

SEQ ID NO: 644651 - DNA, 25 bp, Rattus norvegicus
tgtatttttcttacccagcttactc

SEQ ID NO: 644652 - DNA, 25 bp, Rattus norvegicus
tgtatttttctttcccagcttactc

SEQ ID NO: 644653 - DNA, 25 bp, Rattus norvegicus
tgtatttttgtgacagccagcttcc

SEQ ID NO: 644654 - DNA, 25 bp, Rattus norvegicus
tgtatttttgtgtcagccagcttcc

SEQ ID NO: 644655 - DNA, 25 bp, Rattus norvegicus
tgtattttttaaacacccacgtgtg

SEQ ID NO: 644656 - DNA, 25 bp, Rattus norvegicus
tgtattttttaatcacccacgtgtg

SEQ ID NO: 644657 - DNA, 25 bp, Rattus norvegicus
tgtattttttccacctcgctgtaaa

SEQ ID NO: 644658 - DNA, 25 bp, Rattus norvegicus
tgtattttttcctcctcgctgtaaa

SEQ ID NO: 644659 - DNA, 25 bp, Rattus norvegicus
tgtcaaaaaacaatttaggcccctg

SEQ ID NO: 644660 - DNA, 25 bp, Rattus norvegicus
tgtcaaaaaacattttaggcccctg

SEQ ID NO: 644661 - DNA, 25 bp, Rattus norvegicus
tgtcaaaaatggctttcctgctcct

SEQ ID NO: 644662 - DNA, 25 bp, Rattus norvegicus
tgtcaaaaatgggtttcctgctcct

SEQ ID NO: 644663 - DNA, 25 bp, Rattus norvegicus
tgtcaaaactcacatccccaatgga

SEQ ID NO: 644664 - DNA, 25 bp, Rattus norvegicus
tgtcaaaactcagatccccaatgga

SEQ ID NO: 644665 - DNA, 25 bp, Rattus norvegicus
tgtcaaaatccactctgccttccgg

SEQ ID NO: 644666 - DNA, 25 bp, Rattus norvegicus
tgtcaaaatccagtctgccttccgg

SEQ ID NO: 644667 - DNA, 25 bp, Rattus norvegicus
tgtcaaaccacacagcaagccaagt

SEQ ID NO: 644668 - DNA, 25 bp, Rattus norvegicus
tgtcaaaccacagagcaagccaagt

SEQ ID NO: 644669 - DNA, 25 bp, Rattus norvegicus
tgtcaaacgggcattcctatctgtc

SEQ ID NO: 644670 - DNA, 25 bp, Rattus norvegicus
tgtcaaacgggctttcctatctgtc

SEQ ID NO: 644671 - DNA, 25 bp, Rattus norvegicus
tgtcaaactgggatgtttgctcctg

SEQ ID NO: 644672 - DNA, 25 bp, Rattus norvegicus
tgtcaaactgggttgtttgctcctg

SEQ ID NO: 644673 - DNA, 25 bp, Rattus norvegicus
tgtcaaacttttaagtgcacagaag

SEQ ID NO: 644674 - DNA, 25 bp, Rattus norvegicus
tgtcaaactttttagtgcacagaag

SEQ ID NO: 644675 - DNA, 25 bp, Rattus norvegicus
tgtcaaagaacaaaccagggcaaga

SEQ ID NO: 644676 - DNA, 25 bp, Rattus norvegicus
tgtcaaagaacataccagggcaaga

SEQ ID NO: 644677 - DNA, 25 bp, Rattus norvegicus
tgtcaaagaatcaagccgccttctg

SEQ ID NO: 644678 - DNA, 25 bp, Rattus norvegicus
tgtcaaagaatctagccgccttctg

SEQ ID NO: 644679 - DNA, 25 bp, Rattus norvegicus
tgtcaaagacctcgccggcttggga

SEQ ID NO: 644680 - DNA, 25 bp, Rattus norvegicus
tgtcaaagacctggccggcttggga

SEQ ID NO: 644681 - DNA, 25 bp, Rattus norvegicus
tgtcaaagacgaccaaccttctaat

SEQ ID NO: 644682 - DNA, 25 bp, Rattus norvegicus
tgtcaaagacgagcaaccttctaat

SEQ ID NO: 644683 - DNA, 25 bp, Rattus norvegicus
tgtcaaagctccacacaaagtgttt

SEQ ID NO: 644684 - DNA, 25 bp, Rattus norvegicus
tgtcaaagctcctcacaaagtgttt

SEQ ID NO: 644685 - DNA, 25 bp, Rattus norvegicus
tgtcaaaggacaccgcatcaagaaa

SEQ ID NO: 644686 - DNA, 25 bp, Rattus norvegicus
tgtcaaaggacagcgcatcaagaaa

SEQ ID NO: 644687 - DNA, 25 bp, Rattus norvegicus
tgtcaaagggacacctcactgttta

SEQ ID NO: 644688 - DNA, 25 bp, Rattus norvegicus
tgtcaaagggactcctcactgttta

SEQ ID NO: 644689 - DNA, 25 bp, Rattus norvegicus
tgtcaaagtaccagctgagccacaa

SEQ ID NO: 644690 - DNA, 25 bp, Rattus norvegicus
tgtcaaagtacctgctgagccacaa

SEQ ID NO: 644691 - DNA, 25 bp, Rattus norvegicus
tgtcaaagttgcactctgtatcctg

SEQ ID NO: 644692 - DNA, 25 bp, Rattus norvegicus
tgtcaaagttgctctctgtatcctg

SEQ ID NO: 644693 - DNA, 25 bp, Rattus norvegicus
tgtcaaatagctcatccaaacttat

SEQ ID NO: 644694 - DNA, 25 bp, Rattus norvegicus
tgtcaaatagctgatccaaacttat

SEQ ID NO: 644695 - DNA, 25 bp, Rattus norvegicus
tgtcaaatgatgctggttccccttt

SEQ ID NO: 644696 - DNA, 25 bp, Rattus norvegicus
tgtcaaatgatggtggttccccttt

SEQ ID NO: 644697 - DNA, 25 bp, Rattus norvegicus
tgtcaaattctccacatctaggcac

SEQ ID NO: 644698 - DNA, 25 bp, Rattus norvegicus
tgtcaaattctcgacatctaggcac

SEQ ID NO: 644699 - DNA, 25 bp, Rattus norvegicus
tgtcaacagctgaaccatgtggtga

SEQ ID NO: 644700 - DNA, 25 bp, Rattus norvegicus
tgtcaacagctgtaccatgtggtga

SEQ ID NO: 644701 - DNA, 25 bp, Rattus norvegicus
tgtcaacagttgactcaatcccatt

SEQ ID NO: 644702 - DNA, 25 bp, Rattus norvegicus
tgtcaacagttgtctcaatcccatt

SEQ ID NO: 644703 - DNA, 25 bp, Rattus norvegicus
tgtcaacatccccaaaagattccca

SEQ ID NO: 644704 - DNA, 25 bp, Rattus norvegicus
tgtcaacatcccgaaaagattccca

SEQ ID NO: 644705 - DNA, 25 bp, Rattus norvegicus
tgtcaacatcgcatggaaccgtgaa

SEQ ID NO: 644706 - DNA, 25 bp, Rattus norvegicus
tgtcaacatcgcttggaaccgtgaa

SEQ ID NO: 644707 - DNA, 25 bp, Rattus norvegicus
tgtcaacatggcaactggcctggct

SEQ ID NO: 644708 - DNA, 25 bp, Rattus norvegicus
tgtcaacatggctactggcctggct

SEQ ID NO: 644709 - DNA, 25 bp, Rattus norvegicus
tgtcaacattgtcgccttcgcttat

SEQ ID NO: 644710 - DNA, 25 bp, Rattus norvegicus
tgtcaacattgtggccttcgcttat

SEQ ID NO: 644711 - DNA, 25 bp, Rattus norvegicus
tgtcaaccactgaaagagatgcctt

SEQ ID NO: 644712 - DNA, 25 bp, Rattus norvegicus
tgtcaaccactgtaagagatgcctt

SEQ ID NO: 644713 - DNA, 25 bp, Rattus norvegicus
tgtcaaccagccactctagataagc

SEQ ID NO: 644714 - DNA, 25 bp, Rattus norvegicus
tgtcaaccagcctctctagataagc

SEQ ID NO: 644715 - DNA, 25 bp, Rattus norvegicus
tgtcaaccatcgagttccagcggga

SEQ ID NO: 644716 - DNA, 25 bp, Rattus norvegicus
tgtcaaccatcgtgttccagcggga

SEQ ID NO: 644717 - DNA, 25 bp, Rattus norvegicus
tgtcaaccccatctgctatgcactg

SEQ ID NO: 644718 - DNA, 25 bp, Rattus norvegicus
tgtcaaccccatgtgctatgcactg

SEQ ID NO: 644719 - DNA, 25 bp, Rattus norvegicus
tgtcaaccccttcctgagcagagat

SEQ ID NO: 644720 - DNA, 25 bp, Rattus norvegicus
tgtcaaccccttgctgagcagagat

SEQ ID NO: 644721 - DNA, 25 bp, Rattus norvegicus
tgtcaaccctaacagtctgcacaat

SEQ ID NO: 644722 - DNA, 25 bp, Rattus norvegicus
tgtcaaccctaagagtctgcacaat

SEQ ID NO: 644723 - DNA, 25 bp, Rattus norvegicus
tgtcaacctcccacatattgagatg

SEQ ID NO: 644724 - DNA, 25 bp, Rattus norvegicus
tgtcaacctccctcatattgagatg

SEQ ID NO: 644725 - DNA, 25 bp, Rattus norvegicus
tgtcaacctctacattacccggaaa

SEQ ID NO: 644726 - DNA, 25 bp, Rattus norvegicus
tgtcaacctctagattacccggaaa

SEQ ID NO: 644727 - DNA, 25 bp, Rattus norvegicus
tgtcaacctgctccagtcacatgaa

SEQ ID NO: 644728 - DNA, 25 bp, Rattus norvegicus
tgtcaacctgctgcagtcacatgaa

SEQ ID NO: 644729 - DNA, 25 bp, Rattus norvegicus
tgtcaaccttcactgaggaggctgt

SEQ ID NO: 644730 - DNA, 25 bp, Rattus norvegicus
tgtcaaccttcagtgaggaggctgt

SEQ ID NO: 644731 - DNA, 25 bp, Rattus norvegicus
tgtcaaccttgacccatctgcaaat

SEQ ID NO: 644732 - DNA, 25 bp, Rattus norvegicus
tgtcaaccttgagccatctgcaaat

SEQ ID NO: 644733 - DNA, 25 bp, Rattus norvegicus
tgtcaacctttcagcacctcaagaa

SEQ ID NO: 644734 - DNA, 25 bp, Rattus norvegicus
tgtcaacctttctgcacctcaagaa

SEQ ID NO: 644735 - DNA, 25 bp, Rattus norvegicus
tgtcaacgagacctttcctaccgaa

SEQ ID NO: 644736 - DNA, 25 bp, Rattus norvegicus
tgtcaacgagacgtttcctaccgaa

SEQ ID NO: 644737 - DNA, 25 bp, Rattus norvegicus
tgtcaactgggacagagccactctt

SEQ ID NO: 644738 - DNA, 25 bp, Rattus norvegicus
tgtcaactgggagagagccactctt

SEQ ID NO: 644739 - DNA, 25 bp, Rattus norvegicus
tgtcaacttcaccaaagagctgttt

SEQ ID NO: 644740 - DNA, 25 bp, Rattus norvegicus
tgtcaacttcacgaaagagctgttt

SEQ ID NO: 644741 - DNA, 25 bp, Rattus norvegicus
tgtcaacttttcattccagtcacac

SEQ ID NO: 644742 - DNA, 25 bp, Rattus norvegicus
tgtcaacttttctttccagtcacac

SEQ ID NO: 644743 - DNA, 25 bp, Rattus norvegicus
tgtcaagaaccaatctgtccacatc

SEQ ID NO: 644744 - DNA, 25 bp, Rattus norvegicus
tgtcaagaaccattctgtccacatc

SEQ ID NO: 644745 - DNA, 25 bp, Rattus norvegicus
tgtcaagacctacacgtgggcgcac

SEQ ID NO: 644746 - DNA, 25 bp, Rattus norvegicus
tgtcaagacctagacgtgggcgcac

SEQ ID NO: 644747 - DNA, 25 bp, Rattus norvegicus
tgtcaagagcagagagagggtcccc

SEQ ID NO: 644748 - DNA, 25 bp, Rattus norvegicus
tgtcaagagcagtgagagggtcccc

SEQ ID NO: 644749 - DNA, 25 bp, Rattus norvegicus
tgtcaagatgccaggttcctttctg

SEQ ID NO: 644750 - DNA, 25 bp, Rattus norvegicus
tgtcaagatgcctggttcctttctg

SEQ ID NO: 644751 - DNA, 25 bp, Rattus norvegicus
tgtcaagattaaatctctcccctgg

SEQ ID NO: 644752 - DNA, 25 bp, Rattus norvegicus
tgtcaagattaattctctcccctgg

SEQ ID NO: 644753 - DNA, 25 bp, Rattus norvegicus
tgtcaagcccagaccttcagagaaa

SEQ ID NO: 644754 - DNA, 25 bp, Rattus norvegicus
tgtcaagcccagtccttcagagaaa

SEQ ID NO: 644755 - DNA, 25 bp, Rattus norvegicus
tgtcaagggcacatggctctagggc

SEQ ID NO: 644756 - DNA, 25 bp, Rattus norvegicus
tgtcaagggcacttggctctagggc

SEQ ID NO: 644757 - DNA, 25 bp, Rattus norvegicus
tgtcaagtacttagcccaggaggct

SEQ ID NO: 644758 - DNA, 25 bp, Rattus norvegicus
tgtcaagtactttgcccaggaggct

SEQ ID NO: 644759 - DNA, 25 bp, Rattus norvegicus
tgtcaagtccgtacatgtcggcaga

SEQ ID NO: 644760 - DNA, 25 bp, Rattus norvegicus
tgtcaagtccgttcatgtcggcaga

SEQ ID NO: 644761 - DNA, 25 bp, Rattus norvegicus
tgtcaagtgaccctgacttgggtgt

SEQ ID NO: 644762 - DNA, 25 bp, Rattus norvegicus
tgtcaagtgaccgtgacttgggtgt

SEQ ID NO: 644763 - DNA, 25 bp, Rattus norvegicus
tgtcaagtgcagatcgtcttctcca

SEQ ID NO: 644764 - DNA, 25 bp, Rattus norvegicus
tgtcaagtgcagttcgtcttctcca

SEQ ID NO: 644765 - DNA, 25 bp, Rattus norvegicus
tgtcaagtgtgaatctgctccccag

SEQ ID NO: 644766 - DNA, 25 bp, Rattus norvegicus
tgtcaagtgtgattctgctccccag

SEQ ID NO: 644767 - DNA, 25 bp, Rattus norvegicus
tgtcaagttccacacgctcaaaagc

SEQ ID NO: 644768 - DNA, 25 bp, Rattus norvegicus
tgtcaagttccagacgctcaaaagc

SEQ ID NO: 644769 - DNA, 25 bp, Rattus norvegicus
tgtcaagttcccagaaccgtgtttt

SEQ ID NO: 644770 - DNA, 25 bp, Rattus norvegicus
tgtcaagttccctgaaccgtgtttt

SEQ ID NO: 644771 - DNA, 25 bp, Rattus norvegicus
tgtcaagttgccagaaagtccttca

SEQ ID NO: 644772 - DNA, 25 bp, Rattus norvegicus
tgtcaagttgcctgaaagtccttca

SEQ ID NO: 644773 - DNA, 25 bp, Rattus norvegicus
tgtcaagtttccctgggtttactag

SEQ ID NO: 644774 - DNA, 25 bp, Rattus norvegicus
tgtcaagtttccgtgggtttactag

SEQ ID NO: 644775 - DNA, 25 bp, Rattus norvegicus
tgtcaatacccacaggcaccaggag

SEQ ID NO: 644776 - DNA, 25 bp, Rattus norvegicus
tgtcaatacccagaggcaccaggag

SEQ ID NO: 644777 - DNA, 25 bp, Rattus norvegicus
tgtcaatatgatctggctcttccta

SEQ ID NO: 644778 - DNA, 25 bp, Rattus norvegicus
tgtcaatatgatgtggctcttccta

SEQ ID NO: 644779 - DNA, 25 bp, Rattus norvegicus
tgtcaatcacagcatccctaatggt

SEQ ID NO: 644780 - DNA, 25 bp, Rattus norvegicus
tgtcaatcacaggatccctaatggt

SEQ ID NO: 644781 - DNA, 25 bp, Rattus norvegicus
tgtcaatcaccactccatcaaatgt

SEQ ID NO: 644782 - DNA, 25 bp, Rattus norvegicus
tgtcaatcaccagtccatcaaatgt

SEQ ID NO: 644783 - DNA, 25 bp, Rattus norvegicus
tgtcaatcagacagacccgcctgga

SEQ ID NO: 644784 - DNA, 25 bp, Rattus norvegicus
tgtcaatcagactgacccgcctgga

SEQ ID NO: 644785 - DNA, 25 bp, Rattus norvegicus
tgtcaatccctcactgcgcgctaag

SEQ ID NO: 644786 - DNA, 25 bp, Rattus norvegicus
tgtcaatccctcctttcttctttgt

SEQ ID NO: 644787 - DNA, 25 bp, Rattus norvegicus
tgtcaatccctcgtttcttctttgt

SEQ ID NO: 644788 - DNA, 25 bp, Rattus norvegicus
tgtcaatccctctctgcgcgctaag

SEQ ID NO: 644789 - DNA, 25 bp, Rattus norvegicus
tgtcaatctgaaccgatgggtcaac

SEQ ID NO: 644790 - DNA, 25 bp, Rattus norvegicus
tgtcaatctgaagcgatgggtcaac

SEQ ID NO: 644791 - DNA, 25 bp, Rattus norvegicus
tgtcaatgaccaactggccatcaga

SEQ ID NO: 644792 - DNA, 25 bp, Rattus norvegicus
tgtcaatgaccatctggccatcaga

SEQ ID NO: 644793 - DNA, 25 bp, Rattus norvegicus
tgtcaatgcagtctgtgtgtccttc

SEQ ID NO: 644794 - DNA, 25 bp, Rattus norvegicus
tgtcaatgcagtgtgtgtgtccttc

SEQ ID NO: 644795 - DNA, 25 bp, Rattus norvegicus
tgtcaatggccaagctcactcccag

SEQ ID NO: 644796 - DNA, 25 bp, Rattus norvegicus
tgtcaatggccatgctcactcccag

SEQ ID NO: 644797 - DNA, 25 bp, Rattus norvegicus
tgtcaatggcctctgggctgtcttt

SEQ ID NO: 644798 - DNA, 25 bp, Rattus norvegicus
tgtcaatggcctgtgggctgtcttt

SEQ ID NO: 644799 - DNA, 25 bp, Rattus norvegicus
tgtcaatgtctccacggcaacggaa

SEQ ID NO: 644800 - DNA, 25 bp, Rattus norvegicus
tgtcaatgtctcgacggcaacggaa

SEQ ID NO: 644801 - DNA, 25 bp, Rattus norvegicus
tgtcaattccggagggcccttggag

SEQ ID NO: 644802 - DNA, 25 bp, Rattus norvegicus
tgtcaattccggtgggcccttggag

SEQ ID NO: 644803 - DNA, 25 bp, Rattus norvegicus
tgtcacaaatgtctactcgtcatac

SEQ ID NO: 644804 - DNA, 25 bp, Rattus norvegicus
tgtcacaaatgtgtactcgtcatac

SEQ ID NO: 644805 - DNA, 25 bp, Rattus norvegicus
tgtcacaagcttcaggcaggtaccc

SEQ ID NO: 644806 - DNA, 25 bp, Rattus norvegicus
tgtcacaagcttgaggcaggtaccc

SEQ ID NO: 644807 - DNA, 25 bp, Rattus norvegicus
tgtcacaatatacatgccccaggtc

SEQ ID NO: 644808 - DNA, 25 bp, Rattus norvegicus
tgtcacaatatagatgccccaggtc

SEQ ID NO: 644809 - DNA, 25 bp, Rattus norvegicus
tgtcacaatctacaatcatcagcat

SEQ ID NO: 644810 - DNA, 25 bp, Rattus norvegicus
tgtcacaatctagaatcatcagcat

SEQ ID NO: 644811 - DNA, 25 bp, Rattus norvegicus
tgtcacacagtcactggacagatga

SEQ ID NO: 644812 - DNA, 25 bp, Rattus norvegicus
tgtcacacagtctctggacagatga

SEQ ID NO: 644813 - DNA, 25 bp, Rattus norvegicus
tgtcacacattacttcagcctagag

SEQ ID NO: 644814 - DNA, 25 bp, Rattus norvegicus
tgtcacacattagttcagcctagag

SEQ ID NO: 644815 - DNA, 25 bp, Rattus norvegicus
tgtcacactacaagtcaggtccagg

SEQ ID NO: 644816 - DNA, 25 bp, Rattus norvegicus
tgtcacactacatgtcaggtccagg

SEQ ID NO: 644817 - DNA, 25 bp, Rattus norvegicus
tgtcacactgtgaactttgagttga

SEQ ID NO: 644818 - DNA, 25 bp, Rattus norvegicus
tgtcacactgtgactgatcagcaag

SEQ ID NO: 644819 - DNA, 25 bp, Rattus norvegicus
tgtcacactgtgtactttgagttga

SEQ ID NO: 644820 - DNA, 25 bp, Rattus norvegicus
tgtcacactgtgtctgatcagcaag

SEQ ID NO: 644821 - DNA, 25 bp, Rattus norvegicus
tgtcacagagtcagccatcagatct

SEQ ID NO: 644822 - DNA, 25 bp, Rattus norvegicus
tgtcacagagtctgccatcagatct

SEQ ID NO: 644823 - DNA, 25 bp, Rattus norvegicus
tgtcacagatccatttggtttttaa

SEQ ID NO: 644824 - DNA, 25 bp, Rattus norvegicus
tgtcacagatccttttggtttttaa

SEQ ID NO: 644825 - DNA, 25 bp, Rattus norvegicus
tgtcacagccatagagttccccgag

SEQ ID NO: 644826 - DNA, 25 bp, Rattus norvegicus
tgtcacagccattgagttccccgag

SEQ ID NO: 644827 - DNA, 25 bp, Rattus norvegicus
tgtcacagtaaaaggcgggatctct

SEQ ID NO: 644828 - DNA, 25 bp, Rattus norvegicus
tgtcacagtaaatggcgggatctct

SEQ ID NO: 644829 - DNA, 25 bp, Rattus norvegicus
tgtcacagtcttccctattctactt

SEQ ID NO: 644830 - DNA, 25 bp, Rattus norvegicus
tgtcacagtcttgcctattctactt

SEQ ID NO: 644831 - DNA, 25 bp, Rattus norvegicus
tgtcacagttcacgtgtggaaacct

SEQ ID NO: 644832 - DNA, 25 bp, Rattus norvegicus
tgtcacagttcaggtgtggaaacct

SEQ ID NO: 644833 - DNA, 25 bp, Rattus norvegicus
tgtcacataaccagaactcgctcat

SEQ ID NO: 644834 - DNA, 25 bp, Rattus norvegicus
tgtcacataacctgaactcgctcat

SEQ ID NO: 644835 - DNA, 25 bp, Rattus norvegicus
tgtcacatccctaatacttcagtac

SEQ ID NO: 644836 - DNA, 25 bp, Rattus norvegicus
tgtcacatcccttatacttcagtac

SEQ ID NO: 644837 - DNA, 25 bp, Rattus norvegicus
tgtcacatcttaactcttttcatta

SEQ ID NO: 644838 - DNA, 25 bp, Rattus norvegicus
tgtcacatcttatctcttttcatta

SEQ ID NO: 644839 - DNA, 25 bp, Rattus norvegicus
tgtcacatgactacaaacttccctc

SEQ ID NO: 644840 - DNA, 25 bp, Rattus norvegicus
tgtcacatgacttcaaacttccctc

SEQ ID NO: 644841 - DNA, 25 bp, Rattus norvegicus
tgtcacatgatacacaaggtcagta

SEQ ID NO: 644842 - DNA, 25 bp, Rattus norvegicus
tgtcacatgatagacaaggtcagta

SEQ ID NO: 644843 - DNA, 25 bp, Rattus norvegicus
tgtcacatgttgcacactcctgtct

SEQ ID NO: 644844 - DNA, 25 bp, Rattus norvegicus
tgtcacatgttggacactcctgtct

SEQ ID NO: 644845 - DNA, 25 bp, Rattus norvegicus
tgtcacattactcggcaaactgttc

SEQ ID NO: 644846 - DNA, 25 bp, Rattus norvegicus
tgtcacattactgggcaaactgttc

SEQ ID NO: 644847 - DNA, 25 bp, Rattus norvegicus
tgtcaccaaagtctaccgtgtcctt

SEQ ID NO: 644848 - DNA, 25 bp, Rattus norvegicus
tgtcaccaaagtgtaccgtgtcctt

SEQ ID NO: 644849 - DNA, 25 bp, Rattus norvegicus
tgtcaccaagtaaccagctttcgct

SEQ ID NO: 644850 - DNA, 25 bp, Rattus norvegicus
tgtcaccaagtatccagctttcgct

SEQ ID NO: 644851 - DNA, 25 bp, Rattus norvegicus
tgtcaccaccaaaggcaatcatttt

SEQ ID NO: 644852 - DNA, 25 bp, Rattus norvegicus
tgtcaccaccaatggcaatcatttt

SEQ ID NO: 644853 - DNA, 25 bp, Rattus norvegicus
tgtcaccagaaacaaggcgccgcag

SEQ ID NO: 644854 - DNA, 25 bp, Rattus norvegicus
tgtcaccagaaagaaggcgccgcag

SEQ ID NO: 644855 - DNA, 25 bp, Rattus norvegicus
tgtcaccagacactgctttggtttt

SEQ ID NO: 644856 - DNA, 25 bp, Rattus norvegicus
tgtcaccagacagtgctttggtttt

SEQ ID NO: 644857 - DNA, 25 bp, Rattus norvegicus
tgtcaccagattattattattaatg

SEQ ID NO: 644858 - DNA, 25 bp, Rattus norvegicus
tgtcaccagatttttattattaatg

SEQ ID NO: 644859 - DNA, 25 bp, Rattus norvegicus
tgtcaccagcatacttcaagtagga

SEQ ID NO: 644860 - DNA, 25 bp, Rattus norvegicus
tgtcaccagcattcttcaagtagga

SEQ ID NO: 644861 - DNA, 25 bp, Rattus norvegicus
tgtcaccatccacagcggagagtct

SEQ ID NO: 644862 - DNA, 25 bp, Rattus norvegicus
tgtcaccatccagagcggagagtct

SEQ ID NO: 644863 - DNA, 25 bp, Rattus norvegicus
tgtcaccatgacaccagaggaaagt

SEQ ID NO: 644864 - DNA, 25 bp, Rattus norvegicus
tgtcaccatgactccagaggaaagt

SEQ ID NO: 644865 - DNA, 25 bp, Rattus norvegicus
tgtcaccatgtcacttttccaagat

SEQ ID NO: 644866 - DNA, 25 bp, Rattus norvegicus
tgtcaccatgtcatgaaaacatgtc

SEQ ID NO: 644867 - DNA, 25 bp, Rattus norvegicus
tgtcaccatgtctcttttccaagat

SEQ ID NO: 644868 - DNA, 25 bp, Rattus norvegicus
tgtcaccatgtcttgaaaacatgtc

SEQ ID NO: 644869 - DNA, 25 bp, Rattus norvegicus
tgtcaccattggaacagaacaacga

SEQ ID NO: 644870 - DNA, 25 bp, Rattus norvegicus
tgtcaccattggtacagaacaacga

SEQ ID NO: 644871 - DNA, 25 bp, Rattus norvegicus
tgtcacccacctcacttgttaggat

SEQ ID NO: 644872 - DNA, 25 bp, Rattus norvegicus
tgtcacccacctgacttgttaggat

SEQ ID NO: 644873 - DNA, 25 bp, Rattus norvegicus
tgtcaccccaatactggaaggcttt

SEQ ID NO: 644874 - DNA, 25 bp, Rattus norvegicus
tgtcaccccaattctggaaggcttt

SEQ ID NO: 644875 - DNA, 25 bp, Rattus norvegicus
tgtcacccctagatcctggatatta

SEQ ID NO: 644876 - DNA, 25 bp, Rattus norvegicus
tgtcacccctagttcctggatatta

SEQ ID NO: 644877 - DNA, 25 bp, Rattus norvegicus
tgtcacccgcaaacgaaactgtcag

SEQ ID NO: 644878 - DNA, 25 bp, Rattus norvegicus
tgtcacccgcaatcgaaactgtcag

SEQ ID NO: 644879 - DNA, 25 bp, Rattus norvegicus
tgtcaccctgctcaacacaatttat

SEQ ID NO: 644880 - DNA, 25 bp, Rattus norvegicus
tgtcaccctgctgaacacaatttat

SEQ ID NO: 644881 - DNA, 25 bp, Rattus norvegicus
tgtcaccctggtctagagcaacagc

SEQ ID NO: 644882 - DNA, 25 bp, Rattus norvegicus
tgtcaccctggtgtagagcaacagc

SEQ ID NO: 644883 - DNA, 25 bp, Rattus norvegicus
tgtcaccctgtgattgccaaacaat

SEQ ID NO: 644884 - DNA, 25 bp, Rattus norvegicus
tgtcaccctgtgtttgccaaacaat

SEQ ID NO: 644885 - DNA, 25 bp, Rattus norvegicus
tgtcacccttcactaacgctaagtg

SEQ ID NO: 644886 - DNA, 25 bp, Rattus norvegicus
tgtcacccttcagtaacgctaagtg

SEQ ID NO: 644887 - DNA, 25 bp, Rattus norvegicus
tgtcaccgagacagctggacctgca

SEQ ID NO: 644888 - DNA, 25 bp, Rattus norvegicus
tgtcaccgagactgctggacctgca

SEQ ID NO: 644889 - DNA, 25 bp, Rattus norvegicus
tgtcaccgcatcctagaatcaggtc

SEQ ID NO: 644890 - DNA, 25 bp, Rattus norvegicus
tgtcaccgcatcgtagaatcaggtc

SEQ ID NO: 644891 - DNA, 25 bp, Rattus norvegicus
tgtcaccgcctaacagaacaccgat

SEQ ID NO: 644892 - DNA, 25 bp, Rattus norvegicus
tgtcaccgcctatcagaacaccgat

SEQ ID NO: 644893 - DNA, 25 bp, Rattus norvegicus
tgtcaccgcctgagacctcgcgaga

SEQ ID NO: 644894 - DNA, 25 bp, Rattus norvegicus
tgtcaccgcctgtgacctcgcgaga

SEQ ID NO: 644895 - DNA, 25 bp, Rattus norvegicus
tgtcaccgcgagaagtgaatcgcat

SEQ ID NO: 644896 - DNA, 25 bp, Rattus norvegicus
tgtcaccgcgagtagtgaatcgcat

SEQ ID NO: 644897 - DNA, 25 bp, Rattus norvegicus
tgtcaccgtgtgacagaggcctgga

SEQ ID NO: 644898 - DNA, 25 bp, Rattus norvegicus
tgtcaccgtgtgtcagaggcctgga

SEQ ID NO: 644899 - DNA, 25 bp, Rattus norvegicus
tgtcacctacgcagtgggcaccagg

SEQ ID NO: 644900 - DNA, 25 bp, Rattus norvegicus
tgtcacctacgctgtgggcaccagg

SEQ ID NO: 644901 - DNA, 25 bp, Rattus norvegicus
tgtcacctacttatggcagaactgg

SEQ ID NO: 644902 - DNA, 25 bp, Rattus norvegicus
tgtcacctacttttggcagaactgg

SEQ ID NO: 644903 - DNA, 25 bp, Rattus norvegicus
tgtcacctccaaagggaaccgtggg

SEQ ID NO: 644904 - DNA, 25 bp, Rattus norvegicus
tgtcacctccaatgggaaccgtggg

SEQ ID NO: 644905 - DNA, 25 bp, Rattus norvegicus
tgtcacctcctcacaattatggtaa

SEQ ID NO: 644906 - DNA, 25 bp, Rattus norvegicus
tgtcacctcctctcaattatggtaa

SEQ ID NO: 644907 - DNA, 25 bp, Rattus norvegicus
tgtcacctcttgagaagcccagttt

SEQ ID NO: 644908 - DNA, 25 bp, Rattus norvegicus
tgtcacctcttgtgaagcccagttt

SEQ ID NO: 644909 - DNA, 25 bp, Rattus norvegicus
tgtcacctgatactgtggctgtgta

SEQ ID NO: 644910 - DNA, 25 bp, Rattus norvegicus
tgtcacctgatagtgtggctgtgta

SEQ ID NO: 644911 - DNA, 25 bp, Rattus norvegicus
tgtcacctgcaccagggctgcggtt

SEQ ID NO: 644912 - DNA, 25 bp, Rattus norvegicus
tgtcacctgcacgagggctgcggtt

SEQ ID NO: 644913 - DNA, 25 bp, Rattus norvegicus
tgtcacctgccaagcgaggccgcag

SEQ ID NO: 644914 - DNA, 25 bp, Rattus norvegicus
tgtcacctgccatgcgaggccgcag

SEQ ID NO: 644915 - DNA, 25 bp, Rattus norvegicus
tgtcacctgcccctagttatttttt

SEQ ID NO: 644916 - DNA, 25 bp, Rattus norvegicus
tgtcacctgcccgtagttatttttt

SEQ ID NO: 644917 - DNA, 25 bp, Rattus norvegicus
tgtcacctggccaagctactgaagc

SEQ ID NO: 644918 - DNA, 25 bp, Rattus norvegicus
tgtcacctggcctagctactgaagc

SEQ ID NO: 644919 - DNA, 25 bp, Rattus norvegicus
tgtcacctgtgacccttaaacatta

SEQ ID NO: 644920 - DNA, 25 bp, Rattus norvegicus
tgtcacctgtgagccttaaacatta

SEQ ID NO: 644921 - DNA, 25 bp, Rattus norvegicus
tgtcacctgttcatcacatacttga

SEQ ID NO: 644922 - DNA, 25 bp, Rattus norvegicus
tgtcacctgttcttcacatacttga

SEQ ID NO: 644923 - DNA, 25 bp, Rattus norvegicus
tgtcaccttacacgacggcacaaag

SEQ ID NO: 644924 - DNA, 25 bp, Rattus norvegicus
tgtcaccttacaggacggcacaaag

SEQ ID NO: 644925 - DNA, 25 bp, Rattus norvegicus
tgtcaccttagtcacgagagcagaa

SEQ ID NO: 644926 - DNA, 25 bp, Rattus norvegicus
tgtcaccttagtgacgagagcagaa

SEQ ID NO: 644927 - DNA, 25 bp, Rattus norvegicus
tgtcaccttccaaggtcactgaaag

SEQ ID NO: 644928 - DNA, 25 bp, Rattus norvegicus
tgtcaccttccatggtcactgaaag

SEQ ID NO: 644929 - DNA, 25 bp, Rattus norvegicus
tgtcaccttcccctattttaagaag

SEQ ID NO: 644930 - DNA, 25 bp, Rattus norvegicus
tgtcaccttcccgtattttaagaag

SEQ ID NO: 644931 - DNA, 25 bp, Rattus norvegicus
tgtcaccttgcaaaaagctcaagtc

SEQ ID NO: 644932 - DNA, 25 bp, Rattus norvegicus
tgtcaccttgcataaagctcaagtc

SEQ ID NO: 644933 - DNA, 25 bp, Rattus norvegicus
tgtcacctttccacagtaaaacctt

SEQ ID NO: 644934 - DNA, 25 bp, Rattus norvegicus
tgtcacctttcctcagtaaaacctt

SEQ ID NO: 644935 - DNA, 25 bp, Rattus norvegicus
tgtcacgatgcacaaaccttttaac

SEQ ID NO: 644936 - DNA, 25 bp, Rattus norvegicus
tgtcacgatgcagaaaccttttaac

SEQ ID NO: 644937 - DNA, 25 bp, Rattus norvegicus
tgtcacgcctatcaagttcttctgg

SEQ ID NO: 644938 - DNA, 25 bp, Rattus norvegicus
tgtcacgcctatgaagttcttctgg

SEQ ID NO: 644939 - DNA, 25 bp, Rattus norvegicus
tgtcacgcctgccataagtcaaggt

SEQ ID NO: 644940 - DNA, 25 bp, Rattus norvegicus
tgtcacgcctgcgataagtcaaggt

SEQ ID NO: 644941 - DNA, 25 bp, Rattus norvegicus
tgtcacgctccccacggtgaggagt

SEQ ID NO: 644942 - DNA, 25 bp, Rattus norvegicus
tgtcacgctcccgacggtgaggagt

SEQ ID NO: 644943 - DNA, 25 bp, Rattus norvegicus
tgtcacggcaggactgtcgtcgctg

SEQ ID NO: 644944 - DNA, 25 bp, Rattus norvegicus
tgtcacggcaggtctgtcgtcgctg

SEQ ID NO: 644945 - DNA, 25 bp, Rattus norvegicus
tgtcacgggaggagaagcccagctc

SEQ ID NO: 644946 - DNA, 25 bp, Rattus norvegicus
tgtcacgggaggtgaagcccagctc

SEQ ID NO: 644947 - DNA, 25 bp, Rattus norvegicus
tgtcacggtcaaagtggcaactcat

SEQ ID NO: 644948 - DNA, 25 bp, Rattus norvegicus
tgtcacggtcaatgtggcaactcat

SEQ ID NO: 644949 - DNA, 25 bp, Rattus norvegicus
tgtcacggtctcactaggcaaagtt

SEQ ID NO: 644950 - DNA, 25 bp, Rattus norvegicus
tgtcacggtctctctaggcaaagtt

SEQ ID NO: 644951 - DNA, 25 bp, Rattus norvegicus
tgtcacgtcgggagtcaatcacact

SEQ ID NO: 644952 - DNA, 25 bp, Rattus norvegicus
tgtcacgtcgggtgtcaatcacact

SEQ ID NO: 644953 - DNA, 25 bp, Rattus norvegicus
tgtcacgtgggcatcttcaaagaaa

SEQ ID NO: 644954 - DNA, 25 bp, Rattus norvegicus
tgtcacgtgggcttcttcaaagaaa

SEQ ID NO: 644955 - DNA, 25 bp, Rattus norvegicus
tgtcactaaaagaacttcccgccta

SEQ ID NO: 644956 - DNA, 25 bp, Rattus norvegicus
tgtcactaaaagtacttcccgccta

SEQ ID NO: 644957 - DNA, 25 bp, Rattus norvegicus
tgtcactaccgcactggcaaagaga

SEQ ID NO: 644958 - DNA, 25 bp, Rattus norvegicus
tgtcactaccgctctggcaaagaga

SEQ ID NO: 644959 - DNA, 25 bp, Rattus norvegicus
tgtcactactctctcaactgcttca

SEQ ID NO: 644960 - DNA, 25 bp, Rattus norvegicus
tgtcactactctgtcaactgcttca

SEQ ID NO: 644961 - DNA, 25 bp, Rattus norvegicus
tgtcactactgaagggcactgctgc

SEQ ID NO: 644962 - DNA, 25 bp, Rattus norvegicus
tgtcactactgatgggcactgctgc

SEQ ID NO: 644963 - DNA, 25 bp, Rattus norvegicus
tgtcactatctcatgatgtataaaa

SEQ ID NO: 644964 - DNA, 25 bp, Rattus norvegicus
tgtcactatctcttgatgtataaaa

SEQ ID NO: 644965 - DNA, 25 bp, Rattus norvegicus
tgtcactatggtacagatcctccac

SEQ ID NO: 644966 - DNA, 25 bp, Rattus norvegicus
tgtcactatggttcagatcctccac

SEQ ID NO: 644967 - DNA, 25 bp, Rattus norvegicus
tgtcactcagtcatacctcatcgga

SEQ ID NO: 644968 - DNA, 25 bp, Rattus norvegicus
tgtcactcagtcattctaattctaa

SEQ ID NO: 644969 - DNA, 25 bp, Rattus norvegicus
tgtcactcagtcttacctcatcgga

SEQ ID NO: 644970 - DNA, 25 bp, Rattus norvegicus
tgtcactcagtctttctaattctaa

SEQ ID NO: 644971 - DNA, 25 bp, Rattus norvegicus
tgtcactcagtgctgctctgagctg

SEQ ID NO: 644972 - DNA, 25 bp, Rattus norvegicus
tgtcactcagtgctgctttgaactg

SEQ ID NO: 644973 - DNA, 25 bp, Rattus norvegicus
tgtcactcagtggtgctctgagctg

SEQ ID NO: 644974 - DNA, 25 bp, Rattus norvegicus
tgtcactcagtggtgctttgaactg

SEQ ID NO: 644975 - DNA, 25 bp, Rattus norvegicus
tgtcactccagtccaagttgcctta

SEQ ID NO: 644976 - DNA, 25 bp, Rattus norvegicus
tgtcactccagtgcaagttgcctta

SEQ ID NO: 644977 - DNA, 25 bp, Rattus norvegicus
tgtcactcctcaagttggccatact

SEQ ID NO: 644978 - DNA, 25 bp, Rattus norvegicus
tgtcactcctcatgttggccatact

SEQ ID NO: 644979 - DNA, 25 bp, Rattus norvegicus
tgtcactctctgctaagctcgccgg

SEQ ID NO: 644980 - DNA, 25 bp, Rattus norvegicus
tgtcactctctggtaagctcgccgg

SEQ ID NO: 644981 - DNA, 25 bp, Rattus norvegicus
tgtcactctgacctttgggctagac

SEQ ID NO: 644982 - DNA, 25 bp, Rattus norvegicus
tgtcactctgacgtttgggctagac

SEQ ID NO: 644983 - DNA, 25 bp, Rattus norvegicus
tgtcactgacagctggttttagagg

SEQ ID NO: 644984 - DNA, 25 bp, Rattus norvegicus
tgtcactgacaggtggttttagagg

SEQ ID NO: 644985 - DNA, 25 bp, Rattus norvegicus
tgtcactgacatcgcagatactgct

SEQ ID NO: 644986 - DNA, 25 bp, Rattus norvegicus
tgtcactgacatggcagatactgct

SEQ ID NO: 644987 - DNA, 25 bp, Rattus norvegicus
tgtcactgacttcttcccttagaag

SEQ ID NO: 644988 - DNA, 25 bp, Rattus norvegicus
tgtcactgacttgttcccttagaag

SEQ ID NO: 644989 - DNA, 25 bp, Rattus norvegicus
tgtcactgagagaagctactgccac

SEQ ID NO: 644990 - DNA, 25 bp, Rattus norvegicus
tgtcactgagagtagctactgccac

SEQ ID NO: 644991 - DNA, 25 bp, Rattus norvegicus
tgtcactgatacctgaaacgccatc

SEQ ID NO: 644992 - DNA, 25 bp, Rattus norvegicus
tgtcactgatacgtgaaacgccatc

SEQ ID NO: 644993 - DNA, 25 bp, Rattus norvegicus
tgtcactgatccctttgcattcaaa

SEQ ID NO: 644994 - DNA, 25 bp, Rattus norvegicus
tgtcactgatccgtttgcattcaaa

SEQ ID NO: 644995 - DNA, 25 bp, Rattus norvegicus
tgtcactgcagtagagggcgcctca

SEQ ID NO: 644996 - DNA, 25 bp, Rattus norvegicus
tgtcactgcagtcggcgtacatacc

SEQ ID NO: 644997 - DNA, 25 bp, Rattus norvegicus
tgtcactgcagtgggcgtacatacc

SEQ ID NO: 644998 - DNA, 25 bp, Rattus norvegicus
tgtcactgcagttgagggcgcctca

SEQ ID NO: 644999 - DNA, 25 bp, Rattus norvegicus
tgtcactgcattctggtagcatcca

SEQ ID NO: 645000 - DNA, 25 bp, Rattus norvegicus
tgtcactgcattgtggtagcatcca

SEQ ID NO: 645001 - DNA, 25 bp, Rattus norvegicus
tgtcactgccagactcagagatttt

SEQ ID NO: 645002 - DNA, 25 bp, Rattus norvegicus
tgtcactgccagtctcagagatttt

SEQ ID NO: 645003 - DNA, 25 bp, Rattus norvegicus
tgtcactgcctaaagtggcaagcac

SEQ ID NO: 645004 - DNA, 25 bp, Rattus norvegicus
tgtcactgcctatagtggcaagcac

SEQ ID NO: 645005 - DNA, 25 bp, Rattus norvegicus
tgtcactgcctcaagtcactttgta

SEQ ID NO: 645006 - DNA, 25 bp, Rattus norvegicus
tgtcactgcctctagtcactttgta

SEQ ID NO: 645007 - DNA, 25 bp, Rattus norvegicus
tgtcactggaacctgcgctggaatg

SEQ ID NO: 645008 - DNA, 25 bp, Rattus norvegicus
tgtcactggaacgtgcgctggaatg

SEQ ID NO: 645009 - DNA, 25 bp, Rattus norvegicus
tgtcactggaggagggtcgccatct

SEQ ID NO: 645010 - DNA, 25 bp, Rattus norvegicus
tgtcactggaggtgggtcgccatct

SEQ ID NO: 645011 - DNA, 25 bp, Rattus norvegicus
tgtcactggagtatggaattgtcac

SEQ ID NO: 645012 - DNA, 25 bp, Rattus norvegicus
tgtcactggagtttggaattgtcac

SEQ ID NO: 645013 - DNA, 25 bp, Rattus norvegicus
tgtcactggcaccttcgacttggag

SEQ ID NO: 645014 - DNA, 25 bp, Rattus norvegicus
tgtcactggcacgttcgacttggag

SEQ ID NO: 645015 - DNA, 25 bp, Rattus norvegicus
tgtcactggcagacacatgcacctg

SEQ ID NO: 645016 - DNA, 25 bp, Rattus norvegicus
tgtcactggcagtcacatgcacctg

SEQ ID NO: 645017 - DNA, 25 bp, Rattus norvegicus
tgtcactggcggagccacacagcta

SEQ ID NO: 645018 - DNA, 25 bp, Rattus norvegicus
tgtcactggcggtgccacacagcta

SEQ ID NO: 645019 - DNA, 25 bp, Rattus norvegicus
tgtcactgggcacagaccactcggt

SEQ ID NO: 645020 - DNA, 25 bp, Rattus norvegicus
tgtcactgggcagagaccactcggt

SEQ ID NO: 645021 - DNA, 25 bp, Rattus norvegicus
tgtcactggtccaccatatactgac

SEQ ID NO: 645022 - DNA, 25 bp, Rattus norvegicus
tgtcactggtcctccatatactgac

SEQ ID NO: 645023 - DNA, 25 bp, Rattus norvegicus
tgtcactgtatcctccacattatgt

SEQ ID NO: 645024 - DNA, 25 bp, Rattus norvegicus
tgtcactgtatcgtccacattatgt

SEQ ID NO: 645025 - DNA, 25 bp, Rattus norvegicus
tgtcactgtgccaggactacatgga

SEQ ID NO: 645026 - DNA, 25 bp, Rattus norvegicus
tgtcactgtgcctggactacatgga

SEQ ID NO: 645027 - DNA, 25 bp, Rattus norvegicus
tgtcacttccccatttccaggaaat

SEQ ID NO: 645028 - DNA, 25 bp, Rattus norvegicus
tgtcacttccccttttccaggaaat

SEQ ID NO: 645029 - DNA, 25 bp, Rattus norvegicus
tgtcacttcctgatcttattttaga

SEQ ID NO: 645030 - DNA, 25 bp, Rattus norvegicus
tgtcacttcctgttcttattttaga

SEQ ID NO: 645031 - DNA, 25 bp, Rattus norvegicus
tgtcacttccttattgccgagagaa

SEQ ID NO: 645032 - DNA, 25 bp, Rattus norvegicus
tgtcacttcctttttgccgagagaa

SEQ ID NO: 645033 - DNA, 25 bp, Rattus norvegicus
tgtcacttgccacagggattccttc

SEQ ID NO: 645034 - DNA, 25 bp, Rattus norvegicus
tgtcacttgccagagggattccttc

SEQ ID NO: 645035 - DNA, 25 bp, Rattus norvegicus
tgtcacttgcctagaatctcacgga

SEQ ID NO: 645036 - DNA, 25 bp, Rattus norvegicus
tgtcacttgccttgaatctcacgga

SEQ ID NO: 645037 - DNA, 25 bp, Rattus norvegicus
tgtcacttgtgcattcttgcaaaat

SEQ ID NO: 645038 - DNA, 25 bp, Rattus norvegicus
tgtcacttgtgctttcttgcaaaat

SEQ ID NO: 645039 - DNA, 25 bp, Rattus norvegicus
tgtcactttctaatacctaatgttg

SEQ ID NO: 645040 - DNA, 25 bp, Rattus norvegicus
tgtcactttctattacctaatgttg

SEQ ID NO: 645041 - DNA, 25 bp, Rattus norvegicus
tgtcactttcttcatgttatccagc

SEQ ID NO: 645042 - DNA, 25 bp, Rattus norvegicus
tgtcactttcttgatgttatccagc

SEQ ID NO: 645043 - DNA, 25 bp, Rattus norvegicus
tgtcactttgtcactgcctttggag

SEQ ID NO: 645044 - DNA, 25 bp, Rattus norvegicus
tgtcactttgtcacttcaagaatgt

SEQ ID NO: 645045 - DNA, 25 bp, Rattus norvegicus
tgtcactttgtctctgcctttggag

SEQ ID NO: 645046 - DNA, 25 bp, Rattus norvegicus
tgtcactttgtctcttcaagaatgt

SEQ ID NO: 645047 - DNA, 25 bp, Rattus norvegicus
tgtcacttttccaggcctattaaat

SEQ ID NO: 645048 - DNA, 25 bp, Rattus norvegicus
tgtcacttttcctggcctattaaat

SEQ ID NO: 645049 - DNA, 25 bp, Rattus norvegicus
tgtcacttttgcaagtacacaggca

SEQ ID NO: 645050 - DNA, 25 bp, Rattus norvegicus
tgtcacttttgctagtacacaggca

SEQ ID NO: 645051 - DNA, 25 bp, Rattus norvegicus
tgtcacttttgtccccacagtgaga

SEQ ID NO: 645052 - DNA, 25 bp, Rattus norvegicus
tgtcacttttgtgcccacagtgaga

SEQ ID NO: 645053 - DNA, 25 bp, Rattus norvegicus
tgtcagaaaccacaagcttcgccaa

SEQ ID NO: 645054 - DNA, 25 bp, Rattus norvegicus
tgtcagaaaccagaagcttcgccaa

SEQ ID NO: 645055 - DNA, 25 bp, Rattus norvegicus
tgtcagaacacactgccagtcagag

SEQ ID NO: 645056 - DNA, 25 bp, Rattus norvegicus
tgtcagaacacagtgccagtcagag

SEQ ID NO: 645057 - DNA, 25 bp, Rattus norvegicus
tgtcagaacagcaactccgctaatt

SEQ ID NO: 645058 - DNA, 25 bp, Rattus norvegicus
tgtcagaacagctactccgctaatt

SEQ ID NO: 645059 - DNA, 25 bp, Rattus norvegicus
tgtcagaacatcaaaggcgcctctc

SEQ ID NO: 645060 - DNA, 25 bp, Rattus norvegicus
tgtcagaacatctaaggcgcctctc

SEQ ID NO: 645061 - DNA, 25 bp, Rattus norvegicus
tgtcagaaccaacccagagcttatt

SEQ ID NO: 645062 - DNA, 25 bp, Rattus norvegicus
tgtcagaaccaagccagagcttatt

SEQ ID NO: 645063 - DNA, 25 bp, Rattus norvegicus
tgtcagaaccccatttaatttcctg

SEQ ID NO: 645064 - DNA, 25 bp, Rattus norvegicus
tgtcagaaccccttttaatttcctg

SEQ ID NO: 645065 - DNA, 25 bp, Rattus norvegicus
tgtcagaagcatcttgaggccctct

SEQ ID NO: 645066 - DNA, 25 bp, Rattus norvegicus
tgtcagaagcatgttgaggccctct

SEQ ID NO: 645067 - DNA, 25 bp, Rattus norvegicus
tgtcagaagcggcatagcacccacg

SEQ ID NO: 645068 - DNA, 25 bp, Rattus norvegicus
tgtcagaagcgggatagcacccacg

SEQ ID NO: 645069 - DNA, 25 bp, Rattus norvegicus
tgtcagaatctgcagtggatgcctt

SEQ ID NO: 645070 - DNA, 25 bp, Rattus norvegicus
tgtcagaatctggagtggatgcctt

SEQ ID NO: 645071 - DNA, 25 bp, Rattus norvegicus
tgtcagaatttcagtttgccccttc

SEQ ID NO: 645072 - DNA, 25 bp, Rattus norvegicus
tgtcagaatttctgtttgccccttc

SEQ ID NO: 645073 - DNA, 25 bp, Rattus norvegicus
tgtcagacatccagcaagccctgat

SEQ ID NO: 645074 - DNA, 25 bp, Rattus norvegicus
tgtcagacatcctgcaagccctgat

SEQ ID NO: 645075 - DNA, 25 bp, Rattus norvegicus
tgtcagaccaaaatcaccactcatt

SEQ ID NO: 645076 - DNA, 25 bp, Rattus norvegicus
tgtcagaccaaattcaccactcatt

SEQ ID NO: 645077 - DNA, 25 bp, Rattus norvegicus
tgtcagaccccgaggtaccaccaaa

SEQ ID NO: 645078 - DNA, 25 bp, Rattus norvegicus
tgtcagaccccgtggtaccaccaaa

SEQ ID NO: 645079 - DNA, 25 bp, Rattus norvegicus
tgtcagaccctcagattttagttgt

SEQ ID NO: 645080 - DNA, 25 bp, Rattus norvegicus
tgtcagaccctctgattttagttgt

SEQ ID NO: 645081 - DNA, 25 bp, Rattus norvegicus
tgtcagacctcaatttccctggttg

SEQ ID NO: 645082 - DNA, 25 bp, Rattus norvegicus
tgtcagacctcattttccctggttg

SEQ ID NO: 645083 - DNA, 25 bp, Rattus norvegicus
tgtcagacggtcatcaagcgcaggt

SEQ ID NO: 645084 - DNA, 25 bp, Rattus norvegicus
tgtcagacggtcttcaagcgcaggt

SEQ ID NO: 645085 - DNA, 25 bp, Rattus norvegicus
tgtcagactccaaacgcattgcagc

SEQ ID NO: 645086 - DNA, 25 bp, Rattus norvegicus
tgtcagactccatacgcattgcagc

SEQ ID NO: 645087 - DNA, 25 bp, Rattus norvegicus
tgtcagagactcaatcttccttcac

SEQ ID NO: 645088 - DNA, 25 bp, Rattus norvegicus
tgtcagagactctatcttccttcac

SEQ ID NO: 645089 - DNA, 25 bp, Rattus norvegicus
tgtcagagcgcactgaccgtgtgct

SEQ ID NO: 645090 - DNA, 25 bp, Rattus norvegicus
tgtcagagcgcagtgaccgtgtgct

SEQ ID NO: 645091 - DNA, 25 bp, Rattus norvegicus
tgtcagagctgtcggtgcaacacgc

SEQ ID NO: 645092 - DNA, 25 bp, Rattus norvegicus
tgtcagagctgtgggtgcaacacgc

SEQ ID NO: 645093 - DNA, 25 bp, Rattus norvegicus
tgtcagaggctgatggagtctttct

SEQ ID NO: 645094 - DNA, 25 bp, Rattus norvegicus
tgtcagaggctgttggagtctttct

SEQ ID NO: 645095 - DNA, 25 bp, Rattus norvegicus
tgtcagagtcctccccagaattgct

SEQ ID NO: 645096 - DNA, 25 bp, Rattus norvegicus
tgtcagagtcctgcccagaattgct

SEQ ID NO: 645097 - DNA, 25 bp, Rattus norvegicus
tgtcagagtgctagagtgttgcgct

SEQ ID NO: 645098 - DNA, 25 bp, Rattus norvegicus
tgtcagagtgcttgagtgttgcgct

SEQ ID NO: 645099 - DNA, 25 bp, Rattus norvegicus
tgtcagagttgcagcagcgctcaga

SEQ ID NO: 645100 - DNA, 25 bp, Rattus norvegicus
tgtcagagttgctgcagcgctcaga

SEQ ID NO: 645101 - DNA, 25 bp, Rattus norvegicus
tgtcagatggccacgggaacctttg

SEQ ID NO: 645102 - DNA, 25 bp, Rattus norvegicus
tgtcagatggcctcgggaacctttg

SEQ ID NO: 645103 - DNA, 25 bp, Rattus norvegicus
tgtcagcaaagaagtggccaagcac

SEQ ID NO: 645104 - DNA, 25 bp, Rattus norvegicus
tgtcagcaaagatgtggccaagcac

SEQ ID NO: 645105 - DNA, 25 bp, Rattus norvegicus
tgtcagcaatacaaagggcttcctc

SEQ ID NO: 645106 - DNA, 25 bp, Rattus norvegicus
tgtcagcaatactaagggcttcctc

SEQ ID NO: 645107 - DNA, 25 bp, Rattus norvegicus
tgtcagcaattacgcaggtcaagtt

SEQ ID NO: 645108 - DNA, 25 bp, Rattus norvegicus
tgtcagcaattaggcaggtcaagtt

SEQ ID NO: 645109 - DNA, 25 bp, Rattus norvegicus
tgtcagcactgtcggcatagacttc

SEQ ID NO: 645110 - DNA, 25 bp, Rattus norvegicus
tgtcagcactgtgggcatagacttc

SEQ ID NO: 645111 - DNA, 25 bp, Rattus norvegicus
tgtcagcagagaaaccccagttggt

SEQ ID NO: 645112 - DNA, 25 bp, Rattus norvegicus
tgtcagcagagataccccagttggt

SEQ ID NO: 645113 - DNA, 25 bp, Rattus norvegicus
tgtcagcagcccctgtggctaaaga

SEQ ID NO: 645114 - DNA, 25 bp, Rattus norvegicus
tgtcagcagcccgtgtggctaaaga

SEQ ID NO: 645115 - DNA, 25 bp, Rattus norvegicus
tgtcagcagcgtatgctcccagacc

SEQ ID NO: 645116 - DNA, 25 bp, Rattus norvegicus
tgtcagcagcgtttgctcccagacc

SEQ ID NO: 645117 - DNA, 25 bp, Rattus norvegicus
tgtcagcagctaagaccgaggccaa

SEQ ID NO: 645118 - DNA, 25 bp, Rattus norvegicus
tgtcagcagctatgaccgaggccaa

SEQ ID NO: 645119 - DNA, 25 bp, Rattus norvegicus
tgtcagcaggcgcactacaaatgat

SEQ ID NO: 645120 - DNA, 25 bp, Rattus norvegicus
tgtcagcaggcggactacaaatgat

SEQ ID NO: 645121 - DNA, 25 bp, Rattus norvegicus
tgtcagcatgaaccactccagatca

SEQ ID NO: 645122 - DNA, 25 bp, Rattus norvegicus
tgtcagcatgaagcactccagatca

SEQ ID NO: 645123 - DNA, 25 bp, Rattus norvegicus
tgtcagcatggtacatctttccctt

SEQ ID NO: 645124 - DNA, 25 bp, Rattus norvegicus
tgtcagcatggttcatctttccctt

SEQ ID NO: 645125 - DNA, 25 bp, Rattus norvegicus
tgtcagccagcacggtcaggacagt

SEQ ID NO: 645126 - DNA, 25 bp, Rattus norvegicus
tgtcagccagcagggtcaggacagt

SEQ ID NO: 645127 - DNA, 25 bp, Rattus norvegicus
tgtcagccagtgcatcgccaggaaa

SEQ ID NO: 645128 - DNA, 25 bp, Rattus norvegicus
tgtcagccagtggatcgccaggaaa

SEQ ID NO: 645129 - DNA, 25 bp, Rattus norvegicus
tgtcagccattgctcccaagctagt

SEQ ID NO: 645130 - DNA, 25 bp, Rattus norvegicus
tgtcagccattggtcccaagctagt

SEQ ID NO: 645131 - DNA, 25 bp, Rattus norvegicus
tgtcagcccttaaatcccataatct

SEQ ID NO: 645132 - DNA, 25 bp, Rattus norvegicus
tgtcagcccttatatcccataatct

SEQ ID NO: 645133 - DNA, 25 bp, Rattus norvegicus
tgtcagcctcctaatgaatgcgtgt

SEQ ID NO: 645134 - DNA, 25 bp, Rattus norvegicus
tgtcagcctccttatgaatgcgtgt

SEQ ID NO: 645135 - DNA, 25 bp, Rattus norvegicus
tgtcagcctggcatggagtccgtgc

SEQ ID NO: 645136 - DNA, 25 bp, Rattus norvegicus
tgtcagcctggcttggagtccgtgc

SEQ ID NO: 645137 - DNA, 25 bp, Rattus norvegicus
tgtcagcctgtaagtccaccaaact

SEQ ID NO: 645138 - DNA, 25 bp, Rattus norvegicus
tgtcagcctgtaccaccccaaggtt

SEQ ID NO: 645139 - DNA, 25 bp, Rattus norvegicus
tgtcagcctgtagcaccccaaggtt

SEQ ID NO: 645140 - DNA, 25 bp, Rattus norvegicus
tgtcagcctgtatgtccaccaaact

SEQ ID NO: 645141 - DNA, 25 bp, Rattus norvegicus
tgtcagcgaaagatttcccggtccg

SEQ ID NO: 645142 - DNA, 25 bp, Rattus norvegicus
tgtcagcgaaagttttcccggtccg

SEQ ID NO: 645143 - DNA, 25 bp, Rattus norvegicus
tgtcagcggctcataccaaagaaat

SEQ ID NO: 645144 - DNA, 25 bp, Rattus norvegicus
tgtcagcggctcttaccaaagaaat

SEQ ID NO: 645145 - DNA, 25 bp, Rattus norvegicus
tgtcagctaccactaatccacagtc

SEQ ID NO: 645146 - DNA, 25 bp, Rattus norvegicus
tgtcagctaccagtaatccacagtc

SEQ ID NO: 645147 - DNA, 25 bp, Rattus norvegicus
tgtcagctatttaagtgtcccaaga

SEQ ID NO: 645148 - DNA, 25 bp, Rattus norvegicus
tgtcagctattttagtgtcccaaga

SEQ ID NO: 645149 - DNA, 25 bp, Rattus norvegicus
tgtcagctcagtcagcactgggagt

SEQ ID NO: 645150 - DNA, 25 bp, Rattus norvegicus
tgtcagctcagtgagcactgggagt

SEQ ID NO: 645151 - DNA, 25 bp, Rattus norvegicus
tgtcagctctcacgttgggttcaaa

SEQ ID NO: 645152 - DNA, 25 bp, Rattus norvegicus
tgtcagctctcaggttgggttcaaa

SEQ ID NO: 645153 - DNA, 25 bp, Rattus norvegicus
tgtcagctgcggagcttcggaacct

SEQ ID NO: 645154 - DNA, 25 bp, Rattus norvegicus
tgtcagctgcggtgcttcggaacct

SEQ ID NO: 645155 - DNA, 25 bp, Rattus norvegicus
tgtcagctgcttcatcgagcgaggc

SEQ ID NO: 645156 - DNA, 25 bp, Rattus norvegicus
tgtcagctgcttgatcgagcgaggc

SEQ ID NO: 645157 - DNA, 25 bp, Rattus norvegicus
tgtcagctgtagcagcgctgcgaaa

SEQ ID NO: 645158 - DNA, 25 bp, Rattus norvegicus
tgtcagctgtaggagcgctgcgaaa

SEQ ID NO: 645159 - DNA, 25 bp, Rattus norvegicus
tgtcagctgtctcttcttcatttaa

SEQ ID NO: 645160 - DNA, 25 bp, Rattus norvegicus
tgtcagctgtctgttcttcatttaa

SEQ ID NO: 645161 - DNA, 25 bp, Rattus norvegicus
tgtcagctgtgcactatttatagtc

SEQ ID NO: 645162 - DNA, 25 bp, Rattus norvegicus
tgtcagctgtgctctatttatagtc

SEQ ID NO: 645163 - DNA, 25 bp, Rattus norvegicus
tgtcagcttccaacatgctacggca

SEQ ID NO: 645164 - DNA, 25 bp, Rattus norvegicus
tgtcagcttccatcatgctacggca

SEQ ID NO: 645165 - DNA, 25 bp, Rattus norvegicus
tgtcagcttcctctctgtctcagta

SEQ ID NO: 645166 - DNA, 25 bp, Rattus norvegicus
tgtcagcttcctgtctgtctcagta

SEQ ID NO: 645167 - DNA, 25 bp, Rattus norvegicus
tgtcagctttctctggtcaaggtca

SEQ ID NO: 645168 - DNA, 25 bp, Rattus norvegicus
tgtcagctttctgtggtcaaggtca

SEQ ID NO: 645169 - DNA, 25 bp, Rattus norvegicus
tgtcaggaagctacttgtgtctcca

SEQ ID NO: 645170 - DNA, 25 bp, Rattus norvegicus
tgtcaggaagctctttgcccctcag

SEQ ID NO: 645171 - DNA, 25 bp, Rattus norvegicus
tgtcaggaagctgtttgcccctcag

SEQ ID NO: 645172 - DNA, 25 bp, Rattus norvegicus
tgtcaggaagcttcttgtgtctcca

SEQ ID NO: 645173 - DNA, 25 bp, Rattus norvegicus
tgtcaggaccatctaatctctacac

SEQ ID NO: 645174 - DNA, 25 bp, Rattus norvegicus
tgtcaggaccatgtaatctctacac

SEQ ID NO: 645175 - DNA, 25 bp, Rattus norvegicus
tgtcaggacctgatctttgttccta

SEQ ID NO: 645176 - DNA, 25 bp, Rattus norvegicus
tgtcaggacctgttctttgttccta

SEQ ID NO: 645177 - DNA, 25 bp, Rattus norvegicus
tgtcaggaggctatatacccaccag

SEQ ID NO: 645178 - DNA, 25 bp, Rattus norvegicus
tgtcaggaggctttatacccaccag

SEQ ID NO: 645179 - DNA, 25 bp, Rattus norvegicus
tgtcaggatccgattattctctttc

SEQ ID NO: 645180 - DNA, 25 bp, Rattus norvegicus
tgtcaggatccgtttattctctttc

SEQ ID NO: 645181 - DNA, 25 bp, Rattus norvegicus
tgtcaggcagcccatgctccaacag

SEQ ID NO: 645182 - DNA, 25 bp, Rattus norvegicus
tgtcaggcagccgatgctccaacag

SEQ ID NO: 645183 - DNA, 25 bp, Rattus norvegicus
tgtcaggcaggtaatcaggaacttt

SEQ ID NO: 645184 - DNA, 25 bp, Rattus norvegicus
tgtcaggcaggttatcaggaacttt

SEQ ID NO: 645185 - DNA, 25 bp, Rattus norvegicus
tgtcaggcataaaaggtgcggccac

SEQ ID NO: 645186 - DNA, 25 bp, Rattus norvegicus
tgtcaggcataataggtgcggccac

SEQ ID NO: 645187 - DNA, 25 bp, Rattus norvegicus
tgtcaggccccacaacagagagatc

SEQ ID NO: 645188 - DNA, 25 bp, Rattus norvegicus
tgtcaggccccagaacagagagatc

SEQ ID NO: 645189 - DNA, 25 bp, Rattus norvegicus
tgtcaggctctcagtatcctggaat

SEQ ID NO: 645190 - DNA, 25 bp, Rattus norvegicus
tgtcaggctctctgtatcctggaat

SEQ ID NO: 645191 - DNA, 25 bp, Rattus norvegicus
tgtcagggaattaccacctctgtta

SEQ ID NO: 645192 - DNA, 25 bp, Rattus norvegicus
tgtcagggaatttccacctctgtta

SEQ ID NO: 645193 - DNA, 25 bp, Rattus norvegicus
tgtcagggaggcatcactccacaaa

SEQ ID NO: 645194 - DNA, 25 bp, Rattus norvegicus
tgtcagggaggcttcactccacaaa

SEQ ID NO: 645195 - DNA, 25 bp, Rattus norvegicus
tgtcagggcaatagtttctctccgc

SEQ ID NO: 645196 - DNA, 25 bp, Rattus norvegicus
tgtcagggcaattgtttctctccgc

SEQ ID NO: 645197 - DNA, 25 bp, Rattus norvegicus
tgtcagggtaagagatctaggcact

SEQ ID NO: 645198 - DNA, 25 bp, Rattus norvegicus
tgtcagggtaagtgatctaggcact

SEQ ID NO: 645199 - DNA, 25 bp, Rattus norvegicus
tgtcagggtctaaagctagctctct

SEQ ID NO: 645200 - DNA, 25 bp, Rattus norvegicus
tgtcagggtctatagctagctctct

SEQ ID NO: 645201 - DNA, 25 bp, Rattus norvegicus
tgtcagggtcttcctgtatagccca

SEQ ID NO: 645202 - DNA, 25 bp, Rattus norvegicus
tgtcagggtcttgctgtatagccca

SEQ ID NO: 645203 - DNA, 25 bp, Rattus norvegicus
tgtcaggtctcactccacagtggaa

SEQ ID NO: 645204 - DNA, 25 bp, Rattus norvegicus
tgtcaggtctcagtccacagtggaa

SEQ ID NO: 645205 - DNA, 25 bp, Rattus norvegicus
tgtcaggttacacgttccttctttt

SEQ ID NO: 645206 - DNA, 25 bp, Rattus norvegicus
tgtcaggttacaggttccttctttt

SEQ ID NO: 645207 - DNA, 25 bp, Rattus norvegicus
tgtcaggttctcagccccagaggga

SEQ ID NO: 645208 - DNA, 25 bp, Rattus norvegicus
tgtcaggttctctgccccagaggga

SEQ ID NO: 645209 - DNA, 25 bp, Rattus norvegicus
tgtcaggttcttatcttccgggaga

SEQ ID NO: 645210 - DNA, 25 bp, Rattus norvegicus
tgtcaggttcttttcttccgggaga

SEQ ID NO: 645211 - DNA, 25 bp, Rattus norvegicus
tgtcagtagcatctctctgggccaa

SEQ ID NO: 645212 - DNA, 25 bp, Rattus norvegicus
tgtcagtagcatgtctctgggccaa

SEQ ID NO: 645213 - DNA, 25 bp, Rattus norvegicus
tgtcagtaggtcatgggccagccaa

SEQ ID NO: 645214 - DNA, 25 bp, Rattus norvegicus
tgtcagtaggtcttgggccagccaa

SEQ ID NO: 645215 - DNA, 25 bp, Rattus norvegicus
tgtcagtagttcctcagccttggaa

SEQ ID NO: 645216 - DNA, 25 bp, Rattus norvegicus
tgtcagtagttcgtcagccttggaa

SEQ ID NO: 645217 - DNA, 25 bp, Rattus norvegicus
tgtcagtatattatccacctccgaa

SEQ ID NO: 645218 - DNA, 25 bp, Rattus norvegicus
tgtcagtatattccacagtcacttg

SEQ ID NO: 645219 - DNA, 25 bp, Rattus norvegicus
tgtcagtatattgcacagtcacttg

SEQ ID NO: 645220 - DNA, 25 bp, Rattus norvegicus
tgtcagtatattttccacctccgaa

SEQ ID NO: 645221 - DNA, 25 bp, Rattus norvegicus
tgtcagtattacaccaaactttttt

SEQ ID NO: 645222 - DNA, 25 bp, Rattus norvegicus
tgtcagtattactccaaactttttt

SEQ ID NO: 645223 - DNA, 25 bp, Rattus norvegicus
tgtcagtattcccttcgtatgccta

SEQ ID NO: 645224 - DNA, 25 bp, Rattus norvegicus
tgtcagtattccgttcgtatgccta

SEQ ID NO: 645225 - DNA, 25 bp, Rattus norvegicus
tgtcagtattctacctggtcacgcc

SEQ ID NO: 645226 - DNA, 25 bp, Rattus norvegicus
tgtcagtattcttcctggtcacgcc

SEQ ID NO: 645227 - DNA, 25 bp, Rattus norvegicus
tgtcagtattttagtaaggttccgt

SEQ ID NO: 645228 - DNA, 25 bp, Rattus norvegicus
tgtcagtatttttgtaaggttccgt

SEQ ID NO: 645229 - DNA, 25 bp, Rattus norvegicus
tgtcagtcacagctaggtttaaaga

SEQ ID NO: 645230 - DNA, 25 bp, Rattus norvegicus
tgtcagtcacaggtaggtttaaaga

SEQ ID NO: 645231 - DNA, 25 bp, Rattus norvegicus
tgtcagtcactgctacatgcgggct

SEQ ID NO: 645232 - DNA, 25 bp, Rattus norvegicus
tgtcagtcactggtacatgcgggct

SEQ ID NO: 645233 - DNA, 25 bp, Rattus norvegicus
tgtcagtcaggaacacattagagtt

SEQ ID NO: 645234 - DNA, 25 bp, Rattus norvegicus
tgtcagtcaggatcacattagagtt

SEQ ID NO: 645235 - DNA, 25 bp, Rattus norvegicus
tgtcagtcctcacgttcagcaagtc

SEQ ID NO: 645236 - DNA, 25 bp, Rattus norvegicus
tgtcagtcctcaggttcagcaagtc

SEQ ID NO: 645237 - DNA, 25 bp, Rattus norvegicus
tgtcagtcgcatactcaccctctgt

SEQ ID NO: 645238 - DNA, 25 bp, Rattus norvegicus
tgtcagtcgcattctcaccctctgt

SEQ ID NO: 645239 - DNA, 25 bp, Rattus norvegicus
tgtcagtcttgtattccagttctct

SEQ ID NO: 645240 - DNA, 25 bp, Rattus norvegicus
tgtcagtcttgttttccagttctct

SEQ ID NO: 645241 - DNA, 25 bp, Rattus norvegicus
tgtcagtctttgcttgggtttgtta

SEQ ID NO: 645242 - DNA, 25 bp, Rattus norvegicus
tgtcagtctttggttgggtttgtta

SEQ ID NO: 645243 - DNA, 25 bp, Rattus norvegicus
tgtcagtgacataaggtccttcctc

SEQ ID NO: 645244 - DNA, 25 bp, Rattus norvegicus
tgtcagtgacattaggtccttcctc

SEQ ID NO: 645245 - DNA, 25 bp, Rattus norvegicus
tgtcagtgaccaagttcaccgccaa

SEQ ID NO: 645246 - DNA, 25 bp, Rattus norvegicus
tgtcagtgaccatgttcaccgccaa

SEQ ID NO: 645247 - DNA, 25 bp, Rattus norvegicus
tgtcagtgactgcaaagcttgtttg

SEQ ID NO: 645248 - DNA, 25 bp, Rattus norvegicus
tgtcagtgactggaaagcttgtttg

SEQ ID NO: 645249 - DNA, 25 bp, Rattus norvegicus
tgtcagtgagtccagtgccgacgaa

SEQ ID NO: 645250 - DNA, 25 bp, Rattus norvegicus
tgtcagtgagtcgagtgccgacgaa

SEQ ID NO: 645251 - DNA, 25 bp, Rattus norvegicus
tgtcagtgatttcgcttctcctgag

SEQ ID NO: 645252 - DNA, 25 bp, Rattus norvegicus
tgtcagtgatttggcttctcctgag

SEQ ID NO: 645253 - DNA, 25 bp, Rattus norvegicus
tgtcagtgcgtcagcatcctgtgta

SEQ ID NO: 645254 - DNA, 25 bp, Rattus norvegicus
tgtcagtgcgtctgcatcctgtgta

SEQ ID NO: 645255 - DNA, 25 bp, Rattus norvegicus
tgtcagtggccaccatccacaggtg

SEQ ID NO: 645256 - DNA, 25 bp, Rattus norvegicus
tgtcagtggccagcatccacaggtg

SEQ ID NO: 645257 - DNA, 25 bp, Rattus norvegicus
tgtcagtgttcacatgaggtcctcc

SEQ ID NO: 645258 - DNA, 25 bp, Rattus norvegicus
tgtcagtgttcagatgaggtcctcc

SEQ ID NO: 645259 - DNA, 25 bp, Rattus norvegicus
tgtcagttcaataccagcctggtat

SEQ ID NO: 645260 - DNA, 25 bp, Rattus norvegicus
tgtcagttcaattccagcctggtat

SEQ ID NO: 645261 - DNA, 25 bp, Rattus norvegicus
tgtcagttcctgcacgaggacccgg

SEQ ID NO: 645262 - DNA, 25 bp, Rattus norvegicus
tgtcagttcctggacgaggacccgg

SEQ ID NO: 645263 - DNA, 25 bp, Rattus norvegicus
tgtcagttgagcaggccctagaagt

SEQ ID NO: 645264 - DNA, 25 bp, Rattus norvegicus
tgtcagttgagctggccctagaagt

SEQ ID NO: 645265 - DNA, 25 bp, Rattus norvegicus
tgtcagttgatacctttgtgcacct

SEQ ID NO: 645266 - DNA, 25 bp, Rattus norvegicus
tgtcagttgatagctttgtgcacct

SEQ ID NO: 645267 - DNA, 25 bp, Rattus norvegicus
tgtcagtttctaagttggaccttga

SEQ ID NO: 645268 - DNA, 25 bp, Rattus norvegicus
tgtcagtttctatgttggaccttga

SEQ ID NO: 645269 - DNA, 25 bp, Rattus norvegicus
tgtcagtttttacctttttctcctt

SEQ ID NO: 645270 - DNA, 25 bp, Rattus norvegicus
tgtcagtttttagctttttctcctt

SEQ ID NO: 645271 - DNA, 25 bp, Rattus norvegicus
tgtcataacatcattgccaccgaat

SEQ ID NO: 645272 - DNA, 25 bp, Rattus norvegicus
tgtcataacatctttgccaccgaat

SEQ ID NO: 645273 - DNA, 25 bp, Rattus norvegicus
tgtcataagcaacccatccctaatg

SEQ ID NO: 645274 - DNA, 25 bp, Rattus norvegicus
tgtcataagcaagccatccctaatg

SEQ ID NO: 645275 - DNA, 25 bp, Rattus norvegicus
tgtcataccatcacagagcctgcag

SEQ ID NO: 645276 - DNA, 25 bp, Rattus norvegicus
tgtcataccatctcagagcctgcag

SEQ ID NO: 645277 - DNA, 25 bp, Rattus norvegicus
tgtcatacccaccatggtgacacgg

SEQ ID NO: 645278 - DNA, 25 bp, Rattus norvegicus
tgtcatacccacgatggtgacacgg

SEQ ID NO: 645279 - DNA, 25 bp, Rattus norvegicus
tgtcatactgacctttttgctgcat

SEQ ID NO: 645280 - DNA, 25 bp, Rattus norvegicus
tgtcatactgacgtttttgctgcat

SEQ ID NO: 645281 - DNA, 25 bp, Rattus norvegicus
tgtcatagccccaggagcatccaag

SEQ ID NO: 645282 - DNA, 25 bp, Rattus norvegicus
tgtcatagcccctggagcatccaag

SEQ ID NO: 645283 - DNA, 25 bp, Rattus norvegicus
tgtcataggccccacttggtgctat

SEQ ID NO: 645284 - DNA, 25 bp, Rattus norvegicus
tgtcataggcccgacttggtgctat

SEQ ID NO: 645285 - DNA, 25 bp, Rattus norvegicus
tgtcatagttcaagactgccagcat

SEQ ID NO: 645286 - DNA, 25 bp, Rattus norvegicus
tgtcatagttcatgactgccagcat

SEQ ID NO: 645287 - DNA, 25 bp, Rattus norvegicus
tgtcatattctcatcctgtctcgat

SEQ ID NO: 645288 - DNA, 25 bp, Rattus norvegicus
tgtcatattctcttcctgtctcgat

SEQ ID NO: 645289 - DNA, 25 bp, Rattus norvegicus
tgtcatcaactacaaggtctccctc

SEQ ID NO: 645290 - DNA, 25 bp, Rattus norvegicus
tgtcatcaactagaaggtctccctc

SEQ ID NO: 645291 - DNA, 25 bp, Rattus norvegicus
tgtcatcaagatcccggagtcagcc

SEQ ID NO: 645292 - DNA, 25 bp, Rattus norvegicus
tgtcatcaagatgccggagtcagcc

SEQ ID NO: 645293 - DNA, 25 bp, Rattus norvegicus
tgtcatcacaacacggagccgacaa

SEQ ID NO: 645294 - DNA, 25 bp, Rattus norvegicus
tgtcatcacaactcggagccgacaa

SEQ ID NO: 645295 - DNA, 25 bp, Rattus norvegicus
tgtcatcacagaaacatatgttata

SEQ ID NO: 645296 - DNA, 25 bp, Rattus norvegicus
tgtcatcacagatacatatgttata

SEQ ID NO: 645297 - DNA, 25 bp, Rattus norvegicus
tgtcatcactgcatctgccctgttt

SEQ ID NO: 645298 - DNA, 25 bp, Rattus norvegicus
tgtcatcactgcttctgccctgttt

SEQ ID NO: 645299 - DNA, 25 bp, Rattus norvegicus
tgtcatcagatcctcaacccactcc

SEQ ID NO: 645300 - DNA, 25 bp, Rattus norvegicus
tgtcatcagatcgtcaacccactcc

SEQ ID NO: 645301 - DNA, 25 bp, Rattus norvegicus
tgtcatcaggataactttggcgaac

SEQ ID NO: 645302 - DNA, 25 bp, Rattus norvegicus
tgtcatcaggattactttggcgaac

SEQ ID NO: 645303 - DNA, 25 bp, Rattus norvegicus
tgtcatcatcacctctatccagaat

SEQ ID NO: 645304 - DNA, 25 bp, Rattus norvegicus
tgtcatcatcaccttagacttgtcc

SEQ ID NO: 645305 - DNA, 25 bp, Rattus norvegicus
tgtcatcatcacgtctatccagaat

SEQ ID NO: 645306 - DNA, 25 bp, Rattus norvegicus
tgtcatcatcacgttagacttgtcc

SEQ ID NO: 645307 - DNA, 25 bp, Rattus norvegicus
tgtcatccacttcgccctcaaggaa

SEQ ID NO: 645308 - DNA, 25 bp, Rattus norvegicus
tgtcatccacttggccctcaaggaa

SEQ ID NO: 645309 - DNA, 25 bp, Rattus norvegicus
tgtcatccaggtagagtccagctct

SEQ ID NO: 645310 - DNA, 25 bp, Rattus norvegicus
tgtcatccaggttgagtccagctct

SEQ ID NO: 645311 - DNA, 25 bp, Rattus norvegicus
tgtcatccatgtaatttcccgtcca

SEQ ID NO: 645312 - DNA, 25 bp, Rattus norvegicus
tgtcatccatgttatttcccgtcca

SEQ ID NO: 645313 - DNA, 25 bp, Rattus norvegicus
tgtcatccccagaatccaggaggca

SEQ ID NO: 645314 - DNA, 25 bp, Rattus norvegicus
tgtcatccccagtatccaggaggca

SEQ ID NO: 645315 - DNA, 25 bp, Rattus norvegicus
tgtcatccgggcatttgcttcgtgc

SEQ ID NO: 645316 - DNA, 25 bp, Rattus norvegicus
tgtcatccgggcttttgcttcgtgc

SEQ ID NO: 645317 - DNA, 25 bp, Rattus norvegicus
tgtcatcctcttcggaaacatcgca

SEQ ID NO: 645318 - DNA, 25 bp, Rattus norvegicus
tgtcatcctcttgggaaacatcgca

SEQ ID NO: 645319 - DNA, 25 bp, Rattus norvegicus
tgtcatcctgacaaaccacagagta

SEQ ID NO: 645320 - DNA, 25 bp, Rattus norvegicus
tgtcatcctgactaaccacagagta

SEQ ID NO: 645321 - DNA, 25 bp, Rattus norvegicus
tgtcatcctgagaccacaaacatgg

SEQ ID NO: 645322 - DNA, 25 bp, Rattus norvegicus
tgtcatcctgagtccacaaacatgg

SEQ ID NO: 645323 - DNA, 25 bp, Rattus norvegicus
tgtcatcgcctgacacctacagtaa

SEQ ID NO: 645324 - DNA, 25 bp, Rattus norvegicus
tgtcatcgcctgtcacctacagtaa

SEQ ID NO: 645325 - DNA, 25 bp, Rattus norvegicus
tgtcatcgtgctaccgtcatgcaga

SEQ ID NO: 645326 - DNA, 25 bp, Rattus norvegicus
tgtcatcgtgcttccgtcatgcaga

SEQ ID NO: 645327 - DNA, 25 bp, Rattus norvegicus
tgtcatctaataacaccagttctct

SEQ ID NO: 645328 - DNA, 25 bp, Rattus norvegicus
tgtcatctaatatcaccagttctct

SEQ ID NO: 645329 - DNA, 25 bp, Rattus norvegicus
tgtcatctaccacgcgagtggtgga

SEQ ID NO: 645330 - DNA, 25 bp, Rattus norvegicus
tgtcatctaccaggcgagtggtgga

SEQ ID NO: 645331 - DNA, 25 bp, Rattus norvegicus
tgtcatctagatcgtccctttcacg

SEQ ID NO: 645332 - DNA, 25 bp, Rattus norvegicus
tgtcatctagatggtccctttcacg

SEQ ID NO: 645333 - DNA, 25 bp, Rattus norvegicus
tgtcatctagtgagacggtgggcca

SEQ ID NO: 645334 - DNA, 25 bp, Rattus norvegicus
tgtcatctagtgtgacggtgggcca

SEQ ID NO: 645335 - DNA, 25 bp, Rattus norvegicus
tgtcatctcagcatctgggaagcaa

SEQ ID NO: 645336 - DNA, 25 bp, Rattus norvegicus
tgtcatctcagcttctgggaagcaa

SEQ ID NO: 645337 - DNA, 25 bp, Rattus norvegicus
tgtcatctgagaccaccttcctttt

SEQ ID NO: 645338 - DNA, 25 bp, Rattus norvegicus
tgtcatctgagagcaccttcctttt

SEQ ID NO: 645339 - DNA, 25 bp, Rattus norvegicus
tgtcatctggaaaccagtgggattt

SEQ ID NO: 645340 - DNA, 25 bp, Rattus norvegicus
tgtcatctggaaacgcccagacaga

SEQ ID NO: 645341 - DNA, 25 bp, Rattus norvegicus
tgtcatctggaatccagtgggattt

SEQ ID NO: 645342 - DNA, 25 bp, Rattus norvegicus
tgtcatctggaatcgcccagacaga

SEQ ID NO: 645343 - DNA, 25 bp, Rattus norvegicus
tgtcatctggccctggagcacagaa

SEQ ID NO: 645344 - DNA, 25 bp, Rattus norvegicus
tgtcatctggccgtggagcacagaa

SEQ ID NO: 645345 - DNA, 25 bp, Rattus norvegicus
tgtcatcttcatcgccactcagtga

SEQ ID NO: 645346 - DNA, 25 bp, Rattus norvegicus
tgtcatcttcatggccactcagtga

SEQ ID NO: 645347 - DNA, 25 bp, Rattus norvegicus
tgtcatcttctgcaacaccaagagg

SEQ ID NO: 645348 - DNA, 25 bp, Rattus norvegicus
tgtcatcttctggaacaccaagagg

SEQ ID NO: 645349 - DNA, 25 bp, Rattus norvegicus
tgtcatgaaacccatgccacattga

SEQ ID NO: 645350 - DNA, 25 bp, Rattus norvegicus
tgtcatgaaaccgatgccacattga

SEQ ID NO: 645351 - DNA, 25 bp, Rattus norvegicus
tgtcatgaagtgctccaggtcctgc

SEQ ID NO: 645352 - DNA, 25 bp, Rattus norvegicus
tgtcatgaagtggtccaggtcctgc

SEQ ID NO: 645353 - DNA, 25 bp, Rattus norvegicus
tgtcatgacctgcttccggcagaaa

SEQ ID NO: 645354 - DNA, 25 bp, Rattus norvegicus
tgtcatgacctggttccggcagaaa

SEQ ID NO: 645355 - DNA, 25 bp, Rattus norvegicus
tgtcatgactacctggccaacggaa

SEQ ID NO: 645356 - DNA, 25 bp, Rattus norvegicus
tgtcatgactacgtggccaacggaa

SEQ ID NO: 645357 - DNA, 25 bp, Rattus norvegicus
tgtcatgagctcagcttatatctct

SEQ ID NO: 645358 - DNA, 25 bp, Rattus norvegicus
tgtcatgagctctgcttatatctct

SEQ ID NO: 645359 - DNA, 25 bp, Rattus norvegicus
tgtcatgcaagtatgtatgccggaa

SEQ ID NO: 645360 - DNA, 25 bp, Rattus norvegicus
tgtcatgcaagtttgtatgccggaa

SEQ ID NO: 645361 - DNA, 25 bp, Rattus norvegicus
tgtcatgcagccacacaaagtcttc

SEQ ID NO: 645362 - DNA, 25 bp, Rattus norvegicus
tgtcatgcagcctcacaaagtcttc

SEQ ID NO: 645363 - DNA, 25 bp, Rattus norvegicus
tgtcatgccacgaggaagccgcagt

SEQ ID NO: 645364 - DNA, 25 bp, Rattus norvegicus
tgtcatgccacgtggaagccgcagt

SEQ ID NO: 645365 - DNA, 25 bp, Rattus norvegicus
tgtcatgcccgcagaagacactccg

SEQ ID NO: 645366 - DNA, 25 bp, Rattus norvegicus
tgtcatgcccgctgaagacactccg

SEQ ID NO: 645367 - DNA, 25 bp, Rattus norvegicus
tgtcatgcgggaactgcacttcacc

SEQ ID NO: 645368 - DNA, 25 bp, Rattus norvegicus
tgtcatgcgggatctgcacttcacc

SEQ ID NO: 645369 - DNA, 25 bp, Rattus norvegicus
tgtcatgcggtcactgggtcagaac

SEQ ID NO: 645370 - DNA, 25 bp, Rattus norvegicus
tgtcatgcggtctctgggtcagaac

SEQ ID NO: 645371 - DNA, 25 bp, Rattus norvegicus
tgtcatgctctaagtgctctgagga

SEQ ID NO: 645372 - DNA, 25 bp, Rattus norvegicus
tgtcatgctctatgtgctctgagga

SEQ ID NO: 645373 - DNA, 25 bp, Rattus norvegicus
tgtcatgcttctaaaccactgcgat

SEQ ID NO: 645374 - DNA, 25 bp, Rattus norvegicus
tgtcatgcttcttaaccactgcgat

SEQ ID NO: 645375 - DNA, 25 bp, Rattus norvegicus
tgtcatggaaacactctgccggttt

SEQ ID NO: 645376 - DNA, 25 bp, Rattus norvegicus
tgtcatggaaactctctgccggttt

SEQ ID NO: 645377 - DNA, 25 bp, Rattus norvegicus
tgtcatggaattcgccctttgagat

SEQ ID NO: 645378 - DNA, 25 bp, Rattus norvegicus
tgtcatggaattggccctttgagat

SEQ ID NO: 645379 - DNA, 25 bp, Rattus norvegicus
tgtcatggcaccaggatgcgtggtc

SEQ ID NO: 645380 - DNA, 25 bp, Rattus norvegicus
tgtcatggcacctggatgcgtggtc

SEQ ID NO: 645381 - DNA, 25 bp, Rattus norvegicus
tgtcatggccacatagaactgtgtg

SEQ ID NO: 645382 - DNA, 25 bp, Rattus norvegicus
tgtcatggccacttagaactgtgtg

SEQ ID NO: 645383 - DNA, 25 bp, Rattus norvegicus
tgtcatgggtctacctgtttttgta

SEQ ID NO: 645384 - DNA, 25 bp, Rattus norvegicus
tgtcatgggtcttcctgtttttgta

SEQ ID NO: 645385 - DNA, 25 bp, Rattus norvegicus
tgtcatgtaatcatgagcctgccct

SEQ ID NO: 645386 - DNA, 25 bp, Rattus norvegicus
tgtcatgtaatcttgagcctgccct

SEQ ID NO: 645387 - DNA, 25 bp, Rattus norvegicus
tgtcatgtatgcctcttcaatcata

SEQ ID NO: 645388 - DNA, 25 bp, Rattus norvegicus
tgtcatgtatgcgtcttcaatcata

SEQ ID NO: 645389 - DNA, 25 bp, Rattus norvegicus
tgtcatgtcctacaacacctggatt

SEQ ID NO: 645390 - DNA, 25 bp, Rattus norvegicus
tgtcatgtcctagaacacctggatt

SEQ ID NO: 645391 - DNA, 25 bp, Rattus norvegicus
tgtcatgtctacattcaggaggcag

SEQ ID NO: 645392 - DNA, 25 bp, Rattus norvegicus
tgtcatgtctactttcaggaggcag

SEQ ID NO: 645393 - DNA, 25 bp, Rattus norvegicus
tgtcatgtctgcagctgtacaaata

SEQ ID NO: 645394 - DNA, 25 bp, Rattus norvegicus
tgtcatgtctgctgctgtacaaata

SEQ ID NO: 645395 - DNA, 25 bp, Rattus norvegicus
tgtcatgtggtgaccagggcccgca

SEQ ID NO: 645396 - DNA, 25 bp, Rattus norvegicus
tgtcatgtggtgtccagggcccgca

SEQ ID NO: 645397 - DNA, 25 bp, Rattus norvegicus
tgtcatgtgtacagcagatgtgcgt

SEQ ID NO: 645398 - DNA, 25 bp, Rattus norvegicus
tgtcatgtgtactgcagatgtgcgt

SEQ ID NO: 645399 - DNA, 25 bp, Rattus norvegicus
tgtcatgtgtatctttgtagggagt

SEQ ID NO: 645400 - DNA, 25 bp, Rattus norvegicus
tgtcatgtgtatgtttgtagggagt

SEQ ID NO: 645401 - DNA, 25 bp, Rattus norvegicus
tgtcattaaagtagctacaccctaa

SEQ ID NO: 645402 - DNA, 25 bp, Rattus norvegicus
tgtcattaaagttgctacaccctaa

SEQ ID NO: 645403 - DNA, 25 bp, Rattus norvegicus
tgtcattaccccattcaaacagctt

SEQ ID NO: 645404 - DNA, 25 bp, Rattus norvegicus
tgtcattacccctttcaaacagctt

SEQ ID NO: 645405 - DNA, 25 bp, Rattus norvegicus
tgtcattaccgaatcaaaggcctgt

SEQ ID NO: 645406 - DNA, 25 bp, Rattus norvegicus
tgtcattaccgattcaaaggcctgt

SEQ ID NO: 645407 - DNA, 25 bp, Rattus norvegicus
tgtcattaggttagggacccttctc

SEQ ID NO: 645408 - DNA, 25 bp, Rattus norvegicus
tgtcattaggtttgggacccttctc

SEQ ID NO: 645409 - DNA, 25 bp, Rattus norvegicus
tgtcattattttacccctccacggg

SEQ ID NO: 645410 - DNA, 25 bp, Rattus norvegicus
tgtcattatttttcccctccacggg

SEQ ID NO: 645411 - DNA, 25 bp, Rattus norvegicus
tgtcattcaaacctgactccgaggt

SEQ ID NO: 645412 - DNA, 25 bp, Rattus norvegicus
tgtcattcaaacgtgactccgaggt

SEQ ID NO: 645413 - DNA, 25 bp, Rattus norvegicus
tgtcattcacagcacggttcttttg

SEQ ID NO: 645414 - DNA, 25 bp, Rattus norvegicus
tgtcattcacaggacggttcttttg

SEQ ID NO: 645415 - DNA, 25 bp, Rattus norvegicus
tgtcattcagctcatcagcgtgtac

SEQ ID NO: 645416 - DNA, 25 bp, Rattus norvegicus
tgtcattcagctgatcagcgtgtac

SEQ ID NO: 645417 - DNA, 25 bp, Rattus norvegicus
tgtcattccctgcttaatgctagga

SEQ ID NO: 645418 - DNA, 25 bp, Rattus norvegicus
tgtcattccctggttaatgctagga

SEQ ID NO: 645419 - DNA, 25 bp, Rattus norvegicus
tgtcattcctacacatatcccagtt

SEQ ID NO: 645420 - DNA, 25 bp, Rattus norvegicus
tgtcattcctactcatatcccagtt

SEQ ID NO: 645421 - DNA, 25 bp, Rattus norvegicus
tgtcattccttgagatgattctgtc

SEQ ID NO: 645422 - DNA, 25 bp, Rattus norvegicus
tgtcattccttgtgatgattctgtc

SEQ ID NO: 645423 - DNA, 25 bp, Rattus norvegicus
tgtcattcctttatatgaagtgctg

SEQ ID NO: 645424 - DNA, 25 bp, Rattus norvegicus
tgtcattcctttttatgaagtgctg

SEQ ID NO: 645425 - DNA, 25 bp, Rattus norvegicus
tgtcattcgaacaaattcttccaga

SEQ ID NO: 645426 - DNA, 25 bp, Rattus norvegicus
tgtcattcgaactaattcttccaga

SEQ ID NO: 645427 - DNA, 25 bp, Rattus norvegicus
tgtcattctggtcatgctgtccatg

SEQ ID NO: 645428 - DNA, 25 bp, Rattus norvegicus
tgtcattctggtgatgctgtccatg

SEQ ID NO: 645429 - DNA, 25 bp, Rattus norvegicus
tgtcattctgtactaccactcatat

SEQ ID NO: 645430 - DNA, 25 bp, Rattus norvegicus
tgtcattctgtagtaccactcatat

SEQ ID NO: 645431 - DNA, 25 bp, Rattus norvegicus
tgtcattgcgtccagagtgccacta

SEQ ID NO: 645432 - DNA, 25 bp, Rattus norvegicus
tgtcattgcgtcgagagtgccacta

SEQ ID NO: 645433 - DNA, 25 bp, Rattus norvegicus
tgtcattgcttcaagttatctttct

SEQ ID NO: 645434 - DNA, 25 bp, Rattus norvegicus
tgtcattgcttctagttatctttct

SEQ ID NO: 645435 - DNA, 25 bp, Rattus norvegicus
tgtcattgcttgctctagtcctaac

SEQ ID NO: 645436 - DNA, 25 bp, Rattus norvegicus
tgtcattgcttggtctagtcctaac

SEQ ID NO: 645437 - DNA, 25 bp, Rattus norvegicus
tgtcattggagaagtcctcgttcct

SEQ ID NO: 645438 - DNA, 25 bp, Rattus norvegicus
tgtcattggagatgtcctcgttcct

SEQ ID NO: 645439 - DNA, 25 bp, Rattus norvegicus
tgtcattggcaccattccacagaga

SEQ ID NO: 645440 - DNA, 25 bp, Rattus norvegicus
tgtcattggcacgattccacagaga

SEQ ID NO: 645441 - DNA, 25 bp, Rattus norvegicus
tgtcattggcttaatttctggctcc

SEQ ID NO: 645442 - DNA, 25 bp, Rattus norvegicus
tgtcattggctttatttctggctcc

SEQ ID NO: 645443 - DNA, 25 bp, Rattus norvegicus
tgtcattgtaggctccgcgaggacc

SEQ ID NO: 645444 - DNA, 25 bp, Rattus norvegicus
tgtcattgtagggtccgcgaggacc

SEQ ID NO: 645445 - DNA, 25 bp, Rattus norvegicus
tgtcattgtcatatttcccacctaa

SEQ ID NO: 645446 - DNA, 25 bp, Rattus norvegicus
tgtcattgtcatttttcccacctaa

SEQ ID NO: 645447 - DNA, 25 bp, Rattus norvegicus
tgtcattgtctcagtctctttgcct

SEQ ID NO: 645448 - DNA, 25 bp, Rattus norvegicus
tgtcattgtctctgtctctttgcct

SEQ ID NO: 645449 - DNA, 25 bp, Rattus norvegicus
tgtcatttacagcatccgtgtccgc

SEQ ID NO: 645450 - DNA, 25 bp, Rattus norvegicus
tgtcatttacaggatccgtgtccgc

SEQ ID NO: 645451 - DNA, 25 bp, Rattus norvegicus
tgtcatttacccaacggtggctgaa

SEQ ID NO: 645452 - DNA, 25 bp, Rattus norvegicus
tgtcatttaccctacggtggctgaa

SEQ ID NO: 645453 - DNA, 25 bp, Rattus norvegicus
tgtcatttattacaagatggtttaa

SEQ ID NO: 645454 - DNA, 25 bp, Rattus norvegicus
tgtcatttattagaagatggtttaa

SEQ ID NO: 645455 - DNA, 25 bp, Rattus norvegicus
tgtcatttccacacggctcttgaga

SEQ ID NO: 645456 - DNA, 25 bp, Rattus norvegicus
tgtcatttccactcggctcttgaga

SEQ ID NO: 645457 - DNA, 25 bp, Rattus norvegicus
tgtcatttctaaaacctcctgtcag

SEQ ID NO: 645458 - DNA, 25 bp, Rattus norvegicus
tgtcatttctaatacctcctgtcag

SEQ ID NO: 645459 - DNA, 25 bp, Rattus norvegicus
tgtcatttcttacttgccaatcagc

SEQ ID NO: 645460 - DNA, 25 bp, Rattus norvegicus
tgtcatttcttagttgccaatcagc

SEQ ID NO: 645461 - DNA, 25 bp, Rattus norvegicus
tgtcatttgctgattctgctgttca

SEQ ID NO: 645462 - DNA, 25 bp, Rattus norvegicus
tgtcatttgctgctttctcttttgc

SEQ ID NO: 645463 - DNA, 25 bp, Rattus norvegicus
tgtcatttgctggtttctcttttgc

SEQ ID NO: 645464 - DNA, 25 bp, Rattus norvegicus
tgtcatttgctgtttctgctgttca

SEQ ID NO: 645465 - DNA, 25 bp, Rattus norvegicus
tgtcatttgtcacccctcacaggag

SEQ ID NO: 645466 - DNA, 25 bp, Rattus norvegicus
tgtcatttgtcagccctcacaggag

SEQ ID NO: 645467 - DNA, 25 bp, Rattus norvegicus
tgtcatttgtttagactgtgccaat

SEQ ID NO: 645468 - DNA, 25 bp, Rattus norvegicus
tgtcatttgttttgactgtgccaat

SEQ ID NO: 645469 - DNA, 25 bp, Rattus norvegicus
tgtcattttgccctcaatcttggaa

SEQ ID NO: 645470 - DNA, 25 bp, Rattus norvegicus
tgtcattttgccgtcaatcttggaa

SEQ ID NO: 645471 - DNA, 25 bp, Rattus norvegicus
tgtcattttgtcaggctggtcctaa

SEQ ID NO: 645472 - DNA, 25 bp, Rattus norvegicus
tgtcattttgtctggctggtcctaa

SEQ ID NO: 645473 - DNA, 25 bp, Rattus norvegicus
tgtcattttgtgaaagactgtctaa

SEQ ID NO: 645474 - DNA, 25 bp, Rattus norvegicus
tgtcattttgtgtaagactgtctaa

SEQ ID NO: 645475 - DNA, 25 bp, Rattus norvegicus
tgtcatttttaaacgcataagcaga

SEQ ID NO: 645476 - DNA, 25 bp, Rattus norvegicus
tgtcatttttaatcgcataagcaga

SEQ ID NO: 645477 - DNA, 25 bp, Rattus norvegicus
tgtccaaaagaacccccaggaagag

SEQ ID NO: 645478 - DNA, 25 bp, Rattus norvegicus
tgtccaaaagaagccccaggaagag

SEQ ID NO: 645479 - DNA, 25 bp, Rattus norvegicus
tgtccaaacaccagatgctccatta

SEQ ID NO: 645480 - DNA, 25 bp, Rattus norvegicus
tgtccaaacacctgatgctccatta

SEQ ID NO: 645481 - DNA, 25 bp, Rattus norvegicus
tgtccaaacactcgtacacactaag

SEQ ID NO: 645482 - DNA, 25 bp, Rattus norvegicus
tgtccaaacactggtacacactaag

SEQ ID NO: 645483 - DNA, 25 bp, Rattus norvegicus
tgtccaaacaggcagaaatctttct

SEQ ID NO: 645484 - DNA, 25 bp, Rattus norvegicus
tgtccaaacagggagaaatctttct

SEQ ID NO: 645485 - DNA, 25 bp, Rattus norvegicus
tgtccaaacccaacggtgtggtgaa

SEQ ID NO: 645486 - DNA, 25 bp, Rattus norvegicus
tgtccaaacccatcggtgtggtgaa

SEQ ID NO: 645487 - DNA, 25 bp, Rattus norvegicus
tgtccaaatttcaattttccagggc

SEQ ID NO: 645488 - DNA, 25 bp, Rattus norvegicus
tgtccaaatttctattttccagggc

SEQ ID NO: 645489 - DNA, 25 bp, Rattus norvegicus
tgtccaaatttgaccatcatccatt

SEQ ID NO: 645490 - DNA, 25 bp, Rattus norvegicus
tgtccaaatttgtccatcatccatt

SEQ ID NO: 645491 - DNA, 25 bp, Rattus norvegicus
tgtccaacagttacgcagaatgcta

SEQ ID NO: 645492 - DNA, 25 bp, Rattus norvegicus
tgtccaacagtttcgcagaatgcta

SEQ ID NO: 645493 - DNA, 25 bp, Rattus norvegicus
tgtccaactagcactgccttttatg

SEQ ID NO: 645494 - DNA, 25 bp, Rattus norvegicus
tgtccaactagctctgccttttatg

SEQ ID NO: 645495 - DNA, 25 bp, Rattus norvegicus
tgtccaactgagcacgtccatgata

SEQ ID NO: 645496 - DNA, 25 bp, Rattus norvegicus
tgtccaactgaggacgtccatgata

SEQ ID NO: 645497 - DNA, 25 bp, Rattus norvegicus
tgtccaagactacttttctttgggc

SEQ ID NO: 645498 - DNA, 25 bp, Rattus norvegicus
tgtccaagactagttttctttgggc

SEQ ID NO: 645499 - DNA, 25 bp, Rattus norvegicus
tgtccaagactcagtcatcccactg

SEQ ID NO: 645500 - DNA, 25 bp, Rattus norvegicus
tgtccaagactctgtcatcccactg

SEQ ID NO: 645501 - DNA, 25 bp, Rattus norvegicus
tgtccaagagcaccctgcttaccat

SEQ ID NO: 645502 - DNA, 25 bp, Rattus norvegicus
tgtccaagagcagcctgcttaccat

SEQ ID NO: 645503 - DNA, 25 bp, Rattus norvegicus
tgtccaagcagacttgatcagcccc

SEQ ID NO: 645504 - DNA, 25 bp, Rattus norvegicus
tgtccaagcagagttgatcagcccc

SEQ ID NO: 645505 - DNA, 25 bp, Rattus norvegicus
tgtccaagcctcagtgcacctgcag

SEQ ID NO: 645506 - DNA, 25 bp, Rattus norvegicus
tgtccaagcctctgtgcacctgcag

SEQ ID NO: 645507 - DNA, 25 bp, Rattus norvegicus
tgtccaaggacaactttaaacttcg

SEQ ID NO: 645508 - DNA, 25 bp, Rattus norvegicus
tgtccaaggacatctttaaacttcg

SEQ ID NO: 645509 - DNA, 25 bp, Rattus norvegicus
tgtccaaggctgagggagcgatcaa

SEQ ID NO: 645510 - DNA, 25 bp, Rattus norvegicus
tgtccaaggctgtgggagcgatcaa

SEQ ID NO: 645511 - DNA, 25 bp, Rattus norvegicus
tgtccaaggcttatttctctccaag

SEQ ID NO: 645512 - DNA, 25 bp, Rattus norvegicus
tgtccaaggcttccgattacatccg

SEQ ID NO: 645513 - DNA, 25 bp, Rattus norvegicus
tgtccaaggcttgcgattacatccg

SEQ ID NO: 645514 - DNA, 25 bp, Rattus norvegicus
tgtccaaggcttttttctctccaag

SEQ ID NO: 645515 - DNA, 25 bp, Rattus norvegicus
tgtccaagtgctcgccccttagaga

SEQ ID NO: 645516 - DNA, 25 bp, Rattus norvegicus
tgtccaagtgctggccccttagaga

SEQ ID NO: 645517 - DNA, 25 bp, Rattus norvegicus
tgtccaataagccaaacctcttcaa

SEQ ID NO: 645518 - DNA, 25 bp, Rattus norvegicus
tgtccaataagcgaaacctcttcaa

SEQ ID NO: 645519 - DNA, 25 bp, Rattus norvegicus
tgtccaatagccatgttccagaaag

SEQ ID NO: 645520 - DNA, 25 bp, Rattus norvegicus
tgtccaatagccttgttccagaaag

SEQ ID NO: 645521 - DNA, 25 bp, Rattus norvegicus
tgtccaatccatccctatgagcgat

SEQ ID NO: 645522 - DNA, 25 bp, Rattus norvegicus
tgtccaatccatgcctatgagcgat

SEQ ID NO: 645523 - DNA, 25 bp, Rattus norvegicus
tgtccaatcccaagtgctgtgtaac

SEQ ID NO: 645524 - DNA, 25 bp, Rattus norvegicus
tgtccaatcccatgtgctgtgtaac

SEQ ID NO: 645525 - DNA, 25 bp, Rattus norvegicus
tgtccaatcccgagcgccgcagggt

SEQ ID NO: 645526 - DNA, 25 bp, Rattus norvegicus
tgtccaatcccgtgcgccgcagggt

SEQ ID NO: 645527 - DNA, 25 bp, Rattus norvegicus
tgtccaatgcaaagctctgagtctt

SEQ ID NO: 645528 - DNA, 25 bp, Rattus norvegicus
tgtccaatgcaatgctctgagtctt

SEQ ID NO: 645529 - DNA, 25 bp, Rattus norvegicus
tgtccaatgctgattcccttttgaa

SEQ ID NO: 645530 - DNA, 25 bp, Rattus norvegicus
tgtccaatgctgtttcccttttgaa

SEQ ID NO: 645531 - DNA, 25 bp, Rattus norvegicus
tgtccaatggctactgcctgggact

SEQ ID NO: 645532 - DNA, 25 bp, Rattus norvegicus
tgtccaatggcttctgcctgggact

SEQ ID NO: 645533 - DNA, 25 bp, Rattus norvegicus
tgtccacacaacagaggtttcttta

SEQ ID NO: 645534 - DNA, 25 bp, Rattus norvegicus
tgtccacacaactgaggtttcttta

SEQ ID NO: 645535 - DNA, 25 bp, Rattus norvegicus
tgtccacaggaaccttaaccgtagt

SEQ ID NO: 645536 - DNA, 25 bp, Rattus norvegicus
tgtccacaggaagcttaaccgtagt

SEQ ID NO: 645537 - DNA, 25 bp, Rattus norvegicus
tgtccacagggaacagaggtacttt

SEQ ID NO: 645538 - DNA, 25 bp, Rattus norvegicus
tgtccacagggatcagaggtacttt

SEQ ID NO: 645539 - DNA, 25 bp, Rattus norvegicus
tgtccacagggcacttgagtttcac

SEQ ID NO: 645540 - DNA, 25 bp, Rattus norvegicus
tgtccacagggctcttgagtttcac

SEQ ID NO: 645541 - DNA, 25 bp, Rattus norvegicus
tgtccacagtgaatgtaccaacttg

SEQ ID NO: 645542 - DNA, 25 bp, Rattus norvegicus
tgtccacagtgattgtaccaacttg

SEQ ID NO: 645543 - DNA, 25 bp, Rattus norvegicus
tgtccacatagccattgcccagaat

SEQ ID NO: 645544 - DNA, 25 bp, Rattus norvegicus
tgtccacatagcgattgcccagaat

SEQ ID NO: 645545 - DNA, 25 bp, Rattus norvegicus
tgtccacatcatcctcagagcgtgc

SEQ ID NO: 645546 - DNA, 25 bp, Rattus norvegicus
tgtccacatcatgctcagagcgtgc

SEQ ID NO: 645547 - DNA, 25 bp, Rattus norvegicus
tgtccacatgaacgcgctcaccaga

SEQ ID NO: 645548 - DNA, 25 bp, Rattus norvegicus
tgtccacatgaaggcgctcaccaga

SEQ ID NO: 645549 - DNA, 25 bp, Rattus norvegicus
tgtccacatgacacgtggtctggat

SEQ ID NO: 645550 - DNA, 25 bp, Rattus norvegicus
tgtccacatgacagatgctgctcgc

SEQ ID NO: 645551 - DNA, 25 bp, Rattus norvegicus
tgtccacatgactcgtggtctggat

SEQ ID NO: 645552 - DNA, 25 bp, Rattus norvegicus
tgtccacatgactgatgctgctcgc

SEQ ID NO: 645553 - DNA, 25 bp, Rattus norvegicus
tgtccacatgagacatggaggcctc

SEQ ID NO: 645554 - DNA, 25 bp, Rattus norvegicus
tgtccacatgagtcatggaggcctc

SEQ ID NO: 645555 - DNA, 25 bp, Rattus norvegicus
tgtccacattccctacactcttgtt

SEQ ID NO: 645556 - DNA, 25 bp, Rattus norvegicus
tgtccacattccgtacactcttgtt

SEQ ID NO: 645557 - DNA, 25 bp, Rattus norvegicus
tgtccacatttgagtccgcatcttt

SEQ ID NO: 645558 - DNA, 25 bp, Rattus norvegicus
tgtccacatttgtgtccgcatcttt

SEQ ID NO: 645559 - DNA, 25 bp, Rattus norvegicus
tgtccaccaactcaacaccggaagg

SEQ ID NO: 645560 - DNA, 25 bp, Rattus norvegicus
tgtccaccaactgaacaccggaagg

SEQ ID NO: 645561 - DNA, 25 bp, Rattus norvegicus
tgtccaccagacattggctcttgct

SEQ ID NO: 645562 - DNA, 25 bp, Rattus norvegicus
tgtccaccagactttggctcttgct

SEQ ID NO: 645563 - DNA, 25 bp, Rattus norvegicus
tgtccacccagacacagcatatatg

SEQ ID NO: 645564 - DNA, 25 bp, Rattus norvegicus
tgtccacccagagacagcatatatg

SEQ ID NO: 645565 - DNA, 25 bp, Rattus norvegicus
tgtccaccccaactacttcaagatg

SEQ ID NO: 645566 - DNA, 25 bp, Rattus norvegicus
tgtccaccccaagtacttcaagatg

SEQ ID NO: 645567 - DNA, 25 bp, Rattus norvegicus
tgtccaccctggctgggccatcagg

SEQ ID NO: 645568 - DNA, 25 bp, Rattus norvegicus
tgtccaccctgggtgggccatcagg

SEQ ID NO: 645569 - DNA, 25 bp, Rattus norvegicus
tgtccaccgcggaaattcttgtttg

SEQ ID NO: 645570 - DNA, 25 bp, Rattus norvegicus
tgtccaccgcggtaattcttgtttg

SEQ ID NO: 645571 - DNA, 25 bp, Rattus norvegicus
tgtccaccggctagctaatgatata

SEQ ID NO: 645572 - DNA, 25 bp, Rattus norvegicus
tgtccaccggcttgctaatgatata

SEQ ID NO: 645573 - DNA, 25 bp, Rattus norvegicus
tgtccaccgggtctccttaggtagg

SEQ ID NO: 645574 - DNA, 25 bp, Rattus norvegicus
tgtccaccgggtgtccttaggtagg

SEQ ID NO: 645575 - DNA, 25 bp, Rattus norvegicus
tgtccaccgtgcctagggaacagag

SEQ ID NO: 645576 - DNA, 25 bp, Rattus norvegicus
tgtccaccgtgcgtagggaacagag

SEQ ID NO: 645577 - DNA, 25 bp, Rattus norvegicus
tgtccacctaaaatggttttcagag

SEQ ID NO: 645578 - DNA, 25 bp, Rattus norvegicus
tgtccacctaaattggttttcagag

SEQ ID NO: 645579 - DNA, 25 bp, Rattus norvegicus
tgtccacctcacagaggagcaggga

SEQ ID NO: 645580 - DNA, 25 bp, Rattus norvegicus
tgtccacctcactgaggagcaggga

SEQ ID NO: 645581 - DNA, 25 bp, Rattus norvegicus
tgtccacctcttcccaatatatttt

SEQ ID NO: 645582 - DNA, 25 bp, Rattus norvegicus
tgtccacctcttgccaatatatttt

SEQ ID NO: 645583 - DNA, 25 bp, Rattus norvegicus
tgtccacctgaaacgcgtacagtaa

SEQ ID NO: 645584 - DNA, 25 bp, Rattus norvegicus
tgtccacctgaatcgcgtacagtaa

SEQ ID NO: 645585 - DNA, 25 bp, Rattus norvegicus
tgtccacctgctccgttagcataaa

SEQ ID NO: 645586 - DNA, 25 bp, Rattus norvegicus
tgtccacctgctgcgttagcataaa

SEQ ID NO: 645587 - DNA, 25 bp, Rattus norvegicus
tgtccaccttcacgtcacatttaag

SEQ ID NO: 645588 - DNA, 25 bp, Rattus norvegicus
tgtccaccttcaggtcacatttaag

SEQ ID NO: 645589 - DNA, 25 bp, Rattus norvegicus
tgtccacgacagattattctatata

SEQ ID NO: 645590 - DNA, 25 bp, Rattus norvegicus
tgtccacgacagtttattctatata

SEQ ID NO: 645591 - DNA, 25 bp, Rattus norvegicus
tgtccacgatgaacactttgctcag

SEQ ID NO: 645592 - DNA, 25 bp, Rattus norvegicus
tgtccacgatgatcactttgctcag

SEQ ID NO: 645593 - DNA, 25 bp, Rattus norvegicus
tgtccacgcttcaataggcctgatg

SEQ ID NO: 645594 - DNA, 25 bp, Rattus norvegicus
tgtccacgcttctataggcctgatg

SEQ ID NO: 645595 - DNA, 25 bp, Rattus norvegicus
tgtccacgggaaagtaccactcaga

SEQ ID NO: 645596 - DNA, 25 bp, Rattus norvegicus
tgtccacgggaatgtaccactcaga

SEQ ID NO: 645597 - DNA, 25 bp, Rattus norvegicus
tgtccacgggacagatagcagcact

SEQ ID NO: 645598 - DNA, 25 bp, Rattus norvegicus
tgtccacgggactgatagcagcact

SEQ ID NO: 645599 - DNA, 25 bp, Rattus norvegicus
tgtccactaaggctgtcatggtgag

SEQ ID NO: 645600 - DNA, 25 bp, Rattus norvegicus
tgtccactaagggtgtcatggtgag

SEQ ID NO: 645601 - DNA, 25 bp, Rattus norvegicus
tgtccactatggctatgcaggcaac

SEQ ID NO: 645602 - DNA, 25 bp, Rattus norvegicus
tgtccactatgggtatgcaggcaac

SEQ ID NO: 645603 - DNA, 25 bp, Rattus norvegicus
tgtccactcactcgctctgaataag

SEQ ID NO: 645604 - DNA, 25 bp, Rattus norvegicus
tgtccactcactggctctgaataag

SEQ ID NO: 645605 - DNA, 25 bp, Rattus norvegicus
tgtccactcccacgagcagagggca

SEQ ID NO: 645606 - DNA, 25 bp, Rattus norvegicus
tgtccactcccaggagcagagggca

SEQ ID NO: 645607 - DNA, 25 bp, Rattus norvegicus
tgtccactgaccaacatacatcggg

SEQ ID NO: 645608 - DNA, 25 bp, Rattus norvegicus
tgtccactgacctacatacatcggg

SEQ ID NO: 645609 - DNA, 25 bp, Rattus norvegicus
tgtccactgacgacatatacacaca

SEQ ID NO: 645610 - DNA, 25 bp, Rattus norvegicus
tgtccactgacgtcatatacacaca

SEQ ID NO: 645611 - DNA, 25 bp, Rattus norvegicus
tgtccactgcctcctatatgatgga

SEQ ID NO: 645612 - DNA, 25 bp, Rattus norvegicus
tgtccactgcctgctatatgatgga

SEQ ID NO: 645613 - DNA, 25 bp, Rattus norvegicus
tgtccactgtccacgggaaagtagc

SEQ ID NO: 645614 - DNA, 25 bp, Rattus norvegicus
tgtccactgtcctcgggaaagtagc

SEQ ID NO: 645615 - DNA, 25 bp, Rattus norvegicus
tgtccacttcctcaggtcacagagg

SEQ ID NO: 645616 - DNA, 25 bp, Rattus norvegicus
tgtccacttcctgaggtcacagagg

SEQ ID NO: 645617 - DNA, 25 bp, Rattus norvegicus
tgtccacttctcatttgtcttttaa

SEQ ID NO: 645618 - DNA, 25 bp, Rattus norvegicus
tgtccacttctcttttgtcttttaa

SEQ ID NO: 645619 - DNA, 25 bp, Rattus norvegicus
tgtccacttgttcacaaagcagcct

SEQ ID NO: 645620 - DNA, 25 bp, Rattus norvegicus
tgtccacttgttgacaaagcagcct

SEQ ID NO: 645621 - DNA, 25 bp, Rattus norvegicus
tgtccagaaacacatgatcctcctg

SEQ ID NO: 645622 - DNA, 25 bp, Rattus norvegicus
tgtccagaaacagatgatcctcctg

SEQ ID NO: 645623 - DNA, 25 bp, Rattus norvegicus
tgtccagacctgacagagccctaga

SEQ ID NO: 645624 - DNA, 25 bp, Rattus norvegicus
tgtccagacctgtcagagccctaga

SEQ ID NO: 645625 - DNA, 25 bp, Rattus norvegicus
tgtccagactagaatcactcacctt

SEQ ID NO: 645626 - DNA, 25 bp, Rattus norvegicus
tgtccagactagtatcactcacctt

SEQ ID NO: 645627 - DNA, 25 bp, Rattus norvegicus
tgtccagagcaacccactgaaggat

SEQ ID NO: 645628 - DNA, 25 bp, Rattus norvegicus
tgtccagagcaagccactgaaggat

SEQ ID NO: 645629 - DNA, 25 bp, Rattus norvegicus
tgtccagagccactgtcatctgata

SEQ ID NO: 645630 - DNA, 25 bp, Rattus norvegicus
tgtccagagccagtgtcatctgata

SEQ ID NO: 645631 - DNA, 25 bp, Rattus norvegicus
tgtccagaggacaactacccgtaag

SEQ ID NO: 645632 - DNA, 25 bp, Rattus norvegicus
tgtccagaggactactacccgtaag

SEQ ID NO: 645633 - DNA, 25 bp, Rattus norvegicus
tgtccagaggtcaccacacatatgg

SEQ ID NO: 645634 - DNA, 25 bp, Rattus norvegicus
tgtccagaggtctccacacatatgg

SEQ ID NO: 645635 - DNA, 25 bp, Rattus norvegicus
tgtccagagtgtacttgcccaacaa

SEQ ID NO: 645636 - DNA, 25 bp, Rattus norvegicus
tgtccagagtgttcttgcccaacaa

SEQ ID NO: 645637 - DNA, 25 bp, Rattus norvegicus
tgtccagatgctcctgcacaccagg

SEQ ID NO: 645638 - DNA, 25 bp, Rattus norvegicus
tgtccagatgctgctgcacaccagg

SEQ ID NO: 645639 - DNA, 25 bp, Rattus norvegicus
tgtccagcagctcggtcacttccat

SEQ ID NO: 645640 - DNA, 25 bp, Rattus norvegicus
tgtccagcagctgggtcacttccat

SEQ ID NO: 645641 - DNA, 25 bp, Rattus norvegicus
tgtccagcaggacctttactgtttc

SEQ ID NO: 645642 - DNA, 25 bp, Rattus norvegicus
tgtccagcaggagctttactgtttc

SEQ ID NO: 645643 - DNA, 25 bp, Rattus norvegicus
tgtccagccaagatccaggagagat

SEQ ID NO: 645644 - DNA, 25 bp, Rattus norvegicus
tgtccagccaagttccaggagagat

SEQ ID NO: 645645 - DNA, 25 bp, Rattus norvegicus
tgtccagccagaccaaagaccaggt

SEQ ID NO: 645646 - DNA, 25 bp, Rattus norvegicus
tgtccagccagaccctgtttgtaga

SEQ ID NO: 645647 - DNA, 25 bp, Rattus norvegicus
tgtccagccagagcaaagaccaggt

SEQ ID NO: 645648 - DNA, 25 bp, Rattus norvegicus
tgtccagccagagcctgtttgtaga

SEQ ID NO: 645649 - DNA, 25 bp, Rattus norvegicus
tgtccagccccaacttatggacgga

SEQ ID NO: 645650 - DNA, 25 bp, Rattus norvegicus
tgtccagccccatcttatggacgga

SEQ ID NO: 645651 - DNA, 25 bp, Rattus norvegicus
tgtccagccgcgcagtcgtgcacga

SEQ ID NO: 645652 - DNA, 25 bp, Rattus norvegicus
tgtccagccgcggagtcgtgcacga

SEQ ID NO: 645653 - DNA, 25 bp, Rattus norvegicus
tgtccagccgtgaggcagttcaaga

SEQ ID NO: 645654 - DNA, 25 bp, Rattus norvegicus
tgtccagccgtgtggcagttcaaga

SEQ ID NO: 645655 - DNA, 25 bp, Rattus norvegicus
tgtccagctggactgtgacccaatg

SEQ ID NO: 645656 - DNA, 25 bp, Rattus norvegicus
tgtccagctggagtgtgacccaatg

SEQ ID NO: 645657 - DNA, 25 bp, Rattus norvegicus
tgtccagctgtaaataaacccaatg

SEQ ID NO: 645658 - DNA, 25 bp, Rattus norvegicus
tgtccagctgtatataaacccaatg

SEQ ID NO: 645659 - DNA, 25 bp, Rattus norvegicus
tgtccagcttctcccttgggaaagc

SEQ ID NO: 645660 - DNA, 25 bp, Rattus norvegicus
tgtccagcttctgccttgggaaagc

SEQ ID NO: 645661 - DNA, 25 bp, Rattus norvegicus
tgtccaggaaaaccgggcggccgta

SEQ ID NO: 645662 - DNA, 25 bp, Rattus norvegicus
tgtccaggaaaagcgggcggccgta

SEQ ID NO: 645663 - DNA, 25 bp, Rattus norvegicus
tgtccaggacttcctacctttgtaa

SEQ ID NO: 645664 - DNA, 25 bp, Rattus norvegicus
tgtccaggacttgctacctttgtaa

SEQ ID NO: 645665 - DNA, 25 bp, Rattus norvegicus
tgtccaggcatcagggttaattccc

SEQ ID NO: 645666 - DNA, 25 bp, Rattus norvegicus
tgtccaggcatctgggttaattccc

SEQ ID NO: 645667 - DNA, 25 bp, Rattus norvegicus
tgtccaggcccaagcacagtaagaa

SEQ ID NO: 645668 - DNA, 25 bp, Rattus norvegicus
tgtccaggcccatgcacagtaagaa

SEQ ID NO: 645669 - DNA, 25 bp, Rattus norvegicus
tgtccaggcgttacaaagtttttct

SEQ ID NO: 645670 - DNA, 25 bp, Rattus norvegicus
tgtccaggcgtttcaaagtttttct

SEQ ID NO: 645671 - DNA, 25 bp, Rattus norvegicus
tgtccagggacacagtcaggcctaa

SEQ ID NO: 645672 - DNA, 25 bp, Rattus norvegicus
tgtccagggacagagtcaggcctaa

SEQ ID NO: 645673 - DNA, 25 bp, Rattus norvegicus
tgtccagggaccactagctgagttg

SEQ ID NO: 645674 - DNA, 25 bp, Rattus norvegicus
tgtccagggacctctagctgagttg

SEQ ID NO: 645675 - DNA, 25 bp, Rattus norvegicus
tgtccagggcaacccactagaggcc

SEQ ID NO: 645676 - DNA, 25 bp, Rattus norvegicus
tgtccagggcaagccactagaggcc

SEQ ID NO: 645677 - DNA, 25 bp, Rattus norvegicus
tgtccagggtagaaaggcgaagact

SEQ ID NO: 645678 - DNA, 25 bp, Rattus norvegicus
tgtccagggtagtaaggcgaagact

SEQ ID NO: 645679 - DNA, 25 bp, Rattus norvegicus
tgtccaggtcaaatccgtcaagttt

SEQ ID NO: 645680 - DNA, 25 bp, Rattus norvegicus
tgtccaggtcaattccgtcaagttt

SEQ ID NO: 645681 - DNA, 25 bp, Rattus norvegicus
tgtccaggtgctctttctaacaaga

SEQ ID NO: 645682 - DNA, 25 bp, Rattus norvegicus
tgtccaggtgctgtttctaacaaga

SEQ ID NO: 645683 - DNA, 25 bp, Rattus norvegicus
tgtccaggtggtcttttcaaaccca

SEQ ID NO: 645684 - DNA, 25 bp, Rattus norvegicus
tgtccaggtggtgttttcaaaccca

SEQ ID NO: 645685 - DNA, 25 bp, Rattus norvegicus
tgtccagtagatagcacgttagtgt

SEQ ID NO: 645686 - DNA, 25 bp, Rattus norvegicus
tgtccagtagattgcacgttagtgt

SEQ ID NO: 645687 - DNA, 25 bp, Rattus norvegicus
tgtccagtcagcagcgtgtggtact

SEQ ID NO: 645688 - DNA, 25 bp, Rattus norvegicus
tgtccagtcagctgcgtgtggtact

SEQ ID NO: 645689 - DNA, 25 bp, Rattus norvegicus
tgtccagtgactctgtgacagccag

SEQ ID NO: 645690 - DNA, 25 bp, Rattus norvegicus
tgtccagtgactgtgtgacagccag

SEQ ID NO: 645691 - DNA, 25 bp, Rattus norvegicus
tgtccagtgcacaggcaagcgcgat

SEQ ID NO: 645692 - DNA, 25 bp, Rattus norvegicus
tgtccagtgcactggcaagcgcgat

SEQ ID NO: 645693 - DNA, 25 bp, Rattus norvegicus
tgtccagtgctcaggaatccacaat

SEQ ID NO: 645694 - DNA, 25 bp, Rattus norvegicus
tgtccagtgctctggaatccacaat

SEQ ID NO: 645695 - DNA, 25 bp, Rattus norvegicus
tgtccagtgctgcagaaaggccttt

SEQ ID NO: 645696 - DNA, 25 bp, Rattus norvegicus
tgtccagtgctggagaaaggccttt

SEQ ID NO: 645697 - DNA, 25 bp, Rattus norvegicus
tgtccagtggacctgggtattccca

SEQ ID NO: 645698 - DNA, 25 bp, Rattus norvegicus
tgtccagtggacgtgggtattccca

SEQ ID NO: 645699 - DNA, 25 bp, Rattus norvegicus
tgtccagtttcacttaacacagctg

SEQ ID NO: 645700 - DNA, 25 bp, Rattus norvegicus
tgtccagtttcagttaacacagctg

SEQ ID NO: 645701 - DNA, 25 bp, Rattus norvegicus
tgtccagtttctccagtcagacatc

SEQ ID NO: 645702 - DNA, 25 bp, Rattus norvegicus
tgtccagtttctgcagtcagacatc

SEQ ID NO: 645703 - DNA, 25 bp, Rattus norvegicus
tgtccagtttttaagcaaccagcca

SEQ ID NO: 645704 - DNA, 25 bp, Rattus norvegicus
tgtccagttttttagcaaccagcca

SEQ ID NO: 645705 - DNA, 25 bp, Rattus norvegicus
tgtccataatgaaaccaattacttt

SEQ ID NO: 645706 - DNA, 25 bp, Rattus norvegicus
tgtccataatgataccaattacttt

SEQ ID NO: 645707 - DNA, 25 bp, Rattus norvegicus
tgtccataccccaaattctgcattt

SEQ ID NO: 645708 - DNA, 25 bp, Rattus norvegicus
tgtccatacccctaattctgcattt

SEQ ID NO: 645709 - DNA, 25 bp, Rattus norvegicus
tgtccatataccaatcccaacagag

SEQ ID NO: 645710 - DNA, 25 bp, Rattus norvegicus
tgtccatatacctatcccaacagag

SEQ ID NO: 645711 - DNA, 25 bp, Rattus norvegicus
tgtccatatgggatctgtctgtcca

SEQ ID NO: 645712 - DNA, 25 bp, Rattus norvegicus
tgtccatatgggttctgtctgtcca

SEQ ID NO: 645713 - DNA, 25 bp, Rattus norvegicus
tgtccatcaagcagcgtcccgggaa

SEQ ID NO: 645714 - DNA, 25 bp, Rattus norvegicus
tgtccatcaagctgcgtcccgggaa

SEQ ID NO: 645715 - DNA, 25 bp, Rattus norvegicus
tgtccatcaatgctacctatgttat

SEQ ID NO: 645716 - DNA, 25 bp, Rattus norvegicus
tgtccatcaatggtacctatgttat

SEQ ID NO: 645717 - DNA, 25 bp, Rattus norvegicus
tgtccatcacagcgctgtgcactgc

SEQ ID NO: 645718 - DNA, 25 bp, Rattus norvegicus
tgtccatcacagggctgtgcactgc

SEQ ID NO: 645719 - DNA, 25 bp, Rattus norvegicus
tgtccatcatggatctggctgccag

SEQ ID NO: 645720 - DNA, 25 bp, Rattus norvegicus
tgtccatcatggttctggctgccag

SEQ ID NO: 645721 - DNA, 25 bp, Rattus norvegicus
tgtccatccacaccttagctgttgg

SEQ ID NO: 645722 - DNA, 25 bp, Rattus norvegicus
tgtccatccacagcttagctgttgg

SEQ ID NO: 645723 - DNA, 25 bp, Rattus norvegicus
tgtccatccctcacaacaaggtgga

SEQ ID NO: 645724 - DNA, 25 bp, Rattus norvegicus
tgtccatccctctcaacaaggtgga

SEQ ID NO: 645725 - DNA, 25 bp, Rattus norvegicus
tgtccatcctgcaagttcagaggta

SEQ ID NO: 645726 - DNA, 25 bp, Rattus norvegicus
tgtccatcctgcctaacagagcaag

SEQ ID NO: 645727 - DNA, 25 bp, Rattus norvegicus
tgtccatcctgcgtaacagagcaag

SEQ ID NO: 645728 - DNA, 25 bp, Rattus norvegicus
tgtccatcctgctagttcagaggta

SEQ ID NO: 645729 - DNA, 25 bp, Rattus norvegicus
tgtccatcgaacagtggctttgaac

SEQ ID NO: 645730 - DNA, 25 bp, Rattus norvegicus
tgtccatcgaactgtggctttgaac

SEQ ID NO: 645731 - DNA, 25 bp, Rattus norvegicus
tgtccatctcatatcctgatcaaag

SEQ ID NO: 645732 - DNA, 25 bp, Rattus norvegicus
tgtccatctcatttcctgatcaaag

SEQ ID NO: 645733 - DNA, 25 bp, Rattus norvegicus
tgtccatctgacaagcttcttcaaa

SEQ ID NO: 645734 - DNA, 25 bp, Rattus norvegicus
tgtccatctgactagcttcttcaaa

SEQ ID NO: 645735 - DNA, 25 bp, Rattus norvegicus
tgtccatctgtcactgggtttcaga

SEQ ID NO: 645736 - DNA, 25 bp, Rattus norvegicus
tgtccatctgtctctgggtttcaga

SEQ ID NO: 645737 - DNA, 25 bp, Rattus norvegicus
tgtccatgaaacattcaggcctgac

SEQ ID NO: 645738 - DNA, 25 bp, Rattus norvegicus
tgtccatgaaactttcaggcctgac

SEQ ID NO: 645739 - DNA, 25 bp, Rattus norvegicus
tgtccatgaaatattccacctgcag

SEQ ID NO: 645740 - DNA, 25 bp, Rattus norvegicus
tgtccatgaaattttccacctgcag

SEQ ID NO: 645741 - DNA, 25 bp, Rattus norvegicus
tgtccatgaaccactgtacagcatc

SEQ ID NO: 645742 - DNA, 25 bp, Rattus norvegicus
tgtccatgaacctctgtacagcatc

SEQ ID NO: 645743 - DNA, 25 bp, Rattus norvegicus
tgtccatgaagcagtggtctccttg

SEQ ID NO: 645744 - DNA, 25 bp, Rattus norvegicus
tgtccatgaagctgtggtctccttg

SEQ ID NO: 645745 - DNA, 25 bp, Rattus norvegicus
tgtccatgagaacgtggcctcgagc

SEQ ID NO: 645746 - DNA, 25 bp, Rattus norvegicus
tgtccatgagaaggtggcctcgagc

SEQ ID NO: 645747 - DNA, 25 bp, Rattus norvegicus
tgtccatgagtcaccccagtgacgg

SEQ ID NO: 645748 - DNA, 25 bp, Rattus norvegicus
tgtccatgagtctccccagtgacgg

SEQ ID NO: 645749 - DNA, 25 bp, Rattus norvegicus
tgtccatgccgcctgcaggataaga

SEQ ID NO: 645750 - DNA, 25 bp, Rattus norvegicus
tgtccatgccgcgtgcaggataaga

SEQ ID NO: 645751 - DNA, 25 bp, Rattus norvegicus
tgtccatgcctcagaagggtcctct

SEQ ID NO: 645752 - DNA, 25 bp, Rattus norvegicus
tgtccatgcctctgaagggtcctct

SEQ ID NO: 645753 - DNA, 25 bp, Rattus norvegicus
tgtccatgcgtaccttgtcactctc

SEQ ID NO: 645754 - DNA, 25 bp, Rattus norvegicus
tgtccatgcgtagcttgtcactctc

SEQ ID NO: 645755 - DNA, 25 bp, Rattus norvegicus
tgtccatggagccacattgttctct

SEQ ID NO: 645756 - DNA, 25 bp, Rattus norvegicus
tgtccatggagcgacattgttctct

SEQ ID NO: 645757 - DNA, 25 bp, Rattus norvegicus
tgtccatgtatcactctccttttgt

SEQ ID NO: 645758 - DNA, 25 bp, Rattus norvegicus
tgtccatgtatctctctccttttgt

SEQ ID NO: 645759 - DNA, 25 bp, Rattus norvegicus
tgtccattcacactgatcaaccctg

SEQ ID NO: 645760 - DNA, 25 bp, Rattus norvegicus
tgtccattcacagtgatcaaccctg

SEQ ID NO: 645761 - DNA, 25 bp, Rattus norvegicus
tgtccattcagcagcatcctgagga

SEQ ID NO: 645762 - DNA, 25 bp, Rattus norvegicus
tgtccattcagctgcatcctgagga

SEQ ID NO: 645763 - DNA, 25 bp, Rattus norvegicus
tgtccattccagacattggtgcaaa

SEQ ID NO: 645764 - DNA, 25 bp, Rattus norvegicus
tgtccattccagtcattggtgcaaa

SEQ ID NO: 645765 - DNA, 25 bp, Rattus norvegicus
tgtccattgaaccaaagtcctcagg

SEQ ID NO: 645766 - DNA, 25 bp, Rattus norvegicus
tgtccattgaacgaaagtcctcagg

SEQ ID NO: 645767 - DNA, 25 bp, Rattus norvegicus
tgtccattgcaccatttctttcttt

SEQ ID NO: 645768 - DNA, 25 bp, Rattus norvegicus
tgtccattgcacgatttctttcttt

SEQ ID NO: 645769 - DNA, 25 bp, Rattus norvegicus
tgtccatttacacccttttgttgtg

SEQ ID NO: 645770 - DNA, 25 bp, Rattus norvegicus
tgtccatttacagccttttgttgtg

SEQ ID NO: 645771 - DNA, 25 bp, Rattus norvegicus
tgtccatttggactttcattcccag

SEQ ID NO: 645772 - DNA, 25 bp, Rattus norvegicus
tgtccatttggagtttcattcccag

SEQ ID NO: 645773 - DNA, 25 bp, Rattus norvegicus
tgtcccaaagctcttgcctatgaat

SEQ ID NO: 645774 - DNA, 25 bp, Rattus norvegicus
tgtcccaaagctgttgcctatgaat

SEQ ID NO: 645775 - DNA, 25 bp, Rattus norvegicus
tgtcccaaagttctctgacactcta

SEQ ID NO: 645776 - DNA, 25 bp, Rattus norvegicus
tgtcccaaagttgtctgacactcta

SEQ ID NO: 645777 - DNA, 25 bp, Rattus norvegicus
tgtcccaacaatcctaattgcctag

SEQ ID NO: 645778 - DNA, 25 bp, Rattus norvegicus
tgtcccaacaatgctaattgcctag

SEQ ID NO: 645779 - DNA, 25 bp, Rattus norvegicus
tgtcccaacaccaggagcctagtag

SEQ ID NO: 645780 - DNA, 25 bp, Rattus norvegicus
tgtcccaacacctggagcctagtag

SEQ ID NO: 645781 - DNA, 25 bp, Rattus norvegicus
tgtcccaactatatccgctaagata

SEQ ID NO: 645782 - DNA, 25 bp, Rattus norvegicus
tgtcccaactatttccgctaagata

SEQ ID NO: 645783 - DNA, 25 bp, Rattus norvegicus
tgtcccaactccagatttcggtaaa

SEQ ID NO: 645784 - DNA, 25 bp, Rattus norvegicus
tgtcccaactcctgatttcggtaaa

SEQ ID NO: 645785 - DNA, 25 bp, Rattus norvegicus
tgtcccaacttcctttcaatattta

SEQ ID NO: 645786 - DNA, 25 bp, Rattus norvegicus
tgtcccaacttcgtttcaatattta

SEQ ID NO: 645787 - DNA, 25 bp, Rattus norvegicus
tgtcccaagggccagctagaagctt

SEQ ID NO: 645788 - DNA, 25 bp, Rattus norvegicus
tgtcccaagggcgagctagaagctt

SEQ ID NO: 645789 - DNA, 25 bp, Rattus norvegicus
tgtcccaagtgtaactcctcagttt

SEQ ID NO: 645790 - DNA, 25 bp, Rattus norvegicus
tgtcccaagtgttactcctcagttt

SEQ ID NO: 645791 - DNA, 25 bp, Rattus norvegicus
tgtcccacacttcgtccaaggccat

SEQ ID NO: 645792 - DNA, 25 bp, Rattus norvegicus
tgtcccacacttggtccaaggccat

SEQ ID NO: 645793 - DNA, 25 bp, Rattus norvegicus
tgtcccacagacaggccaatgttaa

SEQ ID NO: 645794 - DNA, 25 bp, Rattus norvegicus
tgtcccacagactggccaatgttaa

SEQ ID NO: 645795 - DNA, 25 bp, Rattus norvegicus
tgtcccacagggaattgacgcatcg

SEQ ID NO: 645796 - DNA, 25 bp, Rattus norvegicus
tgtcccacagggtattgacgcatcg

SEQ ID NO: 645797 - DNA, 25 bp, Rattus norvegicus
tgtcccacccacctagggaaggatg

SEQ ID NO: 645798 - DNA, 25 bp, Rattus norvegicus
tgtcccacccacgtagggaaggatg

SEQ ID NO: 645799 - DNA, 25 bp, Rattus norvegicus
tgtcccacctaaaaaagagcctctg

SEQ ID NO: 645800 - DNA, 25 bp, Rattus norvegicus
tgtcccacctaataaagagcctctg

SEQ ID NO: 645801 - DNA, 25 bp, Rattus norvegicus
tgtcccacctgcagtttacaataaa

SEQ ID NO: 645802 - DNA, 25 bp, Rattus norvegicus
tgtcccacctgctgtttacaataaa

SEQ ID NO: 645803 - DNA, 25 bp, Rattus norvegicus
tgtcccacgtgcaccagtttgaaga

SEQ ID NO: 645804 - DNA, 25 bp, Rattus norvegicus
tgtcccacgtgctccagtttgaaga

SEQ ID NO: 645805 - DNA, 25 bp, Rattus norvegicus
tgtcccactctgagcagtactaaat

SEQ ID NO: 645806 - DNA, 25 bp, Rattus norvegicus
tgtcccactctgtgcagtactaaat

SEQ ID NO: 645807 - DNA, 25 bp, Rattus norvegicus
tgtcccactgagctttttacaaaag

SEQ ID NO: 645808 - DNA, 25 bp, Rattus norvegicus
tgtcccactgaggtttttacaaaag

SEQ ID NO: 645809 - DNA, 25 bp, Rattus norvegicus
tgtcccacttacactatgcagtatc

SEQ ID NO: 645810 - DNA, 25 bp, Rattus norvegicus
tgtcccacttactctatgcagtatc

SEQ ID NO: 645811 - DNA, 25 bp, Rattus norvegicus
tgtcccacttgacgtctcagcaaat

SEQ ID NO: 645812 - DNA, 25 bp, Rattus norvegicus
tgtcccacttgaggtctcagcaaat

SEQ ID NO: 645813 - DNA, 25 bp, Rattus norvegicus
tgtcccagacctatgggttgacttt

SEQ ID NO: 645814 - DNA, 25 bp, Rattus norvegicus
tgtcccagacctttgggttgacttt

SEQ ID NO: 645815 - DNA, 25 bp, Rattus norvegicus
tgtcccagagccacatgaggaaggc

SEQ ID NO: 645816 - DNA, 25 bp, Rattus norvegicus
tgtcccagagcctcatgaggaaggc

SEQ ID NO: 645817 - DNA, 25 bp, Rattus norvegicus
tgtcccagcacacttccaaataaaa

SEQ ID NO: 645818 - DNA, 25 bp, Rattus norvegicus
tgtcccagcacagttccaaataaaa

SEQ ID NO: 645819 - DNA, 25 bp, Rattus norvegicus
tgtcccagccatcgatatctgcttc

SEQ ID NO: 645820 - DNA, 25 bp, Rattus norvegicus
tgtcccagccatggatatctgcttc

SEQ ID NO: 645821 - DNA, 25 bp, Rattus norvegicus
tgtcccagcggcagctcagattttg

SEQ ID NO: 645822 - DNA, 25 bp, Rattus norvegicus
tgtcccagcggctgctcagattttg

SEQ ID NO: 645823 - DNA, 25 bp, Rattus norvegicus
tgtcccaggacacttttttacgttg

SEQ ID NO: 645824 - DNA, 25 bp, Rattus norvegicus
tgtcccaggacagttttttacgttg

SEQ ID NO: 645825 - DNA, 25 bp, Rattus norvegicus
tgtcccagggctatcaggtttgtaa

SEQ ID NO: 645826 - DNA, 25 bp, Rattus norvegicus
tgtcccagggctttcaggtttgtaa

SEQ ID NO: 645827 - DNA, 25 bp, Rattus norvegicus
tgtcccagggtcatgtggccaccac

SEQ ID NO: 645828 - DNA, 25 bp, Rattus norvegicus
tgtcccagggtcttgtggccaccac

SEQ ID NO: 645829 - DNA, 25 bp, Rattus norvegicus
tgtcccagggtgagtccatgctcta

SEQ ID NO: 645830 - DNA, 25 bp, Rattus norvegicus
tgtcccagggtgtgtccatgctcta

SEQ ID NO: 645831 - DNA, 25 bp, Rattus norvegicus
tgtcccaggtttaagtgttccctct

SEQ ID NO: 645832 - DNA, 25 bp, Rattus norvegicus
tgtcccaggttttagtgttccctct

SEQ ID NO: 645833 - DNA, 25 bp, Rattus norvegicus
tgtcccagtggcataggcttgttga

SEQ ID NO: 645834 - DNA, 25 bp, Rattus norvegicus
tgtcccagtggcttaggcttgttga

SEQ ID NO: 645835 - DNA, 25 bp, Rattus norvegicus
tgtcccagtttaattctccatttac

SEQ ID NO: 645836 - DNA, 25 bp, Rattus norvegicus
tgtcccagtttatttctccatttac

SEQ ID NO: 645837 - DNA, 25 bp, Rattus norvegicus
tgtcccatcagccaataaacttcaa

SEQ ID NO: 645838 - DNA, 25 bp, Rattus norvegicus
tgtcccatcagcgaataaacttcaa

SEQ ID NO: 645839 - DNA, 25 bp, Rattus norvegicus
tgtcccatctcgctttgcaaaaagc

SEQ ID NO: 645840 - DNA, 25 bp, Rattus norvegicus
tgtcccatctcggtttgcaaaaagc

SEQ ID NO: 645841 - DNA, 25 bp, Rattus norvegicus
tgtcccatgagaagctttgtcagca

SEQ ID NO: 645842 - DNA, 25 bp, Rattus norvegicus
tgtcccatgagatgctttgtcagca

SEQ ID NO: 645843 - DNA, 25 bp, Rattus norvegicus
tgtcccatgccaaatgtcctttgtg

SEQ ID NO: 645844 - DNA, 25 bp, Rattus norvegicus
tgtcccatgccatatgtcctttgtg

SEQ ID NO: 645845 - DNA, 25 bp, Rattus norvegicus
tgtcccatgcgccaaaaccaacatg

SEQ ID NO: 645846 - DNA, 25 bp, Rattus norvegicus
tgtcccatgcgcgaaaaccaacatg

SEQ ID NO: 645847 - DNA, 25 bp, Rattus norvegicus
tgtcccatgcggagagccccataac

SEQ ID NO: 645848 - DNA, 25 bp, Rattus norvegicus
tgtcccatgcggtgagccccataac

SEQ ID NO: 645849 - DNA, 25 bp, Rattus norvegicus
tgtcccatgctgcttctgtggagcc

SEQ ID NO: 645850 - DNA, 25 bp, Rattus norvegicus
tgtcccatgctggttctgtggagcc

SEQ ID NO: 645851 - DNA, 25 bp, Rattus norvegicus
tgtcccatggacatttgagcactaa

SEQ ID NO: 645852 - DNA, 25 bp, Rattus norvegicus
tgtcccatggacttttgagcactaa

SEQ ID NO: 645853 - DNA, 25 bp, Rattus norvegicus
tgtcccatgtcaatgaggctaccgc

SEQ ID NO: 645854 - DNA, 25 bp, Rattus norvegicus
tgtcccatgtcattgaggctaccgc

SEQ ID NO: 645855 - DNA, 25 bp, Rattus norvegicus
tgtcccattctcagaattccccaaa

SEQ ID NO: 645856 - DNA, 25 bp, Rattus norvegicus
tgtcccattctctgaattccccaaa

SEQ ID NO: 645857 - DNA, 25 bp, Rattus norvegicus
tgtcccattgccacatgaacagtgt

SEQ ID NO: 645858 - DNA, 25 bp, Rattus norvegicus
tgtcccattgcctcatgaacagtgt

SEQ ID NO: 645859 - DNA, 25 bp, Rattus norvegicus
tgtcccattgttctgaccctaaaac

SEQ ID NO: 645860 - DNA, 25 bp, Rattus norvegicus
tgtcccattgttgtgaccctaaaac

SEQ ID NO: 645861 - DNA, 25 bp, Rattus norvegicus
tgtcccattttcacagcttttgcag

SEQ ID NO: 645862 - DNA, 25 bp, Rattus norvegicus
tgtcccattttcagttctcacaaag

SEQ ID NO: 645863 - DNA, 25 bp, Rattus norvegicus
tgtcccattttctcagcttttgcag

SEQ ID NO: 645864 - DNA, 25 bp, Rattus norvegicus
tgtcccattttctgttctcacaaag

SEQ ID NO: 645865 - DNA, 25 bp, Rattus norvegicus
tgtccccaaacacttccttggagga

SEQ ID NO: 645866 - DNA, 25 bp, Rattus norvegicus
tgtccccaaacagttccttggagga

SEQ ID NO: 645867 - DNA, 25 bp, Rattus norvegicus
tgtccccaaatcacatggtaacaat

SEQ ID NO: 645868 - DNA, 25 bp, Rattus norvegicus
tgtccccaaatctcatggtaacaat

SEQ ID NO: 645869 - DNA, 25 bp, Rattus norvegicus
tgtccccaaattaactgatgcatca

SEQ ID NO: 645870 - DNA, 25 bp, Rattus norvegicus
tgtccccaaatttactgatgcatca

SEQ ID NO: 645871 - DNA, 25 bp, Rattus norvegicus
tgtccccaaggccatcttagcaatg

SEQ ID NO: 645872 - DNA, 25 bp, Rattus norvegicus
tgtccccaaggcgatcttagcaatg

SEQ ID NO: 645873 - DNA, 25 bp, Rattus norvegicus
tgtccccaagtcctcagaaagatat

SEQ ID NO: 645874 - DNA, 25 bp, Rattus norvegicus
tgtccccaagtcgtcagaaagatat

SEQ ID NO: 645875 - DNA, 25 bp, Rattus norvegicus
tgtccccaatgaagttgagcgcttc

SEQ ID NO: 645876 - DNA, 25 bp, Rattus norvegicus
tgtccccaatgatgttgagcgcttc

SEQ ID NO: 645877 - DNA, 25 bp, Rattus norvegicus
tgtccccacagcaagatcaacacta

SEQ ID NO: 645878 - DNA, 25 bp, Rattus norvegicus
tgtccccacagctagatcaacacta

SEQ ID NO: 645879 - DNA, 25 bp, Rattus norvegicus
tgtccccacatcatacagactttaa

SEQ ID NO: 645880 - DNA, 25 bp, Rattus norvegicus
tgtccccacatcttacagactttaa

SEQ ID NO: 645881 - DNA, 25 bp, Rattus norvegicus
tgtccccacctaaacgagcagagat

SEQ ID NO: 645882 - DNA, 25 bp, Rattus norvegicus
tgtccccacctatacgagcagagat

SEQ ID NO: 645883 - DNA, 25 bp, Rattus norvegicus
tgtccccactcacaaagtaatctgt

SEQ ID NO: 645884 - DNA, 25 bp, Rattus norvegicus
tgtccccactcagaaagtaatctgt

SEQ ID NO: 645885 - DNA, 25 bp, Rattus norvegicus
tgtccccacttcaggcagatatgga

SEQ ID NO: 645886 - DNA, 25 bp, Rattus norvegicus
tgtccccacttctggcagatatgga

SEQ ID NO: 645887 - DNA, 25 bp, Rattus norvegicus
tgtccccagaagcatgctacgagtg

SEQ ID NO: 645888 - DNA, 25 bp, Rattus norvegicus
tgtccccagaaggatgctacgagtg

SEQ ID NO: 645889 - DNA, 25 bp, Rattus norvegicus
tgtccccagacaatgctagccagtg

SEQ ID NO: 645890 - DNA, 25 bp, Rattus norvegicus
tgtccccagacattgctagccagtg

SEQ ID NO: 645891 - DNA, 25 bp, Rattus norvegicus
tgtccccagaccacgctaaaatgga

SEQ ID NO: 645892 - DNA, 25 bp, Rattus norvegicus
tgtccccagacctcgctaaaatgga

SEQ ID NO: 645893 - DNA, 25 bp, Rattus norvegicus
tgtccccaggacatcagcaggacac

SEQ ID NO: 645894 - DNA, 25 bp, Rattus norvegicus
tgtccccaggacttcagcaggacac

SEQ ID NO: 645895 - DNA, 25 bp, Rattus norvegicus
tgtccccaggttctgtggataccaa

SEQ ID NO: 645896 - DNA, 25 bp, Rattus norvegicus
tgtccccaggttgtgtggataccaa

SEQ ID NO: 645897 - DNA, 25 bp, Rattus norvegicus
tgtccccagtccactaaggattgta

SEQ ID NO: 645898 - DNA, 25 bp, Rattus norvegicus
tgtccccagtcctctaaggattgta

SEQ ID NO: 645899 - DNA, 25 bp, Rattus norvegicus
tgtccccatatccaccaaagactta

SEQ ID NO: 645900 - DNA, 25 bp, Rattus norvegicus
tgtccccatatcgaccaaagactta

SEQ ID NO: 645901 - DNA, 25 bp, Rattus norvegicus
tgtccccatcatcgcagggagatgt

SEQ ID NO: 645902 - DNA, 25 bp, Rattus norvegicus
tgtccccatcatggcagggagatgt

SEQ ID NO: 645903 - DNA, 25 bp, Rattus norvegicus
tgtccccatcgaccattgtgagcat

SEQ ID NO: 645904 - DNA, 25 bp, Rattus norvegicus
tgtccccatcgagcattgtgagcat

SEQ ID NO: 645905 - DNA, 25 bp, Rattus norvegicus
tgtccccatgctatcgtggagacat

SEQ ID NO: 645906 - DNA, 25 bp, Rattus norvegicus
tgtccccatgctttcgtggagacat

SEQ ID NO: 645907 - DNA, 25 bp, Rattus norvegicus
tgtccccatggtcatagcgtgaaga

SEQ ID NO: 645908 - DNA, 25 bp, Rattus norvegicus
tgtccccatggtgatagcgtgaaga

SEQ ID NO: 645909 - DNA, 25 bp, Rattus norvegicus
tgtccccatgtcagtcagtgtatgt

SEQ ID NO: 645910 - DNA, 25 bp, Rattus norvegicus
tgtccccatgtctgtcagtgtatgt

SEQ ID NO: 645911 - DNA, 25 bp, Rattus norvegicus
tgtccccattccaatgtcgtgtttt

SEQ ID NO: 645912 - DNA, 25 bp, Rattus norvegicus
tgtccccattcctatgtcgtgtttt

SEQ ID NO: 645913 - DNA, 25 bp, Rattus norvegicus
tgtccccatttaagcaacaggagtc

SEQ ID NO: 645914 - DNA, 25 bp, Rattus norvegicus
tgtccccatttatgcaacaggagtc

SEQ ID NO: 645915 - DNA, 25 bp, Rattus norvegicus
tgtccccgacaactctagcaaagaa

SEQ ID NO: 645916 - DNA, 25 bp, Rattus norvegicus
tgtccccgacaagtctagcaaagaa

SEQ ID NO: 645917 - DNA, 25 bp, Rattus norvegicus
tgtccccgccaaaagaaattaatct

SEQ ID NO: 645918 - DNA, 25 bp, Rattus norvegicus
tgtccccgccaatagaaattaatct

SEQ ID NO: 645919 - DNA, 25 bp, Rattus norvegicus
tgtccccgggtacttatattcctat

SEQ ID NO: 645920 - DNA, 25 bp, Rattus norvegicus
tgtccccgggtagttatattcctat

SEQ ID NO: 645921 - DNA, 25 bp, Rattus norvegicus
tgtccccgggtcatccaacggactg

SEQ ID NO: 645922 - DNA, 25 bp, Rattus norvegicus
tgtccccgggtcttccaacggactg

SEQ ID NO: 645923 - DNA, 25 bp, Rattus norvegicus
tgtccccggtgtccgggcttcatga

SEQ ID NO: 645924 - DNA, 25 bp, Rattus norvegicus
tgtccccggtgtgcgggcttcatga

SEQ ID NO: 645925 - DNA, 25 bp, Rattus norvegicus
tgtcccctaagtaattctcactgta

SEQ ID NO: 645926 - DNA, 25 bp, Rattus norvegicus
tgtcccctaagttattctcactgta

SEQ ID NO: 645927 - DNA, 25 bp, Rattus norvegicus
tgtcccctaatgactgtcagttgta

SEQ ID NO: 645928 - DNA, 25 bp, Rattus norvegicus
tgtcccctaatgtctgtcagttgta

SEQ ID NO: 645929 - DNA, 25 bp, Rattus norvegicus
tgtcccctagttatggatcatgaga

SEQ ID NO: 645930 - DNA, 25 bp, Rattus norvegicus
tgtcccctagttttggatcatgaga

SEQ ID NO: 645931 - DNA, 25 bp, Rattus norvegicus
tgtcccctattcctcctttttctgg

SEQ ID NO: 645932 - DNA, 25 bp, Rattus norvegicus
tgtcccctattcgtcctttttctgg

SEQ ID NO: 645933 - DNA, 25 bp, Rattus norvegicus
tgtcccctccagagtattaacgctc

SEQ ID NO: 645934 - DNA, 25 bp, Rattus norvegicus
tgtcccctccagtgtattaacgctc

SEQ ID NO: 645935 - DNA, 25 bp, Rattus norvegicus
tgtcccctctgcctgaggtatcacg

SEQ ID NO: 645936 - DNA, 25 bp, Rattus norvegicus
tgtcccctctgcgtgaggtatcacg

SEQ ID NO: 645937 - DNA, 25 bp, Rattus norvegicus
tgtcccctctgtatttatacccatt

SEQ ID NO: 645938 - DNA, 25 bp, Rattus norvegicus
tgtcccctctgtttttatacccatt

SEQ ID NO: 645939 - DNA, 25 bp, Rattus norvegicus
tgtcccctgattcaccatggtaatg

SEQ ID NO: 645940 - DNA, 25 bp, Rattus norvegicus
tgtcccctgattgaccatggtaatg

SEQ ID NO: 645941 - DNA, 25 bp, Rattus norvegicus
tgtcccctgccaaaagaactaaact

SEQ ID NO: 645942 - DNA, 25 bp, Rattus norvegicus
tgtcccctgccataagaactaaact

SEQ ID NO: 645943 - DNA, 25 bp, Rattus norvegicus
tgtcccctggcgaggaggaccgaaa

SEQ ID NO: 645944 - DNA, 25 bp, Rattus norvegicus
tgtcccctggcgtggaggaccgaaa

SEQ ID NO: 645945 - DNA, 25 bp, Rattus norvegicus
tgtcccctgttcatgcaaagtgctg

SEQ ID NO: 645946 - DNA, 25 bp, Rattus norvegicus
tgtcccctgttcttgcaaagtgctg

SEQ ID NO: 645947 - DNA, 25 bp, Rattus norvegicus
tgtcccctgttgctggctcctgaca

SEQ ID NO: 645948 - DNA, 25 bp, Rattus norvegicus
tgtcccctgttggtggctcctgaca

SEQ ID NO: 645949 - DNA, 25 bp, Rattus norvegicus
tgtccccttcatatcctttacttat

SEQ ID NO: 645950 - DNA, 25 bp, Rattus norvegicus
tgtccccttcatttcctttacttat

SEQ ID NO: 645951 - DNA, 25 bp, Rattus norvegicus
tgtcccctttctccattgtatgatg

SEQ ID NO: 645952 - DNA, 25 bp, Rattus norvegicus
tgtcccctttctgcattgtatgatg

SEQ ID NO: 645953 - DNA, 25 bp, Rattus norvegicus
tgtcccctttgtctggttgagctaa

SEQ ID NO: 645954 - DNA, 25 bp, Rattus norvegicus
tgtcccctttgtgtggttgagctaa

SEQ ID NO: 645955 - DNA, 25 bp, Rattus norvegicus
tgtccccttttgattccaggaagat

SEQ ID NO: 645956 - DNA, 25 bp, Rattus norvegicus
tgtccccttttgtttccaggaagat

SEQ ID NO: 645957 - DNA, 25 bp, Rattus norvegicus
tgtcccgaaggtcctagttgtggtc

SEQ ID NO: 645958 - DNA, 25 bp, Rattus norvegicus
tgtcccgaaggtgctagttgtggtc

SEQ ID NO: 645959 - DNA, 25 bp, Rattus norvegicus
tgtcccgacacactactttgtggta

SEQ ID NO: 645960 - DNA, 25 bp, Rattus norvegicus
tgtcccgacacagtactttgtggta

SEQ ID NO: 645961 - DNA, 25 bp, Rattus norvegicus
tgtcccgataatcccgaaatgtcat

SEQ ID NO: 645962 - DNA, 25 bp, Rattus norvegicus
tgtcccgataatgccgaaatgtcat

SEQ ID NO: 645963 - DNA, 25 bp, Rattus norvegicus
tgtcccgatccgattgagtgttcca

SEQ ID NO: 645964 - DNA, 25 bp, Rattus norvegicus
tgtcccgatccgtttgagtgttcca

SEQ ID NO: 645965 - DNA, 25 bp, Rattus norvegicus
tgtcccgcagtgacaggctccagtg

SEQ ID NO: 645966 - DNA, 25 bp, Rattus norvegicus
tgtcccgcagtgtcaggctccagtg

SEQ ID NO: 645967 - DNA, 25 bp, Rattus norvegicus
tgtcccgccgctaaggaagtcgcag

SEQ ID NO: 645968 - DNA, 25 bp, Rattus norvegicus
tgtcccgccgcttaggaagtcgcag

SEQ ID NO: 645969 - DNA, 25 bp, Rattus norvegicus
tgtcccgctcctcaatacatgtaaa

SEQ ID NO: 645970 - DNA, 25 bp, Rattus norvegicus
tgtcccgctcctgaatacatgtaaa

SEQ ID NO: 645971 - DNA, 25 bp, Rattus norvegicus
tgtcccgctttgacagcgctagaaa

SEQ ID NO: 645972 - DNA, 25 bp, Rattus norvegicus
tgtcccgctttgtcagcgctagaaa

SEQ ID NO: 645973 - DNA, 25 bp, Rattus norvegicus
tgtcccgggcttcaacagacggtgt

SEQ ID NO: 645974 - DNA, 25 bp, Rattus norvegicus
tgtcccgggcttgaacagacggtgt

SEQ ID NO: 645975 - DNA, 25 bp, Rattus norvegicus
tgtcccggtcctccagtgggtattt

SEQ ID NO: 645976 - DNA, 25 bp, Rattus norvegicus
tgtcccggtcctgcagtgggtattt

SEQ ID NO: 645977 - DNA, 25 bp, Rattus norvegicus
tgtcccgtaaacagttccagctaag

SEQ ID NO: 645978 - DNA, 25 bp, Rattus norvegicus
tgtcccgtaaactgttccagctaag

SEQ ID NO: 645979 - DNA, 25 bp, Rattus norvegicus
tgtcccgtaggaccctgaagcacat

SEQ ID NO: 645980 - DNA, 25 bp, Rattus norvegicus
tgtcccgtaggagcctgaagcacat

SEQ ID NO: 645981 - DNA, 25 bp, Rattus norvegicus
tgtcccgtgcacagaagctggcggc

SEQ ID NO: 645982 - DNA, 25 bp, Rattus norvegicus
tgtcccgtgcactgaagctggcggc

SEQ ID NO: 645983 - DNA, 25 bp, Rattus norvegicus
tgtcccgtgcagcacatggtgactg

SEQ ID NO: 645984 - DNA, 25 bp, Rattus norvegicus
tgtcccgtgcaggacatggtgactg

SEQ ID NO: 645985 - DNA, 25 bp, Rattus norvegicus
tgtcccgtgcatactgtcagcaatg

SEQ ID NO: 645986 - DNA, 25 bp, Rattus norvegicus
tgtcccgtgcattctgtcagcaatg

SEQ ID NO: 645987 - DNA, 25 bp, Rattus norvegicus
tgtcccgtggtcactgcagaagatg

SEQ ID NO: 645988 - DNA, 25 bp, Rattus norvegicus
tgtcccgtggtctctgcagaagatg

SEQ ID NO: 645989 - DNA, 25 bp, Rattus norvegicus
tgtcccgtgtgaatcaccgccgcgg

SEQ ID NO: 645990 - DNA, 25 bp, Rattus norvegicus
tgtcccgtgtgattcaccgccgcgg

SEQ ID NO: 645991 - DNA, 25 bp, Rattus norvegicus
tgtcccgttgtgattgttccacaga

SEQ ID NO: 645992 - DNA, 25 bp, Rattus norvegicus
tgtcccgttgtgtttgttccacaga

SEQ ID NO: 645993 - DNA, 25 bp, Rattus norvegicus
tgtccctaaactacgtccagagcga

SEQ ID NO: 645994 - DNA, 25 bp, Rattus norvegicus
tgtccctaaacttcgtccagagcga

SEQ ID NO: 645995 - DNA, 25 bp, Rattus norvegicus
tgtccctacagacccagagcagtta

SEQ ID NO: 645996 - DNA, 25 bp, Rattus norvegicus
tgtccctacagagccagagcagtta

SEQ ID NO: 645997 - DNA, 25 bp, Rattus norvegicus
tgtccctaccgcaggcttgaacaga

SEQ ID NO: 645998 - DNA, 25 bp, Rattus norvegicus
tgtccctaccgctggcttgaacaga

SEQ ID NO: 645999 - DNA, 25 bp, Rattus norvegicus
tgtccctactcactcaatggtgtat

SEQ ID NO: 646000 - DNA, 25 bp, Rattus norvegicus
tgtccctactcagtcaatggtgtat

SEQ ID NO: 646001 - DNA, 25 bp, Rattus norvegicus
tgtccctagaaaccttttatcctcc

SEQ ID NO: 646002 - DNA, 25 bp, Rattus norvegicus
tgtccctagaaagcttttatcctcc

SEQ ID NO: 646003 - DNA, 25 bp, Rattus norvegicus
tgtccctagcaaaaccgctgagcgc

SEQ ID NO: 646004 - DNA, 25 bp, Rattus norvegicus
tgtccctagcaataccgctgagcgc

SEQ ID NO: 646005 - DNA, 25 bp, Rattus norvegicus
tgtccctagccccaggccaagagga

SEQ ID NO: 646006 - DNA, 25 bp, Rattus norvegicus
tgtccctagcccgaggccaagagga

SEQ ID NO: 646007 - DNA, 25 bp, Rattus norvegicus
tgtccctatgaacaggctctgggtg

SEQ ID NO: 646008 - DNA, 25 bp, Rattus norvegicus
tgtccctatgaagaggctctgggtg

SEQ ID NO: 646009 - DNA, 25 bp, Rattus norvegicus
tgtccctatgggactatggtcactg

SEQ ID NO: 646010 - DNA, 25 bp, Rattus norvegicus
tgtccctatgggtctatggtcactg

SEQ ID NO: 646011 - DNA, 25 bp, Rattus norvegicus
tgtccctcaaataacgggtacctga

SEQ ID NO: 646012 - DNA, 25 bp, Rattus norvegicus
tgtccctcaaattacgggtacctga

SEQ ID NO: 646013 - DNA, 25 bp, Rattus norvegicus
tgtccctcacagaaaccaggttggt

SEQ ID NO: 646014 - DNA, 25 bp, Rattus norvegicus
tgtccctcacagtaaccaggttggt

SEQ ID NO: 646015 - DNA, 25 bp, Rattus norvegicus
tgtccctcacgaccttcagaaacta

SEQ ID NO: 646016 - DNA, 25 bp, Rattus norvegicus
tgtccctcacgagcttcagaaacta

SEQ ID NO: 646017 - DNA, 25 bp, Rattus norvegicus
tgtccctcagacagctggaatatct

SEQ ID NO: 646018 - DNA, 25 bp, Rattus norvegicus
tgtccctcagactgctggaatatct

SEQ ID NO: 646019 - DNA, 25 bp, Rattus norvegicus
tgtccctcaggcaatgagtgccaca

SEQ ID NO: 646020 - DNA, 25 bp, Rattus norvegicus
tgtccctcaggctatgagtgccaca

SEQ ID NO: 646021 - DNA, 25 bp, Rattus norvegicus
tgtccctcatctctgcggaagattt

SEQ ID NO: 646022 - DNA, 25 bp, Rattus norvegicus
tgtccctcatctgtgcggaagattt

SEQ ID NO: 646023 - DNA, 25 bp, Rattus norvegicus
tgtccctccaaactgtcgcgatgat

SEQ ID NO: 646024 - DNA, 25 bp, Rattus norvegicus
tgtccctccaaagtgtcgcgatgat

SEQ ID NO: 646025 - DNA, 25 bp, Rattus norvegicus
tgtccctccactcgatgtcacagag

SEQ ID NO: 646026 - DNA, 25 bp, Rattus norvegicus
tgtccctccactggatgtcacagag

SEQ ID NO: 646027 - DNA, 25 bp, Rattus norvegicus
tgtccctccatcagaaaccttggtt

SEQ ID NO: 646028 - DNA, 25 bp, Rattus norvegicus
tgtccctccatctgaaaccttggtt

SEQ ID NO: 646029 - DNA, 25 bp, Rattus norvegicus
tgtccctcccacaagaagccatgag

SEQ ID NO: 646030 - DNA, 25 bp, Rattus norvegicus
tgtccctcccactagaagccatgag

SEQ ID NO: 646031 - DNA, 25 bp, Rattus norvegicus
tgtccctccgagaaaacggtcttag

SEQ ID NO: 646032 - DNA, 25 bp, Rattus norvegicus
tgtccctccgagtaaacggtcttag

SEQ ID NO: 646033 - DNA, 25 bp, Rattus norvegicus
tgtccctcctatagtgcaaggcatc

SEQ ID NO: 646034 - DNA, 25 bp, Rattus norvegicus
tgtccctcctattgtgcaaggcatc

SEQ ID NO: 646035 - DNA, 25 bp, Rattus norvegicus
tgtccctcctctacatacagtcaga

SEQ ID NO: 646036 - DNA, 25 bp, Rattus norvegicus
tgtccctcctctctgtgaaaagaaa

SEQ ID NO: 646037 - DNA, 25 bp, Rattus norvegicus
tgtccctcctctgtgtgaaaagaaa

SEQ ID NO: 646038 - DNA, 25 bp, Rattus norvegicus
tgtccctcctcttcatacagtcaga

SEQ ID NO: 646039 - DNA, 25 bp, Rattus norvegicus
tgtccctcctgccacagatgtgaaa

SEQ ID NO: 646040 - DNA, 25 bp, Rattus norvegicus
tgtccctcctgcgacagatgtgaaa

SEQ ID NO: 646041 - DNA, 25 bp, Rattus norvegicus
tgtccctctaacagtccacagaaac

SEQ ID NO: 646042 - DNA, 25 bp, Rattus norvegicus
tgtccctctaactgtccacagaaac

SEQ ID NO: 646043 - DNA, 25 bp, Rattus norvegicus
tgtccctctgcacaggtctctcggg

SEQ ID NO: 646044 - DNA, 25 bp, Rattus norvegicus
tgtccctctgcagaggtctctcggg

SEQ ID NO: 646045 - DNA, 25 bp, Rattus norvegicus
tgtccctctggtatgtgacattcca

SEQ ID NO: 646046 - DNA, 25 bp, Rattus norvegicus
tgtccctctggtttgtgacattcca

SEQ ID NO: 646047 - DNA, 25 bp, Rattus norvegicus
tgtccctcttgtccactatttattg

SEQ ID NO: 646048 - DNA, 25 bp, Rattus norvegicus
tgtccctcttgtgcactatttattg

SEQ ID NO: 646049 - DNA, 25 bp, Rattus norvegicus
tgtccctgaacaaactacctaacct

SEQ ID NO: 646050 - DNA, 25 bp, Rattus norvegicus
tgtccctgaacatactacctaacct

SEQ ID NO: 646051 - DNA, 25 bp, Rattus norvegicus
tgtccctgactccttttagtatagc

SEQ ID NO: 646052 - DNA, 25 bp, Rattus norvegicus
tgtccctgactcgttttagtatagc

SEQ ID NO: 646053 - DNA, 25 bp, Rattus norvegicus
tgtccctgagatcatgctgtgcttc

SEQ ID NO: 646054 - DNA, 25 bp, Rattus norvegicus
tgtccctgagatgatgctgtgcttc

SEQ ID NO: 646055 - DNA, 25 bp, Rattus norvegicus
tgtccctgagggaccattgtgaaag

SEQ ID NO: 646056 - DNA, 25 bp, Rattus norvegicus
tgtccctgagggtccattgtgaaag

SEQ ID NO: 646057 - DNA, 25 bp, Rattus norvegicus
tgtccctgcgctcgaaaggctgtgt

SEQ ID NO: 646058 - DNA, 25 bp, Rattus norvegicus
tgtccctgcgctggaaaggctgtgt

SEQ ID NO: 646059 - DNA, 25 bp, Rattus norvegicus
tgtccctgcggtataactctaggat

SEQ ID NO: 646060 - DNA, 25 bp, Rattus norvegicus
tgtccctgcggtttaactctaggat

SEQ ID NO: 646061 - DNA, 25 bp, Rattus norvegicus
tgtccctgctataggatccccttaa

SEQ ID NO: 646062 - DNA, 25 bp, Rattus norvegicus
tgtccctgctattggatccccttaa

SEQ ID NO: 646063 - DNA, 25 bp, Rattus norvegicus
tgtccctggaaactgagggtccccg

SEQ ID NO: 646064 - DNA, 25 bp, Rattus norvegicus
tgtccctggaaagtgagggtccccg

SEQ ID NO: 646065 - DNA, 25 bp, Rattus norvegicus
tgtccctggactcccatgtagagaa

SEQ ID NO: 646066 - DNA, 25 bp, Rattus norvegicus
tgtccctggactgccatgtagagaa

SEQ ID NO: 646067 - DNA, 25 bp, Rattus norvegicus
tgtccctggcagaccaatatcctgg

SEQ ID NO: 646068 - DNA, 25 bp, Rattus norvegicus
tgtccctggcagtccaatatcctgg

SEQ ID NO: 646069 - DNA, 25 bp, Rattus norvegicus
tgtccctgggcacactcaagcaagc

SEQ ID NO: 646070 - DNA, 25 bp, Rattus norvegicus
tgtccctgggcagactcaagcaagc

SEQ ID NO: 646071 - DNA, 25 bp, Rattus norvegicus
tgtccctgggttcttctaagtctca

SEQ ID NO: 646072 - DNA, 25 bp, Rattus norvegicus
tgtccctgggttgttctaagtctca

SEQ ID NO: 646073 - DNA, 25 bp, Rattus norvegicus
tgtccctggtcgatagcagcaatga

SEQ ID NO: 646074 - DNA, 25 bp, Rattus norvegicus
tgtccctggtcgttagcagcaatga

SEQ ID NO: 646075 - DNA, 25 bp, Rattus norvegicus
tgtccctggtctaattttcattgtg

SEQ ID NO: 646076 - DNA, 25 bp, Rattus norvegicus
tgtccctggtcttattttcattgtg

SEQ ID NO: 646077 - DNA, 25 bp, Rattus norvegicus
tgtccctgtgaccatctgctagtgt

SEQ ID NO: 646078 - DNA, 25 bp, Rattus norvegicus
tgtccctgtgacgatctgctagtgt

SEQ ID NO: 646079 - DNA, 25 bp, Rattus norvegicus
tgtccctgtgagcacattttaagac

SEQ ID NO: 646080 - DNA, 25 bp, Rattus norvegicus
tgtccctgtgaggacattttaagac

SEQ ID NO: 646081 - DNA, 25 bp, Rattus norvegicus
tgtcccttaggacacatgagcccca

SEQ ID NO: 646082 - DNA, 25 bp, Rattus norvegicus
tgtcccttaggagacatgagcccca

SEQ ID NO: 646083 - DNA, 25 bp, Rattus norvegicus
tgtcccttagggatataggccagtt

SEQ ID NO: 646084 - DNA, 25 bp, Rattus norvegicus
tgtcccttagggttataggccagtt

SEQ ID NO: 646085 - DNA, 25 bp, Rattus norvegicus
tgtcccttcaggacaaccgcctgaa

SEQ ID NO: 646086 - DNA, 25 bp, Rattus norvegicus
tgtcccttcaggtcaaccgcctgaa

SEQ ID NO: 646087 - DNA, 25 bp, Rattus norvegicus
tgtcccttcctcagctaaggaacag

SEQ ID NO: 646088 - DNA, 25 bp, Rattus norvegicus
tgtcccttcctctgctaaggaacag

SEQ ID NO: 646089 - DNA, 25 bp, Rattus norvegicus
tgtcccttctctatggtgctactct

SEQ ID NO: 646090 - DNA, 25 bp, Rattus norvegicus
tgtcccttctctttggtgctactct

SEQ ID NO: 646091 - DNA, 25 bp, Rattus norvegicus
tgtcccttgctgcttcagtaatcta

SEQ ID NO: 646092 - DNA, 25 bp, Rattus norvegicus
tgtcccttgctggttcagtaatcta

SEQ ID NO: 646093 - DNA, 25 bp, Rattus norvegicus
tgtcccttggcacgtttctgagacg

SEQ ID NO: 646094 - DNA, 25 bp, Rattus norvegicus
tgtcccttggcaggtttctgagacg

SEQ ID NO: 646095 - DNA, 25 bp, Rattus norvegicus
tgtcccttggtaacgcgcgcagatg

SEQ ID NO: 646096 - DNA, 25 bp, Rattus norvegicus
tgtcccttggtatcgcgcgcagatg

SEQ ID NO: 646097 - DNA, 25 bp, Rattus norvegicus
tgtcccttgtaaaaactgcagccac

SEQ ID NO: 646098 - DNA, 25 bp, Rattus norvegicus
tgtcccttgtaataactgcagccac

SEQ ID NO: 646099 - DNA, 25 bp, Rattus norvegicus
tgtcccttgtccctatttcgaaata

SEQ ID NO: 646100 - DNA, 25 bp, Rattus norvegicus
tgtcccttgtccgtatttcgaaata

SEQ ID NO: 646101 - DNA, 25 bp, Rattus norvegicus
tgtccctttaagctagccccagaca

SEQ ID NO: 646102 - DNA, 25 bp, Rattus norvegicus
tgtccctttaaggtagccccagaca

SEQ ID NO: 646103 - DNA, 25 bp, Rattus norvegicus
tgtccctttacacagactcagagga

SEQ ID NO: 646104 - DNA, 25 bp, Rattus norvegicus
tgtccctttacagagactcagagga

SEQ ID NO: 646105 - DNA, 25 bp, Rattus norvegicus
tgtccctttcctcagggctgaaaag

SEQ ID NO: 646106 - DNA, 25 bp, Rattus norvegicus
tgtccctttcctgagggctgaaaag

SEQ ID NO: 646107 - DNA, 25 bp, Rattus norvegicus
tgtccctttggcattcagagagcaa

SEQ ID NO: 646108 - DNA, 25 bp, Rattus norvegicus
tgtccctttggctttcagagagcaa

SEQ ID NO: 646109 - DNA, 25 bp, Rattus norvegicus
tgtccctttttcattgtctcttcat

SEQ ID NO: 646110 - DNA, 25 bp, Rattus norvegicus
tgtccctttttctttgtctcttcat

SEQ ID NO: 646111 - DNA, 25 bp, Rattus norvegicus
tgtccgaagtcccaggctactaagg

SEQ ID NO: 646112 - DNA, 25 bp, Rattus norvegicus
tgtccgaagtccgaggctactaagg

SEQ ID NO: 646113 - DNA, 25 bp, Rattus norvegicus
tgtccgaccgtgcatcaaggactgc

SEQ ID NO: 646114 - DNA, 25 bp, Rattus norvegicus
tgtccgaccgtggatcaaggactgc

SEQ ID NO: 646115 - DNA, 25 bp, Rattus norvegicus
tgtccgacgggaacttcttagagcg

SEQ ID NO: 646116 - DNA, 25 bp, Rattus norvegicus
tgtccgacgggatcttcttagagcg

SEQ ID NO: 646117 - DNA, 25 bp, Rattus norvegicus
tgtccgaggccgagaagcgcccgtt

SEQ ID NO: 646118 - DNA, 25 bp, Rattus norvegicus
tgtccgaggccgtgaagcgcccgtt

SEQ ID NO: 646119 - DNA, 25 bp, Rattus norvegicus
tgtccgagtccgagggagcctctct

SEQ ID NO: 646120 - DNA, 25 bp, Rattus norvegicus
tgtccgagtccgtgggagcctctct

SEQ ID NO: 646121 - DNA, 25 bp, Rattus norvegicus
tgtccgcacctaccaggaacataaa

SEQ ID NO: 646122 - DNA, 25 bp, Rattus norvegicus
tgtccgcacctagcaggaacataaa

SEQ ID NO: 646123 - DNA, 25 bp, Rattus norvegicus
tgtccgccattgagggcccgaggat

SEQ ID NO: 646124 - DNA, 25 bp, Rattus norvegicus
tgtccgccattgtgggcccgaggat

SEQ ID NO: 646125 - DNA, 25 bp, Rattus norvegicus
tgtccgcccctcaataaaagcaatt

SEQ ID NO: 646126 - DNA, 25 bp, Rattus norvegicus
tgtccgcccctctataaaagcaatt

SEQ ID NO: 646127 - DNA, 25 bp, Rattus norvegicus
tgtccgcctaggagcctgtgttaag

SEQ ID NO: 646128 - DNA, 25 bp, Rattus norvegicus
tgtccgcctaggtgcctgtgttaag

SEQ ID NO: 646129 - DNA, 25 bp, Rattus norvegicus
tgtccgcgcatcagaagctgcaaga

SEQ ID NO: 646130 - DNA, 25 bp, Rattus norvegicus
tgtccgcgcatctgaagctgcaaga

SEQ ID NO: 646131 - DNA, 25 bp, Rattus norvegicus
tgtccggaacagacagattcttcta

SEQ ID NO: 646132 - DNA, 25 bp, Rattus norvegicus
tgtccggaacagtcagattcttcta

SEQ ID NO: 646133 - DNA, 25 bp, Rattus norvegicus
tgtccggactttccttattggagtt

SEQ ID NO: 646134 - DNA, 25 bp, Rattus norvegicus
tgtccggactttgcttattggagtt

SEQ ID NO: 646135 - DNA, 25 bp, Rattus norvegicus
tgtccggcacctacccggagggaat

SEQ ID NO: 646136 - DNA, 25 bp, Rattus norvegicus
tgtccggcaccttcccggagggaat

SEQ ID NO: 646137 - DNA, 25 bp, Rattus norvegicus
tgtccggcatcacccagaaaaatct

SEQ ID NO: 646138 - DNA, 25 bp, Rattus norvegicus
tgtccggcatcagccagaaaaatct

SEQ ID NO: 646139 - DNA, 25 bp, Rattus norvegicus
tgtccggctttaacttcgctgaaat

SEQ ID NO: 646140 - DNA, 25 bp, Rattus norvegicus
tgtccggctttatcttcgctgaaat

SEQ ID NO: 646141 - DNA, 25 bp, Rattus norvegicus
tgtccgggcctaacccatatggtga

SEQ ID NO: 646142 - DNA, 25 bp, Rattus norvegicus
tgtccgggcctatcccatatggtga

SEQ ID NO: 646143 - DNA, 25 bp, Rattus norvegicus
tgtccgggttagagcagatttactt

SEQ ID NO: 646144 - DNA, 25 bp, Rattus norvegicus
tgtccgggttagtgcagatttactt

SEQ ID NO: 646145 - DNA, 25 bp, Rattus norvegicus
tgtccgggttttctttaaagcacag

SEQ ID NO: 646146 - DNA, 25 bp, Rattus norvegicus
tgtccgggttttgtttaaagcacag

SEQ ID NO: 646147 - DNA, 25 bp, Rattus norvegicus
tgtccgtcacccatgttactgaagt

SEQ ID NO: 646148 - DNA, 25 bp, Rattus norvegicus
tgtccgtcacccttgttactgaagt

SEQ ID NO: 646149 - DNA, 25 bp, Rattus norvegicus
tgtccgtcagacagaagcagctgga

SEQ ID NO: 646150 - DNA, 25 bp, Rattus norvegicus
tgtccgtcagactgaagcagctgga

SEQ ID NO: 646151 - DNA, 25 bp, Rattus norvegicus
tgtccgtccatcactctgtgtgtgt

SEQ ID NO: 646152 - DNA, 25 bp, Rattus norvegicus
tgtccgtccatctctctgtgtgtgt

SEQ ID NO: 646153 - DNA, 25 bp, Rattus norvegicus
tgtccgtcgatgattctacatcatg

SEQ ID NO: 646154 - DNA, 25 bp, Rattus norvegicus
tgtccgtcgatgtttctacatcatg

SEQ ID NO: 646155 - DNA, 25 bp, Rattus norvegicus
tgtccgtcgggcagtcttgccaagc

SEQ ID NO: 646156 - DNA, 25 bp, Rattus norvegicus
tgtccgtcgggctgtcttgccaagc

SEQ ID NO: 646157 - DNA, 25 bp, Rattus norvegicus
tgtccgtctccaaccatgattgtct

SEQ ID NO: 646158 - DNA, 25 bp, Rattus norvegicus
tgtccgtctccatccatgattgtct

SEQ ID NO: 646159 - DNA, 25 bp, Rattus norvegicus
tgtccgtgacttaggctttgtttaa

SEQ ID NO: 646160 - DNA, 25 bp, Rattus norvegicus
tgtccgtgactttggctttgtttaa

SEQ ID NO: 646161 - DNA, 25 bp, Rattus norvegicus
tgtccgtgccctatgtgatttcagt

SEQ ID NO: 646162 - DNA, 25 bp, Rattus norvegicus
tgtccgtgccctttgtgatttcagt

SEQ ID NO: 646163 - DNA, 25 bp, Rattus norvegicus
tgtccgtgggctaaaggcccaaaat

SEQ ID NO: 646164 - DNA, 25 bp, Rattus norvegicus
tgtccgtgggcttaaggcccaaaat

SEQ ID NO: 646165 - DNA, 25 bp, Rattus norvegicus
tgtccgtgtattacctcttgtgaat

SEQ ID NO: 646166 - DNA, 25 bp, Rattus norvegicus
tgtccgtgtatttcctcttgtgaat

SEQ ID NO: 646167 - DNA, 25 bp, Rattus norvegicus
tgtccgtgtcctcgcccattgaagg

SEQ ID NO: 646168 - DNA, 25 bp, Rattus norvegicus
tgtccgtgtcctggcccattgaagg

SEQ ID NO: 646169 - DNA, 25 bp, Rattus norvegicus
tgtccgttggttatgggtcggctcg

SEQ ID NO: 646170 - DNA, 25 bp, Rattus norvegicus
tgtccgttggttttgggtcggctcg

SEQ ID NO: 646171 - DNA, 25 bp, Rattus norvegicus
tgtccgttgtgaccttgcaaatggt

SEQ ID NO: 646172 - DNA, 25 bp, Rattus norvegicus
tgtccgttgtgagcttgcaaatggt

SEQ ID NO: 646173 - DNA, 25 bp, Rattus norvegicus
tgtcctaaaaccagtactttgcctt

SEQ ID NO: 646174 - DNA, 25 bp, Rattus norvegicus
tgtcctaaaacctgtactttgcctt

SEQ ID NO: 646175 - DNA, 25 bp, Rattus norvegicus
tgtcctaaacacactatgaccgctc

SEQ ID NO: 646176 - DNA, 25 bp, Rattus norvegicus
tgtcctaaacactctatgaccgctc

SEQ ID NO: 646177 - DNA, 25 bp, Rattus norvegicus
tgtcctaagcttattggtgtgtaac

SEQ ID NO: 646178 - DNA, 25 bp, Rattus norvegicus
tgtcctaagctttttggtgtgtaac

SEQ ID NO: 646179 - DNA, 25 bp, Rattus norvegicus
tgtcctaattttacctagctttcag

SEQ ID NO: 646180 - DNA, 25 bp, Rattus norvegicus
tgtcctaatttttcctagctttcag

SEQ ID NO: 646181 - DNA, 25 bp, Rattus norvegicus
tgtcctacaactcctggagagcctc

SEQ ID NO: 646182 - DNA, 25 bp, Rattus norvegicus
tgtcctacaactgctggagagcctc

SEQ ID NO: 646183 - DNA, 25 bp, Rattus norvegicus
tgtcctacaagaacacctgcataac

SEQ ID NO: 646184 - DNA, 25 bp, Rattus norvegicus
tgtcctacaagatcacctgcataac

SEQ ID NO: 646185 - DNA, 25 bp, Rattus norvegicus
tgtcctacagagatactggttctat

SEQ ID NO: 646186 - DNA, 25 bp, Rattus norvegicus
tgtcctacagagttactggttctat

SEQ ID NO: 646187 - DNA, 25 bp, Rattus norvegicus
tgtcctacccttagtgtttcatctt

SEQ ID NO: 646188 - DNA, 25 bp, Rattus norvegicus
tgtcctaccctttgtgtttcatctt

SEQ ID NO: 646189 - DNA, 25 bp, Rattus norvegicus
tgtcctacggaaaccaagcacgtgt

SEQ ID NO: 646190 - DNA, 25 bp, Rattus norvegicus
tgtcctacggaatccaagcacgtgt

SEQ ID NO: 646191 - DNA, 25 bp, Rattus norvegicus
tgtcctactaccattttgtttcaga

SEQ ID NO: 646192 - DNA, 25 bp, Rattus norvegicus
tgtcctactacctttttgtttcaga

SEQ ID NO: 646193 - DNA, 25 bp, Rattus norvegicus
tgtcctactactcacttccatgttg

SEQ ID NO: 646194 - DNA, 25 bp, Rattus norvegicus
tgtcctactactgacttccatgttg

SEQ ID NO: 646195 - DNA, 25 bp, Rattus norvegicus
tgtcctactggtcgttcctgcacct

SEQ ID NO: 646196 - DNA, 25 bp, Rattus norvegicus
tgtcctactggtggttcctgcacct

SEQ ID NO: 646197 - DNA, 25 bp, Rattus norvegicus
tgtcctagacttacttagcctgtgt

SEQ ID NO: 646198 - DNA, 25 bp, Rattus norvegicus
tgtcctagactttcttagcctgtgt

SEQ ID NO: 646199 - DNA, 25 bp, Rattus norvegicus
tgtcctagcaataccatttatatgt

SEQ ID NO: 646200 - DNA, 25 bp, Rattus norvegicus
tgtcctagcaattccatttatatgt

SEQ ID NO: 646201 - DNA, 25 bp, Rattus norvegicus
tgtcctagccacagggaatgctgga

SEQ ID NO: 646202 - DNA, 25 bp, Rattus norvegicus
tgtcctagccactgggaatgctgga

SEQ ID NO: 646203 - DNA, 25 bp, Rattus norvegicus
tgtcctagctgactggcttgacaca

SEQ ID NO: 646204 - DNA, 25 bp, Rattus norvegicus
tgtcctagctgagtggcttgacaca

SEQ ID NO: 646205 - DNA, 25 bp, Rattus norvegicus
tgtcctaggaaccaatgccagccca

SEQ ID NO: 646206 - DNA, 25 bp, Rattus norvegicus
tgtcctaggaacgaatgccagccca

SEQ ID NO: 646207 - DNA, 25 bp, Rattus norvegicus
tgtcctagtcatcctttgagcagag

SEQ ID NO: 646208 - DNA, 25 bp, Rattus norvegicus
tgtcctagtcatgctttgagcagag

SEQ ID NO: 646209 - DNA, 25 bp, Rattus norvegicus
tgtcctataacacagattccctggg

SEQ ID NO: 646210 - DNA, 25 bp, Rattus norvegicus
tgtcctataacagagattccctggg

SEQ ID NO: 646211 - DNA, 25 bp, Rattus norvegicus
tgtcctatagaaatcccagagccac

SEQ ID NO: 646212 - DNA, 25 bp, Rattus norvegicus
tgtcctatagaattcccagagccac

SEQ ID NO: 646213 - DNA, 25 bp, Rattus norvegicus
tgtcctatcagcatgcttttctttc

SEQ ID NO: 646214 - DNA, 25 bp, Rattus norvegicus
tgtcctatcagcttgcttttctttc

SEQ ID NO: 646215 - DNA, 25 bp, Rattus norvegicus
tgtcctatccttctcaccagggaga

SEQ ID NO: 646216 - DNA, 25 bp, Rattus norvegicus
tgtcctatccttgtcaccagggaga

SEQ ID NO: 646217 - DNA, 25 bp, Rattus norvegicus
tgtcctatgaccaccatgtttgtat

SEQ ID NO: 646218 - DNA, 25 bp, Rattus norvegicus
tgtcctatgacccatttgtggccat

SEQ ID NO: 646219 - DNA, 25 bp, Rattus norvegicus
tgtcctatgaccgatttgtggccat

SEQ ID NO: 646220 - DNA, 25 bp, Rattus norvegicus
tgtcctatgacctccatgtttgtat

SEQ ID NO: 646221 - DNA, 25 bp, Rattus norvegicus
tgtcctatggtgctatttcctcaag

SEQ ID NO: 646222 - DNA, 25 bp, Rattus norvegicus
tgtcctatggtggtatttcctcaag

SEQ ID NO: 646223 - DNA, 25 bp, Rattus norvegicus
tgtcctatgtctcaccgggtggcat

SEQ ID NO: 646224 - DNA, 25 bp, Rattus norvegicus
tgtcctatgtctgaccgggtggcat

SEQ ID NO: 646225 - DNA, 25 bp, Rattus norvegicus
tgtcctatgtgtccatggtcattga

SEQ ID NO: 646226 - DNA, 25 bp, Rattus norvegicus
tgtcctatgtgtgcatggtcattga

SEQ ID NO: 646227 - DNA, 25 bp, Rattus norvegicus
tgtcctatttagcagagttgtcatt

SEQ ID NO: 646228 - DNA, 25 bp, Rattus norvegicus
tgtcctatttaggagagttgtcatt

SEQ ID NO: 646229 - DNA, 25 bp, Rattus norvegicus
tgtcctcaaacccagacatcttgag

SEQ ID NO: 646230 - DNA, 25 bp, Rattus norvegicus
tgtcctcaaaccgagacatcttgag

SEQ ID NO: 646231 - DNA, 25 bp, Rattus norvegicus
tgtcctcaaccaaaccttgcagcag

SEQ ID NO: 646232 - DNA, 25 bp, Rattus norvegicus
tgtcctcaaccataccttgcagcag

SEQ ID NO: 646233 - DNA, 25 bp, Rattus norvegicus
tgtcctcaactgaattccgtgacgt

SEQ ID NO: 646234 - DNA, 25 bp, Rattus norvegicus
tgtcctcaactgtattccgtgacgt

SEQ ID NO: 646235 - DNA, 25 bp, Rattus norvegicus
tgtcctcaaggaagatgctccccga

SEQ ID NO: 646236 - DNA, 25 bp, Rattus norvegicus
tgtcctcaaggacgtctgcagtgac

SEQ ID NO: 646237 - DNA, 25 bp, Rattus norvegicus
tgtcctcaaggaggtctgcagtgac

SEQ ID NO: 646238 - DNA, 25 bp, Rattus norvegicus
tgtcctcaaggatgatgctccccga

SEQ ID NO: 646239 - DNA, 25 bp, Rattus norvegicus
tgtcctcaccacacatgagctgtga

SEQ ID NO: 646240 - DNA, 25 bp, Rattus norvegicus
tgtcctcaccactcatgagctgtga

SEQ ID NO: 646241 - DNA, 25 bp, Rattus norvegicus
tgtcctcagacaaactgggcagcct

SEQ ID NO: 646242 - DNA, 25 bp, Rattus norvegicus
tgtcctcagacatactgggcagcct

SEQ ID NO: 646243 - DNA, 25 bp, Rattus norvegicus
tgtcctcagcggcacagatgctttc

SEQ ID NO: 646244 - DNA, 25 bp, Rattus norvegicus
tgtcctcagcgggacagatgctttc

SEQ ID NO: 646245 - DNA, 25 bp, Rattus norvegicus
tgtcctcagtcaacaactctgtcaa

SEQ ID NO: 646246 - DNA, 25 bp, Rattus norvegicus
tgtcctcagtcatcaactctgtcaa

SEQ ID NO: 646247 - DNA, 25 bp, Rattus norvegicus
tgtcctcagtgaattactctcttgg

SEQ ID NO: 646248 - DNA, 25 bp, Rattus norvegicus
tgtcctcagtgatttactctcttgg

SEQ ID NO: 646249 - DNA, 25 bp, Rattus norvegicus
tgtcctcatggcaatatgctccaag

SEQ ID NO: 646250 - DNA, 25 bp, Rattus norvegicus
tgtcctcatggctatatgctccaag

SEQ ID NO: 646251 - DNA, 25 bp, Rattus norvegicus
tgtcctcattccaagaaactctgtc

SEQ ID NO: 646252 - DNA, 25 bp, Rattus norvegicus
tgtcctcattcctagaaactctgtc

SEQ ID NO: 646253 - DNA, 25 bp, Rattus norvegicus
tgtcctccaaatattaacttctcaa

SEQ ID NO: 646254 - DNA, 25 bp, Rattus norvegicus
tgtcctccaaattttaacttctcaa

SEQ ID NO: 646255 - DNA, 25 bp, Rattus norvegicus
tgtcctccacatactattgtcctaa

SEQ ID NO: 646256 - DNA, 25 bp, Rattus norvegicus
tgtcctccacatccatcaggtcagg

SEQ ID NO: 646257 - DNA, 25 bp, Rattus norvegicus
tgtcctccacatgcatcaggtcagg

SEQ ID NO: 646258 - DNA, 25 bp, Rattus norvegicus
tgtcctccacattctattgtcctaa

SEQ ID NO: 646259 - DNA, 25 bp, Rattus norvegicus
tgtcctccagccacaaaaggtttga

SEQ ID NO: 646260 - DNA, 25 bp, Rattus norvegicus
tgtcctccagcccaatttgtattgt

SEQ ID NO: 646261 - DNA, 25 bp, Rattus norvegicus
tgtcctccagccgaatttgtattgt

SEQ ID NO: 646262 - DNA, 25 bp, Rattus norvegicus
tgtcctccagcctcaaaaggtttga

SEQ ID NO: 646263 - DNA, 25 bp, Rattus norvegicus
tgtcctccagctcttggtcaattag

SEQ ID NO: 646264 - DNA, 25 bp, Rattus norvegicus
tgtcctccagctgttggtcaattag

SEQ ID NO: 646265 - DNA, 25 bp, Rattus norvegicus
tgtcctccagtcagagtaagtgctt

SEQ ID NO: 646266 - DNA, 25 bp, Rattus norvegicus
tgtcctccagtctgagtaagtgctt

SEQ ID NO: 646267 - DNA, 25 bp, Rattus norvegicus
tgtcctccatggctcctgaacaggt

SEQ ID NO: 646268 - DNA, 25 bp, Rattus norvegicus
tgtcctccatgggtcctgaacaggt

SEQ ID NO: 646269 - DNA, 25 bp, Rattus norvegicus
tgtcctcccaccagtttgagacagg

SEQ ID NO: 646270 - DNA, 25 bp, Rattus norvegicus
tgtcctcccacctgtttgagacagg

SEQ ID NO: 646271 - DNA, 25 bp, Rattus norvegicus
tgtcctcccagacactggatttaag

SEQ ID NO: 646272 - DNA, 25 bp, Rattus norvegicus
tgtcctcccagagactggatttaag

SEQ ID NO: 646273 - DNA, 25 bp, Rattus norvegicus
tgtcctccctgcaaacatgataaag

SEQ ID NO: 646274 - DNA, 25 bp, Rattus norvegicus
tgtcctccctgctaacatgataaag

SEQ ID NO: 646275 - DNA, 25 bp, Rattus norvegicus
tgtcctccctgtcgagttcctcagt

SEQ ID NO: 646276 - DNA, 25 bp, Rattus norvegicus
tgtcctccctgtggagttcctcagt

SEQ ID NO: 646277 - DNA, 25 bp, Rattus norvegicus
tgtcctccgggaaacatggctgatc

SEQ ID NO: 646278 - DNA, 25 bp, Rattus norvegicus
tgtcctccgggatacatggctgatc

SEQ ID NO: 646279 - DNA, 25 bp, Rattus norvegicus
tgtcctccgtttcattagtggccga

SEQ ID NO: 646280 - DNA, 25 bp, Rattus norvegicus
tgtcctccgtttgattagtggccga

SEQ ID NO: 646281 - DNA, 25 bp, Rattus norvegicus
tgtcctcctggcacataaggtggct

SEQ ID NO: 646282 - DNA, 25 bp, Rattus norvegicus
tgtcctcctggctcataaggtggct

SEQ ID NO: 646283 - DNA, 25 bp, Rattus norvegicus
tgtcctccttacagcgggaacacag

SEQ ID NO: 646284 - DNA, 25 bp, Rattus norvegicus
tgtcctccttactgcgggaacacag

SEQ ID NO: 646285 - DNA, 25 bp, Rattus norvegicus
tgtcctccttagaaatgcggccaga

SEQ ID NO: 646286 - DNA, 25 bp, Rattus norvegicus
tgtcctccttagtaatgcggccaga

SEQ ID NO: 646287 - DNA, 25 bp, Rattus norvegicus
tgtcctccttgccaaagttacacaa

SEQ ID NO: 646288 - DNA, 25 bp, Rattus norvegicus
tgtcctccttgcgaaagttacacaa

SEQ ID NO: 646289 - DNA, 25 bp, Rattus norvegicus
tgtcctcctttccattggactgtca

SEQ ID NO: 646290 - DNA, 25 bp, Rattus norvegicus
tgtcctcctttcgattggactgtca

SEQ ID NO: 646291 - DNA, 25 bp, Rattus norvegicus
tgtcctcgaactaagacctctaact

SEQ ID NO: 646292 - DNA, 25 bp, Rattus norvegicus
tgtcctcgaacttagacctctaact

SEQ ID NO: 646293 - DNA, 25 bp, Rattus norvegicus
tgtcctcgaaggagctgtgctcatc

SEQ ID NO: 646294 - DNA, 25 bp, Rattus norvegicus
tgtcctcgaaggtgctgtgctcatc

SEQ ID NO: 646295 - DNA, 25 bp, Rattus norvegicus
tgtcctcgaccgcatgatgaagaag

SEQ ID NO: 646296 - DNA, 25 bp, Rattus norvegicus
tgtcctcgaccggatgatgaagaag

SEQ ID NO: 646297 - DNA, 25 bp, Rattus norvegicus
tgtcctcgccaactggccagagcaa

SEQ ID NO: 646298 - DNA, 25 bp, Rattus norvegicus
tgtcctcgccaagtggccagagcaa

SEQ ID NO: 646299 - DNA, 25 bp, Rattus norvegicus
tgtcctcgcctgaagctttgttaaa

SEQ ID NO: 646300 - DNA, 25 bp, Rattus norvegicus
tgtcctcgcctgtagctttgttaaa

SEQ ID NO: 646301 - DNA, 25 bp, Rattus norvegicus
tgtcctcgcggtaatttctttgaga

SEQ ID NO: 646302 - DNA, 25 bp, Rattus norvegicus
tgtcctcgcggttatttctttgaga

SEQ ID NO: 646303 - DNA, 25 bp, Rattus norvegicus
tgtcctcggaagaggtccaagggcc

SEQ ID NO: 646304 - DNA, 25 bp, Rattus norvegicus
tgtcctcggaagagttcacatccag

SEQ ID NO: 646305 - DNA, 25 bp, Rattus norvegicus
tgtcctcggaagtggtccaagggcc

SEQ ID NO: 646306 - DNA, 25 bp, Rattus norvegicus
tgtcctcggaagtgttcacatccag

SEQ ID NO: 646307 - DNA, 25 bp, Rattus norvegicus
tgtcctcggctactctgttgaagag

SEQ ID NO: 646308 - DNA, 25 bp, Rattus norvegicus
tgtcctcggctagtctgttgaagag

SEQ ID NO: 646309 - DNA, 25 bp, Rattus norvegicus
tgtcctcgtggtctggagcaactgt

SEQ ID NO: 646310 - DNA, 25 bp, Rattus norvegicus
tgtcctcgtggtgtggagcaactgt

SEQ ID NO: 646311 - DNA, 25 bp, Rattus norvegicus
tgtcctcgttttactgggctcaaac

SEQ ID NO: 646312 - DNA, 25 bp, Rattus norvegicus
tgtcctcgtttttctgggctcaaac

SEQ ID NO: 646313 - DNA, 25 bp, Rattus norvegicus
tgtcctctacgcacaagtctgtgtg

SEQ ID NO: 646314 - DNA, 25 bp, Rattus norvegicus
tgtcctctacgctcaagtctgtgtg

SEQ ID NO: 646315 - DNA, 25 bp, Rattus norvegicus
tgtcctctactaatcaatgctgtga

SEQ ID NO: 646316 - DNA, 25 bp, Rattus norvegicus
tgtcctctactattcaatgctgtga

SEQ ID NO: 646317 - DNA, 25 bp, Rattus norvegicus
tgtcctctagtgaagcactttccgt

SEQ ID NO: 646318 - DNA, 25 bp, Rattus norvegicus
tgtcctctagtgtagcactttccgt

SEQ ID NO: 646319 - DNA, 25 bp, Rattus norvegicus
tgtcctctccacacggaagaaagat

SEQ ID NO: 646320 - DNA, 25 bp, Rattus norvegicus
tgtcctctccactcggaagaaagat

SEQ ID NO: 646321 - DNA, 25 bp, Rattus norvegicus
tgtcctctccataaatgtgcctgta

SEQ ID NO: 646322 - DNA, 25 bp, Rattus norvegicus
tgtcctctccattaatgtgcctgta

SEQ ID NO: 646323 - DNA, 25 bp, Rattus norvegicus
tgtcctctccgtcttctggaataga

SEQ ID NO: 646324 - DNA, 25 bp, Rattus norvegicus
tgtcctctccgtgttctggaataga

SEQ ID NO: 646325 - DNA, 25 bp, Rattus norvegicus
tgtcctctcctcacagcatatgttg

SEQ ID NO: 646326 - DNA, 25 bp, Rattus norvegicus
tgtcctctcctctcagcatatgttg

SEQ ID NO: 646327 - DNA, 25 bp, Rattus norvegicus
tgtcctctcctgacagtgcaatcag

SEQ ID NO: 646328 - DNA, 25 bp, Rattus norvegicus
tgtcctctcctgtcagtgcaatcag

SEQ ID NO: 646329 - DNA, 25 bp, Rattus norvegicus
tgtcctctctcaatgcttgatggag

SEQ ID NO: 646330 - DNA, 25 bp, Rattus norvegicus
tgtcctctctcattgcttgatggag

SEQ ID NO: 646331 - DNA, 25 bp, Rattus norvegicus
tgtcctctctctcccaaggagaatc

SEQ ID NO: 646332 - DNA, 25 bp, Rattus norvegicus
tgtcctctctctgccaaggagaatc

SEQ ID NO: 646333 - DNA, 25 bp, Rattus norvegicus
tgtcctctgaaacaccatgctatag

SEQ ID NO: 646334 - DNA, 25 bp, Rattus norvegicus
tgtcctctgaaagaccatgctatag

SEQ ID NO: 646335 - DNA, 25 bp, Rattus norvegicus
tgtcctctgattaagctgctgcctc

SEQ ID NO: 646336 - DNA, 25 bp, Rattus norvegicus
tgtcctctgatttagctgctgcctc

SEQ ID NO: 646337 - DNA, 25 bp, Rattus norvegicus
tgtcctctgtaaaacgtggtgtcaa

SEQ ID NO: 646338 - DNA, 25 bp, Rattus norvegicus
tgtcctctgtaatacgtggtgtcaa

SEQ ID NO: 646339 - DNA, 25 bp, Rattus norvegicus
tgtcctctgtagctcaagtctccgg

SEQ ID NO: 646340 - DNA, 25 bp, Rattus norvegicus
tgtcctctgtaggtcaagtctccgg

SEQ ID NO: 646341 - DNA, 25 bp, Rattus norvegicus
tgtcctctgtgaagactgtcagctg

SEQ ID NO: 646342 - DNA, 25 bp, Rattus norvegicus
tgtcctctgtgatgactgtcagctg

SEQ ID NO: 646343 - DNA, 25 bp, Rattus norvegicus
tgtcctctgtggcttatgtgtctca

SEQ ID NO: 646344 - DNA, 25 bp, Rattus norvegicus
tgtcctctgtgggttatgtgtctca

SEQ ID NO: 646345 - DNA, 25 bp, Rattus norvegicus
tgtcctcttaccagaccgacaaaga

SEQ ID NO: 646346 - DNA, 25 bp, Rattus norvegicus
tgtcctcttacctgaccgacaaaga

SEQ ID NO: 646347 - DNA, 25 bp, Rattus norvegicus
tgtcctcttcacctttaactgttgg

SEQ ID NO: 646348 - DNA, 25 bp, Rattus norvegicus
tgtcctcttcacgtttaactgttgg

SEQ ID NO: 646349 - DNA, 25 bp, Rattus norvegicus
tgtcctcttcctcggcgatgactaa

SEQ ID NO: 646350 - DNA, 25 bp, Rattus norvegicus
tgtcctcttcctgggcgatgactaa

SEQ ID NO: 646351 - DNA, 25 bp, Rattus norvegicus
tgtcctcttcggacggagtagttta

SEQ ID NO: 646352 - DNA, 25 bp, Rattus norvegicus
tgtcctcttcggtcggagtagttta

SEQ ID NO: 646353 - DNA, 25 bp, Rattus norvegicus
tgtcctcttctgaccacgctggcat

SEQ ID NO: 646354 - DNA, 25 bp, Rattus norvegicus
tgtcctcttctgtccacgctggcat

SEQ ID NO: 646355 - DNA, 25 bp, Rattus norvegicus
tgtcctcttgaaacatggcttccag

SEQ ID NO: 646356 - DNA, 25 bp, Rattus norvegicus
tgtcctcttgaatcatggcttccag

SEQ ID NO: 646357 - DNA, 25 bp, Rattus norvegicus
tgtcctgaagccacctgactgctta

SEQ ID NO: 646358 - DNA, 25 bp, Rattus norvegicus
tgtcctgaagcctcctgactgctta

SEQ ID NO: 646359 - DNA, 25 bp, Rattus norvegicus
tgtcctgaattcacatgaaaaatgt

SEQ ID NO: 646360 - DNA, 25 bp, Rattus norvegicus
tgtcctgaattctcatgaaaaatgt

SEQ ID NO: 646361 - DNA, 25 bp, Rattus norvegicus
tgtcctgaccctcctggctgacagg

SEQ ID NO: 646362 - DNA, 25 bp, Rattus norvegicus
tgtcctgaccctgctggctgacagg

SEQ ID NO: 646363 - DNA, 25 bp, Rattus norvegicus
tgtcctgagataacatttgcattgt

SEQ ID NO: 646364 - DNA, 25 bp, Rattus norvegicus
tgtcctgagatatcatttgcattgt

SEQ ID NO: 646365 - DNA, 25 bp, Rattus norvegicus
tgtcctgagatcaacaccgggctgt

SEQ ID NO: 646366 - DNA, 25 bp, Rattus norvegicus
tgtcctgagatctacaccgggctgt

SEQ ID NO: 646367 - DNA, 25 bp, Rattus norvegicus
tgtcctgagccaaatctgccattgg

SEQ ID NO: 646368 - DNA, 25 bp, Rattus norvegicus
tgtcctgagccatatctgccattgg

SEQ ID NO: 646369 - DNA, 25 bp, Rattus norvegicus
tgtcctgagcctcatgactcccaaa

SEQ ID NO: 646370 - DNA, 25 bp, Rattus norvegicus
tgtcctgagcctgatgactcccaaa

SEQ ID NO: 646371 - DNA, 25 bp, Rattus norvegicus
tgtcctgaggacatcatgctgttgt

SEQ ID NO: 646372 - DNA, 25 bp, Rattus norvegicus
tgtcctgaggacttcatgctgttgt

SEQ ID NO: 646373 - DNA, 25 bp, Rattus norvegicus
tgtcctgatcggcatgctggtaaaa

SEQ ID NO: 646374 - DNA, 25 bp, Rattus norvegicus
tgtcctgatcgggatgctggtaaaa

SEQ ID NO: 646375 - DNA, 25 bp, Rattus norvegicus
tgtcctgatcgtcgtcgtagccatg

SEQ ID NO: 646376 - DNA, 25 bp, Rattus norvegicus
tgtcctgatcgtggtcgtagccatg

SEQ ID NO: 646377 - DNA, 25 bp, Rattus norvegicus
tgtcctgatcttatcatcaaggcgc

SEQ ID NO: 646378 - DNA, 25 bp, Rattus norvegicus
tgtcctgatcttttcatcaaggcgc

SEQ ID NO: 646379 - DNA, 25 bp, Rattus norvegicus
tgtcctgatgacacttggcggctga

SEQ ID NO: 646380 - DNA, 25 bp, Rattus norvegicus
tgtcctgatgactcttggcggctga

SEQ ID NO: 646381 - DNA, 25 bp, Rattus norvegicus
tgtcctgatgcaacttttgcctaat

SEQ ID NO: 646382 - DNA, 25 bp, Rattus norvegicus
tgtcctgatgcatcttttgcctaat

SEQ ID NO: 646383 - DNA, 25 bp, Rattus norvegicus
tgtcctgcagacagtgcggctcctg

SEQ ID NO: 646384 - DNA, 25 bp, Rattus norvegicus
tgtcctgcagactgtgcggctcctg

SEQ ID NO: 646385 - DNA, 25 bp, Rattus norvegicus
tgtcctgcagccagcaaaacctgaa

SEQ ID NO: 646386 - DNA, 25 bp, Rattus norvegicus
tgtcctgcagcctgcaaaacctgaa

SEQ ID NO: 646387 - DNA, 25 bp, Rattus norvegicus
tgtcctgcatgtctttgaccatgtc

SEQ ID NO: 646388 - DNA, 25 bp, Rattus norvegicus
tgtcctgcatgtgtttgaccatgtc

SEQ ID NO: 646389 - DNA, 25 bp, Rattus norvegicus
tgtcctgccgctcataatgtggcat

SEQ ID NO: 646390 - DNA, 25 bp, Rattus norvegicus
tgtcctgccgctgataatgtggcat

SEQ ID NO: 646391 - DNA, 25 bp, Rattus norvegicus
tgtcctgcgcgcagcgacgtgtcgc

SEQ ID NO: 646392 - DNA, 25 bp, Rattus norvegicus
tgtcctgcgcgctgcgacgtgtcgc

SEQ ID NO: 646393 - DNA, 25 bp, Rattus norvegicus
tgtcctgcggctcggagatcacaga

SEQ ID NO: 646394 - DNA, 25 bp, Rattus norvegicus
tgtcctgcggctgggagatcacaga

SEQ ID NO: 646395 - DNA, 25 bp, Rattus norvegicus
tgtcctgcgtggcattggaatcaca

SEQ ID NO: 646396 - DNA, 25 bp, Rattus norvegicus
tgtcctgcgtgggattggaatcaca

SEQ ID NO: 646397 - DNA, 25 bp, Rattus norvegicus
tgtcctgctcttcccatgtaacata

SEQ ID NO: 646398 - DNA, 25 bp, Rattus norvegicus
tgtcctgctcttgccatgtaacata

SEQ ID NO: 646399 - DNA, 25 bp, Rattus norvegicus
tgtcctgctgtaaagccatggccat

SEQ ID NO: 646400 - DNA, 25 bp, Rattus norvegicus
tgtcctgctgtatagccatggccat

SEQ ID NO: 646401 - DNA, 25 bp, Rattus norvegicus
tgtcctgctgtgaatgtgctgatgc

SEQ ID NO: 646402 - DNA, 25 bp, Rattus norvegicus
tgtcctgctgtgtatgtgctgatgc

SEQ ID NO: 646403 - DNA, 25 bp, Rattus norvegicus
tgtcctggaaatcactgccgatgat

SEQ ID NO: 646404 - DNA, 25 bp, Rattus norvegicus
tgtcctggaaatgactgccgatgat

SEQ ID NO: 646405 - DNA, 25 bp, Rattus norvegicus
tgtcctggaacaacctttgtagact

SEQ ID NO: 646406 - DNA, 25 bp, Rattus norvegicus
tgtcctggaacatcctttgtagact

SEQ ID NO: 646407 - DNA, 25 bp, Rattus norvegicus
tgtcctggacaaaaagcactgctga

SEQ ID NO: 646408 - DNA, 25 bp, Rattus norvegicus
tgtcctggacaataagcactgctga

SEQ ID NO: 646409 - DNA, 25 bp, Rattus norvegicus
tgtcctggacttctgcttcggtgag

SEQ ID NO: 646410 - DNA, 25 bp, Rattus norvegicus
tgtcctggacttgtgcttcggtgag

SEQ ID NO: 646411 - DNA, 25 bp, Rattus norvegicus
tgtcctggcactcggcctaaactag

SEQ ID NO: 646412 - DNA, 25 bp, Rattus norvegicus
tgtcctggcactgggcctaaactag

SEQ ID NO: 646413 - DNA, 25 bp, Rattus norvegicus
tgtcctggcatgatggtgatctcaa

SEQ ID NO: 646414 - DNA, 25 bp, Rattus norvegicus
tgtcctggcatgttggtgatctcaa

SEQ ID NO: 646415 - DNA, 25 bp, Rattus norvegicus
tgtcctggctcgagtcgaagaactc

SEQ ID NO: 646416 - DNA, 25 bp, Rattus norvegicus
tgtcctggctcgtgtcgaagaactc

SEQ ID NO: 646417 - DNA, 25 bp, Rattus norvegicus
tgtcctgggtagagagtttgtccta

SEQ ID NO: 646418 - DNA, 25 bp, Rattus norvegicus
tgtcctgggtagtgagtttgtccta

SEQ ID NO: 646419 - DNA, 25 bp, Rattus norvegicus
tgtcctggtatcagcctttgcaata

SEQ ID NO: 646420 - DNA, 25 bp, Rattus norvegicus
tgtcctggtatctgcctttgcaata

SEQ ID NO: 646421 - DNA, 25 bp, Rattus norvegicus
tgtcctggtcctctgtgtatttaac

SEQ ID NO: 646422 - DNA, 25 bp, Rattus norvegicus
tgtcctggtcctgtgtgtatttaac

SEQ ID NO: 646423 - DNA, 25 bp, Rattus norvegicus
tgtcctgtaactcataaaagctgta

SEQ ID NO: 646424 - DNA, 25 bp, Rattus norvegicus
tgtcctgtaactgataaaagctgta

SEQ ID NO: 646425 - DNA, 25 bp, Rattus norvegicus
tgtcctgtacaactccaacttttaa

SEQ ID NO: 646426 - DNA, 25 bp, Rattus norvegicus
tgtcctgtacaagtccaacttttaa

SEQ ID NO: 646427 - DNA, 25 bp, Rattus norvegicus
tgtcctgtccatcgctgaagagcga

SEQ ID NO: 646428 - DNA, 25 bp, Rattus norvegicus
tgtcctgtccatggctgaagagcga

SEQ ID NO: 646429 - DNA, 25 bp, Rattus norvegicus
tgtcctgtcgttaacaaacctgact

SEQ ID NO: 646430 - DNA, 25 bp, Rattus norvegicus
tgtcctgtcgtttacaaacctgact

SEQ ID NO: 646431 - DNA, 25 bp, Rattus norvegicus
tgtcctgtctctagcatgtctgttc

SEQ ID NO: 646432 - DNA, 25 bp, Rattus norvegicus
tgtcctgtctcttgcatgtctgttc

SEQ ID NO: 646433 - DNA, 25 bp, Rattus norvegicus
tgtcctgtctgtctctcagatgcag

SEQ ID NO: 646434 - DNA, 25 bp, Rattus norvegicus
tgtcctgtctgtgtctcagatgcag

SEQ ID NO: 646435 - DNA, 25 bp, Rattus norvegicus
tgtcctgtcttaacctttgcagttc

SEQ ID NO: 646436 - DNA, 25 bp, Rattus norvegicus
tgtcctgtcttatcctttgcagttc

SEQ ID NO: 646437 - DNA, 25 bp, Rattus norvegicus
tgtcctgtgactaacgccagggtag

SEQ ID NO: 646438 - DNA, 25 bp, Rattus norvegicus
tgtcctgtgacttacgccagggtag

SEQ ID NO: 646439 - DNA, 25 bp, Rattus norvegicus
tgtcctgtgccaccaacaaacttgg

SEQ ID NO: 646440 - DNA, 25 bp, Rattus norvegicus
tgtcctgtgccagcaacaaacttgg

SEQ ID NO: 646441 - DNA, 25 bp, Rattus norvegicus
tgtcctgtgcctatgagtgggcagt

SEQ ID NO: 646442 - DNA, 25 bp, Rattus norvegicus
tgtcctgtgcctttgagtgggcagt

SEQ ID NO: 646443 - DNA, 25 bp, Rattus norvegicus
tgtcctgtgcgtactgacttggaga

SEQ ID NO: 646444 - DNA, 25 bp, Rattus norvegicus
tgtcctgtgcgttctgacttggaga

SEQ ID NO: 646445 - DNA, 25 bp, Rattus norvegicus
tgtcctgtgggtcacgatacctcct

SEQ ID NO: 646446 - DNA, 25 bp, Rattus norvegicus
tgtcctgtgggtgacgatacctcct

SEQ ID NO: 646447 - DNA, 25 bp, Rattus norvegicus
tgtcctgtgtttccatagctacatc

SEQ ID NO: 646448 - DNA, 25 bp, Rattus norvegicus
tgtcctgtgtttgcatagctacatc

SEQ ID NO: 646449 - DNA, 25 bp, Rattus norvegicus
tgtcctgttcagatgggcatgcatc

SEQ ID NO: 646450 - DNA, 25 bp, Rattus norvegicus
tgtcctgttcagttgggcatgcatc

SEQ ID NO: 646451 - DNA, 25 bp, Rattus norvegicus
tgtcctgttcttaggctgacatggt

SEQ ID NO: 646452 - DNA, 25 bp, Rattus norvegicus
tgtcctgttctttggctgacatggt

SEQ ID NO: 646453 - DNA, 25 bp, Rattus norvegicus
tgtcctgttgctatcatggccatag

SEQ ID NO: 646454 - DNA, 25 bp, Rattus norvegicus
tgtcctgttgctttcatggccatag

SEQ ID NO: 646455 - DNA, 25 bp, Rattus norvegicus
tgtcctgttgtcagctagttcctag

SEQ ID NO: 646456 - DNA, 25 bp, Rattus norvegicus
tgtcctgttgtctgctagttcctag

SEQ ID NO: 646457 - DNA, 25 bp, Rattus norvegicus
tgtcctgtttccctgtataaagtca

SEQ ID NO: 646458 - DNA, 25 bp, Rattus norvegicus
tgtcctgtttccgtgtataaagtca

SEQ ID NO: 646459 - DNA, 25 bp, Rattus norvegicus
tgtcctgtttctcgagtggccagag

SEQ ID NO: 646460 - DNA, 25 bp, Rattus norvegicus
tgtcctgtttctggagtggccagag

SEQ ID NO: 646461 - DNA, 25 bp, Rattus norvegicus
tgtcctgtttgcactgtgtgccaaa

SEQ ID NO: 646462 - DNA, 25 bp, Rattus norvegicus
tgtcctgtttgctctgtgtgccaaa

SEQ ID NO: 646463 - DNA, 25 bp, Rattus norvegicus
tgtccttacagtcactagatgacat

SEQ ID NO: 646464 - DNA, 25 bp, Rattus norvegicus
tgtccttacagtcccttatctgatg

SEQ ID NO: 646465 - DNA, 25 bp, Rattus norvegicus
tgtccttacagtgactagatgacat

SEQ ID NO: 646466 - DNA, 25 bp, Rattus norvegicus
tgtccttacagtgccttatctgatg

SEQ ID NO: 646467 - DNA, 25 bp, Rattus norvegicus
tgtccttacgtgaggcatcttcaga

SEQ ID NO: 646468 - DNA, 25 bp, Rattus norvegicus
tgtccttacgtgtggcatcttcaga

SEQ ID NO: 646469 - DNA, 25 bp, Rattus norvegicus
tgtccttacttgactaaaaccccat

SEQ ID NO: 646470 - DNA, 25 bp, Rattus norvegicus
tgtccttacttgtctaaaaccccat

SEQ ID NO: 646471 - DNA, 25 bp, Rattus norvegicus
tgtccttagaatcattcctgaccag

SEQ ID NO: 646472 - DNA, 25 bp, Rattus norvegicus
tgtccttagaatgattcctgaccag

SEQ ID NO: 646473 - DNA, 25 bp, Rattus norvegicus
tgtccttagagacttacttccaaag

SEQ ID NO: 646474 - DNA, 25 bp, Rattus norvegicus
tgtccttagagagttacttccaaag

SEQ ID NO: 646475 - DNA, 25 bp, Rattus norvegicus
tgtccttaggtgagtgtttatagtc

SEQ ID NO: 646476 - DNA, 25 bp, Rattus norvegicus
tgtccttaggtgtgtgtttatagtc

SEQ ID NO: 646477 - DNA, 25 bp, Rattus norvegicus
tgtccttatccaaggtctgggccaa

SEQ ID NO: 646478 - DNA, 25 bp, Rattus norvegicus
tgtccttatccatggtctgggccaa

SEQ ID NO: 646479 - DNA, 25 bp, Rattus norvegicus
tgtccttatggtctacttttacaag

SEQ ID NO: 646480 - DNA, 25 bp, Rattus norvegicus
tgtccttatggtgtacttttacaag

SEQ ID NO: 646481 - DNA, 25 bp, Rattus norvegicus
tgtccttcacaacatttccctggaa

SEQ ID NO: 646482 - DNA, 25 bp, Rattus norvegicus
tgtccttcacaagatttccctggaa

SEQ ID NO: 646483 - DNA, 25 bp, Rattus norvegicus
tgtccttcacagcatatgcccaaaa

SEQ ID NO: 646484 - DNA, 25 bp, Rattus norvegicus
tgtccttcacaggatatgcccaaaa

SEQ ID NO: 646485 - DNA, 25 bp, Rattus norvegicus
tgtccttcacgaccgtttctaagga

SEQ ID NO: 646486 - DNA, 25 bp, Rattus norvegicus
tgtccttcacgagcgtttctaagga

SEQ ID NO: 646487 - DNA, 25 bp, Rattus norvegicus
tgtccttcagaacaaccaccgagaa

SEQ ID NO: 646488 - DNA, 25 bp, Rattus norvegicus
tgtccttcagaagaaccaccgagaa

SEQ ID NO: 646489 - DNA, 25 bp, Rattus norvegicus
tgtccttcagctcctaacggaactg

SEQ ID NO: 646490 - DNA, 25 bp, Rattus norvegicus
tgtccttcagctgctaacggaactg

SEQ ID NO: 646491 - DNA, 25 bp, Rattus norvegicus
tgtccttcagtcctaacatccgtga

SEQ ID NO: 646492 - DNA, 25 bp, Rattus norvegicus
tgtccttcagtcgtaacatccgtga

SEQ ID NO: 646493 - DNA, 25 bp, Rattus norvegicus
tgtccttcatcaacgccgagatggt

SEQ ID NO: 646494 - DNA, 25 bp, Rattus norvegicus
tgtccttcatcatcgccgagatggt

SEQ ID NO: 646495 - DNA, 25 bp, Rattus norvegicus
tgtccttcatttacctcctaaagtt

SEQ ID NO: 646496 - DNA, 25 bp, Rattus norvegicus
tgtccttcattttcctcctaaagtt

SEQ ID NO: 646497 - DNA, 25 bp, Rattus norvegicus
tgtccttccacacccagatgaggta

SEQ ID NO: 646498 - DNA, 25 bp, Rattus norvegicus
tgtccttccacagccagatgaggta

SEQ ID NO: 646499 - DNA, 25 bp, Rattus norvegicus
tgtccttccattctctctagtgaaa

SEQ ID NO: 646500 - DNA, 25 bp, Rattus norvegicus
tgtccttccattgtctctagtgaaa

SEQ ID NO: 646501 - DNA, 25 bp, Rattus norvegicus
tgtccttcccacagacttggaacca

SEQ ID NO: 646502 - DNA, 25 bp, Rattus norvegicus
tgtccttcccacagagaaacacatg

SEQ ID NO: 646503 - DNA, 25 bp, Rattus norvegicus
tgtccttcccactgacttggaacca

SEQ ID NO: 646504 - DNA, 25 bp, Rattus norvegicus
tgtccttcccactgagaaacacatg

SEQ ID NO: 646505 - DNA, 25 bp, Rattus norvegicus
tgtccttccctcagggccgaaagtt

SEQ ID NO: 646506 - DNA, 25 bp, Rattus norvegicus
tgtccttccctctgggccgaaagtt

SEQ ID NO: 646507 - DNA, 25 bp, Rattus norvegicus
tgtccttcctctctgaatttgacag

SEQ ID NO: 646508 - DNA, 25 bp, Rattus norvegicus
tgtccttcctctgtgaatttgacag

SEQ ID NO: 646509 - DNA, 25 bp, Rattus norvegicus
tgtccttccttaagtccagttcaag

SEQ ID NO: 646510 - DNA, 25 bp, Rattus norvegicus
tgtccttccttatgtccagttcaag

SEQ ID NO: 646511 - DNA, 25 bp, Rattus norvegicus
tgtccttcgaagcagtgactggcat

SEQ ID NO: 646512 - DNA, 25 bp, Rattus norvegicus
tgtccttcgaaggagtgactggcat

SEQ ID NO: 646513 - DNA, 25 bp, Rattus norvegicus
tgtccttctcttagggtatttgcac

SEQ ID NO: 646514 - DNA, 25 bp, Rattus norvegicus
tgtccttctctttgggtatttgcac

SEQ ID NO: 646515 - DNA, 25 bp, Rattus norvegicus
tgtccttctgccaggtcaatcaagg

SEQ ID NO: 646516 - DNA, 25 bp, Rattus norvegicus
tgtccttctgcctggtcaatcaagg

SEQ ID NO: 646517 - DNA, 25 bp, Rattus norvegicus
tgtccttcttgtcgctgtaacgcag

SEQ ID NO: 646518 - DNA, 25 bp, Rattus norvegicus
tgtccttcttgtggctgtaacgcag

SEQ ID NO: 646519 - DNA, 25 bp, Rattus norvegicus
tgtccttctttaagcctatacaatg

SEQ ID NO: 646520 - DNA, 25 bp, Rattus norvegicus
tgtccttctttatgcctatacaatg

SEQ ID NO: 646521 - DNA, 25 bp, Rattus norvegicus
tgtccttgaaccacgggaatgtcag

SEQ ID NO: 646522 - DNA, 25 bp, Rattus norvegicus
tgtccttgaacctcgggaatgtcag

SEQ ID NO: 646523 - DNA, 25 bp, Rattus norvegicus
tgtccttgacaaccctgttcatgga

SEQ ID NO: 646524 - DNA, 25 bp, Rattus norvegicus
tgtccttgacaagcctgttcatgga

SEQ ID NO: 646525 - DNA, 25 bp, Rattus norvegicus
tgtccttgagacaagcaccatgcag

SEQ ID NO: 646526 - DNA, 25 bp, Rattus norvegicus
tgtccttgagactagcaccatgcag

SEQ ID NO: 646527 - DNA, 25 bp, Rattus norvegicus
tgtccttgagagacgagaagcctgt

SEQ ID NO: 646528 - DNA, 25 bp, Rattus norvegicus
tgtccttgagagtcgagaagcctgt

SEQ ID NO: 646529 - DNA, 25 bp, Rattus norvegicus
tgtccttgaggaaatgtgaacttat

SEQ ID NO: 646530 - DNA, 25 bp, Rattus norvegicus
tgtccttgaggatatgtgaacttat

SEQ ID NO: 646531 - DNA, 25 bp, Rattus norvegicus
tgtccttgagtcaccacagtgtgag

SEQ ID NO: 646532 - DNA, 25 bp, Rattus norvegicus
tgtccttgagtctccacagtgtgag

SEQ ID NO: 646533 - DNA, 25 bp, Rattus norvegicus
tgtccttgcagaaaggtacccctag

SEQ ID NO: 646534 - DNA, 25 bp, Rattus norvegicus
tgtccttgcagataggtacccctag

SEQ ID NO: 646535 - DNA, 25 bp, Rattus norvegicus
tgtccttgcaggaacattgtagctc

SEQ ID NO: 646536 - DNA, 25 bp, Rattus norvegicus
tgtccttgcaggtacattgtagctc

SEQ ID NO: 646537 - DNA, 25 bp, Rattus norvegicus
tgtccttgctgacgagccccgagaa

SEQ ID NO: 646538 - DNA, 25 bp, Rattus norvegicus
tgtccttgctgaggagccccgagaa

SEQ ID NO: 646539 - DNA, 25 bp, Rattus norvegicus
tgtccttggaacactgacctatgtc

SEQ ID NO: 646540 - DNA, 25 bp, Rattus norvegicus
tgtccttggaacaggccactgatgt

SEQ ID NO: 646541 - DNA, 25 bp, Rattus norvegicus
tgtccttggaactctgacctatgtc

SEQ ID NO: 646542 - DNA, 25 bp, Rattus norvegicus
tgtccttggaactggccactgatgt

SEQ ID NO: 646543 - DNA, 25 bp, Rattus norvegicus
tgtccttggaggcaggagacaccca

SEQ ID NO: 646544 - DNA, 25 bp, Rattus norvegicus
tgtccttggagggaggagacaccca

SEQ ID NO: 646545 - DNA, 25 bp, Rattus norvegicus
tgtccttggcaaatgcatctctata

SEQ ID NO: 646546 - DNA, 25 bp, Rattus norvegicus
tgtccttggcaattgcatctctata

SEQ ID NO: 646547 - DNA, 25 bp, Rattus norvegicus
tgtccttgggcaaaggtctgagtct

SEQ ID NO: 646548 - DNA, 25 bp, Rattus norvegicus
tgtccttgggcataggtctgagtct

SEQ ID NO: 646549 - DNA, 25 bp, Rattus norvegicus
tgtccttgggtcattttagtaccag

SEQ ID NO: 646550 - DNA, 25 bp, Rattus norvegicus
tgtccttgggtctttttagtaccag

SEQ ID NO: 646551 - DNA, 25 bp, Rattus norvegicus
tgtccttgtacccaggccctaaaga

SEQ ID NO: 646552 - DNA, 25 bp, Rattus norvegicus
tgtccttgtaccgaggccctaaaga

SEQ ID NO: 646553 - DNA, 25 bp, Rattus norvegicus
tgtccttgtcgtagctgtaaaatgt

SEQ ID NO: 646554 - DNA, 25 bp, Rattus norvegicus
tgtccttgtcgttgctgtaaaatgt

SEQ ID NO: 646555 - DNA, 25 bp, Rattus norvegicus
tgtccttgtctccagcaggtctgta

SEQ ID NO: 646556 - DNA, 25 bp, Rattus norvegicus
tgtccttgtctcgagcaggtctgta

SEQ ID NO: 646557 - DNA, 25 bp, Rattus norvegicus
tgtccttgtcttacctatttttcag

SEQ ID NO: 646558 - DNA, 25 bp, Rattus norvegicus
tgtccttgtctttcctatttttcag

SEQ ID NO: 646559 - DNA, 25 bp, Rattus norvegicus
tgtccttgtgacagcggcctagtaa

SEQ ID NO: 646560 - DNA, 25 bp, Rattus norvegicus
tgtccttgtgactgcggcctagtaa

SEQ ID NO: 646561 - DNA, 25 bp, Rattus norvegicus
tgtccttgtgttcccaagtcattga

SEQ ID NO: 646562 - DNA, 25 bp, Rattus norvegicus
tgtccttgtgttgccaagtcattga

SEQ ID NO: 646563 - DNA, 25 bp, Rattus norvegicus
tgtccttgttatatactttcctcct

SEQ ID NO: 646564 - DNA, 25 bp, Rattus norvegicus
tgtccttgttatttactttcctcct

SEQ ID NO: 646565 - DNA, 25 bp, Rattus norvegicus
tgtccttgttgacctttgccatggt

SEQ ID NO: 646566 - DNA, 25 bp, Rattus norvegicus
tgtccttgttgagctttgccatggt

SEQ ID NO: 646567 - DNA, 25 bp, Rattus norvegicus
tgtccttgttgtaccttcgttttga

SEQ ID NO: 646568 - DNA, 25 bp, Rattus norvegicus
tgtccttgttgttccttcgttttga

SEQ ID NO: 646569 - DNA, 25 bp, Rattus norvegicus
tgtcctttagaaacgctgtcagcat

SEQ ID NO: 646570 - DNA, 25 bp, Rattus norvegicus
tgtcctttagaacccacatgcaagt

SEQ ID NO: 646571 - DNA, 25 bp, Rattus norvegicus
tgtcctttagaagccacatgcaagt

SEQ ID NO: 646572 - DNA, 25 bp, Rattus norvegicus
tgtcctttagaatcgctgtcagcat

SEQ ID NO: 646573 - DNA, 25 bp, Rattus norvegicus
tgtcctttccacaagtctgtttttg

SEQ ID NO: 646574 - DNA, 25 bp, Rattus norvegicus
tgtcctttccactagtctgtttttg

SEQ ID NO: 646575 - DNA, 25 bp, Rattus norvegicus
tgtcctttccatcgtaccagtgcac

SEQ ID NO: 646576 - DNA, 25 bp, Rattus norvegicus
tgtcctttccatggtaccagtgcac

SEQ ID NO: 646577 - DNA, 25 bp, Rattus norvegicus
tgtcctttccctatgtaaactacat

SEQ ID NO: 646578 - DNA, 25 bp, Rattus norvegicus
tgtcctttccctttgtaaactacat

SEQ ID NO: 646579 - DNA, 25 bp, Rattus norvegicus
tgtcctttcctcatgtacctaacag

SEQ ID NO: 646580 - DNA, 25 bp, Rattus norvegicus
tgtcctttcctcttgtacctaacag

SEQ ID NO: 646581 - DNA, 25 bp, Rattus norvegicus
tgtcctttccttcccattctttttt

SEQ ID NO: 646582 - DNA, 25 bp, Rattus norvegicus
tgtcctttccttgccattctttttt

SEQ ID NO: 646583 - DNA, 25 bp, Rattus norvegicus
tgtcctttctcactgacgtattcat

SEQ ID NO: 646584 - DNA, 25 bp, Rattus norvegicus
tgtcctttctcagtgacgtattcat

SEQ ID NO: 646585 - DNA, 25 bp, Rattus norvegicus
tgtcctttctgcactaatttctagt

SEQ ID NO: 646586 - DNA, 25 bp, Rattus norvegicus
tgtcctttctgctctaatttctagt

SEQ ID NO: 646587 - DNA, 25 bp, Rattus norvegicus
tgtcctttgctcatatggccaactt

SEQ ID NO: 646588 - DNA, 25 bp, Rattus norvegicus
tgtcctttgctcctgatgggcgtta

SEQ ID NO: 646589 - DNA, 25 bp, Rattus norvegicus
tgtcctttgctcgtgatgggcgtta

SEQ ID NO: 646590 - DNA, 25 bp, Rattus norvegicus
tgtcctttgctcttatggccaactt

SEQ ID NO: 646591 - DNA, 25 bp, Rattus norvegicus
tgtccttttaagaccaaccgatgta

SEQ ID NO: 646592 - DNA, 25 bp, Rattus norvegicus
tgtccttttaagtccaaccgatgta

SEQ ID NO: 646593 - DNA, 25 bp, Rattus norvegicus
tgtccttttaccacttgagcagacg

SEQ ID NO: 646594 - DNA, 25 bp, Rattus norvegicus
tgtccttttacctcttgagcagacg

SEQ ID NO: 646595 - DNA, 25 bp, Rattus norvegicus
tgtccttttataacctagcagcttc

SEQ ID NO: 646596 - DNA, 25 bp, Rattus norvegicus
tgtccttttatatcctagcagcttc

SEQ ID NO: 646597 - DNA, 25 bp, Rattus norvegicus
tgtccttttatcctcttgtgtattc

SEQ ID NO: 646598 - DNA, 25 bp, Rattus norvegicus
tgtccttttatcgtcttgtgtattc

SEQ ID NO: 646599 - DNA, 25 bp, Rattus norvegicus
tgtccttttcccagttgaggaactg

SEQ ID NO: 646600 - DNA, 25 bp, Rattus norvegicus
tgtccttttccctgttgaggaactg

SEQ ID NO: 646601 - DNA, 25 bp, Rattus norvegicus
tgtccttttcttatagccttagcag

SEQ ID NO: 646602 - DNA, 25 bp, Rattus norvegicus
tgtccttttcttttagccttagcag

SEQ ID NO: 646603 - DNA, 25 bp, Rattus norvegicus
tgtcctttttgtactctgattcacc

SEQ ID NO: 646604 - DNA, 25 bp, Rattus norvegicus
tgtcctttttgttctctgattcacc

SEQ ID NO: 646605 - DNA, 25 bp, Rattus norvegicus
tgtcgaaacgaaacaggctggtcct

SEQ ID NO: 646606 - DNA, 25 bp, Rattus norvegicus
tgtcgaaacgaatcaggctggtcct

SEQ ID NO: 646607 - DNA, 25 bp, Rattus norvegicus
tgtcgaagatctagaaggtcataat

SEQ ID NO: 646608 - DNA, 25 bp, Rattus norvegicus
tgtcgaagatcttgaaggtcataat

SEQ ID NO: 646609 - DNA, 25 bp, Rattus norvegicus
tgtcgaattcagatagctcagctac

SEQ ID NO: 646610 - DNA, 25 bp, Rattus norvegicus
tgtcgaattcagttagctcagctac

SEQ ID NO: 646611 - DNA, 25 bp, Rattus norvegicus
tgtcgacacattcccagctaaggct

SEQ ID NO: 646612 - DNA, 25 bp, Rattus norvegicus
tgtcgacacattgccagctaaggct

SEQ ID NO: 646613 - DNA, 25 bp, Rattus norvegicus
tgtcgacaccacagctgtgttggac

SEQ ID NO: 646614 - DNA, 25 bp, Rattus norvegicus
tgtcgacaccactgctgtgttggac

SEQ ID NO: 646615 - DNA, 25 bp, Rattus norvegicus
tgtcgacagcagatcgtgcactgta

SEQ ID NO: 646616 - DNA, 25 bp, Rattus norvegicus
tgtcgacagcagttcgtgcactgta

SEQ ID NO: 646617 - DNA, 25 bp, Rattus norvegicus
tgtcgacccataagccacattggag

SEQ ID NO: 646618 - DNA, 25 bp, Rattus norvegicus
tgtcgacccatatgccacattggag

SEQ ID NO: 646619 - DNA, 25 bp, Rattus norvegicus
tgtcgactctgaacctagctgaatt

SEQ ID NO: 646620 - DNA, 25 bp, Rattus norvegicus
tgtcgactctgatcctagctgaatt

SEQ ID NO: 646621 - DNA, 25 bp, Rattus norvegicus
tgtcgactgtacagcagcatgtgtc

SEQ ID NO: 646622 - DNA, 25 bp, Rattus norvegicus
tgtcgactgtactgcagcatgtgtc

SEQ ID NO: 646623 - DNA, 25 bp, Rattus norvegicus
tgtcgactgttccacctggctgtat

SEQ ID NO: 646624 - DNA, 25 bp, Rattus norvegicus
tgtcgactgttcgacctggctgtat

SEQ ID NO: 646625 - DNA, 25 bp, Rattus norvegicus
tgtcgagacagtatacgcccagcta

SEQ ID NO: 646626 - DNA, 25 bp, Rattus norvegicus
tgtcgagacagtttacgcccagcta

SEQ ID NO: 646627 - DNA, 25 bp, Rattus norvegicus
tgtcgagagggtattttccgcctca

SEQ ID NO: 646628 - DNA, 25 bp, Rattus norvegicus
tgtcgagagggttttttccgcctca

SEQ ID NO: 646629 - DNA, 25 bp, Rattus norvegicus
tgtcgagatcgaatgcagcctggct

SEQ ID NO: 646630 - DNA, 25 bp, Rattus norvegicus
tgtcgagatcgattgcagcctggct

SEQ ID NO: 646631 - DNA, 25 bp, Rattus norvegicus
tgtcgagcattgaccctttccttta

SEQ ID NO: 646632 - DNA, 25 bp, Rattus norvegicus
tgtcgagcattgtccctttccttta

SEQ ID NO: 646633 - DNA, 25 bp, Rattus norvegicus
tgtcgagcctatcagagctcagctg

SEQ ID NO: 646634 - DNA, 25 bp, Rattus norvegicus
tgtcgagcctatgagagctcagctg

SEQ ID NO: 646635 - DNA, 25 bp, Rattus norvegicus
tgtcgagctctgattactgttcaag

SEQ ID NO: 646636 - DNA, 25 bp, Rattus norvegicus
tgtcgagctctgtttactgttcaag

SEQ ID NO: 646637 - DNA, 25 bp, Rattus norvegicus
tgtcgagtctaaatccagttggtgg

SEQ ID NO: 646638 - DNA, 25 bp, Rattus norvegicus
tgtcgagtctaattccagttggtgg

SEQ ID NO: 646639 - DNA, 25 bp, Rattus norvegicus
tgtcgagtctcaattccttcatgtc

SEQ ID NO: 646640 - DNA, 25 bp, Rattus norvegicus
tgtcgagtctcatttccttcatgtc

SEQ ID NO: 646641 - DNA, 25 bp, Rattus norvegicus
tgtcgagtgtctatttggcttttgt

SEQ ID NO: 646642 - DNA, 25 bp, Rattus norvegicus
tgtcgagtgtctttttggcttttgt

SEQ ID NO: 646643 - DNA, 25 bp, Rattus norvegicus
tgtcgatcagttccaagtgcgttta

SEQ ID NO: 646644 - DNA, 25 bp, Rattus norvegicus
tgtcgatcagttgcaagtgcgttta

SEQ ID NO: 646645 - DNA, 25 bp, Rattus norvegicus
tgtcgatcatctctgtctactacta

SEQ ID NO: 646646 - DNA, 25 bp, Rattus norvegicus
tgtcgatcatctgtgtctactacta

SEQ ID NO: 646647 - DNA, 25 bp, Rattus norvegicus
tgtcgatccagacgtctgtcaggga

SEQ ID NO: 646648 - DNA, 25 bp, Rattus norvegicus
tgtcgatccagaggtctgtcaggga

SEQ ID NO: 646649 - DNA, 25 bp, Rattus norvegicus
tgtcgatgacagacttgctcagcgc

SEQ ID NO: 646650 - DNA, 25 bp, Rattus norvegicus
tgtcgatgacagtcttgctcagcgc

SEQ ID NO: 646651 - DNA, 25 bp, Rattus norvegicus
tgtcgatgcccgcatgctggatcac

SEQ ID NO: 646652 - DNA, 25 bp, Rattus norvegicus
tgtcgatgcccggatgctggatcac

SEQ ID NO: 646653 - DNA, 25 bp, Rattus norvegicus
tgtcgatggacaccacaagcttcat

SEQ ID NO: 646654 - DNA, 25 bp, Rattus norvegicus
tgtcgatggacagcacaagcttcat

SEQ ID NO: 646655 - DNA, 25 bp, Rattus norvegicus
tgtcgatgttaacctgctgcagagc

SEQ ID NO: 646656 - DNA, 25 bp, Rattus norvegicus
tgtcgatgttaagctgctgcagagc

SEQ ID NO: 646657 - DNA, 25 bp, Rattus norvegicus
tgtcgatgttccactgccacgttag

SEQ ID NO: 646658 - DNA, 25 bp, Rattus norvegicus
tgtcgatgttcctctgccacgttag

SEQ ID NO: 646659 - DNA, 25 bp, Rattus norvegicus
tgtcgatgttgactacagagtaact

SEQ ID NO: 646660 - DNA, 25 bp, Rattus norvegicus
tgtcgatgttgagtacagagtaact

SEQ ID NO: 646661 - DNA, 25 bp, Rattus norvegicus
tgtcgattacgtagaagctgtttcc

SEQ ID NO: 646662 - DNA, 25 bp, Rattus norvegicus
tgtcgattacgttgaagctgtttcc

SEQ ID NO: 646663 - DNA, 25 bp, Rattus norvegicus
tgtcgcaaagcgctcacctgtggtt

SEQ ID NO: 646664 - DNA, 25 bp, Rattus norvegicus
tgtcgcaaagcggtcacctgtggtt

SEQ ID NO: 646665 - DNA, 25 bp, Rattus norvegicus
tgtcgcacggtgaggagcttcgctt

SEQ ID NO: 646666 - DNA, 25 bp, Rattus norvegicus
tgtcgcacggtgtggagcttcgctt

SEQ ID NO: 646667 - DNA, 25 bp, Rattus norvegicus
tgtcgcagagatacacccggattaa

SEQ ID NO: 646668 - DNA, 25 bp, Rattus norvegicus
tgtcgcagagattcacccggattaa

SEQ ID NO: 646669 - DNA, 25 bp, Rattus norvegicus
tgtcgcagcccacagcagacagggt

SEQ ID NO: 646670 - DNA, 25 bp, Rattus norvegicus
tgtcgcagcccagagcagacagggt

SEQ ID NO: 646671 - DNA, 25 bp, Rattus norvegicus
tgtcgcagccttctgaggagctaga

SEQ ID NO: 646672 - DNA, 25 bp, Rattus norvegicus
tgtcgcagccttgtgaggagctaga

SEQ ID NO: 646673 - DNA, 25 bp, Rattus norvegicus
tgtcgcatctcactaattaaaggtt

SEQ ID NO: 646674 - DNA, 25 bp, Rattus norvegicus
tgtcgcatctcagtaattaaaggtt

SEQ ID NO: 646675 - DNA, 25 bp, Rattus norvegicus
tgtcgccacagcaagttttcacaag

SEQ ID NO: 646676 - DNA, 25 bp, Rattus norvegicus
tgtcgccacagctagttttcacaag

SEQ ID NO: 646677 - DNA, 25 bp, Rattus norvegicus
tgtcgccacttgatgcccaatggga

SEQ ID NO: 646678 - DNA, 25 bp, Rattus norvegicus
tgtcgccacttgttgcccaatggga

SEQ ID NO: 646679 - DNA, 25 bp, Rattus norvegicus
tgtcgccagcaaacagggttcccta

SEQ ID NO: 646680 - DNA, 25 bp, Rattus norvegicus
tgtcgccagcaatcagggttcccta

SEQ ID NO: 646681 - DNA, 25 bp, Rattus norvegicus
tgtcgccaggctaccattaacagaa

SEQ ID NO: 646682 - DNA, 25 bp, Rattus norvegicus
tgtcgccaggcttccattaacagaa

SEQ ID NO: 646683 - DNA, 25 bp, Rattus norvegicus
tgtcgccatcatccttacgggtgga

SEQ ID NO: 646684 - DNA, 25 bp, Rattus norvegicus
tgtcgccatcatgcttacgggtgga

SEQ ID NO: 646685 - DNA, 25 bp, Rattus norvegicus
tgtcgccatcgcaaatgcagctgat

SEQ ID NO: 646686 - DNA, 25 bp, Rattus norvegicus
tgtcgccatcgctaatgcagctgat

SEQ ID NO: 646687 - DNA, 25 bp, Rattus norvegicus
tgtcgcccaaggactattccacaaa

SEQ ID NO: 646688 - DNA, 25 bp, Rattus norvegicus
tgtcgcccaaggtctattccacaaa

SEQ ID NO: 646689 - DNA, 25 bp, Rattus norvegicus
tgtcgcccagcgagaatgggttttt

SEQ ID NO: 646690 - DNA, 25 bp, Rattus norvegicus
tgtcgcccagcgtgaatgggttttt

SEQ ID NO: 646691 - DNA, 25 bp, Rattus norvegicus
tgtcgccccagcatgtaggaaacag

SEQ ID NO: 646692 - DNA, 25 bp, Rattus norvegicus
tgtcgccccagcttgtaggaaacag

SEQ ID NO: 646693 - DNA, 25 bp, Rattus norvegicus
tgtcgccctcttagagcagcagtga

SEQ ID NO: 646694 - DNA, 25 bp, Rattus norvegicus
tgtcgccctctttgagcagcagtga

SEQ ID NO: 646695 - DNA, 25 bp, Rattus norvegicus
tgtcgccgagacactgatgttccag

SEQ ID NO: 646696 - DNA, 25 bp, Rattus norvegicus
tgtcgccgagactctgatgttccag

SEQ ID NO: 646697 - DNA, 25 bp, Rattus norvegicus
tgtcgccgccgaatttgctgctgct

SEQ ID NO: 646698 - DNA, 25 bp, Rattus norvegicus
tgtcgccgccgattttgctgctgct

SEQ ID NO: 646699 - DNA, 25 bp, Rattus norvegicus
tgtcgcctaagcattctgggtagta

SEQ ID NO: 646700 - DNA, 25 bp, Rattus norvegicus
tgtcgcctaagctttctgggtagta

SEQ ID NO: 646701 - DNA, 25 bp, Rattus norvegicus
tgtcgcctagtgactgagcacatac

SEQ ID NO: 646702 - DNA, 25 bp, Rattus norvegicus
tgtcgcctagtgtctgagcacatac

SEQ ID NO: 646703 - DNA, 25 bp, Rattus norvegicus
tgtcgcctagttatatgtcagttta

SEQ ID NO: 646704 - DNA, 25 bp, Rattus norvegicus
tgtcgcctagttttatgtcagttta

SEQ ID NO: 646705 - DNA, 25 bp, Rattus norvegicus
tgtcgcctgacaacagcgctggtgt

SEQ ID NO: 646706 - DNA, 25 bp, Rattus norvegicus
tgtcgcctgacatcagcgctggtgt

SEQ ID NO: 646707 - DNA, 25 bp, Rattus norvegicus
tgtcgcctgcttcgtttttataact

SEQ ID NO: 646708 - DNA, 25 bp, Rattus norvegicus
tgtcgcctgcttggtttttataact

SEQ ID NO: 646709 - DNA, 25 bp, Rattus norvegicus
tgtcgccttctccaagctgcagttc

SEQ ID NO: 646710 - DNA, 25 bp, Rattus norvegicus
tgtcgccttctcgaagctgcagttc

SEQ ID NO: 646711 - DNA, 25 bp, Rattus norvegicus
tgtcgccttgaccacaatcctgact

SEQ ID NO: 646712 - DNA, 25 bp, Rattus norvegicus
tgtcgccttgacgacaatcctgact

SEQ ID NO: 646713 - DNA, 25 bp, Rattus norvegicus
tgtcgcggcgcacgtacgtgttccc

SEQ ID NO: 646714 - DNA, 25 bp, Rattus norvegicus
tgtcgcggcgcaggtacgtgttccc

SEQ ID NO: 646715 - DNA, 25 bp, Rattus norvegicus
tgtcgctacatcactgaacctctgc

SEQ ID NO: 646716 - DNA, 25 bp, Rattus norvegicus
tgtcgctacatctctgaacctctgc

SEQ ID NO: 646717 - DNA, 25 bp, Rattus norvegicus
tgtcgctcacggcatgtctcagcaa

SEQ ID NO: 646718 - DNA, 25 bp, Rattus norvegicus
tgtcgctcacgggatgtctcagcaa

SEQ ID NO: 646719 - DNA, 25 bp, Rattus norvegicus
tgtcgctctgcaccaggatgcaatg

SEQ ID NO: 646720 - DNA, 25 bp, Rattus norvegicus
tgtcgctctgcagcaggatgcaatg

SEQ ID NO: 646721 - DNA, 25 bp, Rattus norvegicus
tgtcgctgaaccagcattagagagt

SEQ ID NO: 646722 - DNA, 25 bp, Rattus norvegicus
tgtcgctgaacctgcattagagagt

SEQ ID NO: 646723 - DNA, 25 bp, Rattus norvegicus
tgtcgctgaccgagagtatcccggg

SEQ ID NO: 646724 - DNA, 25 bp, Rattus norvegicus
tgtcgctgaccgtgagtatcccggg

SEQ ID NO: 646725 - DNA, 25 bp, Rattus norvegicus
tgtcgctgccttatcggaagtatga

SEQ ID NO: 646726 - DNA, 25 bp, Rattus norvegicus
tgtcgctgccttttcggaagtatga

SEQ ID NO: 646727 - DNA, 25 bp, Rattus norvegicus
tgtcgctgcgtgagctggctacaca

SEQ ID NO: 646728 - DNA, 25 bp, Rattus norvegicus
tgtcgctgcgtgtgctggctacaca

SEQ ID NO: 646729 - DNA, 25 bp, Rattus norvegicus
tgtcgctggactcttttgcagctcc

SEQ ID NO: 646730 - DNA, 25 bp, Rattus norvegicus
tgtcgctggactgttttgcagctcc

SEQ ID NO: 646731 - DNA, 25 bp, Rattus norvegicus
tgtcgctggcgtctcatgtgatgta

SEQ ID NO: 646732 - DNA, 25 bp, Rattus norvegicus
tgtcgctggcgtgtcatgtgatgta

SEQ ID NO: 646733 - DNA, 25 bp, Rattus norvegicus
tgtcgctgggttagcccatttgaaa

SEQ ID NO: 646734 - DNA, 25 bp, Rattus norvegicus
tgtcgctgggtttgcccatttgaaa

SEQ ID NO: 646735 - DNA, 25 bp, Rattus norvegicus
tgtcgcttgtccatgtgaagtccat

SEQ ID NO: 646736 - DNA, 25 bp, Rattus norvegicus
tgtcgcttgtccttgtgaagtccat

SEQ ID NO: 646737 - DNA, 25 bp, Rattus norvegicus
tgtcggaagacaccgtgtactcaca

SEQ ID NO: 646738 - DNA, 25 bp, Rattus norvegicus
tgtcggaagacagcgtgtactcaca

SEQ ID NO: 646739 - DNA, 25 bp, Rattus norvegicus
tgtcggaagtgccactctgctagag

SEQ ID NO: 646740 - DNA, 25 bp, Rattus norvegicus
tgtcggaagtgcgactctgctagag

SEQ ID NO: 646741 - DNA, 25 bp, Rattus norvegicus
tgtcggacaactacaagcgctcttt

SEQ ID NO: 646742 - DNA, 25 bp, Rattus norvegicus
tgtcggacaacttcaagcgctcttt

SEQ ID NO: 646743 - DNA, 25 bp, Rattus norvegicus
tgtcggacgatgctaggcctctaga

SEQ ID NO: 646744 - DNA, 25 bp, Rattus norvegicus
tgtcggacgatggtaggcctctaga

SEQ ID NO: 646745 - DNA, 25 bp, Rattus norvegicus
tgtcggacgccgagggtgacttctc

SEQ ID NO: 646746 - DNA, 25 bp, Rattus norvegicus
tgtcggacgccgtgggtgacttctc

SEQ ID NO: 646747 - DNA, 25 bp, Rattus norvegicus
tgtcggagcagaagggcacccaaga

SEQ ID NO: 646748 - DNA, 25 bp, Rattus norvegicus
tgtcggagcagatgggcacccaaga

SEQ ID NO: 646749 - DNA, 25 bp, Rattus norvegicus
tgtcggaggagcacatcagcgcgca

SEQ ID NO: 646750 - DNA, 25 bp, Rattus norvegicus
tgtcggaggagctcatcagcgcgca

SEQ ID NO: 646751 - DNA, 25 bp, Rattus norvegicus
tgtcggccaggcacaatgtcgctgt

SEQ ID NO: 646752 - DNA, 25 bp, Rattus norvegicus
tgtcggccaggctcaatgtcgctgt

SEQ ID NO: 646753 - DNA, 25 bp, Rattus norvegicus
tgtcggcctgcgctggacgccacag

SEQ ID NO: 646754 - DNA, 25 bp, Rattus norvegicus
tgtcggcctgcggtggacgccacag

SEQ ID NO: 646755 - DNA, 25 bp, Rattus norvegicus
tgtcggctctacagtgacccagaag

SEQ ID NO: 646756 - DNA, 25 bp, Rattus norvegicus
tgtcggctctactgtgacccagaag

SEQ ID NO: 646757 - DNA, 25 bp, Rattus norvegicus
tgtcggctgctcatgggacagacag

SEQ ID NO: 646758 - DNA, 25 bp, Rattus norvegicus
tgtcggctgctcttgggacagacag

SEQ ID NO: 646759 - DNA, 25 bp, Rattus norvegicus
tgtcggctttggaaacagacacctt

SEQ ID NO: 646760 - DNA, 25 bp, Rattus norvegicus
tgtcggctttggtaacagacacctt

SEQ ID NO: 646761 - DNA, 25 bp, Rattus norvegicus
tgtcgggatgtgctccacctgtacc

SEQ ID NO: 646762 - DNA, 25 bp, Rattus norvegicus
tgtcgggatgtggtccacctgtacc

SEQ ID NO: 646763 - DNA, 25 bp, Rattus norvegicus
tgtcgggcaggcacctggaacagaa

SEQ ID NO: 646764 - DNA, 25 bp, Rattus norvegicus
tgtcgggcaggctcctggaacagaa

SEQ ID NO: 646765 - DNA, 25 bp, Rattus norvegicus
tgtcgggctgtgcttgttcacttca

SEQ ID NO: 646766 - DNA, 25 bp, Rattus norvegicus
tgtcgggctgtggttgttcacttca

SEQ ID NO: 646767 - DNA, 25 bp, Rattus norvegicus
tgtcggtatagtatccttcttgtgc

SEQ ID NO: 646768 - DNA, 25 bp, Rattus norvegicus
tgtcggtatagtttccttcttgtgc

SEQ ID NO: 646769 - DNA, 25 bp, Rattus norvegicus
tgtcggtatcagacttcggcaacca

SEQ ID NO: 646770 - DNA, 25 bp, Rattus norvegicus
tgtcggtatcagtcttcggcaacca

SEQ ID NO: 646771 - DNA, 25 bp, Rattus norvegicus
tgtcggtcacgtctgttttcttttt

SEQ ID NO: 646772 - DNA, 25 bp, Rattus norvegicus
tgtcggtcacgtgtgttttcttttt

SEQ ID NO: 646773 - DNA, 25 bp, Rattus norvegicus
tgtcggtcagacaaaaagctacttg

SEQ ID NO: 646774 - DNA, 25 bp, Rattus norvegicus
tgtcggtcagactaaaagctacttg

SEQ ID NO: 646775 - DNA, 25 bp, Rattus norvegicus
tgtcggtcttgaaaagggccccagt

SEQ ID NO: 646776 - DNA, 25 bp, Rattus norvegicus
tgtcggtcttgataagggccccagt

SEQ ID NO: 646777 - DNA, 25 bp, Rattus norvegicus
tgtcggtgaactctgaccgcacttt

SEQ ID NO: 646778 - DNA, 25 bp, Rattus norvegicus
tgtcggtgaactgtgaccgcacttt

SEQ ID NO: 646779 - DNA, 25 bp, Rattus norvegicus
tgtcggtgccagagtgggccttcaa

SEQ ID NO: 646780 - DNA, 25 bp, Rattus norvegicus
tgtcggtgccagtgtgggccttcaa

SEQ ID NO: 646781 - DNA, 25 bp, Rattus norvegicus
tgtcggtgctgtaccacgcatagag

SEQ ID NO: 646782 - DNA, 25 bp, Rattus norvegicus
tgtcggtgctgttccacgcatagag

SEQ ID NO: 646783 - DNA, 25 bp, Rattus norvegicus
tgtcggttgcatcccagagtataaa

SEQ ID NO: 646784 - DNA, 25 bp, Rattus norvegicus
tgtcggttgcatgccagagtataaa

SEQ ID NO: 646785 - DNA, 25 bp, Rattus norvegicus
tgtcgtacggaaagttcaccggcca

SEQ ID NO: 646786 - DNA, 25 bp, Rattus norvegicus
tgtcgtacggaatgttcaccggcca

SEQ ID NO: 646787 - DNA, 25 bp, Rattus norvegicus
tgtcgtagatgtccacgtagcctgt

SEQ ID NO: 646788 - DNA, 25 bp, Rattus norvegicus
tgtcgtagatgtgcacgtagcctgt

SEQ ID NO: 646789 - DNA, 25 bp, Rattus norvegicus
tgtcgtatcaccagaatttgtaaaa

SEQ ID NO: 646790 - DNA, 25 bp, Rattus norvegicus
tgtcgtatcacctgaatttgtaaaa

SEQ ID NO: 646791 - DNA, 25 bp, Rattus norvegicus
tgtcgtatcccaatcgagcttcgaa

SEQ ID NO: 646792 - DNA, 25 bp, Rattus norvegicus
tgtcgtatcccattcgagcttcgaa

SEQ ID NO: 646793 - DNA, 25 bp, Rattus norvegicus
tgtcgtatcttacccatagtttcca

SEQ ID NO: 646794 - DNA, 25 bp, Rattus norvegicus
tgtcgtatcttagccatagtttcca

SEQ ID NO: 646795 - DNA, 25 bp, Rattus norvegicus
tgtcgtcaaccacagaacaaagctg

SEQ ID NO: 646796 - DNA, 25 bp, Rattus norvegicus
tgtcgtcaaccagagaacaaagctg

SEQ ID NO: 646797 - DNA, 25 bp, Rattus norvegicus
tgtcgtcagactatctgtccagagt

SEQ ID NO: 646798 - DNA, 25 bp, Rattus norvegicus
tgtcgtcagactttctgtccagagt

SEQ ID NO: 646799 - DNA, 25 bp, Rattus norvegicus
tgtcgtcagatgctgcagctggctc

SEQ ID NO: 646800 - DNA, 25 bp, Rattus norvegicus
tgtcgtcagatggtgcagctggctc

SEQ ID NO: 646801 - DNA, 25 bp, Rattus norvegicus
tgtcgtcagctcatgtcctcaggtg

SEQ ID NO: 646802 - DNA, 25 bp, Rattus norvegicus
tgtcgtcagctcttgtcctcaggtg

SEQ ID NO: 646803 - DNA, 25 bp, Rattus norvegicus
tgtcgtcagctgaatgtcactgcca

SEQ ID NO: 646804 - DNA, 25 bp, Rattus norvegicus
tgtcgtcagctgtatgtcactgcca

SEQ ID NO: 646805 - DNA, 25 bp, Rattus norvegicus
tgtcgtccagcaccttgtccacgat

SEQ ID NO: 646806 - DNA, 25 bp, Rattus norvegicus
tgtcgtccagcagcttgtccacgat

SEQ ID NO: 646807 - DNA, 25 bp, Rattus norvegicus
tgtcgtccaggacccgtttgcatga

SEQ ID NO: 646808 - DNA, 25 bp, Rattus norvegicus
tgtcgtccaggagccgtttgcatga

SEQ ID NO: 646809 - DNA, 25 bp, Rattus norvegicus
tgtcgtccaggtctcgcagattgtg

SEQ ID NO: 646810 - DNA, 25 bp, Rattus norvegicus
tgtcgtccaggtgtcgcagattgtg

SEQ ID NO: 646811 - DNA, 25 bp, Rattus norvegicus
tgtcgtccatcacccttttaagaaa

SEQ ID NO: 646812 - DNA, 25 bp, Rattus norvegicus
tgtcgtccatcagccttttaagaaa

SEQ ID NO: 646813 - DNA, 25 bp, Rattus norvegicus
tgtcgtcccaacacgctggcagcaa

SEQ ID NO: 646814 - DNA, 25 bp, Rattus norvegicus
tgtcgtcccaactcgctggcagcaa

SEQ ID NO: 646815 - DNA, 25 bp, Rattus norvegicus
tgtcgtcctgctatctcaagatggg

SEQ ID NO: 646816 - DNA, 25 bp, Rattus norvegicus
tgtcgtcctgctttctcaagatggg

SEQ ID NO: 646817 - DNA, 25 bp, Rattus norvegicus
tgtcgtcctttcattttccaacaat

SEQ ID NO: 646818 - DNA, 25 bp, Rattus norvegicus
tgtcgtcctttctttttccaacaat

SEQ ID NO: 646819 - DNA, 25 bp, Rattus norvegicus
tgtcgtcgctgccacagtgactctt

SEQ ID NO: 646820 - DNA, 25 bp, Rattus norvegicus
tgtcgtcgctgcgacagtgactctt

SEQ ID NO: 646821 - DNA, 25 bp, Rattus norvegicus
tgtcgtctcgagaacctccaggttc

SEQ ID NO: 646822 - DNA, 25 bp, Rattus norvegicus
tgtcgtctcgagtacctccaggttc

SEQ ID NO: 646823 - DNA, 25 bp, Rattus norvegicus
tgtcgtctcttaccctgtgtaaaca

SEQ ID NO: 646824 - DNA, 25 bp, Rattus norvegicus
tgtcgtctcttagcctgtgtaaaca

SEQ ID NO: 646825 - DNA, 25 bp, Rattus norvegicus
tgtcgtgcatgacgtgacccaggcc

SEQ ID NO: 646826 - DNA, 25 bp, Rattus norvegicus
tgtcgtgcatgaggtgacccaggcc

SEQ ID NO: 646827 - DNA, 25 bp, Rattus norvegicus
tgtcgtgctcaaatatcccatgtga

SEQ ID NO: 646828 - DNA, 25 bp, Rattus norvegicus
tgtcgtgctcaattatcccatgtga

SEQ ID NO: 646829 - DNA, 25 bp, Rattus norvegicus
tgtcgtgctgcacacttgtagttag

SEQ ID NO: 646830 - DNA, 25 bp, Rattus norvegicus
tgtcgtgctgcagacttgtagttag

SEQ ID NO: 646831 - DNA, 25 bp, Rattus norvegicus
tgtcgtggagtcaactggcgtcttc

SEQ ID NO: 646832 - DNA, 25 bp, Rattus norvegicus
tgtcgtggagtctactggcgtcttc

SEQ ID NO: 646833 - DNA, 25 bp, Rattus norvegicus
tgtcgtggcgtcagatttgtatgtc

SEQ ID NO: 646834 - DNA, 25 bp, Rattus norvegicus
tgtcgtggcgtctgatttgtatgtc

SEQ ID NO: 646835 - DNA, 25 bp, Rattus norvegicus
tgtcgtggtctacgtccaggagcta

SEQ ID NO: 646836 - DNA, 25 bp, Rattus norvegicus
tgtcgtggtctaggtccaggagcta

SEQ ID NO: 646837 - DNA, 25 bp, Rattus norvegicus
tgtcgtgtcctcagagttaccgttg

SEQ ID NO: 646838 - DNA, 25 bp, Rattus norvegicus
tgtcgtgtcctctgagttaccgttg

SEQ ID NO: 646839 - DNA, 25 bp, Rattus norvegicus
tgtcgtgtctccaacaccatgatga

SEQ ID NO: 646840 - DNA, 25 bp, Rattus norvegicus
tgtcgtgtctcctacaccatgatga

SEQ ID NO: 646841 - DNA, 25 bp, Rattus norvegicus
tgtcgtgtgatgaggctttgtcttc

SEQ ID NO: 646842 - DNA, 25 bp, Rattus norvegicus
tgtcgtgtgatgtggctttgtcttc

SEQ ID NO: 646843 - DNA, 25 bp, Rattus norvegicus
tgtcgttcatgcacctttaggaaca

SEQ ID NO: 646844 - DNA, 25 bp, Rattus norvegicus
tgtcgttcatgctcctttaggaaca

SEQ ID NO: 646845 - DNA, 25 bp, Rattus norvegicus
tgtcgttcctggactgtgggcgctc

SEQ ID NO: 646846 - DNA, 25 bp, Rattus norvegicus
tgtcgttcctggtctgtgggcgctc

SEQ ID NO: 646847 - DNA, 25 bp, Rattus norvegicus
tgtcgttctgcaagccgggatagac

SEQ ID NO: 646848 - DNA, 25 bp, Rattus norvegicus
tgtcgttctgcatgccgggatagac

SEQ ID NO: 646849 - DNA, 25 bp, Rattus norvegicus
tgtcgttgttcacttgtcagataca

SEQ ID NO: 646850 - DNA, 25 bp, Rattus norvegicus
tgtcgttgttcagttgtcagataca

SEQ ID NO: 646851 - DNA, 25 bp, Rattus norvegicus
tgtctaaaacccacctttgtctgag

SEQ ID NO: 646852 - DNA, 25 bp, Rattus norvegicus
tgtctaaaaccctcctttgtctgag

SEQ ID NO: 646853 - DNA, 25 bp, Rattus norvegicus
tgtctaaactccactcccacagtta

SEQ ID NO: 646854 - DNA, 25 bp, Rattus norvegicus
tgtctaaactcctctcccacagtta

SEQ ID NO: 646855 - DNA, 25 bp, Rattus norvegicus
tgtctaacattcacaacatcccagc

SEQ ID NO: 646856 - DNA, 25 bp, Rattus norvegicus
tgtctaacattctcaacatcccagc

SEQ ID NO: 646857 - DNA, 25 bp, Rattus norvegicus
tgtctaacccaccattaaactggat

SEQ ID NO: 646858 - DNA, 25 bp, Rattus norvegicus
tgtctaacccacgattaaactggat

SEQ ID NO: 646859 - DNA, 25 bp, Rattus norvegicus
tgtctaaccttcaagcttctatatg

SEQ ID NO: 646860 - DNA, 25 bp, Rattus norvegicus
tgtctaaccttctagcttctatatg

SEQ ID NO: 646861 - DNA, 25 bp, Rattus norvegicus
tgtctaatgtgacttgtccctttcc

SEQ ID NO: 646862 - DNA, 25 bp, Rattus norvegicus
tgtctaatgtgagttgtccctttcc

SEQ ID NO: 646863 - DNA, 25 bp, Rattus norvegicus
tgtctaatgtttagtgtggcaccta

SEQ ID NO: 646864 - DNA, 25 bp, Rattus norvegicus
tgtctaatgttttgtgtggcaccta

SEQ ID NO: 646865 - DNA, 25 bp, Rattus norvegicus
tgtctacaacaactctgcctggcgc

SEQ ID NO: 646866 - DNA, 25 bp, Rattus norvegicus
tgtctacaacaagtctgcctggcgc

SEQ ID NO: 646867 - DNA, 25 bp, Rattus norvegicus
tgtctacaacgacgccatcatcttt

SEQ ID NO: 646868 - DNA, 25 bp, Rattus norvegicus
tgtctacaacgaggccatcatcttt

SEQ ID NO: 646869 - DNA, 25 bp, Rattus norvegicus
tgtctacagcaccaagtatcttcag

SEQ ID NO: 646870 - DNA, 25 bp, Rattus norvegicus
tgtctacagcacgaagtatcttcag

SEQ ID NO: 646871 - DNA, 25 bp, Rattus norvegicus
tgtctacagctactacgcacagaac

SEQ ID NO: 646872 - DNA, 25 bp, Rattus norvegicus
tgtctacagctagtacgcacagaac

SEQ ID NO: 646873 - DNA, 25 bp, Rattus norvegicus
tgtctacagttcaccgatagccgac

SEQ ID NO: 646874 - DNA, 25 bp, Rattus norvegicus
tgtctacagttctccgatagccgac

SEQ ID NO: 646875 - DNA, 25 bp, Rattus norvegicus
tgtctacataagatccagctgtgga

SEQ ID NO: 646876 - DNA, 25 bp, Rattus norvegicus
tgtctacataagttccagctgtgga

SEQ ID NO: 646877 - DNA, 25 bp, Rattus norvegicus
tgtctacattcgaactagtgttggg

SEQ ID NO: 646878 - DNA, 25 bp, Rattus norvegicus
tgtctacattcgtactagtgttggg

SEQ ID NO: 646879 - DNA, 25 bp, Rattus norvegicus
tgtctacattgcaattttaccgccc

SEQ ID NO: 646880 - DNA, 25 bp, Rattus norvegicus
tgtctacattgctattttaccgccc

SEQ ID NO: 646881 - DNA, 25 bp, Rattus norvegicus
tgtctaccagcgagatgtctaccag

SEQ ID NO: 646882 - DNA, 25 bp, Rattus norvegicus
tgtctaccagcgtgatgtctaccag

SEQ ID NO: 646883 - DNA, 25 bp, Rattus norvegicus
tgtctacccataaaccgagctgtta

SEQ ID NO: 646884 - DNA, 25 bp, Rattus norvegicus
tgtctacccatataccgagctgtta

SEQ ID NO: 646885 - DNA, 25 bp, Rattus norvegicus
tgtctaccctctcctgtaaaaacaa

SEQ ID NO: 646886 - DNA, 25 bp, Rattus norvegicus
tgtctaccctctgctgtaaaaacaa

SEQ ID NO: 646887 - DNA, 25 bp, Rattus norvegicus
tgtctacctcttacatacattgtat

SEQ ID NO: 646888 - DNA, 25 bp, Rattus norvegicus
tgtctacctcttcggctgtgaactg

SEQ ID NO: 646889 - DNA, 25 bp, Rattus norvegicus
tgtctacctcttgggctgtgaactg

SEQ ID NO: 646890 - DNA, 25 bp, Rattus norvegicus
tgtctacctctttcatacattgtat

SEQ ID NO: 646891 - DNA, 25 bp, Rattus norvegicus
tgtctaccttttactagaattacct

SEQ ID NO: 646892 - DNA, 25 bp, Rattus norvegicus
tgtctacctttttctagaattacct

SEQ ID NO: 646893 - DNA, 25 bp, Rattus norvegicus
tgtctacgaaatcctaacctgcaag

SEQ ID NO: 646894 - DNA, 25 bp, Rattus norvegicus
tgtctacgaaatgctaacctgcaag

SEQ ID NO: 646895 - DNA, 25 bp, Rattus norvegicus
tgtctacgggccaaccaagagggtc

SEQ ID NO: 646896 - DNA, 25 bp, Rattus norvegicus
tgtctacgggcctaccaagagggtc

SEQ ID NO: 646897 - DNA, 25 bp, Rattus norvegicus
tgtctactatgtctccaaggcaagc

SEQ ID NO: 646898 - DNA, 25 bp, Rattus norvegicus
tgtctactatgtgtccaaggcaagc

SEQ ID NO: 646899 - DNA, 25 bp, Rattus norvegicus
tgtctactgcttcggttactgatta

SEQ ID NO: 646900 - DNA, 25 bp, Rattus norvegicus
tgtctactgcttgggttactgatta

SEQ ID NO: 646901 - DNA, 25 bp, Rattus norvegicus
tgtctactgtgtatccaaggcaagt

SEQ ID NO: 646902 - DNA, 25 bp, Rattus norvegicus
tgtctactgtgtttccaaggcaagt

SEQ ID NO: 646903 - DNA, 25 bp, Rattus norvegicus
tgtctacttagtactcagctgcctc

SEQ ID NO: 646904 - DNA, 25 bp, Rattus norvegicus
tgtctacttagttctcagctgcctc

SEQ ID NO: 646905 - DNA, 25 bp, Rattus norvegicus
tgtctagaacttaccaacctggcca

SEQ ID NO: 646906 - DNA, 25 bp, Rattus norvegicus
tgtctagaactttccaacctggcca

SEQ ID NO: 646907 - DNA, 25 bp, Rattus norvegicus
tgtctagaccttccactttgaccag

SEQ ID NO: 646908 - DNA, 25 bp, Rattus norvegicus
tgtctagaccttgcactttgaccag

SEQ ID NO: 646909 - DNA, 25 bp, Rattus norvegicus
tgtctagactaaccctccctgtgtg

SEQ ID NO: 646910 - DNA, 25 bp, Rattus norvegicus
tgtctagactaagcctccctgtgtg

SEQ ID NO: 646911 - DNA, 25 bp, Rattus norvegicus
tgtctagagcacattggaggacctc

SEQ ID NO: 646912 - DNA, 25 bp, Rattus norvegicus
tgtctagagcactttggaggacctc

SEQ ID NO: 646913 - DNA, 25 bp, Rattus norvegicus
tgtctagattatactcactcagagg

SEQ ID NO: 646914 - DNA, 25 bp, Rattus norvegicus
tgtctagattattctcactcagagg

SEQ ID NO: 646915 - DNA, 25 bp, Rattus norvegicus
tgtctagcatcacacagcctacgat

SEQ ID NO: 646916 - DNA, 25 bp, Rattus norvegicus
tgtctagcatcagacagcctacgat

SEQ ID NO: 646917 - DNA, 25 bp, Rattus norvegicus
tgtctagcatcccatggtcacaaaa

SEQ ID NO: 646918 - DNA, 25 bp, Rattus norvegicus
tgtctagcatccgatggtcacaaaa

SEQ ID NO: 646919 - DNA, 25 bp, Rattus norvegicus
tgtctagcatttccctctggttagg

SEQ ID NO: 646920 - DNA, 25 bp, Rattus norvegicus
tgtctagcatttgcctctggttagg

SEQ ID NO: 646921 - DNA, 25 bp, Rattus norvegicus
tgtctagcctggagaccaagttcat

SEQ ID NO: 646922 - DNA, 25 bp, Rattus norvegicus
tgtctagcctggtgaccaagttcat

SEQ ID NO: 646923 - DNA, 25 bp, Rattus norvegicus
tgtctagcgacacgcactgaatagc

SEQ ID NO: 646924 - DNA, 25 bp, Rattus norvegicus
tgtctagcgacaggcactgaatagc

SEQ ID NO: 646925 - DNA, 25 bp, Rattus norvegicus
tgtctagctctcatggcatgcactc

SEQ ID NO: 646926 - DNA, 25 bp, Rattus norvegicus
tgtctagctctcttggcatgcactc

SEQ ID NO: 646927 - DNA, 25 bp, Rattus norvegicus
tgtctagctgtcacggtaagttaat

SEQ ID NO: 646928 - DNA, 25 bp, Rattus norvegicus
tgtctagctgtctcggtaagttaat

SEQ ID NO: 646929 - DNA, 25 bp, Rattus norvegicus
tgtctagcttgtactctctctgcaa

SEQ ID NO: 646930 - DNA, 25 bp, Rattus norvegicus
tgtctagcttgttctctctctgcaa

SEQ ID NO: 646931 - DNA, 25 bp, Rattus norvegicus
tgtctaggatatacccctgaactcc

SEQ ID NO: 646932 - DNA, 25 bp, Rattus norvegicus
tgtctaggatattcccctgaactcc

SEQ ID NO: 646933 - DNA, 25 bp, Rattus norvegicus
tgtctaggctggactcaagtacctg

SEQ ID NO: 646934 - DNA, 25 bp, Rattus norvegicus
tgtctaggctggtctcaagtacctg

SEQ ID NO: 646935 - DNA, 25 bp, Rattus norvegicus
tgtctaggtggccatcccaacaaat

SEQ ID NO: 646936 - DNA, 25 bp, Rattus norvegicus
tgtctaggtggcgatcccaacaaat

SEQ ID NO: 646937 - DNA, 25 bp, Rattus norvegicus
tgtctagtacttacccgaagcgatg

SEQ ID NO: 646938 - DNA, 25 bp, Rattus norvegicus
tgtctagtactttcccgaagcgatg

SEQ ID NO: 646939 - DNA, 25 bp, Rattus norvegicus
tgtctagttactaatcagcctgttt

SEQ ID NO: 646940 - DNA, 25 bp, Rattus norvegicus
tgtctagttacttatcagcctgttt

SEQ ID NO: 646941 - DNA, 25 bp, Rattus norvegicus
tgtctagttatcagtgtccctgttg

SEQ ID NO: 646942 - DNA, 25 bp, Rattus norvegicus
tgtctagttatctgtgtccctgttg

SEQ ID NO: 646943 - DNA, 25 bp, Rattus norvegicus
tgtctatactagagggcacacagaa

SEQ ID NO: 646944 - DNA, 25 bp, Rattus norvegicus
tgtctatactagtgggcacacagaa

SEQ ID NO: 646945 - DNA, 25 bp, Rattus norvegicus
tgtctatatgacaactgctcacgct

SEQ ID NO: 646946 - DNA, 25 bp, Rattus norvegicus
tgtctatatgactactgctcacgct

SEQ ID NO: 646947 - DNA, 25 bp, Rattus norvegicus
tgtctatcagtgaagcctggcttct

SEQ ID NO: 646948 - DNA, 25 bp, Rattus norvegicus
tgtctatcagtgtagcctggcttct

SEQ ID NO: 646949 - DNA, 25 bp, Rattus norvegicus
tgtctatcatccaacaggaccctgt

SEQ ID NO: 646950 - DNA, 25 bp, Rattus norvegicus
tgtctatcatcctacaggaccctgt

SEQ ID NO: 646951 - DNA, 25 bp, Rattus norvegicus
tgtctatccaagcagaatgttccgg

SEQ ID NO: 646952 - DNA, 25 bp, Rattus norvegicus
tgtctatccaaggagaatgttccgg

SEQ ID NO: 646953 - DNA, 25 bp, Rattus norvegicus
tgtctatcgcgtcctcccagggagg

SEQ ID NO: 646954 - DNA, 25 bp, Rattus norvegicus
tgtctatcgcgtgctcccagggagg

SEQ ID NO: 646955 - DNA, 25 bp, Rattus norvegicus
tgtctatctctaactctacccctag

SEQ ID NO: 646956 - DNA, 25 bp, Rattus norvegicus
tgtctatctctatctctacccctag

SEQ ID NO: 646957 - DNA, 25 bp, Rattus norvegicus
tgtctatgaccaatgtaagctgcca

SEQ ID NO: 646958 - DNA, 25 bp, Rattus norvegicus
tgtctatgaccattgtaagctgcca

SEQ ID NO: 646959 - DNA, 25 bp, Rattus norvegicus
tgtctatggagcctcagtccgactg

SEQ ID NO: 646960 - DNA, 25 bp, Rattus norvegicus
tgtctatggagcgtcagtccgactg

SEQ ID NO: 646961 - DNA, 25 bp, Rattus norvegicus
tgtctatgtctgactcgggttcctg

SEQ ID NO: 646962 - DNA, 25 bp, Rattus norvegicus
tgtctatgtctgtctcgggttcctg

SEQ ID NO: 646963 - DNA, 25 bp, Rattus norvegicus
tgtctattcactagatccacatgcg

SEQ ID NO: 646964 - DNA, 25 bp, Rattus norvegicus
tgtctattcacttgatccacatgcg

SEQ ID NO: 646965 - DNA, 25 bp, Rattus norvegicus
tgtctattggtcactcccgttgttg

SEQ ID NO: 646966 - DNA, 25 bp, Rattus norvegicus
tgtctattggtctctcccgttgttg

SEQ ID NO: 646967 - DNA, 25 bp, Rattus norvegicus
tgtctattttgtactcttccctatt

SEQ ID NO: 646968 - DNA, 25 bp, Rattus norvegicus
tgtctattttgttctcttccctatt

SEQ ID NO: 646969 - DNA, 25 bp, Rattus norvegicus
tgtctcaaaacactagtagcttatg

SEQ ID NO: 646970 - DNA, 25 bp, Rattus norvegicus
tgtctcaaaacagtagtagcttatg

SEQ ID NO: 646971 - DNA, 25 bp, Rattus norvegicus
tgtctcaaaaccacacaagggattt

SEQ ID NO: 646972 - DNA, 25 bp, Rattus norvegicus
tgtctcaaaacctcacaagggattt

SEQ ID NO: 646973 - DNA, 25 bp, Rattus norvegicus
tgtctcaacctaacgggtggtccat

SEQ ID NO: 646974 - DNA, 25 bp, Rattus norvegicus
tgtctcaacctatcgggtggtccat

SEQ ID NO: 646975 - DNA, 25 bp, Rattus norvegicus
tgtctcaacgtaactgcgtgcttat

SEQ ID NO: 646976 - DNA, 25 bp, Rattus norvegicus
tgtctcaacgtatctgcgtgcttat

SEQ ID NO: 646977 - DNA, 25 bp, Rattus norvegicus
tgtctcaactggattttgttctcac

SEQ ID NO: 646978 - DNA, 25 bp, Rattus norvegicus
tgtctcaactggtttttgttctcac

SEQ ID NO: 646979 - DNA, 25 bp, Rattus norvegicus
tgtctcaatcctactttgcacagag

SEQ ID NO: 646980 - DNA, 25 bp, Rattus norvegicus
tgtctcaatccttctttgcacagag

SEQ ID NO: 646981 - DNA, 25 bp, Rattus norvegicus
tgtctcacacacaggttccaattgt

SEQ ID NO: 646982 - DNA, 25 bp, Rattus norvegicus
tgtctcacacactggttccaattgt

SEQ ID NO: 646983 - DNA, 25 bp, Rattus norvegicus
tgtctcacaggcagcgacagtgtta

SEQ ID NO: 646984 - DNA, 25 bp, Rattus norvegicus
tgtctcacaggctgcgacagtgtta

SEQ ID NO: 646985 - DNA, 25 bp, Rattus norvegicus
tgtctcaccccaaggcaggccaaat

SEQ ID NO: 646986 - DNA, 25 bp, Rattus norvegicus
tgtctcaccccatggcaggccaaat

SEQ ID NO: 646987 - DNA, 25 bp, Rattus norvegicus
tgtctcaccctacttgttaatttgc

SEQ ID NO: 646988 - DNA, 25 bp, Rattus norvegicus
tgtctcaccctagttgttaatttgc

SEQ ID NO: 646989 - DNA, 25 bp, Rattus norvegicus
tgtctcaccgccattttataacagt

SEQ ID NO: 646990 - DNA, 25 bp, Rattus norvegicus
tgtctcaccgcctttttataacagt

SEQ ID NO: 646991 - DNA, 25 bp, Rattus norvegicus
tgtctcacctcacgctttcaggtca

SEQ ID NO: 646992 - DNA, 25 bp, Rattus norvegicus
tgtctcacctcaggctttcaggtca

SEQ ID NO: 646993 - DNA, 25 bp, Rattus norvegicus
tgtctcactcctcctgcagtaaagt

SEQ ID NO: 646994 - DNA, 25 bp, Rattus norvegicus
tgtctcactcctgctgcagtaaagt

SEQ ID NO: 646995 - DNA, 25 bp, Rattus norvegicus
tgtctcactggccatcagtattgga

SEQ ID NO: 646996 - DNA, 25 bp, Rattus norvegicus
tgtctcactggcgatcagtattgga

SEQ ID NO: 646997 - DNA, 25 bp, Rattus norvegicus
tgtctcacttcccaaagcttttcat

SEQ ID NO: 646998 - DNA, 25 bp, Rattus norvegicus
tgtctcacttccgaaagcttttcat

SEQ ID NO: 646999 - DNA, 25 bp, Rattus norvegicus
tgtctcagaaggaccagcagttctt

SEQ ID NO: 647000 - DNA, 25 bp, Rattus norvegicus
tgtctcagaaggtccagcagttctt

SEQ ID NO: 647001 - DNA, 25 bp, Rattus norvegicus
tgtctcagactacaccccagggtgt

SEQ ID NO: 647002 - DNA, 25 bp, Rattus norvegicus
tgtctcagactagaccccagggtgt

SEQ ID NO: 647003 - DNA, 25 bp, Rattus norvegicus
tgtctcagctcactttgccattctg

SEQ ID NO: 647004 - DNA, 25 bp, Rattus norvegicus
tgtctcagctcagtttgccattctg

SEQ ID NO: 647005 - DNA, 25 bp, Rattus norvegicus
tgtctcaggaacaggtggaccctca

SEQ ID NO: 647006 - DNA, 25 bp, Rattus norvegicus
tgtctcaggaactggtggaccctca

SEQ ID NO: 647007 - DNA, 25 bp, Rattus norvegicus
tgtctcaggtacatgtcctgcctct

SEQ ID NO: 647008 - DNA, 25 bp, Rattus norvegicus
tgtctcaggtacttgtcctgcctct

SEQ ID NO: 647009 - DNA, 25 bp, Rattus norvegicus
tgtctcagttcaaggtttcaactgg

SEQ ID NO: 647010 - DNA, 25 bp, Rattus norvegicus
tgtctcagttcatggtttcaactgg

SEQ ID NO: 647011 - DNA, 25 bp, Rattus norvegicus
tgtctcatcatactcaggtgttctg

SEQ ID NO: 647012 - DNA, 25 bp, Rattus norvegicus
tgtctcatcatagtcaggtgttctg

SEQ ID NO: 647013 - DNA, 25 bp, Rattus norvegicus
tgtctcatgacacctcgaaataaat

SEQ ID NO: 647014 - DNA, 25 bp, Rattus norvegicus
tgtctcatgacagctcgaaataaat

SEQ ID NO: 647015 - DNA, 25 bp, Rattus norvegicus
tgtctcatggttcaagttggctcct

SEQ ID NO: 647016 - DNA, 25 bp, Rattus norvegicus
tgtctcatggttgaagttggctcct

SEQ ID NO: 647017 - DNA, 25 bp, Rattus norvegicus
tgtctcatgtgaagtccttgccaat

SEQ ID NO: 647018 - DNA, 25 bp, Rattus norvegicus
tgtctcatgtgatgtccttgccaat

SEQ ID NO: 647019 - DNA, 25 bp, Rattus norvegicus
tgtctcattaaacaggcaggcccca

SEQ ID NO: 647020 - DNA, 25 bp, Rattus norvegicus
tgtctcattaaagaggcaggcccca

SEQ ID NO: 647021 - DNA, 25 bp, Rattus norvegicus
tgtctcattctgctgccctgtctgg

SEQ ID NO: 647022 - DNA, 25 bp, Rattus norvegicus
tgtctcattctggtgccctgtctgg

SEQ ID NO: 647023 - DNA, 25 bp, Rattus norvegicus
tgtctcattgtaactgtggcacctt

SEQ ID NO: 647024 - DNA, 25 bp, Rattus norvegicus
tgtctcattgtatctgtggcacctt

SEQ ID NO: 647025 - DNA, 25 bp, Rattus norvegicus
tgtctccaacacagccatgattgct

SEQ ID NO: 647026 - DNA, 25 bp, Rattus norvegicus
tgtctccaacactgccatgattgct

SEQ ID NO: 647027 - DNA, 25 bp, Rattus norvegicus
tgtctccaagagcaattctgtcagg

SEQ ID NO: 647028 - DNA, 25 bp, Rattus norvegicus
tgtctccaagaggaattctgtcagg

SEQ ID NO: 647029 - DNA, 25 bp, Rattus norvegicus
tgtctccaagccaaccaaccaaata

SEQ ID NO: 647030 - DNA, 25 bp, Rattus norvegicus
tgtctccaagcctaccaaccaaata

SEQ ID NO: 647031 - DNA, 25 bp, Rattus norvegicus
tgtctccaaggcctagttcctggac

SEQ ID NO: 647032 - DNA, 25 bp, Rattus norvegicus
tgtctccaaggcgtagttcctggac

SEQ ID NO: 647033 - DNA, 25 bp, Rattus norvegicus
tgtctccaagttcctaccttgagat

SEQ ID NO: 647034 - DNA, 25 bp, Rattus norvegicus
tgtctccaagttgctaccttgagat

SEQ ID NO: 647035 - DNA, 25 bp, Rattus norvegicus
tgtctccacaatattttctgtctcc

SEQ ID NO: 647036 - DNA, 25 bp, Rattus norvegicus
tgtctccacaattttttctgtctcc

SEQ ID NO: 647037 - DNA, 25 bp, Rattus norvegicus
tgtctccacacacaggcactgactt

SEQ ID NO: 647038 - DNA, 25 bp, Rattus norvegicus
tgtctccacacagaggcactgactt

SEQ ID NO: 647039 - DNA, 25 bp, Rattus norvegicus
tgtctccacactagcacactgaaga

SEQ ID NO: 647040 - DNA, 25 bp, Rattus norvegicus
tgtctccacacttgcacactgaaga

SEQ ID NO: 647041 - DNA, 25 bp, Rattus norvegicus
tgtctccacccacgtctaataagtg

SEQ ID NO: 647042 - DNA, 25 bp, Rattus norvegicus
tgtctccacccaggtctaataagtg

SEQ ID NO: 647043 - DNA, 25 bp, Rattus norvegicus
tgtctccaccgtaccttggaagaga

SEQ ID NO: 647044 - DNA, 25 bp, Rattus norvegicus
tgtctccaccgttccttggaagaga

SEQ ID NO: 647045 - DNA, 25 bp, Rattus norvegicus
tgtctccactcaccaaaggtatttt

SEQ ID NO: 647046 - DNA, 25 bp, Rattus norvegicus
tgtctccactcagcaaaggtatttt

SEQ ID NO: 647047 - DNA, 25 bp, Rattus norvegicus
tgtctccagagcagtccaggaattt

SEQ ID NO: 647048 - DNA, 25 bp, Rattus norvegicus
tgtctccagagctgtccaggaattt

SEQ ID NO: 647049 - DNA, 25 bp, Rattus norvegicus
tgtctccagcatctcagagtgtcca

SEQ ID NO: 647050 - DNA, 25 bp, Rattus norvegicus
tgtctccagcatgtcagagtgtcca

SEQ ID NO: 647051 - DNA, 25 bp, Rattus norvegicus
tgtctccagctgaccctggacttag

SEQ ID NO: 647052 - DNA, 25 bp, Rattus norvegicus
tgtctccagctgtccctggacttag

SEQ ID NO: 647053 - DNA, 25 bp, Rattus norvegicus
tgtctccatattcccagttgctggg

SEQ ID NO: 647054 - DNA, 25 bp, Rattus norvegicus
tgtctccatattgccagttgctggg

SEQ ID NO: 647055 - DNA, 25 bp, Rattus norvegicus
tgtctccatctccctatctatctat

SEQ ID NO: 647056 - DNA, 25 bp, Rattus norvegicus
tgtctccatctcgctatctatctat

SEQ ID NO: 647057 - DNA, 25 bp, Rattus norvegicus
tgtctccatgtaaactgaccctctg

SEQ ID NO: 647058 - DNA, 25 bp, Rattus norvegicus
tgtctccatgtacgtttcccatcaa

SEQ ID NO: 647059 - DNA, 25 bp, Rattus norvegicus
tgtctccatgtaggtttcccatcaa

SEQ ID NO: 647060 - DNA, 25 bp, Rattus norvegicus
tgtctccatgtatactgaccctctg

SEQ ID NO: 647061 - DNA, 25 bp, Rattus norvegicus
tgtctccattacaattcctctgcaa

SEQ ID NO: 647062 - DNA, 25 bp, Rattus norvegicus
tgtctccattactattcctctgcaa

SEQ ID NO: 647063 - DNA, 25 bp, Rattus norvegicus
tgtctccatttacgcaacacatcag

SEQ ID NO: 647064 - DNA, 25 bp, Rattus norvegicus
tgtctccatttaggcaacacatcag

SEQ ID NO: 647065 - DNA, 25 bp, Rattus norvegicus
tgtctccatttgatcattctgtata

SEQ ID NO: 647066 - DNA, 25 bp, Rattus norvegicus
tgtctccatttgttcattctgtata

SEQ ID NO: 647067 - DNA, 25 bp, Rattus norvegicus
tgtctcccaaaccttgttagtctag

SEQ ID NO: 647068 - DNA, 25 bp, Rattus norvegicus
tgtctcccaaacgttgttagtctag

SEQ ID NO: 647069 - DNA, 25 bp, Rattus norvegicus
tgtctcccaagcagtgtgccaggca

SEQ ID NO: 647070 - DNA, 25 bp, Rattus norvegicus
tgtctcccaagctgtgtgccaggca

SEQ ID NO: 647071 - DNA, 25 bp, Rattus norvegicus
tgtctcccacggagccaacctgtta

SEQ ID NO: 647072 - DNA, 25 bp, Rattus norvegicus
tgtctcccacggtgccaacctgtta

SEQ ID NO: 647073 - DNA, 25 bp, Rattus norvegicus
tgtctcccacttcgctttggcaaat

SEQ ID NO: 647074 - DNA, 25 bp, Rattus norvegicus
tgtctcccacttggctttggcaaat

SEQ ID NO: 647075 - DNA, 25 bp, Rattus norvegicus
tgtctcccatcaattccattaggac

SEQ ID NO: 647076 - DNA, 25 bp, Rattus norvegicus
tgtctcccatcatttccattaggac

SEQ ID NO: 647077 - DNA, 25 bp, Rattus norvegicus
tgtctcccattgatgtgccacgtgg

SEQ ID NO: 647078 - DNA, 25 bp, Rattus norvegicus
tgtctcccattgttgtgccacgtgg

SEQ ID NO: 647079 - DNA, 25 bp, Rattus norvegicus
tgtctccccaccaataaaagttcac

SEQ ID NO: 647080 - DNA, 25 bp, Rattus norvegicus
tgtctccccacctataaaagttcac

SEQ ID NO: 647081 - DNA, 25 bp, Rattus norvegicus
tgtctccccactatatttaccagga

SEQ ID NO: 647082 - DNA, 25 bp, Rattus norvegicus
tgtctccccactttatttaccagga

SEQ ID NO: 647083 - DNA, 25 bp, Rattus norvegicus
tgtctccccaggaaactgcacatgg

SEQ ID NO: 647084 - DNA, 25 bp, Rattus norvegicus
tgtctccccaggtaactgcacatgg

SEQ ID NO: 647085 - DNA, 25 bp, Rattus norvegicus
tgtctccccatgagtgctgaaggaa

SEQ ID NO: 647086 - DNA, 25 bp, Rattus norvegicus
tgtctccccatgtgtgctgaaggaa

SEQ ID NO: 647087 - DNA, 25 bp, Rattus norvegicus
tgtctccccggacactctgagagaa

SEQ ID NO: 647088 - DNA, 25 bp, Rattus norvegicus
tgtctccccggagactctgagagaa

SEQ ID NO: 647089 - DNA, 25 bp, Rattus norvegicus
tgtctcccgcatcattctaaactga

SEQ ID NO: 647090 - DNA, 25 bp, Rattus norvegicus
tgtctcccgcatgattctaaactga

SEQ ID NO: 647091 - DNA, 25 bp, Rattus norvegicus
tgtctcccggccacgtgtgatcatc

SEQ ID NO: 647092 - DNA, 25 bp, Rattus norvegicus
tgtctcccggcctcgtgtgatcatc

SEQ ID NO: 647093 - DNA, 25 bp, Rattus norvegicus
tgtctcccgtggagtttgcatcacg

SEQ ID NO: 647094 - DNA, 25 bp, Rattus norvegicus
tgtctcccgtggtgtttgcatcacg

SEQ ID NO: 647095 - DNA, 25 bp, Rattus norvegicus
tgtctccctaacaccagtgtcaatt

SEQ ID NO: 647096 - DNA, 25 bp, Rattus norvegicus
tgtctccctaactccagtgtcaatt

SEQ ID NO: 647097 - DNA, 25 bp, Rattus norvegicus
tgtctccctcacaggtctcaaatga

SEQ ID NO: 647098 - DNA, 25 bp, Rattus norvegicus
tgtctccctcactggtctcaaatga

SEQ ID NO: 647099 - DNA, 25 bp, Rattus norvegicus
tgtctccctcagaggagagaagatg

SEQ ID NO: 647100 - DNA, 25 bp, Rattus norvegicus
tgtctccctcagcaaaacattctct

SEQ ID NO: 647101 - DNA, 25 bp, Rattus norvegicus
tgtctccctcaggaaaacattctct

SEQ ID NO: 647102 - DNA, 25 bp, Rattus norvegicus
tgtctccctcagtggagagaagatg

SEQ ID NO: 647103 - DNA, 25 bp, Rattus norvegicus
tgtctccctctgacagaacaggtga

SEQ ID NO: 647104 - DNA, 25 bp, Rattus norvegicus
tgtctccctctgtcagaacaggtga

SEQ ID NO: 647105 - DNA, 25 bp, Rattus norvegicus
tgtctccctgtgacagcattaactt

SEQ ID NO: 647106 - DNA, 25 bp, Rattus norvegicus
tgtctccctgtgtcagcattaactt

SEQ ID NO: 647107 - DNA, 25 bp, Rattus norvegicus
tgtctccctttgaggaacagcagag

SEQ ID NO: 647108 - DNA, 25 bp, Rattus norvegicus
tgtctccctttgtggaacagcagag

SEQ ID NO: 647109 - DNA, 25 bp, Rattus norvegicus
tgtctccgaaccacgtgtttcttta

SEQ ID NO: 647110 - DNA, 25 bp, Rattus norvegicus
tgtctccgaacctcgtgtttcttta

SEQ ID NO: 647111 - DNA, 25 bp, Rattus norvegicus
tgtctccggacacgtactttatagc

SEQ ID NO: 647112 - DNA, 25 bp, Rattus norvegicus
tgtctccggacaggtactttatagc

SEQ ID NO: 647113 - DNA, 25 bp, Rattus norvegicus
tgtctccgggagcactagctgccta

SEQ ID NO: 647114 - DNA, 25 bp, Rattus norvegicus
tgtctccgggaggactagctgccta

SEQ ID NO: 647115 - DNA, 25 bp, Rattus norvegicus
tgtctcctagaacacacagccttag

SEQ ID NO: 647116 - DNA, 25 bp, Rattus norvegicus
tgtctcctagaagacacagccttag

SEQ ID NO: 647117 - DNA, 25 bp, Rattus norvegicus
tgtctcctcagcacacttgggaggc

SEQ ID NO: 647118 - DNA, 25 bp, Rattus norvegicus
tgtctcctcagctcacttgggaggc

SEQ ID NO: 647119 - DNA, 25 bp, Rattus norvegicus
tgtctcctcagtacctatttattta

SEQ ID NO: 647120 - DNA, 25 bp, Rattus norvegicus
tgtctcctcagttcctatttattta

SEQ ID NO: 647121 - DNA, 25 bp, Rattus norvegicus
tgtctcctcatcagtgcctaaagat

SEQ ID NO: 647122 - DNA, 25 bp, Rattus norvegicus
tgtctcctcatctgtgcctaaagat

SEQ ID NO: 647123 - DNA, 25 bp, Rattus norvegicus
tgtctcctcattccacacgaattcg

SEQ ID NO: 647124 - DNA, 25 bp, Rattus norvegicus
tgtctcctcattgcacacgaattcg

SEQ ID NO: 647125 - DNA, 25 bp, Rattus norvegicus
tgtctcctccacacagaaattcata

SEQ ID NO: 647126 - DNA, 25 bp, Rattus norvegicus
tgtctcctccactcagaaattcata

SEQ ID NO: 647127 - DNA, 25 bp, Rattus norvegicus
tgtctcctccagactggagcggata

SEQ ID NO: 647128 - DNA, 25 bp, Rattus norvegicus
tgtctcctccagagaaaccagatca

SEQ ID NO: 647129 - DNA, 25 bp, Rattus norvegicus
tgtctcctccagtctggagcggata

SEQ ID NO: 647130 - DNA, 25 bp, Rattus norvegicus
tgtctcctccagtgaaaccagatca

SEQ ID NO: 647131 - DNA, 25 bp, Rattus norvegicus
tgtctcctcccaaacgaacggttgg

SEQ ID NO: 647132 - DNA, 25 bp, Rattus norvegicus
tgtctcctcccatacgaacggttgg

SEQ ID NO: 647133 - DNA, 25 bp, Rattus norvegicus
tgtctcctctctacagtaggctact

SEQ ID NO: 647134 - DNA, 25 bp, Rattus norvegicus
tgtctcctctcttcagtaggctact

SEQ ID NO: 647135 - DNA, 25 bp, Rattus norvegicus
tgtctcctctgaactttgacttgat

SEQ ID NO: 647136 - DNA, 25 bp, Rattus norvegicus
tgtctcctctgatctttgacttgat

SEQ ID NO: 647137 - DNA, 25 bp, Rattus norvegicus
tgtctcctctgtaggtttgtgaagt

SEQ ID NO: 647138 - DNA, 25 bp, Rattus norvegicus
tgtctcctctgtatacatggctgtc

SEQ ID NO: 647139 - DNA, 25 bp, Rattus norvegicus
tgtctcctctgttggtttgtgaagt

SEQ ID NO: 647140 - DNA, 25 bp, Rattus norvegicus
tgtctcctctgtttacatggctgtc

SEQ ID NO: 647141 - DNA, 25 bp, Rattus norvegicus
tgtctcctgagacgccgtcgatggt

SEQ ID NO: 647142 - DNA, 25 bp, Rattus norvegicus
tgtctcctgagaggccgtcgatggt

SEQ ID NO: 647143 - DNA, 25 bp, Rattus norvegicus
tgtctcctgcatcggacacatgttg

SEQ ID NO: 647144 - DNA, 25 bp, Rattus norvegicus
tgtctcctgcatgggacacatgttg

SEQ ID NO: 647145 - DNA, 25 bp, Rattus norvegicus
tgtctcctgcgtctcccagatgaaa

SEQ ID NO: 647146 - DNA, 25 bp, Rattus norvegicus
tgtctcctgcgtgtcccagatgaaa

SEQ ID NO: 647147 - DNA, 25 bp, Rattus norvegicus
tgtctcctggataattaaatattca

SEQ ID NO: 647148 - DNA, 25 bp, Rattus norvegicus
tgtctcctggattattaaatattca

SEQ ID NO: 647149 - DNA, 25 bp, Rattus norvegicus
tgtctcctgtgcactgaaggcatca

SEQ ID NO: 647150 - DNA, 25 bp, Rattus norvegicus
tgtctcctgtgcagtacctaataaa

SEQ ID NO: 647151 - DNA, 25 bp, Rattus norvegicus
tgtctcctgtgctctgaaggcatca

SEQ ID NO: 647152 - DNA, 25 bp, Rattus norvegicus
tgtctcctgtgctgtacctaataaa

SEQ ID NO: 647153 - DNA, 25 bp, Rattus norvegicus
tgtctcctgtttcagcactcagagt

SEQ ID NO: 647154 - DNA, 25 bp, Rattus norvegicus
tgtctcctgtttgagcactcagagt

SEQ ID NO: 647155 - DNA, 25 bp, Rattus norvegicus
tgtctccttccaaggatttctgtaa

SEQ ID NO: 647156 - DNA, 25 bp, Rattus norvegicus
tgtctccttccatggatttctgtaa

SEQ ID NO: 647157 - DNA, 25 bp, Rattus norvegicus
tgtctcctttgcacggtaaattcag

SEQ ID NO: 647158 - DNA, 25 bp, Rattus norvegicus
tgtctcctttgctcggtaaattcag

SEQ ID NO: 647159 - DNA, 25 bp, Rattus norvegicus
tgtctcgcagcgctgtctatctggg

SEQ ID NO: 647160 - DNA, 25 bp, Rattus norvegicus
tgtctcgcagcggtgtctatctggg

SEQ ID NO: 647161 - DNA, 25 bp, Rattus norvegicus
tgtctcgcagttcccggttaagcca

SEQ ID NO: 647162 - DNA, 25 bp, Rattus norvegicus
tgtctcgcagttgccggttaagcca

SEQ ID NO: 647163 - DNA, 25 bp, Rattus norvegicus
tgtctcgccctcattggttgaggaa

SEQ ID NO: 647164 - DNA, 25 bp, Rattus norvegicus
tgtctcgccctctttggttgaggaa

SEQ ID NO: 647165 - DNA, 25 bp, Rattus norvegicus
tgtctcgctgaccattcgacgtgta

SEQ ID NO: 647166 - DNA, 25 bp, Rattus norvegicus
tgtctcgctgacgattcgacgtgta

SEQ ID NO: 647167 - DNA, 25 bp, Rattus norvegicus
tgtctcgctttgagcaggtcaccaa

SEQ ID NO: 647168 - DNA, 25 bp, Rattus norvegicus
tgtctcgctttgtgcaggtcaccaa

SEQ ID NO: 647169 - DNA, 25 bp, Rattus norvegicus
tgtctcggaccaagcggcagctgga

SEQ ID NO: 647170 - DNA, 25 bp, Rattus norvegicus
tgtctcggaccatgcggcagctgga

SEQ ID NO: 647171 - DNA, 25 bp, Rattus norvegicus
tgtctcgtatgcaaactaagtctct

SEQ ID NO: 647172 - DNA, 25 bp, Rattus norvegicus
tgtctcgtatgctaactaagtctct

SEQ ID NO: 647173 - DNA, 25 bp, Rattus norvegicus
tgtctcgtccttccataatttcttt

SEQ ID NO: 647174 - DNA, 25 bp, Rattus norvegicus
tgtctcgtccttgcataatttcttt

SEQ ID NO: 647175 - DNA, 25 bp, Rattus norvegicus
tgtctcgtcttacttcacatcgggt

SEQ ID NO: 647176 - DNA, 25 bp, Rattus norvegicus
tgtctcgtcttagttcacatcgggt

SEQ ID NO: 647177 - DNA, 25 bp, Rattus norvegicus
tgtctcgtgactaagcagcattgca

SEQ ID NO: 647178 - DNA, 25 bp, Rattus norvegicus
tgtctcgtgacttagcagcattgca

SEQ ID NO: 647179 - DNA, 25 bp, Rattus norvegicus
tgtctcgttctgctttttcaatgaa

SEQ ID NO: 647180 - DNA, 25 bp, Rattus norvegicus
tgtctcgttctggtttttcaatgaa

SEQ ID NO: 647181 - DNA, 25 bp, Rattus norvegicus
tgtctctaacagcttctgcttgaag

SEQ ID NO: 647182 - DNA, 25 bp, Rattus norvegicus
tgtctctaacaggttctgcttgaag

SEQ ID NO: 647183 - DNA, 25 bp, Rattus norvegicus
tgtctctaagcaactctggtttgtt

SEQ ID NO: 647184 - DNA, 25 bp, Rattus norvegicus
tgtctctaagcatctctggtttgtt

SEQ ID NO: 647185 - DNA, 25 bp, Rattus norvegicus
tgtctctacaccattaaccatcttg

SEQ ID NO: 647186 - DNA, 25 bp, Rattus norvegicus
tgtctctacacctttaaccatcttg

SEQ ID NO: 647187 - DNA, 25 bp, Rattus norvegicus
tgtctctacccactgagtgctagga

SEQ ID NO: 647188 - DNA, 25 bp, Rattus norvegicus
tgtctctacccagtgagtgctagga

SEQ ID NO: 647189 - DNA, 25 bp, Rattus norvegicus
tgtctctagaaactagcaccttgcc

SEQ ID NO: 647190 - DNA, 25 bp, Rattus norvegicus
tgtctctagaaagtagcaccttgcc

SEQ ID NO: 647191 - DNA, 25 bp, Rattus norvegicus
tgtctctagatcacatagctcactg

SEQ ID NO: 647192 - DNA, 25 bp, Rattus norvegicus
tgtctctagatctcatagctcactg

SEQ ID NO: 647193 - DNA, 25 bp, Rattus norvegicus
tgtctctaggagctgtgtggtttct

SEQ ID NO: 647194 - DNA, 25 bp, Rattus norvegicus
tgtctctaggaggtgtgtggtttct

SEQ ID NO: 647195 - DNA, 25 bp, Rattus norvegicus
tgtctctatagcactatgtcacctc

SEQ ID NO: 647196 - DNA, 25 bp, Rattus norvegicus
tgtctctatagctctatgtcacctc

SEQ ID NO: 647197 - DNA, 25 bp, Rattus norvegicus
tgtctctcaaagatgtccagccaga

SEQ ID NO: 647198 - DNA, 25 bp, Rattus norvegicus
tgtctctcaaagttgtccagccaga

SEQ ID NO: 647199 - DNA, 25 bp, Rattus norvegicus
tgtctctcaacgctgttcggtttaa

SEQ ID NO: 647200 - DNA, 25 bp, Rattus norvegicus
tgtctctcaacggtgttcggtttaa

SEQ ID NO: 647201 - DNA, 25 bp, Rattus norvegicus
tgtctctcagacacccttacaaact

SEQ ID NO: 647202 - DNA, 25 bp, Rattus norvegicus
tgtctctcagactcccttacaaact

SEQ ID NO: 647203 - DNA, 25 bp, Rattus norvegicus
tgtctctcagatccaggcttcctgc

SEQ ID NO: 647204 - DNA, 25 bp, Rattus norvegicus
tgtctctcagatgcaggcttcctgc

SEQ ID NO: 647205 - DNA, 25 bp, Rattus norvegicus
tgtctctcattcatgtgcagtgata

SEQ ID NO: 647206 - DNA, 25 bp, Rattus norvegicus
tgtctctcattcttgtgcagtgata

SEQ ID NO: 647207 - DNA, 25 bp, Rattus norvegicus
tgtctctccatcagggcagtgcaga

SEQ ID NO: 647208 - DNA, 25 bp, Rattus norvegicus
tgtctctccatctgggcagtgcaga

SEQ ID NO: 647209 - DNA, 25 bp, Rattus norvegicus
tgtctctcctagaggccaatggaat

SEQ ID NO: 647210 - DNA, 25 bp, Rattus norvegicus
tgtctctcctagtggccaatggaat

SEQ ID NO: 647211 - DNA, 25 bp, Rattus norvegicus
tgtctctcctctaaatatatgcctg

SEQ ID NO: 647212 - DNA, 25 bp, Rattus norvegicus
tgtctctcctcttaatatatgcctg

SEQ ID NO: 647213 - DNA, 25 bp, Rattus norvegicus
tgtctctcctgcatcataggccaaa

SEQ ID NO: 647214 - DNA, 25 bp, Rattus norvegicus
tgtctctcctgcttcataggccaaa

SEQ ID NO: 647215 - DNA, 25 bp, Rattus norvegicus
tgtctctccttcagcaaggctataa

SEQ ID NO: 647216 - DNA, 25 bp, Rattus norvegicus
tgtctctccttctgcaaggctataa

SEQ ID NO: 647217 - DNA, 25 bp, Rattus norvegicus
tgtctctcctttaagcagtcacttc

SEQ ID NO: 647218 - DNA, 25 bp, Rattus norvegicus
tgtctctccttttagcagtcacttc

SEQ ID NO: 647219 - DNA, 25 bp, Rattus norvegicus
tgtctctcgaaacacatactcgttc

SEQ ID NO: 647220 - DNA, 25 bp, Rattus norvegicus
tgtctctcgaaagacatactcgttc

SEQ ID NO: 647221 - DNA, 25 bp, Rattus norvegicus
tgtctctcgagtatgtgtctggtaa

SEQ ID NO: 647222 - DNA, 25 bp, Rattus norvegicus
tgtctctcgagtttgtgtctggtaa

SEQ ID NO: 647223 - DNA, 25 bp, Rattus norvegicus
tgtctctctgggacactggattgcc

SEQ ID NO: 647224 - DNA, 25 bp, Rattus norvegicus
tgtctctctgggtcactggattgcc

SEQ ID NO: 647225 - DNA, 25 bp, Rattus norvegicus
tgtctctctgtcattatatctgcct

SEQ ID NO: 647226 - DNA, 25 bp, Rattus norvegicus
tgtctctctgtctttatatctgcct

SEQ ID NO: 647227 - DNA, 25 bp, Rattus norvegicus
tgtctctgacacaattctccatgta

SEQ ID NO: 647228 - DNA, 25 bp, Rattus norvegicus
tgtctctgacactattctccatgta

SEQ ID NO: 647229 - DNA, 25 bp, Rattus norvegicus
tgtctctgactccaactctggaatc

SEQ ID NO: 647230 - DNA, 25 bp, Rattus norvegicus
tgtctctgactcgaactctggaatc

SEQ ID NO: 647231 - DNA, 25 bp, Rattus norvegicus
tgtctctgactgagcggtgatcaca

SEQ ID NO: 647232 - DNA, 25 bp, Rattus norvegicus
tgtctctgactgtgcggtgatcaca

SEQ ID NO: 647233 - DNA, 25 bp, Rattus norvegicus
tgtctctgagccacggatctgataa

SEQ ID NO: 647234 - DNA, 25 bp, Rattus norvegicus
tgtctctgagcctcggatctgataa

SEQ ID NO: 647235 - DNA, 25 bp, Rattus norvegicus
tgtctctgaggaagtctgctctctt

SEQ ID NO: 647236 - DNA, 25 bp, Rattus norvegicus
tgtctctgaggatgtctgctctctt

SEQ ID NO: 647237 - DNA, 25 bp, Rattus norvegicus
tgtctctgatgcagcttatacgaag

SEQ ID NO: 647238 - DNA, 25 bp, Rattus norvegicus
tgtctctgatgctgcttatacgaag

SEQ ID NO: 647239 - DNA, 25 bp, Rattus norvegicus
tgtctctgcagaacaattaccctct

SEQ ID NO: 647240 - DNA, 25 bp, Rattus norvegicus
tgtctctgcagatcaattaccctct

SEQ ID NO: 647241 - DNA, 25 bp, Rattus norvegicus
tgtctctgcatccagagcactggga

SEQ ID NO: 647242 - DNA, 25 bp, Rattus norvegicus
tgtctctgcatcgagagcactggga

SEQ ID NO: 647243 - DNA, 25 bp, Rattus norvegicus
tgtctctgccgtcgctttcggaaaa

SEQ ID NO: 647244 - DNA, 25 bp, Rattus norvegicus
tgtctctgccgtggctttcggaaaa

SEQ ID NO: 647245 - DNA, 25 bp, Rattus norvegicus
tgtctctgcgctctgggcctcgact

SEQ ID NO: 647246 - DNA, 25 bp, Rattus norvegicus
tgtctctgcgctgtgggcctcgact

SEQ ID NO: 647247 - DNA, 25 bp, Rattus norvegicus
tgtctctgctgtcctggctctgatg

SEQ ID NO: 647248 - DNA, 25 bp, Rattus norvegicus
tgtctctgctgtgctggctctgatg

SEQ ID NO: 647249 - DNA, 25 bp, Rattus norvegicus
tgtctctgcttcctctgttaggact

SEQ ID NO: 647250 - DNA, 25 bp, Rattus norvegicus
tgtctctgcttcgtctgttaggact

SEQ ID NO: 647251 - DNA, 25 bp, Rattus norvegicus
tgtctctgcttgcaacccacaggga

SEQ ID NO: 647252 - DNA, 25 bp, Rattus norvegicus
tgtctctgcttggaacccacaggga

SEQ ID NO: 647253 - DNA, 25 bp, Rattus norvegicus
tgtctctggccaccttgctattaaa

SEQ ID NO: 647254 - DNA, 25 bp, Rattus norvegicus
tgtctctggccagcttgctattaaa

SEQ ID NO: 647255 - DNA, 25 bp, Rattus norvegicus
tgtctctggtgaccaagtctttaga

SEQ ID NO: 647256 - DNA, 25 bp, Rattus norvegicus
tgtctctggtgagcaagtctttaga

SEQ ID NO: 647257 - DNA, 25 bp, Rattus norvegicus
tgtctctgtacgcacagctcaagtt

SEQ ID NO: 647258 - DNA, 25 bp, Rattus norvegicus
tgtctctgtacggacagctcaagtt

SEQ ID NO: 647259 - DNA, 25 bp, Rattus norvegicus
tgtctctgtagccatgtgtcagcct

SEQ ID NO: 647260 - DNA, 25 bp, Rattus norvegicus
tgtctctgtagcgatgtgtcagcct

SEQ ID NO: 647261 - DNA, 25 bp, Rattus norvegicus
tgtctctgtctaaatgctctaaagt

SEQ ID NO: 647262 - DNA, 25 bp, Rattus norvegicus
tgtctctgtctatatgctctaaagt

SEQ ID NO: 647263 - DNA, 25 bp, Rattus norvegicus
tgtctctgtgacattgatgccccat

SEQ ID NO: 647264 - DNA, 25 bp, Rattus norvegicus
tgtctctgtgactttgatgccccat

SEQ ID NO: 647265 - DNA, 25 bp, Rattus norvegicus
tgtctctgttcacccatgtgtgcaa

SEQ ID NO: 647266 - DNA, 25 bp, Rattus norvegicus
tgtctctgttcagccatgtgtgcaa

SEQ ID NO: 647267 - DNA, 25 bp, Rattus norvegicus
tgtctcttacttaacctttatcctg

SEQ ID NO: 647268 - DNA, 25 bp, Rattus norvegicus
tgtctcttacttagctcttggtcca

SEQ ID NO: 647269 - DNA, 25 bp, Rattus norvegicus
tgtctcttactttacctttatcctg

SEQ ID NO: 647270 - DNA, 25 bp, Rattus norvegicus
tgtctcttactttgctcttggtcca

SEQ ID NO: 647271 - DNA, 25 bp, Rattus norvegicus
tgtctcttagctcccttggttccag

SEQ ID NO: 647272 - DNA, 25 bp, Rattus norvegicus
tgtctcttagctgccttggttccag

SEQ ID NO: 647273 - DNA, 25 bp, Rattus norvegicus
tgtctcttatcaagctcgtggaggt

SEQ ID NO: 647274 - DNA, 25 bp, Rattus norvegicus
tgtctcttatcatgctcgtggaggt

SEQ ID NO: 647275 - DNA, 25 bp, Rattus norvegicus
tgtctcttattccaaagcagcaggg

SEQ ID NO: 647276 - DNA, 25 bp, Rattus norvegicus
tgtctcttattcgaaagcagcaggg

SEQ ID NO: 647277 - DNA, 25 bp, Rattus norvegicus
tgtctcttatttcctgccctttgtc

SEQ ID NO: 647278 - DNA, 25 bp, Rattus norvegicus
tgtctcttatttgctgccctttgtc

SEQ ID NO: 647279 - DNA, 25 bp, Rattus norvegicus
tgtctcttcacacactgaattctgg

SEQ ID NO: 647280 - DNA, 25 bp, Rattus norvegicus
tgtctcttcacagactgaattctgg

SEQ ID NO: 647281 - DNA, 25 bp, Rattus norvegicus
tgtctcttcatcatgtagcgatggt

SEQ ID NO: 647282 - DNA, 25 bp, Rattus norvegicus
tgtctcttcatcttgtagcgatggt

SEQ ID NO: 647283 - DNA, 25 bp, Rattus norvegicus
tgtctcttcttgacacaggcgagaa

SEQ ID NO: 647284 - DNA, 25 bp, Rattus norvegicus
tgtctcttcttgtcacaggcgagaa

SEQ ID NO: 647285 - DNA, 25 bp, Rattus norvegicus
tgtctcttgatgctagagcacttgc

SEQ ID NO: 647286 - DNA, 25 bp, Rattus norvegicus
tgtctcttgatggtagagcacttgc

SEQ ID NO: 647287 - DNA, 25 bp, Rattus norvegicus
tgtctcttgcaccttctccttggag

SEQ ID NO: 647288 - DNA, 25 bp, Rattus norvegicus
tgtctcttgcacgttctccttggag

SEQ ID NO: 647289 - DNA, 25 bp, Rattus norvegicus
tgtctcttgtccactagtagtctaa

SEQ ID NO: 647290 - DNA, 25 bp, Rattus norvegicus
tgtctcttgtcctctagtagtctaa

SEQ ID NO: 647291 - DNA, 25 bp, Rattus norvegicus
tgtctcttgttcatgtaccgattct

SEQ ID NO: 647292 - DNA, 25 bp, Rattus norvegicus
tgtctcttgttcttgtaccgattct

SEQ ID NO: 647293 - DNA, 25 bp, Rattus norvegicus
tgtctcttgtttaccggaggtcata

SEQ ID NO: 647294 - DNA, 25 bp, Rattus norvegicus
tgtctcttgttttccggaggtcata

SEQ ID NO: 647295 - DNA, 25 bp, Rattus norvegicus
tgtctctttcctacctaacattaaa

SEQ ID NO: 647296 - DNA, 25 bp, Rattus norvegicus
tgtctctttccttcctaacattaaa

SEQ ID NO: 647297 - DNA, 25 bp, Rattus norvegicus
tgtctctttcttcctactccttctt

SEQ ID NO: 647298 - DNA, 25 bp, Rattus norvegicus
tgtctctttcttgctactccttctt

SEQ ID NO: 647299 - DNA, 25 bp, Rattus norvegicus
tgtctctttgtcattgtagccccat

SEQ ID NO: 647300 - DNA, 25 bp, Rattus norvegicus
tgtctctttgtctttgtagccccat

SEQ ID NO: 647301 - DNA, 25 bp, Rattus norvegicus
tgtctcttttctctcgcattttaaa

SEQ ID NO: 647302 - DNA, 25 bp, Rattus norvegicus
tgtctcttttctgtcgcattttaaa

SEQ ID NO: 647303 - DNA, 25 bp, Rattus norvegicus
tgtctgaaagatcaggtggccctgt

SEQ ID NO: 647304 - DNA, 25 bp, Rattus norvegicus
tgtctgaaagatgaggtggccctgt

SEQ ID NO: 647305 - DNA, 25 bp, Rattus norvegicus
tgtctgaagacaccaagcgtcactt

SEQ ID NO: 647306 - DNA, 25 bp, Rattus norvegicus
tgtctgaagacagcaagcgtcactt

SEQ ID NO: 647307 - DNA, 25 bp, Rattus norvegicus
tgtctgaatggtcctgcctcctttc

SEQ ID NO: 647308 - DNA, 25 bp, Rattus norvegicus
tgtctgaatggtgctgcctcctttc

SEQ ID NO: 647309 - DNA, 25 bp, Rattus norvegicus
tgtctgaccaagagtctgggacctt

SEQ ID NO: 647310 - DNA, 25 bp, Rattus norvegicus
tgtctgaccaagtgtctgggacctt

SEQ ID NO: 647311 - DNA, 25 bp, Rattus norvegicus
tgtctgaccctcagtcaactcaaac

SEQ ID NO: 647312 - DNA, 25 bp, Rattus norvegicus
tgtctgaccctctgtcaactcaaac

SEQ ID NO: 647313 - DNA, 25 bp, Rattus norvegicus
tgtctgacctctacatctttgataa

SEQ ID NO: 647314 - DNA, 25 bp, Rattus norvegicus
tgtctgacctcttcatctttgataa

SEQ ID NO: 647315 - DNA, 25 bp, Rattus norvegicus
tgtctgaccttgcactcttcctgaa

SEQ ID NO: 647316 - DNA, 25 bp, Rattus norvegicus
tgtctgaccttggactcttcctgaa

SEQ ID NO: 647317 - DNA, 25 bp, Rattus norvegicus
tgtctgactgtacctccgagggatc

SEQ ID NO: 647318 - DNA, 25 bp, Rattus norvegicus
tgtctgactgtacgtggactctcaa

SEQ ID NO: 647319 - DNA, 25 bp, Rattus norvegicus
tgtctgactgtagctccgagggatc

SEQ ID NO: 647320 - DNA, 25 bp, Rattus norvegicus
tgtctgactgtaggtggactctcaa

SEQ ID NO: 647321 - DNA, 25 bp, Rattus norvegicus
tgtctgagaaccaccacagtatctg

SEQ ID NO: 647322 - DNA, 25 bp, Rattus norvegicus
tgtctgagaacctccacagtatctg

SEQ ID NO: 647323 - DNA, 25 bp, Rattus norvegicus
tgtctgagacatcattatcttccag

SEQ ID NO: 647324 - DNA, 25 bp, Rattus norvegicus
tgtctgagacatgattatcttccag

SEQ ID NO: 647325 - DNA, 25 bp, Rattus norvegicus
tgtctgagcaggagcagccgatcca

SEQ ID NO: 647326 - DNA, 25 bp, Rattus norvegicus
tgtctgagcaggtgcagccgatcca

SEQ ID NO: 647327 - DNA, 25 bp, Rattus norvegicus
tgtctgagccacctgaagaaaaggt

SEQ ID NO: 647328 - DNA, 25 bp, Rattus norvegicus
tgtctgagccacgtgaagaaaaggt

SEQ ID NO: 647329 - DNA, 25 bp, Rattus norvegicus
tgtctgagccccacactctgagatg

SEQ ID NO: 647330 - DNA, 25 bp, Rattus norvegicus
tgtctgagcccctcactctgagatg

SEQ ID NO: 647331 - DNA, 25 bp, Rattus norvegicus
tgtctgagctggacaagtccttgca

SEQ ID NO: 647332 - DNA, 25 bp, Rattus norvegicus
tgtctgagctggtcaagtccttgca

SEQ ID NO: 647333 - DNA, 25 bp, Rattus norvegicus
tgtctgaggctgcactaacctctga

SEQ ID NO: 647334 - DNA, 25 bp, Rattus norvegicus
tgtctgaggctggactaacctctga

SEQ ID NO: 647335 - DNA, 25 bp, Rattus norvegicus
tgtctgagtctcaaggtggtttccc

SEQ ID NO: 647336 - DNA, 25 bp, Rattus norvegicus
tgtctgagtctctaggtggtttccc

SEQ ID NO: 647337 - DNA, 25 bp, Rattus norvegicus
tgtctgagtcttccgtacctgttag

SEQ ID NO: 647338 - DNA, 25 bp, Rattus norvegicus
tgtctgagtcttgcgtacctgttag

SEQ ID NO: 647339 - DNA, 25 bp, Rattus norvegicus
tgtctgatcagaagaagggcctcct

SEQ ID NO: 647340 - DNA, 25 bp, Rattus norvegicus
tgtctgatcagatgaagggcctcct

SEQ ID NO: 647341 - DNA, 25 bp, Rattus norvegicus
tgtctgatctgtcctgtcacggtga

SEQ ID NO: 647342 - DNA, 25 bp, Rattus norvegicus
tgtctgatctgtgctgtcacggtga

SEQ ID NO: 647343 - DNA, 25 bp, Rattus norvegicus
tgtctgatgaccagtgtatctgtcc

SEQ ID NO: 647344 - DNA, 25 bp, Rattus norvegicus
tgtctgatgacctgtgtatctgtcc

SEQ ID NO: 647345 - DNA, 25 bp, Rattus norvegicus
tgtctgatgcacaggctgagctgaa

SEQ ID NO: 647346 - DNA, 25 bp, Rattus norvegicus
tgtctgatgcactggctgagctgaa

SEQ ID NO: 647347 - DNA, 25 bp, Rattus norvegicus
tgtctgatgtccctgagtcttccgt

SEQ ID NO: 647348 - DNA, 25 bp, Rattus norvegicus
tgtctgatgtccgtgagtcttccgt

SEQ ID NO: 647349 - DNA, 25 bp, Rattus norvegicus
tgtctgcaaagacccgaggcggcaa

SEQ ID NO: 647350 - DNA, 25 bp, Rattus norvegicus
tgtctgcaaagagccgaggcggcaa

SEQ ID NO: 647351 - DNA, 25 bp, Rattus norvegicus
tgtctgcacctcctaatgctgggat

SEQ ID NO: 647352 - DNA, 25 bp, Rattus norvegicus
tgtctgcacctcgtaatgctgggat

SEQ ID NO: 647353 - DNA, 25 bp, Rattus norvegicus
tgtctgcactgcatatcagctcctg

SEQ ID NO: 647354 - DNA, 25 bp, Rattus norvegicus
tgtctgcactgcttatcagctcctg

SEQ ID NO: 647355 - DNA, 25 bp, Rattus norvegicus
tgtctgcagaaaccccatcatgtaa

SEQ ID NO: 647356 - DNA, 25 bp, Rattus norvegicus
tgtctgcagaaagcccatcatgtaa

SEQ ID NO: 647357 - DNA, 25 bp, Rattus norvegicus
tgtctgcagccaacatgtccatagc

SEQ ID NO: 647358 - DNA, 25 bp, Rattus norvegicus
tgtctgcagccatcatgtccatagc

SEQ ID NO: 647359 - DNA, 25 bp, Rattus norvegicus
tgtctgcagccccttggaggagtca

SEQ ID NO: 647360 - DNA, 25 bp, Rattus norvegicus
tgtctgcagcccgttggaggagtca

SEQ ID NO: 647361 - DNA, 25 bp, Rattus norvegicus
tgtctgcagggaagcggcctccaca

SEQ ID NO: 647362 - DNA, 25 bp, Rattus norvegicus
tgtctgcagggatgcggcctccaca

SEQ ID NO: 647363 - DNA, 25 bp, Rattus norvegicus
tgtctgcagggcatggagtcactca

SEQ ID NO: 647364 - DNA, 25 bp, Rattus norvegicus
tgtctgcagggcttggagtcactca

SEQ ID NO: 647365 - DNA, 25 bp, Rattus norvegicus
tgtctgcagtgtcctggaattcctc

SEQ ID NO: 647366 - DNA, 25 bp, Rattus norvegicus
tgtctgcagtgtgctggaattcctc

SEQ ID NO: 647367 - DNA, 25 bp, Rattus norvegicus
tgtctgcatgggaatctgcacacca

SEQ ID NO: 647368 - DNA, 25 bp, Rattus norvegicus
tgtctgcatgggtatctgcacacca

SEQ ID NO: 647369 - DNA, 25 bp, Rattus norvegicus
tgtctgcatttgattctgagtctat

SEQ ID NO: 647370 - DNA, 25 bp, Rattus norvegicus
tgtctgcatttgtttctgagtctat

SEQ ID NO: 647371 - DNA, 25 bp, Rattus norvegicus
tgtctgccagcaagtgcttgtcaag

SEQ ID NO: 647372 - DNA, 25 bp, Rattus norvegicus
tgtctgccagcatgtgcttgtcaag

SEQ ID NO: 647373 - DNA, 25 bp, Rattus norvegicus
tgtctgcccagacagctcatgagct

SEQ ID NO: 647374 - DNA, 25 bp, Rattus norvegicus
tgtctgcccagagagctcatgagct

SEQ ID NO: 647375 - DNA, 25 bp, Rattus norvegicus
tgtctgccccgaagctggtcagcaa

SEQ ID NO: 647376 - DNA, 25 bp, Rattus norvegicus
tgtctgccccgatgctggtcagcaa

SEQ ID NO: 647377 - DNA, 25 bp, Rattus norvegicus
tgtctgcccctgaaggtgcatcatg

SEQ ID NO: 647378 - DNA, 25 bp, Rattus norvegicus
tgtctgcccctgtaggtgcatcatg

SEQ ID NO: 647379 - DNA, 25 bp, Rattus norvegicus
tgtctgccctgacctatccatgcta

SEQ ID NO: 647380 - DNA, 25 bp, Rattus norvegicus
tgtctgccctgagctatccatgcta

SEQ ID NO: 647381 - DNA, 25 bp, Rattus norvegicus
tgtctgccgctactatgaccatgat

SEQ ID NO: 647382 - DNA, 25 bp, Rattus norvegicus
tgtctgccgctagtatgaccatgat

SEQ ID NO: 647383 - DNA, 25 bp, Rattus norvegicus
tgtctgcctatgctaaacatccctg

SEQ ID NO: 647384 - DNA, 25 bp, Rattus norvegicus
tgtctgcctatggtaaacatccctg

SEQ ID NO: 647385 - DNA, 25 bp, Rattus norvegicus
tgtctgcctgtcagacacaaggtct

SEQ ID NO: 647386 - DNA, 25 bp, Rattus norvegicus
tgtctgcctgtctgacacaaggtct

SEQ ID NO: 647387 - DNA, 25 bp, Rattus norvegicus
tgtctgccttccagtggtaaagctg

SEQ ID NO: 647388 - DNA, 25 bp, Rattus norvegicus
tgtctgccttcctgtggtaaagctg

SEQ ID NO: 647389 - DNA, 25 bp, Rattus norvegicus
tgtctgccttgacgaagctgtgtca

SEQ ID NO: 647390 - DNA, 25 bp, Rattus norvegicus
tgtctgccttgaggaagctgtgtca

SEQ ID NO: 647391 - DNA, 25 bp, Rattus norvegicus
tgtctgcgatgtctctgtctaaagc

SEQ ID NO: 647392 - DNA, 25 bp, Rattus norvegicus
tgtctgcgatgtgtctgtctaaagc

SEQ ID NO: 647393 - DNA, 25 bp, Rattus norvegicus
tgtctgcgcctcatacaaagtgatg

SEQ ID NO: 647394 - DNA, 25 bp, Rattus norvegicus
tgtctgcgcctcttacaaagtgatg

SEQ ID NO: 647395 - DNA, 25 bp, Rattus norvegicus
tgtctgctatagaaatccatggtgt

SEQ ID NO: 647396 - DNA, 25 bp, Rattus norvegicus
tgtctgctatagtaatccatggtgt

SEQ ID NO: 647397 - DNA, 25 bp, Rattus norvegicus
tgtctgctcacacgtgcacaggtga

SEQ ID NO: 647398 - DNA, 25 bp, Rattus norvegicus
tgtctgctcacaggtgcacaggtga

SEQ ID NO: 647399 - DNA, 25 bp, Rattus norvegicus
tgtctgctcagtacgtggcccaaca

SEQ ID NO: 647400 - DNA, 25 bp, Rattus norvegicus
tgtctgctcagttcgtggcccaaca

SEQ ID NO: 647401 - DNA, 25 bp, Rattus norvegicus
tgtctgctccatcccttgaaataaa

SEQ ID NO: 647402 - DNA, 25 bp, Rattus norvegicus
tgtctgctccatgccttgaaataaa

SEQ ID NO: 647403 - DNA, 25 bp, Rattus norvegicus
tgtctgctccccagaataaatcctt

SEQ ID NO: 647404 - DNA, 25 bp, Rattus norvegicus
tgtctgctcccctgaataaatcctt

SEQ ID NO: 647405 - DNA, 25 bp, Rattus norvegicus
tgtctgctctccagctgacccaggt

SEQ ID NO: 647406 - DNA, 25 bp, Rattus norvegicus
tgtctgctctcctgctgacccaggt

SEQ ID NO: 647407 - DNA, 25 bp, Rattus norvegicus
tgtctgctcttgcacaagacccaga

SEQ ID NO: 647408 - DNA, 25 bp, Rattus norvegicus
tgtctgctcttggacaagacccaga

SEQ ID NO: 647409 - DNA, 25 bp, Rattus norvegicus
tgtctgctgaacaggtcagagtcta

SEQ ID NO: 647410 - DNA, 25 bp, Rattus norvegicus
tgtctgctgaactggtcagagtcta

SEQ ID NO: 647411 - DNA, 25 bp, Rattus norvegicus
tgtctgctgcaaatgatcctgaatc

SEQ ID NO: 647412 - DNA, 25 bp, Rattus norvegicus
tgtctgctgcaattgatcctgaatc

SEQ ID NO: 647413 - DNA, 25 bp, Rattus norvegicus
tgtctgctgcccaggtgctaaatgg

SEQ ID NO: 647414 - DNA, 25 bp, Rattus norvegicus
tgtctgctgccctggtgctaaatgg

SEQ ID NO: 647415 - DNA, 25 bp, Rattus norvegicus
tgtctgctgctgaaagggctgctac

SEQ ID NO: 647416 - DNA, 25 bp, Rattus norvegicus
tgtctgctgctgaatatgccaggtt

SEQ ID NO: 647417 - DNA, 25 bp, Rattus norvegicus
tgtctgctgctgagagtctcctgga

SEQ ID NO: 647418 - DNA, 25 bp, Rattus norvegicus
tgtctgctgctgtaagggctgctac

SEQ ID NO: 647419 - DNA, 25 bp, Rattus norvegicus
tgtctgctgctgtatatgccaggtt

SEQ ID NO: 647420 - DNA, 25 bp, Rattus norvegicus
tgtctgctgctgtgagtctcctgga

SEQ ID NO: 647421 - DNA, 25 bp, Rattus norvegicus
tgtctgctgcttcggctgcggatct

SEQ ID NO: 647422 - DNA, 25 bp, Rattus norvegicus
tgtctgctgcttgggctgcggatct

SEQ ID NO: 647423 - DNA, 25 bp, Rattus norvegicus
tgtctgcttacaacactgggagatg

SEQ ID NO: 647424 - DNA, 25 bp, Rattus norvegicus
tgtctgcttacatcactgggagatg

SEQ ID NO: 647425 - DNA, 25 bp, Rattus norvegicus
tgtctgcttctcacaatgatgctgt

SEQ ID NO: 647426 - DNA, 25 bp, Rattus norvegicus
tgtctgcttctctcaatgatgctgt

SEQ ID NO: 647427 - DNA, 25 bp, Rattus norvegicus
tgtctgcttcttacttccatagtca

SEQ ID NO: 647428 - DNA, 25 bp, Rattus norvegicus
tgtctgcttctttcttccatagtca

SEQ ID NO: 647429 - DNA, 25 bp, Rattus norvegicus
tgtctggaaacaccaccaccattgt

SEQ ID NO: 647430 - DNA, 25 bp, Rattus norvegicus
tgtctggaaacagcaccaccattgt

SEQ ID NO: 647431 - DNA, 25 bp, Rattus norvegicus
tgtctggagtgcatactttaggaag

SEQ ID NO: 647432 - DNA, 25 bp, Rattus norvegicus
tgtctggagtgcttactttaggaag

SEQ ID NO: 647433 - DNA, 25 bp, Rattus norvegicus
tgtctggcacccaagcggatctggt

SEQ ID NO: 647434 - DNA, 25 bp, Rattus norvegicus
tgtctggcaccctagcggatctggt

SEQ ID NO: 647435 - DNA, 25 bp, Rattus norvegicus
tgtctggccacaacccctaataaaa

SEQ ID NO: 647436 - DNA, 25 bp, Rattus norvegicus
tgtctggccacatcccctaataaaa

SEQ ID NO: 647437 - DNA, 25 bp, Rattus norvegicus
tgtctggccatcacacactgggagg

SEQ ID NO: 647438 - DNA, 25 bp, Rattus norvegicus
tgtctggccatctcacactgggagg

SEQ ID NO: 647439 - DNA, 25 bp, Rattus norvegicus
tgtctggccttacatcaggatgtcc

SEQ ID NO: 647440 - DNA, 25 bp, Rattus norvegicus
tgtctggccttagatcaggatgtcc

SEQ ID NO: 647441 - DNA, 25 bp, Rattus norvegicus
tgtctggcgcagaagagagaaagct

SEQ ID NO: 647442 - DNA, 25 bp, Rattus norvegicus
tgtctggcgcagtagagagaaagct

SEQ ID NO: 647443 - DNA, 25 bp, Rattus norvegicus
tgtctggctcccagcgacaacaagg

SEQ ID NO: 647444 - DNA, 25 bp, Rattus norvegicus
tgtctggctccctgcgacaacaagg

SEQ ID NO: 647445 - DNA, 25 bp, Rattus norvegicus
tgtctggctctcataatatcaaaat

SEQ ID NO: 647446 - DNA, 25 bp, Rattus norvegicus
tgtctggctctcttaatatcaaaat

SEQ ID NO: 647447 - DNA, 25 bp, Rattus norvegicus
tgtctggctgagatgcaggaacctc

SEQ ID NO: 647448 - DNA, 25 bp, Rattus norvegicus
tgtctggctgagttgcaggaacctc

SEQ ID NO: 647449 - DNA, 25 bp, Rattus norvegicus
tgtctgggaacacccttgctgccta

SEQ ID NO: 647450 - DNA, 25 bp, Rattus norvegicus
tgtctgggaacagccttgctgccta

SEQ ID NO: 647451 - DNA, 25 bp, Rattus norvegicus
tgtctgggcattatcacttctggga

SEQ ID NO: 647452 - DNA, 25 bp, Rattus norvegicus
tgtctgggcattttcacttctggga

SEQ ID NO: 647453 - DNA, 25 bp, Rattus norvegicus
tgtctgggtaaccatcagctgccct

SEQ ID NO: 647454 - DNA, 25 bp, Rattus norvegicus
tgtctgggtaacgatcagctgccct

SEQ ID NO: 647455 - DNA, 25 bp, Rattus norvegicus
tgtctgggtcccagttacaagtcag

SEQ ID NO: 647456 - DNA, 25 bp, Rattus norvegicus
tgtctgggtccctgttacaagtcag

SEQ ID NO: 647457 - DNA, 25 bp, Rattus norvegicus
tgtctgggttagactgttttctgtt

SEQ ID NO: 647458 - DNA, 25 bp, Rattus norvegicus
tgtctgggttagtctgttttctgtt

SEQ ID NO: 647459 - DNA, 25 bp, Rattus norvegicus
tgtctggtctgcacactaggatgtg

SEQ ID NO: 647460 - DNA, 25 bp, Rattus norvegicus
tgtctggtctgctcactaggatgtg

SEQ ID NO: 647461 - DNA, 25 bp, Rattus norvegicus
tgtctggtggatatgccaaagcctc

SEQ ID NO: 647462 - DNA, 25 bp, Rattus norvegicus
tgtctggtggatttgccaaagcctc

SEQ ID NO: 647463 - DNA, 25 bp, Rattus norvegicus
tgtctggttatgatgtctgcacttt

SEQ ID NO: 647464 - DNA, 25 bp, Rattus norvegicus
tgtctggttatgttgtctgcacttt

SEQ ID NO: 647465 - DNA, 25 bp, Rattus norvegicus
tgtctggttggcacaaagatcctgt

SEQ ID NO: 647466 - DNA, 25 bp, Rattus norvegicus
tgtctggttggctcaaagatcctgt

SEQ ID NO: 647467 - DNA, 25 bp, Rattus norvegicus
tgtctggtttttaacattccaagga

SEQ ID NO: 647468 - DNA, 25 bp, Rattus norvegicus
tgtctggttttttacattccaagga

SEQ ID NO: 647469 - DNA, 25 bp, Rattus norvegicus
tgtctgtaaagcaccatgtcctgga

SEQ ID NO: 647470 - DNA, 25 bp, Rattus norvegicus
tgtctgtaaagctccatgtcctgga

SEQ ID NO: 647471 - DNA, 25 bp, Rattus norvegicus
tgtctgtaaattccaggttatccag

SEQ ID NO: 647472 - DNA, 25 bp, Rattus norvegicus
tgtctgtaaattgcaggttatccag

SEQ ID NO: 647473 - DNA, 25 bp, Rattus norvegicus
tgtctgtaacccatctctgggaaaa

SEQ ID NO: 647474 - DNA, 25 bp, Rattus norvegicus
tgtctgtaacccttctctgggaaaa

SEQ ID NO: 647475 - DNA, 25 bp, Rattus norvegicus
tgtctgtaaggaacgctgggctcta

SEQ ID NO: 647476 - DNA, 25 bp, Rattus norvegicus
tgtctgtaaggatcgctgggctcta

SEQ ID NO: 647477 - DNA, 25 bp, Rattus norvegicus
tgtctgtacctcctgtgtatctgaa

SEQ ID NO: 647478 - DNA, 25 bp, Rattus norvegicus
tgtctgtacctcgtgtgtatctgaa

SEQ ID NO: 647479 - DNA, 25 bp, Rattus norvegicus
tgtctgtaccttccagtagtcacct

SEQ ID NO: 647480 - DNA, 25 bp, Rattus norvegicus
tgtctgtaccttgcagtagtcacct

SEQ ID NO: 647481 - DNA, 25 bp, Rattus norvegicus
tgtctgtagagaccggtggcccaca

SEQ ID NO: 647482 - DNA, 25 bp, Rattus norvegicus
tgtctgtagagagcggtggcccaca

SEQ ID NO: 647483 - DNA, 25 bp, Rattus norvegicus
tgtctgtagcaacctggccacaaaa

SEQ ID NO: 647484 - DNA, 25 bp, Rattus norvegicus
tgtctgtagcaagctggccacaaaa

SEQ ID NO: 647485 - DNA, 25 bp, Rattus norvegicus
tgtctgtagcccctgtgtaatatgg

SEQ ID NO: 647486 - DNA, 25 bp, Rattus norvegicus
tgtctgtagcccgtgtgtaatatgg

SEQ ID NO: 647487 - DNA, 25 bp, Rattus norvegicus
tgtctgtaggcgacaaacctgctga

SEQ ID NO: 647488 - DNA, 25 bp, Rattus norvegicus
tgtctgtaggcgtcaaacctgctga

SEQ ID NO: 647489 - DNA, 25 bp, Rattus norvegicus
tgtctgtatagcactcgatgtcctg

SEQ ID NO: 647490 - DNA, 25 bp, Rattus norvegicus
tgtctgtatagctctcgatgtcctg

SEQ ID NO: 647491 - DNA, 25 bp, Rattus norvegicus
tgtctgtatataacctccatgcctg

SEQ ID NO: 647492 - DNA, 25 bp, Rattus norvegicus
tgtctgtatatatcctccatgcctg

SEQ ID NO: 647493 - DNA, 25 bp, Rattus norvegicus
tgtctgtatatgagcccatgcctgt

SEQ ID NO: 647494 - DNA, 25 bp, Rattus norvegicus
tgtctgtatatgtgcccatgcctgt

SEQ ID NO: 647495 - DNA, 25 bp, Rattus norvegicus
tgtctgtatgccattccagctcaat

SEQ ID NO: 647496 - DNA, 25 bp, Rattus norvegicus
tgtctgtatgcctttccagctcaat

SEQ ID NO: 647497 - DNA, 25 bp, Rattus norvegicus
tgtctgtatggtacctgtacctaca

SEQ ID NO: 647498 - DNA, 25 bp, Rattus norvegicus
tgtctgtatggttcctgtacctaca

SEQ ID NO: 647499 - DNA, 25 bp, Rattus norvegicus
tgtctgtattgtaccttcttcatag

SEQ ID NO: 647500 - DNA, 25 bp, Rattus norvegicus
tgtctgtattgttccttcttcatag

SEQ ID NO: 647501 - DNA, 25 bp, Rattus norvegicus
tgtctgtcatgcaccagccgtacat

SEQ ID NO: 647502 - DNA, 25 bp, Rattus norvegicus
tgtctgtcatgctccagccgtacat

SEQ ID NO: 647503 - DNA, 25 bp, Rattus norvegicus
tgtctgtccacacattgcatgcatg

SEQ ID NO: 647504 - DNA, 25 bp, Rattus norvegicus
tgtctgtccacagattgcatgcatg

SEQ ID NO: 647505 - DNA, 25 bp, Rattus norvegicus
tgtctgtccatcatacgtacacaca

SEQ ID NO: 647506 - DNA, 25 bp, Rattus norvegicus
tgtctgtccatcttacgtacacaca

SEQ ID NO: 647507 - DNA, 25 bp, Rattus norvegicus
tgtctgtcccagacatccagcaggt

SEQ ID NO: 647508 - DNA, 25 bp, Rattus norvegicus
tgtctgtcccagtcatccagcaggt

SEQ ID NO: 647509 - DNA, 25 bp, Rattus norvegicus
tgtctgtccctaatgctgttaaacc

SEQ ID NO: 647510 - DNA, 25 bp, Rattus norvegicus
tgtctgtccctattgctgttaaacc

SEQ ID NO: 647511 - DNA, 25 bp, Rattus norvegicus
tgtctgtcccttagctgtcgtctaa

SEQ ID NO: 647512 - DNA, 25 bp, Rattus norvegicus
tgtctgtccctttgctgtcgtctaa

SEQ ID NO: 647513 - DNA, 25 bp, Rattus norvegicus
tgtctgtccgcaacggattgctcta

SEQ ID NO: 647514 - DNA, 25 bp, Rattus norvegicus
tgtctgtccgcatcggattgctcta

SEQ ID NO: 647515 - DNA, 25 bp, Rattus norvegicus
tgtctgtcctaacctgcaagtctgt

SEQ ID NO: 647516 - DNA, 25 bp, Rattus norvegicus
tgtctgtcctaagctgcaagtctgt

SEQ ID NO: 647517 - DNA, 25 bp, Rattus norvegicus
tgtctgtcctgcataatctctgtta

SEQ ID NO: 647518 - DNA, 25 bp, Rattus norvegicus
tgtctgtcctgcttaatctctgtta

SEQ ID NO: 647519 - DNA, 25 bp, Rattus norvegicus
tgtctgtccttcaccttcacataca

SEQ ID NO: 647520 - DNA, 25 bp, Rattus norvegicus
tgtctgtccttctccttcacataca

SEQ ID NO: 647521 - DNA, 25 bp, Rattus norvegicus
tgtctgtctcaaaatttcctgtgcc

SEQ ID NO: 647522 - DNA, 25 bp, Rattus norvegicus
tgtctgtctcaatatttcctgtgcc

SEQ ID NO: 647523 - DNA, 25 bp, Rattus norvegicus
tgtctgtctgtaaggattcatgtgc

SEQ ID NO: 647524 - DNA, 25 bp, Rattus norvegicus
tgtctgtctgtatggattcatgtgc

SEQ ID NO: 647525 - DNA, 25 bp, Rattus norvegicus
tgtctgtctgtcaggctttcctagg

SEQ ID NO: 647526 - DNA, 25 bp, Rattus norvegicus
tgtctgtctgtctggctttcctagg

SEQ ID NO: 647527 - DNA, 25 bp, Rattus norvegicus
tgtctgtctgtgacctcctttgaaa

SEQ ID NO: 647528 - DNA, 25 bp, Rattus norvegicus
tgtctgtctgtgtcctcctttgaaa

SEQ ID NO: 647529 - DNA, 25 bp, Rattus norvegicus
tgtctgtcttccctgtgaacatgac

SEQ ID NO: 647530 - DNA, 25 bp, Rattus norvegicus
tgtctgtcttccgtgtgaacatgac

SEQ ID NO: 647531 - DNA, 25 bp, Rattus norvegicus
tgtctgtcttgtacttccactactg

SEQ ID NO: 647532 - DNA, 25 bp, Rattus norvegicus
tgtctgtcttgttcttccactactg

SEQ ID NO: 647533 - DNA, 25 bp, Rattus norvegicus
tgtctgtgccacaaacgagcacctg

SEQ ID NO: 647534 - DNA, 25 bp, Rattus norvegicus
tgtctgtgccactaacgagcacctg

SEQ ID NO: 647535 - DNA, 25 bp, Rattus norvegicus
tgtctgtgccttacctattccaaac

SEQ ID NO: 647536 - DNA, 25 bp, Rattus norvegicus
tgtctgtgcctttcctattccaaac

SEQ ID NO: 647537 - DNA, 25 bp, Rattus norvegicus
tgtctgtggaccactttcaagaacc

SEQ ID NO: 647538 - DNA, 25 bp, Rattus norvegicus
tgtctgtggacctctttcaagaacc

SEQ ID NO: 647539 - DNA, 25 bp, Rattus norvegicus
tgtctgtggcagagataaccagctc

SEQ ID NO: 647540 - DNA, 25 bp, Rattus norvegicus
tgtctgtggcagtgataaccagctc

SEQ ID NO: 647541 - DNA, 25 bp, Rattus norvegicus
tgtctgtggcccagtagtcctgagc

SEQ ID NO: 647542 - DNA, 25 bp, Rattus norvegicus
tgtctgtggccctgtagtcctgagc

SEQ ID NO: 647543 - DNA, 25 bp, Rattus norvegicus
tgtctgtggtcacctgccaagcggt

SEQ ID NO: 647544 - DNA, 25 bp, Rattus norvegicus
tgtctgtggtcagctgccaagcggt

SEQ ID NO: 647545 - DNA, 25 bp, Rattus norvegicus
tgtctgtgtcctactttggatgcaa

SEQ ID NO: 647546 - DNA, 25 bp, Rattus norvegicus
tgtctgtgtccttctttggatgcaa

SEQ ID NO: 647547 - DNA, 25 bp, Rattus norvegicus
tgtctgtgtcgaaacattgctgtga

SEQ ID NO: 647548 - DNA, 25 bp, Rattus norvegicus
tgtctgtgtcgatacattgctgtga

SEQ ID NO: 647549 - DNA, 25 bp, Rattus norvegicus
tgtctgtgtgtcaccatagcaccat

SEQ ID NO: 647550 - DNA, 25 bp, Rattus norvegicus
tgtctgtgtgtctccatagcaccat

SEQ ID NO: 647551 - DNA, 25 bp, Rattus norvegicus
tgtctgtgttctctgtcacaaaggt

SEQ ID NO: 647552 - DNA, 25 bp, Rattus norvegicus
tgtctgtgttctgtgtcacaaaggt

SEQ ID NO: 647553 - DNA, 25 bp, Rattus norvegicus
tgtctgttcactcattgctttcaca

SEQ ID NO: 647554 - DNA, 25 bp, Rattus norvegicus
tgtctgttcactgattgctttcaca

SEQ ID NO: 647555 - DNA, 25 bp, Rattus norvegicus
tgtctgttccccaagcttttggttt

SEQ ID NO: 647556 - DNA, 25 bp, Rattus norvegicus
tgtctgttcccctagcttttggttt

SEQ ID NO: 647557 - DNA, 25 bp, Rattus norvegicus
tgtctgttctctaccttattaaaat

SEQ ID NO: 647558 - DNA, 25 bp, Rattus norvegicus
tgtctgttctcttccttattaaaat

SEQ ID NO: 647559 - DNA, 25 bp, Rattus norvegicus
tgtctgttctgtagttgagtcccca

SEQ ID NO: 647560 - DNA, 25 bp, Rattus norvegicus
tgtctgttctgttgttgagtcccca

SEQ ID NO: 647561 - DNA, 25 bp, Rattus norvegicus
tgtctgttgagtcctgtcttaccca

SEQ ID NO: 647562 - DNA, 25 bp, Rattus norvegicus
tgtctgttgagtgctgtcttaccca

SEQ ID NO: 647563 - DNA, 25 bp, Rattus norvegicus
tgtctgttggacatgaggacctctt

SEQ ID NO: 647564 - DNA, 25 bp, Rattus norvegicus
tgtctgttggacttgaggacctctt

SEQ ID NO: 647565 - DNA, 25 bp, Rattus norvegicus
tgtctgttggtacttatccccacat

SEQ ID NO: 647566 - DNA, 25 bp, Rattus norvegicus
tgtctgttggtagttatccccacat

SEQ ID NO: 647567 - DNA, 25 bp, Rattus norvegicus
tgtctgttgtacctgctgagattac

SEQ ID NO: 647568 - DNA, 25 bp, Rattus norvegicus
tgtctgttgtacgtgctgagattac

SEQ ID NO: 647569 - DNA, 25 bp, Rattus norvegicus
tgtctgtttcagcatgagttctaaa

SEQ ID NO: 647570 - DNA, 25 bp, Rattus norvegicus
tgtctgtttcaggatgagttctaaa

SEQ ID NO: 647571 - DNA, 25 bp, Rattus norvegicus
tgtctgtttggaactatgttgcttc

SEQ ID NO: 647572 - DNA, 25 bp, Rattus norvegicus
tgtctgtttggatctatgttgcttc

SEQ ID NO: 647573 - DNA, 25 bp, Rattus norvegicus
tgtctgttttccctagcagcagagg

SEQ ID NO: 647574 - DNA, 25 bp, Rattus norvegicus
tgtctgttttccgtagcagcagagg

SEQ ID NO: 647575 - DNA, 25 bp, Rattus norvegicus
tgtctgttttctccttcacgtcaaa

SEQ ID NO: 647576 - DNA, 25 bp, Rattus norvegicus
tgtctgttttctcgcttccaaatag

SEQ ID NO: 647577 - DNA, 25 bp, Rattus norvegicus
tgtctgttttctgcttcacgtcaaa

SEQ ID NO: 647578 - DNA, 25 bp, Rattus norvegicus
tgtctgttttctggcttccaaatag

SEQ ID NO: 647579 - DNA, 25 bp, Rattus norvegicus
tgtctgttttttcccccattgaatt

SEQ ID NO: 647580 - DNA, 25 bp, Rattus norvegicus
tgtctgttttttgccccattgaatt

SEQ ID NO: 647581 - DNA, 25 bp, Rattus norvegicus
tgtcttaaagccagtcctgtcatca

SEQ ID NO: 647582 - DNA, 25 bp, Rattus norvegicus
tgtcttaaagcctgtcctgtcatca

SEQ ID NO: 647583 - DNA, 25 bp, Rattus norvegicus
tgtcttaaagtcagctggtgtctct

SEQ ID NO: 647584 - DNA, 25 bp, Rattus norvegicus
tgtcttaaagtctgctggtgtctct

SEQ ID NO: 647585 - DNA, 25 bp, Rattus norvegicus
tgtcttaactgtccatcatctcaac

SEQ ID NO: 647586 - DNA, 25 bp, Rattus norvegicus
tgtcttaactgtgcatcatctcaac

SEQ ID NO: 647587 - DNA, 25 bp, Rattus norvegicus
tgtcttaagataacagcccactgtg

SEQ ID NO: 647588 - DNA, 25 bp, Rattus norvegicus
tgtcttaagatatcagcccactgtg

SEQ ID NO: 647589 - DNA, 25 bp, Rattus norvegicus
tgtcttaagtggcagcctgtgtgca

SEQ ID NO: 647590 - DNA, 25 bp, Rattus norvegicus
tgtcttaagtgggagcctgtgtgca

SEQ ID NO: 647591 - DNA, 25 bp, Rattus norvegicus
tgtcttaattgactagaggctgtta

SEQ ID NO: 647592 - DNA, 25 bp, Rattus norvegicus
tgtcttaattgagtagaggctgtta

SEQ ID NO: 647593 - DNA, 25 bp, Rattus norvegicus
tgtcttacatatacccacagcacag

SEQ ID NO: 647594 - DNA, 25 bp, Rattus norvegicus
tgtcttacatattcccacagcacag

SEQ ID NO: 647595 - DNA, 25 bp, Rattus norvegicus
tgtcttacatgtcagttgcccttac

SEQ ID NO: 647596 - DNA, 25 bp, Rattus norvegicus
tgtcttacatgtgagttgcccttac

SEQ ID NO: 647597 - DNA, 25 bp, Rattus norvegicus
tgtcttacctatcgtgaggctctgc

SEQ ID NO: 647598 - DNA, 25 bp, Rattus norvegicus
tgtcttacctatggtgaggctctgc

SEQ ID NO: 647599 - DNA, 25 bp, Rattus norvegicus
tgtcttactctgatctgtagatgag

SEQ ID NO: 647600 - DNA, 25 bp, Rattus norvegicus
tgtcttactctgttctgtagatgag

SEQ ID NO: 647601 - DNA, 25 bp, Rattus norvegicus
tgtcttacttgtacttacccatgtc

SEQ ID NO: 647602 - DNA, 25 bp, Rattus norvegicus
tgtcttacttgttcttacccatgtc

SEQ ID NO: 647603 - DNA, 25 bp, Rattus norvegicus
tgtcttactttgcttctctcttgat

SEQ ID NO: 647604 - DNA, 25 bp, Rattus norvegicus
tgtcttactttggttctctcttgat

SEQ ID NO: 647605 - DNA, 25 bp, Rattus norvegicus
tgtcttagcagaaagtctctcctgg

SEQ ID NO: 647606 - DNA, 25 bp, Rattus norvegicus
tgtcttagcagatagtctctcctgg

SEQ ID NO: 647607 - DNA, 25 bp, Rattus norvegicus
tgtcttagccctagatgcccttaga

SEQ ID NO: 647608 - DNA, 25 bp, Rattus norvegicus
tgtcttagcccttgatgcccttaga

SEQ ID NO: 647609 - DNA, 25 bp, Rattus norvegicus
tgtcttagccgcacaatcattcctg

SEQ ID NO: 647610 - DNA, 25 bp, Rattus norvegicus
tgtcttagccgctcaatcattcctg

SEQ ID NO: 647611 - DNA, 25 bp, Rattus norvegicus
tgtcttagggctcccgactggcagt

SEQ ID NO: 647612 - DNA, 25 bp, Rattus norvegicus
tgtcttagggctgccgactggcagt

SEQ ID NO: 647613 - DNA, 25 bp, Rattus norvegicus
tgtcttaggtaactttttgtccagg

SEQ ID NO: 647614 - DNA, 25 bp, Rattus norvegicus
tgtcttaggtaagtttttgtccagg

SEQ ID NO: 647615 - DNA, 25 bp, Rattus norvegicus
tgtcttagtcaccttgcttcattgt

SEQ ID NO: 647616 - DNA, 25 bp, Rattus norvegicus
tgtcttagtcacgttgcttcattgt

SEQ ID NO: 647617 - DNA, 25 bp, Rattus norvegicus
tgtcttagtcttctttccggttcaa

SEQ ID NO: 647618 - DNA, 25 bp, Rattus norvegicus
tgtcttagtcttgtttccggttcaa

SEQ ID NO: 647619 - DNA, 25 bp, Rattus norvegicus
tgtcttagttacatccacagcacgg

SEQ ID NO: 647620 - DNA, 25 bp, Rattus norvegicus
tgtcttagttacttccacagcacgg

SEQ ID NO: 647621 - DNA, 25 bp, Rattus norvegicus
tgtcttataatcctgcatcacttcc

SEQ ID NO: 647622 - DNA, 25 bp, Rattus norvegicus
tgtcttataatcgtgcatcacttcc

SEQ ID NO: 647623 - DNA, 25 bp, Rattus norvegicus
tgtcttatcaatagcatagccttct

SEQ ID NO: 647624 - DNA, 25 bp, Rattus norvegicus
tgtcttatcaattgcatagccttct

SEQ ID NO: 647625 - DNA, 25 bp, Rattus norvegicus
tgtcttatgcgcatcctcccaagtg

SEQ ID NO: 647626 - DNA, 25 bp, Rattus norvegicus
tgtcttatgcgcttcctcccaagtg

SEQ ID NO: 647627 - DNA, 25 bp, Rattus norvegicus
tgtcttatgggtcaatgtggtcccc

SEQ ID NO: 647628 - DNA, 25 bp, Rattus norvegicus
tgtcttatgggtgaatgtggtcccc

SEQ ID NO: 647629 - DNA, 25 bp, Rattus norvegicus
tgtcttatggtcagagtttgatctc

SEQ ID NO: 647630 - DNA, 25 bp, Rattus norvegicus
tgtcttatggtctgagtttgatctc

SEQ ID NO: 647631 - DNA, 25 bp, Rattus norvegicus
tgtcttatgtttatactgccgcaaa

SEQ ID NO: 647632 - DNA, 25 bp, Rattus norvegicus
tgtcttatgtttttactgccgcaaa

SEQ ID NO: 647633 - DNA, 25 bp, Rattus norvegicus
tgtcttattaccctagttctcctat

SEQ ID NO: 647634 - DNA, 25 bp, Rattus norvegicus
tgtcttattaccgtagttctcctat

SEQ ID NO: 647635 - DNA, 25 bp, Rattus norvegicus
tgtcttatttaacttggtcccctgg

SEQ ID NO: 647636 - DNA, 25 bp, Rattus norvegicus
tgtcttatttaagttggtcccctgg

SEQ ID NO: 647637 - DNA, 25 bp, Rattus norvegicus
tgtcttattttccttgctgcattta

SEQ ID NO: 647638 - DNA, 25 bp, Rattus norvegicus
tgtcttattttcgttgctgcattta

SEQ ID NO: 647639 - DNA, 25 bp, Rattus norvegicus
tgtcttcaagtgatccaagtgccaa

SEQ ID NO: 647640 - DNA, 25 bp, Rattus norvegicus
tgtcttcaagtgttccaagtgccaa

SEQ ID NO: 647641 - DNA, 25 bp, Rattus norvegicus
tgtcttcaatgtattctgtacccca

SEQ ID NO: 647642 - DNA, 25 bp, Rattus norvegicus
tgtcttcaatgttttctgtacccca

SEQ ID NO: 647643 - DNA, 25 bp, Rattus norvegicus
tgtcttcacaagacacccagggtta

SEQ ID NO: 647644 - DNA, 25 bp, Rattus norvegicus
tgtcttcacaagtcacccagggtta

SEQ ID NO: 647645 - DNA, 25 bp, Rattus norvegicus
tgtcttcacacactactcctttggg

SEQ ID NO: 647646 - DNA, 25 bp, Rattus norvegicus
tgtcttcacacagtactcctttggg

SEQ ID NO: 647647 - DNA, 25 bp, Rattus norvegicus
tgtcttcaccagcagtcgtgttgga

SEQ ID NO: 647648 - DNA, 25 bp, Rattus norvegicus
tgtcttcaccaggagtcgtgttgga

SEQ ID NO: 647649 - DNA, 25 bp, Rattus norvegicus
tgtcttcaccttctttcctgtggat

SEQ ID NO: 647650 - DNA, 25 bp, Rattus norvegicus
tgtcttcaccttgtttcctgtggat

SEQ ID NO: 647651 - DNA, 25 bp, Rattus norvegicus
tgtcttcacgagaaggcggccacag

SEQ ID NO: 647652 - DNA, 25 bp, Rattus norvegicus
tgtcttcacgagtaggcggccacag

SEQ ID NO: 647653 - DNA, 25 bp, Rattus norvegicus
tgtcttcactgacgaaagcccctac

SEQ ID NO: 647654 - DNA, 25 bp, Rattus norvegicus
tgtcttcactgaggaaagcccctac

SEQ ID NO: 647655 - DNA, 25 bp, Rattus norvegicus
tgtcttcagcacactcattcaaggg

SEQ ID NO: 647656 - DNA, 25 bp, Rattus norvegicus
tgtcttcagcactctcattcaaggg

SEQ ID NO: 647657 - DNA, 25 bp, Rattus norvegicus
tgtcttcagcgcaggtagctatatc

SEQ ID NO: 647658 - DNA, 25 bp, Rattus norvegicus
tgtcttcagcgctggtagctatatc

SEQ ID NO: 647659 - DNA, 25 bp, Rattus norvegicus
tgtcttcatattaactccccacaaa

SEQ ID NO: 647660 - DNA, 25 bp, Rattus norvegicus
tgtcttcatatttactccccacaaa

SEQ ID NO: 647661 - DNA, 25 bp, Rattus norvegicus
tgtcttcatcgacctctgttttgat

SEQ ID NO: 647662 - DNA, 25 bp, Rattus norvegicus
tgtcttcatcgagctctgttttgat

SEQ ID NO: 647663 - DNA, 25 bp, Rattus norvegicus
tgtcttcatctaatgcagcacgtgg

SEQ ID NO: 647664 - DNA, 25 bp, Rattus norvegicus
tgtcttcatctattgcagcacgtgg

SEQ ID NO: 647665 - DNA, 25 bp, Rattus norvegicus
tgtcttcatctcagcgactccagag

SEQ ID NO: 647666 - DNA, 25 bp, Rattus norvegicus
tgtcttcatctctgcgactccagag

SEQ ID NO: 647667 - DNA, 25 bp, Rattus norvegicus
tgtcttcattcccaagcactatgtg

SEQ ID NO: 647668 - DNA, 25 bp, Rattus norvegicus
tgtcttcattccgaagcactatgtg

SEQ ID NO: 647669 - DNA, 25 bp, Rattus norvegicus
tgtcttcatttcacactgtgcactt

SEQ ID NO: 647670 - DNA, 25 bp, Rattus norvegicus
tgtcttcatttctcactgtgcactt

SEQ ID NO: 647671 - DNA, 25 bp, Rattus norvegicus
tgtcttcattttctgcagcatcctg

SEQ ID NO: 647672 - DNA, 25 bp, Rattus norvegicus
tgtcttcattttgtgcagcatcctg

SEQ ID NO: 647673 - DNA, 25 bp, Rattus norvegicus
tgtcttccaaaacctttgcgtaagg

SEQ ID NO: 647674 - DNA, 25 bp, Rattus norvegicus
tgtcttccaaaagctttgcgtaagg

SEQ ID NO: 647675 - DNA, 25 bp, Rattus norvegicus
tgtcttccaattcaggcctggatgt

SEQ ID NO: 647676 - DNA, 25 bp, Rattus norvegicus
tgtcttccaattgaggcctggatgt

SEQ ID NO: 647677 - DNA, 25 bp, Rattus norvegicus
tgtcttccaccaatggcagattgtc

SEQ ID NO: 647678 - DNA, 25 bp, Rattus norvegicus
tgtcttccaccattggcagattgtc

SEQ ID NO: 647679 - DNA, 25 bp, Rattus norvegicus
tgtcttccagagagttgggcaggac

SEQ ID NO: 647680 - DNA, 25 bp, Rattus norvegicus
tgtcttccagagtgttgggcaggac

SEQ ID NO: 647681 - DNA, 25 bp, Rattus norvegicus
tgtcttccagccacataatttaacc

SEQ ID NO: 647682 - DNA, 25 bp, Rattus norvegicus
tgtcttccagcctcataatttaacc

SEQ ID NO: 647683 - DNA, 25 bp, Rattus norvegicus
tgtcttccagtcaccggctagtggt

SEQ ID NO: 647684 - DNA, 25 bp, Rattus norvegicus
tgtcttccagtctccggctagtggt

SEQ ID NO: 647685 - DNA, 25 bp, Rattus norvegicus
tgtcttcccggaccaagtatcaagg

SEQ ID NO: 647686 - DNA, 25 bp, Rattus norvegicus
tgtcttcccggagcaagtatcaagg

SEQ ID NO: 647687 - DNA, 25 bp, Rattus norvegicus
tgtcttccctcacctgactgtggta

SEQ ID NO: 647688 - DNA, 25 bp, Rattus norvegicus
tgtcttccctcagctgactgtggta

SEQ ID NO: 647689 - DNA, 25 bp, Rattus norvegicus
tgtcttccctgcacctttatgagaa

SEQ ID NO: 647690 - DNA, 25 bp, Rattus norvegicus
tgtcttccctgctcctttatgagaa

SEQ ID NO: 647691 - DNA, 25 bp, Rattus norvegicus
tgtcttcccttacacttgggtccag

SEQ ID NO: 647692 - DNA, 25 bp, Rattus norvegicus
tgtcttcccttagacttgggtccag

SEQ ID NO: 647693 - DNA, 25 bp, Rattus norvegicus
tgtcttcccttgagtccatatttaa

SEQ ID NO: 647694 - DNA, 25 bp, Rattus norvegicus
tgtcttcccttgtgtccatatttaa

SEQ ID NO: 647695 - DNA, 25 bp, Rattus norvegicus
tgtcttccgagcattcctggaatat

SEQ ID NO: 647696 - DNA, 25 bp, Rattus norvegicus
tgtcttccgagctttcctggaatat

SEQ ID NO: 647697 - DNA, 25 bp, Rattus norvegicus
tgtcttccgtgtacacatggatgtt

SEQ ID NO: 647698 - DNA, 25 bp, Rattus norvegicus
tgtcttccgtgttcacatggatgtt

SEQ ID NO: 647699 - DNA, 25 bp, Rattus norvegicus
tgtcttcctcaaatctgtctttgac

SEQ ID NO: 647700 - DNA, 25 bp, Rattus norvegicus
tgtcttcctcaattctgtctttgac

SEQ ID NO: 647701 - DNA, 25 bp, Rattus norvegicus
tgtcttcctttaatcctcaaaacag

SEQ ID NO: 647702 - DNA, 25 bp, Rattus norvegicus
tgtcttcctttattcctcaaaacag

SEQ ID NO: 647703 - DNA, 25 bp, Rattus norvegicus
tgtcttcctttccaccaaagtaggg

SEQ ID NO: 647704 - DNA, 25 bp, Rattus norvegicus
tgtcttcctttcgaccaaagtaggg

SEQ ID NO: 647705 - DNA, 25 bp, Rattus norvegicus
tgtcttcctttgatattatgttgtt

SEQ ID NO: 647706 - DNA, 25 bp, Rattus norvegicus
tgtcttcctttgttattatgttgtt

SEQ ID NO: 647707 - DNA, 25 bp, Rattus norvegicus
tgtcttcgcctcattgattttctaa

SEQ ID NO: 647708 - DNA, 25 bp, Rattus norvegicus
tgtcttcgcctctttgattttctaa

SEQ ID NO: 647709 - DNA, 25 bp, Rattus norvegicus
tgtcttcggcttctggttaaaccct

SEQ ID NO: 647710 - DNA, 25 bp, Rattus norvegicus
tgtcttcggcttgtggttaaaccct

SEQ ID NO: 647711 - DNA, 25 bp, Rattus norvegicus
tgtcttcgggccaagctacagataa

SEQ ID NO: 647712 - DNA, 25 bp, Rattus norvegicus
tgtcttcgggcctagctacagataa

SEQ ID NO: 647713 - DNA, 25 bp, Rattus norvegicus
tgtcttcgtcaaagtatccaccaat

SEQ ID NO: 647714 - DNA, 25 bp, Rattus norvegicus
tgtcttcgtcaatgtatccaccaat

SEQ ID NO: 647715 - DNA, 25 bp, Rattus norvegicus
tgtcttctacacagggatggctgcc

SEQ ID NO: 647716 - DNA, 25 bp, Rattus norvegicus
tgtcttctacactgggatggctgcc

SEQ ID NO: 647717 - DNA, 25 bp, Rattus norvegicus
tgtcttctactcatttttaccctca

SEQ ID NO: 647718 - DNA, 25 bp, Rattus norvegicus
tgtcttctactcttttttaccctca

SEQ ID NO: 647719 - DNA, 25 bp, Rattus norvegicus
tgtcttctatatacaccagtgcaga

SEQ ID NO: 647720 - DNA, 25 bp, Rattus norvegicus
tgtcttctatattcaccagtgcaga

SEQ ID NO: 647721 - DNA, 25 bp, Rattus norvegicus
tgtcttctattgaccgttccatcat

SEQ ID NO: 647722 - DNA, 25 bp, Rattus norvegicus
tgtcttctattgtccgttccatcat

SEQ ID NO: 647723 - DNA, 25 bp, Rattus norvegicus
tgtcttctcaaacaaagggcctgaa

SEQ ID NO: 647724 - DNA, 25 bp, Rattus norvegicus
tgtcttctcaaagaaagggcctgaa

SEQ ID NO: 647725 - DNA, 25 bp, Rattus norvegicus
tgtcttctcaacctcgggaaatggg

SEQ ID NO: 647726 - DNA, 25 bp, Rattus norvegicus
tgtcttctcaacgtcgggaaatggg

SEQ ID NO: 647727 - DNA, 25 bp, Rattus norvegicus
tgtcttctcagcatctgcctgtcag

SEQ ID NO: 647728 - DNA, 25 bp, Rattus norvegicus
tgtcttctcagcttctgcctgtcag

SEQ ID NO: 647729 - DNA, 25 bp, Rattus norvegicus
tgtcttctccatcgttgttggtata

SEQ ID NO: 647730 - DNA, 25 bp, Rattus norvegicus
tgtcttctccatggttgttggtata

SEQ ID NO: 647731 - DNA, 25 bp, Rattus norvegicus
tgtcttctcgaacgctgtactacag

SEQ ID NO: 647732 - DNA, 25 bp, Rattus norvegicus
tgtcttctcgaaggctgtactacag

SEQ ID NO: 647733 - DNA, 25 bp, Rattus norvegicus
tgtcttctctaaaatcacccagtat

SEQ ID NO: 647734 - DNA, 25 bp, Rattus norvegicus
tgtcttctctaatatcacccagtat

SEQ ID NO: 647735 - DNA, 25 bp, Rattus norvegicus
tgtcttctctcgaccagaagcctga

SEQ ID NO: 647736 - DNA, 25 bp, Rattus norvegicus
tgtcttctctcgtccagaagcctga

SEQ ID NO: 647737 - DNA, 25 bp, Rattus norvegicus
tgtcttctgaccctaagccaggcct

SEQ ID NO: 647738 - DNA, 25 bp, Rattus norvegicus
tgtcttctgaccgtaagccaggcct

SEQ ID NO: 647739 - DNA, 25 bp, Rattus norvegicus
tgtcttctgattattgccccttgca

SEQ ID NO: 647740 - DNA, 25 bp, Rattus norvegicus
tgtcttctgatttttgccccttgca

SEQ ID NO: 647741 - DNA, 25 bp, Rattus norvegicus
tgtcttctgccaatctcattgctag

SEQ ID NO: 647742 - DNA, 25 bp, Rattus norvegicus
tgtcttctgccattctcattgctag

SEQ ID NO: 647743 - DNA, 25 bp, Rattus norvegicus
tgtcttctgctcaagctgaggtggg

SEQ ID NO: 647744 - DNA, 25 bp, Rattus norvegicus
tgtcttctgctctagctgaggtggg

SEQ ID NO: 647745 - DNA, 25 bp, Rattus norvegicus
tgtcttctggaacttcatcaccgca

SEQ ID NO: 647746 - DNA, 25 bp, Rattus norvegicus
tgtcttctggaagttcatcaccgca

SEQ ID NO: 647747 - DNA, 25 bp, Rattus norvegicus
tgtcttctgtgccttgcaactatga

SEQ ID NO: 647748 - DNA, 25 bp, Rattus norvegicus
tgtcttctgtgcgttgcaactatga

SEQ ID NO: 647749 - DNA, 25 bp, Rattus norvegicus
tgtcttctgttgattgtgcatagca

SEQ ID NO: 647750 - DNA, 25 bp, Rattus norvegicus
tgtcttctgttgcacagttgggctt

SEQ ID NO: 647751 - DNA, 25 bp, Rattus norvegicus
tgtcttctgttggacagttgggctt

SEQ ID NO: 647752 - DNA, 25 bp, Rattus norvegicus
tgtcttctgttgtttgtgcatagca

SEQ ID NO: 647753 - DNA, 25 bp, Rattus norvegicus
tgtcttctgtttcttccccagggag

SEQ ID NO: 647754 - DNA, 25 bp, Rattus norvegicus
tgtcttctgtttgttccccagggag

SEQ ID NO: 647755 - DNA, 25 bp, Rattus norvegicus
tgtcttcttaaccttccaaataaat

SEQ ID NO: 647756 - DNA, 25 bp, Rattus norvegicus
tgtcttcttaacgttccaaataaat

SEQ ID NO: 647757 - DNA, 25 bp, Rattus norvegicus
tgtcttcttccaccgagcagaggaa

SEQ ID NO: 647758 - DNA, 25 bp, Rattus norvegicus
tgtcttcttccactagagccgtgaa

SEQ ID NO: 647759 - DNA, 25 bp, Rattus norvegicus
tgtcttcttccagcgagcagaggaa

SEQ ID NO: 647760 - DNA, 25 bp, Rattus norvegicus
tgtcttcttccagtagagccgtgaa

SEQ ID NO: 647761 - DNA, 25 bp, Rattus norvegicus
tgtcttcttctgacccatgcaagaa

SEQ ID NO: 647762 - DNA, 25 bp, Rattus norvegicus
tgtcttcttctgtcccatgcaagaa

SEQ ID NO: 647763 - DNA, 25 bp, Rattus norvegicus
tgtcttcttgtgctccaggcaggga

SEQ ID NO: 647764 - DNA, 25 bp, Rattus norvegicus
tgtcttcttgtggtccaggcaggga

SEQ ID NO: 647765 - DNA, 25 bp, Rattus norvegicus
tgtcttctttctctctcagtgtttt

SEQ ID NO: 647766 - DNA, 25 bp, Rattus norvegicus
tgtcttctttctgtctcagtgtttt

SEQ ID NO: 647767 - DNA, 25 bp, Rattus norvegicus
tgtcttcttttaactgagctccgcg

SEQ ID NO: 647768 - DNA, 25 bp, Rattus norvegicus
tgtcttcttttatctgagctccgcg

SEQ ID NO: 647769 - DNA, 25 bp, Rattus norvegicus
tgtcttctttttccagtttcttctg

SEQ ID NO: 647770 - DNA, 25 bp, Rattus norvegicus
tgtcttctttttgcagtttcttctg

SEQ ID NO: 647771 - DNA, 25 bp, Rattus norvegicus
tgtcttgagactcccaattccattg

SEQ ID NO: 647772 - DNA, 25 bp, Rattus norvegicus
tgtcttgagactgccaattccattg

SEQ ID NO: 647773 - DNA, 25 bp, Rattus norvegicus
tgtcttgagagcctgccccaaaagt

SEQ ID NO: 647774 - DNA, 25 bp, Rattus norvegicus
tgtcttgagagcgtgccccaaaagt

SEQ ID NO: 647775 - DNA, 25 bp, Rattus norvegicus
tgtcttgcagttatactcctgtcca

SEQ ID NO: 647776 - DNA, 25 bp, Rattus norvegicus
tgtcttgcagttttactcctgtcca

SEQ ID NO: 647777 - DNA, 25 bp, Rattus norvegicus
tgtcttgcatgtcagtcacacaggc

SEQ ID NO: 647778 - DNA, 25 bp, Rattus norvegicus
tgtcttgcatgtgagtcacacaggc

SEQ ID NO: 647779 - DNA, 25 bp, Rattus norvegicus
tgtcttgcctgtcccatagatatgg

SEQ ID NO: 647780 - DNA, 25 bp, Rattus norvegicus
tgtcttgcctgtgccatagatatgg

SEQ ID NO: 647781 - DNA, 25 bp, Rattus norvegicus
tgtcttgcttcaacccacagggata

SEQ ID NO: 647782 - DNA, 25 bp, Rattus norvegicus
tgtcttgcttcatcccacagggata

SEQ ID NO: 647783 - DNA, 25 bp, Rattus norvegicus
tgtcttggagctatcttggctcatg

SEQ ID NO: 647784 - DNA, 25 bp, Rattus norvegicus
tgtcttggagctttcttggctcatg

SEQ ID NO: 647785 - DNA, 25 bp, Rattus norvegicus
tgtcttggccagactttatccttct

SEQ ID NO: 647786 - DNA, 25 bp, Rattus norvegicus
tgtcttggccagtctttatccttct

SEQ ID NO: 647787 - DNA, 25 bp, Rattus norvegicus
tgtcttgggcaaacactcttgtggg

SEQ ID NO: 647788 - DNA, 25 bp, Rattus norvegicus
tgtcttgggcaatcactcttgtggg

SEQ ID NO: 647789 - DNA, 25 bp, Rattus norvegicus
tgtcttgggcatactgaggtaacct

SEQ ID NO: 647790 - DNA, 25 bp, Rattus norvegicus
tgtcttgggcattctgaggtaacct

SEQ ID NO: 647791 - DNA, 25 bp, Rattus norvegicus
tgtcttggtgcaatattccctttaa

SEQ ID NO: 647792 - DNA, 25 bp, Rattus norvegicus
tgtcttggtgcattattccctttaa

SEQ ID NO: 647793 - DNA, 25 bp, Rattus norvegicus
tgtcttggttatcccttacatcttt

SEQ ID NO: 647794 - DNA, 25 bp, Rattus norvegicus
tgtcttggttatgccttacatcttt

SEQ ID NO: 647795 - DNA, 25 bp, Rattus norvegicus
tgtcttggttcccttgggagcaaaa

SEQ ID NO: 647796 - DNA, 25 bp, Rattus norvegicus
tgtcttggttccgttgggagcaaaa

SEQ ID NO: 647797 - DNA, 25 bp, Rattus norvegicus
tgtcttggtttactttacagttctt

SEQ ID NO: 647798 - DNA, 25 bp, Rattus norvegicus
tgtcttggtttagtttacagttctt

SEQ ID NO: 647799 - DNA, 25 bp, Rattus norvegicus
tgtcttgtaccgacgcggatatcga

SEQ ID NO: 647800 - DNA, 25 bp, Rattus norvegicus
tgtcttgtaccgtcgcggatatcga

SEQ ID NO: 647801 - DNA, 25 bp, Rattus norvegicus
tgtcttgtactgatcttagctgcta

SEQ ID NO: 647802 - DNA, 25 bp, Rattus norvegicus
tgtcttgtactgttcttagctgcta

SEQ ID NO: 647803 - DNA, 25 bp, Rattus norvegicus
tgtcttgtcctccaaaccgtatgtt

SEQ ID NO: 647804 - DNA, 25 bp, Rattus norvegicus
tgtcttgtcctcgaaaccgtatgtt

SEQ ID NO: 647805 - DNA, 25 bp, Rattus norvegicus
tgtcttgtctgtctttctcttcgca

SEQ ID NO: 647806 - DNA, 25 bp, Rattus norvegicus
tgtcttgtctgtgtttctcttcgca

SEQ ID NO: 647807 - DNA, 25 bp, Rattus norvegicus
tgtcttgtttccagggagcgatgcc

SEQ ID NO: 647808 - DNA, 25 bp, Rattus norvegicus
tgtcttgtttcctgggagcgatgcc

SEQ ID NO: 647809 - DNA, 25 bp, Rattus norvegicus
tgtcttgttttgcttctcatggaaa

SEQ ID NO: 647810 - DNA, 25 bp, Rattus norvegicus
tgtcttgttttggttctcatggaaa

SEQ ID NO: 647811 - DNA, 25 bp, Rattus norvegicus
tgtctttaaatgatctgcccctttg

SEQ ID NO: 647812 - DNA, 25 bp, Rattus norvegicus
tgtctttaaatgttctgcccctttg

SEQ ID NO: 647813 - DNA, 25 bp, Rattus norvegicus
tgtctttacctcaaaagcttaggta

SEQ ID NO: 647814 - DNA, 25 bp, Rattus norvegicus
tgtctttacctctaaagcttaggta

SEQ ID NO: 647815 - DNA, 25 bp, Rattus norvegicus
tgtctttagcacagactgcctactg

SEQ ID NO: 647816 - DNA, 25 bp, Rattus norvegicus
tgtctttagcactgactgcctactg

SEQ ID NO: 647817 - DNA, 25 bp, Rattus norvegicus
tgtctttagttacggttagcattac

SEQ ID NO: 647818 - DNA, 25 bp, Rattus norvegicus
tgtctttagttagggttagcattac

SEQ ID NO: 647819 - DNA, 25 bp, Rattus norvegicus
tgtctttagttcctgactttgcacc

SEQ ID NO: 647820 - DNA, 25 bp, Rattus norvegicus
tgtctttagttcgtgactttgcacc

SEQ ID NO: 647821 - DNA, 25 bp, Rattus norvegicus
tgtctttatacacttgtgcacctgc

SEQ ID NO: 647822 - DNA, 25 bp, Rattus norvegicus
tgtctttatacagttgtgcacctgc

SEQ ID NO: 647823 - DNA, 25 bp, Rattus norvegicus
tgtctttatatgaagctgccctcct

SEQ ID NO: 647824 - DNA, 25 bp, Rattus norvegicus
tgtctttatatgtagctgccctcct

SEQ ID NO: 647825 - DNA, 25 bp, Rattus norvegicus
tgtctttatcttcgctttcatcatg

SEQ ID NO: 647826 - DNA, 25 bp, Rattus norvegicus
tgtctttatcttggctttcatcatg

SEQ ID NO: 647827 - DNA, 25 bp, Rattus norvegicus
tgtctttcagaaaaactgccatgga

SEQ ID NO: 647828 - DNA, 25 bp, Rattus norvegicus
tgtctttcagaataactgccatgga

SEQ ID NO: 647829 - DNA, 25 bp, Rattus norvegicus
tgtctttccaacacttgagcagcag

SEQ ID NO: 647830 - DNA, 25 bp, Rattus norvegicus
tgtctttccaactcttgagcagcag

SEQ ID NO: 647831 - DNA, 25 bp, Rattus norvegicus
tgtctttccccactgtggtgagtaa

SEQ ID NO: 647832 - DNA, 25 bp, Rattus norvegicus
tgtctttccccagtgtggtgagtaa

SEQ ID NO: 647833 - DNA, 25 bp, Rattus norvegicus
tgtctttcctgtattttgttctctg

SEQ ID NO: 647834 - DNA, 25 bp, Rattus norvegicus
tgtctttcctgttttttgttctctg

SEQ ID NO: 647835 - DNA, 25 bp, Rattus norvegicus
tgtctttccttaattggcttcccaa

SEQ ID NO: 647836 - DNA, 25 bp, Rattus norvegicus
tgtctttccttatttggcttcccaa

SEQ ID NO: 647837 - DNA, 25 bp, Rattus norvegicus
tgtctttctcaaccatcactcttat

SEQ ID NO: 647838 - DNA, 25 bp, Rattus norvegicus
tgtctttctcaagcatcactcttat

SEQ ID NO: 647839 - DNA, 25 bp, Rattus norvegicus
tgtctttctcccagatacaggtgga

SEQ ID NO: 647840 - DNA, 25 bp, Rattus norvegicus
tgtctttctccctgatacaggtgga

SEQ ID NO: 647841 - DNA, 25 bp, Rattus norvegicus
tgtctttctctccagccatactgta

SEQ ID NO: 647842 - DNA, 25 bp, Rattus norvegicus
tgtctttctctcgagccatactgta

SEQ ID NO: 647843 - DNA, 25 bp, Rattus norvegicus
tgtctttctcttcagctcctgcaaa

SEQ ID NO: 647844 - DNA, 25 bp, Rattus norvegicus
tgtctttctcttgagctcctgcaaa

SEQ ID NO: 647845 - DNA, 25 bp, Rattus norvegicus
tgtctttctgcaagagtgcgaccgt

SEQ ID NO: 647846 - DNA, 25 bp, Rattus norvegicus
tgtctttctgcatgagtgcgaccgt

SEQ ID NO: 647847 - DNA, 25 bp, Rattus norvegicus
tgtctttgaaatacacacctgctcc

SEQ ID NO: 647848 - DNA, 25 bp, Rattus norvegicus
tgtctttgaaattcacacctgctcc

SEQ ID NO: 647849 - DNA, 25 bp, Rattus norvegicus
tgtctttgaacaacgcagctggtct

SEQ ID NO: 647850 - DNA, 25 bp, Rattus norvegicus
tgtctttgaacatcgcagctggtct

SEQ ID NO: 647851 - DNA, 25 bp, Rattus norvegicus
tgtctttgcagactgttgtccatta

SEQ ID NO: 647852 - DNA, 25 bp, Rattus norvegicus
tgtctttgcagagtgttgtccatta

SEQ ID NO: 647853 - DNA, 25 bp, Rattus norvegicus
tgtctttggcgaaggttgtacactt

SEQ ID NO: 647854 - DNA, 25 bp, Rattus norvegicus
tgtctttggcgatggttgtacactt

SEQ ID NO: 647855 - DNA, 25 bp, Rattus norvegicus
tgtctttgggacactccagaagaag

SEQ ID NO: 647856 - DNA, 25 bp, Rattus norvegicus
tgtctttgggactctccagaagaag

SEQ ID NO: 647857 - DNA, 25 bp, Rattus norvegicus
tgtctttgtctcactttttgttttg

SEQ ID NO: 647858 - DNA, 25 bp, Rattus norvegicus
tgtctttgtctctctttttgttttg

SEQ ID NO: 647859 - DNA, 25 bp, Rattus norvegicus
tgtctttgttaccacagccattcag

SEQ ID NO: 647860 - DNA, 25 bp, Rattus norvegicus
tgtctttgttacgacagccattcag

SEQ ID NO: 647861 - DNA, 25 bp, Rattus norvegicus
tgtcttttacccactttgaccaaat

SEQ ID NO: 647862 - DNA, 25 bp, Rattus norvegicus
tgtcttttaccctctttgaccaaat

SEQ ID NO: 647863 - DNA, 25 bp, Rattus norvegicus
tgtcttttcaggattgcttcatgga

SEQ ID NO: 647864 - DNA, 25 bp, Rattus norvegicus
tgtcttttcaggtttgcttcatgga

SEQ ID NO: 647865 - DNA, 25 bp, Rattus norvegicus
tgtcttttccaccaagtgcctaaaa

SEQ ID NO: 647866 - DNA, 25 bp, Rattus norvegicus
tgtcttttccacgaagtgcctaaaa

SEQ ID NO: 647867 - DNA, 25 bp, Rattus norvegicus
tgtcttttccttaaccagagatttg

SEQ ID NO: 647868 - DNA, 25 bp, Rattus norvegicus
tgtcttttcctttaccagagatttg

SEQ ID NO: 647869 - DNA, 25 bp, Rattus norvegicus
tgtcttttctggctgtgtgtccata

SEQ ID NO: 647870 - DNA, 25 bp, Rattus norvegicus
tgtcttttctgggtgtgtgtccata

SEQ ID NO: 647871 - DNA, 25 bp, Rattus norvegicus
tgtcttttgaccattcatctggaaa

SEQ ID NO: 647872 - DNA, 25 bp, Rattus norvegicus
tgtcttttgacctttcatctggaaa

SEQ ID NO: 647873 - DNA, 25 bp, Rattus norvegicus
tgtcttttgagtaaaccctgggtag

SEQ ID NO: 647874 - DNA, 25 bp, Rattus norvegicus
tgtcttttgagttaaccctgggtag

SEQ ID NO: 647875 - DNA, 25 bp, Rattus norvegicus
tgtcttttgcttcggcgttacagca

SEQ ID NO: 647876 - DNA, 25 bp, Rattus norvegicus
tgtcttttgcttgggcgttacagca

SEQ ID NO: 647877 - DNA, 25 bp, Rattus norvegicus
tgtcttttgtgcaatgttgctgaag

SEQ ID NO: 647878 - DNA, 25 bp, Rattus norvegicus
tgtcttttgtgctatgttgctgaag

SEQ ID NO: 647879 - DNA, 25 bp, Rattus norvegicus
tgtcttttgtgtagcccatcaatca

SEQ ID NO: 647880 - DNA, 25 bp, Rattus norvegicus
tgtcttttgtgttgcccatcaatca

SEQ ID NO: 647881 - DNA, 25 bp, Rattus norvegicus
tgtctttttcggaatcccagctgta

SEQ ID NO: 647882 - DNA, 25 bp, Rattus norvegicus
tgtctttttcggtatcccagctgta

SEQ ID NO: 647883 - DNA, 25 bp, Rattus norvegicus
tgtctttttctacctctgctcagct

SEQ ID NO: 647884 - DNA, 25 bp, Rattus norvegicus
tgtctttttctaccttgtctggaaa

SEQ ID NO: 647885 - DNA, 25 bp, Rattus norvegicus
tgtctttttctagctctgctcagct

SEQ ID NO: 647886 - DNA, 25 bp, Rattus norvegicus
tgtctttttctagcttgtctggaaa

SEQ ID NO: 647887 - DNA, 25 bp, Rattus norvegicus
tgtctttttctcagcagcagggtag

SEQ ID NO: 647888 - DNA, 25 bp, Rattus norvegicus
tgtctttttctctgcagcagggtag

SEQ ID NO: 647889 - DNA, 25 bp, Rattus norvegicus
tgtctttttgtaaagcgtatgcatg

SEQ ID NO: 647890 - DNA, 25 bp, Rattus norvegicus
tgtctttttgtatagcgtatgcatg

SEQ ID NO: 647891 - DNA, 25 bp, Rattus norvegicus
tgtcttttttaccaaggcactcgct

SEQ ID NO: 647892 - DNA, 25 bp, Rattus norvegicus
tgtcttttttacgaaggcactcgct

SEQ ID NO: 647893 - DNA, 25 bp, Rattus norvegicus
tgtgaaaaagccatccatccttcca

SEQ ID NO: 647894 - DNA, 25 bp, Rattus norvegicus
tgtgaaaaagccttccatccttcca

SEQ ID NO: 647895 - DNA, 25 bp, Rattus norvegicus
tgtgaaaaattcagccccaggtgta

SEQ ID NO: 647896 - DNA, 25 bp, Rattus norvegicus
tgtgaaaaattctgccccaggtgta

SEQ ID NO: 647897 - DNA, 25 bp, Rattus norvegicus
tgtgaaaaccatcagaactcctcaa

SEQ ID NO: 647898 - DNA, 25 bp, Rattus norvegicus
tgtgaaaaccatgagaactcctcaa

SEQ ID NO: 647899 - DNA, 25 bp, Rattus norvegicus
tgtgaaaatcagattgccctcccca

SEQ ID NO: 647900 - DNA, 25 bp, Rattus norvegicus
tgtgaaaatcagtttgccctcccca

SEQ ID NO: 647901 - DNA, 25 bp, Rattus norvegicus
tgtgaaaattccatccttcgttttg

SEQ ID NO: 647902 - DNA, 25 bp, Rattus norvegicus
tgtgaaaattccttccttcgttttg

SEQ ID NO: 647903 - DNA, 25 bp, Rattus norvegicus
tgtgaaacaagaacagcctgccgtc

SEQ ID NO: 647904 - DNA, 25 bp, Rattus norvegicus
tgtgaaacaagatcagcctgccgtc

SEQ ID NO: 647905 - DNA, 25 bp, Rattus norvegicus
tgtgaaacacaaatctggcagccca

SEQ ID NO: 647906 - DNA, 25 bp, Rattus norvegicus
tgtgaaacacaattctggcagccca

SEQ ID NO: 647907 - DNA, 25 bp, Rattus norvegicus
tgtgaaacactaacactcgattttg

SEQ ID NO: 647908 - DNA, 25 bp, Rattus norvegicus
tgtgaaacactatcactcgattttg

SEQ ID NO: 647909 - DNA, 25 bp, Rattus norvegicus
tgtgaaacagcaaccgcagccagga

SEQ ID NO: 647910 - DNA, 25 bp, Rattus norvegicus
tgtgaaacagcatccgcagccagga

SEQ ID NO: 647911 - DNA, 25 bp, Rattus norvegicus
tgtgaaacagctcgaggtatccctc

SEQ ID NO: 647912 - DNA, 25 bp, Rattus norvegicus
tgtgaaacagctggaggtatccctc

SEQ ID NO: 647913 - DNA, 25 bp, Rattus norvegicus
tgtgaaacataactggaccacgcca

SEQ ID NO: 647914 - DNA, 25 bp, Rattus norvegicus
tgtgaaacataagtggaccacgcca

SEQ ID NO: 647915 - DNA, 25 bp, Rattus norvegicus
tgtgaaactatacacccgcacactg

SEQ ID NO: 647916 - DNA, 25 bp, Rattus norvegicus
tgtgaaactatagacccgcacactg

SEQ ID NO: 647917 - DNA, 25 bp, Rattus norvegicus
tgtgaaactcatacagcaggctgaa

SEQ ID NO: 647918 - DNA, 25 bp, Rattus norvegicus
tgtgaaactcattcagcaggctgaa

SEQ ID NO: 647919 - DNA, 25 bp, Rattus norvegicus
tgtgaaactgaccagctctcgacct

SEQ ID NO: 647920 - DNA, 25 bp, Rattus norvegicus
tgtgaaactgacgagctctcgacct

SEQ ID NO: 647921 - DNA, 25 bp, Rattus norvegicus
tgtgaaacttaccacacagctgcct

SEQ ID NO: 647922 - DNA, 25 bp, Rattus norvegicus
tgtgaaacttacgacacagctgcct

SEQ ID NO: 647923 - DNA, 25 bp, Rattus norvegicus
tgtgaaagagaaaaccaagacccca

SEQ ID NO: 647924 - DNA, 25 bp, Rattus norvegicus
tgtgaaagagaataccaagacccca

SEQ ID NO: 647925 - DNA, 25 bp, Rattus norvegicus
tgtgaaagcaggactcagtatcccc

SEQ ID NO: 647926 - DNA, 25 bp, Rattus norvegicus
tgtgaaagcaggtctcagtatcccc

SEQ ID NO: 647927 - DNA, 25 bp, Rattus norvegicus
tgtgaaagccacagtctggccctgt

SEQ ID NO: 647928 - DNA, 25 bp, Rattus norvegicus
tgtgaaagccactgtctggccctgt

SEQ ID NO: 647929 - DNA, 25 bp, Rattus norvegicus
tgtgaaagctgcagtcctcagacac

SEQ ID NO: 647930 - DNA, 25 bp, Rattus norvegicus
tgtgaaagctgctgtcctcagacac

SEQ ID NO: 647931 - DNA, 25 bp, Rattus norvegicus
tgtgaaagggtccaagttgccacct

SEQ ID NO: 647932 - DNA, 25 bp, Rattus norvegicus
tgtgaaagggtcgaagttgccacct

SEQ ID NO: 647933 - DNA, 25 bp, Rattus norvegicus
tgtgaaagggtgctttggcccccaa

SEQ ID NO: 647934 - DNA, 25 bp, Rattus norvegicus
tgtgaaagggtggtttggcccccaa

SEQ ID NO: 647935 - DNA, 25 bp, Rattus norvegicus
tgtgaaaggtatacacccgcctctg

SEQ ID NO: 647936 - DNA, 25 bp, Rattus norvegicus
tgtgaaaggtattcacccgcctctg

SEQ ID NO: 647937 - DNA, 25 bp, Rattus norvegicus
tgtgaaagtgtcacaaagctctcca

SEQ ID NO: 647938 - DNA, 25 bp, Rattus norvegicus
tgtgaaagtgtctcaaagctctcca

SEQ ID NO: 647939 - DNA, 25 bp, Rattus norvegicus
tgtgaaatcacacggttctgtccac

SEQ ID NO: 647940 - DNA, 25 bp, Rattus norvegicus
tgtgaaatcacagggttctgtccac

SEQ ID NO: 647941 - DNA, 25 bp, Rattus norvegicus
tgtgaaatcctgactacttcctgta

SEQ ID NO: 647942 - DNA, 25 bp, Rattus norvegicus
tgtgaaatcctgtctacttcctgta

SEQ ID NO: 647943 - DNA, 25 bp, Rattus norvegicus
tgtgaaatctcactgatgatgctct

SEQ ID NO: 647944 - DNA, 25 bp, Rattus norvegicus
tgtgaaatctcagtgatgatgctct

SEQ ID NO: 647945 - DNA, 25 bp, Rattus norvegicus
tgtgaaatgagcagctctcctccgc

SEQ ID NO: 647946 - DNA, 25 bp, Rattus norvegicus
tgtgaaatgagctgctctcctccgc

SEQ ID NO: 647947 - DNA, 25 bp, Rattus norvegicus
tgtgaaatgcaactccccagattgg

SEQ ID NO: 647948 - DNA, 25 bp, Rattus norvegicus
tgtgaaatgcaagtccccagattgg

SEQ ID NO: 647949 - DNA, 25 bp, Rattus norvegicus
tgtgaaatgtaccatttgaccagaa

SEQ ID NO: 647950 - DNA, 25 bp, Rattus norvegicus
tgtgaaatgtacgatttgaccagaa

SEQ ID NO: 647951 - DNA, 25 bp, Rattus norvegicus
tgtgaaatgtcaccctgatactcag

SEQ ID NO: 647952 - DNA, 25 bp, Rattus norvegicus
tgtgaaatgtcagcctgatactcag

SEQ ID NO: 647953 - DNA, 25 bp, Rattus norvegicus
tgtgaaattgctatcccatctgctt

SEQ ID NO: 647954 - DNA, 25 bp, Rattus norvegicus
tgtgaaattgctttcccatctgctt

SEQ ID NO: 647955 - DNA, 25 bp, Rattus norvegicus
tgtgaaattggcatcagtgccctca

SEQ ID NO: 647956 - DNA, 25 bp, Rattus norvegicus
tgtgaaattggcttcagtgccctca

SEQ ID NO: 647957 - DNA, 25 bp, Rattus norvegicus
tgtgaaatttacctcaaagtggtcc

SEQ ID NO: 647958 - DNA, 25 bp, Rattus norvegicus
tgtgaaatttacgtcaaagtggtcc

SEQ ID NO: 647959 - DNA, 25 bp, Rattus norvegicus
tgtgaaatttttagcctctctgatt

SEQ ID NO: 647960 - DNA, 25 bp, Rattus norvegicus
tgtgaaattttttgcctctctgatt

SEQ ID NO: 647961 - DNA, 25 bp, Rattus norvegicus
tgtgaacaaacacctaccacttctc

SEQ ID NO: 647962 - DNA, 25 bp, Rattus norvegicus
tgtgaacaaacagctaccacttctc

SEQ ID NO: 647963 - DNA, 25 bp, Rattus norvegicus
tgtgaacaacccatgaggtcctcat

SEQ ID NO: 647964 - DNA, 25 bp, Rattus norvegicus
tgtgaacaacccttgaggtcctcat

SEQ ID NO: 647965 - DNA, 25 bp, Rattus norvegicus
tgtgaacaagcgaccccagcgtaat

SEQ ID NO: 647966 - DNA, 25 bp, Rattus norvegicus
tgtgaacaagcgtccccagcgtaat

SEQ ID NO: 647967 - DNA, 25 bp, Rattus norvegicus
tgtgaacacacgaaccttggtcagc

SEQ ID NO: 647968 - DNA, 25 bp, Rattus norvegicus
tgtgaacacacgtaccttggtcagc

SEQ ID NO: 647969 - DNA, 25 bp, Rattus norvegicus
tgtgaacacactccatatcctcatc

SEQ ID NO: 647970 - DNA, 25 bp, Rattus norvegicus
tgtgaacacactgcatatcctcatc

SEQ ID NO: 647971 - DNA, 25 bp, Rattus norvegicus
tgtgaacacaggactgcagcaccca

SEQ ID NO: 647972 - DNA, 25 bp, Rattus norvegicus
tgtgaacacaggtctgcagcaccca

SEQ ID NO: 647973 - DNA, 25 bp, Rattus norvegicus
tgtgaacactaaaattttccatcct

SEQ ID NO: 647974 - DNA, 25 bp, Rattus norvegicus
tgtgaacactaatattttccatcct

SEQ ID NO: 647975 - DNA, 25 bp, Rattus norvegicus
tgtgaacactgaagacatggtatag

SEQ ID NO: 647976 - DNA, 25 bp, Rattus norvegicus
tgtgaacactgatgacatggtatag

SEQ ID NO: 647977 - DNA, 25 bp, Rattus norvegicus
tgtgaacagactccatgacctatgc

SEQ ID NO: 647978 - DNA, 25 bp, Rattus norvegicus
tgtgaacagactgcatgacctatgc

SEQ ID NO: 647979 - DNA, 25 bp, Rattus norvegicus
tgtgaacagagcaaccttccaggac

SEQ ID NO: 647980 - DNA, 25 bp, Rattus norvegicus
tgtgaacagagctaccttccaggac

SEQ ID NO: 647981 - DNA, 25 bp, Rattus norvegicus
tgtgaacagcctcaggaaccttgct

SEQ ID NO: 647982 - DNA, 25 bp, Rattus norvegicus
tgtgaacagcctgaggaaccttgct

SEQ ID NO: 647983 - DNA, 25 bp, Rattus norvegicus
tgtgaacagctgattgcactcgctc

SEQ ID NO: 647984 - DNA, 25 bp, Rattus norvegicus
tgtgaacagctgtttgcactcgctc

SEQ ID NO: 647985 - DNA, 25 bp, Rattus norvegicus
tgtgaacaggacacccatctctgct

SEQ ID NO: 647986 - DNA, 25 bp, Rattus norvegicus
tgtgaacaggactcccatctctgct

SEQ ID NO: 647987 - DNA, 25 bp, Rattus norvegicus
tgtgaacaggcactaaagctaatgt

SEQ ID NO: 647988 - DNA, 25 bp, Rattus norvegicus
tgtgaacaggcagtaaagctaatgt

SEQ ID NO: 647989 - DNA, 25 bp, Rattus norvegicus
tgtgaacagggcaggagctgtccct

SEQ ID NO: 647990 - DNA, 25 bp, Rattus norvegicus
tgtgaacagggctggagctgtccct

SEQ ID NO: 647991 - DNA, 25 bp, Rattus norvegicus
tgtgaacagttacacattccctgcc

SEQ ID NO: 647992 - DNA, 25 bp, Rattus norvegicus
tgtgaacagttagacattccctgcc

SEQ ID NO: 647993 - DNA, 25 bp, Rattus norvegicus
tgtgaaccagcaacgggattcctac

SEQ ID NO: 647994 - DNA, 25 bp, Rattus norvegicus
tgtgaaccagcacatacggagcagt

SEQ ID NO: 647995 - DNA, 25 bp, Rattus norvegicus
tgtgaaccagcagatacggagcagt

SEQ ID NO: 647996 - DNA, 25 bp, Rattus norvegicus
tgtgaaccagcatcgggattcctac

SEQ ID NO: 647997 - DNA, 25 bp, Rattus norvegicus
tgtgaaccagtcaagggtccctgct

SEQ ID NO: 647998 - DNA, 25 bp, Rattus norvegicus
tgtgaaccagtctagggtccctgct

SEQ ID NO: 647999 - DNA, 25 bp, Rattus norvegicus
tgtgaaccattgctacattgtaggt

SEQ ID NO: 648000 - DNA, 25 bp, Rattus norvegicus
tgtgaaccattggtacattgtaggt

SEQ ID NO: 648001 - DNA, 25 bp, Rattus norvegicus
tgtgaaccccacagtgttcctgtat

SEQ ID NO: 648002 - DNA, 25 bp, Rattus norvegicus
tgtgaaccccactgtgttcctgtat

SEQ ID NO: 648003 - DNA, 25 bp, Rattus norvegicus
tgtgaacccttccttctttaaggtg

SEQ ID NO: 648004 - DNA, 25 bp, Rattus norvegicus
tgtgaacccttcgttctttaaggtg

SEQ ID NO: 648005 - DNA, 25 bp, Rattus norvegicus
tgtgaacccttgaccctgtcgatcc

SEQ ID NO: 648006 - DNA, 25 bp, Rattus norvegicus
tgtgaacccttgtccctgtcgatcc

SEQ ID NO: 648007 - DNA, 25 bp, Rattus norvegicus
tgtgaacctctgaacccgtgaagag

SEQ ID NO: 648008 - DNA, 25 bp, Rattus norvegicus
tgtgaacctctgtacccgtgaagag

SEQ ID NO: 648009 - DNA, 25 bp, Rattus norvegicus
tgtgaaccttttctctggactgtct

SEQ ID NO: 648010 - DNA, 25 bp, Rattus norvegicus
tgtgaaccttttgtctggactgtct

SEQ ID NO: 648011 - DNA, 25 bp, Rattus norvegicus
tgtgaacgcaccatctggagcccga

SEQ ID NO: 648012 - DNA, 25 bp, Rattus norvegicus
tgtgaacgcaccttctggagcccga

SEQ ID NO: 648013 - DNA, 25 bp, Rattus norvegicus
tgtgaactaaacagctgggccacct

SEQ ID NO: 648014 - DNA, 25 bp, Rattus norvegicus
tgtgaactaaactgctgggccacct

SEQ ID NO: 648015 - DNA, 25 bp, Rattus norvegicus
tgtgaactacagaagcgggcaaaac

SEQ ID NO: 648016 - DNA, 25 bp, Rattus norvegicus
tgtgaactacagtagcgggcaaaac

SEQ ID NO: 648017 - DNA, 25 bp, Rattus norvegicus
tgtgaactatcacccacagtggcgt

SEQ ID NO: 648018 - DNA, 25 bp, Rattus norvegicus
tgtgaactatcagccacagtggcgt

SEQ ID NO: 648019 - DNA, 25 bp, Rattus norvegicus
tgtgaactccacatgctgcaaattc

SEQ ID NO: 648020 - DNA, 25 bp, Rattus norvegicus
tgtgaactccacttgctgcaaattc

SEQ ID NO: 648021 - DNA, 25 bp, Rattus norvegicus
tgtgaactcccgaagagtgtcaggt

SEQ ID NO: 648022 - DNA, 25 bp, Rattus norvegicus
tgtgaactcccgtagagtgtcaggt

SEQ ID NO: 648023 - DNA, 25 bp, Rattus norvegicus
tgtgaactcgctctccactccaagt

SEQ ID NO: 648024 - DNA, 25 bp, Rattus norvegicus
tgtgaactcgctgtccactccaagt

SEQ ID NO: 648025 - DNA, 25 bp, Rattus norvegicus
tgtgaactctctcccgtttgtaagc

SEQ ID NO: 648026 - DNA, 25 bp, Rattus norvegicus
tgtgaactctctcgatggcagccaa

SEQ ID NO: 648027 - DNA, 25 bp, Rattus norvegicus
tgtgaactctctgccgtttgtaagc

SEQ ID NO: 648028 - DNA, 25 bp, Rattus norvegicus
tgtgaactctctggatggcagccaa

SEQ ID NO: 648029 - DNA, 25 bp, Rattus norvegicus
tgtgaactgcttcccctggataaaa

SEQ ID NO: 648030 - DNA, 25 bp, Rattus norvegicus
tgtgaactgcttcgtgagacccagg

SEQ ID NO: 648031 - DNA, 25 bp, Rattus norvegicus
tgtgaactgcttgccctggataaaa

SEQ ID NO: 648032 - DNA, 25 bp, Rattus norvegicus
tgtgaactgcttggtgagacccagg

SEQ ID NO: 648033 - DNA, 25 bp, Rattus norvegicus
tgtgaactgtgtacagtcccacaca

SEQ ID NO: 648034 - DNA, 25 bp, Rattus norvegicus
tgtgaactgtgttcagtcccacaca

SEQ ID NO: 648035 - DNA, 25 bp, Rattus norvegicus
tgtgaactgttaactctgccctgaa

SEQ ID NO: 648036 - DNA, 25 bp, Rattus norvegicus
tgtgaactgttatctctgccctgaa

SEQ ID NO: 648037 - DNA, 25 bp, Rattus norvegicus
tgtgaacttagaccactccatcagg

SEQ ID NO: 648038 - DNA, 25 bp, Rattus norvegicus
tgtgaacttagagcactccatcagg

SEQ ID NO: 648039 - DNA, 25 bp, Rattus norvegicus
tgtgaacttgatccctttaacctga

SEQ ID NO: 648040 - DNA, 25 bp, Rattus norvegicus
tgtgaacttgatgcctttaacctga

SEQ ID NO: 648041 - DNA, 25 bp, Rattus norvegicus
tgtgaacttgtcagctgcagaactt

SEQ ID NO: 648042 - DNA, 25 bp, Rattus norvegicus
tgtgaacttgtctgctgcagaactt

SEQ ID NO: 648043 - DNA, 25 bp, Rattus norvegicus
tgtgaagaagttcctgcagcctggc

SEQ ID NO: 648044 - DNA, 25 bp, Rattus norvegicus
tgtgaagaagttgctgcagcctggc

SEQ ID NO: 648045 - DNA, 25 bp, Rattus norvegicus
tgtgaagacaatccaaaccttgtga

SEQ ID NO: 648046 - DNA, 25 bp, Rattus norvegicus
tgtgaagacaatgcaaaccttgtga

SEQ ID NO: 648047 - DNA, 25 bp, Rattus norvegicus
tgtgaagacagccaccttatctcca

SEQ ID NO: 648048 - DNA, 25 bp, Rattus norvegicus
tgtgaagacagcgaccttatctcca

SEQ ID NO: 648049 - DNA, 25 bp, Rattus norvegicus
tgtgaagacatccacaccacactga

SEQ ID NO: 648050 - DNA, 25 bp, Rattus norvegicus
tgtgaagacatcgacaccacactga

SEQ ID NO: 648051 - DNA, 25 bp, Rattus norvegicus
tgtgaagaccctctaaactgcaatc

SEQ ID NO: 648052 - DNA, 25 bp, Rattus norvegicus
tgtgaagaccctgtaaactgcaatc

SEQ ID NO: 648053 - DNA, 25 bp, Rattus norvegicus
tgtgaagacgtacttgagaccagac

SEQ ID NO: 648054 - DNA, 25 bp, Rattus norvegicus
tgtgaagacgtagttgagaccagac

SEQ ID NO: 648055 - DNA, 25 bp, Rattus norvegicus
tgtgaagacgtgctcacttacccat

SEQ ID NO: 648056 - DNA, 25 bp, Rattus norvegicus
tgtgaagacgtggtcacttacccat

SEQ ID NO: 648057 - DNA, 25 bp, Rattus norvegicus
tgtgaagactctataccccagtgta

SEQ ID NO: 648058 - DNA, 25 bp, Rattus norvegicus
tgtgaagactctttaccccagtgta

SEQ ID NO: 648059 - DNA, 25 bp, Rattus norvegicus
tgtgaagagaatccagagacccagt

SEQ ID NO: 648060 - DNA, 25 bp, Rattus norvegicus
tgtgaagagaatgcagagacccagt

SEQ ID NO: 648061 - DNA, 25 bp, Rattus norvegicus
tgtgaagagagacctctgcgacctg

SEQ ID NO: 648062 - DNA, 25 bp, Rattus norvegicus
tgtgaagagagagctctgcgacctg

SEQ ID NO: 648063 - DNA, 25 bp, Rattus norvegicus
tgtgaagagtatatgccctgcgtct

SEQ ID NO: 648064 - DNA, 25 bp, Rattus norvegicus
tgtgaagagtatttgccctgcgtct

SEQ ID NO: 648065 - DNA, 25 bp, Rattus norvegicus
tgtgaagatggaaacctagcccctc

SEQ ID NO: 648066 - DNA, 25 bp, Rattus norvegicus
tgtgaagatggatacctagcccctc

SEQ ID NO: 648067 - DNA, 25 bp, Rattus norvegicus
tgtgaagattgactgggtaccccat

SEQ ID NO: 648068 - DNA, 25 bp, Rattus norvegicus
tgtgaagattgagtgggtaccccat

SEQ ID NO: 648069 - DNA, 25 bp, Rattus norvegicus
tgtgaagcaaaaagcctgcccggca

SEQ ID NO: 648070 - DNA, 25 bp, Rattus norvegicus
tgtgaagcaaaatgcctgcccggca

SEQ ID NO: 648071 - DNA, 25 bp, Rattus norvegicus
tgtgaagcactaagctgaccctgct

SEQ ID NO: 648072 - DNA, 25 bp, Rattus norvegicus
tgtgaagcactatgctgaccctgct

SEQ ID NO: 648073 - DNA, 25 bp, Rattus norvegicus
tgtgaagcactgctgctagccccat

SEQ ID NO: 648074 - DNA, 25 bp, Rattus norvegicus
tgtgaagcactggtgctagccccat

SEQ ID NO: 648075 - DNA, 25 bp, Rattus norvegicus
tgtgaagcagcaacgggaggccttt

SEQ ID NO: 648076 - DNA, 25 bp, Rattus norvegicus
tgtgaagcagcatcgggaggccttt

SEQ ID NO: 648077 - DNA, 25 bp, Rattus norvegicus
tgtgaagccagcatgggcccaagtg

SEQ ID NO: 648078 - DNA, 25 bp, Rattus norvegicus
tgtgaagccagcttgggcccaagtg

SEQ ID NO: 648079 - DNA, 25 bp, Rattus norvegicus
tgtgaagccgctagagtccagactt

SEQ ID NO: 648080 - DNA, 25 bp, Rattus norvegicus
tgtgaagccgcttgagtccagactt

SEQ ID NO: 648081 - DNA, 25 bp, Rattus norvegicus
tgtgaagccgtaccagtgtcccgta

SEQ ID NO: 648082 - DNA, 25 bp, Rattus norvegicus
tgtgaagccgtagcagtgtcccgta

SEQ ID NO: 648083 - DNA, 25 bp, Rattus norvegicus
tgtgaagccttgagacacgcagcct

SEQ ID NO: 648084 - DNA, 25 bp, Rattus norvegicus
tgtgaagccttgtgacacgcagcct

SEQ ID NO: 648085 - DNA, 25 bp, Rattus norvegicus
tgtgaagcgcttatccacggtggca

SEQ ID NO: 648086 - DNA, 25 bp, Rattus norvegicus
tgtgaagcgcttttccacggtggca

SEQ ID NO: 648087 - DNA, 25 bp, Rattus norvegicus
tgtgaagctcacatcttcaggccag

SEQ ID NO: 648088 - DNA, 25 bp, Rattus norvegicus
tgtgaagctcacttcttcaggccag

SEQ ID NO: 648089 - DNA, 25 bp, Rattus norvegicus
tgtgaagcttgcacacctcggcact

SEQ ID NO: 648090 - DNA, 25 bp, Rattus norvegicus
tgtgaagcttgctcacctcggcact

SEQ ID NO: 648091 - DNA, 25 bp, Rattus norvegicus
tgtgaaggcaaaacggctgccgcct

SEQ ID NO: 648092 - DNA, 25 bp, Rattus norvegicus
tgtgaaggcaaatcggctgccgcct

SEQ ID NO: 648093 - DNA, 25 bp, Rattus norvegicus
tgtgaaggccttatagcttgcacct

SEQ ID NO: 648094 - DNA, 25 bp, Rattus norvegicus
tgtgaaggccttttagcttgcacct

SEQ ID NO: 648095 - DNA, 25 bp, Rattus norvegicus
tgtgaaggtctacttcaggctccct

SEQ ID NO: 648096 - DNA, 25 bp, Rattus norvegicus
tgtgaaggtctagttcaggctccct

SEQ ID NO: 648097 - DNA, 25 bp, Rattus norvegicus
tgtgaagtcacgatcaatgtccccg

SEQ ID NO: 648098 - DNA, 25 bp, Rattus norvegicus
tgtgaagtcacgttcaatgtccccg

SEQ ID NO: 648099 - DNA, 25 bp, Rattus norvegicus
tgtgaagtcagtaccggtcggtgta

SEQ ID NO: 648100 - DNA, 25 bp, Rattus norvegicus
tgtgaagtcagttccggtcggtgta

SEQ ID NO: 648101 - DNA, 25 bp, Rattus norvegicus
tgtgaagtcggtcacgttacttacc

SEQ ID NO: 648102 - DNA, 25 bp, Rattus norvegicus
tgtgaagtcggtgacgttacttacc

SEQ ID NO: 648103 - DNA, 25 bp, Rattus norvegicus
tgtgaagttactatcccgcgggcgg

SEQ ID NO: 648104 - DNA, 25 bp, Rattus norvegicus
tgtgaagttactttcccgcgggcgg

SEQ ID NO: 648105 - DNA, 25 bp, Rattus norvegicus
tgtgaagttccaaccatttgtcaag

SEQ ID NO: 648106 - DNA, 25 bp, Rattus norvegicus
tgtgaagttccatccatttgtcaag

SEQ ID NO: 648107 - DNA, 25 bp, Rattus norvegicus
tgtgaagtttaccaccagcctgttt

SEQ ID NO: 648108 - DNA, 25 bp, Rattus norvegicus
tgtgaagtttacgaccagcctgttt

SEQ ID NO: 648109 - DNA, 25 bp, Rattus norvegicus
tgtgaatagggcacttctctccata

SEQ ID NO: 648110 - DNA, 25 bp, Rattus norvegicus
tgtgaatagggctcttctctccata

SEQ ID NO: 648111 - DNA, 25 bp, Rattus norvegicus
tgtgaatcaagaccccagggagtcc

SEQ ID NO: 648112 - DNA, 25 bp, Rattus norvegicus
tgtgaatcaagagcccagggagtcc

SEQ ID NO: 648113 - DNA, 25 bp, Rattus norvegicus
tgtgaatcacggcaagcttcgctct

SEQ ID NO: 648114 - DNA, 25 bp, Rattus norvegicus
tgtgaatcacgggaagcttcgctct

SEQ ID NO: 648115 - DNA, 25 bp, Rattus norvegicus
tgtgaatccaaaatctctttcccct

SEQ ID NO: 648116 - DNA, 25 bp, Rattus norvegicus
tgtgaatccaaattctctttcccct

SEQ ID NO: 648117 - DNA, 25 bp, Rattus norvegicus
tgtgaatccaagaccccttcaaatg

SEQ ID NO: 648118 - DNA, 25 bp, Rattus norvegicus
tgtgaatccaagtccccttcaaatg

SEQ ID NO: 648119 - DNA, 25 bp, Rattus norvegicus
tgtgaatcccaaagtctgcctagtc

SEQ ID NO: 648120 - DNA, 25 bp, Rattus norvegicus
tgtgaatcccaatgtctgcctagtc

SEQ ID NO: 648121 - DNA, 25 bp, Rattus norvegicus
tgtgaatccttccatatcctcttta

SEQ ID NO: 648122 - DNA, 25 bp, Rattus norvegicus
tgtgaatccttcgatatcctcttta

SEQ ID NO: 648123 - DNA, 25 bp, Rattus norvegicus
tgtgaatgacctcacacctgctaac

SEQ ID NO: 648124 - DNA, 25 bp, Rattus norvegicus
tgtgaatgacctgacacctgctaac

SEQ ID NO: 648125 - DNA, 25 bp, Rattus norvegicus
tgtgaatgccgtacaaacctttatt

SEQ ID NO: 648126 - DNA, 25 bp, Rattus norvegicus
tgtgaatgccgttcaaacctttatt

SEQ ID NO: 648127 - DNA, 25 bp, Rattus norvegicus
tgtgaatgtagtacctctgcccagt

SEQ ID NO: 648128 - DNA, 25 bp, Rattus norvegicus
tgtgaatgtagttcctctgcccagt

SEQ ID NO: 648129 - DNA, 25 bp, Rattus norvegicus
tgtgaatgttcacagccccaagggc

SEQ ID NO: 648130 - DNA, 25 bp, Rattus norvegicus
tgtgaatgttcagagccccaagggc

SEQ ID NO: 648131 - DNA, 25 bp, Rattus norvegicus
tgtgaatgttgtcctgaagttgtac

SEQ ID NO: 648132 - DNA, 25 bp, Rattus norvegicus
tgtgaatgttgtgctgaagttgtac

SEQ ID NO: 648133 - DNA, 25 bp, Rattus norvegicus
tgtgaattcccaccgtatcccagaa

SEQ ID NO: 648134 - DNA, 25 bp, Rattus norvegicus
tgtgaattcccagcgtatcccagaa

SEQ ID NO: 648135 - DNA, 25 bp, Rattus norvegicus
tgtgaattctgtactgtcctcagtc

SEQ ID NO: 648136 - DNA, 25 bp, Rattus norvegicus
tgtgaattctgttctgtcctcagtc

SEQ ID NO: 648137 - DNA, 25 bp, Rattus norvegicus
tgtgaattgtgcatttctatccaga

SEQ ID NO: 648138 - DNA, 25 bp, Rattus norvegicus
tgtgaattgtgcttttctatccaga

SEQ ID NO: 648139 - DNA, 25 bp, Rattus norvegicus
tgtgacaaacacagcctggtacgta

SEQ ID NO: 648140 - DNA, 25 bp, Rattus norvegicus
tgtgacaaacactgcctggtacgta

SEQ ID NO: 648141 - DNA, 25 bp, Rattus norvegicus
tgtgacaaacataccttacttaaag

SEQ ID NO: 648142 - DNA, 25 bp, Rattus norvegicus
tgtgacaaacattccttacttaaag

SEQ ID NO: 648143 - DNA, 25 bp, Rattus norvegicus
tgtgacaaccctctgttgacccctg

SEQ ID NO: 648144 - DNA, 25 bp, Rattus norvegicus
tgtgacaaccctgtgttgacccctg

SEQ ID NO: 648145 - DNA, 25 bp, Rattus norvegicus
tgtgacaacctcagtggcctgtaga

SEQ ID NO: 648146 - DNA, 25 bp, Rattus norvegicus
tgtgacaacctctgtggcctgtaga

SEQ ID NO: 648147 - DNA, 25 bp, Rattus norvegicus
tgtgacaagaatccgcatttgtatt

SEQ ID NO: 648148 - DNA, 25 bp, Rattus norvegicus
tgtgacaagaatgcgcatttgtatt

SEQ ID NO: 648149 - DNA, 25 bp, Rattus norvegicus
tgtgacaagggcctccaagcactca

SEQ ID NO: 648150 - DNA, 25 bp, Rattus norvegicus
tgtgacaagggcgtccaagcactca

SEQ ID NO: 648151 - DNA, 25 bp, Rattus norvegicus
tgtgacaatcagcaaagcctcgcct

SEQ ID NO: 648152 - DNA, 25 bp, Rattus norvegicus
tgtgacaatcaggaaagcctcgcct

SEQ ID NO: 648153 - DNA, 25 bp, Rattus norvegicus
tgtgacacagggaacatctcaattt

SEQ ID NO: 648154 - DNA, 25 bp, Rattus norvegicus
tgtgacacagggtacatctcaattt

SEQ ID NO: 648155 - DNA, 25 bp, Rattus norvegicus
tgtgacacatggaccagaggcccca

SEQ ID NO: 648156 - DNA, 25 bp, Rattus norvegicus
tgtgacacatggtccagaggcccca

SEQ ID NO: 648157 - DNA, 25 bp, Rattus norvegicus
tgtgacaccaaccatacagttatgt

SEQ ID NO: 648158 - DNA, 25 bp, Rattus norvegicus
tgtgacaccaacgatacagttatgt

SEQ ID NO: 648159 - DNA, 25 bp, Rattus norvegicus
tgtgacaccattcccaagatctcca

SEQ ID NO: 648160 - DNA, 25 bp, Rattus norvegicus
tgtgacaccattgccaagatctcca

SEQ ID NO: 648161 - DNA, 25 bp, Rattus norvegicus
tgtgacacccttactgtacttttat

SEQ ID NO: 648162 - DNA, 25 bp, Rattus norvegicus
tgtgacaccctttctgtacttttat

SEQ ID NO: 648163 - DNA, 25 bp, Rattus norvegicus
tgtgacaccgtcatccaggagctgg

SEQ ID NO: 648164 - DNA, 25 bp, Rattus norvegicus
tgtgacaccgtcttccaggagctgg

SEQ ID NO: 648165 - DNA, 25 bp, Rattus norvegicus
tgtgacactgcaattcaggtgctgc

SEQ ID NO: 648166 - DNA, 25 bp, Rattus norvegicus
tgtgacactgcatttcaggtgctgc

SEQ ID NO: 648167 - DNA, 25 bp, Rattus norvegicus
tgtgacagccagacgtacactccag

SEQ ID NO: 648168 - DNA, 25 bp, Rattus norvegicus
tgtgacagccagtcgtacactccag

SEQ ID NO: 648169 - DNA, 25 bp, Rattus norvegicus
tgtgacagctatcaccggaggttct

SEQ ID NO: 648170 - DNA, 25 bp, Rattus norvegicus
tgtgacagctatgaccggaggttct

SEQ ID NO: 648171 - DNA, 25 bp, Rattus norvegicus
tgtgacagctgacggaggcctcttc

SEQ ID NO: 648172 - DNA, 25 bp, Rattus norvegicus
tgtgacagctgagggaggcctcttc

SEQ ID NO: 648173 - DNA, 25 bp, Rattus norvegicus
tgtgacagctgtcaaccacctgtaa

SEQ ID NO: 648174 - DNA, 25 bp, Rattus norvegicus
tgtgacagctgtgaaccacctgtaa

SEQ ID NO: 648175 - DNA, 25 bp, Rattus norvegicus
tgtgacagcttcctaaagagattct

SEQ ID NO: 648176 - DNA, 25 bp, Rattus norvegicus
tgtgacagcttcgtaaagagattct

SEQ ID NO: 648177 - DNA, 25 bp, Rattus norvegicus
tgtgacaggatccacacgagttcct

SEQ ID NO: 648178 - DNA, 25 bp, Rattus norvegicus
tgtgacaggatcgacacgagttcct

SEQ ID NO: 648179 - DNA, 25 bp, Rattus norvegicus
tgtgacaggcctcccttctgtggac

SEQ ID NO: 648180 - DNA, 25 bp, Rattus norvegicus
tgtgacaggcctgccttctgtggac

SEQ ID NO: 648181 - DNA, 25 bp, Rattus norvegicus
tgtgacagggagactgctactgcct

SEQ ID NO: 648182 - DNA, 25 bp, Rattus norvegicus
tgtgacagggagtctgctactgcct

SEQ ID NO: 648183 - DNA, 25 bp, Rattus norvegicus
tgtgacagggtcagatagactgtat

SEQ ID NO: 648184 - DNA, 25 bp, Rattus norvegicus
tgtgacagggtctgatagactgtat

SEQ ID NO: 648185 - DNA, 25 bp, Rattus norvegicus
tgtgacaggtacagggtggcaccaa

SEQ ID NO: 648186 - DNA, 25 bp, Rattus norvegicus
tgtgacaggtactgggtggcaccaa

SEQ ID NO: 648187 - DNA, 25 bp, Rattus norvegicus
tgtgacagtactaatcccttgatag

SEQ ID NO: 648188 - DNA, 25 bp, Rattus norvegicus
tgtgacagtacttatcccttgatag

SEQ ID NO: 648189 - DNA, 25 bp, Rattus norvegicus
tgtgacagtagaaggcagtctgcat

SEQ ID NO: 648190 - DNA, 25 bp, Rattus norvegicus
tgtgacagtagatggcagtctgcat

SEQ ID NO: 648191 - DNA, 25 bp, Rattus norvegicus
tgtgacagtataccccaatatccct

SEQ ID NO: 648192 - DNA, 25 bp, Rattus norvegicus
tgtgacagtatagcccaatatccct

SEQ ID NO: 648193 - DNA, 25 bp, Rattus norvegicus
tgtgacagtgtacctataaccccag

SEQ ID NO: 648194 - DNA, 25 bp, Rattus norvegicus
tgtgacagtgtagctataaccccag

SEQ ID NO: 648195 - DNA, 25 bp, Rattus norvegicus
tgtgacatctccacactatgtccta

SEQ ID NO: 648196 - DNA, 25 bp, Rattus norvegicus
tgtgacatctcctcactatgtccta

SEQ ID NO: 648197 - DNA, 25 bp, Rattus norvegicus
tgtgacatctgcacacagatctctc

SEQ ID NO: 648198 - DNA, 25 bp, Rattus norvegicus
tgtgacatctgctcacagatctctc

SEQ ID NO: 648199 - DNA, 25 bp, Rattus norvegicus
tgtgacatctgtcgcaagcgctaca

SEQ ID NO: 648200 - DNA, 25 bp, Rattus norvegicus
tgtgacatctgtggcaagcgctaca

SEQ ID NO: 648201 - DNA, 25 bp, Rattus norvegicus
tgtgacatctttaccctctacctgg

SEQ ID NO: 648202 - DNA, 25 bp, Rattus norvegicus
tgtgacatcttttccctctacctgg

SEQ ID NO: 648203 - DNA, 25 bp, Rattus norvegicus
tgtgacatgaccctacccaagtaac

SEQ ID NO: 648204 - DNA, 25 bp, Rattus norvegicus
tgtgacatgaccgtacccaagtaac

SEQ ID NO: 648205 - DNA, 25 bp, Rattus norvegicus
tgtgacatgggcatgggattctact

SEQ ID NO: 648206 - DNA, 25 bp, Rattus norvegicus
tgtgacatgggcttgggattctact

SEQ ID NO: 648207 - DNA, 25 bp, Rattus norvegicus
tgtgacattaataaccctggccctt

SEQ ID NO: 648208 - DNA, 25 bp, Rattus norvegicus
tgtgacattaattaccctggccctt

SEQ ID NO: 648209 - DNA, 25 bp, Rattus norvegicus
tgtgacattactactgcagccgagc

SEQ ID NO: 648210 - DNA, 25 bp, Rattus norvegicus
tgtgacattacttctgcagccgagc

SEQ ID NO: 648211 - DNA, 25 bp, Rattus norvegicus
tgtgacattatcagtgacaccatag

SEQ ID NO: 648212 - DNA, 25 bp, Rattus norvegicus
tgtgacattatctgtgacaccatag

SEQ ID NO: 648213 - DNA, 25 bp, Rattus norvegicus
tgtgacattcatagaggctcagcca

SEQ ID NO: 648214 - DNA, 25 bp, Rattus norvegicus
tgtgacattcattgaggctcagcca

SEQ ID NO: 648215 - DNA, 25 bp, Rattus norvegicus
tgtgacattccaagaccacatccat

SEQ ID NO: 648216 - DNA, 25 bp, Rattus norvegicus
tgtgacattccatgaccacatccat

SEQ ID NO: 648217 - DNA, 25 bp, Rattus norvegicus
tgtgaccacagcacttgcttggata

SEQ ID NO: 648218 - DNA, 25 bp, Rattus norvegicus
tgtgaccacagctcttgcttggata

SEQ ID NO: 648219 - DNA, 25 bp, Rattus norvegicus
tgtgaccaccaacacataggaactt

SEQ ID NO: 648220 - DNA, 25 bp, Rattus norvegicus
tgtgaccaccaagacataggaactt

SEQ ID NO: 648221 - DNA, 25 bp, Rattus norvegicus
tgtgaccacctcaaggtgacgtgca

SEQ ID NO: 648222 - DNA, 25 bp, Rattus norvegicus
tgtgaccacctctaggtgacgtgca

SEQ ID NO: 648223 - DNA, 25 bp, Rattus norvegicus
tgtgaccacgtgcatgaagtccctg

SEQ ID NO: 648224 - DNA, 25 bp, Rattus norvegicus
tgtgaccacgtggatgaagtccctg

SEQ ID NO: 648225 - DNA, 25 bp, Rattus norvegicus
tgtgaccagatgcagctctcagagc

SEQ ID NO: 648226 - DNA, 25 bp, Rattus norvegicus
tgtgaccagatggagctctcagagc

SEQ ID NO: 648227 - DNA, 25 bp, Rattus norvegicus
tgtgaccagcagaccaatggcgttt

SEQ ID NO: 648228 - DNA, 25 bp, Rattus norvegicus
tgtgaccagcagtccaatggcgttt

SEQ ID NO: 648229 - DNA, 25 bp, Rattus norvegicus
tgtgaccagtgtaccagggcggccc

SEQ ID NO: 648230 - DNA, 25 bp, Rattus norvegicus
tgtgaccagtgttccagggcggccc

SEQ ID NO: 648231 - DNA, 25 bp, Rattus norvegicus
tgtgaccatctgcagcacgtgtcca

SEQ ID NO: 648232 - DNA, 25 bp, Rattus norvegicus
tgtgaccatctggagcacgtgtcca

SEQ ID NO: 648233 - DNA, 25 bp, Rattus norvegicus
tgtgaccattctctgcccagagtgc

SEQ ID NO: 648234 - DNA, 25 bp, Rattus norvegicus
tgtgaccattctgtgcccagagtgc

SEQ ID NO: 648235 - DNA, 25 bp, Rattus norvegicus
tgtgaccatttgactgtcctgcact

SEQ ID NO: 648236 - DNA, 25 bp, Rattus norvegicus
tgtgaccatttgtctgtcctgcact

SEQ ID NO: 648237 - DNA, 25 bp, Rattus norvegicus
tgtgacccacagacttaagtctgta

SEQ ID NO: 648238 - DNA, 25 bp, Rattus norvegicus
tgtgacccacagtcttaagtctgta

SEQ ID NO: 648239 - DNA, 25 bp, Rattus norvegicus
tgtgacccagatctgaaaacctcct

SEQ ID NO: 648240 - DNA, 25 bp, Rattus norvegicus
tgtgacccagatgtgaaaacctcct

SEQ ID NO: 648241 - DNA, 25 bp, Rattus norvegicus
tgtgacccagcgacattcagtattt

SEQ ID NO: 648242 - DNA, 25 bp, Rattus norvegicus
tgtgacccagcgtcattcagtattt

SEQ ID NO: 648243 - DNA, 25 bp, Rattus norvegicus
tgtgacccaggcattctagtaagaa

SEQ ID NO: 648244 - DNA, 25 bp, Rattus norvegicus
tgtgacccaggctttctagtaagaa

SEQ ID NO: 648245 - DNA, 25 bp, Rattus norvegicus
tgtgaccccacaacatagacactgg

SEQ ID NO: 648246 - DNA, 25 bp, Rattus norvegicus
tgtgaccccacatcatagacactgg

SEQ ID NO: 648247 - DNA, 25 bp, Rattus norvegicus
tgtgaccccagaatgcagtaaggga

SEQ ID NO: 648248 - DNA, 25 bp, Rattus norvegicus
tgtgaccccagattgcagtaaggga

SEQ ID NO: 648249 - DNA, 25 bp, Rattus norvegicus
tgtgaccccagcagttgagaagcag

SEQ ID NO: 648250 - DNA, 25 bp, Rattus norvegicus
tgtgaccccagctgttgagaagcag

SEQ ID NO: 648251 - DNA, 25 bp, Rattus norvegicus
tgtgaccccaggctgctttaaaact

SEQ ID NO: 648252 - DNA, 25 bp, Rattus norvegicus
tgtgaccccagggtgctttaaaact

SEQ ID NO: 648253 - DNA, 25 bp, Rattus norvegicus
tgtgaccccgccagccctgaggtat

SEQ ID NO: 648254 - DNA, 25 bp, Rattus norvegicus
tgtgaccccgcctgccctgaggtat

SEQ ID NO: 648255 - DNA, 25 bp, Rattus norvegicus
tgtgacccctggacctttagcttcc

SEQ ID NO: 648256 - DNA, 25 bp, Rattus norvegicus
tgtgacccctggtcctttagcttcc

SEQ ID NO: 648257 - DNA, 25 bp, Rattus norvegicus
tgtgacccctgtcttggtatcctgc

SEQ ID NO: 648258 - DNA, 25 bp, Rattus norvegicus
tgtgacccctgtgttggtatcctgc

SEQ ID NO: 648259 - DNA, 25 bp, Rattus norvegicus
tgtgaccctctactacagcatgggc

SEQ ID NO: 648260 - DNA, 25 bp, Rattus norvegicus
tgtgaccctctagtacagcatgggc

SEQ ID NO: 648261 - DNA, 25 bp, Rattus norvegicus
tgtgaccctgcaattaccaatattc

SEQ ID NO: 648262 - DNA, 25 bp, Rattus norvegicus
tgtgaccctgcatttaccaatattc

SEQ ID NO: 648263 - DNA, 25 bp, Rattus norvegicus
tgtgaccctgggatatcagctctat

SEQ ID NO: 648264 - DNA, 25 bp, Rattus norvegicus
tgtgaccctgggttatcagctctat

SEQ ID NO: 648265 - DNA, 25 bp, Rattus norvegicus
tgtgaccctgtcagtgaagcgtgct

SEQ ID NO: 648266 - DNA, 25 bp, Rattus norvegicus
tgtgaccctgtctgtgaagcgtgct

SEQ ID NO: 648267 - DNA, 25 bp, Rattus norvegicus
tgtgaccgacccagagaagctcaac

SEQ ID NO: 648268 - DNA, 25 bp, Rattus norvegicus
tgtgaccgaccctgagaagctcaac

SEQ ID NO: 648269 - DNA, 25 bp, Rattus norvegicus
tgtgacctaaagcatctgtgaacgt

SEQ ID NO: 648270 - DNA, 25 bp, Rattus norvegicus
tgtgacctaaaggatctgtgaacgt

SEQ ID NO: 648271 - DNA, 25 bp, Rattus norvegicus
tgtgacctaacaccgagttaaacat

SEQ ID NO: 648272 - DNA, 25 bp, Rattus norvegicus
tgtgacctaacagcgagttaaacat

SEQ ID NO: 648273 - DNA, 25 bp, Rattus norvegicus
tgtgacctacaaagatgccatgctc

SEQ ID NO: 648274 - DNA, 25 bp, Rattus norvegicus
tgtgacctacaatgatgccatgctc

SEQ ID NO: 648275 - DNA, 25 bp, Rattus norvegicus
tgtgacctacagagagtctctcatt

SEQ ID NO: 648276 - DNA, 25 bp, Rattus norvegicus
tgtgacctacagtgagtctctcatt

SEQ ID NO: 648277 - DNA, 25 bp, Rattus norvegicus
tgtgacctcaggatgttgctactgt

SEQ ID NO: 648278 - DNA, 25 bp, Rattus norvegicus
tgtgacctcaggttgttgctactgt

SEQ ID NO: 648279 - DNA, 25 bp, Rattus norvegicus
tgtgacctccacagccttaggtgag

SEQ ID NO: 648280 - DNA, 25 bp, Rattus norvegicus
tgtgacctccactgccttaggtgag

SEQ ID NO: 648281 - DNA, 25 bp, Rattus norvegicus
tgtgacctccccaccaaaacaagtt

SEQ ID NO: 648282 - DNA, 25 bp, Rattus norvegicus
tgtgacctcccctccaaaacaagtt

SEQ ID NO: 648283 - DNA, 25 bp, Rattus norvegicus
tgtgacctccctcttatttaatctc

SEQ ID NO: 648284 - DNA, 25 bp, Rattus norvegicus
tgtgacctccctgttatttaatctc

SEQ ID NO: 648285 - DNA, 25 bp, Rattus norvegicus
tgtgacctccgtctggagactggaa

SEQ ID NO: 648286 - DNA, 25 bp, Rattus norvegicus
tgtgacctccgtgtggagactggaa

SEQ ID NO: 648287 - DNA, 25 bp, Rattus norvegicus
tgtgacctcctgaactgtctctgag

SEQ ID NO: 648288 - DNA, 25 bp, Rattus norvegicus
tgtgacctcctgtactgtctctgag

SEQ ID NO: 648289 - DNA, 25 bp, Rattus norvegicus
tgtgacctctgcctggttggattag

SEQ ID NO: 648290 - DNA, 25 bp, Rattus norvegicus
tgtgacctctgcgtggttggattag

SEQ ID NO: 648291 - DNA, 25 bp, Rattus norvegicus
tgtgacctggatcaactcaatgcat

SEQ ID NO: 648292 - DNA, 25 bp, Rattus norvegicus
tgtgacctggatgaactcaatgcat

SEQ ID NO: 648293 - DNA, 25 bp, Rattus norvegicus
tgtgacctggccatgtagggctacg

SEQ ID NO: 648294 - DNA, 25 bp, Rattus norvegicus
tgtgacctggccttgtagggctacg

SEQ ID NO: 648295 - DNA, 25 bp, Rattus norvegicus
tgtgacctgtgacatcagcgaggat

SEQ ID NO: 648296 - DNA, 25 bp, Rattus norvegicus
tgtgacctgtgagatcagcgaggat

SEQ ID NO: 648297 - DNA, 25 bp, Rattus norvegicus
tgtgaccttcacattaatttcctgt

SEQ ID NO: 648298 - DNA, 25 bp, Rattus norvegicus
tgtgaccttcactttaatttcctgt

SEQ ID NO: 648299 - DNA, 25 bp, Rattus norvegicus
tgtgaccttccaacgcagtatgggc

SEQ ID NO: 648300 - DNA, 25 bp, Rattus norvegicus
tgtgaccttccatcgcagtatgggc

SEQ ID NO: 648301 - DNA, 25 bp, Rattus norvegicus
tgtgaccttcctcaggctagcaaaa

SEQ ID NO: 648302 - DNA, 25 bp, Rattus norvegicus
tgtgaccttcctgaggctagcaaaa

SEQ ID NO: 648303 - DNA, 25 bp, Rattus norvegicus
tgtgacctttcaatggccctgcagt

SEQ ID NO: 648304 - DNA, 25 bp, Rattus norvegicus
tgtgacctttcattggccctgcagt

SEQ ID NO: 648305 - DNA, 25 bp, Rattus norvegicus
tgtgaccttttcatccccatgcagt

SEQ ID NO: 648306 - DNA, 25 bp, Rattus norvegicus
tgtgaccttttccttgggttggaca

SEQ ID NO: 648307 - DNA, 25 bp, Rattus norvegicus
tgtgaccttttcgttgggttggaca

SEQ ID NO: 648308 - DNA, 25 bp, Rattus norvegicus
tgtgaccttttcttccccatgcagt

SEQ ID NO: 648309 - DNA, 25 bp, Rattus norvegicus
tgtgacgacagtatcctggtcaaga

SEQ ID NO: 648310 - DNA, 25 bp, Rattus norvegicus
tgtgacgacagtttcctggtcaaga

SEQ ID NO: 648311 - DNA, 25 bp, Rattus norvegicus
tgtgacgacgatcccaaatactgct

SEQ ID NO: 648312 - DNA, 25 bp, Rattus norvegicus
tgtgacgacgatgccaaatactgct

SEQ ID NO: 648313 - DNA, 25 bp, Rattus norvegicus
tgtgacgagcacattacttccgagc

SEQ ID NO: 648314 - DNA, 25 bp, Rattus norvegicus
tgtgacgagcactttacttccgagc

SEQ ID NO: 648315 - DNA, 25 bp, Rattus norvegicus
tgtgacggatgccaattgccaccaa

SEQ ID NO: 648316 - DNA, 25 bp, Rattus norvegicus
tgtgacggatgcgaattgccaccaa

SEQ ID NO: 648317 - DNA, 25 bp, Rattus norvegicus
tgtgacgtcaaaacgcaaatgttta

SEQ ID NO: 648318 - DNA, 25 bp, Rattus norvegicus
tgtgacgtcaaatcgcaaatgttta

SEQ ID NO: 648319 - DNA, 25 bp, Rattus norvegicus
tgtgacgtgagcagctttgctctgc

SEQ ID NO: 648320 - DNA, 25 bp, Rattus norvegicus
tgtgacgtgagctgctttgctctgc

SEQ ID NO: 648321 - DNA, 25 bp, Rattus norvegicus
tgtgacgtgatgctatcccttttca

SEQ ID NO: 648322 - DNA, 25 bp, Rattus norvegicus
tgtgacgtgatggtatcccttttca

SEQ ID NO: 648323 - DNA, 25 bp, Rattus norvegicus
tgtgactacagaaggctatgaattc

SEQ ID NO: 648324 - DNA, 25 bp, Rattus norvegicus
tgtgactacagatggctatgaattc

SEQ ID NO: 648325 - DNA, 25 bp, Rattus norvegicus
tgtgactacccgacctgtggaagag

SEQ ID NO: 648326 - DNA, 25 bp, Rattus norvegicus
tgtgactacccgtcctgtggaagag

SEQ ID NO: 648327 - DNA, 25 bp, Rattus norvegicus
tgtgactagcggatgagctcctgaa

SEQ ID NO: 648328 - DNA, 25 bp, Rattus norvegicus
tgtgactagcggttgagctcctgaa

SEQ ID NO: 648329 - DNA, 25 bp, Rattus norvegicus
tgtgactatcagagacttctcagct

SEQ ID NO: 648330 - DNA, 25 bp, Rattus norvegicus
tgtgactatcagtgacttctcagct

SEQ ID NO: 648331 - DNA, 25 bp, Rattus norvegicus
tgtgactatttcattacccatggca

SEQ ID NO: 648332 - DNA, 25 bp, Rattus norvegicus
tgtgactatttctttacccatggca

SEQ ID NO: 648333 - DNA, 25 bp, Rattus norvegicus
tgtgactcagaactccagtggtcca

SEQ ID NO: 648334 - DNA, 25 bp, Rattus norvegicus
tgtgactcagaagtccagtggtcca

SEQ ID NO: 648335 - DNA, 25 bp, Rattus norvegicus
tgtgactcaggcaagccctagggta

SEQ ID NO: 648336 - DNA, 25 bp, Rattus norvegicus
tgtgactcaggctagccctagggta

SEQ ID NO: 648337 - DNA, 25 bp, Rattus norvegicus
tgtgactcattcctgccggaagata

SEQ ID NO: 648338 - DNA, 25 bp, Rattus norvegicus
tgtgactcattcgtgccggaagata

SEQ ID NO: 648339 - DNA, 25 bp, Rattus norvegicus
tgtgactccaaacaccctgctaagt

SEQ ID NO: 648340 - DNA, 25 bp, Rattus norvegicus
tgtgactccaaagaccctgctaagt

SEQ ID NO: 648341 - DNA, 25 bp, Rattus norvegicus
tgtgactccatgagctccaggaaag

SEQ ID NO: 648342 - DNA, 25 bp, Rattus norvegicus
tgtgactccatgattgtgttttcct

SEQ ID NO: 648343 - DNA, 25 bp, Rattus norvegicus
tgtgactccatgtgctccaggaaag

SEQ ID NO: 648344 - DNA, 25 bp, Rattus norvegicus
tgtgactccatgtttgtgttttcct

SEQ ID NO: 648345 - DNA, 25 bp, Rattus norvegicus
tgtgactcccagcttaactaaaata

SEQ ID NO: 648346 - DNA, 25 bp, Rattus norvegicus
tgtgactcccaggttaactaaaata

SEQ ID NO: 648347 - DNA, 25 bp, Rattus norvegicus
tgtgactccctgagcagtgttaagt

SEQ ID NO: 648348 - DNA, 25 bp, Rattus norvegicus
tgtgactccctgtgcagtgttaagt

SEQ ID NO: 648349 - DNA, 25 bp, Rattus norvegicus
tgtgactccttacaaccaagcattg

SEQ ID NO: 648350 - DNA, 25 bp, Rattus norvegicus
tgtgactccttagaaccaagcattg

SEQ ID NO: 648351 - DNA, 25 bp, Rattus norvegicus
tgtgactcgcacattaaactgtccc

SEQ ID NO: 648352 - DNA, 25 bp, Rattus norvegicus
tgtgactcgcactttaaactgtccc

SEQ ID NO: 648353 - DNA, 25 bp, Rattus norvegicus
tgtgactcgcttagctgaaacctaa

SEQ ID NO: 648354 - DNA, 25 bp, Rattus norvegicus
tgtgactcgctttgctgaaacctaa

SEQ ID NO: 648355 - DNA, 25 bp, Rattus norvegicus
tgtgactcgggtcagaggccacccc

SEQ ID NO: 648356 - DNA, 25 bp, Rattus norvegicus
tgtgactcgggtgagaggccacccc

SEQ ID NO: 648357 - DNA, 25 bp, Rattus norvegicus
tgtgactcggttctgcagctagaag

SEQ ID NO: 648358 - DNA, 25 bp, Rattus norvegicus
tgtgactcggttgtgcagctagaag

SEQ ID NO: 648359 - DNA, 25 bp, Rattus norvegicus
tgtgactctaggctacctcagtgtc

SEQ ID NO: 648360 - DNA, 25 bp, Rattus norvegicus
tgtgactctagggtacctcagtgtc

SEQ ID NO: 648361 - DNA, 25 bp, Rattus norvegicus
tgtgactctgtacatctcatccctg

SEQ ID NO: 648362 - DNA, 25 bp, Rattus norvegicus
tgtgactctgtagatctcatccctg

SEQ ID NO: 648363 - DNA, 25 bp, Rattus norvegicus
tgtgactgacttcgcctccttttgt

SEQ ID NO: 648364 - DNA, 25 bp, Rattus norvegicus
tgtgactgacttggcctccttttgt

SEQ ID NO: 648365 - DNA, 25 bp, Rattus norvegicus
tgtgactgctggagagctcatcccc

SEQ ID NO: 648366 - DNA, 25 bp, Rattus norvegicus
tgtgactgctggtgagctcatcccc

SEQ ID NO: 648367 - DNA, 25 bp, Rattus norvegicus
tgtgactgctttacagagtcatggt

SEQ ID NO: 648368 - DNA, 25 bp, Rattus norvegicus
tgtgactgcttttcagagtcatggt

SEQ ID NO: 648369 - DNA, 25 bp, Rattus norvegicus
tgtgactggaatcgctgcctccttg

SEQ ID NO: 648370 - DNA, 25 bp, Rattus norvegicus
tgtgactggaatggctgcctccttg

SEQ ID NO: 648371 - DNA, 25 bp, Rattus norvegicus
tgtgactggccgctgtgtatctgct

SEQ ID NO: 648372 - DNA, 25 bp, Rattus norvegicus
tgtgactggccggtgtgtatctgct

SEQ ID NO: 648373 - DNA, 25 bp, Rattus norvegicus
tgtgactggctcagaactgacccca

SEQ ID NO: 648374 - DNA, 25 bp, Rattus norvegicus
tgtgactggctctgaactgacccca

SEQ ID NO: 648375 - DNA, 25 bp, Rattus norvegicus
tgtgactgggccatcatgctctgag

SEQ ID NO: 648376 - DNA, 25 bp, Rattus norvegicus
tgtgactgggccttcatgctctgag

SEQ ID NO: 648377 - DNA, 25 bp, Rattus norvegicus
tgtgactggtaaacctcacagccca

SEQ ID NO: 648378 - DNA, 25 bp, Rattus norvegicus
tgtgactggtaatcctcacagccca

SEQ ID NO: 648379 - DNA, 25 bp, Rattus norvegicus
tgtgactgtgcaccccttgctgggt

SEQ ID NO: 648380 - DNA, 25 bp, Rattus norvegicus
tgtgactgtgcagcccttgctgggt

SEQ ID NO: 648381 - DNA, 25 bp, Rattus norvegicus
tgtgactgttcactcctgggagaga

SEQ ID NO: 648382 - DNA, 25 bp, Rattus norvegicus
tgtgactgttcagtcctgggagaga

SEQ ID NO: 648383 - DNA, 25 bp, Rattus norvegicus
tgtgacttacatagtagcagcaaat

SEQ ID NO: 648384 - DNA, 25 bp, Rattus norvegicus
tgtgacttacattgtagcagcaaat

SEQ ID NO: 648385 - DNA, 25 bp, Rattus norvegicus
tgtgacttcacaattggcacctcgt

SEQ ID NO: 648386 - DNA, 25 bp, Rattus norvegicus
tgtgacttcacatttggcacctcgt

SEQ ID NO: 648387 - DNA, 25 bp, Rattus norvegicus
tgtgacttcaccaagaccctggagc

SEQ ID NO: 648388 - DNA, 25 bp, Rattus norvegicus
tgtgacttcaccaagtacagatctt

SEQ ID NO: 648389 - DNA, 25 bp, Rattus norvegicus
tgtgacttcaccagcaggtctgatt

SEQ ID NO: 648390 - DNA, 25 bp, Rattus norvegicus
tgtgacttcacctagaccctggagc

SEQ ID NO: 648391 - DNA, 25 bp, Rattus norvegicus
tgtgacttcacctagtacagatctt

SEQ ID NO: 648392 - DNA, 25 bp, Rattus norvegicus
tgtgacttcacctgcaggtctgatt

SEQ ID NO: 648393 - DNA, 25 bp, Rattus norvegicus
tgtgacttcactccgtctactaaga

SEQ ID NO: 648394 - DNA, 25 bp, Rattus norvegicus
tgtgacttcactgcgtctactaaga

SEQ ID NO: 648395 - DNA, 25 bp, Rattus norvegicus
tgtgacttgaacactacctggacaa

SEQ ID NO: 648396 - DNA, 25 bp, Rattus norvegicus
tgtgacttgaactctacctggacaa

SEQ ID NO: 648397 - DNA, 25 bp, Rattus norvegicus
tgtgacttgaagatccatggtttgg

SEQ ID NO: 648398 - DNA, 25 bp, Rattus norvegicus
tgtgacttgaagttccatggtttgg

SEQ ID NO: 648399 - DNA, 25 bp, Rattus norvegicus
tgtgacttgtccatgttcccaaaag

SEQ ID NO: 648400 - DNA, 25 bp, Rattus norvegicus
tgtgacttgtccttgttcccaaaag

SEQ ID NO: 648401 - DNA, 25 bp, Rattus norvegicus
tgtgactttaaacccagcctggacc

SEQ ID NO: 648402 - DNA, 25 bp, Rattus norvegicus
tgtgactttaaagccagcctggacc

SEQ ID NO: 648403 - DNA, 25 bp, Rattus norvegicus
tgtgacttttccatgtttttcctaa

SEQ ID NO: 648404 - DNA, 25 bp, Rattus norvegicus
tgtgacttttccttgtttttcctaa

SEQ ID NO: 648405 - DNA, 25 bp, Rattus norvegicus
tgtgagaaaccgattgaaggcccct

SEQ ID NO: 648406 - DNA, 25 bp, Rattus norvegicus
tgtgagaaaccgtttgaaggcccct

SEQ ID NO: 648407 - DNA, 25 bp, Rattus norvegicus
tgtgagaaacctagtccccttggta

SEQ ID NO: 648408 - DNA, 25 bp, Rattus norvegicus
tgtgagaaaccttgtccccttggta

SEQ ID NO: 648409 - DNA, 25 bp, Rattus norvegicus
tgtgagaaagtaaccagcgcagtgt

SEQ ID NO: 648410 - DNA, 25 bp, Rattus norvegicus
tgtgagaaagtatccagcgcagtgt

SEQ ID NO: 648411 - DNA, 25 bp, Rattus norvegicus
tgtgagaaatcaccgattgcccttg

SEQ ID NO: 648412 - DNA, 25 bp, Rattus norvegicus
tgtgagaaatcagcgattgcccttg

SEQ ID NO: 648413 - DNA, 25 bp, Rattus norvegicus
tgtgagaaattcagctgagcagtta

SEQ ID NO: 648414 - DNA, 25 bp, Rattus norvegicus
tgtgagaaattctgctgagcagtta

SEQ ID NO: 648415 - DNA, 25 bp, Rattus norvegicus
tgtgagaactgacctgacctggacc

SEQ ID NO: 648416 - DNA, 25 bp, Rattus norvegicus
tgtgagaactgagctgacctggacc

SEQ ID NO: 648417 - DNA, 25 bp, Rattus norvegicus
tgtgagaagcctcattactgccctg

SEQ ID NO: 648418 - DNA, 25 bp, Rattus norvegicus
tgtgagaagcctgattactgccctg

SEQ ID NO: 648419 - DNA, 25 bp, Rattus norvegicus
tgtgagaatttcctagcctatccca

SEQ ID NO: 648420 - DNA, 25 bp, Rattus norvegicus
tgtgagaatttcgtagcctatccca

SEQ ID NO: 648421 - DNA, 25 bp, Rattus norvegicus
tgtgagacaacaagggctgtcccaa

SEQ ID NO: 648422 - DNA, 25 bp, Rattus norvegicus
tgtgagacaacatgggctgtcccaa

SEQ ID NO: 648423 - DNA, 25 bp, Rattus norvegicus
tgtgagacacatccgccatgggaaa

SEQ ID NO: 648424 - DNA, 25 bp, Rattus norvegicus
tgtgagacacatgcgccatgggaaa

SEQ ID NO: 648425 - DNA, 25 bp, Rattus norvegicus
tgtgagacaccaactacttctgacc

SEQ ID NO: 648426 - DNA, 25 bp, Rattus norvegicus
tgtgagacaccatctacttctgacc

SEQ ID NO: 648427 - DNA, 25 bp, Rattus norvegicus
tgtgagacagatcacttccccaggt

SEQ ID NO: 648428 - DNA, 25 bp, Rattus norvegicus
tgtgagacagatgacttccccaggt

SEQ ID NO: 648429 - DNA, 25 bp, Rattus norvegicus
tgtgagacccacagtgacccaacac

SEQ ID NO: 648430 - DNA, 25 bp, Rattus norvegicus
tgtgagacccactgtgacccaacac

SEQ ID NO: 648431 - DNA, 25 bp, Rattus norvegicus
tgtgagacccatcgcacgagtcagt

SEQ ID NO: 648432 - DNA, 25 bp, Rattus norvegicus
tgtgagacccatggcacgagtcagt

SEQ ID NO: 648433 - DNA, 25 bp, Rattus norvegicus
tgtgagacctcaactgctggaatga

SEQ ID NO: 648434 - DNA, 25 bp, Rattus norvegicus
tgtgagacctcatctgctggaatga

SEQ ID NO: 648435 - DNA, 25 bp, Rattus norvegicus
tgtgagagaccacccttccagaatc

SEQ ID NO: 648436 - DNA, 25 bp, Rattus norvegicus
tgtgagagaccagccttccagaatc

SEQ ID NO: 648437 - DNA, 25 bp, Rattus norvegicus
tgtgagagcacgagtcagagacaac

SEQ ID NO: 648438 - DNA, 25 bp, Rattus norvegicus
tgtgagagcacgtgtcagagacaac

SEQ ID NO: 648439 - DNA, 25 bp, Rattus norvegicus
tgtgagagtctgagtacccggcact

SEQ ID NO: 648440 - DNA, 25 bp, Rattus norvegicus
tgtgagagtctgtgtacccggcact

SEQ ID NO: 648441 - DNA, 25 bp, Rattus norvegicus
tgtgagatagatacaggtcatccct

SEQ ID NO: 648442 - DNA, 25 bp, Rattus norvegicus
tgtgagatagattcaggtcatccct

SEQ ID NO: 648443 - DNA, 25 bp, Rattus norvegicus
tgtgagatggatcgctgagccccac

SEQ ID NO: 648444 - DNA, 25 bp, Rattus norvegicus
tgtgagatggatggctgagccccac

SEQ ID NO: 648445 - DNA, 25 bp, Rattus norvegicus
tgtgagcaccacagagtgatctgtg

SEQ ID NO: 648446 - DNA, 25 bp, Rattus norvegicus
tgtgagcaccactgagtgatctgtg

SEQ ID NO: 648447 - DNA, 25 bp, Rattus norvegicus
tgtgagcacggcaacctccaacatg

SEQ ID NO: 648448 - DNA, 25 bp, Rattus norvegicus
tgtgagcacggctacctccaacatg

SEQ ID NO: 648449 - DNA, 25 bp, Rattus norvegicus
tgtgagcagacactcagagcccagt

SEQ ID NO: 648450 - DNA, 25 bp, Rattus norvegicus
tgtgagcagacagtcagagcccagt

SEQ ID NO: 648451 - DNA, 25 bp, Rattus norvegicus
tgtgagcagatcctgagaacccacc

SEQ ID NO: 648452 - DNA, 25 bp, Rattus norvegicus
tgtgagcagatcgtgagaacccacc

SEQ ID NO: 648453 - DNA, 25 bp, Rattus norvegicus
tgtgagcagatgagtttagggcccc

SEQ ID NO: 648454 - DNA, 25 bp, Rattus norvegicus
tgtgagcagatgtgtttagggcccc

SEQ ID NO: 648455 - DNA, 25 bp, Rattus norvegicus
tgtgagcataatcctgcctcagtct

SEQ ID NO: 648456 - DNA, 25 bp, Rattus norvegicus
tgtgagcataatgctgcctcagtct

SEQ ID NO: 648457 - DNA, 25 bp, Rattus norvegicus
tgtgagcatgtcagtgtgcattctg

SEQ ID NO: 648458 - DNA, 25 bp, Rattus norvegicus
tgtgagcatgtctgtgtgcattctg

SEQ ID NO: 648459 - DNA, 25 bp, Rattus norvegicus
tgtgagcattctctcactggatccc

SEQ ID NO: 648460 - DNA, 25 bp, Rattus norvegicus
tgtgagcattctgtcactggatccc

SEQ ID NO: 648461 - DNA, 25 bp, Rattus norvegicus
tgtgagcattgcagatgacgaatct

SEQ ID NO: 648462 - DNA, 25 bp, Rattus norvegicus
tgtgagcattgctgatgacgaatct

SEQ ID NO: 648463 - DNA, 25 bp, Rattus norvegicus
tgtgagccaatcaagaaggttgcat

SEQ ID NO: 648464 - DNA, 25 bp, Rattus norvegicus
tgtgagccaatctagaaggttgcat

SEQ ID NO: 648465 - DNA, 25 bp, Rattus norvegicus
tgtgagccaatgagaacccttcctt

SEQ ID NO: 648466 - DNA, 25 bp, Rattus norvegicus
tgtgagccaatgtgaacccttcctt

SEQ ID NO: 648467 - DNA, 25 bp, Rattus norvegicus
tgtgagccactcagagggacagcac

SEQ ID NO: 648468 - DNA, 25 bp, Rattus norvegicus
tgtgagccactctgagggacagcac

SEQ ID NO: 648469 - DNA, 25 bp, Rattus norvegicus
tgtgagccagcacaaccatgcagtc

SEQ ID NO: 648470 - DNA, 25 bp, Rattus norvegicus
tgtgagccagcagaaccatgcagtc

SEQ ID NO: 648471 - DNA, 25 bp, Rattus norvegicus
tgtgagccagctattcggatgtcat

SEQ ID NO: 648472 - DNA, 25 bp, Rattus norvegicus
tgtgagccagcttttcggatgtcat

SEQ ID NO: 648473 - DNA, 25 bp, Rattus norvegicus
tgtgagccagtcatattcaaaccac

SEQ ID NO: 648474 - DNA, 25 bp, Rattus norvegicus
tgtgagccagtcttattcaaaccac

SEQ ID NO: 648475 - DNA, 25 bp, Rattus norvegicus
tgtgagcccacactgtcagccattg

SEQ ID NO: 648476 - DNA, 25 bp, Rattus norvegicus
tgtgagcccacagtgtcagccattg

SEQ ID NO: 648477 - DNA, 25 bp, Rattus norvegicus
tgtgagcccaccatagctacagcta

SEQ ID NO: 648478 - DNA, 25 bp, Rattus norvegicus
tgtgagcccaccttagctacagcta

SEQ ID NO: 648479 - DNA, 25 bp, Rattus norvegicus
tgtgagcctccacagagaattcccc

SEQ ID NO: 648480 - DNA, 25 bp, Rattus norvegicus
tgtgagcctccagagagaattcccc

SEQ ID NO: 648481 - DNA, 25 bp, Rattus norvegicus
tgtgagcctggcctgtctgtcgaca

SEQ ID NO: 648482 - DNA, 25 bp, Rattus norvegicus
tgtgagcctggcgtgtctgtcgaca

SEQ ID NO: 648483 - DNA, 25 bp, Rattus norvegicus
tgtgagccttctacagatcatctgg

SEQ ID NO: 648484 - DNA, 25 bp, Rattus norvegicus
tgtgagccttcttcagatcatctgg

SEQ ID NO: 648485 - DNA, 25 bp, Rattus norvegicus
tgtgagcgaatgaagctggccatta

SEQ ID NO: 648486 - DNA, 25 bp, Rattus norvegicus
tgtgagcgaatgtagctggccatta

SEQ ID NO: 648487 - DNA, 25 bp, Rattus norvegicus
tgtgagcgactcattaacctggaga

SEQ ID NO: 648488 - DNA, 25 bp, Rattus norvegicus
tgtgagcgactctttaacctggaga

SEQ ID NO: 648489 - DNA, 25 bp, Rattus norvegicus
tgtgagcggcgaaggctcctagact

SEQ ID NO: 648490 - DNA, 25 bp, Rattus norvegicus
tgtgagcggcgatggctcctagact

SEQ ID NO: 648491 - DNA, 25 bp, Rattus norvegicus
tgtgagcggtaaccttctagcccat

SEQ ID NO: 648492 - DNA, 25 bp, Rattus norvegicus
tgtgagcggtaagcttctagcccat

SEQ ID NO: 648493 - DNA, 25 bp, Rattus norvegicus
tgtgagcgttctccatggctgcggg

SEQ ID NO: 648494 - DNA, 25 bp, Rattus norvegicus
tgtgagcgttctgcatggctgcggg

SEQ ID NO: 648495 - DNA, 25 bp, Rattus norvegicus
tgtgagctaccactttcctaaatag

SEQ ID NO: 648496 - DNA, 25 bp, Rattus norvegicus
tgtgagctaccagtttcctaaatag

SEQ ID NO: 648497 - DNA, 25 bp, Rattus norvegicus
tgtgagctatgcagccagtcaacgg

SEQ ID NO: 648498 - DNA, 25 bp, Rattus norvegicus
tgtgagctatgctgccagtcaacgg

SEQ ID NO: 648499 - DNA, 25 bp, Rattus norvegicus
tgtgagctcagtacactacgggcaa

SEQ ID NO: 648500 - DNA, 25 bp, Rattus norvegicus
tgtgagctcagttcactacgggcaa

SEQ ID NO: 648501 - DNA, 25 bp, Rattus norvegicus
tgtgagctctcacggttccatcgca

SEQ ID NO: 648502 - DNA, 25 bp, Rattus norvegicus
tgtgagctctcagggttccatcgca

SEQ ID NO: 648503 - DNA, 25 bp, Rattus norvegicus
tgtgagctctgaagtcaacctgact

SEQ ID NO: 648504 - DNA, 25 bp, Rattus norvegicus
tgtgagctctgatgtcaacctgact

SEQ ID NO: 648505 - DNA, 25 bp, Rattus norvegicus
tgtgagctgcccatagtattagtag

SEQ ID NO: 648506 - DNA, 25 bp, Rattus norvegicus
tgtgagctgcccttagtattagtag

SEQ ID NO: 648507 - DNA, 25 bp, Rattus norvegicus
tgtgagctgctccaatgcctgaatt

SEQ ID NO: 648508 - DNA, 25 bp, Rattus norvegicus
tgtgagctgctcgaatgcctgaatt

SEQ ID NO: 648509 - DNA, 25 bp, Rattus norvegicus
tgtgagctgctgagaattgatttta

SEQ ID NO: 648510 - DNA, 25 bp, Rattus norvegicus
tgtgagctgctgtgaattgatttta

SEQ ID NO: 648511 - DNA, 25 bp, Rattus norvegicus
tgtgagcttgctccagcgtttctca

SEQ ID NO: 648512 - DNA, 25 bp, Rattus norvegicus
tgtgagcttgctgcagcgtttctca

SEQ ID NO: 648513 - DNA, 25 bp, Rattus norvegicus
tgtgagcttgggaaagttactttgt

SEQ ID NO: 648514 - DNA, 25 bp, Rattus norvegicus
tgtgagcttgggtaagttactttgt

SEQ ID NO: 648515 - DNA, 25 bp, Rattus norvegicus
tgtgagctttttcgcacacctaagc

SEQ ID NO: 648516 - DNA, 25 bp, Rattus norvegicus
tgtgagctttttggcacacctaagc

SEQ ID NO: 648517 - DNA, 25 bp, Rattus norvegicus
tgtgaggaacagcagtgttgcccaa

SEQ ID NO: 648518 - DNA, 25 bp, Rattus norvegicus
tgtgaggaacaggagtgttgcccaa

SEQ ID NO: 648519 - DNA, 25 bp, Rattus norvegicus
tgtgaggaagctagtactgcccatc

SEQ ID NO: 648520 - DNA, 25 bp, Rattus norvegicus
tgtgaggaagcttgtactgcccatc

SEQ ID NO: 648521 - DNA, 25 bp, Rattus norvegicus
tgtgaggaagttaccctgacctctc

SEQ ID NO: 648522 - DNA, 25 bp, Rattus norvegicus
tgtgaggaagtttccctgacctctc

SEQ ID NO: 648523 - DNA, 25 bp, Rattus norvegicus
tgtgaggactcaatcccagtactca

SEQ ID NO: 648524 - DNA, 25 bp, Rattus norvegicus
tgtgaggactcattcccagtactca

SEQ ID NO: 648525 - DNA, 25 bp, Rattus norvegicus
tgtgaggatcccagccccagtgtgg

SEQ ID NO: 648526 - DNA, 25 bp, Rattus norvegicus
tgtgaggatccctgccccagtgtgg

SEQ ID NO: 648527 - DNA, 25 bp, Rattus norvegicus
tgtgaggatgagcaaccccatgcgc

SEQ ID NO: 648528 - DNA, 25 bp, Rattus norvegicus
tgtgaggatgaggaaccccatgcgc

SEQ ID NO: 648529 - DNA, 25 bp, Rattus norvegicus
tgtgaggcctctacctcgttgctga

SEQ ID NO: 648530 - DNA, 25 bp, Rattus norvegicus
tgtgaggcctcttcctcgttgctga

SEQ ID NO: 648531 - DNA, 25 bp, Rattus norvegicus
tgtgaggctccgaactcaggcccgg

SEQ ID NO: 648532 - DNA, 25 bp, Rattus norvegicus
tgtgaggctccgtactcaggcccgg

SEQ ID NO: 648533 - DNA, 25 bp, Rattus norvegicus
tgtgaggctgggacacgaacaccct

SEQ ID NO: 648534 - DNA, 25 bp, Rattus norvegicus
tgtgaggctgggtcacgaacaccct

SEQ ID NO: 648535 - DNA, 25 bp, Rattus norvegicus
tgtgagggacatagcactctatcct

SEQ ID NO: 648536 - DNA, 25 bp, Rattus norvegicus
tgtgagggacattgcactctatcct

SEQ ID NO: 648537 - DNA, 25 bp, Rattus norvegicus
tgtgagggacttaactgctgtgcta

SEQ ID NO: 648538 - DNA, 25 bp, Rattus norvegicus
tgtgagggactttactgctgtgcta

SEQ ID NO: 648539 - DNA, 25 bp, Rattus norvegicus
tgtgagggtagccccacgttttaag

SEQ ID NO: 648540 - DNA, 25 bp, Rattus norvegicus
tgtgagggtagcgccacgttttaag

SEQ ID NO: 648541 - DNA, 25 bp, Rattus norvegicus
tgtgaggtacacagcaagactgtgc

SEQ ID NO: 648542 - DNA, 25 bp, Rattus norvegicus
tgtgaggtacactgcaagactgtgc

SEQ ID NO: 648543 - DNA, 25 bp, Rattus norvegicus
tgtgaggtccccacggaagttactg

SEQ ID NO: 648544 - DNA, 25 bp, Rattus norvegicus
tgtgaggtcccctcggaagttactg

SEQ ID NO: 648545 - DNA, 25 bp, Rattus norvegicus
tgtgaggtcctgcattgtggcccct

SEQ ID NO: 648546 - DNA, 25 bp, Rattus norvegicus
tgtgaggtcctggattgtggcccct

SEQ ID NO: 648547 - DNA, 25 bp, Rattus norvegicus
tgtgaggtctgccaatgaactaact

SEQ ID NO: 648548 - DNA, 25 bp, Rattus norvegicus
tgtgaggtctgcgaatgaactaact

SEQ ID NO: 648549 - DNA, 25 bp, Rattus norvegicus
tgtgaggtttccattaacacgcctt

SEQ ID NO: 648550 - DNA, 25 bp, Rattus norvegicus
tgtgaggtttcctttaacacgcctt

SEQ ID NO: 648551 - DNA, 25 bp, Rattus norvegicus
tgtgagtaacatcgttgtcttcccc

SEQ ID NO: 648552 - DNA, 25 bp, Rattus norvegicus
tgtgagtaacatggttgtcttcccc

SEQ ID NO: 648553 - DNA, 25 bp, Rattus norvegicus
tgtgagtaatcacctgcaagcctcc

SEQ ID NO: 648554 - DNA, 25 bp, Rattus norvegicus
tgtgagtaatcagctgcaagcctcc

SEQ ID NO: 648555 - DNA, 25 bp, Rattus norvegicus
tgtgagtaccgcattccagaggaga

SEQ ID NO: 648556 - DNA, 25 bp, Rattus norvegicus
tgtgagtaccgctttccagaggaga

SEQ ID NO: 648557 - DNA, 25 bp, Rattus norvegicus
tgtgagtactcacaggccctcaaga

SEQ ID NO: 648558 - DNA, 25 bp, Rattus norvegicus
tgtgagtactcagaggccctcaaga

SEQ ID NO: 648559 - DNA, 25 bp, Rattus norvegicus
tgtgagtagctcattaagaccctgt

SEQ ID NO: 648560 - DNA, 25 bp, Rattus norvegicus
tgtgagtagctctttaagaccctgt

SEQ ID NO: 648561 - DNA, 25 bp, Rattus norvegicus
tgtgagtaggacatcatacacccta

SEQ ID NO: 648562 - DNA, 25 bp, Rattus norvegicus
tgtgagtaggacttcatacacccta

SEQ ID NO: 648563 - DNA, 25 bp, Rattus norvegicus
tgtgagtcacctacaatttcctgcc

SEQ ID NO: 648564 - DNA, 25 bp, Rattus norvegicus
tgtgagtcaccttcaatttcctgcc

SEQ ID NO: 648565 - DNA, 25 bp, Rattus norvegicus
tgtgagtccacaactgggatcccac

SEQ ID NO: 648566 - DNA, 25 bp, Rattus norvegicus
tgtgagtccacatctgggatcccac

SEQ ID NO: 648567 - DNA, 25 bp, Rattus norvegicus
tgtgagtcccatatttgtcccagaa

SEQ ID NO: 648568 - DNA, 25 bp, Rattus norvegicus
tgtgagtcccatttttgtcccagaa

SEQ ID NO: 648569 - DNA, 25 bp, Rattus norvegicus
tgtgagtccctccagcagggatata

SEQ ID NO: 648570 - DNA, 25 bp, Rattus norvegicus
tgtgagtccctcgagcagggatata

SEQ ID NO: 648571 - DNA, 25 bp, Rattus norvegicus
tgtgagtcctaacctattgccatga

SEQ ID NO: 648572 - DNA, 25 bp, Rattus norvegicus
tgtgagtcctaagctattgccatga

SEQ ID NO: 648573 - DNA, 25 bp, Rattus norvegicus
tgtgagtccttcaaaccatcgagaa

SEQ ID NO: 648574 - DNA, 25 bp, Rattus norvegicus
tgtgagtccttctaaccatcgagaa

SEQ ID NO: 648575 - DNA, 25 bp, Rattus norvegicus
tgtgagtcctttctcctgtacagaa

SEQ ID NO: 648576 - DNA, 25 bp, Rattus norvegicus
tgtgagtcctttgtcctgtacagaa

SEQ ID NO: 648577 - DNA, 25 bp, Rattus norvegicus
tgtgagtcgtctctcccttctccat

SEQ ID NO: 648578 - DNA, 25 bp, Rattus norvegicus
tgtgagtcgtctgtcccttctccat

SEQ ID NO: 648579 - DNA, 25 bp, Rattus norvegicus
tgtgagtctcaacatttcccgtccg

SEQ ID NO: 648580 - DNA, 25 bp, Rattus norvegicus
tgtgagtctcaagatttcccgtccg

SEQ ID NO: 648581 - DNA, 25 bp, Rattus norvegicus
tgtgagtctcacagccatgatgtcc

SEQ ID NO: 648582 - DNA, 25 bp, Rattus norvegicus
tgtgagtctcactgccatgatgtcc

SEQ ID NO: 648583 - DNA, 25 bp, Rattus norvegicus
tgtgagtgacaacggctccacatcc

SEQ ID NO: 648584 - DNA, 25 bp, Rattus norvegicus
tgtgagtgacaagggctccacatcc

SEQ ID NO: 648585 - DNA, 25 bp, Rattus norvegicus
tgtgagtgatctaagcagccccagc

SEQ ID NO: 648586 - DNA, 25 bp, Rattus norvegicus
tgtgagtgatcttagcagccccagc

SEQ ID NO: 648587 - DNA, 25 bp, Rattus norvegicus
tgtgagtgccaaacctcgatgccca

SEQ ID NO: 648588 - DNA, 25 bp, Rattus norvegicus
tgtgagtgccaatcctcgatgccca

SEQ ID NO: 648589 - DNA, 25 bp, Rattus norvegicus
tgtgagtgccctatgtagtgttaac

SEQ ID NO: 648590 - DNA, 25 bp, Rattus norvegicus
tgtgagtgccctttgtagtgttaac

SEQ ID NO: 648591 - DNA, 25 bp, Rattus norvegicus
tgtgagtgtgctccccgtgtccaga

SEQ ID NO: 648592 - DNA, 25 bp, Rattus norvegicus
tgtgagtgtgctgcccgtgtccaga

SEQ ID NO: 648593 - DNA, 25 bp, Rattus norvegicus
tgtgagttcaccatttagtggtcat

SEQ ID NO: 648594 - DNA, 25 bp, Rattus norvegicus
tgtgagttcaccttttagtggtcat

SEQ ID NO: 648595 - DNA, 25 bp, Rattus norvegicus
tgtgagttcccaccttctgttccag

SEQ ID NO: 648596 - DNA, 25 bp, Rattus norvegicus
tgtgagttcccagcttctgttccag

SEQ ID NO: 648597 - DNA, 25 bp, Rattus norvegicus
tgtgagttcctcagtgctgtgccaa

SEQ ID NO: 648598 - DNA, 25 bp, Rattus norvegicus
tgtgagttcctctgtgctgtgccaa

SEQ ID NO: 648599 - DNA, 25 bp, Rattus norvegicus
tgtgagttgcagagctgtcgctgaa

SEQ ID NO: 648600 - DNA, 25 bp, Rattus norvegicus
tgtgagttgcagtgctgtcgctgaa

SEQ ID NO: 648601 - DNA, 25 bp, Rattus norvegicus
tgtgagttgggccttccctaggaac

SEQ ID NO: 648602 - DNA, 25 bp, Rattus norvegicus
tgtgagttgggcgttccctaggaac

SEQ ID NO: 648603 - DNA, 25 bp, Rattus norvegicus
tgtgagtttcacactgcacgaaggt

SEQ ID NO: 648604 - DNA, 25 bp, Rattus norvegicus
tgtgagtttcacatctggcccaaag

SEQ ID NO: 648605 - DNA, 25 bp, Rattus norvegicus
tgtgagtttcactctgcacgaaggt

SEQ ID NO: 648606 - DNA, 25 bp, Rattus norvegicus
tgtgagtttcacttctggcccaaag

SEQ ID NO: 648607 - DNA, 25 bp, Rattus norvegicus
tgtgagtttgccctgcttcgagact

SEQ ID NO: 648608 - DNA, 25 bp, Rattus norvegicus
tgtgagtttgccgtgcttcgagact

SEQ ID NO: 648609 - DNA, 25 bp, Rattus norvegicus
tgtgataacaccatttggccagccc

SEQ ID NO: 648610 - DNA, 25 bp, Rattus norvegicus
tgtgataacaccttttggccagccc

SEQ ID NO: 648611 - DNA, 25 bp, Rattus norvegicus
tgtgataactcaactcaacccggga

SEQ ID NO: 648612 - DNA, 25 bp, Rattus norvegicus
tgtgataactcatctcaacccggga

SEQ ID NO: 648613 - DNA, 25 bp, Rattus norvegicus
tgtgataagcatcaccggagaggtt

SEQ ID NO: 648614 - DNA, 25 bp, Rattus norvegicus
tgtgataagcatgaccggagaggtt

SEQ ID NO: 648615 - DNA, 25 bp, Rattus norvegicus
tgtgataagctgatggcctaccctc

SEQ ID NO: 648616 - DNA, 25 bp, Rattus norvegicus
tgtgataagctgttggcctaccctc

SEQ ID NO: 648617 - DNA, 25 bp, Rattus norvegicus
tgtgataagttcatgtcgatcctat

SEQ ID NO: 648618 - DNA, 25 bp, Rattus norvegicus
tgtgataagttcttgtcgatcctat

SEQ ID NO: 648619 - DNA, 25 bp, Rattus norvegicus
tgtgataatccaactgcttgaggca

SEQ ID NO: 648620 - DNA, 25 bp, Rattus norvegicus
tgtgataatccatctgcttgaggca

SEQ ID NO: 648621 - DNA, 25 bp, Rattus norvegicus
tgtgataatgcacacctctaattcc

SEQ ID NO: 648622 - DNA, 25 bp, Rattus norvegicus
tgtgataatgcagacctctaattcc

SEQ ID NO: 648623 - DNA, 25 bp, Rattus norvegicus
tgtgatacataaactcccaaggcca

SEQ ID NO: 648624 - DNA, 25 bp, Rattus norvegicus
tgtgatacataatctcccaaggcca

SEQ ID NO: 648625 - DNA, 25 bp, Rattus norvegicus
tgtgataccaaaaccttccagtcag

SEQ ID NO: 648626 - DNA, 25 bp, Rattus norvegicus
tgtgataccaaatccttccagtcag

SEQ ID NO: 648627 - DNA, 25 bp, Rattus norvegicus
tgtgatagcacacacctgtaacccc

SEQ ID NO: 648628 - DNA, 25 bp, Rattus norvegicus
tgtgatagcacagacctgtaacccc

SEQ ID NO: 648629 - DNA, 25 bp, Rattus norvegicus
tgtgatagtgagagtcccctgtgta

SEQ ID NO: 648630 - DNA, 25 bp, Rattus norvegicus
tgtgatagtgagtgtcccctgtgta

SEQ ID NO: 648631 - DNA, 25 bp, Rattus norvegicus
tgtgatatacttccttgttccgcgt

SEQ ID NO: 648632 - DNA, 25 bp, Rattus norvegicus
tgtgatatacttgcttgttccgcgt

SEQ ID NO: 648633 - DNA, 25 bp, Rattus norvegicus
tgtgatatgaacagcagctccatgt

SEQ ID NO: 648634 - DNA, 25 bp, Rattus norvegicus
tgtgatatgaactgcagctccatgt

SEQ ID NO: 648635 - DNA, 25 bp, Rattus norvegicus
tgtgatatgcacagaaaggacatta

SEQ ID NO: 648636 - DNA, 25 bp, Rattus norvegicus
tgtgatatgcactgaaaggacatta

SEQ ID NO: 648637 - DNA, 25 bp, Rattus norvegicus
tgtgatattctaaccagtgcttgcc

SEQ ID NO: 648638 - DNA, 25 bp, Rattus norvegicus
tgtgatattctatccagtgcttgcc

SEQ ID NO: 648639 - DNA, 25 bp, Rattus norvegicus
tgtgatattgtgcttaggcctctgc

SEQ ID NO: 648640 - DNA, 25 bp, Rattus norvegicus
tgtgatattgtggttaggcctctgc

SEQ ID NO: 648641 - DNA, 25 bp, Rattus norvegicus
tgtgatatttccacagcctcctcag

SEQ ID NO: 648642 - DNA, 25 bp, Rattus norvegicus
tgtgatatttcctcagcctcctcag

SEQ ID NO: 648643 - DNA, 25 bp, Rattus norvegicus
tgtgatatttgcaaccgtccgtgag

SEQ ID NO: 648644 - DNA, 25 bp, Rattus norvegicus
tgtgatatttgctaccgtccgtgag

SEQ ID NO: 648645 - DNA, 25 bp, Rattus norvegicus
tgtgatcaagccattgtgctcccag

SEQ ID NO: 648646 - DNA, 25 bp, Rattus norvegicus
tgtgatcaagcctttgtgctcccag

SEQ ID NO: 648647 - DNA, 25 bp, Rattus norvegicus
tgtgatcaaggcaacacccagtacc

SEQ ID NO: 648648 - DNA, 25 bp, Rattus norvegicus
tgtgatcaaggctacacccagtacc

SEQ ID NO: 648649 - DNA, 25 bp, Rattus norvegicus
tgtgatcaataaaaacgtccctctg

SEQ ID NO: 648650 - DNA, 25 bp, Rattus norvegicus
tgtgatcaataataacgtccctctg

SEQ ID NO: 648651 - DNA, 25 bp, Rattus norvegicus
tgtgatcacagcattcaggctgcga

SEQ ID NO: 648652 - DNA, 25 bp, Rattus norvegicus
tgtgatcacagctttcaggctgcga

SEQ ID NO: 648653 - DNA, 25 bp, Rattus norvegicus
tgtgatcactgcatcttgcggccgg

SEQ ID NO: 648654 - DNA, 25 bp, Rattus norvegicus
tgtgatcactgcttcttgcggccgg

SEQ ID NO: 648655 - DNA, 25 bp, Rattus norvegicus
tgtgatcagatcaagtgtggtggat

SEQ ID NO: 648656 - DNA, 25 bp, Rattus norvegicus
tgtgatcagatctagtgtggtggat

SEQ ID NO: 648657 - DNA, 25 bp, Rattus norvegicus
tgtgatcagattcctctctctagta

SEQ ID NO: 648658 - DNA, 25 bp, Rattus norvegicus
tgtgatcagattgctctctctagta

SEQ ID NO: 648659 - DNA, 25 bp, Rattus norvegicus
tgtgatcatctcaagcttgctgcat

SEQ ID NO: 648660 - DNA, 25 bp, Rattus norvegicus
tgtgatcatctctagcttgctgcat

SEQ ID NO: 648661 - DNA, 25 bp, Rattus norvegicus
tgtgatcatgctcggacaccaccat

SEQ ID NO: 648662 - DNA, 25 bp, Rattus norvegicus
tgtgatcatgctgggacaccaccat

SEQ ID NO: 648663 - DNA, 25 bp, Rattus norvegicus
tgtgatccagctcccagcctagcat

SEQ ID NO: 648664 - DNA, 25 bp, Rattus norvegicus
tgtgatccagctcttgttacttact

SEQ ID NO: 648665 - DNA, 25 bp, Rattus norvegicus
tgtgatccagctgccagcctagcat

SEQ ID NO: 648666 - DNA, 25 bp, Rattus norvegicus
tgtgatccagctgttgttacttact

SEQ ID NO: 648667 - DNA, 25 bp, Rattus norvegicus
tgtgatcccatcctgtgttcaaagt

SEQ ID NO: 648668 - DNA, 25 bp, Rattus norvegicus
tgtgatcccatcgtgtgttcaaagt

SEQ ID NO: 648669 - DNA, 25 bp, Rattus norvegicus
tgtgatcccattattgacagcaaac

SEQ ID NO: 648670 - DNA, 25 bp, Rattus norvegicus
tgtgatcccatttttgacagcaaac

SEQ ID NO: 648671 - DNA, 25 bp, Rattus norvegicus
tgtgatccccaaaacctacctggtg

SEQ ID NO: 648672 - DNA, 25 bp, Rattus norvegicus
tgtgatccccaatacctacctggtg

SEQ ID NO: 648673 - DNA, 25 bp, Rattus norvegicus
tgtgatcccctgactagcaatagcc

SEQ ID NO: 648674 - DNA, 25 bp, Rattus norvegicus
tgtgatcccctgtctagcaatagcc

SEQ ID NO: 648675 - DNA, 25 bp, Rattus norvegicus
tgtgatccctacaattgattctgcc

SEQ ID NO: 648676 - DNA, 25 bp, Rattus norvegicus
tgtgatccctactattgattctgcc

SEQ ID NO: 648677 - DNA, 25 bp, Rattus norvegicus
tgtgatccctgactctgttgaggct

SEQ ID NO: 648678 - DNA, 25 bp, Rattus norvegicus
tgtgatccctgagtctgttgaggct

SEQ ID NO: 648679 - DNA, 25 bp, Rattus norvegicus
tgtgatccgggaaaagcccctcttc

SEQ ID NO: 648680 - DNA, 25 bp, Rattus norvegicus
tgtgatccgggataagcccctcttc

SEQ ID NO: 648681 - DNA, 25 bp, Rattus norvegicus
tgtgatccgggcactggagaacaga

SEQ ID NO: 648682 - DNA, 25 bp, Rattus norvegicus
tgtgatccgggctctggagaacaga

SEQ ID NO: 648683 - DNA, 25 bp, Rattus norvegicus
tgtgatcgcattcctcgttgcagag

SEQ ID NO: 648684 - DNA, 25 bp, Rattus norvegicus
tgtgatcgcattgctcgttgcagag

SEQ ID NO: 648685 - DNA, 25 bp, Rattus norvegicus
tgtgatcgcccacattgggtgagac

SEQ ID NO: 648686 - DNA, 25 bp, Rattus norvegicus
tgtgatcgcccagattgggtgagac

SEQ ID NO: 648687 - DNA, 25 bp, Rattus norvegicus
tgtgatctagagagtgggccgtaac

SEQ ID NO: 648688 - DNA, 25 bp, Rattus norvegicus
tgtgatctagagtgtgggccgtaac

SEQ ID NO: 648689 - DNA, 25 bp, Rattus norvegicus
tgtgatctcaatcttttgttttctc

SEQ ID NO: 648690 - DNA, 25 bp, Rattus norvegicus
tgtgatctcaatgttttgttttctc

SEQ ID NO: 648691 - DNA, 25 bp, Rattus norvegicus
tgtgatctcaggcttccaaccttgg

SEQ ID NO: 648692 - DNA, 25 bp, Rattus norvegicus
tgtgatctcagggttccaaccttgg

SEQ ID NO: 648693 - DNA, 25 bp, Rattus norvegicus
tgtgatctcctgaagcaaacccatt

SEQ ID NO: 648694 - DNA, 25 bp, Rattus norvegicus
tgtgatctcctgtagcaaacccatt

SEQ ID NO: 648695 - DNA, 25 bp, Rattus norvegicus
tgtgatctcgttagaccatcgtctt

SEQ ID NO: 648696 - DNA, 25 bp, Rattus norvegicus
tgtgatctcgtttgaccatcgtctt

SEQ ID NO: 648697 - DNA, 25 bp, Rattus norvegicus
tgtgatctctttctagttcccagaa

SEQ ID NO: 648698 - DNA, 25 bp, Rattus norvegicus
tgtgatctctttgtagttcccagaa

SEQ ID NO: 648699 - DNA, 25 bp, Rattus norvegicus
tgtgatctgcacatcacttgctcag

SEQ ID NO: 648700 - DNA, 25 bp, Rattus norvegicus
tgtgatctgcacttcacttgctcag

SEQ ID NO: 648701 - DNA, 25 bp, Rattus norvegicus
tgtgatctgctgaccggatgaagga

SEQ ID NO: 648702 - DNA, 25 bp, Rattus norvegicus
tgtgatctgctgtccggatgaagga

SEQ ID NO: 648703 - DNA, 25 bp, Rattus norvegicus
tgtgatcttaacactcagggtagac

SEQ ID NO: 648704 - DNA, 25 bp, Rattus norvegicus
tgtgatcttaactctcagggtagac

SEQ ID NO: 648705 - DNA, 25 bp, Rattus norvegicus
tgtgatcttacacactcaaccacct

SEQ ID NO: 648706 - DNA, 25 bp, Rattus norvegicus
tgtgatcttacagactcaaccacct

SEQ ID NO: 648707 - DNA, 25 bp, Rattus norvegicus
tgtgatcttgaaccactcatgtgag

SEQ ID NO: 648708 - DNA, 25 bp, Rattus norvegicus
tgtgatcttgaagcactcatgtgag

SEQ ID NO: 648709 - DNA, 25 bp, Rattus norvegicus
tgtgatgaatataccccaccatatc

SEQ ID NO: 648710 - DNA, 25 bp, Rattus norvegicus
tgtgatgaatattccccaccatatc

SEQ ID NO: 648711 - DNA, 25 bp, Rattus norvegicus
tgtgatgaccctaccaaagccctgc

SEQ ID NO: 648712 - DNA, 25 bp, Rattus norvegicus
tgtgatgacccttccaaagccctgc

SEQ ID NO: 648713 - DNA, 25 bp, Rattus norvegicus
tgtgatgacttaaccctcaggagac

SEQ ID NO: 648714 - DNA, 25 bp, Rattus norvegicus
tgtgatgacttatccctcaggagac

SEQ ID NO: 648715 - DNA, 25 bp, Rattus norvegicus
tgtgatgagtgaataccgaggcttt

SEQ ID NO: 648716 - DNA, 25 bp, Rattus norvegicus
tgtgatgagtgattaccgaggcttt

SEQ ID NO: 648717 - DNA, 25 bp, Rattus norvegicus
tgtgatgccctgaccagagtcgtgt

SEQ ID NO: 648718 - DNA, 25 bp, Rattus norvegicus
tgtgatgccctgtccagagtcgtgt

SEQ ID NO: 648719 - DNA, 25 bp, Rattus norvegicus
tgtgatgccgagcactgaactcagg

SEQ ID NO: 648720 - DNA, 25 bp, Rattus norvegicus
tgtgatgccgaggactgaactcagg

SEQ ID NO: 648721 - DNA, 25 bp, Rattus norvegicus
tgtgatgctaacaacagccacctca

SEQ ID NO: 648722 - DNA, 25 bp, Rattus norvegicus
tgtgatgctaacactcctcagggtg

SEQ ID NO: 648723 - DNA, 25 bp, Rattus norvegicus
tgtgatgctaactacagccacctca

SEQ ID NO: 648724 - DNA, 25 bp, Rattus norvegicus
tgtgatgctaactctcctcagggtg

SEQ ID NO: 648725 - DNA, 25 bp, Rattus norvegicus
tgtgatgcttaaaacccctggatac

SEQ ID NO: 648726 - DNA, 25 bp, Rattus norvegicus
tgtgatgcttaatacccctggatac

SEQ ID NO: 648727 - DNA, 25 bp, Rattus norvegicus
tgtgatgcttcactgcttccgagta

SEQ ID NO: 648728 - DNA, 25 bp, Rattus norvegicus
tgtgatgcttcagtgcttccgagta

SEQ ID NO: 648729 - DNA, 25 bp, Rattus norvegicus
tgtgatggcgttacactgtgatccc

SEQ ID NO: 648730 - DNA, 25 bp, Rattus norvegicus
tgtgatggcgtttcactgtgatccc

SEQ ID NO: 648731 - DNA, 25 bp, Rattus norvegicus
tgtgatggctctaccccttgaaggg

SEQ ID NO: 648732 - DNA, 25 bp, Rattus norvegicus
tgtgatggctcttccccttgaaggg

SEQ ID NO: 648733 - DNA, 25 bp, Rattus norvegicus
tgtgatggcttaagaccgctacctg

SEQ ID NO: 648734 - DNA, 25 bp, Rattus norvegicus
tgtgatggcttatgaccgctacctg

SEQ ID NO: 648735 - DNA, 25 bp, Rattus norvegicus
tgtgatggtgttagtcccggtccta

SEQ ID NO: 648736 - DNA, 25 bp, Rattus norvegicus
tgtgatggtgtttgtcccggtccta

SEQ ID NO: 648737 - DNA, 25 bp, Rattus norvegicus
tgtgatgtacttcgccagcctcgtg

SEQ ID NO: 648738 - DNA, 25 bp, Rattus norvegicus
tgtgatgtacttggccagcctcgtg

SEQ ID NO: 648739 - DNA, 25 bp, Rattus norvegicus
tgtgatgtatggaatgtgccctccc

SEQ ID NO: 648740 - DNA, 25 bp, Rattus norvegicus
tgtgatgtatggtatgtgccctccc

SEQ ID NO: 648741 - DNA, 25 bp, Rattus norvegicus
tgtgatgtattgacttccagttgca

SEQ ID NO: 648742 - DNA, 25 bp, Rattus norvegicus
tgtgatgtattgtcttccagttgca

SEQ ID NO: 648743 - DNA, 25 bp, Rattus norvegicus
tgtgatgtcccgcagagagactctg

SEQ ID NO: 648744 - DNA, 25 bp, Rattus norvegicus
tgtgatgtcccggagagagactctg

SEQ ID NO: 648745 - DNA, 25 bp, Rattus norvegicus
tgtgatgtgaacagctgggtgacca

SEQ ID NO: 648746 - DNA, 25 bp, Rattus norvegicus
tgtgatgtgaactgctgggtgacca

SEQ ID NO: 648747 - DNA, 25 bp, Rattus norvegicus
tgtgatgtgagcagcagccagcctg

SEQ ID NO: 648748 - DNA, 25 bp, Rattus norvegicus
tgtgatgtgagctgcagccagcctg

SEQ ID NO: 648749 - DNA, 25 bp, Rattus norvegicus
tgtgatgtggtacctatatcccgtc

SEQ ID NO: 648750 - DNA, 25 bp, Rattus norvegicus
tgtgatgtggtagctatatcccgtc

SEQ ID NO: 648751 - DNA, 25 bp, Rattus norvegicus
tgtgatgttagtccgcgggataata

SEQ ID NO: 648752 - DNA, 25 bp, Rattus norvegicus
tgtgatgttagtgcgcgggataata

SEQ ID NO: 648753 - DNA, 25 bp, Rattus norvegicus
tgtgatgttcacctgtggctttgac

SEQ ID NO: 648754 - DNA, 25 bp, Rattus norvegicus
tgtgatgttcacgtgtggctttgac

SEQ ID NO: 648755 - DNA, 25 bp, Rattus norvegicus
tgtgatgttcctaccagtagtgcca

SEQ ID NO: 648756 - DNA, 25 bp, Rattus norvegicus
tgtgatgttccttccagtagtgcca

SEQ ID NO: 648757 - DNA, 25 bp, Rattus norvegicus
tgtgatgttcgtagggctgtccgct

SEQ ID NO: 648758 - DNA, 25 bp, Rattus norvegicus
tgtgatgttcgttgggctgtccgct

SEQ ID NO: 648759 - DNA, 25 bp, Rattus norvegicus
tgtgattacagtattgagcttcccc

SEQ ID NO: 648760 - DNA, 25 bp, Rattus norvegicus
tgtgattacagttttgagcttcccc

SEQ ID NO: 648761 - DNA, 25 bp, Rattus norvegicus
tgtgattagtgactgccgcttgagc

SEQ ID NO: 648762 - DNA, 25 bp, Rattus norvegicus
tgtgattagtgagtgccgcttgagc

SEQ ID NO: 648763 - DNA, 25 bp, Rattus norvegicus
tgtgattcggtaaacaggcggccat

SEQ ID NO: 648764 - DNA, 25 bp, Rattus norvegicus
tgtgattcggtatacaggcggccat

SEQ ID NO: 648765 - DNA, 25 bp, Rattus norvegicus
tgtgattctaatccgtttttcccat

SEQ ID NO: 648766 - DNA, 25 bp, Rattus norvegicus
tgtgattctaatgcgtttttcccat

SEQ ID NO: 648767 - DNA, 25 bp, Rattus norvegicus
tgtgattctagtcagcctgtggcta

SEQ ID NO: 648768 - DNA, 25 bp, Rattus norvegicus
tgtgattctagtgagcctgtggcta

SEQ ID NO: 648769 - DNA, 25 bp, Rattus norvegicus
tgtgattgacttctcagactctcca

SEQ ID NO: 648770 - DNA, 25 bp, Rattus norvegicus
tgtgattgacttgtcagactctcca

SEQ ID NO: 648771 - DNA, 25 bp, Rattus norvegicus
tgtgattgcatgattccttcaactg

SEQ ID NO: 648772 - DNA, 25 bp, Rattus norvegicus
tgtgattgcatgtttccttcaactg

SEQ ID NO: 648773 - DNA, 25 bp, Rattus norvegicus
tgtgattggtgcaccctgggcctcc

SEQ ID NO: 648774 - DNA, 25 bp, Rattus norvegicus
tgtgattggtgctccctgggcctcc

SEQ ID NO: 648775 - DNA, 25 bp, Rattus norvegicus
tgtgattgtggcatggagagtcccc

SEQ ID NO: 648776 - DNA, 25 bp, Rattus norvegicus
tgtgattgtggcttggagagtcccc

SEQ ID NO: 648777 - DNA, 25 bp, Rattus norvegicus
tgtgatttaaacactgtttctcggt

SEQ ID NO: 648778 - DNA, 25 bp, Rattus norvegicus
tgtgatttaaactctgtttctcggt

SEQ ID NO: 648779 - DNA, 25 bp, Rattus norvegicus
tgtgatttcaacattgccttcctta

SEQ ID NO: 648780 - DNA, 25 bp, Rattus norvegicus
tgtgatttcaactttgccttcctta

SEQ ID NO: 648781 - DNA, 25 bp, Rattus norvegicus
tgtgatttccacactctggcttgta

SEQ ID NO: 648782 - DNA, 25 bp, Rattus norvegicus
tgtgatttccactctctggcttgta

SEQ ID NO: 648783 - DNA, 25 bp, Rattus norvegicus
tgtgatttctgaagctgcccatcgg

SEQ ID NO: 648784 - DNA, 25 bp, Rattus norvegicus
tgtgatttctgatgctgcccatcgg

SEQ ID NO: 648785 - DNA, 25 bp, Rattus norvegicus
tgtgatttctgcagacgttctcctt

SEQ ID NO: 648786 - DNA, 25 bp, Rattus norvegicus
tgtgatttctgctgacgttctcctt

SEQ ID NO: 648787 - DNA, 25 bp, Rattus norvegicus
tgtgatttgtctatgctcgctctat

SEQ ID NO: 648788 - DNA, 25 bp, Rattus norvegicus
tgtgatttgtctttgctcgctctat

SEQ ID NO: 648789 - DNA, 25 bp, Rattus norvegicus
tgtgattttatcctccagcctgtca

SEQ ID NO: 648790 - DNA, 25 bp, Rattus norvegicus
tgtgattttatcgtccagcctgtca

SEQ ID NO: 648791 - DNA, 25 bp, Rattus norvegicus
tgtgcaaaaccccatgttctagttg

SEQ ID NO: 648792 - DNA, 25 bp, Rattus norvegicus
tgtgcaaaacccgatgttctagttg

SEQ ID NO: 648793 - DNA, 25 bp, Rattus norvegicus
tgtgcaaaattgctggctgcctctg

SEQ ID NO: 648794 - DNA, 25 bp, Rattus norvegicus
tgtgcaaaattggtggctgcctctg

SEQ ID NO: 648795 - DNA, 25 bp, Rattus norvegicus
tgtgcaaacatcactatacattgaa

SEQ ID NO: 648796 - DNA, 25 bp, Rattus norvegicus
tgtgcaaacatctctatacattgaa

SEQ ID NO: 648797 - DNA, 25 bp, Rattus norvegicus
tgtgcaaacctgagggctagctgtc

SEQ ID NO: 648798 - DNA, 25 bp, Rattus norvegicus
tgtgcaaacctgtgggctagctgtc

SEQ ID NO: 648799 - DNA, 25 bp, Rattus norvegicus
tgtgcaaagaccctgtcgctgtggt

SEQ ID NO: 648800 - DNA, 25 bp, Rattus norvegicus
tgtgcaaagaccgtgtcgctgtggt

SEQ ID NO: 648801 - DNA, 25 bp, Rattus norvegicus
tgtgcaacaattcagctactgcctc

SEQ ID NO: 648802 - DNA, 25 bp, Rattus norvegicus
tgtgcaacaattgagctactgcctc

SEQ ID NO: 648803 - DNA, 25 bp, Rattus norvegicus
tgtgcaaccacaccgagttcagtta

SEQ ID NO: 648804 - DNA, 25 bp, Rattus norvegicus
tgtgcaaccacagcgagttcagtta

SEQ ID NO: 648805 - DNA, 25 bp, Rattus norvegicus
tgtgcaaccaggactcctacggaga

SEQ ID NO: 648806 - DNA, 25 bp, Rattus norvegicus
tgtgcaaccaggtctcctacggaga

SEQ ID NO: 648807 - DNA, 25 bp, Rattus norvegicus
tgtgcaacccttccatttatgtaaa

SEQ ID NO: 648808 - DNA, 25 bp, Rattus norvegicus
tgtgcaacccttgcatttatgtaaa

SEQ ID NO: 648809 - DNA, 25 bp, Rattus norvegicus
tgtgcaaccgcacacttctcagaat

SEQ ID NO: 648810 - DNA, 25 bp, Rattus norvegicus
tgtgcaaccgcagacttctcagaat

SEQ ID NO: 648811 - DNA, 25 bp, Rattus norvegicus
tgtgcaaccgcgctgagtatctaaa

SEQ ID NO: 648812 - DNA, 25 bp, Rattus norvegicus
tgtgcaaccgcggtgagtatctaaa

SEQ ID NO: 648813 - DNA, 25 bp, Rattus norvegicus
tgtgcaagtcagatgagccctccac

SEQ ID NO: 648814 - DNA, 25 bp, Rattus norvegicus
tgtgcaagtcagttgagccctccac

SEQ ID NO: 648815 - DNA, 25 bp, Rattus norvegicus
tgtgcaagtccactgtcaccagagc

SEQ ID NO: 648816 - DNA, 25 bp, Rattus norvegicus
tgtgcaagtccagtgtcaccagagc

SEQ ID NO: 648817 - DNA, 25 bp, Rattus norvegicus
tgtgcaagttatcgaggcctctgtc

SEQ ID NO: 648818 - DNA, 25 bp, Rattus norvegicus
tgtgcaagttatggaggcctctgtc

SEQ ID NO: 648819 - DNA, 25 bp, Rattus norvegicus
tgtgcaataacaacatctccgaggg

SEQ ID NO: 648820 - DNA, 25 bp, Rattus norvegicus
tgtgcaataacatcatctccgaggg

SEQ ID NO: 648821 - DNA, 25 bp, Rattus norvegicus
tgtgcaatatgccaaaaccgctctc

SEQ ID NO: 648822 - DNA, 25 bp, Rattus norvegicus
tgtgcaatatgcgaaaaccgctctc

SEQ ID NO: 648823 - DNA, 25 bp, Rattus norvegicus
tgtgcaatgacacaggtaatgacct

SEQ ID NO: 648824 - DNA, 25 bp, Rattus norvegicus
tgtgcaatgacagaggtaatgacct

SEQ ID NO: 648825 - DNA, 25 bp, Rattus norvegicus
tgtgcaatgcctcccctttgggaca

SEQ ID NO: 648826 - DNA, 25 bp, Rattus norvegicus
tgtgcaatgcctgccctttgggaca

SEQ ID NO: 648827 - DNA, 25 bp, Rattus norvegicus
tgtgcaatggtgctggctttgctac

SEQ ID NO: 648828 - DNA, 25 bp, Rattus norvegicus
tgtgcaatggtggtggctttgctac

SEQ ID NO: 648829 - DNA, 25 bp, Rattus norvegicus
tgtgcacaacttcgcccagtttttt

SEQ ID NO: 648830 - DNA, 25 bp, Rattus norvegicus
tgtgcacaacttggcccagtttttt

SEQ ID NO: 648831 - DNA, 25 bp, Rattus norvegicus
tgtgcacacaagctctcgggtgatg

SEQ ID NO: 648832 - DNA, 25 bp, Rattus norvegicus
tgtgcacacaaggtctcgggtgatg

SEQ ID NO: 648833 - DNA, 25 bp, Rattus norvegicus
tgtgcacacatgaacattctcataa

SEQ ID NO: 648834 - DNA, 25 bp, Rattus norvegicus
tgtgcacacatgtacattctcataa

SEQ ID NO: 648835 - DNA, 25 bp, Rattus norvegicus
tgtgcacacccgaccgagagtccat

SEQ ID NO: 648836 - DNA, 25 bp, Rattus norvegicus
tgtgcacacccgtccgagagtccat

SEQ ID NO: 648837 - DNA, 25 bp, Rattus norvegicus
tgtgcacacgccagtggtctagcag

SEQ ID NO: 648838 - DNA, 25 bp, Rattus norvegicus
tgtgcacacgcctgtggtctagcag

SEQ ID NO: 648839 - DNA, 25 bp, Rattus norvegicus
tgtgcacacggtcctttagaactac

SEQ ID NO: 648840 - DNA, 25 bp, Rattus norvegicus
tgtgcacacggtgctttagaactac

SEQ ID NO: 648841 - DNA, 25 bp, Rattus norvegicus
tgtgcacactccattttccttaata

SEQ ID NO: 648842 - DNA, 25 bp, Rattus norvegicus
tgtgcacactcctttttccttaata

SEQ ID NO: 648843 - DNA, 25 bp, Rattus norvegicus
tgtgcacactgcagatcacggacac

SEQ ID NO: 648844 - DNA, 25 bp, Rattus norvegicus
tgtgcacactgctgatcacggacac

SEQ ID NO: 648845 - DNA, 25 bp, Rattus norvegicus
tgtgcacacttacacacggctgagc

SEQ ID NO: 648846 - DNA, 25 bp, Rattus norvegicus
tgtgcacacttagacacggctgagc

SEQ ID NO: 648847 - DNA, 25 bp, Rattus norvegicus
tgtgcacagagcactggacccggtt

SEQ ID NO: 648848 - DNA, 25 bp, Rattus norvegicus
tgtgcacagagctctggacccggtt

SEQ ID NO: 648849 - DNA, 25 bp, Rattus norvegicus
tgtgcacagcctcgaaacctttcct

SEQ ID NO: 648850 - DNA, 25 bp, Rattus norvegicus
tgtgcacagcctggaaacctttcct

SEQ ID NO: 648851 - DNA, 25 bp, Rattus norvegicus
tgtgcacagctcatctctgaacaat

SEQ ID NO: 648852 - DNA, 25 bp, Rattus norvegicus
tgtgcacagctcttctctgaacaat

SEQ ID NO: 648853 - DNA, 25 bp, Rattus norvegicus
tgtgcacatacccagttactctaga

SEQ ID NO: 648854 - DNA, 25 bp, Rattus norvegicus
tgtgcacataccgagttactctaga

SEQ ID NO: 648855 - DNA, 25 bp, Rattus norvegicus
tgtgcacatcacacttgctgcaaag

SEQ ID NO: 648856 - DNA, 25 bp, Rattus norvegicus
tgtgcacatcactcttgctgcaaag

SEQ ID NO: 648857 - DNA, 25 bp, Rattus norvegicus
tgtgcacatgccagggcttgtatgt

SEQ ID NO: 648858 - DNA, 25 bp, Rattus norvegicus
tgtgcacatgcctgggcttgtatgt

SEQ ID NO: 648859 - DNA, 25 bp, Rattus norvegicus
tgtgcacatgtgatggcgtctaccc

SEQ ID NO: 648860 - DNA, 25 bp, Rattus norvegicus
tgtgcacatgtgttggcgtctaccc

SEQ ID NO: 648861 - DNA, 25 bp, Rattus norvegicus
tgtgcacattcaaaacctcgaagtt

SEQ ID NO: 648862 - DNA, 25 bp, Rattus norvegicus
tgtgcacattcataacctcgaagtt

SEQ ID NO: 648863 - DNA, 25 bp, Rattus norvegicus
tgtgcacattgtcctgcgttccacc

SEQ ID NO: 648864 - DNA, 25 bp, Rattus norvegicus
tgtgcacattgtgctgcgttccacc

SEQ ID NO: 648865 - DNA, 25 bp, Rattus norvegicus
tgtgcacatttgaacacctgactta

SEQ ID NO: 648866 - DNA, 25 bp, Rattus norvegicus
tgtgcacatttgcttgtatcttccc

SEQ ID NO: 648867 - DNA, 25 bp, Rattus norvegicus
tgtgcacatttggttgtatcttccc

SEQ ID NO: 648868 - DNA, 25 bp, Rattus norvegicus
tgtgcacatttgtacacctgactta

SEQ ID NO: 648869 - DNA, 25 bp, Rattus norvegicus
tgtgcaccacagacaatgatggatt

SEQ ID NO: 648870 - DNA, 25 bp, Rattus norvegicus
tgtgcaccacagtcaatgatggatt

SEQ ID NO: 648871 - DNA, 25 bp, Rattus norvegicus
tgtgcaccagcccttttgttgtaac

SEQ ID NO: 648872 - DNA, 25 bp, Rattus norvegicus
tgtgcaccagccgttttgttgtaac

SEQ ID NO: 648873 - DNA, 25 bp, Rattus norvegicus
tgtgcacccaccagtcgaatagagg

SEQ ID NO: 648874 - DNA, 25 bp, Rattus norvegicus
tgtgcacccacctgtcgaatagagg

SEQ ID NO: 648875 - DNA, 25 bp, Rattus norvegicus
tgtgcaccgagtcctgtgagccgta

SEQ ID NO: 648876 - DNA, 25 bp, Rattus norvegicus
tgtgcaccgagtgctgtgagccgta

SEQ ID NO: 648877 - DNA, 25 bp, Rattus norvegicus
tgtgcaccgcgaagagacaccgcta

SEQ ID NO: 648878 - DNA, 25 bp, Rattus norvegicus
tgtgcaccgcgatgagacaccgcta

SEQ ID NO: 648879 - DNA, 25 bp, Rattus norvegicus
tgtgcacctaggattgaggcccagt

SEQ ID NO: 648880 - DNA, 25 bp, Rattus norvegicus
tgtgcacctaggtttgaggcccagt

SEQ ID NO: 648881 - DNA, 25 bp, Rattus norvegicus
tgtgcacctgtgaccagagagtaca

SEQ ID NO: 648882 - DNA, 25 bp, Rattus norvegicus
tgtgcacctgtgtccagagagtaca

SEQ ID NO: 648883 - DNA, 25 bp, Rattus norvegicus
tgtgcacgcctcagcatgagaaaaa

SEQ ID NO: 648884 - DNA, 25 bp, Rattus norvegicus
tgtgcacgcctctgcatgagaaaaa

SEQ ID NO: 648885 - DNA, 25 bp, Rattus norvegicus
tgtgcacgccttcgacatggaggat

SEQ ID NO: 648886 - DNA, 25 bp, Rattus norvegicus
tgtgcacgccttggacatggaggat

SEQ ID NO: 648887 - DNA, 25 bp, Rattus norvegicus
tgtgcacggagtcctgcagctttca

SEQ ID NO: 648888 - DNA, 25 bp, Rattus norvegicus
tgtgcacggagtgctgcagctttca

SEQ ID NO: 648889 - DNA, 25 bp, Rattus norvegicus
tgtgcacgtgtcagtgtgtatgctt

SEQ ID NO: 648890 - DNA, 25 bp, Rattus norvegicus
tgtgcacgtgtctgtgtgtatgctt

SEQ ID NO: 648891 - DNA, 25 bp, Rattus norvegicus
tgtgcacgttcgaccctgtcggtgg

SEQ ID NO: 648892 - DNA, 25 bp, Rattus norvegicus
tgtgcacgttcgtccctgtcggtgg

SEQ ID NO: 648893 - DNA, 25 bp, Rattus norvegicus
tgtgcactaaaccatctcaagattc

SEQ ID NO: 648894 - DNA, 25 bp, Rattus norvegicus
tgtgcactaaacgatctcaagattc

SEQ ID NO: 648895 - DNA, 25 bp, Rattus norvegicus
tgtgcactaactacagatagctgga

SEQ ID NO: 648896 - DNA, 25 bp, Rattus norvegicus
tgtgcactaacttcagatagctgga

SEQ ID NO: 648897 - DNA, 25 bp, Rattus norvegicus
tgtgcactatttattgctctcctca

SEQ ID NO: 648898 - DNA, 25 bp, Rattus norvegicus
tgtgcactattttttgctctcctca

SEQ ID NO: 648899 - DNA, 25 bp, Rattus norvegicus
tgtgcactcactaccgtgttgatgc

SEQ ID NO: 648900 - DNA, 25 bp, Rattus norvegicus
tgtgcactcactctagaaaggcagt

SEQ ID NO: 648901 - DNA, 25 bp, Rattus norvegicus
tgtgcactcactgtagaaaggcagt

SEQ ID NO: 648902 - DNA, 25 bp, Rattus norvegicus
tgtgcactcacttccgtgttgatgc

SEQ ID NO: 648903 - DNA, 25 bp, Rattus norvegicus
tgtgcactccctctttggattgatg

SEQ ID NO: 648904 - DNA, 25 bp, Rattus norvegicus
tgtgcactccctgtttggattgatg

SEQ ID NO: 648905 - DNA, 25 bp, Rattus norvegicus
tgtgcactcctgcactttctgacct

SEQ ID NO: 648906 - DNA, 25 bp, Rattus norvegicus
tgtgcactcctggactttctgacct

SEQ ID NO: 648907 - DNA, 25 bp, Rattus norvegicus
tgtgcactcgagatttggccataga

SEQ ID NO: 648908 - DNA, 25 bp, Rattus norvegicus
tgtgcactcgagttttggccataga

SEQ ID NO: 648909 - DNA, 25 bp, Rattus norvegicus
tgtgcactcttgcaaaacacccata

SEQ ID NO: 648910 - DNA, 25 bp, Rattus norvegicus
tgtgcactcttggaaaacacccata

SEQ ID NO: 648911 - DNA, 25 bp, Rattus norvegicus
tgtgcactgaaccagaaatatttgg

SEQ ID NO: 648912 - DNA, 25 bp, Rattus norvegicus
tgtgcactgaacgagaaatatttgg

SEQ ID NO: 648913 - DNA, 25 bp, Rattus norvegicus
tgtgcactgacgctctcctaggaga

SEQ ID NO: 648914 - DNA, 25 bp, Rattus norvegicus
tgtgcactgacggtctcctaggaga

SEQ ID NO: 648915 - DNA, 25 bp, Rattus norvegicus
tgtgcactgaggaccgtgggctata

SEQ ID NO: 648916 - DNA, 25 bp, Rattus norvegicus
tgtgcactgaggtccgtgggctata

SEQ ID NO: 648917 - DNA, 25 bp, Rattus norvegicus
tgtgcactgccacatactgttcatt

SEQ ID NO: 648918 - DNA, 25 bp, Rattus norvegicus
tgtgcactgccagatactgttcatt

SEQ ID NO: 648919 - DNA, 25 bp, Rattus norvegicus
tgtgcactgggaagcatcttacctt

SEQ ID NO: 648920 - DNA, 25 bp, Rattus norvegicus
tgtgcactgggatgcatcttacctt

SEQ ID NO: 648921 - DNA, 25 bp, Rattus norvegicus
tgtgcactgttcattcagtctggtc

SEQ ID NO: 648922 - DNA, 25 bp, Rattus norvegicus
tgtgcactgttctttcagtctggtc

SEQ ID NO: 648923 - DNA, 25 bp, Rattus norvegicus
tgtgcactgttgagtctgcgggcca

SEQ ID NO: 648924 - DNA, 25 bp, Rattus norvegicus
tgtgcactgttgtgtctgcgggcca

SEQ ID NO: 648925 - DNA, 25 bp, Rattus norvegicus
tgtgcacttaggagcaagcttccct

SEQ ID NO: 648926 - DNA, 25 bp, Rattus norvegicus
tgtgcacttaggtgcaagcttccct

SEQ ID NO: 648927 - DNA, 25 bp, Rattus norvegicus
tgtgcagaaatcaccactcagtcta

SEQ ID NO: 648928 - DNA, 25 bp, Rattus norvegicus
tgtgcagaaatccactgagccccag

SEQ ID NO: 648929 - DNA, 25 bp, Rattus norvegicus
tgtgcagaaatcgactgagccccag

SEQ ID NO: 648930 - DNA, 25 bp, Rattus norvegicus
tgtgcagaaatctccactcagtcta

SEQ ID NO: 648931 - DNA, 25 bp, Rattus norvegicus
tgtgcagaagcaacttaaggccctt

SEQ ID NO: 648932 - DNA, 25 bp, Rattus norvegicus
tgtgcagaagcatcttaaggccctt

SEQ ID NO: 648933 - DNA, 25 bp, Rattus norvegicus
tgtgcagaatttagtgctgccccgg

SEQ ID NO: 648934 - DNA, 25 bp, Rattus norvegicus
tgtgcagaattttgtgctgccccgg

SEQ ID NO: 648935 - DNA, 25 bp, Rattus norvegicus
tgtgcagacacaaccttcaatgacc

SEQ ID NO: 648936 - DNA, 25 bp, Rattus norvegicus
tgtgcagacacatccttcaatgacc

SEQ ID NO: 648937 - DNA, 25 bp, Rattus norvegicus
tgtgcagacattagacccagaactt

SEQ ID NO: 648938 - DNA, 25 bp, Rattus norvegicus
tgtgcagacatttgacccagaactt

SEQ ID NO: 648939 - DNA, 25 bp, Rattus norvegicus
tgtgcagaccacctgctgttccatg

SEQ ID NO: 648940 - DNA, 25 bp, Rattus norvegicus
tgtgcagaccacgtgctgttccatg

SEQ ID NO: 648941 - DNA, 25 bp, Rattus norvegicus
tgtgcagacccaagaccactcaggg

SEQ ID NO: 648942 - DNA, 25 bp, Rattus norvegicus
tgtgcagacccatgaccactcaggg

SEQ ID NO: 648943 - DNA, 25 bp, Rattus norvegicus
tgtgcagaccctagtatgagaacct

SEQ ID NO: 648944 - DNA, 25 bp, Rattus norvegicus
tgtgcagacccttgtatgagaacct

SEQ ID NO: 648945 - DNA, 25 bp, Rattus norvegicus
tgtgcagacgccactgtgaatcgga

SEQ ID NO: 648946 - DNA, 25 bp, Rattus norvegicus
tgtgcagacgcctctgtgaatcgga

SEQ ID NO: 648947 - DNA, 25 bp, Rattus norvegicus
tgtgcagacgtcctgtgctttcaga

SEQ ID NO: 648948 - DNA, 25 bp, Rattus norvegicus
tgtgcagacgtcgtgtgctttcaga

SEQ ID NO: 648949 - DNA, 25 bp, Rattus norvegicus
tgtgcagactctcctaaaccagtat

SEQ ID NO: 648950 - DNA, 25 bp, Rattus norvegicus
tgtgcagactctgctaaaccagtat

SEQ ID NO: 648951 - DNA, 25 bp, Rattus norvegicus
tgtgcagactgcaggaagggcttca

SEQ ID NO: 648952 - DNA, 25 bp, Rattus norvegicus
tgtgcagactgctggaagggcttca

SEQ ID NO: 648953 - DNA, 25 bp, Rattus norvegicus
tgtgcagacttgatgtgcggtcccg

SEQ ID NO: 648954 - DNA, 25 bp, Rattus norvegicus
tgtgcagacttgttgtgcggtcccg

SEQ ID NO: 648955 - DNA, 25 bp, Rattus norvegicus
tgtgcagactttctacttctctact

SEQ ID NO: 648956 - DNA, 25 bp, Rattus norvegicus
tgtgcagactttgtacttctctact

SEQ ID NO: 648957 - DNA, 25 bp, Rattus norvegicus
tgtgcagagagcactccagcctcta

SEQ ID NO: 648958 - DNA, 25 bp, Rattus norvegicus
tgtgcagagagctctccagcctcta

SEQ ID NO: 648959 - DNA, 25 bp, Rattus norvegicus
tgtgcagatcttcattgcaacccca

SEQ ID NO: 648960 - DNA, 25 bp, Rattus norvegicus
tgtgcagatcttgattgcaacccca

SEQ ID NO: 648961 - DNA, 25 bp, Rattus norvegicus
tgtgcagattaaccagcctctccta

SEQ ID NO: 648962 - DNA, 25 bp, Rattus norvegicus
tgtgcagattaagcagcctctccta

SEQ ID NO: 648963 - DNA, 25 bp, Rattus norvegicus
tgtgcagcaggaataccttctgtag

SEQ ID NO: 648964 - DNA, 25 bp, Rattus norvegicus
tgtgcagcaggattaccttctgtag

SEQ ID NO: 648965 - DNA, 25 bp, Rattus norvegicus
tgtgcagcaggtacagcgtcttccg

SEQ ID NO: 648966 - DNA, 25 bp, Rattus norvegicus
tgtgcagcaggttcagcgtcttccg

SEQ ID NO: 648967 - DNA, 25 bp, Rattus norvegicus
tgtgcagccactcaactcttagtgg

SEQ ID NO: 648968 - DNA, 25 bp, Rattus norvegicus
tgtgcagccactgaactcttagtgg

SEQ ID NO: 648969 - DNA, 25 bp, Rattus norvegicus
tgtgcagccatcaacagcaagtgct

SEQ ID NO: 648970 - DNA, 25 bp, Rattus norvegicus
tgtgcagccatctacagcaagtgct

SEQ ID NO: 648971 - DNA, 25 bp, Rattus norvegicus
tgtgcagcccagctttttcaggcga

SEQ ID NO: 648972 - DNA, 25 bp, Rattus norvegicus
tgtgcagcccaggtttttcaggcga

SEQ ID NO: 648973 - DNA, 25 bp, Rattus norvegicus
tgtgcagccctactacagttgtatt

SEQ ID NO: 648974 - DNA, 25 bp, Rattus norvegicus
tgtgcagccctagtacagttgtatt

SEQ ID NO: 648975 - DNA, 25 bp, Rattus norvegicus
tgtgcagccggaactcacaagctgt

SEQ ID NO: 648976 - DNA, 25 bp, Rattus norvegicus
tgtgcagccggatctcacaagctgt

SEQ ID NO: 648977 - DNA, 25 bp, Rattus norvegicus
tgtgcagcctcgcatgacagttgtc

SEQ ID NO: 648978 - DNA, 25 bp, Rattus norvegicus
tgtgcagcctcggatgacagttgtc

SEQ ID NO: 648979 - DNA, 25 bp, Rattus norvegicus
tgtgcagcctgacacctgggagata

SEQ ID NO: 648980 - DNA, 25 bp, Rattus norvegicus
tgtgcagcctgagacctgggagata

SEQ ID NO: 648981 - DNA, 25 bp, Rattus norvegicus
tgtgcagcctgtccacggcaggata

SEQ ID NO: 648982 - DNA, 25 bp, Rattus norvegicus
tgtgcagcctgtcctcagtgagtgc

SEQ ID NO: 648983 - DNA, 25 bp, Rattus norvegicus
tgtgcagcctgtgcacggcaggata

SEQ ID NO: 648984 - DNA, 25 bp, Rattus norvegicus
tgtgcagcctgtgctcagtgagtgc

SEQ ID NO: 648985 - DNA, 25 bp, Rattus norvegicus
tgtgcagccttgagacagacttccc

SEQ ID NO: 648986 - DNA, 25 bp, Rattus norvegicus
tgtgcagccttgtgacagacttccc

SEQ ID NO: 648987 - DNA, 25 bp, Rattus norvegicus
tgtgcagcggctatgtgccggttcc

SEQ ID NO: 648988 - DNA, 25 bp, Rattus norvegicus
tgtgcagcggctttgtgccggttcc

SEQ ID NO: 648989 - DNA, 25 bp, Rattus norvegicus
tgtgcagctcgaagtcggcgtcgac

SEQ ID NO: 648990 - DNA, 25 bp, Rattus norvegicus
tgtgcagctcgatgtcggcgtcgac

SEQ ID NO: 648991 - DNA, 25 bp, Rattus norvegicus
tgtgcagctgctcgagggtctccat

SEQ ID NO: 648992 - DNA, 25 bp, Rattus norvegicus
tgtgcagctgctggagggtctccat

SEQ ID NO: 648993 - DNA, 25 bp, Rattus norvegicus
tgtgcagcttcccaagccagtgcag

SEQ ID NO: 648994 - DNA, 25 bp, Rattus norvegicus
tgtgcagcttccgaagccagtgcag

SEQ ID NO: 648995 - DNA, 25 bp, Rattus norvegicus
tgtgcaggagcacgacaccatttgt

SEQ ID NO: 648996 - DNA, 25 bp, Rattus norvegicus
tgtgcaggagcaggacaccatttgt

SEQ ID NO: 648997 - DNA, 25 bp, Rattus norvegicus
tgtgcaggatccaggtccgtgaacc

SEQ ID NO: 648998 - DNA, 25 bp, Rattus norvegicus
tgtgcaggatcctggtccgtgaacc

SEQ ID NO: 648999 - DNA, 25 bp, Rattus norvegicus
tgtgcaggcaacaaacagtccaagt

SEQ ID NO: 649000 - DNA, 25 bp, Rattus norvegicus
tgtgcaggcaactaacagtccaagt

SEQ ID NO: 649001 - DNA, 25 bp, Rattus norvegicus
tgtgcaggcacaccgatacagtgag

SEQ ID NO: 649002 - DNA, 25 bp, Rattus norvegicus
tgtgcaggcacagcgatacagtgag

SEQ ID NO: 649003 - DNA, 25 bp, Rattus norvegicus
tgtgcaggcactaatcaccttattc

SEQ ID NO: 649004 - DNA, 25 bp, Rattus norvegicus
tgtgcaggcacttatcaccttattc

SEQ ID NO: 649005 - DNA, 25 bp, Rattus norvegicus
tgtgcaggctggaattatcaacacg

SEQ ID NO: 649006 - DNA, 25 bp, Rattus norvegicus
tgtgcaggctggtattatcaacacg

SEQ ID NO: 649007 - DNA, 25 bp, Rattus norvegicus
tgtgcagggccaacatgaccagttt

SEQ ID NO: 649008 - DNA, 25 bp, Rattus norvegicus
tgtgcagggccatcatgaccagttt

SEQ ID NO: 649009 - DNA, 25 bp, Rattus norvegicus
tgtgcagggcttaatccatctactt

SEQ ID NO: 649010 - DNA, 25 bp, Rattus norvegicus
tgtgcagggctttatccatctactt

SEQ ID NO: 649011 - DNA, 25 bp, Rattus norvegicus
tgtgcagggtagatctccagagcca

SEQ ID NO: 649012 - DNA, 25 bp, Rattus norvegicus
tgtgcagggtagttctccagagcca

SEQ ID NO: 649013 - DNA, 25 bp, Rattus norvegicus
tgtgcaggtttaacttttcacttgc

SEQ ID NO: 649014 - DNA, 25 bp, Rattus norvegicus
tgtgcaggtttatcttttcacttgc

SEQ ID NO: 649015 - DNA, 25 bp, Rattus norvegicus
tgtgcagtaattagaggatctcctc

SEQ ID NO: 649016 - DNA, 25 bp, Rattus norvegicus
tgtgcagtaatttgaggatctcctc

SEQ ID NO: 649017 - DNA, 25 bp, Rattus norvegicus
tgtgcagtagttacacttcagcgtg

SEQ ID NO: 649018 - DNA, 25 bp, Rattus norvegicus
tgtgcagtagtttcacttcagcgtg

SEQ ID NO: 649019 - DNA, 25 bp, Rattus norvegicus
tgtgcagtcactaagaagtcgcccc

SEQ ID NO: 649020 - DNA, 25 bp, Rattus norvegicus
tgtgcagtcactacattgagtccca

SEQ ID NO: 649021 - DNA, 25 bp, Rattus norvegicus
tgtgcagtcacttagaagtcgcccc

SEQ ID NO: 649022 - DNA, 25 bp, Rattus norvegicus
tgtgcagtcacttcattgagtccca

SEQ ID NO: 649023 - DNA, 25 bp, Rattus norvegicus
tgtgcagtccatctaccaatatctt

SEQ ID NO: 649024 - DNA, 25 bp, Rattus norvegicus
tgtgcagtccatgtaccaatatctt

SEQ ID NO: 649025 - DNA, 25 bp, Rattus norvegicus
tgtgcagtctgcatgtattcaacaa

SEQ ID NO: 649026 - DNA, 25 bp, Rattus norvegicus
tgtgcagtctgcttgtattcaacaa

SEQ ID NO: 649027 - DNA, 25 bp, Rattus norvegicus
tgtgcagtggcactcttccatctga

SEQ ID NO: 649028 - DNA, 25 bp, Rattus norvegicus
tgtgcagtggcagtcttccatctga

SEQ ID NO: 649029 - DNA, 25 bp, Rattus norvegicus
tgtgcagtgtgtcgtttcatttccc

SEQ ID NO: 649030 - DNA, 25 bp, Rattus norvegicus
tgtgcagtgtgtggtttcatttccc

SEQ ID NO: 649031 - DNA, 25 bp, Rattus norvegicus
tgtgcagttcgtattggttgtccat

SEQ ID NO: 649032 - DNA, 25 bp, Rattus norvegicus
tgtgcagttcgttttggttgtccat

SEQ ID NO: 649033 - DNA, 25 bp, Rattus norvegicus
tgtgcagtttctacccaaagcaagg

SEQ ID NO: 649034 - DNA, 25 bp, Rattus norvegicus
tgtgcagtttcttcccaaagcaagg

SEQ ID NO: 649035 - DNA, 25 bp, Rattus norvegicus
tgtgcataactcaagttccccttgg

SEQ ID NO: 649036 - DNA, 25 bp, Rattus norvegicus
tgtgcataactctagttccccttgg

SEQ ID NO: 649037 - DNA, 25 bp, Rattus norvegicus
tgtgcataccggcaatgcatgctgt

SEQ ID NO: 649038 - DNA, 25 bp, Rattus norvegicus
tgtgcataccgggaatgcatgctgt

SEQ ID NO: 649039 - DNA, 25 bp, Rattus norvegicus
tgtgcatagactcagggccatggcc

SEQ ID NO: 649040 - DNA, 25 bp, Rattus norvegicus
tgtgcatagactgagggccatggcc

SEQ ID NO: 649041 - DNA, 25 bp, Rattus norvegicus
tgtgcatatgccataactctgacca

SEQ ID NO: 649042 - DNA, 25 bp, Rattus norvegicus
tgtgcatatgccttaactctgacca

SEQ ID NO: 649043 - DNA, 25 bp, Rattus norvegicus
tgtgcatatgtactactgtgcatgt

SEQ ID NO: 649044 - DNA, 25 bp, Rattus norvegicus
tgtgcatatgtagtactgtgcatgt

SEQ ID NO: 649045 - DNA, 25 bp, Rattus norvegicus
tgtgcatcaggcatcaagataggct

SEQ ID NO: 649046 - DNA, 25 bp, Rattus norvegicus
tgtgcatcaggcttcaagataggct

SEQ ID NO: 649047 - DNA, 25 bp, Rattus norvegicus
tgtgcatcaggtcccatcatatagt

SEQ ID NO: 649048 - DNA, 25 bp, Rattus norvegicus
tgtgcatcaggtgccatcatatagt

SEQ ID NO: 649049 - DNA, 25 bp, Rattus norvegicus
tgtgcatccgctcctttcgggacat

SEQ ID NO: 649050 - DNA, 25 bp, Rattus norvegicus
tgtgcatccgctgctttcgggacat

SEQ ID NO: 649051 - DNA, 25 bp, Rattus norvegicus
tgtgcatctccaagctttggctgca

SEQ ID NO: 649052 - DNA, 25 bp, Rattus norvegicus
tgtgcatctccatgctttggctgca

SEQ ID NO: 649053 - DNA, 25 bp, Rattus norvegicus
tgtgcatctgtcaggttatctaccc

SEQ ID NO: 649054 - DNA, 25 bp, Rattus norvegicus
tgtgcatctgtctggttatctaccc

SEQ ID NO: 649055 - DNA, 25 bp, Rattus norvegicus
tgtgcatcttctacagcagcctggg

SEQ ID NO: 649056 - DNA, 25 bp, Rattus norvegicus
tgtgcatcttcttcagcagcctggg

SEQ ID NO: 649057 - DNA, 25 bp, Rattus norvegicus
tgtgcatctttaaccccatcaactt

SEQ ID NO: 649058 - DNA, 25 bp, Rattus norvegicus
tgtgcatctttatccccatcaactt

SEQ ID NO: 649059 - DNA, 25 bp, Rattus norvegicus
tgtgcatgaaacaagatccctgtct

SEQ ID NO: 649060 - DNA, 25 bp, Rattus norvegicus
tgtgcatgaaacacgagcccagcat

SEQ ID NO: 649061 - DNA, 25 bp, Rattus norvegicus
tgtgcatgaaactagatccctgtct

SEQ ID NO: 649062 - DNA, 25 bp, Rattus norvegicus
tgtgcatgaaactcgagcccagcat

SEQ ID NO: 649063 - DNA, 25 bp, Rattus norvegicus
tgtgcatgacacatggcatctgcta

SEQ ID NO: 649064 - DNA, 25 bp, Rattus norvegicus
tgtgcatgacacttggcatctgcta

SEQ ID NO: 649065 - DNA, 25 bp, Rattus norvegicus
tgtgcatgaggtcccttgaagccat

SEQ ID NO: 649066 - DNA, 25 bp, Rattus norvegicus
tgtgcatgaggtgccttgaagccat

SEQ ID NO: 649067 - DNA, 25 bp, Rattus norvegicus
tgtgcatgctacagtaaggtggttt

SEQ ID NO: 649068 - DNA, 25 bp, Rattus norvegicus
tgtgcatgctactgtaaggtggttt

SEQ ID NO: 649069 - DNA, 25 bp, Rattus norvegicus
tgtgcatggatgctggcaacctcgt

SEQ ID NO: 649070 - DNA, 25 bp, Rattus norvegicus
tgtgcatggatggtggcaacctcgt

SEQ ID NO: 649071 - DNA, 25 bp, Rattus norvegicus
tgtgcatggctaacccactctcaag

SEQ ID NO: 649072 - DNA, 25 bp, Rattus norvegicus
tgtgcatggctatcccactctcaag

SEQ ID NO: 649073 - DNA, 25 bp, Rattus norvegicus
tgtgcatgggttctgcgtcttcagc

SEQ ID NO: 649074 - DNA, 25 bp, Rattus norvegicus
tgtgcatgggttgtgcgtcttcagc

SEQ ID NO: 649075 - DNA, 25 bp, Rattus norvegicus
tgtgcatggtgtcttgtgccttaga

SEQ ID NO: 649076 - DNA, 25 bp, Rattus norvegicus
tgtgcatggtgtgttgtgccttaga

SEQ ID NO: 649077 - DNA, 25 bp, Rattus norvegicus
tgtgcatgtaccctctattcttttg

SEQ ID NO: 649078 - DNA, 25 bp, Rattus norvegicus
tgtgcatgtaccgtctattcttttg

SEQ ID NO: 649079 - DNA, 25 bp, Rattus norvegicus
tgtgcatgtcagatctcagcagagt

SEQ ID NO: 649080 - DNA, 25 bp, Rattus norvegicus
tgtgcatgtcagttctcagcagagt

SEQ ID NO: 649081 - DNA, 25 bp, Rattus norvegicus
tgtgcatgtccgagtgtgagattgt

SEQ ID NO: 649082 - DNA, 25 bp, Rattus norvegicus
tgtgcatgtccgtgtgtgagattgt

SEQ ID NO: 649083 - DNA, 25 bp, Rattus norvegicus
tgtgcatgtgcgaccgtcccataca

SEQ ID NO: 649084 - DNA, 25 bp, Rattus norvegicus
tgtgcatgtgcgtccgtcccataca

SEQ ID NO: 649085 - DNA, 25 bp, Rattus norvegicus
tgtgcatgtgctattctctgattaa

SEQ ID NO: 649086 - DNA, 25 bp, Rattus norvegicus
tgtgcatgtgcttttctctgattaa

SEQ ID NO: 649087 - DNA, 25 bp, Rattus norvegicus
tgtgcatgtggtctggccctctcct

SEQ ID NO: 649088 - DNA, 25 bp, Rattus norvegicus
tgtgcatgtggtgtggccctctcct

SEQ ID NO: 649089 - DNA, 25 bp, Rattus norvegicus
tgtgcatgtgtgctcatgaatacat

SEQ ID NO: 649090 - DNA, 25 bp, Rattus norvegicus
tgtgcatgtgtggtcatgaatacat

SEQ ID NO: 649091 - DNA, 25 bp, Rattus norvegicus
tgtgcatgtgttactcactggtcat

SEQ ID NO: 649092 - DNA, 25 bp, Rattus norvegicus
tgtgcatgtgtttctcactggtcat

SEQ ID NO: 649093 - DNA, 25 bp, Rattus norvegicus
tgtgcattcacaaaacgagctgtta

SEQ ID NO: 649094 - DNA, 25 bp, Rattus norvegicus
tgtgcattcacataacgagctgtta

SEQ ID NO: 649095 - DNA, 25 bp, Rattus norvegicus
tgtgcattcggtatggtttctgtag

SEQ ID NO: 649096 - DNA, 25 bp, Rattus norvegicus
tgtgcattcggtttggtttctgtag

SEQ ID NO: 649097 - DNA, 25 bp, Rattus norvegicus
tgtgcattctctctggagtcggcct

SEQ ID NO: 649098 - DNA, 25 bp, Rattus norvegicus
tgtgcattctctgtggagtcggcct

SEQ ID NO: 649099 - DNA, 25 bp, Rattus norvegicus
tgtgcattctttaccttcctggtac

SEQ ID NO: 649100 - DNA, 25 bp, Rattus norvegicus
tgtgcattcttttccttcctggtac

SEQ ID NO: 649101 - DNA, 25 bp, Rattus norvegicus
tgtgcattgcacacatggccgtcat

SEQ ID NO: 649102 - DNA, 25 bp, Rattus norvegicus
tgtgcattgcactcatggccgtcat

SEQ ID NO: 649103 - DNA, 25 bp, Rattus norvegicus
tgtgcattgcgcagggctacgccaa

SEQ ID NO: 649104 - DNA, 25 bp, Rattus norvegicus
tgtgcattgcgctgggctacgccaa

SEQ ID NO: 649105 - DNA, 25 bp, Rattus norvegicus
tgtgcattggagacatgggcctctt

SEQ ID NO: 649106 - DNA, 25 bp, Rattus norvegicus
tgtgcattggagtcatgggcctctt

SEQ ID NO: 649107 - DNA, 25 bp, Rattus norvegicus
tgtgcattgtgcagtgaaacctctg

SEQ ID NO: 649108 - DNA, 25 bp, Rattus norvegicus
tgtgcattgtgctgtgaaacctctg

SEQ ID NO: 649109 - DNA, 25 bp, Rattus norvegicus
tgtgcatttcctatggaagaagtga

SEQ ID NO: 649110 - DNA, 25 bp, Rattus norvegicus
tgtgcatttcctattgcagagaagc

SEQ ID NO: 649111 - DNA, 25 bp, Rattus norvegicus
tgtgcatttcctttggaagaagtga

SEQ ID NO: 649112 - DNA, 25 bp, Rattus norvegicus
tgtgcatttccttttgcagagaagc

SEQ ID NO: 649113 - DNA, 25 bp, Rattus norvegicus
tgtgcatttggcactttacctagaa

SEQ ID NO: 649114 - DNA, 25 bp, Rattus norvegicus
tgtgcatttggctctttacctagaa

SEQ ID NO: 649115 - DNA, 25 bp, Rattus norvegicus
tgtgcattttcaatgagctctgcat

SEQ ID NO: 649116 - DNA, 25 bp, Rattus norvegicus
tgtgcattttcattgagctctgcat

SEQ ID NO: 649117 - DNA, 25 bp, Rattus norvegicus
tgtgccaaacttacctttctgttaa

SEQ ID NO: 649118 - DNA, 25 bp, Rattus norvegicus
tgtgccaaactttcctttctgttaa

SEQ ID NO: 649119 - DNA, 25 bp, Rattus norvegicus
tgtgccaacaatagccgtgcgcagg

SEQ ID NO: 649120 - DNA, 25 bp, Rattus norvegicus
tgtgccaacaattgccgtgcgcagg

SEQ ID NO: 649121 - DNA, 25 bp, Rattus norvegicus
tgtgccaaccatccgggatatcttt

SEQ ID NO: 649122 - DNA, 25 bp, Rattus norvegicus
tgtgccaaccatgcgggatatcttt

SEQ ID NO: 649123 - DNA, 25 bp, Rattus norvegicus
tgtgccaactccagaggccgaactc

SEQ ID NO: 649124 - DNA, 25 bp, Rattus norvegicus
tgtgccaactcctgaggccgaactc

SEQ ID NO: 649125 - DNA, 25 bp, Rattus norvegicus
tgtgccaacttcacatggaccgcaa

SEQ ID NO: 649126 - DNA, 25 bp, Rattus norvegicus
tgtgccaacttctcatggaccgcaa

SEQ ID NO: 649127 - DNA, 25 bp, Rattus norvegicus
tgtgccaagaagcaaccccagtgtt

SEQ ID NO: 649128 - DNA, 25 bp, Rattus norvegicus
tgtgccaagaaggaaccccagtgtt

SEQ ID NO: 649129 - DNA, 25 bp, Rattus norvegicus
tgtgccaagcaaacccctgtcagaa

SEQ ID NO: 649130 - DNA, 25 bp, Rattus norvegicus
tgtgccaagcaatcccctgtcagaa

SEQ ID NO: 649131 - DNA, 25 bp, Rattus norvegicus
tgtgccaagggcattgctgacttgc

SEQ ID NO: 649132 - DNA, 25 bp, Rattus norvegicus
tgtgccaagggctttgctgacttgc

SEQ ID NO: 649133 - DNA, 25 bp, Rattus norvegicus
tgtgccaatcacctaaaagtctcat

SEQ ID NO: 649134 - DNA, 25 bp, Rattus norvegicus
tgtgccaatcacgtaaaagtctcat

SEQ ID NO: 649135 - DNA, 25 bp, Rattus norvegicus
tgtgccaatggccacactaccagaa

SEQ ID NO: 649136 - DNA, 25 bp, Rattus norvegicus
tgtgccaatggcgacactaccagaa

SEQ ID NO: 649137 - DNA, 25 bp, Rattus norvegicus
tgtgccaattaccagacccatctga

SEQ ID NO: 649138 - DNA, 25 bp, Rattus norvegicus
tgtgccaattacgagacccatctga

SEQ ID NO: 649139 - DNA, 25 bp, Rattus norvegicus
tgtgccaatttgatcctgtatccat

SEQ ID NO: 649140 - DNA, 25 bp, Rattus norvegicus
tgtgccaatttgttcctgtatccat

SEQ ID NO: 649141 - DNA, 25 bp, Rattus norvegicus
tgtgccacagacaaagatgcctttg

SEQ ID NO: 649142 - DNA, 25 bp, Rattus norvegicus
tgtgccacagactaagatgcctttg

SEQ ID NO: 649143 - DNA, 25 bp, Rattus norvegicus
tgtgccacagcacgcaagatttaga

SEQ ID NO: 649144 - DNA, 25 bp, Rattus norvegicus
tgtgccacagcaggcaagatttaga

SEQ ID NO: 649145 - DNA, 25 bp, Rattus norvegicus
tgtgccacagctcggaagtagcagt

SEQ ID NO: 649146 - DNA, 25 bp, Rattus norvegicus
tgtgccacagctgggaagtagcagt

SEQ ID NO: 649147 - DNA, 25 bp, Rattus norvegicus
tgtgccacaggcatttgggttgctg

SEQ ID NO: 649148 - DNA, 25 bp, Rattus norvegicus
tgtgccacaggcttttgggttgctg

SEQ ID NO: 649149 - DNA, 25 bp, Rattus norvegicus
tgtgccacagtgcagcaggagcctc

SEQ ID NO: 649150 - DNA, 25 bp, Rattus norvegicus
tgtgccacagtggagcaggagcctc

SEQ ID NO: 649151 - DNA, 25 bp, Rattus norvegicus
tgtgccaccaccaagatttcaatta

SEQ ID NO: 649152 - DNA, 25 bp, Rattus norvegicus
tgtgccaccaccaaggagcaggaga

SEQ ID NO: 649153 - DNA, 25 bp, Rattus norvegicus
tgtgccaccacctagatttcaatta

SEQ ID NO: 649154 - DNA, 25 bp, Rattus norvegicus
tgtgccaccacctaggagcaggaga

SEQ ID NO: 649155 - DNA, 25 bp, Rattus norvegicus
tgtgccaccagtacagctgttagat

SEQ ID NO: 649156 - DNA, 25 bp, Rattus norvegicus
tgtgccaccagttcagctgttagat

SEQ ID NO: 649157 - DNA, 25 bp, Rattus norvegicus
tgtgccaccatgcatctgcattggg

SEQ ID NO: 649158 - DNA, 25 bp, Rattus norvegicus
tgtgccaccatggatctgcattggg

SEQ ID NO: 649159 - DNA, 25 bp, Rattus norvegicus
tgtgccaccgcaaacacgtgaaggt

SEQ ID NO: 649160 - DNA, 25 bp, Rattus norvegicus
tgtgccaccgcatacacgtgaaggt

SEQ ID NO: 649161 - DNA, 25 bp, Rattus norvegicus
tgtgccacctgcagaggatgggata

SEQ ID NO: 649162 - DNA, 25 bp, Rattus norvegicus
tgtgccacctgctgaggatgggata

SEQ ID NO: 649163 - DNA, 25 bp, Rattus norvegicus
tgtgccacctgtctctgactcagca

SEQ ID NO: 649164 - DNA, 25 bp, Rattus norvegicus
tgtgccacctgtgtctgactcagca

SEQ ID NO: 649165 - DNA, 25 bp, Rattus norvegicus
tgtgccacgacgagatcttcgccga

SEQ ID NO: 649166 - DNA, 25 bp, Rattus norvegicus
tgtgccacgacgtgatcttcgccga

SEQ ID NO: 649167 - DNA, 25 bp, Rattus norvegicus
tgtgccacggcgaatgcacacaccg

SEQ ID NO: 649168 - DNA, 25 bp, Rattus norvegicus
tgtgccacggcgtatgcacacaccg

SEQ ID NO: 649169 - DNA, 25 bp, Rattus norvegicus
tgtgccacggctagtactggagcct

SEQ ID NO: 649170 - DNA, 25 bp, Rattus norvegicus
tgtgccacggcttgtactggagcct

SEQ ID NO: 649171 - DNA, 25 bp, Rattus norvegicus
tgtgccactattaatttccgcagta

SEQ ID NO: 649172 - DNA, 25 bp, Rattus norvegicus
tgtgccactatttatttccgcagta

SEQ ID NO: 649173 - DNA, 25 bp, Rattus norvegicus
tgtgccactgggagaccgtatttac

SEQ ID NO: 649174 - DNA, 25 bp, Rattus norvegicus
tgtgccactgggtgaccgtatttac

SEQ ID NO: 649175 - DNA, 25 bp, Rattus norvegicus
tgtgccactgtgagcagaccatgaa

SEQ ID NO: 649176 - DNA, 25 bp, Rattus norvegicus
tgtgccactgtgtgcagaccatgaa

SEQ ID NO: 649177 - DNA, 25 bp, Rattus norvegicus
tgtgccactttgatcagctgctctt

SEQ ID NO: 649178 - DNA, 25 bp, Rattus norvegicus
tgtgccactttgttcagctgctctt

SEQ ID NO: 649179 - DNA, 25 bp, Rattus norvegicus
tgtgccacttttcatcagagtagct

SEQ ID NO: 649180 - DNA, 25 bp, Rattus norvegicus
tgtgccacttttgatcagagtagct

SEQ ID NO: 649181 - DNA, 25 bp, Rattus norvegicus
tgtgccagactgagggcctctcagt

SEQ ID NO: 649182 - DNA, 25 bp, Rattus norvegicus
tgtgccagactgtgggcctctcagt

SEQ ID NO: 649183 - DNA, 25 bp, Rattus norvegicus
tgtgccagagggacacgccagcctg

SEQ ID NO: 649184 - DNA, 25 bp, Rattus norvegicus
tgtgccagagggtcacgccagcctg

SEQ ID NO: 649185 - DNA, 25 bp, Rattus norvegicus
tgtgccagattgctgatgtcctcat

SEQ ID NO: 649186 - DNA, 25 bp, Rattus norvegicus
tgtgccagattggtgatgtcctcat

SEQ ID NO: 649187 - DNA, 25 bp, Rattus norvegicus
tgtgccagccagcactcttattgtc

SEQ ID NO: 649188 - DNA, 25 bp, Rattus norvegicus
tgtgccagccaggactcttattgtc

SEQ ID NO: 649189 - DNA, 25 bp, Rattus norvegicus
tgtgccagcctgacttaggccaggg

SEQ ID NO: 649190 - DNA, 25 bp, Rattus norvegicus
tgtgccagcctgtcttaggccaggg

SEQ ID NO: 649191 - DNA, 25 bp, Rattus norvegicus
tgtgccagctcgactctgaaaatgt

SEQ ID NO: 649192 - DNA, 25 bp, Rattus norvegicus
tgtgccagctcgtctctgaaaatgt

SEQ ID NO: 649193 - DNA, 25 bp, Rattus norvegicus
tgtgccagctctcttgagtactttg

SEQ ID NO: 649194 - DNA, 25 bp, Rattus norvegicus
tgtgccagctctgttgagtactttg

SEQ ID NO: 649195 - DNA, 25 bp, Rattus norvegicus
tgtgccaggatgactctgttaccca

SEQ ID NO: 649196 - DNA, 25 bp, Rattus norvegicus
tgtgccaggatgtctctgttaccca

SEQ ID NO: 649197 - DNA, 25 bp, Rattus norvegicus
tgtgccaggctgagcagttcagagc

SEQ ID NO: 649198 - DNA, 25 bp, Rattus norvegicus
tgtgccaggctgtgcagttcagagc

SEQ ID NO: 649199 - DNA, 25 bp, Rattus norvegicus
tgtgccagggatactacccagctat

SEQ ID NO: 649200 - DNA, 25 bp, Rattus norvegicus
tgtgccagggattctacccagctat

SEQ ID NO: 649201 - DNA, 25 bp, Rattus norvegicus
tgtgccagggtcacatccaacagga

SEQ ID NO: 649202 - DNA, 25 bp, Rattus norvegicus
tgtgccagggtctcatccaacagga

SEQ ID NO: 649203 - DNA, 25 bp, Rattus norvegicus
tgtgccagtgccagtggaaccaaca

SEQ ID NO: 649204 - DNA, 25 bp, Rattus norvegicus
tgtgccagtgcctgtggaaccaaca

SEQ ID NO: 649205 - DNA, 25 bp, Rattus norvegicus
tgtgccagtgtgagtgaacttctga

SEQ ID NO: 649206 - DNA, 25 bp, Rattus norvegicus
tgtgccagtgtgtgtgaacttctga

SEQ ID NO: 649207 - DNA, 25 bp, Rattus norvegicus
tgtgccataaggcttcttccactca

SEQ ID NO: 649208 - DNA, 25 bp, Rattus norvegicus
tgtgccataagggttcttccactca

SEQ ID NO: 649209 - DNA, 25 bp, Rattus norvegicus
tgtgccatccacacactaggtttgg

SEQ ID NO: 649210 - DNA, 25 bp, Rattus norvegicus
tgtgccatccactcactaggtttgg

SEQ ID NO: 649211 - DNA, 25 bp, Rattus norvegicus
tgtgccatctgtacactgctgggat

SEQ ID NO: 649212 - DNA, 25 bp, Rattus norvegicus
tgtgccatctgttcactgctgggat

SEQ ID NO: 649213 - DNA, 25 bp, Rattus norvegicus
tgtgccatgagactccatttccaga

SEQ ID NO: 649214 - DNA, 25 bp, Rattus norvegicus
tgtgccatgagagtccatttccaga

SEQ ID NO: 649215 - DNA, 25 bp, Rattus norvegicus
tgtgccatgcttctgggtctccggt

SEQ ID NO: 649216 - DNA, 25 bp, Rattus norvegicus
tgtgccatgcttgtgggtctccggt

SEQ ID NO: 649217 - DNA, 25 bp, Rattus norvegicus
tgtgccatggcaatcaaagagttaa

SEQ ID NO: 649218 - DNA, 25 bp, Rattus norvegicus
tgtgccatggcattcaaagagttaa

SEQ ID NO: 649219 - DNA, 25 bp, Rattus norvegicus
tgtgccatggtaagtgtagaggtca

SEQ ID NO: 649220 - DNA, 25 bp, Rattus norvegicus
tgtgccatggtatgtgtagaggtca

SEQ ID NO: 649221 - DNA, 25 bp, Rattus norvegicus
tgtgccatgtgtaatattcacccac

SEQ ID NO: 649222 - DNA, 25 bp, Rattus norvegicus
tgtgccatgtgttatattcacccac

SEQ ID NO: 649223 - DNA, 25 bp, Rattus norvegicus
tgtgccattctccaagctacagctg

SEQ ID NO: 649224 - DNA, 25 bp, Rattus norvegicus
tgtgccattctcgaagctacagctg

SEQ ID NO: 649225 - DNA, 25 bp, Rattus norvegicus
tgtgccattctgatccaaatcttcc

SEQ ID NO: 649226 - DNA, 25 bp, Rattus norvegicus
tgtgccattctgttccaaatcttcc

SEQ ID NO: 649227 - DNA, 25 bp, Rattus norvegicus
tgtgccattgtgattgaggttacct

SEQ ID NO: 649228 - DNA, 25 bp, Rattus norvegicus
tgtgccattgtgtttgaggttacct

SEQ ID NO: 649229 - DNA, 25 bp, Rattus norvegicus
tgtgcccaaaagagcttcccttagt

SEQ ID NO: 649230 - DNA, 25 bp, Rattus norvegicus
tgtgcccaaaagtgcttcccttagt

SEQ ID NO: 649231 - DNA, 25 bp, Rattus norvegicus
tgtgcccaacagctctcagagtgtt

SEQ ID NO: 649232 - DNA, 25 bp, Rattus norvegicus
tgtgcccaacaggtctcagagtgtt

SEQ ID NO: 649233 - DNA, 25 bp, Rattus norvegicus
tgtgcccaaggacaatgtcagagtc

SEQ ID NO: 649234 - DNA, 25 bp, Rattus norvegicus
tgtgcccaaggagaatgtcagagtc

SEQ ID NO: 649235 - DNA, 25 bp, Rattus norvegicus
tgtgcccacaccagatcctgagagt

SEQ ID NO: 649236 - DNA, 25 bp, Rattus norvegicus
tgtgcccacacctgatcctgagagt

SEQ ID NO: 649237 - DNA, 25 bp, Rattus norvegicus
tgtgcccacagtacctttgaaagaa

SEQ ID NO: 649238 - DNA, 25 bp, Rattus norvegicus
tgtgcccacagtccggagcctgaaa

SEQ ID NO: 649239 - DNA, 25 bp, Rattus norvegicus
tgtgcccacagtgcggagcctgaaa

SEQ ID NO: 649240 - DNA, 25 bp, Rattus norvegicus
tgtgcccacagttcctttgaaagaa

SEQ ID NO: 649241 - DNA, 25 bp, Rattus norvegicus
tgtgcccacttcaacagcatcaaat

SEQ ID NO: 649242 - DNA, 25 bp, Rattus norvegicus
tgtgcccacttctacagcatcaaat

SEQ ID NO: 649243 - DNA, 25 bp, Rattus norvegicus
tgtgcccagaggacttctttcatag

SEQ ID NO: 649244 - DNA, 25 bp, Rattus norvegicus
tgtgcccagaggtcttctttcatag

SEQ ID NO: 649245 - DNA, 25 bp, Rattus norvegicus
tgtgcccagcctcacttttagaaag

SEQ ID NO: 649246 - DNA, 25 bp, Rattus norvegicus
tgtgcccagcctctctgtgtactta

SEQ ID NO: 649247 - DNA, 25 bp, Rattus norvegicus
tgtgcccagcctgacttttagaaag

SEQ ID NO: 649248 - DNA, 25 bp, Rattus norvegicus
tgtgcccagcctgtctgtgtactta

SEQ ID NO: 649249 - DNA, 25 bp, Rattus norvegicus
tgtgcccagctactataacccagca

SEQ ID NO: 649250 - DNA, 25 bp, Rattus norvegicus
tgtgcccagctagtataacccagca

SEQ ID NO: 649251 - DNA, 25 bp, Rattus norvegicus
tgtgcccaggatcaagacgctgtta

SEQ ID NO: 649252 - DNA, 25 bp, Rattus norvegicus
tgtgcccaggatgaagacgctgtta

SEQ ID NO: 649253 - DNA, 25 bp, Rattus norvegicus
tgtgcccatcccagagagctcagag

SEQ ID NO: 649254 - DNA, 25 bp, Rattus norvegicus
tgtgcccatccctgagagctcagag

SEQ ID NO: 649255 - DNA, 25 bp, Rattus norvegicus
tgtgcccatcgtcaacctgaaggat

SEQ ID NO: 649256 - DNA, 25 bp, Rattus norvegicus
tgtgcccatcgtgaacctgaaggat

SEQ ID NO: 649257 - DNA, 25 bp, Rattus norvegicus
tgtgcccatgcccaagttgagcaat

SEQ ID NO: 649258 - DNA, 25 bp, Rattus norvegicus
tgtgcccatgccgaagttgagcaat

SEQ ID NO: 649259 - DNA, 25 bp, Rattus norvegicus
tgtgcccatggtccttggaatacaa

SEQ ID NO: 649260 - DNA, 25 bp, Rattus norvegicus
tgtgcccatggtgcttggaatacaa

SEQ ID NO: 649261 - DNA, 25 bp, Rattus norvegicus
tgtgcccattatacccgtgacggga

SEQ ID NO: 649262 - DNA, 25 bp, Rattus norvegicus
tgtgcccattattcccgtgacggga

SEQ ID NO: 649263 - DNA, 25 bp, Rattus norvegicus
tgtgcccattctaagacctgaggta

SEQ ID NO: 649264 - DNA, 25 bp, Rattus norvegicus
tgtgcccattcttagacctgaggta

SEQ ID NO: 649265 - DNA, 25 bp, Rattus norvegicus
tgtgccccaaaccttgaccaggaca

SEQ ID NO: 649266 - DNA, 25 bp, Rattus norvegicus
tgtgccccaaacgttgaccaggaca

SEQ ID NO: 649267 - DNA, 25 bp, Rattus norvegicus
tgtgccccaaatccagcttcatttt

SEQ ID NO: 649268 - DNA, 25 bp, Rattus norvegicus
tgtgccccaaatgcagcttcatttt

SEQ ID NO: 649269 - DNA, 25 bp, Rattus norvegicus
tgtgccccaaggcttggtggtaact

SEQ ID NO: 649270 - DNA, 25 bp, Rattus norvegicus
tgtgccccaagggttggtggtaact

SEQ ID NO: 649271 - DNA, 25 bp, Rattus norvegicus
tgtgccccacacaagtgctctgaat

SEQ ID NO: 649272 - DNA, 25 bp, Rattus norvegicus
tgtgccccacactagtgctctgaat

SEQ ID NO: 649273 - DNA, 25 bp, Rattus norvegicus
tgtgccccacagaaaggtcacttgt

SEQ ID NO: 649274 - DNA, 25 bp, Rattus norvegicus
tgtgccccacagtaaggtcacttgt

SEQ ID NO: 649275 - DNA, 25 bp, Rattus norvegicus
tgtgccccagacaaagagcagcgtt

SEQ ID NO: 649276 - DNA, 25 bp, Rattus norvegicus
tgtgccccagactaagagcagcgtt

SEQ ID NO: 649277 - DNA, 25 bp, Rattus norvegicus
tgtgccccagagctctatgtgagga

SEQ ID NO: 649278 - DNA, 25 bp, Rattus norvegicus
tgtgccccagaggtctatgtgagga

SEQ ID NO: 649279 - DNA, 25 bp, Rattus norvegicus
tgtgccccaggaacagaaactttct

SEQ ID NO: 649280 - DNA, 25 bp, Rattus norvegicus
tgtgccccaggatcagaaactttct

SEQ ID NO: 649281 - DNA, 25 bp, Rattus norvegicus
tgtgccccagtcagacttttacaaa

SEQ ID NO: 649282 - DNA, 25 bp, Rattus norvegicus
tgtgccccagtctgacttttacaaa

SEQ ID NO: 649283 - DNA, 25 bp, Rattus norvegicus
tgtgccccatagatttgtccagagc

SEQ ID NO: 649284 - DNA, 25 bp, Rattus norvegicus
tgtgccccatagttttgtccagagc

SEQ ID NO: 649285 - DNA, 25 bp, Rattus norvegicus
tgtgccccgagaagagacccacctt

SEQ ID NO: 649286 - DNA, 25 bp, Rattus norvegicus
tgtgccccgagatgagacccacctt

SEQ ID NO: 649287 - DNA, 25 bp, Rattus norvegicus
tgtgccccgagtccctggacactga

SEQ ID NO: 649288 - DNA, 25 bp, Rattus norvegicus
tgtgccccgagtgcctggacactga

SEQ ID NO: 649289 - DNA, 25 bp, Rattus norvegicus
tgtgcccctaacagctgtctggaca

SEQ ID NO: 649290 - DNA, 25 bp, Rattus norvegicus
tgtgcccctaactgctgtctggaca

SEQ ID NO: 649291 - DNA, 25 bp, Rattus norvegicus
tgtgcccctacacacatgtcaggtt

SEQ ID NO: 649292 - DNA, 25 bp, Rattus norvegicus
tgtgcccctacagacatgtcaggtt

SEQ ID NO: 649293 - DNA, 25 bp, Rattus norvegicus
tgtgcccctactccctgtggtagag

SEQ ID NO: 649294 - DNA, 25 bp, Rattus norvegicus
tgtgcccctactgcctgtggtagag

SEQ ID NO: 649295 - DNA, 25 bp, Rattus norvegicus
tgtgcccctgaaccttcatcaagtg

SEQ ID NO: 649296 - DNA, 25 bp, Rattus norvegicus
tgtgcccctgaagcttcatcaagtg

SEQ ID NO: 649297 - DNA, 25 bp, Rattus norvegicus
tgtgcccctgatacaagaccggatc

SEQ ID NO: 649298 - DNA, 25 bp, Rattus norvegicus
tgtgcccctgattcaagaccggatc

SEQ ID NO: 649299 - DNA, 25 bp, Rattus norvegicus
tgtgcccgggttaactcagaaagct

SEQ ID NO: 649300 - DNA, 25 bp, Rattus norvegicus
tgtgcccgggtttactcagaaagct

SEQ ID NO: 649301 - DNA, 25 bp, Rattus norvegicus
tgtgcccgtactaacatctactgaa

SEQ ID NO: 649302 - DNA, 25 bp, Rattus norvegicus
tgtgcccgtacttacatctactgaa

SEQ ID NO: 649303 - DNA, 25 bp, Rattus norvegicus
tgtgcccgtggcattttggtagaaa

SEQ ID NO: 649304 - DNA, 25 bp, Rattus norvegicus
tgtgcccgtggctttttggtagaaa

SEQ ID NO: 649305 - DNA, 25 bp, Rattus norvegicus
tgtgccctaagaactcagtttgttt

SEQ ID NO: 649306 - DNA, 25 bp, Rattus norvegicus
tgtgccctaagatctcagtttgttt

SEQ ID NO: 649307 - DNA, 25 bp, Rattus norvegicus
tgtgccctaccacttctgatcagat

SEQ ID NO: 649308 - DNA, 25 bp, Rattus norvegicus
tgtgccctaccagttctgatcagat

SEQ ID NO: 649309 - DNA, 25 bp, Rattus norvegicus
tgtgccctcattacactttatgacc

SEQ ID NO: 649310 - DNA, 25 bp, Rattus norvegicus
tgtgccctcatttcactttatgacc

SEQ ID NO: 649311 - DNA, 25 bp, Rattus norvegicus
tgtgccctccctaggacaggacaac

SEQ ID NO: 649312 - DNA, 25 bp, Rattus norvegicus
tgtgccctcccttggacaggacaac

SEQ ID NO: 649313 - DNA, 25 bp, Rattus norvegicus
tgtgccctcgtgactgagtgctgat

SEQ ID NO: 649314 - DNA, 25 bp, Rattus norvegicus
tgtgccctcgtgtctgagtgctgat

SEQ ID NO: 649315 - DNA, 25 bp, Rattus norvegicus
tgtgccctctcacctgaggagcaga

SEQ ID NO: 649316 - DNA, 25 bp, Rattus norvegicus
tgtgccctctcagctgaggagcaga

SEQ ID NO: 649317 - DNA, 25 bp, Rattus norvegicus
tgtgccctctccatcactgtgaaca

SEQ ID NO: 649318 - DNA, 25 bp, Rattus norvegicus
tgtgccctctccttcactgtgaaca

SEQ ID NO: 649319 - DNA, 25 bp, Rattus norvegicus
tgtgccctctgcaagatacaggtga

SEQ ID NO: 649320 - DNA, 25 bp, Rattus norvegicus
tgtgccctctgctagatacaggtga

SEQ ID NO: 649321 - DNA, 25 bp, Rattus norvegicus
tgtgccctgaggatgcacgtgcctc

SEQ ID NO: 649322 - DNA, 25 bp, Rattus norvegicus
tgtgccctgaggttgcacgtgcctc

SEQ ID NO: 649323 - DNA, 25 bp, Rattus norvegicus
tgtgccctgatgaactttcgataga

SEQ ID NO: 649324 - DNA, 25 bp, Rattus norvegicus
tgtgccctgatgacagctccagtga

SEQ ID NO: 649325 - DNA, 25 bp, Rattus norvegicus
tgtgccctgatgtactttcgataga

SEQ ID NO: 649326 - DNA, 25 bp, Rattus norvegicus
tgtgccctgatgtcagctccagtga

SEQ ID NO: 649327 - DNA, 25 bp, Rattus norvegicus
tgtgccctgattattgtcgtgccaa

SEQ ID NO: 649328 - DNA, 25 bp, Rattus norvegicus
tgtgccctgatttttgtcgtgccaa

SEQ ID NO: 649329 - DNA, 25 bp, Rattus norvegicus
tgtgcccttaggatgccatgtcagg

SEQ ID NO: 649330 - DNA, 25 bp, Rattus norvegicus
tgtgcccttaggttgccatgtcagg

SEQ ID NO: 649331 - DNA, 25 bp, Rattus norvegicus
tgtgcccttcctctctttaagttta

SEQ ID NO: 649332 - DNA, 25 bp, Rattus norvegicus
tgtgcccttcctgtctttaagttta

SEQ ID NO: 649333 - DNA, 25 bp, Rattus norvegicus
tgtgcccttgccattgttcattgaa

SEQ ID NO: 649334 - DNA, 25 bp, Rattus norvegicus
tgtgcccttgcctttgttcattgaa

SEQ ID NO: 649335 - DNA, 25 bp, Rattus norvegicus
tgtgccctttacaccggagttgaaa

SEQ ID NO: 649336 - DNA, 25 bp, Rattus norvegicus
tgtgccctttactccggagttgaaa

SEQ ID NO: 649337 - DNA, 25 bp, Rattus norvegicus
tgtgccctttgtatggccaagcatt

SEQ ID NO: 649338 - DNA, 25 bp, Rattus norvegicus
tgtgccctttgtttggccaagcatt

SEQ ID NO: 649339 - DNA, 25 bp, Rattus norvegicus
tgtgccgacatcactataactcagt

SEQ ID NO: 649340 - DNA, 25 bp, Rattus norvegicus
tgtgccgacatctctataactcagt

SEQ ID NO: 649341 - DNA, 25 bp, Rattus norvegicus
tgtgccgactctccatgatctgtag

SEQ ID NO: 649342 - DNA, 25 bp, Rattus norvegicus
tgtgccgactctgcatgatctgtag

SEQ ID NO: 649343 - DNA, 25 bp, Rattus norvegicus
tgtgccgcaacgacatttcctggaa

SEQ ID NO: 649344 - DNA, 25 bp, Rattus norvegicus
tgtgccgcaacgtcatttcctggaa

SEQ ID NO: 649345 - DNA, 25 bp, Rattus norvegicus
tgtgccgccagaaccgccatcagta

SEQ ID NO: 649346 - DNA, 25 bp, Rattus norvegicus
tgtgccgccagatccgccatcagta

SEQ ID NO: 649347 - DNA, 25 bp, Rattus norvegicus
tgtgccgccctgctcaaagtctgct

SEQ ID NO: 649348 - DNA, 25 bp, Rattus norvegicus
tgtgccgccctggtcaaagtctgct

SEQ ID NO: 649349 - DNA, 25 bp, Rattus norvegicus
tgtgccgcgtcactcatgccgaagc

SEQ ID NO: 649350 - DNA, 25 bp, Rattus norvegicus
tgtgccgcgtcagtcatgccgaagc

SEQ ID NO: 649351 - DNA, 25 bp, Rattus norvegicus
tgtgccgctgctccatagccatgaa

SEQ ID NO: 649352 - DNA, 25 bp, Rattus norvegicus
tgtgccgctgctgcatagccatgaa

SEQ ID NO: 649353 - DNA, 25 bp, Rattus norvegicus
tgtgccggcatgacacctgatacag

SEQ ID NO: 649354 - DNA, 25 bp, Rattus norvegicus
tgtgccggcatgtcacctgatacag

SEQ ID NO: 649355 - DNA, 25 bp, Rattus norvegicus
tgtgccggctacagtcctagcatgg

SEQ ID NO: 649356 - DNA, 25 bp, Rattus norvegicus
tgtgccggctactgtcctagcatgg

SEQ ID NO: 649357 - DNA, 25 bp, Rattus norvegicus
tgtgccgggagcaacgcagtgaact

SEQ ID NO: 649358 - DNA, 25 bp, Rattus norvegicus
tgtgccgggagccacgcgccgtgcg

SEQ ID NO: 649359 - DNA, 25 bp, Rattus norvegicus
tgtgccgggagcgacgcgccgtgcg

SEQ ID NO: 649360 - DNA, 25 bp, Rattus norvegicus
tgtgccgggagctacgcagtgaact

SEQ ID NO: 649361 - DNA, 25 bp, Rattus norvegicus
tgtgccggtgaactcggagacccac

SEQ ID NO: 649362 - DNA, 25 bp, Rattus norvegicus
tgtgccggtgaagtcggagacccac

SEQ ID NO: 649363 - DNA, 25 bp, Rattus norvegicus
tgtgccgtagtcctaatttagctga

SEQ ID NO: 649364 - DNA, 25 bp, Rattus norvegicus
tgtgccgtagtcgtaatttagctga

SEQ ID NO: 649365 - DNA, 25 bp, Rattus norvegicus
tgtgccgtcttgagatccagaggag

SEQ ID NO: 649366 - DNA, 25 bp, Rattus norvegicus
tgtgccgtcttgtgatccagaggag

SEQ ID NO: 649367 - DNA, 25 bp, Rattus norvegicus
tgtgccgtttgtctttttgttacat

SEQ ID NO: 649368 - DNA, 25 bp, Rattus norvegicus
tgtgccgtttgtgtttttgttacat

SEQ ID NO: 649369 - DNA, 25 bp, Rattus norvegicus
tgtgcctagagactggcccaccaga

SEQ ID NO: 649370 - DNA, 25 bp, Rattus norvegicus
tgtgcctagagagtggcccaccaga

SEQ ID NO: 649371 - DNA, 25 bp, Rattus norvegicus
tgtgcctagataatgaagtgttttc

SEQ ID NO: 649372 - DNA, 25 bp, Rattus norvegicus
tgtgcctagatattgaagtgttttc

SEQ ID NO: 649373 - DNA, 25 bp, Rattus norvegicus
tgtgcctatgatcgctgccggcagc

SEQ ID NO: 649374 - DNA, 25 bp, Rattus norvegicus
tgtgcctatgatggctgccggcagc

SEQ ID NO: 649375 - DNA, 25 bp, Rattus norvegicus
tgtgcctatgctcccaagttggagt

SEQ ID NO: 649376 - DNA, 25 bp, Rattus norvegicus
tgtgcctatgctccccatggccgag

SEQ ID NO: 649377 - DNA, 25 bp, Rattus norvegicus
tgtgcctatgctgccaagttggagt

SEQ ID NO: 649378 - DNA, 25 bp, Rattus norvegicus
tgtgcctatgctgcccatggccgag

SEQ ID NO: 649379 - DNA, 25 bp, Rattus norvegicus
tgtgcctcaattaccattctgtttg

SEQ ID NO: 649380 - DNA, 25 bp, Rattus norvegicus
tgtgcctcaatttccattctgtttg

SEQ ID NO: 649381 - DNA, 25 bp, Rattus norvegicus
tgtgcctcacggacggaactgtttt

SEQ ID NO: 649382 - DNA, 25 bp, Rattus norvegicus
tgtgcctcacggtcggaactgtttt

SEQ ID NO: 649383 - DNA, 25 bp, Rattus norvegicus
tgtgcctcactgactgcagagcagg

SEQ ID NO: 649384 - DNA, 25 bp, Rattus norvegicus
tgtgcctcactgtctgcagagcagg

SEQ ID NO: 649385 - DNA, 25 bp, Rattus norvegicus
tgtgcctcagcaattctacaaagaa

SEQ ID NO: 649386 - DNA, 25 bp, Rattus norvegicus
tgtgcctcagcatttctacaaagaa

SEQ ID NO: 649387 - DNA, 25 bp, Rattus norvegicus
tgtgcctcatatatcaccacaaata

SEQ ID NO: 649388 - DNA, 25 bp, Rattus norvegicus
tgtgcctcatatttcaccacaaata

SEQ ID NO: 649389 - DNA, 25 bp, Rattus norvegicus
tgtgcctccacacggaaatgctgca

SEQ ID NO: 649390 - DNA, 25 bp, Rattus norvegicus
tgtgcctccacagggaaatgctgca

SEQ ID NO: 649391 - DNA, 25 bp, Rattus norvegicus
tgtgcctccagtattcagacattcc

SEQ ID NO: 649392 - DNA, 25 bp, Rattus norvegicus
tgtgcctccagttttcagacattcc

SEQ ID NO: 649393 - DNA, 25 bp, Rattus norvegicus
tgtgcctcccaacaagcagatcgtg

SEQ ID NO: 649394 - DNA, 25 bp, Rattus norvegicus
tgtgcctcccaagaagcagatcgtg

SEQ ID NO: 649395 - DNA, 25 bp, Rattus norvegicus
tgtgcctcgaatcatgcttctcaaa

SEQ ID NO: 649396 - DNA, 25 bp, Rattus norvegicus
tgtgcctcgaatgatgcttctcaaa

SEQ ID NO: 649397 - DNA, 25 bp, Rattus norvegicus
tgtgcctcgtcgcttgggacctaaa

SEQ ID NO: 649398 - DNA, 25 bp, Rattus norvegicus
tgtgcctcgtcggttgggacctaaa

SEQ ID NO: 649399 - DNA, 25 bp, Rattus norvegicus
tgtgcctctctgaagatgtgtaccc

SEQ ID NO: 649400 - DNA, 25 bp, Rattus norvegicus
tgtgcctctctgtagatgtgtaccc

SEQ ID NO: 649401 - DNA, 25 bp, Rattus norvegicus
tgtgcctctgagattctggacatat

SEQ ID NO: 649402 - DNA, 25 bp, Rattus norvegicus
tgtgcctctgagcagcatgtctgac

SEQ ID NO: 649403 - DNA, 25 bp, Rattus norvegicus
tgtgcctctgaggagcatgtctgac

SEQ ID NO: 649404 - DNA, 25 bp, Rattus norvegicus
tgtgcctctgagtttctggacatat

SEQ ID NO: 649405 - DNA, 25 bp, Rattus norvegicus
tgtgcctctgcaatactggtcctgg

SEQ ID NO: 649406 - DNA, 25 bp, Rattus norvegicus
tgtgcctctgcattactggtcctgg

SEQ ID NO: 649407 - DNA, 25 bp, Rattus norvegicus
tgtgcctctgtcagtgcccaggtag

SEQ ID NO: 649408 - DNA, 25 bp, Rattus norvegicus
tgtgcctctgtctgtgcccaggtag

SEQ ID NO: 649409 - DNA, 25 bp, Rattus norvegicus
tgtgcctcttatctggcagcggcaa

SEQ ID NO: 649410 - DNA, 25 bp, Rattus norvegicus
tgtgcctcttatgtggcagcggcaa

SEQ ID NO: 649411 - DNA, 25 bp, Rattus norvegicus
tgtgcctgaagaactaggaaaaggt

SEQ ID NO: 649412 - DNA, 25 bp, Rattus norvegicus
tgtgcctgaagatctaggaaaaggt

SEQ ID NO: 649413 - DNA, 25 bp, Rattus norvegicus
tgtgcctgaagtcacgaacagtgct

SEQ ID NO: 649414 - DNA, 25 bp, Rattus norvegicus
tgtgcctgaagtgacgaacagtgct

SEQ ID NO: 649415 - DNA, 25 bp, Rattus norvegicus
tgtgcctgactaatactaccctgta

SEQ ID NO: 649416 - DNA, 25 bp, Rattus norvegicus
tgtgcctgactattactaccctgta

SEQ ID NO: 649417 - DNA, 25 bp, Rattus norvegicus
tgtgcctgagcactgagcagccaga

SEQ ID NO: 649418 - DNA, 25 bp, Rattus norvegicus
tgtgcctgagcagtgagcagccaga

SEQ ID NO: 649419 - DNA, 25 bp, Rattus norvegicus
tgtgcctgagcgataaagggattgt

SEQ ID NO: 649420 - DNA, 25 bp, Rattus norvegicus
tgtgcctgagcgttaaagggattgt

SEQ ID NO: 649421 - DNA, 25 bp, Rattus norvegicus
tgtgcctgaggcaggaatccatgaa

SEQ ID NO: 649422 - DNA, 25 bp, Rattus norvegicus
tgtgcctgaggctggaatccatgaa

SEQ ID NO: 649423 - DNA, 25 bp, Rattus norvegicus
tgtgcctgagttctgaccgtatttc

SEQ ID NO: 649424 - DNA, 25 bp, Rattus norvegicus
tgtgcctgagttgtgaccgtatttc

SEQ ID NO: 649425 - DNA, 25 bp, Rattus norvegicus
tgtgcctgatgacggagccacctgc

SEQ ID NO: 649426 - DNA, 25 bp, Rattus norvegicus
tgtgcctgatgagggagccacctgc

SEQ ID NO: 649427 - DNA, 25 bp, Rattus norvegicus
tgtgcctgcacacacgcagtaaata

SEQ ID NO: 649428 - DNA, 25 bp, Rattus norvegicus
tgtgcctgcacagacgcagtaaata

SEQ ID NO: 649429 - DNA, 25 bp, Rattus norvegicus
tgtgcctgcactcagggacatctgc

SEQ ID NO: 649430 - DNA, 25 bp, Rattus norvegicus
tgtgcctgcactgagggacatctgc

SEQ ID NO: 649431 - DNA, 25 bp, Rattus norvegicus
tgtgcctgcccgcagaccaagaagg

SEQ ID NO: 649432 - DNA, 25 bp, Rattus norvegicus
tgtgcctgcccggagaccaagaagg

SEQ ID NO: 649433 - DNA, 25 bp, Rattus norvegicus
tgtgcctgcctaagctttgacagta

SEQ ID NO: 649434 - DNA, 25 bp, Rattus norvegicus
tgtgcctgcctatgctttgacagta

SEQ ID NO: 649435 - DNA, 25 bp, Rattus norvegicus
tgtgcctggctcaccggcaacgcgt

SEQ ID NO: 649436 - DNA, 25 bp, Rattus norvegicus
tgtgcctggctctccggcaacgcgt

SEQ ID NO: 649437 - DNA, 25 bp, Rattus norvegicus
tgtgcctggcttagaggaccatctg

SEQ ID NO: 649438 - DNA, 25 bp, Rattus norvegicus
tgtgcctggctttgaggaccatctg

SEQ ID NO: 649439 - DNA, 25 bp, Rattus norvegicus
tgtgcctgggacctctgcgaagcct

SEQ ID NO: 649440 - DNA, 25 bp, Rattus norvegicus
tgtgcctgggacgtctgcgaagcct

SEQ ID NO: 649441 - DNA, 25 bp, Rattus norvegicus
tgtgcctgggccagcttggaaagca

SEQ ID NO: 649442 - DNA, 25 bp, Rattus norvegicus
tgtgcctgggcctgcttggaaagca

SEQ ID NO: 649443 - DNA, 25 bp, Rattus norvegicus
tgtgcctggtacctgtggagactac

SEQ ID NO: 649444 - DNA, 25 bp, Rattus norvegicus
tgtgcctggtacgtgtggagactac

SEQ ID NO: 649445 - DNA, 25 bp, Rattus norvegicus
tgtgcctggttcactgccataagag

SEQ ID NO: 649446 - DNA, 25 bp, Rattus norvegicus
tgtgcctggttcagttaatttatga

SEQ ID NO: 649447 - DNA, 25 bp, Rattus norvegicus
tgtgcctggttcatgtgtatttaat

SEQ ID NO: 649448 - DNA, 25 bp, Rattus norvegicus
tgtgcctggttctctgccataagag

SEQ ID NO: 649449 - DNA, 25 bp, Rattus norvegicus
tgtgcctggttctgttaatttatga

SEQ ID NO: 649450 - DNA, 25 bp, Rattus norvegicus
tgtgcctggttcttgtgtatttaat

SEQ ID NO: 649451 - DNA, 25 bp, Rattus norvegicus
tgtgcctgtcacaatataactcctg

SEQ ID NO: 649452 - DNA, 25 bp, Rattus norvegicus
tgtgcctgtcactatataactcctg

SEQ ID NO: 649453 - DNA, 25 bp, Rattus norvegicus
tgtgcctgtcagcaggaacgttctg

SEQ ID NO: 649454 - DNA, 25 bp, Rattus norvegicus
tgtgcctgtcaggaggaacgttctg

SEQ ID NO: 649455 - DNA, 25 bp, Rattus norvegicus
tgtgcctgtgccagtccctagaaga

SEQ ID NO: 649456 - DNA, 25 bp, Rattus norvegicus
tgtgcctgtgcctgtccctagaaga

SEQ ID NO: 649457 - DNA, 25 bp, Rattus norvegicus
tgtgcctgtggtcggaatcattctt

SEQ ID NO: 649458 - DNA, 25 bp, Rattus norvegicus
tgtgcctgtggtgggaatcattctt

SEQ ID NO: 649459 - DNA, 25 bp, Rattus norvegicus
tgtgccttaaaaaacctgccttcct

SEQ ID NO: 649460 - DNA, 25 bp, Rattus norvegicus
tgtgccttaaaatacctgccttcct

SEQ ID NO: 649461 - DNA, 25 bp, Rattus norvegicus
tgtgccttagctaccttatttgtaa

SEQ ID NO: 649462 - DNA, 25 bp, Rattus norvegicus
tgtgccttagcttccttatttgtaa

SEQ ID NO: 649463 - DNA, 25 bp, Rattus norvegicus
tgtgccttcaagaccttttagtttc

SEQ ID NO: 649464 - DNA, 25 bp, Rattus norvegicus
tgtgccttcaagtccttttagtttc

SEQ ID NO: 649465 - DNA, 25 bp, Rattus norvegicus
tgtgccttcacaatcagttaaaaac

SEQ ID NO: 649466 - DNA, 25 bp, Rattus norvegicus
tgtgccttcacattcagttaaaaac

SEQ ID NO: 649467 - DNA, 25 bp, Rattus norvegicus
tgtgccttcctgcagagatccagaa

SEQ ID NO: 649468 - DNA, 25 bp, Rattus norvegicus
tgtgccttcctggagagatccagaa

SEQ ID NO: 649469 - DNA, 25 bp, Rattus norvegicus
tgtgccttccttagcatttagtttt

SEQ ID NO: 649470 - DNA, 25 bp, Rattus norvegicus
tgtgccttcctttgcatttagtttt

SEQ ID NO: 649471 - DNA, 25 bp, Rattus norvegicus
tgtgccttcgagacccaggatgaaa

SEQ ID NO: 649472 - DNA, 25 bp, Rattus norvegicus
tgtgccttcgagtcccaggatgaaa

SEQ ID NO: 649473 - DNA, 25 bp, Rattus norvegicus
tgtgccttcgctctcagtatgaata

SEQ ID NO: 649474 - DNA, 25 bp, Rattus norvegicus
tgtgccttcgctgtcagtatgaata

SEQ ID NO: 649475 - DNA, 25 bp, Rattus norvegicus
tgtgccttctaactgaccccaggaa

SEQ ID NO: 649476 - DNA, 25 bp, Rattus norvegicus
tgtgccttctaagtgaccccaggaa

SEQ ID NO: 649477 - DNA, 25 bp, Rattus norvegicus
tgtgccttctataccactggaagta

SEQ ID NO: 649478 - DNA, 25 bp, Rattus norvegicus
tgtgccttctattccactggaagta

SEQ ID NO: 649479 - DNA, 25 bp, Rattus norvegicus
tgtgccttggaaaacggcctctggg

SEQ ID NO: 649480 - DNA, 25 bp, Rattus norvegicus
tgtgccttggaatacggcctctggg

SEQ ID NO: 649481 - DNA, 25 bp, Rattus norvegicus
tgtgccttggatagatacagttatc

SEQ ID NO: 649482 - DNA, 25 bp, Rattus norvegicus
tgtgccttggattgatacagttatc

SEQ ID NO: 649483 - DNA, 25 bp, Rattus norvegicus
tgtgccttggcccatcttggcaagt

SEQ ID NO: 649484 - DNA, 25 bp, Rattus norvegicus
tgtgccttggccgatcttggcaagt

SEQ ID NO: 649485 - DNA, 25 bp, Rattus norvegicus
tgtgccttgtcaccctttgaaagtc

SEQ ID NO: 649486 - DNA, 25 bp, Rattus norvegicus
tgtgccttgtcagcctttgaaagtc

SEQ ID NO: 649487 - DNA, 25 bp, Rattus norvegicus
tgtgcctttatgaactggtaagtat

SEQ ID NO: 649488 - DNA, 25 bp, Rattus norvegicus
tgtgcctttatgtactggtaagtat

SEQ ID NO: 649489 - DNA, 25 bp, Rattus norvegicus
tgtgcctttctcactcatagggagc

SEQ ID NO: 649490 - DNA, 25 bp, Rattus norvegicus
tgtgcctttctctctcatagggagc

SEQ ID NO: 649491 - DNA, 25 bp, Rattus norvegicus
tgtgcctttctgcaacaccggagaa

SEQ ID NO: 649492 - DNA, 25 bp, Rattus norvegicus
tgtgcctttctggaacaccggagaa

SEQ ID NO: 649493 - DNA, 25 bp, Rattus norvegicus
tgtgcctttggcctaatcacagacc

SEQ ID NO: 649494 - DNA, 25 bp, Rattus norvegicus
tgtgcctttggcgtaatcacagacc

SEQ ID NO: 649495 - DNA, 25 bp, Rattus norvegicus
tgtgcctttgtcaactatgtctaca

SEQ ID NO: 649496 - DNA, 25 bp, Rattus norvegicus
tgtgcctttgtctactatgtctaca

SEQ ID NO: 649497 - DNA, 25 bp, Rattus norvegicus
tgtgcctttgttcctgacagctgct

SEQ ID NO: 649498 - DNA, 25 bp, Rattus norvegicus
tgtgcctttgttgctgacagctgct

SEQ ID NO: 649499 - DNA, 25 bp, Rattus norvegicus
tgtgccttttgtaccatccctttaa

SEQ ID NO: 649500 - DNA, 25 bp, Rattus norvegicus
tgtgccttttgttccatccctttaa

SEQ ID NO: 649501 - DNA, 25 bp, Rattus norvegicus
tgtgcctttttcatctccagcagag

SEQ ID NO: 649502 - DNA, 25 bp, Rattus norvegicus
tgtgcctttttcttctccagcagag

SEQ ID NO: 649503 - DNA, 25 bp, Rattus norvegicus
tgtgcctttttgactgtatgtgaat

SEQ ID NO: 649504 - DNA, 25 bp, Rattus norvegicus
tgtgcctttttgtctgtatgtgaat

SEQ ID NO: 649505 - DNA, 25 bp, Rattus norvegicus
tgtgccttttttattgcgtttgtgg

SEQ ID NO: 649506 - DNA, 25 bp, Rattus norvegicus
tgtgcctttttttttgcgtttgtgg

SEQ ID NO: 649507 - DNA, 25 bp, Rattus norvegicus
tgtgcgaaccacagtgacagccgtg

SEQ ID NO: 649508 - DNA, 25 bp, Rattus norvegicus
tgtgcgaaccactgtgacagccgtg

SEQ ID NO: 649509 - DNA, 25 bp, Rattus norvegicus
tgtgcgaactgtcatggcctcctga

SEQ ID NO: 649510 - DNA, 25 bp, Rattus norvegicus
tgtgcgaactgtgatggcctcctga

SEQ ID NO: 649511 - DNA, 25 bp, Rattus norvegicus
tgtgcgaagtgcacccagggctgca

SEQ ID NO: 649512 - DNA, 25 bp, Rattus norvegicus
tgtgcgaagtgctcccagggctgca

SEQ ID NO: 649513 - DNA, 25 bp, Rattus norvegicus
tgtgcgacagctattccaccaggtg

SEQ ID NO: 649514 - DNA, 25 bp, Rattus norvegicus
tgtgcgacagcttttccaccaggtg

SEQ ID NO: 649515 - DNA, 25 bp, Rattus norvegicus
tgtgcgacccagagtaggcccttag

SEQ ID NO: 649516 - DNA, 25 bp, Rattus norvegicus
tgtgcgacccagtgtaggcccttag

SEQ ID NO: 649517 - DNA, 25 bp, Rattus norvegicus
tgtgcgagtgagcaaccaccagtga

SEQ ID NO: 649518 - DNA, 25 bp, Rattus norvegicus
tgtgcgagtgaggaaccaccagtga

SEQ ID NO: 649519 - DNA, 25 bp, Rattus norvegicus
tgtgcgatcctgattctttttcaaa

SEQ ID NO: 649520 - DNA, 25 bp, Rattus norvegicus
tgtgcgatcctgtttctttttcaaa

SEQ ID NO: 649521 - DNA, 25 bp, Rattus norvegicus
tgtgcgcacggcagtgtacatgtat

SEQ ID NO: 649522 - DNA, 25 bp, Rattus norvegicus
tgtgcgcacggctgtgtacatgtat

SEQ ID NO: 649523 - DNA, 25 bp, Rattus norvegicus
tgtgcgcacgtcactgtatgtgtgt

SEQ ID NO: 649524 - DNA, 25 bp, Rattus norvegicus
tgtgcgcacgtctctgtatgtgtgt

SEQ ID NO: 649525 - DNA, 25 bp, Rattus norvegicus
tgtgcgccacgacgatctactgctg

SEQ ID NO: 649526 - DNA, 25 bp, Rattus norvegicus
tgtgcgccacgaggatctactgctg

SEQ ID NO: 649527 - DNA, 25 bp, Rattus norvegicus
tgtgcgccatctctgaagcaggttt

SEQ ID NO: 649528 - DNA, 25 bp, Rattus norvegicus
tgtgcgccatctgtgaagcaggttt

SEQ ID NO: 649529 - DNA, 25 bp, Rattus norvegicus
tgtgcgcccctaaatggatgcagtc

SEQ ID NO: 649530 - DNA, 25 bp, Rattus norvegicus
tgtgcgcccctatatggatgcagtc

SEQ ID NO: 649531 - DNA, 25 bp, Rattus norvegicus
tgtgcgctaagcctggacttgatcc

SEQ ID NO: 649532 - DNA, 25 bp, Rattus norvegicus
tgtgcgctaagcgtggacttgatcc

SEQ ID NO: 649533 - DNA, 25 bp, Rattus norvegicus
tgtgcgctacaaaaagtcagtcagt

SEQ ID NO: 649534 - DNA, 25 bp, Rattus norvegicus
tgtgcgctacaataagtcagtcagt

SEQ ID NO: 649535 - DNA, 25 bp, Rattus norvegicus
tgtgcgctagtcatcccatgtatac

SEQ ID NO: 649536 - DNA, 25 bp, Rattus norvegicus
tgtgcgctagtcttcccatgtatac

SEQ ID NO: 649537 - DNA, 25 bp, Rattus norvegicus
tgtgcgctccgtcttagtgtagcct

SEQ ID NO: 649538 - DNA, 25 bp, Rattus norvegicus
tgtgcgctccgtgttagtgtagcct

SEQ ID NO: 649539 - DNA, 25 bp, Rattus norvegicus
tgtgcgcttaggacgctaccctcgt

SEQ ID NO: 649540 - DNA, 25 bp, Rattus norvegicus
tgtgcgcttaggtcgctaccctcgt

SEQ ID NO: 649541 - DNA, 25 bp, Rattus norvegicus
tgtgcgcttattcgtcccctggaat

SEQ ID NO: 649542 - DNA, 25 bp, Rattus norvegicus
tgtgcgcttattggtcccctggaat

SEQ ID NO: 649543 - DNA, 25 bp, Rattus norvegicus
tgtgcggcaggtaccaactctgagg

SEQ ID NO: 649544 - DNA, 25 bp, Rattus norvegicus
tgtgcggcaggttccaactctgagg

SEQ ID NO: 649545 - DNA, 25 bp, Rattus norvegicus
tgtgcggccaaaaccatcagatcaa

SEQ ID NO: 649546 - DNA, 25 bp, Rattus norvegicus
tgtgcggccaaatccatcagatcaa

SEQ ID NO: 649547 - DNA, 25 bp, Rattus norvegicus
tgtgcggccagtagtgcgttcctgc

SEQ ID NO: 649548 - DNA, 25 bp, Rattus norvegicus
tgtgcggccagttgtgcgttcctgc

SEQ ID NO: 649549 - DNA, 25 bp, Rattus norvegicus
tgtgcggcgccgctctacgtaagac

SEQ ID NO: 649550 - DNA, 25 bp, Rattus norvegicus
tgtgcggcgccggtctacgtaagac

SEQ ID NO: 649551 - DNA, 25 bp, Rattus norvegicus
tgtgcggctgttccttcgctagctc

SEQ ID NO: 649552 - DNA, 25 bp, Rattus norvegicus
tgtgcggctgttgcttcgctagctc

SEQ ID NO: 649553 - DNA, 25 bp, Rattus norvegicus
tgtgcgggcaaaccttctgttgcta

SEQ ID NO: 649554 - DNA, 25 bp, Rattus norvegicus
tgtgcgggcaaagcttctgttgcta

SEQ ID NO: 649555 - DNA, 25 bp, Rattus norvegicus
tgtgcgggcacacccattcaaactt

SEQ ID NO: 649556 - DNA, 25 bp, Rattus norvegicus
tgtgcgggcacagccattcaaactt

SEQ ID NO: 649557 - DNA, 25 bp, Rattus norvegicus
tgtgcggtcagcagcccaccgtgac

SEQ ID NO: 649558 - DNA, 25 bp, Rattus norvegicus
tgtgcggtcagctgcccaccgtgac

SEQ ID NO: 649559 - DNA, 25 bp, Rattus norvegicus
tgtgcggtccacctcagctgtggca

SEQ ID NO: 649560 - DNA, 25 bp, Rattus norvegicus
tgtgcggtccacgtcagctgtggca

SEQ ID NO: 649561 - DNA, 25 bp, Rattus norvegicus
tgtgcggtgaatctctactgtagcc

SEQ ID NO: 649562 - DNA, 25 bp, Rattus norvegicus
tgtgcggtgaatgtctactgtagcc

SEQ ID NO: 649563 - DNA, 25 bp, Rattus norvegicus
tgtgcggtgtacaagtctcaggact

SEQ ID NO: 649564 - DNA, 25 bp, Rattus norvegicus
tgtgcggtgtactagtctcaggact

SEQ ID NO: 649565 - DNA, 25 bp, Rattus norvegicus
tgtgcggtttccctggagaatctga

SEQ ID NO: 649566 - DNA, 25 bp, Rattus norvegicus
tgtgcggtttccgtggagaatctga

SEQ ID NO: 649567 - DNA, 25 bp, Rattus norvegicus
tgtgcgtcaacacctacggaagcta

SEQ ID NO: 649568 - DNA, 25 bp, Rattus norvegicus
tgtgcgtcaacagctacggaagcta

SEQ ID NO: 649569 - DNA, 25 bp, Rattus norvegicus
tgtgcgtcagcaatctccatcggag

SEQ ID NO: 649570 - DNA, 25 bp, Rattus norvegicus
tgtgcgtcagcattctccatcggag

SEQ ID NO: 649571 - DNA, 25 bp, Rattus norvegicus
tgtgcgtcctttctgtctgttgatt

SEQ ID NO: 649572 - DNA, 25 bp, Rattus norvegicus
tgtgcgtcctttgtgtctgttgatt

SEQ ID NO: 649573 - DNA, 25 bp, Rattus norvegicus
tgtgcgtcggtccagtccactgtaa

SEQ ID NO: 649574 - DNA, 25 bp, Rattus norvegicus
tgtgcgtcggtcgagtccactgtaa

SEQ ID NO: 649575 - DNA, 25 bp, Rattus norvegicus
tgtgcgtctgtgagcattcactttc

SEQ ID NO: 649576 - DNA, 25 bp, Rattus norvegicus
tgtgcgtctgtgtgcattcactttc

SEQ ID NO: 649577 - DNA, 25 bp, Rattus norvegicus
tgtgcgtctttcattaccgggtgga

SEQ ID NO: 649578 - DNA, 25 bp, Rattus norvegicus
tgtgcgtctttctttaccgggtgga

SEQ ID NO: 649579 - DNA, 25 bp, Rattus norvegicus
tgtgcgtgagcaatctcagcctcaa

SEQ ID NO: 649580 - DNA, 25 bp, Rattus norvegicus
tgtgcgtgagcattctcagcctcaa

SEQ ID NO: 649581 - DNA, 25 bp, Rattus norvegicus
tgtgcgtgccttcaaaactgatctt

SEQ ID NO: 649582 - DNA, 25 bp, Rattus norvegicus
tgtgcgtgccttgaaaactgatctt

SEQ ID NO: 649583 - DNA, 25 bp, Rattus norvegicus
tgtgcgtgtgtcatgcccgcagaag

SEQ ID NO: 649584 - DNA, 25 bp, Rattus norvegicus
tgtgcgtgtgtcttgcccgcagaag

SEQ ID NO: 649585 - DNA, 25 bp, Rattus norvegicus
tgtgcgtgtgtgactatgtccatgc

SEQ ID NO: 649586 - DNA, 25 bp, Rattus norvegicus
tgtgcgtgtgtgtctatgtccatgc

SEQ ID NO: 649587 - DNA, 25 bp, Rattus norvegicus
tgtgcgtgtgttagctctgtaaccc

SEQ ID NO: 649588 - DNA, 25 bp, Rattus norvegicus
tgtgcgtgtgtttgctctgtaaccc

SEQ ID NO: 649589 - DNA, 25 bp, Rattus norvegicus
tgtgcgtttccactgtttatcagcc

SEQ ID NO: 649590 - DNA, 25 bp, Rattus norvegicus
tgtgcgtttccagtgtttatcagcc

SEQ ID NO: 649591 - DNA, 25 bp, Rattus norvegicus
tgtgcgtttgctccagctccaggct

SEQ ID NO: 649592 - DNA, 25 bp, Rattus norvegicus
tgtgcgtttgctgcagctccaggct

SEQ ID NO: 649593 - DNA, 25 bp, Rattus norvegicus
tgtgctaacaacagtgacgctctgg

SEQ ID NO: 649594 - DNA, 25 bp, Rattus norvegicus
tgtgctaacaactgtgacgctctgg

SEQ ID NO: 649595 - DNA, 25 bp, Rattus norvegicus
tgtgctaagcacacccggagatggg

SEQ ID NO: 649596 - DNA, 25 bp, Rattus norvegicus
tgtgctaagcactcccggagatggg

SEQ ID NO: 649597 - DNA, 25 bp, Rattus norvegicus
tgtgctaagcctaaacagtggcaaa

SEQ ID NO: 649598 - DNA, 25 bp, Rattus norvegicus
tgtgctaagccttaacagtggcaaa

SEQ ID NO: 649599 - DNA, 25 bp, Rattus norvegicus
tgtgctacaaacatctctaatgctg

SEQ ID NO: 649600 - DNA, 25 bp, Rattus norvegicus
tgtgctacaaacttctctaatgctg

SEQ ID NO: 649601 - DNA, 25 bp, Rattus norvegicus
tgtgctacagggactgatgtggcaa

SEQ ID NO: 649602 - DNA, 25 bp, Rattus norvegicus
tgtgctacagggtctgatgtggcaa

SEQ ID NO: 649603 - DNA, 25 bp, Rattus norvegicus
tgtgctacatgccaagaccatgcct

SEQ ID NO: 649604 - DNA, 25 bp, Rattus norvegicus
tgtgctacatgcgaagaccatgcct

SEQ ID NO: 649605 - DNA, 25 bp, Rattus norvegicus
tgtgctacatttctgcaccaggcag

SEQ ID NO: 649606 - DNA, 25 bp, Rattus norvegicus
tgtgctacatttgtgcaccaggcag

SEQ ID NO: 649607 - DNA, 25 bp, Rattus norvegicus
tgtgctaccaagacaaccttttcca

SEQ ID NO: 649608 - DNA, 25 bp, Rattus norvegicus
tgtgctaccaagtcaaccttttcca

SEQ ID NO: 649609 - DNA, 25 bp, Rattus norvegicus
tgtgctacccagactacttgctttt

SEQ ID NO: 649610 - DNA, 25 bp, Rattus norvegicus
tgtgctacccagcaagtctccagag

SEQ ID NO: 649611 - DNA, 25 bp, Rattus norvegicus
tgtgctacccaggaagtctccagag

SEQ ID NO: 649612 - DNA, 25 bp, Rattus norvegicus
tgtgctacccagtctacttgctttt

SEQ ID NO: 649613 - DNA, 25 bp, Rattus norvegicus
tgtgctacctgcatgtgaatctggt

SEQ ID NO: 649614 - DNA, 25 bp, Rattus norvegicus
tgtgctacctgcttgtgaatctggt

SEQ ID NO: 649615 - DNA, 25 bp, Rattus norvegicus
tgtgctacctttcctgtcagctaaa

SEQ ID NO: 649616 - DNA, 25 bp, Rattus norvegicus
tgtgctacctttgctgtcagctaaa

SEQ ID NO: 649617 - DNA, 25 bp, Rattus norvegicus
tgtgctacgagtctaacggccagtc

SEQ ID NO: 649618 - DNA, 25 bp, Rattus norvegicus
tgtgctacgagtgtaacggccagtc

SEQ ID NO: 649619 - DNA, 25 bp, Rattus norvegicus
tgtgctagattaacccacacacctg

SEQ ID NO: 649620 - DNA, 25 bp, Rattus norvegicus
tgtgctagattatcccacacacctg

SEQ ID NO: 649621 - DNA, 25 bp, Rattus norvegicus
tgtgctagtgtgatatgcttttggc

SEQ ID NO: 649622 - DNA, 25 bp, Rattus norvegicus
tgtgctagtgtgttatgcttttggc

SEQ ID NO: 649623 - DNA, 25 bp, Rattus norvegicus
tgtgctatatatacctacccaaggg

SEQ ID NO: 649624 - DNA, 25 bp, Rattus norvegicus
tgtgctatatattcctacccaaggg

SEQ ID NO: 649625 - DNA, 25 bp, Rattus norvegicus
tgtgctatcattacaccttggaata

SEQ ID NO: 649626 - DNA, 25 bp, Rattus norvegicus
tgtgctatcatttcaccttggaata

SEQ ID NO: 649627 - DNA, 25 bp, Rattus norvegicus
tgtgctatgagcaggcgaagcgcct

SEQ ID NO: 649628 - DNA, 25 bp, Rattus norvegicus
tgtgctatgagctggcgaagcgcct

SEQ ID NO: 649629 - DNA, 25 bp, Rattus norvegicus
tgtgctatgcacaggaaggacattt

SEQ ID NO: 649630 - DNA, 25 bp, Rattus norvegicus
tgtgctatgcactggaaggacattt

SEQ ID NO: 649631 - DNA, 25 bp, Rattus norvegicus
tgtgctatgccacgatctcccagga

SEQ ID NO: 649632 - DNA, 25 bp, Rattus norvegicus
tgtgctatgccaggatctcccagga

SEQ ID NO: 649633 - DNA, 25 bp, Rattus norvegicus
tgtgctattcagaagctgctgggca

SEQ ID NO: 649634 - DNA, 25 bp, Rattus norvegicus
tgtgctattcagtagctgctgggca

SEQ ID NO: 649635 - DNA, 25 bp, Rattus norvegicus
tgtgctcaaaccacgtgaggtcggt

SEQ ID NO: 649636 - DNA, 25 bp, Rattus norvegicus
tgtgctcaaacctcgtgaggtcggt

SEQ ID NO: 649637 - DNA, 25 bp, Rattus norvegicus
tgtgctcaactcatcagacctctaa

SEQ ID NO: 649638 - DNA, 25 bp, Rattus norvegicus
tgtgctcaactcttcagacctctaa

SEQ ID NO: 649639 - DNA, 25 bp, Rattus norvegicus
tgtgctcaagcgaagctgctcactg

SEQ ID NO: 649640 - DNA, 25 bp, Rattus norvegicus
tgtgctcaagcgtagctgctcactg

SEQ ID NO: 649641 - DNA, 25 bp, Rattus norvegicus
tgtgctcaaggacccaccggaggtc

SEQ ID NO: 649642 - DNA, 25 bp, Rattus norvegicus
tgtgctcaaggagccaccggaggtc

SEQ ID NO: 649643 - DNA, 25 bp, Rattus norvegicus
tgtgctcaaggcagggctgttccgt

SEQ ID NO: 649644 - DNA, 25 bp, Rattus norvegicus
tgtgctcaaggctgggctgttccgt

SEQ ID NO: 649645 - DNA, 25 bp, Rattus norvegicus
tgtgctcaatgtatgtgtctgctta

SEQ ID NO: 649646 - DNA, 25 bp, Rattus norvegicus
tgtgctcaatgtccggactccagac

SEQ ID NO: 649647 - DNA, 25 bp, Rattus norvegicus
tgtgctcaatgtgcggactccagac

SEQ ID NO: 649648 - DNA, 25 bp, Rattus norvegicus
tgtgctcaatgtttgtgtctgctta

SEQ ID NO: 649649 - DNA, 25 bp, Rattus norvegicus
tgtgctcacaccagtacactgaggc

SEQ ID NO: 649650 - DNA, 25 bp, Rattus norvegicus
tgtgctcacacctgtacactgaggc

SEQ ID NO: 649651 - DNA, 25 bp, Rattus norvegicus
tgtgctcaccacagttgtactggag

SEQ ID NO: 649652 - DNA, 25 bp, Rattus norvegicus
tgtgctcaccactgttgtactggag

SEQ ID NO: 649653 - DNA, 25 bp, Rattus norvegicus
tgtgctcactccagttttctgctca

SEQ ID NO: 649654 - DNA, 25 bp, Rattus norvegicus
tgtgctcactcctgttttctgctca

SEQ ID NO: 649655 - DNA, 25 bp, Rattus norvegicus
tgtgctcacttacgccggagttact

SEQ ID NO: 649656 - DNA, 25 bp, Rattus norvegicus
tgtgctcacttaggccggagttact

SEQ ID NO: 649657 - DNA, 25 bp, Rattus norvegicus
tgtgctcagcacataacttatatgt

SEQ ID NO: 649658 - DNA, 25 bp, Rattus norvegicus
tgtgctcagcacttaacttatatgt

SEQ ID NO: 649659 - DNA, 25 bp, Rattus norvegicus
tgtgctcagcctcaaggatgccctt

SEQ ID NO: 649660 - DNA, 25 bp, Rattus norvegicus
tgtgctcagcctgaaggatgccctt

SEQ ID NO: 649661 - DNA, 25 bp, Rattus norvegicus
tgtgctcaggtactgtgcatccgtc

SEQ ID NO: 649662 - DNA, 25 bp, Rattus norvegicus
tgtgctcaggtagtgtgcatccgtc

SEQ ID NO: 649663 - DNA, 25 bp, Rattus norvegicus
tgtgctcatacacccagtattggct

SEQ ID NO: 649664 - DNA, 25 bp, Rattus norvegicus
tgtgctcatacagccagtattggct

SEQ ID NO: 649665 - DNA, 25 bp, Rattus norvegicus
tgtgctcatgcacctatggatggca

SEQ ID NO: 649666 - DNA, 25 bp, Rattus norvegicus
tgtgctcatgcagctatggatggca

SEQ ID NO: 649667 - DNA, 25 bp, Rattus norvegicus
tgtgctcatgtaagtccacgactac

SEQ ID NO: 649668 - DNA, 25 bp, Rattus norvegicus
tgtgctcatgtatgtccacgactac

SEQ ID NO: 649669 - DNA, 25 bp, Rattus norvegicus
tgtgctccacaccagccgtagtttc

SEQ ID NO: 649670 - DNA, 25 bp, Rattus norvegicus
tgtgctccacacgagccgtagtttc

SEQ ID NO: 649671 - DNA, 25 bp, Rattus norvegicus
tgtgctccaccactgcgtcagtaaa

SEQ ID NO: 649672 - DNA, 25 bp, Rattus norvegicus
tgtgctccaccagtgcgtcagtaaa

SEQ ID NO: 649673 - DNA, 25 bp, Rattus norvegicus
tgtgctccagctactgtttgattgt

SEQ ID NO: 649674 - DNA, 25 bp, Rattus norvegicus
tgtgctccagcttctgtttgattgt

SEQ ID NO: 649675 - DNA, 25 bp, Rattus norvegicus
tgtgctccagggctatcttctcttg

SEQ ID NO: 649676 - DNA, 25 bp, Rattus norvegicus
tgtgctccaggggtatcttctcttg

SEQ ID NO: 649677 - DNA, 25 bp, Rattus norvegicus
tgtgctccagtaatgcaactccggc

SEQ ID NO: 649678 - DNA, 25 bp, Rattus norvegicus
tgtgctccagtattgcaactccggc

SEQ ID NO: 649679 - DNA, 25 bp, Rattus norvegicus
tgtgctccccatccaagtatgttta

SEQ ID NO: 649680 - DNA, 25 bp, Rattus norvegicus
tgtgctccccatgcaagtatgttta

SEQ ID NO: 649681 - DNA, 25 bp, Rattus norvegicus
tgtgctccctccacagttttggaac

SEQ ID NO: 649682 - DNA, 25 bp, Rattus norvegicus
tgtgctccctcctcagttttggaac

SEQ ID NO: 649683 - DNA, 25 bp, Rattus norvegicus
tgtgctccctggctcttgctctgct

SEQ ID NO: 649684 - DNA, 25 bp, Rattus norvegicus
tgtgctccctgggtcttgctctgct

SEQ ID NO: 649685 - DNA, 25 bp, Rattus norvegicus
tgtgctccgcgcaagtcggtgacag

SEQ ID NO: 649686 - DNA, 25 bp, Rattus norvegicus
tgtgctccgcgctagtcggtgacag

SEQ ID NO: 649687 - DNA, 25 bp, Rattus norvegicus
tgtgctccgcgtactttggtgacca

SEQ ID NO: 649688 - DNA, 25 bp, Rattus norvegicus
tgtgctccgcgttctttggtgacca

SEQ ID NO: 649689 - DNA, 25 bp, Rattus norvegicus
tgtgctcctaccactaacacactga

SEQ ID NO: 649690 - DNA, 25 bp, Rattus norvegicus
tgtgctcctacctctaacacactga

SEQ ID NO: 649691 - DNA, 25 bp, Rattus norvegicus
tgtgctcctacgatgttctgtgaat

SEQ ID NO: 649692 - DNA, 25 bp, Rattus norvegicus
tgtgctcctacgttgttctgtgaat

SEQ ID NO: 649693 - DNA, 25 bp, Rattus norvegicus
tgtgctcctgtacccctgaaatggt

SEQ ID NO: 649694 - DNA, 25 bp, Rattus norvegicus
tgtgctcctgtagccctgaaatggt

SEQ ID NO: 649695 - DNA, 25 bp, Rattus norvegicus
tgtgctcctgttagggaccgccaca

SEQ ID NO: 649696 - DNA, 25 bp, Rattus norvegicus
tgtgctcctgttcatcctaagcagg

SEQ ID NO: 649697 - DNA, 25 bp, Rattus norvegicus
tgtgctcctgttgatcctaagcagg

SEQ ID NO: 649698 - DNA, 25 bp, Rattus norvegicus
tgtgctcctgtttgggaccgccaca

SEQ ID NO: 649699 - DNA, 25 bp, Rattus norvegicus
tgtgctccttacaagtctctcttga

SEQ ID NO: 649700 - DNA, 25 bp, Rattus norvegicus
tgtgctccttacaccatcatgacaa

SEQ ID NO: 649701 - DNA, 25 bp, Rattus norvegicus
tgtgctccttactagtctctcttga

SEQ ID NO: 649702 - DNA, 25 bp, Rattus norvegicus
tgtgctccttactccatcatgacaa

SEQ ID NO: 649703 - DNA, 25 bp, Rattus norvegicus
tgtgctcgcaataccagctactgga

SEQ ID NO: 649704 - DNA, 25 bp, Rattus norvegicus
tgtgctcgcaattccagctactgga

SEQ ID NO: 649705 - DNA, 25 bp, Rattus norvegicus
tgtgctcggagcaggcattgctagt

SEQ ID NO: 649706 - DNA, 25 bp, Rattus norvegicus
tgtgctcggagctggcattgctagt

SEQ ID NO: 649707 - DNA, 25 bp, Rattus norvegicus
tgtgctctagcacgacatagcccca

SEQ ID NO: 649708 - DNA, 25 bp, Rattus norvegicus
tgtgctctagcaggacatagcccca

SEQ ID NO: 649709 - DNA, 25 bp, Rattus norvegicus
tgtgctctatgtcgagagtggccca

SEQ ID NO: 649710 - DNA, 25 bp, Rattus norvegicus
tgtgctctatgtggagagtggccca

SEQ ID NO: 649711 - DNA, 25 bp, Rattus norvegicus
tgtgctctcagtagcttccagaaga

SEQ ID NO: 649712 - DNA, 25 bp, Rattus norvegicus
tgtgctctcagttgcttccagaaga

SEQ ID NO: 649713 - DNA, 25 bp, Rattus norvegicus
tgtgctctctcaactattctgggac

SEQ ID NO: 649714 - DNA, 25 bp, Rattus norvegicus
tgtgctctctcatctattctgggac

SEQ ID NO: 649715 - DNA, 25 bp, Rattus norvegicus
tgtgctctctgtcgaactgaagttt

SEQ ID NO: 649716 - DNA, 25 bp, Rattus norvegicus
tgtgctctctgtggaactgaagttt

SEQ ID NO: 649717 - DNA, 25 bp, Rattus norvegicus
tgtgctctgagacgctgggcactca

SEQ ID NO: 649718 - DNA, 25 bp, Rattus norvegicus
tgtgctctgagaggctgggcactca

SEQ ID NO: 649719 - DNA, 25 bp, Rattus norvegicus
tgtgctctgagcagagccccgagtt

SEQ ID NO: 649720 - DNA, 25 bp, Rattus norvegicus
tgtgctctgagctgagccccgagtt

SEQ ID NO: 649721 - DNA, 25 bp, Rattus norvegicus
tgtgctctgatcactccagaagcaa

SEQ ID NO: 649722 - DNA, 25 bp, Rattus norvegicus
tgtgctctgatcagatgggccacat

SEQ ID NO: 649723 - DNA, 25 bp, Rattus norvegicus
tgtgctctgatctctccagaagcaa

SEQ ID NO: 649724 - DNA, 25 bp, Rattus norvegicus
tgtgctctgatctgatgggccacat

SEQ ID NO: 649725 - DNA, 25 bp, Rattus norvegicus
tgtgctctgattagttggttcttct

SEQ ID NO: 649726 - DNA, 25 bp, Rattus norvegicus
tgtgctctgatttgttggttcttct

SEQ ID NO: 649727 - DNA, 25 bp, Rattus norvegicus
tgtgctctgcatattctggttttat

SEQ ID NO: 649728 - DNA, 25 bp, Rattus norvegicus
tgtgctctgcattttctggttttat

SEQ ID NO: 649729 - DNA, 25 bp, Rattus norvegicus
tgtgctctgctgaaacccaatagtt

SEQ ID NO: 649730 - DNA, 25 bp, Rattus norvegicus
tgtgctctgctgtaacccaatagtt

SEQ ID NO: 649731 - DNA, 25 bp, Rattus norvegicus
tgtgctctgggccaacagaagatgt

SEQ ID NO: 649732 - DNA, 25 bp, Rattus norvegicus
tgtgctctgggcgaacagaagatgt

SEQ ID NO: 649733 - DNA, 25 bp, Rattus norvegicus
tgtgctctggtgcagatgctcacat

SEQ ID NO: 649734 - DNA, 25 bp, Rattus norvegicus
tgtgctctggtggagatgctcacat

SEQ ID NO: 649735 - DNA, 25 bp, Rattus norvegicus
tgtgctctgtatcccatcttaagac

SEQ ID NO: 649736 - DNA, 25 bp, Rattus norvegicus
tgtgctctgtatgccatcttaagac

SEQ ID NO: 649737 - DNA, 25 bp, Rattus norvegicus
tgtgctctgtggaatctcattctaa

SEQ ID NO: 649738 - DNA, 25 bp, Rattus norvegicus
tgtgctctgtggtatctcattctaa

SEQ ID NO: 649739 - DNA, 25 bp, Rattus norvegicus
tgtgctctgtgtcctcttttcccat

SEQ ID NO: 649740 - DNA, 25 bp, Rattus norvegicus
tgtgctctgtgtgctcttttcccat

SEQ ID NO: 649741 - DNA, 25 bp, Rattus norvegicus
tgtgctctgttacactatgctttgc

SEQ ID NO: 649742 - DNA, 25 bp, Rattus norvegicus
tgtgctctgttagactatgctttgc

SEQ ID NO: 649743 - DNA, 25 bp, Rattus norvegicus
tgtgctcttagcatatacctcaatc

SEQ ID NO: 649744 - DNA, 25 bp, Rattus norvegicus
tgtgctcttagcttatacctcaatc

SEQ ID NO: 649745 - DNA, 25 bp, Rattus norvegicus
tgtgctcttagtaacatggattcgc

SEQ ID NO: 649746 - DNA, 25 bp, Rattus norvegicus
tgtgctcttagttacatggattcgc

SEQ ID NO: 649747 - DNA, 25 bp, Rattus norvegicus
tgtgctcttcatcctgggacagggc

SEQ ID NO: 649748 - DNA, 25 bp, Rattus norvegicus
tgtgctcttcatcttggttcaataa

SEQ ID NO: 649749 - DNA, 25 bp, Rattus norvegicus
tgtgctcttcatgctgggacagggc

SEQ ID NO: 649750 - DNA, 25 bp, Rattus norvegicus
tgtgctcttcatgttggttcaataa

SEQ ID NO: 649751 - DNA, 25 bp, Rattus norvegicus
tgtgctcttcccaaatgccaagaag

SEQ ID NO: 649752 - DNA, 25 bp, Rattus norvegicus
tgtgctcttccctaatgccaagaag

SEQ ID NO: 649753 - DNA, 25 bp, Rattus norvegicus
tgtgctcttctactcaaaattcaat

SEQ ID NO: 649754 - DNA, 25 bp, Rattus norvegicus
tgtgctcttctagtcaaaattcaat

SEQ ID NO: 649755 - DNA, 25 bp, Rattus norvegicus
tgtgctcttctcagtgagtttcaac

SEQ ID NO: 649756 - DNA, 25 bp, Rattus norvegicus
tgtgctcttctctgtgagtttcaac

SEQ ID NO: 649757 - DNA, 25 bp, Rattus norvegicus
tgtgctcttgcacatcatggtgcat

SEQ ID NO: 649758 - DNA, 25 bp, Rattus norvegicus
tgtgctcttgcagatcatggtgcat

SEQ ID NO: 649759 - DNA, 25 bp, Rattus norvegicus
tgtgctcttgtgagtgtactgccca

SEQ ID NO: 649760 - DNA, 25 bp, Rattus norvegicus
tgtgctcttgtgtgtgtactgccca

SEQ ID NO: 649761 - DNA, 25 bp, Rattus norvegicus
tgtgctctttttctgactcagtttt

SEQ ID NO: 649762 - DNA, 25 bp, Rattus norvegicus
tgtgctctttttgtgactcagtttt

SEQ ID NO: 649763 - DNA, 25 bp, Rattus norvegicus
tgtgctgaacccaataacccaggtg

SEQ ID NO: 649764 - DNA, 25 bp, Rattus norvegicus
tgtgctgaaccctataacccaggtg

SEQ ID NO: 649765 - DNA, 25 bp, Rattus norvegicus
tgtgctgaaggcctagctcacttac

SEQ ID NO: 649766 - DNA, 25 bp, Rattus norvegicus
tgtgctgaaggcgtagctcacttac

SEQ ID NO: 649767 - DNA, 25 bp, Rattus norvegicus
tgtgctgacactactgctcacggaa

SEQ ID NO: 649768 - DNA, 25 bp, Rattus norvegicus
tgtgctgacacttctgctcacggaa

SEQ ID NO: 649769 - DNA, 25 bp, Rattus norvegicus
tgtgctgagcacatccctgtccagg

SEQ ID NO: 649770 - DNA, 25 bp, Rattus norvegicus
tgtgctgagcacttccctgtccagg

SEQ ID NO: 649771 - DNA, 25 bp, Rattus norvegicus
tgtgctgagctcagcagtggcgact

SEQ ID NO: 649772 - DNA, 25 bp, Rattus norvegicus
tgtgctgagctctgcagtggcgact

SEQ ID NO: 649773 - DNA, 25 bp, Rattus norvegicus
tgtgctgaggaaccctagcctgcag

SEQ ID NO: 649774 - DNA, 25 bp, Rattus norvegicus
tgtgctgaggaagcctagcctgcag

SEQ ID NO: 649775 - DNA, 25 bp, Rattus norvegicus
tgtgctgatcctagtgtccctgtta

SEQ ID NO: 649776 - DNA, 25 bp, Rattus norvegicus
tgtgctgatccttgtgtccctgtta

SEQ ID NO: 649777 - DNA, 25 bp, Rattus norvegicus
tgtgctgatcttacaagtgtcccca

SEQ ID NO: 649778 - DNA, 25 bp, Rattus norvegicus
tgtgctgatctttcaagtgtcccca

SEQ ID NO: 649779 - DNA, 25 bp, Rattus norvegicus
tgtgctgatgtgaaactcccggagt

SEQ ID NO: 649780 - DNA, 25 bp, Rattus norvegicus
tgtgctgatgtgtaactcccggagt

SEQ ID NO: 649781 - DNA, 25 bp, Rattus norvegicus
tgtgctgcacagacattacgttcaa

SEQ ID NO: 649782 - DNA, 25 bp, Rattus norvegicus
tgtgctgcacagtcattacgttcaa

SEQ ID NO: 649783 - DNA, 25 bp, Rattus norvegicus
tgtgctgcacatcggctggattttt

SEQ ID NO: 649784 - DNA, 25 bp, Rattus norvegicus
tgtgctgcacatgggctggattttt

SEQ ID NO: 649785 - DNA, 25 bp, Rattus norvegicus
tgtgctgcaggcaactgagtcattt

SEQ ID NO: 649786 - DNA, 25 bp, Rattus norvegicus
tgtgctgcaggctactgagtcattt

SEQ ID NO: 649787 - DNA, 25 bp, Rattus norvegicus
tgtgctgcatctactcgctcttcaa

SEQ ID NO: 649788 - DNA, 25 bp, Rattus norvegicus
tgtgctgcatcttctcgctcttcaa

SEQ ID NO: 649789 - DNA, 25 bp, Rattus norvegicus
tgtgctgccagcaagctgtcagaga

SEQ ID NO: 649790 - DNA, 25 bp, Rattus norvegicus
tgtgctgccagctagctgtcagaga

SEQ ID NO: 649791 - DNA, 25 bp, Rattus norvegicus
tgtgctgccatcctggactactttg

SEQ ID NO: 649792 - DNA, 25 bp, Rattus norvegicus
tgtgctgccatcgtggactactttg

SEQ ID NO: 649793 - DNA, 25 bp, Rattus norvegicus
tgtgctgcccagagttggccaaagc

SEQ ID NO: 649794 - DNA, 25 bp, Rattus norvegicus
tgtgctgcccagtgttggccaaagc

SEQ ID NO: 649795 - DNA, 25 bp, Rattus norvegicus
tgtgctgccctgagctgcagctcct

SEQ ID NO: 649796 - DNA, 25 bp, Rattus norvegicus
tgtgctgccctgtgctgcagctcct

SEQ ID NO: 649797 - DNA, 25 bp, Rattus norvegicus
tgtgctgccgtcattgacaagttca

SEQ ID NO: 649798 - DNA, 25 bp, Rattus norvegicus
tgtgctgccgtctttgacaagttca

SEQ ID NO: 649799 - DNA, 25 bp, Rattus norvegicus
tgtgctgcctctcccaatgtgaaaa

SEQ ID NO: 649800 - DNA, 25 bp, Rattus norvegicus
tgtgctgcctctgccaatgtgaaaa

SEQ ID NO: 649801 - DNA, 25 bp, Rattus norvegicus
tgtgctgccttacagtttgtactgt

SEQ ID NO: 649802 - DNA, 25 bp, Rattus norvegicus
tgtgctgccttagagtttgtactgt

SEQ ID NO: 649803 - DNA, 25 bp, Rattus norvegicus
tgtgctgctattccccttatttgaa

SEQ ID NO: 649804 - DNA, 25 bp, Rattus norvegicus
tgtgctgctattgcccttatttgaa

SEQ ID NO: 649805 - DNA, 25 bp, Rattus norvegicus
tgtgctgctcaccgaggcccctctg

SEQ ID NO: 649806 - DNA, 25 bp, Rattus norvegicus
tgtgctgctcacggaggcccctctg

SEQ ID NO: 649807 - DNA, 25 bp, Rattus norvegicus
tgtgctgctccaatcatctgtgaag

SEQ ID NO: 649808 - DNA, 25 bp, Rattus norvegicus
tgtgctgctccattcatctgtgaag

SEQ ID NO: 649809 - DNA, 25 bp, Rattus norvegicus
tgtgctgctcctccaaatggtggca

SEQ ID NO: 649810 - DNA, 25 bp, Rattus norvegicus
tgtgctgctcctgcaaatggtggca

SEQ ID NO: 649811 - DNA, 25 bp, Rattus norvegicus
tgtgctgctctcaaggcccttggag

SEQ ID NO: 649812 - DNA, 25 bp, Rattus norvegicus
tgtgctgctctctaggcccttggag

SEQ ID NO: 649813 - DNA, 25 bp, Rattus norvegicus
tgtgctgctgctataggctcaacca

SEQ ID NO: 649814 - DNA, 25 bp, Rattus norvegicus
tgtgctgctgctttaggctcaacca

SEQ ID NO: 649815 - DNA, 25 bp, Rattus norvegicus
tgtgctgctggtcccaaacgtttga

SEQ ID NO: 649816 - DNA, 25 bp, Rattus norvegicus
tgtgctgctggtgccaaacgtttga

SEQ ID NO: 649817 - DNA, 25 bp, Rattus norvegicus
tgtgctgcttttcgcctgtgggcat

SEQ ID NO: 649818 - DNA, 25 bp, Rattus norvegicus
tgtgctgcttttggcctgtgggcat

SEQ ID NO: 649819 - DNA, 25 bp, Rattus norvegicus
tgtgctggaactcggccctcattga

SEQ ID NO: 649820 - DNA, 25 bp, Rattus norvegicus
tgtgctggaactgggccctcattga

SEQ ID NO: 649821 - DNA, 25 bp, Rattus norvegicus
tgtgctggagaaactcggtgtgact

SEQ ID NO: 649822 - DNA, 25 bp, Rattus norvegicus
tgtgctggagaatctcggtgtgact

SEQ ID NO: 649823 - DNA, 25 bp, Rattus norvegicus
tgtgctggagatacgtgtccgttac

SEQ ID NO: 649824 - DNA, 25 bp, Rattus norvegicus
tgtgctggagattcgtgtccgttac

SEQ ID NO: 649825 - DNA, 25 bp, Rattus norvegicus
tgtgctggatcacagcgacttgtca

SEQ ID NO: 649826 - DNA, 25 bp, Rattus norvegicus
tgtgctggatcagagcgacttgtca

SEQ ID NO: 649827 - DNA, 25 bp, Rattus norvegicus
tgtgctggcaccatgtatttaaccc

SEQ ID NO: 649828 - DNA, 25 bp, Rattus norvegicus
tgtgctggcaccttgtatttaaccc

SEQ ID NO: 649829 - DNA, 25 bp, Rattus norvegicus
tgtgctggccacctctagactacta

SEQ ID NO: 649830 - DNA, 25 bp, Rattus norvegicus
tgtgctggccacgtctagactacta

SEQ ID NO: 649831 - DNA, 25 bp, Rattus norvegicus
tgtgctggccataacacctggagta

SEQ ID NO: 649832 - DNA, 25 bp, Rattus norvegicus
tgtgctggccattacacctggagta

SEQ ID NO: 649833 - DNA, 25 bp, Rattus norvegicus
tgtgctggcgcacattctcaagcgc

SEQ ID NO: 649834 - DNA, 25 bp, Rattus norvegicus
tgtgctggcgcagattctcaagcgc

SEQ ID NO: 649835 - DNA, 25 bp, Rattus norvegicus
tgtgctggctgcaatcagacacctt

SEQ ID NO: 649836 - DNA, 25 bp, Rattus norvegicus
tgtgctggctgctatcagacacctt

SEQ ID NO: 649837 - DNA, 25 bp, Rattus norvegicus
tgtgctgggaatatttcatgccttc

SEQ ID NO: 649838 - DNA, 25 bp, Rattus norvegicus
tgtgctgggaatttttcatgccttc

SEQ ID NO: 649839 - DNA, 25 bp, Rattus norvegicus
tgtgctgggaccagcaacctggctg

SEQ ID NO: 649840 - DNA, 25 bp, Rattus norvegicus
tgtgctgggacctgcaacctggctg

SEQ ID NO: 649841 - DNA, 25 bp, Rattus norvegicus
tgtgctgggcagagatatcctcacc

SEQ ID NO: 649842 - DNA, 25 bp, Rattus norvegicus
tgtgctgggcagtgatatcctcacc

SEQ ID NO: 649843 - DNA, 25 bp, Rattus norvegicus
tgtgctgggtctctggtgctcttca

SEQ ID NO: 649844 - DNA, 25 bp, Rattus norvegicus
tgtgctgggtctgtggtgctcttca

SEQ ID NO: 649845 - DNA, 25 bp, Rattus norvegicus
tgtgctgggttcacactaacatagt

SEQ ID NO: 649846 - DNA, 25 bp, Rattus norvegicus
tgtgctgggttctcactaacatagt

SEQ ID NO: 649847 - DNA, 25 bp, Rattus norvegicus
tgtgctggtcacagatagctcctag

SEQ ID NO: 649848 - DNA, 25 bp, Rattus norvegicus
tgtgctggtcactgatagctcctag

SEQ ID NO: 649849 - DNA, 25 bp, Rattus norvegicus
tgtgctggtcgtagtgagtctgctc

SEQ ID NO: 649850 - DNA, 25 bp, Rattus norvegicus
tgtgctggtcgttgtgagtctgctc

SEQ ID NO: 649851 - DNA, 25 bp, Rattus norvegicus
tgtgctggtctgaggatttatttct

SEQ ID NO: 649852 - DNA, 25 bp, Rattus norvegicus
tgtgctggtctgtggatttatttct

SEQ ID NO: 649853 - DNA, 25 bp, Rattus norvegicus
tgtgctggtgcacgcctgtaatgcc

SEQ ID NO: 649854 - DNA, 25 bp, Rattus norvegicus
tgtgctggtgcaggcctgtaatgcc

SEQ ID NO: 649855 - DNA, 25 bp, Rattus norvegicus
tgtgctgtaggcacccttgtgggct

SEQ ID NO: 649856 - DNA, 25 bp, Rattus norvegicus
tgtgctgtaggctcccttgtgggct

SEQ ID NO: 649857 - DNA, 25 bp, Rattus norvegicus
tgtgctgtcattcctaggtgttctc

SEQ ID NO: 649858 - DNA, 25 bp, Rattus norvegicus
tgtgctgtcattgctaggtgttctc

SEQ ID NO: 649859 - DNA, 25 bp, Rattus norvegicus
tgtgctgtccggcaacctaagggtt

SEQ ID NO: 649860 - DNA, 25 bp, Rattus norvegicus
tgtgctgtccgggaacctaagggtt

SEQ ID NO: 649861 - DNA, 25 bp, Rattus norvegicus
tgtgctgtcctaactattcattgta

SEQ ID NO: 649862 - DNA, 25 bp, Rattus norvegicus
tgtgctgtcctatctattcattgta

SEQ ID NO: 649863 - DNA, 25 bp, Rattus norvegicus
tgtgctgtgaaccttttctgccaaa

SEQ ID NO: 649864 - DNA, 25 bp, Rattus norvegicus
tgtgctgtgaacgttttctgccaaa

SEQ ID NO: 649865 - DNA, 25 bp, Rattus norvegicus
tgtgctgtgagccttttgtgacaca

SEQ ID NO: 649866 - DNA, 25 bp, Rattus norvegicus
tgtgctgtgagcgttttgtgacaca

SEQ ID NO: 649867 - DNA, 25 bp, Rattus norvegicus
tgtgctgtgcccatttataagaggg

SEQ ID NO: 649868 - DNA, 25 bp, Rattus norvegicus
tgtgctgtgcccctaagttcatttt

SEQ ID NO: 649869 - DNA, 25 bp, Rattus norvegicus
tgtgctgtgcccgtaagttcatttt

SEQ ID NO: 649870 - DNA, 25 bp, Rattus norvegicus
tgtgctgtgcccttttataagaggg

SEQ ID NO: 649871 - DNA, 25 bp, Rattus norvegicus
tgtgctgtgcggacaaaacccaggt

SEQ ID NO: 649872 - DNA, 25 bp, Rattus norvegicus
tgtgctgtgcggtcaaaacccaggt

SEQ ID NO: 649873 - DNA, 25 bp, Rattus norvegicus
tgtgctgtgctcagatcggaaggat

SEQ ID NO: 649874 - DNA, 25 bp, Rattus norvegicus
tgtgctgtgctctgatcggaaggat

SEQ ID NO: 649875 - DNA, 25 bp, Rattus norvegicus
tgtgctgtgctgaaccagggtctca

SEQ ID NO: 649876 - DNA, 25 bp, Rattus norvegicus
tgtgctgtgctgtaccagggtctca

SEQ ID NO: 649877 - DNA, 25 bp, Rattus norvegicus
tgtgctgtgcttactcttgaggagt

SEQ ID NO: 649878 - DNA, 25 bp, Rattus norvegicus
tgtgctgtgctttctcttgaggagt

SEQ ID NO: 649879 - DNA, 25 bp, Rattus norvegicus
tgtgctgtgttactgctgtatctga

SEQ ID NO: 649880 - DNA, 25 bp, Rattus norvegicus
tgtgctgtgttagtgctgtatctga

SEQ ID NO: 649881 - DNA, 25 bp, Rattus norvegicus
tgtgctgtgtttatgccttttgtag

SEQ ID NO: 649882 - DNA, 25 bp, Rattus norvegicus
tgtgctgtgtttcaggccctagaga

SEQ ID NO: 649883 - DNA, 25 bp, Rattus norvegicus
tgtgctgtgtttgaggccctagaga

SEQ ID NO: 649884 - DNA, 25 bp, Rattus norvegicus
tgtgctgtgtttttgccttttgtag

SEQ ID NO: 649885 - DNA, 25 bp, Rattus norvegicus
tgtgctgttatcacgcttattggaa

SEQ ID NO: 649886 - DNA, 25 bp, Rattus norvegicus
tgtgctgttatctcgcttattggaa

SEQ ID NO: 649887 - DNA, 25 bp, Rattus norvegicus
tgtgctgttcatctgtgactgcgca

SEQ ID NO: 649888 - DNA, 25 bp, Rattus norvegicus
tgtgctgttcatgtgtgactgcgca

SEQ ID NO: 649889 - DNA, 25 bp, Rattus norvegicus
tgtgctgttcccacttgtgttgtct

SEQ ID NO: 649890 - DNA, 25 bp, Rattus norvegicus
tgtgctgttccctcttgtgttgtct

SEQ ID NO: 649891 - DNA, 25 bp, Rattus norvegicus
tgtgctgttcttatggacgtcccca

SEQ ID NO: 649892 - DNA, 25 bp, Rattus norvegicus
tgtgctgttcttttggacgtcccca

SEQ ID NO: 649893 - DNA, 25 bp, Rattus norvegicus
tgtgctgttgcacggtcctcaagta

SEQ ID NO: 649894 - DNA, 25 bp, Rattus norvegicus
tgtgctgttgcagggtcctcaagta

SEQ ID NO: 649895 - DNA, 25 bp, Rattus norvegicus
tgtgctgttgctacctgagaccaaa

SEQ ID NO: 649896 - DNA, 25 bp, Rattus norvegicus
tgtgctgttgcttcctgagaccaaa

SEQ ID NO: 649897 - DNA, 25 bp, Rattus norvegicus
tgtgctgttggcatggtgttcacca

SEQ ID NO: 649898 - DNA, 25 bp, Rattus norvegicus
tgtgctgttggcttggtgttcacca

SEQ ID NO: 649899 - DNA, 25 bp, Rattus norvegicus
tgtgcttaaaagaagtcctccccga

SEQ ID NO: 649900 - DNA, 25 bp, Rattus norvegicus
tgtgcttaaaagtagtcctccccga

SEQ ID NO: 649901 - DNA, 25 bp, Rattus norvegicus
tgtgcttaaacaccctattacctct

SEQ ID NO: 649902 - DNA, 25 bp, Rattus norvegicus
tgtgcttaaacagcctattacctct

SEQ ID NO: 649903 - DNA, 25 bp, Rattus norvegicus
tgtgcttaaagccaaccctgctgta

SEQ ID NO: 649904 - DNA, 25 bp, Rattus norvegicus
tgtgcttaaagcgaaccctgctgta

SEQ ID NO: 649905 - DNA, 25 bp, Rattus norvegicus
tgtgcttaagctcgattcttctggc

SEQ ID NO: 649906 - DNA, 25 bp, Rattus norvegicus
tgtgcttaagctggattcttctggc

SEQ ID NO: 649907 - DNA, 25 bp, Rattus norvegicus
tgtgcttaattcaggcaaccggccc

SEQ ID NO: 649908 - DNA, 25 bp, Rattus norvegicus
tgtgcttaattctggcaaccggccc

SEQ ID NO: 649909 - DNA, 25 bp, Rattus norvegicus
tgtgcttagcaaaagtctgacccct

SEQ ID NO: 649910 - DNA, 25 bp, Rattus norvegicus
tgtgcttagcaatagtctgacccct

SEQ ID NO: 649911 - DNA, 25 bp, Rattus norvegicus
tgtgcttagctgcaagagcgcgctc

SEQ ID NO: 649912 - DNA, 25 bp, Rattus norvegicus
tgtgcttagctggaagagcgcgctc

SEQ ID NO: 649913 - DNA, 25 bp, Rattus norvegicus
tgtgcttattttactacctttggta

SEQ ID NO: 649914 - DNA, 25 bp, Rattus norvegicus
tgtgcttatttttctacctttggta

SEQ ID NO: 649915 - DNA, 25 bp, Rattus norvegicus
tgtgcttcacctcactcggcgcagt

SEQ ID NO: 649916 - DNA, 25 bp, Rattus norvegicus
tgtgcttcacctgactcggcgcagt

SEQ ID NO: 649917 - DNA, 25 bp, Rattus norvegicus
tgtgcttcagctcagtcattgtgga

SEQ ID NO: 649918 - DNA, 25 bp, Rattus norvegicus
tgtgcttcagctgagtcattgtgga

SEQ ID NO: 649919 - DNA, 25 bp, Rattus norvegicus
tgtgcttcatcacgcacatgtgcat

SEQ ID NO: 649920 - DNA, 25 bp, Rattus norvegicus
tgtgcttcatcaggcacatgtgcat

SEQ ID NO: 649921 - DNA, 25 bp, Rattus norvegicus
tgtgcttccaagacactgttggttt

SEQ ID NO: 649922 - DNA, 25 bp, Rattus norvegicus
tgtgcttccaagtcactgttggttt

SEQ ID NO: 649923 - DNA, 25 bp, Rattus norvegicus
tgtgcttccacacagaccctggaag

SEQ ID NO: 649924 - DNA, 25 bp, Rattus norvegicus
tgtgcttccacagagaccctggaag

SEQ ID NO: 649925 - DNA, 25 bp, Rattus norvegicus
tgtgcttccagaagaggccgtgtct

SEQ ID NO: 649926 - DNA, 25 bp, Rattus norvegicus
tgtgcttccagatgaggccgtgtct

SEQ ID NO: 649927 - DNA, 25 bp, Rattus norvegicus
tgtgcttccgatcggagttcctata

SEQ ID NO: 649928 - DNA, 25 bp, Rattus norvegicus
tgtgcttccgatgggagttcctata

SEQ ID NO: 649929 - DNA, 25 bp, Rattus norvegicus
tgtgcttccgtccagagtggagtta

SEQ ID NO: 649930 - DNA, 25 bp, Rattus norvegicus
tgtgcttccgtcgagagtggagtta

SEQ ID NO: 649931 - DNA, 25 bp, Rattus norvegicus
tgtgcttcctgaactgtaccagagt

SEQ ID NO: 649932 - DNA, 25 bp, Rattus norvegicus
tgtgcttcctgatctgtaccagagt

SEQ ID NO: 649933 - DNA, 25 bp, Rattus norvegicus
tgtgcttcctgtctccagatgggag

SEQ ID NO: 649934 - DNA, 25 bp, Rattus norvegicus
tgtgcttcctgtgtccagatgggag

SEQ ID NO: 649935 - DNA, 25 bp, Rattus norvegicus
tgtgcttcgagcagcaacctagcta

SEQ ID NO: 649936 - DNA, 25 bp, Rattus norvegicus
tgtgcttcgagctgcaacctagcta

SEQ ID NO: 649937 - DNA, 25 bp, Rattus norvegicus
tgtgcttcgaggacttccagaggaa

SEQ ID NO: 649938 - DNA, 25 bp, Rattus norvegicus
tgtgcttcgaggtcttccagaggaa

SEQ ID NO: 649939 - DNA, 25 bp, Rattus norvegicus
tgtgcttcgataacggtgccgagac

SEQ ID NO: 649940 - DNA, 25 bp, Rattus norvegicus
tgtgcttcgatatcggtgccgagac

SEQ ID NO: 649941 - DNA, 25 bp, Rattus norvegicus
tgtgcttctaagagtgttgtccctt

SEQ ID NO: 649942 - DNA, 25 bp, Rattus norvegicus
tgtgcttctaagtgtgttgtccctt

SEQ ID NO: 649943 - DNA, 25 bp, Rattus norvegicus
tgtgcttctgaaatcttctcacgaa

SEQ ID NO: 649944 - DNA, 25 bp, Rattus norvegicus
tgtgcttctgaattcttctcacgaa

SEQ ID NO: 649945 - DNA, 25 bp, Rattus norvegicus
tgtgcttcttacactggcaagtacc

SEQ ID NO: 649946 - DNA, 25 bp, Rattus norvegicus
tgtgcttcttactctggcaagtacc

SEQ ID NO: 649947 - DNA, 25 bp, Rattus norvegicus
tgtgcttcttgtcatcaaccttggt

SEQ ID NO: 649948 - DNA, 25 bp, Rattus norvegicus
tgtgcttcttgtgatcaaccttggt

SEQ ID NO: 649949 - DNA, 25 bp, Rattus norvegicus
tgtgcttgccacactgataggcagt

SEQ ID NO: 649950 - DNA, 25 bp, Rattus norvegicus
tgtgcttgccactctgataggcagt

SEQ ID NO: 649951 - DNA, 25 bp, Rattus norvegicus
tgtgcttgccagactccaaaatcat

SEQ ID NO: 649952 - DNA, 25 bp, Rattus norvegicus
tgtgcttgccagtctccaaaatcat

SEQ ID NO: 649953 - DNA, 25 bp, Rattus norvegicus
tgtgcttgcctgcaactgactatag

SEQ ID NO: 649954 - DNA, 25 bp, Rattus norvegicus
tgtgcttgcctggaactgactatag

SEQ ID NO: 649955 - DNA, 25 bp, Rattus norvegicus
tgtgcttgccttctgcatcaataaa

SEQ ID NO: 649956 - DNA, 25 bp, Rattus norvegicus
tgtgcttgccttgtgcatcaataaa

SEQ ID NO: 649957 - DNA, 25 bp, Rattus norvegicus
tgtgcttgcgctagccactgagcta

SEQ ID NO: 649958 - DNA, 25 bp, Rattus norvegicus
tgtgcttgcgcttgccactgagcta

SEQ ID NO: 649959 - DNA, 25 bp, Rattus norvegicus
tgtgcttggctgctgtctgaattaa

SEQ ID NO: 649960 - DNA, 25 bp, Rattus norvegicus
tgtgcttggctggtgtctgaattaa

SEQ ID NO: 649961 - DNA, 25 bp, Rattus norvegicus
tgtgcttgtcctagtccgatgaaac

SEQ ID NO: 649962 - DNA, 25 bp, Rattus norvegicus
tgtgcttgtccttgtccgatgaaac

SEQ ID NO: 649963 - DNA, 25 bp, Rattus norvegicus
tgtgcttgtgtgaccatcccagctt

SEQ ID NO: 649964 - DNA, 25 bp, Rattus norvegicus
tgtgcttgtgtgagtccataaatag

SEQ ID NO: 649965 - DNA, 25 bp, Rattus norvegicus
tgtgcttgtgtgtccatcccagctt

SEQ ID NO: 649966 - DNA, 25 bp, Rattus norvegicus
tgtgcttgtgtgtgtccataaatag

SEQ ID NO: 649967 - DNA, 25 bp, Rattus norvegicus
tgtgctttacacagttgcctataaa

SEQ ID NO: 649968 - DNA, 25 bp, Rattus norvegicus
tgtgctttacactgttgcctataaa

SEQ ID NO: 649969 - DNA, 25 bp, Rattus norvegicus
tgtgctttagagatggccagacggc

SEQ ID NO: 649970 - DNA, 25 bp, Rattus norvegicus
tgtgctttagagttggccagacggc

SEQ ID NO: 649971 - DNA, 25 bp, Rattus norvegicus
tgtgctttcaaaatttgtttccctt

SEQ ID NO: 649972 - DNA, 25 bp, Rattus norvegicus
tgtgctttcaaattttgtttccctt

SEQ ID NO: 649973 - DNA, 25 bp, Rattus norvegicus
tgtgctttcaacaccagactcatgc

SEQ ID NO: 649974 - DNA, 25 bp, Rattus norvegicus
tgtgctttcaactccagactcatgc

SEQ ID NO: 649975 - DNA, 25 bp, Rattus norvegicus
tgtgctttcactagtctgtagactg

SEQ ID NO: 649976 - DNA, 25 bp, Rattus norvegicus
tgtgctttcacttgtctgtagactg

SEQ ID NO: 649977 - DNA, 25 bp, Rattus norvegicus
tgtgctttcatgactggattttgtg

SEQ ID NO: 649978 - DNA, 25 bp, Rattus norvegicus
tgtgctttcatgtctggattttgtg

SEQ ID NO: 649979 - DNA, 25 bp, Rattus norvegicus
tgtgctttcgggaaggcggctccgc

SEQ ID NO: 649980 - DNA, 25 bp, Rattus norvegicus
tgtgctttcgggtaggcggctccgc

SEQ ID NO: 649981 - DNA, 25 bp, Rattus norvegicus
tgtgctttcgtccagcggacacaag

SEQ ID NO: 649982 - DNA, 25 bp, Rattus norvegicus
tgtgctttcgtcgagcggacacaag

SEQ ID NO: 649983 - DNA, 25 bp, Rattus norvegicus
tgtgctttcgtgctctggactgcga

SEQ ID NO: 649984 - DNA, 25 bp, Rattus norvegicus
tgtgctttcgtggtctggactgcga

SEQ ID NO: 649985 - DNA, 25 bp, Rattus norvegicus
tgtgctttcgttccttcagtaaaca

SEQ ID NO: 649986 - DNA, 25 bp, Rattus norvegicus
tgtgctttcgttgcttcagtaaaca

SEQ ID NO: 649987 - DNA, 25 bp, Rattus norvegicus
tgtgctttctgacgaggtggcccaa

SEQ ID NO: 649988 - DNA, 25 bp, Rattus norvegicus
tgtgctttctgaggaggtggcccaa

SEQ ID NO: 649989 - DNA, 25 bp, Rattus norvegicus
tgtgctttcttgatgtccctggtgg

SEQ ID NO: 649990 - DNA, 25 bp, Rattus norvegicus
tgtgctttcttgttgtccctggtgg

SEQ ID NO: 649991 - DNA, 25 bp, Rattus norvegicus
tgtgctttgaagacaggtgtctgaa

SEQ ID NO: 649992 - DNA, 25 bp, Rattus norvegicus
tgtgctttgaagtcaggtgtctgaa

SEQ ID NO: 649993 - DNA, 25 bp, Rattus norvegicus
tgtgctttgtgaaactgtacgcccc

SEQ ID NO: 649994 - DNA, 25 bp, Rattus norvegicus
tgtgctttgtgatactgtacgcccc

SEQ ID NO: 649995 - DNA, 25 bp, Rattus norvegicus
tgtgcttttattagtgtcctgtccc

SEQ ID NO: 649996 - DNA, 25 bp, Rattus norvegicus
tgtgcttttatttgtgtcctgtccc

SEQ ID NO: 649997 - DNA, 25 bp, Rattus norvegicus
tgtgcttttcagactgcagagttct

SEQ ID NO: 649998 - DNA, 25 bp, Rattus norvegicus
tgtgcttttcagtctgcagagttct

SEQ ID NO: 649999 - DNA, 25 bp, Rattus norvegicus
tgtgctttttacaatctggctttaa

SEQ ID NO: 650000 - DNA, 25 bp, Rattus norvegicus
tgtgctttttactatctggctttaa

SEQ ID NO: 650001 - DNA, 25 bp, Rattus norvegicus
tgtgctttttgtaacatgacctgtt

SEQ ID NO: 650002 - DNA, 25 bp, Rattus norvegicus
tgtgctttttgttacatgacctgtt

SEQ ID NO: 650003 - DNA, 25 bp, Rattus norvegicus
tgtgcttttttcactggctgaaacg

SEQ ID NO: 650004 - DNA, 25 bp, Rattus norvegicus
tgtgcttttttctctggctgaaacg

SEQ ID NO: 650005 - DNA, 25 bp, Rattus norvegicus
tgtggaaaaactctctacctccttt

SEQ ID NO: 650006 - DNA, 25 bp, Rattus norvegicus
tgtggaaaaactgtctacctccttt

SEQ ID NO: 650007 - DNA, 25 bp, Rattus norvegicus
tgtggaaaagcaccatttgtgactc

SEQ ID NO: 650008 - DNA, 25 bp, Rattus norvegicus
tgtggaaaagcagcatttgtgactc

SEQ ID NO: 650009 - DNA, 25 bp, Rattus norvegicus
tgtggaaacaccactgtcccatggc

SEQ ID NO: 650010 - DNA, 25 bp, Rattus norvegicus
tgtggaaacacctctgtcccatggc

SEQ ID NO: 650011 - DNA, 25 bp, Rattus norvegicus
tgtggaaaccatctgtctagtactg

SEQ ID NO: 650012 - DNA, 25 bp, Rattus norvegicus
tgtggaaaccatgtgtctagtactg

SEQ ID NO: 650013 - DNA, 25 bp, Rattus norvegicus
tgtggaaaccttcctgtccagtgtc

SEQ ID NO: 650014 - DNA, 25 bp, Rattus norvegicus
tgtggaaaccttgctgtccagtgtc

SEQ ID NO: 650015 - DNA, 25 bp, Rattus norvegicus
tgtggaaagcacatggtggattgta

SEQ ID NO: 650016 - DNA, 25 bp, Rattus norvegicus
tgtggaaagcacttggtggattgta

SEQ ID NO: 650017 - DNA, 25 bp, Rattus norvegicus
tgtggaaatctgactgcttgtttac

SEQ ID NO: 650018 - DNA, 25 bp, Rattus norvegicus
tgtggaaatctgtctgcttgtttac

SEQ ID NO: 650019 - DNA, 25 bp, Rattus norvegicus
tgtggaacaataaccatccctcgtg

SEQ ID NO: 650020 - DNA, 25 bp, Rattus norvegicus
tgtggaacaatatccatccctcgtg

SEQ ID NO: 650021 - DNA, 25 bp, Rattus norvegicus
tgtggaacagccctctatctacgac

SEQ ID NO: 650022 - DNA, 25 bp, Rattus norvegicus
tgtggaacagccgtctatctacgac

SEQ ID NO: 650023 - DNA, 25 bp, Rattus norvegicus
tgtggaacagtacctcatctcaaga

SEQ ID NO: 650024 - DNA, 25 bp, Rattus norvegicus
tgtggaacagtagctcatctcaaga

SEQ ID NO: 650025 - DNA, 25 bp, Rattus norvegicus
tgtggaaccagtcaccatgctctgc

SEQ ID NO: 650026 - DNA, 25 bp, Rattus norvegicus
tgtggaaccagtgaccatgctctgc

SEQ ID NO: 650027 - DNA, 25 bp, Rattus norvegicus
tgtggaacgaccagaggcccaagct

SEQ ID NO: 650028 - DNA, 25 bp, Rattus norvegicus
tgtggaacgacctgaggcccaagct

SEQ ID NO: 650029 - DNA, 25 bp, Rattus norvegicus
tgtggaactgatactctcggctctg

SEQ ID NO: 650030 - DNA, 25 bp, Rattus norvegicus
tgtggaactgattctctcggctctg

SEQ ID NO: 650031 - DNA, 25 bp, Rattus norvegicus
tgtggaactgccctttaccttaatg

SEQ ID NO: 650032 - DNA, 25 bp, Rattus norvegicus
tgtggaactgccgtttaccttaatg

SEQ ID NO: 650033 - DNA, 25 bp, Rattus norvegicus
tgtggaacttcaccattccttctcg

SEQ ID NO: 650034 - DNA, 25 bp, Rattus norvegicus
tgtggaacttcagcattccttctcg

SEQ ID NO: 650035 - DNA, 25 bp, Rattus norvegicus
tgtggaagaaggaggaagtccgtcc

SEQ ID NO: 650036 - DNA, 25 bp, Rattus norvegicus
tgtggaagaaggtggaagtccgtcc

SEQ ID NO: 650037 - DNA, 25 bp, Rattus norvegicus
tgtggaagagatccgccagtccctt

SEQ ID NO: 650038 - DNA, 25 bp, Rattus norvegicus
tgtggaagagatgcgccagtccctt

SEQ ID NO: 650039 - DNA, 25 bp, Rattus norvegicus
tgtggaagagttacctcctggctgc

SEQ ID NO: 650040 - DNA, 25 bp, Rattus norvegicus
tgtggaagagtttcctcctggctgc

SEQ ID NO: 650041 - DNA, 25 bp, Rattus norvegicus
tgtggaagatccattcacctgacgg

SEQ ID NO: 650042 - DNA, 25 bp, Rattus norvegicus
tgtggaagatcctttcacctgacgg

SEQ ID NO: 650043 - DNA, 25 bp, Rattus norvegicus
tgtggaagccacatctgtcatcttg

SEQ ID NO: 650044 - DNA, 25 bp, Rattus norvegicus
tgtggaagccacttctgtcatcttg

SEQ ID NO: 650045 - DNA, 25 bp, Rattus norvegicus
tgtggaagccgacctccgtttgcga

SEQ ID NO: 650046 - DNA, 25 bp, Rattus norvegicus
tgtggaagccgagctccgtttgcga

SEQ ID NO: 650047 - DNA, 25 bp, Rattus norvegicus
tgtggaagccttcccttgtgaattt

SEQ ID NO: 650048 - DNA, 25 bp, Rattus norvegicus
tgtggaagccttgccttgtgaattt

SEQ ID NO: 650049 - DNA, 25 bp, Rattus norvegicus
tgtggaaggctcaggccgccaacta

SEQ ID NO: 650050 - DNA, 25 bp, Rattus norvegicus
tgtggaaggctctggccgccaacta

SEQ ID NO: 650051 - DNA, 25 bp, Rattus norvegicus
tgtggaagggctcctgaatgctctc

SEQ ID NO: 650052 - DNA, 25 bp, Rattus norvegicus
tgtggaagggctgctgaatgctctc

SEQ ID NO: 650053 - DNA, 25 bp, Rattus norvegicus
tgtggaagtgccagggtccgtaccc

SEQ ID NO: 650054 - DNA, 25 bp, Rattus norvegicus
tgtggaagtgcctgggtccgtaccc

SEQ ID NO: 650055 - DNA, 25 bp, Rattus norvegicus
tgtggaatccacagtgtcgggccct

SEQ ID NO: 650056 - DNA, 25 bp, Rattus norvegicus
tgtggaatccactgtgtcgggccct

SEQ ID NO: 650057 - DNA, 25 bp, Rattus norvegicus
tgtggaatcctgaactgtacgtgta

SEQ ID NO: 650058 - DNA, 25 bp, Rattus norvegicus
tgtggaatcctgtactgtacgtgta

SEQ ID NO: 650059 - DNA, 25 bp, Rattus norvegicus
tgtggaatcggtacttgttcctctg

SEQ ID NO: 650060 - DNA, 25 bp, Rattus norvegicus
tgtggaatcggttcttgttcctctg

SEQ ID NO: 650061 - DNA, 25 bp, Rattus norvegicus
tgtggaatgggtccttcctacctcc

SEQ ID NO: 650062 - DNA, 25 bp, Rattus norvegicus
tgtggaatgggtgcttcctacctcc

SEQ ID NO: 650063 - DNA, 25 bp, Rattus norvegicus
tgtggaattgtgaaagaggcccttt

SEQ ID NO: 650064 - DNA, 25 bp, Rattus norvegicus
tgtggaattgtgtaagaggcccttt

SEQ ID NO: 650065 - DNA, 25 bp, Rattus norvegicus
tgtggaatttacatggccatccctc

SEQ ID NO: 650066 - DNA, 25 bp, Rattus norvegicus
tgtggaatttacttggccatccctc

SEQ ID NO: 650067 - DNA, 25 bp, Rattus norvegicus
tgtggaattttcatgggaccggttg

SEQ ID NO: 650068 - DNA, 25 bp, Rattus norvegicus
tgtggaattttcttgggaccggttg

SEQ ID NO: 650069 - DNA, 25 bp, Rattus norvegicus
tgtggacaagttatcaggcagatct

SEQ ID NO: 650070 - DNA, 25 bp, Rattus norvegicus
tgtggacaagttttcaggcagatct

SEQ ID NO: 650071 - DNA, 25 bp, Rattus norvegicus
tgtggacaatacaggctgctggacg

SEQ ID NO: 650072 - DNA, 25 bp, Rattus norvegicus
tgtggacaatactggctgctggacg

SEQ ID NO: 650073 - DNA, 25 bp, Rattus norvegicus
tgtggacaatggctggatctccttg

SEQ ID NO: 650074 - DNA, 25 bp, Rattus norvegicus
tgtggacaatgggtggatctccttg

SEQ ID NO: 650075 - DNA, 25 bp, Rattus norvegicus
tgtggacacagcaacatgccttcca

SEQ ID NO: 650076 - DNA, 25 bp, Rattus norvegicus
tgtggacacagcactttcctctttt

SEQ ID NO: 650077 - DNA, 25 bp, Rattus norvegicus
tgtggacacagctacatgccttcca

SEQ ID NO: 650078 - DNA, 25 bp, Rattus norvegicus
tgtggacacagctctttcctctttt

SEQ ID NO: 650079 - DNA, 25 bp, Rattus norvegicus
tgtggacacattcactgtttctgca

SEQ ID NO: 650080 - DNA, 25 bp, Rattus norvegicus
tgtggacacattgactgtttctgca

SEQ ID NO: 650081 - DNA, 25 bp, Rattus norvegicus
tgtggacaccagaatcggcacccta

SEQ ID NO: 650082 - DNA, 25 bp, Rattus norvegicus
tgtggacaccagtatcggcacccta

SEQ ID NO: 650083 - DNA, 25 bp, Rattus norvegicus
tgtggacaccctaacagttcatcaa

SEQ ID NO: 650084 - DNA, 25 bp, Rattus norvegicus
tgtggacacccttacagttcatcaa

SEQ ID NO: 650085 - DNA, 25 bp, Rattus norvegicus
tgtggacactgccaactaatcgatg

SEQ ID NO: 650086 - DNA, 25 bp, Rattus norvegicus
tgtggacactgcgaactaatcgatg

SEQ ID NO: 650087 - DNA, 25 bp, Rattus norvegicus
tgtggacagaacacttccgaggcct

SEQ ID NO: 650088 - DNA, 25 bp, Rattus norvegicus
tgtggacagaactcttccgaggcct

SEQ ID NO: 650089 - DNA, 25 bp, Rattus norvegicus
tgtggacagtctcagcagctctagc

SEQ ID NO: 650090 - DNA, 25 bp, Rattus norvegicus
tgtggacagtctgagcagctctagc

SEQ ID NO: 650091 - DNA, 25 bp, Rattus norvegicus
tgtggacatggcactgctgttccgt

SEQ ID NO: 650092 - DNA, 25 bp, Rattus norvegicus
tgtggacatggcatcttttggcatc

SEQ ID NO: 650093 - DNA, 25 bp, Rattus norvegicus
tgtggacatggctctgctgttccgt

SEQ ID NO: 650094 - DNA, 25 bp, Rattus norvegicus
tgtggacatggcttcttttggcatc

SEQ ID NO: 650095 - DNA, 25 bp, Rattus norvegicus
tgtggacattttcagccttgccaag

SEQ ID NO: 650096 - DNA, 25 bp, Rattus norvegicus
tgtggacattttgagccttgccaag

SEQ ID NO: 650097 - DNA, 25 bp, Rattus norvegicus
tgtggaccaattaacactccctgtg

SEQ ID NO: 650098 - DNA, 25 bp, Rattus norvegicus
tgtggaccaatttacactccctgtg

SEQ ID NO: 650099 - DNA, 25 bp, Rattus norvegicus
tgtggaccacgcctgtttctaaggt

SEQ ID NO: 650100 - DNA, 25 bp, Rattus norvegicus
tgtggaccacgcgtgtttctaaggt

SEQ ID NO: 650101 - DNA, 25 bp, Rattus norvegicus
tgtggaccagtacctcaatatcaaa

SEQ ID NO: 650102 - DNA, 25 bp, Rattus norvegicus
tgtggaccagtagctcaatatcaaa

SEQ ID NO: 650103 - DNA, 25 bp, Rattus norvegicus
tgtggaccagtcatatttcaagtgt

SEQ ID NO: 650104 - DNA, 25 bp, Rattus norvegicus
tgtggaccagtcttatttcaagtgt

SEQ ID NO: 650105 - DNA, 25 bp, Rattus norvegicus
tgtggacccaacagtccttcaggga

SEQ ID NO: 650106 - DNA, 25 bp, Rattus norvegicus
tgtggacccaactgtccttcaggga

SEQ ID NO: 650107 - DNA, 25 bp, Rattus norvegicus
tgtggacccatcaccttccctgggc

SEQ ID NO: 650108 - DNA, 25 bp, Rattus norvegicus
tgtggacccatctccttccctgggc

SEQ ID NO: 650109 - DNA, 25 bp, Rattus norvegicus
tgtggaccccagagactccaagctt

SEQ ID NO: 650110 - DNA, 25 bp, Rattus norvegicus
tgtggaccccagtgactccaagctt

SEQ ID NO: 650111 - DNA, 25 bp, Rattus norvegicus
tgtggacccctgacagatcctgaaa

SEQ ID NO: 650112 - DNA, 25 bp, Rattus norvegicus
tgtggacccctgtcagatcctgaaa

SEQ ID NO: 650113 - DNA, 25 bp, Rattus norvegicus
tgtggacccggtcaacttcaagctc

SEQ ID NO: 650114 - DNA, 25 bp, Rattus norvegicus
tgtggacccggtgaacttcaagctc

SEQ ID NO: 650115 - DNA, 25 bp, Rattus norvegicus
tgtggaccctacatggagacttcat

SEQ ID NO: 650116 - DNA, 25 bp, Rattus norvegicus
tgtggaccctacttggagacttcat

SEQ ID NO: 650117 - DNA, 25 bp, Rattus norvegicus
tgtggaccgttccttgtgatttgga

SEQ ID NO: 650118 - DNA, 25 bp, Rattus norvegicus
tgtggaccgttcgttgtgatttgga

SEQ ID NO: 650119 - DNA, 25 bp, Rattus norvegicus
tgtggacctcacagggaaccttcgg

SEQ ID NO: 650120 - DNA, 25 bp, Rattus norvegicus
tgtggacctcactgggaaccttcgg

SEQ ID NO: 650121 - DNA, 25 bp, Rattus norvegicus
tgtggacctgccattctggaaatta

SEQ ID NO: 650122 - DNA, 25 bp, Rattus norvegicus
tgtggacctgcctttctggaaatta

SEQ ID NO: 650123 - DNA, 25 bp, Rattus norvegicus
tgtggacctggacgctcgcaattat

SEQ ID NO: 650124 - DNA, 25 bp, Rattus norvegicus
tgtggacctggaggctcgcaattat

SEQ ID NO: 650125 - DNA, 25 bp, Rattus norvegicus
tgtggacctgtaagtgtgcctctta

SEQ ID NO: 650126 - DNA, 25 bp, Rattus norvegicus
tgtggacctgtactgatcctattgt

SEQ ID NO: 650127 - DNA, 25 bp, Rattus norvegicus
tgtggacctgtagtgatcctattgt

SEQ ID NO: 650128 - DNA, 25 bp, Rattus norvegicus
tgtggacctgtatgtgtgcctctta

SEQ ID NO: 650129 - DNA, 25 bp, Rattus norvegicus
tgtggacctgttaatatccatcaaa

SEQ ID NO: 650130 - DNA, 25 bp, Rattus norvegicus
tgtggacctgtttatatccatcaaa

SEQ ID NO: 650131 - DNA, 25 bp, Rattus norvegicus
tgtggaccttcccatcctgaaatcg

SEQ ID NO: 650132 - DNA, 25 bp, Rattus norvegicus
tgtggaccttccgatcctgaaatcg

SEQ ID NO: 650133 - DNA, 25 bp, Rattus norvegicus
tgtggacctttaaccaaagacttgt

SEQ ID NO: 650134 - DNA, 25 bp, Rattus norvegicus
tgtggacctttatccaaagacttgt

SEQ ID NO: 650135 - DNA, 25 bp, Rattus norvegicus
tgtggactcttgattccgcaaaaca

SEQ ID NO: 650136 - DNA, 25 bp, Rattus norvegicus
tgtggactcttgtttccgcaaaaca

SEQ ID NO: 650137 - DNA, 25 bp, Rattus norvegicus
tgtggactgacaactaactggtagc

SEQ ID NO: 650138 - DNA, 25 bp, Rattus norvegicus
tgtggactgacatctaactggtagc

SEQ ID NO: 650139 - DNA, 25 bp, Rattus norvegicus
tgtggactgcacacagcacaggctg

SEQ ID NO: 650140 - DNA, 25 bp, Rattus norvegicus
tgtggactgcactcagcacaggctg

SEQ ID NO: 650141 - DNA, 25 bp, Rattus norvegicus
tgtggactgcagaaccattgtggat

SEQ ID NO: 650142 - DNA, 25 bp, Rattus norvegicus
tgtggactgcagtaccattgtggat

SEQ ID NO: 650143 - DNA, 25 bp, Rattus norvegicus
tgtggactggatcaacgaccgcatt

SEQ ID NO: 650144 - DNA, 25 bp, Rattus norvegicus
tgtggactggatgaacgaccgcatt

SEQ ID NO: 650145 - DNA, 25 bp, Rattus norvegicus
tgtggactgtgaatggccttcccaa

SEQ ID NO: 650146 - DNA, 25 bp, Rattus norvegicus
tgtggactgtgattggccttcccaa

SEQ ID NO: 650147 - DNA, 25 bp, Rattus norvegicus
tgtggactgtgccactcccatttgg

SEQ ID NO: 650148 - DNA, 25 bp, Rattus norvegicus
tgtggactgtgcgactcccatttgg

SEQ ID NO: 650149 - DNA, 25 bp, Rattus norvegicus
tgtggactgtttcctgcaggcctgt

SEQ ID NO: 650150 - DNA, 25 bp, Rattus norvegicus
tgtggactgtttgctgcaggcctgt

SEQ ID NO: 650151 - DNA, 25 bp, Rattus norvegicus
tgtggacttaaacgcagaaccccgt

SEQ ID NO: 650152 - DNA, 25 bp, Rattus norvegicus
tgtggacttaaaggcagaaccccgt

SEQ ID NO: 650153 - DNA, 25 bp, Rattus norvegicus
tgtggacttcacatcaataaaaaac

SEQ ID NO: 650154 - DNA, 25 bp, Rattus norvegicus
tgtggacttcacttcaataaaaaac

SEQ ID NO: 650155 - DNA, 25 bp, Rattus norvegicus
tgtggacttcctcatacgcaaaggg

SEQ ID NO: 650156 - DNA, 25 bp, Rattus norvegicus
tgtggacttcctccgtaagcagagc

SEQ ID NO: 650157 - DNA, 25 bp, Rattus norvegicus
tgtggacttcctgatacgcaaaggg

SEQ ID NO: 650158 - DNA, 25 bp, Rattus norvegicus
tgtggacttcctgcgtaagcagagc

SEQ ID NO: 650159 - DNA, 25 bp, Rattus norvegicus
tgtggacttggactcagctcctttg

SEQ ID NO: 650160 - DNA, 25 bp, Rattus norvegicus
tgtggacttggagtcagctcctttg

SEQ ID NO: 650161 - DNA, 25 bp, Rattus norvegicus
tgtggagaacacagcatggccgagt

SEQ ID NO: 650162 - DNA, 25 bp, Rattus norvegicus
tgtggagaacactgcatggccgagt

SEQ ID NO: 650163 - DNA, 25 bp, Rattus norvegicus
tgtggagaagctcccaagtgttccc

SEQ ID NO: 650164 - DNA, 25 bp, Rattus norvegicus
tgtggagaagctgccaagtgttccc

SEQ ID NO: 650165 - DNA, 25 bp, Rattus norvegicus
tgtggagaccccaaagggcctggca

SEQ ID NO: 650166 - DNA, 25 bp, Rattus norvegicus
tgtggagacccctaagggcctggca

SEQ ID NO: 650167 - DNA, 25 bp, Rattus norvegicus
tgtggagacgagactgctgttagca

SEQ ID NO: 650168 - DNA, 25 bp, Rattus norvegicus
tgtggagacgagtctgctgttagca

SEQ ID NO: 650169 - DNA, 25 bp, Rattus norvegicus
tgtggagagcgcactttgcacccca

SEQ ID NO: 650170 - DNA, 25 bp, Rattus norvegicus
tgtggagagcgctctttgcacccca

SEQ ID NO: 650171 - DNA, 25 bp, Rattus norvegicus
tgtggagagcttctcacagtaccca

SEQ ID NO: 650172 - DNA, 25 bp, Rattus norvegicus
tgtggagagcttgtcacagtaccca

SEQ ID NO: 650173 - DNA, 25 bp, Rattus norvegicus
tgtggagaggtcaaggcttccctaa

SEQ ID NO: 650174 - DNA, 25 bp, Rattus norvegicus
tgtggagaggtctaggcttccctaa

SEQ ID NO: 650175 - DNA, 25 bp, Rattus norvegicus
tgtggagaggtgactcttccagagc

SEQ ID NO: 650176 - DNA, 25 bp, Rattus norvegicus
tgtggagaggtgtctcttccagagc

SEQ ID NO: 650177 - DNA, 25 bp, Rattus norvegicus
tgtggagatatcaccccgggtttga

SEQ ID NO: 650178 - DNA, 25 bp, Rattus norvegicus
tgtggagatatctccccgggtttga

SEQ ID NO: 650179 - DNA, 25 bp, Rattus norvegicus
tgtggagatcatcccttccctcagg

SEQ ID NO: 650180 - DNA, 25 bp, Rattus norvegicus
tgtggagatcatgccttccctcagg

SEQ ID NO: 650181 - DNA, 25 bp, Rattus norvegicus
tgtggagatccaaaccctggattct

SEQ ID NO: 650182 - DNA, 25 bp, Rattus norvegicus
tgtggagatccataccctggattct

SEQ ID NO: 650183 - DNA, 25 bp, Rattus norvegicus
tgtggagcaagcacacttccctgca

SEQ ID NO: 650184 - DNA, 25 bp, Rattus norvegicus
tgtggagcaagctcacttccctgca

SEQ ID NO: 650185 - DNA, 25 bp, Rattus norvegicus
tgtggagcacagatattcagggttc

SEQ ID NO: 650186 - DNA, 25 bp, Rattus norvegicus
tgtggagcacagttattcagggttc

SEQ ID NO: 650187 - DNA, 25 bp, Rattus norvegicus
tgtggagcactgcaaactcactcac

SEQ ID NO: 650188 - DNA, 25 bp, Rattus norvegicus
tgtggagcactggaaactcactcac

SEQ ID NO: 650189 - DNA, 25 bp, Rattus norvegicus
tgtggagcagtccttcttcaatgac

SEQ ID NO: 650190 - DNA, 25 bp, Rattus norvegicus
tgtggagcagtcgttcttcaatgac

SEQ ID NO: 650191 - DNA, 25 bp, Rattus norvegicus
tgtggagccaccagccaagggagaa

SEQ ID NO: 650192 - DNA, 25 bp, Rattus norvegicus
tgtggagccacctgccaagggagaa

SEQ ID NO: 650193 - DNA, 25 bp, Rattus norvegicus
tgtggagccacgacagacctggagc

SEQ ID NO: 650194 - DNA, 25 bp, Rattus norvegicus
tgtggagccacgtcagacctggagc

SEQ ID NO: 650195 - DNA, 25 bp, Rattus norvegicus
tgtggagccagaccttacccaaatc

SEQ ID NO: 650196 - DNA, 25 bp, Rattus norvegicus
tgtggagccagagcttacccaaatc

SEQ ID NO: 650197 - DNA, 25 bp, Rattus norvegicus
tgtggagccaggacaggaccctcat

SEQ ID NO: 650198 - DNA, 25 bp, Rattus norvegicus
tgtggagccaggtcaggaccctcat

SEQ ID NO: 650199 - DNA, 25 bp, Rattus norvegicus
tgtggagcgcatccaccagccaggt

SEQ ID NO: 650200 - DNA, 25 bp, Rattus norvegicus
tgtggagcgcatgcaccagccaggt

SEQ ID NO: 650201 - DNA, 25 bp, Rattus norvegicus
tgtggagctgacagaaccttcgttc

SEQ ID NO: 650202 - DNA, 25 bp, Rattus norvegicus
tgtggagctgacagccttcaattca

SEQ ID NO: 650203 - DNA, 25 bp, Rattus norvegicus
tgtggagctgactgaaccttcgttc

SEQ ID NO: 650204 - DNA, 25 bp, Rattus norvegicus
tgtggagctgactgccttcaattca

SEQ ID NO: 650205 - DNA, 25 bp, Rattus norvegicus
tgtggagctgccatcggaagactca

SEQ ID NO: 650206 - DNA, 25 bp, Rattus norvegicus
tgtggagctgccttcggaagactca

SEQ ID NO: 650207 - DNA, 25 bp, Rattus norvegicus
tgtggaggacataactgtgccgcct

SEQ ID NO: 650208 - DNA, 25 bp, Rattus norvegicus
tgtggaggacattactgtgccgcct

SEQ ID NO: 650209 - DNA, 25 bp, Rattus norvegicus
tgtggaggcaatacctgtcttgctc

SEQ ID NO: 650210 - DNA, 25 bp, Rattus norvegicus
tgtggaggcaattcctgtcttgctc

SEQ ID NO: 650211 - DNA, 25 bp, Rattus norvegicus
tgtggaggccacattttgctcacca

SEQ ID NO: 650212 - DNA, 25 bp, Rattus norvegicus
tgtggaggccactttttgctcacca

SEQ ID NO: 650213 - DNA, 25 bp, Rattus norvegicus
tgtggaggtcctcggcattatcttc

SEQ ID NO: 650214 - DNA, 25 bp, Rattus norvegicus
tgtggaggtcctgggcattatcttc

SEQ ID NO: 650215 - DNA, 25 bp, Rattus norvegicus
tgtggaggtgtacagcagggcagac

SEQ ID NO: 650216 - DNA, 25 bp, Rattus norvegicus
tgtggaggtgtagagcagggcagac

SEQ ID NO: 650217 - DNA, 25 bp, Rattus norvegicus
tgtggagtcatgaggctcactgcgc

SEQ ID NO: 650218 - DNA, 25 bp, Rattus norvegicus
tgtggagtcatgtggctcactgcgc

SEQ ID NO: 650219 - DNA, 25 bp, Rattus norvegicus
tgtggagtcccaatgcctatccctg

SEQ ID NO: 650220 - DNA, 25 bp, Rattus norvegicus
tgtggagtcccattgcctatccctg

SEQ ID NO: 650221 - DNA, 25 bp, Rattus norvegicus
tgtggagtcccgagtgtcccacgcg

SEQ ID NO: 650222 - DNA, 25 bp, Rattus norvegicus
tgtggagtcccgtgtgtcccacgcg

SEQ ID NO: 650223 - DNA, 25 bp, Rattus norvegicus
tgtggagtctggcactagtcccaag

SEQ ID NO: 650224 - DNA, 25 bp, Rattus norvegicus
tgtggagtctgggactagtcccaag

SEQ ID NO: 650225 - DNA, 25 bp, Rattus norvegicus
tgtggagtgcagagtaccttccctg

SEQ ID NO: 650226 - DNA, 25 bp, Rattus norvegicus
tgtggagtgcagtgtaccttccctg

SEQ ID NO: 650227 - DNA, 25 bp, Rattus norvegicus
tgtggagtgcggcttccttcagctc

SEQ ID NO: 650228 - DNA, 25 bp, Rattus norvegicus
tgtggagtgcgggttccttcagctc

SEQ ID NO: 650229 - DNA, 25 bp, Rattus norvegicus
tgtggagtgtctagattcaccctct

SEQ ID NO: 650230 - DNA, 25 bp, Rattus norvegicus
tgtggagtgtcttgattcaccctct

SEQ ID NO: 650231 - DNA, 25 bp, Rattus norvegicus
tgtggagttgatccctaccatctca

SEQ ID NO: 650232 - DNA, 25 bp, Rattus norvegicus
tgtggagttgatgcctaccatctca

SEQ ID NO: 650233 - DNA, 25 bp, Rattus norvegicus
tgtggagttggtattctctttctac

SEQ ID NO: 650234 - DNA, 25 bp, Rattus norvegicus
tgtggagttggttttctctttctac

SEQ ID NO: 650235 - DNA, 25 bp, Rattus norvegicus
tgtggagtttacatgggcctctgat

SEQ ID NO: 650236 - DNA, 25 bp, Rattus norvegicus
tgtggagtttacttgggcctctgat

SEQ ID NO: 650237 - DNA, 25 bp, Rattus norvegicus
tgtggagtttctcgacttgctggac

SEQ ID NO: 650238 - DNA, 25 bp, Rattus norvegicus
tgtggagtttctggacttgctggac

SEQ ID NO: 650239 - DNA, 25 bp, Rattus norvegicus
tgtggataacagacccaatcaggaa

SEQ ID NO: 650240 - DNA, 25 bp, Rattus norvegicus
tgtggataacagtcccaatcaggaa

SEQ ID NO: 650241 - DNA, 25 bp, Rattus norvegicus
tgtggataacttcgccctggaacct

SEQ ID NO: 650242 - DNA, 25 bp, Rattus norvegicus
tgtggataacttggccctggaacct

SEQ ID NO: 650243 - DNA, 25 bp, Rattus norvegicus
tgtggataccaacatgctcaaaggg

SEQ ID NO: 650244 - DNA, 25 bp, Rattus norvegicus
tgtggataccaagatgctcaaaggg

SEQ ID NO: 650245 - DNA, 25 bp, Rattus norvegicus
tgtggatagcccaaactgttgccta

SEQ ID NO: 650246 - DNA, 25 bp, Rattus norvegicus
tgtggatagccctaactgttgccta

SEQ ID NO: 650247 - DNA, 25 bp, Rattus norvegicus
tgtggatatctgaattccctccttg

SEQ ID NO: 650248 - DNA, 25 bp, Rattus norvegicus
tgtggatatctgtattccctccttg

SEQ ID NO: 650249 - DNA, 25 bp, Rattus norvegicus
tgtggatcacttcaaacaacacttg

SEQ ID NO: 650250 - DNA, 25 bp, Rattus norvegicus
tgtggatcacttgaaacaacacttg

SEQ ID NO: 650251 - DNA, 25 bp, Rattus norvegicus
tgtggatcatgacttccgtgacgct

SEQ ID NO: 650252 - DNA, 25 bp, Rattus norvegicus
tgtggatcatgagttccgtgacgct

SEQ ID NO: 650253 - DNA, 25 bp, Rattus norvegicus
tgtggatccacaaccttatcaacgg

SEQ ID NO: 650254 - DNA, 25 bp, Rattus norvegicus
tgtggatccacatccttatcaacgg

SEQ ID NO: 650255 - DNA, 25 bp, Rattus norvegicus
tgtggatccaggacagcccttgagg

SEQ ID NO: 650256 - DNA, 25 bp, Rattus norvegicus
tgtggatccaggtcagcccttgagg

SEQ ID NO: 650257 - DNA, 25 bp, Rattus norvegicus
tgtggatccctaaggcagacttccc

SEQ ID NO: 650258 - DNA, 25 bp, Rattus norvegicus
tgtggatccctatggcagacttccc

SEQ ID NO: 650259 - DNA, 25 bp, Rattus norvegicus
tgtggatccctcatgggaccttgtc

SEQ ID NO: 650260 - DNA, 25 bp, Rattus norvegicus
tgtggatccctcttgggaccttgtc

SEQ ID NO: 650261 - DNA, 25 bp, Rattus norvegicus
tgtggatcctgcagctcagatcagg

SEQ ID NO: 650262 - DNA, 25 bp, Rattus norvegicus
tgtggatcctgctgctcagatcagg

SEQ ID NO: 650263 - DNA, 25 bp, Rattus norvegicus
tgtggatctcaaccctccagctgtc

SEQ ID NO: 650264 - DNA, 25 bp, Rattus norvegicus
tgtggatctcaagcctccagctgtc

SEQ ID NO: 650265 - DNA, 25 bp, Rattus norvegicus
tgtggatctgccctaagcaagtgtt

SEQ ID NO: 650266 - DNA, 25 bp, Rattus norvegicus
tgtggatctgccgtaagcaagtgtt

SEQ ID NO: 650267 - DNA, 25 bp, Rattus norvegicus
tgtggatgacacatgttctcctgac

SEQ ID NO: 650268 - DNA, 25 bp, Rattus norvegicus
tgtggatgacacttgttctcctgac

SEQ ID NO: 650269 - DNA, 25 bp, Rattus norvegicus
tgtggatgacagagccctcaagaat

SEQ ID NO: 650270 - DNA, 25 bp, Rattus norvegicus
tgtggatgacagtgccctcaagaat

SEQ ID NO: 650271 - DNA, 25 bp, Rattus norvegicus
tgtggatgatgcacacttctgtcat

SEQ ID NO: 650272 - DNA, 25 bp, Rattus norvegicus
tgtggatgatgctcacttctgtcat

SEQ ID NO: 650273 - DNA, 25 bp, Rattus norvegicus
tgtggatgatttccctagtgctgcc

SEQ ID NO: 650274 - DNA, 25 bp, Rattus norvegicus
tgtggatgatttgcctagtgctgcc

SEQ ID NO: 650275 - DNA, 25 bp, Rattus norvegicus
tgtggatgcacacagctaccccata

SEQ ID NO: 650276 - DNA, 25 bp, Rattus norvegicus
tgtggatgcacagagctaccccata

SEQ ID NO: 650277 - DNA, 25 bp, Rattus norvegicus
tgtggatgcactcctaagcggcgca

SEQ ID NO: 650278 - DNA, 25 bp, Rattus norvegicus
tgtggatgcactctgccagcaaaga

SEQ ID NO: 650279 - DNA, 25 bp, Rattus norvegicus
tgtggatgcactgctaagcggcgca

SEQ ID NO: 650280 - DNA, 25 bp, Rattus norvegicus
tgtggatgcactgtgccagcaaaga

SEQ ID NO: 650281 - DNA, 25 bp, Rattus norvegicus
tgtggatgccaacaacctcctggat

SEQ ID NO: 650282 - DNA, 25 bp, Rattus norvegicus
tgtggatgccaagaacctcctggat

SEQ ID NO: 650283 - DNA, 25 bp, Rattus norvegicus
tgtggatgcccacctgcagattgga

SEQ ID NO: 650284 - DNA, 25 bp, Rattus norvegicus
tgtggatgcccagctgcagattgga

SEQ ID NO: 650285 - DNA, 25 bp, Rattus norvegicus
tgtggatgccccagctttaagaacc

SEQ ID NO: 650286 - DNA, 25 bp, Rattus norvegicus
tgtggatgcccctgctttaagaacc

SEQ ID NO: 650287 - DNA, 25 bp, Rattus norvegicus
tgtggatgcctaaatggaccctggg

SEQ ID NO: 650288 - DNA, 25 bp, Rattus norvegicus
tgtggatgcctatatggaccctggg

SEQ ID NO: 650289 - DNA, 25 bp, Rattus norvegicus
tgtggatgctgtccaatgctcttct

SEQ ID NO: 650290 - DNA, 25 bp, Rattus norvegicus
tgtggatgctgtgcaatgctcttct

SEQ ID NO: 650291 - DNA, 25 bp, Rattus norvegicus
tgtggatggcacaattttattactt

SEQ ID NO: 650292 - DNA, 25 bp, Rattus norvegicus
tgtggatggcactattttattactt

SEQ ID NO: 650293 - DNA, 25 bp, Rattus norvegicus
tgtggatgtagtacccctgcctagt

SEQ ID NO: 650294 - DNA, 25 bp, Rattus norvegicus
tgtggatgtagttcccctgcctagt

SEQ ID NO: 650295 - DNA, 25 bp, Rattus norvegicus
tgtggatgtcacaggtgccttgata

SEQ ID NO: 650296 - DNA, 25 bp, Rattus norvegicus
tgtggatgtcactggtgccttgata

SEQ ID NO: 650297 - DNA, 25 bp, Rattus norvegicus
tgtggatgtgtgattcccaggcaga

SEQ ID NO: 650298 - DNA, 25 bp, Rattus norvegicus
tgtggatgtgtgtttcccaggcaga

SEQ ID NO: 650299 - DNA, 25 bp, Rattus norvegicus
tgtggattacacagtcttaccctct

SEQ ID NO: 650300 - DNA, 25 bp, Rattus norvegicus
tgtggattacactgtcttaccctct

SEQ ID NO: 650301 - DNA, 25 bp, Rattus norvegicus
tgtggattaccaaagcctcagtgaa

SEQ ID NO: 650302 - DNA, 25 bp, Rattus norvegicus
tgtggattaccatagcctcagtgaa

SEQ ID NO: 650303 - DNA, 25 bp, Rattus norvegicus
tgtggattccctctaatgtgtatga

SEQ ID NO: 650304 - DNA, 25 bp, Rattus norvegicus
tgtggattccctgtaatgtgtatga

SEQ ID NO: 650305 - DNA, 25 bp, Rattus norvegicus
tgtggattgagacccatcttccttc

SEQ ID NO: 650306 - DNA, 25 bp, Rattus norvegicus
tgtggattgagagccatcttccttc

SEQ ID NO: 650307 - DNA, 25 bp, Rattus norvegicus
tgtggatttgtcaggagccccgttt

SEQ ID NO: 650308 - DNA, 25 bp, Rattus norvegicus
tgtggatttgtctggagccccgttt

SEQ ID NO: 650309 - DNA, 25 bp, Rattus norvegicus
tgtggcaaaaccattcttaatgttt

SEQ ID NO: 650310 - DNA, 25 bp, Rattus norvegicus
tgtggcaaaacctttcttaatgttt

SEQ ID NO: 650311 - DNA, 25 bp, Rattus norvegicus
tgtggcaaacaactgtggcctctat

SEQ ID NO: 650312 - DNA, 25 bp, Rattus norvegicus
tgtggcaaacaagtgtggcctctat

SEQ ID NO: 650313 - DNA, 25 bp, Rattus norvegicus
tgtggcaaaggcagctctgatccca

SEQ ID NO: 650314 - DNA, 25 bp, Rattus norvegicus
tgtggcaaaggctgctctgatccca

SEQ ID NO: 650315 - DNA, 25 bp, Rattus norvegicus
tgtggcaaagttcccatttctctta

SEQ ID NO: 650316 - DNA, 25 bp, Rattus norvegicus
tgtggcaaagttgccatttctctta

SEQ ID NO: 650317 - DNA, 25 bp, Rattus norvegicus
tgtggcaacaggctctctctgctga

SEQ ID NO: 650318 - DNA, 25 bp, Rattus norvegicus
tgtggcaacagggtctctctgctga

SEQ ID NO: 650319 - DNA, 25 bp, Rattus norvegicus
tgtggcaagagcaaccgctccttct

SEQ ID NO: 650320 - DNA, 25 bp, Rattus norvegicus
tgtggcaagagctaccgctccttct

SEQ ID NO: 650321 - DNA, 25 bp, Rattus norvegicus
tgtggcaagcagacacccggcatgc

SEQ ID NO: 650322 - DNA, 25 bp, Rattus norvegicus
tgtggcaagcagtcacccggcatgc

SEQ ID NO: 650323 - DNA, 25 bp, Rattus norvegicus
tgtggcacacataggtcatcccaga

SEQ ID NO: 650324 - DNA, 25 bp, Rattus norvegicus
tgtggcacacatcacagactcccag

SEQ ID NO: 650325 - DNA, 25 bp, Rattus norvegicus
tgtggcacacatgacagactcccag

SEQ ID NO: 650326 - DNA, 25 bp, Rattus norvegicus
tgtggcacacattggtcatcccaga

SEQ ID NO: 650327 - DNA, 25 bp, Rattus norvegicus
tgtggcacatctacagacgtgtagt

SEQ ID NO: 650328 - DNA, 25 bp, Rattus norvegicus
tgtggcacatcttcagacgtgtagt

SEQ ID NO: 650329 - DNA, 25 bp, Rattus norvegicus
tgtggcacattcattcctggaccat

SEQ ID NO: 650330 - DNA, 25 bp, Rattus norvegicus
tgtggcacattctttcctggaccat

SEQ ID NO: 650331 - DNA, 25 bp, Rattus norvegicus
tgtggcaccacaaccagtttgcagt

SEQ ID NO: 650332 - DNA, 25 bp, Rattus norvegicus
tgtggcaccacatccagtttgcagt

SEQ ID NO: 650333 - DNA, 25 bp, Rattus norvegicus
tgtggcactcatcctttttactcat

SEQ ID NO: 650334 - DNA, 25 bp, Rattus norvegicus
tgtggcactcatgctttttactcat

SEQ ID NO: 650335 - DNA, 25 bp, Rattus norvegicus
tgtggcactccaaattctgtgggaa

SEQ ID NO: 650336 - DNA, 25 bp, Rattus norvegicus
tgtggcactccatattctgtgggaa

SEQ ID NO: 650337 - DNA, 25 bp, Rattus norvegicus
tgtggcactgccagagttccaacaa

SEQ ID NO: 650338 - DNA, 25 bp, Rattus norvegicus
tgtggcactgcctgagttccaacaa

SEQ ID NO: 650339 - DNA, 25 bp, Rattus norvegicus
tgtggcactgctccaagaagcctta

SEQ ID NO: 650340 - DNA, 25 bp, Rattus norvegicus
tgtggcactgctgcaagaagcctta

SEQ ID NO: 650341 - DNA, 25 bp, Rattus norvegicus
tgtggcagacagaacaccagtgctt

SEQ ID NO: 650342 - DNA, 25 bp, Rattus norvegicus
tgtggcagacagtacaccagtgctt

SEQ ID NO: 650343 - DNA, 25 bp, Rattus norvegicus
tgtggcagcagtcgcagtaaccaac

SEQ ID NO: 650344 - DNA, 25 bp, Rattus norvegicus
tgtggcagcagtggcagtaaccaac

SEQ ID NO: 650345 - DNA, 25 bp, Rattus norvegicus
tgtggcagcatcctttcatactgtc

SEQ ID NO: 650346 - DNA, 25 bp, Rattus norvegicus
tgtggcagcatcgtttcatactgtc

SEQ ID NO: 650347 - DNA, 25 bp, Rattus norvegicus
tgtggcagccatcttagaactggat

SEQ ID NO: 650348 - DNA, 25 bp, Rattus norvegicus
tgtggcagccatgttagaactggat

SEQ ID NO: 650349 - DNA, 25 bp, Rattus norvegicus
tgtggcagcgaccatctccagcaag

SEQ ID NO: 650350 - DNA, 25 bp, Rattus norvegicus
tgtggcagcgacgatctccagcaag

SEQ ID NO: 650351 - DNA, 25 bp, Rattus norvegicus
tgtggcagcgagagcagccggcttt

SEQ ID NO: 650352 - DNA, 25 bp, Rattus norvegicus
tgtggcagcgagtgcagccggcttt

SEQ ID NO: 650353 - DNA, 25 bp, Rattus norvegicus
tgtggcagcggcatcatgttgtatt

SEQ ID NO: 650354 - DNA, 25 bp, Rattus norvegicus
tgtggcagcggcttcatgttgtatt

SEQ ID NO: 650355 - DNA, 25 bp, Rattus norvegicus
tgtggcagcgggactccctggagat

SEQ ID NO: 650356 - DNA, 25 bp, Rattus norvegicus
tgtggcagcgggtctccctggagat

SEQ ID NO: 650357 - DNA, 25 bp, Rattus norvegicus
tgtggcagctttcaggtagtacttt

SEQ ID NO: 650358 - DNA, 25 bp, Rattus norvegicus
tgtggcagctttgaggtagtacttt

SEQ ID NO: 650359 - DNA, 25 bp, Rattus norvegicus
tgtggcaggaaaagtcccacccagt

SEQ ID NO: 650360 - DNA, 25 bp, Rattus norvegicus
tgtggcaggaaatgtcccacccagt

SEQ ID NO: 650361 - DNA, 25 bp, Rattus norvegicus
tgtggcaggtgtccatcctattggc

SEQ ID NO: 650362 - DNA, 25 bp, Rattus norvegicus
tgtggcaggtgtgcatcctattggc

SEQ ID NO: 650363 - DNA, 25 bp, Rattus norvegicus
tgtggcaggttcacatctccataaa

SEQ ID NO: 650364 - DNA, 25 bp, Rattus norvegicus
tgtggcaggttctcatctccataaa

SEQ ID NO: 650365 - DNA, 25 bp, Rattus norvegicus
tgtggcagtaatctagtgaattcct

SEQ ID NO: 650366 - DNA, 25 bp, Rattus norvegicus
tgtggcagtaatgtagtgaattcct

SEQ ID NO: 650367 - DNA, 25 bp, Rattus norvegicus
tgtggcagtaggcttggcattttct

SEQ ID NO: 650368 - DNA, 25 bp, Rattus norvegicus
tgtggcagtagggttggcattttct

SEQ ID NO: 650369 - DNA, 25 bp, Rattus norvegicus
tgtggcagtctcacttatgaaccgc

SEQ ID NO: 650370 - DNA, 25 bp, Rattus norvegicus
tgtggcagtctctcttatgaaccgc

SEQ ID NO: 650371 - DNA, 25 bp, Rattus norvegicus
tgtggcatccatcacctgtgggctt

SEQ ID NO: 650372 - DNA, 25 bp, Rattus norvegicus
tgtggcatccatgacctgtgggctt

SEQ ID NO: 650373 - DNA, 25 bp, Rattus norvegicus
tgtggcatctgcattccttcataaa

SEQ ID NO: 650374 - DNA, 25 bp, Rattus norvegicus
tgtggcatctgctttccttcataaa

SEQ ID NO: 650375 - DNA, 25 bp, Rattus norvegicus
tgtggcatgggcactgcagattccc

SEQ ID NO: 650376 - DNA, 25 bp, Rattus norvegicus
tgtggcatgggctctgcagattccc

SEQ ID NO: 650377 - DNA, 25 bp, Rattus norvegicus
tgtggcattgccctctgcactaagg

SEQ ID NO: 650378 - DNA, 25 bp, Rattus norvegicus
tgtggcattgccgtctgcactaagg

SEQ ID NO: 650379 - DNA, 25 bp, Rattus norvegicus
tgtggcattgtcatttttaacctag

SEQ ID NO: 650380 - DNA, 25 bp, Rattus norvegicus
tgtggcattgtcttttttaacctag

SEQ ID NO: 650381 - DNA, 25 bp, Rattus norvegicus
tgtggccaatggcatgccctatcca

SEQ ID NO: 650382 - DNA, 25 bp, Rattus norvegicus
tgtggccaatgggatgccctatcca

SEQ ID NO: 650383 - DNA, 25 bp, Rattus norvegicus
tgtggccactacaagttcaagttcc

SEQ ID NO: 650384 - DNA, 25 bp, Rattus norvegicus
tgtggccactactagttcaagttcc

SEQ ID NO: 650385 - DNA, 25 bp, Rattus norvegicus
tgtggccactggattaagcaatgtt

SEQ ID NO: 650386 - DNA, 25 bp, Rattus norvegicus
tgtggccactggtttaagcaatgtt

SEQ ID NO: 650387 - DNA, 25 bp, Rattus norvegicus
tgtggccacttgctagtcagtaggt

SEQ ID NO: 650388 - DNA, 25 bp, Rattus norvegicus
tgtggccacttggtagtcagtaggt

SEQ ID NO: 650389 - DNA, 25 bp, Rattus norvegicus
tgtggccagcacactataaagacgg

SEQ ID NO: 650390 - DNA, 25 bp, Rattus norvegicus
tgtggccagcactctataaagacgg

SEQ ID NO: 650391 - DNA, 25 bp, Rattus norvegicus
tgtggccaggtcacaccaggcagtt

SEQ ID NO: 650392 - DNA, 25 bp, Rattus norvegicus
tgtggccaggtctcaccaggcagtt

SEQ ID NO: 650393 - DNA, 25 bp, Rattus norvegicus
tgtggccagttactgttaccctaac

SEQ ID NO: 650394 - DNA, 25 bp, Rattus norvegicus
tgtggccagttagtgttaccctaac

SEQ ID NO: 650395 - DNA, 25 bp, Rattus norvegicus
tgtggccagttcacctgggataagt

SEQ ID NO: 650396 - DNA, 25 bp, Rattus norvegicus
tgtggccagttctcctgggataagt

SEQ ID NO: 650397 - DNA, 25 bp, Rattus norvegicus
tgtggccagttgacaatctgtcacc

SEQ ID NO: 650398 - DNA, 25 bp, Rattus norvegicus
tgtggccagttgtcaatctgtcacc

SEQ ID NO: 650399 - DNA, 25 bp, Rattus norvegicus
tgtggccatcagacaggatctaatt

SEQ ID NO: 650400 - DNA, 25 bp, Rattus norvegicus
tgtggccatcagtcaggatctaatt

SEQ ID NO: 650401 - DNA, 25 bp, Rattus norvegicus
tgtggcccaaatatatgctatccgg

SEQ ID NO: 650402 - DNA, 25 bp, Rattus norvegicus
tgtggcccaaatttatgctatccgg

SEQ ID NO: 650403 - DNA, 25 bp, Rattus norvegicus
tgtggcccaatgacccatgtacaaa

SEQ ID NO: 650404 - DNA, 25 bp, Rattus norvegicus
tgtggcccaatgtcccatgtacaaa

SEQ ID NO: 650405 - DNA, 25 bp, Rattus norvegicus
tgtggcccacccatgcctcaaattt

SEQ ID NO: 650406 - DNA, 25 bp, Rattus norvegicus
tgtggcccaccccaagtgaaaatga

SEQ ID NO: 650407 - DNA, 25 bp, Rattus norvegicus
tgtggcccacccgaagtgaaaatga

SEQ ID NO: 650408 - DNA, 25 bp, Rattus norvegicus
tgtggcccacccttgcctcaaattt

SEQ ID NO: 650409 - DNA, 25 bp, Rattus norvegicus
tgtggcccaggcattagaggtcatc

SEQ ID NO: 650410 - DNA, 25 bp, Rattus norvegicus
tgtggcccaggctttagaggtcatc

SEQ ID NO: 650411 - DNA, 25 bp, Rattus norvegicus
tgtggccccaagacactgaggtgaa

SEQ ID NO: 650412 - DNA, 25 bp, Rattus norvegicus
tgtggccccaagtcactgaggtgaa

SEQ ID NO: 650413 - DNA, 25 bp, Rattus norvegicus
tgtggccccagcagctcagatgtga

SEQ ID NO: 650414 - DNA, 25 bp, Rattus norvegicus
tgtggccccagctgctcagatgtga

SEQ ID NO: 650415 - DNA, 25 bp, Rattus norvegicus
tgtggcccctacagtagtctgtgga

SEQ ID NO: 650416 - DNA, 25 bp, Rattus norvegicus
tgtggcccctactgtagtctgtgga

SEQ ID NO: 650417 - DNA, 25 bp, Rattus norvegicus
tgtggcccctttattcaagacagtg

SEQ ID NO: 650418 - DNA, 25 bp, Rattus norvegicus
tgtggccccttttttcaagacagtg

SEQ ID NO: 650419 - DNA, 25 bp, Rattus norvegicus
tgtggcccgaaaaactcctacttga

SEQ ID NO: 650420 - DNA, 25 bp, Rattus norvegicus
tgtggcccgaaatactcctacttga

SEQ ID NO: 650421 - DNA, 25 bp, Rattus norvegicus
tgtggcccgatgctctcactaactt

SEQ ID NO: 650422 - DNA, 25 bp, Rattus norvegicus
tgtggcccgatggtctcactaactt

SEQ ID NO: 650423 - DNA, 25 bp, Rattus norvegicus
tgtggccctacccatgaaggcttgc

SEQ ID NO: 650424 - DNA, 25 bp, Rattus norvegicus
tgtggccctaccgatgaaggcttgc

SEQ ID NO: 650425 - DNA, 25 bp, Rattus norvegicus
tgtggccctctgaagaatttctgtg

SEQ ID NO: 650426 - DNA, 25 bp, Rattus norvegicus
tgtggccctctgtagaatttctgtg

SEQ ID NO: 650427 - DNA, 25 bp, Rattus norvegicus
tgtggccctggcaaattctgtaaag

SEQ ID NO: 650428 - DNA, 25 bp, Rattus norvegicus
tgtggccctggctaattctgtaaag

SEQ ID NO: 650429 - DNA, 25 bp, Rattus norvegicus
tgtggcccttgacatacatgcaggc

SEQ ID NO: 650430 - DNA, 25 bp, Rattus norvegicus
tgtggcccttgagatacatgcaggc

SEQ ID NO: 650431 - DNA, 25 bp, Rattus norvegicus
tgtggccctttgaagtcctcgaaac

SEQ ID NO: 650432 - DNA, 25 bp, Rattus norvegicus
tgtggccctttgtagtcctcgaaac

SEQ ID NO: 650433 - DNA, 25 bp, Rattus norvegicus
tgtggccgtggacttccgcgactac

SEQ ID NO: 650434 - DNA, 25 bp, Rattus norvegicus
tgtggccgtggagttccgcgactac

SEQ ID NO: 650435 - DNA, 25 bp, Rattus norvegicus
tgtggcctagttcagtggttacccc

SEQ ID NO: 650436 - DNA, 25 bp, Rattus norvegicus
tgtggcctagttgagtggttacccc

SEQ ID NO: 650437 - DNA, 25 bp, Rattus norvegicus
tgtggcctatgacaactacctgctg

SEQ ID NO: 650438 - DNA, 25 bp, Rattus norvegicus
tgtggcctatgagaactacctgctg

SEQ ID NO: 650439 - DNA, 25 bp, Rattus norvegicus
tgtggcctcaagaggctggtgcttt

SEQ ID NO: 650440 - DNA, 25 bp, Rattus norvegicus
tgtggcctcaagtggctggtgcttt

SEQ ID NO: 650441 - DNA, 25 bp, Rattus norvegicus
tgtggcctccacaaccttggaaaag

SEQ ID NO: 650442 - DNA, 25 bp, Rattus norvegicus
tgtggcctccactaccttggaaaag

SEQ ID NO: 650443 - DNA, 25 bp, Rattus norvegicus
tgtggcctccctcaagaaccattca

SEQ ID NO: 650444 - DNA, 25 bp, Rattus norvegicus
tgtggcctccctgaagaaccattca

SEQ ID NO: 650445 - DNA, 25 bp, Rattus norvegicus
tgtggcctcgagactctgctactac

SEQ ID NO: 650446 - DNA, 25 bp, Rattus norvegicus
tgtggcctcgagtctctgctactac

SEQ ID NO: 650447 - DNA, 25 bp, Rattus norvegicus
tgtggcctcgatccaagcagccctg

SEQ ID NO: 650448 - DNA, 25 bp, Rattus norvegicus
tgtggcctcgatgcaagcagccctg

SEQ ID NO: 650449 - DNA, 25 bp, Rattus norvegicus
tgtggcctctgaaccttcagcagta

SEQ ID NO: 650450 - DNA, 25 bp, Rattus norvegicus
tgtggcctctgatccttcagcagta

SEQ ID NO: 650451 - DNA, 25 bp, Rattus norvegicus
tgtggcctctttacaaggctctgag

SEQ ID NO: 650452 - DNA, 25 bp, Rattus norvegicus
tgtggcctcttttcaaggctctgag

SEQ ID NO: 650453 - DNA, 25 bp, Rattus norvegicus
tgtggcctgaatacagttttcctat

SEQ ID NO: 650454 - DNA, 25 bp, Rattus norvegicus
tgtggcctgaattcagttttcctat

SEQ ID NO: 650455 - DNA, 25 bp, Rattus norvegicus
tgtggcctgctccttcttggaggca

SEQ ID NO: 650456 - DNA, 25 bp, Rattus norvegicus
tgtggcctgctcgttcttggaggca

SEQ ID NO: 650457 - DNA, 25 bp, Rattus norvegicus
tgtggccttaaaatcctggtgaatc

SEQ ID NO: 650458 - DNA, 25 bp, Rattus norvegicus
tgtggccttaaattcctggtgaatc

SEQ ID NO: 650459 - DNA, 25 bp, Rattus norvegicus
tgtggccttaatccccaaaggtgac

SEQ ID NO: 650460 - DNA, 25 bp, Rattus norvegicus
tgtggccttaatgcccaaaggtgac

SEQ ID NO: 650461 - DNA, 25 bp, Rattus norvegicus
tgtggccttaccaatctgggcaaca

SEQ ID NO: 650462 - DNA, 25 bp, Rattus norvegicus
tgtggccttacctatctgggcaaca

SEQ ID NO: 650463 - DNA, 25 bp, Rattus norvegicus
tgtggccttagtccagtgggtttaa

SEQ ID NO: 650464 - DNA, 25 bp, Rattus norvegicus
tgtggccttagtgcagtgggtttaa

SEQ ID NO: 650465 - DNA, 25 bp, Rattus norvegicus
tgtggccttgatccctgtccatgga

SEQ ID NO: 650466 - DNA, 25 bp, Rattus norvegicus
tgtggccttgatgcctgtccatgga

SEQ ID NO: 650467 - DNA, 25 bp, Rattus norvegicus
tgtggcgaccggaccccaagaaaga

SEQ ID NO: 650468 - DNA, 25 bp, Rattus norvegicus
tgtggcgaccggtccccaagaaaga

SEQ ID NO: 650469 - DNA, 25 bp, Rattus norvegicus
tgtggcgggatcatgaacaactgat

SEQ ID NO: 650470 - DNA, 25 bp, Rattus norvegicus
tgtggcgggatcttgaacaactgat

SEQ ID NO: 650471 - DNA, 25 bp, Rattus norvegicus
tgtggcggtactcttcctgcacttt

SEQ ID NO: 650472 - DNA, 25 bp, Rattus norvegicus
tgtggcggtactgttcctgcacttt

SEQ ID NO: 650473 - DNA, 25 bp, Rattus norvegicus
tgtggcggtcctctgtaaccatcag

SEQ ID NO: 650474 - DNA, 25 bp, Rattus norvegicus
tgtggcggtcctgtgtaaccatcag

SEQ ID NO: 650475 - DNA, 25 bp, Rattus norvegicus
tgtggcgtcaacaggtttgcaaaca

SEQ ID NO: 650476 - DNA, 25 bp, Rattus norvegicus
tgtggcgtcaactggtttgcaaaca

SEQ ID NO: 650477 - DNA, 25 bp, Rattus norvegicus
tgtggcgtccagaaaccgcatcaat

SEQ ID NO: 650478 - DNA, 25 bp, Rattus norvegicus
tgtggcgtccagtaaccgcatcaat

SEQ ID NO: 650479 - DNA, 25 bp, Rattus norvegicus
tgtggcgtctgacctttgtttctgt

SEQ ID NO: 650480 - DNA, 25 bp, Rattus norvegicus
tgtggcgtctgagctttgtttctgt

SEQ ID NO: 650481 - DNA, 25 bp, Rattus norvegicus
tgtggcgtgcctaaactctatgtgg

SEQ ID NO: 650482 - DNA, 25 bp, Rattus norvegicus
tgtggcgtgccttaactctatgtgg

SEQ ID NO: 650483 - DNA, 25 bp, Rattus norvegicus
tgtggcgtgctacctcatacattat

SEQ ID NO: 650484 - DNA, 25 bp, Rattus norvegicus
tgtggcgtgctagctcatacattat

SEQ ID NO: 650485 - DNA, 25 bp, Rattus norvegicus
tgtggcgttaaacgagctaccctgt

SEQ ID NO: 650486 - DNA, 25 bp, Rattus norvegicus
tgtggcgttaaaggagctaccctgt

SEQ ID NO: 650487 - DNA, 25 bp, Rattus norvegicus
tgtggctaacctaggaattttccta

SEQ ID NO: 650488 - DNA, 25 bp, Rattus norvegicus
tgtggctaaccttggaattttccta

SEQ ID NO: 650489 - DNA, 25 bp, Rattus norvegicus
tgtggctacttcactggcaagtata

SEQ ID NO: 650490 - DNA, 25 bp, Rattus norvegicus
tgtggctacttctctggcaagtata

SEQ ID NO: 650491 - DNA, 25 bp, Rattus norvegicus
tgtggctatcagcacttataactct

SEQ ID NO: 650492 - DNA, 25 bp, Rattus norvegicus
tgtggctatcaggacttataactct

SEQ ID NO: 650493 - DNA, 25 bp, Rattus norvegicus
tgtggctcaagcagtagcaacccct

SEQ ID NO: 650494 - DNA, 25 bp, Rattus norvegicus
tgtggctcaagctgtagcaacccct

SEQ ID NO: 650495 - DNA, 25 bp, Rattus norvegicus
tgtggctcacccatgtggacacatg

SEQ ID NO: 650496 - DNA, 25 bp, Rattus norvegicus
tgtggctcacccttgtggacacatg

SEQ ID NO: 650497 - DNA, 25 bp, Rattus norvegicus
tgtggctcacttagtcaaatcctct

SEQ ID NO: 650498 - DNA, 25 bp, Rattus norvegicus
tgtggctcactttgtcaaatcctct

SEQ ID NO: 650499 - DNA, 25 bp, Rattus norvegicus
tgtggctcagagcatgctcaccgat

SEQ ID NO: 650500 - DNA, 25 bp, Rattus norvegicus
tgtggctcagaggatgctcaccgat

SEQ ID NO: 650501 - DNA, 25 bp, Rattus norvegicus
tgtggctcaggtactcctcagcctc

SEQ ID NO: 650502 - DNA, 25 bp, Rattus norvegicus
tgtggctcaggttctcctcagcctc

SEQ ID NO: 650503 - DNA, 25 bp, Rattus norvegicus
tgtggctcagttctcaaaagtgttg

SEQ ID NO: 650504 - DNA, 25 bp, Rattus norvegicus
tgtggctcagttgtcaaaagtgttg

SEQ ID NO: 650505 - DNA, 25 bp, Rattus norvegicus
tgtggctccaagaaagactgtgact

SEQ ID NO: 650506 - DNA, 25 bp, Rattus norvegicus
tgtggctccaagtaagactgtgact

SEQ ID NO: 650507 - DNA, 25 bp, Rattus norvegicus
tgtggctccctgacgcaataatgta

SEQ ID NO: 650508 - DNA, 25 bp, Rattus norvegicus
tgtggctccctgctttggagataat

SEQ ID NO: 650509 - DNA, 25 bp, Rattus norvegicus
tgtggctccctggtttggagataat

SEQ ID NO: 650510 - DNA, 25 bp, Rattus norvegicus
tgtggctccctgtcgcaataatgta

SEQ ID NO: 650511 - DNA, 25 bp, Rattus norvegicus
tgtggctccggaaacctcctgtgtg

SEQ ID NO: 650512 - DNA, 25 bp, Rattus norvegicus
tgtggctccggatacctcctgtgtg

SEQ ID NO: 650513 - DNA, 25 bp, Rattus norvegicus
tgtggctcctagaaagtcaaccgta

SEQ ID NO: 650514 - DNA, 25 bp, Rattus norvegicus
tgtggctcctagtaagtcaaccgta

SEQ ID NO: 650515 - DNA, 25 bp, Rattus norvegicus
tgtggctcctcactcagctttatac

SEQ ID NO: 650516 - DNA, 25 bp, Rattus norvegicus
tgtggctcctcagtcagctttatac

SEQ ID NO: 650517 - DNA, 25 bp, Rattus norvegicus
tgtggctcctgtcgtagcttctgct

SEQ ID NO: 650518 - DNA, 25 bp, Rattus norvegicus
tgtggctcctgtggtagcttctgct

SEQ ID NO: 650519 - DNA, 25 bp, Rattus norvegicus
tgtggctctacccaattcagggagg

SEQ ID NO: 650520 - DNA, 25 bp, Rattus norvegicus
tgtggctctaccgaattcagggagg

SEQ ID NO: 650521 - DNA, 25 bp, Rattus norvegicus
tgtggctctatgactggcagggcca

SEQ ID NO: 650522 - DNA, 25 bp, Rattus norvegicus
tgtggctctatgtctggcagggcca

SEQ ID NO: 650523 - DNA, 25 bp, Rattus norvegicus
tgtggctctgctacagtcacctcaa

SEQ ID NO: 650524 - DNA, 25 bp, Rattus norvegicus
tgtggctctgcttcagtcacctcaa

SEQ ID NO: 650525 - DNA, 25 bp, Rattus norvegicus
tgtggctctgttcacttatctgtga

SEQ ID NO: 650526 - DNA, 25 bp, Rattus norvegicus
tgtggctctgttgacttatctgtga

SEQ ID NO: 650527 - DNA, 25 bp, Rattus norvegicus
tgtggctcttccatggaggaccaga

SEQ ID NO: 650528 - DNA, 25 bp, Rattus norvegicus
tgtggctcttccttggaggaccaga

SEQ ID NO: 650529 - DNA, 25 bp, Rattus norvegicus
tgtggctcttggagacagcctgagt

SEQ ID NO: 650530 - DNA, 25 bp, Rattus norvegicus
tgtggctcttggtgacagcctgagt

SEQ ID NO: 650531 - DNA, 25 bp, Rattus norvegicus
tgtggctcttgtacattttcttctc

SEQ ID NO: 650532 - DNA, 25 bp, Rattus norvegicus
tgtggctcttgttcattttcttctc

SEQ ID NO: 650533 - DNA, 25 bp, Rattus norvegicus
tgtggctgagaaagcgcaagcttgt

SEQ ID NO: 650534 - DNA, 25 bp, Rattus norvegicus
tgtggctgagaatgcgcaagcttgt

SEQ ID NO: 650535 - DNA, 25 bp, Rattus norvegicus
tgtggctgatcccgcacctccgggt

SEQ ID NO: 650536 - DNA, 25 bp, Rattus norvegicus
tgtggctgatccggcacctccgggt

SEQ ID NO: 650537 - DNA, 25 bp, Rattus norvegicus
tgtggctgcaagactgtaaccctgg

SEQ ID NO: 650538 - DNA, 25 bp, Rattus norvegicus
tgtggctgcaagtctgtaaccctgg

SEQ ID NO: 650539 - DNA, 25 bp, Rattus norvegicus
tgtggctgcacaaatctggttcctg

SEQ ID NO: 650540 - DNA, 25 bp, Rattus norvegicus
tgtggctgcacatatctggttcctg

SEQ ID NO: 650541 - DNA, 25 bp, Rattus norvegicus
tgtggctgcagacgctgtccatcct

SEQ ID NO: 650542 - DNA, 25 bp, Rattus norvegicus
tgtggctgcagaggctgtccatcct

SEQ ID NO: 650543 - DNA, 25 bp, Rattus norvegicus
tgtggctgcagcaagctgcaggcct

SEQ ID NO: 650544 - DNA, 25 bp, Rattus norvegicus
tgtggctgcagctagctgcaggcct

SEQ ID NO: 650545 - DNA, 25 bp, Rattus norvegicus
tgtggctgcagtcgtccacactact

SEQ ID NO: 650546 - DNA, 25 bp, Rattus norvegicus
tgtggctgcagtggtccacactact

SEQ ID NO: 650547 - DNA, 25 bp, Rattus norvegicus
tgtggctgccacaaggtcttcctga

SEQ ID NO: 650548 - DNA, 25 bp, Rattus norvegicus
tgtggctgccactaggtcttcctga

SEQ ID NO: 650549 - DNA, 25 bp, Rattus norvegicus
tgtggctgcctaagactaccagggc

SEQ ID NO: 650550 - DNA, 25 bp, Rattus norvegicus
tgtggctgcctatgactaccagggc

SEQ ID NO: 650551 - DNA, 25 bp, Rattus norvegicus
tgtggctgctttccaggtgatgaca

SEQ ID NO: 650552 - DNA, 25 bp, Rattus norvegicus
tgtggctgctttgcaggtgatgaca

SEQ ID NO: 650553 - DNA, 25 bp, Rattus norvegicus
tgtggctggccgacaacgactacaa

SEQ ID NO: 650554 - DNA, 25 bp, Rattus norvegicus
tgtggctggccgtcaacgactacaa

SEQ ID NO: 650555 - DNA, 25 bp, Rattus norvegicus
tgtggctgtaccatggctgtttctc

SEQ ID NO: 650556 - DNA, 25 bp, Rattus norvegicus
tgtggctgtaccttggctgtttctc

SEQ ID NO: 650557 - DNA, 25 bp, Rattus norvegicus
tgtggctgtcacattttgtattaga

SEQ ID NO: 650558 - DNA, 25 bp, Rattus norvegicus
tgtggctgtcactttttgtattaga

SEQ ID NO: 650559 - DNA, 25 bp, Rattus norvegicus
tgtggctgtcatagtacttgtggcc

SEQ ID NO: 650560 - DNA, 25 bp, Rattus norvegicus
tgtggctgtcattgtacttgtggcc

SEQ ID NO: 650561 - DNA, 25 bp, Rattus norvegicus
tgtggctgtccacttgaacatcgtg

SEQ ID NO: 650562 - DNA, 25 bp, Rattus norvegicus
tgtggctgtccagttgaacatcgtg

SEQ ID NO: 650563 - DNA, 25 bp, Rattus norvegicus
tgtggctgtcgaaagggaacccgct

SEQ ID NO: 650564 - DNA, 25 bp, Rattus norvegicus
tgtggctgtcgatagggaacccgct

SEQ ID NO: 650565 - DNA, 25 bp, Rattus norvegicus
tgtggctgtgatacctgagggtcat

SEQ ID NO: 650566 - DNA, 25 bp, Rattus norvegicus
tgtggctgtgattcctgagggtcat

SEQ ID NO: 650567 - DNA, 25 bp, Rattus norvegicus
tgtggctgtgcgaggcaagaaccct

SEQ ID NO: 650568 - DNA, 25 bp, Rattus norvegicus
tgtggctgtgcgtggcaagaaccct

SEQ ID NO: 650569 - DNA, 25 bp, Rattus norvegicus
tgtggctgttagctcgacctgtctc

SEQ ID NO: 650570 - DNA, 25 bp, Rattus norvegicus
tgtggctgttaggtcgacctgtctc

SEQ ID NO: 650571 - DNA, 25 bp, Rattus norvegicus
tgtggcttagaaaggcaatgtcttc

SEQ ID NO: 650572 - DNA, 25 bp, Rattus norvegicus
tgtggcttagaatggcaatgtcttc

SEQ ID NO: 650573 - DNA, 25 bp, Rattus norvegicus
tgtggcttagttagactcagggtct

SEQ ID NO: 650574 - DNA, 25 bp, Rattus norvegicus
tgtggcttagtttgactcagggtct

SEQ ID NO: 650575 - DNA, 25 bp, Rattus norvegicus
tgtggcttcaacaggtagcctggta

SEQ ID NO: 650576 - DNA, 25 bp, Rattus norvegicus
tgtggcttcaactggtagcctggta

SEQ ID NO: 650577 - DNA, 25 bp, Rattus norvegicus
tgtggcttcaagcactggctcccct

SEQ ID NO: 650578 - DNA, 25 bp, Rattus norvegicus
tgtggcttcaaggactggctcccct

SEQ ID NO: 650579 - DNA, 25 bp, Rattus norvegicus
tgtggcttcagtcgtgtgataccca

SEQ ID NO: 650580 - DNA, 25 bp, Rattus norvegicus
tgtggcttcagtggtgtgataccca

SEQ ID NO: 650581 - DNA, 25 bp, Rattus norvegicus
tgtggcttccacagttgttaattat

SEQ ID NO: 650582 - DNA, 25 bp, Rattus norvegicus
tgtggcttccactgttgttaattat

SEQ ID NO: 650583 - DNA, 25 bp, Rattus norvegicus
tgtggcttcctcaggctgataataa

SEQ ID NO: 650584 - DNA, 25 bp, Rattus norvegicus
tgtggcttcctctggctgataataa

SEQ ID NO: 650585 - DNA, 25 bp, Rattus norvegicus
tgtggcttctaacggcagcagctgc

SEQ ID NO: 650586 - DNA, 25 bp, Rattus norvegicus
tgtggcttctaactgactgctgtgt

SEQ ID NO: 650587 - DNA, 25 bp, Rattus norvegicus
tgtggcttctaagggcagcagctgc

SEQ ID NO: 650588 - DNA, 25 bp, Rattus norvegicus
tgtggcttctaagtgactgctgtgt

SEQ ID NO: 650589 - DNA, 25 bp, Rattus norvegicus
tgtggcttctctaacggctagtaaa

SEQ ID NO: 650590 - DNA, 25 bp, Rattus norvegicus
tgtggcttctcttacggctagtaaa

SEQ ID NO: 650591 - DNA, 25 bp, Rattus norvegicus
tgtggcttctgtccaagcgtcccag

SEQ ID NO: 650592 - DNA, 25 bp, Rattus norvegicus
tgtggcttctgtcgagtcggcctca

SEQ ID NO: 650593 - DNA, 25 bp, Rattus norvegicus
tgtggcttctgtgcaagcgtcccag

SEQ ID NO: 650594 - DNA, 25 bp, Rattus norvegicus
tgtggcttctgtggagtcggcctca

SEQ ID NO: 650595 - DNA, 25 bp, Rattus norvegicus
tgtggcttctttactgagctgctgc

SEQ ID NO: 650596 - DNA, 25 bp, Rattus norvegicus
tgtggcttcttttctgagctgctgc

SEQ ID NO: 650597 - DNA, 25 bp, Rattus norvegicus
tgtggcttgaacaactgctggaccc

SEQ ID NO: 650598 - DNA, 25 bp, Rattus norvegicus
tgtggcttgaactactgctggaccc

SEQ ID NO: 650599 - DNA, 25 bp, Rattus norvegicus
tgtggcttgcacagagcaccaggta

SEQ ID NO: 650600 - DNA, 25 bp, Rattus norvegicus
tgtggcttgcactgagcaccaggta

SEQ ID NO: 650601 - DNA, 25 bp, Rattus norvegicus
tgtggcttggtgatagttcagtctc

SEQ ID NO: 650602 - DNA, 25 bp, Rattus norvegicus
tgtggcttggtgttagttcagtctc

SEQ ID NO: 650603 - DNA, 25 bp, Rattus norvegicus
tgtggctttcaaaggcttggcttcc

SEQ ID NO: 650604 - DNA, 25 bp, Rattus norvegicus
tgtggctttcaatggcttggcttcc

SEQ ID NO: 650605 - DNA, 25 bp, Rattus norvegicus
tgtggctttcctatcctgtgtgcac

SEQ ID NO: 650606 - DNA, 25 bp, Rattus norvegicus
tgtggctttcctttcctgtgtgcac

SEQ ID NO: 650607 - DNA, 25 bp, Rattus norvegicus
tgtggctttctaaggccagccagcc

SEQ ID NO: 650608 - DNA, 25 bp, Rattus norvegicus
tgtggctttctacagaacccaacct

SEQ ID NO: 650609 - DNA, 25 bp, Rattus norvegicus
tgtggctttctagagaacccaacct

SEQ ID NO: 650610 - DNA, 25 bp, Rattus norvegicus
tgtggctttctatggccagccagcc

SEQ ID NO: 650611 - DNA, 25 bp, Rattus norvegicus
tgtggctttctgacatatggctatg

SEQ ID NO: 650612 - DNA, 25 bp, Rattus norvegicus
tgtggctttctgtcatatggctatg

SEQ ID NO: 650613 - DNA, 25 bp, Rattus norvegicus
tgtggctttggtatacccacctaca

SEQ ID NO: 650614 - DNA, 25 bp, Rattus norvegicus
tgtggctttggtctgcacatgcaca

SEQ ID NO: 650615 - DNA, 25 bp, Rattus norvegicus
tgtggctttggtgtgcacatgcaca

SEQ ID NO: 650616 - DNA, 25 bp, Rattus norvegicus
tgtggctttggtttacccacctaca

SEQ ID NO: 650617 - DNA, 25 bp, Rattus norvegicus
tgtggcttttgaccgctgctccatc

SEQ ID NO: 650618 - DNA, 25 bp, Rattus norvegicus
tgtggcttttgagcgctgctccatc

SEQ ID NO: 650619 - DNA, 25 bp, Rattus norvegicus
tgtgggaaaccaccaaactggcttt

SEQ ID NO: 650620 - DNA, 25 bp, Rattus norvegicus
tgtgggaaaccagcaaactggcttt

SEQ ID NO: 650621 - DNA, 25 bp, Rattus norvegicus
tgtgggaaagccctggacatcgccc

SEQ ID NO: 650622 - DNA, 25 bp, Rattus norvegicus
tgtgggaaagccgtggacatcgccc

SEQ ID NO: 650623 - DNA, 25 bp, Rattus norvegicus
tgtgggaacattacacctgctgagt

SEQ ID NO: 650624 - DNA, 25 bp, Rattus norvegicus
tgtgggaacatttcacctgctgagt

SEQ ID NO: 650625 - DNA, 25 bp, Rattus norvegicus
tgtgggaaccccaatggagatatta

SEQ ID NO: 650626 - DNA, 25 bp, Rattus norvegicus
tgtgggaacccctatggagatatta

SEQ ID NO: 650627 - DNA, 25 bp, Rattus norvegicus
tgtgggaacctcagaactgcttcac

SEQ ID NO: 650628 - DNA, 25 bp, Rattus norvegicus
tgtgggaacctctgaactgcttcac

SEQ ID NO: 650629 - DNA, 25 bp, Rattus norvegicus
tgtgggaactgaccttgagtcctct

SEQ ID NO: 650630 - DNA, 25 bp, Rattus norvegicus
tgtgggaactgagcttgagtcctct

SEQ ID NO: 650631 - DNA, 25 bp, Rattus norvegicus
tgtgggaagcagcaactgggcatct

SEQ ID NO: 650632 - DNA, 25 bp, Rattus norvegicus
tgtgggaagcaggaactgggcatct

SEQ ID NO: 650633 - DNA, 25 bp, Rattus norvegicus
tgtgggaatctcagtgaccagtgag

SEQ ID NO: 650634 - DNA, 25 bp, Rattus norvegicus
tgtgggaatctctgtgaccagtgag

SEQ ID NO: 650635 - DNA, 25 bp, Rattus norvegicus
tgtgggaatttgaacacctcacccc

SEQ ID NO: 650636 - DNA, 25 bp, Rattus norvegicus
tgtgggaatttgtacacctcacccc

SEQ ID NO: 650637 - DNA, 25 bp, Rattus norvegicus
tgtgggacacacctttgctacccta

SEQ ID NO: 650638 - DNA, 25 bp, Rattus norvegicus
tgtgggacacacgtttgctacccta

SEQ ID NO: 650639 - DNA, 25 bp, Rattus norvegicus
tgtgggacacttagtgtgcctttca

SEQ ID NO: 650640 - DNA, 25 bp, Rattus norvegicus
tgtgggacactttgtgtgcctttca

SEQ ID NO: 650641 - DNA, 25 bp, Rattus norvegicus
tgtgggacatgcacacctgatcacc

SEQ ID NO: 650642 - DNA, 25 bp, Rattus norvegicus
tgtgggacatgctcacctgatcacc

SEQ ID NO: 650643 - DNA, 25 bp, Rattus norvegicus
tgtgggaccctgaaagtatctcttt

SEQ ID NO: 650644 - DNA, 25 bp, Rattus norvegicus
tgtgggaccctgtaagtatctcttt

SEQ ID NO: 650645 - DNA, 25 bp, Rattus norvegicus
tgtgggacctacacttttgttcagt

SEQ ID NO: 650646 - DNA, 25 bp, Rattus norvegicus
tgtgggacctactcttttgttcagt

SEQ ID NO: 650647 - DNA, 25 bp, Rattus norvegicus
tgtgggacgtgtccaccggctcctt

SEQ ID NO: 650648 - DNA, 25 bp, Rattus norvegicus
tgtgggacgtgtgcaccggctcctt

SEQ ID NO: 650649 - DNA, 25 bp, Rattus norvegicus
tgtgggactctaagccacgccggtg

SEQ ID NO: 650650 - DNA, 25 bp, Rattus norvegicus
tgtgggactctatgccacgccggtg

SEQ ID NO: 650651 - DNA, 25 bp, Rattus norvegicus
tgtgggactgatctccttgacctgt

SEQ ID NO: 650652 - DNA, 25 bp, Rattus norvegicus
tgtgggactgatgtccttgacctgt

SEQ ID NO: 650653 - DNA, 25 bp, Rattus norvegicus
tgtgggacttcaccccagaaactgc

SEQ ID NO: 650654 - DNA, 25 bp, Rattus norvegicus
tgtgggacttcagcccagaaactgc

SEQ ID NO: 650655 - DNA, 25 bp, Rattus norvegicus
tgtgggagcagcacgtccactttca

SEQ ID NO: 650656 - DNA, 25 bp, Rattus norvegicus
tgtgggagcagctcgtccactttca

SEQ ID NO: 650657 - DNA, 25 bp, Rattus norvegicus
tgtgggagctgcattgatggactct

SEQ ID NO: 650658 - DNA, 25 bp, Rattus norvegicus
tgtgggagctgctttgatggactct

SEQ ID NO: 650659 - DNA, 25 bp, Rattus norvegicus
tgtgggaggctgacctcttgcttgc

SEQ ID NO: 650660 - DNA, 25 bp, Rattus norvegicus
tgtgggaggctgtcctcttgcttgc

SEQ ID NO: 650661 - DNA, 25 bp, Rattus norvegicus
tgtgggagtccactttcctctctat

SEQ ID NO: 650662 - DNA, 25 bp, Rattus norvegicus
tgtgggagtccagtttcctctctat

SEQ ID NO: 650663 - DNA, 25 bp, Rattus norvegicus
tgtgggagtgcccaactgtctgtaa

SEQ ID NO: 650664 - DNA, 25 bp, Rattus norvegicus
tgtgggagtgccgaactgtctgtaa

SEQ ID NO: 650665 - DNA, 25 bp, Rattus norvegicus
tgtgggatggccaatgttaccttca

SEQ ID NO: 650666 - DNA, 25 bp, Rattus norvegicus
tgtgggatggccattgccacagcac

SEQ ID NO: 650667 - DNA, 25 bp, Rattus norvegicus
tgtgggatggcctatgttaccttca

SEQ ID NO: 650668 - DNA, 25 bp, Rattus norvegicus
tgtgggatggcctttgccacagcac

SEQ ID NO: 650669 - DNA, 25 bp, Rattus norvegicus
tgtgggatttgaagcccgctcctgt

SEQ ID NO: 650670 - DNA, 25 bp, Rattus norvegicus
tgtgggatttgatgcccgctcctgt

SEQ ID NO: 650671 - DNA, 25 bp, Rattus norvegicus
tgtgggcaaaaccagctacttcctc

SEQ ID NO: 650672 - DNA, 25 bp, Rattus norvegicus
tgtgggcaaaacgagctacttcctc

SEQ ID NO: 650673 - DNA, 25 bp, Rattus norvegicus
tgtgggcaacatcttaaaaataccg

SEQ ID NO: 650674 - DNA, 25 bp, Rattus norvegicus
tgtgggcaacatgttaaaaataccg

SEQ ID NO: 650675 - DNA, 25 bp, Rattus norvegicus
tgtgggcaactcctttttcaataaa

SEQ ID NO: 650676 - DNA, 25 bp, Rattus norvegicus
tgtgggcaactcgtttttcaataaa

SEQ ID NO: 650677 - DNA, 25 bp, Rattus norvegicus
tgtgggcaagcactttgacctgatg

SEQ ID NO: 650678 - DNA, 25 bp, Rattus norvegicus
tgtgggcaagcagtttgacctgatg

SEQ ID NO: 650679 - DNA, 25 bp, Rattus norvegicus
tgtgggcaccacaccaggttgatag

SEQ ID NO: 650680 - DNA, 25 bp, Rattus norvegicus
tgtgggcaccactccaggttgatag

SEQ ID NO: 650681 - DNA, 25 bp, Rattus norvegicus
tgtgggcacctaagcatactcacat

SEQ ID NO: 650682 - DNA, 25 bp, Rattus norvegicus
tgtgggcacctatgcatactcacat

SEQ ID NO: 650683 - DNA, 25 bp, Rattus norvegicus
tgtgggcacctgcactcacacagat

SEQ ID NO: 650684 - DNA, 25 bp, Rattus norvegicus
tgtgggcacctggactcacacagat

SEQ ID NO: 650685 - DNA, 25 bp, Rattus norvegicus
tgtgggcactgccacgtggttcttc

SEQ ID NO: 650686 - DNA, 25 bp, Rattus norvegicus
tgtgggcactgcgacgtggttcttc

SEQ ID NO: 650687 - DNA, 25 bp, Rattus norvegicus
tgtgggcactggaatttacccctgc

SEQ ID NO: 650688 - DNA, 25 bp, Rattus norvegicus
tgtgggcactggtatttacccctgc

SEQ ID NO: 650689 - DNA, 25 bp, Rattus norvegicus
tgtgggcagatcatcaaagctatgt

SEQ ID NO: 650690 - DNA, 25 bp, Rattus norvegicus
tgtgggcagatcttcaaagctatgt

SEQ ID NO: 650691 - DNA, 25 bp, Rattus norvegicus
tgtgggcagcccaagatgagcaaat

SEQ ID NO: 650692 - DNA, 25 bp, Rattus norvegicus
tgtgggcagccctagatgagcaaat

SEQ ID NO: 650693 - DNA, 25 bp, Rattus norvegicus
tgtgggcataataaccgaacctcat

SEQ ID NO: 650694 - DNA, 25 bp, Rattus norvegicus
tgtgggcataattaccgaacctcat

SEQ ID NO: 650695 - DNA, 25 bp, Rattus norvegicus
tgtgggcatctgatccaggatcggc

SEQ ID NO: 650696 - DNA, 25 bp, Rattus norvegicus
tgtgggcatctgttccaggatcggc

SEQ ID NO: 650697 - DNA, 25 bp, Rattus norvegicus
tgtgggcatcttctctgcagctgct

SEQ ID NO: 650698 - DNA, 25 bp, Rattus norvegicus
tgtgggcatcttgtctgcagctgct

SEQ ID NO: 650699 - DNA, 25 bp, Rattus norvegicus
tgtgggcatgccagagagagacttt

SEQ ID NO: 650700 - DNA, 25 bp, Rattus norvegicus
tgtgggcatgcctgagagagacttt

SEQ ID NO: 650701 - DNA, 25 bp, Rattus norvegicus
tgtgggcatgctctggtgccaccct

SEQ ID NO: 650702 - DNA, 25 bp, Rattus norvegicus
tgtgggcatgctgtggtgccaccct

SEQ ID NO: 650703 - DNA, 25 bp, Rattus norvegicus
tgtgggccaaacatcgagcgagcaa

SEQ ID NO: 650704 - DNA, 25 bp, Rattus norvegicus
tgtgggccaaacttcgagcgagcaa

SEQ ID NO: 650705 - DNA, 25 bp, Rattus norvegicus
tgtgggccaactcctccagttagtt

SEQ ID NO: 650706 - DNA, 25 bp, Rattus norvegicus
tgtgggccaactgctccagttagtt

SEQ ID NO: 650707 - DNA, 25 bp, Rattus norvegicus
tgtgggccagaacagttccttcctg

SEQ ID NO: 650708 - DNA, 25 bp, Rattus norvegicus
tgtgggccagaagagttccttcctg

SEQ ID NO: 650709 - DNA, 25 bp, Rattus norvegicus
tgtgggccagagagacccttgcctt

SEQ ID NO: 650710 - DNA, 25 bp, Rattus norvegicus
tgtgggccagagtgacccttgcctt

SEQ ID NO: 650711 - DNA, 25 bp, Rattus norvegicus
tgtgggccaggtcctcggtttctaa

SEQ ID NO: 650712 - DNA, 25 bp, Rattus norvegicus
tgtgggccaggtgctcggtttctaa

SEQ ID NO: 650713 - DNA, 25 bp, Rattus norvegicus
tgtgggccagtcctgtggcaacaca

SEQ ID NO: 650714 - DNA, 25 bp, Rattus norvegicus
tgtgggccagtcgtgtggcaacaca

SEQ ID NO: 650715 - DNA, 25 bp, Rattus norvegicus
tgtgggccatcacctaagctctggg

SEQ ID NO: 650716 - DNA, 25 bp, Rattus norvegicus
tgtgggccatcagctaagctctggg

SEQ ID NO: 650717 - DNA, 25 bp, Rattus norvegicus
tgtgggccatgcacatcgtcgtgtg

SEQ ID NO: 650718 - DNA, 25 bp, Rattus norvegicus
tgtgggccatgctcatcgtcgtgtg

SEQ ID NO: 650719 - DNA, 25 bp, Rattus norvegicus
tgtgggccatttccttagtgtgctt

SEQ ID NO: 650720 - DNA, 25 bp, Rattus norvegicus
tgtgggccatttgcttagtgtgctt

SEQ ID NO: 650721 - DNA, 25 bp, Rattus norvegicus
tgtgggcccactatcttacgaccaa

SEQ ID NO: 650722 - DNA, 25 bp, Rattus norvegicus
tgtgggcccactttcttacgaccaa

SEQ ID NO: 650723 - DNA, 25 bp, Rattus norvegicus
tgtgggcccatcaccttcttcaaaa

SEQ ID NO: 650724 - DNA, 25 bp, Rattus norvegicus
tgtgggcccatctccttcttcaaaa

SEQ ID NO: 650725 - DNA, 25 bp, Rattus norvegicus
tgtgggcccctgagggatgatgtca

SEQ ID NO: 650726 - DNA, 25 bp, Rattus norvegicus
tgtgggcccctgtgggatgatgtca

SEQ ID NO: 650727 - DNA, 25 bp, Rattus norvegicus
tgtgggcctcccagaattagagaaa

SEQ ID NO: 650728 - DNA, 25 bp, Rattus norvegicus
tgtgggcctccctgaattagagaaa

SEQ ID NO: 650729 - DNA, 25 bp, Rattus norvegicus
tgtgggcgcatcctacagagagatt

SEQ ID NO: 650730 - DNA, 25 bp, Rattus norvegicus
tgtgggcgcatcgtacagagagatt

SEQ ID NO: 650731 - DNA, 25 bp, Rattus norvegicus
tgtgggcgctacaccatgagggaat

SEQ ID NO: 650732 - DNA, 25 bp, Rattus norvegicus
tgtgggcgctactccatgagggaat

SEQ ID NO: 650733 - DNA, 25 bp, Rattus norvegicus
tgtgggcgctggactaatcctgctg

SEQ ID NO: 650734 - DNA, 25 bp, Rattus norvegicus
tgtgggcgctggtctaatcctgctg

SEQ ID NO: 650735 - DNA, 25 bp, Rattus norvegicus
tgtgggctaaagatccggcctaagc

SEQ ID NO: 650736 - DNA, 25 bp, Rattus norvegicus
tgtgggctaaagttccggcctaagc

SEQ ID NO: 650737 - DNA, 25 bp, Rattus norvegicus
tgtgggctcactccctggcatagac

SEQ ID NO: 650738 - DNA, 25 bp, Rattus norvegicus
tgtgggctcactgcctggcatagac

SEQ ID NO: 650739 - DNA, 25 bp, Rattus norvegicus
tgtgggctcatcagtaactgcacac

SEQ ID NO: 650740 - DNA, 25 bp, Rattus norvegicus
tgtgggctcatctgtaactgcacac

SEQ ID NO: 650741 - DNA, 25 bp, Rattus norvegicus
tgtgggctcggcacttcagtaagga

SEQ ID NO: 650742 - DNA, 25 bp, Rattus norvegicus
tgtgggctcggctcttcagtaagga

SEQ ID NO: 650743 - DNA, 25 bp, Rattus norvegicus
tgtgggctctagcaccctcattcta

SEQ ID NO: 650744 - DNA, 25 bp, Rattus norvegicus
tgtgggctctaggaccctcattcta

SEQ ID NO: 650745 - DNA, 25 bp, Rattus norvegicus
tgtgggctctccagggcacttgcaa

SEQ ID NO: 650746 - DNA, 25 bp, Rattus norvegicus
tgtgggctctcctgggcacttgcaa

SEQ ID NO: 650747 - DNA, 25 bp, Rattus norvegicus
tgtgggctgccaaccaatctaatgt

SEQ ID NO: 650748 - DNA, 25 bp, Rattus norvegicus
tgtgggctgccaacggtgcacctgt

SEQ ID NO: 650749 - DNA, 25 bp, Rattus norvegicus
tgtgggctgccacatatggatgtca

SEQ ID NO: 650750 - DNA, 25 bp, Rattus norvegicus
tgtgggctgccagatatggatgtca

SEQ ID NO: 650751 - DNA, 25 bp, Rattus norvegicus
tgtgggctgccatccaatctaatgt

SEQ ID NO: 650752 - DNA, 25 bp, Rattus norvegicus
tgtgggctgccatcggtgcacctgt

SEQ ID NO: 650753 - DNA, 25 bp, Rattus norvegicus
tgtgggctgctgagacacgtctcag

SEQ ID NO: 650754 - DNA, 25 bp, Rattus norvegicus
tgtgggctgctgtgacacgtctcag

SEQ ID NO: 650755 - DNA, 25 bp, Rattus norvegicus
tgtgggctgggtatttatctctaag

SEQ ID NO: 650756 - DNA, 25 bp, Rattus norvegicus
tgtgggctgggtttttatctctaag

SEQ ID NO: 650757 - DNA, 25 bp, Rattus norvegicus
tgtgggctgtgcactcaatgactct

SEQ ID NO: 650758 - DNA, 25 bp, Rattus norvegicus
tgtgggctgtgctctcaatgactct

SEQ ID NO: 650759 - DNA, 25 bp, Rattus norvegicus
tgtgggcttaagagtgctgctctcc

SEQ ID NO: 650760 - DNA, 25 bp, Rattus norvegicus
tgtgggcttaagtgtgctgctctcc

SEQ ID NO: 650761 - DNA, 25 bp, Rattus norvegicus
tgtgggcttgctcgtggatctcctc

SEQ ID NO: 650762 - DNA, 25 bp, Rattus norvegicus
tgtgggcttgctggtggatctcctc

SEQ ID NO: 650763 - DNA, 25 bp, Rattus norvegicus
tgtgggcttggcagtactactgaaa

SEQ ID NO: 650764 - DNA, 25 bp, Rattus norvegicus
tgtgggcttggctgtactactgaaa

SEQ ID NO: 650765 - DNA, 25 bp, Rattus norvegicus
tgtggggctagtcctatttcaaaaa

SEQ ID NO: 650766 - DNA, 25 bp, Rattus norvegicus
tgtggggctagtgctatttcaaaaa

SEQ ID NO: 650767 - DNA, 25 bp, Rattus norvegicus
tgtggggtacatatgcctttgtttg

SEQ ID NO: 650768 - DNA, 25 bp, Rattus norvegicus
tgtggggtacatttgcctttgtttg

SEQ ID NO: 650769 - DNA, 25 bp, Rattus norvegicus
tgtggggttcccaacagggagctcc

SEQ ID NO: 650770 - DNA, 25 bp, Rattus norvegicus
tgtggggttccctacagggagctcc

SEQ ID NO: 650771 - DNA, 25 bp, Rattus norvegicus
tgtgggtaaactcggcccctttctg

SEQ ID NO: 650772 - DNA, 25 bp, Rattus norvegicus
tgtgggtaaactgggcccctttctg

SEQ ID NO: 650773 - DNA, 25 bp, Rattus norvegicus
tgtgggtaacctccaattattcctt

SEQ ID NO: 650774 - DNA, 25 bp, Rattus norvegicus
tgtgggtaacctgcaattattcctt

SEQ ID NO: 650775 - DNA, 25 bp, Rattus norvegicus
tgtgggtacacacatgccatggtgt

SEQ ID NO: 650776 - DNA, 25 bp, Rattus norvegicus
tgtgggtacacactctccatgcaaa

SEQ ID NO: 650777 - DNA, 25 bp, Rattus norvegicus
tgtgggtacacagatgccatggtgt

SEQ ID NO: 650778 - DNA, 25 bp, Rattus norvegicus
tgtgggtacacagtctccatgcaaa

SEQ ID NO: 650779 - DNA, 25 bp, Rattus norvegicus
tgtgggtacacgaggcttcatctga

SEQ ID NO: 650780 - DNA, 25 bp, Rattus norvegicus
tgtgggtacacgtggcttcatctga

SEQ ID NO: 650781 - DNA, 25 bp, Rattus norvegicus
tgtgggtaccaacactttcttgttc

SEQ ID NO: 650782 - DNA, 25 bp, Rattus norvegicus
tgtgggtaccaagactttcttgttc

SEQ ID NO: 650783 - DNA, 25 bp, Rattus norvegicus
tgtgggtataatcggtctcttttta

SEQ ID NO: 650784 - DNA, 25 bp, Rattus norvegicus
tgtgggtataatgggtctcttttta

SEQ ID NO: 650785 - DNA, 25 bp, Rattus norvegicus
tgtgggtcagacacctctggactct

SEQ ID NO: 650786 - DNA, 25 bp, Rattus norvegicus
tgtgggtcagactcctctggactct

SEQ ID NO: 650787 - DNA, 25 bp, Rattus norvegicus
tgtgggtccaagacctggcaacgag

SEQ ID NO: 650788 - DNA, 25 bp, Rattus norvegicus
tgtgggtccaagtcctggcaacgag

SEQ ID NO: 650789 - DNA, 25 bp, Rattus norvegicus
tgtgggtccagacacatacatcctg

SEQ ID NO: 650790 - DNA, 25 bp, Rattus norvegicus
tgtgggtccagagacatacatcctg

SEQ ID NO: 650791 - DNA, 25 bp, Rattus norvegicus
tgtgggtccagcatttcccataagc

SEQ ID NO: 650792 - DNA, 25 bp, Rattus norvegicus
tgtgggtccagcttttcccataagc

SEQ ID NO: 650793 - DNA, 25 bp, Rattus norvegicus
tgtgggtccagtcttgtctgtcatc

SEQ ID NO: 650794 - DNA, 25 bp, Rattus norvegicus
tgtgggtccagtgttgtctgtcatc

SEQ ID NO: 650795 - DNA, 25 bp, Rattus norvegicus
tgtgggtcccctcagcccaagaggt

SEQ ID NO: 650796 - DNA, 25 bp, Rattus norvegicus
tgtgggtcccctgagcccaagaggt

SEQ ID NO: 650797 - DNA, 25 bp, Rattus norvegicus
tgtgggtcccgcaggccacactgct

SEQ ID NO: 650798 - DNA, 25 bp, Rattus norvegicus
tgtgggtcccgctggccacactgct

SEQ ID NO: 650799 - DNA, 25 bp, Rattus norvegicus
tgtgggtcggatcgctcccagcttc

SEQ ID NO: 650800 - DNA, 25 bp, Rattus norvegicus
tgtgggtcggatggctcccagcttc

SEQ ID NO: 650801 - DNA, 25 bp, Rattus norvegicus
tgtgggtctgaccagttacttaaga

SEQ ID NO: 650802 - DNA, 25 bp, Rattus norvegicus
tgtgggtctgacgagttacttaaga

SEQ ID NO: 650803 - DNA, 25 bp, Rattus norvegicus
tgtgggtctgctcctgaagacactg

SEQ ID NO: 650804 - DNA, 25 bp, Rattus norvegicus
tgtgggtctgctgctgaagacactg

SEQ ID NO: 650805 - DNA, 25 bp, Rattus norvegicus
tgtgggtctttaattcttgtggtga

SEQ ID NO: 650806 - DNA, 25 bp, Rattus norvegicus
tgtgggtctttatttcttgtggtga

SEQ ID NO: 650807 - DNA, 25 bp, Rattus norvegicus
tgtgggtgaccgacaagtcctcagc

SEQ ID NO: 650808 - DNA, 25 bp, Rattus norvegicus
tgtgggtgaccgtcaagtcctcagc

SEQ ID NO: 650809 - DNA, 25 bp, Rattus norvegicus
tgtgggtgtccaaggcattgttaca

SEQ ID NO: 650810 - DNA, 25 bp, Rattus norvegicus
tgtgggtgtccatggcattgttaca

SEQ ID NO: 650811 - DNA, 25 bp, Rattus norvegicus
tgtgggtgtctgcactgcgtactca

SEQ ID NO: 650812 - DNA, 25 bp, Rattus norvegicus
tgtgggtgtctggactgcgtactca

SEQ ID NO: 650813 - DNA, 25 bp, Rattus norvegicus
tgtgggtgtgtaaatgcaagttcct

SEQ ID NO: 650814 - DNA, 25 bp, Rattus norvegicus
tgtgggtgtgtatatgcaagttcct

SEQ ID NO: 650815 - DNA, 25 bp, Rattus norvegicus
tgtgggtgttacaccgtttttgata

SEQ ID NO: 650816 - DNA, 25 bp, Rattus norvegicus
tgtgggtgttactccgtttttgata

SEQ ID NO: 650817 - DNA, 25 bp, Rattus norvegicus
tgtgggttaccaactgcctttttag

SEQ ID NO: 650818 - DNA, 25 bp, Rattus norvegicus
tgtgggttaccatctgcctttttag

SEQ ID NO: 650819 - DNA, 25 bp, Rattus norvegicus
tgtgggttatttctaaaggcctctt

SEQ ID NO: 650820 - DNA, 25 bp, Rattus norvegicus
tgtgggttatttgtaaaggcctctt

SEQ ID NO: 650821 - DNA, 25 bp, Rattus norvegicus
tgtgggttcaagagcctgttggctt

SEQ ID NO: 650822 - DNA, 25 bp, Rattus norvegicus
tgtgggttcaagtgcctgttggctt

SEQ ID NO: 650823 - DNA, 25 bp, Rattus norvegicus
tgtgggttccccactttctgttcct

SEQ ID NO: 650824 - DNA, 25 bp, Rattus norvegicus
tgtgggttcccctctttctgttcct

SEQ ID NO: 650825 - DNA, 25 bp, Rattus norvegicus
tgtgggttctctaattttcgggaat

SEQ ID NO: 650826 - DNA, 25 bp, Rattus norvegicus
tgtgggttctcttattttcgggaat

SEQ ID NO: 650827 - DNA, 25 bp, Rattus norvegicus
tgtgggttgcacctgcatcttctga

SEQ ID NO: 650828 - DNA, 25 bp, Rattus norvegicus
tgtgggttgcacgtgcatcttctga

SEQ ID NO: 650829 - DNA, 25 bp, Rattus norvegicus
tgtgggttgtccaccgacactgggc

SEQ ID NO: 650830 - DNA, 25 bp, Rattus norvegicus
tgtgggttgtcctccgacactgggc

SEQ ID NO: 650831 - DNA, 25 bp, Rattus norvegicus
tgtgggtttccccatgggacacatc

SEQ ID NO: 650832 - DNA, 25 bp, Rattus norvegicus
tgtgggtttcccgatgggacacatc

SEQ ID NO: 650833 - DNA, 25 bp, Rattus norvegicus
tgtgggtttcgcaggagccatcatc

SEQ ID NO: 650834 - DNA, 25 bp, Rattus norvegicus
tgtgggtttcgctggagccatcatc

SEQ ID NO: 650835 - DNA, 25 bp, Rattus norvegicus
tgtgggtttgcgatttttgcatcgt

SEQ ID NO: 650836 - DNA, 25 bp, Rattus norvegicus
tgtgggtttgcgttttttgcatcgt

SEQ ID NO: 650837 - DNA, 25 bp, Rattus norvegicus
tgtgggttttccagtctgctcaaca

SEQ ID NO: 650838 - DNA, 25 bp, Rattus norvegicus
tgtgggttttcctgtctgctcaaca

SEQ ID NO: 650839 - DNA, 25 bp, Rattus norvegicus
tgtggtaaaagcatctctcgatcct

SEQ ID NO: 650840 - DNA, 25 bp, Rattus norvegicus
tgtggtaaaagcttctctcgatcct

SEQ ID NO: 650841 - DNA, 25 bp, Rattus norvegicus
tgtggtaacattccattaagcctta

SEQ ID NO: 650842 - DNA, 25 bp, Rattus norvegicus
tgtggtaacattgcattaagcctta

SEQ ID NO: 650843 - DNA, 25 bp, Rattus norvegicus
tgtggtaaccctcaactgtataatt

SEQ ID NO: 650844 - DNA, 25 bp, Rattus norvegicus
tgtggtaaccctgaactgtataatt

SEQ ID NO: 650845 - DNA, 25 bp, Rattus norvegicus
tgtggtaactcccatgttgaacccc

SEQ ID NO: 650846 - DNA, 25 bp, Rattus norvegicus
tgtggtaactccgatgttgaacccc

SEQ ID NO: 650847 - DNA, 25 bp, Rattus norvegicus
tgtggtaactgactgtccctgcgtt

SEQ ID NO: 650848 - DNA, 25 bp, Rattus norvegicus
tgtggtaactgagtgtccctgcgtt

SEQ ID NO: 650849 - DNA, 25 bp, Rattus norvegicus
tgtggtaacttgaaggtgccctgca

SEQ ID NO: 650850 - DNA, 25 bp, Rattus norvegicus
tgtggtaacttgtaggtgccctgca

SEQ ID NO: 650851 - DNA, 25 bp, Rattus norvegicus
tgtggtaactttcccaaacggtgat

SEQ ID NO: 650852 - DNA, 25 bp, Rattus norvegicus
tgtggtaactttgccaaacggtgat

SEQ ID NO: 650853 - DNA, 25 bp, Rattus norvegicus
tgtggtaagcgacccacccctgtgg

SEQ ID NO: 650854 - DNA, 25 bp, Rattus norvegicus
tgtggtaagcgagccacccctgtgg

SEQ ID NO: 650855 - DNA, 25 bp, Rattus norvegicus
tgtggtaatgccagttttcatctgt

SEQ ID NO: 650856 - DNA, 25 bp, Rattus norvegicus
tgtggtaatgcctgttttcatctgt

SEQ ID NO: 650857 - DNA, 25 bp, Rattus norvegicus
tgtggtacagacatgcatgcaagca

SEQ ID NO: 650858 - DNA, 25 bp, Rattus norvegicus
tgtggtacagacttgcatgcaagca

SEQ ID NO: 650859 - DNA, 25 bp, Rattus norvegicus
tgtggtacagtgactgcctgagttt

SEQ ID NO: 650860 - DNA, 25 bp, Rattus norvegicus
tgtggtacagtgtctgcctgagttt

SEQ ID NO: 650861 - DNA, 25 bp, Rattus norvegicus
tgtggtacatgcatttaatcccaac

SEQ ID NO: 650862 - DNA, 25 bp, Rattus norvegicus
tgtggtacatgcttttaatcccaac

SEQ ID NO: 650863 - DNA, 25 bp, Rattus norvegicus
tgtggtaccacgacattcagtattt

SEQ ID NO: 650864 - DNA, 25 bp, Rattus norvegicus
tgtggtaccacgtcattcagtattt

SEQ ID NO: 650865 - DNA, 25 bp, Rattus norvegicus
tgtggtacccacagttctgtctcta

SEQ ID NO: 650866 - DNA, 25 bp, Rattus norvegicus
tgtggtacccactgttctgtctcta

SEQ ID NO: 650867 - DNA, 25 bp, Rattus norvegicus
tgtggtacgccaccgccagcgtgtt

SEQ ID NO: 650868 - DNA, 25 bp, Rattus norvegicus
tgtggtacgccagcgccagcgtgtt

SEQ ID NO: 650869 - DNA, 25 bp, Rattus norvegicus
tgtggtactacccatcttttcgcag

SEQ ID NO: 650870 - DNA, 25 bp, Rattus norvegicus
tgtggtactaccgatcttttcgcag

SEQ ID NO: 650871 - DNA, 25 bp, Rattus norvegicus
tgtggtactcataagcctcataact

SEQ ID NO: 650872 - DNA, 25 bp, Rattus norvegicus
tgtggtactcattagcctcataact

SEQ ID NO: 650873 - DNA, 25 bp, Rattus norvegicus
tgtggtactgagcttgtttctctgc

SEQ ID NO: 650874 - DNA, 25 bp, Rattus norvegicus
tgtggtactgaggttgtttctctgc

SEQ ID NO: 650875 - DNA, 25 bp, Rattus norvegicus
tgtggtagaacacactctggctgat

SEQ ID NO: 650876 - DNA, 25 bp, Rattus norvegicus
tgtggtagaacagactctggctgat

SEQ ID NO: 650877 - DNA, 25 bp, Rattus norvegicus
tgtggtagctttacgtttctgacgt

SEQ ID NO: 650878 - DNA, 25 bp, Rattus norvegicus
tgtggtagcttttcgtttctgacgt

SEQ ID NO: 650879 - DNA, 25 bp, Rattus norvegicus
tgtggtaggcctattaacattttgt

SEQ ID NO: 650880 - DNA, 25 bp, Rattus norvegicus
tgtggtaggccttttaacattttgt

SEQ ID NO: 650881 - DNA, 25 bp, Rattus norvegicus
tgtggtatcatcctatgcagggcaa

SEQ ID NO: 650882 - DNA, 25 bp, Rattus norvegicus
tgtggtatcatcgtatgcagggcaa

SEQ ID NO: 650883 - DNA, 25 bp, Rattus norvegicus
tgtggtatgtgcaaactggctggcc

SEQ ID NO: 650884 - DNA, 25 bp, Rattus norvegicus
tgtggtatgtgctaactggctggcc

SEQ ID NO: 650885 - DNA, 25 bp, Rattus norvegicus
tgtggtattggaccccgtttgtata

SEQ ID NO: 650886 - DNA, 25 bp, Rattus norvegicus
tgtggtattggagcccgtttgtata

SEQ ID NO: 650887 - DNA, 25 bp, Rattus norvegicus
tgtggtatttctccaggctcagcat

SEQ ID NO: 650888 - DNA, 25 bp, Rattus norvegicus
tgtggtatttctgcaggctcagcat

SEQ ID NO: 650889 - DNA, 25 bp, Rattus norvegicus
tgtggtattttgacctgtaactgaa

SEQ ID NO: 650890 - DNA, 25 bp, Rattus norvegicus
tgtggtattttgtcctgtaactgaa

SEQ ID NO: 650891 - DNA, 25 bp, Rattus norvegicus
tgtggtcacagtcagcctcccaagt

SEQ ID NO: 650892 - DNA, 25 bp, Rattus norvegicus
tgtggtcacagtgagcctcccaagt

SEQ ID NO: 650893 - DNA, 25 bp, Rattus norvegicus
tgtggtcaccgtatccgcaacagct

SEQ ID NO: 650894 - DNA, 25 bp, Rattus norvegicus
tgtggtcaccgtttccgcaacagct

SEQ ID NO: 650895 - DNA, 25 bp, Rattus norvegicus
tgtggtcacttacttctctgcactg

SEQ ID NO: 650896 - DNA, 25 bp, Rattus norvegicus
tgtggtcacttagttctctgcactg

SEQ ID NO: 650897 - DNA, 25 bp, Rattus norvegicus
tgtggtcagcttcctagctcctgaa

SEQ ID NO: 650898 - DNA, 25 bp, Rattus norvegicus
tgtggtcagcttgctagctcctgaa

SEQ ID NO: 650899 - DNA, 25 bp, Rattus norvegicus
tgtggtcagtggctggctctcatac

SEQ ID NO: 650900 - DNA, 25 bp, Rattus norvegicus
tgtggtcagtgggtggctctcatac

SEQ ID NO: 650901 - DNA, 25 bp, Rattus norvegicus
tgtggtcagttcagcacccattgca

SEQ ID NO: 650902 - DNA, 25 bp, Rattus norvegicus
tgtggtcagttctgcacccattgca

SEQ ID NO: 650903 - DNA, 25 bp, Rattus norvegicus
tgtggtcatctgagggcacgacact

SEQ ID NO: 650904 - DNA, 25 bp, Rattus norvegicus
tgtggtcatctgtgggcacgacact

SEQ ID NO: 650905 - DNA, 25 bp, Rattus norvegicus
tgtggtcatggaactcagcgccgac

SEQ ID NO: 650906 - DNA, 25 bp, Rattus norvegicus
tgtggtcatggatctcagcgccgac

SEQ ID NO: 650907 - DNA, 25 bp, Rattus norvegicus
tgtggtcatgtccatggccctgcat

SEQ ID NO: 650908 - DNA, 25 bp, Rattus norvegicus
tgtggtcatgtcgatggccctgcat

SEQ ID NO: 650909 - DNA, 25 bp, Rattus norvegicus
tgtggtccaacaagctgcttgcagt

SEQ ID NO: 650910 - DNA, 25 bp, Rattus norvegicus
tgtggtccaacatgctgcttgcagt

SEQ ID NO: 650911 - DNA, 25 bp, Rattus norvegicus
tgtggtccacttactggtgtggcaa

SEQ ID NO: 650912 - DNA, 25 bp, Rattus norvegicus
tgtggtccactttctggtgtggcaa

SEQ ID NO: 650913 - DNA, 25 bp, Rattus norvegicus
tgtggtccagaaagcccatacgagt

SEQ ID NO: 650914 - DNA, 25 bp, Rattus norvegicus
tgtggtccagaatgcccatacgagt

SEQ ID NO: 650915 - DNA, 25 bp, Rattus norvegicus
tgtggtccaggaaccgaatctgcga

SEQ ID NO: 650916 - DNA, 25 bp, Rattus norvegicus
tgtggtccaggacctagaatcttag

SEQ ID NO: 650917 - DNA, 25 bp, Rattus norvegicus
tgtggtccaggagctagaatcttag

SEQ ID NO: 650918 - DNA, 25 bp, Rattus norvegicus
tgtggtccaggatccgaatctgcga

SEQ ID NO: 650919 - DNA, 25 bp, Rattus norvegicus
tgtggtcccaccaagaaaattctta

SEQ ID NO: 650920 - DNA, 25 bp, Rattus norvegicus
tgtggtcccacctagaaaattctta

SEQ ID NO: 650921 - DNA, 25 bp, Rattus norvegicus
tgtggtcccctcctttgtggtaaag

SEQ ID NO: 650922 - DNA, 25 bp, Rattus norvegicus
tgtggtcccctcgtttgtggtaaag

SEQ ID NO: 650923 - DNA, 25 bp, Rattus norvegicus
tgtggtccctcaagtcccaggagtg

SEQ ID NO: 650924 - DNA, 25 bp, Rattus norvegicus
tgtggtccctcatgtcccaggagtg

SEQ ID NO: 650925 - DNA, 25 bp, Rattus norvegicus
tgtggtccctgtatggctgtctgca

SEQ ID NO: 650926 - DNA, 25 bp, Rattus norvegicus
tgtggtccctgtttggctgtctgca

SEQ ID NO: 650927 - DNA, 25 bp, Rattus norvegicus
tgtggtcctgagcattcctgagttc

SEQ ID NO: 650928 - DNA, 25 bp, Rattus norvegicus
tgtggtcctgaggattcctgagttc

SEQ ID NO: 650929 - DNA, 25 bp, Rattus norvegicus
tgtggtccttgcaggtctaggcgca

SEQ ID NO: 650930 - DNA, 25 bp, Rattus norvegicus
tgtggtccttgctggtctaggcgca

SEQ ID NO: 650931 - DNA, 25 bp, Rattus norvegicus
tgtggtcgagccagtgcagcctcaa

SEQ ID NO: 650932 - DNA, 25 bp, Rattus norvegicus
tgtggtcgagcctgtgcagcctcaa

SEQ ID NO: 650933 - DNA, 25 bp, Rattus norvegicus
tgtggtcgagttcagtccttgctaa

SEQ ID NO: 650934 - DNA, 25 bp, Rattus norvegicus
tgtggtcgagttgagtccttgctaa

SEQ ID NO: 650935 - DNA, 25 bp, Rattus norvegicus
tgtggtcgccctcgtggaagcactc

SEQ ID NO: 650936 - DNA, 25 bp, Rattus norvegicus
tgtggtcgccctggtggaagcactc

SEQ ID NO: 650937 - DNA, 25 bp, Rattus norvegicus
tgtggtcgtcgccaatttccaagca

SEQ ID NO: 650938 - DNA, 25 bp, Rattus norvegicus
tgtggtcgtcgcgaatttccaagca

SEQ ID NO: 650939 - DNA, 25 bp, Rattus norvegicus
tgtggtctaaccatttatgtgtgat

SEQ ID NO: 650940 - DNA, 25 bp, Rattus norvegicus
tgtggtctaaccttttatgtgtgat

SEQ ID NO: 650941 - DNA, 25 bp, Rattus norvegicus
tgtggtctacgccctcaaacggcag

SEQ ID NO: 650942 - DNA, 25 bp, Rattus norvegicus
tgtggtctacgcgctcaaacggcag

SEQ ID NO: 650943 - DNA, 25 bp, Rattus norvegicus
tgtggtctcagtagggctcttggca

SEQ ID NO: 650944 - DNA, 25 bp, Rattus norvegicus
tgtggtctcagttgggctcttggca

SEQ ID NO: 650945 - DNA, 25 bp, Rattus norvegicus
tgtggtctcgctatctgtgtcatga

SEQ ID NO: 650946 - DNA, 25 bp, Rattus norvegicus
tgtggtctcgctttctgtgtcatga

SEQ ID NO: 650947 - DNA, 25 bp, Rattus norvegicus
tgtggtctctgcatggaggcttaac

SEQ ID NO: 650948 - DNA, 25 bp, Rattus norvegicus
tgtggtctctgcttggaggcttaac

SEQ ID NO: 650949 - DNA, 25 bp, Rattus norvegicus
tgtggtctcttcacagtttgctacc

SEQ ID NO: 650950 - DNA, 25 bp, Rattus norvegicus
tgtggtctcttctcagtttgctacc

SEQ ID NO: 650951 - DNA, 25 bp, Rattus norvegicus
tgtggtctggacctgcttttacaag

SEQ ID NO: 650952 - DNA, 25 bp, Rattus norvegicus
tgtggtctggacgtgcttttacaag

SEQ ID NO: 650953 - DNA, 25 bp, Rattus norvegicus
tgtggtctggctacaggccaaccaa

SEQ ID NO: 650954 - DNA, 25 bp, Rattus norvegicus
tgtggtctggcttcaggccaaccaa

SEQ ID NO: 650955 - DNA, 25 bp, Rattus norvegicus
tgtggtctgtctctgagtccaggcc

SEQ ID NO: 650956 - DNA, 25 bp, Rattus norvegicus
tgtggtctgtctgtgagtccaggcc

SEQ ID NO: 650957 - DNA, 25 bp, Rattus norvegicus
tgtggtctgtgtacctggctggaaa

SEQ ID NO: 650958 - DNA, 25 bp, Rattus norvegicus
tgtggtctgtgttcctggctggaaa

SEQ ID NO: 650959 - DNA, 25 bp, Rattus norvegicus
tgtggtcttccacaggctgagcctg

SEQ ID NO: 650960 - DNA, 25 bp, Rattus norvegicus
tgtggtcttccagaggctgagcctg

SEQ ID NO: 650961 - DNA, 25 bp, Rattus norvegicus
tgtggtcttgccctgtatcaggaaa

SEQ ID NO: 650962 - DNA, 25 bp, Rattus norvegicus
tgtggtcttgccgtgtatcaggaaa

SEQ ID NO: 650963 - DNA, 25 bp, Rattus norvegicus
tgtggtctttgtataacttcctgaa

SEQ ID NO: 650964 - DNA, 25 bp, Rattus norvegicus
tgtggtctttgtttaacttcctgaa

SEQ ID NO: 650965 - DNA, 25 bp, Rattus norvegicus
tgtggtgaacagcactccttggtgc

SEQ ID NO: 650966 - DNA, 25 bp, Rattus norvegicus
tgtggtgaacaggactccttggtgc

SEQ ID NO: 650967 - DNA, 25 bp, Rattus norvegicus
tgtggtgacactctcctggcttcag

SEQ ID NO: 650968 - DNA, 25 bp, Rattus norvegicus
tgtggtgacactgtcctggcttcag

SEQ ID NO: 650969 - DNA, 25 bp, Rattus norvegicus
tgtggtgacttaacccaaaggtgat

SEQ ID NO: 650970 - DNA, 25 bp, Rattus norvegicus
tgtggtgacttatcccaaaggtgat

SEQ ID NO: 650971 - DNA, 25 bp, Rattus norvegicus
tgtggtgactttctctcggagctca

SEQ ID NO: 650972 - DNA, 25 bp, Rattus norvegicus
tgtggtgactttgtctcggagctca

SEQ ID NO: 650973 - DNA, 25 bp, Rattus norvegicus
tgtggtgagtgccaggtactaccct

SEQ ID NO: 650974 - DNA, 25 bp, Rattus norvegicus
tgtggtgagtgcgaggtactaccct

SEQ ID NO: 650975 - DNA, 25 bp, Rattus norvegicus
tgtggtgatgaacgccagctccagc

SEQ ID NO: 650976 - DNA, 25 bp, Rattus norvegicus
tgtggtgatgaaggccagctccagc

SEQ ID NO: 650977 - DNA, 25 bp, Rattus norvegicus
tgtggtgcagccatcctgcccggga

SEQ ID NO: 650978 - DNA, 25 bp, Rattus norvegicus
tgtggtgcagccttcctgcccggga

SEQ ID NO: 650979 - DNA, 25 bp, Rattus norvegicus
tgtggtgcagtgagcacacccgtgc

SEQ ID NO: 650980 - DNA, 25 bp, Rattus norvegicus
tgtggtgcagtgtgcacacccgtgc

SEQ ID NO: 650981 - DNA, 25 bp, Rattus norvegicus
tgtggtgccagacattgagcttctt

SEQ ID NO: 650982 - DNA, 25 bp, Rattus norvegicus
tgtggtgccagagattgagcttctt

SEQ ID NO: 650983 - DNA, 25 bp, Rattus norvegicus
tgtggtgccattattactgccattt

SEQ ID NO: 650984 - DNA, 25 bp, Rattus norvegicus
tgtggtgccatttttactgccattt

SEQ ID NO: 650985 - DNA, 25 bp, Rattus norvegicus
tgtggtgcccagctgccagaaagca

SEQ ID NO: 650986 - DNA, 25 bp, Rattus norvegicus
tgtggtgcccaggtgccagaaagca

SEQ ID NO: 650987 - DNA, 25 bp, Rattus norvegicus
tgtggtgctgctcccctgggtacaa

SEQ ID NO: 650988 - DNA, 25 bp, Rattus norvegicus
tgtggtgctgctgccctgggtacaa

SEQ ID NO: 650989 - DNA, 25 bp, Rattus norvegicus
tgtggtgctggcatgtctccagaga

SEQ ID NO: 650990 - DNA, 25 bp, Rattus norvegicus
tgtggtgctggcttgtctccagaga

SEQ ID NO: 650991 - DNA, 25 bp, Rattus norvegicus
tgtggtgctgttaggtctctagaaa

SEQ ID NO: 650992 - DNA, 25 bp, Rattus norvegicus
tgtggtgctgtttggtctctagaaa

SEQ ID NO: 650993 - DNA, 25 bp, Rattus norvegicus
tgtggtggacctacctgttcagtct

SEQ ID NO: 650994 - DNA, 25 bp, Rattus norvegicus
tgtggtggaccttcctgttcagtct

SEQ ID NO: 650995 - DNA, 25 bp, Rattus norvegicus
tgtggtggaggtacctgcttctctc

SEQ ID NO: 650996 - DNA, 25 bp, Rattus norvegicus
tgtggtggaggttcctgcttctctc

SEQ ID NO: 650997 - DNA, 25 bp, Rattus norvegicus
tgtggtggagttaccttccccatga

SEQ ID NO: 650998 - DNA, 25 bp, Rattus norvegicus
tgtggtggagtttccttccccatga

SEQ ID NO: 650999 - DNA, 25 bp, Rattus norvegicus
tgtggtggatgccaagctgccaact

SEQ ID NO: 651000 - DNA, 25 bp, Rattus norvegicus
tgtggtggatgcgaagctgccaact

SEQ ID NO: 651001 - DNA, 25 bp, Rattus norvegicus
tgtggtggcataagctagagatagc

SEQ ID NO: 651002 - DNA, 25 bp, Rattus norvegicus
tgtggtggcatatgctagagatagc

SEQ ID NO: 651003 - DNA, 25 bp, Rattus norvegicus
tgtggtggcttcacagtcggcatcc

SEQ ID NO: 651004 - DNA, 25 bp, Rattus norvegicus
tgtggtggcttcagtcatgtgtcac

SEQ ID NO: 651005 - DNA, 25 bp, Rattus norvegicus
tgtggtggcttctcagtcggcatcc

SEQ ID NO: 651006 - DNA, 25 bp, Rattus norvegicus
tgtggtggcttctgtcatgtgtcac

SEQ ID NO: 651007 - DNA, 25 bp, Rattus norvegicus
tgtggtgggaatcaaacctgagtcc

SEQ ID NO: 651008 - DNA, 25 bp, Rattus norvegicus
tgtggtgggaatgaaacctgagtcc

SEQ ID NO: 651009 - DNA, 25 bp, Rattus norvegicus
tgtggtgggtctaccttctgctgct

SEQ ID NO: 651010 - DNA, 25 bp, Rattus norvegicus
tgtggtgggtcttccttctgctgct

SEQ ID NO: 651011 - DNA, 25 bp, Rattus norvegicus
tgtggtggtacccagactgtcaatc

SEQ ID NO: 651012 - DNA, 25 bp, Rattus norvegicus
tgtggtggtaccgagactgtcaatc

SEQ ID NO: 651013 - DNA, 25 bp, Rattus norvegicus
tgtggtggttgcacaggaccatcct

SEQ ID NO: 651014 - DNA, 25 bp, Rattus norvegicus
tgtggtggttgctcaggaccatcct

SEQ ID NO: 651015 - DNA, 25 bp, Rattus norvegicus
tgtggtgtaaagcatccgctcactg

SEQ ID NO: 651016 - DNA, 25 bp, Rattus norvegicus
tgtggtgtaaaggatccgctcactg

SEQ ID NO: 651017 - DNA, 25 bp, Rattus norvegicus
tgtggtgtaaccaagccattccgaa

SEQ ID NO: 651018 - DNA, 25 bp, Rattus norvegicus
tgtggtgtaacctagccattccgaa

SEQ ID NO: 651019 - DNA, 25 bp, Rattus norvegicus
tgtggtgtcacgaggtcatttcagc

SEQ ID NO: 651020 - DNA, 25 bp, Rattus norvegicus
tgtggtgtcacgtggtcatttcagc

SEQ ID NO: 651021 - DNA, 25 bp, Rattus norvegicus
tgtggtgtcatgatccagactcagc

SEQ ID NO: 651022 - DNA, 25 bp, Rattus norvegicus
tgtggtgtcatgttccagactcagc

SEQ ID NO: 651023 - DNA, 25 bp, Rattus norvegicus
tgtggtgtccttacacacatgtaat

SEQ ID NO: 651024 - DNA, 25 bp, Rattus norvegicus
tgtggtgtcctttcacacatgtaat

SEQ ID NO: 651025 - DNA, 25 bp, Rattus norvegicus
tgtggtgtctggctttcttaaggat

SEQ ID NO: 651026 - DNA, 25 bp, Rattus norvegicus
tgtggtgtctgggtttcttaaggat

SEQ ID NO: 651027 - DNA, 25 bp, Rattus norvegicus
tgtggtgtgatacccaacagtggcc

SEQ ID NO: 651028 - DNA, 25 bp, Rattus norvegicus
tgtggtgtgatagccaacagtggcc

SEQ ID NO: 651029 - DNA, 25 bp, Rattus norvegicus
tgtggtgtggccagtgtaacttact

SEQ ID NO: 651030 - DNA, 25 bp, Rattus norvegicus
tgtggtgtggcctgtgtaacttact

SEQ ID NO: 651031 - DNA, 25 bp, Rattus norvegicus
tgtggtgtgtccatcagttcttgac

SEQ ID NO: 651032 - DNA, 25 bp, Rattus norvegicus
tgtggtgtgtccttcagttcttgac

SEQ ID NO: 651033 - DNA, 25 bp, Rattus norvegicus
tgtggtgtgtctccatccctgagga

SEQ ID NO: 651034 - DNA, 25 bp, Rattus norvegicus
tgtggtgtgtctgcatccctgagga

SEQ ID NO: 651035 - DNA, 25 bp, Rattus norvegicus
tgtggtgtgtgacaagcagcccacc

SEQ ID NO: 651036 - DNA, 25 bp, Rattus norvegicus
tgtggtgtgtgagaagcagcccacc

SEQ ID NO: 651037 - DNA, 25 bp, Rattus norvegicus
tgtggtgttatactctctcttgttt

SEQ ID NO: 651038 - DNA, 25 bp, Rattus norvegicus
tgtggtgttatagtctctcttgttt

SEQ ID NO: 651039 - DNA, 25 bp, Rattus norvegicus
tgtggtgtttaaatggattcctttt

SEQ ID NO: 651040 - DNA, 25 bp, Rattus norvegicus
tgtggtgtttaattggattcctttt

SEQ ID NO: 651041 - DNA, 25 bp, Rattus norvegicus
tgtggtgtttccctaccaacccagc

SEQ ID NO: 651042 - DNA, 25 bp, Rattus norvegicus
tgtggtgtttccgtaccaacccagc

SEQ ID NO: 651043 - DNA, 25 bp, Rattus norvegicus
tgtggtgtttctaatgagcattgta

SEQ ID NO: 651044 - DNA, 25 bp, Rattus norvegicus
tgtggtgtttcttatgagcattgta

SEQ ID NO: 651045 - DNA, 25 bp, Rattus norvegicus
tgtggttaaaagaacatgccccgac

SEQ ID NO: 651046 - DNA, 25 bp, Rattus norvegicus
tgtggttaaaagtacatgccccgac

SEQ ID NO: 651047 - DNA, 25 bp, Rattus norvegicus
tgtggttaccacaagtctgttgagg

SEQ ID NO: 651048 - DNA, 25 bp, Rattus norvegicus
tgtggttaccactagtctgttgagg

SEQ ID NO: 651049 - DNA, 25 bp, Rattus norvegicus
tgtggttcaaacagcactgcgcgta

SEQ ID NO: 651050 - DNA, 25 bp, Rattus norvegicus
tgtggttcaaactgcactgcgcgta

SEQ ID NO: 651051 - DNA, 25 bp, Rattus norvegicus
tgtggttcaaggcagatatttttat

SEQ ID NO: 651052 - DNA, 25 bp, Rattus norvegicus
tgtggttcaagggagatatttttat

SEQ ID NO: 651053 - DNA, 25 bp, Rattus norvegicus
tgtggttcaccaacagtctgtaact

SEQ ID NO: 651054 - DNA, 25 bp, Rattus norvegicus
tgtggttcaccatcagtctgtaact

SEQ ID NO: 651055 - DNA, 25 bp, Rattus norvegicus
tgtggttcacccctgtaatcttgtt

SEQ ID NO: 651056 - DNA, 25 bp, Rattus norvegicus
tgtggttcacccgtgtaatcttgtt

SEQ ID NO: 651057 - DNA, 25 bp, Rattus norvegicus
tgtggttcacctcaccatacaagac

SEQ ID NO: 651058 - DNA, 25 bp, Rattus norvegicus
tgtggttcacctgaccatacaagac

SEQ ID NO: 651059 - DNA, 25 bp, Rattus norvegicus
tgtggttcacgcaggatcctcggca

SEQ ID NO: 651060 - DNA, 25 bp, Rattus norvegicus
tgtggttcacgctggatcctcggca

SEQ ID NO: 651061 - DNA, 25 bp, Rattus norvegicus
tgtggttcagagagcttttcttccc

SEQ ID NO: 651062 - DNA, 25 bp, Rattus norvegicus
tgtggttcagagtgcttttcttccc

SEQ ID NO: 651063 - DNA, 25 bp, Rattus norvegicus
tgtggttcagatctccttggctcct

SEQ ID NO: 651064 - DNA, 25 bp, Rattus norvegicus
tgtggttcagatgtccttggctcct

SEQ ID NO: 651065 - DNA, 25 bp, Rattus norvegicus
tgtggttccaacatcctaaatcatg

SEQ ID NO: 651066 - DNA, 25 bp, Rattus norvegicus
tgtggttccaacttcctaaatcatg

SEQ ID NO: 651067 - DNA, 25 bp, Rattus norvegicus
tgtggttcccatcctgagtttggaa

SEQ ID NO: 651068 - DNA, 25 bp, Rattus norvegicus
tgtggttcccatgctgagtttggaa

SEQ ID NO: 651069 - DNA, 25 bp, Rattus norvegicus
tgtggttccccaatactgtgccaag

SEQ ID NO: 651070 - DNA, 25 bp, Rattus norvegicus
tgtggttccccattactgtgccaag

SEQ ID NO: 651071 - DNA, 25 bp, Rattus norvegicus
tgtggttccttacacaagtcgctgt

SEQ ID NO: 651072 - DNA, 25 bp, Rattus norvegicus
tgtggttccttagacaagtcgctgt

SEQ ID NO: 651073 - DNA, 25 bp, Rattus norvegicus
tgtggttccttgctctggccttgaa

SEQ ID NO: 651074 - DNA, 25 bp, Rattus norvegicus
tgtggttccttggtctggccttgaa

SEQ ID NO: 651075 - DNA, 25 bp, Rattus norvegicus
tgtggttctcatcactgcagaggca

SEQ ID NO: 651076 - DNA, 25 bp, Rattus norvegicus
tgtggttctcatgactgcagaggca

SEQ ID NO: 651077 - DNA, 25 bp, Rattus norvegicus
tgtggttctgtgattcatctctaac

SEQ ID NO: 651078 - DNA, 25 bp, Rattus norvegicus
tgtggttctgtgtttcatctctaac

SEQ ID NO: 651079 - DNA, 25 bp, Rattus norvegicus
tgtggttgaccccatggcagagtat

SEQ ID NO: 651080 - DNA, 25 bp, Rattus norvegicus
tgtggttgacccgatggcagagtat

SEQ ID NO: 651081 - DNA, 25 bp, Rattus norvegicus
tgtggttgattactccaagtgagta

SEQ ID NO: 651082 - DNA, 25 bp, Rattus norvegicus
tgtggttgattagtccaagtgagta

SEQ ID NO: 651083 - DNA, 25 bp, Rattus norvegicus
tgtggttgccatatcttcccaaggc

SEQ ID NO: 651084 - DNA, 25 bp, Rattus norvegicus
tgtggttgccatttcttcccaaggc

SEQ ID NO: 651085 - DNA, 25 bp, Rattus norvegicus
tgtggttgccgacggcttcgtccaa

SEQ ID NO: 651086 - DNA, 25 bp, Rattus norvegicus
tgtggttgccgagggcttcgtccaa

SEQ ID NO: 651087 - DNA, 25 bp, Rattus norvegicus
tgtggttgcctacagtttacacagg

SEQ ID NO: 651088 - DNA, 25 bp, Rattus norvegicus
tgtggttgcctagagtttacacagg

SEQ ID NO: 651089 - DNA, 25 bp, Rattus norvegicus
tgtggttggaaactcactgcctcac

SEQ ID NO: 651090 - DNA, 25 bp, Rattus norvegicus
tgtggttggaaagtcactgcctcac

SEQ ID NO: 651091 - DNA, 25 bp, Rattus norvegicus
tgtggttggcatctttctggaataa

SEQ ID NO: 651092 - DNA, 25 bp, Rattus norvegicus
tgtggttggcatgtttctggaataa

SEQ ID NO: 651093 - DNA, 25 bp, Rattus norvegicus
tgtggttgggatcctgcctgacttc

SEQ ID NO: 651094 - DNA, 25 bp, Rattus norvegicus
tgtggttgggatgctgcctgacttc

SEQ ID NO: 651095 - DNA, 25 bp, Rattus norvegicus
tgtggttgtcacctgttcattccct

SEQ ID NO: 651096 - DNA, 25 bp, Rattus norvegicus
tgtggttgtcacgtgttcattccct

SEQ ID NO: 651097 - DNA, 25 bp, Rattus norvegicus
tgtggttgtcccctgggagacccta

SEQ ID NO: 651098 - DNA, 25 bp, Rattus norvegicus
tgtggttgtcccgtgggagacccta

SEQ ID NO: 651099 - DNA, 25 bp, Rattus norvegicus
tgtggttgtcttatattcattcccc

SEQ ID NO: 651100 - DNA, 25 bp, Rattus norvegicus
tgtggttgtcttttattcattcccc

SEQ ID NO: 651101 - DNA, 25 bp, Rattus norvegicus
tgtggttgtgacatccgcacagtaa

SEQ ID NO: 651102 - DNA, 25 bp, Rattus norvegicus
tgtggttgtgacttccgcacagtaa

SEQ ID NO: 651103 - DNA, 25 bp, Rattus norvegicus
tgtggttgttacagcgctgtttccc

SEQ ID NO: 651104 - DNA, 25 bp, Rattus norvegicus
tgtggttgttactgcgctgtttccc

SEQ ID NO: 651105 - DNA, 25 bp, Rattus norvegicus
tgtggttgttttacgttccaagact

SEQ ID NO: 651106 - DNA, 25 bp, Rattus norvegicus
tgtggttgtttttcgttccaagact

SEQ ID NO: 651107 - DNA, 25 bp, Rattus norvegicus
tgtggtttacttaccttttctgaat

SEQ ID NO: 651108 - DNA, 25 bp, Rattus norvegicus
tgtggtttactttccttttctgaat

SEQ ID NO: 651109 - DNA, 25 bp, Rattus norvegicus
tgtggtttcagcactggcccacgct

SEQ ID NO: 651110 - DNA, 25 bp, Rattus norvegicus
tgtggtttcagctctggcccacgct

SEQ ID NO: 651111 - DNA, 25 bp, Rattus norvegicus
tgtggtttcataaccaccctccaaa

SEQ ID NO: 651112 - DNA, 25 bp, Rattus norvegicus
tgtggtttcatatccaccctccaaa

SEQ ID NO: 651113 - DNA, 25 bp, Rattus norvegicus
tgtggtttcatcaatctcagctcag

SEQ ID NO: 651114 - DNA, 25 bp, Rattus norvegicus
tgtggtttcatctatctcagctcag

SEQ ID NO: 651115 - DNA, 25 bp, Rattus norvegicus
tgtggtttccagacaggacgtcaga

SEQ ID NO: 651116 - DNA, 25 bp, Rattus norvegicus
tgtggtttccagtcaggacgtcaga

SEQ ID NO: 651117 - DNA, 25 bp, Rattus norvegicus
tgtggtttctgcatagttcgagttc

SEQ ID NO: 651118 - DNA, 25 bp, Rattus norvegicus
tgtggtttctgcttagttcgagttc

SEQ ID NO: 651119 - DNA, 25 bp, Rattus norvegicus
tgtggtttgaacatcacttactcaa

SEQ ID NO: 651120 - DNA, 25 bp, Rattus norvegicus
tgtggtttgaacttcacttactcaa

SEQ ID NO: 651121 - DNA, 25 bp, Rattus norvegicus
tgtggtttgcctaatcagtgggtta

SEQ ID NO: 651122 - DNA, 25 bp, Rattus norvegicus
tgtggtttgccttatcagtgggtta

SEQ ID NO: 651123 - DNA, 25 bp, Rattus norvegicus
tgtggtttgtgccagtccccttaca

SEQ ID NO: 651124 - DNA, 25 bp, Rattus norvegicus
tgtggtttgtgcgagtccccttaca

SEQ ID NO: 651125 - DNA, 25 bp, Rattus norvegicus
tgtggttttagtcagttgcaggtct

SEQ ID NO: 651126 - DNA, 25 bp, Rattus norvegicus
tgtggttttagtgagttgcaggtct

SEQ ID NO: 651127 - DNA, 25 bp, Rattus norvegicus
tgtggttttcgacttgcgtctgtac

SEQ ID NO: 651128 - DNA, 25 bp, Rattus norvegicus
tgtggttttcgagttgcgtctgtac

SEQ ID NO: 651129 - DNA, 25 bp, Rattus norvegicus
tgtggttttctacattttaggcact

SEQ ID NO: 651130 - DNA, 25 bp, Rattus norvegicus
tgtggttttctacccttaccttcag

SEQ ID NO: 651131 - DNA, 25 bp, Rattus norvegicus
tgtggttttctagattttaggcact

SEQ ID NO: 651132 - DNA, 25 bp, Rattus norvegicus
tgtggttttctagccttaccttcag

SEQ ID NO: 651133 - DNA, 25 bp, Rattus norvegicus
tgtggttttgctagactcgcaggac

SEQ ID NO: 651134 - DNA, 25 bp, Rattus norvegicus
tgtggttttgcttgactcgcaggac

SEQ ID NO: 651135 - DNA, 25 bp, Rattus norvegicus
tgtggttttggaaggcctcttagcc

SEQ ID NO: 651136 - DNA, 25 bp, Rattus norvegicus
tgtggttttggatggcctcttagcc

SEQ ID NO: 651137 - DNA, 25 bp, Rattus norvegicus
tgtggttttgttcgcacctgttacc

SEQ ID NO: 651138 - DNA, 25 bp, Rattus norvegicus
tgtggttttgttggcacctgttacc

SEQ ID NO: 651139 - DNA, 25 bp, Rattus norvegicus
tgtggtttttctcgagaacctcctt

SEQ ID NO: 651140 - DNA, 25 bp, Rattus norvegicus
tgtggtttttctggagaacctcctt

SEQ ID NO: 651141 - DNA, 25 bp, Rattus norvegicus
tgtgtaaaccagctggctttgaact

SEQ ID NO: 651142 - DNA, 25 bp, Rattus norvegicus
tgtgtaaaccaggtggctttgaact

SEQ ID NO: 651143 - DNA, 25 bp, Rattus norvegicus
tgtgtaaacttcagcctttccttag

SEQ ID NO: 651144 - DNA, 25 bp, Rattus norvegicus
tgtgtaaacttctgcctttccttag

SEQ ID NO: 651145 - DNA, 25 bp, Rattus norvegicus
tgtgtaaaggccaggttcccagcca

SEQ ID NO: 651146 - DNA, 25 bp, Rattus norvegicus
tgtgtaaaggcctggttcccagcca

SEQ ID NO: 651147 - DNA, 25 bp, Rattus norvegicus
tgtgtaaatgcacccgcccacgttc

SEQ ID NO: 651148 - DNA, 25 bp, Rattus norvegicus
tgtgtaaatgcagccgcccacgttc

SEQ ID NO: 651149 - DNA, 25 bp, Rattus norvegicus
tgtgtaaccacaaccactcatacgg

SEQ ID NO: 651150 - DNA, 25 bp, Rattus norvegicus
tgtgtaaccacatccactcatacgg

SEQ ID NO: 651151 - DNA, 25 bp, Rattus norvegicus
tgtgtaaccccgacttaataagaga

SEQ ID NO: 651152 - DNA, 25 bp, Rattus norvegicus
tgtgtaaccccgtcttaataagaga

SEQ ID NO: 651153 - DNA, 25 bp, Rattus norvegicus
tgtgtaacccctcacatactcattc

SEQ ID NO: 651154 - DNA, 25 bp, Rattus norvegicus
tgtgtaacccctgacatactcattc

SEQ ID NO: 651155 - DNA, 25 bp, Rattus norvegicus
tgtgtaagaagaccctcagctcttt

SEQ ID NO: 651156 - DNA, 25 bp, Rattus norvegicus
tgtgtaagaagagcctcagctcttt

SEQ ID NO: 651157 - DNA, 25 bp, Rattus norvegicus
tgtgtaagtcatcttctacgccagc

SEQ ID NO: 651158 - DNA, 25 bp, Rattus norvegicus
tgtgtaagtcatgttctacgccagc

SEQ ID NO: 651159 - DNA, 25 bp, Rattus norvegicus
tgtgtaagtcttatcctgtaggtac

SEQ ID NO: 651160 - DNA, 25 bp, Rattus norvegicus
tgtgtaagtcttttcctgtaggtac

SEQ ID NO: 651161 - DNA, 25 bp, Rattus norvegicus
tgtgtaagtgtcatcccctggcctt

SEQ ID NO: 651162 - DNA, 25 bp, Rattus norvegicus
tgtgtaagtgtcttcccctggcctt

SEQ ID NO: 651163 - DNA, 25 bp, Rattus norvegicus
tgtgtaagtttacaacccgcccaca

SEQ ID NO: 651164 - DNA, 25 bp, Rattus norvegicus
tgtgtaagtttagaacccgcccaca

SEQ ID NO: 651165 - DNA, 25 bp, Rattus norvegicus
tgtgtaataccaccacagcttacgg

SEQ ID NO: 651166 - DNA, 25 bp, Rattus norvegicus
tgtgtaataccagcacagcttacgg

SEQ ID NO: 651167 - DNA, 25 bp, Rattus norvegicus
tgtgtacaacatccccatgcaaaga

SEQ ID NO: 651168 - DNA, 25 bp, Rattus norvegicus
tgtgtacaacatgcccatgcaaaga

SEQ ID NO: 651169 - DNA, 25 bp, Rattus norvegicus
tgtgtacaacggatctgctggcagt

SEQ ID NO: 651170 - DNA, 25 bp, Rattus norvegicus
tgtgtacaacggttctgctggcagt

SEQ ID NO: 651171 - DNA, 25 bp, Rattus norvegicus
tgtgtacacacaaccagccaaacga

SEQ ID NO: 651172 - DNA, 25 bp, Rattus norvegicus
tgtgtacacacatccagccaaacga

SEQ ID NO: 651173 - DNA, 25 bp, Rattus norvegicus
tgtgtacacagcaagaaaagatcgg

SEQ ID NO: 651174 - DNA, 25 bp, Rattus norvegicus
tgtgtacacagccttagacgaccct

SEQ ID NO: 651175 - DNA, 25 bp, Rattus norvegicus
tgtgtacacagcgttagacgaccct

SEQ ID NO: 651176 - DNA, 25 bp, Rattus norvegicus
tgtgtacacagctagaaaagatcgg

SEQ ID NO: 651177 - DNA, 25 bp, Rattus norvegicus
tgtgtacactcacgctccagaatca

SEQ ID NO: 651178 - DNA, 25 bp, Rattus norvegicus
tgtgtacactcaggctccagaatca

SEQ ID NO: 651179 - DNA, 25 bp, Rattus norvegicus
tgtgtacactgacgcctagcagcca

SEQ ID NO: 651180 - DNA, 25 bp, Rattus norvegicus
tgtgtacactgaggcctagcagcca

SEQ ID NO: 651181 - DNA, 25 bp, Rattus norvegicus
tgtgtacagagtagacttcatgccc

SEQ ID NO: 651182 - DNA, 25 bp, Rattus norvegicus
tgtgtacagagttgacttcatgccc

SEQ ID NO: 651183 - DNA, 25 bp, Rattus norvegicus
tgtgtacagcatctcccggatggct

SEQ ID NO: 651184 - DNA, 25 bp, Rattus norvegicus
tgtgtacagcatgtcccggatggct

SEQ ID NO: 651185 - DNA, 25 bp, Rattus norvegicus
tgtgtacagggcagtgtgtcatata

SEQ ID NO: 651186 - DNA, 25 bp, Rattus norvegicus
tgtgtacagggctgtgtgtcatata

SEQ ID NO: 651187 - DNA, 25 bp, Rattus norvegicus
tgtgtacatccaaacctcctgtcta

SEQ ID NO: 651188 - DNA, 25 bp, Rattus norvegicus
tgtgtacatccaattcttctttcat

SEQ ID NO: 651189 - DNA, 25 bp, Rattus norvegicus
tgtgtacatccatacctcctgtcta

SEQ ID NO: 651190 - DNA, 25 bp, Rattus norvegicus
tgtgtacatccatttcttctttcat

SEQ ID NO: 651191 - DNA, 25 bp, Rattus norvegicus
tgtgtacatgcaattttctttcttt

SEQ ID NO: 651192 - DNA, 25 bp, Rattus norvegicus
tgtgtacatgcatttttctttcttt

SEQ ID NO: 651193 - DNA, 25 bp, Rattus norvegicus
tgtgtaccattgagcctgggcccaa

SEQ ID NO: 651194 - DNA, 25 bp, Rattus norvegicus
tgtgtaccattgtgcctgggcccaa

SEQ ID NO: 651195 - DNA, 25 bp, Rattus norvegicus
tgtgtacccataatcaagagcatct

SEQ ID NO: 651196 - DNA, 25 bp, Rattus norvegicus
tgtgtacccatattcaagagcatct

SEQ ID NO: 651197 - DNA, 25 bp, Rattus norvegicus
tgtgtacccgacctgaacataggct

SEQ ID NO: 651198 - DNA, 25 bp, Rattus norvegicus
tgtgtacccgacgtgaacataggct

SEQ ID NO: 651199 - DNA, 25 bp, Rattus norvegicus
tgtgtaccggacaaacaaacccaag

SEQ ID NO: 651200 - DNA, 25 bp, Rattus norvegicus
tgtgtaccggactaacaaacccaag

SEQ ID NO: 651201 - DNA, 25 bp, Rattus norvegicus
tgtgtaccgtccaagttactttctg

SEQ ID NO: 651202 - DNA, 25 bp, Rattus norvegicus
tgtgtaccgtcctagttactttctg

SEQ ID NO: 651203 - DNA, 25 bp, Rattus norvegicus
tgtgtacctcacagcaggtggtatg

SEQ ID NO: 651204 - DNA, 25 bp, Rattus norvegicus
tgtgtacctcactgcaggtggtatg

SEQ ID NO: 651205 - DNA, 25 bp, Rattus norvegicus
tgtgtacctccacatgcacatacac

SEQ ID NO: 651206 - DNA, 25 bp, Rattus norvegicus
tgtgtacctccagatgcacatacac

SEQ ID NO: 651207 - DNA, 25 bp, Rattus norvegicus
tgtgtacctcttatgaatctttccc

SEQ ID NO: 651208 - DNA, 25 bp, Rattus norvegicus
tgtgtacctcttttgaatctttccc

SEQ ID NO: 651209 - DNA, 25 bp, Rattus norvegicus
tgtgtacctggtaccgggctagtga

SEQ ID NO: 651210 - DNA, 25 bp, Rattus norvegicus
tgtgtacctggttccgggctagtga

SEQ ID NO: 651211 - DNA, 25 bp, Rattus norvegicus
tgtgtacctgtgatttatcatcccc

SEQ ID NO: 651212 - DNA, 25 bp, Rattus norvegicus
tgtgtacctgtgttttatcatcccc

SEQ ID NO: 651213 - DNA, 25 bp, Rattus norvegicus
tgtgtaccttgacttccagaacaga

SEQ ID NO: 651214 - DNA, 25 bp, Rattus norvegicus
tgtgtaccttgagttccagaacaga

SEQ ID NO: 651215 - DNA, 25 bp, Rattus norvegicus
tgtgtacgcacgatcctgtcctaaa

SEQ ID NO: 651216 - DNA, 25 bp, Rattus norvegicus
tgtgtacgcacgttcctgtcctaaa

SEQ ID NO: 651217 - DNA, 25 bp, Rattus norvegicus
tgtgtactacaacccactggtctac

SEQ ID NO: 651218 - DNA, 25 bp, Rattus norvegicus
tgtgtactacaagccactggtctac

SEQ ID NO: 651219 - DNA, 25 bp, Rattus norvegicus
tgtgtactacatctgggcagtgccc

SEQ ID NO: 651220 - DNA, 25 bp, Rattus norvegicus
tgtgtactacatgtgggcagtgccc

SEQ ID NO: 651221 - DNA, 25 bp, Rattus norvegicus
tgtgtactcaccacaggcttctgca

SEQ ID NO: 651222 - DNA, 25 bp, Rattus norvegicus
tgtgtactcacctcaggcttctgca

SEQ ID NO: 651223 - DNA, 25 bp, Rattus norvegicus
tgtgtactctcaattctacttcagg

SEQ ID NO: 651224 - DNA, 25 bp, Rattus norvegicus
tgtgtactctcatttctacttcagg

SEQ ID NO: 651225 - DNA, 25 bp, Rattus norvegicus
tgtgtactctgtcttcttctctgct

SEQ ID NO: 651226 - DNA, 25 bp, Rattus norvegicus
tgtgtactctgtgttcttctctgct

SEQ ID NO: 651227 - DNA, 25 bp, Rattus norvegicus
tgtgtactctttagctgttaccctg

SEQ ID NO: 651228 - DNA, 25 bp, Rattus norvegicus
tgtgtactcttttgctgttaccctg

SEQ ID NO: 651229 - DNA, 25 bp, Rattus norvegicus
tgtgtacttacacagggtttcagca

SEQ ID NO: 651230 - DNA, 25 bp, Rattus norvegicus
tgtgtacttacagagggtttcagca

SEQ ID NO: 651231 - DNA, 25 bp, Rattus norvegicus
tgtgtacttctaattcctttgccag

SEQ ID NO: 651232 - DNA, 25 bp, Rattus norvegicus
tgtgtacttctatttcctttgccag

SEQ ID NO: 651233 - DNA, 25 bp, Rattus norvegicus
tgtgtagaacacaggcaatatggat

SEQ ID NO: 651234 - DNA, 25 bp, Rattus norvegicus
tgtgtagaacactggcaatatggat

SEQ ID NO: 651235 - DNA, 25 bp, Rattus norvegicus
tgtgtagacaatatactccctgccc

SEQ ID NO: 651236 - DNA, 25 bp, Rattus norvegicus
tgtgtagacaatttactccctgccc

SEQ ID NO: 651237 - DNA, 25 bp, Rattus norvegicus
tgtgtagacccactgcactatgaag

SEQ ID NO: 651238 - DNA, 25 bp, Rattus norvegicus
tgtgtagacccagtgcactatgaag

SEQ ID NO: 651239 - DNA, 25 bp, Rattus norvegicus
tgtgtagcaaaaacccgagcaccaa

SEQ ID NO: 651240 - DNA, 25 bp, Rattus norvegicus
tgtgtagcaaaatcccgagcaccaa

SEQ ID NO: 651241 - DNA, 25 bp, Rattus norvegicus
tgtgtagcatagatgccctgcccaa

SEQ ID NO: 651242 - DNA, 25 bp, Rattus norvegicus
tgtgtagcatagttgccctgcccaa

SEQ ID NO: 651243 - DNA, 25 bp, Rattus norvegicus
tgtgtagccagcatctgaccatcag

SEQ ID NO: 651244 - DNA, 25 bp, Rattus norvegicus
tgtgtagccagcttctgaccatcag

SEQ ID NO: 651245 - DNA, 25 bp, Rattus norvegicus
tgtgtagcccctcggaaaacacgaa

SEQ ID NO: 651246 - DNA, 25 bp, Rattus norvegicus
tgtgtagcccctgggaaaacacgaa

SEQ ID NO: 651247 - DNA, 25 bp, Rattus norvegicus
tgtgtagccctcatctgttttttca

SEQ ID NO: 651248 - DNA, 25 bp, Rattus norvegicus
tgtgtagccctcttctgttttttca

SEQ ID NO: 651249 - DNA, 25 bp, Rattus norvegicus
tgtgtagccttcatgatcctggaac

SEQ ID NO: 651250 - DNA, 25 bp, Rattus norvegicus
tgtgtagccttcttgatcctggaac

SEQ ID NO: 651251 - DNA, 25 bp, Rattus norvegicus
tgtgtagcttaaatgtcttcctgcc

SEQ ID NO: 651252 - DNA, 25 bp, Rattus norvegicus
tgtgtagcttaattgtcttcctgcc

SEQ ID NO: 651253 - DNA, 25 bp, Rattus norvegicus
tgtgtaggaggaaactccctcacct

SEQ ID NO: 651254 - DNA, 25 bp, Rattus norvegicus
tgtgtaggaggacaccctgccttta

SEQ ID NO: 651255 - DNA, 25 bp, Rattus norvegicus
tgtgtaggaggagaccctgccttta

SEQ ID NO: 651256 - DNA, 25 bp, Rattus norvegicus
tgtgtaggaggatactccctcacct

SEQ ID NO: 651257 - DNA, 25 bp, Rattus norvegicus
tgtgtaggctcgcttcctgcgcacg

SEQ ID NO: 651258 - DNA, 25 bp, Rattus norvegicus
tgtgtaggctcggttcctgcgcacg

SEQ ID NO: 651259 - DNA, 25 bp, Rattus norvegicus
tgtgtagggatcatggccatctcct

SEQ ID NO: 651260 - DNA, 25 bp, Rattus norvegicus
tgtgtagggatcttggccatctcct

SEQ ID NO: 651261 - DNA, 25 bp, Rattus norvegicus
tgtgtagggctgcacacagcccaca

SEQ ID NO: 651262 - DNA, 25 bp, Rattus norvegicus
tgtgtagggctggacacagcccaca

SEQ ID NO: 651263 - DNA, 25 bp, Rattus norvegicus
tgtgtagggtagcttttccgcccaa

SEQ ID NO: 651264 - DNA, 25 bp, Rattus norvegicus
tgtgtagggtaggttttccgcccaa

SEQ ID NO: 651265 - DNA, 25 bp, Rattus norvegicus
tgtgtagggtgcagggcacctcaca

SEQ ID NO: 651266 - DNA, 25 bp, Rattus norvegicus
tgtgtagggtgctgggcacctcaca

SEQ ID NO: 651267 - DNA, 25 bp, Rattus norvegicus
tgtgtagtacatcattttacccact

SEQ ID NO: 651268 - DNA, 25 bp, Rattus norvegicus
tgtgtagtacatgattttacccact

SEQ ID NO: 651269 - DNA, 25 bp, Rattus norvegicus
tgtgtagtagtgagtgagccctcag

SEQ ID NO: 651270 - DNA, 25 bp, Rattus norvegicus
tgtgtagtagtgtgtgagccctcag

SEQ ID NO: 651271 - DNA, 25 bp, Rattus norvegicus
tgtgtagtatcacctctgcccagga

SEQ ID NO: 651272 - DNA, 25 bp, Rattus norvegicus
tgtgtagtatcagctctgcccagga

SEQ ID NO: 651273 - DNA, 25 bp, Rattus norvegicus
tgtgtagtctgcagctccatatggg

SEQ ID NO: 651274 - DNA, 25 bp, Rattus norvegicus
tgtgtagtctgctgctccatatggg

SEQ ID NO: 651275 - DNA, 25 bp, Rattus norvegicus
tgtgtagtgcttacgacatgatttt

SEQ ID NO: 651276 - DNA, 25 bp, Rattus norvegicus
tgtgtagtgctttcgacatgatttt

SEQ ID NO: 651277 - DNA, 25 bp, Rattus norvegicus
tgtgtataattgcacttttagtttg

SEQ ID NO: 651278 - DNA, 25 bp, Rattus norvegicus
tgtgtataattggacttttagtttg

SEQ ID NO: 651279 - DNA, 25 bp, Rattus norvegicus
tgtgtataatttacctcccagtagg

SEQ ID NO: 651280 - DNA, 25 bp, Rattus norvegicus
tgtgtataattttcctcccagtagg

SEQ ID NO: 651281 - DNA, 25 bp, Rattus norvegicus
tgtgtatacaacaccctggctgttg

SEQ ID NO: 651282 - DNA, 25 bp, Rattus norvegicus
tgtgtatacaactccctggctgttg

SEQ ID NO: 651283 - DNA, 25 bp, Rattus norvegicus
tgtgtatacacactgctcatgcacc

SEQ ID NO: 651284 - DNA, 25 bp, Rattus norvegicus
tgtgtatacacagtgctcatgcacc

SEQ ID NO: 651285 - DNA, 25 bp, Rattus norvegicus
tgtgtatacttactgcctgcttgag

SEQ ID NO: 651286 - DNA, 25 bp, Rattus norvegicus
tgtgtatacttagtgcctgcttgag

SEQ ID NO: 651287 - DNA, 25 bp, Rattus norvegicus
tgtgtatagcaaacaggactttctg

SEQ ID NO: 651288 - DNA, 25 bp, Rattus norvegicus
tgtgtatagcaatcaggactttctg

SEQ ID NO: 651289 - DNA, 25 bp, Rattus norvegicus
tgtgtatattctcaaggcttcttat

SEQ ID NO: 651290 - DNA, 25 bp, Rattus norvegicus
tgtgtatattctgaaggcttcttat

SEQ ID NO: 651291 - DNA, 25 bp, Rattus norvegicus
tgtgtatattttccttcacccacgc

SEQ ID NO: 651292 - DNA, 25 bp, Rattus norvegicus
tgtgtatattttgcttcacccacgc

SEQ ID NO: 651293 - DNA, 25 bp, Rattus norvegicus
tgtgtatcacctaggcagttgtggg

SEQ ID NO: 651294 - DNA, 25 bp, Rattus norvegicus
tgtgtatcaccttggcagttgtggg

SEQ ID NO: 651295 - DNA, 25 bp, Rattus norvegicus
tgtgtatccagtcatgctcggctag

SEQ ID NO: 651296 - DNA, 25 bp, Rattus norvegicus
tgtgtatccagtgatgctcggctag

SEQ ID NO: 651297 - DNA, 25 bp, Rattus norvegicus
tgtgtatcctttctcagtgctttgc

SEQ ID NO: 651298 - DNA, 25 bp, Rattus norvegicus
tgtgtatcctttgtcagtgctttgc

SEQ ID NO: 651299 - DNA, 25 bp, Rattus norvegicus
tgtgtatctgctattgtgatgccaa

SEQ ID NO: 651300 - DNA, 25 bp, Rattus norvegicus
tgtgtatctgcttttgtgatgccaa

SEQ ID NO: 651301 - DNA, 25 bp, Rattus norvegicus
tgtgtatgcagaagcccagaggcca

SEQ ID NO: 651302 - DNA, 25 bp, Rattus norvegicus
tgtgtatgcagatgcccagaggcca

SEQ ID NO: 651303 - DNA, 25 bp, Rattus norvegicus
tgtgtatgcatcatcagtccctata

SEQ ID NO: 651304 - DNA, 25 bp, Rattus norvegicus
tgtgtatgcatcttcagtccctata

SEQ ID NO: 651305 - DNA, 25 bp, Rattus norvegicus
tgtgtatggccaagttctcatttcg

SEQ ID NO: 651306 - DNA, 25 bp, Rattus norvegicus
tgtgtatggccatgttctcatttcg

SEQ ID NO: 651307 - DNA, 25 bp, Rattus norvegicus
tgtgtatgggtaattcatctgcatg

SEQ ID NO: 651308 - DNA, 25 bp, Rattus norvegicus
tgtgtatgggtatttcatctgcatg

SEQ ID NO: 651309 - DNA, 25 bp, Rattus norvegicus
tgtgtatgtggacgcaaccgtccgt

SEQ ID NO: 651310 - DNA, 25 bp, Rattus norvegicus
tgtgtatgtggaggcaaccgtccgt

SEQ ID NO: 651311 - DNA, 25 bp, Rattus norvegicus
tgtgtatgtgtcagatctgctacct

SEQ ID NO: 651312 - DNA, 25 bp, Rattus norvegicus
tgtgtatgtgtctgatctgctacct

SEQ ID NO: 651313 - DNA, 25 bp, Rattus norvegicus
tgtgtatgttctcccctgctccttt

SEQ ID NO: 651314 - DNA, 25 bp, Rattus norvegicus
tgtgtatgttctgccctgctccttt

SEQ ID NO: 651315 - DNA, 25 bp, Rattus norvegicus
tgtgtatgttgaactttaacccgtt

SEQ ID NO: 651316 - DNA, 25 bp, Rattus norvegicus
tgtgtatgttgatctttaacccgtt

SEQ ID NO: 651317 - DNA, 25 bp, Rattus norvegicus
tgtgtatgtttccatgtccatgaac

SEQ ID NO: 651318 - DNA, 25 bp, Rattus norvegicus
tgtgtatgtttcgatgtccatgaac

SEQ ID NO: 651319 - DNA, 25 bp, Rattus norvegicus
tgtgtatgttttacttcctaaggtt

SEQ ID NO: 651320 - DNA, 25 bp, Rattus norvegicus
tgtgtatgtttttcttcctaaggtt

SEQ ID NO: 651321 - DNA, 25 bp, Rattus norvegicus
tgtgtattaactatttcctcatccc

SEQ ID NO: 651322 - DNA, 25 bp, Rattus norvegicus
tgtgtattaactttttcctcatccc

SEQ ID NO: 651323 - DNA, 25 bp, Rattus norvegicus
tgtgtattcacacgaaacccctggt

SEQ ID NO: 651324 - DNA, 25 bp, Rattus norvegicus
tgtgtattcacaggaaacccctggt

SEQ ID NO: 651325 - DNA, 25 bp, Rattus norvegicus
tgtgtattccggcttttgttcttgg

SEQ ID NO: 651326 - DNA, 25 bp, Rattus norvegicus
tgtgtattccgggttttgttcttgg

SEQ ID NO: 651327 - DNA, 25 bp, Rattus norvegicus
tgtgtattctgcattctccatgaga

SEQ ID NO: 651328 - DNA, 25 bp, Rattus norvegicus
tgtgtattctgctttctccatgaga

SEQ ID NO: 651329 - DNA, 25 bp, Rattus norvegicus
tgtgtattgagaccctgtatttgct

SEQ ID NO: 651330 - DNA, 25 bp, Rattus norvegicus
tgtgtattgagagcctgtatttgct

SEQ ID NO: 651331 - DNA, 25 bp, Rattus norvegicus
tgtgtattgtacctgctatgcttaa

SEQ ID NO: 651332 - DNA, 25 bp, Rattus norvegicus
tgtgtattgtacgtgctatgcttaa

SEQ ID NO: 651333 - DNA, 25 bp, Rattus norvegicus
tgtgtattgttaccttcaggcagat

SEQ ID NO: 651334 - DNA, 25 bp, Rattus norvegicus
tgtgtattgttagcttcaggcagat

SEQ ID NO: 651335 - DNA, 25 bp, Rattus norvegicus
tgtgtatttaggacagcagggcagc

SEQ ID NO: 651336 - DNA, 25 bp, Rattus norvegicus
tgtgtatttaggtcagcagggcagc

SEQ ID NO: 651337 - DNA, 25 bp, Rattus norvegicus
tgtgtatttcctagcttgagtctca

SEQ ID NO: 651338 - DNA, 25 bp, Rattus norvegicus
tgtgtatttccttgcttgagtctca

SEQ ID NO: 651339 - DNA, 25 bp, Rattus norvegicus
tgtgtattttcactgtcccctgtca

SEQ ID NO: 651340 - DNA, 25 bp, Rattus norvegicus
tgtgtattttcagtgtcccctgtca

SEQ ID NO: 651341 - DNA, 25 bp, Rattus norvegicus
tgtgtatttttccatagtcccacct

SEQ ID NO: 651342 - DNA, 25 bp, Rattus norvegicus
tgtgtatttttcgatagtcccacct

SEQ ID NO: 651343 - DNA, 25 bp, Rattus norvegicus
tgtgtcaaaaccaattctgcttcag

SEQ ID NO: 651344 - DNA, 25 bp, Rattus norvegicus
tgtgtcaaaacctattctgcttcag

SEQ ID NO: 651345 - DNA, 25 bp, Rattus norvegicus
tgtgtcaaaccaactatctgcagag

SEQ ID NO: 651346 - DNA, 25 bp, Rattus norvegicus
tgtgtcaaaccatctatctgcagag

SEQ ID NO: 651347 - DNA, 25 bp, Rattus norvegicus
tgtgtcaaagacacccaaatcagaa

SEQ ID NO: 651348 - DNA, 25 bp, Rattus norvegicus
tgtgtcaaagactcccaaatcagaa

SEQ ID NO: 651349 - DNA, 25 bp, Rattus norvegicus
tgtgtcaaccgacgcactcaaacca

SEQ ID NO: 651350 - DNA, 25 bp, Rattus norvegicus
tgtgtcaaccgaggcactcaaacca

SEQ ID NO: 651351 - DNA, 25 bp, Rattus norvegicus
tgtgtcaaggacagcgaactcccgt

SEQ ID NO: 651352 - DNA, 25 bp, Rattus norvegicus
tgtgtcaaggactgcgaactcccgt

SEQ ID NO: 651353 - DNA, 25 bp, Rattus norvegicus
tgtgtcaaggccagcctcagtgata

SEQ ID NO: 651354 - DNA, 25 bp, Rattus norvegicus
tgtgtcaaggcctgcctcagtgata

SEQ ID NO: 651355 - DNA, 25 bp, Rattus norvegicus
tgtgtcaagtaacccggaacattcc

SEQ ID NO: 651356 - DNA, 25 bp, Rattus norvegicus
tgtgtcaagtaagccggaacattcc

SEQ ID NO: 651357 - DNA, 25 bp, Rattus norvegicus
tgtgtcaagtggcaaagctgttctt

SEQ ID NO: 651358 - DNA, 25 bp, Rattus norvegicus
tgtgtcaagtgggaaagctgttctt

SEQ ID NO: 651359 - DNA, 25 bp, Rattus norvegicus
tgtgtcaatcctaacgaatcttgta

SEQ ID NO: 651360 - DNA, 25 bp, Rattus norvegicus
tgtgtcaatccttacgaatcttgta

SEQ ID NO: 651361 - DNA, 25 bp, Rattus norvegicus
tgtgtcacacatcccaggtgatgtg

SEQ ID NO: 651362 - DNA, 25 bp, Rattus norvegicus
tgtgtcacacatgccaggtgatgtg

SEQ ID NO: 651363 - DNA, 25 bp, Rattus norvegicus
tgtgtcacccacctttgggagaaga

SEQ ID NO: 651364 - DNA, 25 bp, Rattus norvegicus
tgtgtcacccacgtttgggagaaga

SEQ ID NO: 651365 - DNA, 25 bp, Rattus norvegicus
tgtgtcacctgcattttgggaccct

SEQ ID NO: 651366 - DNA, 25 bp, Rattus norvegicus
tgtgtcacctgctttttgggaccct

SEQ ID NO: 651367 - DNA, 25 bp, Rattus norvegicus
tgtgtcacctggcattcttgttgaa

SEQ ID NO: 651368 - DNA, 25 bp, Rattus norvegicus
tgtgtcacctgggattcttgttgaa

SEQ ID NO: 651369 - DNA, 25 bp, Rattus norvegicus
tgtgtcaccttcatctgtcaacata

SEQ ID NO: 651370 - DNA, 25 bp, Rattus norvegicus
tgtgtcaccttcttctgtcaacata

SEQ ID NO: 651371 - DNA, 25 bp, Rattus norvegicus
tgtgtcacggtgatagctatcagcc

SEQ ID NO: 651372 - DNA, 25 bp, Rattus norvegicus
tgtgtcacggtgttagctatcagcc

SEQ ID NO: 651373 - DNA, 25 bp, Rattus norvegicus
tgtgtcacgtggaggtcggaacctt

SEQ ID NO: 651374 - DNA, 25 bp, Rattus norvegicus
tgtgtcacgtggtggtcggaacctt

SEQ ID NO: 651375 - DNA, 25 bp, Rattus norvegicus
tgtgtcactgaaaaactcaccccag

SEQ ID NO: 651376 - DNA, 25 bp, Rattus norvegicus
tgtgtcactgaataactcaccccag

SEQ ID NO: 651377 - DNA, 25 bp, Rattus norvegicus
tgtgtcacttggctgatttgctgac

SEQ ID NO: 651378 - DNA, 25 bp, Rattus norvegicus
tgtgtcacttggctggttcggtcta

SEQ ID NO: 651379 - DNA, 25 bp, Rattus norvegicus
tgtgtcacttgggtgatttgctgac

SEQ ID NO: 651380 - DNA, 25 bp, Rattus norvegicus
tgtgtcacttgggtggttcggtcta

SEQ ID NO: 651381 - DNA, 25 bp, Rattus norvegicus
tgtgtcactttcactgagccgggaa

SEQ ID NO: 651382 - DNA, 25 bp, Rattus norvegicus
tgtgtcactttctctgagccgggaa

SEQ ID NO: 651383 - DNA, 25 bp, Rattus norvegicus
tgtgtcagaagaccatggctccggt

SEQ ID NO: 651384 - DNA, 25 bp, Rattus norvegicus
tgtgtcagaagagcatggctccggt

SEQ ID NO: 651385 - DNA, 25 bp, Rattus norvegicus
tgtgtcagaccaaacaagtgcctct

SEQ ID NO: 651386 - DNA, 25 bp, Rattus norvegicus
tgtgtcagaccatacaagtgcctct

SEQ ID NO: 651387 - DNA, 25 bp, Rattus norvegicus
tgtgtcagcagaatggttaattccc

SEQ ID NO: 651388 - DNA, 25 bp, Rattus norvegicus
tgtgtcagcagattggttaattccc

SEQ ID NO: 651389 - DNA, 25 bp, Rattus norvegicus
tgtgtcagccctacagagtttctgg

SEQ ID NO: 651390 - DNA, 25 bp, Rattus norvegicus
tgtgtcagcccttcagagtttctgg

SEQ ID NO: 651391 - DNA, 25 bp, Rattus norvegicus
tgtgtcaggcgcctttgcagctctc

SEQ ID NO: 651392 - DNA, 25 bp, Rattus norvegicus
tgtgtcaggcgcgtttgcagctctc

SEQ ID NO: 651393 - DNA, 25 bp, Rattus norvegicus
tgtgtcaggtgactgagcccatgtc

SEQ ID NO: 651394 - DNA, 25 bp, Rattus norvegicus
tgtgtcaggtgagtgagcccatgtc

SEQ ID NO: 651395 - DNA, 25 bp, Rattus norvegicus
tgtgtcagtcacaagccatgggctt

SEQ ID NO: 651396 - DNA, 25 bp, Rattus norvegicus
tgtgtcagtcactagccatgggctt

SEQ ID NO: 651397 - DNA, 25 bp, Rattus norvegicus
tgtgtcataatacaacaatttctgt

SEQ ID NO: 651398 - DNA, 25 bp, Rattus norvegicus
tgtgtcataatagaacaatttctgt

SEQ ID NO: 651399 - DNA, 25 bp, Rattus norvegicus
tgtgtcatacagcaggcaatccctt

SEQ ID NO: 651400 - DNA, 25 bp, Rattus norvegicus
tgtgtcatacaggaggcaatccctt

SEQ ID NO: 651401 - DNA, 25 bp, Rattus norvegicus
tgtgtcatcaccagggtctcctctc

SEQ ID NO: 651402 - DNA, 25 bp, Rattus norvegicus
tgtgtcatcacctgggtctcctctc

SEQ ID NO: 651403 - DNA, 25 bp, Rattus norvegicus
tgtgtcatcagtcaggcactgttct

SEQ ID NO: 651404 - DNA, 25 bp, Rattus norvegicus
tgtgtcatcagtgaggcactgttct

SEQ ID NO: 651405 - DNA, 25 bp, Rattus norvegicus
tgtgtcatccaaataacccattctc

SEQ ID NO: 651406 - DNA, 25 bp, Rattus norvegicus
tgtgtcatccaattaacccattctc

SEQ ID NO: 651407 - DNA, 25 bp, Rattus norvegicus
tgtgtcatctcccagcaagtcggtg

SEQ ID NO: 651408 - DNA, 25 bp, Rattus norvegicus
tgtgtcatctccgagcaagtcggtg

SEQ ID NO: 651409 - DNA, 25 bp, Rattus norvegicus
tgtgtcatgagcactgcttccaagc

SEQ ID NO: 651410 - DNA, 25 bp, Rattus norvegicus
tgtgtcatgagctctgcttccaagc

SEQ ID NO: 651411 - DNA, 25 bp, Rattus norvegicus
tgtgtcatgataaggctcagccatt

SEQ ID NO: 651412 - DNA, 25 bp, Rattus norvegicus
tgtgtcatgatatggctcagccatt

SEQ ID NO: 651413 - DNA, 25 bp, Rattus norvegicus
tgtgtcatgatcctgagttgtcgca

SEQ ID NO: 651414 - DNA, 25 bp, Rattus norvegicus
tgtgtcatgatcgtgagttgtcgca

SEQ ID NO: 651415 - DNA, 25 bp, Rattus norvegicus
tgtgtcatggcccattcatgtctta

SEQ ID NO: 651416 - DNA, 25 bp, Rattus norvegicus
tgtgtcatggccgattcatgtctta

SEQ ID NO: 651417 - DNA, 25 bp, Rattus norvegicus
tgtgtcatttcaattacaaagacga

SEQ ID NO: 651418 - DNA, 25 bp, Rattus norvegicus
tgtgtcatttcatttacaaagacga

SEQ ID NO: 651419 - DNA, 25 bp, Rattus norvegicus
tgtgtccaaacactgccagaagcag

SEQ ID NO: 651420 - DNA, 25 bp, Rattus norvegicus
tgtgtccaaacagtgccagaagcag

SEQ ID NO: 651421 - DNA, 25 bp, Rattus norvegicus
tgtgtccaacagaagccctcaggaa

SEQ ID NO: 651422 - DNA, 25 bp, Rattus norvegicus
tgtgtccaacagtagccctcaggaa

SEQ ID NO: 651423 - DNA, 25 bp, Rattus norvegicus
tgtgtccaactaagaagggcaaggg

SEQ ID NO: 651424 - DNA, 25 bp, Rattus norvegicus
tgtgtccaactatgaagggcaaggg

SEQ ID NO: 651425 - DNA, 25 bp, Rattus norvegicus
tgtgtccacagaagtcaaccccaag

SEQ ID NO: 651426 - DNA, 25 bp, Rattus norvegicus
tgtgtccacagatgtcaaccccaag

SEQ ID NO: 651427 - DNA, 25 bp, Rattus norvegicus
tgtgtccacatgcatttctacccat

SEQ ID NO: 651428 - DNA, 25 bp, Rattus norvegicus
tgtgtccacatggatttctacccat

SEQ ID NO: 651429 - DNA, 25 bp, Rattus norvegicus
tgtgtccagcaaaggcagtcgggtt

SEQ ID NO: 651430 - DNA, 25 bp, Rattus norvegicus
tgtgtccagcaatggcagtcgggtt

SEQ ID NO: 651431 - DNA, 25 bp, Rattus norvegicus
tgtgtccagcctctaattccaatta

SEQ ID NO: 651432 - DNA, 25 bp, Rattus norvegicus
tgtgtccagcctgtaattccaatta

SEQ ID NO: 651433 - DNA, 25 bp, Rattus norvegicus
tgtgtccagctcagacaacactacg

SEQ ID NO: 651434 - DNA, 25 bp, Rattus norvegicus
tgtgtccagctctgacaacactacg

SEQ ID NO: 651435 - DNA, 25 bp, Rattus norvegicus
tgtgtccagtatctttgctattttg

SEQ ID NO: 651436 - DNA, 25 bp, Rattus norvegicus
tgtgtccagtatgtttgctattttg

SEQ ID NO: 651437 - DNA, 25 bp, Rattus norvegicus
tgtgtccatcagatcagcctaaaaa

SEQ ID NO: 651438 - DNA, 25 bp, Rattus norvegicus
tgtgtccatcagttcagcctaaaaa

SEQ ID NO: 651439 - DNA, 25 bp, Rattus norvegicus
tgtgtcccagccatttcaaaatgta

SEQ ID NO: 651440 - DNA, 25 bp, Rattus norvegicus
tgtgtcccagccttttcaaaatgta

SEQ ID NO: 651441 - DNA, 25 bp, Rattus norvegicus
tgtgtcccagcgctgccttgtgcaa

SEQ ID NO: 651442 - DNA, 25 bp, Rattus norvegicus
tgtgtcccagcggtgccttgtgcaa

SEQ ID NO: 651443 - DNA, 25 bp, Rattus norvegicus
tgtgtcccagtcacatccaactata

SEQ ID NO: 651444 - DNA, 25 bp, Rattus norvegicus
tgtgtcccagtcagccctcaaacat

SEQ ID NO: 651445 - DNA, 25 bp, Rattus norvegicus
tgtgtcccagtctcatccaactata

SEQ ID NO: 651446 - DNA, 25 bp, Rattus norvegicus
tgtgtcccagtctgccctcaaacat

SEQ ID NO: 651447 - DNA, 25 bp, Rattus norvegicus
tgtgtcccagtgaaccatccaatgt

SEQ ID NO: 651448 - DNA, 25 bp, Rattus norvegicus
tgtgtcccagtgtaccatccaatgt

SEQ ID NO: 651449 - DNA, 25 bp, Rattus norvegicus
tgtgtcccagttacatccaatttta

SEQ ID NO: 651450 - DNA, 25 bp, Rattus norvegicus
tgtgtcccagtttcatccaatttta

SEQ ID NO: 651451 - DNA, 25 bp, Rattus norvegicus
tgtgtcccatcaagcctgaaacagc

SEQ ID NO: 651452 - DNA, 25 bp, Rattus norvegicus
tgtgtcccatcatgcctgaaacagc

SEQ ID NO: 651453 - DNA, 25 bp, Rattus norvegicus
tgtgtccccaagaacccattactga

SEQ ID NO: 651454 - DNA, 25 bp, Rattus norvegicus
tgtgtccccaagtacccattactga

SEQ ID NO: 651455 - DNA, 25 bp, Rattus norvegicus
tgtgtccccaatacttatctggtaa

SEQ ID NO: 651456 - DNA, 25 bp, Rattus norvegicus
tgtgtccccaattcttatctggtaa

SEQ ID NO: 651457 - DNA, 25 bp, Rattus norvegicus
tgtgtccccacaatcactgatttga

SEQ ID NO: 651458 - DNA, 25 bp, Rattus norvegicus
tgtgtccccacattcactgatttga

SEQ ID NO: 651459 - DNA, 25 bp, Rattus norvegicus
tgtgtcccctcacccaggaaaggag

SEQ ID NO: 651460 - DNA, 25 bp, Rattus norvegicus
tgtgtcccctcagccaggaaaggag

SEQ ID NO: 651461 - DNA, 25 bp, Rattus norvegicus
tgtgtcccctgtacatgcacgggaa

SEQ ID NO: 651462 - DNA, 25 bp, Rattus norvegicus
tgtgtcccctgtccaatatctgttc

SEQ ID NO: 651463 - DNA, 25 bp, Rattus norvegicus
tgtgtcccctgtgcaatatctgttc

SEQ ID NO: 651464 - DNA, 25 bp, Rattus norvegicus
tgtgtcccctgttcatgcacgggaa

SEQ ID NO: 651465 - DNA, 25 bp, Rattus norvegicus
tgtgtcccgatcacaccaggcagct

SEQ ID NO: 651466 - DNA, 25 bp, Rattus norvegicus
tgtgtcccgatctcaccaggcagct

SEQ ID NO: 651467 - DNA, 25 bp, Rattus norvegicus
tgtgtcccgcatcatcattgaagaa

SEQ ID NO: 651468 - DNA, 25 bp, Rattus norvegicus
tgtgtcccgcatgatcattgaagaa

SEQ ID NO: 651469 - DNA, 25 bp, Rattus norvegicus
tgtgtcccgtgaacttttgctctat

SEQ ID NO: 651470 - DNA, 25 bp, Rattus norvegicus
tgtgtcccgtgatcttttgctctat

SEQ ID NO: 651471 - DNA, 25 bp, Rattus norvegicus
tgtgtccctaagaccttgggagcag

SEQ ID NO: 651472 - DNA, 25 bp, Rattus norvegicus
tgtgtccctaagtccttgggagcag

SEQ ID NO: 651473 - DNA, 25 bp, Rattus norvegicus
tgtgtccctcaactgctctagaaac

SEQ ID NO: 651474 - DNA, 25 bp, Rattus norvegicus
tgtgtccctcaagtgctctagaaac

SEQ ID NO: 651475 - DNA, 25 bp, Rattus norvegicus
tgtgtccctcatacaactagaccaa

SEQ ID NO: 651476 - DNA, 25 bp, Rattus norvegicus
tgtgtccctcattcaactagaccaa

SEQ ID NO: 651477 - DNA, 25 bp, Rattus norvegicus
tgtgtccgaatcagctccaagtctt

SEQ ID NO: 651478 - DNA, 25 bp, Rattus norvegicus
tgtgtccgaatctgctccaagtctt

SEQ ID NO: 651479 - DNA, 25 bp, Rattus norvegicus
tgtgtccgtctcacggatgagggtc

SEQ ID NO: 651480 - DNA, 25 bp, Rattus norvegicus
tgtgtccgtctctcggatgagggtc

SEQ ID NO: 651481 - DNA, 25 bp, Rattus norvegicus
tgtgtccgtctgatgtacatgttca

SEQ ID NO: 651482 - DNA, 25 bp, Rattus norvegicus
tgtgtccgtctgttgtacatgttca

SEQ ID NO: 651483 - DNA, 25 bp, Rattus norvegicus
tgtgtcctacagagtgtcctgcaat

SEQ ID NO: 651484 - DNA, 25 bp, Rattus norvegicus
tgtgtcctacagtgtgtcctgcaat

SEQ ID NO: 651485 - DNA, 25 bp, Rattus norvegicus
tgtgtcctactgatttctcttgcta

SEQ ID NO: 651486 - DNA, 25 bp, Rattus norvegicus
tgtgtcctactgttttctcttgcta

SEQ ID NO: 651487 - DNA, 25 bp, Rattus norvegicus
tgtgtcctatggcacctcagagctt

SEQ ID NO: 651488 - DNA, 25 bp, Rattus norvegicus
tgtgtcctatgggacctcagagctt

SEQ ID NO: 651489 - DNA, 25 bp, Rattus norvegicus
tgtgtcctcagtctcctcagtggtc

SEQ ID NO: 651490 - DNA, 25 bp, Rattus norvegicus
tgtgtcctcagtgtcctcagtggtc

SEQ ID NO: 651491 - DNA, 25 bp, Rattus norvegicus
tgtgtcctcctgagcaagcttctta

SEQ ID NO: 651492 - DNA, 25 bp, Rattus norvegicus
tgtgtcctcctgtgcaagcttctta

SEQ ID NO: 651493 - DNA, 25 bp, Rattus norvegicus
tgtgtcctgagtaccagcgctggga

SEQ ID NO: 651494 - DNA, 25 bp, Rattus norvegicus
tgtgtcctgagttccagcgctggga

SEQ ID NO: 651495 - DNA, 25 bp, Rattus norvegicus
tgtgtcctgctgaagcctcaagtga

SEQ ID NO: 651496 - DNA, 25 bp, Rattus norvegicus
tgtgtcctgctgcagaatctgccca

SEQ ID NO: 651497 - DNA, 25 bp, Rattus norvegicus
tgtgtcctgctggagaatctgccca

SEQ ID NO: 651498 - DNA, 25 bp, Rattus norvegicus
tgtgtcctgctgtagcctcaagtga

SEQ ID NO: 651499 - DNA, 25 bp, Rattus norvegicus
tgtgtcctgcttaggtggttaatct

SEQ ID NO: 651500 - DNA, 25 bp, Rattus norvegicus
tgtgtcctgctttggtggttaatct

SEQ ID NO: 651501 - DNA, 25 bp, Rattus norvegicus
tgtgtcctggagctctggtagaatc

SEQ ID NO: 651502 - DNA, 25 bp, Rattus norvegicus
tgtgtcctggaggtctggtagaatc

SEQ ID NO: 651503 - DNA, 25 bp, Rattus norvegicus
tgtgtcctggatctgagcaagtcgc

SEQ ID NO: 651504 - DNA, 25 bp, Rattus norvegicus
tgtgtcctggatgtgagcaagtcgc

SEQ ID NO: 651505 - DNA, 25 bp, Rattus norvegicus
tgtgtcctgggtacggtgcattcca

SEQ ID NO: 651506 - DNA, 25 bp, Rattus norvegicus
tgtgtcctgggttcggtgcattcca

SEQ ID NO: 651507 - DNA, 25 bp, Rattus norvegicus
tgtgtcctgtccctcggatttcaca

SEQ ID NO: 651508 - DNA, 25 bp, Rattus norvegicus
tgtgtcctgtccgtcggatttcaca

SEQ ID NO: 651509 - DNA, 25 bp, Rattus norvegicus
tgtgtcctgtctatgtttcatacca

SEQ ID NO: 651510 - DNA, 25 bp, Rattus norvegicus
tgtgtcctgtctttgtttcatacca

SEQ ID NO: 651511 - DNA, 25 bp, Rattus norvegicus
tgtgtcctgtgcattccctgatttt

SEQ ID NO: 651512 - DNA, 25 bp, Rattus norvegicus
tgtgtcctgtgctttccctgatttt

SEQ ID NO: 651513 - DNA, 25 bp, Rattus norvegicus
tgtgtcctgttgctgtctcgtttat

SEQ ID NO: 651514 - DNA, 25 bp, Rattus norvegicus
tgtgtcctgttggtgtctcgtttat

SEQ ID NO: 651515 - DNA, 25 bp, Rattus norvegicus
tgtgtcctttttacaccaacctggt

SEQ ID NO: 651516 - DNA, 25 bp, Rattus norvegicus
tgtgtccttttttcaccaacctggt

SEQ ID NO: 651517 - DNA, 25 bp, Rattus norvegicus
tgtgtcgattttagtcagctcccca

SEQ ID NO: 651518 - DNA, 25 bp, Rattus norvegicus
tgtgtcgatttttgtcagctcccca

SEQ ID NO: 651519 - DNA, 25 bp, Rattus norvegicus
tgtgtcgccccacggctgagaaaag

SEQ ID NO: 651520 - DNA, 25 bp, Rattus norvegicus
tgtgtcgccccagggctgagaaaag

SEQ ID NO: 651521 - DNA, 25 bp, Rattus norvegicus
tgtgtcgccttgagaaccgctacga

SEQ ID NO: 651522 - DNA, 25 bp, Rattus norvegicus
tgtgtcgccttgtgaaccgctacga

SEQ ID NO: 651523 - DNA, 25 bp, Rattus norvegicus
tgtgtcgggactcgctccaaccgga

SEQ ID NO: 651524 - DNA, 25 bp, Rattus norvegicus
tgtgtcgggactggctccaaccgga

SEQ ID NO: 651525 - DNA, 25 bp, Rattus norvegicus
tgtgtcggtggaactctctacagat

SEQ ID NO: 651526 - DNA, 25 bp, Rattus norvegicus
tgtgtcggtggatctctctacagat

SEQ ID NO: 651527 - DNA, 25 bp, Rattus norvegicus
tgtgtcggtttgaccaggaccactt

SEQ ID NO: 651528 - DNA, 25 bp, Rattus norvegicus
tgtgtcggtttgtccaggaccactt

SEQ ID NO: 651529 - DNA, 25 bp, Rattus norvegicus
tgtgtcgtccagaaagatgaataaa

SEQ ID NO: 651530 - DNA, 25 bp, Rattus norvegicus
tgtgtcgtccagtaagatgaataaa

SEQ ID NO: 651531 - DNA, 25 bp, Rattus norvegicus
tgtgtcgtctcacttgctgctgcct

SEQ ID NO: 651532 - DNA, 25 bp, Rattus norvegicus
tgtgtcgtctcagttgctgctgcct

SEQ ID NO: 651533 - DNA, 25 bp, Rattus norvegicus
tgtgtcgtctttatgcttttcctga

SEQ ID NO: 651534 - DNA, 25 bp, Rattus norvegicus
tgtgtcgtctttttgcttttcctga

SEQ ID NO: 651535 - DNA, 25 bp, Rattus norvegicus
tgtgtcgtgcagctggctctacaat

SEQ ID NO: 651536 - DNA, 25 bp, Rattus norvegicus
tgtgtcgtgcaggtggctctacaat

SEQ ID NO: 651537 - DNA, 25 bp, Rattus norvegicus
tgtgtcgtggttaagctactcagtg

SEQ ID NO: 651538 - DNA, 25 bp, Rattus norvegicus
tgtgtcgtggtttagctactcagtg

SEQ ID NO: 651539 - DNA, 25 bp, Rattus norvegicus
tgtgtcgtgtgtaaggcattcttct

SEQ ID NO: 651540 - DNA, 25 bp, Rattus norvegicus
tgtgtcgtgtgttaggcattcttct

SEQ ID NO: 651541 - DNA, 25 bp, Rattus norvegicus
tgtgtcgtgtttcaccttggcccag

SEQ ID NO: 651542 - DNA, 25 bp, Rattus norvegicus
tgtgtcgtgtttgaccttggcccag

SEQ ID NO: 651543 - DNA, 25 bp, Rattus norvegicus
tgtgtcgttctgatgctgcaaatca

SEQ ID NO: 651544 - DNA, 25 bp, Rattus norvegicus
tgtgtcgttctgttgctgcaaatca

SEQ ID NO: 651545 - DNA, 25 bp, Rattus norvegicus
tgtgtctacatcaacactacctctt

SEQ ID NO: 651546 - DNA, 25 bp, Rattus norvegicus
tgtgtctacatctacactacctctt

SEQ ID NO: 651547 - DNA, 25 bp, Rattus norvegicus
tgtgtctaccacacagatttcactg

SEQ ID NO: 651548 - DNA, 25 bp, Rattus norvegicus
tgtgtctaccactcagatttcactg

SEQ ID NO: 651549 - DNA, 25 bp, Rattus norvegicus
tgtgtctacccaacgtcgatgatga

SEQ ID NO: 651550 - DNA, 25 bp, Rattus norvegicus
tgtgtctacccaagagtttcttcca

SEQ ID NO: 651551 - DNA, 25 bp, Rattus norvegicus
tgtgtctacccatcgtcgatgatga

SEQ ID NO: 651552 - DNA, 25 bp, Rattus norvegicus
tgtgtctacccatgagtttcttcca

SEQ ID NO: 651553 - DNA, 25 bp, Rattus norvegicus
tgtgtctaccttcgactccaggaga

SEQ ID NO: 651554 - DNA, 25 bp, Rattus norvegicus
tgtgtctaccttggactccaggaga

SEQ ID NO: 651555 - DNA, 25 bp, Rattus norvegicus
tgtgtctactaacgaccagcacttg

SEQ ID NO: 651556 - DNA, 25 bp, Rattus norvegicus
tgtgtctactaaggaccagcacttg

SEQ ID NO: 651557 - DNA, 25 bp, Rattus norvegicus
tgtgtctactccaagactcctaaag

SEQ ID NO: 651558 - DNA, 25 bp, Rattus norvegicus
tgtgtctactccagtttataccttc

SEQ ID NO: 651559 - DNA, 25 bp, Rattus norvegicus
tgtgtctactcctagactcctaaag

SEQ ID NO: 651560 - DNA, 25 bp, Rattus norvegicus
tgtgtctactcctgtttataccttc

SEQ ID NO: 651561 - DNA, 25 bp, Rattus norvegicus
tgtgtctactctaccttgagactta

SEQ ID NO: 651562 - DNA, 25 bp, Rattus norvegicus
tgtgtctactcttccttgagactta

SEQ ID NO: 651563 - DNA, 25 bp, Rattus norvegicus
tgtgtctagcccacccagttatcta

SEQ ID NO: 651564 - DNA, 25 bp, Rattus norvegicus
tgtgtctagccctcccagttatcta

SEQ ID NO: 651565 - DNA, 25 bp, Rattus norvegicus
tgtgtctagtccacattatctgcat

SEQ ID NO: 651566 - DNA, 25 bp, Rattus norvegicus
tgtgtctagtcctcattatctgcat

SEQ ID NO: 651567 - DNA, 25 bp, Rattus norvegicus
tgtgtctatagccagtaccttgtgt

SEQ ID NO: 651568 - DNA, 25 bp, Rattus norvegicus
tgtgtctatagcgagtaccttgtgt

SEQ ID NO: 651569 - DNA, 25 bp, Rattus norvegicus
tgtgtctatttcatacgtgccttgt

SEQ ID NO: 651570 - DNA, 25 bp, Rattus norvegicus
tgtgtctatttcttacgtgccttgt

SEQ ID NO: 651571 - DNA, 25 bp, Rattus norvegicus
tgtgtctcaccaagaatcctgccta

SEQ ID NO: 651572 - DNA, 25 bp, Rattus norvegicus
tgtgtctcaccatgaatcctgccta

SEQ ID NO: 651573 - DNA, 25 bp, Rattus norvegicus
tgtgtctcagatcggtaaagtcgtt

SEQ ID NO: 651574 - DNA, 25 bp, Rattus norvegicus
tgtgtctcagatgggtaaagtcgtt

SEQ ID NO: 651575 - DNA, 25 bp, Rattus norvegicus
tgtgtctcatctcctggactctaga

SEQ ID NO: 651576 - DNA, 25 bp, Rattus norvegicus
tgtgtctcatctgctggactctaga

SEQ ID NO: 651577 - DNA, 25 bp, Rattus norvegicus
tgtgtctcatgtcatcatccctgtt

SEQ ID NO: 651578 - DNA, 25 bp, Rattus norvegicus
tgtgtctcatgtgatcatccctgtt

SEQ ID NO: 651579 - DNA, 25 bp, Rattus norvegicus
tgtgtctccaccactactgaatagt

SEQ ID NO: 651580 - DNA, 25 bp, Rattus norvegicus
tgtgtctccacctctactgaatagt

SEQ ID NO: 651581 - DNA, 25 bp, Rattus norvegicus
tgtgtctccggcagtaggtaaagac

SEQ ID NO: 651582 - DNA, 25 bp, Rattus norvegicus
tgtgtctccggctgtaggtaaagac

SEQ ID NO: 651583 - DNA, 25 bp, Rattus norvegicus
tgtgtctccgttagtagctttggat

SEQ ID NO: 651584 - DNA, 25 bp, Rattus norvegicus
tgtgtctccgtttgtagctttggat

SEQ ID NO: 651585 - DNA, 25 bp, Rattus norvegicus
tgtgtctcctacagtgaccgcaggc

SEQ ID NO: 651586 - DNA, 25 bp, Rattus norvegicus
tgtgtctcctactgtgaccgcaggc

SEQ ID NO: 651587 - DNA, 25 bp, Rattus norvegicus
tgtgtctctagcagctgccgggagt

SEQ ID NO: 651588 - DNA, 25 bp, Rattus norvegicus
tgtgtctctagctgctgccgggagt

SEQ ID NO: 651589 - DNA, 25 bp, Rattus norvegicus
tgtgtctctctcagtgtatgtgtgt

SEQ ID NO: 651590 - DNA, 25 bp, Rattus norvegicus
tgtgtctctctctgtgtatgtgtgt

SEQ ID NO: 651591 - DNA, 25 bp, Rattus norvegicus
tgtgtctctctgagcgattctgtct

SEQ ID NO: 651592 - DNA, 25 bp, Rattus norvegicus
tgtgtctctctgtgcgattctgtct

SEQ ID NO: 651593 - DNA, 25 bp, Rattus norvegicus
tgtgtctctgacagtgggcccggat

SEQ ID NO: 651594 - DNA, 25 bp, Rattus norvegicus
tgtgtctctgactgtgggcccggat

SEQ ID NO: 651595 - DNA, 25 bp, Rattus norvegicus
tgtgtctcttcgacagctgttctca

SEQ ID NO: 651596 - DNA, 25 bp, Rattus norvegicus
tgtgtctcttcgtcagctgttctca

SEQ ID NO: 651597 - DNA, 25 bp, Rattus norvegicus
tgtgtctgaagcagtctcccaagca

SEQ ID NO: 651598 - DNA, 25 bp, Rattus norvegicus
tgtgtctgaagctgtctcccaagca

SEQ ID NO: 651599 - DNA, 25 bp, Rattus norvegicus
tgtgtctgagacatttcctgtctac

SEQ ID NO: 651600 - DNA, 25 bp, Rattus norvegicus
tgtgtctgagacttttcctgtctac

SEQ ID NO: 651601 - DNA, 25 bp, Rattus norvegicus
tgtgtctgatctcctacctgtgtgg

SEQ ID NO: 651602 - DNA, 25 bp, Rattus norvegicus
tgtgtctgatctgctacctgtgtgg

SEQ ID NO: 651603 - DNA, 25 bp, Rattus norvegicus
tgtgtctgcatgcacactaccagct

SEQ ID NO: 651604 - DNA, 25 bp, Rattus norvegicus
tgtgtctgcatggacactaccagct

SEQ ID NO: 651605 - DNA, 25 bp, Rattus norvegicus
tgtgtctgcattcttcctgaaggga

SEQ ID NO: 651606 - DNA, 25 bp, Rattus norvegicus
tgtgtctgcattgttcctgaaggga

SEQ ID NO: 651607 - DNA, 25 bp, Rattus norvegicus
tgtgtctgctcaaagctcatgctaa

SEQ ID NO: 651608 - DNA, 25 bp, Rattus norvegicus
tgtgtctgctcacctttttagtcta

SEQ ID NO: 651609 - DNA, 25 bp, Rattus norvegicus
tgtgtctgctcagctttttagtcta

SEQ ID NO: 651610 - DNA, 25 bp, Rattus norvegicus
tgtgtctgctcatagctcatgctaa

SEQ ID NO: 651611 - DNA, 25 bp, Rattus norvegicus
tgtgtctgctgcaaggtccctcctt

SEQ ID NO: 651612 - DNA, 25 bp, Rattus norvegicus
tgtgtctgctgctaggtccctcctt

SEQ ID NO: 651613 - DNA, 25 bp, Rattus norvegicus
tgtgtctgcttacatcctggagggc

SEQ ID NO: 651614 - DNA, 25 bp, Rattus norvegicus
tgtgtctgcttagatcctggagggc

SEQ ID NO: 651615 - DNA, 25 bp, Rattus norvegicus
tgtgtctggactcctctgtaagcaa

SEQ ID NO: 651616 - DNA, 25 bp, Rattus norvegicus
tgtgtctggactgctctgtaagcaa

SEQ ID NO: 651617 - DNA, 25 bp, Rattus norvegicus
tgtgtctggcaaccctcaagctcag

SEQ ID NO: 651618 - DNA, 25 bp, Rattus norvegicus
tgtgtctggcaagcctcaagctcag

SEQ ID NO: 651619 - DNA, 25 bp, Rattus norvegicus
tgtgtctgggtaaggctcatctgta

SEQ ID NO: 651620 - DNA, 25 bp, Rattus norvegicus
tgtgtctgggtacggcattatgtct

SEQ ID NO: 651621 - DNA, 25 bp, Rattus norvegicus
tgtgtctgggtagggcattatgtct

SEQ ID NO: 651622 - DNA, 25 bp, Rattus norvegicus
tgtgtctgggtatggctcatctgta

SEQ ID NO: 651623 - DNA, 25 bp, Rattus norvegicus
tgtgtctgtacaaatccttttaaca

SEQ ID NO: 651624 - DNA, 25 bp, Rattus norvegicus
tgtgtctgtacatatccttttaaca

SEQ ID NO: 651625 - DNA, 25 bp, Rattus norvegicus
tgtgtctgtcagaagtcaccctggg

SEQ ID NO: 651626 - DNA, 25 bp, Rattus norvegicus
tgtgtctgtcagtagtcaccctggg

SEQ ID NO: 651627 - DNA, 25 bp, Rattus norvegicus
tgtgtctgtctacatgtcgacccta

SEQ ID NO: 651628 - DNA, 25 bp, Rattus norvegicus
tgtgtctgtctagatgtcgacccta

SEQ ID NO: 651629 - DNA, 25 bp, Rattus norvegicus
tgtgtctgtgacacccatgaaaatc

SEQ ID NO: 651630 - DNA, 25 bp, Rattus norvegicus
tgtgtctgtgactcccatgaaaatc

SEQ ID NO: 651631 - DNA, 25 bp, Rattus norvegicus
tgtgtctgtggactcaaccaaccat

SEQ ID NO: 651632 - DNA, 25 bp, Rattus norvegicus
tgtgtctgtggagtcaaccaaccat

SEQ ID NO: 651633 - DNA, 25 bp, Rattus norvegicus
tgtgtctgtggcaatcaatggaact

SEQ ID NO: 651634 - DNA, 25 bp, Rattus norvegicus
tgtgtctgtggctatcaatggaact

SEQ ID NO: 651635 - DNA, 25 bp, Rattus norvegicus
tgtgtctgtgtaagggtaccccatc

SEQ ID NO: 651636 - DNA, 25 bp, Rattus norvegicus
tgtgtctgtgtatgggtaccccatc

SEQ ID NO: 651637 - DNA, 25 bp, Rattus norvegicus
tgtgtctgtttgaccatcctgctta

SEQ ID NO: 651638 - DNA, 25 bp, Rattus norvegicus
tgtgtctgtttgtccatcctgctta

SEQ ID NO: 651639 - DNA, 25 bp, Rattus norvegicus
tgtgtcttcacaaggagccagcaag

SEQ ID NO: 651640 - DNA, 25 bp, Rattus norvegicus
tgtgtcttcacatggagccagcaag

SEQ ID NO: 651641 - DNA, 25 bp, Rattus norvegicus
tgtgtcttccatagtgtttgtgtgt

SEQ ID NO: 651642 - DNA, 25 bp, Rattus norvegicus
tgtgtcttccattgtgtttgtgtgt

SEQ ID NO: 651643 - DNA, 25 bp, Rattus norvegicus
tgtgtcttctcactggaaagtccca

SEQ ID NO: 651644 - DNA, 25 bp, Rattus norvegicus
tgtgtcttctcagtggaaagtccca

SEQ ID NO: 651645 - DNA, 25 bp, Rattus norvegicus
tgtgtcttctctaaggcttcagcag

SEQ ID NO: 651646 - DNA, 25 bp, Rattus norvegicus
tgtgtcttctcttaggcttcagcag

SEQ ID NO: 651647 - DNA, 25 bp, Rattus norvegicus
tgtgtcttctgaacatgctggctgt

SEQ ID NO: 651648 - DNA, 25 bp, Rattus norvegicus
tgtgtcttctgaccattctggttgt

SEQ ID NO: 651649 - DNA, 25 bp, Rattus norvegicus
tgtgtcttctgagcattctggttgt

SEQ ID NO: 651650 - DNA, 25 bp, Rattus norvegicus
tgtgtcttctgatcatgctggctgt

SEQ ID NO: 651651 - DNA, 25 bp, Rattus norvegicus
tgtgtcttgcataggaggtctgtgt

SEQ ID NO: 651652 - DNA, 25 bp, Rattus norvegicus
tgtgtcttgcattggaggtctgtgt

SEQ ID NO: 651653 - DNA, 25 bp, Rattus norvegicus
tgtgtcttgggtatccaggcagatc

SEQ ID NO: 651654 - DNA, 25 bp, Rattus norvegicus
tgtgtcttgggtttccaggcagatc

SEQ ID NO: 651655 - DNA, 25 bp, Rattus norvegicus
tgtgtctttagtagcgtggctacgc

SEQ ID NO: 651656 - DNA, 25 bp, Rattus norvegicus
tgtgtctttagttgcgtggctacgc

SEQ ID NO: 651657 - DNA, 25 bp, Rattus norvegicus
tgtgtctttattacctctgctagaa

SEQ ID NO: 651658 - DNA, 25 bp, Rattus norvegicus
tgtgtctttatttcctctgctagaa

SEQ ID NO: 651659 - DNA, 25 bp, Rattus norvegicus
tgtgtctttggacccagcaaaagct

SEQ ID NO: 651660 - DNA, 25 bp, Rattus norvegicus
tgtgtctttggagccagcaaaagct

SEQ ID NO: 651661 - DNA, 25 bp, Rattus norvegicus
tgtgtctttgtactgtgatgtccct

SEQ ID NO: 651662 - DNA, 25 bp, Rattus norvegicus
tgtgtctttgtagtgtgatgtccct

SEQ ID NO: 651663 - DNA, 25 bp, Rattus norvegicus
tgtgtgaaaaggacatgccgggttt

SEQ ID NO: 651664 - DNA, 25 bp, Rattus norvegicus
tgtgtgaaaaggtcatgccgggttt

SEQ ID NO: 651665 - DNA, 25 bp, Rattus norvegicus
tgtgtgaacacaaccacatccacag

SEQ ID NO: 651666 - DNA, 25 bp, Rattus norvegicus
tgtgtgaacacatccacatccacag

SEQ ID NO: 651667 - DNA, 25 bp, Rattus norvegicus
tgtgtgaaccgacatgcaggtcgct

SEQ ID NO: 651668 - DNA, 25 bp, Rattus norvegicus
tgtgtgaaccgagatgcaggtcgct

SEQ ID NO: 651669 - DNA, 25 bp, Rattus norvegicus
tgtgtgaaccttcggagcaagcgct

SEQ ID NO: 651670 - DNA, 25 bp, Rattus norvegicus
tgtgtgaaccttgggagcaagcgct

SEQ ID NO: 651671 - DNA, 25 bp, Rattus norvegicus
tgtgtgaagaaccttttcccaaaag

SEQ ID NO: 651672 - DNA, 25 bp, Rattus norvegicus
tgtgtgaagaacgttttcccaaaag

SEQ ID NO: 651673 - DNA, 25 bp, Rattus norvegicus
tgtgtgaattccatagactcgcaga

SEQ ID NO: 651674 - DNA, 25 bp, Rattus norvegicus
tgtgtgaattccttagactcgcaga

SEQ ID NO: 651675 - DNA, 25 bp, Rattus norvegicus
tgtgtgaattgcatggatcctctag

SEQ ID NO: 651676 - DNA, 25 bp, Rattus norvegicus
tgtgtgaattgcttggatcctctag

SEQ ID NO: 651677 - DNA, 25 bp, Rattus norvegicus
tgtgtgacacacatgtttttgcagt

SEQ ID NO: 651678 - DNA, 25 bp, Rattus norvegicus
tgtgtgacacacttgtttttgcagt

SEQ ID NO: 651679 - DNA, 25 bp, Rattus norvegicus
tgtgtgacacatcttattaccaata

SEQ ID NO: 651680 - DNA, 25 bp, Rattus norvegicus
tgtgtgacacatgttattaccaata

SEQ ID NO: 651681 - DNA, 25 bp, Rattus norvegicus
tgtgtgacagtgcacctcagcaggt

SEQ ID NO: 651682 - DNA, 25 bp, Rattus norvegicus
tgtgtgacagtggacctcagcaggt

SEQ ID NO: 651683 - DNA, 25 bp, Rattus norvegicus
tgtgtgacatctcacgaagcctgct

SEQ ID NO: 651684 - DNA, 25 bp, Rattus norvegicus
tgtgtgacatctgacgaagcctgct

SEQ ID NO: 651685 - DNA, 25 bp, Rattus norvegicus
tgtgtgacatgcagtgacgccaaca

SEQ ID NO: 651686 - DNA, 25 bp, Rattus norvegicus
tgtgtgacatgctgtgacgccaaca

SEQ ID NO: 651687 - DNA, 25 bp, Rattus norvegicus
tgtgtgaccaccaagcctctggcta

SEQ ID NO: 651688 - DNA, 25 bp, Rattus norvegicus
tgtgtgaccacctagcctctggcta

SEQ ID NO: 651689 - DNA, 25 bp, Rattus norvegicus
tgtgtgaccctcaagatggtggccc

SEQ ID NO: 651690 - DNA, 25 bp, Rattus norvegicus
tgtgtgaccctctagatggtggccc

SEQ ID NO: 651691 - DNA, 25 bp, Rattus norvegicus
tgtgtgaccctgagtacccgaggag

SEQ ID NO: 651692 - DNA, 25 bp, Rattus norvegicus
tgtgtgaccctgtgtacccgaggag

SEQ ID NO: 651693 - DNA, 25 bp, Rattus norvegicus
tgtgtgacccttacatgcatgtgaa

SEQ ID NO: 651694 - DNA, 25 bp, Rattus norvegicus
tgtgtgaccctttcatgcatgtgaa

SEQ ID NO: 651695 - DNA, 25 bp, Rattus norvegicus
tgtgtgacctctccaaactttgtag

SEQ ID NO: 651696 - DNA, 25 bp, Rattus norvegicus
tgtgtgacctctgcaaactttgtag

SEQ ID NO: 651697 - DNA, 25 bp, Rattus norvegicus
tgtgtgacgcgcaactatgcgagcg

SEQ ID NO: 651698 - DNA, 25 bp, Rattus norvegicus
tgtgtgacgcgctactatgcgagcg

SEQ ID NO: 651699 - DNA, 25 bp, Rattus norvegicus
tgtgtgactctgacaaccccgttgt

SEQ ID NO: 651700 - DNA, 25 bp, Rattus norvegicus
tgtgtgactctgtcaaccccgttgt

SEQ ID NO: 651701 - DNA, 25 bp, Rattus norvegicus
tgtgtgactgacagcttcaacttgc

SEQ ID NO: 651702 - DNA, 25 bp, Rattus norvegicus
tgtgtgactgactgcttcaacttgc

SEQ ID NO: 651703 - DNA, 25 bp, Rattus norvegicus
tgtgtgacttcaagttcaacctcaa

SEQ ID NO: 651704 - DNA, 25 bp, Rattus norvegicus
tgtgtgacttcacctccaggaagta

SEQ ID NO: 651705 - DNA, 25 bp, Rattus norvegicus
tgtgtgacttcacgcaaatctctcg

SEQ ID NO: 651706 - DNA, 25 bp, Rattus norvegicus
tgtgtgacttcagctccaggaagta

SEQ ID NO: 651707 - DNA, 25 bp, Rattus norvegicus
tgtgtgacttcaggcaaatctctcg

SEQ ID NO: 651708 - DNA, 25 bp, Rattus norvegicus
tgtgtgacttcatgttcaacctcaa

SEQ ID NO: 651709 - DNA, 25 bp, Rattus norvegicus
tgtgtgagagacagcaccctggtat

SEQ ID NO: 651710 - DNA, 25 bp, Rattus norvegicus
tgtgtgagagactgcaccctggtat

SEQ ID NO: 651711 - DNA, 25 bp, Rattus norvegicus
tgtgtgagcatgacgccgtccacca

SEQ ID NO: 651712 - DNA, 25 bp, Rattus norvegicus
tgtgtgagcatgtcgccgtccacca

SEQ ID NO: 651713 - DNA, 25 bp, Rattus norvegicus
tgtgtgagcattagtgcacccactc

SEQ ID NO: 651714 - DNA, 25 bp, Rattus norvegicus
tgtgtgagcatttgtgcacccactc

SEQ ID NO: 651715 - DNA, 25 bp, Rattus norvegicus
tgtgtgagccttagtctcccagcat

SEQ ID NO: 651716 - DNA, 25 bp, Rattus norvegicus
tgtgtgagcctttgtctcccagcat

SEQ ID NO: 651717 - DNA, 25 bp, Rattus norvegicus
tgtgtgagctctcttgttccaccga

SEQ ID NO: 651718 - DNA, 25 bp, Rattus norvegicus
tgtgtgagctctgttgttccaccga

SEQ ID NO: 651719 - DNA, 25 bp, Rattus norvegicus
tgtgtgagctgcattgcctgttcca

SEQ ID NO: 651720 - DNA, 25 bp, Rattus norvegicus
tgtgtgagctgctttgcctgttcca

SEQ ID NO: 651721 - DNA, 25 bp, Rattus norvegicus
tgtgtgaggaggatgggccgccgtc

SEQ ID NO: 651722 - DNA, 25 bp, Rattus norvegicus
tgtgtgaggaggttgggccgccgtc

SEQ ID NO: 651723 - DNA, 25 bp, Rattus norvegicus
tgtgtgagtactagagcctggagcc

SEQ ID NO: 651724 - DNA, 25 bp, Rattus norvegicus
tgtgtgagtacttgagcctggagcc

SEQ ID NO: 651725 - DNA, 25 bp, Rattus norvegicus
tgtgtgagtctcaggcaaatgcctc

SEQ ID NO: 651726 - DNA, 25 bp, Rattus norvegicus
tgtgtgagtctctggcaaatgcctc

SEQ ID NO: 651727 - DNA, 25 bp, Rattus norvegicus
tgtgtgataattccccattgtctta

SEQ ID NO: 651728 - DNA, 25 bp, Rattus norvegicus
tgtgtgataattgcccattgtctta

SEQ ID NO: 651729 - DNA, 25 bp, Rattus norvegicus
tgtgtgatactacatcatcccacca

SEQ ID NO: 651730 - DNA, 25 bp, Rattus norvegicus
tgtgtgatactagatcatcccacca

SEQ ID NO: 651731 - DNA, 25 bp, Rattus norvegicus
tgtgtgatagtcagtcagtctcctt

SEQ ID NO: 651732 - DNA, 25 bp, Rattus norvegicus
tgtgtgatagtctgtcagtctcctt

SEQ ID NO: 651733 - DNA, 25 bp, Rattus norvegicus
tgtgtgatcaaaccgtgtcttccaa

SEQ ID NO: 651734 - DNA, 25 bp, Rattus norvegicus
tgtgtgatcaaagcgtgtcttccaa

SEQ ID NO: 651735 - DNA, 25 bp, Rattus norvegicus
tgtgtgatcacaccctatgccttgt

SEQ ID NO: 651736 - DNA, 25 bp, Rattus norvegicus
tgtgtgatcacagcctatgccttgt

SEQ ID NO: 651737 - DNA, 25 bp, Rattus norvegicus
tgtgtgatgttgattccaggatttc

SEQ ID NO: 651738 - DNA, 25 bp, Rattus norvegicus
tgtgtgatgttgtttccaggatttc

SEQ ID NO: 651739 - DNA, 25 bp, Rattus norvegicus
tgtgtgattataaatattccctggg

SEQ ID NO: 651740 - DNA, 25 bp, Rattus norvegicus
tgtgtgattatatatattccctggg

SEQ ID NO: 651741 - DNA, 25 bp, Rattus norvegicus
tgtgtgattccacttacatgacatt

SEQ ID NO: 651742 - DNA, 25 bp, Rattus norvegicus
tgtgtgattccagttacatgacatt

SEQ ID NO: 651743 - DNA, 25 bp, Rattus norvegicus
tgtgtgcaaggcattctctcatatt

SEQ ID NO: 651744 - DNA, 25 bp, Rattus norvegicus
tgtgtgcaaggctttctctcatatt

SEQ ID NO: 651745 - DNA, 25 bp, Rattus norvegicus
tgtgtgcacaatacgagtggactgt

SEQ ID NO: 651746 - DNA, 25 bp, Rattus norvegicus
tgtgtgcacaattcgagtggactgt

SEQ ID NO: 651747 - DNA, 25 bp, Rattus norvegicus
tgtgtgcacattatccaaggctttg

SEQ ID NO: 651748 - DNA, 25 bp, Rattus norvegicus
tgtgtgcacattttccaaggctttg

SEQ ID NO: 651749 - DNA, 25 bp, Rattus norvegicus
tgtgtgcaccttctgtatctggtaa

SEQ ID NO: 651750 - DNA, 25 bp, Rattus norvegicus
tgtgtgcaccttgtgtatctggtaa

SEQ ID NO: 651751 - DNA, 25 bp, Rattus norvegicus
tgtgtgcagcacattgccctaatat

SEQ ID NO: 651752 - DNA, 25 bp, Rattus norvegicus
tgtgtgcagcactttgccctaatat

SEQ ID NO: 651753 - DNA, 25 bp, Rattus norvegicus
tgtgtgcagctcacagccttgtatg

SEQ ID NO: 651754 - DNA, 25 bp, Rattus norvegicus
tgtgtgcagctctcagccttgtatg

SEQ ID NO: 651755 - DNA, 25 bp, Rattus norvegicus
tgtgtgcagtgaatgtatacagctt

SEQ ID NO: 651756 - DNA, 25 bp, Rattus norvegicus
tgtgtgcagtgattgtatacagctt

SEQ ID NO: 651757 - DNA, 25 bp, Rattus norvegicus
tgtgtgcataaacataattccaggc

SEQ ID NO: 651758 - DNA, 25 bp, Rattus norvegicus
tgtgtgcataaagataattccaggc

SEQ ID NO: 651759 - DNA, 25 bp, Rattus norvegicus
tgtgtgcatctcctcgtcagtcgtc

SEQ ID NO: 651760 - DNA, 25 bp, Rattus norvegicus
tgtgtgcatctcgtcgtcagtcgtc

SEQ ID NO: 651761 - DNA, 25 bp, Rattus norvegicus
tgtgtgcatgacagatccgcctacc

SEQ ID NO: 651762 - DNA, 25 bp, Rattus norvegicus
tgtgtgcatgactgatccgcctacc

SEQ ID NO: 651763 - DNA, 25 bp, Rattus norvegicus
tgtgtgcattagcaacccttctctc

SEQ ID NO: 651764 - DNA, 25 bp, Rattus norvegicus
tgtgtgcattaggaacccttctctc

SEQ ID NO: 651765 - DNA, 25 bp, Rattus norvegicus
tgtgtgcatttaacagtcccatcat

SEQ ID NO: 651766 - DNA, 25 bp, Rattus norvegicus
tgtgtgcatttatcagtcccatcat

SEQ ID NO: 651767 - DNA, 25 bp, Rattus norvegicus
tgtgtgccaaatcttgccaaattgt

SEQ ID NO: 651768 - DNA, 25 bp, Rattus norvegicus
tgtgtgccaaatgttgccaaattgt

SEQ ID NO: 651769 - DNA, 25 bp, Rattus norvegicus
tgtgtgccaccactgttgggctcaa

SEQ ID NO: 651770 - DNA, 25 bp, Rattus norvegicus
tgtgtgccaccagtgttgggctcaa

SEQ ID NO: 651771 - DNA, 25 bp, Rattus norvegicus
tgtgtgccagctagacacaagttgg

SEQ ID NO: 651772 - DNA, 25 bp, Rattus norvegicus
tgtgtgccagcttgacacaagttgg

SEQ ID NO: 651773 - DNA, 25 bp, Rattus norvegicus
tgtgtgcccagcagcttagaaggaa

SEQ ID NO: 651774 - DNA, 25 bp, Rattus norvegicus
tgtgtgcccagctgcttagaaggaa

SEQ ID NO: 651775 - DNA, 25 bp, Rattus norvegicus
tgtgtgcccatgctacctgatatga

SEQ ID NO: 651776 - DNA, 25 bp, Rattus norvegicus
tgtgtgcccatggtacctgatatga

SEQ ID NO: 651777 - DNA, 25 bp, Rattus norvegicus
tgtgtgccccacagactgaacttgc

SEQ ID NO: 651778 - DNA, 25 bp, Rattus norvegicus
tgtgtgccccactgactgaacttgc

SEQ ID NO: 651779 - DNA, 25 bp, Rattus norvegicus
tgtgtgccccgacagactccattca

SEQ ID NO: 651780 - DNA, 25 bp, Rattus norvegicus
tgtgtgccccgagagactccattca

SEQ ID NO: 651781 - DNA, 25 bp, Rattus norvegicus
tgtgtgcctctcaaaggatccctgg

SEQ ID NO: 651782 - DNA, 25 bp, Rattus norvegicus
tgtgtgcctctctaaggatccctgg

SEQ ID NO: 651783 - DNA, 25 bp, Rattus norvegicus
tgtgtgcctgacactgtttaccagt

SEQ ID NO: 651784 - DNA, 25 bp, Rattus norvegicus
tgtgtgcctgactctgtttaccagt

SEQ ID NO: 651785 - DNA, 25 bp, Rattus norvegicus
tgtgtgcctgccaccaagaagaacg

SEQ ID NO: 651786 - DNA, 25 bp, Rattus norvegicus
tgtgtgcctgcctccaagaagaacg

SEQ ID NO: 651787 - DNA, 25 bp, Rattus norvegicus
tgtgtgcctggacgagccgccatac

SEQ ID NO: 651788 - DNA, 25 bp, Rattus norvegicus
tgtgtgcctggaggagccgccatac

SEQ ID NO: 651789 - DNA, 25 bp, Rattus norvegicus
tgtgtgcctgggacctacactaaag

SEQ ID NO: 651790 - DNA, 25 bp, Rattus norvegicus
tgtgtgcctgggtcctacactaaag

SEQ ID NO: 651791 - DNA, 25 bp, Rattus norvegicus
tgtgtgccttcaccgagcgcagcat

SEQ ID NO: 651792 - DNA, 25 bp, Rattus norvegicus
tgtgtgccttcagcgagcgcagcat

SEQ ID NO: 651793 - DNA, 25 bp, Rattus norvegicus
tgtgtgccttctcttagttcctgtc

SEQ ID NO: 651794 - DNA, 25 bp, Rattus norvegicus
tgtgtgccttctgttagttcctgtc

SEQ ID NO: 651795 - DNA, 25 bp, Rattus norvegicus
tgtgtgccttgccttgcaccccgat

SEQ ID NO: 651796 - DNA, 25 bp, Rattus norvegicus
tgtgtgccttgcgttgcaccccgat

SEQ ID NO: 651797 - DNA, 25 bp, Rattus norvegicus
tgtgtgcgcgcgctattttattgtc

SEQ ID NO: 651798 - DNA, 25 bp, Rattus norvegicus
tgtgtgcgcgcggtattttattgtc

SEQ ID NO: 651799 - DNA, 25 bp, Rattus norvegicus
tgtgtgcgcgtgattgtacacatgt

SEQ ID NO: 651800 - DNA, 25 bp, Rattus norvegicus
tgtgtgcgcgtgtttgtacacatgt

SEQ ID NO: 651801 - DNA, 25 bp, Rattus norvegicus
tgtgtgcgcttcctgtcatactgac

SEQ ID NO: 651802 - DNA, 25 bp, Rattus norvegicus
tgtgtgcgcttcgtgtcatactgac

SEQ ID NO: 651803 - DNA, 25 bp, Rattus norvegicus
tgtgtgcggctgatgctcatctcca

SEQ ID NO: 651804 - DNA, 25 bp, Rattus norvegicus
tgtgtgcggctgttgctcatctcca

SEQ ID NO: 651805 - DNA, 25 bp, Rattus norvegicus
tgtgtgctaaacacatggcctcgtg

SEQ ID NO: 651806 - DNA, 25 bp, Rattus norvegicus
tgtgtgctaaactcatggcctcgtg

SEQ ID NO: 651807 - DNA, 25 bp, Rattus norvegicus
tgtgtgctaatgatgcggttcctaa

SEQ ID NO: 651808 - DNA, 25 bp, Rattus norvegicus
tgtgtgctaatgttgcggttcctaa

SEQ ID NO: 651809 - DNA, 25 bp, Rattus norvegicus
tgtgtgctagttccttcttgctgct

SEQ ID NO: 651810 - DNA, 25 bp, Rattus norvegicus
tgtgtgctagttgcttcttgctgct

SEQ ID NO: 651811 - DNA, 25 bp, Rattus norvegicus
tgtgtgctccacagtagttaacccc

SEQ ID NO: 651812 - DNA, 25 bp, Rattus norvegicus
tgtgtgctccactgtagttaacccc

SEQ ID NO: 651813 - DNA, 25 bp, Rattus norvegicus
tgtgtgctctagattccatctcaag

SEQ ID NO: 651814 - DNA, 25 bp, Rattus norvegicus
tgtgtgctctagtttccatctcaag

SEQ ID NO: 651815 - DNA, 25 bp, Rattus norvegicus
tgtgtgctctatcctccatgtcaag

SEQ ID NO: 651816 - DNA, 25 bp, Rattus norvegicus
tgtgtgctctatgctccatgtcaag

SEQ ID NO: 651817 - DNA, 25 bp, Rattus norvegicus
tgtgtgctcttgacaggtgttctta

SEQ ID NO: 651818 - DNA, 25 bp, Rattus norvegicus
tgtgtgctcttgtcaggtgttctta

SEQ ID NO: 651819 - DNA, 25 bp, Rattus norvegicus
tgtgtgctctttacccatggccagt

SEQ ID NO: 651820 - DNA, 25 bp, Rattus norvegicus
tgtgtgctcttttcccatggccagt

SEQ ID NO: 651821 - DNA, 25 bp, Rattus norvegicus
tgtgtgctgagacctacccggatac

SEQ ID NO: 651822 - DNA, 25 bp, Rattus norvegicus
tgtgtgctgagagctacccggatac

SEQ ID NO: 651823 - DNA, 25 bp, Rattus norvegicus
tgtgtgctgaggacagggcctacat

SEQ ID NO: 651824 - DNA, 25 bp, Rattus norvegicus
tgtgtgctgaggtcagggcctacat

SEQ ID NO: 651825 - DNA, 25 bp, Rattus norvegicus
tgtgtgctgttcagagctgcactct

SEQ ID NO: 651826 - DNA, 25 bp, Rattus norvegicus
tgtgtgctgttctgagctgcactct

SEQ ID NO: 651827 - DNA, 25 bp, Rattus norvegicus
tgtgtgcttactacccttgtttaac

SEQ ID NO: 651828 - DNA, 25 bp, Rattus norvegicus
tgtgtgcttacttcccttgtttaac

SEQ ID NO: 651829 - DNA, 25 bp, Rattus norvegicus
tgtgtgctttctaattctcgttttt

SEQ ID NO: 651830 - DNA, 25 bp, Rattus norvegicus
tgtgtgctttcttattctcgttttt

SEQ ID NO: 651831 - DNA, 25 bp, Rattus norvegicus
tgtgtgctttgcatcctgtaaatga

SEQ ID NO: 651832 - DNA, 25 bp, Rattus norvegicus
tgtgtgctttgcttcctgtaaatga

SEQ ID NO: 651833 - DNA, 25 bp, Rattus norvegicus
tgtgtggaaacacggctttttataa

SEQ ID NO: 651834 - DNA, 25 bp, Rattus norvegicus
tgtgtggaaacagggctttttataa

SEQ ID NO: 651835 - DNA, 25 bp, Rattus norvegicus
tgtgtggaacccaagcttctcatac

SEQ ID NO: 651836 - DNA, 25 bp, Rattus norvegicus
tgtgtggaaccctagcttctcatac

SEQ ID NO: 651837 - DNA, 25 bp, Rattus norvegicus
tgtgtggaactgcagctgctgctaa

SEQ ID NO: 651838 - DNA, 25 bp, Rattus norvegicus
tgtgtggaactggagctgctgctaa

SEQ ID NO: 651839 - DNA, 25 bp, Rattus norvegicus
tgtgtggaagctcagcgcgtcctat

SEQ ID NO: 651840 - DNA, 25 bp, Rattus norvegicus
tgtgtggaagctgagcgcgtcctat

SEQ ID NO: 651841 - DNA, 25 bp, Rattus norvegicus
tgtgtggacacgactcaggagctca

SEQ ID NO: 651842 - DNA, 25 bp, Rattus norvegicus
tgtgtggacacgtctcaggagctca

SEQ ID NO: 651843 - DNA, 25 bp, Rattus norvegicus
tgtgtggactgtccggttcttaaga

SEQ ID NO: 651844 - DNA, 25 bp, Rattus norvegicus
tgtgtggactgtgcggttcttaaga

SEQ ID NO: 651845 - DNA, 25 bp, Rattus norvegicus
tgtgtggacttcctcatacgcaaag

SEQ ID NO: 651846 - DNA, 25 bp, Rattus norvegicus
tgtgtggacttcgtcatacgcaaag

SEQ ID NO: 651847 - DNA, 25 bp, Rattus norvegicus
tgtgtggagacactaacctcaataa

SEQ ID NO: 651848 - DNA, 25 bp, Rattus norvegicus
tgtgtggagacagtaacctcaataa

SEQ ID NO: 651849 - DNA, 25 bp, Rattus norvegicus
tgtgtggagaccatcagtgctgcag

SEQ ID NO: 651850 - DNA, 25 bp, Rattus norvegicus
tgtgtggagaccttcagtgctgcag

SEQ ID NO: 651851 - DNA, 25 bp, Rattus norvegicus
tgtgtggagcttaactgcctgcctg

SEQ ID NO: 651852 - DNA, 25 bp, Rattus norvegicus
tgtgtggagctttactgcctgcctg

SEQ ID NO: 651853 - DNA, 25 bp, Rattus norvegicus
tgtgtggaggacaaacgttactgaa

SEQ ID NO: 651854 - DNA, 25 bp, Rattus norvegicus
tgtgtggaggactaacgttactgaa

SEQ ID NO: 651855 - DNA, 25 bp, Rattus norvegicus
tgtgtggaggtaaaccgccttcggc

SEQ ID NO: 651856 - DNA, 25 bp, Rattus norvegicus
tgtgtggaggtataccgccttcggc

SEQ ID NO: 651857 - DNA, 25 bp, Rattus norvegicus
tgtgtggagtcacatgaggccaaat

SEQ ID NO: 651858 - DNA, 25 bp, Rattus norvegicus
tgtgtggagtcagatgaggccaaat

SEQ ID NO: 651859 - DNA, 25 bp, Rattus norvegicus
tgtgtggatatccactcctgcttcg

SEQ ID NO: 651860 - DNA, 25 bp, Rattus norvegicus
tgtgtggatatcgactcctgcttcg

SEQ ID NO: 651861 - DNA, 25 bp, Rattus norvegicus
tgtgtggatgctacaagctcctaaa

SEQ ID NO: 651862 - DNA, 25 bp, Rattus norvegicus
tgtgtggatgcttcaagctcctaaa

SEQ ID NO: 651863 - DNA, 25 bp, Rattus norvegicus
tgtgtggatggaaacaacctcccct

SEQ ID NO: 651864 - DNA, 25 bp, Rattus norvegicus
tgtgtggatggatacaacctcccct

SEQ ID NO: 651865 - DNA, 25 bp, Rattus norvegicus
tgtgtggattctagccctttctcaa

SEQ ID NO: 651866 - DNA, 25 bp, Rattus norvegicus
tgtgtggattcttgccctttctcaa

SEQ ID NO: 651867 - DNA, 25 bp, Rattus norvegicus
tgtgtggattggaggctctatcctg

SEQ ID NO: 651868 - DNA, 25 bp, Rattus norvegicus
tgtgtggattggtggctctatcctg

SEQ ID NO: 651869 - DNA, 25 bp, Rattus norvegicus
tgtgtggattgtattccttctctca

SEQ ID NO: 651870 - DNA, 25 bp, Rattus norvegicus
tgtgtggattgttttccttctctca

SEQ ID NO: 651871 - DNA, 25 bp, Rattus norvegicus
tgtgtggcaaatctgtttttctctc

SEQ ID NO: 651872 - DNA, 25 bp, Rattus norvegicus
tgtgtggcaaatgtgtttttctctc

SEQ ID NO: 651873 - DNA, 25 bp, Rattus norvegicus
tgtgtggcactgatccttattctaa

SEQ ID NO: 651874 - DNA, 25 bp, Rattus norvegicus
tgtgtggcactgttccttattctaa

SEQ ID NO: 651875 - DNA, 25 bp, Rattus norvegicus
tgtgtggcagaaacagcaccaccgc

SEQ ID NO: 651876 - DNA, 25 bp, Rattus norvegicus
tgtgtggcagaatcagcaccaccgc

SEQ ID NO: 651877 - DNA, 25 bp, Rattus norvegicus
tgtgtggcagggatcctctatgtac

SEQ ID NO: 651878 - DNA, 25 bp, Rattus norvegicus
tgtgtggcagggttcctctatgtac

SEQ ID NO: 651879 - DNA, 25 bp, Rattus norvegicus
tgtgtggcagttccgcaatatgatc

SEQ ID NO: 651880 - DNA, 25 bp, Rattus norvegicus
tgtgtggcagttgcgcaatatgatc

SEQ ID NO: 651881 - DNA, 25 bp, Rattus norvegicus
tgtgtggccaggaagcagcctgcat

SEQ ID NO: 651882 - DNA, 25 bp, Rattus norvegicus
tgtgtggccaggtagcagcctgcat

SEQ ID NO: 651883 - DNA, 25 bp, Rattus norvegicus
tgtgtggcccaaacgtacggtaatc

SEQ ID NO: 651884 - DNA, 25 bp, Rattus norvegicus
tgtgtggcccaatcgtacggtaatc

SEQ ID NO: 651885 - DNA, 25 bp, Rattus norvegicus
tgtgtggcccacagcgatgactgaa

SEQ ID NO: 651886 - DNA, 25 bp, Rattus norvegicus
tgtgtggcccactgcgatgactgaa

SEQ ID NO: 651887 - DNA, 25 bp, Rattus norvegicus
tgtgtggcccctcgttatcctggaa

SEQ ID NO: 651888 - DNA, 25 bp, Rattus norvegicus
tgtgtggcccctggttatcctggaa

SEQ ID NO: 651889 - DNA, 25 bp, Rattus norvegicus
tgtgtggccctgaagtaattactga

SEQ ID NO: 651890 - DNA, 25 bp, Rattus norvegicus
tgtgtggccctgtagtaattactga

SEQ ID NO: 651891 - DNA, 25 bp, Rattus norvegicus
tgtgtggctaccaacgcgcatggca

SEQ ID NO: 651892 - DNA, 25 bp, Rattus norvegicus
tgtgtggctacctacgcgcatggca

SEQ ID NO: 651893 - DNA, 25 bp, Rattus norvegicus
tgtgtgggaaacaacctcatggatg

SEQ ID NO: 651894 - DNA, 25 bp, Rattus norvegicus
tgtgtgggaaactacctcatggatg

SEQ ID NO: 651895 - DNA, 25 bp, Rattus norvegicus
tgtgtgggaaagaggctcccatccc

SEQ ID NO: 651896 - DNA, 25 bp, Rattus norvegicus
tgtgtgggaaagtggctcccatccc

SEQ ID NO: 651897 - DNA, 25 bp, Rattus norvegicus
tgtgtgggactaacggaattactta

SEQ ID NO: 651898 - DNA, 25 bp, Rattus norvegicus
tgtgtgggactatcggaattactta

SEQ ID NO: 651899 - DNA, 25 bp, Rattus norvegicus
tgtgtgggactgcactttctgatca

SEQ ID NO: 651900 - DNA, 25 bp, Rattus norvegicus
tgtgtgggactggactttctgatca

SEQ ID NO: 651901 - DNA, 25 bp, Rattus norvegicus
tgtgtgggcacaagtcactcctgtt

SEQ ID NO: 651902 - DNA, 25 bp, Rattus norvegicus
tgtgtgggcacatgtcactcctgtt

SEQ ID NO: 651903 - DNA, 25 bp, Rattus norvegicus
tgtgtgggtattacgtctgcatgta

SEQ ID NO: 651904 - DNA, 25 bp, Rattus norvegicus
tgtgtgggtatttcgtctgcatgta

SEQ ID NO: 651905 - DNA, 25 bp, Rattus norvegicus
tgtgtgggtgccatcccagaatcta

SEQ ID NO: 651906 - DNA, 25 bp, Rattus norvegicus
tgtgtgggtgccttcccagaatcta

SEQ ID NO: 651907 - DNA, 25 bp, Rattus norvegicus
tgtgtgggtgggaaccgatccttaa

SEQ ID NO: 651908 - DNA, 25 bp, Rattus norvegicus
tgtgtgggtgggtaccgatccttaa

SEQ ID NO: 651909 - DNA, 25 bp, Rattus norvegicus
tgtgtgggttaactcaccccagcat

SEQ ID NO: 651910 - DNA, 25 bp, Rattus norvegicus
tgtgtgggttaagtcaccccagcat

SEQ ID NO: 651911 - DNA, 25 bp, Rattus norvegicus
tgtgtggtaaccacattgcctgtga

SEQ ID NO: 651912 - DNA, 25 bp, Rattus norvegicus
tgtgtggtaacctcattgcctgtga

SEQ ID NO: 651913 - DNA, 25 bp, Rattus norvegicus
tgtgtggtcacaaatgcatgggcat

SEQ ID NO: 651914 - DNA, 25 bp, Rattus norvegicus
tgtgtggtcacatatgcatgggcat

SEQ ID NO: 651915 - DNA, 25 bp, Rattus norvegicus
tgtgtggtcgccagcactgtcagaa

SEQ ID NO: 651916 - DNA, 25 bp, Rattus norvegicus
tgtgtggtcgcctgcactgtcagaa

SEQ ID NO: 651917 - DNA, 25 bp, Rattus norvegicus
tgtgtggtctctatggttttatata

SEQ ID NO: 651918 - DNA, 25 bp, Rattus norvegicus
tgtgtggtctctttggttttatata

SEQ ID NO: 651919 - DNA, 25 bp, Rattus norvegicus
tgtgtggtgaccaagcagggttccc

SEQ ID NO: 651920 - DNA, 25 bp, Rattus norvegicus
tgtgtggtgacctagcagggttccc

SEQ ID NO: 651921 - DNA, 25 bp, Rattus norvegicus
tgtgtggtgaggatctttttctctc

SEQ ID NO: 651922 - DNA, 25 bp, Rattus norvegicus
tgtgtggtgaggttctttttctctc

SEQ ID NO: 651923 - DNA, 25 bp, Rattus norvegicus
tgtgtggtggccatggcaacagacc

SEQ ID NO: 651924 - DNA, 25 bp, Rattus norvegicus
tgtgtggtggccttggcaacagacc

SEQ ID NO: 651925 - DNA, 25 bp, Rattus norvegicus
tgtgtggtgtgcagcacctcagaag

SEQ ID NO: 651926 - DNA, 25 bp, Rattus norvegicus
tgtgtggtgtgctgcacctcagaag

SEQ ID NO: 651927 - DNA, 25 bp, Rattus norvegicus
tgtgtggtgtgtcactctcccaact

SEQ ID NO: 651928 - DNA, 25 bp, Rattus norvegicus
tgtgtggtgtgtgactctcccaact

SEQ ID NO: 651929 - DNA, 25 bp, Rattus norvegicus
tgtgtggttaaaccccaagcatcct

SEQ ID NO: 651930 - DNA, 25 bp, Rattus norvegicus
tgtgtggttaaagcccaagcatcct

SEQ ID NO: 651931 - DNA, 25 bp, Rattus norvegicus
tgtgtggttttcatggttttgtcct

SEQ ID NO: 651932 - DNA, 25 bp, Rattus norvegicus
tgtgtggttttcttggttttgtcct

SEQ ID NO: 651933 - DNA, 25 bp, Rattus norvegicus
tgtgtgtaacatacggagtcttccc

SEQ ID NO: 651934 - DNA, 25 bp, Rattus norvegicus
tgtgtgtaacattcggagtcttccc

SEQ ID NO: 651935 - DNA, 25 bp, Rattus norvegicus
tgtgtgtaacttccagtcctctctg

SEQ ID NO: 651936 - DNA, 25 bp, Rattus norvegicus
tgtgtgtaacttgcagtcctctctg

SEQ ID NO: 651937 - DNA, 25 bp, Rattus norvegicus
tgtgtgtaagatcatgcccattcat

SEQ ID NO: 651938 - DNA, 25 bp, Rattus norvegicus
tgtgtgtaagatgatgcccattcat

SEQ ID NO: 651939 - DNA, 25 bp, Rattus norvegicus
tgtgtgtaagcacgccaccgttcac

SEQ ID NO: 651940 - DNA, 25 bp, Rattus norvegicus
tgtgtgtaagcaggccaccgttcac

SEQ ID NO: 651941 - DNA, 25 bp, Rattus norvegicus
tgtgtgtaaggcactttttgtgcag

SEQ ID NO: 651942 - DNA, 25 bp, Rattus norvegicus
tgtgtgtaaggctctttttgtgcag

SEQ ID NO: 651943 - DNA, 25 bp, Rattus norvegicus
tgtgtgtaccagcatgccaaaaatt

SEQ ID NO: 651944 - DNA, 25 bp, Rattus norvegicus
tgtgtgtaccagctccaacagtcac

SEQ ID NO: 651945 - DNA, 25 bp, Rattus norvegicus
tgtgtgtaccaggatgccaaaaatt

SEQ ID NO: 651946 - DNA, 25 bp, Rattus norvegicus
tgtgtgtaccaggtccaacagtcac

SEQ ID NO: 651947 - DNA, 25 bp, Rattus norvegicus
tgtgtgtacccgaactttaagcttt

SEQ ID NO: 651948 - DNA, 25 bp, Rattus norvegicus
tgtgtgtacccgtactttaagcttt

SEQ ID NO: 651949 - DNA, 25 bp, Rattus norvegicus
tgtgtgtacctccttctttatgaaa

SEQ ID NO: 651950 - DNA, 25 bp, Rattus norvegicus
tgtgtgtacctcgttctttatgaaa

SEQ ID NO: 651951 - DNA, 25 bp, Rattus norvegicus
tgtgtgtacctgaatgcgtatgcat

SEQ ID NO: 651952 - DNA, 25 bp, Rattus norvegicus
tgtgtgtacctgtatgcgtatgcat

SEQ ID NO: 651953 - DNA, 25 bp, Rattus norvegicus
tgtgtgtactcaaacgcacgcacat

SEQ ID NO: 651954 - DNA, 25 bp, Rattus norvegicus
tgtgtgtactcatacgcacgcacat

SEQ ID NO: 651955 - DNA, 25 bp, Rattus norvegicus
tgtgtgtactccagggcacccgtca

SEQ ID NO: 651956 - DNA, 25 bp, Rattus norvegicus
tgtgtgtactcctgggcacccgtca

SEQ ID NO: 651957 - DNA, 25 bp, Rattus norvegicus
tgtgtgtatacaccgtgagtcaccg

SEQ ID NO: 651958 - DNA, 25 bp, Rattus norvegicus
tgtgtgtatacagcgtgagtcaccg

SEQ ID NO: 651959 - DNA, 25 bp, Rattus norvegicus
tgtgtgtataggaaggtgtagtcat

SEQ ID NO: 651960 - DNA, 25 bp, Rattus norvegicus
tgtgtgtataggtaggtgtagtcat

SEQ ID NO: 651961 - DNA, 25 bp, Rattus norvegicus
tgtgtgtatgttatggctcctcccc

SEQ ID NO: 651962 - DNA, 25 bp, Rattus norvegicus
tgtgtgtatgttttggctcctcccc

SEQ ID NO: 651963 - DNA, 25 bp, Rattus norvegicus
tgtgtgtatttcctgctctggctgc

SEQ ID NO: 651964 - DNA, 25 bp, Rattus norvegicus
tgtgtgtatttcgtgctctggctgc

SEQ ID NO: 651965 - DNA, 25 bp, Rattus norvegicus
tgtgtgtcaatgcatatcagccatg

SEQ ID NO: 651966 - DNA, 25 bp, Rattus norvegicus
tgtgtgtcaatggatatcagccatg

SEQ ID NO: 651967 - DNA, 25 bp, Rattus norvegicus
tgtgtgtcacacacattgctaccag

SEQ ID NO: 651968 - DNA, 25 bp, Rattus norvegicus
tgtgtgtcacactcattgctaccag

SEQ ID NO: 651969 - DNA, 25 bp, Rattus norvegicus
tgtgtgtcagcactgcccaacatgt

SEQ ID NO: 651970 - DNA, 25 bp, Rattus norvegicus
tgtgtgtcagcagtgcccaacatgt

SEQ ID NO: 651971 - DNA, 25 bp, Rattus norvegicus
tgtgtgtcagctcagtacccttcta

SEQ ID NO: 651972 - DNA, 25 bp, Rattus norvegicus
tgtgtgtcagctgagtacccttcta

SEQ ID NO: 651973 - DNA, 25 bp, Rattus norvegicus
tgtgtgtcattccattccagagaga

SEQ ID NO: 651974 - DNA, 25 bp, Rattus norvegicus
tgtgtgtcattcgattccagagaga

SEQ ID NO: 651975 - DNA, 25 bp, Rattus norvegicus
tgtgtgtccacacgcatgtgcgatg

SEQ ID NO: 651976 - DNA, 25 bp, Rattus norvegicus
tgtgtgtccacaggcatgtgcgatg

SEQ ID NO: 651977 - DNA, 25 bp, Rattus norvegicus
tgtgtgtccaccataggagccattg

SEQ ID NO: 651978 - DNA, 25 bp, Rattus norvegicus
tgtgtgtccaccttaggagccattg

SEQ ID NO: 651979 - DNA, 25 bp, Rattus norvegicus
tgtgtgtcccctctgtgggtccagt

SEQ ID NO: 651980 - DNA, 25 bp, Rattus norvegicus
tgtgtgtcccctgtgtgggtccagt

SEQ ID NO: 651981 - DNA, 25 bp, Rattus norvegicus
tgtgtgtcccgaactcaccaggcag

SEQ ID NO: 651982 - DNA, 25 bp, Rattus norvegicus
tgtgtgtcccgatctcaccaggcag

SEQ ID NO: 651983 - DNA, 25 bp, Rattus norvegicus
tgtgtgtccctgacatcccgtggtg

SEQ ID NO: 651984 - DNA, 25 bp, Rattus norvegicus
tgtgtgtccctgtcatcccgtggtg

SEQ ID NO: 651985 - DNA, 25 bp, Rattus norvegicus
tgtgtgtccgatctcctgtttccat

SEQ ID NO: 651986 - DNA, 25 bp, Rattus norvegicus
tgtgtgtccgatgtcctgtttccat

SEQ ID NO: 651987 - DNA, 25 bp, Rattus norvegicus
tgtgtgtccgtcaatctgcatgagc

SEQ ID NO: 651988 - DNA, 25 bp, Rattus norvegicus
tgtgtgtccgtctatctgcatgagc

SEQ ID NO: 651989 - DNA, 25 bp, Rattus norvegicus
tgtgtgtccgtgctctgtaaatcag

SEQ ID NO: 651990 - DNA, 25 bp, Rattus norvegicus
tgtgtgtccgtggtctgtaaatcag

SEQ ID NO: 651991 - DNA, 25 bp, Rattus norvegicus
tgtgtgtcctcacagcagctacaag

SEQ ID NO: 651992 - DNA, 25 bp, Rattus norvegicus
tgtgtgtcctcagagcagctacaag

SEQ ID NO: 651993 - DNA, 25 bp, Rattus norvegicus
tgtgtgtcctctatcatttcaatga

SEQ ID NO: 651994 - DNA, 25 bp, Rattus norvegicus
tgtgtgtcctctttcatttcaatga

SEQ ID NO: 651995 - DNA, 25 bp, Rattus norvegicus
tgtgtgtctaagacctccaagctgg

SEQ ID NO: 651996 - DNA, 25 bp, Rattus norvegicus
tgtgtgtctaagtcctccaagctgg

SEQ ID NO: 651997 - DNA, 25 bp, Rattus norvegicus
tgtgtgtctacaagttcctggagcc

SEQ ID NO: 651998 - DNA, 25 bp, Rattus norvegicus
tgtgtgtctacatgttcctggagcc

SEQ ID NO: 651999 - DNA, 25 bp, Rattus norvegicus
tgtgtgtctccacggcaagctctca

SEQ ID NO: 652000 - DNA, 25 bp, Rattus norvegicus
tgtgtgtctccagggcaagctctca

SEQ ID NO: 652001 - DNA, 25 bp, Rattus norvegicus
tgtgtgtctcccagaaggcattaca

SEQ ID NO: 652002 - DNA, 25 bp, Rattus norvegicus
tgtgtgtctccctgaaggcattaca

SEQ ID NO: 652003 - DNA, 25 bp, Rattus norvegicus
tgtgtgtctcctcccactttgccat

SEQ ID NO: 652004 - DNA, 25 bp, Rattus norvegicus
tgtgtgtctcctgccactttgccat

SEQ ID NO: 652005 - DNA, 25 bp, Rattus norvegicus
tgtgtgtctctgagattcaccccaa

SEQ ID NO: 652006 - DNA, 25 bp, Rattus norvegicus
tgtgtgtctctgtgattcaccccaa

SEQ ID NO: 652007 - DNA, 25 bp, Rattus norvegicus
tgtgtgtctgcaagccgtggtgtcc

SEQ ID NO: 652008 - DNA, 25 bp, Rattus norvegicus
tgtgtgtctgcatgccgtggtgtcc

SEQ ID NO: 652009 - DNA, 25 bp, Rattus norvegicus
tgtgtgtctgctcctaatgttgcat

SEQ ID NO: 652010 - DNA, 25 bp, Rattus norvegicus
tgtgtgtctgctgctaatgttgcat

SEQ ID NO: 652011 - DNA, 25 bp, Rattus norvegicus
tgtgtgtctttactttgtggctttc

SEQ ID NO: 652012 - DNA, 25 bp, Rattus norvegicus
tgtgtgtctttagtttgtggctttc

SEQ ID NO: 652013 - DNA, 25 bp, Rattus norvegicus
tgtgtgtctttccaaactgaggccc

SEQ ID NO: 652014 - DNA, 25 bp, Rattus norvegicus
tgtgtgtctttcgaaactgaggccc

SEQ ID NO: 652015 - DNA, 25 bp, Rattus norvegicus
tgtgtgtgacaaccccgcagcttat

SEQ ID NO: 652016 - DNA, 25 bp, Rattus norvegicus
tgtgtgtgacaagcccgcagcttat

SEQ ID NO: 652017 - DNA, 25 bp, Rattus norvegicus
tgtgtgtgagcacatgctaccgcct

SEQ ID NO: 652018 - DNA, 25 bp, Rattus norvegicus
tgtgtgtgagcagatgctaccgcct

SEQ ID NO: 652019 - DNA, 25 bp, Rattus norvegicus
tgtgtgtgcaccctccacagaaaga

SEQ ID NO: 652020 - DNA, 25 bp, Rattus norvegicus
tgtgtgtgcaccgtccacagaaaga

SEQ ID NO: 652021 - DNA, 25 bp, Rattus norvegicus
tgtgtgtgcattaatcattggatct

SEQ ID NO: 652022 - DNA, 25 bp, Rattus norvegicus
tgtgtgtgcattatatccactaaat

SEQ ID NO: 652023 - DNA, 25 bp, Rattus norvegicus
tgtgtgtgcatttatcattggatct

SEQ ID NO: 652024 - DNA, 25 bp, Rattus norvegicus
tgtgtgtgcattttatccactaaat

SEQ ID NO: 652025 - DNA, 25 bp, Rattus norvegicus
tgtgtgtgcccaactgctgtataca

SEQ ID NO: 652026 - DNA, 25 bp, Rattus norvegicus
tgtgtgtgcccacgaacggttgaca

SEQ ID NO: 652027 - DNA, 25 bp, Rattus norvegicus
tgtgtgtgcccaggaacggttgaca

SEQ ID NO: 652028 - DNA, 25 bp, Rattus norvegicus
tgtgtgtgcccatctgctgtataca

SEQ ID NO: 652029 - DNA, 25 bp, Rattus norvegicus
tgtgtgtggacaccctcagcagttg

SEQ ID NO: 652030 - DNA, 25 bp, Rattus norvegicus
tgtgtgtggacagcctcagcagttg

SEQ ID NO: 652031 - DNA, 25 bp, Rattus norvegicus
tgtgtgtggtgtcctttttggaccc

SEQ ID NO: 652032 - DNA, 25 bp, Rattus norvegicus
tgtgtgtggtgtgctttttggaccc

SEQ ID NO: 652033 - DNA, 25 bp, Rattus norvegicus
tgtgtgtgtatccaagctcttccac

SEQ ID NO: 652034 - DNA, 25 bp, Rattus norvegicus
tgtgtgtgtatcgaagctcttccac

SEQ ID NO: 652035 - DNA, 25 bp, Rattus norvegicus
tgtgtgtgtcccatgtagcaggaat

SEQ ID NO: 652036 - DNA, 25 bp, Rattus norvegicus
tgtgtgtgtcccttgtagcaggaat

SEQ ID NO: 652037 - DNA, 25 bp, Rattus norvegicus
tgtgtgtgtcgtagtgccttttgat

SEQ ID NO: 652038 - DNA, 25 bp, Rattus norvegicus
tgtgtgtgtcgttgtgccttttgat

SEQ ID NO: 652039 - DNA, 25 bp, Rattus norvegicus
tgtgtgtgtctgaccatcctgaatc

SEQ ID NO: 652040 - DNA, 25 bp, Rattus norvegicus
tgtgtgtgtctgtccatcctgaatc

SEQ ID NO: 652041 - DNA, 25 bp, Rattus norvegicus
tgtgtgtgtttcactcctggccatc

SEQ ID NO: 652042 - DNA, 25 bp, Rattus norvegicus
tgtgtgtgtttctctcctggccatc

SEQ ID NO: 652043 - DNA, 25 bp, Rattus norvegicus
tgtgtgttactaagcccagcattaa

SEQ ID NO: 652044 - DNA, 25 bp, Rattus norvegicus
tgtgtgttactatgcccagcattaa

SEQ ID NO: 652045 - DNA, 25 bp, Rattus norvegicus
tgtgtgttcattactcgtctcacaa

SEQ ID NO: 652046 - DNA, 25 bp, Rattus norvegicus
tgtgtgttcatttctcgtctcacaa

SEQ ID NO: 652047 - DNA, 25 bp, Rattus norvegicus
tgtgtgttcctaagtctgcttactg

SEQ ID NO: 652048 - DNA, 25 bp, Rattus norvegicus
tgtgtgttcctatgtctgcttactg

SEQ ID NO: 652049 - DNA, 25 bp, Rattus norvegicus
tgtgtgttcttacggttttccatcc

SEQ ID NO: 652050 - DNA, 25 bp, Rattus norvegicus
tgtgtgttcttagggttttccatcc

SEQ ID NO: 652051 - DNA, 25 bp, Rattus norvegicus
tgtgtgttctttccatgggcttaaa

SEQ ID NO: 652052 - DNA, 25 bp, Rattus norvegicus
tgtgtgttctttgcatgggcttaaa

SEQ ID NO: 652053 - DNA, 25 bp, Rattus norvegicus
tgtgtgttgaaaaaccttaacccta

SEQ ID NO: 652054 - DNA, 25 bp, Rattus norvegicus
tgtgtgttgaaataccttaacccta

SEQ ID NO: 652055 - DNA, 25 bp, Rattus norvegicus
tgtgtgtttaccactgtgcaatcag

SEQ ID NO: 652056 - DNA, 25 bp, Rattus norvegicus
tgtgtgtttacctctgtgcaatcag

SEQ ID NO: 652057 - DNA, 25 bp, Rattus norvegicus
tgtgtgtttcacagcgagggacatc

SEQ ID NO: 652058 - DNA, 25 bp, Rattus norvegicus
tgtgtgtttcactgcgagggacatc

SEQ ID NO: 652059 - DNA, 25 bp, Rattus norvegicus
tgtgtgtttcctagtgttggttttt

SEQ ID NO: 652060 - DNA, 25 bp, Rattus norvegicus
tgtgtgtttccttgtgttggttttt

SEQ ID NO: 652061 - DNA, 25 bp, Rattus norvegicus
tgtgtgtttctcctttatgtagcgc

SEQ ID NO: 652062 - DNA, 25 bp, Rattus norvegicus
tgtgtgtttctcgtttatgtagcgc

SEQ ID NO: 652063 - DNA, 25 bp, Rattus norvegicus
tgtgtgtttgcacacatctcgccct

SEQ ID NO: 652064 - DNA, 25 bp, Rattus norvegicus
tgtgtgtttgcagacatctcgccct

SEQ ID NO: 652065 - DNA, 25 bp, Rattus norvegicus
tgtgtgtttgccatgtctggctcct

SEQ ID NO: 652066 - DNA, 25 bp, Rattus norvegicus
tgtgtgtttgccttgtctggctcct

SEQ ID NO: 652067 - DNA, 25 bp, Rattus norvegicus
tgtgtgtttgctaaacaacctccct

SEQ ID NO: 652068 - DNA, 25 bp, Rattus norvegicus
tgtgtgtttgcttaacaacctccct

SEQ ID NO: 652069 - DNA, 25 bp, Rattus norvegicus
tgtgtgttttcaatcctggacgcaa

SEQ ID NO: 652070 - DNA, 25 bp, Rattus norvegicus
tgtgtgttttcattcctggacgcaa

SEQ ID NO: 652071 - DNA, 25 bp, Rattus norvegicus
tgtgtgtttttaccttcaatatgaa

SEQ ID NO: 652072 - DNA, 25 bp, Rattus norvegicus
tgtgtgtttttagcttcaatatgaa

SEQ ID NO: 652073 - DNA, 25 bp, Rattus norvegicus
tgtgttaaagccacagtgcctccaa

SEQ ID NO: 652074 - DNA, 25 bp, Rattus norvegicus
tgtgttaaagcctcagtgcctccaa

SEQ ID NO: 652075 - DNA, 25 bp, Rattus norvegicus
tgtgttaacgaacctccagagtact

SEQ ID NO: 652076 - DNA, 25 bp, Rattus norvegicus
tgtgttaacgaagctccagagtact

SEQ ID NO: 652077 - DNA, 25 bp, Rattus norvegicus
tgtgttaacgacatcagccttctga

SEQ ID NO: 652078 - DNA, 25 bp, Rattus norvegicus
tgtgttaacgacttcagccttctga

SEQ ID NO: 652079 - DNA, 25 bp, Rattus norvegicus
tgtgttaacttaatgctgggactcc

SEQ ID NO: 652080 - DNA, 25 bp, Rattus norvegicus
tgtgttaacttattgctgggactcc

SEQ ID NO: 652081 - DNA, 25 bp, Rattus norvegicus
tgtgttacacacacgggaaactgga

SEQ ID NO: 652082 - DNA, 25 bp, Rattus norvegicus
tgtgttacacactcgggaaactgga

SEQ ID NO: 652083 - DNA, 25 bp, Rattus norvegicus
tgtgttacactccagccaagattga

SEQ ID NO: 652084 - DNA, 25 bp, Rattus norvegicus
tgtgttacactcgagccaagattga

SEQ ID NO: 652085 - DNA, 25 bp, Rattus norvegicus
tgtgttacagcccttcgaacgtgta

SEQ ID NO: 652086 - DNA, 25 bp, Rattus norvegicus
tgtgttacagccgttcgaacgtgta

SEQ ID NO: 652087 - DNA, 25 bp, Rattus norvegicus
tgtgttacctgaactcagacccata

SEQ ID NO: 652088 - DNA, 25 bp, Rattus norvegicus
tgtgttacctgatctcagacccata

SEQ ID NO: 652089 - DNA, 25 bp, Rattus norvegicus
tgtgttagatccagccatcaacagc

SEQ ID NO: 652090 - DNA, 25 bp, Rattus norvegicus
tgtgttagatcctgccatcaacagc

SEQ ID NO: 652091 - DNA, 25 bp, Rattus norvegicus
tgtgttagcactctctgtcatctca

SEQ ID NO: 652092 - DNA, 25 bp, Rattus norvegicus
tgtgttagcactgtctgtcatctca

SEQ ID NO: 652093 - DNA, 25 bp, Rattus norvegicus
tgtgttaggcaccatcctcagcaaa

SEQ ID NO: 652094 - DNA, 25 bp, Rattus norvegicus
tgtgttaggcacgatcctcagcaaa

SEQ ID NO: 652095 - DNA, 25 bp, Rattus norvegicus
tgtgttatcttcaagctttaagctg

SEQ ID NO: 652096 - DNA, 25 bp, Rattus norvegicus
tgtgttatcttctagctttaagctg

SEQ ID NO: 652097 - DNA, 25 bp, Rattus norvegicus
tgtgttatgtctagtgaaccccaac

SEQ ID NO: 652098 - DNA, 25 bp, Rattus norvegicus
tgtgttatgtcttgtgaaccccaac

SEQ ID NO: 652099 - DNA, 25 bp, Rattus norvegicus
tgtgttattagacatgcaccattaa

SEQ ID NO: 652100 - DNA, 25 bp, Rattus norvegicus
tgtgttattagagatgcaccattaa

SEQ ID NO: 652101 - DNA, 25 bp, Rattus norvegicus
tgtgttatttctcatctctcatctg

SEQ ID NO: 652102 - DNA, 25 bp, Rattus norvegicus
tgtgttatttctgatctctcatctg

SEQ ID NO: 652103 - DNA, 25 bp, Rattus norvegicus
tgtgttcaacctcatccatgtggta

SEQ ID NO: 652104 - DNA, 25 bp, Rattus norvegicus
tgtgttcaacctgatccatgtggta

SEQ ID NO: 652105 - DNA, 25 bp, Rattus norvegicus
tgtgttcaattcatttactcccaat

SEQ ID NO: 652106 - DNA, 25 bp, Rattus norvegicus
tgtgttcaattccttatactgcaga

SEQ ID NO: 652107 - DNA, 25 bp, Rattus norvegicus
tgtgttcaattcgttatactgcaga

SEQ ID NO: 652108 - DNA, 25 bp, Rattus norvegicus
tgtgttcaattcttttactcccaat

SEQ ID NO: 652109 - DNA, 25 bp, Rattus norvegicus
tgtgttcacactcttgtagtctcct

SEQ ID NO: 652110 - DNA, 25 bp, Rattus norvegicus
tgtgttcacactgttgtagtctcct

SEQ ID NO: 652111 - DNA, 25 bp, Rattus norvegicus
tgtgttcacagaccaccgaggattc

SEQ ID NO: 652112 - DNA, 25 bp, Rattus norvegicus
tgtgttcacagagcaccgaggattc

SEQ ID NO: 652113 - DNA, 25 bp, Rattus norvegicus
tgtgttcacagtccagcagcttctc

SEQ ID NO: 652114 - DNA, 25 bp, Rattus norvegicus
tgtgttcacagtgcagcagcttctc

SEQ ID NO: 652115 - DNA, 25 bp, Rattus norvegicus
tgtgttcaccaactctccttatcag

SEQ ID NO: 652116 - DNA, 25 bp, Rattus norvegicus
tgtgttcaccaagtctccttatcag

SEQ ID NO: 652117 - DNA, 25 bp, Rattus norvegicus
tgtgttcaccatccataatgctctg

SEQ ID NO: 652118 - DNA, 25 bp, Rattus norvegicus
tgtgttcaccatgcataatgctctg

SEQ ID NO: 652119 - DNA, 25 bp, Rattus norvegicus
tgtgttcaccccactaatttatttt

SEQ ID NO: 652120 - DNA, 25 bp, Rattus norvegicus
tgtgttcacccctctaatttatttt

SEQ ID NO: 652121 - DNA, 25 bp, Rattus norvegicus
tgtgttcacggaacacgccatggaa

SEQ ID NO: 652122 - DNA, 25 bp, Rattus norvegicus
tgtgttcacggatcacgccatggaa

SEQ ID NO: 652123 - DNA, 25 bp, Rattus norvegicus
tgtgttcagaacatccgtatgctga

SEQ ID NO: 652124 - DNA, 25 bp, Rattus norvegicus
tgtgttcagaacttccgtatgctga

SEQ ID NO: 652125 - DNA, 25 bp, Rattus norvegicus
tgtgttcagacaaacagccatcctc

SEQ ID NO: 652126 - DNA, 25 bp, Rattus norvegicus
tgtgttcagacatacagccatcctc

SEQ ID NO: 652127 - DNA, 25 bp, Rattus norvegicus
tgtgttcagcctcttgggagttgta

SEQ ID NO: 652128 - DNA, 25 bp, Rattus norvegicus
tgtgttcagcctgttgggagttgta

SEQ ID NO: 652129 - DNA, 25 bp, Rattus norvegicus
tgtgttcagctaagtcagtgcccag

SEQ ID NO: 652130 - DNA, 25 bp, Rattus norvegicus
tgtgttcagctatgtcagtgcccag

SEQ ID NO: 652131 - DNA, 25 bp, Rattus norvegicus
tgtgttcagctcacctgttacctca

SEQ ID NO: 652132 - DNA, 25 bp, Rattus norvegicus
tgtgttcagctcagacttccaggag

SEQ ID NO: 652133 - DNA, 25 bp, Rattus norvegicus
tgtgttcagctctcctgttacctca

SEQ ID NO: 652134 - DNA, 25 bp, Rattus norvegicus
tgtgttcagctctgacttccaggag

SEQ ID NO: 652135 - DNA, 25 bp, Rattus norvegicus
tgtgttcatgacactcaagggccat

SEQ ID NO: 652136 - DNA, 25 bp, Rattus norvegicus
tgtgttcatgactctcaagggccat

SEQ ID NO: 652137 - DNA, 25 bp, Rattus norvegicus
tgtgttccacttaatgactccaggc

SEQ ID NO: 652138 - DNA, 25 bp, Rattus norvegicus
tgtgttccactttatgactccaggc

SEQ ID NO: 652139 - DNA, 25 bp, Rattus norvegicus
tgtgttccaggaattcaaccaccac

SEQ ID NO: 652140 - DNA, 25 bp, Rattus norvegicus
tgtgttccaggatttcaaccaccac

SEQ ID NO: 652141 - DNA, 25 bp, Rattus norvegicus
tgtgttccagttcgcatttccagtg

SEQ ID NO: 652142 - DNA, 25 bp, Rattus norvegicus
tgtgttccagttggcatttccagtg

SEQ ID NO: 652143 - DNA, 25 bp, Rattus norvegicus
tgtgttccatgtccagtgttgcctc

SEQ ID NO: 652144 - DNA, 25 bp, Rattus norvegicus
tgtgttccatgtgcagtgttgcctc

SEQ ID NO: 652145 - DNA, 25 bp, Rattus norvegicus
tgtgttcccagcatgtccatggatt

SEQ ID NO: 652146 - DNA, 25 bp, Rattus norvegicus
tgtgttcccagcttgtccatggatt

SEQ ID NO: 652147 - DNA, 25 bp, Rattus norvegicus
tgtgttcccatacggcttgatgcca

SEQ ID NO: 652148 - DNA, 25 bp, Rattus norvegicus
tgtgttcccatagggcttgatgcca

SEQ ID NO: 652149 - DNA, 25 bp, Rattus norvegicus
tgtgttccctcaactaaagaactgg

SEQ ID NO: 652150 - DNA, 25 bp, Rattus norvegicus
tgtgttccctcatctaaagaactgg

SEQ ID NO: 652151 - DNA, 25 bp, Rattus norvegicus
tgtgttcctcccatttcaagtattg

SEQ ID NO: 652152 - DNA, 25 bp, Rattus norvegicus
tgtgttcctcccttttcaagtattg

SEQ ID NO: 652153 - DNA, 25 bp, Rattus norvegicus
tgtgttcctgcccttgtgccttagt

SEQ ID NO: 652154 - DNA, 25 bp, Rattus norvegicus
tgtgttcctgccgttgtgccttagt

SEQ ID NO: 652155 - DNA, 25 bp, Rattus norvegicus
tgtgttcctggaccgcattgacaga

SEQ ID NO: 652156 - DNA, 25 bp, Rattus norvegicus
tgtgttcctggagcgcattgacaga

SEQ ID NO: 652157 - DNA, 25 bp, Rattus norvegicus
tgtgttcctgttagcatgacctgtc

SEQ ID NO: 652158 - DNA, 25 bp, Rattus norvegicus
tgtgttcctgtttgcatgacctgtc

SEQ ID NO: 652159 - DNA, 25 bp, Rattus norvegicus
tgtgttccttctacaagtacagagt

SEQ ID NO: 652160 - DNA, 25 bp, Rattus norvegicus
tgtgttccttcttcaagtacagagt

SEQ ID NO: 652161 - DNA, 25 bp, Rattus norvegicus
tgtgttcctttgaaggcggctccat

SEQ ID NO: 652162 - DNA, 25 bp, Rattus norvegicus
tgtgttcctttgtaggcggctccat

SEQ ID NO: 652163 - DNA, 25 bp, Rattus norvegicus
tgtgttcgagtcaagtctttgccca

SEQ ID NO: 652164 - DNA, 25 bp, Rattus norvegicus
tgtgttcgagtctagtctttgccca

SEQ ID NO: 652165 - DNA, 25 bp, Rattus norvegicus
tgtgttcggcccatgctagagggac

SEQ ID NO: 652166 - DNA, 25 bp, Rattus norvegicus
tgtgttcggcccttgctagagggac

SEQ ID NO: 652167 - DNA, 25 bp, Rattus norvegicus
tgtgttcggtccagaggtagcctta

SEQ ID NO: 652168 - DNA, 25 bp, Rattus norvegicus
tgtgttcggtcctgaggtagcctta

SEQ ID NO: 652169 - DNA, 25 bp, Rattus norvegicus
tgtgttcgttgtcggcttgtaaagc

SEQ ID NO: 652170 - DNA, 25 bp, Rattus norvegicus
tgtgttcgttgtgggcttgtaaagc

SEQ ID NO: 652171 - DNA, 25 bp, Rattus norvegicus
tgtgttctagccactcctgagggtc

SEQ ID NO: 652172 - DNA, 25 bp, Rattus norvegicus
tgtgttctagcctctcctgagggtc

SEQ ID NO: 652173 - DNA, 25 bp, Rattus norvegicus
tgtgttctatggctttcagttctga

SEQ ID NO: 652174 - DNA, 25 bp, Rattus norvegicus
tgtgttctatgggtttcagttctga

SEQ ID NO: 652175 - DNA, 25 bp, Rattus norvegicus
tgtgttctattgatcacattgagaa

SEQ ID NO: 652176 - DNA, 25 bp, Rattus norvegicus
tgtgttctattgttcacattgagaa

SEQ ID NO: 652177 - DNA, 25 bp, Rattus norvegicus
tgtgttctcctaacctgtccctcaa

SEQ ID NO: 652178 - DNA, 25 bp, Rattus norvegicus
tgtgttctcctatcctgtccctcaa

SEQ ID NO: 652179 - DNA, 25 bp, Rattus norvegicus
tgtgttctctatagcctcatgtgta

SEQ ID NO: 652180 - DNA, 25 bp, Rattus norvegicus
tgtgttctctattgcctcatgtgta

SEQ ID NO: 652181 - DNA, 25 bp, Rattus norvegicus
tgtgttctgcctcggtgtatatcca

SEQ ID NO: 652182 - DNA, 25 bp, Rattus norvegicus
tgtgttctgcctgggtgtatatcca

SEQ ID NO: 652183 - DNA, 25 bp, Rattus norvegicus
tgtgttctgggcagaaatccaggac

SEQ ID NO: 652184 - DNA, 25 bp, Rattus norvegicus
tgtgttctgggctgaaatccaggac

SEQ ID NO: 652185 - DNA, 25 bp, Rattus norvegicus
tgtgttcttcatatgcttcgttccc

SEQ ID NO: 652186 - DNA, 25 bp, Rattus norvegicus
tgtgttcttcatttgcttcgttccc

SEQ ID NO: 652187 - DNA, 25 bp, Rattus norvegicus
tgtgttcttcccagtgctctggtca

SEQ ID NO: 652188 - DNA, 25 bp, Rattus norvegicus
tgtgttcttccctgtgctctggtca

SEQ ID NO: 652189 - DNA, 25 bp, Rattus norvegicus
tgtgttcttcctagcacacaggcaa

SEQ ID NO: 652190 - DNA, 25 bp, Rattus norvegicus
tgtgttcttccttgcacacaggcaa

SEQ ID NO: 652191 - DNA, 25 bp, Rattus norvegicus
tgtgttcttgaccacagagtctcca

SEQ ID NO: 652192 - DNA, 25 bp, Rattus norvegicus
tgtgttcttgacgacagagtctcca

SEQ ID NO: 652193 - DNA, 25 bp, Rattus norvegicus
tgtgttcttgctacgttgtgtgagt

SEQ ID NO: 652194 - DNA, 25 bp, Rattus norvegicus
tgtgttcttgcttcgttgtgtgagt

SEQ ID NO: 652195 - DNA, 25 bp, Rattus norvegicus
tgtgttctttcacgcgatggtgact

SEQ ID NO: 652196 - DNA, 25 bp, Rattus norvegicus
tgtgttctttcaggcgatggtgact

SEQ ID NO: 652197 - DNA, 25 bp, Rattus norvegicus
tgtgttctttgtacagtgtttgtct

SEQ ID NO: 652198 - DNA, 25 bp, Rattus norvegicus
tgtgttctttgttcagtgtttgtct

SEQ ID NO: 652199 - DNA, 25 bp, Rattus norvegicus
tgtgttctttttctgctggcagaga

SEQ ID NO: 652200 - DNA, 25 bp, Rattus norvegicus
tgtgttctttttgtgctggcagaga

SEQ ID NO: 652201 - DNA, 25 bp, Rattus norvegicus
tgtgttgaaatccttgtctcctgta

SEQ ID NO: 652202 - DNA, 25 bp, Rattus norvegicus
tgtgttgaaatcgttgtctcctgta

SEQ ID NO: 652203 - DNA, 25 bp, Rattus norvegicus
tgtgttgacaccatgccctaaacat

SEQ ID NO: 652204 - DNA, 25 bp, Rattus norvegicus
tgtgttgacaccttgccctaaacat

SEQ ID NO: 652205 - DNA, 25 bp, Rattus norvegicus
tgtgttgacacgcacatatggaatc

SEQ ID NO: 652206 - DNA, 25 bp, Rattus norvegicus
tgtgttgacacggacatatggaatc

SEQ ID NO: 652207 - DNA, 25 bp, Rattus norvegicus
tgtgttgacttccaagtaccgttaa

SEQ ID NO: 652208 - DNA, 25 bp, Rattus norvegicus
tgtgttgacttcgaagtaccgttaa

SEQ ID NO: 652209 - DNA, 25 bp, Rattus norvegicus
tgtgttgaggccagtgtccactgga

SEQ ID NO: 652210 - DNA, 25 bp, Rattus norvegicus
tgtgttgaggcctgtgtccactgga

SEQ ID NO: 652211 - DNA, 25 bp, Rattus norvegicus
tgtgttgatcttatcttcctcaacc

SEQ ID NO: 652212 - DNA, 25 bp, Rattus norvegicus
tgtgttgatcttttcttcctcaacc

SEQ ID NO: 652213 - DNA, 25 bp, Rattus norvegicus
tgtgttgatggaaaaccaggcagaa

SEQ ID NO: 652214 - DNA, 25 bp, Rattus norvegicus
tgtgttgatggataaccaggcagaa

SEQ ID NO: 652215 - DNA, 25 bp, Rattus norvegicus
tgtgttgatgtcacctttcagggtt

SEQ ID NO: 652216 - DNA, 25 bp, Rattus norvegicus
tgtgttgatgtctcctttcagggtt

SEQ ID NO: 652217 - DNA, 25 bp, Rattus norvegicus
tgtgttgatttgcttcttttctgga

SEQ ID NO: 652218 - DNA, 25 bp, Rattus norvegicus
tgtgttgatttggttcttttctgga

SEQ ID NO: 652219 - DNA, 25 bp, Rattus norvegicus
tgtgttgcaaacctggaccaattgt

SEQ ID NO: 652220 - DNA, 25 bp, Rattus norvegicus
tgtgttgcaaacgtggaccaattgt

SEQ ID NO: 652221 - DNA, 25 bp, Rattus norvegicus
tgtgttgcagcgagccacctgtaac

SEQ ID NO: 652222 - DNA, 25 bp, Rattus norvegicus
tgtgttgcagcgtgccacctgtaac

SEQ ID NO: 652223 - DNA, 25 bp, Rattus norvegicus
tgtgttgccagcactctgtacaaat

SEQ ID NO: 652224 - DNA, 25 bp, Rattus norvegicus
tgtgttgccagctctctgtacaaat

SEQ ID NO: 652225 - DNA, 25 bp, Rattus norvegicus
tgtgttgcccagattgagccagatt

SEQ ID NO: 652226 - DNA, 25 bp, Rattus norvegicus
tgtgttgcccagtttgagccagatt

SEQ ID NO: 652227 - DNA, 25 bp, Rattus norvegicus
tgtgttgcctacatttctcctagga

SEQ ID NO: 652228 - DNA, 25 bp, Rattus norvegicus
tgtgttgcctaccacattcagcctt

SEQ ID NO: 652229 - DNA, 25 bp, Rattus norvegicus
tgtgttgcctacgacattcagcctt

SEQ ID NO: 652230 - DNA, 25 bp, Rattus norvegicus
tgtgttgcctacttttctcctagga

SEQ ID NO: 652231 - DNA, 25 bp, Rattus norvegicus
tgtgttgccttcaccatctgtccta

SEQ ID NO: 652232 - DNA, 25 bp, Rattus norvegicus
tgtgttgccttctccatctgtccta

SEQ ID NO: 652233 - DNA, 25 bp, Rattus norvegicus
tgtgttgctattactggttctcttt

SEQ ID NO: 652234 - DNA, 25 bp, Rattus norvegicus
tgtgttgctatttctggttctcttt

SEQ ID NO: 652235 - DNA, 25 bp, Rattus norvegicus
tgtgttgctcccattctggaaataa

SEQ ID NO: 652236 - DNA, 25 bp, Rattus norvegicus
tgtgttgctccctttctggaaataa

SEQ ID NO: 652237 - DNA, 25 bp, Rattus norvegicus
tgtgttgctctcaggaggtggtttc

SEQ ID NO: 652238 - DNA, 25 bp, Rattus norvegicus
tgtgttgctctctggaggtggtttc

SEQ ID NO: 652239 - DNA, 25 bp, Rattus norvegicus
tgtgttgctcttcaggctttacctg

SEQ ID NO: 652240 - DNA, 25 bp, Rattus norvegicus
tgtgttgctcttgaggctttacctg

SEQ ID NO: 652241 - DNA, 25 bp, Rattus norvegicus
tgtgttgctgctccctgtgggacat

SEQ ID NO: 652242 - DNA, 25 bp, Rattus norvegicus
tgtgttgctgctgcctgtgggacat

SEQ ID NO: 652243 - DNA, 25 bp, Rattus norvegicus
tgtgttggaagtacgtgagccccgc

SEQ ID NO: 652244 - DNA, 25 bp, Rattus norvegicus
tgtgttggaagttcgtgagccccgc

SEQ ID NO: 652245 - DNA, 25 bp, Rattus norvegicus
tgtgttggaattctcgctgccttaa

SEQ ID NO: 652246 - DNA, 25 bp, Rattus norvegicus
tgtgttggaattgtcgctgccttaa

SEQ ID NO: 652247 - DNA, 25 bp, Rattus norvegicus
tgtgttggtccaaacttgaatctga

SEQ ID NO: 652248 - DNA, 25 bp, Rattus norvegicus
tgtgttggtccatacttgaatctga

SEQ ID NO: 652249 - DNA, 25 bp, Rattus norvegicus
tgtgttgtaccgacttagctattcc

SEQ ID NO: 652250 - DNA, 25 bp, Rattus norvegicus
tgtgttgtaccgtcttagctattcc

SEQ ID NO: 652251 - DNA, 25 bp, Rattus norvegicus
tgtgttgtagtgcagctccattact

SEQ ID NO: 652252 - DNA, 25 bp, Rattus norvegicus
tgtgttgtagtggagctccattact

SEQ ID NO: 652253 - DNA, 25 bp, Rattus norvegicus
tgtgttgtcacaaggccagagccca

SEQ ID NO: 652254 - DNA, 25 bp, Rattus norvegicus
tgtgttgtcacatggccagagccca

SEQ ID NO: 652255 - DNA, 25 bp, Rattus norvegicus
tgtgttgtcaggctgatgacccagt

SEQ ID NO: 652256 - DNA, 25 bp, Rattus norvegicus
tgtgttgtcagggtgatgacccagt

SEQ ID NO: 652257 - DNA, 25 bp, Rattus norvegicus
tgtgttgtcagtctcttctttgtaa

SEQ ID NO: 652258 - DNA, 25 bp, Rattus norvegicus
tgtgttgtcagtgtcttctttgtaa

SEQ ID NO: 652259 - DNA, 25 bp, Rattus norvegicus
tgtgttgtcatcagaagggcgcccc

SEQ ID NO: 652260 - DNA, 25 bp, Rattus norvegicus
tgtgttgtcatctgaagggcgcccc

SEQ ID NO: 652261 - DNA, 25 bp, Rattus norvegicus
tgtgttgtccctcatgccatttttc

SEQ ID NO: 652262 - DNA, 25 bp, Rattus norvegicus
tgtgttgtccctctatgcctctggt

SEQ ID NO: 652263 - DNA, 25 bp, Rattus norvegicus
tgtgttgtccctgatgccatttttc

SEQ ID NO: 652264 - DNA, 25 bp, Rattus norvegicus
tgtgttgtccctgtatgcctctggt

SEQ ID NO: 652265 - DNA, 25 bp, Rattus norvegicus
tgtgttgtcgccagcgttaatgcat

SEQ ID NO: 652266 - DNA, 25 bp, Rattus norvegicus
tgtgttgtcgcctgcgttaatgcat

SEQ ID NO: 652267 - DNA, 25 bp, Rattus norvegicus
tgtgttgtctgcagtcgctggtaac

SEQ ID NO: 652268 - DNA, 25 bp, Rattus norvegicus
tgtgttgtctgctgtcgctggtaac

SEQ ID NO: 652269 - DNA, 25 bp, Rattus norvegicus
tgtgttgtctgtaacgtgcttccca

SEQ ID NO: 652270 - DNA, 25 bp, Rattus norvegicus
tgtgttgtctgttacgtgcttccca

SEQ ID NO: 652271 - DNA, 25 bp, Rattus norvegicus
tgtgttgtgctacattcctgagcaa

SEQ ID NO: 652272 - DNA, 25 bp, Rattus norvegicus
tgtgttgtgctagattcctgagcaa

SEQ ID NO: 652273 - DNA, 25 bp, Rattus norvegicus
tgtgttgttcacatcccatcagggt

SEQ ID NO: 652274 - DNA, 25 bp, Rattus norvegicus
tgtgttgttcacttcccatcagggt

SEQ ID NO: 652275 - DNA, 25 bp, Rattus norvegicus
tgtgttgttgtcagcatttggctgc

SEQ ID NO: 652276 - DNA, 25 bp, Rattus norvegicus
tgtgttgttgtctgcatttggctgc

SEQ ID NO: 652277 - DNA, 25 bp, Rattus norvegicus
tgtgttgtttatactctccttcctg

SEQ ID NO: 652278 - DNA, 25 bp, Rattus norvegicus
tgtgttgtttattctctccttcctg

SEQ ID NO: 652279 - DNA, 25 bp, Rattus norvegicus
tgtgttgtttctcgctttgattata

SEQ ID NO: 652280 - DNA, 25 bp, Rattus norvegicus
tgtgttgtttctggctttgattata

SEQ ID NO: 652281 - DNA, 25 bp, Rattus norvegicus
tgtgttgtttgcatgtttctttgct

SEQ ID NO: 652282 - DNA, 25 bp, Rattus norvegicus
tgtgttgtttgcttgtttctttgct

SEQ ID NO: 652283 - DNA, 25 bp, Rattus norvegicus
tgtgtttaacttactgagggacttc

SEQ ID NO: 652284 - DNA, 25 bp, Rattus norvegicus
tgtgtttaactttctgagggacttc

SEQ ID NO: 652285 - DNA, 25 bp, Rattus norvegicus
tgtgtttaagccatgtgcccagaat

SEQ ID NO: 652286 - DNA, 25 bp, Rattus norvegicus
tgtgtttaagccttgtgcccagaat

SEQ ID NO: 652287 - DNA, 25 bp, Rattus norvegicus
tgtgtttacatgatccgtccatcca

SEQ ID NO: 652288 - DNA, 25 bp, Rattus norvegicus
tgtgtttacatgttccgtccatcca

SEQ ID NO: 652289 - DNA, 25 bp, Rattus norvegicus
tgtgtttacgtaagttcctgtcgct

SEQ ID NO: 652290 - DNA, 25 bp, Rattus norvegicus
tgtgtttacgtatgttcctgtcgct

SEQ ID NO: 652291 - DNA, 25 bp, Rattus norvegicus
tgtgtttagggaccccaattttctg

SEQ ID NO: 652292 - DNA, 25 bp, Rattus norvegicus
tgtgtttagggagcccaattttctg

SEQ ID NO: 652293 - DNA, 25 bp, Rattus norvegicus
tgtgtttatcccactcgtaacttct

SEQ ID NO: 652294 - DNA, 25 bp, Rattus norvegicus
tgtgtttatccctctcgtaacttct

SEQ ID NO: 652295 - DNA, 25 bp, Rattus norvegicus
tgtgtttcacctcacactggaatct

SEQ ID NO: 652296 - DNA, 25 bp, Rattus norvegicus
tgtgtttcacctgacactggaatct

SEQ ID NO: 652297 - DNA, 25 bp, Rattus norvegicus
tgtgtttcagcaaaccctgtgactg

SEQ ID NO: 652298 - DNA, 25 bp, Rattus norvegicus
tgtgtttcagcataccctgtgactg

SEQ ID NO: 652299 - DNA, 25 bp, Rattus norvegicus
tgtgtttccagcagctcatgagtga

SEQ ID NO: 652300 - DNA, 25 bp, Rattus norvegicus
tgtgtttccagctgctcatgagtga

SEQ ID NO: 652301 - DNA, 25 bp, Rattus norvegicus
tgtgtttccattccacggtgacaaa

SEQ ID NO: 652302 - DNA, 25 bp, Rattus norvegicus
tgtgtttccattgcacggtgacaaa

SEQ ID NO: 652303 - DNA, 25 bp, Rattus norvegicus
tgtgtttcccacaatcactgtacat

SEQ ID NO: 652304 - DNA, 25 bp, Rattus norvegicus
tgtgtttcccactatcactgtacat

SEQ ID NO: 652305 - DNA, 25 bp, Rattus norvegicus
tgtgtttccccaacagtttttaaat

SEQ ID NO: 652306 - DNA, 25 bp, Rattus norvegicus
tgtgtttccccatcagtttttaaat

SEQ ID NO: 652307 - DNA, 25 bp, Rattus norvegicus
tgtgtttcctaccagctctgagtaa

SEQ ID NO: 652308 - DNA, 25 bp, Rattus norvegicus
tgtgtttcctacgagctctgagtaa

SEQ ID NO: 652309 - DNA, 25 bp, Rattus norvegicus
tgtgtttccttcacaacagtcactt

SEQ ID NO: 652310 - DNA, 25 bp, Rattus norvegicus
tgtgtttccttcactgacttgtaat

SEQ ID NO: 652311 - DNA, 25 bp, Rattus norvegicus
tgtgtttccttctcaacagtcactt

SEQ ID NO: 652312 - DNA, 25 bp, Rattus norvegicus
tgtgtttccttctctgacttgtaat

SEQ ID NO: 652313 - DNA, 25 bp, Rattus norvegicus
tgtgtttctaacaaagccatttaat

SEQ ID NO: 652314 - DNA, 25 bp, Rattus norvegicus
tgtgtttctaactaagccatttaat

SEQ ID NO: 652315 - DNA, 25 bp, Rattus norvegicus
tgtgtttctacaacagtgcatcttg

SEQ ID NO: 652316 - DNA, 25 bp, Rattus norvegicus
tgtgtttctacatcagtgcatcttg

SEQ ID NO: 652317 - DNA, 25 bp, Rattus norvegicus
tgtgtttctcccattcttagaggga

SEQ ID NO: 652318 - DNA, 25 bp, Rattus norvegicus
tgtgtttctccctttcttagaggga

SEQ ID NO: 652319 - DNA, 25 bp, Rattus norvegicus
tgtgtttctgccatgggtttctgcc

SEQ ID NO: 652320 - DNA, 25 bp, Rattus norvegicus
tgtgtttctgccttgggtttctgcc

SEQ ID NO: 652321 - DNA, 25 bp, Rattus norvegicus
tgtgtttctgctagcctaccttcaa

SEQ ID NO: 652322 - DNA, 25 bp, Rattus norvegicus
tgtgtttctgcttgcctaccttcaa

SEQ ID NO: 652323 - DNA, 25 bp, Rattus norvegicus
tgtgtttgaattagtacggccaccc

SEQ ID NO: 652324 - DNA, 25 bp, Rattus norvegicus
tgtgtttgaatttgtacggccaccc

SEQ ID NO: 652325 - DNA, 25 bp, Rattus norvegicus
tgtgtttgagatcgtccctcaggct

SEQ ID NO: 652326 - DNA, 25 bp, Rattus norvegicus
tgtgtttgagatggtccctcaggct

SEQ ID NO: 652327 - DNA, 25 bp, Rattus norvegicus
tgtgtttgatccaactctacctaag

SEQ ID NO: 652328 - DNA, 25 bp, Rattus norvegicus
tgtgtttgatcctactctacctaag

SEQ ID NO: 652329 - DNA, 25 bp, Rattus norvegicus
tgtgtttgctcaccagttccagaaa

SEQ ID NO: 652330 - DNA, 25 bp, Rattus norvegicus
tgtgtttgctcagcagttccagaaa

SEQ ID NO: 652331 - DNA, 25 bp, Rattus norvegicus
tgtgtttgctttaccggaccccgct

SEQ ID NO: 652332 - DNA, 25 bp, Rattus norvegicus
tgtgtttgcttttccggaccccgct

SEQ ID NO: 652333 - DNA, 25 bp, Rattus norvegicus
tgtgtttggagaatgttcctactgt

SEQ ID NO: 652334 - DNA, 25 bp, Rattus norvegicus
tgtgtttggagattgttcctactgt

SEQ ID NO: 652335 - DNA, 25 bp, Rattus norvegicus
tgtgtttggagtccccgtgctacaa

SEQ ID NO: 652336 - DNA, 25 bp, Rattus norvegicus
tgtgtttggagtgcccgtgctacaa

SEQ ID NO: 652337 - DNA, 25 bp, Rattus norvegicus
tgtgtttggccacatgaaaccaggc

SEQ ID NO: 652338 - DNA, 25 bp, Rattus norvegicus
tgtgtttggccagatgaaaccaggc

SEQ ID NO: 652339 - DNA, 25 bp, Rattus norvegicus
tgtgtttggcgacttctgttcattc

SEQ ID NO: 652340 - DNA, 25 bp, Rattus norvegicus
tgtgtttggcgagttctgttcattc

SEQ ID NO: 652341 - DNA, 25 bp, Rattus norvegicus
tgtgtttgggctcagtcatctgcac

SEQ ID NO: 652342 - DNA, 25 bp, Rattus norvegicus
tgtgtttgggctccctcataccaga

SEQ ID NO: 652343 - DNA, 25 bp, Rattus norvegicus
tgtgtttgggctgagtcatctgcac

SEQ ID NO: 652344 - DNA, 25 bp, Rattus norvegicus
tgtgtttgggctgcctcataccaga

SEQ ID NO: 652345 - DNA, 25 bp, Rattus norvegicus
tgtgtttgtagtaccattccttttt

SEQ ID NO: 652346 - DNA, 25 bp, Rattus norvegicus
tgtgtttgtagttccattccttttt

SEQ ID NO: 652347 - DNA, 25 bp, Rattus norvegicus
tgtgtttgtcataagcctgactaga

SEQ ID NO: 652348 - DNA, 25 bp, Rattus norvegicus
tgtgtttgtcattagcctgactaga

SEQ ID NO: 652349 - DNA, 25 bp, Rattus norvegicus
tgtgtttgtgtcagacccacacatg

SEQ ID NO: 652350 - DNA, 25 bp, Rattus norvegicus
tgtgtttgtgtcagtttctgtaccg

SEQ ID NO: 652351 - DNA, 25 bp, Rattus norvegicus
tgtgtttgtgtctgacccacacatg

SEQ ID NO: 652352 - DNA, 25 bp, Rattus norvegicus
tgtgtttgtgtctgtttctgtaccg

SEQ ID NO: 652353 - DNA, 25 bp, Rattus norvegicus
tgtgtttgtgtgaccagatttccct

SEQ ID NO: 652354 - DNA, 25 bp, Rattus norvegicus
tgtgtttgtgtgtccagatttccct

SEQ ID NO: 652355 - DNA, 25 bp, Rattus norvegicus
tgtgtttgttttcttctcttcgttt

SEQ ID NO: 652356 - DNA, 25 bp, Rattus norvegicus
tgtgtttgttttgttctcttcgttt

SEQ ID NO: 652357 - DNA, 25 bp, Rattus norvegicus
tgtgttttacatcttgtcgcctgtg

SEQ ID NO: 652358 - DNA, 25 bp, Rattus norvegicus
tgtgttttacatgttgtcgcctgtg

SEQ ID NO: 652359 - DNA, 25 bp, Rattus norvegicus
tgtgttttactccagtcgccagaaa

SEQ ID NO: 652360 - DNA, 25 bp, Rattus norvegicus
tgtgttttactcgagtcgccagaaa

SEQ ID NO: 652361 - DNA, 25 bp, Rattus norvegicus
tgtgttttccagctttctttcccat

SEQ ID NO: 652362 - DNA, 25 bp, Rattus norvegicus
tgtgttttccaggtttctttcccat

SEQ ID NO: 652363 - DNA, 25 bp, Rattus norvegicus
tgtgttttccctattgtcccaatgg

SEQ ID NO: 652364 - DNA, 25 bp, Rattus norvegicus
tgtgttttcccttttgtcccaatgg

SEQ ID NO: 652365 - DNA, 25 bp, Rattus norvegicus
tgtgttttcgataaactccgctgag

SEQ ID NO: 652366 - DNA, 25 bp, Rattus norvegicus
tgtgttttcgattaactccgctgag

SEQ ID NO: 652367 - DNA, 25 bp, Rattus norvegicus
tgtgttttctctactctggtaataa

SEQ ID NO: 652368 - DNA, 25 bp, Rattus norvegicus
tgtgttttctctacttgcattaggc

SEQ ID NO: 652369 - DNA, 25 bp, Rattus norvegicus
tgtgttttctcttctctggtaataa

SEQ ID NO: 652370 - DNA, 25 bp, Rattus norvegicus
tgtgttttctcttcttgcattaggc

SEQ ID NO: 652371 - DNA, 25 bp, Rattus norvegicus
tgtgttttcttcagaccattctccc

SEQ ID NO: 652372 - DNA, 25 bp, Rattus norvegicus
tgtgttttcttctgaccattctccc

SEQ ID NO: 652373 - DNA, 25 bp, Rattus norvegicus
tgtgttttctttcgcttgacagtaa

SEQ ID NO: 652374 - DNA, 25 bp, Rattus norvegicus
tgtgttttctttggcttgacagtaa

SEQ ID NO: 652375 - DNA, 25 bp, Rattus norvegicus
tgtgtttttgtcattaccccttcag

SEQ ID NO: 652376 - DNA, 25 bp, Rattus norvegicus
tgtgtttttgtctttaccccttcag

SEQ ID NO: 652377 - DNA, 25 bp, Rattus norvegicus
tgtgttttttacacggcctgtaatt

SEQ ID NO: 652378 - DNA, 25 bp, Rattus norvegicus
tgtgttttttactcggcctgtaatt

SEQ ID NO: 652379 - DNA, 25 bp, Rattus norvegicus
tgtgttttttgtcctgtttactgtc

SEQ ID NO: 652380 - DNA, 25 bp, Rattus norvegicus
tgtgttttttgtgctgtttactgtc

SEQ ID NO: 652381 - DNA, 25 bp, Rattus norvegicus
tgttaaaaacagatccccattgtgg

SEQ ID NO: 652382 - DNA, 25 bp, Rattus norvegicus
tgttaaaaacagttccccattgtgg

SEQ ID NO: 652383 - DNA, 25 bp, Rattus norvegicus
tgttaaaaatcactccccgttggtg

SEQ ID NO: 652384 - DNA, 25 bp, Rattus norvegicus
tgttaaaaatcagtccccgttggtg

SEQ ID NO: 652385 - DNA, 25 bp, Rattus norvegicus
tgttaaaagcacactggacctccag

SEQ ID NO: 652386 - DNA, 25 bp, Rattus norvegicus
tgttaaaagcactctggacctccag

SEQ ID NO: 652387 - DNA, 25 bp, Rattus norvegicus
tgttaaaatgcaccctttgggacct

SEQ ID NO: 652388 - DNA, 25 bp, Rattus norvegicus
tgttaaaatgcagcctttgggacct

SEQ ID NO: 652389 - DNA, 25 bp, Rattus norvegicus
tgttaaaccatgctgaccttgaagt

SEQ ID NO: 652390 - DNA, 25 bp, Rattus norvegicus
tgttaaaccatggtgaccttgaagt

SEQ ID NO: 652391 - DNA, 25 bp, Rattus norvegicus
tgttaaacccctcttaactctccat

SEQ ID NO: 652392 - DNA, 25 bp, Rattus norvegicus
tgttaaacccctgttaactctccat

SEQ ID NO: 652393 - DNA, 25 bp, Rattus norvegicus
tgttaaactgccagcttgggcaaaa

SEQ ID NO: 652394 - DNA, 25 bp, Rattus norvegicus
tgttaaactgcctgcttgggcaaaa

SEQ ID NO: 652395 - DNA, 25 bp, Rattus norvegicus
tgttaaagttggcacctactgggca

SEQ ID NO: 652396 - DNA, 25 bp, Rattus norvegicus
tgttaaagttgggacctactgggca

SEQ ID NO: 652397 - DNA, 25 bp, Rattus norvegicus
tgttaaatccttaatgaacctttca

SEQ ID NO: 652398 - DNA, 25 bp, Rattus norvegicus
tgttaaatcctttatgaacctttca

SEQ ID NO: 652399 - DNA, 25 bp, Rattus norvegicus
tgttaacaacccatatctcttagtg

SEQ ID NO: 652400 - DNA, 25 bp, Rattus norvegicus
tgttaacaacccttatctcttagtg

SEQ ID NO: 652401 - DNA, 25 bp, Rattus norvegicus
tgttaacacagccaacttactttcc

SEQ ID NO: 652402 - DNA, 25 bp, Rattus norvegicus
tgttaacacagcgaacttactttcc

SEQ ID NO: 652403 - DNA, 25 bp, Rattus norvegicus
tgttaacaccttattctggacccct

SEQ ID NO: 652404 - DNA, 25 bp, Rattus norvegicus
tgttaacacctttttctggacccct

SEQ ID NO: 652405 - DNA, 25 bp, Rattus norvegicus
tgttaacagctcagacatcatcagt

SEQ ID NO: 652406 - DNA, 25 bp, Rattus norvegicus
tgttaacagctctgacatcatcagt

SEQ ID NO: 652407 - DNA, 25 bp, Rattus norvegicus
tgttaacataggctcagggactgat

SEQ ID NO: 652408 - DNA, 25 bp, Rattus norvegicus
tgttaacatagggtcagggactgat

SEQ ID NO: 652409 - DNA, 25 bp, Rattus norvegicus
tgttaaccactgataccctggacaa

SEQ ID NO: 652410 - DNA, 25 bp, Rattus norvegicus
tgttaaccactgttaccctggacaa

SEQ ID NO: 652411 - DNA, 25 bp, Rattus norvegicus
tgttaaccagcacgttcatcaccgc

SEQ ID NO: 652412 - DNA, 25 bp, Rattus norvegicus
tgttaaccagcaggttcatcaccgc

SEQ ID NO: 652413 - DNA, 25 bp, Rattus norvegicus
tgttaacctcatctagcagattcac

SEQ ID NO: 652414 - DNA, 25 bp, Rattus norvegicus
tgttaacctcatgtagcagattcac

SEQ ID NO: 652415 - DNA, 25 bp, Rattus norvegicus
tgttaaccttcactggtacctacca

SEQ ID NO: 652416 - DNA, 25 bp, Rattus norvegicus
tgttaaccttcagtggtacctacca

SEQ ID NO: 652417 - DNA, 25 bp, Rattus norvegicus
tgttaactagtgaggctcttcagcg

SEQ ID NO: 652418 - DNA, 25 bp, Rattus norvegicus
tgttaactagtgtggctcttcagcg

SEQ ID NO: 652419 - DNA, 25 bp, Rattus norvegicus
tgttaactcgccatactataaaggg

SEQ ID NO: 652420 - DNA, 25 bp, Rattus norvegicus
tgttaactcgccttactataaaggg

SEQ ID NO: 652421 - DNA, 25 bp, Rattus norvegicus
tgttaactcgttacgctgctaggca

SEQ ID NO: 652422 - DNA, 25 bp, Rattus norvegicus
tgttaactcgtttcgctgctaggca

SEQ ID NO: 652423 - DNA, 25 bp, Rattus norvegicus
tgttaactctccacccaagtacaga

SEQ ID NO: 652424 - DNA, 25 bp, Rattus norvegicus
tgttaactctcctcccaagtacaga

SEQ ID NO: 652425 - DNA, 25 bp, Rattus norvegicus
tgttaactctttacatgcctcactt

SEQ ID NO: 652426 - DNA, 25 bp, Rattus norvegicus
tgttaactcttttcatgcctcactt

SEQ ID NO: 652427 - DNA, 25 bp, Rattus norvegicus
tgttaactgtccaaattctgccatc

SEQ ID NO: 652428 - DNA, 25 bp, Rattus norvegicus
tgttaactgtcctaattctgccatc

SEQ ID NO: 652429 - DNA, 25 bp, Rattus norvegicus
tgttaacttattcctgggactcctt

SEQ ID NO: 652430 - DNA, 25 bp, Rattus norvegicus
tgttaacttattgctgggactcctt

SEQ ID NO: 652431 - DNA, 25 bp, Rattus norvegicus
tgttaacttcagaagcagcctcggt

SEQ ID NO: 652432 - DNA, 25 bp, Rattus norvegicus
tgttaacttcagtagcagcctcggt

SEQ ID NO: 652433 - DNA, 25 bp, Rattus norvegicus
tgttaagacatcagccgggccgact

SEQ ID NO: 652434 - DNA, 25 bp, Rattus norvegicus
tgttaagacatctgccgggccgact

SEQ ID NO: 652435 - DNA, 25 bp, Rattus norvegicus
tgttaagagtcccatgagcacccac

SEQ ID NO: 652436 - DNA, 25 bp, Rattus norvegicus
tgttaagagtccgatgagcacccac

SEQ ID NO: 652437 - DNA, 25 bp, Rattus norvegicus
tgttaagatgtgaacctgccgtctc

SEQ ID NO: 652438 - DNA, 25 bp, Rattus norvegicus
tgttaagatgtgtacctgccgtctc

SEQ ID NO: 652439 - DNA, 25 bp, Rattus norvegicus
tgttaagcaagaatcgcccacgtgg

SEQ ID NO: 652440 - DNA, 25 bp, Rattus norvegicus
tgttaagcaagattcgcccacgtgg

SEQ ID NO: 652441 - DNA, 25 bp, Rattus norvegicus
tgttaagcacagcagccagatctcc

SEQ ID NO: 652442 - DNA, 25 bp, Rattus norvegicus
tgttaagcacaggagccagatctcc

SEQ ID NO: 652443 - DNA, 25 bp, Rattus norvegicus
tgttaagcagtcagtattccacact

SEQ ID NO: 652444 - DNA, 25 bp, Rattus norvegicus
tgttaagcagtctgtattccacact

SEQ ID NO: 652445 - DNA, 25 bp, Rattus norvegicus
tgttaagcctacacaatcctgtcca

SEQ ID NO: 652446 - DNA, 25 bp, Rattus norvegicus
tgttaagcctactcaatcctgtcca

SEQ ID NO: 652447 - DNA, 25 bp, Rattus norvegicus
tgttaaggcaacagttccccagaca

SEQ ID NO: 652448 - DNA, 25 bp, Rattus norvegicus
tgttaaggcaactgttccccagaca

SEQ ID NO: 652449 - DNA, 25 bp, Rattus norvegicus
tgttaagtattccagccatgctgct

SEQ ID NO: 652450 - DNA, 25 bp, Rattus norvegicus
tgttaagtattcgagccatgctgct

SEQ ID NO: 652451 - DNA, 25 bp, Rattus norvegicus
tgttaagtggcaataaaacccacca

SEQ ID NO: 652452 - DNA, 25 bp, Rattus norvegicus
tgttaagtggcattaaaacccacca

SEQ ID NO: 652453 - DNA, 25 bp, Rattus norvegicus
tgttaagtggccatggacccttgtc

SEQ ID NO: 652454 - DNA, 25 bp, Rattus norvegicus
tgttaagtggccttggacccttgtc

SEQ ID NO: 652455 - DNA, 25 bp, Rattus norvegicus
tgttaagtggctattccagcgagat

SEQ ID NO: 652456 - DNA, 25 bp, Rattus norvegicus
tgttaagtggcttttccagcgagat

SEQ ID NO: 652457 - DNA, 25 bp, Rattus norvegicus
tgttaataagctagccctgcctcgg

SEQ ID NO: 652458 - DNA, 25 bp, Rattus norvegicus
tgttaataagcttgccctgcctcgg

SEQ ID NO: 652459 - DNA, 25 bp, Rattus norvegicus
tgttaataagtcctccatcctggag

SEQ ID NO: 652460 - DNA, 25 bp, Rattus norvegicus
tgttaataagtcgtccatcctggag

SEQ ID NO: 652461 - DNA, 25 bp, Rattus norvegicus
tgttaataccttcaccatgcggagc

SEQ ID NO: 652462 - DNA, 25 bp, Rattus norvegicus
tgttaataccttgaccatgcggagc

SEQ ID NO: 652463 - DNA, 25 bp, Rattus norvegicus
tgttaataggttatctccatcccca

SEQ ID NO: 652464 - DNA, 25 bp, Rattus norvegicus
tgttaataggttttctccatcccca

SEQ ID NO: 652465 - DNA, 25 bp, Rattus norvegicus
tgttaatagttaacacctcctgggt

SEQ ID NO: 652466 - DNA, 25 bp, Rattus norvegicus
tgttaatagttatcacctcctgggt

SEQ ID NO: 652467 - DNA, 25 bp, Rattus norvegicus
tgttaatatcttacgttatgggtaa

SEQ ID NO: 652468 - DNA, 25 bp, Rattus norvegicus
tgttaatatctttcgttatgggtaa

SEQ ID NO: 652469 - DNA, 25 bp, Rattus norvegicus
tgttaatccaacaggagcgccaaag

SEQ ID NO: 652470 - DNA, 25 bp, Rattus norvegicus
tgttaatccaactggagcgccaaag

SEQ ID NO: 652471 - DNA, 25 bp, Rattus norvegicus
tgttaattatgcagggccctggaat

SEQ ID NO: 652472 - DNA, 25 bp, Rattus norvegicus
tgttaattatgctgggccctggaat

SEQ ID NO: 652473 - DNA, 25 bp, Rattus norvegicus
tgttaattctataccaatgggccca

SEQ ID NO: 652474 - DNA, 25 bp, Rattus norvegicus
tgttaattctattccaatgggccca

SEQ ID NO: 652475 - DNA, 25 bp, Rattus norvegicus
tgttaattctcacaggccacatctc

SEQ ID NO: 652476 - DNA, 25 bp, Rattus norvegicus
tgttaattctcagaggccacatctc

SEQ ID NO: 652477 - DNA, 25 bp, Rattus norvegicus
tgttaatttattagcttccctcctt

SEQ ID NO: 652478 - DNA, 25 bp, Rattus norvegicus
tgttaatttatttgcttccctcctt

SEQ ID NO: 652479 - DNA, 25 bp, Rattus norvegicus
tgttaatttcatctgtgcccgtggc

SEQ ID NO: 652480 - DNA, 25 bp, Rattus norvegicus
tgttaatttcatgtgtgcccgtggc

SEQ ID NO: 652481 - DNA, 25 bp, Rattus norvegicus
tgttaatttcctcgttacttggagt

SEQ ID NO: 652482 - DNA, 25 bp, Rattus norvegicus
tgttaatttcctggttacttggagt

SEQ ID NO: 652483 - DNA, 25 bp, Rattus norvegicus
tgttaatttgcacacactagtcatt

SEQ ID NO: 652484 - DNA, 25 bp, Rattus norvegicus
tgttaatttgcagacactagtcatt

SEQ ID NO: 652485 - DNA, 25 bp, Rattus norvegicus
tgttaattttgtaaagagcagccca

SEQ ID NO: 652486 - DNA, 25 bp, Rattus norvegicus
tgttaattttgttaagagcagccca

SEQ ID NO: 652487 - DNA, 25 bp, Rattus norvegicus
tgttacaaaccacacgatgcacctt

SEQ ID NO: 652488 - DNA, 25 bp, Rattus norvegicus
tgttacaaaccagacgatgcacctt

SEQ ID NO: 652489 - DNA, 25 bp, Rattus norvegicus
tgttacaacaacacatccccacttg

SEQ ID NO: 652490 - DNA, 25 bp, Rattus norvegicus
tgttacaacaactcatccccacttg

SEQ ID NO: 652491 - DNA, 25 bp, Rattus norvegicus
tgttacaactctatcggatggctct

SEQ ID NO: 652492 - DNA, 25 bp, Rattus norvegicus
tgttacaactctttcggatggctct

SEQ ID NO: 652493 - DNA, 25 bp, Rattus norvegicus
tgttacaagccaagtccagtcactg

SEQ ID NO: 652494 - DNA, 25 bp, Rattus norvegicus
tgttacaagccatgtccagtcactg

SEQ ID NO: 652495 - DNA, 25 bp, Rattus norvegicus
tgttacaaggtcaccccacaagtga

SEQ ID NO: 652496 - DNA, 25 bp, Rattus norvegicus
tgttacaaggtctccccacaagtga

SEQ ID NO: 652497 - DNA, 25 bp, Rattus norvegicus
tgttacacaaaactgtccccaagtc

SEQ ID NO: 652498 - DNA, 25 bp, Rattus norvegicus
tgttacacaaaagtgtccccaagtc

SEQ ID NO: 652499 - DNA, 25 bp, Rattus norvegicus
tgttacacaaagctactggtagttt

SEQ ID NO: 652500 - DNA, 25 bp, Rattus norvegicus
tgttacacaaaggtactggtagttt

SEQ ID NO: 652501 - DNA, 25 bp, Rattus norvegicus
tgttacagagcccaagaagatccag

SEQ ID NO: 652502 - DNA, 25 bp, Rattus norvegicus
tgttacagagccgaagaagatccag

SEQ ID NO: 652503 - DNA, 25 bp, Rattus norvegicus
tgttacagccaaactgggaagtgct

SEQ ID NO: 652504 - DNA, 25 bp, Rattus norvegicus
tgttacagccaatctgggaagtgct

SEQ ID NO: 652505 - DNA, 25 bp, Rattus norvegicus
tgttacagccttctggcacagctta

SEQ ID NO: 652506 - DNA, 25 bp, Rattus norvegicus
tgttacagccttgtggcacagctta

SEQ ID NO: 652507 - DNA, 25 bp, Rattus norvegicus
tgttacagggcgctctttatcagat

SEQ ID NO: 652508 - DNA, 25 bp, Rattus norvegicus
tgttacagggcggtctttatcagat

SEQ ID NO: 652509 - DNA, 25 bp, Rattus norvegicus
tgttacataacacgctttcgaccag

SEQ ID NO: 652510 - DNA, 25 bp, Rattus norvegicus
tgttacataacaggctttcgaccag

SEQ ID NO: 652511 - DNA, 25 bp, Rattus norvegicus
tgttacatctgcagccacacctgct

SEQ ID NO: 652512 - DNA, 25 bp, Rattus norvegicus
tgttacatctgctgccacacctgct

SEQ ID NO: 652513 - DNA, 25 bp, Rattus norvegicus
tgttacatgccgagagagcccctaa

SEQ ID NO: 652514 - DNA, 25 bp, Rattus norvegicus
tgttacatgccgtgagagcccctaa

SEQ ID NO: 652515 - DNA, 25 bp, Rattus norvegicus
tgttacattctcaatctgcgcacgt

SEQ ID NO: 652516 - DNA, 25 bp, Rattus norvegicus
tgttacattctctatctgcgcacgt

SEQ ID NO: 652517 - DNA, 25 bp, Rattus norvegicus
tgttaccaacttccaccatgtggtt

SEQ ID NO: 652518 - DNA, 25 bp, Rattus norvegicus
tgttaccaacttgcaccatgtggtt

SEQ ID NO: 652519 - DNA, 25 bp, Rattus norvegicus
tgttaccaagtgcttcgtcccggcc

SEQ ID NO: 652520 - DNA, 25 bp, Rattus norvegicus
tgttaccaagtggttcgtcccggcc

SEQ ID NO: 652521 - DNA, 25 bp, Rattus norvegicus
tgttaccactttagtagtcctttcg

SEQ ID NO: 652522 - DNA, 25 bp, Rattus norvegicus
tgttaccacttttgtagtcctttcg

SEQ ID NO: 652523 - DNA, 25 bp, Rattus norvegicus
tgttaccagcaaaacagcctccatt

SEQ ID NO: 652524 - DNA, 25 bp, Rattus norvegicus
tgttaccagcaatacagcctccatt

SEQ ID NO: 652525 - DNA, 25 bp, Rattus norvegicus
tgttaccagcctatcaaatgaccgc

SEQ ID NO: 652526 - DNA, 25 bp, Rattus norvegicus
tgttaccagcctttcaaatgaccgc

SEQ ID NO: 652527 - DNA, 25 bp, Rattus norvegicus
tgttaccaggcaccagaggaccaag

SEQ ID NO: 652528 - DNA, 25 bp, Rattus norvegicus
tgttaccaggcagcagaggaccaag

SEQ ID NO: 652529 - DNA, 25 bp, Rattus norvegicus
tgttaccagggaccagcacgatgca

SEQ ID NO: 652530 - DNA, 25 bp, Rattus norvegicus
tgttaccagggagcagcacgatgca

SEQ ID NO: 652531 - DNA, 25 bp, Rattus norvegicus
tgttaccagggtagttccaacattg

SEQ ID NO: 652532 - DNA, 25 bp, Rattus norvegicus
tgttaccagggttgttccaacattg

SEQ ID NO: 652533 - DNA, 25 bp, Rattus norvegicus
tgttaccaggttacttatgctttct

SEQ ID NO: 652534 - DNA, 25 bp, Rattus norvegicus
tgttaccaggtttcttatgctttct

SEQ ID NO: 652535 - DNA, 25 bp, Rattus norvegicus
tgttaccattctcttctgacagctt

SEQ ID NO: 652536 - DNA, 25 bp, Rattus norvegicus
tgttaccattctgttctgacagctt

SEQ ID NO: 652537 - DNA, 25 bp, Rattus norvegicus
tgttacccaagcaagtgccgctgat

SEQ ID NO: 652538 - DNA, 25 bp, Rattus norvegicus
tgttacccaagctagtgccgctgat

SEQ ID NO: 652539 - DNA, 25 bp, Rattus norvegicus
tgttacccaatgcccgttaggggag

SEQ ID NO: 652540 - DNA, 25 bp, Rattus norvegicus
tgttacccaatggccgttaggggag

SEQ ID NO: 652541 - DNA, 25 bp, Rattus norvegicus
tgttacccactgatcttcacccgat

SEQ ID NO: 652542 - DNA, 25 bp, Rattus norvegicus
tgttacccactgttcttcacccgat

SEQ ID NO: 652543 - DNA, 25 bp, Rattus norvegicus
tgttacccattcaaaaatcagctgt

SEQ ID NO: 652544 - DNA, 25 bp, Rattus norvegicus
tgttacccattctaaaatcagctgt

SEQ ID NO: 652545 - DNA, 25 bp, Rattus norvegicus
tgttaccccagtcacggaagcggtt

SEQ ID NO: 652546 - DNA, 25 bp, Rattus norvegicus
tgttaccccagtgacggaagcggtt

SEQ ID NO: 652547 - DNA, 25 bp, Rattus norvegicus
tgttacccctgtcgtacgtgttagt

SEQ ID NO: 652548 - DNA, 25 bp, Rattus norvegicus
tgttacccctgtggtacgtgttagt

SEQ ID NO: 652549 - DNA, 25 bp, Rattus norvegicus
tgttaccctgatcttttccaaatct

SEQ ID NO: 652550 - DNA, 25 bp, Rattus norvegicus
tgttaccctgatgttttccaaatct

SEQ ID NO: 652551 - DNA, 25 bp, Rattus norvegicus
tgttacccttctctgagcttgccgt

SEQ ID NO: 652552 - DNA, 25 bp, Rattus norvegicus
tgttacccttctgtgagcttgccgt

SEQ ID NO: 652553 - DNA, 25 bp, Rattus norvegicus
tgttacccttgtagagcgctcatac

SEQ ID NO: 652554 - DNA, 25 bp, Rattus norvegicus
tgttacccttgttgagcgctcatac

SEQ ID NO: 652555 - DNA, 25 bp, Rattus norvegicus
tgttaccgtcagaacacccagcaga

SEQ ID NO: 652556 - DNA, 25 bp, Rattus norvegicus
tgttaccgtcagtacacccagcaga

SEQ ID NO: 652557 - DNA, 25 bp, Rattus norvegicus
tgttaccgtttacacactcacttcg

SEQ ID NO: 652558 - DNA, 25 bp, Rattus norvegicus
tgttaccgtttagacactcacttcg

SEQ ID NO: 652559 - DNA, 25 bp, Rattus norvegicus
tgttacctaattacactttgtgcct

SEQ ID NO: 652560 - DNA, 25 bp, Rattus norvegicus
tgttacctaatttcactttgtgcct

SEQ ID NO: 652561 - DNA, 25 bp, Rattus norvegicus
tgttacctacaccattgcactaagt

SEQ ID NO: 652562 - DNA, 25 bp, Rattus norvegicus
tgttacctacacgattgcactaagt

SEQ ID NO: 652563 - DNA, 25 bp, Rattus norvegicus
tgttacctagttcgttagtacctct

SEQ ID NO: 652564 - DNA, 25 bp, Rattus norvegicus
tgttacctagttggttagtacctct

SEQ ID NO: 652565 - DNA, 25 bp, Rattus norvegicus
tgttacctcagaaccctatgtcatc

SEQ ID NO: 652566 - DNA, 25 bp, Rattus norvegicus
tgttacctcagatccctatgtcatc

SEQ ID NO: 652567 - DNA, 25 bp, Rattus norvegicus
tgttacctcctcacaagtacattaa

SEQ ID NO: 652568 - DNA, 25 bp, Rattus norvegicus
tgttacctcctctcaagtacattaa

SEQ ID NO: 652569 - DNA, 25 bp, Rattus norvegicus
tgttacctcctgagaatctgacctt

SEQ ID NO: 652570 - DNA, 25 bp, Rattus norvegicus
tgttacctcctgtgaatctgacctt

SEQ ID NO: 652571 - DNA, 25 bp, Rattus norvegicus
tgttacctcgtcacaaggctctaga

SEQ ID NO: 652572 - DNA, 25 bp, Rattus norvegicus
tgttacctcgtctcaaggctctaga

SEQ ID NO: 652573 - DNA, 25 bp, Rattus norvegicus
tgttacctctagcacttttccttta

SEQ ID NO: 652574 - DNA, 25 bp, Rattus norvegicus
tgttacctctaggacttttccttta

SEQ ID NO: 652575 - DNA, 25 bp, Rattus norvegicus
tgttacctgctaaactatctctcca

SEQ ID NO: 652576 - DNA, 25 bp, Rattus norvegicus
tgttacctgctatactatctctcca

SEQ ID NO: 652577 - DNA, 25 bp, Rattus norvegicus
tgttacggtcttagtgtgttttgaa

SEQ ID NO: 652578 - DNA, 25 bp, Rattus norvegicus
tgttacggtctttgtgtgttttgaa

SEQ ID NO: 652579 - DNA, 25 bp, Rattus norvegicus
tgttacgtactgattctttctttga

SEQ ID NO: 652580 - DNA, 25 bp, Rattus norvegicus
tgttacgtactgtttctttctttga

SEQ ID NO: 652581 - DNA, 25 bp, Rattus norvegicus
tgttacgtcctcctcttaaaaattg

SEQ ID NO: 652582 - DNA, 25 bp, Rattus norvegicus
tgttacgtcctcgtcttaaaaattg

SEQ ID NO: 652583 - DNA, 25 bp, Rattus norvegicus
tgttacgtttctcactacttaaagc

SEQ ID NO: 652584 - DNA, 25 bp, Rattus norvegicus
tgttacgtttctgactacttaaagc

SEQ ID NO: 652585 - DNA, 25 bp, Rattus norvegicus
tgttactaagttctccaccttgtcc

SEQ ID NO: 652586 - DNA, 25 bp, Rattus norvegicus
tgttactaagttgtccaccttgtcc

SEQ ID NO: 652587 - DNA, 25 bp, Rattus norvegicus
tgttactattgtattatgccaggac

SEQ ID NO: 652588 - DNA, 25 bp, Rattus norvegicus
tgttactattgttttatgccaggac

SEQ ID NO: 652589 - DNA, 25 bp, Rattus norvegicus
tgttactcagagaagcccggctagt

SEQ ID NO: 652590 - DNA, 25 bp, Rattus norvegicus
tgttactcagagtagcccggctagt

SEQ ID NO: 652591 - DNA, 25 bp, Rattus norvegicus
tgttactcagccactgtgggagcgg

SEQ ID NO: 652592 - DNA, 25 bp, Rattus norvegicus
tgttactcagcctctgtgggagcgg

SEQ ID NO: 652593 - DNA, 25 bp, Rattus norvegicus
tgttactccagtaggtgccgtttgc

SEQ ID NO: 652594 - DNA, 25 bp, Rattus norvegicus
tgttactccagttggtgccgtttgc

SEQ ID NO: 652595 - DNA, 25 bp, Rattus norvegicus
tgttactcccagattctacgtgatc

SEQ ID NO: 652596 - DNA, 25 bp, Rattus norvegicus
tgttactcccagtttctacgtgatc

SEQ ID NO: 652597 - DNA, 25 bp, Rattus norvegicus
tgttactctctcacagcattcacag

SEQ ID NO: 652598 - DNA, 25 bp, Rattus norvegicus
tgttactctctctcagcattcacag

SEQ ID NO: 652599 - DNA, 25 bp, Rattus norvegicus
tgttactctgtgctgccctgagctg

SEQ ID NO: 652600 - DNA, 25 bp, Rattus norvegicus
tgttactctgtggtgccctgagctg

SEQ ID NO: 652601 - DNA, 25 bp, Rattus norvegicus
tgttactctttaatcttctgggcaa

SEQ ID NO: 652602 - DNA, 25 bp, Rattus norvegicus
tgttactctttattcttctgggcaa

SEQ ID NO: 652603 - DNA, 25 bp, Rattus norvegicus
tgttactgagctccgttttacaccc

SEQ ID NO: 652604 - DNA, 25 bp, Rattus norvegicus
tgttactgagctgcgttttacaccc

SEQ ID NO: 652605 - DNA, 25 bp, Rattus norvegicus
tgttactgagttagatcccgggacc

SEQ ID NO: 652606 - DNA, 25 bp, Rattus norvegicus
tgttactgagtttgatcccgggacc

SEQ ID NO: 652607 - DNA, 25 bp, Rattus norvegicus
tgttactgatgtccaaggccctaat

SEQ ID NO: 652608 - DNA, 25 bp, Rattus norvegicus
tgttactgatgtgcaaggccctaat

SEQ ID NO: 652609 - DNA, 25 bp, Rattus norvegicus
tgttacttaaaccttggccaggcta

SEQ ID NO: 652610 - DNA, 25 bp, Rattus norvegicus
tgttacttaaacgttggccaggcta

SEQ ID NO: 652611 - DNA, 25 bp, Rattus norvegicus
tgttacttagaacaggccacctgag

SEQ ID NO: 652612 - DNA, 25 bp, Rattus norvegicus
tgttacttagaagaggccacctgag

SEQ ID NO: 652613 - DNA, 25 bp, Rattus norvegicus
tgttacttccccatttgctttgttg

SEQ ID NO: 652614 - DNA, 25 bp, Rattus norvegicus
tgttacttccccttttgctttgttg

SEQ ID NO: 652615 - DNA, 25 bp, Rattus norvegicus
tgttacttcttaaccaagtcccaac

SEQ ID NO: 652616 - DNA, 25 bp, Rattus norvegicus
tgttacttcttatccaagtcccaac

SEQ ID NO: 652617 - DNA, 25 bp, Rattus norvegicus
tgttacttcttcattgcccaaacca

SEQ ID NO: 652618 - DNA, 25 bp, Rattus norvegicus
tgttacttcttctttgcccaaacca

SEQ ID NO: 652619 - DNA, 25 bp, Rattus norvegicus
tgttacttgagacacactgcccagt

SEQ ID NO: 652620 - DNA, 25 bp, Rattus norvegicus
tgttacttgagagacactgcccagt

SEQ ID NO: 652621 - DNA, 25 bp, Rattus norvegicus
tgttacttgcttacatatgccatgc

SEQ ID NO: 652622 - DNA, 25 bp, Rattus norvegicus
tgttacttgctttcatatgccatgc

SEQ ID NO: 652623 - DNA, 25 bp, Rattus norvegicus
tgttactttcatactcacaggagcg

SEQ ID NO: 652624 - DNA, 25 bp, Rattus norvegicus
tgttactttcattctcacaggagcg

SEQ ID NO: 652625 - DNA, 25 bp, Rattus norvegicus
tgttactttctgatcaccccaggtt

SEQ ID NO: 652626 - DNA, 25 bp, Rattus norvegicus
tgttactttctgttcaccccaggtt

SEQ ID NO: 652627 - DNA, 25 bp, Rattus norvegicus
tgttagaaccaacgcagcgctggct

SEQ ID NO: 652628 - DNA, 25 bp, Rattus norvegicus
tgttagaaccaaggcagcgctggct

SEQ ID NO: 652629 - DNA, 25 bp, Rattus norvegicus
tgttagaactgtcatacccacactc

SEQ ID NO: 652630 - DNA, 25 bp, Rattus norvegicus
tgttagaactgtgatacccacactc

SEQ ID NO: 652631 - DNA, 25 bp, Rattus norvegicus
tgttagacacgacctttccaggacc

SEQ ID NO: 652632 - DNA, 25 bp, Rattus norvegicus
tgttagacacgagctttccaggacc

SEQ ID NO: 652633 - DNA, 25 bp, Rattus norvegicus
tgttagacccttaaaggagtctttg

SEQ ID NO: 652634 - DNA, 25 bp, Rattus norvegicus
tgttagaccctttaaggagtctttg

SEQ ID NO: 652635 - DNA, 25 bp, Rattus norvegicus
tgttagacctagagccagtgtggcc

SEQ ID NO: 652636 - DNA, 25 bp, Rattus norvegicus
tgttagacctagtgccagtgtggcc

SEQ ID NO: 652637 - DNA, 25 bp, Rattus norvegicus
tgttagactaaccttcagccagtcc

SEQ ID NO: 652638 - DNA, 25 bp, Rattus norvegicus
tgttagactaacgttcagccagtcc

SEQ ID NO: 652639 - DNA, 25 bp, Rattus norvegicus
tgttagacttcaattcgcacgtgtg

SEQ ID NO: 652640 - DNA, 25 bp, Rattus norvegicus
tgttagacttcatttcgcacgtgtg

SEQ ID NO: 652641 - DNA, 25 bp, Rattus norvegicus
tgttagagagttcccaagctctgct

SEQ ID NO: 652642 - DNA, 25 bp, Rattus norvegicus
tgttagagagttgccaagctctgct

SEQ ID NO: 652643 - DNA, 25 bp, Rattus norvegicus
tgttagaggagaccccacgagtcag

SEQ ID NO: 652644 - DNA, 25 bp, Rattus norvegicus
tgttagaggagagcccacgagtcag

SEQ ID NO: 652645 - DNA, 25 bp, Rattus norvegicus
tgttagagtaccaaggacacgcccg

SEQ ID NO: 652646 - DNA, 25 bp, Rattus norvegicus
tgttagagtacctaggacacgcccg

SEQ ID NO: 652647 - DNA, 25 bp, Rattus norvegicus
tgttagatctgccagtgccacaacc

SEQ ID NO: 652648 - DNA, 25 bp, Rattus norvegicus
tgttagatctgcgagtgccacaacc

SEQ ID NO: 652649 - DNA, 25 bp, Rattus norvegicus
tgttagatctgtcctaacctcctta

SEQ ID NO: 652650 - DNA, 25 bp, Rattus norvegicus
tgttagatctgtgctaacctcctta

SEQ ID NO: 652651 - DNA, 25 bp, Rattus norvegicus
tgttagattgtccagcacacacaga

SEQ ID NO: 652652 - DNA, 25 bp, Rattus norvegicus
tgttagattgtcgagcacacacaga

SEQ ID NO: 652653 - DNA, 25 bp, Rattus norvegicus
tgttagcaacccaggttcccttgtg

SEQ ID NO: 652654 - DNA, 25 bp, Rattus norvegicus
tgttagcaaccctggttcccttgtg

SEQ ID NO: 652655 - DNA, 25 bp, Rattus norvegicus
tgttagccacagaacacggaccttt

SEQ ID NO: 652656 - DNA, 25 bp, Rattus norvegicus
tgttagccacagtacacggaccttt

SEQ ID NO: 652657 - DNA, 25 bp, Rattus norvegicus
tgttagccacttagccatttgggtt

SEQ ID NO: 652658 - DNA, 25 bp, Rattus norvegicus
tgttagccactttgccatttgggtt

SEQ ID NO: 652659 - DNA, 25 bp, Rattus norvegicus
tgttagccatttctcctaggtttga

SEQ ID NO: 652660 - DNA, 25 bp, Rattus norvegicus
tgttagccatttgtcctaggtttga

SEQ ID NO: 652661 - DNA, 25 bp, Rattus norvegicus
tgttagcctctcctccagtttattt

SEQ ID NO: 652662 - DNA, 25 bp, Rattus norvegicus
tgttagcctctcgtccagtttattt

SEQ ID NO: 652663 - DNA, 25 bp, Rattus norvegicus
tgttagcgatatctttgttcacggg

SEQ ID NO: 652664 - DNA, 25 bp, Rattus norvegicus
tgttagcgatatgtttgttcacggg

SEQ ID NO: 652665 - DNA, 25 bp, Rattus norvegicus
tgttagcgcagcagcagagggcaca

SEQ ID NO: 652666 - DNA, 25 bp, Rattus norvegicus
tgttagcgcagctgcagagggcaca

SEQ ID NO: 652667 - DNA, 25 bp, Rattus norvegicus
tgttagcttgccctgatgcctgacc

SEQ ID NO: 652668 - DNA, 25 bp, Rattus norvegicus
tgttagcttgccgtgatgcctgacc

SEQ ID NO: 652669 - DNA, 25 bp, Rattus norvegicus
tgttagctttatccgttttccctct

SEQ ID NO: 652670 - DNA, 25 bp, Rattus norvegicus
tgttagctttatgcgttttccctct

SEQ ID NO: 652671 - DNA, 25 bp, Rattus norvegicus
tgttaggaatggacatgaaagactc

SEQ ID NO: 652672 - DNA, 25 bp, Rattus norvegicus
tgttaggaatggtcatgaaagactc

SEQ ID NO: 652673 - DNA, 25 bp, Rattus norvegicus
tgttaggagcacagcctgtagggcc

SEQ ID NO: 652674 - DNA, 25 bp, Rattus norvegicus
tgttaggagcactgcctgtagggcc

SEQ ID NO: 652675 - DNA, 25 bp, Rattus norvegicus
tgttaggagtgtcccatccctttac

SEQ ID NO: 652676 - DNA, 25 bp, Rattus norvegicus
tgttaggagtgtgccatccctttac

SEQ ID NO: 652677 - DNA, 25 bp, Rattus norvegicus
tgttaggatctgaatatgcttggtc

SEQ ID NO: 652678 - DNA, 25 bp, Rattus norvegicus
tgttaggatctgtatatgcttggtc

SEQ ID NO: 652679 - DNA, 25 bp, Rattus norvegicus
tgttaggcatctaaagtcatctttt

SEQ ID NO: 652680 - DNA, 25 bp, Rattus norvegicus
tgttaggcatcttaagtcatctttt

SEQ ID NO: 652681 - DNA, 25 bp, Rattus norvegicus
tgttaggcccttcagatcgcattgt

SEQ ID NO: 652682 - DNA, 25 bp, Rattus norvegicus
tgttaggcccttgagatcgcattgt

SEQ ID NO: 652683 - DNA, 25 bp, Rattus norvegicus
tgttaggcctttagttgctggccat

SEQ ID NO: 652684 - DNA, 25 bp, Rattus norvegicus
tgttaggccttttgttgctggccat

SEQ ID NO: 652685 - DNA, 25 bp, Rattus norvegicus
tgttaggcgcgcacgagaggcctcc

SEQ ID NO: 652686 - DNA, 25 bp, Rattus norvegicus
tgttaggcgcgctcgagaggcctcc

SEQ ID NO: 652687 - DNA, 25 bp, Rattus norvegicus
tgttagggatgccaccacaacgcac

SEQ ID NO: 652688 - DNA, 25 bp, Rattus norvegicus
tgttagggatgcgaccacaacgcac

SEQ ID NO: 652689 - DNA, 25 bp, Rattus norvegicus
tgttaggtcttcagctaagcacgaa

SEQ ID NO: 652690 - DNA, 25 bp, Rattus norvegicus
tgttaggtcttctgctaagcacgaa

SEQ ID NO: 652691 - DNA, 25 bp, Rattus norvegicus
tgttaggtgggacctgcgatacctc

SEQ ID NO: 652692 - DNA, 25 bp, Rattus norvegicus
tgttaggtgggagctgcgatacctc

SEQ ID NO: 652693 - DNA, 25 bp, Rattus norvegicus
tgttagtaccgaagtctgaatgccc

SEQ ID NO: 652694 - DNA, 25 bp, Rattus norvegicus
tgttagtaccgatgtctgaatgccc

SEQ ID NO: 652695 - DNA, 25 bp, Rattus norvegicus
tgttagtccccacaaaggccaagtt

SEQ ID NO: 652696 - DNA, 25 bp, Rattus norvegicus
tgttagtccccagaaaggccaagtt

SEQ ID NO: 652697 - DNA, 25 bp, Rattus norvegicus
tgttagtccctcacgtccaagatgt

SEQ ID NO: 652698 - DNA, 25 bp, Rattus norvegicus
tgttagtccctctcgtccaagatgt

SEQ ID NO: 652699 - DNA, 25 bp, Rattus norvegicus
tgttagtctttgatccacgtgtatc

SEQ ID NO: 652700 - DNA, 25 bp, Rattus norvegicus
tgttagtctttgttccacgtgtatc

SEQ ID NO: 652701 - DNA, 25 bp, Rattus norvegicus
tgttagttcctaaagttattctgtt

SEQ ID NO: 652702 - DNA, 25 bp, Rattus norvegicus
tgttagttcctatagttattctgtt

SEQ ID NO: 652703 - DNA, 25 bp, Rattus norvegicus
tgttataccagaagccaaaggctaa

SEQ ID NO: 652704 - DNA, 25 bp, Rattus norvegicus
tgttataccagatgccaaaggctaa

SEQ ID NO: 652705 - DNA, 25 bp, Rattus norvegicus
tgttataccttcataaatcctaccg

SEQ ID NO: 652706 - DNA, 25 bp, Rattus norvegicus
tgttataccttcttaaatcctaccg

SEQ ID NO: 652707 - DNA, 25 bp, Rattus norvegicus
tgttatagtgccagtccaggagccc

SEQ ID NO: 652708 - DNA, 25 bp, Rattus norvegicus
tgttatagtgcctgtccaggagccc

SEQ ID NO: 652709 - DNA, 25 bp, Rattus norvegicus
tgttatagttttcctctcccaaata

SEQ ID NO: 652710 - DNA, 25 bp, Rattus norvegicus
tgttatagttttgctctcccaaata

SEQ ID NO: 652711 - DNA, 25 bp, Rattus norvegicus
tgttatcaaccaattcaccaggaga

SEQ ID NO: 652712 - DNA, 25 bp, Rattus norvegicus
tgttatcaaccatttcaccaggaga

SEQ ID NO: 652713 - DNA, 25 bp, Rattus norvegicus
tgttatcactacagagacacttgct

SEQ ID NO: 652714 - DNA, 25 bp, Rattus norvegicus
tgttatcactactgagacacttgct

SEQ ID NO: 652715 - DNA, 25 bp, Rattus norvegicus
tgttatcagtgaaggctcttctctg

SEQ ID NO: 652716 - DNA, 25 bp, Rattus norvegicus
tgttatcagtgatggctcttctctg

SEQ ID NO: 652717 - DNA, 25 bp, Rattus norvegicus
tgttatcatctccattttccaaatg

SEQ ID NO: 652718 - DNA, 25 bp, Rattus norvegicus
tgttatcatctcgattttccaaatg

SEQ ID NO: 652719 - DNA, 25 bp, Rattus norvegicus
tgttatcattttctactgtctcggt

SEQ ID NO: 652720 - DNA, 25 bp, Rattus norvegicus
tgttatcattttgtactgtctcggt

SEQ ID NO: 652721 - DNA, 25 bp, Rattus norvegicus
tgttatccagaaagggcttccctga

SEQ ID NO: 652722 - DNA, 25 bp, Rattus norvegicus
tgttatccagaatgggcttccctga

SEQ ID NO: 652723 - DNA, 25 bp, Rattus norvegicus
tgttatcccaggcacctaaagtgaa

SEQ ID NO: 652724 - DNA, 25 bp, Rattus norvegicus
tgttatcccagggacctaaagtgaa

SEQ ID NO: 652725 - DNA, 25 bp, Rattus norvegicus
tgttatcccagtattgtcccagtag

SEQ ID NO: 652726 - DNA, 25 bp, Rattus norvegicus
tgttatcccagttttgtcccagtag

SEQ ID NO: 652727 - DNA, 25 bp, Rattus norvegicus
tgttatcccggcactaaagaaactg

SEQ ID NO: 652728 - DNA, 25 bp, Rattus norvegicus
tgttatcccggctctaaagaaactg

SEQ ID NO: 652729 - DNA, 25 bp, Rattus norvegicus
tgttatccctccagctcatggctaa

SEQ ID NO: 652730 - DNA, 25 bp, Rattus norvegicus
tgttatccctcctgctcatggctaa

SEQ ID NO: 652731 - DNA, 25 bp, Rattus norvegicus
tgttatccctttaaccccaattgag

SEQ ID NO: 652732 - DNA, 25 bp, Rattus norvegicus
tgttatcccttttaccccaattgag

SEQ ID NO: 652733 - DNA, 25 bp, Rattus norvegicus
tgttatccgcctcctgtttccacag

SEQ ID NO: 652734 - DNA, 25 bp, Rattus norvegicus
tgttatccgcctgctgtttccacag

SEQ ID NO: 652735 - DNA, 25 bp, Rattus norvegicus
tgttatcctcacaaagcctttagca

SEQ ID NO: 652736 - DNA, 25 bp, Rattus norvegicus
tgttatcctcactaagcctttagca

SEQ ID NO: 652737 - DNA, 25 bp, Rattus norvegicus
tgttatctaaatactggctcgctct

SEQ ID NO: 652738 - DNA, 25 bp, Rattus norvegicus
tgttatctaaattctggctcgctct

SEQ ID NO: 652739 - DNA, 25 bp, Rattus norvegicus
tgttatctacaaacctcagttgcaa

SEQ ID NO: 652740 - DNA, 25 bp, Rattus norvegicus
tgttatctacaatcctcagttgcaa

SEQ ID NO: 652741 - DNA, 25 bp, Rattus norvegicus
tgttatctccatccgaaggtaggct

SEQ ID NO: 652742 - DNA, 25 bp, Rattus norvegicus
tgttatctccatgcgaaggtaggct

SEQ ID NO: 652743 - DNA, 25 bp, Rattus norvegicus
tgttatctcccacatatttcgtcaa

SEQ ID NO: 652744 - DNA, 25 bp, Rattus norvegicus
tgttatctcccagatatttcgtcaa

SEQ ID NO: 652745 - DNA, 25 bp, Rattus norvegicus
tgttatctcgaacataagccccagc

SEQ ID NO: 652746 - DNA, 25 bp, Rattus norvegicus
tgttatctcgaagataagccccagc

SEQ ID NO: 652747 - DNA, 25 bp, Rattus norvegicus
tgttatctgtcaagtgtcaagctgt

SEQ ID NO: 652748 - DNA, 25 bp, Rattus norvegicus
tgttatctgtcatgtgtcaagctgt

SEQ ID NO: 652749 - DNA, 25 bp, Rattus norvegicus
tgttatctttctctgcactctatca

SEQ ID NO: 652750 - DNA, 25 bp, Rattus norvegicus
tgttatctttctgtgcactctatca

SEQ ID NO: 652751 - DNA, 25 bp, Rattus norvegicus
tgttatgacctgagcccgaggctct

SEQ ID NO: 652752 - DNA, 25 bp, Rattus norvegicus
tgttatgacctgtgcccgaggctct

SEQ ID NO: 652753 - DNA, 25 bp, Rattus norvegicus
tgttatgatgagagtagacctagtc

SEQ ID NO: 652754 - DNA, 25 bp, Rattus norvegicus
tgttatgatgagtgtagacctagtc

SEQ ID NO: 652755 - DNA, 25 bp, Rattus norvegicus
tgttatggaatactatgtaccaatt

SEQ ID NO: 652756 - DNA, 25 bp, Rattus norvegicus
tgttatggaatagtatgtaccaatt

SEQ ID NO: 652757 - DNA, 25 bp, Rattus norvegicus
tgttatggacgcctcatctctgagc

SEQ ID NO: 652758 - DNA, 25 bp, Rattus norvegicus
tgttatggacgcgtcatctctgagc

SEQ ID NO: 652759 - DNA, 25 bp, Rattus norvegicus
tgttatggcccaccagttggcacat

SEQ ID NO: 652760 - DNA, 25 bp, Rattus norvegicus
tgttatggcccagcagttggcacat

SEQ ID NO: 652761 - DNA, 25 bp, Rattus norvegicus
tgttatggtcatcagcagtgtcagt

SEQ ID NO: 652762 - DNA, 25 bp, Rattus norvegicus
tgttatggtcatgagcagtgtcagt

SEQ ID NO: 652763 - DNA, 25 bp, Rattus norvegicus
tgttatgtcccacccattcatgaca

SEQ ID NO: 652764 - DNA, 25 bp, Rattus norvegicus
tgttatgtcccagccattcatgaca

SEQ ID NO: 652765 - DNA, 25 bp, Rattus norvegicus
tgttatgtcctaatcatctgtaaag

SEQ ID NO: 652766 - DNA, 25 bp, Rattus norvegicus
tgttatgtcctattcatctgtaaag

SEQ ID NO: 652767 - DNA, 25 bp, Rattus norvegicus
tgttatgtccttacctggcaatagc

SEQ ID NO: 652768 - DNA, 25 bp, Rattus norvegicus
tgttatgtcctttcctggcaatagc

SEQ ID NO: 652769 - DNA, 25 bp, Rattus norvegicus
tgttatgttccaaccagtgatgcat

SEQ ID NO: 652770 - DNA, 25 bp, Rattus norvegicus
tgttatgttccatccagtgatgcat

SEQ ID NO: 652771 - DNA, 25 bp, Rattus norvegicus
tgttatgttctaaaggctacctgct

SEQ ID NO: 652772 - DNA, 25 bp, Rattus norvegicus
tgttatgttctataggctacctgct

SEQ ID NO: 652773 - DNA, 25 bp, Rattus norvegicus
tgttatgttcttcttactgcaattg

SEQ ID NO: 652774 - DNA, 25 bp, Rattus norvegicus
tgttatgttcttgttactgcaattg

SEQ ID NO: 652775 - DNA, 25 bp, Rattus norvegicus
tgttattacagcatcccagaccaca

SEQ ID NO: 652776 - DNA, 25 bp, Rattus norvegicus
tgttattacagcttcccagaccaca

SEQ ID NO: 652777 - DNA, 25 bp, Rattus norvegicus
tgttattcaactccaggacctcatg

SEQ ID NO: 652778 - DNA, 25 bp, Rattus norvegicus
tgttattcaactgcaggacctcatg

SEQ ID NO: 652779 - DNA, 25 bp, Rattus norvegicus
tgttattcaccacaagacacctact

SEQ ID NO: 652780 - DNA, 25 bp, Rattus norvegicus
tgttattcaccagaagacacctact

SEQ ID NO: 652781 - DNA, 25 bp, Rattus norvegicus
tgttattccattacagccatgttgt

SEQ ID NO: 652782 - DNA, 25 bp, Rattus norvegicus
tgttattccatttcagccatgttgt

SEQ ID NO: 652783 - DNA, 25 bp, Rattus norvegicus
tgttattcctggattgaggcctcgc

SEQ ID NO: 652784 - DNA, 25 bp, Rattus norvegicus
tgttattcctggtttgaggcctcgc

SEQ ID NO: 652785 - DNA, 25 bp, Rattus norvegicus
tgttattcttttatgaggtgcactc

SEQ ID NO: 652786 - DNA, 25 bp, Rattus norvegicus
tgttattcttttttgaggtgcactc

SEQ ID NO: 652787 - DNA, 25 bp, Rattus norvegicus
tgttattgtgaccttcattcccttc

SEQ ID NO: 652788 - DNA, 25 bp, Rattus norvegicus
tgttattgtgacgttcattcccttc

SEQ ID NO: 652789 - DNA, 25 bp, Rattus norvegicus
tgttatttaatgatgcgctgctctc

SEQ ID NO: 652790 - DNA, 25 bp, Rattus norvegicus
tgttatttaatgttgcgctgctctc

SEQ ID NO: 652791 - DNA, 25 bp, Rattus norvegicus
tgttatttattgctggttttcctgg

SEQ ID NO: 652792 - DNA, 25 bp, Rattus norvegicus
tgttatttattggtggttttcctgg

SEQ ID NO: 652793 - DNA, 25 bp, Rattus norvegicus
tgttatttcagtactcaacccacag

SEQ ID NO: 652794 - DNA, 25 bp, Rattus norvegicus
tgttatttcagttctcaacccacag

SEQ ID NO: 652795 - DNA, 25 bp, Rattus norvegicus
tgttatttcccacaaactaaactct

SEQ ID NO: 652796 - DNA, 25 bp, Rattus norvegicus
tgttatttcccagaaactaaactct

SEQ ID NO: 652797 - DNA, 25 bp, Rattus norvegicus
tgttatttcttcatactgtagcact

SEQ ID NO: 652798 - DNA, 25 bp, Rattus norvegicus
tgttatttcttcttactgtagcact

SEQ ID NO: 652799 - DNA, 25 bp, Rattus norvegicus
tgttatttgttgaggccaaccgccc

SEQ ID NO: 652800 - DNA, 25 bp, Rattus norvegicus
tgttatttgttgtggccaaccgccc

SEQ ID NO: 652801 - DNA, 25 bp, Rattus norvegicus
tgttcaaaaatgactccttgcctga

SEQ ID NO: 652802 - DNA, 25 bp, Rattus norvegicus
tgttcaaaaatgtctccttgcctga

SEQ ID NO: 652803 - DNA, 25 bp, Rattus norvegicus
tgttcaaaacagacattcccaggtg

SEQ ID NO: 652804 - DNA, 25 bp, Rattus norvegicus
tgttcaaaacagtcattcccaggtg

SEQ ID NO: 652805 - DNA, 25 bp, Rattus norvegicus
tgttcaaaccacagattggtctctg

SEQ ID NO: 652806 - DNA, 25 bp, Rattus norvegicus
tgttcaaaccactgattggtctctg

SEQ ID NO: 652807 - DNA, 25 bp, Rattus norvegicus
tgttcaaactgaccacattttgccc

SEQ ID NO: 652808 - DNA, 25 bp, Rattus norvegicus
tgttcaaactgagcacattttgccc

SEQ ID NO: 652809 - DNA, 25 bp, Rattus norvegicus
tgttcaaagaccagctagcgctcat

SEQ ID NO: 652810 - DNA, 25 bp, Rattus norvegicus
tgttcaaagacctgctagcgctcat

SEQ ID NO: 652811 - DNA, 25 bp, Rattus norvegicus
tgttcaaatctcagggactcggttt

SEQ ID NO: 652812 - DNA, 25 bp, Rattus norvegicus
tgttcaaatctctgggactcggttt

SEQ ID NO: 652813 - DNA, 25 bp, Rattus norvegicus
tgttcaacatcgacaggatcctgat

SEQ ID NO: 652814 - DNA, 25 bp, Rattus norvegicus
tgttcaacatcgtcaggatcctgat

SEQ ID NO: 652815 - DNA, 25 bp, Rattus norvegicus
tgttcaaccaccagtacgctttgta

SEQ ID NO: 652816 - DNA, 25 bp, Rattus norvegicus
tgttcaaccacctgtacgctttgta

SEQ ID NO: 652817 - DNA, 25 bp, Rattus norvegicus
tgttcaacctttctgggaggaccct

SEQ ID NO: 652818 - DNA, 25 bp, Rattus norvegicus
tgttcaacctttgtgggaggaccct

SEQ ID NO: 652819 - DNA, 25 bp, Rattus norvegicus
tgttcaacggcacaagggtttttat

SEQ ID NO: 652820 - DNA, 25 bp, Rattus norvegicus
tgttcaacggcagaagggtttttat

SEQ ID NO: 652821 - DNA, 25 bp, Rattus norvegicus
tgttcaactaaaatactccttccct

SEQ ID NO: 652822 - DNA, 25 bp, Rattus norvegicus
tgttcaactaaattactccttccct

SEQ ID NO: 652823 - DNA, 25 bp, Rattus norvegicus
tgttcaactgagacctgtagatgag

SEQ ID NO: 652824 - DNA, 25 bp, Rattus norvegicus
tgttcaactgagtcctgtagatgag

SEQ ID NO: 652825 - DNA, 25 bp, Rattus norvegicus
tgttcaagaacaagctgggtttttt

SEQ ID NO: 652826 - DNA, 25 bp, Rattus norvegicus
tgttcaagaacatgctgggtttttt

SEQ ID NO: 652827 - DNA, 25 bp, Rattus norvegicus
tgttcaagaagtaacctgtcctctt

SEQ ID NO: 652828 - DNA, 25 bp, Rattus norvegicus
tgttcaagaagttacctgtcctctt

SEQ ID NO: 652829 - DNA, 25 bp, Rattus norvegicus
tgttcaaggacgagcgggactcagt

SEQ ID NO: 652830 - DNA, 25 bp, Rattus norvegicus
tgttcaaggacgtgcgggactcagt

SEQ ID NO: 652831 - DNA, 25 bp, Rattus norvegicus
tgttcaaggtcccaaaccgcttgca

SEQ ID NO: 652832 - DNA, 25 bp, Rattus norvegicus
tgttcaaggtccgaaaccgcttgca

SEQ ID NO: 652833 - DNA, 25 bp, Rattus norvegicus
tgttcaagtgtacccgcaggacata

SEQ ID NO: 652834 - DNA, 25 bp, Rattus norvegicus
tgttcaagtgtagccgcaggacata

SEQ ID NO: 652835 - DNA, 25 bp, Rattus norvegicus
tgttcaagttttaatttcctcgtag

SEQ ID NO: 652836 - DNA, 25 bp, Rattus norvegicus
tgttcaagtttttatttcctcgtag

SEQ ID NO: 652837 - DNA, 25 bp, Rattus norvegicus
tgttcaatattcatggctgccctaa

SEQ ID NO: 652838 - DNA, 25 bp, Rattus norvegicus
tgttcaatattcttggctgccctaa

SEQ ID NO: 652839 - DNA, 25 bp, Rattus norvegicus
tgttcaattctaagtgcaccatggg

SEQ ID NO: 652840 - DNA, 25 bp, Rattus norvegicus
tgttcaattctatgtgcaccatggg

SEQ ID NO: 652841 - DNA, 25 bp, Rattus norvegicus
tgttcacaaagtacacggctgctgg

SEQ ID NO: 652842 - DNA, 25 bp, Rattus norvegicus
tgttcacaaagttcacggctgctgg

SEQ ID NO: 652843 - DNA, 25 bp, Rattus norvegicus
tgttcacaagccacggatccttaga

SEQ ID NO: 652844 - DNA, 25 bp, Rattus norvegicus
tgttcacaagcctcggatccttaga

SEQ ID NO: 652845 - DNA, 25 bp, Rattus norvegicus
tgttcacaattcctcaggctcagtt

SEQ ID NO: 652846 - DNA, 25 bp, Rattus norvegicus
tgttcacaattcgtcaggctcagtt

SEQ ID NO: 652847 - DNA, 25 bp, Rattus norvegicus
tgttcacacatactcattccagggt

SEQ ID NO: 652848 - DNA, 25 bp, Rattus norvegicus
tgttcacacatagtcattccagggt

SEQ ID NO: 652849 - DNA, 25 bp, Rattus norvegicus
tgttcacagagaaaccgccagagga

SEQ ID NO: 652850 - DNA, 25 bp, Rattus norvegicus
tgttcacagagataccgccagagga

SEQ ID NO: 652851 - DNA, 25 bp, Rattus norvegicus
tgttcacagggcacggattcggtaa

SEQ ID NO: 652852 - DNA, 25 bp, Rattus norvegicus
tgttcacagggctcggattcggtaa

SEQ ID NO: 652853 - DNA, 25 bp, Rattus norvegicus
tgttcacagtgactcacgtgtccta

SEQ ID NO: 652854 - DNA, 25 bp, Rattus norvegicus
tgttcacagtgagtcacgtgtccta

SEQ ID NO: 652855 - DNA, 25 bp, Rattus norvegicus
tgttcacagttcacagcacagccta

SEQ ID NO: 652856 - DNA, 25 bp, Rattus norvegicus
tgttcacagttctcagcacagccta

SEQ ID NO: 652857 - DNA, 25 bp, Rattus norvegicus
tgttcacatgtgagtagcctctcca

SEQ ID NO: 652858 - DNA, 25 bp, Rattus norvegicus
tgttcacatgtgtgtagcctctcca

SEQ ID NO: 652859 - DNA, 25 bp, Rattus norvegicus
tgttcacattccacagtccagttct

SEQ ID NO: 652860 - DNA, 25 bp, Rattus norvegicus
tgttcacattcctcagtccagttct

SEQ ID NO: 652861 - DNA, 25 bp, Rattus norvegicus
tgttcaccaactccgtctgtaagaa

SEQ ID NO: 652862 - DNA, 25 bp, Rattus norvegicus
tgttcaccaactgcgtctgtaagaa

SEQ ID NO: 652863 - DNA, 25 bp, Rattus norvegicus
tgttcaccaagtctccttatcagga

SEQ ID NO: 652864 - DNA, 25 bp, Rattus norvegicus
tgttcaccaagtgtccttatcagga

SEQ ID NO: 652865 - DNA, 25 bp, Rattus norvegicus
tgttcaccagcccttgagcagagaa

SEQ ID NO: 652866 - DNA, 25 bp, Rattus norvegicus
tgttcaccagccgttgagcagagaa

SEQ ID NO: 652867 - DNA, 25 bp, Rattus norvegicus
tgttcaccagggaatgcacactctt

SEQ ID NO: 652868 - DNA, 25 bp, Rattus norvegicus
tgttcaccagggtatgcacactctt

SEQ ID NO: 652869 - DNA, 25 bp, Rattus norvegicus
tgttcaccccaaagactagatccag

SEQ ID NO: 652870 - DNA, 25 bp, Rattus norvegicus
tgttcaccccaatgactagatccag

SEQ ID NO: 652871 - DNA, 25 bp, Rattus norvegicus
tgttcaccctttcagtggttttgtt

SEQ ID NO: 652872 - DNA, 25 bp, Rattus norvegicus
tgttcaccctttgagtggttttgtt

SEQ ID NO: 652873 - DNA, 25 bp, Rattus norvegicus
tgttcaccgagacctcctcagataa

SEQ ID NO: 652874 - DNA, 25 bp, Rattus norvegicus
tgttcaccgagagctcctcagataa

SEQ ID NO: 652875 - DNA, 25 bp, Rattus norvegicus
tgttcaccgtttagaccgtctgtaa

SEQ ID NO: 652876 - DNA, 25 bp, Rattus norvegicus
tgttcaccgttttgaccgtctgtaa

SEQ ID NO: 652877 - DNA, 25 bp, Rattus norvegicus
tgttcacctcacaaaatcagctctg

SEQ ID NO: 652878 - DNA, 25 bp, Rattus norvegicus
tgttcacctcactaaatcagctctg

SEQ ID NO: 652879 - DNA, 25 bp, Rattus norvegicus
tgttcacctctaccagtggtagcag

SEQ ID NO: 652880 - DNA, 25 bp, Rattus norvegicus
tgttcacctctagcagtggtagcag

SEQ ID NO: 652881 - DNA, 25 bp, Rattus norvegicus
tgttcacctctgattccctttaacc

SEQ ID NO: 652882 - DNA, 25 bp, Rattus norvegicus
tgttcacctctgtttccctttaacc

SEQ ID NO: 652883 - DNA, 25 bp, Rattus norvegicus
tgttcacctgaacctttgccatatt

SEQ ID NO: 652884 - DNA, 25 bp, Rattus norvegicus
tgttcacctgaagctttgccatatt

SEQ ID NO: 652885 - DNA, 25 bp, Rattus norvegicus
tgttcaccttcacccaaggacaacg

SEQ ID NO: 652886 - DNA, 25 bp, Rattus norvegicus
tgttcaccttcagccaaggacaacg

SEQ ID NO: 652887 - DNA, 25 bp, Rattus norvegicus
tgttcaccttgtaccctttaaggat

SEQ ID NO: 652888 - DNA, 25 bp, Rattus norvegicus
tgttcaccttgttccctttaaggat

SEQ ID NO: 652889 - DNA, 25 bp, Rattus norvegicus
tgttcacgacagacggacggaaacc

SEQ ID NO: 652890 - DNA, 25 bp, Rattus norvegicus
tgttcacgacagtcggacggaaacc

SEQ ID NO: 652891 - DNA, 25 bp, Rattus norvegicus
tgttcacgtgacaggcgctgccggc

SEQ ID NO: 652892 - DNA, 25 bp, Rattus norvegicus
tgttcacgtgactggcgctgccggc

SEQ ID NO: 652893 - DNA, 25 bp, Rattus norvegicus
tgttcacgttaacgcagtcatcaaa

SEQ ID NO: 652894 - DNA, 25 bp, Rattus norvegicus
tgttcacgttaaggcagtcatcaaa

SEQ ID NO: 652895 - DNA, 25 bp, Rattus norvegicus
tgttcacgttgtacctggcatttga

SEQ ID NO: 652896 - DNA, 25 bp, Rattus norvegicus
tgttcacgttgttcctggcatttga

SEQ ID NO: 652897 - DNA, 25 bp, Rattus norvegicus
tgttcactagggatcctcaaccaat

SEQ ID NO: 652898 - DNA, 25 bp, Rattus norvegicus
tgttcactagggttcctcaaccaat

SEQ ID NO: 652899 - DNA, 25 bp, Rattus norvegicus
tgttcactatacatcagttagcatg

SEQ ID NO: 652900 - DNA, 25 bp, Rattus norvegicus
tgttcactatacttcagttagcatg

SEQ ID NO: 652901 - DNA, 25 bp, Rattus norvegicus
tgttcactattccaagatcttatat

SEQ ID NO: 652902 - DNA, 25 bp, Rattus norvegicus
tgttcactattcgaagatcttatat

SEQ ID NO: 652903 - DNA, 25 bp, Rattus norvegicus
tgttcactcatgctgccggcggcgc

SEQ ID NO: 652904 - DNA, 25 bp, Rattus norvegicus
tgttcactcatggtgccggcggcgc

SEQ ID NO: 652905 - DNA, 25 bp, Rattus norvegicus
tgttcactcttacacactatccgga

SEQ ID NO: 652906 - DNA, 25 bp, Rattus norvegicus
tgttcactcttagacactatccgga

SEQ ID NO: 652907 - DNA, 25 bp, Rattus norvegicus
tgttcactgccaatgctgtgcttgc

SEQ ID NO: 652908 - DNA, 25 bp, Rattus norvegicus
tgttcactgccattgctgtgcttgc

SEQ ID NO: 652909 - DNA, 25 bp, Rattus norvegicus
tgttcacttctaagggccctgtttt

SEQ ID NO: 652910 - DNA, 25 bp, Rattus norvegicus
tgttcacttctatgggccctgtttt

SEQ ID NO: 652911 - DNA, 25 bp, Rattus norvegicus
tgttcagaaaccaagtgaccgggaa

SEQ ID NO: 652912 - DNA, 25 bp, Rattus norvegicus
tgttcagaaacctagtgaccgggaa

SEQ ID NO: 652913 - DNA, 25 bp, Rattus norvegicus
tgttcagaaatacccacaggatgga

SEQ ID NO: 652914 - DNA, 25 bp, Rattus norvegicus
tgttcagaaatagccacaggatgga

SEQ ID NO: 652915 - DNA, 25 bp, Rattus norvegicus
tgttcagaactaaggctctcacgtg

SEQ ID NO: 652916 - DNA, 25 bp, Rattus norvegicus
tgttcagaactatggctctcacgtg

SEQ ID NO: 652917 - DNA, 25 bp, Rattus norvegicus
tgttcagaacttacagcactgccct

SEQ ID NO: 652918 - DNA, 25 bp, Rattus norvegicus
tgttcagaactttcagcactgccct

SEQ ID NO: 652919 - DNA, 25 bp, Rattus norvegicus
tgttcagactcactgtctgctgtga

SEQ ID NO: 652920 - DNA, 25 bp, Rattus norvegicus
tgttcagactcagtgtctgctgtga

SEQ ID NO: 652921 - DNA, 25 bp, Rattus norvegicus
tgttcagactgcatctcaagacctg

SEQ ID NO: 652922 - DNA, 25 bp, Rattus norvegicus
tgttcagactgcttctcaagacctg

SEQ ID NO: 652923 - DNA, 25 bp, Rattus norvegicus
tgttcagacttgcagggccagacat

SEQ ID NO: 652924 - DNA, 25 bp, Rattus norvegicus
tgttcagacttggagggccagacat

SEQ ID NO: 652925 - DNA, 25 bp, Rattus norvegicus
tgttcagagcagacccacagtgcat

SEQ ID NO: 652926 - DNA, 25 bp, Rattus norvegicus
tgttcagagcagtcccacagtgcat

SEQ ID NO: 652927 - DNA, 25 bp, Rattus norvegicus
tgttcagagccccaggctgagattt

SEQ ID NO: 652928 - DNA, 25 bp, Rattus norvegicus
tgttcagagcccgaggctgagattt

SEQ ID NO: 652929 - DNA, 25 bp, Rattus norvegicus
tgttcagagcgccagcagtgccatc

SEQ ID NO: 652930 - DNA, 25 bp, Rattus norvegicus
tgttcagagcgcgagcagtgccatc

SEQ ID NO: 652931 - DNA, 25 bp, Rattus norvegicus
tgttcagagctaaccatagccacgc

SEQ ID NO: 652932 - DNA, 25 bp, Rattus norvegicus
tgttcagagctatccatagccacgc

SEQ ID NO: 652933 - DNA, 25 bp, Rattus norvegicus
tgttcagaggatcttcaggctctcc

SEQ ID NO: 652934 - DNA, 25 bp, Rattus norvegicus
tgttcagaggatgttcaggctctcc

SEQ ID NO: 652935 - DNA, 25 bp, Rattus norvegicus
tgttcagaggttcccatcctggagg

SEQ ID NO: 652936 - DNA, 25 bp, Rattus norvegicus
tgttcagaggttgccatcctggagg

SEQ ID NO: 652937 - DNA, 25 bp, Rattus norvegicus
tgttcagagtctacgcttccatggg

SEQ ID NO: 652938 - DNA, 25 bp, Rattus norvegicus
tgttcagagtcttcgcttccatggg

SEQ ID NO: 652939 - DNA, 25 bp, Rattus norvegicus
tgttcagatgcaactgcagcccagt

SEQ ID NO: 652940 - DNA, 25 bp, Rattus norvegicus
tgttcagatgcatctgcagcccagt

SEQ ID NO: 652941 - DNA, 25 bp, Rattus norvegicus
tgttcagatggacattagaatcggg

SEQ ID NO: 652942 - DNA, 25 bp, Rattus norvegicus
tgttcagatggactgcccttgggca

SEQ ID NO: 652943 - DNA, 25 bp, Rattus norvegicus
tgttcagatggagattagaatcggg

SEQ ID NO: 652944 - DNA, 25 bp, Rattus norvegicus
tgttcagatggagtgcccttgggca

SEQ ID NO: 652945 - DNA, 25 bp, Rattus norvegicus
tgttcagatgttacaatgcctcatg

SEQ ID NO: 652946 - DNA, 25 bp, Rattus norvegicus
tgttcagatgtttcaatgcctcatg

SEQ ID NO: 652947 - DNA, 25 bp, Rattus norvegicus
tgttcagattggaaatggccagcaa

SEQ ID NO: 652948 - DNA, 25 bp, Rattus norvegicus
tgttcagattggtaatggccagcaa

SEQ ID NO: 652949 - DNA, 25 bp, Rattus norvegicus
tgttcagcaaggctctggctctaag

SEQ ID NO: 652950 - DNA, 25 bp, Rattus norvegicus
tgttcagcaagggtctggctctaag

SEQ ID NO: 652951 - DNA, 25 bp, Rattus norvegicus
tgttcagcaatcatggcagcatcag

SEQ ID NO: 652952 - DNA, 25 bp, Rattus norvegicus
tgttcagcaatcttggcagcatcag

SEQ ID NO: 652953 - DNA, 25 bp, Rattus norvegicus
tgttcagcaccaatgtactcacttc

SEQ ID NO: 652954 - DNA, 25 bp, Rattus norvegicus
tgttcagcaccattgtactcacttc

SEQ ID NO: 652955 - DNA, 25 bp, Rattus norvegicus
tgttcagcacctccgacacagagaa

SEQ ID NO: 652956 - DNA, 25 bp, Rattus norvegicus
tgttcagcacctgcgacacagagaa

SEQ ID NO: 652957 - DNA, 25 bp, Rattus norvegicus
tgttcagcactgatcatgcaatgga

SEQ ID NO: 652958 - DNA, 25 bp, Rattus norvegicus
tgttcagcactgttcatgcaatgga

SEQ ID NO: 652959 - DNA, 25 bp, Rattus norvegicus
tgttcagccaacaggagcacccttt

SEQ ID NO: 652960 - DNA, 25 bp, Rattus norvegicus
tgttcagccaactggagcacccttt

SEQ ID NO: 652961 - DNA, 25 bp, Rattus norvegicus
tgttcagccagtatcttcagagttt

SEQ ID NO: 652962 - DNA, 25 bp, Rattus norvegicus
tgttcagccagtcacagtgcgacat

SEQ ID NO: 652963 - DNA, 25 bp, Rattus norvegicus
tgttcagccagtgacagtgcgacat

SEQ ID NO: 652964 - DNA, 25 bp, Rattus norvegicus
tgttcagccagtttcttcagagttt

SEQ ID NO: 652965 - DNA, 25 bp, Rattus norvegicus
tgttcagccatgatcctctataata

SEQ ID NO: 652966 - DNA, 25 bp, Rattus norvegicus
tgttcagccatgttcctctataata

SEQ ID NO: 652967 - DNA, 25 bp, Rattus norvegicus
tgttcagccctgatccttggaaaag

SEQ ID NO: 652968 - DNA, 25 bp, Rattus norvegicus
tgttcagccctgttccttggaaaag

SEQ ID NO: 652969 - DNA, 25 bp, Rattus norvegicus
tgttcagcctacaacttcaagtcga

SEQ ID NO: 652970 - DNA, 25 bp, Rattus norvegicus
tgttcagcctactacttcaagtcga

SEQ ID NO: 652971 - DNA, 25 bp, Rattus norvegicus
tgttcagcctcaccagtgggacttg

SEQ ID NO: 652972 - DNA, 25 bp, Rattus norvegicus
tgttcagcctcagcagtgggacttg

SEQ ID NO: 652973 - DNA, 25 bp, Rattus norvegicus
tgttcagcctgtccccaccggtggt

SEQ ID NO: 652974 - DNA, 25 bp, Rattus norvegicus
tgttcagcctgtgcccaccggtggt

SEQ ID NO: 652975 - DNA, 25 bp, Rattus norvegicus
tgttcagctcatacttaggcagtca

SEQ ID NO: 652976 - DNA, 25 bp, Rattus norvegicus
tgttcagctcattcttaggcagtca

SEQ ID NO: 652977 - DNA, 25 bp, Rattus norvegicus
tgttcagctctgatcctagtttgca

SEQ ID NO: 652978 - DNA, 25 bp, Rattus norvegicus
tgttcagctctgttcctagtttgca

SEQ ID NO: 652979 - DNA, 25 bp, Rattus norvegicus
tgttcaggatgcacttttaccaggg

SEQ ID NO: 652980 - DNA, 25 bp, Rattus norvegicus
tgttcaggatgctcttttaccaggg

SEQ ID NO: 652981 - DNA, 25 bp, Rattus norvegicus
tgttcaggcacgccagaaggatgcc

SEQ ID NO: 652982 - DNA, 25 bp, Rattus norvegicus
tgttcaggcacggcagaaggatgcc

SEQ ID NO: 652983 - DNA, 25 bp, Rattus norvegicus
tgttcaggctgaaggttcttggcat

SEQ ID NO: 652984 - DNA, 25 bp, Rattus norvegicus
tgttcaggctgatggttcttggcat

SEQ ID NO: 652985 - DNA, 25 bp, Rattus norvegicus
tgttcagggcgcctttgcagacaca

SEQ ID NO: 652986 - DNA, 25 bp, Rattus norvegicus
tgttcagggcgcgtttgcagacaca

SEQ ID NO: 652987 - DNA, 25 bp, Rattus norvegicus
tgttcagggtcaagtgggagcacct

SEQ ID NO: 652988 - DNA, 25 bp, Rattus norvegicus
tgttcagggtcatgtgggagcacct

SEQ ID NO: 652989 - DNA, 25 bp, Rattus norvegicus
tgttcaggtattccagtggtggctt

SEQ ID NO: 652990 - DNA, 25 bp, Rattus norvegicus
tgttcaggtattgcagtggtggctt

SEQ ID NO: 652991 - DNA, 25 bp, Rattus norvegicus
tgttcaggtcagcagctctcagata

SEQ ID NO: 652992 - DNA, 25 bp, Rattus norvegicus
tgttcaggtcaggagctctcagata

SEQ ID NO: 652993 - DNA, 25 bp, Rattus norvegicus
tgttcaggtctcatatgctattgga

SEQ ID NO: 652994 - DNA, 25 bp, Rattus norvegicus
tgttcaggtctcttatgctattgga

SEQ ID NO: 652995 - DNA, 25 bp, Rattus norvegicus
tgttcaggtgcgattgcattggctc

SEQ ID NO: 652996 - DNA, 25 bp, Rattus norvegicus
tgttcaggtgcgtttgcattggctc

SEQ ID NO: 652997 - DNA, 25 bp, Rattus norvegicus
tgttcagtacgtctgttgtgtttcc

SEQ ID NO: 652998 - DNA, 25 bp, Rattus norvegicus
tgttcagtacgtgtgttgtgtttcc

SEQ ID NO: 652999 - DNA, 25 bp, Rattus norvegicus
tgttcagtactgagtcggtccagat

SEQ ID NO: 653000 - DNA, 25 bp, Rattus norvegicus
tgttcagtactgtgtcggtccagat

SEQ ID NO: 653001 - DNA, 25 bp, Rattus norvegicus
tgttcagtcatgctgtgtcagcctt

SEQ ID NO: 653002 - DNA, 25 bp, Rattus norvegicus
tgttcagtcatggtgtgtcagcctt

SEQ ID NO: 653003 - DNA, 25 bp, Rattus norvegicus
tgttcagtctcaacttcaagctcat

SEQ ID NO: 653004 - DNA, 25 bp, Rattus norvegicus
tgttcagtctcatcttcaagctcat

SEQ ID NO: 653005 - DNA, 25 bp, Rattus norvegicus
tgttcagtgaccacgctgtgttgaa

SEQ ID NO: 653006 - DNA, 25 bp, Rattus norvegicus
tgttcagtgacctcgctgtgttgaa

SEQ ID NO: 653007 - DNA, 25 bp, Rattus norvegicus
tgttcagtgtctacaccaaagggaa

SEQ ID NO: 653008 - DNA, 25 bp, Rattus norvegicus
tgttcagtgtcttcaccaaagggaa

SEQ ID NO: 653009 - DNA, 25 bp, Rattus norvegicus
tgttcagtgtgcagtggcttgcctg

SEQ ID NO: 653010 - DNA, 25 bp, Rattus norvegicus
tgttcagtgtgctgtggcttgcctg

SEQ ID NO: 653011 - DNA, 25 bp, Rattus norvegicus
tgttcagttattacccaagtaaggg

SEQ ID NO: 653012 - DNA, 25 bp, Rattus norvegicus
tgttcagttatttcccaagtaaggg

SEQ ID NO: 653013 - DNA, 25 bp, Rattus norvegicus
tgttcagttcccaaggccagtcaga

SEQ ID NO: 653014 - DNA, 25 bp, Rattus norvegicus
tgttcagttccctaggccagtcaga

SEQ ID NO: 653015 - DNA, 25 bp, Rattus norvegicus
tgttcagttctgagtctggtggcta

SEQ ID NO: 653016 - DNA, 25 bp, Rattus norvegicus
tgttcagttctgtgtctggtggcta

SEQ ID NO: 653017 - DNA, 25 bp, Rattus norvegicus
tgttcagttggacccatgacgcaat

SEQ ID NO: 653018 - DNA, 25 bp, Rattus norvegicus
tgttcagttggagccatgacgcaat

SEQ ID NO: 653019 - DNA, 25 bp, Rattus norvegicus
tgttcataaagcatgggtctggctc

SEQ ID NO: 653020 - DNA, 25 bp, Rattus norvegicus
tgttcataaagcttgggtctggctc

SEQ ID NO: 653021 - DNA, 25 bp, Rattus norvegicus
tgttcataacttctaattcaccgtt

SEQ ID NO: 653022 - DNA, 25 bp, Rattus norvegicus
tgttcataacttgtaattcaccgtt

SEQ ID NO: 653023 - DNA, 25 bp, Rattus norvegicus
tgttcataagacatcatcctcaccc

SEQ ID NO: 653024 - DNA, 25 bp, Rattus norvegicus
tgttcataagacttcatcctcaccc

SEQ ID NO: 653025 - DNA, 25 bp, Rattus norvegicus
tgttcatacattagtgctgcccatg

SEQ ID NO: 653026 - DNA, 25 bp, Rattus norvegicus
tgttcatacatttgtgctgcccatg

SEQ ID NO: 653027 - DNA, 25 bp, Rattus norvegicus
tgttcatagctacatggccagccct

SEQ ID NO: 653028 - DNA, 25 bp, Rattus norvegicus
tgttcatagctagatggccagccct

SEQ ID NO: 653029 - DNA, 25 bp, Rattus norvegicus
tgttcataggttctcatccctcacc

SEQ ID NO: 653030 - DNA, 25 bp, Rattus norvegicus
tgttcataggttgtcatccctcacc

SEQ ID NO: 653031 - DNA, 25 bp, Rattus norvegicus
tgttcatagttcactttgctgtctt

SEQ ID NO: 653032 - DNA, 25 bp, Rattus norvegicus
tgttcatagttctctttgctgtctt

SEQ ID NO: 653033 - DNA, 25 bp, Rattus norvegicus
tgttcatcaaagctttttaatcgga

SEQ ID NO: 653034 - DNA, 25 bp, Rattus norvegicus
tgttcatcaaaggtttttaatcgga

SEQ ID NO: 653035 - DNA, 25 bp, Rattus norvegicus
tgttcatccatcctgtcccaggaaa

SEQ ID NO: 653036 - DNA, 25 bp, Rattus norvegicus
tgttcatccatcgtgtcccaggaaa

SEQ ID NO: 653037 - DNA, 25 bp, Rattus norvegicus
tgttcatcccgaccttggtttagag

SEQ ID NO: 653038 - DNA, 25 bp, Rattus norvegicus
tgttcatcccgagcttggtttagag

SEQ ID NO: 653039 - DNA, 25 bp, Rattus norvegicus
tgttcatcctgaagactgcccagca

SEQ ID NO: 653040 - DNA, 25 bp, Rattus norvegicus
tgttcatcctgatgactgcccagca

SEQ ID NO: 653041 - DNA, 25 bp, Rattus norvegicus
tgttcatccttaccacagagtgcag

SEQ ID NO: 653042 - DNA, 25 bp, Rattus norvegicus
tgttcatccttagcacagagtgcag

SEQ ID NO: 653043 - DNA, 25 bp, Rattus norvegicus
tgttcatcgggaccttgctcttcac

SEQ ID NO: 653044 - DNA, 25 bp, Rattus norvegicus
tgttcatcgggagcttgctcttcac

SEQ ID NO: 653045 - DNA, 25 bp, Rattus norvegicus
tgttcatcgggtacatcctgagcaa

SEQ ID NO: 653046 - DNA, 25 bp, Rattus norvegicus
tgttcatcgggttcatcctgagcaa

SEQ ID NO: 653047 - DNA, 25 bp, Rattus norvegicus
tgttcatcgtgactcactagctggc

SEQ ID NO: 653048 - DNA, 25 bp, Rattus norvegicus
tgttcatcgtgagtcactagctggc

SEQ ID NO: 653049 - DNA, 25 bp, Rattus norvegicus
tgttcatctaagctgttactcgcca

SEQ ID NO: 653050 - DNA, 25 bp, Rattus norvegicus
tgttcatctaaggtgttactcgcca

SEQ ID NO: 653051 - DNA, 25 bp, Rattus norvegicus
tgttcatctacacccacttcaaaca

SEQ ID NO: 653052 - DNA, 25 bp, Rattus norvegicus
tgttcatctacagccacttcaaaca

SEQ ID NO: 653053 - DNA, 25 bp, Rattus norvegicus
tgttcatctcacctacttgtagtca

SEQ ID NO: 653054 - DNA, 25 bp, Rattus norvegicus
tgttcatctcacgtacttgtagtca

SEQ ID NO: 653055 - DNA, 25 bp, Rattus norvegicus
tgttcatcttcaactgtctgcagag

SEQ ID NO: 653056 - DNA, 25 bp, Rattus norvegicus
tgttcatcttcatctgtctgcagag

SEQ ID NO: 653057 - DNA, 25 bp, Rattus norvegicus
tgttcatgagcgcatccggatacag

SEQ ID NO: 653058 - DNA, 25 bp, Rattus norvegicus
tgttcatgagcggatccggatacag

SEQ ID NO: 653059 - DNA, 25 bp, Rattus norvegicus
tgttcatgatgtcagagtgtcctct

SEQ ID NO: 653060 - DNA, 25 bp, Rattus norvegicus
tgttcatgatgtgagagtgtcctct

SEQ ID NO: 653061 - DNA, 25 bp, Rattus norvegicus
tgttcatgcatgactctgcagctgc

SEQ ID NO: 653062 - DNA, 25 bp, Rattus norvegicus
tgttcatgcatgtctctgcagctgc

SEQ ID NO: 653063 - DNA, 25 bp, Rattus norvegicus
tgttcatgcctgacattggcaagcg

SEQ ID NO: 653064 - DNA, 25 bp, Rattus norvegicus
tgttcatgcctgtcattggcaagcg

SEQ ID NO: 653065 - DNA, 25 bp, Rattus norvegicus
tgttcatgccttaatttgaccggaa

SEQ ID NO: 653066 - DNA, 25 bp, Rattus norvegicus
tgttcatgcctttatttgaccggaa

SEQ ID NO: 653067 - DNA, 25 bp, Rattus norvegicus
tgttcatggacaactgctcggagct

SEQ ID NO: 653068 - DNA, 25 bp, Rattus norvegicus
tgttcatggacatctgctcggagct

SEQ ID NO: 653069 - DNA, 25 bp, Rattus norvegicus
tgttcatgtactactatgtggccat

SEQ ID NO: 653070 - DNA, 25 bp, Rattus norvegicus
tgttcatgtacttctatgtggccat

SEQ ID NO: 653071 - DNA, 25 bp, Rattus norvegicus
tgttcatgtcacctgtagccgcaag

SEQ ID NO: 653072 - DNA, 25 bp, Rattus norvegicus
tgttcatgtcacgtgtagccgcaag

SEQ ID NO: 653073 - DNA, 25 bp, Rattus norvegicus
tgttcattaatgagatccctcggcc

SEQ ID NO: 653074 - DNA, 25 bp, Rattus norvegicus
tgttcattaatgtgatccctcggcc

SEQ ID NO: 653075 - DNA, 25 bp, Rattus norvegicus
tgttcattatcgactgcttcctggg

SEQ ID NO: 653076 - DNA, 25 bp, Rattus norvegicus
tgttcattatcgtctgcttcctggg

SEQ ID NO: 653077 - DNA, 25 bp, Rattus norvegicus
tgttcattattccagcaggtgctct

SEQ ID NO: 653078 - DNA, 25 bp, Rattus norvegicus
tgttcattattcgagcaggtgctct

SEQ ID NO: 653079 - DNA, 25 bp, Rattus norvegicus
tgttcattcacaacttccattgctg

SEQ ID NO: 653080 - DNA, 25 bp, Rattus norvegicus
tgttcattcacatcttccattgctg

SEQ ID NO: 653081 - DNA, 25 bp, Rattus norvegicus
tgttcattgcaaaactggtgactga

SEQ ID NO: 653082 - DNA, 25 bp, Rattus norvegicus
tgttcattgcaatactggtgactga

SEQ ID NO: 653083 - DNA, 25 bp, Rattus norvegicus
tgttcattgcccatctccagataaa

SEQ ID NO: 653084 - DNA, 25 bp, Rattus norvegicus
tgttcattgcccttctccagataaa

SEQ ID NO: 653085 - DNA, 25 bp, Rattus norvegicus
tgttcattggctatctatgctgctt

SEQ ID NO: 653086 - DNA, 25 bp, Rattus norvegicus
tgttcattggctttctatgctgctt

SEQ ID NO: 653087 - DNA, 25 bp, Rattus norvegicus
tgttcattgtcaagtaactgatcat

SEQ ID NO: 653088 - DNA, 25 bp, Rattus norvegicus
tgttcattgtcatgtaactgatcat

SEQ ID NO: 653089 - DNA, 25 bp, Rattus norvegicus
tgttcattgtggagcattggcctct

SEQ ID NO: 653090 - DNA, 25 bp, Rattus norvegicus
tgttcattgtggtgcattggcctct

SEQ ID NO: 653091 - DNA, 25 bp, Rattus norvegicus
tgttcatttccacaccaaacttcaa

SEQ ID NO: 653092 - DNA, 25 bp, Rattus norvegicus
tgttcatttccagaccaaacttcaa

SEQ ID NO: 653093 - DNA, 25 bp, Rattus norvegicus
tgttcatttctcaaagtccttccaa

SEQ ID NO: 653094 - DNA, 25 bp, Rattus norvegicus
tgttcatttctctaagtccttccaa

SEQ ID NO: 653095 - DNA, 25 bp, Rattus norvegicus
tgttcattttaaaggccacggccat

SEQ ID NO: 653096 - DNA, 25 bp, Rattus norvegicus
tgttcattttaacactccttgttga

SEQ ID NO: 653097 - DNA, 25 bp, Rattus norvegicus
tgttcattttaagactccttgttga

SEQ ID NO: 653098 - DNA, 25 bp, Rattus norvegicus
tgttcattttaatggccacggccat

SEQ ID NO: 653099 - DNA, 25 bp, Rattus norvegicus
tgttcattttgaccaaccgtgtctc

SEQ ID NO: 653100 - DNA, 25 bp, Rattus norvegicus
tgttcattttgagcaaccgtgtctc

SEQ ID NO: 653101 - DNA, 25 bp, Rattus norvegicus
tgttcattttgccaccgttgcccca

SEQ ID NO: 653102 - DNA, 25 bp, Rattus norvegicus
tgttcattttgcgaccgttgcccca

SEQ ID NO: 653103 - DNA, 25 bp, Rattus norvegicus
tgttccaaaagcatatggacggact

SEQ ID NO: 653104 - DNA, 25 bp, Rattus norvegicus
tgttccaaaagcttatggacggact

SEQ ID NO: 653105 - DNA, 25 bp, Rattus norvegicus
tgttccaaacccatctttagtgtct

SEQ ID NO: 653106 - DNA, 25 bp, Rattus norvegicus
tgttccaaacccttctttagtgtct

SEQ ID NO: 653107 - DNA, 25 bp, Rattus norvegicus
tgttccaaaggcacagacgagtctc

SEQ ID NO: 653108 - DNA, 25 bp, Rattus norvegicus
tgttccaaaggctcagacgagtctc

SEQ ID NO: 653109 - DNA, 25 bp, Rattus norvegicus
tgttccaacaacagaaacgtccact

SEQ ID NO: 653110 - DNA, 25 bp, Rattus norvegicus
tgttccaacaactgaaacgtccact

SEQ ID NO: 653111 - DNA, 25 bp, Rattus norvegicus
tgttccaacacgcagaatcctttcc

SEQ ID NO: 653112 - DNA, 25 bp, Rattus norvegicus
tgttccaacacggagaatcctttcc

SEQ ID NO: 653113 - DNA, 25 bp, Rattus norvegicus
tgttccaagaccctctcaaggacat

SEQ ID NO: 653114 - DNA, 25 bp, Rattus norvegicus
tgttccaagaccgtctcaaggacat

SEQ ID NO: 653115 - DNA, 25 bp, Rattus norvegicus
tgttccaaggtcaaccacaggctat

SEQ ID NO: 653116 - DNA, 25 bp, Rattus norvegicus
tgttccaaggtctaccacaggctat

SEQ ID NO: 653117 - DNA, 25 bp, Rattus norvegicus
tgttccacacagcacttacagtttg

SEQ ID NO: 653118 - DNA, 25 bp, Rattus norvegicus
tgttccacacaggacttacagtttg

SEQ ID NO: 653119 - DNA, 25 bp, Rattus norvegicus
tgttccacagtcagggtcaccatag

SEQ ID NO: 653120 - DNA, 25 bp, Rattus norvegicus
tgttccacagtctgggtcaccatag

SEQ ID NO: 653121 - DNA, 25 bp, Rattus norvegicus
tgttccacccggcagatctgaggag

SEQ ID NO: 653122 - DNA, 25 bp, Rattus norvegicus
tgttccacccgggagatctgaggag

SEQ ID NO: 653123 - DNA, 25 bp, Rattus norvegicus
tgttccaccgttcaggctgtctgaa

SEQ ID NO: 653124 - DNA, 25 bp, Rattus norvegicus
tgttccaccgttgaggctgtctgaa

SEQ ID NO: 653125 - DNA, 25 bp, Rattus norvegicus
tgttccactcccagtttgtggtgac

SEQ ID NO: 653126 - DNA, 25 bp, Rattus norvegicus
tgttccactccctgtttgtggtgac

SEQ ID NO: 653127 - DNA, 25 bp, Rattus norvegicus
tgttccactgatacactgggaccac

SEQ ID NO: 653128 - DNA, 25 bp, Rattus norvegicus
tgttccactgattcactgggaccac

SEQ ID NO: 653129 - DNA, 25 bp, Rattus norvegicus
tgttccactgcacagggcccaggct

SEQ ID NO: 653130 - DNA, 25 bp, Rattus norvegicus
tgttccactgcagagggcccaggct

SEQ ID NO: 653131 - DNA, 25 bp, Rattus norvegicus
tgttccagaccgagagccgattact

SEQ ID NO: 653132 - DNA, 25 bp, Rattus norvegicus
tgttccagaccgtgagccgattact

SEQ ID NO: 653133 - DNA, 25 bp, Rattus norvegicus
tgttccagactgaccgaaggccaaa

SEQ ID NO: 653134 - DNA, 25 bp, Rattus norvegicus
tgttccagactgtccgaaggccaaa

SEQ ID NO: 653135 - DNA, 25 bp, Rattus norvegicus
tgttccagcacacgctctgaatgag

SEQ ID NO: 653136 - DNA, 25 bp, Rattus norvegicus
tgttccagcacaggctctgaatgag

SEQ ID NO: 653137 - DNA, 25 bp, Rattus norvegicus
tgttccagccgcaggccttctatag

SEQ ID NO: 653138 - DNA, 25 bp, Rattus norvegicus
tgttccagccgctggccttctatag

SEQ ID NO: 653139 - DNA, 25 bp, Rattus norvegicus
tgttccagccttccttcattggcat

SEQ ID NO: 653140 - DNA, 25 bp, Rattus norvegicus
tgttccagccttgcttcattggcat

SEQ ID NO: 653141 - DNA, 25 bp, Rattus norvegicus
tgttccagcttccacacaagaggca

SEQ ID NO: 653142 - DNA, 25 bp, Rattus norvegicus
tgttccagcttcgacacaagaggca

SEQ ID NO: 653143 - DNA, 25 bp, Rattus norvegicus
tgttccaggaacacggaggcgccat

SEQ ID NO: 653144 - DNA, 25 bp, Rattus norvegicus
tgttccaggaactcggaggcgccat

SEQ ID NO: 653145 - DNA, 25 bp, Rattus norvegicus
tgttccaggacaactcttcaaggtg

SEQ ID NO: 653146 - DNA, 25 bp, Rattus norvegicus
tgttccaggacatctcttcaaggtg

SEQ ID NO: 653147 - DNA, 25 bp, Rattus norvegicus
tgttccaggacccatgtgtctcatt

SEQ ID NO: 653148 - DNA, 25 bp, Rattus norvegicus
tgttccaggaccgatgtgtctcatt

SEQ ID NO: 653149 - DNA, 25 bp, Rattus norvegicus
tgttccaggagcagctgacgctcga

SEQ ID NO: 653150 - DNA, 25 bp, Rattus norvegicus
tgttccaggagctgctgacgctcga

SEQ ID NO: 653151 - DNA, 25 bp, Rattus norvegicus
tgttccaggcatacctcaactacta

SEQ ID NO: 653152 - DNA, 25 bp, Rattus norvegicus
tgttccaggcattcctcaactacta

SEQ ID NO: 653153 - DNA, 25 bp, Rattus norvegicus
tgttccaggctcaagttgtttttga

SEQ ID NO: 653154 - DNA, 25 bp, Rattus norvegicus
tgttccaggctctagttgtttttga

SEQ ID NO: 653155 - DNA, 25 bp, Rattus norvegicus
tgttccaggtgtacgtaatttaatc

SEQ ID NO: 653156 - DNA, 25 bp, Rattus norvegicus
tgttccaggtgttcgtaatttaatc

SEQ ID NO: 653157 - DNA, 25 bp, Rattus norvegicus
tgttccagtgctcattgctttgttc

SEQ ID NO: 653158 - DNA, 25 bp, Rattus norvegicus
tgttccagtgctgattgctttgttc

SEQ ID NO: 653159 - DNA, 25 bp, Rattus norvegicus
tgttccagtggccttgggatgactt

SEQ ID NO: 653160 - DNA, 25 bp, Rattus norvegicus
tgttccagtggcgttgggatgactt

SEQ ID NO: 653161 - DNA, 25 bp, Rattus norvegicus
tgttccataactccatgtgctgttg

SEQ ID NO: 653162 - DNA, 25 bp, Rattus norvegicus
tgttccataactgcatgtgctgttg

SEQ ID NO: 653163 - DNA, 25 bp, Rattus norvegicus
tgttccatactgactttccttacaa

SEQ ID NO: 653164 - DNA, 25 bp, Rattus norvegicus
tgttccatactgtctttccttacaa

SEQ ID NO: 653165 - DNA, 25 bp, Rattus norvegicus
tgttccatcatcattgttttccatc

SEQ ID NO: 653166 - DNA, 25 bp, Rattus norvegicus
tgttccatcatctttgttttccatc

SEQ ID NO: 653167 - DNA, 25 bp, Rattus norvegicus
tgttccatctcgactaccataaatt

SEQ ID NO: 653168 - DNA, 25 bp, Rattus norvegicus
tgttccatctcgtctaccataaatt

SEQ ID NO: 653169 - DNA, 25 bp, Rattus norvegicus
tgttccatgcctatctattttttgt

SEQ ID NO: 653170 - DNA, 25 bp, Rattus norvegicus
tgttccatgcctttctattttttgt

SEQ ID NO: 653171 - DNA, 25 bp, Rattus norvegicus
tgttccattcttactgcgcggacaa

SEQ ID NO: 653172 - DNA, 25 bp, Rattus norvegicus
tgttccattctttctgcgcggacaa

SEQ ID NO: 653173 - DNA, 25 bp, Rattus norvegicus
tgttccattggtcaacctttctatc

SEQ ID NO: 653174 - DNA, 25 bp, Rattus norvegicus
tgttccattggtgaacctttctatc

SEQ ID NO: 653175 - DNA, 25 bp, Rattus norvegicus
tgttcccaaagtctgtgttcgttcc

SEQ ID NO: 653176 - DNA, 25 bp, Rattus norvegicus
tgttcccaaagtgtgtgttcgttcc

SEQ ID NO: 653177 - DNA, 25 bp, Rattus norvegicus
tgttcccaagacaaattcttccacc

SEQ ID NO: 653178 - DNA, 25 bp, Rattus norvegicus
tgttcccaagactaattcttccacc

SEQ ID NO: 653179 - DNA, 25 bp, Rattus norvegicus
tgttcccaagggattgctctgggtc

SEQ ID NO: 653180 - DNA, 25 bp, Rattus norvegicus
tgttcccaagggtttgctctgggtc

SEQ ID NO: 653181 - DNA, 25 bp, Rattus norvegicus
tgttcccaagtcaggagcgccgcaa

SEQ ID NO: 653182 - DNA, 25 bp, Rattus norvegicus
tgttcccaagtctggagcgccgcaa

SEQ ID NO: 653183 - DNA, 25 bp, Rattus norvegicus
tgttcccaagtgaacaagccttctg

SEQ ID NO: 653184 - DNA, 25 bp, Rattus norvegicus
tgttcccaagtgtacaagccttctg

SEQ ID NO: 653185 - DNA, 25 bp, Rattus norvegicus
tgttcccacactaaaccgtgttata

SEQ ID NO: 653186 - DNA, 25 bp, Rattus norvegicus
tgttcccacacttaaccgtgttata

SEQ ID NO: 653187 - DNA, 25 bp, Rattus norvegicus
tgttcccacatacattgactcgttg

SEQ ID NO: 653188 - DNA, 25 bp, Rattus norvegicus
tgttcccacatagattgactcgttg

SEQ ID NO: 653189 - DNA, 25 bp, Rattus norvegicus
tgttcccaccccatgggaataagtg

SEQ ID NO: 653190 - DNA, 25 bp, Rattus norvegicus
tgttcccaccccttgggaataagtg

SEQ ID NO: 653191 - DNA, 25 bp, Rattus norvegicus
tgttcccaccttacctgaaggaatt

SEQ ID NO: 653192 - DNA, 25 bp, Rattus norvegicus
tgttcccaccttcatcatactgtac

SEQ ID NO: 653193 - DNA, 25 bp, Rattus norvegicus
tgttcccaccttgatcatactgtac

SEQ ID NO: 653194 - DNA, 25 bp, Rattus norvegicus
tgttcccacctttcctgaaggaatt

SEQ ID NO: 653195 - DNA, 25 bp, Rattus norvegicus
tgttcccacgttaaaagccacactg

SEQ ID NO: 653196 - DNA, 25 bp, Rattus norvegicus
tgttcccacgtttaaagccacactg

SEQ ID NO: 653197 - DNA, 25 bp, Rattus norvegicus
tgttcccactctcgagacacaaatc

SEQ ID NO: 653198 - DNA, 25 bp, Rattus norvegicus
tgttcccactctggagacacaaatc

SEQ ID NO: 653199 - DNA, 25 bp, Rattus norvegicus
tgttcccagacaagaccttttcaag

SEQ ID NO: 653200 - DNA, 25 bp, Rattus norvegicus
tgttcccagacatgaccttttcaag

SEQ ID NO: 653201 - DNA, 25 bp, Rattus norvegicus
tgttcccagctaccataattcatgt

SEQ ID NO: 653202 - DNA, 25 bp, Rattus norvegicus
tgttcccagctagcataattcatgt

SEQ ID NO: 653203 - DNA, 25 bp, Rattus norvegicus
tgttcccaggctctaggatcagatg

SEQ ID NO: 653204 - DNA, 25 bp, Rattus norvegicus
tgttcccaggctgtaggatcagatg

SEQ ID NO: 653205 - DNA, 25 bp, Rattus norvegicus
tgttcccagtggaggtatcttccaa

SEQ ID NO: 653206 - DNA, 25 bp, Rattus norvegicus
tgttcccagtggcaagagtacagca

SEQ ID NO: 653207 - DNA, 25 bp, Rattus norvegicus
tgttcccagtgggaagagtacagca

SEQ ID NO: 653208 - DNA, 25 bp, Rattus norvegicus
tgttcccagtggtggtatcttccaa

SEQ ID NO: 653209 - DNA, 25 bp, Rattus norvegicus
tgttcccagttactctaaccaacat

SEQ ID NO: 653210 - DNA, 25 bp, Rattus norvegicus
tgttcccagttagtctaaccaacat

SEQ ID NO: 653211 - DNA, 25 bp, Rattus norvegicus
tgttcccagtttcctggttaccgag

SEQ ID NO: 653212 - DNA, 25 bp, Rattus norvegicus
tgttcccagtttgctggttaccgag

SEQ ID NO: 653213 - DNA, 25 bp, Rattus norvegicus
tgttcccatctcagcagaggaggca

SEQ ID NO: 653214 - DNA, 25 bp, Rattus norvegicus
tgttcccatctctgcagaggaggca

SEQ ID NO: 653215 - DNA, 25 bp, Rattus norvegicus
tgttcccatggacgctccctctgga

SEQ ID NO: 653216 - DNA, 25 bp, Rattus norvegicus
tgttcccatggactacgtcggcata

SEQ ID NO: 653217 - DNA, 25 bp, Rattus norvegicus
tgttcccatggaggctccctctgga

SEQ ID NO: 653218 - DNA, 25 bp, Rattus norvegicus
tgttcccatggagtacgtcggcata

SEQ ID NO: 653219 - DNA, 25 bp, Rattus norvegicus
tgttcccattgtcctaatcatgcca

SEQ ID NO: 653220 - DNA, 25 bp, Rattus norvegicus
tgttcccattgtgctaatcatgcca

SEQ ID NO: 653221 - DNA, 25 bp, Rattus norvegicus
tgttccccaaggattggttctgtga

SEQ ID NO: 653222 - DNA, 25 bp, Rattus norvegicus
tgttccccaaggtttggttctgtga

SEQ ID NO: 653223 - DNA, 25 bp, Rattus norvegicus
tgttccccacagataaagcaccaag

SEQ ID NO: 653224 - DNA, 25 bp, Rattus norvegicus
tgttccccacagttaaagcaccaag

SEQ ID NO: 653225 - DNA, 25 bp, Rattus norvegicus
tgttccccacatctttccatggcaa

SEQ ID NO: 653226 - DNA, 25 bp, Rattus norvegicus
tgttccccacatgtttccatggcaa

SEQ ID NO: 653227 - DNA, 25 bp, Rattus norvegicus
tgttccccagcacaggatttttgtt

SEQ ID NO: 653228 - DNA, 25 bp, Rattus norvegicus
tgttccccagcagaggatttttgtt

SEQ ID NO: 653229 - DNA, 25 bp, Rattus norvegicus
tgttccccaggaagtcttgtaagat

SEQ ID NO: 653230 - DNA, 25 bp, Rattus norvegicus
tgttccccaggatgtcttgtaagat

SEQ ID NO: 653231 - DNA, 25 bp, Rattus norvegicus
tgttccccagtcactgcaaaggtga

SEQ ID NO: 653232 - DNA, 25 bp, Rattus norvegicus
tgttccccagtctctgcaaaggtga

SEQ ID NO: 653233 - DNA, 25 bp, Rattus norvegicus
tgttccccatatcaaggccaatgtg

SEQ ID NO: 653234 - DNA, 25 bp, Rattus norvegicus
tgttccccatatgaaggccaatgtg

SEQ ID NO: 653235 - DNA, 25 bp, Rattus norvegicus
tgttcccctccacattgttatatga

SEQ ID NO: 653236 - DNA, 25 bp, Rattus norvegicus
tgttcccctccagattgttatatga

SEQ ID NO: 653237 - DNA, 25 bp, Rattus norvegicus
tgttcccctgacacctatggaaaga

SEQ ID NO: 653238 - DNA, 25 bp, Rattus norvegicus
tgttcccctgactcctatggaaaga

SEQ ID NO: 653239 - DNA, 25 bp, Rattus norvegicus
tgttcccctgagatacccagacaca

SEQ ID NO: 653240 - DNA, 25 bp, Rattus norvegicus
tgttcccctgagttacccagacaca

SEQ ID NO: 653241 - DNA, 25 bp, Rattus norvegicus
tgttcccctgggaagtaatgtccta

SEQ ID NO: 653242 - DNA, 25 bp, Rattus norvegicus
tgttcccctgggtagtaatgtccta

SEQ ID NO: 653243 - DNA, 25 bp, Rattus norvegicus
tgttcccctgtgaggcggtgagaaa

SEQ ID NO: 653244 - DNA, 25 bp, Rattus norvegicus
tgttcccctgtgcagtacgaccttt

SEQ ID NO: 653245 - DNA, 25 bp, Rattus norvegicus
tgttcccctgtggagtacgaccttt

SEQ ID NO: 653246 - DNA, 25 bp, Rattus norvegicus
tgttcccctgtgtggcggtgagaaa

SEQ ID NO: 653247 - DNA, 25 bp, Rattus norvegicus
tgttccccttgtactgcaacaatat

SEQ ID NO: 653248 - DNA, 25 bp, Rattus norvegicus
tgttccccttgttctgcaacaatat

SEQ ID NO: 653249 - DNA, 25 bp, Rattus norvegicus
tgttcccgaacaccgatgcacgaag

SEQ ID NO: 653250 - DNA, 25 bp, Rattus norvegicus
tgttcccgaacagcgatgcacgaag

SEQ ID NO: 653251 - DNA, 25 bp, Rattus norvegicus
tgttcccgagtaccaggacgacaat

SEQ ID NO: 653252 - DNA, 25 bp, Rattus norvegicus
tgttcccgagtagcaggacgacaat

SEQ ID NO: 653253 - DNA, 25 bp, Rattus norvegicus
tgttcccgccaactaaaccagtgct

SEQ ID NO: 653254 - DNA, 25 bp, Rattus norvegicus
tgttcccgccaagtaaaccagtgct

SEQ ID NO: 653255 - DNA, 25 bp, Rattus norvegicus
tgttcccgggaaccgcagtcagcta

SEQ ID NO: 653256 - DNA, 25 bp, Rattus norvegicus
tgttcccgggaagcgcagtcagcta

SEQ ID NO: 653257 - DNA, 25 bp, Rattus norvegicus
tgttccctaaatcctggtttctaat

SEQ ID NO: 653258 - DNA, 25 bp, Rattus norvegicus
tgttccctaaatgctggtttctaat

SEQ ID NO: 653259 - DNA, 25 bp, Rattus norvegicus
tgttccctaccaatgactcatatat

SEQ ID NO: 653260 - DNA, 25 bp, Rattus norvegicus
tgttccctaccattgactcatatat

SEQ ID NO: 653261 - DNA, 25 bp, Rattus norvegicus
tgttccctagacactgcatggcagc

SEQ ID NO: 653262 - DNA, 25 bp, Rattus norvegicus
tgttccctagactctgcatggcagc

SEQ ID NO: 653263 - DNA, 25 bp, Rattus norvegicus
tgttccctcagaacatggctttaat

SEQ ID NO: 653264 - DNA, 25 bp, Rattus norvegicus
tgttccctcagatcatggctttaat

SEQ ID NO: 653265 - DNA, 25 bp, Rattus norvegicus
tgttccctcctcaagaataccagga

SEQ ID NO: 653266 - DNA, 25 bp, Rattus norvegicus
tgttccctcctctagaataccagga

SEQ ID NO: 653267 - DNA, 25 bp, Rattus norvegicus
tgttccctctcaactttcaaagatt

SEQ ID NO: 653268 - DNA, 25 bp, Rattus norvegicus
tgttccctctcatctttcaaagatt

SEQ ID NO: 653269 - DNA, 25 bp, Rattus norvegicus
tgttccctcttcaggtagcagcgga

SEQ ID NO: 653270 - DNA, 25 bp, Rattus norvegicus
tgttccctcttctggtagcagcgga

SEQ ID NO: 653271 - DNA, 25 bp, Rattus norvegicus
tgttccctctttagggcaaattctt

SEQ ID NO: 653272 - DNA, 25 bp, Rattus norvegicus
tgttccctcttttgggcaaattctt

SEQ ID NO: 653273 - DNA, 25 bp, Rattus norvegicus
tgttccctgcctataatttatcgtg

SEQ ID NO: 653274 - DNA, 25 bp, Rattus norvegicus
tgttccctgcctttaatttatcgtg

SEQ ID NO: 653275 - DNA, 25 bp, Rattus norvegicus
tgttccctgggaaatagcattcttc

SEQ ID NO: 653276 - DNA, 25 bp, Rattus norvegicus
tgttccctgggatatagcattcttc

SEQ ID NO: 653277 - DNA, 25 bp, Rattus norvegicus
tgttcccttccaaatactgtccaga

SEQ ID NO: 653278 - DNA, 25 bp, Rattus norvegicus
tgttcccttccatatactgtccaga

SEQ ID NO: 653279 - DNA, 25 bp, Rattus norvegicus
tgttcccttttaagccaatatagtg

SEQ ID NO: 653280 - DNA, 25 bp, Rattus norvegicus
tgttcccttttatgccaatatagtg

SEQ ID NO: 653281 - DNA, 25 bp, Rattus norvegicus
tgttcccttttgaaatccccttcag

SEQ ID NO: 653282 - DNA, 25 bp, Rattus norvegicus
tgttcccttttgtaatccccttcag

SEQ ID NO: 653283 - DNA, 25 bp, Rattus norvegicus
tgttccctttttcagtaagcagata

SEQ ID NO: 653284 - DNA, 25 bp, Rattus norvegicus
tgttccctttttgagtaagcagata

SEQ ID NO: 653285 - DNA, 25 bp, Rattus norvegicus
tgttccgaacccacttagaagctgt

SEQ ID NO: 653286 - DNA, 25 bp, Rattus norvegicus
tgttccgaaccctcttagaagctgt

SEQ ID NO: 653287 - DNA, 25 bp, Rattus norvegicus
tgttccgacggaagaagccgcactt

SEQ ID NO: 653288 - DNA, 25 bp, Rattus norvegicus
tgttccgacggatgaagccgcactt

SEQ ID NO: 653289 - DNA, 25 bp, Rattus norvegicus
tgttccgacggtaggcacgcagcca

SEQ ID NO: 653290 - DNA, 25 bp, Rattus norvegicus
tgttccgacggttggcacgcagcca

SEQ ID NO: 653291 - DNA, 25 bp, Rattus norvegicus
tgttccgagagcagaatgaggcctt

SEQ ID NO: 653292 - DNA, 25 bp, Rattus norvegicus
tgttccgagagctgaatgaggcctt

SEQ ID NO: 653293 - DNA, 25 bp, Rattus norvegicus
tgttccgatataacaaaatctttgt

SEQ ID NO: 653294 - DNA, 25 bp, Rattus norvegicus
tgttccgatatatcaaaatctttgt

SEQ ID NO: 653295 - DNA, 25 bp, Rattus norvegicus
tgttccgatcccatcaagtgcagaa

SEQ ID NO: 653296 - DNA, 25 bp, Rattus norvegicus
tgttccgatcccttcaagtgcagaa

SEQ ID NO: 653297 - DNA, 25 bp, Rattus norvegicus
tgttccgatttgaggcctgaccaca

SEQ ID NO: 653298 - DNA, 25 bp, Rattus norvegicus
tgttccgatttgtggcctgaccaca

SEQ ID NO: 653299 - DNA, 25 bp, Rattus norvegicus
tgttccgcctgcaggagtacaacat

SEQ ID NO: 653300 - DNA, 25 bp, Rattus norvegicus
tgttccgcctgctggagtacaacat

SEQ ID NO: 653301 - DNA, 25 bp, Rattus norvegicus
tgttccgctactccgcaggcgcgtg

SEQ ID NO: 653302 - DNA, 25 bp, Rattus norvegicus
tgttccgctactgcgcaggcgcgtg

SEQ ID NO: 653303 - DNA, 25 bp, Rattus norvegicus
tgttccgctctcagtaactacaggg

SEQ ID NO: 653304 - DNA, 25 bp, Rattus norvegicus
tgttccgctctctgtaactacaggg

SEQ ID NO: 653305 - DNA, 25 bp, Rattus norvegicus
tgttccgcttctcagaggacgcctt

SEQ ID NO: 653306 - DNA, 25 bp, Rattus norvegicus
tgttccgcttctgagaggacgcctt

SEQ ID NO: 653307 - DNA, 25 bp, Rattus norvegicus
tgttccggaagcaggcatctggatt

SEQ ID NO: 653308 - DNA, 25 bp, Rattus norvegicus
tgttccggaagctggcatctggatt

SEQ ID NO: 653309 - DNA, 25 bp, Rattus norvegicus
tgttccggcttcacttgcagcaggc

SEQ ID NO: 653310 - DNA, 25 bp, Rattus norvegicus
tgttccggcttctcttgcagcaggc

SEQ ID NO: 653311 - DNA, 25 bp, Rattus norvegicus
tgttccgtacgtcagagttgctaga

SEQ ID NO: 653312 - DNA, 25 bp, Rattus norvegicus
tgttccgtacgtgagagttgctaga

SEQ ID NO: 653313 - DNA, 25 bp, Rattus norvegicus
tgttccgtcaccagaattctcggtg

SEQ ID NO: 653314 - DNA, 25 bp, Rattus norvegicus
tgttccgtcacctgaattctcggtg

SEQ ID NO: 653315 - DNA, 25 bp, Rattus norvegicus
tgttccgtcctcaagcggagcgggc

SEQ ID NO: 653316 - DNA, 25 bp, Rattus norvegicus
tgttccgtcctctagcggagcgggc

SEQ ID NO: 653317 - DNA, 25 bp, Rattus norvegicus
tgttccgtccttcttatcagcactg

SEQ ID NO: 653318 - DNA, 25 bp, Rattus norvegicus
tgttccgtccttgttatcagcactg

SEQ ID NO: 653319 - DNA, 25 bp, Rattus norvegicus
tgttccgtgccaactgcagatctga

SEQ ID NO: 653320 - DNA, 25 bp, Rattus norvegicus
tgttccgtgccatctgcagatctga

SEQ ID NO: 653321 - DNA, 25 bp, Rattus norvegicus
tgttccgtgtatacagacaccgtgt

SEQ ID NO: 653322 - DNA, 25 bp, Rattus norvegicus
tgttccgtgtattcagacaccgtgt

SEQ ID NO: 653323 - DNA, 25 bp, Rattus norvegicus
tgttccgttttaaagccatttgcgt

SEQ ID NO: 653324 - DNA, 25 bp, Rattus norvegicus
tgttccgttttatagccatttgcgt

SEQ ID NO: 653325 - DNA, 25 bp, Rattus norvegicus
tgttccgttttgatttctcattggg

SEQ ID NO: 653326 - DNA, 25 bp, Rattus norvegicus
tgttccgttttgttttctcattggg

SEQ ID NO: 653327 - DNA, 25 bp, Rattus norvegicus
tgttcctactggcaaggccctaggt

SEQ ID NO: 653328 - DNA, 25 bp, Rattus norvegicus
tgttcctactgggaaggccctaggt

SEQ ID NO: 653329 - DNA, 25 bp, Rattus norvegicus
tgttcctagacaccagtggctaccg

SEQ ID NO: 653330 - DNA, 25 bp, Rattus norvegicus
tgttcctagacagcagtggctaccg

SEQ ID NO: 653331 - DNA, 25 bp, Rattus norvegicus
tgttcctagtgacgctccggctgtg

SEQ ID NO: 653332 - DNA, 25 bp, Rattus norvegicus
tgttcctagtgaggctccggctgtg

SEQ ID NO: 653333 - DNA, 25 bp, Rattus norvegicus
tgttcctatagaagggcgcgtgcta

SEQ ID NO: 653334 - DNA, 25 bp, Rattus norvegicus
tgttcctatagatgggcgcgtgcta

SEQ ID NO: 653335 - DNA, 25 bp, Rattus norvegicus
tgttcctatcatatgcaaaccaaga

SEQ ID NO: 653336 - DNA, 25 bp, Rattus norvegicus
tgttcctatcatttgcaaaccaaga

SEQ ID NO: 653337 - DNA, 25 bp, Rattus norvegicus
tgttcctattgcacaatgttcctgt

SEQ ID NO: 653338 - DNA, 25 bp, Rattus norvegicus
tgttcctattgctcaatgttcctgt

SEQ ID NO: 653339 - DNA, 25 bp, Rattus norvegicus
tgttcctcaactagttattccagcc

SEQ ID NO: 653340 - DNA, 25 bp, Rattus norvegicus
tgttcctcaacttgttattccagcc

SEQ ID NO: 653341 - DNA, 25 bp, Rattus norvegicus
tgttcctcacaaagctggtggccca

SEQ ID NO: 653342 - DNA, 25 bp, Rattus norvegicus
tgttcctcacaatgctggtggccca

SEQ ID NO: 653343 - DNA, 25 bp, Rattus norvegicus
tgttcctcacgtatgtccacagcaa

SEQ ID NO: 653344 - DNA, 25 bp, Rattus norvegicus
tgttcctcacgtttgtccacagcaa

SEQ ID NO: 653345 - DNA, 25 bp, Rattus norvegicus
tgttcctcagttagcagctaccgag

SEQ ID NO: 653346 - DNA, 25 bp, Rattus norvegicus
tgttcctcagtttgcagctaccgag

SEQ ID NO: 653347 - DNA, 25 bp, Rattus norvegicus
tgttcctcatacagctttcgagcta

SEQ ID NO: 653348 - DNA, 25 bp, Rattus norvegicus
tgttcctcatactgctttcgagcta

SEQ ID NO: 653349 - DNA, 25 bp, Rattus norvegicus
tgttcctcatggctatcacgtccac

SEQ ID NO: 653350 - DNA, 25 bp, Rattus norvegicus
tgttcctcatgggtatcacgtccac

SEQ ID NO: 653351 - DNA, 25 bp, Rattus norvegicus
tgttcctcatttcatcgttgtggca

SEQ ID NO: 653352 - DNA, 25 bp, Rattus norvegicus
tgttcctcatttgatcgttgtggca

SEQ ID NO: 653353 - DNA, 25 bp, Rattus norvegicus
tgttcctccacgagttcatcgatgt

SEQ ID NO: 653354 - DNA, 25 bp, Rattus norvegicus
tgttcctccacgtgttcatcgatgt

SEQ ID NO: 653355 - DNA, 25 bp, Rattus norvegicus
tgttcctcccatctcaggctttggg

SEQ ID NO: 653356 - DNA, 25 bp, Rattus norvegicus
tgttcctcccatgtcaggctttggg

SEQ ID NO: 653357 - DNA, 25 bp, Rattus norvegicus
tgttcctccccaaaatttaaataat

SEQ ID NO: 653358 - DNA, 25 bp, Rattus norvegicus
tgttcctccccataatttaaataat

SEQ ID NO: 653359 - DNA, 25 bp, Rattus norvegicus
tgttcctccctcatgttgtaggaaa

SEQ ID NO: 653360 - DNA, 25 bp, Rattus norvegicus
tgttcctccctcttgttgtaggaaa

SEQ ID NO: 653361 - DNA, 25 bp, Rattus norvegicus
tgttcctccgagctgcagtaacagg

SEQ ID NO: 653362 - DNA, 25 bp, Rattus norvegicus
tgttcctccgaggtgcagtaacagg

SEQ ID NO: 653363 - DNA, 25 bp, Rattus norvegicus
tgttcctccgatatcttaacctatt

SEQ ID NO: 653364 - DNA, 25 bp, Rattus norvegicus
tgttcctccgatttcttaacctatt

SEQ ID NO: 653365 - DNA, 25 bp, Rattus norvegicus
tgttcctcgccaactttttcttttt

SEQ ID NO: 653366 - DNA, 25 bp, Rattus norvegicus
tgttcctcgccatctttttcttttt

SEQ ID NO: 653367 - DNA, 25 bp, Rattus norvegicus
tgttcctctccaatttactttgctt

SEQ ID NO: 653368 - DNA, 25 bp, Rattus norvegicus
tgttcctctccattttactttgctt

SEQ ID NO: 653369 - DNA, 25 bp, Rattus norvegicus
tgttcctctggtacgaagaagcgct

SEQ ID NO: 653370 - DNA, 25 bp, Rattus norvegicus
tgttcctctggttcgaagaagcgct

SEQ ID NO: 653371 - DNA, 25 bp, Rattus norvegicus
tgttcctcttgtatctcaaccattt

SEQ ID NO: 653372 - DNA, 25 bp, Rattus norvegicus
tgttcctcttgtttctcaaccattt

SEQ ID NO: 653373 - DNA, 25 bp, Rattus norvegicus
tgttcctgacagacgatggcatctc

SEQ ID NO: 653374 - DNA, 25 bp, Rattus norvegicus
tgttcctgacagcacagcactggat

SEQ ID NO: 653375 - DNA, 25 bp, Rattus norvegicus
tgttcctgacaggacagcactggat

SEQ ID NO: 653376 - DNA, 25 bp, Rattus norvegicus
tgttcctgacagtcgatggcatctc

SEQ ID NO: 653377 - DNA, 25 bp, Rattus norvegicus
tgttcctgatccagctgagcctggg

SEQ ID NO: 653378 - DNA, 25 bp, Rattus norvegicus
tgttcctgatcctgctgagcctggg

SEQ ID NO: 653379 - DNA, 25 bp, Rattus norvegicus
tgttcctgatctaaagtgcctcttt

SEQ ID NO: 653380 - DNA, 25 bp, Rattus norvegicus
tgttcctgatcttaagtgcctcttt

SEQ ID NO: 653381 - DNA, 25 bp, Rattus norvegicus
tgttcctgatttccctgtgacaata

SEQ ID NO: 653382 - DNA, 25 bp, Rattus norvegicus
tgttcctgatttgcctgtgacaata

SEQ ID NO: 653383 - DNA, 25 bp, Rattus norvegicus
tgttcctgcacaaagtgtcccaact

SEQ ID NO: 653384 - DNA, 25 bp, Rattus norvegicus
tgttcctgcacatagtgtcccaact

SEQ ID NO: 653385 - DNA, 25 bp, Rattus norvegicus
tgttcctgcagccatctctgtttta

SEQ ID NO: 653386 - DNA, 25 bp, Rattus norvegicus
tgttcctgcagcgatctctgtttta

SEQ ID NO: 653387 - DNA, 25 bp, Rattus norvegicus
tgttcctgccctagtgccttagtta

SEQ ID NO: 653388 - DNA, 25 bp, Rattus norvegicus
tgttcctgcccttgtgccttagtta

SEQ ID NO: 653389 - DNA, 25 bp, Rattus norvegicus
tgttcctgcttccttgggtgttcaa

SEQ ID NO: 653390 - DNA, 25 bp, Rattus norvegicus
tgttcctgcttcgttgggtgttcaa

SEQ ID NO: 653391 - DNA, 25 bp, Rattus norvegicus
tgttcctggaaactctgtgttgtgt

SEQ ID NO: 653392 - DNA, 25 bp, Rattus norvegicus
tgttcctggaaagtctgtgttgtgt

SEQ ID NO: 653393 - DNA, 25 bp, Rattus norvegicus
tgttcctggcagcagagatccgaga

SEQ ID NO: 653394 - DNA, 25 bp, Rattus norvegicus
tgttcctggcaggagagatccgaga

SEQ ID NO: 653395 - DNA, 25 bp, Rattus norvegicus
tgttcctggccactggattgtatgt

SEQ ID NO: 653396 - DNA, 25 bp, Rattus norvegicus
tgttcctggccagtggattgtatgt

SEQ ID NO: 653397 - DNA, 25 bp, Rattus norvegicus
tgttcctggcttacccaaggattat

SEQ ID NO: 653398 - DNA, 25 bp, Rattus norvegicus
tgttcctggctttcccaaggattat

SEQ ID NO: 653399 - DNA, 25 bp, Rattus norvegicus
tgttcctgggaactggtacatcttc

SEQ ID NO: 653400 - DNA, 25 bp, Rattus norvegicus
tgttcctgggaagtggtacatcttc

SEQ ID NO: 653401 - DNA, 25 bp, Rattus norvegicus
tgttcctgggcactgagtatctaat

SEQ ID NO: 653402 - DNA, 25 bp, Rattus norvegicus
tgttcctgggcagtgagtatctaat

SEQ ID NO: 653403 - DNA, 25 bp, Rattus norvegicus
tgttccttaaagcaggtgcgctcct

SEQ ID NO: 653404 - DNA, 25 bp, Rattus norvegicus
tgttccttaaaggaggtgcgctcct

SEQ ID NO: 653405 - DNA, 25 bp, Rattus norvegicus
tgttccttaactcatgccaattctg

SEQ ID NO: 653406 - DNA, 25 bp, Rattus norvegicus
tgttccttaactcttgagcctcagc

SEQ ID NO: 653407 - DNA, 25 bp, Rattus norvegicus
tgttccttaactgatgccaattctg

SEQ ID NO: 653408 - DNA, 25 bp, Rattus norvegicus
tgttccttaactgttgagcctcagc

SEQ ID NO: 653409 - DNA, 25 bp, Rattus norvegicus
tgttccttagtacctagccatcttg

SEQ ID NO: 653410 - DNA, 25 bp, Rattus norvegicus
tgttccttagtagctagccatcttg

SEQ ID NO: 653411 - DNA, 25 bp, Rattus norvegicus
tgttccttatagactggtgacctct

SEQ ID NO: 653412 - DNA, 25 bp, Rattus norvegicus
tgttccttatagtctggtgacctct

SEQ ID NO: 653413 - DNA, 25 bp, Rattus norvegicus
tgttccttcactatcctgcgtctgg

SEQ ID NO: 653414 - DNA, 25 bp, Rattus norvegicus
tgttccttcactttcctgcgtctgg

SEQ ID NO: 653415 - DNA, 25 bp, Rattus norvegicus
tgttccttcagacggacctgggttc

SEQ ID NO: 653416 - DNA, 25 bp, Rattus norvegicus
tgttccttcagagggacctgggttc

SEQ ID NO: 653417 - DNA, 25 bp, Rattus norvegicus
tgttccttctgcaggcaggtttgag

SEQ ID NO: 653418 - DNA, 25 bp, Rattus norvegicus
tgttccttctgctggcaggtttgag

SEQ ID NO: 653419 - DNA, 25 bp, Rattus norvegicus
tgttccttctggcagtctgaagcaa

SEQ ID NO: 653420 - DNA, 25 bp, Rattus norvegicus
tgttccttctgggagtctgaagcaa

SEQ ID NO: 653421 - DNA, 25 bp, Rattus norvegicus
tgttccttctttaatcactctgcat

SEQ ID NO: 653422 - DNA, 25 bp, Rattus norvegicus
tgttccttcttttatcactctgcat

SEQ ID NO: 653423 - DNA, 25 bp, Rattus norvegicus
tgttccttgctcactaagttcctta

SEQ ID NO: 653424 - DNA, 25 bp, Rattus norvegicus
tgttccttgctccattcctgttttt

SEQ ID NO: 653425 - DNA, 25 bp, Rattus norvegicus
tgttccttgctcgattcctgttttt

SEQ ID NO: 653426 - DNA, 25 bp, Rattus norvegicus
tgttccttgctctctaagttcctta

SEQ ID NO: 653427 - DNA, 25 bp, Rattus norvegicus
tgttccttggatcagcctgctgcac

SEQ ID NO: 653428 - DNA, 25 bp, Rattus norvegicus
tgttccttggatgagcctgctgcac

SEQ ID NO: 653429 - DNA, 25 bp, Rattus norvegicus
tgttccttgggtcaactgggcttca

SEQ ID NO: 653430 - DNA, 25 bp, Rattus norvegicus
tgttccttgggtgaactgggcttca

SEQ ID NO: 653431 - DNA, 25 bp, Rattus norvegicus
tgttccttgtatctattctcttcca

SEQ ID NO: 653432 - DNA, 25 bp, Rattus norvegicus
tgttccttgtatgtattctcttcca

SEQ ID NO: 653433 - DNA, 25 bp, Rattus norvegicus
tgttccttgtcaatgcacctctctg

SEQ ID NO: 653434 - DNA, 25 bp, Rattus norvegicus
tgttccttgtcattgcacctctctg

SEQ ID NO: 653435 - DNA, 25 bp, Rattus norvegicus
tgttccttgtctctatcacctcatg

SEQ ID NO: 653436 - DNA, 25 bp, Rattus norvegicus
tgttccttgtctgtatcacctcatg

SEQ ID NO: 653437 - DNA, 25 bp, Rattus norvegicus
tgttccttgttcagacttacacctg

SEQ ID NO: 653438 - DNA, 25 bp, Rattus norvegicus
tgttccttgttctgacttacacctg

SEQ ID NO: 653439 - DNA, 25 bp, Rattus norvegicus
tgttccttgtttactcatcattcca

SEQ ID NO: 653440 - DNA, 25 bp, Rattus norvegicus
tgttccttgttttctcatcattcca

SEQ ID NO: 653441 - DNA, 25 bp, Rattus norvegicus
tgttcctttcccctatatttaattg

SEQ ID NO: 653442 - DNA, 25 bp, Rattus norvegicus
tgttcctttcccgtatatttaattg

SEQ ID NO: 653443 - DNA, 25 bp, Rattus norvegicus
tgttcctttcggaaacagtcttaca

SEQ ID NO: 653444 - DNA, 25 bp, Rattus norvegicus
tgttcctttcggtaacagtcttaca

SEQ ID NO: 653445 - DNA, 25 bp, Rattus norvegicus
tgttcctttcttatggccatgaggg

SEQ ID NO: 653446 - DNA, 25 bp, Rattus norvegicus
tgttcctttcttttggccatgaggg

SEQ ID NO: 653447 - DNA, 25 bp, Rattus norvegicus
tgttcctttgttaccaactcccttg

SEQ ID NO: 653448 - DNA, 25 bp, Rattus norvegicus
tgttcctttgtttccaactcccttg

SEQ ID NO: 653449 - DNA, 25 bp, Rattus norvegicus
tgttccttttctaaagcggactcct

SEQ ID NO: 653450 - DNA, 25 bp, Rattus norvegicus
tgttccttttctacagcgatctgtc

SEQ ID NO: 653451 - DNA, 25 bp, Rattus norvegicus
tgttccttttcttaagcggactcct

SEQ ID NO: 653452 - DNA, 25 bp, Rattus norvegicus
tgttccttttcttcagcgatctgtc

SEQ ID NO: 653453 - DNA, 25 bp, Rattus norvegicus
tgttcgaaaacccaaatatcccaag

SEQ ID NO: 653454 - DNA, 25 bp, Rattus norvegicus
tgttcgaaaaccgaaatatcccaag

SEQ ID NO: 653455 - DNA, 25 bp, Rattus norvegicus
tgttcgacgtccattgacggtttat

SEQ ID NO: 653456 - DNA, 25 bp, Rattus norvegicus
tgttcgacgtcctttgacggtttat

SEQ ID NO: 653457 - DNA, 25 bp, Rattus norvegicus
tgttcgaggaggacactcacctgtg

SEQ ID NO: 653458 - DNA, 25 bp, Rattus norvegicus
tgttcgaggaggtcactcacctgtg

SEQ ID NO: 653459 - DNA, 25 bp, Rattus norvegicus
tgttcgatcactcgagactttaaat

SEQ ID NO: 653460 - DNA, 25 bp, Rattus norvegicus
tgttcgatcactggagactttaaat

SEQ ID NO: 653461 - DNA, 25 bp, Rattus norvegicus
tgttcgatcttcagctctggccact

SEQ ID NO: 653462 - DNA, 25 bp, Rattus norvegicus
tgttcgatcttctgctctggccact

SEQ ID NO: 653463 - DNA, 25 bp, Rattus norvegicus
tgttcgatggccataccgtttgcaa

SEQ ID NO: 653464 - DNA, 25 bp, Rattus norvegicus
tgttcgatggccttaccgtttgcaa

SEQ ID NO: 653465 - DNA, 25 bp, Rattus norvegicus
tgttcgatggctctctgttccagag

SEQ ID NO: 653466 - DNA, 25 bp, Rattus norvegicus
tgttcgatggctgtctgttccagag

SEQ ID NO: 653467 - DNA, 25 bp, Rattus norvegicus
tgttcgatgtgtcccacttggagca

SEQ ID NO: 653468 - DNA, 25 bp, Rattus norvegicus
tgttcgatgtgtgccacttggagca

SEQ ID NO: 653469 - DNA, 25 bp, Rattus norvegicus
tgttcgccaaggagctccagaagat

SEQ ID NO: 653470 - DNA, 25 bp, Rattus norvegicus
tgttcgccaaggtgctccagaagat

SEQ ID NO: 653471 - DNA, 25 bp, Rattus norvegicus
tgttcgccgggacgcatgttgccct

SEQ ID NO: 653472 - DNA, 25 bp, Rattus norvegicus
tgttcgccgggaggcatgttgccct

SEQ ID NO: 653473 - DNA, 25 bp, Rattus norvegicus
tgttcgctattccaagtcaacacca

SEQ ID NO: 653474 - DNA, 25 bp, Rattus norvegicus
tgttcgctattcgaagtcaacacca

SEQ ID NO: 653475 - DNA, 25 bp, Rattus norvegicus
tgttcgctgtaaattccctgcaaaa

SEQ ID NO: 653476 - DNA, 25 bp, Rattus norvegicus
tgttcgctgtaatttccctgcaaaa

SEQ ID NO: 653477 - DNA, 25 bp, Rattus norvegicus
tgttcgcttggaatttctgtttctg

SEQ ID NO: 653478 - DNA, 25 bp, Rattus norvegicus
tgttcgcttggattttctgtttctg

SEQ ID NO: 653479 - DNA, 25 bp, Rattus norvegicus
tgttcggaaggtaactttctgctta

SEQ ID NO: 653480 - DNA, 25 bp, Rattus norvegicus
tgttcggaaggttactttctgctta

SEQ ID NO: 653481 - DNA, 25 bp, Rattus norvegicus
tgttcggagctcactggtgtgcgaa

SEQ ID NO: 653482 - DNA, 25 bp, Rattus norvegicus
tgttcggagctctctggtgtgcgaa

SEQ ID NO: 653483 - DNA, 25 bp, Rattus norvegicus
tgttcggaggtcacatcggctcagc

SEQ ID NO: 653484 - DNA, 25 bp, Rattus norvegicus
tgttcggaggtctcatcggctcagc

SEQ ID NO: 653485 - DNA, 25 bp, Rattus norvegicus
tgttcggcagtcattgcagtcctta

SEQ ID NO: 653486 - DNA, 25 bp, Rattus norvegicus
tgttcggcagtctttgcagtcctta

SEQ ID NO: 653487 - DNA, 25 bp, Rattus norvegicus
tgttcggcctttactgtaattgatg

SEQ ID NO: 653488 - DNA, 25 bp, Rattus norvegicus
tgttcggccttttctgtaattgatg

SEQ ID NO: 653489 - DNA, 25 bp, Rattus norvegicus
tgttcggctgatatcggagggattt

SEQ ID NO: 653490 - DNA, 25 bp, Rattus norvegicus
tgttcggctgatttcggagggattt

SEQ ID NO: 653491 - DNA, 25 bp, Rattus norvegicus
tgttcgggtcttcatgctgcatcaa

SEQ ID NO: 653492 - DNA, 25 bp, Rattus norvegicus
tgttcgggtcttgatgctgcatcaa

SEQ ID NO: 653493 - DNA, 25 bp, Rattus norvegicus
tgttcggtgcgcagggcgtacattc

SEQ ID NO: 653494 - DNA, 25 bp, Rattus norvegicus
tgttcggtgcgctgggcgtacattc

SEQ ID NO: 653495 - DNA, 25 bp, Rattus norvegicus
tgttcggtgctgaacaaggatctgt

SEQ ID NO: 653496 - DNA, 25 bp, Rattus norvegicus
tgttcggtgctgtacaaggatctgt

SEQ ID NO: 653497 - DNA, 25 bp, Rattus norvegicus
tgttcggtgtgtaccagagctcctg

SEQ ID NO: 653498 - DNA, 25 bp, Rattus norvegicus
tgttcggtgtgttccagagctcctg

SEQ ID NO: 653499 - DNA, 25 bp, Rattus norvegicus
tgttcggtttgacggcgtgtacatc

SEQ ID NO: 653500 - DNA, 25 bp, Rattus norvegicus
tgttcggtttgagggcgtgtacatc

SEQ ID NO: 653501 - DNA, 25 bp, Rattus norvegicus
tgttcgtagactctaaccctgccaa

SEQ ID NO: 653502 - DNA, 25 bp, Rattus norvegicus
tgttcgtagactgtaaccctgccaa

SEQ ID NO: 653503 - DNA, 25 bp, Rattus norvegicus
tgttcgtcagttacccttctatggc

SEQ ID NO: 653504 - DNA, 25 bp, Rattus norvegicus
tgttcgtcagtttcccttctatggc

SEQ ID NO: 653505 - DNA, 25 bp, Rattus norvegicus
tgttcgtctcctcgaagctgaggtc

SEQ ID NO: 653506 - DNA, 25 bp, Rattus norvegicus
tgttcgtctcctggaagctgaggtc

SEQ ID NO: 653507 - DNA, 25 bp, Rattus norvegicus
tgttcgtcttccagattcctggtga

SEQ ID NO: 653508 - DNA, 25 bp, Rattus norvegicus
tgttcgtcttcctgattcctggtga

SEQ ID NO: 653509 - DNA, 25 bp, Rattus norvegicus
tgttcgtgacatcaggcagacagtt

SEQ ID NO: 653510 - DNA, 25 bp, Rattus norvegicus
tgttcgtgacatgaggcagacagtt

SEQ ID NO: 653511 - DNA, 25 bp, Rattus norvegicus
tgttcgttatgaccctggccgtgtt

SEQ ID NO: 653512 - DNA, 25 bp, Rattus norvegicus
tgttcgttatgagcctggccgtgtt

SEQ ID NO: 653513 - DNA, 25 bp, Rattus norvegicus
tgttcgttgttgagaggtctcccca

SEQ ID NO: 653514 - DNA, 25 bp, Rattus norvegicus
tgttcgttgttgtgaggtctcccca

SEQ ID NO: 653515 - DNA, 25 bp, Rattus norvegicus
tgttcgtttcgtcatggtccccaat

SEQ ID NO: 653516 - DNA, 25 bp, Rattus norvegicus
tgttcgtttcgtgatggtccccaat

SEQ ID NO: 653517 - DNA, 25 bp, Rattus norvegicus
tgttctaaaccgcactgctttgctc

SEQ ID NO: 653518 - DNA, 25 bp, Rattus norvegicus
tgttctaaaccggactgctttgctc

SEQ ID NO: 653519 - DNA, 25 bp, Rattus norvegicus
tgttctaaaggcatccagggtaatg

SEQ ID NO: 653520 - DNA, 25 bp, Rattus norvegicus
tgttctaaaggcttccagggtaatg

SEQ ID NO: 653521 - DNA, 25 bp, Rattus norvegicus
tgttctactgttctgcctacttaaa

SEQ ID NO: 653522 - DNA, 25 bp, Rattus norvegicus
tgttctactgttgtgcctacttaaa

SEQ ID NO: 653523 - DNA, 25 bp, Rattus norvegicus
tgttctacttttcagttctctctct

SEQ ID NO: 653524 - DNA, 25 bp, Rattus norvegicus
tgttctacttttgagttctctctct

SEQ ID NO: 653525 - DNA, 25 bp, Rattus norvegicus
tgttctagaataacgcaccactcgg

SEQ ID NO: 653526 - DNA, 25 bp, Rattus norvegicus
tgttctagaatatcgcaccactcgg

SEQ ID NO: 653527 - DNA, 25 bp, Rattus norvegicus
tgttctagacagagagcgcccctta

SEQ ID NO: 653528 - DNA, 25 bp, Rattus norvegicus
tgttctagacagtgagcgcccctta

SEQ ID NO: 653529 - DNA, 25 bp, Rattus norvegicus
tgttctagcgttcctctgtaattga

SEQ ID NO: 653530 - DNA, 25 bp, Rattus norvegicus
tgttctagcgttgctctgtaattga

SEQ ID NO: 653531 - DNA, 25 bp, Rattus norvegicus
tgttctaggctacatctggccacag

SEQ ID NO: 653532 - DNA, 25 bp, Rattus norvegicus
tgttctaggctagatctggccacag

SEQ ID NO: 653533 - DNA, 25 bp, Rattus norvegicus
tgttctaggtacagttactgtctaa

SEQ ID NO: 653534 - DNA, 25 bp, Rattus norvegicus
tgttctaggtactgttactgtctaa

SEQ ID NO: 653535 - DNA, 25 bp, Rattus norvegicus
tgttctagtgaacctgctacagcaa

SEQ ID NO: 653536 - DNA, 25 bp, Rattus norvegicus
tgttctagtgaagctgctacagcaa

SEQ ID NO: 653537 - DNA, 25 bp, Rattus norvegicus
tgttctatacagcatttccagttta

SEQ ID NO: 653538 - DNA, 25 bp, Rattus norvegicus
tgttctatacaggatttccagttta

SEQ ID NO: 653539 - DNA, 25 bp, Rattus norvegicus
tgttctatcctgaatacctctgtga

SEQ ID NO: 653540 - DNA, 25 bp, Rattus norvegicus
tgttctatcctgtatacctctgtga

SEQ ID NO: 653541 - DNA, 25 bp, Rattus norvegicus
tgttctatgggaatatgatcctgtt

SEQ ID NO: 653542 - DNA, 25 bp, Rattus norvegicus
tgttctatgggattatgatcctgtt

SEQ ID NO: 653543 - DNA, 25 bp, Rattus norvegicus
tgttctatgtagcatacctccctgt

SEQ ID NO: 653544 - DNA, 25 bp, Rattus norvegicus
tgttctatgtaggatacctccctgt

SEQ ID NO: 653545 - DNA, 25 bp, Rattus norvegicus
tgttctatttaaaacctcctgtttt

SEQ ID NO: 653546 - DNA, 25 bp, Rattus norvegicus
tgttctatttaatacctcctgtttt

SEQ ID NO: 653547 - DNA, 25 bp, Rattus norvegicus
tgttctcaaaatctttccacccgac

SEQ ID NO: 653548 - DNA, 25 bp, Rattus norvegicus
tgttctcaaaatgtttccacccgac

SEQ ID NO: 653549 - DNA, 25 bp, Rattus norvegicus
tgttctcaatgcaccaagtgatctt

SEQ ID NO: 653550 - DNA, 25 bp, Rattus norvegicus
tgttctcaatgctccaagtgatctt

SEQ ID NO: 653551 - DNA, 25 bp, Rattus norvegicus
tgttctcacaagcattgcctgtcaa

SEQ ID NO: 653552 - DNA, 25 bp, Rattus norvegicus
tgttctcacaaggattgcctgtcaa

SEQ ID NO: 653553 - DNA, 25 bp, Rattus norvegicus
tgttctcacacaaacagctgcttgt

SEQ ID NO: 653554 - DNA, 25 bp, Rattus norvegicus
tgttctcacacatacagctgcttgt

SEQ ID NO: 653555 - DNA, 25 bp, Rattus norvegicus
tgttctcacaggaatggtctttgga

SEQ ID NO: 653556 - DNA, 25 bp, Rattus norvegicus
tgttctcacaggtatggtctttgga

SEQ ID NO: 653557 - DNA, 25 bp, Rattus norvegicus
tgttctcaccaccatatgttctagt

SEQ ID NO: 653558 - DNA, 25 bp, Rattus norvegicus
tgttctcaccacgatatgttctagt

SEQ ID NO: 653559 - DNA, 25 bp, Rattus norvegicus
tgttctcacctgctcagtacaacca

SEQ ID NO: 653560 - DNA, 25 bp, Rattus norvegicus
tgttctcacctggtcagtacaacca

SEQ ID NO: 653561 - DNA, 25 bp, Rattus norvegicus
tgttctcactaccaaaaatctcttt

SEQ ID NO: 653562 - DNA, 25 bp, Rattus norvegicus
tgttctcactacgaaaaatctcttt

SEQ ID NO: 653563 - DNA, 25 bp, Rattus norvegicus
tgttctcactctcttctctagaaac

SEQ ID NO: 653564 - DNA, 25 bp, Rattus norvegicus
tgttctcactctgttctctagaaac

SEQ ID NO: 653565 - DNA, 25 bp, Rattus norvegicus
tgttctcacttacgcatgactctgg

SEQ ID NO: 653566 - DNA, 25 bp, Rattus norvegicus
tgttctcacttaggcatgactctgg

SEQ ID NO: 653567 - DNA, 25 bp, Rattus norvegicus
tgttctcaggcacgtgcagtgcagc

SEQ ID NO: 653568 - DNA, 25 bp, Rattus norvegicus
tgttctcaggcactccaaagggcag

SEQ ID NO: 653569 - DNA, 25 bp, Rattus norvegicus
tgttctcaggcaggtgcagtgcagc

SEQ ID NO: 653570 - DNA, 25 bp, Rattus norvegicus
tgttctcaggcagtccaaagggcag

SEQ ID NO: 653571 - DNA, 25 bp, Rattus norvegicus
tgttctcagttcaatggttggctgt

SEQ ID NO: 653572 - DNA, 25 bp, Rattus norvegicus
tgttctcagttctatggttggctgt

SEQ ID NO: 653573 - DNA, 25 bp, Rattus norvegicus
tgttctcatggccagagtccagcac

SEQ ID NO: 653574 - DNA, 25 bp, Rattus norvegicus
tgttctcatggcgagagtccagcac

SEQ ID NO: 653575 - DNA, 25 bp, Rattus norvegicus
tgttctcatttcacagagttgtaca

SEQ ID NO: 653576 - DNA, 25 bp, Rattus norvegicus
tgttctcatttctcagagttgtaca

SEQ ID NO: 653577 - DNA, 25 bp, Rattus norvegicus
tgttctcatttgatacagtcataga

SEQ ID NO: 653578 - DNA, 25 bp, Rattus norvegicus
tgttctcatttgttacagtcataga

SEQ ID NO: 653579 - DNA, 25 bp, Rattus norvegicus
tgttctccacccaggtttcttaagt

SEQ ID NO: 653580 - DNA, 25 bp, Rattus norvegicus
tgttctccaccctggtttcttaagt

SEQ ID NO: 653581 - DNA, 25 bp, Rattus norvegicus
tgttctccagaccatttgtcataag

SEQ ID NO: 653582 - DNA, 25 bp, Rattus norvegicus
tgttctccagacgatttgtcataag

SEQ ID NO: 653583 - DNA, 25 bp, Rattus norvegicus
tgttctccatagatgaagccccaaa

SEQ ID NO: 653584 - DNA, 25 bp, Rattus norvegicus
tgttctccatagttgaagccccaaa

SEQ ID NO: 653585 - DNA, 25 bp, Rattus norvegicus
tgttctccatctaccaagcaggttt

SEQ ID NO: 653586 - DNA, 25 bp, Rattus norvegicus
tgttctccatcttccaagcaggttt

SEQ ID NO: 653587 - DNA, 25 bp, Rattus norvegicus
tgttctccatgtctatgcccaggca

SEQ ID NO: 653588 - DNA, 25 bp, Rattus norvegicus
tgttctccatgtgtatgcccaggca

SEQ ID NO: 653589 - DNA, 25 bp, Rattus norvegicus
tgttctcccaccaaactagtattta

SEQ ID NO: 653590 - DNA, 25 bp, Rattus norvegicus
tgttctcccacctaactagtattta

SEQ ID NO: 653591 - DNA, 25 bp, Rattus norvegicus
tgttctccccacatccgtaaataaa

SEQ ID NO: 653592 - DNA, 25 bp, Rattus norvegicus
tgttctccccacttccgtaaataaa

SEQ ID NO: 653593 - DNA, 25 bp, Rattus norvegicus
tgttctccctagagtttcaagtgta

SEQ ID NO: 653594 - DNA, 25 bp, Rattus norvegicus
tgttctccctagtgtttcaagtgta

SEQ ID NO: 653595 - DNA, 25 bp, Rattus norvegicus
tgttctccctggatgcctaatagta

SEQ ID NO: 653596 - DNA, 25 bp, Rattus norvegicus
tgttctccctggttgcctaatagta

SEQ ID NO: 653597 - DNA, 25 bp, Rattus norvegicus
tgttctccctttcagtgattcagaa

SEQ ID NO: 653598 - DNA, 25 bp, Rattus norvegicus
tgttctccctttgagtgattcagaa

SEQ ID NO: 653599 - DNA, 25 bp, Rattus norvegicus
tgttctccgaccaacgggaattcca

SEQ ID NO: 653600 - DNA, 25 bp, Rattus norvegicus
tgttctccgacctacgggaattcca

SEQ ID NO: 653601 - DNA, 25 bp, Rattus norvegicus
tgttctcctcacacattctgtgaaa

SEQ ID NO: 653602 - DNA, 25 bp, Rattus norvegicus
tgttctcctcactcattctgtgaaa

SEQ ID NO: 653603 - DNA, 25 bp, Rattus norvegicus
tgttctcctcagcagttcttactgt

SEQ ID NO: 653604 - DNA, 25 bp, Rattus norvegicus
tgttctcctcaggagttcttactgt

SEQ ID NO: 653605 - DNA, 25 bp, Rattus norvegicus
tgttctcctcgcagtgcttgcaatg

SEQ ID NO: 653606 - DNA, 25 bp, Rattus norvegicus
tgttctcctcgctgtgcttgcaatg

SEQ ID NO: 653607 - DNA, 25 bp, Rattus norvegicus
tgttctcctctgctgttctgatatc

SEQ ID NO: 653608 - DNA, 25 bp, Rattus norvegicus
tgttctcctctggtgttctgatatc

SEQ ID NO: 653609 - DNA, 25 bp, Rattus norvegicus
tgttctcctgagatctagggcagat

SEQ ID NO: 653610 - DNA, 25 bp, Rattus norvegicus
tgttctcctgagctatcattttcct

SEQ ID NO: 653611 - DNA, 25 bp, Rattus norvegicus
tgttctcctgaggtatcattttcct

SEQ ID NO: 653612 - DNA, 25 bp, Rattus norvegicus
tgttctcctgagttctagggcagat

SEQ ID NO: 653613 - DNA, 25 bp, Rattus norvegicus
tgttctcctggtcgctgcccatcag

SEQ ID NO: 653614 - DNA, 25 bp, Rattus norvegicus
tgttctcctggtggctgcccatcag

SEQ ID NO: 653615 - DNA, 25 bp, Rattus norvegicus
tgttctcgcagaacgacacactctg

SEQ ID NO: 653616 - DNA, 25 bp, Rattus norvegicus
tgttctcgcagatcgacacactctg

SEQ ID NO: 653617 - DNA, 25 bp, Rattus norvegicus
tgttctcgttccagcatggttcatt

SEQ ID NO: 653618 - DNA, 25 bp, Rattus norvegicus
tgttctcgttcctgcatggttcatt

SEQ ID NO: 653619 - DNA, 25 bp, Rattus norvegicus
tgttctctactgattcctcaacaag

SEQ ID NO: 653620 - DNA, 25 bp, Rattus norvegicus
tgttctctactgtttcctcaacaag

SEQ ID NO: 653621 - DNA, 25 bp, Rattus norvegicus
tgttctctacttctgtccttgtttt

SEQ ID NO: 653622 - DNA, 25 bp, Rattus norvegicus
tgttctctacttgtgtccttgtttt

SEQ ID NO: 653623 - DNA, 25 bp, Rattus norvegicus
tgttctctagagagtcagtgaccaa

SEQ ID NO: 653624 - DNA, 25 bp, Rattus norvegicus
tgttctctagagtgtcagtgaccaa

SEQ ID NO: 653625 - DNA, 25 bp, Rattus norvegicus
tgttctctatgaattcctaccagga

SEQ ID NO: 653626 - DNA, 25 bp, Rattus norvegicus
tgttctctatgatttcctaccagga

SEQ ID NO: 653627 - DNA, 25 bp, Rattus norvegicus
tgttctctcatcaggtatttctcag

SEQ ID NO: 653628 - DNA, 25 bp, Rattus norvegicus
tgttctctcatctggtatttctcag

SEQ ID NO: 653629 - DNA, 25 bp, Rattus norvegicus
tgttctctcattacacacagacatg

SEQ ID NO: 653630 - DNA, 25 bp, Rattus norvegicus
tgttctctcatttcacacagacatg

SEQ ID NO: 653631 - DNA, 25 bp, Rattus norvegicus
tgttctctcttgcactggtatgttt

SEQ ID NO: 653632 - DNA, 25 bp, Rattus norvegicus
tgttctctcttggactggtatgttt

SEQ ID NO: 653633 - DNA, 25 bp, Rattus norvegicus
tgttctctgaacagcttgcactttt

SEQ ID NO: 653634 - DNA, 25 bp, Rattus norvegicus
tgttctctgaactgcttgcactttt

SEQ ID NO: 653635 - DNA, 25 bp, Rattus norvegicus
tgttctctgacgctgtgctcatgca

SEQ ID NO: 653636 - DNA, 25 bp, Rattus norvegicus
tgttctctgacggtgtgctcatgca

SEQ ID NO: 653637 - DNA, 25 bp, Rattus norvegicus
tgttctctgatgcttgtcaatgccc

SEQ ID NO: 653638 - DNA, 25 bp, Rattus norvegicus
tgttctctgatggttgtcaatgccc

SEQ ID NO: 653639 - DNA, 25 bp, Rattus norvegicus
tgttctctgcttattcctaacagga

SEQ ID NO: 653640 - DNA, 25 bp, Rattus norvegicus
tgttctctgctttttcctaacagga

SEQ ID NO: 653641 - DNA, 25 bp, Rattus norvegicus
tgttctctgggcactacataggaat

SEQ ID NO: 653642 - DNA, 25 bp, Rattus norvegicus
tgttctctgggctctacataggaat

SEQ ID NO: 653643 - DNA, 25 bp, Rattus norvegicus
tgttctctgggtacctatttttggt

SEQ ID NO: 653644 - DNA, 25 bp, Rattus norvegicus
tgttctctgggttcctatttttggt

SEQ ID NO: 653645 - DNA, 25 bp, Rattus norvegicus
tgttctcttagaagccctgggacac

SEQ ID NO: 653646 - DNA, 25 bp, Rattus norvegicus
tgttctcttagatgccctgggacac

SEQ ID NO: 653647 - DNA, 25 bp, Rattus norvegicus
tgttctcttagcacagggatggcag

SEQ ID NO: 653648 - DNA, 25 bp, Rattus norvegicus
tgttctcttagctcagggatggcag

SEQ ID NO: 653649 - DNA, 25 bp, Rattus norvegicus
tgttctcttcatcttgactcctgta

SEQ ID NO: 653650 - DNA, 25 bp, Rattus norvegicus
tgttctcttcatgttgactcctgta

SEQ ID NO: 653651 - DNA, 25 bp, Rattus norvegicus
tgttctcttcgaacagtgcttgcca

SEQ ID NO: 653652 - DNA, 25 bp, Rattus norvegicus
tgttctcttcgatcagtgcttgcca

SEQ ID NO: 653653 - DNA, 25 bp, Rattus norvegicus
tgttctcttctcctctttctgaaga

SEQ ID NO: 653654 - DNA, 25 bp, Rattus norvegicus
tgttctcttctcgtctttctgaaga

SEQ ID NO: 653655 - DNA, 25 bp, Rattus norvegicus
tgttctctttccacagaggccaaga

SEQ ID NO: 653656 - DNA, 25 bp, Rattus norvegicus
tgttctctttcctcagaggccaaga

SEQ ID NO: 653657 - DNA, 25 bp, Rattus norvegicus
tgttctgaactgattgcgcttctga

SEQ ID NO: 653658 - DNA, 25 bp, Rattus norvegicus
tgttctgaactgtttgcgcttctga

SEQ ID NO: 653659 - DNA, 25 bp, Rattus norvegicus
tgttctgaccgtccggtactcacta

SEQ ID NO: 653660 - DNA, 25 bp, Rattus norvegicus
tgttctgaccgtgcggtactcacta

SEQ ID NO: 653661 - DNA, 25 bp, Rattus norvegicus
tgttctgagaacaccccaagagact

SEQ ID NO: 653662 - DNA, 25 bp, Rattus norvegicus
tgttctgagaactccccaagagact

SEQ ID NO: 653663 - DNA, 25 bp, Rattus norvegicus
tgttctgagatgcgcgcgtctgcac

SEQ ID NO: 653664 - DNA, 25 bp, Rattus norvegicus
tgttctgagatgggcgcgtctgcac

SEQ ID NO: 653665 - DNA, 25 bp, Rattus norvegicus
tgttctgagcgtacatttctagttt

SEQ ID NO: 653666 - DNA, 25 bp, Rattus norvegicus
tgttctgagcgttcatttctagttt

SEQ ID NO: 653667 - DNA, 25 bp, Rattus norvegicus
tgttctgagtccattgagatcctga

SEQ ID NO: 653668 - DNA, 25 bp, Rattus norvegicus
tgttctgagtcctttgagatcctga

SEQ ID NO: 653669 - DNA, 25 bp, Rattus norvegicus
tgttctgagttcagtcatggaccgc

SEQ ID NO: 653670 - DNA, 25 bp, Rattus norvegicus
tgttctgagttctgtcatggaccgc

SEQ ID NO: 653671 - DNA, 25 bp, Rattus norvegicus
tgttctgatcagcagtcttggtcct

SEQ ID NO: 653672 - DNA, 25 bp, Rattus norvegicus
tgttctgatcaggagtcttggtcct

SEQ ID NO: 653673 - DNA, 25 bp, Rattus norvegicus
tgttctgatcatacagcctgggcac

SEQ ID NO: 653674 - DNA, 25 bp, Rattus norvegicus
tgttctgatcattcagcctgggcac

SEQ ID NO: 653675 - DNA, 25 bp, Rattus norvegicus
tgttctgatctgatttcagccttct

SEQ ID NO: 653676 - DNA, 25 bp, Rattus norvegicus
tgttctgatctgttttcagccttct

SEQ ID NO: 653677 - DNA, 25 bp, Rattus norvegicus
tgttctgatgtcagtttcctcacac

SEQ ID NO: 653678 - DNA, 25 bp, Rattus norvegicus
tgttctgatgtctgtttcctcacac

SEQ ID NO: 653679 - DNA, 25 bp, Rattus norvegicus
tgttctgattctcagccccttgtca

SEQ ID NO: 653680 - DNA, 25 bp, Rattus norvegicus
tgttctgattctgagccccttgtca

SEQ ID NO: 653681 - DNA, 25 bp, Rattus norvegicus
tgttctgcaaacaacttctgggtct

SEQ ID NO: 653682 - DNA, 25 bp, Rattus norvegicus
tgttctgcaaactacttctgggtct

SEQ ID NO: 653683 - DNA, 25 bp, Rattus norvegicus
tgttctgcagccctgatcgatcagt

SEQ ID NO: 653684 - DNA, 25 bp, Rattus norvegicus
tgttctgcagccgtgatcgatcagt

SEQ ID NO: 653685 - DNA, 25 bp, Rattus norvegicus
tgttctgcaggtacctctggaaaag

SEQ ID NO: 653686 - DNA, 25 bp, Rattus norvegicus
tgttctgcaggtcactgtaccatga

SEQ ID NO: 653687 - DNA, 25 bp, Rattus norvegicus
tgttctgcaggtgactgtaccatga

SEQ ID NO: 653688 - DNA, 25 bp, Rattus norvegicus
tgttctgcaggttcctctggaaaag

SEQ ID NO: 653689 - DNA, 25 bp, Rattus norvegicus
tgttctgcatgccttacggtctaga

SEQ ID NO: 653690 - DNA, 25 bp, Rattus norvegicus
tgttctgcatgcgttacggtctaga

SEQ ID NO: 653691 - DNA, 25 bp, Rattus norvegicus
tgttctgccaatcgagctatacccc

SEQ ID NO: 653692 - DNA, 25 bp, Rattus norvegicus
tgttctgccaatggagctatacccc

SEQ ID NO: 653693 - DNA, 25 bp, Rattus norvegicus
tgttctgccagcaaggcgcactgag

SEQ ID NO: 653694 - DNA, 25 bp, Rattus norvegicus
tgttctgccagctaggcgcactgag

SEQ ID NO: 653695 - DNA, 25 bp, Rattus norvegicus
tgttctgcccacagttttatttttt

SEQ ID NO: 653696 - DNA, 25 bp, Rattus norvegicus
tgttctgcccactgttttatttttt

SEQ ID NO: 653697 - DNA, 25 bp, Rattus norvegicus
tgttctgccccaagattttatccca

SEQ ID NO: 653698 - DNA, 25 bp, Rattus norvegicus
tgttctgccccatgattttatccca

SEQ ID NO: 653699 - DNA, 25 bp, Rattus norvegicus
tgttctgccgacaaacttcaggaag

SEQ ID NO: 653700 - DNA, 25 bp, Rattus norvegicus
tgttctgccgactaacttcaggaag

SEQ ID NO: 653701 - DNA, 25 bp, Rattus norvegicus
tgttctgccttcagtgacagcacca

SEQ ID NO: 653702 - DNA, 25 bp, Rattus norvegicus
tgttctgccttctgtgacagcacca

SEQ ID NO: 653703 - DNA, 25 bp, Rattus norvegicus
tgttctgcggtgaatgtccgtagct

SEQ ID NO: 653704 - DNA, 25 bp, Rattus norvegicus
tgttctgcggtgtatgtccgtagct

SEQ ID NO: 653705 - DNA, 25 bp, Rattus norvegicus
tgttctgctcaacttccagcccgtg

SEQ ID NO: 653706 - DNA, 25 bp, Rattus norvegicus
tgttctgctcaagttccagcccgtg

SEQ ID NO: 653707 - DNA, 25 bp, Rattus norvegicus
tgttctgctcagacatcttaaaaag

SEQ ID NO: 653708 - DNA, 25 bp, Rattus norvegicus
tgttctgctcagatgtgaattttca

SEQ ID NO: 653709 - DNA, 25 bp, Rattus norvegicus
tgttctgctcagtcatcttaaaaag

SEQ ID NO: 653710 - DNA, 25 bp, Rattus norvegicus
tgttctgctcagttgtgaattttca

SEQ ID NO: 653711 - DNA, 25 bp, Rattus norvegicus
tgttctgctctgacttttcataaag

SEQ ID NO: 653712 - DNA, 25 bp, Rattus norvegicus
tgttctgctctgtcttttcataaag

SEQ ID NO: 653713 - DNA, 25 bp, Rattus norvegicus
tgttctgctcttctgagatctcagt

SEQ ID NO: 653714 - DNA, 25 bp, Rattus norvegicus
tgttctgctcttgtgagatctcagt

SEQ ID NO: 653715 - DNA, 25 bp, Rattus norvegicus
tgttctgcttccaaaatgtacctcc

SEQ ID NO: 653716 - DNA, 25 bp, Rattus norvegicus
tgttctgcttcctaaatgtacctcc

SEQ ID NO: 653717 - DNA, 25 bp, Rattus norvegicus
tgttctgcttgcactagggctcgct

SEQ ID NO: 653718 - DNA, 25 bp, Rattus norvegicus
tgttctgcttgctctagggctcgct

SEQ ID NO: 653719 - DNA, 25 bp, Rattus norvegicus
tgttctgctttgcattgctgctgac

SEQ ID NO: 653720 - DNA, 25 bp, Rattus norvegicus
tgttctgctttggattgctgctgac

SEQ ID NO: 653721 - DNA, 25 bp, Rattus norvegicus
tgttctgcttttaataatgcctgaa

SEQ ID NO: 653722 - DNA, 25 bp, Rattus norvegicus
tgttctgctttttataatgcctgaa

SEQ ID NO: 653723 - DNA, 25 bp, Rattus norvegicus
tgttctggaagcactcttctgagat

SEQ ID NO: 653724 - DNA, 25 bp, Rattus norvegicus
tgttctggaagctctcttctgagat

SEQ ID NO: 653725 - DNA, 25 bp, Rattus norvegicus
tgttctggaattatacattactgaa

SEQ ID NO: 653726 - DNA, 25 bp, Rattus norvegicus
tgttctggaattttacattactgaa

SEQ ID NO: 653727 - DNA, 25 bp, Rattus norvegicus
tgttctggagacaaacttgggttta

SEQ ID NO: 653728 - DNA, 25 bp, Rattus norvegicus
tgttctggagactaacttgggttta

SEQ ID NO: 653729 - DNA, 25 bp, Rattus norvegicus
tgttctggagtcagcatttctcagc

SEQ ID NO: 653730 - DNA, 25 bp, Rattus norvegicus
tgttctggagtctgcatttctcagc

SEQ ID NO: 653731 - DNA, 25 bp, Rattus norvegicus
tgttctggattgagccttcaccttc

SEQ ID NO: 653732 - DNA, 25 bp, Rattus norvegicus
tgttctggattgtgccttcaccttc

SEQ ID NO: 653733 - DNA, 25 bp, Rattus norvegicus
tgttctggccttcttatctcctgca

SEQ ID NO: 653734 - DNA, 25 bp, Rattus norvegicus
tgttctggccttgttatctcctgca

SEQ ID NO: 653735 - DNA, 25 bp, Rattus norvegicus
tgttctggctgcaggactcgtgctt

SEQ ID NO: 653736 - DNA, 25 bp, Rattus norvegicus
tgttctggctgctggactcgtgctt

SEQ ID NO: 653737 - DNA, 25 bp, Rattus norvegicus
tgttctgggtctactagagccttca

SEQ ID NO: 653738 - DNA, 25 bp, Rattus norvegicus
tgttctgggtcttctagagccttca

SEQ ID NO: 653739 - DNA, 25 bp, Rattus norvegicus
tgttctggtcagcacaacctttcac

SEQ ID NO: 653740 - DNA, 25 bp, Rattus norvegicus
tgttctggtcaggacaacctttcac

SEQ ID NO: 653741 - DNA, 25 bp, Rattus norvegicus
tgttctggtctcatcctatttttat

SEQ ID NO: 653742 - DNA, 25 bp, Rattus norvegicus
tgttctggtctcttcctatttttat

SEQ ID NO: 653743 - DNA, 25 bp, Rattus norvegicus
tgttctggtggcacacggcgcaagt

SEQ ID NO: 653744 - DNA, 25 bp, Rattus norvegicus
tgttctggtggctcacggcgcaagt

SEQ ID NO: 653745 - DNA, 25 bp, Rattus norvegicus
tgttctggtgtcctatgactcagga

SEQ ID NO: 653746 - DNA, 25 bp, Rattus norvegicus
tgttctggtgtcgtatgactcagga

SEQ ID NO: 653747 - DNA, 25 bp, Rattus norvegicus
tgttctggttacctacttggtgcac

SEQ ID NO: 653748 - DNA, 25 bp, Rattus norvegicus
tgttctggttacgtacttggtgcac

SEQ ID NO: 653749 - DNA, 25 bp, Rattus norvegicus
tgttctgtagataacttgtcttttg

SEQ ID NO: 653750 - DNA, 25 bp, Rattus norvegicus
tgttctgtagatcgagctgagcact

SEQ ID NO: 653751 - DNA, 25 bp, Rattus norvegicus
tgttctgtagatggagctgagcact

SEQ ID NO: 653752 - DNA, 25 bp, Rattus norvegicus
tgttctgtagattacttgtcttttg

SEQ ID NO: 653753 - DNA, 25 bp, Rattus norvegicus
tgttctgtagccaggagtttcatcc

SEQ ID NO: 653754 - DNA, 25 bp, Rattus norvegicus
tgttctgtagccatttgacctcatt

SEQ ID NO: 653755 - DNA, 25 bp, Rattus norvegicus
tgttctgtagcctggagtttcatcc

SEQ ID NO: 653756 - DNA, 25 bp, Rattus norvegicus
tgttctgtagccttttgacctcatt

SEQ ID NO: 653757 - DNA, 25 bp, Rattus norvegicus
tgttctgtagctaagagcgctcact

SEQ ID NO: 653758 - DNA, 25 bp, Rattus norvegicus
tgttctgtagcttagagcgctcact

SEQ ID NO: 653759 - DNA, 25 bp, Rattus norvegicus
tgttctgtaggacggcagacgccat

SEQ ID NO: 653760 - DNA, 25 bp, Rattus norvegicus
tgttctgtaggagggcagacgccat

SEQ ID NO: 653761 - DNA, 25 bp, Rattus norvegicus
tgttctgtatctcgctcaggcttca

SEQ ID NO: 653762 - DNA, 25 bp, Rattus norvegicus
tgttctgtatctggctcaggcttca

SEQ ID NO: 653763 - DNA, 25 bp, Rattus norvegicus
tgttctgtcaacaaccattgctttg

SEQ ID NO: 653764 - DNA, 25 bp, Rattus norvegicus
tgttctgtcaactaccattgctttg

SEQ ID NO: 653765 - DNA, 25 bp, Rattus norvegicus
tgttctgtcagcagtgcctggcagg

SEQ ID NO: 653766 - DNA, 25 bp, Rattus norvegicus
tgttctgtcagctgtgcctggcagg

SEQ ID NO: 653767 - DNA, 25 bp, Rattus norvegicus
tgttctgtccatcgcacacagtatc

SEQ ID NO: 653768 - DNA, 25 bp, Rattus norvegicus
tgttctgtccatggcacacagtatc

SEQ ID NO: 653769 - DNA, 25 bp, Rattus norvegicus
tgttctgtcctcacgtgtaatggaa

SEQ ID NO: 653770 - DNA, 25 bp, Rattus norvegicus
tgttctgtcctctcgtgtaatggaa

SEQ ID NO: 653771 - DNA, 25 bp, Rattus norvegicus
tgttctgtcgaacccatctattggt

SEQ ID NO: 653772 - DNA, 25 bp, Rattus norvegicus
tgttctgtcgaagccatctattggt

SEQ ID NO: 653773 - DNA, 25 bp, Rattus norvegicus
tgttctgtctagctgctcctaattt

SEQ ID NO: 653774 - DNA, 25 bp, Rattus norvegicus
tgttctgtctaggtgctcctaattt

SEQ ID NO: 653775 - DNA, 25 bp, Rattus norvegicus
tgttctgtctttcggcgctcagtac

SEQ ID NO: 653776 - DNA, 25 bp, Rattus norvegicus
tgttctgtctttgggcgctcagtac

SEQ ID NO: 653777 - DNA, 25 bp, Rattus norvegicus
tgttctgtgaacatattgcggtcca

SEQ ID NO: 653778 - DNA, 25 bp, Rattus norvegicus
tgttctgtgaacttattgcggtcca

SEQ ID NO: 653779 - DNA, 25 bp, Rattus norvegicus
tgttctgtgactagttaccctcact

SEQ ID NO: 653780 - DNA, 25 bp, Rattus norvegicus
tgttctgtgacttgttaccctcact

SEQ ID NO: 653781 - DNA, 25 bp, Rattus norvegicus
tgttctgtgttcagctctaaagctc

SEQ ID NO: 653782 - DNA, 25 bp, Rattus norvegicus
tgttctgtgttctgctctaaagctc

SEQ ID NO: 653783 - DNA, 25 bp, Rattus norvegicus
tgttctgtgttgactctcacttgac

SEQ ID NO: 653784 - DNA, 25 bp, Rattus norvegicus
tgttctgtgttgtctctcacttgac

SEQ ID NO: 653785 - DNA, 25 bp, Rattus norvegicus
tgttctgttcttattctgtgggtta

SEQ ID NO: 653786 - DNA, 25 bp, Rattus norvegicus
tgttctgttctttttctgtgggtta

SEQ ID NO: 653787 - DNA, 25 bp, Rattus norvegicus
tgttctgttgtcagcgcctgaaaag

SEQ ID NO: 653788 - DNA, 25 bp, Rattus norvegicus
tgttctgttgtctgcgcctgaaaag

SEQ ID NO: 653789 - DNA, 25 bp, Rattus norvegicus
tgttctgttgttcagctgggaagct

SEQ ID NO: 653790 - DNA, 25 bp, Rattus norvegicus
tgttctgttgttgagctgggaagct

SEQ ID NO: 653791 - DNA, 25 bp, Rattus norvegicus
tgttcttaaaatccgttcttggtag

SEQ ID NO: 653792 - DNA, 25 bp, Rattus norvegicus
tgttcttaaaatgcgttcttggtag

SEQ ID NO: 653793 - DNA, 25 bp, Rattus norvegicus
tgttcttaacagagtcacccacttg

SEQ ID NO: 653794 - DNA, 25 bp, Rattus norvegicus
tgttcttaacagtgtcacccacttg

SEQ ID NO: 653795 - DNA, 25 bp, Rattus norvegicus
tgttcttaacatattcgcgcttata

SEQ ID NO: 653796 - DNA, 25 bp, Rattus norvegicus
tgttcttaacattttcgcgcttata

SEQ ID NO: 653797 - DNA, 25 bp, Rattus norvegicus
tgttcttaagggaagctcagctgcc

SEQ ID NO: 653798 - DNA, 25 bp, Rattus norvegicus
tgttcttaagggtagctcagctgcc

SEQ ID NO: 653799 - DNA, 25 bp, Rattus norvegicus
tgttcttacacaccagccaggttcc

SEQ ID NO: 653800 - DNA, 25 bp, Rattus norvegicus
tgttcttacacagcagccaggttcc

SEQ ID NO: 653801 - DNA, 25 bp, Rattus norvegicus
tgttcttaccttaggccgtagttgg

SEQ ID NO: 653802 - DNA, 25 bp, Rattus norvegicus
tgttcttacctttggccgtagttgg

SEQ ID NO: 653803 - DNA, 25 bp, Rattus norvegicus
tgttcttactagaggagggaggctt

SEQ ID NO: 653804 - DNA, 25 bp, Rattus norvegicus
tgttcttactagtggagggaggctt

SEQ ID NO: 653805 - DNA, 25 bp, Rattus norvegicus
tgttcttagaggctcgagatccact

SEQ ID NO: 653806 - DNA, 25 bp, Rattus norvegicus
tgttcttagagggtcgagatccact

SEQ ID NO: 653807 - DNA, 25 bp, Rattus norvegicus
tgttcttagatgatggtttcccacc

SEQ ID NO: 653808 - DNA, 25 bp, Rattus norvegicus
tgttcttagatgttggtttcccacc

SEQ ID NO: 653809 - DNA, 25 bp, Rattus norvegicus
tgttcttagattatacagacccaag

SEQ ID NO: 653810 - DNA, 25 bp, Rattus norvegicus
tgttcttagattttacagacccaag

SEQ ID NO: 653811 - DNA, 25 bp, Rattus norvegicus
tgttcttagcctatctgtggtttct

SEQ ID NO: 653812 - DNA, 25 bp, Rattus norvegicus
tgttcttagcctttctgtggtttct

SEQ ID NO: 653813 - DNA, 25 bp, Rattus norvegicus
tgttcttcaatgatcttcaggcact

SEQ ID NO: 653814 - DNA, 25 bp, Rattus norvegicus
tgttcttcaatgttcttcaggcact

SEQ ID NO: 653815 - DNA, 25 bp, Rattus norvegicus
tgttcttccactattactctcttaa

SEQ ID NO: 653816 - DNA, 25 bp, Rattus norvegicus
tgttcttccacttttactctcttaa

SEQ ID NO: 653817 - DNA, 25 bp, Rattus norvegicus
tgttcttccagacggtccacagttt

SEQ ID NO: 653818 - DNA, 25 bp, Rattus norvegicus
tgttcttccagagggtccacagttt

SEQ ID NO: 653819 - DNA, 25 bp, Rattus norvegicus
tgttcttccctgcaaattctatttc

SEQ ID NO: 653820 - DNA, 25 bp, Rattus norvegicus
tgttcttccctggaaattctatttc

SEQ ID NO: 653821 - DNA, 25 bp, Rattus norvegicus
tgttcttccgaaagactctatggat

SEQ ID NO: 653822 - DNA, 25 bp, Rattus norvegicus
tgttcttccgaatgactctatggat

SEQ ID NO: 653823 - DNA, 25 bp, Rattus norvegicus
tgttcttcggtcattgttcctgagg

SEQ ID NO: 653824 - DNA, 25 bp, Rattus norvegicus
tgttcttcggtctttgttcctgagg

SEQ ID NO: 653825 - DNA, 25 bp, Rattus norvegicus
tgttcttcggtgacttatttcactc

SEQ ID NO: 653826 - DNA, 25 bp, Rattus norvegicus
tgttcttcggtgtcttatttcactc

SEQ ID NO: 653827 - DNA, 25 bp, Rattus norvegicus
tgttcttcgttcacctgttaaaggt

SEQ ID NO: 653828 - DNA, 25 bp, Rattus norvegicus
tgttcttcgttctcctgttaaaggt

SEQ ID NO: 653829 - DNA, 25 bp, Rattus norvegicus
tgttcttcgtttcctgaagctcatc

SEQ ID NO: 653830 - DNA, 25 bp, Rattus norvegicus
tgttcttcgtttgctgaagctcatc

SEQ ID NO: 653831 - DNA, 25 bp, Rattus norvegicus
tgttcttctacacagggcacaccta

SEQ ID NO: 653832 - DNA, 25 bp, Rattus norvegicus
tgttcttctacagagggcacaccta

SEQ ID NO: 653833 - DNA, 25 bp, Rattus norvegicus
tgttcttctctgctgctctttggaa

SEQ ID NO: 653834 - DNA, 25 bp, Rattus norvegicus
tgttcttctctggtgctctttggaa

SEQ ID NO: 653835 - DNA, 25 bp, Rattus norvegicus
tgttcttgaaacagtgcctcagcct

SEQ ID NO: 653836 - DNA, 25 bp, Rattus norvegicus
tgttcttgaaactgtgcctcagcct

SEQ ID NO: 653837 - DNA, 25 bp, Rattus norvegicus
tgttcttgaagactcccgggacctg

SEQ ID NO: 653838 - DNA, 25 bp, Rattus norvegicus
tgttcttgaagagtcccgggacctg

SEQ ID NO: 653839 - DNA, 25 bp, Rattus norvegicus
tgttcttgaatgagcactctgaggg

SEQ ID NO: 653840 - DNA, 25 bp, Rattus norvegicus
tgttcttgaatgtgcactctgaggg

SEQ ID NO: 653841 - DNA, 25 bp, Rattus norvegicus
tgttcttgcatacgacccaggaccc

SEQ ID NO: 653842 - DNA, 25 bp, Rattus norvegicus
tgttcttgcataggacccaggaccc

SEQ ID NO: 653843 - DNA, 25 bp, Rattus norvegicus
tgttcttgcctgcagatcgaccaga

SEQ ID NO: 653844 - DNA, 25 bp, Rattus norvegicus
tgttcttgcctggagatcgaccaga

SEQ ID NO: 653845 - DNA, 25 bp, Rattus norvegicus
tgttcttgctaccagtttcttctaa

SEQ ID NO: 653846 - DNA, 25 bp, Rattus norvegicus
tgttcttgctacgagtttcttctaa

SEQ ID NO: 653847 - DNA, 25 bp, Rattus norvegicus
tgttcttgctcccaggtacataaat

SEQ ID NO: 653848 - DNA, 25 bp, Rattus norvegicus
tgttcttgctccgaggtacataaat

SEQ ID NO: 653849 - DNA, 25 bp, Rattus norvegicus
tgttcttgctggcttcctccataga

SEQ ID NO: 653850 - DNA, 25 bp, Rattus norvegicus
tgttcttgctgggttcctccataga

SEQ ID NO: 653851 - DNA, 25 bp, Rattus norvegicus
tgttcttggcacaggacagccaggg

SEQ ID NO: 653852 - DNA, 25 bp, Rattus norvegicus
tgttcttggcactggacagccaggg

SEQ ID NO: 653853 - DNA, 25 bp, Rattus norvegicus
tgttcttgtacaacacatcctcttc

SEQ ID NO: 653854 - DNA, 25 bp, Rattus norvegicus
tgttcttgtacacgtcccgggcctt

SEQ ID NO: 653855 - DNA, 25 bp, Rattus norvegicus
tgttcttgtacaggtcccgggcctt

SEQ ID NO: 653856 - DNA, 25 bp, Rattus norvegicus
tgttcttgtacatcacatcctcttc

SEQ ID NO: 653857 - DNA, 25 bp, Rattus norvegicus
tgttcttgtcgcacattaccaaaag

SEQ ID NO: 653858 - DNA, 25 bp, Rattus norvegicus
tgttcttgtcgctcattaccaaaag

SEQ ID NO: 653859 - DNA, 25 bp, Rattus norvegicus
tgttcttgtgacatctactttctag

SEQ ID NO: 653860 - DNA, 25 bp, Rattus norvegicus
tgttcttgtgacttctactttctag

SEQ ID NO: 653861 - DNA, 25 bp, Rattus norvegicus
tgttcttgtgatagtttccttgctt

SEQ ID NO: 653862 - DNA, 25 bp, Rattus norvegicus
tgttcttgtgattgtttccttgctt

SEQ ID NO: 653863 - DNA, 25 bp, Rattus norvegicus
tgttcttgtgtaatcaacgtgctca

SEQ ID NO: 653864 - DNA, 25 bp, Rattus norvegicus
tgttcttgtgtattcaacgtgctca

SEQ ID NO: 653865 - DNA, 25 bp, Rattus norvegicus
tgttctttaattatgggactgtccc

SEQ ID NO: 653866 - DNA, 25 bp, Rattus norvegicus
tgttctttaattttgggactgtccc

SEQ ID NO: 653867 - DNA, 25 bp, Rattus norvegicus
tgttctttacaacatcctgcccctg

SEQ ID NO: 653868 - DNA, 25 bp, Rattus norvegicus
tgttctttacaagatcctgcccctg

SEQ ID NO: 653869 - DNA, 25 bp, Rattus norvegicus
tgttctttacatcttctccagggag

SEQ ID NO: 653870 - DNA, 25 bp, Rattus norvegicus
tgttctttacatgttctccagggag

SEQ ID NO: 653871 - DNA, 25 bp, Rattus norvegicus
tgttctttacggactcagccttctg

SEQ ID NO: 653872 - DNA, 25 bp, Rattus norvegicus
tgttctttacggtctcagccttctg

SEQ ID NO: 653873 - DNA, 25 bp, Rattus norvegicus
tgttctttaggtcttgctccttctt

SEQ ID NO: 653874 - DNA, 25 bp, Rattus norvegicus
tgttctttaggtgttgctccttctt

SEQ ID NO: 653875 - DNA, 25 bp, Rattus norvegicus
tgttctttattcatccttggccaaa

SEQ ID NO: 653876 - DNA, 25 bp, Rattus norvegicus
tgttctttattcttccttggccaaa

SEQ ID NO: 653877 - DNA, 25 bp, Rattus norvegicus
tgttctttcaacatatcgcagaggg

SEQ ID NO: 653878 - DNA, 25 bp, Rattus norvegicus
tgttctttcaacttatcgcagaggg

SEQ ID NO: 653879 - DNA, 25 bp, Rattus norvegicus
tgttctttccccatgactggttaga

SEQ ID NO: 653880 - DNA, 25 bp, Rattus norvegicus
tgttctttccccttgactggttaga

SEQ ID NO: 653881 - DNA, 25 bp, Rattus norvegicus
tgttctttcctgacccattatggag

SEQ ID NO: 653882 - DNA, 25 bp, Rattus norvegicus
tgttctttcctgtcccattatggag

SEQ ID NO: 653883 - DNA, 25 bp, Rattus norvegicus
tgttctttccttctgcggtatgact

SEQ ID NO: 653884 - DNA, 25 bp, Rattus norvegicus
tgttctttccttgtgcggtatgact

SEQ ID NO: 653885 - DNA, 25 bp, Rattus norvegicus
tgttctttctatctctgacctccgt

SEQ ID NO: 653886 - DNA, 25 bp, Rattus norvegicus
tgttctttctatgtctgacctccgt

SEQ ID NO: 653887 - DNA, 25 bp, Rattus norvegicus
tgttctttctcaacaagtctcctta

SEQ ID NO: 653888 - DNA, 25 bp, Rattus norvegicus
tgttctttctcatcaagtctcctta

SEQ ID NO: 653889 - DNA, 25 bp, Rattus norvegicus
tgttctttctctctccagaatcaat

SEQ ID NO: 653890 - DNA, 25 bp, Rattus norvegicus
tgttctttctctgtccagaatcaat

SEQ ID NO: 653891 - DNA, 25 bp, Rattus norvegicus
tgttctttgactaggcttaaaaccg

SEQ ID NO: 653892 - DNA, 25 bp, Rattus norvegicus
tgttctttgacttggcttaaaaccg

SEQ ID NO: 653893 - DNA, 25 bp, Rattus norvegicus
tgttctttgcgacttgggtttcatt

SEQ ID NO: 653894 - DNA, 25 bp, Rattus norvegicus
tgttctttgcgagttgggtttcatt

SEQ ID NO: 653895 - DNA, 25 bp, Rattus norvegicus
tgttctttgtgcagtatcgcccaga

SEQ ID NO: 653896 - DNA, 25 bp, Rattus norvegicus
tgttctttgtgctgtatcgcccaga

SEQ ID NO: 653897 - DNA, 25 bp, Rattus norvegicus
tgttcttttattccgtgctgggatc

SEQ ID NO: 653898 - DNA, 25 bp, Rattus norvegicus
tgttcttttattgcgtgctgggatc

SEQ ID NO: 653899 - DNA, 25 bp, Rattus norvegicus
tgttcttttcttccttttgcaaatg

SEQ ID NO: 653900 - DNA, 25 bp, Rattus norvegicus
tgttcttttcttcggtcaactcagg

SEQ ID NO: 653901 - DNA, 25 bp, Rattus norvegicus
tgttcttttcttgcttttgcaaatg

SEQ ID NO: 653902 - DNA, 25 bp, Rattus norvegicus
tgttcttttcttgggtcaactcagg

SEQ ID NO: 653903 - DNA, 25 bp, Rattus norvegicus
tgttctttttaacgacgctgaccct

SEQ ID NO: 653904 - DNA, 25 bp, Rattus norvegicus
tgttctttttaaggacgctgaccct

SEQ ID NO: 653905 - DNA, 25 bp, Rattus norvegicus
tgttcttttttacttttgacctgct

SEQ ID NO: 653906 - DNA, 25 bp, Rattus norvegicus
tgttcttttttagttttgacctgct

SEQ ID NO: 653907 - DNA, 25 bp, Rattus norvegicus
tgttgaaaaccactagctgctactc

SEQ ID NO: 653908 - DNA, 25 bp, Rattus norvegicus
tgttgaaaaccagtagctgctactc

SEQ ID NO: 653909 - DNA, 25 bp, Rattus norvegicus
tgttgaaacacaaccagtcctgctg

SEQ ID NO: 653910 - DNA, 25 bp, Rattus norvegicus
tgttgaaacacatccagtcctgctg

SEQ ID NO: 653911 - DNA, 25 bp, Rattus norvegicus
tgttgaaaccccattagttcttcag

SEQ ID NO: 653912 - DNA, 25 bp, Rattus norvegicus
tgttgaaacccctttagttcttcag

SEQ ID NO: 653913 - DNA, 25 bp, Rattus norvegicus
tgttgaaactttcctgaccagattg

SEQ ID NO: 653914 - DNA, 25 bp, Rattus norvegicus
tgttgaaactttgctgaccagattg

SEQ ID NO: 653915 - DNA, 25 bp, Rattus norvegicus
tgttgaaagcaaccattcctatttt

SEQ ID NO: 653916 - DNA, 25 bp, Rattus norvegicus
tgttgaaagcaagcattcctatttt

SEQ ID NO: 653917 - DNA, 25 bp, Rattus norvegicus
tgttgaaatcccatgcatgcagctg

SEQ ID NO: 653918 - DNA, 25 bp, Rattus norvegicus
tgttgaaatcccttgcatgcagctg

SEQ ID NO: 653919 - DNA, 25 bp, Rattus norvegicus
tgttgaaatcttcagcagctgcgcc

SEQ ID NO: 653920 - DNA, 25 bp, Rattus norvegicus
tgttgaaatcttgagcagctgcgcc

SEQ ID NO: 653921 - DNA, 25 bp, Rattus norvegicus
tgttgaacacctactgaagcagcca

SEQ ID NO: 653922 - DNA, 25 bp, Rattus norvegicus
tgttgaacaccttctgaagcagcca

SEQ ID NO: 653923 - DNA, 25 bp, Rattus norvegicus
tgttgaacagatcccgtctcaccaa

SEQ ID NO: 653924 - DNA, 25 bp, Rattus norvegicus
tgttgaacagatgccgtctcaccaa

SEQ ID NO: 653925 - DNA, 25 bp, Rattus norvegicus
tgttgaaccagtcctgagtccatcc

SEQ ID NO: 653926 - DNA, 25 bp, Rattus norvegicus
tgttgaaccagtgctgagtccatcc

SEQ ID NO: 653927 - DNA, 25 bp, Rattus norvegicus
tgttgaacccgcactcctggagacg

SEQ ID NO: 653928 - DNA, 25 bp, Rattus norvegicus
tgttgaacccgctctcctggagacg

SEQ ID NO: 653929 - DNA, 25 bp, Rattus norvegicus
tgttgaacttcgctgtccttggaac

SEQ ID NO: 653930 - DNA, 25 bp, Rattus norvegicus
tgttgaacttcggtgtccttggaac

SEQ ID NO: 653931 - DNA, 25 bp, Rattus norvegicus
tgttgaagcccacgttacctctgaa

SEQ ID NO: 653932 - DNA, 25 bp, Rattus norvegicus
tgttgaagcccaggttacctctgaa

SEQ ID NO: 653933 - DNA, 25 bp, Rattus norvegicus
tgttgaaggacaacggctgcagagt

SEQ ID NO: 653934 - DNA, 25 bp, Rattus norvegicus
tgttgaaggacatcggctgcagagt

SEQ ID NO: 653935 - DNA, 25 bp, Rattus norvegicus
tgttgaagtcgtctccagtgtggtc

SEQ ID NO: 653936 - DNA, 25 bp, Rattus norvegicus
tgttgaagtcgtgtccagtgtggtc

SEQ ID NO: 653937 - DNA, 25 bp, Rattus norvegicus
tgttgaatcctaactccctaagaag

SEQ ID NO: 653938 - DNA, 25 bp, Rattus norvegicus
tgttgaatcctatctccctaagaag

SEQ ID NO: 653939 - DNA, 25 bp, Rattus norvegicus
tgttgaatggcaccctctgctcctg

SEQ ID NO: 653940 - DNA, 25 bp, Rattus norvegicus
tgttgaatggcagcctctgctcctg

SEQ ID NO: 653941 - DNA, 25 bp, Rattus norvegicus
tgttgaatgtctaaacctctcgtga

SEQ ID NO: 653942 - DNA, 25 bp, Rattus norvegicus
tgttgaatgtcttaacctctcgtga

SEQ ID NO: 653943 - DNA, 25 bp, Rattus norvegicus
tgttgacaacagacgcctctgaggc

SEQ ID NO: 653944 - DNA, 25 bp, Rattus norvegicus
tgttgacaacagtcgcctctgaggc

SEQ ID NO: 653945 - DNA, 25 bp, Rattus norvegicus
tgttgacaaccgagaacccataccc

SEQ ID NO: 653946 - DNA, 25 bp, Rattus norvegicus
tgttgacaaccgtgaacccataccc

SEQ ID NO: 653947 - DNA, 25 bp, Rattus norvegicus
tgttgacaagagatccacactgcct

SEQ ID NO: 653948 - DNA, 25 bp, Rattus norvegicus
tgttgacaagagttccacactgcct

SEQ ID NO: 653949 - DNA, 25 bp, Rattus norvegicus
tgttgacacaggactgaccgctctt

SEQ ID NO: 653950 - DNA, 25 bp, Rattus norvegicus
tgttgacacaggtctgaccgctctt

SEQ ID NO: 653951 - DNA, 25 bp, Rattus norvegicus
tgttgacactgtattcctcatgcat

SEQ ID NO: 653952 - DNA, 25 bp, Rattus norvegicus
tgttgacactgttttcctcatgcat

SEQ ID NO: 653953 - DNA, 25 bp, Rattus norvegicus
tgttgacagcctactcggagcgcat

SEQ ID NO: 653954 - DNA, 25 bp, Rattus norvegicus
tgttgacagccttctcggagcgcat

SEQ ID NO: 653955 - DNA, 25 bp, Rattus norvegicus
tgttgacatcacaggcttgtgctgt

SEQ ID NO: 653956 - DNA, 25 bp, Rattus norvegicus
tgttgacatcactggcttgtgctgt

SEQ ID NO: 653957 - DNA, 25 bp, Rattus norvegicus
tgttgacatttcattccgaccaagc

SEQ ID NO: 653958 - DNA, 25 bp, Rattus norvegicus
tgttgacatttctttccgaccaagc

SEQ ID NO: 653959 - DNA, 25 bp, Rattus norvegicus
tgttgaccaggtacctaaccactaa

SEQ ID NO: 653960 - DNA, 25 bp, Rattus norvegicus
tgttgaccaggtatgcctctgcaca

SEQ ID NO: 653961 - DNA, 25 bp, Rattus norvegicus
tgttgaccaggttcctaaccactaa

SEQ ID NO: 653962 - DNA, 25 bp, Rattus norvegicus
tgttgaccaggtttgcctctgcaca

SEQ ID NO: 653963 - DNA, 25 bp, Rattus norvegicus
tgttgaccctatccacaaacactgc

SEQ ID NO: 653964 - DNA, 25 bp, Rattus norvegicus
tgttgaccctatgcacaaacactgc

SEQ ID NO: 653965 - DNA, 25 bp, Rattus norvegicus
tgttgaccctgcagttgcggtccaa

SEQ ID NO: 653966 - DNA, 25 bp, Rattus norvegicus
tgttgaccctgctgttgcggtccaa

SEQ ID NO: 653967 - DNA, 25 bp, Rattus norvegicus
tgttgacctcctactttgcaaaggc

SEQ ID NO: 653968 - DNA, 25 bp, Rattus norvegicus
tgttgacctcctctgcatgatgtgc

SEQ ID NO: 653969 - DNA, 25 bp, Rattus norvegicus
tgttgacctcctgtgcatgatgtgc

SEQ ID NO: 653970 - DNA, 25 bp, Rattus norvegicus
tgttgacctccttctttgcaaaggc

SEQ ID NO: 653971 - DNA, 25 bp, Rattus norvegicus
tgttgacctgtcatgttttcacata

SEQ ID NO: 653972 - DNA, 25 bp, Rattus norvegicus
tgttgacctgtcttgttttcacata

SEQ ID NO: 653973 - DNA, 25 bp, Rattus norvegicus
tgttgacgatttattcctaaggaag

SEQ ID NO: 653974 - DNA, 25 bp, Rattus norvegicus
tgttgacgattttttcctaaggaag

SEQ ID NO: 653975 - DNA, 25 bp, Rattus norvegicus
tgttgactacttcgttttcccgaat

SEQ ID NO: 653976 - DNA, 25 bp, Rattus norvegicus
tgttgactacttggttttcccgaat

SEQ ID NO: 653977 - DNA, 25 bp, Rattus norvegicus
tgttgactagatcgcatcccaggaa

SEQ ID NO: 653978 - DNA, 25 bp, Rattus norvegicus
tgttgactagatggcatcccaggaa

SEQ ID NO: 653979 - DNA, 25 bp, Rattus norvegicus
tgttgactcggaacaggcaatctgt

SEQ ID NO: 653980 - DNA, 25 bp, Rattus norvegicus
tgttgactcggatcaggcaatctgt

SEQ ID NO: 653981 - DNA, 25 bp, Rattus norvegicus
tgttgactgaccatgactgctttcc

SEQ ID NO: 653982 - DNA, 25 bp, Rattus norvegicus
tgttgactgaccttgactgctttcc

SEQ ID NO: 653983 - DNA, 25 bp, Rattus norvegicus
tgttgactgactctgctgagagcca

SEQ ID NO: 653984 - DNA, 25 bp, Rattus norvegicus
tgttgactgactgtgctgagagcca

SEQ ID NO: 653985 - DNA, 25 bp, Rattus norvegicus
tgttgactggagcttcagtcctcat

SEQ ID NO: 653986 - DNA, 25 bp, Rattus norvegicus
tgttgactggaggttcagtcctcat

SEQ ID NO: 653987 - DNA, 25 bp, Rattus norvegicus
tgttgactgggtacctactattttt

SEQ ID NO: 653988 - DNA, 25 bp, Rattus norvegicus
tgttgactgggttcctactattttt

SEQ ID NO: 653989 - DNA, 25 bp, Rattus norvegicus
tgttgacttattctcacaccatgaa

SEQ ID NO: 653990 - DNA, 25 bp, Rattus norvegicus
tgttgacttattgtcacaccatgaa

SEQ ID NO: 653991 - DNA, 25 bp, Rattus norvegicus
tgttgacttcaaaacgcctaaaggt

SEQ ID NO: 653992 - DNA, 25 bp, Rattus norvegicus
tgttgacttcaaagcccctgaaggt

SEQ ID NO: 653993 - DNA, 25 bp, Rattus norvegicus
tgttgacttcaatacgcctaaaggt

SEQ ID NO: 653994 - DNA, 25 bp, Rattus norvegicus
tgttgacttcaatgcccctgaaggt

SEQ ID NO: 653995 - DNA, 25 bp, Rattus norvegicus
tgttgacttctaagactacccacaa

SEQ ID NO: 653996 - DNA, 25 bp, Rattus norvegicus
tgttgacttctatgactacccacaa

SEQ ID NO: 653997 - DNA, 25 bp, Rattus norvegicus
tgttgactttctcccaccctaaaaa

SEQ ID NO: 653998 - DNA, 25 bp, Rattus norvegicus
tgttgactttctgccaccctaaaaa

SEQ ID NO: 653999 - DNA, 25 bp, Rattus norvegicus
tgttgagagcccatcacatagcttc

SEQ ID NO: 654000 - DNA, 25 bp, Rattus norvegicus
tgttgagagcccttcacatagcttc

SEQ ID NO: 654001 - DNA, 25 bp, Rattus norvegicus
tgttgagattctcccatctggtgaa

SEQ ID NO: 654002 - DNA, 25 bp, Rattus norvegicus
tgttgagattctgccatctggtgaa

SEQ ID NO: 654003 - DNA, 25 bp, Rattus norvegicus
tgttgagcatctccttttcctcggg

SEQ ID NO: 654004 - DNA, 25 bp, Rattus norvegicus
tgttgagcatctgcttttcctcggg

SEQ ID NO: 654005 - DNA, 25 bp, Rattus norvegicus
tgttgagcatgtaggtattgtcccc

SEQ ID NO: 654006 - DNA, 25 bp, Rattus norvegicus
tgttgagcatgttggtattgtcccc

SEQ ID NO: 654007 - DNA, 25 bp, Rattus norvegicus
tgttgagctaaccaaattgtccatg

SEQ ID NO: 654008 - DNA, 25 bp, Rattus norvegicus
tgttgagctaacgaaattgtccatg

SEQ ID NO: 654009 - DNA, 25 bp, Rattus norvegicus
tgttgagctcaaacgtgtcctacac

SEQ ID NO: 654010 - DNA, 25 bp, Rattus norvegicus
tgttgagctcaatcgtgtcctacac

SEQ ID NO: 654011 - DNA, 25 bp, Rattus norvegicus
tgttgagcttacagcagcccctgaa

SEQ ID NO: 654012 - DNA, 25 bp, Rattus norvegicus
tgttgagcttactgcagcccctgaa

SEQ ID NO: 654013 - DNA, 25 bp, Rattus norvegicus
tgttgaggatgccatgacagccatg

SEQ ID NO: 654014 - DNA, 25 bp, Rattus norvegicus
tgttgaggatgcgatgacagccatg

SEQ ID NO: 654015 - DNA, 25 bp, Rattus norvegicus
tgttgaggccccaaagcatctccag

SEQ ID NO: 654016 - DNA, 25 bp, Rattus norvegicus
tgttgaggcccctaagcatctccag

SEQ ID NO: 654017 - DNA, 25 bp, Rattus norvegicus
tgttgaggctcaactgtttctagga

SEQ ID NO: 654018 - DNA, 25 bp, Rattus norvegicus
tgttgaggctcatctgtttctagga

SEQ ID NO: 654019 - DNA, 25 bp, Rattus norvegicus
tgttgaggctgacgacctcccagag

SEQ ID NO: 654020 - DNA, 25 bp, Rattus norvegicus
tgttgaggctgaggacctcccagag

SEQ ID NO: 654021 - DNA, 25 bp, Rattus norvegicus
tgttgaggtctcacatactgtccct

SEQ ID NO: 654022 - DNA, 25 bp, Rattus norvegicus
tgttgaggtctctcatactgtccct

SEQ ID NO: 654023 - DNA, 25 bp, Rattus norvegicus
tgttgagtatttagtatgctattct

SEQ ID NO: 654024 - DNA, 25 bp, Rattus norvegicus
tgttgagtattttgtatgctattct

SEQ ID NO: 654025 - DNA, 25 bp, Rattus norvegicus
tgttgagtctatcccaaccagtggc

SEQ ID NO: 654026 - DNA, 25 bp, Rattus norvegicus
tgttgagtctatgccaaccagtggc

SEQ ID NO: 654027 - DNA, 25 bp, Rattus norvegicus
tgttgagtcttgattcttccagtag

SEQ ID NO: 654028 - DNA, 25 bp, Rattus norvegicus
tgttgagtcttgtttcttccagtag

SEQ ID NO: 654029 - DNA, 25 bp, Rattus norvegicus
tgttgagtgcatcatccgccaggaa

SEQ ID NO: 654030 - DNA, 25 bp, Rattus norvegicus
tgttgagtgcatgatccgccaggaa

SEQ ID NO: 654031 - DNA, 25 bp, Rattus norvegicus
tgttgagtgctgacttacccatttg

SEQ ID NO: 654032 - DNA, 25 bp, Rattus norvegicus
tgttgagtgctgtcttacccatttg

SEQ ID NO: 654033 - DNA, 25 bp, Rattus norvegicus
tgttgagtgtttactttgcagcgcg

SEQ ID NO: 654034 - DNA, 25 bp, Rattus norvegicus
tgttgagtgttttctttgcagcgcg

SEQ ID NO: 654035 - DNA, 25 bp, Rattus norvegicus
tgttgagttcacacggaatgctttt

SEQ ID NO: 654036 - DNA, 25 bp, Rattus norvegicus
tgttgagttcactcggaatgctttt

SEQ ID NO: 654037 - DNA, 25 bp, Rattus norvegicus
tgttgagttgctctcccctaaaaaa

SEQ ID NO: 654038 - DNA, 25 bp, Rattus norvegicus
tgttgagttgctgtcccctaaaaaa

SEQ ID NO: 654039 - DNA, 25 bp, Rattus norvegicus
tgttgataagtaccgtctgtcccac

SEQ ID NO: 654040 - DNA, 25 bp, Rattus norvegicus
tgttgataagtagcgtctgtcccac

SEQ ID NO: 654041 - DNA, 25 bp, Rattus norvegicus
tgttgataatccagccgacttctac

SEQ ID NO: 654042 - DNA, 25 bp, Rattus norvegicus
tgttgataatcctgccgacttctac

SEQ ID NO: 654043 - DNA, 25 bp, Rattus norvegicus
tgttgatccaccactctccaagaaa

SEQ ID NO: 654044 - DNA, 25 bp, Rattus norvegicus
tgttgatccacctctctccaagaaa

SEQ ID NO: 654045 - DNA, 25 bp, Rattus norvegicus
tgttgatcgctgcttaacccgtcaa

SEQ ID NO: 654046 - DNA, 25 bp, Rattus norvegicus
tgttgatcgctggttaacccgtcaa

SEQ ID NO: 654047 - DNA, 25 bp, Rattus norvegicus
tgttgatgacatccgtttccatgtg

SEQ ID NO: 654048 - DNA, 25 bp, Rattus norvegicus
tgttgatgacatgcgtttccatgtg

SEQ ID NO: 654049 - DNA, 25 bp, Rattus norvegicus
tgttgatgcagccacgtaacttctc

SEQ ID NO: 654050 - DNA, 25 bp, Rattus norvegicus
tgttgatgcagcgacgtaacttctc

SEQ ID NO: 654051 - DNA, 25 bp, Rattus norvegicus
tgttgatgctataccagtgtctctt

SEQ ID NO: 654052 - DNA, 25 bp, Rattus norvegicus
tgttgatgctattccagtgtctctt

SEQ ID NO: 654053 - DNA, 25 bp, Rattus norvegicus
tgttgatgttcaaccatgcatccct

SEQ ID NO: 654054 - DNA, 25 bp, Rattus norvegicus
tgttgatgttcatccatgcatccct

SEQ ID NO: 654055 - DNA, 25 bp, Rattus norvegicus
tgttgattaattatcctggctgttc

SEQ ID NO: 654056 - DNA, 25 bp, Rattus norvegicus
tgttgattaattttcctggctgttc

SEQ ID NO: 654057 - DNA, 25 bp, Rattus norvegicus
tgttgcaacaacaagttcccaggca

SEQ ID NO: 654058 - DNA, 25 bp, Rattus norvegicus
tgttgcaacaactagttcccaggca

SEQ ID NO: 654059 - DNA, 25 bp, Rattus norvegicus
tgttgcaaccctctgacaactggag

SEQ ID NO: 654060 - DNA, 25 bp, Rattus norvegicus
tgttgcaaccctgtgacaactggag

SEQ ID NO: 654061 - DNA, 25 bp, Rattus norvegicus
tgttgcaatgttacccttagtctag

SEQ ID NO: 654062 - DNA, 25 bp, Rattus norvegicus
tgttgcaatgtttcccttagtctag

SEQ ID NO: 654063 - DNA, 25 bp, Rattus norvegicus
tgttgcacacacagggttcctggtc

SEQ ID NO: 654064 - DNA, 25 bp, Rattus norvegicus
tgttgcacacactgggttcctggtc

SEQ ID NO: 654065 - DNA, 25 bp, Rattus norvegicus
tgttgcaccagcctctcatctggaa

SEQ ID NO: 654066 - DNA, 25 bp, Rattus norvegicus
tgttgcaccagcgtctcatctggaa

SEQ ID NO: 654067 - DNA, 25 bp, Rattus norvegicus
tgttgcactggaatggcagccttaa

SEQ ID NO: 654068 - DNA, 25 bp, Rattus norvegicus
tgttgcactggattggcagccttaa

SEQ ID NO: 654069 - DNA, 25 bp, Rattus norvegicus
tgttgcagccagatcccttaggaat

SEQ ID NO: 654070 - DNA, 25 bp, Rattus norvegicus
tgttgcagccagttcccttaggaat

SEQ ID NO: 654071 - DNA, 25 bp, Rattus norvegicus
tgttgcagctgcagcatgagccggc

SEQ ID NO: 654072 - DNA, 25 bp, Rattus norvegicus
tgttgcagctgcagtgccgccttgt

SEQ ID NO: 654073 - DNA, 25 bp, Rattus norvegicus
tgttgcagctgctgcatgagccggc

SEQ ID NO: 654074 - DNA, 25 bp, Rattus norvegicus
tgttgcagctgctgtgccgccttgt

SEQ ID NO: 654075 - DNA, 25 bp, Rattus norvegicus
tgttgcaggcaacggctacagcttt

SEQ ID NO: 654076 - DNA, 25 bp, Rattus norvegicus
tgttgcaggcaagggctacagcttt

SEQ ID NO: 654077 - DNA, 25 bp, Rattus norvegicus
tgttgcaggtgcaggcgtcctccaa

SEQ ID NO: 654078 - DNA, 25 bp, Rattus norvegicus
tgttgcaggtgctggcgtcctccaa

SEQ ID NO: 654079 - DNA, 25 bp, Rattus norvegicus
tgttgcagtcaccacctagcgatat

SEQ ID NO: 654080 - DNA, 25 bp, Rattus norvegicus
tgttgcagtcacgacctagcgatat

SEQ ID NO: 654081 - DNA, 25 bp, Rattus norvegicus
tgttgcagtctgacccaggttgaaa

SEQ ID NO: 654082 - DNA, 25 bp, Rattus norvegicus
tgttgcagtctgtcccaggttgaaa

SEQ ID NO: 654083 - DNA, 25 bp, Rattus norvegicus
tgttgcagttctcccgcgacagcag

SEQ ID NO: 654084 - DNA, 25 bp, Rattus norvegicus
tgttgcagttctgccgcgacagcag

SEQ ID NO: 654085 - DNA, 25 bp, Rattus norvegicus
tgttgcagttgaagccagccatggt

SEQ ID NO: 654086 - DNA, 25 bp, Rattus norvegicus
tgttgcagttgatgccagccatggt

SEQ ID NO: 654087 - DNA, 25 bp, Rattus norvegicus
tgttgcatccccagcagcattttaa

SEQ ID NO: 654088 - DNA, 25 bp, Rattus norvegicus
tgttgcatcccctgcagcattttaa

SEQ ID NO: 654089 - DNA, 25 bp, Rattus norvegicus
tgttgcatcctccagagagcctggt

SEQ ID NO: 654090 - DNA, 25 bp, Rattus norvegicus
tgttgcatcctcgagagagcctggt

SEQ ID NO: 654091 - DNA, 25 bp, Rattus norvegicus
tgttgcatctatagtcctgttgtat

SEQ ID NO: 654092 - DNA, 25 bp, Rattus norvegicus
tgttgcatctattgtcctgttgtat

SEQ ID NO: 654093 - DNA, 25 bp, Rattus norvegicus
tgttgcatcttcagtatttaccatc

SEQ ID NO: 654094 - DNA, 25 bp, Rattus norvegicus
tgttgcatcttctgtatttaccatc

SEQ ID NO: 654095 - DNA, 25 bp, Rattus norvegicus
tgttgcatgcaaccttcttggcttc

SEQ ID NO: 654096 - DNA, 25 bp, Rattus norvegicus
tgttgcatgcaagcttcttggcttc

SEQ ID NO: 654097 - DNA, 25 bp, Rattus norvegicus
tgttgccaaaatcactaaccccaag

SEQ ID NO: 654098 - DNA, 25 bp, Rattus norvegicus
tgttgccaaaatgactaaccccaag

SEQ ID NO: 654099 - DNA, 25 bp, Rattus norvegicus
tgttgccaaagtctagcggttcatt

SEQ ID NO: 654100 - DNA, 25 bp, Rattus norvegicus
tgttgccaaagtgtagcggttcatt

SEQ ID NO: 654101 - DNA, 25 bp, Rattus norvegicus
tgttgccacactataggtccatgta

SEQ ID NO: 654102 - DNA, 25 bp, Rattus norvegicus
tgttgccacactttaggtccatgta

SEQ ID NO: 654103 - DNA, 25 bp, Rattus norvegicus
tgttgccacagacggttgcatcatg

SEQ ID NO: 654104 - DNA, 25 bp, Rattus norvegicus
tgttgccacagagggttgcatcatg

SEQ ID NO: 654105 - DNA, 25 bp, Rattus norvegicus
tgttgccacgttccttgagccacca

SEQ ID NO: 654106 - DNA, 25 bp, Rattus norvegicus
tgttgccacgttgcttgagccacca

SEQ ID NO: 654107 - DNA, 25 bp, Rattus norvegicus
tgttgccactcaacacattgaattg

SEQ ID NO: 654108 - DNA, 25 bp, Rattus norvegicus
tgttgccactcatcacattgaattg

SEQ ID NO: 654109 - DNA, 25 bp, Rattus norvegicus
tgttgccagcaaaccgaaacacacc

SEQ ID NO: 654110 - DNA, 25 bp, Rattus norvegicus
tgttgccagcaatccgaaacacacc

SEQ ID NO: 654111 - DNA, 25 bp, Rattus norvegicus
tgttgccagctaaccgagcgtgaaa

SEQ ID NO: 654112 - DNA, 25 bp, Rattus norvegicus
tgttgccagctatccgagcgtgaaa

SEQ ID NO: 654113 - DNA, 25 bp, Rattus norvegicus
tgttgccaggagaacatcccaggct

SEQ ID NO: 654114 - DNA, 25 bp, Rattus norvegicus
tgttgccaggagtacatcccaggct

SEQ ID NO: 654115 - DNA, 25 bp, Rattus norvegicus
tgttgccagtacaacctgtgcaatg

SEQ ID NO: 654116 - DNA, 25 bp, Rattus norvegicus
tgttgccagtactacctgtgcaatg

SEQ ID NO: 654117 - DNA, 25 bp, Rattus norvegicus
tgttgccatcaacgaccccttcatt

SEQ ID NO: 654118 - DNA, 25 bp, Rattus norvegicus
tgttgccatcaaggaccccttcatt

SEQ ID NO: 654119 - DNA, 25 bp, Rattus norvegicus
tgttgccatggacataggcttaaaa

SEQ ID NO: 654120 - DNA, 25 bp, Rattus norvegicus
tgttgccatggagataggcttaaaa

SEQ ID NO: 654121 - DNA, 25 bp, Rattus norvegicus
tgttgccatggtcacgtccttcctc

SEQ ID NO: 654122 - DNA, 25 bp, Rattus norvegicus
tgttgccatggtgacgtccttcctc

SEQ ID NO: 654123 - DNA, 25 bp, Rattus norvegicus
tgttgccattgactggtctttgtaa

SEQ ID NO: 654124 - DNA, 25 bp, Rattus norvegicus
tgttgccattgagtggtctttgtaa

SEQ ID NO: 654125 - DNA, 25 bp, Rattus norvegicus
tgttgcccaggtatctgtcatcgag

SEQ ID NO: 654126 - DNA, 25 bp, Rattus norvegicus
tgttgcccaggtttctgtcatcgag

SEQ ID NO: 654127 - DNA, 25 bp, Rattus norvegicus
tgttgcccggcaccaccgaaaagaa

SEQ ID NO: 654128 - DNA, 25 bp, Rattus norvegicus
tgttgcccggcagcaccgaaaagaa

SEQ ID NO: 654129 - DNA, 25 bp, Rattus norvegicus
tgttgccctagacttcgagcaagag

SEQ ID NO: 654130 - DNA, 25 bp, Rattus norvegicus
tgttgccctagagttcgagcaagag

SEQ ID NO: 654131 - DNA, 25 bp, Rattus norvegicus
tgttgccctcatactgatttcttcc

SEQ ID NO: 654132 - DNA, 25 bp, Rattus norvegicus
tgttgccctcattctgatttcttcc

SEQ ID NO: 654133 - DNA, 25 bp, Rattus norvegicus
tgttgccctgagatgcagcctttca

SEQ ID NO: 654134 - DNA, 25 bp, Rattus norvegicus
tgttgccctgagttgcagcctttca

SEQ ID NO: 654135 - DNA, 25 bp, Rattus norvegicus
tgttgccctggcctatgtagtggat

SEQ ID NO: 654136 - DNA, 25 bp, Rattus norvegicus
tgttgccctggcgtatgtagtggat

SEQ ID NO: 654137 - DNA, 25 bp, Rattus norvegicus
tgttgcccttggcacactgttttcc

SEQ ID NO: 654138 - DNA, 25 bp, Rattus norvegicus
tgttgcccttgggacactgttttcc

SEQ ID NO: 654139 - DNA, 25 bp, Rattus norvegicus
tgttgccgagctccggtgagacccc

SEQ ID NO: 654140 - DNA, 25 bp, Rattus norvegicus
tgttgccgagctgcggtgagacccc

SEQ ID NO: 654141 - DNA, 25 bp, Rattus norvegicus
tgttgccgctgaccacagagatcag

SEQ ID NO: 654142 - DNA, 25 bp, Rattus norvegicus
tgttgccgctgagcacagagatcag

SEQ ID NO: 654143 - DNA, 25 bp, Rattus norvegicus
tgttgccgcttacgtgcctaattga

SEQ ID NO: 654144 - DNA, 25 bp, Rattus norvegicus
tgttgccgcttaggtgcctaattga

SEQ ID NO: 654145 - DNA, 25 bp, Rattus norvegicus
tgttgccggcgaccttgctgcaagt

SEQ ID NO: 654146 - DNA, 25 bp, Rattus norvegicus
tgttgccggcgagcttgctgcaagt

SEQ ID NO: 654147 - DNA, 25 bp, Rattus norvegicus
tgttgccgggagaatcactagattt

SEQ ID NO: 654148 - DNA, 25 bp, Rattus norvegicus
tgttgccgggagtatcactagattt

SEQ ID NO: 654149 - DNA, 25 bp, Rattus norvegicus
tgttgccgtatcacagaggcttcat

SEQ ID NO: 654150 - DNA, 25 bp, Rattus norvegicus
tgttgccgtatctcagaggcttcat

SEQ ID NO: 654151 - DNA, 25 bp, Rattus norvegicus
tgttgcctcaaaaccttgtaacgcc

SEQ ID NO: 654152 - DNA, 25 bp, Rattus norvegicus
tgttgcctcaaatccttgtaacgcc

SEQ ID NO: 654153 - DNA, 25 bp, Rattus norvegicus
tgttgcctcctaagatctgctggaa

SEQ ID NO: 654154 - DNA, 25 bp, Rattus norvegicus
tgttgcctcctatgatctgctggaa

SEQ ID NO: 654155 - DNA, 25 bp, Rattus norvegicus
tgttgcctctggcaccacgaagcga

SEQ ID NO: 654156 - DNA, 25 bp, Rattus norvegicus
tgttgcctctgggaccacgaagcga

SEQ ID NO: 654157 - DNA, 25 bp, Rattus norvegicus
tgttgcctgaaacttcctcactcac

SEQ ID NO: 654158 - DNA, 25 bp, Rattus norvegicus
tgttgcctgaaagttcctcactcac

SEQ ID NO: 654159 - DNA, 25 bp, Rattus norvegicus
tgttgcctgagaaccatcctgcttg

SEQ ID NO: 654160 - DNA, 25 bp, Rattus norvegicus
tgttgcctgagaaccctatcactta

SEQ ID NO: 654161 - DNA, 25 bp, Rattus norvegicus
tgttgcctgagatccatcctgcttg

SEQ ID NO: 654162 - DNA, 25 bp, Rattus norvegicus
tgttgcctgagatccctatcactta

SEQ ID NO: 654163 - DNA, 25 bp, Rattus norvegicus
tgttgcctgcacagggcttccgtgt

SEQ ID NO: 654164 - DNA, 25 bp, Rattus norvegicus
tgttgcctgcactgggcttccgtgt

SEQ ID NO: 654165 - DNA, 25 bp, Rattus norvegicus
tgttgcctgccacaggatcctcttc

SEQ ID NO: 654166 - DNA, 25 bp, Rattus norvegicus
tgttgcctgccagaggatcctcttc

SEQ ID NO: 654167 - DNA, 25 bp, Rattus norvegicus
tgttgcctgggacactgtacagcac

SEQ ID NO: 654168 - DNA, 25 bp, Rattus norvegicus
tgttgcctgggagactgtacagcac

SEQ ID NO: 654169 - DNA, 25 bp, Rattus norvegicus
tgttgccttacccaacagtggacaa

SEQ ID NO: 654170 - DNA, 25 bp, Rattus norvegicus
tgttgccttaccgaacagtggacaa

SEQ ID NO: 654171 - DNA, 25 bp, Rattus norvegicus
tgttgccttatcaagctctggctgg

SEQ ID NO: 654172 - DNA, 25 bp, Rattus norvegicus
tgttgccttatctagctctggctgg

SEQ ID NO: 654173 - DNA, 25 bp, Rattus norvegicus
tgttgccttctgaatgagctaccta

SEQ ID NO: 654174 - DNA, 25 bp, Rattus norvegicus
tgttgccttctgtatgagctaccta

SEQ ID NO: 654175 - DNA, 25 bp, Rattus norvegicus
tgttgccttgtgctcttttgtaagg

SEQ ID NO: 654176 - DNA, 25 bp, Rattus norvegicus
tgttgccttgtggtcttttgtaagg

SEQ ID NO: 654177 - DNA, 25 bp, Rattus norvegicus
tgttgcgcaaggcaaactactcgga

SEQ ID NO: 654178 - DNA, 25 bp, Rattus norvegicus
tgttgcgcaagggaaactactcgga

SEQ ID NO: 654179 - DNA, 25 bp, Rattus norvegicus
tgttgcgcagaaatcagtcacctca

SEQ ID NO: 654180 - DNA, 25 bp, Rattus norvegicus
tgttgcgcagaattcagtcacctca

SEQ ID NO: 654181 - DNA, 25 bp, Rattus norvegicus
tgttgcgcagccaggagcaggatct

SEQ ID NO: 654182 - DNA, 25 bp, Rattus norvegicus
tgttgcgcagcctggagcaggatct

SEQ ID NO: 654183 - DNA, 25 bp, Rattus norvegicus
tgttgcgccagcaagtgcttaacaa

SEQ ID NO: 654184 - DNA, 25 bp, Rattus norvegicus
tgttgcgccagctagtgcttaacaa

SEQ ID NO: 654185 - DNA, 25 bp, Rattus norvegicus
tgttgcgcgctcagcgtaagaacaa

SEQ ID NO: 654186 - DNA, 25 bp, Rattus norvegicus
tgttgcgcgctctgcgtaagaacaa

SEQ ID NO: 654187 - DNA, 25 bp, Rattus norvegicus
tgttgcggactgactggcattgacc

SEQ ID NO: 654188 - DNA, 25 bp, Rattus norvegicus
tgttgcggactgtctggcattgacc

SEQ ID NO: 654189 - DNA, 25 bp, Rattus norvegicus
tgttgcggtccaagccagcagagac

SEQ ID NO: 654190 - DNA, 25 bp, Rattus norvegicus
tgttgcggtccatgccagcagagac

SEQ ID NO: 654191 - DNA, 25 bp, Rattus norvegicus
tgttgcgtcccaccttcacggcaga

SEQ ID NO: 654192 - DNA, 25 bp, Rattus norvegicus
tgttgcgtcccagcttcacggcaga

SEQ ID NO: 654193 - DNA, 25 bp, Rattus norvegicus
tgttgctaaaggagcagcgacccct

SEQ ID NO: 654194 - DNA, 25 bp, Rattus norvegicus
tgttgctaaaggtgcagcgacccct

SEQ ID NO: 654195 - DNA, 25 bp, Rattus norvegicus
tgttgctacagccttctttatttcc

SEQ ID NO: 654196 - DNA, 25 bp, Rattus norvegicus
tgttgctacagcgttctttatttcc

SEQ ID NO: 654197 - DNA, 25 bp, Rattus norvegicus
tgttgctaccaaacctgatgacctg

SEQ ID NO: 654198 - DNA, 25 bp, Rattus norvegicus
tgttgctaccaatcctgatgacctg

SEQ ID NO: 654199 - DNA, 25 bp, Rattus norvegicus
tgttgctacttccagcctgtagatt

SEQ ID NO: 654200 - DNA, 25 bp, Rattus norvegicus
tgttgctacttcgagcctgtagatt

SEQ ID NO: 654201 - DNA, 25 bp, Rattus norvegicus
tgttgctagagacagccagacgcta

SEQ ID NO: 654202 - DNA, 25 bp, Rattus norvegicus
tgttgctagagagagccagacgcta

SEQ ID NO: 654203 - DNA, 25 bp, Rattus norvegicus
tgttgctagcaccacctaaagccag

SEQ ID NO: 654204 - DNA, 25 bp, Rattus norvegicus
tgttgctagcacgacctaaagccag

SEQ ID NO: 654205 - DNA, 25 bp, Rattus norvegicus
tgttgctagggcaacctttctcaca

SEQ ID NO: 654206 - DNA, 25 bp, Rattus norvegicus
tgttgctagggctacctttctcaca

SEQ ID NO: 654207 - DNA, 25 bp, Rattus norvegicus
tgttgctcaaaaacagggtgaccgt

SEQ ID NO: 654208 - DNA, 25 bp, Rattus norvegicus
tgttgctcaaaatcagggtgaccgt

SEQ ID NO: 654209 - DNA, 25 bp, Rattus norvegicus
tgttgctcaaccactgtgaaatggc

SEQ ID NO: 654210 - DNA, 25 bp, Rattus norvegicus
tgttgctcaacctctgtgaaatggc

SEQ ID NO: 654211 - DNA, 25 bp, Rattus norvegicus
tgttgctcacacacagggaccctga

SEQ ID NO: 654212 - DNA, 25 bp, Rattus norvegicus
tgttgctcacactcagggaccctga

SEQ ID NO: 654213 - DNA, 25 bp, Rattus norvegicus
tgttgctccactctgtttagttgca

SEQ ID NO: 654214 - DNA, 25 bp, Rattus norvegicus
tgttgctccactgtgtttagttgca

SEQ ID NO: 654215 - DNA, 25 bp, Rattus norvegicus
tgttgctccctgatgagaacccact

SEQ ID NO: 654216 - DNA, 25 bp, Rattus norvegicus
tgttgctccctgttgagaacccact

SEQ ID NO: 654217 - DNA, 25 bp, Rattus norvegicus
tgttgctccgcccatgacaaaggtt

SEQ ID NO: 654218 - DNA, 25 bp, Rattus norvegicus
tgttgctccgccgatgacaaaggtt

SEQ ID NO: 654219 - DNA, 25 bp, Rattus norvegicus
tgttgctcctaaaacttctcatcta

SEQ ID NO: 654220 - DNA, 25 bp, Rattus norvegicus
tgttgctcctaatacttctcatcta

SEQ ID NO: 654221 - DNA, 25 bp, Rattus norvegicus
tgttgctctcacaaatacctgcaga

SEQ ID NO: 654222 - DNA, 25 bp, Rattus norvegicus
tgttgctctcactaatacctgcaga

SEQ ID NO: 654223 - DNA, 25 bp, Rattus norvegicus
tgttgctctggcactcaaggtgagg

SEQ ID NO: 654224 - DNA, 25 bp, Rattus norvegicus
tgttgctctggctctcaaggtgagg

SEQ ID NO: 654225 - DNA, 25 bp, Rattus norvegicus
tgttgctcttgtcaactgggtgtcc

SEQ ID NO: 654226 - DNA, 25 bp, Rattus norvegicus
tgttgctcttgtgaactgggtgtcc

SEQ ID NO: 654227 - DNA, 25 bp, Rattus norvegicus
tgttgctctttgagtacccgtatgc

SEQ ID NO: 654228 - DNA, 25 bp, Rattus norvegicus
tgttgctctttgtgtacccgtatgc

SEQ ID NO: 654229 - DNA, 25 bp, Rattus norvegicus
tgttgctgaaaaatcctccttctat

SEQ ID NO: 654230 - DNA, 25 bp, Rattus norvegicus
tgttgctgaaaattcctccttctat

SEQ ID NO: 654231 - DNA, 25 bp, Rattus norvegicus
tgttgctgaacaaacacacacctct

SEQ ID NO: 654232 - DNA, 25 bp, Rattus norvegicus
tgttgctgaacatacacacacctct

SEQ ID NO: 654233 - DNA, 25 bp, Rattus norvegicus
tgttgctgcccaaagttgcttacgg

SEQ ID NO: 654234 - DNA, 25 bp, Rattus norvegicus
tgttgctgcccatagttgcttacgg

SEQ ID NO: 654235 - DNA, 25 bp, Rattus norvegicus
tgttgctgcctgctgatttgtaacc

SEQ ID NO: 654236 - DNA, 25 bp, Rattus norvegicus
tgttgctgcctggtgatttgtaacc

SEQ ID NO: 654237 - DNA, 25 bp, Rattus norvegicus
tgttgctgccttctttcatttgtaa

SEQ ID NO: 654238 - DNA, 25 bp, Rattus norvegicus
tgttgctgccttgtttcatttgtaa

SEQ ID NO: 654239 - DNA, 25 bp, Rattus norvegicus
tgttgctgcggacagctgtatgctc

SEQ ID NO: 654240 - DNA, 25 bp, Rattus norvegicus
tgttgctgcggagagctgtatgctc

SEQ ID NO: 654241 - DNA, 25 bp, Rattus norvegicus
tgttgctgctcaccacaaactggga

SEQ ID NO: 654242 - DNA, 25 bp, Rattus norvegicus
tgttgctgctcagcacaaactggga

SEQ ID NO: 654243 - DNA, 25 bp, Rattus norvegicus
tgttgctgctgcaggtcactccata

SEQ ID NO: 654244 - DNA, 25 bp, Rattus norvegicus
tgttgctgctgctggtcactccata

SEQ ID NO: 654245 - DNA, 25 bp, Rattus norvegicus
tgttgctggtgcagtgacacaggaa

SEQ ID NO: 654246 - DNA, 25 bp, Rattus norvegicus
tgttgctggtgctgtgacacaggaa

SEQ ID NO: 654247 - DNA, 25 bp, Rattus norvegicus
tgttgctgtcataaactgtgggtat

SEQ ID NO: 654248 - DNA, 25 bp, Rattus norvegicus
tgttgctgtcattaactgtgggtat

SEQ ID NO: 654249 - DNA, 25 bp, Rattus norvegicus
tgttgctgtccgagggaggctccaa

SEQ ID NO: 654250 - DNA, 25 bp, Rattus norvegicus
tgttgctgtccgtgggaggctccaa

SEQ ID NO: 654251 - DNA, 25 bp, Rattus norvegicus
tgttgctgttttcccacaatgttaa

SEQ ID NO: 654252 - DNA, 25 bp, Rattus norvegicus
tgttgctgttttgccacaatgttaa

SEQ ID NO: 654253 - DNA, 25 bp, Rattus norvegicus
tgttgcttacctattctcttccaag

SEQ ID NO: 654254 - DNA, 25 bp, Rattus norvegicus
tgttgcttaccttttctcttccaag

SEQ ID NO: 654255 - DNA, 25 bp, Rattus norvegicus
tgttgcttatttacaaaaaggccaa

SEQ ID NO: 654256 - DNA, 25 bp, Rattus norvegicus
tgttgcttattttcaaaaaggccaa

SEQ ID NO: 654257 - DNA, 25 bp, Rattus norvegicus
tgttgcttcctgagttgttgtccta

SEQ ID NO: 654258 - DNA, 25 bp, Rattus norvegicus
tgttgcttcctgatttagtgtctga

SEQ ID NO: 654259 - DNA, 25 bp, Rattus norvegicus
tgttgcttcctgtgttgttgtccta

SEQ ID NO: 654260 - DNA, 25 bp, Rattus norvegicus
tgttgcttcctgttttagtgtctga

SEQ ID NO: 654261 - DNA, 25 bp, Rattus norvegicus
tgttgcttccttaactcagacctaa

SEQ ID NO: 654262 - DNA, 25 bp, Rattus norvegicus
tgttgcttcctttactcagacctaa

SEQ ID NO: 654263 - DNA, 25 bp, Rattus norvegicus
tgttgcttgctcagacttttgtcaa

SEQ ID NO: 654264 - DNA, 25 bp, Rattus norvegicus
tgttgcttgctctgacttttgtcaa

SEQ ID NO: 654265 - DNA, 25 bp, Rattus norvegicus
tgttgctttccacaaacaacaccca

SEQ ID NO: 654266 - DNA, 25 bp, Rattus norvegicus
tgttgctttccagaaacaacaccca

SEQ ID NO: 654267 - DNA, 25 bp, Rattus norvegicus
tgttgcttttacatgcaatggatat

SEQ ID NO: 654268 - DNA, 25 bp, Rattus norvegicus
tgttgcttttacttgcaatggatat

SEQ ID NO: 654269 - DNA, 25 bp, Rattus norvegicus
tgttgcttttctaaacccaccattt

SEQ ID NO: 654270 - DNA, 25 bp, Rattus norvegicus
tgttgcttttcttaacccaccattt

SEQ ID NO: 654271 - DNA, 25 bp, Rattus norvegicus
tgttgcttttgtatcatctctttgg

SEQ ID NO: 654272 - DNA, 25 bp, Rattus norvegicus
tgttgcttttgtttcatctctttgg

SEQ ID NO: 654273 - DNA, 25 bp, Rattus norvegicus
tgttggaacaacagccacgtgggca

SEQ ID NO: 654274 - DNA, 25 bp, Rattus norvegicus
tgttggaacaactgccacgtgggca

SEQ ID NO: 654275 - DNA, 25 bp, Rattus norvegicus
tgttggaacacacccgccacctgtg

SEQ ID NO: 654276 - DNA, 25 bp, Rattus norvegicus
tgttggaacacagccgccacctgtg

SEQ ID NO: 654277 - DNA, 25 bp, Rattus norvegicus
tgttggaattttactccctggccta

SEQ ID NO: 654278 - DNA, 25 bp, Rattus norvegicus
tgttggaatttttctccctggccta

SEQ ID NO: 654279 - DNA, 25 bp, Rattus norvegicus
tgttggacaagccttctcccagaac

SEQ ID NO: 654280 - DNA, 25 bp, Rattus norvegicus
tgttggacaagcgttctcccagaac

SEQ ID NO: 654281 - DNA, 25 bp, Rattus norvegicus
tgttggacagcgagaccctgcatcc

SEQ ID NO: 654282 - DNA, 25 bp, Rattus norvegicus
tgttggacagcgtgaccctgcatcc

SEQ ID NO: 654283 - DNA, 25 bp, Rattus norvegicus
tgttggacagttaggctcagcagac

SEQ ID NO: 654284 - DNA, 25 bp, Rattus norvegicus
tgttggacagtttggctcagcagac

SEQ ID NO: 654285 - DNA, 25 bp, Rattus norvegicus
tgttggaccagcagccccagaagac

SEQ ID NO: 654286 - DNA, 25 bp, Rattus norvegicus
tgttggaccagctgccccagaagac

SEQ ID NO: 654287 - DNA, 25 bp, Rattus norvegicus
tgttggacgtgtcctcacagcaggc

SEQ ID NO: 654288 - DNA, 25 bp, Rattus norvegicus
tgttggacgtgtgctcacagcaggc

SEQ ID NO: 654289 - DNA, 25 bp, Rattus norvegicus
tgttggactctcacagctgactggg

SEQ ID NO: 654290 - DNA, 25 bp, Rattus norvegicus
tgttggactctctcagctgactggg

SEQ ID NO: 654291 - DNA, 25 bp, Rattus norvegicus
tgttggactgaaaatggccgccctc

SEQ ID NO: 654292 - DNA, 25 bp, Rattus norvegicus
tgttggactgaatatggccgccctc

SEQ ID NO: 654293 - DNA, 25 bp, Rattus norvegicus
tgttggactgtgaggcataaacctt

SEQ ID NO: 654294 - DNA, 25 bp, Rattus norvegicus
tgttggactgtgtggcataaacctt

SEQ ID NO: 654295 - DNA, 25 bp, Rattus norvegicus
tgttggacttttcacccttgaaaat

SEQ ID NO: 654296 - DNA, 25 bp, Rattus norvegicus
tgttggacttttctacccttcaagc

SEQ ID NO: 654297 - DNA, 25 bp, Rattus norvegicus
tgttggacttttgacccttgaaaat

SEQ ID NO: 654298 - DNA, 25 bp, Rattus norvegicus
tgttggacttttgtacccttcaagc

SEQ ID NO: 654299 - DNA, 25 bp, Rattus norvegicus
tgttggagaaccctcttcaatcttt

SEQ ID NO: 654300 - DNA, 25 bp, Rattus norvegicus
tgttggagaaccgtcttcaatcttt

SEQ ID NO: 654301 - DNA, 25 bp, Rattus norvegicus
tgttggagacctaggacacatcaat

SEQ ID NO: 654302 - DNA, 25 bp, Rattus norvegicus
tgttggagaccttggacacatcaat

SEQ ID NO: 654303 - DNA, 25 bp, Rattus norvegicus
tgttggagcaagctgcctgcagaca

SEQ ID NO: 654304 - DNA, 25 bp, Rattus norvegicus
tgttggagcaaggtgcctgcagaca

SEQ ID NO: 654305 - DNA, 25 bp, Rattus norvegicus
tgttggagcctgattatctctggag

SEQ ID NO: 654306 - DNA, 25 bp, Rattus norvegicus
tgttggagcctgtttatctctggag

SEQ ID NO: 654307 - DNA, 25 bp, Rattus norvegicus
tgttggatcaggcagcgctgctcat

SEQ ID NO: 654308 - DNA, 25 bp, Rattus norvegicus
tgttggatcagggagcgctgctcat

SEQ ID NO: 654309 - DNA, 25 bp, Rattus norvegicus
tgttggatcgcccatcctgtgggaa

SEQ ID NO: 654310 - DNA, 25 bp, Rattus norvegicus
tgttggatcgccgatcctgtgggaa

SEQ ID NO: 654311 - DNA, 25 bp, Rattus norvegicus
tgttggatgtcccatagcaccctac

SEQ ID NO: 654312 - DNA, 25 bp, Rattus norvegicus
tgttggatgtccgatagcaccctac

SEQ ID NO: 654313 - DNA, 25 bp, Rattus norvegicus
tgttggatttcacacagcaacctgg

SEQ ID NO: 654314 - DNA, 25 bp, Rattus norvegicus
tgttggatttcagacagcaacctgg

SEQ ID NO: 654315 - DNA, 25 bp, Rattus norvegicus
tgttggcaatttatagcacctgata

SEQ ID NO: 654316 - DNA, 25 bp, Rattus norvegicus
tgttggcaatttttagcacctgata

SEQ ID NO: 654317 - DNA, 25 bp, Rattus norvegicus
tgttggcacctgagtcctccccttt

SEQ ID NO: 654318 - DNA, 25 bp, Rattus norvegicus
tgttggcacctgcttcctctgtaaa

SEQ ID NO: 654319 - DNA, 25 bp, Rattus norvegicus
tgttggcacctggttcctctgtaaa

SEQ ID NO: 654320 - DNA, 25 bp, Rattus norvegicus
tgttggcacctgtgtcctccccttt

SEQ ID NO: 654321 - DNA, 25 bp, Rattus norvegicus
tgttggcactcaccctgaagtaatc

SEQ ID NO: 654322 - DNA, 25 bp, Rattus norvegicus
tgttggcactcagcctgaagtaatc

SEQ ID NO: 654323 - DNA, 25 bp, Rattus norvegicus
tgttggcagaatcagtgttcagctt

SEQ ID NO: 654324 - DNA, 25 bp, Rattus norvegicus
tgttggcagaatgagtgttcagctt

SEQ ID NO: 654325 - DNA, 25 bp, Rattus norvegicus
tgttggcagcaacagggacaccctt

SEQ ID NO: 654326 - DNA, 25 bp, Rattus norvegicus
tgttggcagcaagagggacaccctt

SEQ ID NO: 654327 - DNA, 25 bp, Rattus norvegicus
tgttggcatgtcatttcagcgttcc

SEQ ID NO: 654328 - DNA, 25 bp, Rattus norvegicus
tgttggcatgtcttttcagcgttcc

SEQ ID NO: 654329 - DNA, 25 bp, Rattus norvegicus
tgttggcattgcaggtgctgagtct

SEQ ID NO: 654330 - DNA, 25 bp, Rattus norvegicus
tgttggcattgctggtgctgagtct

SEQ ID NO: 654331 - DNA, 25 bp, Rattus norvegicus
tgttggccacagcacggctcatgat

SEQ ID NO: 654332 - DNA, 25 bp, Rattus norvegicus
tgttggccacaggacggctcatgat

SEQ ID NO: 654333 - DNA, 25 bp, Rattus norvegicus
tgttggccattcatcgtctttaata

SEQ ID NO: 654334 - DNA, 25 bp, Rattus norvegicus
tgttggccattcttcgtctttaata

SEQ ID NO: 654335 - DNA, 25 bp, Rattus norvegicus
tgttggcccactaccaggatctaac

SEQ ID NO: 654336 - DNA, 25 bp, Rattus norvegicus
tgttggcccacttccaggatctaac

SEQ ID NO: 654337 - DNA, 25 bp, Rattus norvegicus
tgttggcccattccttgattagatg

SEQ ID NO: 654338 - DNA, 25 bp, Rattus norvegicus
tgttggcccattgcttgattagatg

SEQ ID NO: 654339 - DNA, 25 bp, Rattus norvegicus
tgttggccccaacgctcaagtccaa

SEQ ID NO: 654340 - DNA, 25 bp, Rattus norvegicus
tgttggccccaaggctcaagtccaa

SEQ ID NO: 654341 - DNA, 25 bp, Rattus norvegicus
tgttggcccgaacacagcatttgct

SEQ ID NO: 654342 - DNA, 25 bp, Rattus norvegicus
tgttggcccgaagacagcatttgct

SEQ ID NO: 654343 - DNA, 25 bp, Rattus norvegicus
tgttggccctggactggcctcgagt

SEQ ID NO: 654344 - DNA, 25 bp, Rattus norvegicus
tgttggccctggtctggcctcgagt

SEQ ID NO: 654345 - DNA, 25 bp, Rattus norvegicus
tgttggccgcagatcttctaagaaa

SEQ ID NO: 654346 - DNA, 25 bp, Rattus norvegicus
tgttggccgcagttcttctaagaaa

SEQ ID NO: 654347 - DNA, 25 bp, Rattus norvegicus
tgttggccgccacgctttgcgaacg

SEQ ID NO: 654348 - DNA, 25 bp, Rattus norvegicus
tgttggccgccaggctttgcgaacg

SEQ ID NO: 654349 - DNA, 25 bp, Rattus norvegicus
tgttggcctgcacaacactgtggcg

SEQ ID NO: 654350 - DNA, 25 bp, Rattus norvegicus
tgttggcctgcagaacactgtggcg

SEQ ID NO: 654351 - DNA, 25 bp, Rattus norvegicus
tgttggccttggatgcaagacttct

SEQ ID NO: 654352 - DNA, 25 bp, Rattus norvegicus
tgttggccttggttgcaagacttct

SEQ ID NO: 654353 - DNA, 25 bp, Rattus norvegicus
tgttggcgttccagcttgaattgaa

SEQ ID NO: 654354 - DNA, 25 bp, Rattus norvegicus
tgttggcgttcctgcttgaattgaa

SEQ ID NO: 654355 - DNA, 25 bp, Rattus norvegicus
tgttggctcagaagagacgctgtat

SEQ ID NO: 654356 - DNA, 25 bp, Rattus norvegicus
tgttggctcagatgagacgctgtat

SEQ ID NO: 654357 - DNA, 25 bp, Rattus norvegicus
tgttggctccccaaacaaaggttat

SEQ ID NO: 654358 - DNA, 25 bp, Rattus norvegicus
tgttggctcccctaacaaaggttat

SEQ ID NO: 654359 - DNA, 25 bp, Rattus norvegicus
tgttggctgcacaatgggacactgc

SEQ ID NO: 654360 - DNA, 25 bp, Rattus norvegicus
tgttggctgcactatgggacactgc

SEQ ID NO: 654361 - DNA, 25 bp, Rattus norvegicus
tgttggctgcctcggtaatgctacc

SEQ ID NO: 654362 - DNA, 25 bp, Rattus norvegicus
tgttggctgcctgggtaatgctacc

SEQ ID NO: 654363 - DNA, 25 bp, Rattus norvegicus
tgttggctgctccactgtactctgt

SEQ ID NO: 654364 - DNA, 25 bp, Rattus norvegicus
tgttggctgctcgactgtactctgt

SEQ ID NO: 654365 - DNA, 25 bp, Rattus norvegicus
tgttggctgctgcttgctcactttg

SEQ ID NO: 654366 - DNA, 25 bp, Rattus norvegicus
tgttggctgctggttgctcactttg

SEQ ID NO: 654367 - DNA, 25 bp, Rattus norvegicus
tgttggctggcccaattcacatcga

SEQ ID NO: 654368 - DNA, 25 bp, Rattus norvegicus
tgttggctggccgaattcacatcga

SEQ ID NO: 654369 - DNA, 25 bp, Rattus norvegicus
tgttggctgggcacacagtacttcc

SEQ ID NO: 654370 - DNA, 25 bp, Rattus norvegicus
tgttggctgggctcacagtacttcc

SEQ ID NO: 654371 - DNA, 25 bp, Rattus norvegicus
tgttggctggttcattaagttgaaa

SEQ ID NO: 654372 - DNA, 25 bp, Rattus norvegicus
tgttggctggttgattaagttgaaa

SEQ ID NO: 654373 - DNA, 25 bp, Rattus norvegicus
tgttggcttaacaaaatttccttgt

SEQ ID NO: 654374 - DNA, 25 bp, Rattus norvegicus
tgttggcttaactaaatttccttgt

SEQ ID NO: 654375 - DNA, 25 bp, Rattus norvegicus
tgttgggaaacactaccatcctggc

SEQ ID NO: 654376 - DNA, 25 bp, Rattus norvegicus
tgttgggaaacagtaccatcctggc

SEQ ID NO: 654377 - DNA, 25 bp, Rattus norvegicus
tgttgggaaacgagggcttccttct

SEQ ID NO: 654378 - DNA, 25 bp, Rattus norvegicus
tgttgggaaacgtgggcttccttct

SEQ ID NO: 654379 - DNA, 25 bp, Rattus norvegicus
tgttgggaaaggcacgttccaccgt

SEQ ID NO: 654380 - DNA, 25 bp, Rattus norvegicus
tgttgggaaagggacgttccaccgt

SEQ ID NO: 654381 - DNA, 25 bp, Rattus norvegicus
tgttgggaaccactgaatgcctcag

SEQ ID NO: 654382 - DNA, 25 bp, Rattus norvegicus
tgttgggaaccagtgaatgcctcag

SEQ ID NO: 654383 - DNA, 25 bp, Rattus norvegicus
tgttgggaacccaggcactcaggga

SEQ ID NO: 654384 - DNA, 25 bp, Rattus norvegicus
tgttgggaaccctggcactcaggga

SEQ ID NO: 654385 - DNA, 25 bp, Rattus norvegicus
tgttgggacaacagctacatctttc

SEQ ID NO: 654386 - DNA, 25 bp, Rattus norvegicus
tgttgggacaactgctacatctttc

SEQ ID NO: 654387 - DNA, 25 bp, Rattus norvegicus
tgttgggacacacccggtcagcagc

SEQ ID NO: 654388 - DNA, 25 bp, Rattus norvegicus
tgttgggacacagccggtcagcagc

SEQ ID NO: 654389 - DNA, 25 bp, Rattus norvegicus
tgttgggacagaacgaagtgcctat

SEQ ID NO: 654390 - DNA, 25 bp, Rattus norvegicus
tgttgggacagatcgaagtgcctat

SEQ ID NO: 654391 - DNA, 25 bp, Rattus norvegicus
tgttgggagaccatgcatccagtga

SEQ ID NO: 654392 - DNA, 25 bp, Rattus norvegicus
tgttgggagaccttgcatccagtga

SEQ ID NO: 654393 - DNA, 25 bp, Rattus norvegicus
tgttgggagcacatcttacgtagcc

SEQ ID NO: 654394 - DNA, 25 bp, Rattus norvegicus
tgttgggagcacttcttacgtagcc

SEQ ID NO: 654395 - DNA, 25 bp, Rattus norvegicus
tgttgggagctcctgcctgtcagac

SEQ ID NO: 654396 - DNA, 25 bp, Rattus norvegicus
tgttgggagctcgtgcctgtcagac

SEQ ID NO: 654397 - DNA, 25 bp, Rattus norvegicus
tgttgggattacatgcctgcaccac

SEQ ID NO: 654398 - DNA, 25 bp, Rattus norvegicus
tgttgggattacttgcctgcaccac

SEQ ID NO: 654399 - DNA, 25 bp, Rattus norvegicus
tgttgggcaagaagacctgttcctt

SEQ ID NO: 654400 - DNA, 25 bp, Rattus norvegicus
tgttgggcaagatgacctgttcctt

SEQ ID NO: 654401 - DNA, 25 bp, Rattus norvegicus
tgttgggcaagtacactctggacag

SEQ ID NO: 654402 - DNA, 25 bp, Rattus norvegicus
tgttgggcaagttcactctggacag

SEQ ID NO: 654403 - DNA, 25 bp, Rattus norvegicus
tgttgggcaggacaagcagccccac

SEQ ID NO: 654404 - DNA, 25 bp, Rattus norvegicus
tgttgggcaggagaagcagccccac

SEQ ID NO: 654405 - DNA, 25 bp, Rattus norvegicus
tgttgggccaacacaacccgctggg

SEQ ID NO: 654406 - DNA, 25 bp, Rattus norvegicus
tgttgggccaactcaacccgctggg

SEQ ID NO: 654407 - DNA, 25 bp, Rattus norvegicus
tgttgggcccaaatccacctaggag

SEQ ID NO: 654408 - DNA, 25 bp, Rattus norvegicus
tgttgggcccaattccacctaggag

SEQ ID NO: 654409 - DNA, 25 bp, Rattus norvegicus
tgttgggcccagcaagtagatccag

SEQ ID NO: 654410 - DNA, 25 bp, Rattus norvegicus
tgttgggcccaggaagtagatccag

SEQ ID NO: 654411 - DNA, 25 bp, Rattus norvegicus
tgttgggccccaaaggaccagtgaa

SEQ ID NO: 654412 - DNA, 25 bp, Rattus norvegicus
tgttgggccccataggaccagtgaa

SEQ ID NO: 654413 - DNA, 25 bp, Rattus norvegicus
tgttgggcgtgtaggcacaagccaa

SEQ ID NO: 654414 - DNA, 25 bp, Rattus norvegicus
tgttgggcgtgttggcacaagccaa

SEQ ID NO: 654415 - DNA, 25 bp, Rattus norvegicus
tgttgggctgatacacgtgacgtgc

SEQ ID NO: 654416 - DNA, 25 bp, Rattus norvegicus
tgttgggctgattcacgtgacgtgc

SEQ ID NO: 654417 - DNA, 25 bp, Rattus norvegicus
tgttgggtctaacagtttccctcga

SEQ ID NO: 654418 - DNA, 25 bp, Rattus norvegicus
tgttgggtctaagagtttccctcga

SEQ ID NO: 654419 - DNA, 25 bp, Rattus norvegicus
tgttgggtctgcatctcacagcgta

SEQ ID NO: 654420 - DNA, 25 bp, Rattus norvegicus
tgttgggtctgcttctcacagcgta

SEQ ID NO: 654421 - DNA, 25 bp, Rattus norvegicus
tgttgggtctgtattcttgagctta

SEQ ID NO: 654422 - DNA, 25 bp, Rattus norvegicus
tgttgggtctgttttcttgagctta

SEQ ID NO: 654423 - DNA, 25 bp, Rattus norvegicus
tgttgggtgcagcacaaccccagat

SEQ ID NO: 654424 - DNA, 25 bp, Rattus norvegicus
tgttgggtgcaggacaaccccagat

SEQ ID NO: 654425 - DNA, 25 bp, Rattus norvegicus
tgttgggtggtcctgttctttgctc

SEQ ID NO: 654426 - DNA, 25 bp, Rattus norvegicus
tgttgggtggtcgtgttctttgctc

SEQ ID NO: 654427 - DNA, 25 bp, Rattus norvegicus
tgttggtatcaaacatcagttgtaa

SEQ ID NO: 654428 - DNA, 25 bp, Rattus norvegicus
tgttggtatcaatcatcagttgtaa

SEQ ID NO: 654429 - DNA, 25 bp, Rattus norvegicus
tgttggtccaacaatattaaagata

SEQ ID NO: 654430 - DNA, 25 bp, Rattus norvegicus
tgttggtccaactatattaaagata

SEQ ID NO: 654431 - DNA, 25 bp, Rattus norvegicus
tgttggtctattcttgctttcaggt

SEQ ID NO: 654432 - DNA, 25 bp, Rattus norvegicus
tgttggtctattgttgctttcaggt

SEQ ID NO: 654433 - DNA, 25 bp, Rattus norvegicus
tgttggtctctcactgggactccag

SEQ ID NO: 654434 - DNA, 25 bp, Rattus norvegicus
tgttggtctctctctgggactccag

SEQ ID NO: 654435 - DNA, 25 bp, Rattus norvegicus
tgttggtctgttactaatgctgtct

SEQ ID NO: 654436 - DNA, 25 bp, Rattus norvegicus
tgttggtctgtttctaatgctgtct

SEQ ID NO: 654437 - DNA, 25 bp, Rattus norvegicus
tgttggtgacatacttcagctcctc

SEQ ID NO: 654438 - DNA, 25 bp, Rattus norvegicus
tgttggtgacattcttcagctcctc

SEQ ID NO: 654439 - DNA, 25 bp, Rattus norvegicus
tgttggtgagtacttgcccaggact

SEQ ID NO: 654440 - DNA, 25 bp, Rattus norvegicus
tgttggtgagtagttgcccaggact

SEQ ID NO: 654441 - DNA, 25 bp, Rattus norvegicus
tgttggtgcagaagagggtcccttt

SEQ ID NO: 654442 - DNA, 25 bp, Rattus norvegicus
tgttggtgcagatgagggtcccttt

SEQ ID NO: 654443 - DNA, 25 bp, Rattus norvegicus
tgttggtgccaactataaagtcttg

SEQ ID NO: 654444 - DNA, 25 bp, Rattus norvegicus
tgttggtgccaagtataaagtcttg

SEQ ID NO: 654445 - DNA, 25 bp, Rattus norvegicus
tgttggtgcggcctggcttttcctc

SEQ ID NO: 654446 - DNA, 25 bp, Rattus norvegicus
tgttggtgcggcgtggcttttcctc

SEQ ID NO: 654447 - DNA, 25 bp, Rattus norvegicus
tgttggtggccgatcctgacttcag

SEQ ID NO: 654448 - DNA, 25 bp, Rattus norvegicus
tgttggtggccgttcctgacttcag

SEQ ID NO: 654449 - DNA, 25 bp, Rattus norvegicus
tgttggtgtatcagcagtggccagc

SEQ ID NO: 654450 - DNA, 25 bp, Rattus norvegicus
tgttggtgtatctgcagtggccagc

SEQ ID NO: 654451 - DNA, 25 bp, Rattus norvegicus
tgttggttaatcattcttggcgttt

SEQ ID NO: 654452 - DNA, 25 bp, Rattus norvegicus
tgttggttaatctttcttggcgttt

SEQ ID NO: 654453 - DNA, 25 bp, Rattus norvegicus
tgttggttagctctgtcctgagttc

SEQ ID NO: 654454 - DNA, 25 bp, Rattus norvegicus
tgttggttagctgtgtcctgagttc

SEQ ID NO: 654455 - DNA, 25 bp, Rattus norvegicus
tgttggttctaaaggtgagcactga

SEQ ID NO: 654456 - DNA, 25 bp, Rattus norvegicus
tgttggttctaatggtgagcactga

SEQ ID NO: 654457 - DNA, 25 bp, Rattus norvegicus
tgttggttctttatgtgtgggtcct

SEQ ID NO: 654458 - DNA, 25 bp, Rattus norvegicus
tgttggttctttttgtgtgggtcct

SEQ ID NO: 654459 - DNA, 25 bp, Rattus norvegicus
tgttgtaacaacacaccaagcccag

SEQ ID NO: 654460 - DNA, 25 bp, Rattus norvegicus
tgttgtaacaactcaccaagcccag

SEQ ID NO: 654461 - DNA, 25 bp, Rattus norvegicus
tgttgtaacatgaacctgagcttat

SEQ ID NO: 654462 - DNA, 25 bp, Rattus norvegicus
tgttgtaacatgtacctgagcttat

SEQ ID NO: 654463 - DNA, 25 bp, Rattus norvegicus
tgttgtaaccacacactgtttgcat

SEQ ID NO: 654464 - DNA, 25 bp, Rattus norvegicus
tgttgtaaccactcactgtttgcat

SEQ ID NO: 654465 - DNA, 25 bp, Rattus norvegicus
tgttgtaataccagcctcttcagca

SEQ ID NO: 654466 - DNA, 25 bp, Rattus norvegicus
tgttgtaatacctgcctcttcagca

SEQ ID NO: 654467 - DNA, 25 bp, Rattus norvegicus
tgttgtaatcacaatcctgtcccac

SEQ ID NO: 654468 - DNA, 25 bp, Rattus norvegicus
tgttgtaatcactatcctgtcccac

SEQ ID NO: 654469 - DNA, 25 bp, Rattus norvegicus
tgttgtaattggatctttccccgat

SEQ ID NO: 654470 - DNA, 25 bp, Rattus norvegicus
tgttgtaattggttctttccccgat

SEQ ID NO: 654471 - DNA, 25 bp, Rattus norvegicus
tgttgtacccaaacccttggcacat

SEQ ID NO: 654472 - DNA, 25 bp, Rattus norvegicus
tgttgtacccaatcccttggcacat

SEQ ID NO: 654473 - DNA, 25 bp, Rattus norvegicus
tgttgtactctacccaagttcatta

SEQ ID NO: 654474 - DNA, 25 bp, Rattus norvegicus
tgttgtactctagccaagttcatta

SEQ ID NO: 654475 - DNA, 25 bp, Rattus norvegicus
tgttgtagagcaccccggagccact

SEQ ID NO: 654476 - DNA, 25 bp, Rattus norvegicus
tgttgtagagcagcccggagccact

SEQ ID NO: 654477 - DNA, 25 bp, Rattus norvegicus
tgttgtatataccattctattgaga

SEQ ID NO: 654478 - DNA, 25 bp, Rattus norvegicus
tgttgtatatacgattctattgaga

SEQ ID NO: 654479 - DNA, 25 bp, Rattus norvegicus
tgttgtatccgtatcttgctgtgaa

SEQ ID NO: 654480 - DNA, 25 bp, Rattus norvegicus
tgttgtatccgtttcttgctgtgaa

SEQ ID NO: 654481 - DNA, 25 bp, Rattus norvegicus
tgttgtattaaaacccacctcatcg

SEQ ID NO: 654482 - DNA, 25 bp, Rattus norvegicus
tgttgtattaaatcccacctcatcg

SEQ ID NO: 654483 - DNA, 25 bp, Rattus norvegicus
tgttgtcaagctatctaccaccgaa

SEQ ID NO: 654484 - DNA, 25 bp, Rattus norvegicus
tgttgtcaagctttctaccaccgaa

SEQ ID NO: 654485 - DNA, 25 bp, Rattus norvegicus
tgttgtcactgcactgggtacgtat

SEQ ID NO: 654486 - DNA, 25 bp, Rattus norvegicus
tgttgtcactgctctgggtacgtat

SEQ ID NO: 654487 - DNA, 25 bp, Rattus norvegicus
tgttgtcacttaaaacttgtctggt

SEQ ID NO: 654488 - DNA, 25 bp, Rattus norvegicus
tgttgtcacttataacttgtctggt

SEQ ID NO: 654489 - DNA, 25 bp, Rattus norvegicus
tgttgtcagtgaataaactcgcgga

SEQ ID NO: 654490 - DNA, 25 bp, Rattus norvegicus
tgttgtcagtgattaaactcgcgga

SEQ ID NO: 654491 - DNA, 25 bp, Rattus norvegicus
tgttgtcagttcagtgtccacgtcc

SEQ ID NO: 654492 - DNA, 25 bp, Rattus norvegicus
tgttgtcagttctgtgtccacgtcc

SEQ ID NO: 654493 - DNA, 25 bp, Rattus norvegicus
tgttgtccaggacccaggtgactat

SEQ ID NO: 654494 - DNA, 25 bp, Rattus norvegicus
tgttgtccaggagccaggtgactat

SEQ ID NO: 654495 - DNA, 25 bp, Rattus norvegicus
tgttgtccaggccaccggatgtaga

SEQ ID NO: 654496 - DNA, 25 bp, Rattus norvegicus
tgttgtccaggcgaccggatgtaga

SEQ ID NO: 654497 - DNA, 25 bp, Rattus norvegicus
tgttgtcccaccctacctgtagaag

SEQ ID NO: 654498 - DNA, 25 bp, Rattus norvegicus
tgttgtcccaccgtacctgtagaag

SEQ ID NO: 654499 - DNA, 25 bp, Rattus norvegicus
tgttgtccctacagaaatctctctc

SEQ ID NO: 654500 - DNA, 25 bp, Rattus norvegicus
tgttgtccctactgaaatctctctc

SEQ ID NO: 654501 - DNA, 25 bp, Rattus norvegicus
tgttgtcctatgcaaatcctgactt

SEQ ID NO: 654502 - DNA, 25 bp, Rattus norvegicus
tgttgtcctatggaaatcctgactt

SEQ ID NO: 654503 - DNA, 25 bp, Rattus norvegicus
tgttgtcctattatggtatcagagt

SEQ ID NO: 654504 - DNA, 25 bp, Rattus norvegicus
tgttgtcctattttggtatcagagt

SEQ ID NO: 654505 - DNA, 25 bp, Rattus norvegicus
tgttgtcctgtcagactgttgccag

SEQ ID NO: 654506 - DNA, 25 bp, Rattus norvegicus
tgttgtcctgtctgactgttgccag

SEQ ID NO: 654507 - DNA, 25 bp, Rattus norvegicus
tgttgtccttatcacgtttgctggc

SEQ ID NO: 654508 - DNA, 25 bp, Rattus norvegicus
tgttgtccttatgacgtttgctggc

SEQ ID NO: 654509 - DNA, 25 bp, Rattus norvegicus
tgttgtccttgacactagcaccatg

SEQ ID NO: 654510 - DNA, 25 bp, Rattus norvegicus
tgttgtccttgagactagcaccatg

SEQ ID NO: 654511 - DNA, 25 bp, Rattus norvegicus
tgttgtcgtcttcctttggtttgaa

SEQ ID NO: 654512 - DNA, 25 bp, Rattus norvegicus
tgttgtcgtcttgctttggtttgaa

SEQ ID NO: 654513 - DNA, 25 bp, Rattus norvegicus
tgttgtcgtttcatctacttttatt

SEQ ID NO: 654514 - DNA, 25 bp, Rattus norvegicus
tgttgtcgtttcttctacttttatt

SEQ ID NO: 654515 - DNA, 25 bp, Rattus norvegicus
tgttgtctaagactctgctgctcat

SEQ ID NO: 654516 - DNA, 25 bp, Rattus norvegicus
tgttgtctaagagtctgctgctcat

SEQ ID NO: 654517 - DNA, 25 bp, Rattus norvegicus
tgttgtctaggaaagcccctttctt

SEQ ID NO: 654518 - DNA, 25 bp, Rattus norvegicus
tgttgtctaggatagcccctttctt

SEQ ID NO: 654519 - DNA, 25 bp, Rattus norvegicus
tgttgtctccatactgtatcagctg

SEQ ID NO: 654520 - DNA, 25 bp, Rattus norvegicus
tgttgtctccattctgtatcagctg

SEQ ID NO: 654521 - DNA, 25 bp, Rattus norvegicus
tgttgtctgaacagcactgtgccct

SEQ ID NO: 654522 - DNA, 25 bp, Rattus norvegicus
tgttgtctgaactgcactgtgccct

SEQ ID NO: 654523 - DNA, 25 bp, Rattus norvegicus
tgttgtctgccccaccgagtgggca

SEQ ID NO: 654524 - DNA, 25 bp, Rattus norvegicus
tgttgtctgcccgaccgagtgggca

SEQ ID NO: 654525 - DNA, 25 bp, Rattus norvegicus
tgttgtctggctcttcctcatagcc

SEQ ID NO: 654526 - DNA, 25 bp, Rattus norvegicus
tgttgtctggctgttcctcatagcc

SEQ ID NO: 654527 - DNA, 25 bp, Rattus norvegicus
tgttgtctgtagagaccggtggccc

SEQ ID NO: 654528 - DNA, 25 bp, Rattus norvegicus
tgttgtctgtagtgaccggtggccc

SEQ ID NO: 654529 - DNA, 25 bp, Rattus norvegicus
tgttgtcttatgattcactctgaag

SEQ ID NO: 654530 - DNA, 25 bp, Rattus norvegicus
tgttgtcttatgtttcactctgaag

SEQ ID NO: 654531 - DNA, 25 bp, Rattus norvegicus
tgttgtcttcaacaccctgtctaca

SEQ ID NO: 654532 - DNA, 25 bp, Rattus norvegicus
tgttgtcttcaagaccctgtctaca

SEQ ID NO: 654533 - DNA, 25 bp, Rattus norvegicus
tgttgtcttctaactctctagtgtt

SEQ ID NO: 654534 - DNA, 25 bp, Rattus norvegicus
tgttgtcttctatctctctagtgtt

SEQ ID NO: 654535 - DNA, 25 bp, Rattus norvegicus
tgttgtcttctcacggttgtatata

SEQ ID NO: 654536 - DNA, 25 bp, Rattus norvegicus
tgttgtcttctctcggttgtatata

SEQ ID NO: 654537 - DNA, 25 bp, Rattus norvegicus
tgttgtcttgctagtcttttcatta

SEQ ID NO: 654538 - DNA, 25 bp, Rattus norvegicus
tgttgtcttgcttgtcttttcatta

SEQ ID NO: 654539 - DNA, 25 bp, Rattus norvegicus
tgttgtctttctctcactggatttt

SEQ ID NO: 654540 - DNA, 25 bp, Rattus norvegicus
tgttgtctttctgtcactggatttt

SEQ ID NO: 654541 - DNA, 25 bp, Rattus norvegicus
tgttgtgaagaaacctctgtgcccg

SEQ ID NO: 654542 - DNA, 25 bp, Rattus norvegicus
tgttgtgaagaatcctctgtgcccg

SEQ ID NO: 654543 - DNA, 25 bp, Rattus norvegicus
tgttgtgaccagactagctagcaga

SEQ ID NO: 654544 - DNA, 25 bp, Rattus norvegicus
tgttgtgaccagtctagctagcaga

SEQ ID NO: 654545 - DNA, 25 bp, Rattus norvegicus
tgttgtgacctaccagatttcagaa

SEQ ID NO: 654546 - DNA, 25 bp, Rattus norvegicus
tgttgtgacctagcagatttcagaa

SEQ ID NO: 654547 - DNA, 25 bp, Rattus norvegicus
tgttgtgaccttatgtgtgtttctc

SEQ ID NO: 654548 - DNA, 25 bp, Rattus norvegicus
tgttgtgaccttttgtgtgtttctc

SEQ ID NO: 654549 - DNA, 25 bp, Rattus norvegicus
tgttgtgactcaccacctacctcag

SEQ ID NO: 654550 - DNA, 25 bp, Rattus norvegicus
tgttgtgactcagcacctacctcag

SEQ ID NO: 654551 - DNA, 25 bp, Rattus norvegicus
tgttgtgagactatgatcccagcgc

SEQ ID NO: 654552 - DNA, 25 bp, Rattus norvegicus
tgttgtgagactttgatcccagcgc

SEQ ID NO: 654553 - DNA, 25 bp, Rattus norvegicus
tgttgtgagcggcacgcccagaact

SEQ ID NO: 654554 - DNA, 25 bp, Rattus norvegicus
tgttgtgagcgggacgcccagaact

SEQ ID NO: 654555 - DNA, 25 bp, Rattus norvegicus
tgttgtgcaaacctgtcattctctg

SEQ ID NO: 654556 - DNA, 25 bp, Rattus norvegicus
tgttgtgcaaacgtgtcattctctg

SEQ ID NO: 654557 - DNA, 25 bp, Rattus norvegicus
tgttgtgccagtacagttctccagt

SEQ ID NO: 654558 - DNA, 25 bp, Rattus norvegicus
tgttgtgccagttcagttctccagt

SEQ ID NO: 654559 - DNA, 25 bp, Rattus norvegicus
tgttgtgccatgaagcgagcgtcgc

SEQ ID NO: 654560 - DNA, 25 bp, Rattus norvegicus
tgttgtgccatgtagcgagcgtcgc

SEQ ID NO: 654561 - DNA, 25 bp, Rattus norvegicus
tgttgtgccattacatagggccacc

SEQ ID NO: 654562 - DNA, 25 bp, Rattus norvegicus
tgttgtgccatttcatagggccacc

SEQ ID NO: 654563 - DNA, 25 bp, Rattus norvegicus
tgttgtgcccgcaacagaatgagat

SEQ ID NO: 654564 - DNA, 25 bp, Rattus norvegicus
tgttgtgcccgctacagaatgagat

SEQ ID NO: 654565 - DNA, 25 bp, Rattus norvegicus
tgttgtgccgaaacagaggcctgat

SEQ ID NO: 654566 - DNA, 25 bp, Rattus norvegicus
tgttgtgccgaatcagaggcctgat

SEQ ID NO: 654567 - DNA, 25 bp, Rattus norvegicus
tgttgtgcgcacacatgagatcagc

SEQ ID NO: 654568 - DNA, 25 bp, Rattus norvegicus
tgttgtgcgcactcatgagatcagc

SEQ ID NO: 654569 - DNA, 25 bp, Rattus norvegicus
tgttgtgctcaactgaaactctccc

SEQ ID NO: 654570 - DNA, 25 bp, Rattus norvegicus
tgttgtgctcaagtgaaactctccc

SEQ ID NO: 654571 - DNA, 25 bp, Rattus norvegicus
tgttgtgctcagacttgctctgaaa

SEQ ID NO: 654572 - DNA, 25 bp, Rattus norvegicus
tgttgtgctcagtcttgctctgaaa

SEQ ID NO: 654573 - DNA, 25 bp, Rattus norvegicus
tgttgtggccttcgtcatttctgcg

SEQ ID NO: 654574 - DNA, 25 bp, Rattus norvegicus
tgttgtggccttggtcatttctgcg

SEQ ID NO: 654575 - DNA, 25 bp, Rattus norvegicus
tgttgtggtcctattttcttccaca

SEQ ID NO: 654576 - DNA, 25 bp, Rattus norvegicus
tgttgtggtccttttttcttccaca

SEQ ID NO: 654577 - DNA, 25 bp, Rattus norvegicus
tgttgtgtaacaagcttcctagagt

SEQ ID NO: 654578 - DNA, 25 bp, Rattus norvegicus
tgttgtgtaacatgcttcctagagt

SEQ ID NO: 654579 - DNA, 25 bp, Rattus norvegicus
tgttgtgtagcacctctcgatactg

SEQ ID NO: 654580 - DNA, 25 bp, Rattus norvegicus
tgttgtgtagcagctctcgatactg

SEQ ID NO: 654581 - DNA, 25 bp, Rattus norvegicus
tgttgtgtatttcttctccggtggc

SEQ ID NO: 654582 - DNA, 25 bp, Rattus norvegicus
tgttgtgtatttgttctccggtggc

SEQ ID NO: 654583 - DNA, 25 bp, Rattus norvegicus
tgttgtgtcaaaatccagtggcttc

SEQ ID NO: 654584 - DNA, 25 bp, Rattus norvegicus
tgttgtgtcaaattccagtggcttc

SEQ ID NO: 654585 - DNA, 25 bp, Rattus norvegicus
tgttgtgtctacagagcccattttc

SEQ ID NO: 654586 - DNA, 25 bp, Rattus norvegicus
tgttgtgtctactgagcccattttc

SEQ ID NO: 654587 - DNA, 25 bp, Rattus norvegicus
tgttgtgtctgcagctaagggtacc

SEQ ID NO: 654588 - DNA, 25 bp, Rattus norvegicus
tgttgtgtctgctgctaagggtacc

SEQ ID NO: 654589 - DNA, 25 bp, Rattus norvegicus
tgttgtgtgcaaaacgaccgtcggt

SEQ ID NO: 654590 - DNA, 25 bp, Rattus norvegicus
tgttgtgtgcaatacgaccgtcggt

SEQ ID NO: 654591 - DNA, 25 bp, Rattus norvegicus
tgttgtgtggcacggatctgttttt

SEQ ID NO: 654592 - DNA, 25 bp, Rattus norvegicus
tgttgtgtggcagggatctgttttt

SEQ ID NO: 654593 - DNA, 25 bp, Rattus norvegicus
tgttgtgtggctccactcacgctac

SEQ ID NO: 654594 - DNA, 25 bp, Rattus norvegicus
tgttgtgtggctgcactcacgctac

SEQ ID NO: 654595 - DNA, 25 bp, Rattus norvegicus
tgttgtgtgtaaaccgccaacccct

SEQ ID NO: 654596 - DNA, 25 bp, Rattus norvegicus
tgttgtgtgtaatccgccaacccct

SEQ ID NO: 654597 - DNA, 25 bp, Rattus norvegicus
tgttgtgttagaagacagtgtcctg

SEQ ID NO: 654598 - DNA, 25 bp, Rattus norvegicus
tgttgtgttagatgacagtgtcctg

SEQ ID NO: 654599 - DNA, 25 bp, Rattus norvegicus
tgttgtgtttacatgtggctttgcc

SEQ ID NO: 654600 - DNA, 25 bp, Rattus norvegicus
tgttgtgtttacttgtggctttgcc

SEQ ID NO: 654601 - DNA, 25 bp, Rattus norvegicus
tgttgttaaggcagacagtcctgtt

SEQ ID NO: 654602 - DNA, 25 bp, Rattus norvegicus
tgttgttaaggctgacagtcctgtt

SEQ ID NO: 654603 - DNA, 25 bp, Rattus norvegicus
tgttgttaagttctttagagtcttg

SEQ ID NO: 654604 - DNA, 25 bp, Rattus norvegicus
tgttgttaagttgtttagagtcttg

SEQ ID NO: 654605 - DNA, 25 bp, Rattus norvegicus
tgttgttagtgcaagcagccgctgt

SEQ ID NO: 654606 - DNA, 25 bp, Rattus norvegicus
tgttgttagtgctagcagccgctgt

SEQ ID NO: 654607 - DNA, 25 bp, Rattus norvegicus
tgttgttagtttatccccactgctg

SEQ ID NO: 654608 - DNA, 25 bp, Rattus norvegicus
tgttgttagtttttccccactgctg

SEQ ID NO: 654609 - DNA, 25 bp, Rattus norvegicus
tgttgttatctgcatttcagagtaa

SEQ ID NO: 654610 - DNA, 25 bp, Rattus norvegicus
tgttgttatctggatttcagagtaa

SEQ ID NO: 654611 - DNA, 25 bp, Rattus norvegicus
tgttgttatttcagtcctctggacg

SEQ ID NO: 654612 - DNA, 25 bp, Rattus norvegicus
tgttgttatttctgtcctctggacg

SEQ ID NO: 654613 - DNA, 25 bp, Rattus norvegicus
tgttgttcagcactggatgacacac

SEQ ID NO: 654614 - DNA, 25 bp, Rattus norvegicus
tgttgttcagcagtggatgacacac

SEQ ID NO: 654615 - DNA, 25 bp, Rattus norvegicus
tgttgttcattaacacactgtgagt

SEQ ID NO: 654616 - DNA, 25 bp, Rattus norvegicus
tgttgttcattatcacactgtgagt

SEQ ID NO: 654617 - DNA, 25 bp, Rattus norvegicus
tgttgttccaaactctgactggcgg

SEQ ID NO: 654618 - DNA, 25 bp, Rattus norvegicus
tgttgttccaaagtctgactggcgg

SEQ ID NO: 654619 - DNA, 25 bp, Rattus norvegicus
tgttgttccaggagcacacaggcta

SEQ ID NO: 654620 - DNA, 25 bp, Rattus norvegicus
tgttgttccaggagctcatgtccat

SEQ ID NO: 654621 - DNA, 25 bp, Rattus norvegicus
tgttgttccaggtgcacacaggcta

SEQ ID NO: 654622 - DNA, 25 bp, Rattus norvegicus
tgttgttccaggtgctcatgtccat

SEQ ID NO: 654623 - DNA, 25 bp, Rattus norvegicus
tgttgttccctccaacacacggaag

SEQ ID NO: 654624 - DNA, 25 bp, Rattus norvegicus
tgttgttccctcgaacacacggaag

SEQ ID NO: 654625 - DNA, 25 bp, Rattus norvegicus
tgttgttcccttagcagctttaaaa

SEQ ID NO: 654626 - DNA, 25 bp, Rattus norvegicus
tgttgttccctttgcagctttaaaa

SEQ ID NO: 654627 - DNA, 25 bp, Rattus norvegicus
tgttgttcctcaaagaaccccgtag

SEQ ID NO: 654628 - DNA, 25 bp, Rattus norvegicus
tgttgttcctcatagaaccccgtag

SEQ ID NO: 654629 - DNA, 25 bp, Rattus norvegicus
tgttgttcctctatactttgttctg

SEQ ID NO: 654630 - DNA, 25 bp, Rattus norvegicus
tgttgttcctctttactttgttctg

SEQ ID NO: 654631 - DNA, 25 bp, Rattus norvegicus
tgttgttgaagtccccggcatctgc

SEQ ID NO: 654632 - DNA, 25 bp, Rattus norvegicus
tgttgttgaagtgcccggcatctgc

SEQ ID NO: 654633 - DNA, 25 bp, Rattus norvegicus
tgttgttgattgagcccagttccca

SEQ ID NO: 654634 - DNA, 25 bp, Rattus norvegicus
tgttgttgattgtgcccagttccca

SEQ ID NO: 654635 - DNA, 25 bp, Rattus norvegicus
tgttgttgcttccagctgccacagc

SEQ ID NO: 654636 - DNA, 25 bp, Rattus norvegicus
tgttgttgcttcgagctgccacagc

SEQ ID NO: 654637 - DNA, 25 bp, Rattus norvegicus
tgttgttgctttccctagcagtgtg

SEQ ID NO: 654638 - DNA, 25 bp, Rattus norvegicus
tgttgttgctttgcctagcagtgtg

SEQ ID NO: 654639 - DNA, 25 bp, Rattus norvegicus
tgttgttggaatccagactctgtct

SEQ ID NO: 654640 - DNA, 25 bp, Rattus norvegicus
tgttgttggaatgcagactctgtct

SEQ ID NO: 654641 - DNA, 25 bp, Rattus norvegicus
tgttgttggagacactttccccgtg

SEQ ID NO: 654642 - DNA, 25 bp, Rattus norvegicus
tgttgttggagagactttccccgtg

SEQ ID NO: 654643 - DNA, 25 bp, Rattus norvegicus
tgttgttgggaaatgaccctgcccc

SEQ ID NO: 654644 - DNA, 25 bp, Rattus norvegicus
tgttgttgggaattgaccctgcccc

SEQ ID NO: 654645 - DNA, 25 bp, Rattus norvegicus
tgttgttgtcctaaacttgcttttc

SEQ ID NO: 654646 - DNA, 25 bp, Rattus norvegicus
tgttgttgtccttaacttgcttttc

SEQ ID NO: 654647 - DNA, 25 bp, Rattus norvegicus
tgttgttgtcgtacactgctgagaa

SEQ ID NO: 654648 - DNA, 25 bp, Rattus norvegicus
tgttgttgtcgttcactgctgagaa

SEQ ID NO: 654649 - DNA, 25 bp, Rattus norvegicus
tgttgttgttccagcccacggtaat

SEQ ID NO: 654650 - DNA, 25 bp, Rattus norvegicus
tgttgttgttcctgcccacggtaat

SEQ ID NO: 654651 - DNA, 25 bp, Rattus norvegicus
tgttgtttaaaacttcttggtcagt

SEQ ID NO: 654652 - DNA, 25 bp, Rattus norvegicus
tgttgtttaaaagttcttggtcagt

SEQ ID NO: 654653 - DNA, 25 bp, Rattus norvegicus
tgttgtttacgaatgagcctctctt

SEQ ID NO: 654654 - DNA, 25 bp, Rattus norvegicus
tgttgtttacgattgagcctctctt

SEQ ID NO: 654655 - DNA, 25 bp, Rattus norvegicus
tgttgtttagtcacaaaatctccac

SEQ ID NO: 654656 - DNA, 25 bp, Rattus norvegicus
tgttgtttagtctcaaaatctccac

SEQ ID NO: 654657 - DNA, 25 bp, Rattus norvegicus
tgttgtttcctgcagcctagagaac

SEQ ID NO: 654658 - DNA, 25 bp, Rattus norvegicus
tgttgtttcctggagcctagagaac

SEQ ID NO: 654659 - DNA, 25 bp, Rattus norvegicus
tgttgtttctgcaccttcacaaaga

SEQ ID NO: 654660 - DNA, 25 bp, Rattus norvegicus
tgttgtttctgctccttcacaaaga

SEQ ID NO: 654661 - DNA, 25 bp, Rattus norvegicus
tgttgtttgtggctgagttcctgac

SEQ ID NO: 654662 - DNA, 25 bp, Rattus norvegicus
tgttgtttgtgggtgagttcctgac

SEQ ID NO: 654663 - DNA, 25 bp, Rattus norvegicus
tgttgttttcccaacaaacccatca

SEQ ID NO: 654664 - DNA, 25 bp, Rattus norvegicus
tgttgttttccctacaaacccatca

SEQ ID NO: 654665 - DNA, 25 bp, Rattus norvegicus
tgttgtttttcgaatgtgctactac

SEQ ID NO: 654666 - DNA, 25 bp, Rattus norvegicus
tgttgtttttcgtatgtgctactac

SEQ ID NO: 654667 - DNA, 25 bp, Rattus norvegicus
tgttgtttttttatgaggctcctga

SEQ ID NO: 654668 - DNA, 25 bp, Rattus norvegicus
tgttgtttttttttgaggctcctga

SEQ ID NO: 654669 - DNA, 25 bp, Rattus norvegicus
tgtttaaaaaccctgcagcaatgaa

SEQ ID NO: 654670 - DNA, 25 bp, Rattus norvegicus
tgtttaaaaaccgtgcagcaatgaa

SEQ ID NO: 654671 - DNA, 25 bp, Rattus norvegicus
tgtttaaaaggccctggttcctcat

SEQ ID NO: 654672 - DNA, 25 bp, Rattus norvegicus
tgtttaaaaggcgctggttcctcat

SEQ ID NO: 654673 - DNA, 25 bp, Rattus norvegicus
tgtttaaatccaacactgctggtga

SEQ ID NO: 654674 - DNA, 25 bp, Rattus norvegicus
tgtttaaatccatcactgctggtga

SEQ ID NO: 654675 - DNA, 25 bp, Rattus norvegicus
tgtttaacgcccacacatctaagat

SEQ ID NO: 654676 - DNA, 25 bp, Rattus norvegicus
tgtttaacgccctcacatctaagat

SEQ ID NO: 654677 - DNA, 25 bp, Rattus norvegicus
tgtttaacttataatctctcccacc

SEQ ID NO: 654678 - DNA, 25 bp, Rattus norvegicus
tgtttaacttattatctctcccacc

SEQ ID NO: 654679 - DNA, 25 bp, Rattus norvegicus
tgtttaagctgtagccggaggtctt

SEQ ID NO: 654680 - DNA, 25 bp, Rattus norvegicus
tgtttaagctgtagctgccagtgca

SEQ ID NO: 654681 - DNA, 25 bp, Rattus norvegicus
tgtttaagctgttgccggaggtctt

SEQ ID NO: 654682 - DNA, 25 bp, Rattus norvegicus
tgtttaagctgttgctgccagtgca

SEQ ID NO: 654683 - DNA, 25 bp, Rattus norvegicus
tgtttaagttgtacacctcccattg

SEQ ID NO: 654684 - DNA, 25 bp, Rattus norvegicus
tgtttaagttgttcacctcccattg

SEQ ID NO: 654685 - DNA, 25 bp, Rattus norvegicus
tgtttaataaatcctcgcctttgat

SEQ ID NO: 654686 - DNA, 25 bp, Rattus norvegicus
tgtttaataaatgctcgcctttgat

SEQ ID NO: 654687 - DNA, 25 bp, Rattus norvegicus
tgtttaataatacctagcacgctgt

SEQ ID NO: 654688 - DNA, 25 bp, Rattus norvegicus
tgtttaataatagctagcacgctgt

SEQ ID NO: 654689 - DNA, 25 bp, Rattus norvegicus
tgtttaatctcgacaatggcctcca

SEQ ID NO: 654690 - DNA, 25 bp, Rattus norvegicus
tgtttaatctcgtcaatggcctcca

SEQ ID NO: 654691 - DNA, 25 bp, Rattus norvegicus
tgtttaatgcctaagtttcccctgg

SEQ ID NO: 654692 - DNA, 25 bp, Rattus norvegicus
tgtttaatgccttagtttcccctgg

SEQ ID NO: 654693 - DNA, 25 bp, Rattus norvegicus
tgtttaattattcccgaacacgaga

SEQ ID NO: 654694 - DNA, 25 bp, Rattus norvegicus
tgtttaattattgccgaacacgaga

SEQ ID NO: 654695 - DNA, 25 bp, Rattus norvegicus
tgtttacaaacaaagctctcccagt

SEQ ID NO: 654696 - DNA, 25 bp, Rattus norvegicus
tgtttacaaacatagctctcccagt

SEQ ID NO: 654697 - DNA, 25 bp, Rattus norvegicus
tgtttacaaactaccgaatctcacg

SEQ ID NO: 654698 - DNA, 25 bp, Rattus norvegicus
tgtttacaaacttccgaatctcacg

SEQ ID NO: 654699 - DNA, 25 bp, Rattus norvegicus
tgtttacaagccctgagccctaacc

SEQ ID NO: 654700 - DNA, 25 bp, Rattus norvegicus
tgtttacaagccgtgagccctaacc

SEQ ID NO: 654701 - DNA, 25 bp, Rattus norvegicus
tgtttacacagaatgcagcctcgac

SEQ ID NO: 654702 - DNA, 25 bp, Rattus norvegicus
tgtttacacagattgcagcctcgac

SEQ ID NO: 654703 - DNA, 25 bp, Rattus norvegicus
tgtttacacttcaatgaccaggcct

SEQ ID NO: 654704 - DNA, 25 bp, Rattus norvegicus
tgtttacacttctatgaccaggcct

SEQ ID NO: 654705 - DNA, 25 bp, Rattus norvegicus
tgtttacatgacagggtgaggaccc

SEQ ID NO: 654706 - DNA, 25 bp, Rattus norvegicus
tgtttacatgactgggtgaggaccc

SEQ ID NO: 654707 - DNA, 25 bp, Rattus norvegicus
tgtttacattgacccaagtcctggt

SEQ ID NO: 654708 - DNA, 25 bp, Rattus norvegicus
tgtttacattgagccaagtcctggt

SEQ ID NO: 654709 - DNA, 25 bp, Rattus norvegicus
tgtttaccattcatatttcatttaa

SEQ ID NO: 654710 - DNA, 25 bp, Rattus norvegicus
tgtttaccattcttatttcatttaa

SEQ ID NO: 654711 - DNA, 25 bp, Rattus norvegicus
tgtttacccactcctggaagctaaa

SEQ ID NO: 654712 - DNA, 25 bp, Rattus norvegicus
tgtttacccactgctggaagctaaa

SEQ ID NO: 654713 - DNA, 25 bp, Rattus norvegicus
tgtttaccccaacagggccaaagag

SEQ ID NO: 654714 - DNA, 25 bp, Rattus norvegicus
tgtttaccccaagagggccaaagag

SEQ ID NO: 654715 - DNA, 25 bp, Rattus norvegicus
tgtttaccccacacatatgcaaatg

SEQ ID NO: 654716 - DNA, 25 bp, Rattus norvegicus
tgtttaccccaccaggttacaagct

SEQ ID NO: 654717 - DNA, 25 bp, Rattus norvegicus
tgtttaccccacgaggttacaagct

SEQ ID NO: 654718 - DNA, 25 bp, Rattus norvegicus
tgtttaccccactcatatgcaaatg

SEQ ID NO: 654719 - DNA, 25 bp, Rattus norvegicus
tgtttaccccggcaagcgcgagctc

SEQ ID NO: 654720 - DNA, 25 bp, Rattus norvegicus
tgtttaccccgggaagcgcgagctc

SEQ ID NO: 654721 - DNA, 25 bp, Rattus norvegicus
tgtttacccctccttgtagccattt

SEQ ID NO: 654722 - DNA, 25 bp, Rattus norvegicus
tgtttacccctcgttgtagccattt

SEQ ID NO: 654723 - DNA, 25 bp, Rattus norvegicus
tgtttacctccactccaaattagaa

SEQ ID NO: 654724 - DNA, 25 bp, Rattus norvegicus
tgtttacctccagtccaaattagaa

SEQ ID NO: 654725 - DNA, 25 bp, Rattus norvegicus
tgtttacctgccacgggaccttgga

SEQ ID NO: 654726 - DNA, 25 bp, Rattus norvegicus
tgtttacctgcctcgggaccttgga

SEQ ID NO: 654727 - DNA, 25 bp, Rattus norvegicus
tgtttacctgttcgtttgctttctg

SEQ ID NO: 654728 - DNA, 25 bp, Rattus norvegicus
tgtttacctgttggtttgctttctg

SEQ ID NO: 654729 - DNA, 25 bp, Rattus norvegicus
tgtttaccttttcattgacccgatc

SEQ ID NO: 654730 - DNA, 25 bp, Rattus norvegicus
tgtttaccttttgattgacccgatc

SEQ ID NO: 654731 - DNA, 25 bp, Rattus norvegicus
tgtttacgaattacacttgcaggga

SEQ ID NO: 654732 - DNA, 25 bp, Rattus norvegicus
tgtttacgaatttcacttgcaggga

SEQ ID NO: 654733 - DNA, 25 bp, Rattus norvegicus
tgtttacgtgtaacctacctctgag

SEQ ID NO: 654734 - DNA, 25 bp, Rattus norvegicus
tgtttacgtgtatcctacctctgag

SEQ ID NO: 654735 - DNA, 25 bp, Rattus norvegicus
tgtttacgttctagtgtgcacttat

SEQ ID NO: 654736 - DNA, 25 bp, Rattus norvegicus
tgtttacgttcttgtgtgcacttat

SEQ ID NO: 654737 - DNA, 25 bp, Rattus norvegicus
tgtttactaggaccctgacttccca

SEQ ID NO: 654738 - DNA, 25 bp, Rattus norvegicus
tgtttactaggagcctgacttccca

SEQ ID NO: 654739 - DNA, 25 bp, Rattus norvegicus
tgtttactatttactgactttcatg

SEQ ID NO: 654740 - DNA, 25 bp, Rattus norvegicus
tgtttactattttctgactttcatg

SEQ ID NO: 654741 - DNA, 25 bp, Rattus norvegicus
tgtttactccaaaaggctcatcaag

SEQ ID NO: 654742 - DNA, 25 bp, Rattus norvegicus
tgtttactccaataggctcatcaag

SEQ ID NO: 654743 - DNA, 25 bp, Rattus norvegicus
tgtttactgcctacattaactgaag

SEQ ID NO: 654744 - DNA, 25 bp, Rattus norvegicus
tgtttactgccttcattaactgaag

SEQ ID NO: 654745 - DNA, 25 bp, Rattus norvegicus
tgtttactgcttctgcggccaacat

SEQ ID NO: 654746 - DNA, 25 bp, Rattus norvegicus
tgtttactgcttgtgcggccaacat

SEQ ID NO: 654747 - DNA, 25 bp, Rattus norvegicus
tgtttactgtcccaagagctctttc

SEQ ID NO: 654748 - DNA, 25 bp, Rattus norvegicus
tgtttactgtccgaagagctctttc

SEQ ID NO: 654749 - DNA, 25 bp, Rattus norvegicus
tgtttactttctccatctgttcata

SEQ ID NO: 654750 - DNA, 25 bp, Rattus norvegicus
tgtttactttctgcatctgttcata

SEQ ID NO: 654751 - DNA, 25 bp, Rattus norvegicus
tgtttacttttcacccactgctgac

SEQ ID NO: 654752 - DNA, 25 bp, Rattus norvegicus
tgtttacttttctcccactgctgac

SEQ ID NO: 654753 - DNA, 25 bp, Rattus norvegicus
tgtttagcaaacacacccaatggtt

SEQ ID NO: 654754 - DNA, 25 bp, Rattus norvegicus
tgtttagcaaactcacccaatggtt

SEQ ID NO: 654755 - DNA, 25 bp, Rattus norvegicus
tgtttagcacacacacacatccata

SEQ ID NO: 654756 - DNA, 25 bp, Rattus norvegicus
tgtttagcacactcacacatccata

SEQ ID NO: 654757 - DNA, 25 bp, Rattus norvegicus
tgtttagcacatccaaggtcccacc

SEQ ID NO: 654758 - DNA, 25 bp, Rattus norvegicus
tgtttagcacatgcaaggtcccacc

SEQ ID NO: 654759 - DNA, 25 bp, Rattus norvegicus
tgtttagcaccacctccaggtgtga

SEQ ID NO: 654760 - DNA, 25 bp, Rattus norvegicus
tgtttagcaccagctccaggtgtga

SEQ ID NO: 654761 - DNA, 25 bp, Rattus norvegicus
tgtttagcactgaggtcaccagggt

SEQ ID NO: 654762 - DNA, 25 bp, Rattus norvegicus
tgtttagcactgtggtcaccagggt

SEQ ID NO: 654763 - DNA, 25 bp, Rattus norvegicus
tgtttagcagcgagtttctggccta

SEQ ID NO: 654764 - DNA, 25 bp, Rattus norvegicus
tgtttagcagcgtgtttctggccta

SEQ ID NO: 654765 - DNA, 25 bp, Rattus norvegicus
tgtttagcccataaactactgtttg

SEQ ID NO: 654766 - DNA, 25 bp, Rattus norvegicus
tgtttagcccattaactactgtttg

SEQ ID NO: 654767 - DNA, 25 bp, Rattus norvegicus
tgtttagcctgcacagaatggcccg

SEQ ID NO: 654768 - DNA, 25 bp, Rattus norvegicus
tgtttagcctgctcagaatggcccg

SEQ ID NO: 654769 - DNA, 25 bp, Rattus norvegicus
tgtttaggctgaatgtagtctgact

SEQ ID NO: 654770 - DNA, 25 bp, Rattus norvegicus
tgtttaggctgattgtagtctgact

SEQ ID NO: 654771 - DNA, 25 bp, Rattus norvegicus
tgtttaggttatcgtgagatggctc

SEQ ID NO: 654772 - DNA, 25 bp, Rattus norvegicus
tgtttaggttatggtgagatggctc

SEQ ID NO: 654773 - DNA, 25 bp, Rattus norvegicus
tgtttagtactcaagctagcccagt

SEQ ID NO: 654774 - DNA, 25 bp, Rattus norvegicus
tgtttagtactctagctagcccagt

SEQ ID NO: 654775 - DNA, 25 bp, Rattus norvegicus
tgtttagtcattctgctggtaggca

SEQ ID NO: 654776 - DNA, 25 bp, Rattus norvegicus
tgtttagtcattgtgctggtaggca

SEQ ID NO: 654777 - DNA, 25 bp, Rattus norvegicus
tgtttagtcctacaaggtcccacta

SEQ ID NO: 654778 - DNA, 25 bp, Rattus norvegicus
tgtttagtcctagaaggtcccacta

SEQ ID NO: 654779 - DNA, 25 bp, Rattus norvegicus
tgtttagtgcgaccagtgactgctt

SEQ ID NO: 654780 - DNA, 25 bp, Rattus norvegicus
tgtttagtgcgagcagtgactgctt

SEQ ID NO: 654781 - DNA, 25 bp, Rattus norvegicus
tgtttataaaagacgtggccctcca

SEQ ID NO: 654782 - DNA, 25 bp, Rattus norvegicus
tgtttataaaagtcgtggccctcca

SEQ ID NO: 654783 - DNA, 25 bp, Rattus norvegicus
tgtttataaaccagtactgactttt

SEQ ID NO: 654784 - DNA, 25 bp, Rattus norvegicus
tgtttataaacctgtactgactttt

SEQ ID NO: 654785 - DNA, 25 bp, Rattus norvegicus
tgtttataaccacctgtaaccctag

SEQ ID NO: 654786 - DNA, 25 bp, Rattus norvegicus
tgtttataaccagctgtaaccctag

SEQ ID NO: 654787 - DNA, 25 bp, Rattus norvegicus
tgtttatacattatccctttggcgg

SEQ ID NO: 654788 - DNA, 25 bp, Rattus norvegicus
tgtttatacattttccctttggcgg

SEQ ID NO: 654789 - DNA, 25 bp, Rattus norvegicus
tgtttatagccaatgctcactgctg

SEQ ID NO: 654790 - DNA, 25 bp, Rattus norvegicus
tgtttatagccattgctcactgctg

SEQ ID NO: 654791 - DNA, 25 bp, Rattus norvegicus
tgtttatagcgcagactcccttgta

SEQ ID NO: 654792 - DNA, 25 bp, Rattus norvegicus
tgtttatagcgctgactcccttgta

SEQ ID NO: 654793 - DNA, 25 bp, Rattus norvegicus
tgtttatcacacaatcctgacttcc

SEQ ID NO: 654794 - DNA, 25 bp, Rattus norvegicus
tgtttatcacactatcctgacttcc

SEQ ID NO: 654795 - DNA, 25 bp, Rattus norvegicus
tgtttatcctttactctgagctggc

SEQ ID NO: 654796 - DNA, 25 bp, Rattus norvegicus
tgtttatccttttctctgagctggc

SEQ ID NO: 654797 - DNA, 25 bp, Rattus norvegicus
tgtttatctcgcacactcttggttt

SEQ ID NO: 654798 - DNA, 25 bp, Rattus norvegicus
tgtttatctcgctcactcttggttt

SEQ ID NO: 654799 - DNA, 25 bp, Rattus norvegicus
tgtttatctctcatgcacagcacag

SEQ ID NO: 654800 - DNA, 25 bp, Rattus norvegicus
tgtttatctctcttgcacagcacag

SEQ ID NO: 654801 - DNA, 25 bp, Rattus norvegicus
tgtttatgatacactgcagccaggt

SEQ ID NO: 654802 - DNA, 25 bp, Rattus norvegicus
tgtttatgatactctgcagccaggt

SEQ ID NO: 654803 - DNA, 25 bp, Rattus norvegicus
tgtttatgcaagacccatctcacat

SEQ ID NO: 654804 - DNA, 25 bp, Rattus norvegicus
tgtttatgcaagtcccatctcacat

SEQ ID NO: 654805 - DNA, 25 bp, Rattus norvegicus
tgtttatgctgtatccactttccta

SEQ ID NO: 654806 - DNA, 25 bp, Rattus norvegicus
tgtttatgctgtttccactttccta

SEQ ID NO: 654807 - DNA, 25 bp, Rattus norvegicus
tgtttattgccgcaagctggaccct

SEQ ID NO: 654808 - DNA, 25 bp, Rattus norvegicus
tgtttattgccggaagctggaccct

SEQ ID NO: 654809 - DNA, 25 bp, Rattus norvegicus
tgtttattgtctatctgtgggcaag

SEQ ID NO: 654810 - DNA, 25 bp, Rattus norvegicus
tgtttattgtctttctgtgggcaag

SEQ ID NO: 654811 - DNA, 25 bp, Rattus norvegicus
tgtttatttaacaccttggtcccag

SEQ ID NO: 654812 - DNA, 25 bp, Rattus norvegicus
tgtttatttaactccttggtcccag

SEQ ID NO: 654813 - DNA, 25 bp, Rattus norvegicus
tgtttatttttaacttgccgtggat

SEQ ID NO: 654814 - DNA, 25 bp, Rattus norvegicus
tgtttatttttatcttgccgtggat

SEQ ID NO: 654815 - DNA, 25 bp, Rattus norvegicus
tgtttattttttcctgttgtgcctc

SEQ ID NO: 654816 - DNA, 25 bp, Rattus norvegicus
tgtttattttttgctgttgtgcctc

SEQ ID NO: 654817 - DNA, 25 bp, Rattus norvegicus
tgtttcaaaacccagggcctgcctg

SEQ ID NO: 654818 - DNA, 25 bp, Rattus norvegicus
tgtttcaaaaccgagggcctgcctg

SEQ ID NO: 654819 - DNA, 25 bp, Rattus norvegicus
tgtttcaacgacctaaagcctgtgc

SEQ ID NO: 654820 - DNA, 25 bp, Rattus norvegicus
tgtttcaacgacgtaaagcctgtgc

SEQ ID NO: 654821 - DNA, 25 bp, Rattus norvegicus
tgtttcaacttaccccttttctgta

SEQ ID NO: 654822 - DNA, 25 bp, Rattus norvegicus
tgtttcaacttagcccttttctgta

SEQ ID NO: 654823 - DNA, 25 bp, Rattus norvegicus
tgtttcaatcttagccttcatttcc

SEQ ID NO: 654824 - DNA, 25 bp, Rattus norvegicus
tgtttcaatctttgccttcatttcc

SEQ ID NO: 654825 - DNA, 25 bp, Rattus norvegicus
tgtttcaattttaccacacccatta

SEQ ID NO: 654826 - DNA, 25 bp, Rattus norvegicus
tgtttcaatttttccacacccatta

SEQ ID NO: 654827 - DNA, 25 bp, Rattus norvegicus
tgtttcacagcgattttggaaagca

SEQ ID NO: 654828 - DNA, 25 bp, Rattus norvegicus
tgtttcacagcgtttttggaaagca

SEQ ID NO: 654829 - DNA, 25 bp, Rattus norvegicus
tgtttcaccacgatcgcagattttt

SEQ ID NO: 654830 - DNA, 25 bp, Rattus norvegicus
tgtttcaccacgttcgcagattttt

SEQ ID NO: 654831 - DNA, 25 bp, Rattus norvegicus
tgtttcaccggtactcattgccaag

SEQ ID NO: 654832 - DNA, 25 bp, Rattus norvegicus
tgtttcaccggttctcattgccaag

SEQ ID NO: 654833 - DNA, 25 bp, Rattus norvegicus
tgtttcactccacacttcagtatga

SEQ ID NO: 654834 - DNA, 25 bp, Rattus norvegicus
tgtttcactccagacttcagtatga

SEQ ID NO: 654835 - DNA, 25 bp, Rattus norvegicus
tgtttcactgaacactgtaccacca

SEQ ID NO: 654836 - DNA, 25 bp, Rattus norvegicus
tgtttcactgaagactgtaccacca

SEQ ID NO: 654837 - DNA, 25 bp, Rattus norvegicus
tgtttcactgaccatgacatgtata

SEQ ID NO: 654838 - DNA, 25 bp, Rattus norvegicus
tgtttcactgacgatgacatgtata

SEQ ID NO: 654839 - DNA, 25 bp, Rattus norvegicus
tgtttcactggcacagtagtgggcc

SEQ ID NO: 654840 - DNA, 25 bp, Rattus norvegicus
tgtttcactggcacatctctctata

SEQ ID NO: 654841 - DNA, 25 bp, Rattus norvegicus
tgtttcactggctcagtagtgggcc

SEQ ID NO: 654842 - DNA, 25 bp, Rattus norvegicus
tgtttcactggctcatctctctata

SEQ ID NO: 654843 - DNA, 25 bp, Rattus norvegicus
tgtttcactttgaaaagccacccgg

SEQ ID NO: 654844 - DNA, 25 bp, Rattus norvegicus
tgtttcactttgtaaagccacccgg

SEQ ID NO: 654845 - DNA, 25 bp, Rattus norvegicus
tgtttcagcattcacagagatgagt

SEQ ID NO: 654846 - DNA, 25 bp, Rattus norvegicus
tgtttcagcattgacagagatgagt

SEQ ID NO: 654847 - DNA, 25 bp, Rattus norvegicus
tgtttcagcgtgaggacactgtcct

SEQ ID NO: 654848 - DNA, 25 bp, Rattus norvegicus
tgtttcagcgtgtggacactgtcct

SEQ ID NO: 654849 - DNA, 25 bp, Rattus norvegicus
tgtttcagcttgctataacctccca

SEQ ID NO: 654850 - DNA, 25 bp, Rattus norvegicus
tgtttcagcttggtataacctccca

SEQ ID NO: 654851 - DNA, 25 bp, Rattus norvegicus
tgtttcagggatctccaagcggcct

SEQ ID NO: 654852 - DNA, 25 bp, Rattus norvegicus
tgtttcagggatgtccaagcggcct

SEQ ID NO: 654853 - DNA, 25 bp, Rattus norvegicus
tgtttcagtaaccttcctaacagga

SEQ ID NO: 654854 - DNA, 25 bp, Rattus norvegicus
tgtttcagtaacgttcctaacagga

SEQ ID NO: 654855 - DNA, 25 bp, Rattus norvegicus
tgtttcagtggcatgacacctgggc

SEQ ID NO: 654856 - DNA, 25 bp, Rattus norvegicus
tgtttcagtggcttgacacctgggc

SEQ ID NO: 654857 - DNA, 25 bp, Rattus norvegicus
tgtttcatatgaaccgtcttcgtgt

SEQ ID NO: 654858 - DNA, 25 bp, Rattus norvegicus
tgtttcatatgatccgtcttcgtgt

SEQ ID NO: 654859 - DNA, 25 bp, Rattus norvegicus
tgtttcatggatcaccccacaaaac

SEQ ID NO: 654860 - DNA, 25 bp, Rattus norvegicus
tgtttcatggatcccaggctgactg

SEQ ID NO: 654861 - DNA, 25 bp, Rattus norvegicus
tgtttcatggatgaccccacaaaac

SEQ ID NO: 654862 - DNA, 25 bp, Rattus norvegicus
tgtttcatggatgccaggctgactg

SEQ ID NO: 654863 - DNA, 25 bp, Rattus norvegicus
tgtttcatgtttagcacaccaatgc

SEQ ID NO: 654864 - DNA, 25 bp, Rattus norvegicus
tgtttcatgttttgcacaccaatgc

SEQ ID NO: 654865 - DNA, 25 bp, Rattus norvegicus
tgtttcattacaagccttacaattt

SEQ ID NO: 654866 - DNA, 25 bp, Rattus norvegicus
tgtttcattacatgccttacaattt

SEQ ID NO: 654867 - DNA, 25 bp, Rattus norvegicus
tgtttcattgtcactgccaaaccaa

SEQ ID NO: 654868 - DNA, 25 bp, Rattus norvegicus
tgtttcattgtctctgccaaaccaa

SEQ ID NO: 654869 - DNA, 25 bp, Rattus norvegicus
tgtttcatttgcctaggagtcccag

SEQ ID NO: 654870 - DNA, 25 bp, Rattus norvegicus
tgtttcatttgcgtaggagtcccag

SEQ ID NO: 654871 - DNA, 25 bp, Rattus norvegicus
tgtttcatttttcccatgtgtgcct

SEQ ID NO: 654872 - DNA, 25 bp, Rattus norvegicus
tgtttcatttttgccatgtgtgcct

SEQ ID NO: 654873 - DNA, 25 bp, Rattus norvegicus
tgtttccaactaaactgttctaagt

SEQ ID NO: 654874 - DNA, 25 bp, Rattus norvegicus
tgtttccaactatactgttctaagt

SEQ ID NO: 654875 - DNA, 25 bp, Rattus norvegicus
tgtttccaagctaaaaaccctgcct

SEQ ID NO: 654876 - DNA, 25 bp, Rattus norvegicus
tgtttccaagcttaaaaccctgcct

SEQ ID NO: 654877 - DNA, 25 bp, Rattus norvegicus
tgtttccaaggaaagttttgcctat

SEQ ID NO: 654878 - DNA, 25 bp, Rattus norvegicus
tgtttccaaggatagttttgcctat

SEQ ID NO: 654879 - DNA, 25 bp, Rattus norvegicus
tgtttccaatcaccattacttcacc

SEQ ID NO: 654880 - DNA, 25 bp, Rattus norvegicus
tgtttccaatcagcattacttcacc

SEQ ID NO: 654881 - DNA, 25 bp, Rattus norvegicus
tgtttccacaacacagtaactgtcc

SEQ ID NO: 654882 - DNA, 25 bp, Rattus norvegicus
tgtttccacaactcagtaactgtcc

SEQ ID NO: 654883 - DNA, 25 bp, Rattus norvegicus
tgtttccacaccaatcactctctgt

SEQ ID NO: 654884 - DNA, 25 bp, Rattus norvegicus
tgtttccacacctatcactctctgt

SEQ ID NO: 654885 - DNA, 25 bp, Rattus norvegicus
tgtttccaccaaagttaagttttat

SEQ ID NO: 654886 - DNA, 25 bp, Rattus norvegicus
tgtttccaccaatgttaagttttat

SEQ ID NO: 654887 - DNA, 25 bp, Rattus norvegicus
tgtttccagaaaagaggccatgtct

SEQ ID NO: 654888 - DNA, 25 bp, Rattus norvegicus
tgtttccagaaatgaggccatgtct

SEQ ID NO: 654889 - DNA, 25 bp, Rattus norvegicus
tgtttccagagtccctgagatggca

SEQ ID NO: 654890 - DNA, 25 bp, Rattus norvegicus
tgtttccagagtgcctgagatggca

SEQ ID NO: 654891 - DNA, 25 bp, Rattus norvegicus
tgtttccagcatctgtctcagcctg

SEQ ID NO: 654892 - DNA, 25 bp, Rattus norvegicus
tgtttccagcatgtgtctcagcctg

SEQ ID NO: 654893 - DNA, 25 bp, Rattus norvegicus
tgtttccaggccatgatcactatat

SEQ ID NO: 654894 - DNA, 25 bp, Rattus norvegicus
tgtttccaggccttgatcactatat

SEQ ID NO: 654895 - DNA, 25 bp, Rattus norvegicus
tgtttccagggacacttcccacatg

SEQ ID NO: 654896 - DNA, 25 bp, Rattus norvegicus
tgtttccagggagacttcccacatg

SEQ ID NO: 654897 - DNA, 25 bp, Rattus norvegicus
tgtttccagggtattccacacagag

SEQ ID NO: 654898 - DNA, 25 bp, Rattus norvegicus
tgtttccagggttttccacacagag

SEQ ID NO: 654899 - DNA, 25 bp, Rattus norvegicus
tgtttccatctaaacaccagggctg

SEQ ID NO: 654900 - DNA, 25 bp, Rattus norvegicus
tgtttccatctatacaccagggctg

SEQ ID NO: 654901 - DNA, 25 bp, Rattus norvegicus
tgtttccatctcagtacttatccgt

SEQ ID NO: 654902 - DNA, 25 bp, Rattus norvegicus
tgtttccatctctgtacttatccgt

SEQ ID NO: 654903 - DNA, 25 bp, Rattus norvegicus
tgtttccattaccagatgactgctg

SEQ ID NO: 654904 - DNA, 25 bp, Rattus norvegicus
tgtttccattacgagatgactgctg

SEQ ID NO: 654905 - DNA, 25 bp, Rattus norvegicus
tgtttcccaaacaaacctgttgtat

SEQ ID NO: 654906 - DNA, 25 bp, Rattus norvegicus
tgtttcccaaactaacctgttgtat

SEQ ID NO: 654907 - DNA, 25 bp, Rattus norvegicus
tgtttcccatctcatagtcatcttt

SEQ ID NO: 654908 - DNA, 25 bp, Rattus norvegicus
tgtttcccatctgatagtcatcttt

SEQ ID NO: 654909 - DNA, 25 bp, Rattus norvegicus
tgtttcccatggctgcagctcgagt

SEQ ID NO: 654910 - DNA, 25 bp, Rattus norvegicus
tgtttcccatgggtgcagctcgagt

SEQ ID NO: 654911 - DNA, 25 bp, Rattus norvegicus
tgtttccccaaaactctaatctgta

SEQ ID NO: 654912 - DNA, 25 bp, Rattus norvegicus
tgtttccccaaaccaaagtaagcat

SEQ ID NO: 654913 - DNA, 25 bp, Rattus norvegicus
tgtttccccaaacgcctggaacctg

SEQ ID NO: 654914 - DNA, 25 bp, Rattus norvegicus
tgtttccccaaactactgtgtcacc

SEQ ID NO: 654915 - DNA, 25 bp, Rattus norvegicus
tgtttccccaaagcaaagtaagcat

SEQ ID NO: 654916 - DNA, 25 bp, Rattus norvegicus
tgtttccccaaaggcctggaacctg

SEQ ID NO: 654917 - DNA, 25 bp, Rattus norvegicus
tgtttccccaaagtactgtgtcacc

SEQ ID NO: 654918 - DNA, 25 bp, Rattus norvegicus
tgtttccccaaatctctaatctgta

SEQ ID NO: 654919 - DNA, 25 bp, Rattus norvegicus
tgtttccccactccgttattatctc

SEQ ID NO: 654920 - DNA, 25 bp, Rattus norvegicus
tgtttccccactgcgttattatctc

SEQ ID NO: 654921 - DNA, 25 bp, Rattus norvegicus
tgtttcccctatcgctttgagagta

SEQ ID NO: 654922 - DNA, 25 bp, Rattus norvegicus
tgtttcccctatggctttgagagta

SEQ ID NO: 654923 - DNA, 25 bp, Rattus norvegicus
tgtttcccctctaaagtactttatg

SEQ ID NO: 654924 - DNA, 25 bp, Rattus norvegicus
tgtttcccctcttaagtactttatg

SEQ ID NO: 654925 - DNA, 25 bp, Rattus norvegicus
tgtttccccttgaaggtaacagaga

SEQ ID NO: 654926 - DNA, 25 bp, Rattus norvegicus
tgtttccccttgtaggtaacagaga

SEQ ID NO: 654927 - DNA, 25 bp, Rattus norvegicus
tgtttcccgggaccaggactattca

SEQ ID NO: 654928 - DNA, 25 bp, Rattus norvegicus
tgtttcccgggagcaggactattca

SEQ ID NO: 654929 - DNA, 25 bp, Rattus norvegicus
tgtttcccgggcattgttgtcgtct

SEQ ID NO: 654930 - DNA, 25 bp, Rattus norvegicus
tgtttcccgggctttgttgtcgtct

SEQ ID NO: 654931 - DNA, 25 bp, Rattus norvegicus
tgtttccctaaacagtggtttgtga

SEQ ID NO: 654932 - DNA, 25 bp, Rattus norvegicus
tgtttccctaaagagtggtttgtga

SEQ ID NO: 654933 - DNA, 25 bp, Rattus norvegicus
tgtttccctattctcatgtactctt

SEQ ID NO: 654934 - DNA, 25 bp, Rattus norvegicus
tgtttccctattgtcatgtactctt

SEQ ID NO: 654935 - DNA, 25 bp, Rattus norvegicus
tgtttccctctcataaggacttggc

SEQ ID NO: 654936 - DNA, 25 bp, Rattus norvegicus
tgtttccctctcttaaggacttggc

SEQ ID NO: 654937 - DNA, 25 bp, Rattus norvegicus
tgtttccctgacctcgatggagatt

SEQ ID NO: 654938 - DNA, 25 bp, Rattus norvegicus
tgtttccctgacgtcgatggagatt

SEQ ID NO: 654939 - DNA, 25 bp, Rattus norvegicus
tgtttccctttaccctcactgtaac

SEQ ID NO: 654940 - DNA, 25 bp, Rattus norvegicus
tgtttccctttagcctcactgtaac

SEQ ID NO: 654941 - DNA, 25 bp, Rattus norvegicus
tgtttccgtgtcagtctgttagcta

SEQ ID NO: 654942 - DNA, 25 bp, Rattus norvegicus
tgtttccgtgtctgtctgttagcta

SEQ ID NO: 654943 - DNA, 25 bp, Rattus norvegicus
tgtttcctacttcctattgctaatt

SEQ ID NO: 654944 - DNA, 25 bp, Rattus norvegicus
tgtttcctacttgctattgctaatt

SEQ ID NO: 654945 - DNA, 25 bp, Rattus norvegicus
tgtttcctaggacagctcatgctct

SEQ ID NO: 654946 - DNA, 25 bp, Rattus norvegicus
tgtttcctaggagagctcatgctct

SEQ ID NO: 654947 - DNA, 25 bp, Rattus norvegicus
tgtttcctagggagtcctcagcaga

SEQ ID NO: 654948 - DNA, 25 bp, Rattus norvegicus
tgtttcctagggtgtcctcagcaga

SEQ ID NO: 654949 - DNA, 25 bp, Rattus norvegicus
tgtttcctcagcaacaggagccgga

SEQ ID NO: 654950 - DNA, 25 bp, Rattus norvegicus
tgtttcctcagcactttcagggaga

SEQ ID NO: 654951 - DNA, 25 bp, Rattus norvegicus
tgtttcctcagctacaggagccgga

SEQ ID NO: 654952 - DNA, 25 bp, Rattus norvegicus
tgtttcctcagctctttcagggaga

SEQ ID NO: 654953 - DNA, 25 bp, Rattus norvegicus
tgtttcctcgaacccaaactgttag

SEQ ID NO: 654954 - DNA, 25 bp, Rattus norvegicus
tgtttcctcgaagccaaactgttag

SEQ ID NO: 654955 - DNA, 25 bp, Rattus norvegicus
tgtttcctctccaccctggagtaac

SEQ ID NO: 654956 - DNA, 25 bp, Rattus norvegicus
tgtttcctctcctccctggagtaac

SEQ ID NO: 654957 - DNA, 25 bp, Rattus norvegicus
tgtttcctcttcaagcacagtgatg

SEQ ID NO: 654958 - DNA, 25 bp, Rattus norvegicus
tgtttcctcttctagcacagtgatg

SEQ ID NO: 654959 - DNA, 25 bp, Rattus norvegicus
tgtttcctgaacatgatcttccttc

SEQ ID NO: 654960 - DNA, 25 bp, Rattus norvegicus
tgtttcctgaacttgatcttccttc

SEQ ID NO: 654961 - DNA, 25 bp, Rattus norvegicus
tgtttcctgccaattccggtgtccc

SEQ ID NO: 654962 - DNA, 25 bp, Rattus norvegicus
tgtttcctgccatttccggtgtccc

SEQ ID NO: 654963 - DNA, 25 bp, Rattus norvegicus
tgtttcctgctacttcacaaatggc

SEQ ID NO: 654964 - DNA, 25 bp, Rattus norvegicus
tgtttcctgctagttcacaaatggc

SEQ ID NO: 654965 - DNA, 25 bp, Rattus norvegicus
tgtttcctgctgcatcattcatgat

SEQ ID NO: 654966 - DNA, 25 bp, Rattus norvegicus
tgtttcctgctggatcattcatgat

SEQ ID NO: 654967 - DNA, 25 bp, Rattus norvegicus
tgtttcctgtcaccgtgggcagaga

SEQ ID NO: 654968 - DNA, 25 bp, Rattus norvegicus
tgtttcctgtcagcgtgggcagaga

SEQ ID NO: 654969 - DNA, 25 bp, Rattus norvegicus
tgtttcctgtgcaaatcatctatta

SEQ ID NO: 654970 - DNA, 25 bp, Rattus norvegicus
tgtttcctgtgctaatcatctatta

SEQ ID NO: 654971 - DNA, 25 bp, Rattus norvegicus
tgtttccttacccctacacatacat

SEQ ID NO: 654972 - DNA, 25 bp, Rattus norvegicus
tgtttccttaccgctacacatacat

SEQ ID NO: 654973 - DNA, 25 bp, Rattus norvegicus
tgtttccttattagtcttctttcta

SEQ ID NO: 654974 - DNA, 25 bp, Rattus norvegicus
tgtttccttatttgtcttctttcta

SEQ ID NO: 654975 - DNA, 25 bp, Rattus norvegicus
tgtttccttcccaactgagattgaa

SEQ ID NO: 654976 - DNA, 25 bp, Rattus norvegicus
tgtttccttccctactgagattgaa

SEQ ID NO: 654977 - DNA, 25 bp, Rattus norvegicus
tgtttccttcctccgttgacctgcg

SEQ ID NO: 654978 - DNA, 25 bp, Rattus norvegicus
tgtttccttcctgcgttgacctgcg

SEQ ID NO: 654979 - DNA, 25 bp, Rattus norvegicus
tgtttccttctccaagagtggccgc

SEQ ID NO: 654980 - DNA, 25 bp, Rattus norvegicus
tgtttccttctcgaagagtggccgc

SEQ ID NO: 654981 - DNA, 25 bp, Rattus norvegicus
tgtttccttctgatcctagttgttc

SEQ ID NO: 654982 - DNA, 25 bp, Rattus norvegicus
tgtttccttctgttcctagttgttc

SEQ ID NO: 654983 - DNA, 25 bp, Rattus norvegicus
tgtttccttcttacaaggtcagaga

SEQ ID NO: 654984 - DNA, 25 bp, Rattus norvegicus
tgtttccttctttcaaggtcagaga

SEQ ID NO: 654985 - DNA, 25 bp, Rattus norvegicus
tgtttccttgcaatttactctgaga

SEQ ID NO: 654986 - DNA, 25 bp, Rattus norvegicus
tgtttccttgcattttactctgaga

SEQ ID NO: 654987 - DNA, 25 bp, Rattus norvegicus
tgtttccttgtgaactccagcattg

SEQ ID NO: 654988 - DNA, 25 bp, Rattus norvegicus
tgtttccttgtgagctgagcactga

SEQ ID NO: 654989 - DNA, 25 bp, Rattus norvegicus
tgtttccttgtgtactccagcattg

SEQ ID NO: 654990 - DNA, 25 bp, Rattus norvegicus
tgtttccttgtgtgctgagcactga

SEQ ID NO: 654991 - DNA, 25 bp, Rattus norvegicus
tgtttcctttccatagtgaccaacg

SEQ ID NO: 654992 - DNA, 25 bp, Rattus norvegicus
tgtttcctttccttagtgaccaacg

SEQ ID NO: 654993 - DNA, 25 bp, Rattus norvegicus
tgtttcctttctcattctttttcct

SEQ ID NO: 654994 - DNA, 25 bp, Rattus norvegicus
tgtttcctttctgattctttttcct

SEQ ID NO: 654995 - DNA, 25 bp, Rattus norvegicus
tgtttcctttgaagccattccctaa

SEQ ID NO: 654996 - DNA, 25 bp, Rattus norvegicus
tgtttcctttgatgccattccctaa

SEQ ID NO: 654997 - DNA, 25 bp, Rattus norvegicus
tgtttcctttgcagttgccttggca

SEQ ID NO: 654998 - DNA, 25 bp, Rattus norvegicus
tgtttcctttgctgttgccttggca

SEQ ID NO: 654999 - DNA, 25 bp, Rattus norvegicus
tgtttcctttggattaagcggcagc

SEQ ID NO: 655000 - DNA, 25 bp, Rattus norvegicus
tgtttcctttggtttaagcggcagc

SEQ ID NO: 655001 - DNA, 25 bp, Rattus norvegicus
tgtttccttttcctaggctcatgaa

SEQ ID NO: 655002 - DNA, 25 bp, Rattus norvegicus
tgtttccttttcgtaggctcatgaa

SEQ ID NO: 655003 - DNA, 25 bp, Rattus norvegicus
tgtttcctttttaggctgaagaatg

SEQ ID NO: 655004 - DNA, 25 bp, Rattus norvegicus
tgtttcctttttccttcaagcattt

SEQ ID NO: 655005 - DNA, 25 bp, Rattus norvegicus
tgtttcctttttgcttcaagcattt

SEQ ID NO: 655006 - DNA, 25 bp, Rattus norvegicus
tgtttccttttttggctgaagaatg

SEQ ID NO: 655007 - DNA, 25 bp, Rattus norvegicus
tgtttcgaccacagtctggccgagt

SEQ ID NO: 655008 - DNA, 25 bp, Rattus norvegicus
tgtttcgaccactgtctggccgagt

SEQ ID NO: 655009 - DNA, 25 bp, Rattus norvegicus
tgtttcgacgaacctgacacagatt

SEQ ID NO: 655010 - DNA, 25 bp, Rattus norvegicus
tgtttcgacgaagctgacacagatt

SEQ ID NO: 655011 - DNA, 25 bp, Rattus norvegicus
tgtttcggcatgctagacacctgag

SEQ ID NO: 655012 - DNA, 25 bp, Rattus norvegicus
tgtttcggcatggtagacacctgag

SEQ ID NO: 655013 - DNA, 25 bp, Rattus norvegicus
tgtttcggccacaggcattgaccaa

SEQ ID NO: 655014 - DNA, 25 bp, Rattus norvegicus
tgtttcggccactggcattgaccaa

SEQ ID NO: 655015 - DNA, 25 bp, Rattus norvegicus
tgtttcgggtagacctgcattgcag

SEQ ID NO: 655016 - DNA, 25 bp, Rattus norvegicus
tgtttcgggtagtcctgcattgcag

SEQ ID NO: 655017 - DNA, 25 bp, Rattus norvegicus
tgtttcgttttcctgttgcatgaca

SEQ ID NO: 655018 - DNA, 25 bp, Rattus norvegicus
tgtttcgttttcgtgttgcatgaca

SEQ ID NO: 655019 - DNA, 25 bp, Rattus norvegicus
tgtttctaaagacagaccaccaggt

SEQ ID NO: 655020 - DNA, 25 bp, Rattus norvegicus
tgtttctaaagagagaccaccaggt

SEQ ID NO: 655021 - DNA, 25 bp, Rattus norvegicus
tgtttctaaccacaactgtcacctg

SEQ ID NO: 655022 - DNA, 25 bp, Rattus norvegicus
tgtttctaaccagaactgtcacctg

SEQ ID NO: 655023 - DNA, 25 bp, Rattus norvegicus
tgtttctaagtcacatcctactcac

SEQ ID NO: 655024 - DNA, 25 bp, Rattus norvegicus
tgtttctaagtctcatcctactcac

SEQ ID NO: 655025 - DNA, 25 bp, Rattus norvegicus
tgtttctaatttacggcaagcccca

SEQ ID NO: 655026 - DNA, 25 bp, Rattus norvegicus
tgtttctaattttcggcaagcccca

SEQ ID NO: 655027 - DNA, 25 bp, Rattus norvegicus
tgtttctacctaaactcagtcttgt

SEQ ID NO: 655028 - DNA, 25 bp, Rattus norvegicus
tgtttctacctaaggaaccttgtgg

SEQ ID NO: 655029 - DNA, 25 bp, Rattus norvegicus
tgtttctacctatactcagtcttgt

SEQ ID NO: 655030 - DNA, 25 bp, Rattus norvegicus
tgtttctacctatggaaccttgtgg

SEQ ID NO: 655031 - DNA, 25 bp, Rattus norvegicus
tgtttctagaagcactggcatttcc

SEQ ID NO: 655032 - DNA, 25 bp, Rattus norvegicus
tgtttctagaaggactggcatttcc

SEQ ID NO: 655033 - DNA, 25 bp, Rattus norvegicus
tgtttctagtaccttctcctgagag

SEQ ID NO: 655034 - DNA, 25 bp, Rattus norvegicus
tgtttctagtacgttctcctgagag

SEQ ID NO: 655035 - DNA, 25 bp, Rattus norvegicus
tgtttctagtcccttctttcattac

SEQ ID NO: 655036 - DNA, 25 bp, Rattus norvegicus
tgtttctagtccgttctttcattac

SEQ ID NO: 655037 - DNA, 25 bp, Rattus norvegicus
tgtttctagttaccactgccctgtg

SEQ ID NO: 655038 - DNA, 25 bp, Rattus norvegicus
tgtttctagttagcactgccctgtg

SEQ ID NO: 655039 - DNA, 25 bp, Rattus norvegicus
tgtttctataccagttcacagttct

SEQ ID NO: 655040 - DNA, 25 bp, Rattus norvegicus
tgtttctatacctgttcacagttct

SEQ ID NO: 655041 - DNA, 25 bp, Rattus norvegicus
tgtttctatcagagttgccctcctc

SEQ ID NO: 655042 - DNA, 25 bp, Rattus norvegicus
tgtttctatcagtgttgccctcctc

SEQ ID NO: 655043 - DNA, 25 bp, Rattus norvegicus
tgtttctatgttcccttttcgacca

SEQ ID NO: 655044 - DNA, 25 bp, Rattus norvegicus
tgtttctatgttgccttttcgacca

SEQ ID NO: 655045 - DNA, 25 bp, Rattus norvegicus
tgtttctcacaccaggaccgagtgg

SEQ ID NO: 655046 - DNA, 25 bp, Rattus norvegicus
tgtttctcacacgaggaccgagtgg

SEQ ID NO: 655047 - DNA, 25 bp, Rattus norvegicus
tgtttctcagtcattcttgcttttg

SEQ ID NO: 655048 - DNA, 25 bp, Rattus norvegicus
tgtttctcagtctttcttgcttttg

SEQ ID NO: 655049 - DNA, 25 bp, Rattus norvegicus
tgtttctcattaactctccgaggct

SEQ ID NO: 655050 - DNA, 25 bp, Rattus norvegicus
tgtttctcattatctctccgaggct

SEQ ID NO: 655051 - DNA, 25 bp, Rattus norvegicus
tgtttctccacaaggttctttctgt

SEQ ID NO: 655052 - DNA, 25 bp, Rattus norvegicus
tgtttctccacactctgtgtgatta

SEQ ID NO: 655053 - DNA, 25 bp, Rattus norvegicus
tgtttctccacagtctgtgtgatta

SEQ ID NO: 655054 - DNA, 25 bp, Rattus norvegicus
tgtttctccacatggttctttctgt

SEQ ID NO: 655055 - DNA, 25 bp, Rattus norvegicus
tgtttctccccaagtattatctctg

SEQ ID NO: 655056 - DNA, 25 bp, Rattus norvegicus
tgtttctccccatgtattatctctg

SEQ ID NO: 655057 - DNA, 25 bp, Rattus norvegicus
tgtttctcctttatgcagacgtgaa

SEQ ID NO: 655058 - DNA, 25 bp, Rattus norvegicus
tgtttctcctttttgcagacgtgaa

SEQ ID NO: 655059 - DNA, 25 bp, Rattus norvegicus
tgtttctcgcagatcaattcacctt

SEQ ID NO: 655060 - DNA, 25 bp, Rattus norvegicus
tgtttctcgcagttcaattcacctt

SEQ ID NO: 655061 - DNA, 25 bp, Rattus norvegicus
tgtttctctcagcagctgtgcacaa

SEQ ID NO: 655062 - DNA, 25 bp, Rattus norvegicus
tgtttctctcaggagctgtgcacaa

SEQ ID NO: 655063 - DNA, 25 bp, Rattus norvegicus
tgtttctctccgatgctagccagag

SEQ ID NO: 655064 - DNA, 25 bp, Rattus norvegicus
tgtttctctccgttgctagccagag

SEQ ID NO: 655065 - DNA, 25 bp, Rattus norvegicus
tgtttctctcttcctttcttcaaaa

SEQ ID NO: 655066 - DNA, 25 bp, Rattus norvegicus
tgtttctctcttgctttcttcaaaa

SEQ ID NO: 655067 - DNA, 25 bp, Rattus norvegicus
tgtttctctgctcctgtttgaatgc

SEQ ID NO: 655068 - DNA, 25 bp, Rattus norvegicus
tgtttctctgctctaccttttgtaa

SEQ ID NO: 655069 - DNA, 25 bp, Rattus norvegicus
tgtttctctgctgctgtttgaatgc

SEQ ID NO: 655070 - DNA, 25 bp, Rattus norvegicus
tgtttctctgctgtaccttttgtaa

SEQ ID NO: 655071 - DNA, 25 bp, Rattus norvegicus
tgtttctctggtatatggcttctgg

SEQ ID NO: 655072 - DNA, 25 bp, Rattus norvegicus
tgtttctctggtttatggcttctgg

SEQ ID NO: 655073 - DNA, 25 bp, Rattus norvegicus
tgtttctcttccatgttactgtatt

SEQ ID NO: 655074 - DNA, 25 bp, Rattus norvegicus
tgtttctcttccttgttactgtatt

SEQ ID NO: 655075 - DNA, 25 bp, Rattus norvegicus
tgtttctctttactgttgtttttga

SEQ ID NO: 655076 - DNA, 25 bp, Rattus norvegicus
tgtttctctttagtgttgtttttga

SEQ ID NO: 655077 - DNA, 25 bp, Rattus norvegicus
tgtttctctttgcttgatggtccca

SEQ ID NO: 655078 - DNA, 25 bp, Rattus norvegicus
tgtttctctttggttgatggtccca

SEQ ID NO: 655079 - DNA, 25 bp, Rattus norvegicus
tgtttctgccaaatttatgtcaaga

SEQ ID NO: 655080 - DNA, 25 bp, Rattus norvegicus
tgtttctgccaattttatgtcaaga

SEQ ID NO: 655081 - DNA, 25 bp, Rattus norvegicus
tgtttctggacaatctctttgataa

SEQ ID NO: 655082 - DNA, 25 bp, Rattus norvegicus
tgtttctggacattctctttgataa

SEQ ID NO: 655083 - DNA, 25 bp, Rattus norvegicus
tgtttctggagaacggctcactggg

SEQ ID NO: 655084 - DNA, 25 bp, Rattus norvegicus
tgtttctggagatcggctcactggg

SEQ ID NO: 655085 - DNA, 25 bp, Rattus norvegicus
tgtttctgtatcattgggtgaccct

SEQ ID NO: 655086 - DNA, 25 bp, Rattus norvegicus
tgtttctgtatctttgggtgaccct

SEQ ID NO: 655087 - DNA, 25 bp, Rattus norvegicus
tgtttctgtcaccattgagacgtaa

SEQ ID NO: 655088 - DNA, 25 bp, Rattus norvegicus
tgtttctgtcacgattgagacgtaa

SEQ ID NO: 655089 - DNA, 25 bp, Rattus norvegicus
tgtttctgtctgcagagagctggtc

SEQ ID NO: 655090 - DNA, 25 bp, Rattus norvegicus
tgtttctgtctggagagagctggtc

SEQ ID NO: 655091 - DNA, 25 bp, Rattus norvegicus
tgtttctgtggtacgtgtgtgtgca

SEQ ID NO: 655092 - DNA, 25 bp, Rattus norvegicus
tgtttctgtggttcgtgtgtgtgca

SEQ ID NO: 655093 - DNA, 25 bp, Rattus norvegicus
tgtttctgtgttattggtatgctaa

SEQ ID NO: 655094 - DNA, 25 bp, Rattus norvegicus
tgtttctgtgtttttggtatgctaa

SEQ ID NO: 655095 - DNA, 25 bp, Rattus norvegicus
tgtttctgtttaaatccgtcgtgtt

SEQ ID NO: 655096 - DNA, 25 bp, Rattus norvegicus
tgtttctgtttatatccgtcgtgtt

SEQ ID NO: 655097 - DNA, 25 bp, Rattus norvegicus
tgtttcttacatactgagctcttga

SEQ ID NO: 655098 - DNA, 25 bp, Rattus norvegicus
tgtttcttacattctgagctcttga

SEQ ID NO: 655099 - DNA, 25 bp, Rattus norvegicus
tgtttcttacttactctactcgtta

SEQ ID NO: 655100 - DNA, 25 bp, Rattus norvegicus
tgtttcttactttctctactcgtta

SEQ ID NO: 655101 - DNA, 25 bp, Rattus norvegicus
tgtttcttataccaacctttacagg

SEQ ID NO: 655102 - DNA, 25 bp, Rattus norvegicus
tgtttcttatacgaacctttacagg

SEQ ID NO: 655103 - DNA, 25 bp, Rattus norvegicus
tgtttcttattacactaggctggcc

SEQ ID NO: 655104 - DNA, 25 bp, Rattus norvegicus
tgtttcttattagactaggctggcc

SEQ ID NO: 655105 - DNA, 25 bp, Rattus norvegicus
tgtttcttcaacattactttccctg

SEQ ID NO: 655106 - DNA, 25 bp, Rattus norvegicus
tgtttcttcaactttactttccctg

SEQ ID NO: 655107 - DNA, 25 bp, Rattus norvegicus
tgtttcttcagcatcgtgccaggaa

SEQ ID NO: 655108 - DNA, 25 bp, Rattus norvegicus
tgtttcttcagcttcgtgccaggaa

SEQ ID NO: 655109 - DNA, 25 bp, Rattus norvegicus
tgtttcttcatcagtatggagagga

SEQ ID NO: 655110 - DNA, 25 bp, Rattus norvegicus
tgtttcttcatctgtatggagagga

SEQ ID NO: 655111 - DNA, 25 bp, Rattus norvegicus
tgtttcttcatgaatctctacagta

SEQ ID NO: 655112 - DNA, 25 bp, Rattus norvegicus
tgtttcttcatgtatctctacagta

SEQ ID NO: 655113 - DNA, 25 bp, Rattus norvegicus
tgtttcttcctcagttgacatttcc

SEQ ID NO: 655114 - DNA, 25 bp, Rattus norvegicus
tgtttcttcctctgttgacatttcc

SEQ ID NO: 655115 - DNA, 25 bp, Rattus norvegicus
tgtttcttccttaatttcttcatgt

SEQ ID NO: 655116 - DNA, 25 bp, Rattus norvegicus
tgtttcttcctttatttcttcatgt

SEQ ID NO: 655117 - DNA, 25 bp, Rattus norvegicus
tgtttcttcttgcaacccgctgtaa

SEQ ID NO: 655118 - DNA, 25 bp, Rattus norvegicus
tgtttcttcttggaacccgctgtaa

SEQ ID NO: 655119 - DNA, 25 bp, Rattus norvegicus
tgtttcttgcaccatgtgagcatga

SEQ ID NO: 655120 - DNA, 25 bp, Rattus norvegicus
tgtttcttgcacgatgtgagcatga

SEQ ID NO: 655121 - DNA, 25 bp, Rattus norvegicus
tgtttcttggccatacctgaggctc

SEQ ID NO: 655122 - DNA, 25 bp, Rattus norvegicus
tgtttcttggccttacctgaggctc

SEQ ID NO: 655123 - DNA, 25 bp, Rattus norvegicus
tgtttctttccactgcctgcttctg

SEQ ID NO: 655124 - DNA, 25 bp, Rattus norvegicus
tgtttctttccagtgcctgcttctg

SEQ ID NO: 655125 - DNA, 25 bp, Rattus norvegicus
tgtttctttgttactgccccagtac

SEQ ID NO: 655126 - DNA, 25 bp, Rattus norvegicus
tgtttctttgtttctgccccagtac

SEQ ID NO: 655127 - DNA, 25 bp, Rattus norvegicus
tgtttcttttctatgatttcgttcg

SEQ ID NO: 655128 - DNA, 25 bp, Rattus norvegicus
tgtttcttttctttgatttcgttcg

SEQ ID NO: 655129 - DNA, 25 bp, Rattus norvegicus
tgtttgaaaactagactcgcccctt

SEQ ID NO: 655130 - DNA, 25 bp, Rattus norvegicus
tgtttgaaaacttgactcgcccctt

SEQ ID NO: 655131 - DNA, 25 bp, Rattus norvegicus
tgtttgaaatccctcaccaagtttt

SEQ ID NO: 655132 - DNA, 25 bp, Rattus norvegicus
tgtttgaaatccgtcaccaagtttt

SEQ ID NO: 655133 - DNA, 25 bp, Rattus norvegicus
tgtttgaaatgactccagccctgtg

SEQ ID NO: 655134 - DNA, 25 bp, Rattus norvegicus
tgtttgaaatgagtccagccctgtg

SEQ ID NO: 655135 - DNA, 25 bp, Rattus norvegicus
tgtttgaactgtctacgctgtgcct

SEQ ID NO: 655136 - DNA, 25 bp, Rattus norvegicus
tgtttgaactgtgtacgctgtgcct

SEQ ID NO: 655137 - DNA, 25 bp, Rattus norvegicus
tgtttgaagaacactcccgatccgt

SEQ ID NO: 655138 - DNA, 25 bp, Rattus norvegicus
tgtttgaagaactctcccgatccgt

SEQ ID NO: 655139 - DNA, 25 bp, Rattus norvegicus
tgtttgaagagaccgcagagttact

SEQ ID NO: 655140 - DNA, 25 bp, Rattus norvegicus
tgtttgaagagagcgcagagttact

SEQ ID NO: 655141 - DNA, 25 bp, Rattus norvegicus
tgtttgaatcccaggctcagctgaa

SEQ ID NO: 655142 - DNA, 25 bp, Rattus norvegicus
tgtttgaatccctggctcagctgaa

SEQ ID NO: 655143 - DNA, 25 bp, Rattus norvegicus
tgtttgaattctatggctttgacca

SEQ ID NO: 655144 - DNA, 25 bp, Rattus norvegicus
tgtttgaattctttggctttgacca

SEQ ID NO: 655145 - DNA, 25 bp, Rattus norvegicus
tgtttgacaggacccccctctttac

SEQ ID NO: 655146 - DNA, 25 bp, Rattus norvegicus
tgtttgacaggagccccctctttac

SEQ ID NO: 655147 - DNA, 25 bp, Rattus norvegicus
tgtttgaccacaacgtctcctgcat

SEQ ID NO: 655148 - DNA, 25 bp, Rattus norvegicus
tgtttgaccacatcgtctcctgcat

SEQ ID NO: 655149 - DNA, 25 bp, Rattus norvegicus
tgtttgacccacagtaatgacttac

SEQ ID NO: 655150 - DNA, 25 bp, Rattus norvegicus
tgtttgacccactgtaatgacttac

SEQ ID NO: 655151 - DNA, 25 bp, Rattus norvegicus
tgtttgaccggactccaactggaga

SEQ ID NO: 655152 - DNA, 25 bp, Rattus norvegicus
tgtttgaccggagtccaactggaga

SEQ ID NO: 655153 - DNA, 25 bp, Rattus norvegicus
tgtttgactaacagtccagcaggcc

SEQ ID NO: 655154 - DNA, 25 bp, Rattus norvegicus
tgtttgactaactgtccagcaggcc

SEQ ID NO: 655155 - DNA, 25 bp, Rattus norvegicus
tgtttgactgtgcactgggctctga

SEQ ID NO: 655156 - DNA, 25 bp, Rattus norvegicus
tgtttgactgtggactgggctctga

SEQ ID NO: 655157 - DNA, 25 bp, Rattus norvegicus
tgtttgagactgctctgctctcctc

SEQ ID NO: 655158 - DNA, 25 bp, Rattus norvegicus
tgtttgagactggtctgctctcctc

SEQ ID NO: 655159 - DNA, 25 bp, Rattus norvegicus
tgtttgagagccattacctaccatt

SEQ ID NO: 655160 - DNA, 25 bp, Rattus norvegicus
tgtttgagagcctttacctaccatt

SEQ ID NO: 655161 - DNA, 25 bp, Rattus norvegicus
tgtttgagcagtctttggcctggaa

SEQ ID NO: 655162 - DNA, 25 bp, Rattus norvegicus
tgtttgagcagtgtttggcctggaa

SEQ ID NO: 655163 - DNA, 25 bp, Rattus norvegicus
tgtttgagcctcagcgtgagaggat

SEQ ID NO: 655164 - DNA, 25 bp, Rattus norvegicus
tgtttgagcctctgcgtgagaggat

SEQ ID NO: 655165 - DNA, 25 bp, Rattus norvegicus
tgtttgagcgacatgctgctgaacc

SEQ ID NO: 655166 - DNA, 25 bp, Rattus norvegicus
tgtttgagcgacttgctgctgaacc

SEQ ID NO: 655167 - DNA, 25 bp, Rattus norvegicus
tgtttgaggcaaacgctcactatat

SEQ ID NO: 655168 - DNA, 25 bp, Rattus norvegicus
tgtttgaggcaatcgctcactatat

SEQ ID NO: 655169 - DNA, 25 bp, Rattus norvegicus
tgtttgagggtcagccacatggtag

SEQ ID NO: 655170 - DNA, 25 bp, Rattus norvegicus
tgtttgagggtctgccacatggtag

SEQ ID NO: 655171 - DNA, 25 bp, Rattus norvegicus
tgtttgagtttcaccgcactgtata

SEQ ID NO: 655172 - DNA, 25 bp, Rattus norvegicus
tgtttgagtttctccgcactgtata

SEQ ID NO: 655173 - DNA, 25 bp, Rattus norvegicus
tgtttgatgagaagcctggacccag

SEQ ID NO: 655174 - DNA, 25 bp, Rattus norvegicus
tgtttgatgagatgcctggacccag

SEQ ID NO: 655175 - DNA, 25 bp, Rattus norvegicus
tgtttgatgtcaataccccattcaa

SEQ ID NO: 655176 - DNA, 25 bp, Rattus norvegicus
tgtttgatgtcattaccccattcaa

SEQ ID NO: 655177 - DNA, 25 bp, Rattus norvegicus
tgtttgcaaaacactctcctagata

SEQ ID NO: 655178 - DNA, 25 bp, Rattus norvegicus
tgtttgcaaaactctctcctagata

SEQ ID NO: 655179 - DNA, 25 bp, Rattus norvegicus
tgtttgcaagcacgtagctgaggct

SEQ ID NO: 655180 - DNA, 25 bp, Rattus norvegicus
tgtttgcaagcaggtagctgaggct

SEQ ID NO: 655181 - DNA, 25 bp, Rattus norvegicus
tgtttgcaataaaggcctacaagac

SEQ ID NO: 655182 - DNA, 25 bp, Rattus norvegicus
tgtttgcaataatggcctacaagac

SEQ ID NO: 655183 - DNA, 25 bp, Rattus norvegicus
tgtttgcacaaaacagccactgtat

SEQ ID NO: 655184 - DNA, 25 bp, Rattus norvegicus
tgtttgcacaaatcagccactgtat

SEQ ID NO: 655185 - DNA, 25 bp, Rattus norvegicus
tgtttgcagacgactcctcgggaga

SEQ ID NO: 655186 - DNA, 25 bp, Rattus norvegicus
tgtttgcagacgtctcctcgggaga

SEQ ID NO: 655187 - DNA, 25 bp, Rattus norvegicus
tgtttgcaggctctttgtgaccaac

SEQ ID NO: 655188 - DNA, 25 bp, Rattus norvegicus
tgtttgcaggctgtttgtgaccaac

SEQ ID NO: 655189 - DNA, 25 bp, Rattus norvegicus
tgtttgcagtacaaagcttcccatc

SEQ ID NO: 655190 - DNA, 25 bp, Rattus norvegicus
tgtttgcagtactaagcttcccatc

SEQ ID NO: 655191 - DNA, 25 bp, Rattus norvegicus
tgtttgcagtccaggctccagggcc

SEQ ID NO: 655192 - DNA, 25 bp, Rattus norvegicus
tgtttgcagtcctggctccagggcc

SEQ ID NO: 655193 - DNA, 25 bp, Rattus norvegicus
tgtttgcatgcaacttccaccatgc

SEQ ID NO: 655194 - DNA, 25 bp, Rattus norvegicus
tgtttgcatgcatcttccaccatgc

SEQ ID NO: 655195 - DNA, 25 bp, Rattus norvegicus
tgtttgcattctaacccctgtggtt

SEQ ID NO: 655196 - DNA, 25 bp, Rattus norvegicus
tgtttgcattcttacccctgtggtt

SEQ ID NO: 655197 - DNA, 25 bp, Rattus norvegicus
tgtttgcatttccttttcccaagaa

SEQ ID NO: 655198 - DNA, 25 bp, Rattus norvegicus
tgtttgcatttcgttttcccaagaa

SEQ ID NO: 655199 - DNA, 25 bp, Rattus norvegicus
tgtttgccactcagctctgataaga

SEQ ID NO: 655200 - DNA, 25 bp, Rattus norvegicus
tgtttgccactccacacagagttaa

SEQ ID NO: 655201 - DNA, 25 bp, Rattus norvegicus
tgtttgccactcgacacagagttaa

SEQ ID NO: 655202 - DNA, 25 bp, Rattus norvegicus
tgtttgccactctgctctgataaga

SEQ ID NO: 655203 - DNA, 25 bp, Rattus norvegicus
tgtttgcccaacattgcttctaaat

SEQ ID NO: 655204 - DNA, 25 bp, Rattus norvegicus
tgtttgcccaactttgcttctaaat

SEQ ID NO: 655205 - DNA, 25 bp, Rattus norvegicus
tgtttgcccgccagtctgccaggct

SEQ ID NO: 655206 - DNA, 25 bp, Rattus norvegicus
tgtttgcccgcctgtctgccaggct

SEQ ID NO: 655207 - DNA, 25 bp, Rattus norvegicus
tgtttgccgcctaggatccgtacat

SEQ ID NO: 655208 - DNA, 25 bp, Rattus norvegicus
tgtttgccgccttggatccgtacat

SEQ ID NO: 655209 - DNA, 25 bp, Rattus norvegicus
tgtttgcctataaggatgcctgtat

SEQ ID NO: 655210 - DNA, 25 bp, Rattus norvegicus
tgtttgcctatatggatgcctgtat

SEQ ID NO: 655211 - DNA, 25 bp, Rattus norvegicus
tgtttgcctcaaacgctgtgtttaa

SEQ ID NO: 655212 - DNA, 25 bp, Rattus norvegicus
tgtttgcctcaatcgctgtgtttaa

SEQ ID NO: 655213 - DNA, 25 bp, Rattus norvegicus
tgtttgcctgtacccgggacagcta

SEQ ID NO: 655214 - DNA, 25 bp, Rattus norvegicus
tgtttgcctgtagccgggacagcta

SEQ ID NO: 655215 - DNA, 25 bp, Rattus norvegicus
tgtttgccttgaactctatgagtct

SEQ ID NO: 655216 - DNA, 25 bp, Rattus norvegicus
tgtttgccttgatctctatgagtct

SEQ ID NO: 655217 - DNA, 25 bp, Rattus norvegicus
tgtttgccttgcagtgttccttcta

SEQ ID NO: 655218 - DNA, 25 bp, Rattus norvegicus
tgtttgccttgctgtgttccttcta

SEQ ID NO: 655219 - DNA, 25 bp, Rattus norvegicus
tgtttgcgagtgatcttgagccagg

SEQ ID NO: 655220 - DNA, 25 bp, Rattus norvegicus
tgtttgcgagtgttcttgagccagg

SEQ ID NO: 655221 - DNA, 25 bp, Rattus norvegicus
tgtttgctagcacacgtacttcctg

SEQ ID NO: 655222 - DNA, 25 bp, Rattus norvegicus
tgtttgctagcagacgtacttcctg

SEQ ID NO: 655223 - DNA, 25 bp, Rattus norvegicus
tgtttgctcactctgcacaggttgt

SEQ ID NO: 655224 - DNA, 25 bp, Rattus norvegicus
tgtttgctcactgtgcacaggttgt

SEQ ID NO: 655225 - DNA, 25 bp, Rattus norvegicus
tgtttgctccaacagccacatagga

SEQ ID NO: 655226 - DNA, 25 bp, Rattus norvegicus
tgtttgctccaagagccacatagga

SEQ ID NO: 655227 - DNA, 25 bp, Rattus norvegicus
tgtttgctccccagaagttacagat

SEQ ID NO: 655228 - DNA, 25 bp, Rattus norvegicus
tgtttgctcccctgaagttacagat

SEQ ID NO: 655229 - DNA, 25 bp, Rattus norvegicus
tgtttgctcctaaatgtcctgacat

SEQ ID NO: 655230 - DNA, 25 bp, Rattus norvegicus
tgtttgctcctatatgtcctgacat

SEQ ID NO: 655231 - DNA, 25 bp, Rattus norvegicus
tgtttgctcctgagcttcaaggcag

SEQ ID NO: 655232 - DNA, 25 bp, Rattus norvegicus
tgtttgctcctgtgcttcaaggcag

SEQ ID NO: 655233 - DNA, 25 bp, Rattus norvegicus
tgtttgctgaccattttactttttg

SEQ ID NO: 655234 - DNA, 25 bp, Rattus norvegicus
tgtttgctgacctttttactttttg

SEQ ID NO: 655235 - DNA, 25 bp, Rattus norvegicus
tgtttgctgcccaggtggagtatgc

SEQ ID NO: 655236 - DNA, 25 bp, Rattus norvegicus
tgtttgctgccctggtggagtatgc

SEQ ID NO: 655237 - DNA, 25 bp, Rattus norvegicus
tgtttgctggtgaagacatctccgc

SEQ ID NO: 655238 - DNA, 25 bp, Rattus norvegicus
tgtttgctggtgtagacatctccgc

SEQ ID NO: 655239 - DNA, 25 bp, Rattus norvegicus
tgtttgcttcctctgccgtggtatc

SEQ ID NO: 655240 - DNA, 25 bp, Rattus norvegicus
tgtttgcttcctgtgccgtggtatc

SEQ ID NO: 655241 - DNA, 25 bp, Rattus norvegicus
tgtttgcttctcacctgacagaaaa

SEQ ID NO: 655242 - DNA, 25 bp, Rattus norvegicus
tgtttgcttctctcctgacagaaaa

SEQ ID NO: 655243 - DNA, 25 bp, Rattus norvegicus
tgtttgcttgccattatgcactggg

SEQ ID NO: 655244 - DNA, 25 bp, Rattus norvegicus
tgtttgcttgcctttatgcactggg

SEQ ID NO: 655245 - DNA, 25 bp, Rattus norvegicus
tgtttgcttgttactcagaggtttt

SEQ ID NO: 655246 - DNA, 25 bp, Rattus norvegicus
tgtttgcttgtttctcagaggtttt

SEQ ID NO: 655247 - DNA, 25 bp, Rattus norvegicus
tgtttgctttcccataccacataag

SEQ ID NO: 655248 - DNA, 25 bp, Rattus norvegicus
tgtttgctttccgataccacataag

SEQ ID NO: 655249 - DNA, 25 bp, Rattus norvegicus
tgtttggacggtccgcaggactcct

SEQ ID NO: 655250 - DNA, 25 bp, Rattus norvegicus
tgtttggacggtgcgcaggactcct

SEQ ID NO: 655251 - DNA, 25 bp, Rattus norvegicus
tgtttggactggatctgcacttaga

SEQ ID NO: 655252 - DNA, 25 bp, Rattus norvegicus
tgtttggactggttctgcacttaga

SEQ ID NO: 655253 - DNA, 25 bp, Rattus norvegicus
tgtttggatccccatcagcatgtgg

SEQ ID NO: 655254 - DNA, 25 bp, Rattus norvegicus
tgtttggatcccgatcagcatgtgg

SEQ ID NO: 655255 - DNA, 25 bp, Rattus norvegicus
tgtttggcagccctcctacttttgg

SEQ ID NO: 655256 - DNA, 25 bp, Rattus norvegicus
tgtttggcagccgtcctacttttgg

SEQ ID NO: 655257 - DNA, 25 bp, Rattus norvegicus
tgtttggcctccagagatacgcagt

SEQ ID NO: 655258 - DNA, 25 bp, Rattus norvegicus
tgtttggcctcctgagatacgcagt

SEQ ID NO: 655259 - DNA, 25 bp, Rattus norvegicus
tgtttggctgaaaaacccaacactt

SEQ ID NO: 655260 - DNA, 25 bp, Rattus norvegicus
tgtttggctgaataacccaacactt

SEQ ID NO: 655261 - DNA, 25 bp, Rattus norvegicus
tgtttggcttcaaggatcactgtcc

SEQ ID NO: 655262 - DNA, 25 bp, Rattus norvegicus
tgtttggcttcatggatcactgtcc

SEQ ID NO: 655263 - DNA, 25 bp, Rattus norvegicus
tgtttggctttgaaactatgcttca

SEQ ID NO: 655264 - DNA, 25 bp, Rattus norvegicus
tgtttggctttgtaactatgcttca

SEQ ID NO: 655265 - DNA, 25 bp, Rattus norvegicus
tgtttgggccaactcacgaatgcaa

SEQ ID NO: 655266 - DNA, 25 bp, Rattus norvegicus
tgtttgggccaagtcacgaatgcaa

SEQ ID NO: 655267 - DNA, 25 bp, Rattus norvegicus
tgtttgggttttatcgtacttgact

SEQ ID NO: 655268 - DNA, 25 bp, Rattus norvegicus
tgtttgggttttttcgtacttgact

SEQ ID NO: 655269 - DNA, 25 bp, Rattus norvegicus
tgtttggtaccacccattggcgata

SEQ ID NO: 655270 - DNA, 25 bp, Rattus norvegicus
tgtttggtaccagccattggcgata

SEQ ID NO: 655271 - DNA, 25 bp, Rattus norvegicus
tgtttggtccttacccaatgtggaa

SEQ ID NO: 655272 - DNA, 25 bp, Rattus norvegicus
tgtttggtcctttcccaatgtggaa

SEQ ID NO: 655273 - DNA, 25 bp, Rattus norvegicus
tgtttggtgatgactctgagatctc

SEQ ID NO: 655274 - DNA, 25 bp, Rattus norvegicus
tgtttggtgatgtctctgagatctc

SEQ ID NO: 655275 - DNA, 25 bp, Rattus norvegicus
tgtttggtgggtacctgctttcctc

SEQ ID NO: 655276 - DNA, 25 bp, Rattus norvegicus
tgtttggtgggttcctgctttcctc

SEQ ID NO: 655277 - DNA, 25 bp, Rattus norvegicus
tgtttggttaacacagccagcaccc

SEQ ID NO: 655278 - DNA, 25 bp, Rattus norvegicus
tgtttggttaactcagccagcaccc

SEQ ID NO: 655279 - DNA, 25 bp, Rattus norvegicus
tgtttggttgaacgcctggcaacag

SEQ ID NO: 655280 - DNA, 25 bp, Rattus norvegicus
tgtttggttgaaggcctggcaacag

SEQ ID NO: 655281 - DNA, 25 bp, Rattus norvegicus
tgtttggttttacatgtgcccctgc

SEQ ID NO: 655282 - DNA, 25 bp, Rattus norvegicus
tgtttggttttagatgtgcccctgc

SEQ ID NO: 655283 - DNA, 25 bp, Rattus norvegicus
tgtttggttttgaggtctgtgcccc

SEQ ID NO: 655284 - DNA, 25 bp, Rattus norvegicus
tgtttggttttgtggtctgtgcccc

SEQ ID NO: 655285 - DNA, 25 bp, Rattus norvegicus
tgtttgtaaagcaccttcagttctt

SEQ ID NO: 655286 - DNA, 25 bp, Rattus norvegicus
tgtttgtaaagctccttcagttctt

SEQ ID NO: 655287 - DNA, 25 bp, Rattus norvegicus
tgtttgtaacttcatgcagcatcgc

SEQ ID NO: 655288 - DNA, 25 bp, Rattus norvegicus
tgtttgtaacttgatgcagcatcgc

SEQ ID NO: 655289 - DNA, 25 bp, Rattus norvegicus
tgtttgtacacacgctggcatggag

SEQ ID NO: 655290 - DNA, 25 bp, Rattus norvegicus
tgtttgtacacacttatatttttta

SEQ ID NO: 655291 - DNA, 25 bp, Rattus norvegicus
tgtttgtacacaggctggcatggag

SEQ ID NO: 655292 - DNA, 25 bp, Rattus norvegicus
tgtttgtacacagttatatttttta

SEQ ID NO: 655293 - DNA, 25 bp, Rattus norvegicus
tgtttgtactccaccaaccggagaa

SEQ ID NO: 655294 - DNA, 25 bp, Rattus norvegicus
tgtttgtactcctccaaccggagaa

SEQ ID NO: 655295 - DNA, 25 bp, Rattus norvegicus
tgtttgtatctcaatgtatgctggg

SEQ ID NO: 655296 - DNA, 25 bp, Rattus norvegicus
tgtttgtatctctatgtatgctggg

SEQ ID NO: 655297 - DNA, 25 bp, Rattus norvegicus
tgtttgtcaagaattcgcccactct

SEQ ID NO: 655298 - DNA, 25 bp, Rattus norvegicus
tgtttgtcaagatttcgcccactct

SEQ ID NO: 655299 - DNA, 25 bp, Rattus norvegicus
tgtttgtccactctactgctgctgt

SEQ ID NO: 655300 - DNA, 25 bp, Rattus norvegicus
tgtttgtccactgtactgctgctgt

SEQ ID NO: 655301 - DNA, 25 bp, Rattus norvegicus
tgtttgtcccacacggttactgata

SEQ ID NO: 655302 - DNA, 25 bp, Rattus norvegicus
tgtttgtcccactcggttactgata

SEQ ID NO: 655303 - DNA, 25 bp, Rattus norvegicus
tgtttgtccccaatgttactggact

SEQ ID NO: 655304 - DNA, 25 bp, Rattus norvegicus
tgtttgtccccattgttactggact

SEQ ID NO: 655305 - DNA, 25 bp, Rattus norvegicus
tgtttgtccccgagtctcaccagtg

SEQ ID NO: 655306 - DNA, 25 bp, Rattus norvegicus
tgtttgtccccgtgtctcaccagtg

SEQ ID NO: 655307 - DNA, 25 bp, Rattus norvegicus
tgtttgtcgctaaccacacatatct

SEQ ID NO: 655308 - DNA, 25 bp, Rattus norvegicus
tgtttgtcgctatccacacatatct

SEQ ID NO: 655309 - DNA, 25 bp, Rattus norvegicus
tgtttgtctatcatggaccgtctga

SEQ ID NO: 655310 - DNA, 25 bp, Rattus norvegicus
tgtttgtctatcttggaccgtctga

SEQ ID NO: 655311 - DNA, 25 bp, Rattus norvegicus
tgtttgtctcagagaacctccagct

SEQ ID NO: 655312 - DNA, 25 bp, Rattus norvegicus
tgtttgtctcagtgaacctccagct

SEQ ID NO: 655313 - DNA, 25 bp, Rattus norvegicus
tgtttgtctctgattagcatgccct

SEQ ID NO: 655314 - DNA, 25 bp, Rattus norvegicus
tgtttgtctctgtttagcatgccct

SEQ ID NO: 655315 - DNA, 25 bp, Rattus norvegicus
tgtttgtctcttccctatgacccca

SEQ ID NO: 655316 - DNA, 25 bp, Rattus norvegicus
tgtttgtctcttgcctatgacccca

SEQ ID NO: 655317 - DNA, 25 bp, Rattus norvegicus
tgtttgtctgaaaccacgtgctcca

SEQ ID NO: 655318 - DNA, 25 bp, Rattus norvegicus
tgtttgtctgaatccacgtgctcca

SEQ ID NO: 655319 - DNA, 25 bp, Rattus norvegicus
tgtttgtctgctatagtctgtttcc

SEQ ID NO: 655320 - DNA, 25 bp, Rattus norvegicus
tgtttgtctgctttagtctgtttcc

SEQ ID NO: 655321 - DNA, 25 bp, Rattus norvegicus
tgtttgtctggtccatttcacgttc

SEQ ID NO: 655322 - DNA, 25 bp, Rattus norvegicus
tgtttgtctggtgcatttcacgttc

SEQ ID NO: 655323 - DNA, 25 bp, Rattus norvegicus
tgtttgtgagcccactgatcatcat

SEQ ID NO: 655324 - DNA, 25 bp, Rattus norvegicus
tgtttgtgagccgactgatcatcat

SEQ ID NO: 655325 - DNA, 25 bp, Rattus norvegicus
tgtttgtgcacaaatctgatccttg

SEQ ID NO: 655326 - DNA, 25 bp, Rattus norvegicus
tgtttgtgcacatatctgatccttg

SEQ ID NO: 655327 - DNA, 25 bp, Rattus norvegicus
tgtttgtgcattcttgtacctcgac

SEQ ID NO: 655328 - DNA, 25 bp, Rattus norvegicus
tgtttgtgcattgttgtacctcgac

SEQ ID NO: 655329 - DNA, 25 bp, Rattus norvegicus
tgtttgtggctgactgacggacatt

SEQ ID NO: 655330 - DNA, 25 bp, Rattus norvegicus
tgtttgtggctgtctgacggacatt

SEQ ID NO: 655331 - DNA, 25 bp, Rattus norvegicus
tgtttgtggtccaccatgtttgtgc

SEQ ID NO: 655332 - DNA, 25 bp, Rattus norvegicus
tgtttgtggtcctccatgtttgtgc

SEQ ID NO: 655333 - DNA, 25 bp, Rattus norvegicus
tgtttgtgtctcaggcatggccacc

SEQ ID NO: 655334 - DNA, 25 bp, Rattus norvegicus
tgtttgtgtctctggcatggccacc

SEQ ID NO: 655335 - DNA, 25 bp, Rattus norvegicus
tgtttgtgtgaacacaccgcgttcc

SEQ ID NO: 655336 - DNA, 25 bp, Rattus norvegicus
tgtttgtgtgaagacaccgcgttcc

SEQ ID NO: 655337 - DNA, 25 bp, Rattus norvegicus
tgtttgttaacccttctgacgccat

SEQ ID NO: 655338 - DNA, 25 bp, Rattus norvegicus
tgtttgttaaccgttctgacgccat

SEQ ID NO: 655339 - DNA, 25 bp, Rattus norvegicus
tgtttgttaattctagctttttggt

SEQ ID NO: 655340 - DNA, 25 bp, Rattus norvegicus
tgtttgttaattgtagctttttggt

SEQ ID NO: 655341 - DNA, 25 bp, Rattus norvegicus
tgtttgttcgcccttgccaagaatc

SEQ ID NO: 655342 - DNA, 25 bp, Rattus norvegicus
tgtttgttcgccgttgccaagaatc

SEQ ID NO: 655343 - DNA, 25 bp, Rattus norvegicus
tgtttgttctgtcactgtaggcgga

SEQ ID NO: 655344 - DNA, 25 bp, Rattus norvegicus
tgtttgttctgtgactgtaggcgga

SEQ ID NO: 655345 - DNA, 25 bp, Rattus norvegicus
tgtttgttcttaacgtgtcacgaga

SEQ ID NO: 655346 - DNA, 25 bp, Rattus norvegicus
tgtttgttcttatcgtgtcacgaga

SEQ ID NO: 655347 - DNA, 25 bp, Rattus norvegicus
tgtttgttgcccagtctttccttgt

SEQ ID NO: 655348 - DNA, 25 bp, Rattus norvegicus
tgtttgttgcccctggtaagtgaaa

SEQ ID NO: 655349 - DNA, 25 bp, Rattus norvegicus
tgtttgttgcccgtggtaagtgaaa

SEQ ID NO: 655350 - DNA, 25 bp, Rattus norvegicus
tgtttgttgccctgtctttccttgt

SEQ ID NO: 655351 - DNA, 25 bp, Rattus norvegicus
tgtttgttgctgcttatttctccat

SEQ ID NO: 655352 - DNA, 25 bp, Rattus norvegicus
tgtttgttgctggttatttctccat

SEQ ID NO: 655353 - DNA, 25 bp, Rattus norvegicus
tgtttgttgttgactccccctgcct

SEQ ID NO: 655354 - DNA, 25 bp, Rattus norvegicus
tgtttgttgttgtctccccctgcct

SEQ ID NO: 655355 - DNA, 25 bp, Rattus norvegicus
tgtttgtttctgctagccagggccc

SEQ ID NO: 655356 - DNA, 25 bp, Rattus norvegicus
tgtttgtttctggtagccagggccc

SEQ ID NO: 655357 - DNA, 25 bp, Rattus norvegicus
tgtttgtttgtcactctccaatgga

SEQ ID NO: 655358 - DNA, 25 bp, Rattus norvegicus
tgtttgtttgtcctggtctgcatcc

SEQ ID NO: 655359 - DNA, 25 bp, Rattus norvegicus
tgtttgtttgtcgtggtctgcatcc

SEQ ID NO: 655360 - DNA, 25 bp, Rattus norvegicus
tgtttgtttgtctctctccaatgga

SEQ ID NO: 655361 - DNA, 25 bp, Rattus norvegicus
tgtttgttttccaatcgcagtgcat

SEQ ID NO: 655362 - DNA, 25 bp, Rattus norvegicus
tgtttgttttcctatcgcagtgcat

SEQ ID NO: 655363 - DNA, 25 bp, Rattus norvegicus
tgtttgttttggctcaggttcattt

SEQ ID NO: 655364 - DNA, 25 bp, Rattus norvegicus
tgtttgttttgggtcaggttcattt

SEQ ID NO: 655365 - DNA, 25 bp, Rattus norvegicus
tgttttaagcctcaccctgggctct

SEQ ID NO: 655366 - DNA, 25 bp, Rattus norvegicus
tgttttaagcctgaccctgggctct

SEQ ID NO: 655367 - DNA, 25 bp, Rattus norvegicus
tgttttaatcacactcaaggctttg

SEQ ID NO: 655368 - DNA, 25 bp, Rattus norvegicus
tgttttaatcactctcaaggctttg

SEQ ID NO: 655369 - DNA, 25 bp, Rattus norvegicus
tgttttaatttgaactttgcccaat

SEQ ID NO: 655370 - DNA, 25 bp, Rattus norvegicus
tgttttaatttgtactttgcccaat

SEQ ID NO: 655371 - DNA, 25 bp, Rattus norvegicus
tgttttacagagatggtgcgcacca

SEQ ID NO: 655372 - DNA, 25 bp, Rattus norvegicus
tgttttacagagttggtgcgcacca

SEQ ID NO: 655373 - DNA, 25 bp, Rattus norvegicus
tgttttacattccatttcgttcgtg

SEQ ID NO: 655374 - DNA, 25 bp, Rattus norvegicus
tgttttacattcgatttcgttcgtg

SEQ ID NO: 655375 - DNA, 25 bp, Rattus norvegicus
tgttttacccttactactttgtcag

SEQ ID NO: 655376 - DNA, 25 bp, Rattus norvegicus
tgttttaccctttctactttgtcag

SEQ ID NO: 655377 - DNA, 25 bp, Rattus norvegicus
tgttttaccttcacatctcagacac

SEQ ID NO: 655378 - DNA, 25 bp, Rattus norvegicus
tgttttaccttctcatctcagacac

SEQ ID NO: 655379 - DNA, 25 bp, Rattus norvegicus
tgttttactggtattgcttctcgac

SEQ ID NO: 655380 - DNA, 25 bp, Rattus norvegicus
tgttttactggttttgcttctcgac

SEQ ID NO: 655381 - DNA, 25 bp, Rattus norvegicus
tgttttacttcaactgagcacctct

SEQ ID NO: 655382 - DNA, 25 bp, Rattus norvegicus
tgttttacttcatctgagcacctct

SEQ ID NO: 655383 - DNA, 25 bp, Rattus norvegicus
tgttttacttccctgtagcccaaag

SEQ ID NO: 655384 - DNA, 25 bp, Rattus norvegicus
tgttttacttccgtgtagcccaaag

SEQ ID NO: 655385 - DNA, 25 bp, Rattus norvegicus
tgttttactttcacttaagcactgg

SEQ ID NO: 655386 - DNA, 25 bp, Rattus norvegicus
tgttttactttctcttaagcactgg

SEQ ID NO: 655387 - DNA, 25 bp, Rattus norvegicus
tgttttagcaaaccagagtgttctg

SEQ ID NO: 655388 - DNA, 25 bp, Rattus norvegicus
tgttttagcaaagcagagtgttctg

SEQ ID NO: 655389 - DNA, 25 bp, Rattus norvegicus
tgttttagcacaagtcccgatgccg

SEQ ID NO: 655390 - DNA, 25 bp, Rattus norvegicus
tgttttagcacatgtcccgatgccg

SEQ ID NO: 655391 - DNA, 25 bp, Rattus norvegicus
tgttttagcatgaattcctcgtggg

SEQ ID NO: 655392 - DNA, 25 bp, Rattus norvegicus
tgttttagcatgtattcctcgtggg

SEQ ID NO: 655393 - DNA, 25 bp, Rattus norvegicus
tgttttagcctccacctcttagagt

SEQ ID NO: 655394 - DNA, 25 bp, Rattus norvegicus
tgttttagcctccttgcataccaac

SEQ ID NO: 655395 - DNA, 25 bp, Rattus norvegicus
tgttttagcctcgacctcttagagt

SEQ ID NO: 655396 - DNA, 25 bp, Rattus norvegicus
tgttttagcctcgttgcataccaac

SEQ ID NO: 655397 - DNA, 25 bp, Rattus norvegicus
tgttttagcgggacagacgcataaa

SEQ ID NO: 655398 - DNA, 25 bp, Rattus norvegicus
tgttttagcgggtcagacgcataaa

SEQ ID NO: 655399 - DNA, 25 bp, Rattus norvegicus
tgttttagggccagatccctgatgt

SEQ ID NO: 655400 - DNA, 25 bp, Rattus norvegicus
tgttttagggcctgatccctgatgt

SEQ ID NO: 655401 - DNA, 25 bp, Rattus norvegicus
tgttttagggtgctgtccttctgaa

SEQ ID NO: 655402 - DNA, 25 bp, Rattus norvegicus
tgttttagggtggtgtccttctgaa

SEQ ID NO: 655403 - DNA, 25 bp, Rattus norvegicus
tgttttataattcaccattcagtaa

SEQ ID NO: 655404 - DNA, 25 bp, Rattus norvegicus
tgttttataattgaccattcagtaa

SEQ ID NO: 655405 - DNA, 25 bp, Rattus norvegicus
tgttttataccaacgttgtgcccat

SEQ ID NO: 655406 - DNA, 25 bp, Rattus norvegicus
tgttttataccaatgcctagcagag

SEQ ID NO: 655407 - DNA, 25 bp, Rattus norvegicus
tgttttataccatcgttgtgcccat

SEQ ID NO: 655408 - DNA, 25 bp, Rattus norvegicus
tgttttataccattgcctagcagag

SEQ ID NO: 655409 - DNA, 25 bp, Rattus norvegicus
tgttttatgcctatcagcctccaaa

SEQ ID NO: 655410 - DNA, 25 bp, Rattus norvegicus
tgttttatgcctttcagcctccaaa

SEQ ID NO: 655411 - DNA, 25 bp, Rattus norvegicus
tgttttattaagagtctccttttct

SEQ ID NO: 655412 - DNA, 25 bp, Rattus norvegicus
tgttttattaagtgtctccttttct

SEQ ID NO: 655413 - DNA, 25 bp, Rattus norvegicus
tgttttattaatctaccgtttctgg

SEQ ID NO: 655414 - DNA, 25 bp, Rattus norvegicus
tgttttattaatgtaccgtttctgg

SEQ ID NO: 655415 - DNA, 25 bp, Rattus norvegicus
tgttttattagacttcctttcctag

SEQ ID NO: 655416 - DNA, 25 bp, Rattus norvegicus
tgttttattagagttcctttcctag

SEQ ID NO: 655417 - DNA, 25 bp, Rattus norvegicus
tgttttattataacccctctattag

SEQ ID NO: 655418 - DNA, 25 bp, Rattus norvegicus
tgttttattatatcccctctattag

SEQ ID NO: 655419 - DNA, 25 bp, Rattus norvegicus
tgttttcaacagattttccccaaat

SEQ ID NO: 655420 - DNA, 25 bp, Rattus norvegicus
tgttttcaacagtttttccccaaat

SEQ ID NO: 655421 - DNA, 25 bp, Rattus norvegicus
tgttttcacactcttttccccaggg

SEQ ID NO: 655422 - DNA, 25 bp, Rattus norvegicus
tgttttcacactgttttccccaggg

SEQ ID NO: 655423 - DNA, 25 bp, Rattus norvegicus
tgttttcacattatcccatcactag

SEQ ID NO: 655424 - DNA, 25 bp, Rattus norvegicus
tgttttcacattttcccatcactag

SEQ ID NO: 655425 - DNA, 25 bp, Rattus norvegicus
tgttttcaccgtagtctctcaagaa

SEQ ID NO: 655426 - DNA, 25 bp, Rattus norvegicus
tgttttcaccgttgtctctcaagaa

SEQ ID NO: 655427 - DNA, 25 bp, Rattus norvegicus
tgttttcaccttcactgcaggcaat

SEQ ID NO: 655428 - DNA, 25 bp, Rattus norvegicus
tgttttcaccttgactgcaggcaat

SEQ ID NO: 655429 - DNA, 25 bp, Rattus norvegicus
tgttttcagaatatgcagagttgct

SEQ ID NO: 655430 - DNA, 25 bp, Rattus norvegicus
tgttttcagaatttgcagagttgct

SEQ ID NO: 655431 - DNA, 25 bp, Rattus norvegicus
tgttttcagcaaaacgtcctccacg

SEQ ID NO: 655432 - DNA, 25 bp, Rattus norvegicus
tgttttcagcaatacgtcctccacg

SEQ ID NO: 655433 - DNA, 25 bp, Rattus norvegicus
tgttttcagcacacaattcaccgga

SEQ ID NO: 655434 - DNA, 25 bp, Rattus norvegicus
tgttttcagcactcaattcaccgga

SEQ ID NO: 655435 - DNA, 25 bp, Rattus norvegicus
tgttttcagcatctccttgtccttt

SEQ ID NO: 655436 - DNA, 25 bp, Rattus norvegicus
tgttttcagcatgtccttgtccttt

SEQ ID NO: 655437 - DNA, 25 bp, Rattus norvegicus
tgttttcagccacttcgtagcagct

SEQ ID NO: 655438 - DNA, 25 bp, Rattus norvegicus
tgttttcagccagttcgtagcagct

SEQ ID NO: 655439 - DNA, 25 bp, Rattus norvegicus
tgttttcagtcccttctatcattac

SEQ ID NO: 655440 - DNA, 25 bp, Rattus norvegicus
tgttttcagtccgttctatcattac

SEQ ID NO: 655441 - DNA, 25 bp, Rattus norvegicus
tgttttcatacacatgcatcattgt

SEQ ID NO: 655442 - DNA, 25 bp, Rattus norvegicus
tgttttcatacagatgcatcattgt

SEQ ID NO: 655443 - DNA, 25 bp, Rattus norvegicus
tgttttcatggccactgtcacacac

SEQ ID NO: 655444 - DNA, 25 bp, Rattus norvegicus
tgttttcatggcgactgtcacacac

SEQ ID NO: 655445 - DNA, 25 bp, Rattus norvegicus
tgttttcatgtgattcaagccctga

SEQ ID NO: 655446 - DNA, 25 bp, Rattus norvegicus
tgttttcatgtgcacttgtctgtag

SEQ ID NO: 655447 - DNA, 25 bp, Rattus norvegicus
tgttttcatgtggacttgtctgtag

SEQ ID NO: 655448 - DNA, 25 bp, Rattus norvegicus
tgttttcatgtgtttcaagccctga

SEQ ID NO: 655449 - DNA, 25 bp, Rattus norvegicus
tgttttccaaatcaggtccttttct

SEQ ID NO: 655450 - DNA, 25 bp, Rattus norvegicus
tgttttccaaatgaggtccttttct

SEQ ID NO: 655451 - DNA, 25 bp, Rattus norvegicus
tgttttccacacagcgcggttagaa

SEQ ID NO: 655452 - DNA, 25 bp, Rattus norvegicus
tgttttccacactgcgcggttagaa

SEQ ID NO: 655453 - DNA, 25 bp, Rattus norvegicus
tgttttccagaacgccaggtagctc

SEQ ID NO: 655454 - DNA, 25 bp, Rattus norvegicus
tgttttccagaaggccaggtagctc

SEQ ID NO: 655455 - DNA, 25 bp, Rattus norvegicus
tgttttccatgtctgagcatcacct

SEQ ID NO: 655456 - DNA, 25 bp, Rattus norvegicus
tgttttccatgtgtgagcatcacct

SEQ ID NO: 655457 - DNA, 25 bp, Rattus norvegicus
tgttttcccaacagtttccatcaag

SEQ ID NO: 655458 - DNA, 25 bp, Rattus norvegicus
tgttttcccaactgtttccatcaag

SEQ ID NO: 655459 - DNA, 25 bp, Rattus norvegicus
tgttttcccatgatccaactgtgta

SEQ ID NO: 655460 - DNA, 25 bp, Rattus norvegicus
tgttttcccatgttccaactgtgta

SEQ ID NO: 655461 - DNA, 25 bp, Rattus norvegicus
tgttttccccaaacattattccctg

SEQ ID NO: 655462 - DNA, 25 bp, Rattus norvegicus
tgttttccccaatcattattccctg

SEQ ID NO: 655463 - DNA, 25 bp, Rattus norvegicus
tgttttccccatactaacacaggat

SEQ ID NO: 655464 - DNA, 25 bp, Rattus norvegicus
tgttttccccattctaacacaggat

SEQ ID NO: 655465 - DNA, 25 bp, Rattus norvegicus
tgttttccctaaccgttctgagcag

SEQ ID NO: 655466 - DNA, 25 bp, Rattus norvegicus
tgttttccctaagcgttctgagcag

SEQ ID NO: 655467 - DNA, 25 bp, Rattus norvegicus
tgttttccctaccagtaacggcagc

SEQ ID NO: 655468 - DNA, 25 bp, Rattus norvegicus
tgttttccctacgagtaacggcagc

SEQ ID NO: 655469 - DNA, 25 bp, Rattus norvegicus
tgttttccgacacttagctgaccat

SEQ ID NO: 655470 - DNA, 25 bp, Rattus norvegicus
tgttttccgacagttagctgaccat

SEQ ID NO: 655471 - DNA, 25 bp, Rattus norvegicus
tgttttcctaaaagctacctcttct

SEQ ID NO: 655472 - DNA, 25 bp, Rattus norvegicus
tgttttcctaaacacttgtgtccct

SEQ ID NO: 655473 - DNA, 25 bp, Rattus norvegicus
tgttttcctaaagacttgtgtccct

SEQ ID NO: 655474 - DNA, 25 bp, Rattus norvegicus
tgttttcctaaatgctacctcttct

SEQ ID NO: 655475 - DNA, 25 bp, Rattus norvegicus
tgttttcctactagaatgacccaga

SEQ ID NO: 655476 - DNA, 25 bp, Rattus norvegicus
tgttttcctacttgaatgacccaga

SEQ ID NO: 655477 - DNA, 25 bp, Rattus norvegicus
tgttttcctattatcttcccagctg

SEQ ID NO: 655478 - DNA, 25 bp, Rattus norvegicus
tgttttcctattttcttcccagctg

SEQ ID NO: 655479 - DNA, 25 bp, Rattus norvegicus
tgttttcctgatagctgtgacccac

SEQ ID NO: 655480 - DNA, 25 bp, Rattus norvegicus
tgttttcctgattgctgtgacccac

SEQ ID NO: 655481 - DNA, 25 bp, Rattus norvegicus
tgttttcctgttctgagagccctgg

SEQ ID NO: 655482 - DNA, 25 bp, Rattus norvegicus
tgttttcctgttgtgagagccctgg

SEQ ID NO: 655483 - DNA, 25 bp, Rattus norvegicus
tgttttccttagaggagtggccgct

SEQ ID NO: 655484 - DNA, 25 bp, Rattus norvegicus
tgttttccttagtggagtggccgct

SEQ ID NO: 655485 - DNA, 25 bp, Rattus norvegicus
tgttttccttctcaagtcctgttat

SEQ ID NO: 655486 - DNA, 25 bp, Rattus norvegicus
tgttttccttctgaagtcctgttat

SEQ ID NO: 655487 - DNA, 25 bp, Rattus norvegicus
tgttttcctttcactgtcacacaca

SEQ ID NO: 655488 - DNA, 25 bp, Rattus norvegicus
tgttttcctttctctgtcacacaca

SEQ ID NO: 655489 - DNA, 25 bp, Rattus norvegicus
tgttttcgccgactcattcaggaga

SEQ ID NO: 655490 - DNA, 25 bp, Rattus norvegicus
tgttttcgccgagtcattcaggaga

SEQ ID NO: 655491 - DNA, 25 bp, Rattus norvegicus
tgttttcgctgccactgattaaagt

SEQ ID NO: 655492 - DNA, 25 bp, Rattus norvegicus
tgttttcgctgcgactgattaaagt

SEQ ID NO: 655493 - DNA, 25 bp, Rattus norvegicus
tgttttcgggaaccttgcacatctg

SEQ ID NO: 655494 - DNA, 25 bp, Rattus norvegicus
tgttttcgggaagcttgcacatctg

SEQ ID NO: 655495 - DNA, 25 bp, Rattus norvegicus
tgttttcgtatgacttgggtgctaa

SEQ ID NO: 655496 - DNA, 25 bp, Rattus norvegicus
tgttttcgtatgtcttgggtgctaa

SEQ ID NO: 655497 - DNA, 25 bp, Rattus norvegicus
tgttttctaacaccaatgccgaggt

SEQ ID NO: 655498 - DNA, 25 bp, Rattus norvegicus
tgttttctaacagcaatgccgaggt

SEQ ID NO: 655499 - DNA, 25 bp, Rattus norvegicus
tgttttctaagtcatttctccctac

SEQ ID NO: 655500 - DNA, 25 bp, Rattus norvegicus
tgttttctaagtgatttctccctac

SEQ ID NO: 655501 - DNA, 25 bp, Rattus norvegicus
tgttttctatatattctcccctaat

SEQ ID NO: 655502 - DNA, 25 bp, Rattus norvegicus
tgttttctatattttctcccctaat

SEQ ID NO: 655503 - DNA, 25 bp, Rattus norvegicus
tgttttctatgaccaatcccttttt

SEQ ID NO: 655504 - DNA, 25 bp, Rattus norvegicus
tgttttctatgagcaatcccttttt

SEQ ID NO: 655505 - DNA, 25 bp, Rattus norvegicus
tgttttctccagaccattttcatga

SEQ ID NO: 655506 - DNA, 25 bp, Rattus norvegicus
tgttttctccagtccattttcatga

SEQ ID NO: 655507 - DNA, 25 bp, Rattus norvegicus
tgttttctcgaacgccctgcaaaaa

SEQ ID NO: 655508 - DNA, 25 bp, Rattus norvegicus
tgttttctcgaaggccctgcaaaaa

SEQ ID NO: 655509 - DNA, 25 bp, Rattus norvegicus
tgttttctctgtctccggaatttct

SEQ ID NO: 655510 - DNA, 25 bp, Rattus norvegicus
tgttttctctgtgtccggaatttct

SEQ ID NO: 655511 - DNA, 25 bp, Rattus norvegicus
tgttttctgagacccattgctacgt

SEQ ID NO: 655512 - DNA, 25 bp, Rattus norvegicus
tgttttctgagagccattgctacgt

SEQ ID NO: 655513 - DNA, 25 bp, Rattus norvegicus
tgttttctgaggagagctgctctga

SEQ ID NO: 655514 - DNA, 25 bp, Rattus norvegicus
tgttttctgaggtgagctgctctga

SEQ ID NO: 655515 - DNA, 25 bp, Rattus norvegicus
tgttttctggtacgctttgcttttt

SEQ ID NO: 655516 - DNA, 25 bp, Rattus norvegicus
tgttttctggtaggctttgcttttt

SEQ ID NO: 655517 - DNA, 25 bp, Rattus norvegicus
tgttttctgtaaaccctgtctgcaa

SEQ ID NO: 655518 - DNA, 25 bp, Rattus norvegicus
tgttttctgtaatccctgtctgcaa

SEQ ID NO: 655519 - DNA, 25 bp, Rattus norvegicus
tgttttctgtatcctctaagtgtga

SEQ ID NO: 655520 - DNA, 25 bp, Rattus norvegicus
tgttttctgtatgctctaagtgtga

SEQ ID NO: 655521 - DNA, 25 bp, Rattus norvegicus
tgttttctgtccaaacttcttagga

SEQ ID NO: 655522 - DNA, 25 bp, Rattus norvegicus
tgttttctgtcctaacttcttagga

SEQ ID NO: 655523 - DNA, 25 bp, Rattus norvegicus
tgttttcttcaccttccgcatcttc

SEQ ID NO: 655524 - DNA, 25 bp, Rattus norvegicus
tgttttcttcacgttccgcatcttc

SEQ ID NO: 655525 - DNA, 25 bp, Rattus norvegicus
tgttttcttctgcacgtgattggat

SEQ ID NO: 655526 - DNA, 25 bp, Rattus norvegicus
tgttttcttctggacgtgattggat

SEQ ID NO: 655527 - DNA, 25 bp, Rattus norvegicus
tgttttcttgtcatgtggagtctgc

SEQ ID NO: 655528 - DNA, 25 bp, Rattus norvegicus
tgttttcttgtcttgtggagtctgc

SEQ ID NO: 655529 - DNA, 25 bp, Rattus norvegicus
tgttttgaacaaaggcggtctggag

SEQ ID NO: 655530 - DNA, 25 bp, Rattus norvegicus
tgttttgaacaatggcggtctggag

SEQ ID NO: 655531 - DNA, 25 bp, Rattus norvegicus
tgttttgaacgaatttgccacttaa

SEQ ID NO: 655532 - DNA, 25 bp, Rattus norvegicus
tgttttgaacgattttgccacttaa

SEQ ID NO: 655533 - DNA, 25 bp, Rattus norvegicus
tgttttgaagaacaacaggttgcct

SEQ ID NO: 655534 - DNA, 25 bp, Rattus norvegicus
tgttttgaagaagaacaggttgcct

SEQ ID NO: 655535 - DNA, 25 bp, Rattus norvegicus
tgttttgaatgtccccttttaaagg

SEQ ID NO: 655536 - DNA, 25 bp, Rattus norvegicus
tgttttgaatgtgcccttttaaagg

SEQ ID NO: 655537 - DNA, 25 bp, Rattus norvegicus
tgttttgaatttattaggcctccct

SEQ ID NO: 655538 - DNA, 25 bp, Rattus norvegicus
tgttttgaattttttaggcctccct

SEQ ID NO: 655539 - DNA, 25 bp, Rattus norvegicus
tgttttgacacaagctagtataaga

SEQ ID NO: 655540 - DNA, 25 bp, Rattus norvegicus
tgttttgacacatgctagtataaga

SEQ ID NO: 655541 - DNA, 25 bp, Rattus norvegicus
tgttttgagcttccccaatgagtta

SEQ ID NO: 655542 - DNA, 25 bp, Rattus norvegicus
tgttttgagcttgcccaatgagtta

SEQ ID NO: 655543 - DNA, 25 bp, Rattus norvegicus
tgttttgagttacaattgccccgcc

SEQ ID NO: 655544 - DNA, 25 bp, Rattus norvegicus
tgttttgagttagaattgccccgcc

SEQ ID NO: 655545 - DNA, 25 bp, Rattus norvegicus
tgttttgatgatcccaactgcacgt

SEQ ID NO: 655546 - DNA, 25 bp, Rattus norvegicus
tgttttgatgatgccaactgcacgt

SEQ ID NO: 655547 - DNA, 25 bp, Rattus norvegicus
tgttttgatgcccaaccctagactc

SEQ ID NO: 655548 - DNA, 25 bp, Rattus norvegicus
tgttttgatgccgaaccctagactc

SEQ ID NO: 655549 - DNA, 25 bp, Rattus norvegicus
tgttttgcagatctatccacacact

SEQ ID NO: 655550 - DNA, 25 bp, Rattus norvegicus
tgttttgcagatgtatccacacact

SEQ ID NO: 655551 - DNA, 25 bp, Rattus norvegicus
tgttttgcgtttcagagacatcact

SEQ ID NO: 655552 - DNA, 25 bp, Rattus norvegicus
tgttttgcgtttgagagacatcact

SEQ ID NO: 655553 - DNA, 25 bp, Rattus norvegicus
tgttttgctattacagactctactg

SEQ ID NO: 655554 - DNA, 25 bp, Rattus norvegicus
tgttttgctattaccttgtggctta

SEQ ID NO: 655555 - DNA, 25 bp, Rattus norvegicus
tgttttgctatttcagactctactg

SEQ ID NO: 655556 - DNA, 25 bp, Rattus norvegicus
tgttttgctatttccttgtggctta

SEQ ID NO: 655557 - DNA, 25 bp, Rattus norvegicus
tgttttgcttaaagcccttcgtcaa

SEQ ID NO: 655558 - DNA, 25 bp, Rattus norvegicus
tgttttgcttaatgcccttcgtcaa

SEQ ID NO: 655559 - DNA, 25 bp, Rattus norvegicus
tgttttggtccaatctctttgtatc

SEQ ID NO: 655560 - DNA, 25 bp, Rattus norvegicus
tgttttggtccattctctttgtatc

SEQ ID NO: 655561 - DNA, 25 bp, Rattus norvegicus
tgttttggtcctcgccacccattgt

SEQ ID NO: 655562 - DNA, 25 bp, Rattus norvegicus
tgttttggtcctggccacccattgt

SEQ ID NO: 655563 - DNA, 25 bp, Rattus norvegicus
tgttttggttttacctcctggacat

SEQ ID NO: 655564 - DNA, 25 bp, Rattus norvegicus
tgttttggtttttcctcctggacat

SEQ ID NO: 655565 - DNA, 25 bp, Rattus norvegicus
tgttttgtaaataccttgtttctga

SEQ ID NO: 655566 - DNA, 25 bp, Rattus norvegicus
tgttttgtaaattccttgtttctga

SEQ ID NO: 655567 - DNA, 25 bp, Rattus norvegicus
tgttttgtaaccactttctaaccat

SEQ ID NO: 655568 - DNA, 25 bp, Rattus norvegicus
tgttttgtaacctctttctaaccat

SEQ ID NO: 655569 - DNA, 25 bp, Rattus norvegicus
tgttttgtacgaccctccattggcc

SEQ ID NO: 655570 - DNA, 25 bp, Rattus norvegicus
tgttttgtacgagcctccattggcc

SEQ ID NO: 655571 - DNA, 25 bp, Rattus norvegicus
tgttttgtcacaagtcaaggctgaa

SEQ ID NO: 655572 - DNA, 25 bp, Rattus norvegicus
tgttttgtcacatgtcaaggctgaa

SEQ ID NO: 655573 - DNA, 25 bp, Rattus norvegicus
tgttttgtccagagtccgtgtctct

SEQ ID NO: 655574 - DNA, 25 bp, Rattus norvegicus
tgttttgtccagtgtccgtgtctct

SEQ ID NO: 655575 - DNA, 25 bp, Rattus norvegicus
tgttttgtcccacctgagtactata

SEQ ID NO: 655576 - DNA, 25 bp, Rattus norvegicus
tgttttgtcccagctgagtactata

SEQ ID NO: 655577 - DNA, 25 bp, Rattus norvegicus
tgttttgtctcaattccgttcccca

SEQ ID NO: 655578 - DNA, 25 bp, Rattus norvegicus
tgttttgtctcatttccgttcccca

SEQ ID NO: 655579 - DNA, 25 bp, Rattus norvegicus
tgttttgtgaagagtcggcctctta

SEQ ID NO: 655580 - DNA, 25 bp, Rattus norvegicus
tgttttgtgaagtgtcggcctctta

SEQ ID NO: 655581 - DNA, 25 bp, Rattus norvegicus
tgttttgtgacactggcagacccta

SEQ ID NO: 655582 - DNA, 25 bp, Rattus norvegicus
tgttttgtgacagtggcagacccta

SEQ ID NO: 655583 - DNA, 25 bp, Rattus norvegicus
tgttttgtgataaccgtccctgtca

SEQ ID NO: 655584 - DNA, 25 bp, Rattus norvegicus
tgttttgtgatatccgtccctgtca

SEQ ID NO: 655585 - DNA, 25 bp, Rattus norvegicus
tgttttgtgcttcagtttgtccagt

SEQ ID NO: 655586 - DNA, 25 bp, Rattus norvegicus
tgttttgtgcttgagtttgtccagt

SEQ ID NO: 655587 - DNA, 25 bp, Rattus norvegicus
tgttttgtggtgatttactgctcgt

SEQ ID NO: 655588 - DNA, 25 bp, Rattus norvegicus
tgttttgtggtgttttactgctcgt

SEQ ID NO: 655589 - DNA, 25 bp, Rattus norvegicus
tgttttgtgtgtattccttagatga

SEQ ID NO: 655590 - DNA, 25 bp, Rattus norvegicus
tgttttgtgtgttttccttagatga

SEQ ID NO: 655591 - DNA, 25 bp, Rattus norvegicus
tgttttgttactcttcttgctgcta

SEQ ID NO: 655592 - DNA, 25 bp, Rattus norvegicus
tgttttgttactgttcttgctgcta

SEQ ID NO: 655593 - DNA, 25 bp, Rattus norvegicus
tgttttgttcatatgcagccagttt

SEQ ID NO: 655594 - DNA, 25 bp, Rattus norvegicus
tgttttgttcatttgcagccagttt

SEQ ID NO: 655595 - DNA, 25 bp, Rattus norvegicus
tgttttgttcgtagacttaatgtcc

SEQ ID NO: 655596 - DNA, 25 bp, Rattus norvegicus
tgttttgttcgttgacttaatgtcc

SEQ ID NO: 655597 - DNA, 25 bp, Rattus norvegicus
tgttttgtttataactgtgccttaa

SEQ ID NO: 655598 - DNA, 25 bp, Rattus norvegicus
tgttttgtttattactgtgccttaa

SEQ ID NO: 655599 - DNA, 25 bp, Rattus norvegicus
tgttttgttttacacactctcccaa

SEQ ID NO: 655600 - DNA, 25 bp, Rattus norvegicus
tgttttgttttagacactctcccaa

SEQ ID NO: 655601 - DNA, 25 bp, Rattus norvegicus
tgtttttaaccaaatacctcctcag

SEQ ID NO: 655602 - DNA, 25 bp, Rattus norvegicus
tgtttttaaccatatacctcctcag

SEQ ID NO: 655603 - DNA, 25 bp, Rattus norvegicus
tgtttttaacgcagccccatcaagg

SEQ ID NO: 655604 - DNA, 25 bp, Rattus norvegicus
tgtttttaacgctgccccatcaagg

SEQ ID NO: 655605 - DNA, 25 bp, Rattus norvegicus
tgtttttaagagctaccgagcatta

SEQ ID NO: 655606 - DNA, 25 bp, Rattus norvegicus
tgtttttaagaggtaccgagcatta

SEQ ID NO: 655607 - DNA, 25 bp, Rattus norvegicus
tgtttttacacacctttcactgaat

SEQ ID NO: 655608 - DNA, 25 bp, Rattus norvegicus
tgtttttacacagctttcactgaat

SEQ ID NO: 655609 - DNA, 25 bp, Rattus norvegicus
tgtttttagaatacgggccctggtg

SEQ ID NO: 655610 - DNA, 25 bp, Rattus norvegicus
tgtttttagaattcgggccctggtg

SEQ ID NO: 655611 - DNA, 25 bp, Rattus norvegicus
tgtttttattcaacaggcccagcct

SEQ ID NO: 655612 - DNA, 25 bp, Rattus norvegicus
tgtttttattcatcaggcccagcct

SEQ ID NO: 655613 - DNA, 25 bp, Rattus norvegicus
tgtttttcaaacacccggcttatgt

SEQ ID NO: 655614 - DNA, 25 bp, Rattus norvegicus
tgtttttcaaactcccggcttatgt

SEQ ID NO: 655615 - DNA, 25 bp, Rattus norvegicus
tgtttttcatcgctccattcatctg

SEQ ID NO: 655616 - DNA, 25 bp, Rattus norvegicus
tgtttttcatcggtccattcatctg

SEQ ID NO: 655617 - DNA, 25 bp, Rattus norvegicus
tgtttttccgaaagctacgacccat

SEQ ID NO: 655618 - DNA, 25 bp, Rattus norvegicus
tgtttttccgaatgctacgacccat

SEQ ID NO: 655619 - DNA, 25 bp, Rattus norvegicus
tgtttttccgcaagtacactcaggc

SEQ ID NO: 655620 - DNA, 25 bp, Rattus norvegicus
tgtttttccgcatgtacactcaggc

SEQ ID NO: 655621 - DNA, 25 bp, Rattus norvegicus
tgtttttcctagacatagtacctaa

SEQ ID NO: 655622 - DNA, 25 bp, Rattus norvegicus
tgtttttcctagtcatagtacctaa

SEQ ID NO: 655623 - DNA, 25 bp, Rattus norvegicus
tgtttttcctccatctgtatcagaa

SEQ ID NO: 655624 - DNA, 25 bp, Rattus norvegicus
tgtttttcctccttctgtatcagaa

SEQ ID NO: 655625 - DNA, 25 bp, Rattus norvegicus
tgtttttctcctctgaaggaagtgt

SEQ ID NO: 655626 - DNA, 25 bp, Rattus norvegicus
tgtttttctcctgtgaaggaagtgt

SEQ ID NO: 655627 - DNA, 25 bp, Rattus norvegicus
tgtttttctcttccttgttcaacaa

SEQ ID NO: 655628 - DNA, 25 bp, Rattus norvegicus
tgtttttctcttgcttgttcaacaa

SEQ ID NO: 655629 - DNA, 25 bp, Rattus norvegicus
tgtttttcttctctgctgtctaaga

SEQ ID NO: 655630 - DNA, 25 bp, Rattus norvegicus
tgtttttcttctgtgctgtctaaga

SEQ ID NO: 655631 - DNA, 25 bp, Rattus norvegicus
tgtttttcttgtaagccttcgtgta

SEQ ID NO: 655632 - DNA, 25 bp, Rattus norvegicus
tgtttttcttgttagccttcgtgta

SEQ ID NO: 655633 - DNA, 25 bp, Rattus norvegicus
tgtttttgaaacacgttccgacctg

SEQ ID NO: 655634 - DNA, 25 bp, Rattus norvegicus
tgtttttgaaacagcagtgcctaca

SEQ ID NO: 655635 - DNA, 25 bp, Rattus norvegicus
tgtttttgaaactcgttccgacctg

SEQ ID NO: 655636 - DNA, 25 bp, Rattus norvegicus
tgtttttgaaactgcagtgcctaca

SEQ ID NO: 655637 - DNA, 25 bp, Rattus norvegicus
tgtttttgaccgaaggtttcattat

SEQ ID NO: 655638 - DNA, 25 bp, Rattus norvegicus
tgtttttgaccgtaggtttcattat

SEQ ID NO: 655639 - DNA, 25 bp, Rattus norvegicus
tgtttttgagctatgatttcactgt

SEQ ID NO: 655640 - DNA, 25 bp, Rattus norvegicus
tgtttttgagctttgatttcactgt

SEQ ID NO: 655641 - DNA, 25 bp, Rattus norvegicus
tgtttttgagtcatctgggtctctc

SEQ ID NO: 655642 - DNA, 25 bp, Rattus norvegicus
tgtttttgagtcttctgggtctctc

SEQ ID NO: 655643 - DNA, 25 bp, Rattus norvegicus
tgtttttgtaaaacagttcctttgg

SEQ ID NO: 655644 - DNA, 25 bp, Rattus norvegicus
tgtttttgtaaatcagttcctttgg

SEQ ID NO: 655645 - DNA, 25 bp, Rattus norvegicus
tgtttttgtgggaatctgcctcatt

SEQ ID NO: 655646 - DNA, 25 bp, Rattus norvegicus
tgtttttgtgggtatctgcctcatt

SEQ ID NO: 655647 - DNA, 25 bp, Rattus norvegicus
tgttttttaaaccacctcatctcca

SEQ ID NO: 655648 - DNA, 25 bp, Rattus norvegicus
tgttttttaaacgacctcatctcca

SEQ ID NO: 655649 - DNA, 25 bp, Rattus norvegicus
tgttttttaaccacagattctgtaa

SEQ ID NO: 655650 - DNA, 25 bp, Rattus norvegicus
tgttttttaacctcagattctgtaa

SEQ ID NO: 655651 - DNA, 25 bp, Rattus norvegicus
tgttttttagcacccaggacaacga

SEQ ID NO: 655652 - DNA, 25 bp, Rattus norvegicus
tgttttttagcagccaggacaacga

SEQ ID NO: 655653 - DNA, 25 bp, Rattus norvegicus
tgttttttcacacttaagggcttgg

SEQ ID NO: 655654 - DNA, 25 bp, Rattus norvegicus
tgttttttcacagttaagggcttgg

SEQ ID NO: 655655 - DNA, 25 bp, Rattus norvegicus
tgttttttccagagcgaactccttc

SEQ ID NO: 655656 - DNA, 25 bp, Rattus norvegicus
tgttttttccagtgcgaactccttc

SEQ ID NO: 655657 - DNA, 25 bp, Rattus norvegicus
tgttttttccccatagcatgttagg

SEQ ID NO: 655658 - DNA, 25 bp, Rattus norvegicus
tgttttttccccttagcatgttagg

SEQ ID NO: 655659 - DNA, 25 bp, Rattus norvegicus
tgttttttcctaattcccaccatgt

SEQ ID NO: 655660 - DNA, 25 bp, Rattus norvegicus
tgttttttcctatttcccaccatgt

SEQ ID NO: 655661 - DNA, 25 bp, Rattus norvegicus
tgttttttcctcctctcagattatg

SEQ ID NO: 655662 - DNA, 25 bp, Rattus norvegicus
tgttttttcctcgtctcagattatg

SEQ ID NO: 655663 - DNA, 25 bp, Rattus norvegicus
tgttttttctggattcctggaccat

SEQ ID NO: 655664 - DNA, 25 bp, Rattus norvegicus
tgttttttctggtttcctggaccat

SEQ ID NO: 655665 - DNA, 25 bp, Rattus norvegicus
tgttttttggttacctgtgggcaca

SEQ ID NO: 655666 - DNA, 25 bp, Rattus norvegicus
tgttttttggtttcctgtgggcaca

SEQ ID NO: 655667 - DNA, 25 bp, Rattus norvegicus
ttaaaaacaactcccttctctctca

SEQ ID NO: 655668 - DNA, 25 bp, Rattus norvegicus
ttaaaaacaactgccttctctctca

SEQ ID NO: 655669 - DNA, 25 bp, Rattus norvegicus
ttaaaaacactgaagccctgctatc

SEQ ID NO: 655670 - DNA, 25 bp, Rattus norvegicus
ttaaaaacactgtagccctgctatc

SEQ ID NO: 655671 - DNA, 25 bp, Rattus norvegicus
ttaaaaacattaagccgcgcagggc

SEQ ID NO: 655672 - DNA, 25 bp, Rattus norvegicus
ttaaaaacattatgccgcgcagggc

SEQ ID NO: 655673 - DNA, 25 bp, Rattus norvegicus
ttaaaaagcatacttcctctgaagg

SEQ ID NO: 655674 - DNA, 25 bp, Rattus norvegicus
ttaaaaagcatagttcctctgaagg

SEQ ID NO: 655675 - DNA, 25 bp, Rattus norvegicus
ttaaaaagcccgctcatatccactt

SEQ ID NO: 655676 - DNA, 25 bp, Rattus norvegicus
ttaaaaagcccggtcatatccactt

SEQ ID NO: 655677 - DNA, 25 bp, Rattus norvegicus
ttaaaaagtcagcaccccaacaggg

SEQ ID NO: 655678 - DNA, 25 bp, Rattus norvegicus
ttaaaaagtcaggaccccaacaggg

SEQ ID NO: 655679 - DNA, 25 bp, Rattus norvegicus
ttaaaaagtcgaccaaccacaggtt

SEQ ID NO: 655680 - DNA, 25 bp, Rattus norvegicus
ttaaaaagtcgagcaaccacaggtt

SEQ ID NO: 655681 - DNA, 25 bp, Rattus norvegicus
ttaaaaagttgtccttttcctccag

SEQ ID NO: 655682 - DNA, 25 bp, Rattus norvegicus
ttaaaaagttgtgcttttcctccag

SEQ ID NO: 655683 - DNA, 25 bp, Rattus norvegicus
ttaaaaataccactcattccctgac

SEQ ID NO: 655684 - DNA, 25 bp, Rattus norvegicus
ttaaaaataccagtcattccctgac

SEQ ID NO: 655685 - DNA, 25 bp, Rattus norvegicus
ttaaaaatcattcccggcctctggt

SEQ ID NO: 655686 - DNA, 25 bp, Rattus norvegicus
ttaaaaatcattgccggcctctggt

SEQ ID NO: 655687 - DNA, 25 bp, Rattus norvegicus
ttaaaaatctcactagccacaccgg

SEQ ID NO: 655688 - DNA, 25 bp, Rattus norvegicus
ttaaaaatctcagtagccacaccgg

SEQ ID NO: 655689 - DNA, 25 bp, Rattus norvegicus
ttaaaaatgcacatgtatgcccatt

SEQ ID NO: 655690 - DNA, 25 bp, Rattus norvegicus
ttaaaaatgcacttgtatgcccatt

SEQ ID NO: 655691 - DNA, 25 bp, Rattus norvegicus
ttaaaaatgccccactctttgtagt

SEQ ID NO: 655692 - DNA, 25 bp, Rattus norvegicus
ttaaaaatgcccgactctttgtagt

SEQ ID NO: 655693 - DNA, 25 bp, Rattus norvegicus
ttaaaaatgtccctcctgtgaccat

SEQ ID NO: 655694 - DNA, 25 bp, Rattus norvegicus
ttaaaaatgtccgtcctgtgaccat

SEQ ID NO: 655695 - DNA, 25 bp, Rattus norvegicus
ttaaaacaaatcctgagtgctctgc

SEQ ID NO: 655696 - DNA, 25 bp, Rattus norvegicus
ttaaaacaaatcgtgagtgctctgc

SEQ ID NO: 655697 - DNA, 25 bp, Rattus norvegicus
ttaaaacaatttcatccctctcact

SEQ ID NO: 655698 - DNA, 25 bp, Rattus norvegicus
ttaaaacaatttgatccctctcact

SEQ ID NO: 655699 - DNA, 25 bp, Rattus norvegicus
ttaaaacactctcacatttcgctcc

SEQ ID NO: 655700 - DNA, 25 bp, Rattus norvegicus
ttaaaacactctgacatttcgctcc

SEQ ID NO: 655701 - DNA, 25 bp, Rattus norvegicus
ttaaaacactgcagtcttcacgaca

SEQ ID NO: 655702 - DNA, 25 bp, Rattus norvegicus
ttaaaacactgcatctagggcccat

SEQ ID NO: 655703 - DNA, 25 bp, Rattus norvegicus
ttaaaacactgctgtcttcacgaca

SEQ ID NO: 655704 - DNA, 25 bp, Rattus norvegicus
ttaaaacactgcttctagggcccat

SEQ ID NO: 655705 - DNA, 25 bp, Rattus norvegicus
ttaaaacagctacctcatactcagt

SEQ ID NO: 655706 - DNA, 25 bp, Rattus norvegicus
ttaaaacagctagctcatactcagt

SEQ ID NO: 655707 - DNA, 25 bp, Rattus norvegicus
ttaaaacatgacctctgcggctaaa

SEQ ID NO: 655708 - DNA, 25 bp, Rattus norvegicus
ttaaaacatgacgtctgcggctaaa

SEQ ID NO: 655709 - DNA, 25 bp, Rattus norvegicus
ttaaaaccagccacaactgggttgg

SEQ ID NO: 655710 - DNA, 25 bp, Rattus norvegicus
ttaaaaccagcctcaactgggttgg

SEQ ID NO: 655711 - DNA, 25 bp, Rattus norvegicus
ttaaaaccccgtcgagatgactcag

SEQ ID NO: 655712 - DNA, 25 bp, Rattus norvegicus
ttaaaaccccgtggagatgactcag

SEQ ID NO: 655713 - DNA, 25 bp, Rattus norvegicus
ttaaaacctgctaaagctgtctctc

SEQ ID NO: 655714 - DNA, 25 bp, Rattus norvegicus
ttaaaacctgcttaagctgtctctc

SEQ ID NO: 655715 - DNA, 25 bp, Rattus norvegicus
ttaaaacctgtcagactggcctgtc

SEQ ID NO: 655716 - DNA, 25 bp, Rattus norvegicus
ttaaaacctgtctgactggcctgtc

SEQ ID NO: 655717 - DNA, 25 bp, Rattus norvegicus
ttaaaacctgttctggcctgtgctc

SEQ ID NO: 655718 - DNA, 25 bp, Rattus norvegicus
ttaaaacctgttgtggcctgtgctc

SEQ ID NO: 655719 - DNA, 25 bp, Rattus norvegicus
ttaaaactctgtcatctgatccctg

SEQ ID NO: 655720 - DNA, 25 bp, Rattus norvegicus
ttaaaactctgtgatctgatccctg

SEQ ID NO: 655721 - DNA, 25 bp, Rattus norvegicus
ttaaaacttgttctggctcctgtag

SEQ ID NO: 655722 - DNA, 25 bp, Rattus norvegicus
ttaaaacttgttgtggctcctgtag

SEQ ID NO: 655723 - DNA, 25 bp, Rattus norvegicus
ttaaaagaaatcactacctctgcct

SEQ ID NO: 655724 - DNA, 25 bp, Rattus norvegicus
ttaaaagaaatctctacctctgcct

SEQ ID NO: 655725 - DNA, 25 bp, Rattus norvegicus
ttaaaagacagcctgggccatgccc

SEQ ID NO: 655726 - DNA, 25 bp, Rattus norvegicus
ttaaaagacagcgtgggccatgccc

SEQ ID NO: 655727 - DNA, 25 bp, Rattus norvegicus
ttaaaagacctgatcctggaactcg

SEQ ID NO: 655728 - DNA, 25 bp, Rattus norvegicus
ttaaaagacctgttcctggaactcg

SEQ ID NO: 655729 - DNA, 25 bp, Rattus norvegicus
ttaaaagagctgcatgtgtcctggg

SEQ ID NO: 655730 - DNA, 25 bp, Rattus norvegicus
ttaaaagagctggatgtgtcctggg

SEQ ID NO: 655731 - DNA, 25 bp, Rattus norvegicus
ttaaaagaggatcgccttcctgctg

SEQ ID NO: 655732 - DNA, 25 bp, Rattus norvegicus
ttaaaagaggatggccttcctgctg

SEQ ID NO: 655733 - DNA, 25 bp, Rattus norvegicus
ttaaaagccaccacagttctcagtc

SEQ ID NO: 655734 - DNA, 25 bp, Rattus norvegicus
ttaaaagccaccatgactcgtgcca

SEQ ID NO: 655735 - DNA, 25 bp, Rattus norvegicus
ttaaaagccacctcagttctcagtc

SEQ ID NO: 655736 - DNA, 25 bp, Rattus norvegicus
ttaaaagccaccttgactcgtgcca

SEQ ID NO: 655737 - DNA, 25 bp, Rattus norvegicus
ttaaaagcccaaattacagccgtat

SEQ ID NO: 655738 - DNA, 25 bp, Rattus norvegicus
ttaaaagcccaatttacagccgtat

SEQ ID NO: 655739 - DNA, 25 bp, Rattus norvegicus
ttaaaagccgggatctcaccactga

SEQ ID NO: 655740 - DNA, 25 bp, Rattus norvegicus
ttaaaagccgggttctcaccactga

SEQ ID NO: 655741 - DNA, 25 bp, Rattus norvegicus
ttaaaagcttgccacaatgcgacta

SEQ ID NO: 655742 - DNA, 25 bp, Rattus norvegicus
ttaaaagcttgcgacaatgcgacta

SEQ ID NO: 655743 - DNA, 25 bp, Rattus norvegicus
ttaaaagggtgaccccttccctcat

SEQ ID NO: 655744 - DNA, 25 bp, Rattus norvegicus
ttaaaagggtgagcccttccctcat

SEQ ID NO: 655745 - DNA, 25 bp, Rattus norvegicus
ttaaaaggtctcaccgggcattgtg

SEQ ID NO: 655746 - DNA, 25 bp, Rattus norvegicus
ttaaaaggtctctccgggcattgtg

SEQ ID NO: 655747 - DNA, 25 bp, Rattus norvegicus
ttaaaagtacacactccgggtgcgt

SEQ ID NO: 655748 - DNA, 25 bp, Rattus norvegicus
ttaaaagtacactctccgggtgcgt

SEQ ID NO: 655749 - DNA, 25 bp, Rattus norvegicus
ttaaaagtcaccactgcattatagt

SEQ ID NO: 655750 - DNA, 25 bp, Rattus norvegicus
ttaaaagtcacctctgcattatagt

SEQ ID NO: 655751 - DNA, 25 bp, Rattus norvegicus
ttaaaagtcatgacagttatctgct

SEQ ID NO: 655752 - DNA, 25 bp, Rattus norvegicus
ttaaaagtcatgtcagttatctgct

SEQ ID NO: 655753 - DNA, 25 bp, Rattus norvegicus
ttaaaagtccagactcagtctcagt

SEQ ID NO: 655754 - DNA, 25 bp, Rattus norvegicus
ttaaaagtccagtctcagtctcagt

SEQ ID NO: 655755 - DNA, 25 bp, Rattus norvegicus
ttaaaagtcccaatatcacaggctt

SEQ ID NO: 655756 - DNA, 25 bp, Rattus norvegicus
ttaaaagtcccattatcacaggctt

SEQ ID NO: 655757 - DNA, 25 bp, Rattus norvegicus
ttaaaagtccttccctgcctgaggt

SEQ ID NO: 655758 - DNA, 25 bp, Rattus norvegicus
ttaaaagtccttgcctgcctgaggt

SEQ ID NO: 655759 - DNA, 25 bp, Rattus norvegicus
ttaaaagtcgtcactgcttaaggag

SEQ ID NO: 655760 - DNA, 25 bp, Rattus norvegicus
ttaaaagtcgtctctgcttaaggag

SEQ ID NO: 655761 - DNA, 25 bp, Rattus norvegicus
ttaaaagtgctcagtccaacctaac

SEQ ID NO: 655762 - DNA, 25 bp, Rattus norvegicus
ttaaaagtgctctgtccaacctaac

SEQ ID NO: 655763 - DNA, 25 bp, Rattus norvegicus
ttaaaagtggacaggctctccggga

SEQ ID NO: 655764 - DNA, 25 bp, Rattus norvegicus
ttaaaagtggactggctctccggga

SEQ ID NO: 655765 - DNA, 25 bp, Rattus norvegicus
ttaaaataactcatagcccgcttcc

SEQ ID NO: 655766 - DNA, 25 bp, Rattus norvegicus
ttaaaataactcttagcccgcttcc

SEQ ID NO: 655767 - DNA, 25 bp, Rattus norvegicus
ttaaaataattcaaggatgcctcgg

SEQ ID NO: 655768 - DNA, 25 bp, Rattus norvegicus
ttaaaataattctaggatgcctcgg

SEQ ID NO: 655769 - DNA, 25 bp, Rattus norvegicus
ttaaaatagtgcctcctttgggaag

SEQ ID NO: 655770 - DNA, 25 bp, Rattus norvegicus
ttaaaatagtgcgtcctttgggaag

SEQ ID NO: 655771 - DNA, 25 bp, Rattus norvegicus
ttaaaatcagtcacaccagtccttc

SEQ ID NO: 655772 - DNA, 25 bp, Rattus norvegicus
ttaaaatcagtctcaccagtccttc

SEQ ID NO: 655773 - DNA, 25 bp, Rattus norvegicus
ttaaaatccagacagcgcaattatt

SEQ ID NO: 655774 - DNA, 25 bp, Rattus norvegicus
ttaaaatccagagagcgcaattatt

SEQ ID NO: 655775 - DNA, 25 bp, Rattus norvegicus
ttaaaatgcccaaattccccttcaa

SEQ ID NO: 655776 - DNA, 25 bp, Rattus norvegicus
ttaaaatgcccatattccccttcaa

SEQ ID NO: 655777 - DNA, 25 bp, Rattus norvegicus
ttaaaatgcggcatttgggtctggg

SEQ ID NO: 655778 - DNA, 25 bp, Rattus norvegicus
ttaaaatgcggcttttgggtctggg

SEQ ID NO: 655779 - DNA, 25 bp, Rattus norvegicus
ttaaaatgctccagtgcttgcacgg

SEQ ID NO: 655780 - DNA, 25 bp, Rattus norvegicus
ttaaaatgctcctgtgcttgcacgg

SEQ ID NO: 655781 - DNA, 25 bp, Rattus norvegicus
ttaaaatgtctgctgaataaacttg

SEQ ID NO: 655782 - DNA, 25 bp, Rattus norvegicus
ttaaaatgtctggtgaataaacttg

SEQ ID NO: 655783 - DNA, 25 bp, Rattus norvegicus
ttaaaatgtgggatccattgccagc

SEQ ID NO: 655784 - DNA, 25 bp, Rattus norvegicus
ttaaaatgtgggttccattgccagc

SEQ ID NO: 655785 - DNA, 25 bp, Rattus norvegicus
ttaaaattagccaagcccctgtcca

SEQ ID NO: 655786 - DNA, 25 bp, Rattus norvegicus
ttaaaattagcctagcccctgtcca

SEQ ID NO: 655787 - DNA, 25 bp, Rattus norvegicus
ttaaaattctacacttctgtcccca

SEQ ID NO: 655788 - DNA, 25 bp, Rattus norvegicus
ttaaaattctactcttctgtcccca

SEQ ID NO: 655789 - DNA, 25 bp, Rattus norvegicus
ttaaaattcttcacatcccattgga

SEQ ID NO: 655790 - DNA, 25 bp, Rattus norvegicus
ttaaaattcttctcatcccattgga

SEQ ID NO: 655791 - DNA, 25 bp, Rattus norvegicus
ttaaacaaagcacccctcagacttc

SEQ ID NO: 655792 - DNA, 25 bp, Rattus norvegicus
ttaaacaaagcagccctcagacttc

SEQ ID NO: 655793 - DNA, 25 bp, Rattus norvegicus
ttaaacacactacaaaggtctttct

SEQ ID NO: 655794 - DNA, 25 bp, Rattus norvegicus
ttaaacacactagaaaggtctttct

SEQ ID NO: 655795 - DNA, 25 bp, Rattus norvegicus
ttaaacacattaaccactgtcctgg

SEQ ID NO: 655796 - DNA, 25 bp, Rattus norvegicus
ttaaacacattatccactgtcctgg

SEQ ID NO: 655797 - DNA, 25 bp, Rattus norvegicus
ttaaacaccatgatgctgctgctga

SEQ ID NO: 655798 - DNA, 25 bp, Rattus norvegicus
ttaaacaccatgttgctgctgctga

SEQ ID NO: 655799 - DNA, 25 bp, Rattus norvegicus
ttaaacacgctgcacggctgccaag

SEQ ID NO: 655800 - DNA, 25 bp, Rattus norvegicus
ttaaacacgctggacggctgccaag

SEQ ID NO: 655801 - DNA, 25 bp, Rattus norvegicus
ttaaacactgagctttctcttccgc

SEQ ID NO: 655802 - DNA, 25 bp, Rattus norvegicus
ttaaacactgaggtttctcttccgc

SEQ ID NO: 655803 - DNA, 25 bp, Rattus norvegicus
ttaaacagacacagctcttcgaggg

SEQ ID NO: 655804 - DNA, 25 bp, Rattus norvegicus
ttaaacagacactgctcttcgaggg

SEQ ID NO: 655805 - DNA, 25 bp, Rattus norvegicus
ttaaacagcaagaaatccccaacct

SEQ ID NO: 655806 - DNA, 25 bp, Rattus norvegicus
ttaaacagcaagtaatccccaacct

SEQ ID NO: 655807 - DNA, 25 bp, Rattus norvegicus
ttaaacaggcctaagaagaaatcaa

SEQ ID NO: 655808 - DNA, 25 bp, Rattus norvegicus
ttaaacaggccttagaagaaatcaa

SEQ ID NO: 655809 - DNA, 25 bp, Rattus norvegicus
ttaaacagggaacactccagcctct

SEQ ID NO: 655810 - DNA, 25 bp, Rattus norvegicus
ttaaacagggaagactccagcctct

SEQ ID NO: 655811 - DNA, 25 bp, Rattus norvegicus
ttaaacatatctcagcctcacagtg

SEQ ID NO: 655812 - DNA, 25 bp, Rattus norvegicus
ttaaacatatctgagcctcacagtg

SEQ ID NO: 655813 - DNA, 25 bp, Rattus norvegicus
ttaaacattcagacagctcctcgac

SEQ ID NO: 655814 - DNA, 25 bp, Rattus norvegicus
ttaaacattcagtcagctcctcgac

SEQ ID NO: 655815 - DNA, 25 bp, Rattus norvegicus
ttaaaccacaggctgctgaacctta

SEQ ID NO: 655816 - DNA, 25 bp, Rattus norvegicus
ttaaaccacagggtgctgaacctta

SEQ ID NO: 655817 - DNA, 25 bp, Rattus norvegicus
ttaaaccaccgaatccaagaggatg

SEQ ID NO: 655818 - DNA, 25 bp, Rattus norvegicus
ttaaaccaccgattccaagaggatg

SEQ ID NO: 655819 - DNA, 25 bp, Rattus norvegicus
ttaaaccactcccaatgtcattttt

SEQ ID NO: 655820 - DNA, 25 bp, Rattus norvegicus
ttaaaccactccgaatgtcattttt

SEQ ID NO: 655821 - DNA, 25 bp, Rattus norvegicus
ttaaaccagaatagtccatcacccc

SEQ ID NO: 655822 - DNA, 25 bp, Rattus norvegicus
ttaaaccagaattgtccatcacccc

SEQ ID NO: 655823 - DNA, 25 bp, Rattus norvegicus
ttaaaccagattatcctcaccacat

SEQ ID NO: 655824 - DNA, 25 bp, Rattus norvegicus
ttaaaccagattttcctcaccacat

SEQ ID NO: 655825 - DNA, 25 bp, Rattus norvegicus
ttaaaccagggcagcgatagtcggg

SEQ ID NO: 655826 - DNA, 25 bp, Rattus norvegicus
ttaaaccagggctgcgatagtcggg

SEQ ID NO: 655827 - DNA, 25 bp, Rattus norvegicus
ttaaaccagtttagtctccttcgag

SEQ ID NO: 655828 - DNA, 25 bp, Rattus norvegicus
ttaaaccagttttgtctccttcgag

SEQ ID NO: 655829 - DNA, 25 bp, Rattus norvegicus
ttaaaccatcacaaactgcccataa

SEQ ID NO: 655830 - DNA, 25 bp, Rattus norvegicus
ttaaaccatcactaactgcccataa

SEQ ID NO: 655831 - DNA, 25 bp, Rattus norvegicus
ttaaaccccagcagccggagtccag

SEQ ID NO: 655832 - DNA, 25 bp, Rattus norvegicus
ttaaaccccagctgccggagtccag

SEQ ID NO: 655833 - DNA, 25 bp, Rattus norvegicus
ttaaacccgtccactacagaggcga

SEQ ID NO: 655834 - DNA, 25 bp, Rattus norvegicus
ttaaacccgtcctctacagaggcga

SEQ ID NO: 655835 - DNA, 25 bp, Rattus norvegicus
ttaaaccctaaccaactgaccagag

SEQ ID NO: 655836 - DNA, 25 bp, Rattus norvegicus
ttaaaccctaacgaactgaccagag

SEQ ID NO: 655837 - DNA, 25 bp, Rattus norvegicus
ttaaaccctttgagttactaagcat

SEQ ID NO: 655838 - DNA, 25 bp, Rattus norvegicus
ttaaaccctttgtgttactaagcat

SEQ ID NO: 655839 - DNA, 25 bp, Rattus norvegicus
ttaaacctaagcagacatgaaccta

SEQ ID NO: 655840 - DNA, 25 bp, Rattus norvegicus
ttaaacctaagctgacatgaaccta

SEQ ID NO: 655841 - DNA, 25 bp, Rattus norvegicus
ttaaacctacccactgaaactgcaa

SEQ ID NO: 655842 - DNA, 25 bp, Rattus norvegicus
ttaaacctacccagaagtccacctg

SEQ ID NO: 655843 - DNA, 25 bp, Rattus norvegicus
ttaaacctaccctctgaaactgcaa

SEQ ID NO: 655844 - DNA, 25 bp, Rattus norvegicus
ttaaacctaccctgaagtccacctg

SEQ ID NO: 655845 - DNA, 25 bp, Rattus norvegicus
ttaaacctaggacctcttgtgttct

SEQ ID NO: 655846 - DNA, 25 bp, Rattus norvegicus
ttaaacctaggagctcttgtgttct

SEQ ID NO: 655847 - DNA, 25 bp, Rattus norvegicus
ttaaacctcagacgcagataggcat

SEQ ID NO: 655848 - DNA, 25 bp, Rattus norvegicus
ttaaacctcagaggcagataggcat

SEQ ID NO: 655849 - DNA, 25 bp, Rattus norvegicus
ttaaacctccaccaatagcacctgg

SEQ ID NO: 655850 - DNA, 25 bp, Rattus norvegicus
ttaaacctccacgaatagcacctgg

SEQ ID NO: 655851 - DNA, 25 bp, Rattus norvegicus
ttaaacctccccatgctgtaaatat

SEQ ID NO: 655852 - DNA, 25 bp, Rattus norvegicus
ttaaacctccccttgctgtaaatat

SEQ ID NO: 655853 - DNA, 25 bp, Rattus norvegicus
ttaaacctccctctatagaaaatat

SEQ ID NO: 655854 - DNA, 25 bp, Rattus norvegicus
ttaaacctccctgtatagaaaatat

SEQ ID NO: 655855 - DNA, 25 bp, Rattus norvegicus
ttaaacctcttcattacctttgctt

SEQ ID NO: 655856 - DNA, 25 bp, Rattus norvegicus
ttaaacctcttctttacctttgctt

SEQ ID NO: 655857 - DNA, 25 bp, Rattus norvegicus
ttaaacctgctgatccagctttaac

SEQ ID NO: 655858 - DNA, 25 bp, Rattus norvegicus
ttaaacctgctgttccagctttaac

SEQ ID NO: 655859 - DNA, 25 bp, Rattus norvegicus
ttaaaccttatgaccctcttgcctc

SEQ ID NO: 655860 - DNA, 25 bp, Rattus norvegicus
ttaaaccttatgtccctcttgcctc

SEQ ID NO: 655861 - DNA, 25 bp, Rattus norvegicus
ttaaaccttgctactactcttgagt

SEQ ID NO: 655862 - DNA, 25 bp, Rattus norvegicus
ttaaaccttgcttctactcttgagt

SEQ ID NO: 655863 - DNA, 25 bp, Rattus norvegicus
ttaaacctttcaccctccaatgctg

SEQ ID NO: 655864 - DNA, 25 bp, Rattus norvegicus
ttaaacctttcagcctccaatgctg

SEQ ID NO: 655865 - DNA, 25 bp, Rattus norvegicus
ttaaaccttttccttgcacctccag

SEQ ID NO: 655866 - DNA, 25 bp, Rattus norvegicus
ttaaaccttttcgttgcacctccag

SEQ ID NO: 655867 - DNA, 25 bp, Rattus norvegicus
ttaaacgctgttatcccttaccatg

SEQ ID NO: 655868 - DNA, 25 bp, Rattus norvegicus
ttaaacgctgttttcccttaccatg

SEQ ID NO: 655869 - DNA, 25 bp, Rattus norvegicus
ttaaacggcttcaggaccccggatg

SEQ ID NO: 655870 - DNA, 25 bp, Rattus norvegicus
ttaaacggcttctggaccccggatg

SEQ ID NO: 655871 - DNA, 25 bp, Rattus norvegicus
ttaaacgggcacacagaggtcccag

SEQ ID NO: 655872 - DNA, 25 bp, Rattus norvegicus
ttaaacgggcactcagaggtcccag

SEQ ID NO: 655873 - DNA, 25 bp, Rattus norvegicus
ttaaacgtcctccaattcctcaaag

SEQ ID NO: 655874 - DNA, 25 bp, Rattus norvegicus
ttaaacgtcctcgaattcctcaaag

SEQ ID NO: 655875 - DNA, 25 bp, Rattus norvegicus
ttaaacgtttctactgacagtgcac

SEQ ID NO: 655876 - DNA, 25 bp, Rattus norvegicus
ttaaacgtttctcttcctgtgagac

SEQ ID NO: 655877 - DNA, 25 bp, Rattus norvegicus
ttaaacgtttctgttcctgtgagac

SEQ ID NO: 655878 - DNA, 25 bp, Rattus norvegicus
ttaaacgtttcttctgacagtgcac

SEQ ID NO: 655879 - DNA, 25 bp, Rattus norvegicus
ttaaactactcacagccaggcaggt

SEQ ID NO: 655880 - DNA, 25 bp, Rattus norvegicus
ttaaactactcagagccaggcaggt

SEQ ID NO: 655881 - DNA, 25 bp, Rattus norvegicus
ttaaactactgacctgtctttctat

SEQ ID NO: 655882 - DNA, 25 bp, Rattus norvegicus
ttaaactactgagctgtctttctat

SEQ ID NO: 655883 - DNA, 25 bp, Rattus norvegicus
ttaaactactttaatgcgcgttcat

SEQ ID NO: 655884 - DNA, 25 bp, Rattus norvegicus
ttaaactacttttatgcgcgttcat

SEQ ID NO: 655885 - DNA, 25 bp, Rattus norvegicus
ttaaactatgtcatcttctacccca

SEQ ID NO: 655886 - DNA, 25 bp, Rattus norvegicus
ttaaactatgtcttcttctacccca

SEQ ID NO: 655887 - DNA, 25 bp, Rattus norvegicus
ttaaactcatctcttggccgctaag

SEQ ID NO: 655888 - DNA, 25 bp, Rattus norvegicus
ttaaactcatctgttggccgctaag

SEQ ID NO: 655889 - DNA, 25 bp, Rattus norvegicus
ttaaactccttcacttgccttctaa

SEQ ID NO: 655890 - DNA, 25 bp, Rattus norvegicus
ttaaactccttctcttgccttctaa

SEQ ID NO: 655891 - DNA, 25 bp, Rattus norvegicus
ttaaactctcacaccttcttttgta

SEQ ID NO: 655892 - DNA, 25 bp, Rattus norvegicus
ttaaactctcactccttcttttgta

SEQ ID NO: 655893 - DNA, 25 bp, Rattus norvegicus
ttaaactctgcaactttgtctctgt

SEQ ID NO: 655894 - DNA, 25 bp, Rattus norvegicus
ttaaactctgcatctttgtctctgt

SEQ ID NO: 655895 - DNA, 25 bp, Rattus norvegicus
ttaaactcttaaacgtagcggccat

SEQ ID NO: 655896 - DNA, 25 bp, Rattus norvegicus
ttaaactcttaatcgtagcggccat

SEQ ID NO: 655897 - DNA, 25 bp, Rattus norvegicus
ttaaactgatccacactatgccatg

SEQ ID NO: 655898 - DNA, 25 bp, Rattus norvegicus
ttaaactgatcctcactatgccatg

SEQ ID NO: 655899 - DNA, 25 bp, Rattus norvegicus
ttaaactgctgtacactgacctcac

SEQ ID NO: 655900 - DNA, 25 bp, Rattus norvegicus
ttaaactgctgtcgtgttcggcttc

SEQ ID NO: 655901 - DNA, 25 bp, Rattus norvegicus
ttaaactgctgtggtgttcggcttc

SEQ ID NO: 655902 - DNA, 25 bp, Rattus norvegicus
ttaaactgctgttcactgacctcac

SEQ ID NO: 655903 - DNA, 25 bp, Rattus norvegicus
ttaaactggttgagtcacttggctc

SEQ ID NO: 655904 - DNA, 25 bp, Rattus norvegicus
ttaaactggttgtgtcacttggctc

SEQ ID NO: 655905 - DNA, 25 bp, Rattus norvegicus
ttaaactgtgaaatccacctgccag

SEQ ID NO: 655906 - DNA, 25 bp, Rattus norvegicus
ttaaactgtgaattccacctgccag

SEQ ID NO: 655907 - DNA, 25 bp, Rattus norvegicus
ttaaacttatctacctcaaatccct

SEQ ID NO: 655908 - DNA, 25 bp, Rattus norvegicus
ttaaacttatcttcctcaaatccct

SEQ ID NO: 655909 - DNA, 25 bp, Rattus norvegicus
ttaaacttcttaccctaccaaggcg

SEQ ID NO: 655910 - DNA, 25 bp, Rattus norvegicus
ttaaacttcttagcctaccaaggcg

SEQ ID NO: 655911 - DNA, 25 bp, Rattus norvegicus
ttaaacttggacatcaccttcctat

SEQ ID NO: 655912 - DNA, 25 bp, Rattus norvegicus
ttaaacttggacttcaccttcctat

SEQ ID NO: 655913 - DNA, 25 bp, Rattus norvegicus
ttaaacttgttcatctcgactccgt

SEQ ID NO: 655914 - DNA, 25 bp, Rattus norvegicus
ttaaacttgttcttctcgactccgt

SEQ ID NO: 655915 - DNA, 25 bp, Rattus norvegicus
ttaaacttttccactaggcacctgt

SEQ ID NO: 655916 - DNA, 25 bp, Rattus norvegicus
ttaaacttttcctctaggcacctgt

SEQ ID NO: 655917 - DNA, 25 bp, Rattus norvegicus
ttaaagaaacccaagtgcgccgcaa

SEQ ID NO: 655918 - DNA, 25 bp, Rattus norvegicus
ttaaagaaaccctagtgcgccgcaa

SEQ ID NO: 655919 - DNA, 25 bp, Rattus norvegicus
ttaaagaaagctcgccagccagcct

SEQ ID NO: 655920 - DNA, 25 bp, Rattus norvegicus
ttaaagaaagctggccagccagcct

SEQ ID NO: 655921 - DNA, 25 bp, Rattus norvegicus
ttaaagaaccttctactctctgatg

SEQ ID NO: 655922 - DNA, 25 bp, Rattus norvegicus
ttaaagaaccttgtactctctgatg

SEQ ID NO: 655923 - DNA, 25 bp, Rattus norvegicus
ttaaagaattccaggcgcttgcgtc

SEQ ID NO: 655924 - DNA, 25 bp, Rattus norvegicus
ttaaagaattcctggcgcttgcgtc

SEQ ID NO: 655925 - DNA, 25 bp, Rattus norvegicus
ttaaagacctacactaacccagaag

SEQ ID NO: 655926 - DNA, 25 bp, Rattus norvegicus
ttaaagacctactctaacccagaag

SEQ ID NO: 655927 - DNA, 25 bp, Rattus norvegicus
ttaaagacgtgtcactctgccgctc

SEQ ID NO: 655928 - DNA, 25 bp, Rattus norvegicus
ttaaagacgtgtgactctgccgctc

SEQ ID NO: 655929 - DNA, 25 bp, Rattus norvegicus
ttaaagactaacctgtcttgttggg

SEQ ID NO: 655930 - DNA, 25 bp, Rattus norvegicus
ttaaagactaacgtgtcttgttggg

SEQ ID NO: 655931 - DNA, 25 bp, Rattus norvegicus
ttaaagactggacccacctgtgacc

SEQ ID NO: 655932 - DNA, 25 bp, Rattus norvegicus
ttaaagactggagccacctgtgacc

SEQ ID NO: 655933 - DNA, 25 bp, Rattus norvegicus
ttaaagacttctccctgtttctctg

SEQ ID NO: 655934 - DNA, 25 bp, Rattus norvegicus
ttaaagacttctgcctgtttctctg

SEQ ID NO: 655935 - DNA, 25 bp, Rattus norvegicus
ttaaagacttgtacttgagacccaa

SEQ ID NO: 655936 - DNA, 25 bp, Rattus norvegicus
ttaaagacttgttcttgagacccaa

SEQ ID NO: 655937 - DNA, 25 bp, Rattus norvegicus
ttaaagagcccgcatgcatttgtgg

SEQ ID NO: 655938 - DNA, 25 bp, Rattus norvegicus
ttaaagagcccggatgcatttgtgg

SEQ ID NO: 655939 - DNA, 25 bp, Rattus norvegicus
ttaaagaggattatgtgcctgtgca

SEQ ID NO: 655940 - DNA, 25 bp, Rattus norvegicus
ttaaagaggattttgtgcctgtgca

SEQ ID NO: 655941 - DNA, 25 bp, Rattus norvegicus
ttaaagagggtgactgctttctcag

SEQ ID NO: 655942 - DNA, 25 bp, Rattus norvegicus
ttaaagagggtgtctgctttctcag

SEQ ID NO: 655943 - DNA, 25 bp, Rattus norvegicus
ttaaagagtcctacactcgtctgac

SEQ ID NO: 655944 - DNA, 25 bp, Rattus norvegicus
ttaaagagtccttcactcgtctgac

SEQ ID NO: 655945 - DNA, 25 bp, Rattus norvegicus
ttaaagagtgtaagcccgtcctgag

SEQ ID NO: 655946 - DNA, 25 bp, Rattus norvegicus
ttaaagagtgtatgcccgtcctgag

SEQ ID NO: 655947 - DNA, 25 bp, Rattus norvegicus
ttaaagagtgttatggccagctgac

SEQ ID NO: 655948 - DNA, 25 bp, Rattus norvegicus
ttaaagagtgttttggccagctgac

SEQ ID NO: 655949 - DNA, 25 bp, Rattus norvegicus
ttaaagatacaaacctgggccaggg

SEQ ID NO: 655950 - DNA, 25 bp, Rattus norvegicus
ttaaagatacaatcctgggccaggg

SEQ ID NO: 655951 - DNA, 25 bp, Rattus norvegicus
ttaaagatcactctcctgattatat

SEQ ID NO: 655952 - DNA, 25 bp, Rattus norvegicus
ttaaagatcactgtcctgattatat

SEQ ID NO: 655953 - DNA, 25 bp, Rattus norvegicus
ttaaagatcctaatttctgtctcaa

SEQ ID NO: 655954 - DNA, 25 bp, Rattus norvegicus
ttaaagatcctattttctgtctcaa

SEQ ID NO: 655955 - DNA, 25 bp, Rattus norvegicus
ttaaagatgggtatcccctgtctca

SEQ ID NO: 655956 - DNA, 25 bp, Rattus norvegicus
ttaaagatgggtttcccctgtctca

SEQ ID NO: 655957 - DNA, 25 bp, Rattus norvegicus
ttaaagattcacattcctccgcctc

SEQ ID NO: 655958 - DNA, 25 bp, Rattus norvegicus
ttaaagattcactttcctccgcctc

SEQ ID NO: 655959 - DNA, 25 bp, Rattus norvegicus
ttaaagatttgactgcagaaagcat

SEQ ID NO: 655960 - DNA, 25 bp, Rattus norvegicus
ttaaagatttgagtgcagaaagcat

SEQ ID NO: 655961 - DNA, 25 bp, Rattus norvegicus
ttaaagcagaacacagaggcacctc

SEQ ID NO: 655962 - DNA, 25 bp, Rattus norvegicus
ttaaagcagaactcagaggcacctc

SEQ ID NO: 655963 - DNA, 25 bp, Rattus norvegicus
ttaaagcagatcatcgggcgcccag

SEQ ID NO: 655964 - DNA, 25 bp, Rattus norvegicus
ttaaagcagatcttcgggcgcccag

SEQ ID NO: 655965 - DNA, 25 bp, Rattus norvegicus
ttaaagcagtccatcctggagcgtc

SEQ ID NO: 655966 - DNA, 25 bp, Rattus norvegicus
ttaaagcagtccttcctggagcgtc

SEQ ID NO: 655967 - DNA, 25 bp, Rattus norvegicus
ttaaagccaacgatgtcttccccat

SEQ ID NO: 655968 - DNA, 25 bp, Rattus norvegicus
ttaaagccaacgttgtcttccccat

SEQ ID NO: 655969 - DNA, 25 bp, Rattus norvegicus
ttaaagccacatatctactcaaagc

SEQ ID NO: 655970 - DNA, 25 bp, Rattus norvegicus
ttaaagccacatttctactcaaagc

SEQ ID NO: 655971 - DNA, 25 bp, Rattus norvegicus
ttaaagccagatcctcccaagggtg

SEQ ID NO: 655972 - DNA, 25 bp, Rattus norvegicus
ttaaagccagatgctcccaagggtg

SEQ ID NO: 655973 - DNA, 25 bp, Rattus norvegicus
ttaaagccatatctcaccttaccca

SEQ ID NO: 655974 - DNA, 25 bp, Rattus norvegicus
ttaaagccatatgtcaccttaccca

SEQ ID NO: 655975 - DNA, 25 bp, Rattus norvegicus
ttaaagccctaactgccatgccaac

SEQ ID NO: 655976 - DNA, 25 bp, Rattus norvegicus
ttaaagccctaagtgccatgccaac

SEQ ID NO: 655977 - DNA, 25 bp, Rattus norvegicus
ttaaagccgagcactccgtcatggg

SEQ ID NO: 655978 - DNA, 25 bp, Rattus norvegicus
ttaaagccgagctctccgtcatggg

SEQ ID NO: 655979 - DNA, 25 bp, Rattus norvegicus
ttaaagcctcctcgaagaagccctg

SEQ ID NO: 655980 - DNA, 25 bp, Rattus norvegicus
ttaaagcctcctggaagaagccctg

SEQ ID NO: 655981 - DNA, 25 bp, Rattus norvegicus
ttaaagcctgtgaccatctctagat

SEQ ID NO: 655982 - DNA, 25 bp, Rattus norvegicus
ttaaagcctgtgtccatctctagat

SEQ ID NO: 655983 - DNA, 25 bp, Rattus norvegicus
ttaaagccttctcgataactgacgc

SEQ ID NO: 655984 - DNA, 25 bp, Rattus norvegicus
ttaaagccttctggataactgacgc

SEQ ID NO: 655985 - DNA, 25 bp, Rattus norvegicus
ttaaagccttgcaccattcctagga

SEQ ID NO: 655986 - DNA, 25 bp, Rattus norvegicus
ttaaagccttgctccattcctagga

SEQ ID NO: 655987 - DNA, 25 bp, Rattus norvegicus
ttaaagcgctctctgcagcaggagg

SEQ ID NO: 655988 - DNA, 25 bp, Rattus norvegicus
ttaaagcgctctgtgcagcaggagg

SEQ ID NO: 655989 - DNA, 25 bp, Rattus norvegicus
ttaaagcggttcagtccgtggtgct

SEQ ID NO: 655990 - DNA, 25 bp, Rattus norvegicus
ttaaagcggttctgtccgtggtgct

SEQ ID NO: 655991 - DNA, 25 bp, Rattus norvegicus
ttaaagctaagaacctccactccaa

SEQ ID NO: 655992 - DNA, 25 bp, Rattus norvegicus
ttaaagctaagatcctccactccaa

SEQ ID NO: 655993 - DNA, 25 bp, Rattus norvegicus
ttaaagctatcaactcacgctctac

SEQ ID NO: 655994 - DNA, 25 bp, Rattus norvegicus
ttaaagctatcatctcacgctctac

SEQ ID NO: 655995 - DNA, 25 bp, Rattus norvegicus
ttaaagctcgtgactcactgtctgg

SEQ ID NO: 655996 - DNA, 25 bp, Rattus norvegicus
ttaaagctcgtgtctcactgtctgg

SEQ ID NO: 655997 - DNA, 25 bp, Rattus norvegicus
ttaaagctcttgactctctcagata

SEQ ID NO: 655998 - DNA, 25 bp, Rattus norvegicus
ttaaagctcttgtctctctcagata

SEQ ID NO: 655999 - DNA, 25 bp, Rattus norvegicus
ttaaagctgggaccccactgggagt

SEQ ID NO: 656000 - DNA, 25 bp, Rattus norvegicus
ttaaagctgggagcccactgggagt

SEQ ID NO: 656001 - DNA, 25 bp, Rattus norvegicus
ttaaagcttgtcctgtcacgctatg

SEQ ID NO: 656002 - DNA, 25 bp, Rattus norvegicus
ttaaagcttgtcgtgtcacgctatg

SEQ ID NO: 656003 - DNA, 25 bp, Rattus norvegicus
ttaaaggacaacacacaccctccgc

SEQ ID NO: 656004 - DNA, 25 bp, Rattus norvegicus
ttaaaggacaactcacaccctccgc

SEQ ID NO: 656005 - DNA, 25 bp, Rattus norvegicus
ttaaaggacctgacactacacaaaa

SEQ ID NO: 656006 - DNA, 25 bp, Rattus norvegicus
ttaaaggacctgtcactacacaaaa

SEQ ID NO: 656007 - DNA, 25 bp, Rattus norvegicus
ttaaaggagcttacggccatgttct

SEQ ID NO: 656008 - DNA, 25 bp, Rattus norvegicus
ttaaaggagctttcggccatgttct

SEQ ID NO: 656009 - DNA, 25 bp, Rattus norvegicus
ttaaaggagtctagagttccgctgt

SEQ ID NO: 656010 - DNA, 25 bp, Rattus norvegicus
ttaaaggagtcttgagttccgctgt

SEQ ID NO: 656011 - DNA, 25 bp, Rattus norvegicus
ttaaaggatcatacacagcacagtt

SEQ ID NO: 656012 - DNA, 25 bp, Rattus norvegicus
ttaaaggatcattcacagcacagtt

SEQ ID NO: 656013 - DNA, 25 bp, Rattus norvegicus
ttaaaggatgtgatgtgttcccact

SEQ ID NO: 656014 - DNA, 25 bp, Rattus norvegicus
ttaaaggatgtgttgtgttcccact

SEQ ID NO: 656015 - DNA, 25 bp, Rattus norvegicus
ttaaaggcaacgatgggcctggccg

SEQ ID NO: 656016 - DNA, 25 bp, Rattus norvegicus
ttaaaggcaacgttgggcctggccg

SEQ ID NO: 656017 - DNA, 25 bp, Rattus norvegicus
ttaaaggcagccctgagctgctgct

SEQ ID NO: 656018 - DNA, 25 bp, Rattus norvegicus
ttaaaggcagccgtgagctgctgct

SEQ ID NO: 656019 - DNA, 25 bp, Rattus norvegicus
ttaaaggcagggatccactctcaaa

SEQ ID NO: 656020 - DNA, 25 bp, Rattus norvegicus
ttaaaggcagggttccactctcaaa

SEQ ID NO: 656021 - DNA, 25 bp, Rattus norvegicus
ttaaaggcaggtaccttcatgcccc

SEQ ID NO: 656022 - DNA, 25 bp, Rattus norvegicus
ttaaaggcaggttccttcatgcccc

SEQ ID NO: 656023 - DNA, 25 bp, Rattus norvegicus
ttaaaggcatgcatgccactgtcca

SEQ ID NO: 656024 - DNA, 25 bp, Rattus norvegicus
ttaaaggcatgcttgccactgtcca

SEQ ID NO: 656025 - DNA, 25 bp, Rattus norvegicus
ttaaaggcccctactggcttggtag

SEQ ID NO: 656026 - DNA, 25 bp, Rattus norvegicus
ttaaaggccccttctggcttggtag

SEQ ID NO: 656027 - DNA, 25 bp, Rattus norvegicus
ttaaaggccttacccagatgcttgt

SEQ ID NO: 656028 - DNA, 25 bp, Rattus norvegicus
ttaaaggccttagccagatgcttgt

SEQ ID NO: 656029 - DNA, 25 bp, Rattus norvegicus
ttaaaggcgtgtcgcactaccgcct

SEQ ID NO: 656030 - DNA, 25 bp, Rattus norvegicus
ttaaaggcgtgtggcactaccgcct

SEQ ID NO: 656031 - DNA, 25 bp, Rattus norvegicus
ttaaaggcttgaaccaccacactca

SEQ ID NO: 656032 - DNA, 25 bp, Rattus norvegicus
ttaaaggcttgatccaccacactca

SEQ ID NO: 656033 - DNA, 25 bp, Rattus norvegicus
ttaaagggcaaaaccagggctggca

SEQ ID NO: 656034 - DNA, 25 bp, Rattus norvegicus
ttaaagggcaaatccagggctggca

SEQ ID NO: 656035 - DNA, 25 bp, Rattus norvegicus
ttaaagggtcctcatctctaaccta

SEQ ID NO: 656036 - DNA, 25 bp, Rattus norvegicus
ttaaagggtcctgatctctaaccta

SEQ ID NO: 656037 - DNA, 25 bp, Rattus norvegicus
ttaaaggtccagatggcttggcctg

SEQ ID NO: 656038 - DNA, 25 bp, Rattus norvegicus
ttaaaggtccagttggcttggcctg

SEQ ID NO: 656039 - DNA, 25 bp, Rattus norvegicus
ttaaaggtgcagacatcccggccaa

SEQ ID NO: 656040 - DNA, 25 bp, Rattus norvegicus
ttaaaggtgcagtcatcccggccaa

SEQ ID NO: 656041 - DNA, 25 bp, Rattus norvegicus
ttaaaggttcagatcacctactagt

SEQ ID NO: 656042 - DNA, 25 bp, Rattus norvegicus
ttaaaggttcagttcacctactagt

SEQ ID NO: 656043 - DNA, 25 bp, Rattus norvegicus
ttaaagtatagtaacataagtggac

SEQ ID NO: 656044 - DNA, 25 bp, Rattus norvegicus
ttaaagtatagttacataagtggac

SEQ ID NO: 656045 - DNA, 25 bp, Rattus norvegicus
ttaaagtcagaacgccggatgggtc

SEQ ID NO: 656046 - DNA, 25 bp, Rattus norvegicus
ttaaagtcagaaggccggatgggtc

SEQ ID NO: 656047 - DNA, 25 bp, Rattus norvegicus
ttaaagtccgaaatctctcagagta

SEQ ID NO: 656048 - DNA, 25 bp, Rattus norvegicus
ttaaagtccgaattctctcagagta

SEQ ID NO: 656049 - DNA, 25 bp, Rattus norvegicus
ttaaagtcggccagcggcagtgtca

SEQ ID NO: 656050 - DNA, 25 bp, Rattus norvegicus
ttaaagtcggcctgcggcagtgtca

SEQ ID NO: 656051 - DNA, 25 bp, Rattus norvegicus
ttaaagtctctacctgcaaaccctc

SEQ ID NO: 656052 - DNA, 25 bp, Rattus norvegicus
ttaaagtctctagctgcaaaccctc

SEQ ID NO: 656053 - DNA, 25 bp, Rattus norvegicus
ttaaagtctctgcaggcgtctgctt

SEQ ID NO: 656054 - DNA, 25 bp, Rattus norvegicus
ttaaagtctctgcagtcccacctgg

SEQ ID NO: 656055 - DNA, 25 bp, Rattus norvegicus
ttaaagtctctggaggcgtctgctt

SEQ ID NO: 656056 - DNA, 25 bp, Rattus norvegicus
ttaaagtctctggagtcccacctgg

SEQ ID NO: 656057 - DNA, 25 bp, Rattus norvegicus
ttaaagtctgcaaagctgcgccctg

SEQ ID NO: 656058 - DNA, 25 bp, Rattus norvegicus
ttaaagtctgcactgcccgtctgtt

SEQ ID NO: 656059 - DNA, 25 bp, Rattus norvegicus
ttaaagtctgcagtgcccgtctgtt

SEQ ID NO: 656060 - DNA, 25 bp, Rattus norvegicus
ttaaagtctgcatagctgcgccctg

SEQ ID NO: 656061 - DNA, 25 bp, Rattus norvegicus
ttaaagtctggccaccggactttgc

SEQ ID NO: 656062 - DNA, 25 bp, Rattus norvegicus
ttaaagtctggcgaccggactttgc

SEQ ID NO: 656063 - DNA, 25 bp, Rattus norvegicus
ttaaagtcttagacaggcctgggtg

SEQ ID NO: 656064 - DNA, 25 bp, Rattus norvegicus
ttaaagtcttagtcaggcctgggtg

SEQ ID NO: 656065 - DNA, 25 bp, Rattus norvegicus
ttaaagtgttctcccacagtaccaa

SEQ ID NO: 656066 - DNA, 25 bp, Rattus norvegicus
ttaaagtgttctgccacagtaccaa

SEQ ID NO: 656067 - DNA, 25 bp, Rattus norvegicus
ttaaagttcctactgatgtctcccc

SEQ ID NO: 656068 - DNA, 25 bp, Rattus norvegicus
ttaaagttcctagtgatgtctcccc

SEQ ID NO: 656069 - DNA, 25 bp, Rattus norvegicus
ttaaagttccttataatcctcctgc

SEQ ID NO: 656070 - DNA, 25 bp, Rattus norvegicus
ttaaagttccttttaatcctcctgc

SEQ ID NO: 656071 - DNA, 25 bp, Rattus norvegicus
ttaaagttcgcgagtcttggactaa

SEQ ID NO: 656072 - DNA, 25 bp, Rattus norvegicus
ttaaagttcgcgtgtcttggactaa

SEQ ID NO: 656073 - DNA, 25 bp, Rattus norvegicus
ttaaagttgctgatgctgctaaagt

SEQ ID NO: 656074 - DNA, 25 bp, Rattus norvegicus
ttaaagttgctgttgctgctaaagt

SEQ ID NO: 656075 - DNA, 25 bp, Rattus norvegicus
ttaaagtttcctagacctgtccttg

SEQ ID NO: 656076 - DNA, 25 bp, Rattus norvegicus
ttaaagtttccttgacctgtccttg

SEQ ID NO: 656077 - DNA, 25 bp, Rattus norvegicus
ttaaataaccacactgctccctgag

SEQ ID NO: 656078 - DNA, 25 bp, Rattus norvegicus
ttaaataaccactctgctccctgag

SEQ ID NO: 656079 - DNA, 25 bp, Rattus norvegicus
ttaaataagtgaccccaggctctgc

SEQ ID NO: 656080 - DNA, 25 bp, Rattus norvegicus
ttaaataagtgagcccaggctctgc

SEQ ID NO: 656081 - DNA, 25 bp, Rattus norvegicus
ttaaataatctgcattttctttggc

SEQ ID NO: 656082 - DNA, 25 bp, Rattus norvegicus
ttaaataatctggattttctttggc

SEQ ID NO: 656083 - DNA, 25 bp, Rattus norvegicus
ttaaatagcccgagttgacatccag

SEQ ID NO: 656084 - DNA, 25 bp, Rattus norvegicus
ttaaatagcccgtgttgacatccag

SEQ ID NO: 656085 - DNA, 25 bp, Rattus norvegicus
ttaaatagtcccatatacccctccg

SEQ ID NO: 656086 - DNA, 25 bp, Rattus norvegicus
ttaaatagtcccttatacccctccg

SEQ ID NO: 656087 - DNA, 25 bp, Rattus norvegicus
ttaaatataaccaccctcagggatt

SEQ ID NO: 656088 - DNA, 25 bp, Rattus norvegicus
ttaaatataacctccctcagggatt

SEQ ID NO: 656089 - DNA, 25 bp, Rattus norvegicus
ttaaatatcaacacttcctgcctaa

SEQ ID NO: 656090 - DNA, 25 bp, Rattus norvegicus
ttaaatatcaactcttcctgcctaa

SEQ ID NO: 656091 - DNA, 25 bp, Rattus norvegicus
ttaaatatgacaccactctccctat

SEQ ID NO: 656092 - DNA, 25 bp, Rattus norvegicus
ttaaatatgacagcactctccctat

SEQ ID NO: 656093 - DNA, 25 bp, Rattus norvegicus
ttaaatattaccactggcagccagc

SEQ ID NO: 656094 - DNA, 25 bp, Rattus norvegicus
ttaaatattacctctggcagccagc

SEQ ID NO: 656095 - DNA, 25 bp, Rattus norvegicus
ttaaatattcttctgcaaactggat

SEQ ID NO: 656096 - DNA, 25 bp, Rattus norvegicus
ttaaatattcttgtgcaaactggat

SEQ ID NO: 656097 - DNA, 25 bp, Rattus norvegicus
ttaaatatttcaccctcccttctag

SEQ ID NO: 656098 - DNA, 25 bp, Rattus norvegicus
ttaaatatttcagcctcccttctag

SEQ ID NO: 656099 - DNA, 25 bp, Rattus norvegicus
ttaaatcaagccacagccacagtca

SEQ ID NO: 656100 - DNA, 25 bp, Rattus norvegicus
ttaaatcaagcctcagccacagtca

SEQ ID NO: 656101 - DNA, 25 bp, Rattus norvegicus
ttaaatcaccaaatcaacctttcct

SEQ ID NO: 656102 - DNA, 25 bp, Rattus norvegicus
ttaaatcaccaattcaacctttcct

SEQ ID NO: 656103 - DNA, 25 bp, Rattus norvegicus
ttaaatcagctgaggctacacacct

SEQ ID NO: 656104 - DNA, 25 bp, Rattus norvegicus
ttaaatcagctgtggctacacacct

SEQ ID NO: 656105 - DNA, 25 bp, Rattus norvegicus
ttaaatcaggcgacctcccagtctt

SEQ ID NO: 656106 - DNA, 25 bp, Rattus norvegicus
ttaaatcaggcgtcctcccagtctt

SEQ ID NO: 656107 - DNA, 25 bp, Rattus norvegicus
ttaaatccagttctgctgcccatat

SEQ ID NO: 656108 - DNA, 25 bp, Rattus norvegicus
ttaaatccagttgtgctgcccatat

SEQ ID NO: 656109 - DNA, 25 bp, Rattus norvegicus
ttaaatcccactaccacaaagcaat

SEQ ID NO: 656110 - DNA, 25 bp, Rattus norvegicus
ttaaatcccacttccacaaagcaat

SEQ ID NO: 656111 - DNA, 25 bp, Rattus norvegicus
ttaaatccccacagagaccatggct

SEQ ID NO: 656112 - DNA, 25 bp, Rattus norvegicus
ttaaatccccactgagaccatggct

SEQ ID NO: 656113 - DNA, 25 bp, Rattus norvegicus
ttaaatcccctccaatttctgtcaa

SEQ ID NO: 656114 - DNA, 25 bp, Rattus norvegicus
ttaaatcccctcgaatttctgtcaa

SEQ ID NO: 656115 - DNA, 25 bp, Rattus norvegicus
ttaaatcctggcaaacacatggtgg

SEQ ID NO: 656116 - DNA, 25 bp, Rattus norvegicus
ttaaatcctggctaacacatggtgg

SEQ ID NO: 656117 - DNA, 25 bp, Rattus norvegicus
ttaaatccttctctgccagcccagg

SEQ ID NO: 656118 - DNA, 25 bp, Rattus norvegicus
ttaaatccttctgtgccagcccagg

SEQ ID NO: 656119 - DNA, 25 bp, Rattus norvegicus
ttaaatcgatctaacctgcctaact

SEQ ID NO: 656120 - DNA, 25 bp, Rattus norvegicus
ttaaatcgatcttacctgcctaact

SEQ ID NO: 656121 - DNA, 25 bp, Rattus norvegicus
ttaaatcggtgtctctcttcggtca

SEQ ID NO: 656122 - DNA, 25 bp, Rattus norvegicus
ttaaatcggtgtgtctcttcggtca

SEQ ID NO: 656123 - DNA, 25 bp, Rattus norvegicus
ttaaatctgactatcccaagggctc

SEQ ID NO: 656124 - DNA, 25 bp, Rattus norvegicus
ttaaatctgactttcccaagggctc

SEQ ID NO: 656125 - DNA, 25 bp, Rattus norvegicus
ttaaatctggtcagccaaacggctt

SEQ ID NO: 656126 - DNA, 25 bp, Rattus norvegicus
ttaaatctggtctgccaaacggctt

SEQ ID NO: 656127 - DNA, 25 bp, Rattus norvegicus
ttaaatcttcaaccacctcgtgttc

SEQ ID NO: 656128 - DNA, 25 bp, Rattus norvegicus
ttaaatcttcaagcacctcgtgttc

SEQ ID NO: 656129 - DNA, 25 bp, Rattus norvegicus
ttaaatcttccaattctttatcatg

SEQ ID NO: 656130 - DNA, 25 bp, Rattus norvegicus
ttaaatcttccatttctttatcatg

SEQ ID NO: 656131 - DNA, 25 bp, Rattus norvegicus
ttaaatcttcgtactcgtgagctta

SEQ ID NO: 656132 - DNA, 25 bp, Rattus norvegicus
ttaaatcttcgttctcgtgagctta

SEQ ID NO: 656133 - DNA, 25 bp, Rattus norvegicus
ttaaatgaagcccttctcaggcggg

SEQ ID NO: 656134 - DNA, 25 bp, Rattus norvegicus
ttaaatgaagccgttctcaggcggg

SEQ ID NO: 656135 - DNA, 25 bp, Rattus norvegicus
ttaaatgacacaccttgcaccatgt

SEQ ID NO: 656136 - DNA, 25 bp, Rattus norvegicus
ttaaatgacacagcttgcaccatgt

SEQ ID NO: 656137 - DNA, 25 bp, Rattus norvegicus
ttaaatgaggccattctggaatatt

SEQ ID NO: 656138 - DNA, 25 bp, Rattus norvegicus
ttaaatgaggcctttctggaatatt

SEQ ID NO: 656139 - DNA, 25 bp, Rattus norvegicus
ttaaatgatggtcgctctccaggga

SEQ ID NO: 656140 - DNA, 25 bp, Rattus norvegicus
ttaaatgatggtggctctccaggga

SEQ ID NO: 656141 - DNA, 25 bp, Rattus norvegicus
ttaaatgcaccaagtcccatctggg

SEQ ID NO: 656142 - DNA, 25 bp, Rattus norvegicus
ttaaatgcaccatgtcccatctggg

SEQ ID NO: 656143 - DNA, 25 bp, Rattus norvegicus
ttaaatgcgctgaatccaggctgca

SEQ ID NO: 656144 - DNA, 25 bp, Rattus norvegicus
ttaaatgcgctgtatccaggctgca

SEQ ID NO: 656145 - DNA, 25 bp, Rattus norvegicus
ttaaatgctaatcacgcctgccggc

SEQ ID NO: 656146 - DNA, 25 bp, Rattus norvegicus
ttaaatgctaatgacgcctgccggc

SEQ ID NO: 656147 - DNA, 25 bp, Rattus norvegicus
ttaaatgctataccccaagctttgt

SEQ ID NO: 656148 - DNA, 25 bp, Rattus norvegicus
ttaaatgctatagcccaagctttgt

SEQ ID NO: 656149 - DNA, 25 bp, Rattus norvegicus
ttaaatgctgccatgggcactttaa

SEQ ID NO: 656150 - DNA, 25 bp, Rattus norvegicus
ttaaatgctgccttgggcactttaa

SEQ ID NO: 656151 - DNA, 25 bp, Rattus norvegicus
ttaaatgcttggacttcagcctcgt

SEQ ID NO: 656152 - DNA, 25 bp, Rattus norvegicus
ttaaatgcttggtcttcagcctcgt

SEQ ID NO: 656153 - DNA, 25 bp, Rattus norvegicus
ttaaatggaaccactgctgcccggg

SEQ ID NO: 656154 - DNA, 25 bp, Rattus norvegicus
ttaaatggaacctctgctgcccggg

SEQ ID NO: 656155 - DNA, 25 bp, Rattus norvegicus
ttaaatggacgaccctgtgcatcac

SEQ ID NO: 656156 - DNA, 25 bp, Rattus norvegicus
ttaaatggacgagcctgtgcatcac

SEQ ID NO: 656157 - DNA, 25 bp, Rattus norvegicus
ttaaatgggagtacatttgggctgg

SEQ ID NO: 656158 - DNA, 25 bp, Rattus norvegicus
ttaaatgggagttcatttgggctgg

SEQ ID NO: 656159 - DNA, 25 bp, Rattus norvegicus
ttaaatggtgctaaaagagcccatc

SEQ ID NO: 656160 - DNA, 25 bp, Rattus norvegicus
ttaaatggtgcttaaagagcccatc

SEQ ID NO: 656161 - DNA, 25 bp, Rattus norvegicus
ttaaatggttgtactcacccctcac

SEQ ID NO: 656162 - DNA, 25 bp, Rattus norvegicus
ttaaatggttgttctcacccctcac

SEQ ID NO: 656163 - DNA, 25 bp, Rattus norvegicus
ttaaatgtgtttcctgaggcttgcc

SEQ ID NO: 656164 - DNA, 25 bp, Rattus norvegicus
ttaaatgtgtttgctgaggcttgcc

SEQ ID NO: 656165 - DNA, 25 bp, Rattus norvegicus
ttaaatgttatgagccactgtgccc

SEQ ID NO: 656166 - DNA, 25 bp, Rattus norvegicus
ttaaatgttatgtgccactgtgccc

SEQ ID NO: 656167 - DNA, 25 bp, Rattus norvegicus
ttaaatgttccacggccattgtcgc

SEQ ID NO: 656168 - DNA, 25 bp, Rattus norvegicus
ttaaatgttccagggccattgtcgc

SEQ ID NO: 656169 - DNA, 25 bp, Rattus norvegicus
ttaaatgtttccatctgactccctg

SEQ ID NO: 656170 - DNA, 25 bp, Rattus norvegicus
ttaaatgtttccttctgactccctg

SEQ ID NO: 656171 - DNA, 25 bp, Rattus norvegicus
ttaaatgtttgcatgtgaaagcccc

SEQ ID NO: 656172 - DNA, 25 bp, Rattus norvegicus
ttaaatgtttgcttgtgaaagcccc

SEQ ID NO: 656173 - DNA, 25 bp, Rattus norvegicus
ttaaattacaccacgacgaccacac

SEQ ID NO: 656174 - DNA, 25 bp, Rattus norvegicus
ttaaattacacctcgacgaccacac

SEQ ID NO: 656175 - DNA, 25 bp, Rattus norvegicus
ttaaattagtctctttcagcccctg

SEQ ID NO: 656176 - DNA, 25 bp, Rattus norvegicus
ttaaattagtctgtttcagcccctg

SEQ ID NO: 656177 - DNA, 25 bp, Rattus norvegicus
ttaaattatcctaacaccaccacag

SEQ ID NO: 656178 - DNA, 25 bp, Rattus norvegicus
ttaaattatccttacaccaccacag

SEQ ID NO: 656179 - DNA, 25 bp, Rattus norvegicus
ttaaattcaaagctagcggcccctt

SEQ ID NO: 656180 - DNA, 25 bp, Rattus norvegicus
ttaaattcaaaggtagcggcccctt

SEQ ID NO: 656181 - DNA, 25 bp, Rattus norvegicus
ttaaattcatggcaaccttaggttc

SEQ ID NO: 656182 - DNA, 25 bp, Rattus norvegicus
ttaaattcatgggaaccttaggttc

SEQ ID NO: 656183 - DNA, 25 bp, Rattus norvegicus
ttaaattccctcagaaagcccaaga

SEQ ID NO: 656184 - DNA, 25 bp, Rattus norvegicus
ttaaattccctctgaaagcccaaga

SEQ ID NO: 656185 - DNA, 25 bp, Rattus norvegicus
ttaaattctctcatgctcctcatag

SEQ ID NO: 656186 - DNA, 25 bp, Rattus norvegicus
ttaaattctctcttgctcctcatag

SEQ ID NO: 656187 - DNA, 25 bp, Rattus norvegicus
ttaaattctctgaccacgtggagtc

SEQ ID NO: 656188 - DNA, 25 bp, Rattus norvegicus
ttaaattctctgagtgtaccccatc

SEQ ID NO: 656189 - DNA, 25 bp, Rattus norvegicus
ttaaattctctgtccacgtggagtc

SEQ ID NO: 656190 - DNA, 25 bp, Rattus norvegicus
ttaaattctctgtgtgtaccccatc

SEQ ID NO: 656191 - DNA, 25 bp, Rattus norvegicus
ttaaattgaggtacatttcctgcct

SEQ ID NO: 656192 - DNA, 25 bp, Rattus norvegicus
ttaaattgaggttcatttcctgcct

SEQ ID NO: 656193 - DNA, 25 bp, Rattus norvegicus
ttaaattgctatcccatgctacata

SEQ ID NO: 656194 - DNA, 25 bp, Rattus norvegicus
ttaaattgctatgccatgctacata

SEQ ID NO: 656195 - DNA, 25 bp, Rattus norvegicus
ttaaattggcagctccaagttgctc

SEQ ID NO: 656196 - DNA, 25 bp, Rattus norvegicus
ttaaattggcaggtccaagttgctc

SEQ ID NO: 656197 - DNA, 25 bp, Rattus norvegicus
ttaaattgtcaaactgtgcacagtg

SEQ ID NO: 656198 - DNA, 25 bp, Rattus norvegicus
ttaaattgtcaatctgtgcacagtg

SEQ ID NO: 656199 - DNA, 25 bp, Rattus norvegicus
ttaaattttcatcctgtccccaact

SEQ ID NO: 656200 - DNA, 25 bp, Rattus norvegicus
ttaaattttcatgctgtccccaact

SEQ ID NO: 656201 - DNA, 25 bp, Rattus norvegicus
ttaaattttgtcacctgcctaataa

SEQ ID NO: 656202 - DNA, 25 bp, Rattus norvegicus
ttaaattttgtctcctgcctaataa

SEQ ID NO: 656203 - DNA, 25 bp, Rattus norvegicus
ttaacaaactggacaccgagcctca

SEQ ID NO: 656204 - DNA, 25 bp, Rattus norvegicus
ttaacaaactggtcaccgagcctca

SEQ ID NO: 656205 - DNA, 25 bp, Rattus norvegicus
ttaacaaagacccagaagctccaat

SEQ ID NO: 656206 - DNA, 25 bp, Rattus norvegicus
ttaacaaagaccgagaagctccaat

SEQ ID NO: 656207 - DNA, 25 bp, Rattus norvegicus
ttaacaaaggccagggagcccttct

SEQ ID NO: 656208 - DNA, 25 bp, Rattus norvegicus
ttaacaaaggcctgggagcccttct

SEQ ID NO: 656209 - DNA, 25 bp, Rattus norvegicus
ttaacaaagtatactccaccctcca

SEQ ID NO: 656210 - DNA, 25 bp, Rattus norvegicus
ttaacaaagtattctccaccctcca

SEQ ID NO: 656211 - DNA, 25 bp, Rattus norvegicus
ttaacaacgtgtctcaccgctgact

SEQ ID NO: 656212 - DNA, 25 bp, Rattus norvegicus
ttaacaacgtgtgtcaccgctgact

SEQ ID NO: 656213 - DNA, 25 bp, Rattus norvegicus
ttaacaagccaccacgcagggagtt

SEQ ID NO: 656214 - DNA, 25 bp, Rattus norvegicus
ttaacaagccacgacgcagggagtt

SEQ ID NO: 656215 - DNA, 25 bp, Rattus norvegicus
ttaacaagcgtgatcttgggcctca

SEQ ID NO: 656216 - DNA, 25 bp, Rattus norvegicus
ttaacaagcgtgttcttgggcctca

SEQ ID NO: 656217 - DNA, 25 bp, Rattus norvegicus
ttaacaagctcccaaggtgaatcta

SEQ ID NO: 656218 - DNA, 25 bp, Rattus norvegicus
ttaacaagctccgaaggtgaatcta

SEQ ID NO: 656219 - DNA, 25 bp, Rattus norvegicus
ttaacaatttccagcttttatctgg

SEQ ID NO: 656220 - DNA, 25 bp, Rattus norvegicus
ttaacaatttcctgcttttatctgg

SEQ ID NO: 656221 - DNA, 25 bp, Rattus norvegicus
ttaacacaacctcacagtccttttc

SEQ ID NO: 656222 - DNA, 25 bp, Rattus norvegicus
ttaacacaacctgacagtccttttc

SEQ ID NO: 656223 - DNA, 25 bp, Rattus norvegicus
ttaacacaagagctgcccgggagta

SEQ ID NO: 656224 - DNA, 25 bp, Rattus norvegicus
ttaacacaagaggtgcccgggagta

SEQ ID NO: 656225 - DNA, 25 bp, Rattus norvegicus
ttaacacaatccatcacccttggga

SEQ ID NO: 656226 - DNA, 25 bp, Rattus norvegicus
ttaacacaatccttcacccttggga

SEQ ID NO: 656227 - DNA, 25 bp, Rattus norvegicus
ttaacacacgttaagatagcttatt

SEQ ID NO: 656228 - DNA, 25 bp, Rattus norvegicus
ttaacacacgtttagatagcttatt

SEQ ID NO: 656229 - DNA, 25 bp, Rattus norvegicus
ttaacacacttcatttctgactcga

SEQ ID NO: 656230 - DNA, 25 bp, Rattus norvegicus
ttaacacacttcttttctgactcga

SEQ ID NO: 656231 - DNA, 25 bp, Rattus norvegicus
ttaacacatggcaacactcctgagg

SEQ ID NO: 656232 - DNA, 25 bp, Rattus norvegicus
ttaacacatggctacactcctgagg

SEQ ID NO: 656233 - DNA, 25 bp, Rattus norvegicus
ttaacaccaaatcctctcaactggg

SEQ ID NO: 656234 - DNA, 25 bp, Rattus norvegicus
ttaacaccaaatgctctcaactggg

SEQ ID NO: 656235 - DNA, 25 bp, Rattus norvegicus
ttaacaccatggctctccttaaaga

SEQ ID NO: 656236 - DNA, 25 bp, Rattus norvegicus
ttaacaccatgggtctccttaaaga

SEQ ID NO: 656237 - DNA, 25 bp, Rattus norvegicus
ttaacaccgtgcactatgactccga

SEQ ID NO: 656238 - DNA, 25 bp, Rattus norvegicus
ttaacaccgtgctctatgactccga

SEQ ID NO: 656239 - DNA, 25 bp, Rattus norvegicus
ttaacacctgaaatttccccactgt

SEQ ID NO: 656240 - DNA, 25 bp, Rattus norvegicus
ttaacacctgaattttccccactgt

SEQ ID NO: 656241 - DNA, 25 bp, Rattus norvegicus
ttaacacctgtgagtccagttgact

SEQ ID NO: 656242 - DNA, 25 bp, Rattus norvegicus
ttaacacctgtgtgtccagttgact

SEQ ID NO: 656243 - DNA, 25 bp, Rattus norvegicus
ttaacactagtactccatcagcact

SEQ ID NO: 656244 - DNA, 25 bp, Rattus norvegicus
ttaacactagtagtccatcagcact

SEQ ID NO: 656245 - DNA, 25 bp, Rattus norvegicus
ttaacactcctgagataagcatctg

SEQ ID NO: 656246 - DNA, 25 bp, Rattus norvegicus
ttaacactcctgtgataagcatctg

SEQ ID NO: 656247 - DNA, 25 bp, Rattus norvegicus
ttaacactgtctatctctgagctgt

SEQ ID NO: 656248 - DNA, 25 bp, Rattus norvegicus
ttaacactgtctttctctgagctgt

SEQ ID NO: 656249 - DNA, 25 bp, Rattus norvegicus
ttaacacttaagaagatcctttctg

SEQ ID NO: 656250 - DNA, 25 bp, Rattus norvegicus
ttaacacttaagtagatcctttctg

SEQ ID NO: 656251 - DNA, 25 bp, Rattus norvegicus
ttaacagaaaccaaggctcccgacg

SEQ ID NO: 656252 - DNA, 25 bp, Rattus norvegicus
ttaacagaaacctaggctcccgacg

SEQ ID NO: 656253 - DNA, 25 bp, Rattus norvegicus
ttaacagaacataccagcctacgcc

SEQ ID NO: 656254 - DNA, 25 bp, Rattus norvegicus
ttaacagaacattccagcctacgcc

SEQ ID NO: 656255 - DNA, 25 bp, Rattus norvegicus
ttaacagaagctcactgctttggcc

SEQ ID NO: 656256 - DNA, 25 bp, Rattus norvegicus
ttaacagaagctgactgctttggcc

SEQ ID NO: 656257 - DNA, 25 bp, Rattus norvegicus
ttaacagactgtccccttggaaaca

SEQ ID NO: 656258 - DNA, 25 bp, Rattus norvegicus
ttaacagactgtgcccttggaaaca

SEQ ID NO: 656259 - DNA, 25 bp, Rattus norvegicus
ttaacagagtgccaggagaaccgac

SEQ ID NO: 656260 - DNA, 25 bp, Rattus norvegicus
ttaacagagtgcgaggagaaccgac

SEQ ID NO: 656261 - DNA, 25 bp, Rattus norvegicus
ttaacagattctctcctaatcctcc

SEQ ID NO: 656262 - DNA, 25 bp, Rattus norvegicus
ttaacagattctgtcctaatcctcc

SEQ ID NO: 656263 - DNA, 25 bp, Rattus norvegicus
ttaacagcaagtacccttacccact

SEQ ID NO: 656264 - DNA, 25 bp, Rattus norvegicus
ttaacagcaagttcccttacccact

SEQ ID NO: 656265 - DNA, 25 bp, Rattus norvegicus
ttaacagcacccatcattagccgag

SEQ ID NO: 656266 - DNA, 25 bp, Rattus norvegicus
ttaacagcacccttcattagccgag

SEQ ID NO: 656267 - DNA, 25 bp, Rattus norvegicus
ttaacagcaggtcctccctggaatc

SEQ ID NO: 656268 - DNA, 25 bp, Rattus norvegicus
ttaacagcaggtgctccctggaatc

SEQ ID NO: 656269 - DNA, 25 bp, Rattus norvegicus
ttaacagccctgcttgctctgaaac

SEQ ID NO: 656270 - DNA, 25 bp, Rattus norvegicus
ttaacagccctggttgctctgaaac

SEQ ID NO: 656271 - DNA, 25 bp, Rattus norvegicus
ttaacagcctcacagagcagcagag

SEQ ID NO: 656272 - DNA, 25 bp, Rattus norvegicus
ttaacagcctcagagagcagcagag

SEQ ID NO: 656273 - DNA, 25 bp, Rattus norvegicus
ttaacagcctctatggtcacaagcc

SEQ ID NO: 656274 - DNA, 25 bp, Rattus norvegicus
ttaacagcctctttggtcacaagcc

SEQ ID NO: 656275 - DNA, 25 bp, Rattus norvegicus
ttaacagctgaacacctctccagtg

SEQ ID NO: 656276 - DNA, 25 bp, Rattus norvegicus
ttaacagctgaagacctctccagtg

SEQ ID NO: 656277 - DNA, 25 bp, Rattus norvegicus
ttaacagctgagcttctcgagtgcc

SEQ ID NO: 656278 - DNA, 25 bp, Rattus norvegicus
ttaacagctgaggttctcgagtgcc

SEQ ID NO: 656279 - DNA, 25 bp, Rattus norvegicus
ttaacagctgcgaagaccctttcat

SEQ ID NO: 656280 - DNA, 25 bp, Rattus norvegicus
ttaacagctgcgtagaccctttcat

SEQ ID NO: 656281 - DNA, 25 bp, Rattus norvegicus
ttaacagctgtaccaacccttggat

SEQ ID NO: 656282 - DNA, 25 bp, Rattus norvegicus
ttaacagctgtagcaacccttggat

SEQ ID NO: 656283 - DNA, 25 bp, Rattus norvegicus
ttaacagcttgaaatggctcccagt

SEQ ID NO: 656284 - DNA, 25 bp, Rattus norvegicus
ttaacagcttgatatggctcccagt

SEQ ID NO: 656285 - DNA, 25 bp, Rattus norvegicus
ttaacagggagtcagctgcagtcat

SEQ ID NO: 656286 - DNA, 25 bp, Rattus norvegicus
ttaacagggagtgagctgcagtcat

SEQ ID NO: 656287 - DNA, 25 bp, Rattus norvegicus
ttaacagtaaggatccattcaggat

SEQ ID NO: 656288 - DNA, 25 bp, Rattus norvegicus
ttaacagtaaggttccattcaggat

SEQ ID NO: 656289 - DNA, 25 bp, Rattus norvegicus
ttaacagtagcccatgttgtgtatg

SEQ ID NO: 656290 - DNA, 25 bp, Rattus norvegicus
ttaacagtagccgatgttgtgtatg

SEQ ID NO: 656291 - DNA, 25 bp, Rattus norvegicus
ttaacagtccagcagttagctccca

SEQ ID NO: 656292 - DNA, 25 bp, Rattus norvegicus
ttaacagtccaggagttagctccca

SEQ ID NO: 656293 - DNA, 25 bp, Rattus norvegicus
ttaacagtctggacctgcgcaactg

SEQ ID NO: 656294 - DNA, 25 bp, Rattus norvegicus
ttaacagtctggtcctgcgcaactg

SEQ ID NO: 656295 - DNA, 25 bp, Rattus norvegicus
ttaacagtgacacggcttttctaag

SEQ ID NO: 656296 - DNA, 25 bp, Rattus norvegicus
ttaacagtgacagggcttttctaag

SEQ ID NO: 656297 - DNA, 25 bp, Rattus norvegicus
ttaacagtgctactccattcctgag

SEQ ID NO: 656298 - DNA, 25 bp, Rattus norvegicus
ttaacagtgctagtccattcctgag

SEQ ID NO: 656299 - DNA, 25 bp, Rattus norvegicus
ttaacagttggcactggcccttgac

SEQ ID NO: 656300 - DNA, 25 bp, Rattus norvegicus
ttaacagttggctctggcccttgac

SEQ ID NO: 656301 - DNA, 25 bp, Rattus norvegicus
ttaacagttgttcccctagtagctg

SEQ ID NO: 656302 - DNA, 25 bp, Rattus norvegicus
ttaacagttgttgccctagtagctg

SEQ ID NO: 656303 - DNA, 25 bp, Rattus norvegicus
ttaacagtttacacccttcctcaag

SEQ ID NO: 656304 - DNA, 25 bp, Rattus norvegicus
ttaacagtttactcccttcctcaag

SEQ ID NO: 656305 - DNA, 25 bp, Rattus norvegicus
ttaacagtttttccacctggtggct

SEQ ID NO: 656306 - DNA, 25 bp, Rattus norvegicus
ttaacagtttttgcacctggtggct

SEQ ID NO: 656307 - DNA, 25 bp, Rattus norvegicus
ttaacatacctaacgtttgcctcta

SEQ ID NO: 656308 - DNA, 25 bp, Rattus norvegicus
ttaacatacctatcgtttgcctcta

SEQ ID NO: 656309 - DNA, 25 bp, Rattus norvegicus
ttaacatcagtcatactctcgcatg

SEQ ID NO: 656310 - DNA, 25 bp, Rattus norvegicus
ttaacatcagtcttactctcgcatg

SEQ ID NO: 656311 - DNA, 25 bp, Rattus norvegicus
ttaacatcatgaaccccatccacta

SEQ ID NO: 656312 - DNA, 25 bp, Rattus norvegicus
ttaacatcatgatccccatccacta

SEQ ID NO: 656313 - DNA, 25 bp, Rattus norvegicus
ttaacatccgacctccacatttact

SEQ ID NO: 656314 - DNA, 25 bp, Rattus norvegicus
ttaacatccgacgtccacatttact

SEQ ID NO: 656315 - DNA, 25 bp, Rattus norvegicus
ttaacatctaggatttcctcatccc

SEQ ID NO: 656316 - DNA, 25 bp, Rattus norvegicus
ttaacatctaggttttcctcatccc

SEQ ID NO: 656317 - DNA, 25 bp, Rattus norvegicus
ttaacatctcagaacttcctttagt

SEQ ID NO: 656318 - DNA, 25 bp, Rattus norvegicus
ttaacatctcagtacttcctttagt

SEQ ID NO: 656319 - DNA, 25 bp, Rattus norvegicus
ttaacatctcctatgggcgaaccca

SEQ ID NO: 656320 - DNA, 25 bp, Rattus norvegicus
ttaacatctcctttgggcgaaccca

SEQ ID NO: 656321 - DNA, 25 bp, Rattus norvegicus
ttaacatctctaatcctgggtttcc

SEQ ID NO: 656322 - DNA, 25 bp, Rattus norvegicus
ttaacatctctattcctgggtttcc

SEQ ID NO: 656323 - DNA, 25 bp, Rattus norvegicus
ttaacatgccaactcttttccgtag

SEQ ID NO: 656324 - DNA, 25 bp, Rattus norvegicus
ttaacatgccaagtcttttccgtag

SEQ ID NO: 656325 - DNA, 25 bp, Rattus norvegicus
ttaacatgccccaggtctatataac

SEQ ID NO: 656326 - DNA, 25 bp, Rattus norvegicus
ttaacatgcccctggtctatataac

SEQ ID NO: 656327 - DNA, 25 bp, Rattus norvegicus
ttaacatgccttctctcagtacaaa

SEQ ID NO: 656328 - DNA, 25 bp, Rattus norvegicus
ttaacatgccttgtctcagtacaaa

SEQ ID NO: 656329 - DNA, 25 bp, Rattus norvegicus
ttaacatgctccagagtgggaggcc

SEQ ID NO: 656330 - DNA, 25 bp, Rattus norvegicus
ttaacatgctcctgagtgggaggcc

SEQ ID NO: 656331 - DNA, 25 bp, Rattus norvegicus
ttaacatggactcaggttccccagc

SEQ ID NO: 656332 - DNA, 25 bp, Rattus norvegicus
ttaacatggactgaggttccccagc

SEQ ID NO: 656333 - DNA, 25 bp, Rattus norvegicus
ttaacatggtccagcgtggatgcgc

SEQ ID NO: 656334 - DNA, 25 bp, Rattus norvegicus
ttaacatggtcctgcgtggatgcgc

SEQ ID NO: 656335 - DNA, 25 bp, Rattus norvegicus
ttaacatgttttctccctggaatgg

SEQ ID NO: 656336 - DNA, 25 bp, Rattus norvegicus
ttaacatgttttgtccctggaatgg

SEQ ID NO: 656337 - DNA, 25 bp, Rattus norvegicus
ttaacattattcaggctctctggct

SEQ ID NO: 656338 - DNA, 25 bp, Rattus norvegicus
ttaacattattctggctctctggct

SEQ ID NO: 656339 - DNA, 25 bp, Rattus norvegicus
ttaacattggcaagtctggcaaaga

SEQ ID NO: 656340 - DNA, 25 bp, Rattus norvegicus
ttaacattggcatgtctggcaaaga

SEQ ID NO: 656341 - DNA, 25 bp, Rattus norvegicus
ttaacatttcacagacagacacact

SEQ ID NO: 656342 - DNA, 25 bp, Rattus norvegicus
ttaacatttcactgacagacacact

SEQ ID NO: 656343 - DNA, 25 bp, Rattus norvegicus
ttaacatttgtcaatgaacatgggg

SEQ ID NO: 656344 - DNA, 25 bp, Rattus norvegicus
ttaacatttgtctatgaacatgggg

SEQ ID NO: 656345 - DNA, 25 bp, Rattus norvegicus
ttaaccaaagaccactgcctacaat

SEQ ID NO: 656346 - DNA, 25 bp, Rattus norvegicus
ttaaccaaagacgactgcctacaat

SEQ ID NO: 656347 - DNA, 25 bp, Rattus norvegicus
ttaaccaaagccactgcacatactg

SEQ ID NO: 656348 - DNA, 25 bp, Rattus norvegicus
ttaaccaaagcctctgcacatactg

SEQ ID NO: 656349 - DNA, 25 bp, Rattus norvegicus
ttaaccaacttgacccggttgcgct

SEQ ID NO: 656350 - DNA, 25 bp, Rattus norvegicus
ttaaccaacttgtcccggttgcgct

SEQ ID NO: 656351 - DNA, 25 bp, Rattus norvegicus
ttaaccaagtttacattccagccac

SEQ ID NO: 656352 - DNA, 25 bp, Rattus norvegicus
ttaaccaagttttcattccagccac

SEQ ID NO: 656353 - DNA, 25 bp, Rattus norvegicus
ttaaccaatatcattctgctttcaa

SEQ ID NO: 656354 - DNA, 25 bp, Rattus norvegicus
ttaaccaatatctttctgctttcaa

SEQ ID NO: 656355 - DNA, 25 bp, Rattus norvegicus
ttaaccacaaaaactcttcaactcc

SEQ ID NO: 656356 - DNA, 25 bp, Rattus norvegicus
ttaaccacaaaatctcttcaactcc

SEQ ID NO: 656357 - DNA, 25 bp, Rattus norvegicus
ttaaccacatctcgactgcctctga

SEQ ID NO: 656358 - DNA, 25 bp, Rattus norvegicus
ttaaccacatctggactgcctctga

SEQ ID NO: 656359 - DNA, 25 bp, Rattus norvegicus
ttaaccaccgcaccctagagcagag

SEQ ID NO: 656360 - DNA, 25 bp, Rattus norvegicus
ttaaccaccgcagcctagagcagag

SEQ ID NO: 656361 - DNA, 25 bp, Rattus norvegicus
ttaaccacctctaacctagggctca

SEQ ID NO: 656362 - DNA, 25 bp, Rattus norvegicus
ttaaccacctctctccataaaagtg

SEQ ID NO: 656363 - DNA, 25 bp, Rattus norvegicus
ttaaccacctctgtccataaaagtg

SEQ ID NO: 656364 - DNA, 25 bp, Rattus norvegicus
ttaaccacctcttacctagggctca

SEQ ID NO: 656365 - DNA, 25 bp, Rattus norvegicus
ttaaccacggaacaatctctctagc

SEQ ID NO: 656366 - DNA, 25 bp, Rattus norvegicus
ttaaccacggaagaatctctctagc

SEQ ID NO: 656367 - DNA, 25 bp, Rattus norvegicus
ttaaccactcacacatgccctgtgg

SEQ ID NO: 656368 - DNA, 25 bp, Rattus norvegicus
ttaaccactcactcatgccctgtgg

SEQ ID NO: 656369 - DNA, 25 bp, Rattus norvegicus
ttaaccactgctagcttcgtaattg

SEQ ID NO: 656370 - DNA, 25 bp, Rattus norvegicus
ttaaccactgcttgcttcgtaattg

SEQ ID NO: 656371 - DNA, 25 bp, Rattus norvegicus
ttaaccagcagtataactccccact

SEQ ID NO: 656372 - DNA, 25 bp, Rattus norvegicus
ttaaccagcagtttaactccccact

SEQ ID NO: 656373 - DNA, 25 bp, Rattus norvegicus
ttaaccagcctcaagttgtgcaact

SEQ ID NO: 656374 - DNA, 25 bp, Rattus norvegicus
ttaaccagcctctagttgtgcaact

SEQ ID NO: 656375 - DNA, 25 bp, Rattus norvegicus
ttaaccagctatacttcagacaagg

SEQ ID NO: 656376 - DNA, 25 bp, Rattus norvegicus
ttaaccagctattcttcagacaagg

SEQ ID NO: 656377 - DNA, 25 bp, Rattus norvegicus
ttaaccagtctgatctggcatgctt

SEQ ID NO: 656378 - DNA, 25 bp, Rattus norvegicus
ttaaccagtctgttctggcatgctt

SEQ ID NO: 656379 - DNA, 25 bp, Rattus norvegicus
ttaaccagtgtacccttgacagttt

SEQ ID NO: 656380 - DNA, 25 bp, Rattus norvegicus
ttaaccagtgtagccttgacagttt

SEQ ID NO: 656381 - DNA, 25 bp, Rattus norvegicus
ttaaccagttagacatgcctcttcc

SEQ ID NO: 656382 - DNA, 25 bp, Rattus norvegicus
ttaaccagttagtcatgcctcttcc

SEQ ID NO: 656383 - DNA, 25 bp, Rattus norvegicus
ttaaccagtttcaggtgcctatccg

SEQ ID NO: 656384 - DNA, 25 bp, Rattus norvegicus
ttaaccagtttctggtgcctatccg

SEQ ID NO: 656385 - DNA, 25 bp, Rattus norvegicus
ttaaccatcgttcccaaaccagagt

SEQ ID NO: 656386 - DNA, 25 bp, Rattus norvegicus
ttaaccatcgttgccaaaccagagt

SEQ ID NO: 656387 - DNA, 25 bp, Rattus norvegicus
ttaaccatctccaaaaattctcctg

SEQ ID NO: 656388 - DNA, 25 bp, Rattus norvegicus
ttaaccatctcctaaaattctcctg

SEQ ID NO: 656389 - DNA, 25 bp, Rattus norvegicus
ttaaccatgaccaatgcagctgcca

SEQ ID NO: 656390 - DNA, 25 bp, Rattus norvegicus
ttaaccatgacctatgcagctgcca

SEQ ID NO: 656391 - DNA, 25 bp, Rattus norvegicus
ttaaccatgtgacctactgctgtgt

SEQ ID NO: 656392 - DNA, 25 bp, Rattus norvegicus
ttaaccatgtgagctactgctgtgt

SEQ ID NO: 656393 - DNA, 25 bp, Rattus norvegicus
ttaacccaaaaaagccaagatgtat

SEQ ID NO: 656394 - DNA, 25 bp, Rattus norvegicus
ttaacccaaaaatgccaagatgtat

SEQ ID NO: 656395 - DNA, 25 bp, Rattus norvegicus
ttaacccaaatgctctccttacaag

SEQ ID NO: 656396 - DNA, 25 bp, Rattus norvegicus
ttaacccaaatggtctccttacaag

SEQ ID NO: 656397 - DNA, 25 bp, Rattus norvegicus
ttaacccaagatcctttctccaact

SEQ ID NO: 656398 - DNA, 25 bp, Rattus norvegicus
ttaacccaagatgctttctccaact

SEQ ID NO: 656399 - DNA, 25 bp, Rattus norvegicus
ttaacccaatgtccaaaaaatactg

SEQ ID NO: 656400 - DNA, 25 bp, Rattus norvegicus
ttaacccaatgtgcaaaaaatactg

SEQ ID NO: 656401 - DNA, 25 bp, Rattus norvegicus
ttaacccaattaagccgcacagcga

SEQ ID NO: 656402 - DNA, 25 bp, Rattus norvegicus
ttaacccaattatgccgcacagcga

SEQ ID NO: 656403 - DNA, 25 bp, Rattus norvegicus
ttaacccactcaaagtctgaccagg

SEQ ID NO: 656404 - DNA, 25 bp, Rattus norvegicus
ttaacccactcatagtctgaccagg

SEQ ID NO: 656405 - DNA, 25 bp, Rattus norvegicus
ttaacccattcaatcttagtgtgaa

SEQ ID NO: 656406 - DNA, 25 bp, Rattus norvegicus
ttaacccattcattcttagtgtgaa

SEQ ID NO: 656407 - DNA, 25 bp, Rattus norvegicus
ttaacccattgcagggtcaaccctc

SEQ ID NO: 656408 - DNA, 25 bp, Rattus norvegicus
ttaacccattgctgggtcaaccctc

SEQ ID NO: 656409 - DNA, 25 bp, Rattus norvegicus
ttaaccccagcgctcggaggcagag

SEQ ID NO: 656410 - DNA, 25 bp, Rattus norvegicus
ttaaccccagcggtcggaggcagag

SEQ ID NO: 656411 - DNA, 25 bp, Rattus norvegicus
ttaaccccatagattgcctcagcta

SEQ ID NO: 656412 - DNA, 25 bp, Rattus norvegicus
ttaaccccatagtttgcctcagcta

SEQ ID NO: 656413 - DNA, 25 bp, Rattus norvegicus
ttaaccccatttcgcagatgacatg

SEQ ID NO: 656414 - DNA, 25 bp, Rattus norvegicus
ttaaccccatttggcagatgacatg

SEQ ID NO: 656415 - DNA, 25 bp, Rattus norvegicus
ttaaccccgagtattgcagttgctg

SEQ ID NO: 656416 - DNA, 25 bp, Rattus norvegicus
ttaaccccgagttttgcagttgctg

SEQ ID NO: 656417 - DNA, 25 bp, Rattus norvegicus
ttaacccctaatccaatgtcatcgg

SEQ ID NO: 656418 - DNA, 25 bp, Rattus norvegicus
ttaacccctaatgcaatgtcatcgg

SEQ ID NO: 656419 - DNA, 25 bp, Rattus norvegicus
ttaacccctagacagtgccttcaaa

SEQ ID NO: 656420 - DNA, 25 bp, Rattus norvegicus
ttaacccctagagagtgccttcaaa

SEQ ID NO: 656421 - DNA, 25 bp, Rattus norvegicus
ttaacccctctacgtcttatagtgt

SEQ ID NO: 656422 - DNA, 25 bp, Rattus norvegicus
ttaacccctctaggtcttatagtgt

SEQ ID NO: 656423 - DNA, 25 bp, Rattus norvegicus
ttaaccccttctaaggaggaagctg

SEQ ID NO: 656424 - DNA, 25 bp, Rattus norvegicus
ttaaccccttcttaggaggaagctg

SEQ ID NO: 656425 - DNA, 25 bp, Rattus norvegicus
ttaacccgcagcagccgtgtgagca

SEQ ID NO: 656426 - DNA, 25 bp, Rattus norvegicus
ttaacccgcagctgccgtgtgagca

SEQ ID NO: 656427 - DNA, 25 bp, Rattus norvegicus
ttaaccctactgctgttagtgccac

SEQ ID NO: 656428 - DNA, 25 bp, Rattus norvegicus
ttaaccctactggtgttagtgccac

SEQ ID NO: 656429 - DNA, 25 bp, Rattus norvegicus
ttaaccctatggaacaagaagctgc

SEQ ID NO: 656430 - DNA, 25 bp, Rattus norvegicus
ttaaccctatggtacaagaagctgc

SEQ ID NO: 656431 - DNA, 25 bp, Rattus norvegicus
ttaaccctcttcattcctatttcgt

SEQ ID NO: 656432 - DNA, 25 bp, Rattus norvegicus
ttaaccctcttctttcctatttcgt

SEQ ID NO: 656433 - DNA, 25 bp, Rattus norvegicus
ttaaccctgacaactcaacactgat

SEQ ID NO: 656434 - DNA, 25 bp, Rattus norvegicus
ttaaccctgacatctcaacactgat

SEQ ID NO: 656435 - DNA, 25 bp, Rattus norvegicus
ttaaccctgtcaattacttcttcct

SEQ ID NO: 656436 - DNA, 25 bp, Rattus norvegicus
ttaaccctgtcatttacttcttcct

SEQ ID NO: 656437 - DNA, 25 bp, Rattus norvegicus
ttaaccctgtccatgctgagtgtgg

SEQ ID NO: 656438 - DNA, 25 bp, Rattus norvegicus
ttaaccctgtccattgcggtactgg

SEQ ID NO: 656439 - DNA, 25 bp, Rattus norvegicus
ttaaccctgtccttgctgagtgtgg

SEQ ID NO: 656440 - DNA, 25 bp, Rattus norvegicus
ttaaccctgtcctttgcggtactgg

SEQ ID NO: 656441 - DNA, 25 bp, Rattus norvegicus
ttaaccctgtttacagtctctatgt

SEQ ID NO: 656442 - DNA, 25 bp, Rattus norvegicus
ttaaccctgttttcagtctctatgt

SEQ ID NO: 656443 - DNA, 25 bp, Rattus norvegicus
ttaacccttaacatctcaatccatt

SEQ ID NO: 656444 - DNA, 25 bp, Rattus norvegicus
ttaacccttaacttctcaatccatt

SEQ ID NO: 656445 - DNA, 25 bp, Rattus norvegicus
ttaacccttgctaattgcttgctgt

SEQ ID NO: 656446 - DNA, 25 bp, Rattus norvegicus
ttaacccttgcttattgcttgctgt

SEQ ID NO: 656447 - DNA, 25 bp, Rattus norvegicus
ttaacccttggtcttgcactagagt

SEQ ID NO: 656448 - DNA, 25 bp, Rattus norvegicus
ttaacccttggtgttgcactagagt

SEQ ID NO: 656449 - DNA, 25 bp, Rattus norvegicus
ttaaccctttgcagatcctcaggga

SEQ ID NO: 656450 - DNA, 25 bp, Rattus norvegicus
ttaaccctttgctgatcctcaggga

SEQ ID NO: 656451 - DNA, 25 bp, Rattus norvegicus
ttaaccctttttcacatctgtgatg

SEQ ID NO: 656452 - DNA, 25 bp, Rattus norvegicus
ttaaccctttttgacatctgtgatg

SEQ ID NO: 656453 - DNA, 25 bp, Rattus norvegicus
ttaaccgcagtcaccaagtcaggga

SEQ ID NO: 656454 - DNA, 25 bp, Rattus norvegicus
ttaaccgcagtctccaagtcaggga

SEQ ID NO: 656455 - DNA, 25 bp, Rattus norvegicus
ttaaccgcggagctatttctccaac

SEQ ID NO: 656456 - DNA, 25 bp, Rattus norvegicus
ttaaccgcggaggtatttctccaac

SEQ ID NO: 656457 - DNA, 25 bp, Rattus norvegicus
ttaaccgtgaaacccctatacagtg

SEQ ID NO: 656458 - DNA, 25 bp, Rattus norvegicus
ttaaccgtgaaagccctatacagtg

SEQ ID NO: 656459 - DNA, 25 bp, Rattus norvegicus
ttaaccgtgccaacttgcgaactat

SEQ ID NO: 656460 - DNA, 25 bp, Rattus norvegicus
ttaaccgtgccatcttgcgaactat

SEQ ID NO: 656461 - DNA, 25 bp, Rattus norvegicus
ttaacctaagacaaacactgctttt

SEQ ID NO: 656462 - DNA, 25 bp, Rattus norvegicus
ttaacctaagactaacactgctttt

SEQ ID NO: 656463 - DNA, 25 bp, Rattus norvegicus
ttaacctacggacctcaaactaaat

SEQ ID NO: 656464 - DNA, 25 bp, Rattus norvegicus
ttaacctacggagctcaaactaaat

SEQ ID NO: 656465 - DNA, 25 bp, Rattus norvegicus
ttaacctatccaaacagccacaaat

SEQ ID NO: 656466 - DNA, 25 bp, Rattus norvegicus
ttaacctatccatacagccacaaat

SEQ ID NO: 656467 - DNA, 25 bp, Rattus norvegicus
ttaacctatcctatgcatcagggac

SEQ ID NO: 656468 - DNA, 25 bp, Rattus norvegicus
ttaacctatcctttgcatcagggac

SEQ ID NO: 656469 - DNA, 25 bp, Rattus norvegicus
ttaacctcaacgacacatatccatg

SEQ ID NO: 656470 - DNA, 25 bp, Rattus norvegicus
ttaacctcaacgtcacatatccatg

SEQ ID NO: 656471 - DNA, 25 bp, Rattus norvegicus
ttaacctcactgactgacaggctcc

SEQ ID NO: 656472 - DNA, 25 bp, Rattus norvegicus
ttaacctcactgtctgacaggctcc

SEQ ID NO: 656473 - DNA, 25 bp, Rattus norvegicus
ttaacctcaggaaagaatgtaactt

SEQ ID NO: 656474 - DNA, 25 bp, Rattus norvegicus
ttaacctcaggatagaatgtaactt

SEQ ID NO: 656475 - DNA, 25 bp, Rattus norvegicus
ttaacctccatcatctctgtataga

SEQ ID NO: 656476 - DNA, 25 bp, Rattus norvegicus
ttaacctccatcttctctgtataga

SEQ ID NO: 656477 - DNA, 25 bp, Rattus norvegicus
ttaacctccgctccaatggtgccaa

SEQ ID NO: 656478 - DNA, 25 bp, Rattus norvegicus
ttaacctccgctgcaatggtgccaa

SEQ ID NO: 656479 - DNA, 25 bp, Rattus norvegicus
ttaacctctatgcgtacagcttacc

SEQ ID NO: 656480 - DNA, 25 bp, Rattus norvegicus
ttaacctctatgggtacagcttacc

SEQ ID NO: 656481 - DNA, 25 bp, Rattus norvegicus
ttaacctctgaactccaagcaaatt

SEQ ID NO: 656482 - DNA, 25 bp, Rattus norvegicus
ttaacctctgaagtccaagcaaatt

SEQ ID NO: 656483 - DNA, 25 bp, Rattus norvegicus
ttaacctctgtaatctaatctgtgt

SEQ ID NO: 656484 - DNA, 25 bp, Rattus norvegicus
ttaacctctgtattctaatctgtgt

SEQ ID NO: 656485 - DNA, 25 bp, Rattus norvegicus
ttaacctgaagtatctctcctggag

SEQ ID NO: 656486 - DNA, 25 bp, Rattus norvegicus
ttaacctgaagtttctctcctggag

SEQ ID NO: 656487 - DNA, 25 bp, Rattus norvegicus
ttaacctggcttctttgtcttggtt

SEQ ID NO: 656488 - DNA, 25 bp, Rattus norvegicus
ttaacctggcttgtttgtcttggtt

SEQ ID NO: 656489 - DNA, 25 bp, Rattus norvegicus
ttaacctgggacctgtgaccggtca

SEQ ID NO: 656490 - DNA, 25 bp, Rattus norvegicus
ttaacctgggacgtgtgaccggtca

SEQ ID NO: 656491 - DNA, 25 bp, Rattus norvegicus
ttaacctggtgtacattccaaacat

SEQ ID NO: 656492 - DNA, 25 bp, Rattus norvegicus
ttaacctggtgttcattccaaacat

SEQ ID NO: 656493 - DNA, 25 bp, Rattus norvegicus
ttaacctgtcttaactagtcccttg

SEQ ID NO: 656494 - DNA, 25 bp, Rattus norvegicus
ttaacctgtctttactagtcccttg

SEQ ID NO: 656495 - DNA, 25 bp, Rattus norvegicus
ttaacctgtgatcgctgtaggccct

SEQ ID NO: 656496 - DNA, 25 bp, Rattus norvegicus
ttaacctgtgatggctgtaggccct

SEQ ID NO: 656497 - DNA, 25 bp, Rattus norvegicus
ttaacctgtgctcattaggaccctg

SEQ ID NO: 656498 - DNA, 25 bp, Rattus norvegicus
ttaacctgtgctgattaggaccctg

SEQ ID NO: 656499 - DNA, 25 bp, Rattus norvegicus
ttaacctgtggtagttctctggaca

SEQ ID NO: 656500 - DNA, 25 bp, Rattus norvegicus
ttaacctgtggttgttctctggaca

SEQ ID NO: 656501 - DNA, 25 bp, Rattus norvegicus
ttaaccttacgtactcatggcccat

SEQ ID NO: 656502 - DNA, 25 bp, Rattus norvegicus
ttaaccttacgttctcatggcccat

SEQ ID NO: 656503 - DNA, 25 bp, Rattus norvegicus
ttaaccttgaaaccctgatctcgtg

SEQ ID NO: 656504 - DNA, 25 bp, Rattus norvegicus
ttaaccttgaaagcctgatctcgtg

SEQ ID NO: 656505 - DNA, 25 bp, Rattus norvegicus
ttaaccttggaaacagctttctgag

SEQ ID NO: 656506 - DNA, 25 bp, Rattus norvegicus
ttaaccttggaatcagctttctgag

SEQ ID NO: 656507 - DNA, 25 bp, Rattus norvegicus
ttaacctttcgtctgccaaatctta

SEQ ID NO: 656508 - DNA, 25 bp, Rattus norvegicus
ttaacctttcgtgtgccaaatctta

SEQ ID NO: 656509 - DNA, 25 bp, Rattus norvegicus
ttaacctttgtaaaccatcactgag

SEQ ID NO: 656510 - DNA, 25 bp, Rattus norvegicus
ttaacctttgtataccatcactgag

SEQ ID NO: 656511 - DNA, 25 bp, Rattus norvegicus
ttaacgatgcctacagtgtgatgct

SEQ ID NO: 656512 - DNA, 25 bp, Rattus norvegicus
ttaacgatgccttcagtgtgatgct

SEQ ID NO: 656513 - DNA, 25 bp, Rattus norvegicus
ttaacgatgtagctcaccaaaccca

SEQ ID NO: 656514 - DNA, 25 bp, Rattus norvegicus
ttaacgatgtaggtcaccaaaccca

SEQ ID NO: 656515 - DNA, 25 bp, Rattus norvegicus
ttaacgccattgaaggtcctcagct

SEQ ID NO: 656516 - DNA, 25 bp, Rattus norvegicus
ttaacgccattgtaggtcctcagct

SEQ ID NO: 656517 - DNA, 25 bp, Rattus norvegicus
ttaacgccccaacccatggatggag

SEQ ID NO: 656518 - DNA, 25 bp, Rattus norvegicus
ttaacgccccaagccatggatggag

SEQ ID NO: 656519 - DNA, 25 bp, Rattus norvegicus
ttaacgctagctagcccttggcatg

SEQ ID NO: 656520 - DNA, 25 bp, Rattus norvegicus
ttaacgctagcttgcccttggcatg

SEQ ID NO: 656521 - DNA, 25 bp, Rattus norvegicus
ttaacgctgtttacccagtgtgatc

SEQ ID NO: 656522 - DNA, 25 bp, Rattus norvegicus
ttaacgctgttttcccagtgtgatc

SEQ ID NO: 656523 - DNA, 25 bp, Rattus norvegicus
ttaacgcttgggacactgagatgga

SEQ ID NO: 656524 - DNA, 25 bp, Rattus norvegicus
ttaacgcttgggtcactgagatgga

SEQ ID NO: 656525 - DNA, 25 bp, Rattus norvegicus
ttaacggaagacctcctacccattg

SEQ ID NO: 656526 - DNA, 25 bp, Rattus norvegicus
ttaacggaagacgtcctacccattg

SEQ ID NO: 656527 - DNA, 25 bp, Rattus norvegicus
ttaacggacattactgagccccaaa

SEQ ID NO: 656528 - DNA, 25 bp, Rattus norvegicus
ttaacggacatttctgagccccaaa

SEQ ID NO: 656529 - DNA, 25 bp, Rattus norvegicus
ttaacggaggctccgcctgggctcc

SEQ ID NO: 656530 - DNA, 25 bp, Rattus norvegicus
ttaacggaggctgcgcctgggctcc

SEQ ID NO: 656531 - DNA, 25 bp, Rattus norvegicus
ttaacggagttcaccagcacaccag

SEQ ID NO: 656532 - DNA, 25 bp, Rattus norvegicus
ttaacggagttctccagcacaccag

SEQ ID NO: 656533 - DNA, 25 bp, Rattus norvegicus
ttaacggatcctatctctcctgtgt

SEQ ID NO: 656534 - DNA, 25 bp, Rattus norvegicus
ttaacggatcctttctctcctgtgt

SEQ ID NO: 656535 - DNA, 25 bp, Rattus norvegicus
ttaacggcatatctcaccagcacac

SEQ ID NO: 656536 - DNA, 25 bp, Rattus norvegicus
ttaacggcatatgtcaccagcacac

SEQ ID NO: 656537 - DNA, 25 bp, Rattus norvegicus
ttaacgggcttgctttcgacatggt

SEQ ID NO: 656538 - DNA, 25 bp, Rattus norvegicus
ttaacgggcttggtttcgacatggt

SEQ ID NO: 656539 - DNA, 25 bp, Rattus norvegicus
ttaacgggtattacttgagccaggt

SEQ ID NO: 656540 - DNA, 25 bp, Rattus norvegicus
ttaacgggtatttcttgagccaggt

SEQ ID NO: 656541 - DNA, 25 bp, Rattus norvegicus
ttaacggtcaggctggtttggcaca

SEQ ID NO: 656542 - DNA, 25 bp, Rattus norvegicus
ttaacggtcagggtggtttggcaca

SEQ ID NO: 656543 - DNA, 25 bp, Rattus norvegicus
ttaacggtctccatagcaaatacag

SEQ ID NO: 656544 - DNA, 25 bp, Rattus norvegicus
ttaacggtctccttagcaaatacag

SEQ ID NO: 656545 - DNA, 25 bp, Rattus norvegicus
ttaacggttgggacatgcacatctg

SEQ ID NO: 656546 - DNA, 25 bp, Rattus norvegicus
ttaacggttgggtcatgcacatctg

SEQ ID NO: 656547 - DNA, 25 bp, Rattus norvegicus
ttaacgtaaccgcagctttccaatg

SEQ ID NO: 656548 - DNA, 25 bp, Rattus norvegicus
ttaacgtaaccggagctttccaatg

SEQ ID NO: 656549 - DNA, 25 bp, Rattus norvegicus
ttaacgtcagctaccttgttcccaa

SEQ ID NO: 656550 - DNA, 25 bp, Rattus norvegicus
ttaacgtcagcttccttgttcccaa

SEQ ID NO: 656551 - DNA, 25 bp, Rattus norvegicus
ttaacgtctctgcacagcaccgatg

SEQ ID NO: 656552 - DNA, 25 bp, Rattus norvegicus
ttaacgtctctggacagcaccgatg

SEQ ID NO: 656553 - DNA, 25 bp, Rattus norvegicus
ttaacgtggtccaagccagctatct

SEQ ID NO: 656554 - DNA, 25 bp, Rattus norvegicus
ttaacgtggtcctagccagctatct

SEQ ID NO: 656555 - DNA, 25 bp, Rattus norvegicus
ttaacgtgtgtcatacttcctcaga

SEQ ID NO: 656556 - DNA, 25 bp, Rattus norvegicus
ttaacgtgtgtcttacttcctcaga

SEQ ID NO: 656557 - DNA, 25 bp, Rattus norvegicus
ttaactaattatcgcgtttcctgga

SEQ ID NO: 656558 - DNA, 25 bp, Rattus norvegicus
ttaactaattatggcgtttcctgga

SEQ ID NO: 656559 - DNA, 25 bp, Rattus norvegicus
ttaactacaggcatttaccagctat

SEQ ID NO: 656560 - DNA, 25 bp, Rattus norvegicus
ttaactacaggcttttaccagctat

SEQ ID NO: 656561 - DNA, 25 bp, Rattus norvegicus
ttaactacccacagcgagatggcat

SEQ ID NO: 656562 - DNA, 25 bp, Rattus norvegicus
ttaactacccactgcgagatggcat

SEQ ID NO: 656563 - DNA, 25 bp, Rattus norvegicus
ttaactacgtggcatgtccttttag

SEQ ID NO: 656564 - DNA, 25 bp, Rattus norvegicus
ttaactacgtgggatgtccttttag

SEQ ID NO: 656565 - DNA, 25 bp, Rattus norvegicus
ttaactactctgagcatctgcctga

SEQ ID NO: 656566 - DNA, 25 bp, Rattus norvegicus
ttaactactctgtgcatctgcctga

SEQ ID NO: 656567 - DNA, 25 bp, Rattus norvegicus
ttaactagacacaaccttccaaagt

SEQ ID NO: 656568 - DNA, 25 bp, Rattus norvegicus
ttaactagacactaccttccaaagt

SEQ ID NO: 656569 - DNA, 25 bp, Rattus norvegicus
ttaactagccaactcttccactggg

SEQ ID NO: 656570 - DNA, 25 bp, Rattus norvegicus
ttaactagccaagtcttccactggg

SEQ ID NO: 656571 - DNA, 25 bp, Rattus norvegicus
ttaactatgagcagttgccccattt

SEQ ID NO: 656572 - DNA, 25 bp, Rattus norvegicus
ttaactatgagctgttgccccattt

SEQ ID NO: 656573 - DNA, 25 bp, Rattus norvegicus
ttaactattttgacatcgcctaccc

SEQ ID NO: 656574 - DNA, 25 bp, Rattus norvegicus
ttaactattttgtcatcgcctaccc

SEQ ID NO: 656575 - DNA, 25 bp, Rattus norvegicus
ttaactcaaagtcaaatcttcacta

SEQ ID NO: 656576 - DNA, 25 bp, Rattus norvegicus
ttaactcaaagtgaaatcttcacta

SEQ ID NO: 656577 - DNA, 25 bp, Rattus norvegicus
ttaactcaaccaacagccattcaaa

SEQ ID NO: 656578 - DNA, 25 bp, Rattus norvegicus
ttaactcaaccatcagccattcaaa

SEQ ID NO: 656579 - DNA, 25 bp, Rattus norvegicus
ttaactcaatggaccctgccgggtg

SEQ ID NO: 656580 - DNA, 25 bp, Rattus norvegicus
ttaactcaatggtccctgccgggtg

SEQ ID NO: 656581 - DNA, 25 bp, Rattus norvegicus
ttaactcactgcattagactccata

SEQ ID NO: 656582 - DNA, 25 bp, Rattus norvegicus
ttaactcactgctttagactccata

SEQ ID NO: 656583 - DNA, 25 bp, Rattus norvegicus
ttaactcacttaacataacccctgt

SEQ ID NO: 656584 - DNA, 25 bp, Rattus norvegicus
ttaactcacttatcataacccctgt

SEQ ID NO: 656585 - DNA, 25 bp, Rattus norvegicus
ttaactcaggctatcccatgtgctt

SEQ ID NO: 656586 - DNA, 25 bp, Rattus norvegicus
ttaactcaggctttcccatgtgctt

SEQ ID NO: 656587 - DNA, 25 bp, Rattus norvegicus
ttaactcatatccatgttctctctc

SEQ ID NO: 656588 - DNA, 25 bp, Rattus norvegicus
ttaactcatatcgatgttctctctc

SEQ ID NO: 656589 - DNA, 25 bp, Rattus norvegicus
ttaactcatccgaggaaagccttaa

SEQ ID NO: 656590 - DNA, 25 bp, Rattus norvegicus
ttaactcatccgtggaaagccttaa

SEQ ID NO: 656591 - DNA, 25 bp, Rattus norvegicus
ttaactcatgtacagcctcatcttg

SEQ ID NO: 656592 - DNA, 25 bp, Rattus norvegicus
ttaactcatgtagagcctcatcttg

SEQ ID NO: 656593 - DNA, 25 bp, Rattus norvegicus
ttaactccaagaattctgcctgaag

SEQ ID NO: 656594 - DNA, 25 bp, Rattus norvegicus
ttaactccaagatttctgcctgaag

SEQ ID NO: 656595 - DNA, 25 bp, Rattus norvegicus
ttaactccagtcctctgtgcgcgga

SEQ ID NO: 656596 - DNA, 25 bp, Rattus norvegicus
ttaactccagtcgtctgtgcgcgga

SEQ ID NO: 656597 - DNA, 25 bp, Rattus norvegicus
ttaactccatcacgcagggctcaga

SEQ ID NO: 656598 - DNA, 25 bp, Rattus norvegicus
ttaactccatcaggcagggctcaga

SEQ ID NO: 656599 - DNA, 25 bp, Rattus norvegicus
ttaactccattcacactagccatat

SEQ ID NO: 656600 - DNA, 25 bp, Rattus norvegicus
ttaactccattctcactagccatat

SEQ ID NO: 656601 - DNA, 25 bp, Rattus norvegicus
ttaactcccaacactagtcggcact

SEQ ID NO: 656602 - DNA, 25 bp, Rattus norvegicus
ttaactcccaactctagtcggcact

SEQ ID NO: 656603 - DNA, 25 bp, Rattus norvegicus
ttaactcccaagaagtccattgcaa

SEQ ID NO: 656604 - DNA, 25 bp, Rattus norvegicus
ttaactcccaagaatctacggtctc

SEQ ID NO: 656605 - DNA, 25 bp, Rattus norvegicus
ttaactcccaagtagtccattgcaa

SEQ ID NO: 656606 - DNA, 25 bp, Rattus norvegicus
ttaactcccaagtatctacggtctc

SEQ ID NO: 656607 - DNA, 25 bp, Rattus norvegicus
ttaactccgaggctaaagcttgtgg

SEQ ID NO: 656608 - DNA, 25 bp, Rattus norvegicus
ttaactccgagggtaaagcttgtgg

SEQ ID NO: 656609 - DNA, 25 bp, Rattus norvegicus
ttaactccttgtcaatactcctgtg

SEQ ID NO: 656610 - DNA, 25 bp, Rattus norvegicus
ttaactccttgtgaatactcctgtg

SEQ ID NO: 656611 - DNA, 25 bp, Rattus norvegicus
ttaactctaagaatcctaaggcatg

SEQ ID NO: 656612 - DNA, 25 bp, Rattus norvegicus
ttaactctaagactccggtgaccta

SEQ ID NO: 656613 - DNA, 25 bp, Rattus norvegicus
ttaactctaagagtccggtgaccta

SEQ ID NO: 656614 - DNA, 25 bp, Rattus norvegicus
ttaactctaagattcctaaggcatg

SEQ ID NO: 656615 - DNA, 25 bp, Rattus norvegicus
ttaactctcaccatttatccttcat

SEQ ID NO: 656616 - DNA, 25 bp, Rattus norvegicus
ttaactctcaccttttatccttcat

SEQ ID NO: 656617 - DNA, 25 bp, Rattus norvegicus
ttaactctcgtgacttcctgtgatg

SEQ ID NO: 656618 - DNA, 25 bp, Rattus norvegicus
ttaactctcgtgtcttcctgtgatg

SEQ ID NO: 656619 - DNA, 25 bp, Rattus norvegicus
ttaactctctcaacaaactatcctc

SEQ ID NO: 656620 - DNA, 25 bp, Rattus norvegicus
ttaactctctcatcaaactatcctc

SEQ ID NO: 656621 - DNA, 25 bp, Rattus norvegicus
ttaactctctctcctgtttcactat

SEQ ID NO: 656622 - DNA, 25 bp, Rattus norvegicus
ttaactctctctgctgtttcactat

SEQ ID NO: 656623 - DNA, 25 bp, Rattus norvegicus
ttaactctgacacagtgccttcgtt

SEQ ID NO: 656624 - DNA, 25 bp, Rattus norvegicus
ttaactctgacagagtgccttcgtt

SEQ ID NO: 656625 - DNA, 25 bp, Rattus norvegicus
ttaactctgttgctgtgatctctgc

SEQ ID NO: 656626 - DNA, 25 bp, Rattus norvegicus
ttaactctgttggtgtgatctctgc

SEQ ID NO: 656627 - DNA, 25 bp, Rattus norvegicus
ttaactgacttacagaactgccaca

SEQ ID NO: 656628 - DNA, 25 bp, Rattus norvegicus
ttaactgacttagagaactgccaca

SEQ ID NO: 656629 - DNA, 25 bp, Rattus norvegicus
ttaactgatctgcactcacctggga

SEQ ID NO: 656630 - DNA, 25 bp, Rattus norvegicus
ttaactgatctggactcacctggga

SEQ ID NO: 656631 - DNA, 25 bp, Rattus norvegicus
ttaactgatgttatctgagcccacc

SEQ ID NO: 656632 - DNA, 25 bp, Rattus norvegicus
ttaactgatgttttctgagcccacc

SEQ ID NO: 656633 - DNA, 25 bp, Rattus norvegicus
ttaactgcaactatgctccgtactt

SEQ ID NO: 656634 - DNA, 25 bp, Rattus norvegicus
ttaactgcaactttgctccgtactt

SEQ ID NO: 656635 - DNA, 25 bp, Rattus norvegicus
ttaactgcaccgagggttatgtcat

SEQ ID NO: 656636 - DNA, 25 bp, Rattus norvegicus
ttaactgcaccgtgggttatgtcat

SEQ ID NO: 656637 - DNA, 25 bp, Rattus norvegicus
ttaactgcaggcacagagacaggga

SEQ ID NO: 656638 - DNA, 25 bp, Rattus norvegicus
ttaactgcaggctcagagacaggga

SEQ ID NO: 656639 - DNA, 25 bp, Rattus norvegicus
ttaactgcccatccatctgactgtc

SEQ ID NO: 656640 - DNA, 25 bp, Rattus norvegicus
ttaactgcccatgcatctgactgtc

SEQ ID NO: 656641 - DNA, 25 bp, Rattus norvegicus
ttaactgctccccttggtatatgtt

SEQ ID NO: 656642 - DNA, 25 bp, Rattus norvegicus
ttaactgctcccgttggtatatgtt

SEQ ID NO: 656643 - DNA, 25 bp, Rattus norvegicus
ttaactgctgccacatggtgaacgc

SEQ ID NO: 656644 - DNA, 25 bp, Rattus norvegicus
ttaactgctgcctcatggtgaacgc

SEQ ID NO: 656645 - DNA, 25 bp, Rattus norvegicus
ttaactgctgctattacactctgta

SEQ ID NO: 656646 - DNA, 25 bp, Rattus norvegicus
ttaactgctgcttttacactctgta

SEQ ID NO: 656647 - DNA, 25 bp, Rattus norvegicus
ttaactgcttggacactggatcccc

SEQ ID NO: 656648 - DNA, 25 bp, Rattus norvegicus
ttaactgcttggtcactggatcccc

SEQ ID NO: 656649 - DNA, 25 bp, Rattus norvegicus
ttaactgctttacgcctatttcgat

SEQ ID NO: 656650 - DNA, 25 bp, Rattus norvegicus
ttaactgctttaggcctatttcgat

SEQ ID NO: 656651 - DNA, 25 bp, Rattus norvegicus
ttaactggaactcatggccccttag

SEQ ID NO: 656652 - DNA, 25 bp, Rattus norvegicus
ttaactggaactgatggccccttag

SEQ ID NO: 656653 - DNA, 25 bp, Rattus norvegicus
ttaactggcaccacaagactcaggt

SEQ ID NO: 656654 - DNA, 25 bp, Rattus norvegicus
ttaactggcacctcaagactcaggt

SEQ ID NO: 656655 - DNA, 25 bp, Rattus norvegicus
ttaactggcagcacaacggcaggca

SEQ ID NO: 656656 - DNA, 25 bp, Rattus norvegicus
ttaactggcagctcaacggcaggca

SEQ ID NO: 656657 - DNA, 25 bp, Rattus norvegicus
ttaactggccctacagctccaaggt

SEQ ID NO: 656658 - DNA, 25 bp, Rattus norvegicus
ttaactggcccttcagctccaaggt

SEQ ID NO: 656659 - DNA, 25 bp, Rattus norvegicus
ttaactggtttcaagtggccgccct

SEQ ID NO: 656660 - DNA, 25 bp, Rattus norvegicus
ttaactggtttctagtggccgccct

SEQ ID NO: 656661 - DNA, 25 bp, Rattus norvegicus
ttaactgtacttaattctcacaata

SEQ ID NO: 656662 - DNA, 25 bp, Rattus norvegicus
ttaactgtactttattctcacaata

SEQ ID NO: 656663 - DNA, 25 bp, Rattus norvegicus
ttaactgtcagactctatgcccact

SEQ ID NO: 656664 - DNA, 25 bp, Rattus norvegicus
ttaactgtcagagtctatgcccact

SEQ ID NO: 656665 - DNA, 25 bp, Rattus norvegicus
ttaactgtctccacagccaatcaga

SEQ ID NO: 656666 - DNA, 25 bp, Rattus norvegicus
ttaactgtctcctcagccaatcaga

SEQ ID NO: 656667 - DNA, 25 bp, Rattus norvegicus
ttaactgttaagctacaataaagtc

SEQ ID NO: 656668 - DNA, 25 bp, Rattus norvegicus
ttaactgttaaggtacaataaagtc

SEQ ID NO: 656669 - DNA, 25 bp, Rattus norvegicus
ttaactgttgctatgtatgcccctt

SEQ ID NO: 656670 - DNA, 25 bp, Rattus norvegicus
ttaactgttgctttgtatgcccctt

SEQ ID NO: 656671 - DNA, 25 bp, Rattus norvegicus
ttaactgtttgtacttttcatgcca

SEQ ID NO: 656672 - DNA, 25 bp, Rattus norvegicus
ttaactgtttgtccttgcttagctg

SEQ ID NO: 656673 - DNA, 25 bp, Rattus norvegicus
ttaactgtttgtgcttgcttagctg

SEQ ID NO: 656674 - DNA, 25 bp, Rattus norvegicus
ttaactgtttgttcttttcatgcca

SEQ ID NO: 656675 - DNA, 25 bp, Rattus norvegicus
ttaacttattgcagggactccttgt

SEQ ID NO: 656676 - DNA, 25 bp, Rattus norvegicus
ttaacttattgcattgtatctcggg

SEQ ID NO: 656677 - DNA, 25 bp, Rattus norvegicus
ttaacttattgctgggactccttgt

SEQ ID NO: 656678 - DNA, 25 bp, Rattus norvegicus
ttaacttattgctttgtatctcggg

SEQ ID NO: 656679 - DNA, 25 bp, Rattus norvegicus
ttaacttcagaaccctaagagatct

SEQ ID NO: 656680 - DNA, 25 bp, Rattus norvegicus
ttaacttcagaagcctaagagatct

SEQ ID NO: 656681 - DNA, 25 bp, Rattus norvegicus
ttaacttcatggacatcagtgtagt

SEQ ID NO: 656682 - DNA, 25 bp, Rattus norvegicus
ttaacttcatggtcatcagtgtagt

SEQ ID NO: 656683 - DNA, 25 bp, Rattus norvegicus
ttaacttccctgacctatagcttct

SEQ ID NO: 656684 - DNA, 25 bp, Rattus norvegicus
ttaacttccctgtcctatagcttct

SEQ ID NO: 656685 - DNA, 25 bp, Rattus norvegicus
ttaacttcctcacatcaacacacat

SEQ ID NO: 656686 - DNA, 25 bp, Rattus norvegicus
ttaacttcctcagatcaacacacat

SEQ ID NO: 656687 - DNA, 25 bp, Rattus norvegicus
ttaacttcctgtaccaggctgagct

SEQ ID NO: 656688 - DNA, 25 bp, Rattus norvegicus
ttaacttcctgttccaggctgagct

SEQ ID NO: 656689 - DNA, 25 bp, Rattus norvegicus
ttaacttcgaacaccagcctcatgt

SEQ ID NO: 656690 - DNA, 25 bp, Rattus norvegicus
ttaacttcgaactccagcctcatgt

SEQ ID NO: 656691 - DNA, 25 bp, Rattus norvegicus
ttaacttctctgctttacttttggc

SEQ ID NO: 656692 - DNA, 25 bp, Rattus norvegicus
ttaacttctctggtttacttttggc

SEQ ID NO: 656693 - DNA, 25 bp, Rattus norvegicus
ttaacttctcttagggcctgttcag

SEQ ID NO: 656694 - DNA, 25 bp, Rattus norvegicus
ttaacttctctttgggcctgttcag

SEQ ID NO: 656695 - DNA, 25 bp, Rattus norvegicus
ttaacttgctgaattagagatgcca

SEQ ID NO: 656696 - DNA, 25 bp, Rattus norvegicus
ttaacttgctgatttagagatgcca

SEQ ID NO: 656697 - DNA, 25 bp, Rattus norvegicus
ttaacttgctgccttcaactttgtg

SEQ ID NO: 656698 - DNA, 25 bp, Rattus norvegicus
ttaacttgctgcgttcaactttgtg

SEQ ID NO: 656699 - DNA, 25 bp, Rattus norvegicus
ttaacttgtactatcccagaacttg

SEQ ID NO: 656700 - DNA, 25 bp, Rattus norvegicus
ttaacttgtactttcccagaacttg

SEQ ID NO: 656701 - DNA, 25 bp, Rattus norvegicus
ttaacttgtatcactccgaaatggt

SEQ ID NO: 656702 - DNA, 25 bp, Rattus norvegicus
ttaacttgtatctctccgaaatggt

SEQ ID NO: 656703 - DNA, 25 bp, Rattus norvegicus
ttaacttgtcctctgtgtggctaaa

SEQ ID NO: 656704 - DNA, 25 bp, Rattus norvegicus
ttaacttgtcctgtgtgtggctaaa

SEQ ID NO: 656705 - DNA, 25 bp, Rattus norvegicus
ttaactttaactacatttactctgt

SEQ ID NO: 656706 - DNA, 25 bp, Rattus norvegicus
ttaactttaacttcatttactctgt

SEQ ID NO: 656707 - DNA, 25 bp, Rattus norvegicus
ttaactttacagacttccccacagg

SEQ ID NO: 656708 - DNA, 25 bp, Rattus norvegicus
ttaactttacagtcttccccacagg

SEQ ID NO: 656709 - DNA, 25 bp, Rattus norvegicus
ttaactttccacaagccaggttttg

SEQ ID NO: 656710 - DNA, 25 bp, Rattus norvegicus
ttaactttccacctgcttggctaat

SEQ ID NO: 656711 - DNA, 25 bp, Rattus norvegicus
ttaactttccacgtgcttggctaat

SEQ ID NO: 656712 - DNA, 25 bp, Rattus norvegicus
ttaactttccactagccaggttttg

SEQ ID NO: 656713 - DNA, 25 bp, Rattus norvegicus
ttaactttccagatgaagactcagg

SEQ ID NO: 656714 - DNA, 25 bp, Rattus norvegicus
ttaactttccagttgaagactcagg

SEQ ID NO: 656715 - DNA, 25 bp, Rattus norvegicus
ttaactttcccactgtccacaggct

SEQ ID NO: 656716 - DNA, 25 bp, Rattus norvegicus
ttaactttcccagtgtccacaggct

SEQ ID NO: 656717 - DNA, 25 bp, Rattus norvegicus
ttaactttcctaaatcagaccgcac

SEQ ID NO: 656718 - DNA, 25 bp, Rattus norvegicus
ttaactttcctatatcagaccgcac

SEQ ID NO: 656719 - DNA, 25 bp, Rattus norvegicus
ttaactttgcggaaacacccattgc

SEQ ID NO: 656720 - DNA, 25 bp, Rattus norvegicus
ttaactttgcggtaacacccattgc

SEQ ID NO: 656721 - DNA, 25 bp, Rattus norvegicus
ttaactttgtacaaggctggcctgg

SEQ ID NO: 656722 - DNA, 25 bp, Rattus norvegicus
ttaactttgtactaggctggcctgg

SEQ ID NO: 656723 - DNA, 25 bp, Rattus norvegicus
ttaactttgtcccttattctctcta

SEQ ID NO: 656724 - DNA, 25 bp, Rattus norvegicus
ttaactttgtccgttattctctcta

SEQ ID NO: 656725 - DNA, 25 bp, Rattus norvegicus
ttaactttgtgcatcgggacctggc

SEQ ID NO: 656726 - DNA, 25 bp, Rattus norvegicus
ttaactttgtgcttcgggacctggc

SEQ ID NO: 656727 - DNA, 25 bp, Rattus norvegicus
ttaacttttaccaccttatgccaga

SEQ ID NO: 656728 - DNA, 25 bp, Rattus norvegicus
ttaacttttacctccttatgccaga

SEQ ID NO: 656729 - DNA, 25 bp, Rattus norvegicus
ttaactttttatagactgtgagtag

SEQ ID NO: 656730 - DNA, 25 bp, Rattus norvegicus
ttaactttttattgactgtgagtag

SEQ ID NO: 656731 - DNA, 25 bp, Rattus norvegicus
ttaacttttttgactgcttagccag

SEQ ID NO: 656732 - DNA, 25 bp, Rattus norvegicus
ttaacttttttgtctgcttagccag

SEQ ID NO: 656733 - DNA, 25 bp, Rattus norvegicus
ttaagaaaccagacccttcggtgtg

SEQ ID NO: 656734 - DNA, 25 bp, Rattus norvegicus
ttaagaaaccagtcccttcggtgtg

SEQ ID NO: 656735 - DNA, 25 bp, Rattus norvegicus
ttaagaaagcttctggccctcaggg

SEQ ID NO: 656736 - DNA, 25 bp, Rattus norvegicus
ttaagaaagcttgtggccctcaggg

SEQ ID NO: 656737 - DNA, 25 bp, Rattus norvegicus
ttaagaaaggccagtccctgggtca

SEQ ID NO: 656738 - DNA, 25 bp, Rattus norvegicus
ttaagaaaggcctgtccctgggtca

SEQ ID NO: 656739 - DNA, 25 bp, Rattus norvegicus
ttaagaacatttcctgggccagccg

SEQ ID NO: 656740 - DNA, 25 bp, Rattus norvegicus
ttaagaacatttgctgggccagccg

SEQ ID NO: 656741 - DNA, 25 bp, Rattus norvegicus
ttaagaaccagtatgctacccaatg

SEQ ID NO: 656742 - DNA, 25 bp, Rattus norvegicus
ttaagaaccagtttgctacccaatg

SEQ ID NO: 656743 - DNA, 25 bp, Rattus norvegicus
ttaagaacccaaccatggacctgtg

SEQ ID NO: 656744 - DNA, 25 bp, Rattus norvegicus
ttaagaacccaagcatggacctgtg

SEQ ID NO: 656745 - DNA, 25 bp, Rattus norvegicus
ttaagaacccagaaaacaccacctg

SEQ ID NO: 656746 - DNA, 25 bp, Rattus norvegicus
ttaagaacccagtaaacaccacctg

SEQ ID NO: 656747 - DNA, 25 bp, Rattus norvegicus
ttaagaaccctacggccacttgtag

SEQ ID NO: 656748 - DNA, 25 bp, Rattus norvegicus
ttaagaaccctagggccacttgtag

SEQ ID NO: 656749 - DNA, 25 bp, Rattus norvegicus
ttaagaacccttatgctagctgtgc

SEQ ID NO: 656750 - DNA, 25 bp, Rattus norvegicus
ttaagaacccttttgctagctgtgc

SEQ ID NO: 656751 - DNA, 25 bp, Rattus norvegicus
ttaagaacggacctgttctgtcccg

SEQ ID NO: 656752 - DNA, 25 bp, Rattus norvegicus
ttaagaacggacgtgttctgtcccg

SEQ ID NO: 656753 - DNA, 25 bp, Rattus norvegicus
ttaagaagaattccttcccactctt

SEQ ID NO: 656754 - DNA, 25 bp, Rattus norvegicus
ttaagaagaattgcttcccactctt

SEQ ID NO: 656755 - DNA, 25 bp, Rattus norvegicus
ttaagaagcggaacctgaggaccct

SEQ ID NO: 656756 - DNA, 25 bp, Rattus norvegicus
ttaagaagcggatcctgaggaccct

SEQ ID NO: 656757 - DNA, 25 bp, Rattus norvegicus
ttaagaaggacgattaggcagcccc

SEQ ID NO: 656758 - DNA, 25 bp, Rattus norvegicus
ttaagaaggacgtttaggcagcccc

SEQ ID NO: 656759 - DNA, 25 bp, Rattus norvegicus
ttaagaagggccctccacgaaagct

SEQ ID NO: 656760 - DNA, 25 bp, Rattus norvegicus
ttaagaagggccgtccacgaaagct

SEQ ID NO: 656761 - DNA, 25 bp, Rattus norvegicus
ttaagaataagccagtctcccttcc

SEQ ID NO: 656762 - DNA, 25 bp, Rattus norvegicus
ttaagaataagcgagtctcccttcc

SEQ ID NO: 656763 - DNA, 25 bp, Rattus norvegicus
ttaagaatgcctcactgtcagcctg

SEQ ID NO: 656764 - DNA, 25 bp, Rattus norvegicus
ttaagaatgcctgactgtcagcctg

SEQ ID NO: 656765 - DNA, 25 bp, Rattus norvegicus
ttaagaatgctacaccgatcagggt

SEQ ID NO: 656766 - DNA, 25 bp, Rattus norvegicus
ttaagaatgctagaccgatcagggt

SEQ ID NO: 656767 - DNA, 25 bp, Rattus norvegicus
ttaagaatgtttccacaggacccat

SEQ ID NO: 656768 - DNA, 25 bp, Rattus norvegicus
ttaagaatgtttgcacaggacccat

SEQ ID NO: 656769 - DNA, 25 bp, Rattus norvegicus
ttaagaattgctactgttctctgta

SEQ ID NO: 656770 - DNA, 25 bp, Rattus norvegicus
ttaagaattgcttctgttctctgta

SEQ ID NO: 656771 - DNA, 25 bp, Rattus norvegicus
ttaagacacctccatgcgaaagatg

SEQ ID NO: 656772 - DNA, 25 bp, Rattus norvegicus
ttaagacacctcgatgcgaaagatg

SEQ ID NO: 656773 - DNA, 25 bp, Rattus norvegicus
ttaagacagcctaggtcaccttcat

SEQ ID NO: 656774 - DNA, 25 bp, Rattus norvegicus
ttaagacagccttggtcaccttcat

SEQ ID NO: 656775 - DNA, 25 bp, Rattus norvegicus
ttaagacatcagatctaccagactt

SEQ ID NO: 656776 - DNA, 25 bp, Rattus norvegicus
ttaagacatcagttctaccagactt

SEQ ID NO: 656777 - DNA, 25 bp, Rattus norvegicus
ttaagacattctccagttccctgaa

SEQ ID NO: 656778 - DNA, 25 bp, Rattus norvegicus
ttaagacattctgcagttccctgaa

SEQ ID NO: 656779 - DNA, 25 bp, Rattus norvegicus
ttaagaccagtcacttccttagttg

SEQ ID NO: 656780 - DNA, 25 bp, Rattus norvegicus
ttaagaccagtctcttccttagttg

SEQ ID NO: 656781 - DNA, 25 bp, Rattus norvegicus
ttaagaccattaagcctttccccat

SEQ ID NO: 656782 - DNA, 25 bp, Rattus norvegicus
ttaagaccattatgcctttccccat

SEQ ID NO: 656783 - DNA, 25 bp, Rattus norvegicus
ttaagacccttgctgaccatcactg

SEQ ID NO: 656784 - DNA, 25 bp, Rattus norvegicus
ttaagacccttggtgaccatcactg

SEQ ID NO: 656785 - DNA, 25 bp, Rattus norvegicus
ttaagacctgatccctcagaaccag

SEQ ID NO: 656786 - DNA, 25 bp, Rattus norvegicus
ttaagacctgatgcctcagaaccag

SEQ ID NO: 656787 - DNA, 25 bp, Rattus norvegicus
ttaagaccttgtagtttccctggct

SEQ ID NO: 656788 - DNA, 25 bp, Rattus norvegicus
ttaagaccttgttgtttccctggct

SEQ ID NO: 656789 - DNA, 25 bp, Rattus norvegicus
ttaagacgccttcttctgggacagt

SEQ ID NO: 656790 - DNA, 25 bp, Rattus norvegicus
ttaagacgccttgttctgggacagt

SEQ ID NO: 656791 - DNA, 25 bp, Rattus norvegicus
ttaagacgtttgattcccagagaca

SEQ ID NO: 656792 - DNA, 25 bp, Rattus norvegicus
ttaagacgtttgtttcccagagaca

SEQ ID NO: 656793 - DNA, 25 bp, Rattus norvegicus
ttaagactacttatcccagggtcat

SEQ ID NO: 656794 - DNA, 25 bp, Rattus norvegicus
ttaagactacttttcccagggtcat

SEQ ID NO: 656795 - DNA, 25 bp, Rattus norvegicus
ttaagactatctacccatgggttga

SEQ ID NO: 656796 - DNA, 25 bp, Rattus norvegicus
ttaagactatcttcccatgggttga

SEQ ID NO: 656797 - DNA, 25 bp, Rattus norvegicus
ttaagactcactccttgcttttcca

SEQ ID NO: 656798 - DNA, 25 bp, Rattus norvegicus
ttaagactcactgcttgcttttcca

SEQ ID NO: 656799 - DNA, 25 bp, Rattus norvegicus
ttaagactcagtcttgcggttcttt

SEQ ID NO: 656800 - DNA, 25 bp, Rattus norvegicus
ttaagactcagtgttgcggttcttt

SEQ ID NO: 656801 - DNA, 25 bp, Rattus norvegicus
ttaagactctaaaggtggacacaat

SEQ ID NO: 656802 - DNA, 25 bp, Rattus norvegicus
ttaagactctaatggtggacacaat

SEQ ID NO: 656803 - DNA, 25 bp, Rattus norvegicus
ttaagactgcagctgaacgcctggt

SEQ ID NO: 656804 - DNA, 25 bp, Rattus norvegicus
ttaagactgcagctgcttcctgtct

SEQ ID NO: 656805 - DNA, 25 bp, Rattus norvegicus
ttaagactgcaggtgaacgcctggt

SEQ ID NO: 656806 - DNA, 25 bp, Rattus norvegicus
ttaagactgcaggtgcttcctgtct

SEQ ID NO: 656807 - DNA, 25 bp, Rattus norvegicus
ttaagactgcatccatgcctacaca

SEQ ID NO: 656808 - DNA, 25 bp, Rattus norvegicus
ttaagactgcatgcatgcctacaca

SEQ ID NO: 656809 - DNA, 25 bp, Rattus norvegicus
ttaagactgcccagactgtggaaga

SEQ ID NO: 656810 - DNA, 25 bp, Rattus norvegicus
ttaagactgccctgactgtggaaga

SEQ ID NO: 656811 - DNA, 25 bp, Rattus norvegicus
ttaagactgtcaattgaccgtcccc

SEQ ID NO: 656812 - DNA, 25 bp, Rattus norvegicus
ttaagactgtcatttgaccgtcccc

SEQ ID NO: 656813 - DNA, 25 bp, Rattus norvegicus
ttaagacttttcacgggctgatgat

SEQ ID NO: 656814 - DNA, 25 bp, Rattus norvegicus
ttaagacttttctcgggctgatgat

SEQ ID NO: 656815 - DNA, 25 bp, Rattus norvegicus
ttaagagaatccacaggcatcctcc

SEQ ID NO: 656816 - DNA, 25 bp, Rattus norvegicus
ttaagagaatcctcaggcatcctcc

SEQ ID NO: 656817 - DNA, 25 bp, Rattus norvegicus
ttaagagacttccagagcaccagcg

SEQ ID NO: 656818 - DNA, 25 bp, Rattus norvegicus
ttaagagacttcgagagcaccagcg

SEQ ID NO: 656819 - DNA, 25 bp, Rattus norvegicus
ttaagagacttgcaccttttgggta

SEQ ID NO: 656820 - DNA, 25 bp, Rattus norvegicus
ttaagagacttggaccttttgggta

SEQ ID NO: 656821 - DNA, 25 bp, Rattus norvegicus
ttaagagactttagccccacagtgt

SEQ ID NO: 656822 - DNA, 25 bp, Rattus norvegicus
ttaagagacttttgccccacagtgt

SEQ ID NO: 656823 - DNA, 25 bp, Rattus norvegicus
ttaagagagcccaagacctgtctat

SEQ ID NO: 656824 - DNA, 25 bp, Rattus norvegicus
ttaagagagccctagacctgtctat

SEQ ID NO: 656825 - DNA, 25 bp, Rattus norvegicus
ttaagagatagcaaacccaggaatt

SEQ ID NO: 656826 - DNA, 25 bp, Rattus norvegicus
ttaagagatagctaacccaggaatt

SEQ ID NO: 656827 - DNA, 25 bp, Rattus norvegicus
ttaagagattcccagtgtcagcctc

SEQ ID NO: 656828 - DNA, 25 bp, Rattus norvegicus
ttaagagattccgagtgtcagcctc

SEQ ID NO: 656829 - DNA, 25 bp, Rattus norvegicus
ttaagagcaccaatcttcagtgtgg

SEQ ID NO: 656830 - DNA, 25 bp, Rattus norvegicus
ttaagagcaccattcttcagtgtgg

SEQ ID NO: 656831 - DNA, 25 bp, Rattus norvegicus
ttaagagcacttactcctgagcgtg

SEQ ID NO: 656832 - DNA, 25 bp, Rattus norvegicus
ttaagagcactttctcctgagcgtg

SEQ ID NO: 656833 - DNA, 25 bp, Rattus norvegicus
ttaagagcttggcttccccattatg

SEQ ID NO: 656834 - DNA, 25 bp, Rattus norvegicus
ttaagagcttgggttccccattatg

SEQ ID NO: 656835 - DNA, 25 bp, Rattus norvegicus
ttaagaggaagtcagccctccccac

SEQ ID NO: 656836 - DNA, 25 bp, Rattus norvegicus
ttaagaggaagtgagccctccccac

SEQ ID NO: 656837 - DNA, 25 bp, Rattus norvegicus
ttaagaggcgacatgccagacggga

SEQ ID NO: 656838 - DNA, 25 bp, Rattus norvegicus
ttaagaggcgacttgccagacggga

SEQ ID NO: 656839 - DNA, 25 bp, Rattus norvegicus
ttaagagggtctctctccacagcag

SEQ ID NO: 656840 - DNA, 25 bp, Rattus norvegicus
ttaagagggtctgtctccacagcag

SEQ ID NO: 656841 - DNA, 25 bp, Rattus norvegicus
ttaagagtctatcaccacgctaccc

SEQ ID NO: 656842 - DNA, 25 bp, Rattus norvegicus
ttaagagtctatgaccacgctaccc

SEQ ID NO: 656843 - DNA, 25 bp, Rattus norvegicus
ttaagagtgcttctctagtatgcat

SEQ ID NO: 656844 - DNA, 25 bp, Rattus norvegicus
ttaagagtgcttgtctagtatgcat

SEQ ID NO: 656845 - DNA, 25 bp, Rattus norvegicus
ttaagagtgtttccgatcccaccga

SEQ ID NO: 656846 - DNA, 25 bp, Rattus norvegicus
ttaagagtgtttgcgatcccaccga

SEQ ID NO: 656847 - DNA, 25 bp, Rattus norvegicus
ttaagagtttccacattgcctccaa

SEQ ID NO: 656848 - DNA, 25 bp, Rattus norvegicus
ttaagagtttcctcattgcctccaa

SEQ ID NO: 656849 - DNA, 25 bp, Rattus norvegicus
ttaagataccagatgccagcccaac

SEQ ID NO: 656850 - DNA, 25 bp, Rattus norvegicus
ttaagataccagttgccagcccaac

SEQ ID NO: 656851 - DNA, 25 bp, Rattus norvegicus
ttaagatacgatcacctgatccgca

SEQ ID NO: 656852 - DNA, 25 bp, Rattus norvegicus
ttaagatacgatgacctgatccgca

SEQ ID NO: 656853 - DNA, 25 bp, Rattus norvegicus
ttaagatatacgcttcctacttggg

SEQ ID NO: 656854 - DNA, 25 bp, Rattus norvegicus
ttaagatatacggttcctacttggg

SEQ ID NO: 656855 - DNA, 25 bp, Rattus norvegicus
ttaagatcccagctctctgtagtga

SEQ ID NO: 656856 - DNA, 25 bp, Rattus norvegicus
ttaagatcccaggtctctgtagtga

SEQ ID NO: 656857 - DNA, 25 bp, Rattus norvegicus
ttaagatctaggcatcccttcccac

SEQ ID NO: 656858 - DNA, 25 bp, Rattus norvegicus
ttaagatctagggatcccttcccac

SEQ ID NO: 656859 - DNA, 25 bp, Rattus norvegicus
ttaagatctgtgacccaaatgctaa

SEQ ID NO: 656860 - DNA, 25 bp, Rattus norvegicus
ttaagatctgtgtcccaaatgctaa

SEQ ID NO: 656861 - DNA, 25 bp, Rattus norvegicus
ttaagatgactgactctcctgtgcc

SEQ ID NO: 656862 - DNA, 25 bp, Rattus norvegicus
ttaagatgactgtctctcctgtgcc

SEQ ID NO: 656863 - DNA, 25 bp, Rattus norvegicus
ttaagatgagcaacgctcgctgcac

SEQ ID NO: 656864 - DNA, 25 bp, Rattus norvegicus
ttaagatgagcatcgctcgctgcac

SEQ ID NO: 656865 - DNA, 25 bp, Rattus norvegicus
ttaagatggcccacagtgctcttca

SEQ ID NO: 656866 - DNA, 25 bp, Rattus norvegicus
ttaagatggccctcagtgctcttca

SEQ ID NO: 656867 - DNA, 25 bp, Rattus norvegicus
ttaagatgtaagacctccctatccc

SEQ ID NO: 656868 - DNA, 25 bp, Rattus norvegicus
ttaagatgtaagtcctccctatccc

SEQ ID NO: 656869 - DNA, 25 bp, Rattus norvegicus
ttaagatgtcttaccttcacggaga

SEQ ID NO: 656870 - DNA, 25 bp, Rattus norvegicus
ttaagatgtctttccttcacggaga

SEQ ID NO: 656871 - DNA, 25 bp, Rattus norvegicus
ttaagattaatacctgcccattccc

SEQ ID NO: 656872 - DNA, 25 bp, Rattus norvegicus
ttaagattaatagctgcccattccc

SEQ ID NO: 656873 - DNA, 25 bp, Rattus norvegicus
ttaagattccctcctcctaacagga

SEQ ID NO: 656874 - DNA, 25 bp, Rattus norvegicus
ttaagattccctgctcctaacagga

SEQ ID NO: 656875 - DNA, 25 bp, Rattus norvegicus
ttaagattcgtcagcgtggtcacca

SEQ ID NO: 656876 - DNA, 25 bp, Rattus norvegicus
ttaagattcgtctgcgtggtcacca

SEQ ID NO: 656877 - DNA, 25 bp, Rattus norvegicus
ttaagattgcatatccagccacacc

SEQ ID NO: 656878 - DNA, 25 bp, Rattus norvegicus
ttaagattgcatttccagccacacc

SEQ ID NO: 656879 - DNA, 25 bp, Rattus norvegicus
ttaagattgttgcactgttgggcgt

SEQ ID NO: 656880 - DNA, 25 bp, Rattus norvegicus
ttaagattgttggactgttgggcgt

SEQ ID NO: 656881 - DNA, 25 bp, Rattus norvegicus
ttaagatttcttagcctgccctgaa

SEQ ID NO: 656882 - DNA, 25 bp, Rattus norvegicus
ttaagatttctttgcctgccctgaa

SEQ ID NO: 656883 - DNA, 25 bp, Rattus norvegicus
ttaagcaagctaattgggcacatgg

SEQ ID NO: 656884 - DNA, 25 bp, Rattus norvegicus
ttaagcaagctatttgggcacatgg

SEQ ID NO: 656885 - DNA, 25 bp, Rattus norvegicus
ttaagcacacctcaaaaccagctgt

SEQ ID NO: 656886 - DNA, 25 bp, Rattus norvegicus
ttaagcacacctgaaaaccagctgt

SEQ ID NO: 656887 - DNA, 25 bp, Rattus norvegicus
ttaagcaccaggcattgcacatctg

SEQ ID NO: 656888 - DNA, 25 bp, Rattus norvegicus
ttaagcaccagggattgcacatctg

SEQ ID NO: 656889 - DNA, 25 bp, Rattus norvegicus
ttaagcacgtctctttacctcatga

SEQ ID NO: 656890 - DNA, 25 bp, Rattus norvegicus
ttaagcacgtctgtttacctcatga

SEQ ID NO: 656891 - DNA, 25 bp, Rattus norvegicus
ttaagcagacacacctacgtcggga

SEQ ID NO: 656892 - DNA, 25 bp, Rattus norvegicus
ttaagcagacactcctacgtcggga

SEQ ID NO: 656893 - DNA, 25 bp, Rattus norvegicus
ttaagcagcctgagatgtcctctgt

SEQ ID NO: 656894 - DNA, 25 bp, Rattus norvegicus
ttaagcagcctgtgatgtcctctgt

SEQ ID NO: 656895 - DNA, 25 bp, Rattus norvegicus
ttaagcagcgccacatcaagaaggt

SEQ ID NO: 656896 - DNA, 25 bp, Rattus norvegicus
ttaagcagcgcctcatcaagaaggt

SEQ ID NO: 656897 - DNA, 25 bp, Rattus norvegicus
ttaagcagcttacacgaagcccctg

SEQ ID NO: 656898 - DNA, 25 bp, Rattus norvegicus
ttaagcagcttagacgaagcccctg

SEQ ID NO: 656899 - DNA, 25 bp, Rattus norvegicus
ttaagcagtggtacttctcccctaa

SEQ ID NO: 656900 - DNA, 25 bp, Rattus norvegicus
ttaagcagtggttcttctcccctaa

SEQ ID NO: 656901 - DNA, 25 bp, Rattus norvegicus
ttaagcatacacaaaacctcgtttt

SEQ ID NO: 656902 - DNA, 25 bp, Rattus norvegicus
ttaagcatacacagcagcccagctg

SEQ ID NO: 656903 - DNA, 25 bp, Rattus norvegicus
ttaagcatacactaaacctcgtttt

SEQ ID NO: 656904 - DNA, 25 bp, Rattus norvegicus
ttaagcatacactgcagcccagctg

SEQ ID NO: 656905 - DNA, 25 bp, Rattus norvegicus
ttaagcatcatcatcccttgtgaag

SEQ ID NO: 656906 - DNA, 25 bp, Rattus norvegicus
ttaagcatcatcttcccttgtgaag

SEQ ID NO: 656907 - DNA, 25 bp, Rattus norvegicus
ttaagcatcattagtgacagccaca

SEQ ID NO: 656908 - DNA, 25 bp, Rattus norvegicus
ttaagcatcatttgtgacagccaca

SEQ ID NO: 656909 - DNA, 25 bp, Rattus norvegicus
ttaagcatgactccagtattctagg

SEQ ID NO: 656910 - DNA, 25 bp, Rattus norvegicus
ttaagcatgactgcagtattctagg

SEQ ID NO: 656911 - DNA, 25 bp, Rattus norvegicus
ttaagcatgcccacaccagcctggg

SEQ ID NO: 656912 - DNA, 25 bp, Rattus norvegicus
ttaagcatgccctcaccagcctggg

SEQ ID NO: 656913 - DNA, 25 bp, Rattus norvegicus
ttaagccaagccctagacccacaat

SEQ ID NO: 656914 - DNA, 25 bp, Rattus norvegicus
ttaagccaagccgtagacccacaat

SEQ ID NO: 656915 - DNA, 25 bp, Rattus norvegicus
ttaagccacattacaggccaaggag

SEQ ID NO: 656916 - DNA, 25 bp, Rattus norvegicus
ttaagccacatttcaggccaaggag

SEQ ID NO: 656917 - DNA, 25 bp, Rattus norvegicus
ttaagccaccgaaaacgatgtatgc

SEQ ID NO: 656918 - DNA, 25 bp, Rattus norvegicus
ttaagccaccgataacgatgtatgc

SEQ ID NO: 656919 - DNA, 25 bp, Rattus norvegicus
ttaagccatcagcatctacctcaaa

SEQ ID NO: 656920 - DNA, 25 bp, Rattus norvegicus
ttaagccatcaggatctacctcaaa

SEQ ID NO: 656921 - DNA, 25 bp, Rattus norvegicus
ttaagccatgtcatatgttgagagt

SEQ ID NO: 656922 - DNA, 25 bp, Rattus norvegicus
ttaagccatgtcttatgttgagagt

SEQ ID NO: 656923 - DNA, 25 bp, Rattus norvegicus
ttaagcccagagacatggagccagg

SEQ ID NO: 656924 - DNA, 25 bp, Rattus norvegicus
ttaagcccagagtcatggagccagg

SEQ ID NO: 656925 - DNA, 25 bp, Rattus norvegicus
ttaagcccagcgaacagatgatgtc

SEQ ID NO: 656926 - DNA, 25 bp, Rattus norvegicus
ttaagcccagcgtacagatgatgtc

SEQ ID NO: 656927 - DNA, 25 bp, Rattus norvegicus
ttaagcccagctcaccttggtgaaa

SEQ ID NO: 656928 - DNA, 25 bp, Rattus norvegicus
ttaagcccagctgaccttggtgaaa

SEQ ID NO: 656929 - DNA, 25 bp, Rattus norvegicus
ttaagcccataaacttccttctcag

SEQ ID NO: 656930 - DNA, 25 bp, Rattus norvegicus
ttaagcccataatcttccttctcag

SEQ ID NO: 656931 - DNA, 25 bp, Rattus norvegicus
ttaagcccatctattcgtccaggag

SEQ ID NO: 656932 - DNA, 25 bp, Rattus norvegicus
ttaagcccatcttttcgtccaggag

SEQ ID NO: 656933 - DNA, 25 bp, Rattus norvegicus
ttaagccccaatacttcattactgc

SEQ ID NO: 656934 - DNA, 25 bp, Rattus norvegicus
ttaagccccaattcttcattactgc

SEQ ID NO: 656935 - DNA, 25 bp, Rattus norvegicus
ttaagccccactcagttgctcagag

SEQ ID NO: 656936 - DNA, 25 bp, Rattus norvegicus
ttaagccccactgagttgctcagag

SEQ ID NO: 656937 - DNA, 25 bp, Rattus norvegicus
ttaagccctattaacatcccaaagt

SEQ ID NO: 656938 - DNA, 25 bp, Rattus norvegicus
ttaagccctatttacatcccaaagt

SEQ ID NO: 656939 - DNA, 25 bp, Rattus norvegicus
ttaagccctcttcctgtcagcggag

SEQ ID NO: 656940 - DNA, 25 bp, Rattus norvegicus
ttaagccctcttgctgtcagcggag

SEQ ID NO: 656941 - DNA, 25 bp, Rattus norvegicus
ttaagccctgtgcaagaaggtggaa

SEQ ID NO: 656942 - DNA, 25 bp, Rattus norvegicus
ttaagccctgtggaagaaggtggaa

SEQ ID NO: 656943 - DNA, 25 bp, Rattus norvegicus
ttaagcccttcaattcttgttaaat

SEQ ID NO: 656944 - DNA, 25 bp, Rattus norvegicus
ttaagcccttcaattgctctctgga

SEQ ID NO: 656945 - DNA, 25 bp, Rattus norvegicus
ttaagcccttcatttcttgttaaat

SEQ ID NO: 656946 - DNA, 25 bp, Rattus norvegicus
ttaagcccttcatttgctctctgga

SEQ ID NO: 656947 - DNA, 25 bp, Rattus norvegicus
ttaagccgtttaatgagccccgagg

SEQ ID NO: 656948 - DNA, 25 bp, Rattus norvegicus
ttaagccgtttattgagccccgagg

SEQ ID NO: 656949 - DNA, 25 bp, Rattus norvegicus
ttaagcctagaaagctctcagtccc

SEQ ID NO: 656950 - DNA, 25 bp, Rattus norvegicus
ttaagcctagaatgctctcagtccc

SEQ ID NO: 656951 - DNA, 25 bp, Rattus norvegicus
ttaagcctagccattgcactcctgt

SEQ ID NO: 656952 - DNA, 25 bp, Rattus norvegicus
ttaagcctagcctttgcactcctgt

SEQ ID NO: 656953 - DNA, 25 bp, Rattus norvegicus
ttaagcctatcactgtgtctcaaga

SEQ ID NO: 656954 - DNA, 25 bp, Rattus norvegicus
ttaagcctatcagtgtgtctcaaga

SEQ ID NO: 656955 - DNA, 25 bp, Rattus norvegicus
ttaagcctctccagtggacccagtg

SEQ ID NO: 656956 - DNA, 25 bp, Rattus norvegicus
ttaagcctctcctgtggacccagtg

SEQ ID NO: 656957 - DNA, 25 bp, Rattus norvegicus
ttaagcctctgccatcactgataaa

SEQ ID NO: 656958 - DNA, 25 bp, Rattus norvegicus
ttaagcctctgcgatcactgataaa

SEQ ID NO: 656959 - DNA, 25 bp, Rattus norvegicus
ttaagcctgaatagtcttgtccctg

SEQ ID NO: 656960 - DNA, 25 bp, Rattus norvegicus
ttaagcctgaattgtcttgtccctg

SEQ ID NO: 656961 - DNA, 25 bp, Rattus norvegicus
ttaagcctgcaaccattcaagctgc

SEQ ID NO: 656962 - DNA, 25 bp, Rattus norvegicus
ttaagcctgcaagcattcaagctgc

SEQ ID NO: 656963 - DNA, 25 bp, Rattus norvegicus
ttaagcctggctaggagtatgccaa

SEQ ID NO: 656964 - DNA, 25 bp, Rattus norvegicus
ttaagcctggcttggagtatgccaa

SEQ ID NO: 656965 - DNA, 25 bp, Rattus norvegicus
ttaagcctgtgtccccagagttctg

SEQ ID NO: 656966 - DNA, 25 bp, Rattus norvegicus
ttaagcctgtgtgcccagagttctg

SEQ ID NO: 656967 - DNA, 25 bp, Rattus norvegicus
ttaagccttctaacataaccagcat

SEQ ID NO: 656968 - DNA, 25 bp, Rattus norvegicus
ttaagccttctatcataaccagcat

SEQ ID NO: 656969 - DNA, 25 bp, Rattus norvegicus
ttaagccttctgaagcccatgtggg

SEQ ID NO: 656970 - DNA, 25 bp, Rattus norvegicus
ttaagccttctgaagctgtgaacag

SEQ ID NO: 656971 - DNA, 25 bp, Rattus norvegicus
ttaagccttctgctctggagtcaag

SEQ ID NO: 656972 - DNA, 25 bp, Rattus norvegicus
ttaagccttctggtctggagtcaag

SEQ ID NO: 656973 - DNA, 25 bp, Rattus norvegicus
ttaagccttctgtagcccatgtggg

SEQ ID NO: 656974 - DNA, 25 bp, Rattus norvegicus
ttaagccttctgtagctgtgaacag

SEQ ID NO: 656975 - DNA, 25 bp, Rattus norvegicus
ttaagccttgaactatgcacagagc

SEQ ID NO: 656976 - DNA, 25 bp, Rattus norvegicus
ttaagccttgaagtatgcacagagc

SEQ ID NO: 656977 - DNA, 25 bp, Rattus norvegicus
ttaagcctttgacccttgaaactga

SEQ ID NO: 656978 - DNA, 25 bp, Rattus norvegicus
ttaagcctttgagccttgaaactga

SEQ ID NO: 656979 - DNA, 25 bp, Rattus norvegicus
ttaagcgagtgaaacaagccagtca

SEQ ID NO: 656980 - DNA, 25 bp, Rattus norvegicus
ttaagcgagtgatacaagccagtca

SEQ ID NO: 656981 - DNA, 25 bp, Rattus norvegicus
ttaagcgccacgatgcgggactgat

SEQ ID NO: 656982 - DNA, 25 bp, Rattus norvegicus
ttaagcgccacgttgcgggactgat

SEQ ID NO: 656983 - DNA, 25 bp, Rattus norvegicus
ttaagcgccataagctgtcccttga

SEQ ID NO: 656984 - DNA, 25 bp, Rattus norvegicus
ttaagcgccatatgctgtcccttga

SEQ ID NO: 656985 - DNA, 25 bp, Rattus norvegicus
ttaagcggtgaaccctgtccactga

SEQ ID NO: 656986 - DNA, 25 bp, Rattus norvegicus
ttaagcggtgaagcctgtccactga

SEQ ID NO: 656987 - DNA, 25 bp, Rattus norvegicus
ttaagcgtatcaatctccattctct

SEQ ID NO: 656988 - DNA, 25 bp, Rattus norvegicus
ttaagcgtatcattctccattctct

SEQ ID NO: 656989 - DNA, 25 bp, Rattus norvegicus
ttaagcgtgtttctccagtttagca

SEQ ID NO: 656990 - DNA, 25 bp, Rattus norvegicus
ttaagcgtgtttgtccagtttagca

SEQ ID NO: 656991 - DNA, 25 bp, Rattus norvegicus
ttaagctaacttcttcttcccaggt

SEQ ID NO: 656992 - DNA, 25 bp, Rattus norvegicus
ttaagctaacttgttcttcccaggt

SEQ ID NO: 656993 - DNA, 25 bp, Rattus norvegicus
ttaagctacacacaagggccactct

SEQ ID NO: 656994 - DNA, 25 bp, Rattus norvegicus
ttaagctacacagaagggccactct

SEQ ID NO: 656995 - DNA, 25 bp, Rattus norvegicus
ttaagctagatcagataccagcccc

SEQ ID NO: 656996 - DNA, 25 bp, Rattus norvegicus
ttaagctagatctgataccagcccc

SEQ ID NO: 656997 - DNA, 25 bp, Rattus norvegicus
ttaagctaggccagatgctgctaag

SEQ ID NO: 656998 - DNA, 25 bp, Rattus norvegicus
ttaagctaggcctgatgctgctaag

SEQ ID NO: 656999 - DNA, 25 bp, Rattus norvegicus
ttaagctagggcagcatgtccacct

SEQ ID NO: 657000 - DNA, 25 bp, Rattus norvegicus
ttaagctagggctgcatgtccacct

SEQ ID NO: 657001 - DNA, 25 bp, Rattus norvegicus
ttaagctatctcatgtgccacaaag

SEQ ID NO: 657002 - DNA, 25 bp, Rattus norvegicus
ttaagctatctcttgtgccacaaag

SEQ ID NO: 657003 - DNA, 25 bp, Rattus norvegicus
ttaagctcagagctgttcctctatt

SEQ ID NO: 657004 - DNA, 25 bp, Rattus norvegicus
ttaagctcagaggtgttcctctatt

SEQ ID NO: 657005 - DNA, 25 bp, Rattus norvegicus
ttaagctctacaactccactgggaa

SEQ ID NO: 657006 - DNA, 25 bp, Rattus norvegicus
ttaagctctacatctccactgggaa

SEQ ID NO: 657007 - DNA, 25 bp, Rattus norvegicus
ttaagctctgccagttgactgacca

SEQ ID NO: 657008 - DNA, 25 bp, Rattus norvegicus
ttaagctctgcctgttgactgacca

SEQ ID NO: 657009 - DNA, 25 bp, Rattus norvegicus
ttaagctctgtacttgggaatatct

SEQ ID NO: 657010 - DNA, 25 bp, Rattus norvegicus
ttaagctctgtagttgggaatatct

SEQ ID NO: 657011 - DNA, 25 bp, Rattus norvegicus
ttaagctctttgcagccaatccaag

SEQ ID NO: 657012 - DNA, 25 bp, Rattus norvegicus
ttaagctctttggagccaatccaag

SEQ ID NO: 657013 - DNA, 25 bp, Rattus norvegicus
ttaagctgactgcagggcgaccctg

SEQ ID NO: 657014 - DNA, 25 bp, Rattus norvegicus
ttaagctgactggagggcgaccctg

SEQ ID NO: 657015 - DNA, 25 bp, Rattus norvegicus
ttaagctgagtgagcccacctttat

SEQ ID NO: 657016 - DNA, 25 bp, Rattus norvegicus
ttaagctgagtgtgcccacctttat

SEQ ID NO: 657017 - DNA, 25 bp, Rattus norvegicus
ttaagctgcaggaaatttccaaggt

SEQ ID NO: 657018 - DNA, 25 bp, Rattus norvegicus
ttaagctgcaggtaatttccaaggt

SEQ ID NO: 657019 - DNA, 25 bp, Rattus norvegicus
ttaagctgcagtatgggccacgtac

SEQ ID NO: 657020 - DNA, 25 bp, Rattus norvegicus
ttaagctgcagtttgggccacgtac

SEQ ID NO: 657021 - DNA, 25 bp, Rattus norvegicus
ttaagctgccttctgaaccatacca

SEQ ID NO: 657022 - DNA, 25 bp, Rattus norvegicus
ttaagctgccttgtgaaccatacca

SEQ ID NO: 657023 - DNA, 25 bp, Rattus norvegicus
ttaagctgctttatgtcttcagaag

SEQ ID NO: 657024 - DNA, 25 bp, Rattus norvegicus
ttaagctgctttttgtcttcagaag

SEQ ID NO: 657025 - DNA, 25 bp, Rattus norvegicus
ttaagctggtcaattggcaccctct

SEQ ID NO: 657026 - DNA, 25 bp, Rattus norvegicus
ttaagctggtcatttggcaccctct

SEQ ID NO: 657027 - DNA, 25 bp, Rattus norvegicus
ttaagctgtatgatttctctctctc

SEQ ID NO: 657028 - DNA, 25 bp, Rattus norvegicus
ttaagctgtatgttttctctctctc

SEQ ID NO: 657029 - DNA, 25 bp, Rattus norvegicus
ttaagctgtctcactaccttctaat

SEQ ID NO: 657030 - DNA, 25 bp, Rattus norvegicus
ttaagctgtctctctaccttctaat

SEQ ID NO: 657031 - DNA, 25 bp, Rattus norvegicus
ttaagctgttatcctcttctccata

SEQ ID NO: 657032 - DNA, 25 bp, Rattus norvegicus
ttaagctgttatgctcttctccata

SEQ ID NO: 657033 - DNA, 25 bp, Rattus norvegicus
ttaagctgttcaagcacgtgcctga

SEQ ID NO: 657034 - DNA, 25 bp, Rattus norvegicus
ttaagctgttcatgcacgtgcctga

SEQ ID NO: 657035 - DNA, 25 bp, Rattus norvegicus
ttaagcttgtatcctcgccgcctgt

SEQ ID NO: 657036 - DNA, 25 bp, Rattus norvegicus
ttaagcttgtatgctcgccgcctgt

SEQ ID NO: 657037 - DNA, 25 bp, Rattus norvegicus
ttaagctttgctaaccttcaggcgt

SEQ ID NO: 657038 - DNA, 25 bp, Rattus norvegicus
ttaagctttgcttaccttcaggcgt

SEQ ID NO: 657039 - DNA, 25 bp, Rattus norvegicus
ttaagcttttccactgatgtgccac

SEQ ID NO: 657040 - DNA, 25 bp, Rattus norvegicus
ttaagcttttcctctgatgtgccac

SEQ ID NO: 657041 - DNA, 25 bp, Rattus norvegicus
ttaaggaacagccataaccctccga

SEQ ID NO: 657042 - DNA, 25 bp, Rattus norvegicus
ttaaggaacagcgataaccctccga

SEQ ID NO: 657043 - DNA, 25 bp, Rattus norvegicus
ttaaggaagcgcagtctgtttttaa

SEQ ID NO: 657044 - DNA, 25 bp, Rattus norvegicus
ttaaggaagcgctgtctgtttttaa

SEQ ID NO: 657045 - DNA, 25 bp, Rattus norvegicus
ttaaggaattcaacccgttctcagg

SEQ ID NO: 657046 - DNA, 25 bp, Rattus norvegicus
ttaaggaattcatcccgttctcagg

SEQ ID NO: 657047 - DNA, 25 bp, Rattus norvegicus
ttaaggaccattcttccacacttgg

SEQ ID NO: 657048 - DNA, 25 bp, Rattus norvegicus
ttaaggaccattgttccacacttgg

SEQ ID NO: 657049 - DNA, 25 bp, Rattus norvegicus
ttaaggaccccacaagacagaatgc

SEQ ID NO: 657050 - DNA, 25 bp, Rattus norvegicus
ttaaggaccccagaagacagaatgc

SEQ ID NO: 657051 - DNA, 25 bp, Rattus norvegicus
ttaaggaccgttacagacaaggaag

SEQ ID NO: 657052 - DNA, 25 bp, Rattus norvegicus
ttaaggaccgtttcagacaaggaag

SEQ ID NO: 657053 - DNA, 25 bp, Rattus norvegicus
ttaaggacgcctagacaggccatct

SEQ ID NO: 657054 - DNA, 25 bp, Rattus norvegicus
ttaaggacgccttgacaggccatct

SEQ ID NO: 657055 - DNA, 25 bp, Rattus norvegicus
ttaaggacggcgagagcccttccaa

SEQ ID NO: 657056 - DNA, 25 bp, Rattus norvegicus
ttaaggacggcgtgagcccttccaa

SEQ ID NO: 657057 - DNA, 25 bp, Rattus norvegicus
ttaaggacttgcacaccaaccaatc

SEQ ID NO: 657058 - DNA, 25 bp, Rattus norvegicus
ttaaggacttgctcaccaaccaatc

SEQ ID NO: 657059 - DNA, 25 bp, Rattus norvegicus
ttaaggagctcactcagcgtgcagt

SEQ ID NO: 657060 - DNA, 25 bp, Rattus norvegicus
ttaaggagctcagtcagcgtgcagt

SEQ ID NO: 657061 - DNA, 25 bp, Rattus norvegicus
ttaaggagctgtaagagatggcccg

SEQ ID NO: 657062 - DNA, 25 bp, Rattus norvegicus
ttaaggagctgttagagatggcccg

SEQ ID NO: 657063 - DNA, 25 bp, Rattus norvegicus
ttaaggaggccgacgcagagcacag

SEQ ID NO: 657064 - DNA, 25 bp, Rattus norvegicus
ttaaggaggccgtcgcagagcacag

SEQ ID NO: 657065 - DNA, 25 bp, Rattus norvegicus
ttaaggatccatccagcctccaaac

SEQ ID NO: 657066 - DNA, 25 bp, Rattus norvegicus
ttaaggatccatgcagcctccaaac

SEQ ID NO: 657067 - DNA, 25 bp, Rattus norvegicus
ttaaggatcctcagaccaaccagtg

SEQ ID NO: 657068 - DNA, 25 bp, Rattus norvegicus
ttaaggatcctctgaccaaccagtg

SEQ ID NO: 657069 - DNA, 25 bp, Rattus norvegicus
ttaaggatgtttcctgcctgctgtg

SEQ ID NO: 657070 - DNA, 25 bp, Rattus norvegicus
ttaaggatgtttgctgcctgctgtg

SEQ ID NO: 657071 - DNA, 25 bp, Rattus norvegicus
ttaaggcaacagacttcctgacctc

SEQ ID NO: 657072 - DNA, 25 bp, Rattus norvegicus
ttaaggcaacagtcttcctgacctc

SEQ ID NO: 657073 - DNA, 25 bp, Rattus norvegicus
ttaaggcaggcactgctcgtgcata

SEQ ID NO: 657074 - DNA, 25 bp, Rattus norvegicus
ttaaggcaggcagtgctcgtgcata

SEQ ID NO: 657075 - DNA, 25 bp, Rattus norvegicus
ttaaggcagggacaccagtcagact

SEQ ID NO: 657076 - DNA, 25 bp, Rattus norvegicus
ttaaggcagggagaccagtcagact

SEQ ID NO: 657077 - DNA, 25 bp, Rattus norvegicus
ttaaggcaggtcagtcagttttaaa

SEQ ID NO: 657078 - DNA, 25 bp, Rattus norvegicus
ttaaggcaggtctgtcagttttaaa

SEQ ID NO: 657079 - DNA, 25 bp, Rattus norvegicus
ttaaggccaagtagctgcctccacc

SEQ ID NO: 657080 - DNA, 25 bp, Rattus norvegicus
ttaaggccaagttgctgcctccacc

SEQ ID NO: 657081 - DNA, 25 bp, Rattus norvegicus
ttaaggccagctctgtcatgttttc

SEQ ID NO: 657082 - DNA, 25 bp, Rattus norvegicus
ttaaggccagctgtgtcatgttttc

SEQ ID NO: 657083 - DNA, 25 bp, Rattus norvegicus
ttaaggcccaagactacggaagaga

SEQ ID NO: 657084 - DNA, 25 bp, Rattus norvegicus
ttaaggcccaagtctacggaagaga

SEQ ID NO: 657085 - DNA, 25 bp, Rattus norvegicus
ttaaggcccatcctgagacctcgaa

SEQ ID NO: 657086 - DNA, 25 bp, Rattus norvegicus
ttaaggcccatcgtgagacctcgaa

SEQ ID NO: 657087 - DNA, 25 bp, Rattus norvegicus
ttaaggccccaaaggagcagtttca

SEQ ID NO: 657088 - DNA, 25 bp, Rattus norvegicus
ttaaggccccaatggagcagtttca

SEQ ID NO: 657089 - DNA, 25 bp, Rattus norvegicus
ttaaggcccttacttcagagctggc

SEQ ID NO: 657090 - DNA, 25 bp, Rattus norvegicus
ttaaggcccttagttcagagctggc

SEQ ID NO: 657091 - DNA, 25 bp, Rattus norvegicus
ttaaggcccttccttatctcggagg

SEQ ID NO: 657092 - DNA, 25 bp, Rattus norvegicus
ttaaggcccttcgttatctcggagg

SEQ ID NO: 657093 - DNA, 25 bp, Rattus norvegicus
ttaaggccgctgcatgcgtcaaaca

SEQ ID NO: 657094 - DNA, 25 bp, Rattus norvegicus
ttaaggccgctggatgcgtcaaaca

SEQ ID NO: 657095 - DNA, 25 bp, Rattus norvegicus
ttaaggcctatcagggcctcagata

SEQ ID NO: 657096 - DNA, 25 bp, Rattus norvegicus
ttaaggcctatctgggcctcagata

SEQ ID NO: 657097 - DNA, 25 bp, Rattus norvegicus
ttaaggccttgacacttagcctcca

SEQ ID NO: 657098 - DNA, 25 bp, Rattus norvegicus
ttaaggccttgagacttagcctcca

SEQ ID NO: 657099 - DNA, 25 bp, Rattus norvegicus
ttaaggcctttgacacgagagaatg

SEQ ID NO: 657100 - DNA, 25 bp, Rattus norvegicus
ttaaggcctttgtcacgagagaatg

SEQ ID NO: 657101 - DNA, 25 bp, Rattus norvegicus
ttaaggcgcagcatgtgtcttcaac

SEQ ID NO: 657102 - DNA, 25 bp, Rattus norvegicus
ttaaggcgcagcttgtgtcttcaac

SEQ ID NO: 657103 - DNA, 25 bp, Rattus norvegicus
ttaaggctccatagcctgttcttgt

SEQ ID NO: 657104 - DNA, 25 bp, Rattus norvegicus
ttaaggctccattgcctgttcttgt

SEQ ID NO: 657105 - DNA, 25 bp, Rattus norvegicus
ttaaggctccctagtcgggttcagg

SEQ ID NO: 657106 - DNA, 25 bp, Rattus norvegicus
ttaaggctcccttgtcgggttcagg

SEQ ID NO: 657107 - DNA, 25 bp, Rattus norvegicus
ttaaggctcctgacatcattctgct

SEQ ID NO: 657108 - DNA, 25 bp, Rattus norvegicus
ttaaggctcctgtcatcattctgct

SEQ ID NO: 657109 - DNA, 25 bp, Rattus norvegicus
ttaaggctcgggacctgcgcggcaa

SEQ ID NO: 657110 - DNA, 25 bp, Rattus norvegicus
ttaaggctcgggtcctgcgcggcaa

SEQ ID NO: 657111 - DNA, 25 bp, Rattus norvegicus
ttaaggctgacacgaagactgatgt

SEQ ID NO: 657112 - DNA, 25 bp, Rattus norvegicus
ttaaggctgacaggaagactgatgt

SEQ ID NO: 657113 - DNA, 25 bp, Rattus norvegicus
ttaaggctgcctctgaatctggcct

SEQ ID NO: 657114 - DNA, 25 bp, Rattus norvegicus
ttaaggctgcctgtgaatctggcct

SEQ ID NO: 657115 - DNA, 25 bp, Rattus norvegicus
ttaaggctgttcatgccagcttgtt

SEQ ID NO: 657116 - DNA, 25 bp, Rattus norvegicus
ttaaggctgttcttgccagcttgtt

SEQ ID NO: 657117 - DNA, 25 bp, Rattus norvegicus
ttaaggcttatcacatgggacacaa

SEQ ID NO: 657118 - DNA, 25 bp, Rattus norvegicus
ttaaggcttatctcatgggacacaa

SEQ ID NO: 657119 - DNA, 25 bp, Rattus norvegicus
ttaaggcttttcagccacagagctg

SEQ ID NO: 657120 - DNA, 25 bp, Rattus norvegicus
ttaaggcttttctgccacagagctg

SEQ ID NO: 657121 - DNA, 25 bp, Rattus norvegicus
ttaagggaatgactcttaggccacc

SEQ ID NO: 657122 - DNA, 25 bp, Rattus norvegicus
ttaagggaatgagtcttaggccacc

SEQ ID NO: 657123 - DNA, 25 bp, Rattus norvegicus
ttaagggacaccagaggcctagcct

SEQ ID NO: 657124 - DNA, 25 bp, Rattus norvegicus
ttaagggacacctgaggcctagcct

SEQ ID NO: 657125 - DNA, 25 bp, Rattus norvegicus
ttaagggcacaacaactgagcagta

SEQ ID NO: 657126 - DNA, 25 bp, Rattus norvegicus
ttaagggcacaagaactgagcagta

SEQ ID NO: 657127 - DNA, 25 bp, Rattus norvegicus
ttaagggcatctatgtattgctgtc

SEQ ID NO: 657128 - DNA, 25 bp, Rattus norvegicus
ttaagggcatctttgtattgctgtc

SEQ ID NO: 657129 - DNA, 25 bp, Rattus norvegicus
ttaagggccagaatttcccgcagca

SEQ ID NO: 657130 - DNA, 25 bp, Rattus norvegicus
ttaagggccagacagatagttcaaa

SEQ ID NO: 657131 - DNA, 25 bp, Rattus norvegicus
ttaagggccagagagatagttcaaa

SEQ ID NO: 657132 - DNA, 25 bp, Rattus norvegicus
ttaagggccagattttcccgcagca

SEQ ID NO: 657133 - DNA, 25 bp, Rattus norvegicus
ttaagggcgcacatccactgaggag

SEQ ID NO: 657134 - DNA, 25 bp, Rattus norvegicus
ttaagggcgcacttccactgaggag

SEQ ID NO: 657135 - DNA, 25 bp, Rattus norvegicus
ttaagggcgctacagtgccagatcc

SEQ ID NO: 657136 - DNA, 25 bp, Rattus norvegicus
ttaagggcgctagagtgccagatcc

SEQ ID NO: 657137 - DNA, 25 bp, Rattus norvegicus
ttaagggctattcacctgggtctgc

SEQ ID NO: 657138 - DNA, 25 bp, Rattus norvegicus
ttaagggctattgacctgggtctgc

SEQ ID NO: 657139 - DNA, 25 bp, Rattus norvegicus
ttaagggtcagccattcccacatgc

SEQ ID NO: 657140 - DNA, 25 bp, Rattus norvegicus
ttaagggtcagcctgtccagtggac

SEQ ID NO: 657141 - DNA, 25 bp, Rattus norvegicus
ttaagggtcagcgattcccacatgc

SEQ ID NO: 657142 - DNA, 25 bp, Rattus norvegicus
ttaagggtcagcgtgtccagtggac

SEQ ID NO: 657143 - DNA, 25 bp, Rattus norvegicus
ttaagggtccttcacccactctgtg

SEQ ID NO: 657144 - DNA, 25 bp, Rattus norvegicus
ttaagggtccttgacccactctgtg

SEQ ID NO: 657145 - DNA, 25 bp, Rattus norvegicus
ttaagggttcaaatgctcacgagca

SEQ ID NO: 657146 - DNA, 25 bp, Rattus norvegicus
ttaagggttcaattgctcacgagca

SEQ ID NO: 657147 - DNA, 25 bp, Rattus norvegicus
ttaagggttcctataccatctcctg

SEQ ID NO: 657148 - DNA, 25 bp, Rattus norvegicus
ttaagggttcctcgcgcagcggcaa

SEQ ID NO: 657149 - DNA, 25 bp, Rattus norvegicus
ttaagggttcctggcgcagcggcaa

SEQ ID NO: 657150 - DNA, 25 bp, Rattus norvegicus
ttaagggttcctttaccatctcctg

SEQ ID NO: 657151 - DNA, 25 bp, Rattus norvegicus
ttaagggttgttcttgccgtcctat

SEQ ID NO: 657152 - DNA, 25 bp, Rattus norvegicus
ttaagggttgttgttgccgtcctat

SEQ ID NO: 657153 - DNA, 25 bp, Rattus norvegicus
ttaagggtttctcgcaccgcaggaa

SEQ ID NO: 657154 - DNA, 25 bp, Rattus norvegicus
ttaagggtttctggcaccgcaggaa

SEQ ID NO: 657155 - DNA, 25 bp, Rattus norvegicus
ttaaggtaaggtctccaccctcgat

SEQ ID NO: 657156 - DNA, 25 bp, Rattus norvegicus
ttaaggtaaggtgtccaccctcgat

SEQ ID NO: 657157 - DNA, 25 bp, Rattus norvegicus
ttaaggtatgtcctctagtctgaga

SEQ ID NO: 657158 - DNA, 25 bp, Rattus norvegicus
ttaaggtatgtcgtctagtctgaga

SEQ ID NO: 657159 - DNA, 25 bp, Rattus norvegicus
ttaaggtcacgtagtgttcctccac

SEQ ID NO: 657160 - DNA, 25 bp, Rattus norvegicus
ttaaggtcacgttgtgttcctccac

SEQ ID NO: 657161 - DNA, 25 bp, Rattus norvegicus
ttaaggtcagagatgctctccagcc

SEQ ID NO: 657162 - DNA, 25 bp, Rattus norvegicus
ttaaggtcagagttgctctccagcc

SEQ ID NO: 657163 - DNA, 25 bp, Rattus norvegicus
ttaaggtcatcgatggccagccaga

SEQ ID NO: 657164 - DNA, 25 bp, Rattus norvegicus
ttaaggtcatcgttggccagccaga

SEQ ID NO: 657165 - DNA, 25 bp, Rattus norvegicus
ttaaggtcatttcctttccaccatt

SEQ ID NO: 657166 - DNA, 25 bp, Rattus norvegicus
ttaaggtcatttgctttccaccatt

SEQ ID NO: 657167 - DNA, 25 bp, Rattus norvegicus
ttaaggtccacaaggccttggctgt

SEQ ID NO: 657168 - DNA, 25 bp, Rattus norvegicus
ttaaggtccacatggccttggctgt

SEQ ID NO: 657169 - DNA, 25 bp, Rattus norvegicus
ttaaggtctcttctttaagtgccca

SEQ ID NO: 657170 - DNA, 25 bp, Rattus norvegicus
ttaaggtctcttgtttaagtgccca

SEQ ID NO: 657171 - DNA, 25 bp, Rattus norvegicus
ttaaggtctgtgatcctcgggaaga

SEQ ID NO: 657172 - DNA, 25 bp, Rattus norvegicus
ttaaggtctgtgttcctcgggaaga

SEQ ID NO: 657173 - DNA, 25 bp, Rattus norvegicus
ttaaggtcttgactccatgctaatc

SEQ ID NO: 657174 - DNA, 25 bp, Rattus norvegicus
ttaaggtcttgagtccatgctaatc

SEQ ID NO: 657175 - DNA, 25 bp, Rattus norvegicus
ttaaggttacagctgggcatagccc

SEQ ID NO: 657176 - DNA, 25 bp, Rattus norvegicus
ttaaggttacaggtgggcatagccc

SEQ ID NO: 657177 - DNA, 25 bp, Rattus norvegicus
ttaaggttcagaaacatggaggtcc

SEQ ID NO: 657178 - DNA, 25 bp, Rattus norvegicus
ttaaggttcagatacatggaggtcc

SEQ ID NO: 657179 - DNA, 25 bp, Rattus norvegicus
ttaaggttccctaagatctctccct

SEQ ID NO: 657180 - DNA, 25 bp, Rattus norvegicus
ttaaggttcccttagatctctccct

SEQ ID NO: 657181 - DNA, 25 bp, Rattus norvegicus
ttaaggttctggaagcatcagctat

SEQ ID NO: 657182 - DNA, 25 bp, Rattus norvegicus
ttaaggttctggtagcatcagctat

SEQ ID NO: 657183 - DNA, 25 bp, Rattus norvegicus
ttaaggttttaaacccatctatcaa

SEQ ID NO: 657184 - DNA, 25 bp, Rattus norvegicus
ttaaggttttaatcccatctatcaa

SEQ ID NO: 657185 - DNA, 25 bp, Rattus norvegicus
ttaaggttttgtcacgtttcgctcg

SEQ ID NO: 657186 - DNA, 25 bp, Rattus norvegicus
ttaaggttttgtgacgtttcgctcg

SEQ ID NO: 657187 - DNA, 25 bp, Rattus norvegicus
ttaagtaacacaaacgtccctgcca

SEQ ID NO: 657188 - DNA, 25 bp, Rattus norvegicus
ttaagtaacacatacgtccctgcca

SEQ ID NO: 657189 - DNA, 25 bp, Rattus norvegicus
ttaagtaactgcaaacattctcatt

SEQ ID NO: 657190 - DNA, 25 bp, Rattus norvegicus
ttaagtaactgctaacattctcatt

SEQ ID NO: 657191 - DNA, 25 bp, Rattus norvegicus
ttaagtaagtcccttgacctctctg

SEQ ID NO: 657192 - DNA, 25 bp, Rattus norvegicus
ttaagtaagtccgttgacctctctg

SEQ ID NO: 657193 - DNA, 25 bp, Rattus norvegicus
ttaagtacacagaggctgggcccag

SEQ ID NO: 657194 - DNA, 25 bp, Rattus norvegicus
ttaagtacacagtggctgggcccag

SEQ ID NO: 657195 - DNA, 25 bp, Rattus norvegicus
ttaagtaccaatccagcctccaaag

SEQ ID NO: 657196 - DNA, 25 bp, Rattus norvegicus
ttaagtaccaatgcagcctccaaag

SEQ ID NO: 657197 - DNA, 25 bp, Rattus norvegicus
ttaagtacgagtatggtcctgccat

SEQ ID NO: 657198 - DNA, 25 bp, Rattus norvegicus
ttaagtacgagtttggtcctgccat

SEQ ID NO: 657199 - DNA, 25 bp, Rattus norvegicus
ttaagtactcacaaggctccattct

SEQ ID NO: 657200 - DNA, 25 bp, Rattus norvegicus
ttaagtactcactaggctccattct

SEQ ID NO: 657201 - DNA, 25 bp, Rattus norvegicus
ttaagtagctgcagcggccttgcga

SEQ ID NO: 657202 - DNA, 25 bp, Rattus norvegicus
ttaagtagctgctgcggccttgcga

SEQ ID NO: 657203 - DNA, 25 bp, Rattus norvegicus
ttaagtagtaccatgcctcgctgaa

SEQ ID NO: 657204 - DNA, 25 bp, Rattus norvegicus
ttaagtagtaccttgcctcgctgaa

SEQ ID NO: 657205 - DNA, 25 bp, Rattus norvegicus
ttaagtatcgcaaagcttcgcgccg

SEQ ID NO: 657206 - DNA, 25 bp, Rattus norvegicus
ttaagtatcgcatagcttcgcgccg

SEQ ID NO: 657207 - DNA, 25 bp, Rattus norvegicus
ttaagtatctttccctggtgtctaa

SEQ ID NO: 657208 - DNA, 25 bp, Rattus norvegicus
ttaagtatctttgcctggtgtctaa

SEQ ID NO: 657209 - DNA, 25 bp, Rattus norvegicus
ttaagtattccccaaagcaccaact

SEQ ID NO: 657210 - DNA, 25 bp, Rattus norvegicus
ttaagtattcccgaaagcaccaact

SEQ ID NO: 657211 - DNA, 25 bp, Rattus norvegicus
ttaagtattgaactgctccttcccc

SEQ ID NO: 657212 - DNA, 25 bp, Rattus norvegicus
ttaagtattgaagtgctccttcccc

SEQ ID NO: 657213 - DNA, 25 bp, Rattus norvegicus
ttaagtcaatgtagcctttccctca

SEQ ID NO: 657214 - DNA, 25 bp, Rattus norvegicus
ttaagtcaatgttgcctttccctca

SEQ ID NO: 657215 - DNA, 25 bp, Rattus norvegicus
ttaagtcaccaacgcactgttttat

SEQ ID NO: 657216 - DNA, 25 bp, Rattus norvegicus
ttaagtcaccaaggcactgttttat

SEQ ID NO: 657217 - DNA, 25 bp, Rattus norvegicus
ttaagtcacgtaattcccaacacct

SEQ ID NO: 657218 - DNA, 25 bp, Rattus norvegicus
ttaagtcacgtatttcccaacacct

SEQ ID NO: 657219 - DNA, 25 bp, Rattus norvegicus
ttaagtcagttcacagttatgattt

SEQ ID NO: 657220 - DNA, 25 bp, Rattus norvegicus
ttaagtcagttctcagttatgattt

SEQ ID NO: 657221 - DNA, 25 bp, Rattus norvegicus
ttaagtcatccacactgcctgcctg

SEQ ID NO: 657222 - DNA, 25 bp, Rattus norvegicus
ttaagtcatccagactgcctgcctg

SEQ ID NO: 657223 - DNA, 25 bp, Rattus norvegicus
ttaagtcattgtcactgccaaccac

SEQ ID NO: 657224 - DNA, 25 bp, Rattus norvegicus
ttaagtcattgtgactgccaaccac

SEQ ID NO: 657225 - DNA, 25 bp, Rattus norvegicus
ttaagtccacctaggaggtcaccct

SEQ ID NO: 657226 - DNA, 25 bp, Rattus norvegicus
ttaagtccaccttggaggtcaccct

SEQ ID NO: 657227 - DNA, 25 bp, Rattus norvegicus
ttaagtccagctcacgtactgtgct

SEQ ID NO: 657228 - DNA, 25 bp, Rattus norvegicus
ttaagtccagctgacgtactgtgct

SEQ ID NO: 657229 - DNA, 25 bp, Rattus norvegicus
ttaagtcccaagcactcaggcagca

SEQ ID NO: 657230 - DNA, 25 bp, Rattus norvegicus
ttaagtcccaaggactcaggcagca

SEQ ID NO: 657231 - DNA, 25 bp, Rattus norvegicus
ttaagtccccagatactacactaca

SEQ ID NO: 657232 - DNA, 25 bp, Rattus norvegicus
ttaagtccccagttactacactaca

SEQ ID NO: 657233 - DNA, 25 bp, Rattus norvegicus
ttaagtccccgcagttatctggtgc

SEQ ID NO: 657234 - DNA, 25 bp, Rattus norvegicus
ttaagtccccgctgttatctggtgc

SEQ ID NO: 657235 - DNA, 25 bp, Rattus norvegicus
ttaagtcccgtacaggcccagagtg

SEQ ID NO: 657236 - DNA, 25 bp, Rattus norvegicus
ttaagtcccgtagaggcccagagtg

SEQ ID NO: 657237 - DNA, 25 bp, Rattus norvegicus
ttaagtccgccactggaggcccgca

SEQ ID NO: 657238 - DNA, 25 bp, Rattus norvegicus
ttaagtccgccagtggaggcccgca

SEQ ID NO: 657239 - DNA, 25 bp, Rattus norvegicus
ttaagtcctatgagttgcccattct

SEQ ID NO: 657240 - DNA, 25 bp, Rattus norvegicus
ttaagtcctatgtgttgcccattct

SEQ ID NO: 657241 - DNA, 25 bp, Rattus norvegicus
ttaagtcctccaccatctcttgtat

SEQ ID NO: 657242 - DNA, 25 bp, Rattus norvegicus
ttaagtcctccacgcctggttccat

SEQ ID NO: 657243 - DNA, 25 bp, Rattus norvegicus
ttaagtcctccagcatctcttgtat

SEQ ID NO: 657244 - DNA, 25 bp, Rattus norvegicus
ttaagtcctccaggcctggttccat

SEQ ID NO: 657245 - DNA, 25 bp, Rattus norvegicus
ttaagtcctgtgagaacctggcccc

SEQ ID NO: 657246 - DNA, 25 bp, Rattus norvegicus
ttaagtcctgtgtgaacctggcccc

SEQ ID NO: 657247 - DNA, 25 bp, Rattus norvegicus
ttaagtccttccaattctcttcaca

SEQ ID NO: 657248 - DNA, 25 bp, Rattus norvegicus
ttaagtccttcctattctcttcaca

SEQ ID NO: 657249 - DNA, 25 bp, Rattus norvegicus
ttaagtccttctctactgcactaga

SEQ ID NO: 657250 - DNA, 25 bp, Rattus norvegicus
ttaagtccttctgtactgcactaga

SEQ ID NO: 657251 - DNA, 25 bp, Rattus norvegicus
ttaagtccttgtccccaggaacaat

SEQ ID NO: 657252 - DNA, 25 bp, Rattus norvegicus
ttaagtccttgtgcccaggaacaat

SEQ ID NO: 657253 - DNA, 25 bp, Rattus norvegicus
ttaagtcggtcaaagtggtacacac

SEQ ID NO: 657254 - DNA, 25 bp, Rattus norvegicus
ttaagtcggtcatagtggtacacac

SEQ ID NO: 657255 - DNA, 25 bp, Rattus norvegicus
ttaagtctaactcctcctggaggtg

SEQ ID NO: 657256 - DNA, 25 bp, Rattus norvegicus
ttaagtctaactgctcctggaggtg

SEQ ID NO: 657257 - DNA, 25 bp, Rattus norvegicus
ttaagtctactcacattcgtcggga

SEQ ID NO: 657258 - DNA, 25 bp, Rattus norvegicus
ttaagtctactctcattcgtcggga

SEQ ID NO: 657259 - DNA, 25 bp, Rattus norvegicus
ttaagtctcccactgtggcactgta

SEQ ID NO: 657260 - DNA, 25 bp, Rattus norvegicus
ttaagtctcccagtgtggcactgta

SEQ ID NO: 657261 - DNA, 25 bp, Rattus norvegicus
ttaagtctcctacaaaatgctaatt

SEQ ID NO: 657262 - DNA, 25 bp, Rattus norvegicus
ttaagtctcctagaaaatgctaatt

SEQ ID NO: 657263 - DNA, 25 bp, Rattus norvegicus
ttaagtctctggcatgcgtgtggta

SEQ ID NO: 657264 - DNA, 25 bp, Rattus norvegicus
ttaagtctctgggatgcgtgtggta

SEQ ID NO: 657265 - DNA, 25 bp, Rattus norvegicus
ttaagtctgcttacactcctttgaa

SEQ ID NO: 657266 - DNA, 25 bp, Rattus norvegicus
ttaagtctgctttcactcctttgaa

SEQ ID NO: 657267 - DNA, 25 bp, Rattus norvegicus
ttaagtcttgtcagaatgcttctcc

SEQ ID NO: 657268 - DNA, 25 bp, Rattus norvegicus
ttaagtcttgtctgaatgcttctcc

SEQ ID NO: 657269 - DNA, 25 bp, Rattus norvegicus
ttaagtgaagtcactgtgccccagt

SEQ ID NO: 657270 - DNA, 25 bp, Rattus norvegicus
ttaagtgaagtctctgtgccccagt

SEQ ID NO: 657271 - DNA, 25 bp, Rattus norvegicus
ttaagtgaggacacccgagctgtat

SEQ ID NO: 657272 - DNA, 25 bp, Rattus norvegicus
ttaagtgaggactcccgagctgtat

SEQ ID NO: 657273 - DNA, 25 bp, Rattus norvegicus
ttaagtgatcaccattaagtcagaa

SEQ ID NO: 657274 - DNA, 25 bp, Rattus norvegicus
ttaagtgatcacgattaagtcagaa

SEQ ID NO: 657275 - DNA, 25 bp, Rattus norvegicus
ttaagtgatgacacacctttcccac

SEQ ID NO: 657276 - DNA, 25 bp, Rattus norvegicus
ttaagtgatgactcacctttcccac

SEQ ID NO: 657277 - DNA, 25 bp, Rattus norvegicus
ttaagtgatgtaagcaccctcgccc

SEQ ID NO: 657278 - DNA, 25 bp, Rattus norvegicus
ttaagtgatgtatgcaccctcgccc

SEQ ID NO: 657279 - DNA, 25 bp, Rattus norvegicus
ttaagtgcacaaagcatcgctctcc

SEQ ID NO: 657280 - DNA, 25 bp, Rattus norvegicus
ttaagtgcacaatgcatcgctctcc

SEQ ID NO: 657281 - DNA, 25 bp, Rattus norvegicus
ttaagtgcagtaaggttgtgaatca

SEQ ID NO: 657282 - DNA, 25 bp, Rattus norvegicus
ttaagtgcagtatggttgtgaatca

SEQ ID NO: 657283 - DNA, 25 bp, Rattus norvegicus
ttaagtgccatgcatgtgtcagagt

SEQ ID NO: 657284 - DNA, 25 bp, Rattus norvegicus
ttaagtgccatggatgtgtcagagt

SEQ ID NO: 657285 - DNA, 25 bp, Rattus norvegicus
ttaagtgcctaaccatttaactgtg

SEQ ID NO: 657286 - DNA, 25 bp, Rattus norvegicus
ttaagtgcctaagcatttaactgtg

SEQ ID NO: 657287 - DNA, 25 bp, Rattus norvegicus
ttaagtgctccaatttagtgccaga

SEQ ID NO: 657288 - DNA, 25 bp, Rattus norvegicus
ttaagtgctccattttagtgccaga

SEQ ID NO: 657289 - DNA, 25 bp, Rattus norvegicus
ttaagtggccacatccaccgtgaag

SEQ ID NO: 657290 - DNA, 25 bp, Rattus norvegicus
ttaagtggccacttccaccgtgaag

SEQ ID NO: 657291 - DNA, 25 bp, Rattus norvegicus
ttaagtggcccaagtttctcgtgtg

SEQ ID NO: 657292 - DNA, 25 bp, Rattus norvegicus
ttaagtggcccatgtttctcgtgtg

SEQ ID NO: 657293 - DNA, 25 bp, Rattus norvegicus
ttaagtgggcctcctattagtcaag

SEQ ID NO: 657294 - DNA, 25 bp, Rattus norvegicus
ttaagtgggcctgctattagtcaag

SEQ ID NO: 657295 - DNA, 25 bp, Rattus norvegicus
ttaagtgtcgctattcatgtgctgt

SEQ ID NO: 657296 - DNA, 25 bp, Rattus norvegicus
ttaagtgtcgcttttcatgtgctgt

SEQ ID NO: 657297 - DNA, 25 bp, Rattus norvegicus
ttaagtgtgactcaaaccctgatta

SEQ ID NO: 657298 - DNA, 25 bp, Rattus norvegicus
ttaagtgtgactgaaaccctgatta

SEQ ID NO: 657299 - DNA, 25 bp, Rattus norvegicus
ttaagtgttcaaaagctcaaagcca

SEQ ID NO: 657300 - DNA, 25 bp, Rattus norvegicus
ttaagtgttcaatagctcaaagcca

SEQ ID NO: 657301 - DNA, 25 bp, Rattus norvegicus
ttaagttagatcacactggtcccac

SEQ ID NO: 657302 - DNA, 25 bp, Rattus norvegicus
ttaagttagatctcactggtcccac

SEQ ID NO: 657303 - DNA, 25 bp, Rattus norvegicus
ttaagttcaccaacagctgaccttc

SEQ ID NO: 657304 - DNA, 25 bp, Rattus norvegicus
ttaagttcaccatcagctgaccttc

SEQ ID NO: 657305 - DNA, 25 bp, Rattus norvegicus
ttaagttccctgctaaagacatttt

SEQ ID NO: 657306 - DNA, 25 bp, Rattus norvegicus
ttaagttccctggtaaagacatttt

SEQ ID NO: 657307 - DNA, 25 bp, Rattus norvegicus
ttaagttccttcagctttgctttct

SEQ ID NO: 657308 - DNA, 25 bp, Rattus norvegicus
ttaagttccttctgctttgctttct

SEQ ID NO: 657309 - DNA, 25 bp, Rattus norvegicus
ttaagttccttgatacaccatggtc

SEQ ID NO: 657310 - DNA, 25 bp, Rattus norvegicus
ttaagttccttgttacaccatggtc

SEQ ID NO: 657311 - DNA, 25 bp, Rattus norvegicus
ttaagttctgagatccaggtggcca

SEQ ID NO: 657312 - DNA, 25 bp, Rattus norvegicus
ttaagttctgagttccaggtggcca

SEQ ID NO: 657313 - DNA, 25 bp, Rattus norvegicus
ttaagttcttcacgtcctctcctac

SEQ ID NO: 657314 - DNA, 25 bp, Rattus norvegicus
ttaagttcttcaggtcctctcctac

SEQ ID NO: 657315 - DNA, 25 bp, Rattus norvegicus
ttaagttgcaaaccggggttcactg

SEQ ID NO: 657316 - DNA, 25 bp, Rattus norvegicus
ttaagttgcaaagcggggttcactg

SEQ ID NO: 657317 - DNA, 25 bp, Rattus norvegicus
ttaagttgctccaatcacgatgcta

SEQ ID NO: 657318 - DNA, 25 bp, Rattus norvegicus
ttaagttgctcctatcacgatgcta

SEQ ID NO: 657319 - DNA, 25 bp, Rattus norvegicus
ttaagttgctctcttctaatccaaa

SEQ ID NO: 657320 - DNA, 25 bp, Rattus norvegicus
ttaagttgctctgttctaatccaaa

SEQ ID NO: 657321 - DNA, 25 bp, Rattus norvegicus
ttaagttgctgtcagtgttgcccac

SEQ ID NO: 657322 - DNA, 25 bp, Rattus norvegicus
ttaagttgctgtgagtgttgcccac

SEQ ID NO: 657323 - DNA, 25 bp, Rattus norvegicus
ttaagttggactaagcgacctgaat

SEQ ID NO: 657324 - DNA, 25 bp, Rattus norvegicus
ttaagttggacttagcgacctgaat

SEQ ID NO: 657325 - DNA, 25 bp, Rattus norvegicus
ttaagttgtaatcccttctgatgga

SEQ ID NO: 657326 - DNA, 25 bp, Rattus norvegicus
ttaagttgtaatgccttctgatgga

SEQ ID NO: 657327 - DNA, 25 bp, Rattus norvegicus
ttaagtttacaacacacaccctgtt

SEQ ID NO: 657328 - DNA, 25 bp, Rattus norvegicus
ttaagtttacaagacacaccctgtt

SEQ ID NO: 657329 - DNA, 25 bp, Rattus norvegicus
ttaagtttagcgctcagttcctgga

SEQ ID NO: 657330 - DNA, 25 bp, Rattus norvegicus
ttaagtttagcggtcagttcctgga

SEQ ID NO: 657331 - DNA, 25 bp, Rattus norvegicus
ttaagtttccatatcgctcttccca

SEQ ID NO: 657332 - DNA, 25 bp, Rattus norvegicus
ttaagtttccatttcgctcttccca

SEQ ID NO: 657333 - DNA, 25 bp, Rattus norvegicus
ttaagttttacacccatccttgtcc

SEQ ID NO: 657334 - DNA, 25 bp, Rattus norvegicus
ttaagttttacagccatccttgtcc

SEQ ID NO: 657335 - DNA, 25 bp, Rattus norvegicus
ttaagttttgacactgttcaggcaa

SEQ ID NO: 657336 - DNA, 25 bp, Rattus norvegicus
ttaagttttgactctgttcaggcaa

SEQ ID NO: 657337 - DNA, 25 bp, Rattus norvegicus
ttaataaaaggtcccattacaatgg

SEQ ID NO: 657338 - DNA, 25 bp, Rattus norvegicus
ttaataaaaggtgccattacaatgg

SEQ ID NO: 657339 - DNA, 25 bp, Rattus norvegicus
ttaataaacattctccgggctgtgt

SEQ ID NO: 657340 - DNA, 25 bp, Rattus norvegicus
ttaataaacattgtccgggctgtgt

SEQ ID NO: 657341 - DNA, 25 bp, Rattus norvegicus
ttaataaagggcctctcggagagag

SEQ ID NO: 657342 - DNA, 25 bp, Rattus norvegicus
ttaataaagggcgtctcggagagag

SEQ ID NO: 657343 - DNA, 25 bp, Rattus norvegicus
ttaataaatcctcacttccccagaa

SEQ ID NO: 657344 - DNA, 25 bp, Rattus norvegicus
ttaataaatcctgacttccccagaa

SEQ ID NO: 657345 - DNA, 25 bp, Rattus norvegicus
ttaataaattacactcactctccct

SEQ ID NO: 657346 - DNA, 25 bp, Rattus norvegicus
ttaataaattactctcactctccct

SEQ ID NO: 657347 - DNA, 25 bp, Rattus norvegicus
ttaataacatctcctcccctcttgg

SEQ ID NO: 657348 - DNA, 25 bp, Rattus norvegicus
ttaataacatctgctcccctcttgg

SEQ ID NO: 657349 - DNA, 25 bp, Rattus norvegicus
ttaataaccgttctctcattcacct

SEQ ID NO: 657350 - DNA, 25 bp, Rattus norvegicus
ttaataaccgttgtctcattcacct

SEQ ID NO: 657351 - DNA, 25 bp, Rattus norvegicus
ttaataactgctacaggccatccca

SEQ ID NO: 657352 - DNA, 25 bp, Rattus norvegicus
ttaataactgcttcaggccatccca

SEQ ID NO: 657353 - DNA, 25 bp, Rattus norvegicus
ttaataacttgccttctctatcctt

SEQ ID NO: 657354 - DNA, 25 bp, Rattus norvegicus
ttaataacttgcgttctctatcctt

SEQ ID NO: 657355 - DNA, 25 bp, Rattus norvegicus
ttaataagacctctttgttcctggg

SEQ ID NO: 657356 - DNA, 25 bp, Rattus norvegicus
ttaataagacctgtttgttcctggg

SEQ ID NO: 657357 - DNA, 25 bp, Rattus norvegicus
ttaataatcagaaggctcccctttc

SEQ ID NO: 657358 - DNA, 25 bp, Rattus norvegicus
ttaataatcagatggctcccctttc

SEQ ID NO: 657359 - DNA, 25 bp, Rattus norvegicus
ttaatacaacatccccagcactgat

SEQ ID NO: 657360 - DNA, 25 bp, Rattus norvegicus
ttaatacaacatgcccagcactgat

SEQ ID NO: 657361 - DNA, 25 bp, Rattus norvegicus
ttaataccgaaacctccagagacag

SEQ ID NO: 657362 - DNA, 25 bp, Rattus norvegicus
ttaataccgaaagctccagagacag

SEQ ID NO: 657363 - DNA, 25 bp, Rattus norvegicus
ttaatacctctgcgtctcagttaat

SEQ ID NO: 657364 - DNA, 25 bp, Rattus norvegicus
ttaatacctctgggtctcagttaat

SEQ ID NO: 657365 - DNA, 25 bp, Rattus norvegicus
ttaatacgctgcacatgattctggc

SEQ ID NO: 657366 - DNA, 25 bp, Rattus norvegicus
ttaatacgctgctcatgattctggc

SEQ ID NO: 657367 - DNA, 25 bp, Rattus norvegicus
ttaatactcaggatgcggtggcccc

SEQ ID NO: 657368 - DNA, 25 bp, Rattus norvegicus
ttaatactcaggttgcggtggcccc

SEQ ID NO: 657369 - DNA, 25 bp, Rattus norvegicus
ttaatactgctgagtggtacgttca

SEQ ID NO: 657370 - DNA, 25 bp, Rattus norvegicus
ttaatactgctgtgtggtacgttca

SEQ ID NO: 657371 - DNA, 25 bp, Rattus norvegicus
ttaatactgtaccacattcctgctc

SEQ ID NO: 657372 - DNA, 25 bp, Rattus norvegicus
ttaatactgtacgacattcctgctc

SEQ ID NO: 657373 - DNA, 25 bp, Rattus norvegicus
ttaatacttctgaccctagaccagc

SEQ ID NO: 657374 - DNA, 25 bp, Rattus norvegicus
ttaatacttctgtccctagaccagc

SEQ ID NO: 657375 - DNA, 25 bp, Rattus norvegicus
ttaatactttgcagtcagcctccag

SEQ ID NO: 657376 - DNA, 25 bp, Rattus norvegicus
ttaatactttgctgtcagcctccag

SEQ ID NO: 657377 - DNA, 25 bp, Rattus norvegicus
ttaatagactcgatgccgaggccca

SEQ ID NO: 657378 - DNA, 25 bp, Rattus norvegicus
ttaatagactcgttgccgaggccca

SEQ ID NO: 657379 - DNA, 25 bp, Rattus norvegicus
ttaatagccaaaacaccttgctccc

SEQ ID NO: 657380 - DNA, 25 bp, Rattus norvegicus
ttaatagccaaatcaccttgctccc

SEQ ID NO: 657381 - DNA, 25 bp, Rattus norvegicus
ttaatagccctgaacctgggtgttt

SEQ ID NO: 657382 - DNA, 25 bp, Rattus norvegicus
ttaatagccctgtacctgggtgttt

SEQ ID NO: 657383 - DNA, 25 bp, Rattus norvegicus
ttaatagctctgagttgtgtcccca

SEQ ID NO: 657384 - DNA, 25 bp, Rattus norvegicus
ttaatagctctgtgttgtgtcccca

SEQ ID NO: 657385 - DNA, 25 bp, Rattus norvegicus
ttaataggaactacagcactttttt

SEQ ID NO: 657386 - DNA, 25 bp, Rattus norvegicus
ttaataggaacttcagcactttttt

SEQ ID NO: 657387 - DNA, 25 bp, Rattus norvegicus
ttaatagtaggcagtgcacccttcc

SEQ ID NO: 657388 - DNA, 25 bp, Rattus norvegicus
ttaatagtaggctgtgcacccttcc

SEQ ID NO: 657389 - DNA, 25 bp, Rattus norvegicus
ttaatagtcattactgcttcatcaa

SEQ ID NO: 657390 - DNA, 25 bp, Rattus norvegicus
ttaatagtcatttctgcttcatcaa

SEQ ID NO: 657391 - DNA, 25 bp, Rattus norvegicus
ttaatagtccttagttacagtcagc

SEQ ID NO: 657392 - DNA, 25 bp, Rattus norvegicus
ttaatagtcctttgttacagtcagc

SEQ ID NO: 657393 - DNA, 25 bp, Rattus norvegicus
ttaatagtgcccaggacgttggctt

SEQ ID NO: 657394 - DNA, 25 bp, Rattus norvegicus
ttaatagtgccctggacgttggctt

SEQ ID NO: 657395 - DNA, 25 bp, Rattus norvegicus
ttaatagtttctcggtccttcctgg

SEQ ID NO: 657396 - DNA, 25 bp, Rattus norvegicus
ttaatagtttctgggtccttcctgg

SEQ ID NO: 657397 - DNA, 25 bp, Rattus norvegicus
ttaatatcagccataaccttcgagg

SEQ ID NO: 657398 - DNA, 25 bp, Rattus norvegicus
ttaatatcagccttaaccttcgagg

SEQ ID NO: 657399 - DNA, 25 bp, Rattus norvegicus
ttaatatgcacgcatcacctcacca

SEQ ID NO: 657400 - DNA, 25 bp, Rattus norvegicus
ttaatatgcacggatcacctcacca

SEQ ID NO: 657401 - DNA, 25 bp, Rattus norvegicus
ttaatatggcgactcttagagcttt

SEQ ID NO: 657402 - DNA, 25 bp, Rattus norvegicus
ttaatatggcgagtcttagagcttt

SEQ ID NO: 657403 - DNA, 25 bp, Rattus norvegicus
ttaatatggcgtcctttgtcctcac

SEQ ID NO: 657404 - DNA, 25 bp, Rattus norvegicus
ttaatatggcgtgctttgtcctcac

SEQ ID NO: 657405 - DNA, 25 bp, Rattus norvegicus
ttaatattaacacccacccacattc

SEQ ID NO: 657406 - DNA, 25 bp, Rattus norvegicus
ttaatattaacagccacccacattc

SEQ ID NO: 657407 - DNA, 25 bp, Rattus norvegicus
ttaatattcatcctacttcctccgt

SEQ ID NO: 657408 - DNA, 25 bp, Rattus norvegicus
ttaatattcatcgtacttcctccgt

SEQ ID NO: 657409 - DNA, 25 bp, Rattus norvegicus
ttaatattgctaagtgttcgtcagt

SEQ ID NO: 657410 - DNA, 25 bp, Rattus norvegicus
ttaatattgctatgtgttcgtcagt

SEQ ID NO: 657411 - DNA, 25 bp, Rattus norvegicus
ttaatattgcttctcctgcatggca

SEQ ID NO: 657412 - DNA, 25 bp, Rattus norvegicus
ttaatattgcttgtcctgcatggca

SEQ ID NO: 657413 - DNA, 25 bp, Rattus norvegicus
ttaatatttttcatcacccttctgc

SEQ ID NO: 657414 - DNA, 25 bp, Rattus norvegicus
ttaatatttttcttcacccttctgc

SEQ ID NO: 657415 - DNA, 25 bp, Rattus norvegicus
ttaatcaaccaaacctcaatagccc

SEQ ID NO: 657416 - DNA, 25 bp, Rattus norvegicus
ttaatcaaccaatcctcaatagccc

SEQ ID NO: 657417 - DNA, 25 bp, Rattus norvegicus
ttaatcaactggacctgcctgccta

SEQ ID NO: 657418 - DNA, 25 bp, Rattus norvegicus
ttaatcaactggtcctgcctgccta

SEQ ID NO: 657419 - DNA, 25 bp, Rattus norvegicus
ttaatcacaccacccatgatctgcg

SEQ ID NO: 657420 - DNA, 25 bp, Rattus norvegicus
ttaatcacaccagccatgatctgcg

SEQ ID NO: 657421 - DNA, 25 bp, Rattus norvegicus
ttaatcactgacaagcaagagggta

SEQ ID NO: 657422 - DNA, 25 bp, Rattus norvegicus
ttaatcactgactagcaagagggta

SEQ ID NO: 657423 - DNA, 25 bp, Rattus norvegicus
ttaatcagtgtgacagcctattgct

SEQ ID NO: 657424 - DNA, 25 bp, Rattus norvegicus
ttaatcagtgtgtcagcctattgct

SEQ ID NO: 657425 - DNA, 25 bp, Rattus norvegicus
ttaatcagtgttcagctgctgcagc

SEQ ID NO: 657426 - DNA, 25 bp, Rattus norvegicus
ttaatcagtgttgagctgctgcagc

SEQ ID NO: 657427 - DNA, 25 bp, Rattus norvegicus
ttaatcagttctacctgcagactct

SEQ ID NO: 657428 - DNA, 25 bp, Rattus norvegicus
ttaatcagttcttcctgcagactct

SEQ ID NO: 657429 - DNA, 25 bp, Rattus norvegicus
ttaatcatcagcagctctctgtctg

SEQ ID NO: 657430 - DNA, 25 bp, Rattus norvegicus
ttaatcatcagctgctctctgtctg

SEQ ID NO: 657431 - DNA, 25 bp, Rattus norvegicus
ttaatcattcaacctctccctggag

SEQ ID NO: 657432 - DNA, 25 bp, Rattus norvegicus
ttaatcattcaagctctccctggag

SEQ ID NO: 657433 - DNA, 25 bp, Rattus norvegicus
ttaatccacgccaaccggtttgaga

SEQ ID NO: 657434 - DNA, 25 bp, Rattus norvegicus
ttaatccacgcctaccggtttgaga

SEQ ID NO: 657435 - DNA, 25 bp, Rattus norvegicus
ttaatccagcaccacagtaggcatg

SEQ ID NO: 657436 - DNA, 25 bp, Rattus norvegicus
ttaatccagcacgacagtaggcatg

SEQ ID NO: 657437 - DNA, 25 bp, Rattus norvegicus
ttaatccattgaacaagccgctccc

SEQ ID NO: 657438 - DNA, 25 bp, Rattus norvegicus
ttaatccattgatcaagccgctccc

SEQ ID NO: 657439 - DNA, 25 bp, Rattus norvegicus
ttaatcccaattaggcaactgccca

SEQ ID NO: 657440 - DNA, 25 bp, Rattus norvegicus
ttaatcccaatttggcaactgccca

SEQ ID NO: 657441 - DNA, 25 bp, Rattus norvegicus
ttaatcccagtactcggaggcctat

SEQ ID NO: 657442 - DNA, 25 bp, Rattus norvegicus
ttaatcccagtagtcggaggcctat

SEQ ID NO: 657443 - DNA, 25 bp, Rattus norvegicus
ttaatccccaggagtgttagtccca

SEQ ID NO: 657444 - DNA, 25 bp, Rattus norvegicus
ttaatccccaggtgtgttagtccca

SEQ ID NO: 657445 - DNA, 25 bp, Rattus norvegicus
ttaatcccgttgaagcccaaatcct

SEQ ID NO: 657446 - DNA, 25 bp, Rattus norvegicus
ttaatcccgttgtagcccaaatcct

SEQ ID NO: 657447 - DNA, 25 bp, Rattus norvegicus
ttaatcccttgacagacttctgcct

SEQ ID NO: 657448 - DNA, 25 bp, Rattus norvegicus
ttaatcccttgagagacttctgcct

SEQ ID NO: 657449 - DNA, 25 bp, Rattus norvegicus
ttaatcccttttacatctacaatgg

SEQ ID NO: 657450 - DNA, 25 bp, Rattus norvegicus
ttaatccctttttcatctacaatgg

SEQ ID NO: 657451 - DNA, 25 bp, Rattus norvegicus
ttaatcctaaaaccaccactgaagt

SEQ ID NO: 657452 - DNA, 25 bp, Rattus norvegicus
ttaatcctaaaagcaccactgaagt

SEQ ID NO: 657453 - DNA, 25 bp, Rattus norvegicus
ttaatcctacttaagcagcacaggg

SEQ ID NO: 657454 - DNA, 25 bp, Rattus norvegicus
ttaatcctactttagcagcacaggg

SEQ ID NO: 657455 - DNA, 25 bp, Rattus norvegicus
ttaatcctagctccataaaataagt

SEQ ID NO: 657456 - DNA, 25 bp, Rattus norvegicus
ttaatcctagctgcataaaataagt

SEQ ID NO: 657457 - DNA, 25 bp, Rattus norvegicus
ttaatcctccatacagaacctgcta

SEQ ID NO: 657458 - DNA, 25 bp, Rattus norvegicus
ttaatcctccattcagaacctgcta

SEQ ID NO: 657459 - DNA, 25 bp, Rattus norvegicus
ttaatcctcgttcttttgggtccag

SEQ ID NO: 657460 - DNA, 25 bp, Rattus norvegicus
ttaatcctcgttgttttgggtccag

SEQ ID NO: 657461 - DNA, 25 bp, Rattus norvegicus
ttaatcctgtttcttccttagacag

SEQ ID NO: 657462 - DNA, 25 bp, Rattus norvegicus
ttaatcctgtttgttccttagacag

SEQ ID NO: 657463 - DNA, 25 bp, Rattus norvegicus
ttaatccttgaaccggtgtgggtgc

SEQ ID NO: 657464 - DNA, 25 bp, Rattus norvegicus
ttaatccttgaagcggtgtgggtgc

SEQ ID NO: 657465 - DNA, 25 bp, Rattus norvegicus
ttaatcctttgtcggacaatagtcc

SEQ ID NO: 657466 - DNA, 25 bp, Rattus norvegicus
ttaatcctttgtgggacaatagtcc

SEQ ID NO: 657467 - DNA, 25 bp, Rattus norvegicus
ttaatcgaattacagctgcctccca

SEQ ID NO: 657468 - DNA, 25 bp, Rattus norvegicus
ttaatcgaattagagctgcctccca

SEQ ID NO: 657469 - DNA, 25 bp, Rattus norvegicus
ttaatcgagattcacagcgctgcag

SEQ ID NO: 657470 - DNA, 25 bp, Rattus norvegicus
ttaatcgagattgacagcgctgcag

SEQ ID NO: 657471 - DNA, 25 bp, Rattus norvegicus
ttaatcgcagttcaaacaagggaca

SEQ ID NO: 657472 - DNA, 25 bp, Rattus norvegicus
ttaatcgcagttgaaacaagggaca

SEQ ID NO: 657473 - DNA, 25 bp, Rattus norvegicus
ttaatcgccaatacatcccatgttt

SEQ ID NO: 657474 - DNA, 25 bp, Rattus norvegicus
ttaatcgccaattcatcccatgttt

SEQ ID NO: 657475 - DNA, 25 bp, Rattus norvegicus
ttaatctatctgagaagtggtatct

SEQ ID NO: 657476 - DNA, 25 bp, Rattus norvegicus
ttaatctatctgtgaagtggtatct

SEQ ID NO: 657477 - DNA, 25 bp, Rattus norvegicus
ttaatctcaccaagtagccttcaac

SEQ ID NO: 657478 - DNA, 25 bp, Rattus norvegicus
ttaatctcaccatgtagccttcaac

SEQ ID NO: 657479 - DNA, 25 bp, Rattus norvegicus
ttaatctcagagcacaggcccagct

SEQ ID NO: 657480 - DNA, 25 bp, Rattus norvegicus
ttaatctcagaggacaggcccagct

SEQ ID NO: 657481 - DNA, 25 bp, Rattus norvegicus
ttaatctcagccatggtacgtgcca

SEQ ID NO: 657482 - DNA, 25 bp, Rattus norvegicus
ttaatctcagccttggtacgtgcca

SEQ ID NO: 657483 - DNA, 25 bp, Rattus norvegicus
ttaatctccccacactttcatttta

SEQ ID NO: 657484 - DNA, 25 bp, Rattus norvegicus
ttaatctccccagactttcatttta

SEQ ID NO: 657485 - DNA, 25 bp, Rattus norvegicus
ttaatctctgtcatttggtcccatt

SEQ ID NO: 657486 - DNA, 25 bp, Rattus norvegicus
ttaatctctgtcttttggtcccatt

SEQ ID NO: 657487 - DNA, 25 bp, Rattus norvegicus
ttaatctgaggaccttgcttccttt

SEQ ID NO: 657488 - DNA, 25 bp, Rattus norvegicus
ttaatctgaggagcttgcttccttt

SEQ ID NO: 657489 - DNA, 25 bp, Rattus norvegicus
ttaatctgatttatccttccttctc

SEQ ID NO: 657490 - DNA, 25 bp, Rattus norvegicus
ttaatctgatttttccttccttctc

SEQ ID NO: 657491 - DNA, 25 bp, Rattus norvegicus
ttaatctgcaagacacctcccaaga

SEQ ID NO: 657492 - DNA, 25 bp, Rattus norvegicus
ttaatctgcaagtcacctcccaaga

SEQ ID NO: 657493 - DNA, 25 bp, Rattus norvegicus
ttaatctgctttagtcccacatgac

SEQ ID NO: 657494 - DNA, 25 bp, Rattus norvegicus
ttaatctgcttttgtcccacatgac

SEQ ID NO: 657495 - DNA, 25 bp, Rattus norvegicus
ttaatcttcattcagcagccagtgg

SEQ ID NO: 657496 - DNA, 25 bp, Rattus norvegicus
ttaatcttcattgagcagccagtgg

SEQ ID NO: 657497 - DNA, 25 bp, Rattus norvegicus
ttaatcttcccgaacatgctggtcc

SEQ ID NO: 657498 - DNA, 25 bp, Rattus norvegicus
ttaatcttcccgcttttatcactgg

SEQ ID NO: 657499 - DNA, 25 bp, Rattus norvegicus
ttaatcttcccggttttatcactgg

SEQ ID NO: 657500 - DNA, 25 bp, Rattus norvegicus
ttaatcttcccgtacatgctggtcc

SEQ ID NO: 657501 - DNA, 25 bp, Rattus norvegicus
ttaatcttctcactcatctgcagag

SEQ ID NO: 657502 - DNA, 25 bp, Rattus norvegicus
ttaatcttctcagtcatctgcagag

SEQ ID NO: 657503 - DNA, 25 bp, Rattus norvegicus
ttaatcttcttgactctgtacagcc

SEQ ID NO: 657504 - DNA, 25 bp, Rattus norvegicus
ttaatcttcttgtctctgtacagcc

SEQ ID NO: 657505 - DNA, 25 bp, Rattus norvegicus
ttaatctttgttagctgtctccctt

SEQ ID NO: 657506 - DNA, 25 bp, Rattus norvegicus
ttaatctttgtttgctgtctccctt

SEQ ID NO: 657507 - DNA, 25 bp, Rattus norvegicus
ttaatctttttgctgcctgcaacgt

SEQ ID NO: 657508 - DNA, 25 bp, Rattus norvegicus
ttaatctttttggtgcctgcaacgt

SEQ ID NO: 657509 - DNA, 25 bp, Rattus norvegicus
ttaatgaacacaactgcatgcagcc

SEQ ID NO: 657510 - DNA, 25 bp, Rattus norvegicus
ttaatgaacacatctgcatgcagcc

SEQ ID NO: 657511 - DNA, 25 bp, Rattus norvegicus
ttaatgaaccctataaatcggacat

SEQ ID NO: 657512 - DNA, 25 bp, Rattus norvegicus
ttaatgaaccctttaaatcggacat

SEQ ID NO: 657513 - DNA, 25 bp, Rattus norvegicus
ttaatgaagggccttccttccaaat

SEQ ID NO: 657514 - DNA, 25 bp, Rattus norvegicus
ttaatgaagggcgttccttccaaat

SEQ ID NO: 657515 - DNA, 25 bp, Rattus norvegicus
ttaatgaatcctacccagcactaag

SEQ ID NO: 657516 - DNA, 25 bp, Rattus norvegicus
ttaatgaatccttcccagcactaag

SEQ ID NO: 657517 - DNA, 25 bp, Rattus norvegicus
ttaatgacctggcagccacacctct

SEQ ID NO: 657518 - DNA, 25 bp, Rattus norvegicus
ttaatgacctgggagccacacctct

SEQ ID NO: 657519 - DNA, 25 bp, Rattus norvegicus
ttaatgacttaaaacgtgataccgt

SEQ ID NO: 657520 - DNA, 25 bp, Rattus norvegicus
ttaatgacttaatacgtgataccgt

SEQ ID NO: 657521 - DNA, 25 bp, Rattus norvegicus
ttaatgacttcccacagacggcgag

SEQ ID NO: 657522 - DNA, 25 bp, Rattus norvegicus
ttaatgacttccgacagacggcgag

SEQ ID NO: 657523 - DNA, 25 bp, Rattus norvegicus
ttaatgacttctagcaccatcttgc

SEQ ID NO: 657524 - DNA, 25 bp, Rattus norvegicus
ttaatgacttcttgcaccatcttgc

SEQ ID NO: 657525 - DNA, 25 bp, Rattus norvegicus
ttaatgagattcctgtgtgccccga

SEQ ID NO: 657526 - DNA, 25 bp, Rattus norvegicus
ttaatgagattcgtgtgtgccccga

SEQ ID NO: 657527 - DNA, 25 bp, Rattus norvegicus
ttaatgagcatacctacgttccctt

SEQ ID NO: 657528 - DNA, 25 bp, Rattus norvegicus
ttaatgagcatagctacgttccctt

SEQ ID NO: 657529 - DNA, 25 bp, Rattus norvegicus
ttaatgagggttcttggccctcggc

SEQ ID NO: 657530 - DNA, 25 bp, Rattus norvegicus
ttaatgagggttgttggccctcggc

SEQ ID NO: 657531 - DNA, 25 bp, Rattus norvegicus
ttaatgagtaccacgggccctgagt

SEQ ID NO: 657532 - DNA, 25 bp, Rattus norvegicus
ttaatgagtacctcgggccctgagt

SEQ ID NO: 657533 - DNA, 25 bp, Rattus norvegicus
ttaatgagttatacaggctgaccct

SEQ ID NO: 657534 - DNA, 25 bp, Rattus norvegicus
ttaatgagttattcaggctgaccct

SEQ ID NO: 657535 - DNA, 25 bp, Rattus norvegicus
ttaatgattaccaccctgtactact

SEQ ID NO: 657536 - DNA, 25 bp, Rattus norvegicus
ttaatgattacctccctgtactact

SEQ ID NO: 657537 - DNA, 25 bp, Rattus norvegicus
ttaatgcaatgtcacgctctaccgt

SEQ ID NO: 657538 - DNA, 25 bp, Rattus norvegicus
ttaatgcaatgtgacgctctaccgt

SEQ ID NO: 657539 - DNA, 25 bp, Rattus norvegicus
ttaatgcactcacaaggttcagcgt

SEQ ID NO: 657540 - DNA, 25 bp, Rattus norvegicus
ttaatgcactcagaaggttcagcgt

SEQ ID NO: 657541 - DNA, 25 bp, Rattus norvegicus
ttaatgccagataccagacaaaact

SEQ ID NO: 657542 - DNA, 25 bp, Rattus norvegicus
ttaatgccagattccagacaaaact

SEQ ID NO: 657543 - DNA, 25 bp, Rattus norvegicus
ttaatgccagttaatcttcagatag

SEQ ID NO: 657544 - DNA, 25 bp, Rattus norvegicus
ttaatgccagtttatcttcagatag

SEQ ID NO: 657545 - DNA, 25 bp, Rattus norvegicus
ttaatgcctctgactgcctttgaag

SEQ ID NO: 657546 - DNA, 25 bp, Rattus norvegicus
ttaatgcctctgtctgcctttgaag

SEQ ID NO: 657547 - DNA, 25 bp, Rattus norvegicus
ttaatgccttctagaattctgttag

SEQ ID NO: 657548 - DNA, 25 bp, Rattus norvegicus
ttaatgccttcttgaattctgttag

SEQ ID NO: 657549 - DNA, 25 bp, Rattus norvegicus
ttaatgcgagcaagtgcgtgcacat

SEQ ID NO: 657550 - DNA, 25 bp, Rattus norvegicus
ttaatgcgagcatgtgcgtgcacat

SEQ ID NO: 657551 - DNA, 25 bp, Rattus norvegicus
ttaatgcggtaacggcagcagcctt

SEQ ID NO: 657552 - DNA, 25 bp, Rattus norvegicus
ttaatgcggtaagggcagcagcctt

SEQ ID NO: 657553 - DNA, 25 bp, Rattus norvegicus
ttaatgctacctctttgtgatcaca

SEQ ID NO: 657554 - DNA, 25 bp, Rattus norvegicus
ttaatgctacctgtttgtgatcaca

SEQ ID NO: 657555 - DNA, 25 bp, Rattus norvegicus
ttaatgctatccaactgggtgccta

SEQ ID NO: 657556 - DNA, 25 bp, Rattus norvegicus
ttaatgctatcctactgggtgccta

SEQ ID NO: 657557 - DNA, 25 bp, Rattus norvegicus
ttaatgctcatgagggtcagacttg

SEQ ID NO: 657558 - DNA, 25 bp, Rattus norvegicus
ttaatgctcatgtgggtcagacttg

SEQ ID NO: 657559 - DNA, 25 bp, Rattus norvegicus
ttaatgctcctgagtatgcccttca

SEQ ID NO: 657560 - DNA, 25 bp, Rattus norvegicus
ttaatgctcctgtgtatgcccttca

SEQ ID NO: 657561 - DNA, 25 bp, Rattus norvegicus
ttaatgctggaccactgtctctgag

SEQ ID NO: 657562 - DNA, 25 bp, Rattus norvegicus
ttaatgctggacgactgtctctgag

SEQ ID NO: 657563 - DNA, 25 bp, Rattus norvegicus
ttaatgctggcgacaaacccgacga

SEQ ID NO: 657564 - DNA, 25 bp, Rattus norvegicus
ttaatgctggcgtcaaacccgacga

SEQ ID NO: 657565 - DNA, 25 bp, Rattus norvegicus
ttaatgcttagacctattcctccag

SEQ ID NO: 657566 - DNA, 25 bp, Rattus norvegicus
ttaatgcttagagctattcctccag

SEQ ID NO: 657567 - DNA, 25 bp, Rattus norvegicus
ttaatggaaccaccgcatacgtgct

SEQ ID NO: 657568 - DNA, 25 bp, Rattus norvegicus
ttaatggaaccagcgcatacgtgct

SEQ ID NO: 657569 - DNA, 25 bp, Rattus norvegicus
ttaatggcatgtactaacctcagag

SEQ ID NO: 657570 - DNA, 25 bp, Rattus norvegicus
ttaatggcatgttctaacctcagag

SEQ ID NO: 657571 - DNA, 25 bp, Rattus norvegicus
ttaatggcattcaccttcctggcag

SEQ ID NO: 657572 - DNA, 25 bp, Rattus norvegicus
ttaatggcattctccttcctggcag

SEQ ID NO: 657573 - DNA, 25 bp, Rattus norvegicus
ttaatggcgattcccattcttccat

SEQ ID NO: 657574 - DNA, 25 bp, Rattus norvegicus
ttaatggcgattgccattcttccat

SEQ ID NO: 657575 - DNA, 25 bp, Rattus norvegicus
ttaatggctgtgagtcggtataacc

SEQ ID NO: 657576 - DNA, 25 bp, Rattus norvegicus
ttaatggctgtgtgtcggtataacc

SEQ ID NO: 657577 - DNA, 25 bp, Rattus norvegicus
ttaatggcttaaactctttgtatat

SEQ ID NO: 657578 - DNA, 25 bp, Rattus norvegicus
ttaatggcttaatctctttgtatat

SEQ ID NO: 657579 - DNA, 25 bp, Rattus norvegicus
ttaatggcttccaagtggcacccag

SEQ ID NO: 657580 - DNA, 25 bp, Rattus norvegicus
ttaatggcttcctagtggcacccag

SEQ ID NO: 657581 - DNA, 25 bp, Rattus norvegicus
ttaatgggcccaaagctgcttcctt

SEQ ID NO: 657582 - DNA, 25 bp, Rattus norvegicus
ttaatgggcccatagctgcttcctt

SEQ ID NO: 657583 - DNA, 25 bp, Rattus norvegicus
ttaatgggtcatctgggaaatactg

SEQ ID NO: 657584 - DNA, 25 bp, Rattus norvegicus
ttaatgggtcatgtgggaaatactg

SEQ ID NO: 657585 - DNA, 25 bp, Rattus norvegicus
ttaatggtcactaactgacccctgg

SEQ ID NO: 657586 - DNA, 25 bp, Rattus norvegicus
ttaatggtcacttactgacccctgg

SEQ ID NO: 657587 - DNA, 25 bp, Rattus norvegicus
ttaatggtcagcactaggaagcccc

SEQ ID NO: 657588 - DNA, 25 bp, Rattus norvegicus
ttaatggtcagctctaggaagcccc

SEQ ID NO: 657589 - DNA, 25 bp, Rattus norvegicus
ttaatggtcatgctgccgcaggatg

SEQ ID NO: 657590 - DNA, 25 bp, Rattus norvegicus
ttaatggtcatggtgccgcaggatg

SEQ ID NO: 657591 - DNA, 25 bp, Rattus norvegicus
ttaatggtgtgacttggttggcaat

SEQ ID NO: 657592 - DNA, 25 bp, Rattus norvegicus
ttaatggtgtgagttggttggcaat

SEQ ID NO: 657593 - DNA, 25 bp, Rattus norvegicus
ttaatggtgtttagctgcctacctg

SEQ ID NO: 657594 - DNA, 25 bp, Rattus norvegicus
ttaatggtgttttgctgcctacctg

SEQ ID NO: 657595 - DNA, 25 bp, Rattus norvegicus
ttaatgtacaacacaccacttcacg

SEQ ID NO: 657596 - DNA, 25 bp, Rattus norvegicus
ttaatgtacaactcaccacttcacg

SEQ ID NO: 657597 - DNA, 25 bp, Rattus norvegicus
ttaatgtaccttctctgtttctacc

SEQ ID NO: 657598 - DNA, 25 bp, Rattus norvegicus
ttaatgtaccttgtctgtttctacc

SEQ ID NO: 657599 - DNA, 25 bp, Rattus norvegicus
ttaatgtccagcacagtcatctcgg

SEQ ID NO: 657600 - DNA, 25 bp, Rattus norvegicus
ttaatgtccagctcagtcatctcgg

SEQ ID NO: 657601 - DNA, 25 bp, Rattus norvegicus
ttaatgtcccagagcgctacagaaa

SEQ ID NO: 657602 - DNA, 25 bp, Rattus norvegicus
ttaatgtcccagtgcgctacagaaa

SEQ ID NO: 657603 - DNA, 25 bp, Rattus norvegicus
ttaatgtctcagacactcaccttat

SEQ ID NO: 657604 - DNA, 25 bp, Rattus norvegicus
ttaatgtctcagtcactcaccttat

SEQ ID NO: 657605 - DNA, 25 bp, Rattus norvegicus
ttaatgtgaaacactcaccccaggc

SEQ ID NO: 657606 - DNA, 25 bp, Rattus norvegicus
ttaatgtgaaactctcaccccaggc

SEQ ID NO: 657607 - DNA, 25 bp, Rattus norvegicus
ttaatgtgccaaatacccctgtgtc

SEQ ID NO: 657608 - DNA, 25 bp, Rattus norvegicus
ttaatgtgccaattacccctgtgtc

SEQ ID NO: 657609 - DNA, 25 bp, Rattus norvegicus
ttaatgtgctctcttcccttaggga

SEQ ID NO: 657610 - DNA, 25 bp, Rattus norvegicus
ttaatgtgctctgttcccttaggga

SEQ ID NO: 657611 - DNA, 25 bp, Rattus norvegicus
ttaatgtgctgcatctcccagagag

SEQ ID NO: 657612 - DNA, 25 bp, Rattus norvegicus
ttaatgtgctgcttctcccagagag

SEQ ID NO: 657613 - DNA, 25 bp, Rattus norvegicus
ttaatgtggcaaccgggcctttcat

SEQ ID NO: 657614 - DNA, 25 bp, Rattus norvegicus
ttaatgtggcaagcgggcctttcat

SEQ ID NO: 657615 - DNA, 25 bp, Rattus norvegicus
ttaatgttcacactccctttgggta

SEQ ID NO: 657616 - DNA, 25 bp, Rattus norvegicus
ttaatgttcacagtccctttgggta

SEQ ID NO: 657617 - DNA, 25 bp, Rattus norvegicus
ttaatgttcctaaagacttaaagag

SEQ ID NO: 657618 - DNA, 25 bp, Rattus norvegicus
ttaatgttcctatagacttaaagag

SEQ ID NO: 657619 - DNA, 25 bp, Rattus norvegicus
ttaatgttgaagcttttgcgaaacc

SEQ ID NO: 657620 - DNA, 25 bp, Rattus norvegicus
ttaatgttgaaggttttgcgaaacc

SEQ ID NO: 657621 - DNA, 25 bp, Rattus norvegicus
ttaatgttgatgatctctgctcccc

SEQ ID NO: 657622 - DNA, 25 bp, Rattus norvegicus
ttaatgttgatgttctctgctcccc

SEQ ID NO: 657623 - DNA, 25 bp, Rattus norvegicus
ttaatgttttcacccctggatgctc

SEQ ID NO: 657624 - DNA, 25 bp, Rattus norvegicus
ttaatgttttcagccctggatgctc

SEQ ID NO: 657625 - DNA, 25 bp, Rattus norvegicus
ttaattaaatgacccagcttttcgg

SEQ ID NO: 657626 - DNA, 25 bp, Rattus norvegicus
ttaattaaatgagccagcttttcgg

SEQ ID NO: 657627 - DNA, 25 bp, Rattus norvegicus
ttaattaacagtctccaggggttgg

SEQ ID NO: 657628 - DNA, 25 bp, Rattus norvegicus
ttaattaacagtgtccaggggttgg

SEQ ID NO: 657629 - DNA, 25 bp, Rattus norvegicus
ttaattaggtgactgcagcccttcc

SEQ ID NO: 657630 - DNA, 25 bp, Rattus norvegicus
ttaattaggtgagtgcagcccttcc

SEQ ID NO: 657631 - DNA, 25 bp, Rattus norvegicus
ttaattatgtgcactgtcaggcccc

SEQ ID NO: 657632 - DNA, 25 bp, Rattus norvegicus
ttaattatgtgctctgtcaggcccc

SEQ ID NO: 657633 - DNA, 25 bp, Rattus norvegicus
ttaattcaacctatcatcccatcta

SEQ ID NO: 657634 - DNA, 25 bp, Rattus norvegicus
ttaattcaacctttcatcccatcta

SEQ ID NO: 657635 - DNA, 25 bp, Rattus norvegicus
ttaattcaactgctggtgggaccca

SEQ ID NO: 657636 - DNA, 25 bp, Rattus norvegicus
ttaattcaactggtggtgggaccca

SEQ ID NO: 657637 - DNA, 25 bp, Rattus norvegicus
ttaattcacaacagacactttccct

SEQ ID NO: 657638 - DNA, 25 bp, Rattus norvegicus
ttaattcacaactgacactttccct

SEQ ID NO: 657639 - DNA, 25 bp, Rattus norvegicus
ttaattcagacacgtgccacaagtt

SEQ ID NO: 657640 - DNA, 25 bp, Rattus norvegicus
ttaattcagacaggtgccacaagtt

SEQ ID NO: 657641 - DNA, 25 bp, Rattus norvegicus
ttaattcataatagccctgcgccta

SEQ ID NO: 657642 - DNA, 25 bp, Rattus norvegicus
ttaattcataattgccctgcgccta

SEQ ID NO: 657643 - DNA, 25 bp, Rattus norvegicus
ttaattcatcacactttcttccttt

SEQ ID NO: 657644 - DNA, 25 bp, Rattus norvegicus
ttaattcatcactctttcttccttt

SEQ ID NO: 657645 - DNA, 25 bp, Rattus norvegicus
ttaattcatgtgctacagacgaaag

SEQ ID NO: 657646 - DNA, 25 bp, Rattus norvegicus
ttaattcatgtggtacagacgaaag

SEQ ID NO: 657647 - DNA, 25 bp, Rattus norvegicus
ttaattcatgttcctacccaacagg

SEQ ID NO: 657648 - DNA, 25 bp, Rattus norvegicus
ttaattcatgttgctacccaacagg

SEQ ID NO: 657649 - DNA, 25 bp, Rattus norvegicus
ttaattccaccgcatctggacgttg

SEQ ID NO: 657650 - DNA, 25 bp, Rattus norvegicus
ttaattccaccggatctggacgttg

SEQ ID NO: 657651 - DNA, 25 bp, Rattus norvegicus
ttaattccaggcaatgaggtatatc

SEQ ID NO: 657652 - DNA, 25 bp, Rattus norvegicus
ttaattccaggctatgaggtatatc

SEQ ID NO: 657653 - DNA, 25 bp, Rattus norvegicus
ttaattccagttagcctgtggcaaa

SEQ ID NO: 657654 - DNA, 25 bp, Rattus norvegicus
ttaattccagtttgcctgtggcaaa

SEQ ID NO: 657655 - DNA, 25 bp, Rattus norvegicus
ttaattccatgaccaacagccctgc

SEQ ID NO: 657656 - DNA, 25 bp, Rattus norvegicus
ttaattccatgagcaacagccctgc

SEQ ID NO: 657657 - DNA, 25 bp, Rattus norvegicus
ttaattcctactactgactgtcatt

SEQ ID NO: 657658 - DNA, 25 bp, Rattus norvegicus
ttaattcctacttctgactgtcatt

SEQ ID NO: 657659 - DNA, 25 bp, Rattus norvegicus
ttaattcgaagcactgacttccctg

SEQ ID NO: 657660 - DNA, 25 bp, Rattus norvegicus
ttaattcgaagctctgacttccctg

SEQ ID NO: 657661 - DNA, 25 bp, Rattus norvegicus
ttaattctagcaaccctaaggcctg

SEQ ID NO: 657662 - DNA, 25 bp, Rattus norvegicus
ttaattctagcatccctaaggcctg

SEQ ID NO: 657663 - DNA, 25 bp, Rattus norvegicus
ttaattctcacactattctacccga

SEQ ID NO: 657664 - DNA, 25 bp, Rattus norvegicus
ttaattctcacagtattctacccga

SEQ ID NO: 657665 - DNA, 25 bp, Rattus norvegicus
ttaattctcaccaaatctcctcagt

SEQ ID NO: 657666 - DNA, 25 bp, Rattus norvegicus
ttaattctcaccagaactccatgag

SEQ ID NO: 657667 - DNA, 25 bp, Rattus norvegicus
ttaattctcacctaatctcctcagt

SEQ ID NO: 657668 - DNA, 25 bp, Rattus norvegicus
ttaattctcacctgaactccatgag

SEQ ID NO: 657669 - DNA, 25 bp, Rattus norvegicus
ttaattctccctcatttgctttacc

SEQ ID NO: 657670 - DNA, 25 bp, Rattus norvegicus
ttaattctccctgatttgctttacc

SEQ ID NO: 657671 - DNA, 25 bp, Rattus norvegicus
ttaattctccttactcgcgataaaa

SEQ ID NO: 657672 - DNA, 25 bp, Rattus norvegicus
ttaattctcctttctcgcgataaaa

SEQ ID NO: 657673 - DNA, 25 bp, Rattus norvegicus
ttaattctcttacgagcactctctc

SEQ ID NO: 657674 - DNA, 25 bp, Rattus norvegicus
ttaattctcttaggagcactctctc

SEQ ID NO: 657675 - DNA, 25 bp, Rattus norvegicus
ttaattctgacaaggcatggtgatg

SEQ ID NO: 657676 - DNA, 25 bp, Rattus norvegicus
ttaattctgacatggcatggtgatg

SEQ ID NO: 657677 - DNA, 25 bp, Rattus norvegicus
ttaattctgcatctactagtcttag

SEQ ID NO: 657678 - DNA, 25 bp, Rattus norvegicus
ttaattctgcatgtactagtcttag

SEQ ID NO: 657679 - DNA, 25 bp, Rattus norvegicus
ttaattcttttcactgttcagcagt

SEQ ID NO: 657680 - DNA, 25 bp, Rattus norvegicus
ttaattcttttctctgttcagcagt

SEQ ID NO: 657681 - DNA, 25 bp, Rattus norvegicus
ttaattcttttgatagcctggactg

SEQ ID NO: 657682 - DNA, 25 bp, Rattus norvegicus
ttaattcttttgttagcctggactg

SEQ ID NO: 657683 - DNA, 25 bp, Rattus norvegicus
ttaattgacccaacactgtttccct

SEQ ID NO: 657684 - DNA, 25 bp, Rattus norvegicus
ttaattgacccatcactgtttccct

SEQ ID NO: 657685 - DNA, 25 bp, Rattus norvegicus
ttaattgccctaagtgatttccaca

SEQ ID NO: 657686 - DNA, 25 bp, Rattus norvegicus
ttaattgccctatgtgatttccaca

SEQ ID NO: 657687 - DNA, 25 bp, Rattus norvegicus
ttaattgccctgatttcaaggtgtt

SEQ ID NO: 657688 - DNA, 25 bp, Rattus norvegicus
ttaattgccctgttttcaaggtgtt

SEQ ID NO: 657689 - DNA, 25 bp, Rattus norvegicus
ttaattgccgccaaacagctgactg

SEQ ID NO: 657690 - DNA, 25 bp, Rattus norvegicus
ttaattgccgcctaacagctgactg

SEQ ID NO: 657691 - DNA, 25 bp, Rattus norvegicus
ttaattgctcttaagactactgagg

SEQ ID NO: 657692 - DNA, 25 bp, Rattus norvegicus
ttaattgctctttagactactgagg

SEQ ID NO: 657693 - DNA, 25 bp, Rattus norvegicus
ttaattgcttcgctgcacaggtcct

SEQ ID NO: 657694 - DNA, 25 bp, Rattus norvegicus
ttaattgcttcggtgcacaggtcct

SEQ ID NO: 657695 - DNA, 25 bp, Rattus norvegicus
ttaattggcccacagttactaaggt

SEQ ID NO: 657696 - DNA, 25 bp, Rattus norvegicus
ttaattggcccagagttactaaggt

SEQ ID NO: 657697 - DNA, 25 bp, Rattus norvegicus
ttaattggccccacttgattcttgg

SEQ ID NO: 657698 - DNA, 25 bp, Rattus norvegicus
ttaattggcccctcttgattcttgg

SEQ ID NO: 657699 - DNA, 25 bp, Rattus norvegicus
ttaattggccttaacttaccatttg

SEQ ID NO: 657700 - DNA, 25 bp, Rattus norvegicus
ttaattggcctttacttaccatttg

SEQ ID NO: 657701 - DNA, 25 bp, Rattus norvegicus
ttaattggctcgctgtacaaggcac

SEQ ID NO: 657702 - DNA, 25 bp, Rattus norvegicus
ttaattggctcggtgtacaaggcac

SEQ ID NO: 657703 - DNA, 25 bp, Rattus norvegicus
ttaattgggctgcaaacagtggagt

SEQ ID NO: 657704 - DNA, 25 bp, Rattus norvegicus
ttaattgggctggaaacagtggagt

SEQ ID NO: 657705 - DNA, 25 bp, Rattus norvegicus
ttaattgtagcaattcactgatcct

SEQ ID NO: 657706 - DNA, 25 bp, Rattus norvegicus
ttaattgtagcatttcactgatcct

SEQ ID NO: 657707 - DNA, 25 bp, Rattus norvegicus
ttaatttaaggaatctttcttgtgg

SEQ ID NO: 657708 - DNA, 25 bp, Rattus norvegicus
ttaatttaaggattctttcttgtgg

SEQ ID NO: 657709 - DNA, 25 bp, Rattus norvegicus
ttaatttacgtgaactctagcccca

SEQ ID NO: 657710 - DNA, 25 bp, Rattus norvegicus
ttaatttacgtgtactctagcccca

SEQ ID NO: 657711 - DNA, 25 bp, Rattus norvegicus
ttaatttaggtgctcacagcctggg

SEQ ID NO: 657712 - DNA, 25 bp, Rattus norvegicus
ttaatttaggtggtcacagcctggg

SEQ ID NO: 657713 - DNA, 25 bp, Rattus norvegicus
ttaatttatgctcggcaaatgccct

SEQ ID NO: 657714 - DNA, 25 bp, Rattus norvegicus
ttaatttatgctgggcaaatgccct

SEQ ID NO: 657715 - DNA, 25 bp, Rattus norvegicus
ttaatttcaccaactctgacggcaa

SEQ ID NO: 657716 - DNA, 25 bp, Rattus norvegicus
ttaatttcaccatctctgacggcaa

SEQ ID NO: 657717 - DNA, 25 bp, Rattus norvegicus
ttaatttccactagactcttgtcca

SEQ ID NO: 657718 - DNA, 25 bp, Rattus norvegicus
ttaatttccacttgactcttgtcca

SEQ ID NO: 657719 - DNA, 25 bp, Rattus norvegicus
ttaatttccctgacctatggtctgt

SEQ ID NO: 657720 - DNA, 25 bp, Rattus norvegicus
ttaatttccctgtcctatggtctgt

SEQ ID NO: 657721 - DNA, 25 bp, Rattus norvegicus
ttaatttcctgtacatagcacctat

SEQ ID NO: 657722 - DNA, 25 bp, Rattus norvegicus
ttaatttcctgttcatagcacctat

SEQ ID NO: 657723 - DNA, 25 bp, Rattus norvegicus
ttaatttcctttctcactcgtacat

SEQ ID NO: 657724 - DNA, 25 bp, Rattus norvegicus
ttaatttcctttgtcactcgtacat

SEQ ID NO: 657725 - DNA, 25 bp, Rattus norvegicus
ttaatttgaccgactactccaatcc

SEQ ID NO: 657726 - DNA, 25 bp, Rattus norvegicus
ttaatttgaccgtctactccaatcc

SEQ ID NO: 657727 - DNA, 25 bp, Rattus norvegicus
ttaatttgctttacccttgtgagtc

SEQ ID NO: 657728 - DNA, 25 bp, Rattus norvegicus
ttaatttgcttttcccttgtgagtc

SEQ ID NO: 657729 - DNA, 25 bp, Rattus norvegicus
ttaatttgggccaggttggaccttg

SEQ ID NO: 657730 - DNA, 25 bp, Rattus norvegicus
ttaatttgggcctggttggaccttg

SEQ ID NO: 657731 - DNA, 25 bp, Rattus norvegicus
ttaattttcggaagccttcctcaac

SEQ ID NO: 657732 - DNA, 25 bp, Rattus norvegicus
ttaattttcggatgccttcctcaac

SEQ ID NO: 657733 - DNA, 25 bp, Rattus norvegicus
ttaattttctctagtggcctctgac

SEQ ID NO: 657734 - DNA, 25 bp, Rattus norvegicus
ttaattttctcttgtggcctctgac

SEQ ID NO: 657735 - DNA, 25 bp, Rattus norvegicus
ttaattttctttcccagacctcagt

SEQ ID NO: 657736 - DNA, 25 bp, Rattus norvegicus
ttaattttctttgccagacctcagt

SEQ ID NO: 657737 - DNA, 25 bp, Rattus norvegicus
ttaattttgaaaagctctgctgagg

SEQ ID NO: 657738 - DNA, 25 bp, Rattus norvegicus
ttaattttgaaatgctctgctgagg

SEQ ID NO: 657739 - DNA, 25 bp, Rattus norvegicus
ttaattttgagtcattccccagtcc

SEQ ID NO: 657740 - DNA, 25 bp, Rattus norvegicus
ttaattttgagtgattccccagtcc

SEQ ID NO: 657741 - DNA, 25 bp, Rattus norvegicus
ttaattttgttaatcctgtctggga

SEQ ID NO: 657742 - DNA, 25 bp, Rattus norvegicus
ttaattttgttattcctgtctggga

SEQ ID NO: 657743 - DNA, 25 bp, Rattus norvegicus
ttaatttttaagaccacccgctgag

SEQ ID NO: 657744 - DNA, 25 bp, Rattus norvegicus
ttaatttttaagtccacccgctgag

SEQ ID NO: 657745 - DNA, 25 bp, Rattus norvegicus
ttacaaaaagcaagtaccccgtagg

SEQ ID NO: 657746 - DNA, 25 bp, Rattus norvegicus
ttacaaaaagcatgtaccccgtagg

SEQ ID NO: 657747 - DNA, 25 bp, Rattus norvegicus
ttacaaaaggctccttcccacttct

SEQ ID NO: 657748 - DNA, 25 bp, Rattus norvegicus
ttacaaaaggctgcttcccacttct

SEQ ID NO: 657749 - DNA, 25 bp, Rattus norvegicus
ttacaaaatccgaaccattgctcca

SEQ ID NO: 657750 - DNA, 25 bp, Rattus norvegicus
ttacaaaatccgtaccattgctcca

SEQ ID NO: 657751 - DNA, 25 bp, Rattus norvegicus
ttacaaaatggtcctgtttctgaag

SEQ ID NO: 657752 - DNA, 25 bp, Rattus norvegicus
ttacaaaatggtgctgtttctgaag

SEQ ID NO: 657753 - DNA, 25 bp, Rattus norvegicus
ttacaaaattccacccaatgggcca

SEQ ID NO: 657754 - DNA, 25 bp, Rattus norvegicus
ttacaaaattcctcccaatgggcca

SEQ ID NO: 657755 - DNA, 25 bp, Rattus norvegicus
ttacaaacatccctccctcttattt

SEQ ID NO: 657756 - DNA, 25 bp, Rattus norvegicus
ttacaaacatccgtccctcttattt

SEQ ID NO: 657757 - DNA, 25 bp, Rattus norvegicus
ttacaaacctgacactactttctgc

SEQ ID NO: 657758 - DNA, 25 bp, Rattus norvegicus
ttacaaacctgagactactttctgc

SEQ ID NO: 657759 - DNA, 25 bp, Rattus norvegicus
ttacaaacgtggcaacctgttcttc

SEQ ID NO: 657760 - DNA, 25 bp, Rattus norvegicus
ttacaaacgtgggaacctgttcttc

SEQ ID NO: 657761 - DNA, 25 bp, Rattus norvegicus
ttacaaactaacctttctaacactg

SEQ ID NO: 657762 - DNA, 25 bp, Rattus norvegicus
ttacaaactaacgtttctaacactg

SEQ ID NO: 657763 - DNA, 25 bp, Rattus norvegicus
ttacaaactcacagaagggccccat

SEQ ID NO: 657764 - DNA, 25 bp, Rattus norvegicus
ttacaaactcactgaagggccccat

SEQ ID NO: 657765 - DNA, 25 bp, Rattus norvegicus
ttacaaagaaagctccacccatctc

SEQ ID NO: 657766 - DNA, 25 bp, Rattus norvegicus
ttacaaagaaaggtccacccatctc

SEQ ID NO: 657767 - DNA, 25 bp, Rattus norvegicus
ttacaaagatttcccgctgcggatc

SEQ ID NO: 657768 - DNA, 25 bp, Rattus norvegicus
ttacaaagatttgccgctgcggatc

SEQ ID NO: 657769 - DNA, 25 bp, Rattus norvegicus
ttacaaagtattaccctgatgacaa

SEQ ID NO: 657770 - DNA, 25 bp, Rattus norvegicus
ttacaaagtatttccctgatgacaa

SEQ ID NO: 657771 - DNA, 25 bp, Rattus norvegicus
ttacaaagtgtcacctgctgcatga

SEQ ID NO: 657772 - DNA, 25 bp, Rattus norvegicus
ttacaaagtgtctcctgctgcatga

SEQ ID NO: 657773 - DNA, 25 bp, Rattus norvegicus
ttacaaatacccagggccttctgat

SEQ ID NO: 657774 - DNA, 25 bp, Rattus norvegicus
ttacaaataccctgggccttctgat

SEQ ID NO: 657775 - DNA, 25 bp, Rattus norvegicus
ttacaaatctccacggtttgctcgg

SEQ ID NO: 657776 - DNA, 25 bp, Rattus norvegicus
ttacaaatctcctcggtttgctcgg

SEQ ID NO: 657777 - DNA, 25 bp, Rattus norvegicus
ttacaaatgactctgcgtcctttcc

SEQ ID NO: 657778 - DNA, 25 bp, Rattus norvegicus
ttacaaatgactgtgcgtcctttcc

SEQ ID NO: 657779 - DNA, 25 bp, Rattus norvegicus
ttacaaatgaggagcctgccccagt

SEQ ID NO: 657780 - DNA, 25 bp, Rattus norvegicus
ttacaaatgaggtgcctgccccagt

SEQ ID NO: 657781 - DNA, 25 bp, Rattus norvegicus
ttacaaattggtctccagcttgggc

SEQ ID NO: 657782 - DNA, 25 bp, Rattus norvegicus
ttacaaattggtgtccagcttgggc

SEQ ID NO: 657783 - DNA, 25 bp, Rattus norvegicus
ttacaacaccacaccctatttaagg

SEQ ID NO: 657784 - DNA, 25 bp, Rattus norvegicus
ttacaacaccactccctatttaagg

SEQ ID NO: 657785 - DNA, 25 bp, Rattus norvegicus
ttacaacagagtaggcaatggccga

SEQ ID NO: 657786 - DNA, 25 bp, Rattus norvegicus
ttacaacagagttggcaatggccga

SEQ ID NO: 657787 - DNA, 25 bp, Rattus norvegicus
ttacaacaggaaagagtaggcctct

SEQ ID NO: 657788 - DNA, 25 bp, Rattus norvegicus
ttacaacaggaatgagtaggcctct

SEQ ID NO: 657789 - DNA, 25 bp, Rattus norvegicus
ttacaacagttacacatggcgcttc

SEQ ID NO: 657790 - DNA, 25 bp, Rattus norvegicus
ttacaacagttagacatggcgcttc

SEQ ID NO: 657791 - DNA, 25 bp, Rattus norvegicus
ttacaaccatccagggtgttaccct

SEQ ID NO: 657792 - DNA, 25 bp, Rattus norvegicus
ttacaaccatcctgggtgttaccct

SEQ ID NO: 657793 - DNA, 25 bp, Rattus norvegicus
ttacaacccactacctgaagagcgg

SEQ ID NO: 657794 - DNA, 25 bp, Rattus norvegicus
ttacaacccacttcctgaagagcgg

SEQ ID NO: 657795 - DNA, 25 bp, Rattus norvegicus
ttacaacccatcagttaactccagt

SEQ ID NO: 657796 - DNA, 25 bp, Rattus norvegicus
ttacaacccatctgttaactccagt

SEQ ID NO: 657797 - DNA, 25 bp, Rattus norvegicus
ttacaaccgcttagggacctctggg

SEQ ID NO: 657798 - DNA, 25 bp, Rattus norvegicus
ttacaaccgctttgggacctctggg

SEQ ID NO: 657799 - DNA, 25 bp, Rattus norvegicus
ttacaaccgggcaaaccgggctgtg

SEQ ID NO: 657800 - DNA, 25 bp, Rattus norvegicus
ttacaaccgggctaaccgggctgtg

SEQ ID NO: 657801 - DNA, 25 bp, Rattus norvegicus
ttacaacctccacgtcttagacttt

SEQ ID NO: 657802 - DNA, 25 bp, Rattus norvegicus
ttacaacctccaggtcttagacttt

SEQ ID NO: 657803 - DNA, 25 bp, Rattus norvegicus
ttacaacctgttactggaacttgtc

SEQ ID NO: 657804 - DNA, 25 bp, Rattus norvegicus
ttacaacctgtttctggaacttgtc

SEQ ID NO: 657805 - DNA, 25 bp, Rattus norvegicus
ttacaacgaggccttcagctttgag

SEQ ID NO: 657806 - DNA, 25 bp, Rattus norvegicus
ttacaacgaggcgttcagctttgag

SEQ ID NO: 657807 - DNA, 25 bp, Rattus norvegicus
ttacaactctgacatactgaccttc

SEQ ID NO: 657808 - DNA, 25 bp, Rattus norvegicus
ttacaactctgagatactgaccttc

SEQ ID NO: 657809 - DNA, 25 bp, Rattus norvegicus
ttacaactgtatagaccaggccctc

SEQ ID NO: 657810 - DNA, 25 bp, Rattus norvegicus
ttacaactgtattgaccaggccctc

SEQ ID NO: 657811 - DNA, 25 bp, Rattus norvegicus
ttacaacttacgctgaggctgataa

SEQ ID NO: 657812 - DNA, 25 bp, Rattus norvegicus
ttacaacttacggtgaggctgataa

SEQ ID NO: 657813 - DNA, 25 bp, Rattus norvegicus
ttacaacttgttaacggctctgaaa

SEQ ID NO: 657814 - DNA, 25 bp, Rattus norvegicus
ttacaacttgtttacggctctgaaa

SEQ ID NO: 657815 - DNA, 25 bp, Rattus norvegicus
ttacaagaaactcccatctctgcct

SEQ ID NO: 657816 - DNA, 25 bp, Rattus norvegicus
ttacaagaaactgccatctctgcct

SEQ ID NO: 657817 - DNA, 25 bp, Rattus norvegicus
ttacaagaaccgacctggcctcagt

SEQ ID NO: 657818 - DNA, 25 bp, Rattus norvegicus
ttacaagaaccgtcctggcctcagt

SEQ ID NO: 657819 - DNA, 25 bp, Rattus norvegicus
ttacaagaactcacactggcattga

SEQ ID NO: 657820 - DNA, 25 bp, Rattus norvegicus
ttacaagaactctcactggcattga

SEQ ID NO: 657821 - DNA, 25 bp, Rattus norvegicus
ttacaagaagttatcctggtgacgc

SEQ ID NO: 657822 - DNA, 25 bp, Rattus norvegicus
ttacaagaagttttcctggtgacgc

SEQ ID NO: 657823 - DNA, 25 bp, Rattus norvegicus
ttacaagactttccttggtccctga

SEQ ID NO: 657824 - DNA, 25 bp, Rattus norvegicus
ttacaagactttgcttggtccctga

SEQ ID NO: 657825 - DNA, 25 bp, Rattus norvegicus
ttacaagagtgcaggtgaccctaaa

SEQ ID NO: 657826 - DNA, 25 bp, Rattus norvegicus
ttacaagagtgctggtgaccctaaa

SEQ ID NO: 657827 - DNA, 25 bp, Rattus norvegicus
ttacaagatgtgcacctgcgatccc

SEQ ID NO: 657828 - DNA, 25 bp, Rattus norvegicus
ttacaagatgtggacctgcgatccc

SEQ ID NO: 657829 - DNA, 25 bp, Rattus norvegicus
ttacaagcatatcgcctgagttcaa

SEQ ID NO: 657830 - DNA, 25 bp, Rattus norvegicus
ttacaagcatatggcctgagttcaa

SEQ ID NO: 657831 - DNA, 25 bp, Rattus norvegicus
ttacaagcatttactacccagtctg

SEQ ID NO: 657832 - DNA, 25 bp, Rattus norvegicus
ttacaagcattttctacccagtctg

SEQ ID NO: 657833 - DNA, 25 bp, Rattus norvegicus
ttacaagcccagaatcatgtctgtt

SEQ ID NO: 657834 - DNA, 25 bp, Rattus norvegicus
ttacaagcccagtatcatgtctgtt

SEQ ID NO: 657835 - DNA, 25 bp, Rattus norvegicus
ttacaagcccgtcctgcagaacaag

SEQ ID NO: 657836 - DNA, 25 bp, Rattus norvegicus
ttacaagcccgtgctgcagaacaag

SEQ ID NO: 657837 - DNA, 25 bp, Rattus norvegicus
ttacaagctttcattctgtggctcc

SEQ ID NO: 657838 - DNA, 25 bp, Rattus norvegicus
ttacaagctttctttctgtggctcc

SEQ ID NO: 657839 - DNA, 25 bp, Rattus norvegicus
ttacaaggacaacagcgacttcggg

SEQ ID NO: 657840 - DNA, 25 bp, Rattus norvegicus
ttacaaggacaagagcgacttcggg

SEQ ID NO: 657841 - DNA, 25 bp, Rattus norvegicus
ttacaaggacgaccaggccaagctc

SEQ ID NO: 657842 - DNA, 25 bp, Rattus norvegicus
ttacaaggacgagcaggccaagctc

SEQ ID NO: 657843 - DNA, 25 bp, Rattus norvegicus
ttacaaggccagacttctgcttctc

SEQ ID NO: 657844 - DNA, 25 bp, Rattus norvegicus
ttacaaggccagtcttctgcttctc

SEQ ID NO: 657845 - DNA, 25 bp, Rattus norvegicus
ttacaaggccctcgaagacccgtgg

SEQ ID NO: 657846 - DNA, 25 bp, Rattus norvegicus
ttacaaggccctggaagacccgtgg

SEQ ID NO: 657847 - DNA, 25 bp, Rattus norvegicus
ttacaagggcaactactcggagagg

SEQ ID NO: 657848 - DNA, 25 bp, Rattus norvegicus
ttacaagggcaagtactcggagagg

SEQ ID NO: 657849 - DNA, 25 bp, Rattus norvegicus
ttacaagggctgactgggctgctct

SEQ ID NO: 657850 - DNA, 25 bp, Rattus norvegicus
ttacaagggctgtctgggctgctct

SEQ ID NO: 657851 - DNA, 25 bp, Rattus norvegicus
ttacaagtcccacagtttccgtgat

SEQ ID NO: 657852 - DNA, 25 bp, Rattus norvegicus
ttacaagtcccagagtttccgtgat

SEQ ID NO: 657853 - DNA, 25 bp, Rattus norvegicus
ttacaagttgtgaccctacccctag

SEQ ID NO: 657854 - DNA, 25 bp, Rattus norvegicus
ttacaagttgtgtccctacccctag

SEQ ID NO: 657855 - DNA, 25 bp, Rattus norvegicus
ttacaataaatgacacccagtggcc

SEQ ID NO: 657856 - DNA, 25 bp, Rattus norvegicus
ttacaataaatgtcacccagtggcc

SEQ ID NO: 657857 - DNA, 25 bp, Rattus norvegicus
ttacaatagtgtcagcggtggaaac

SEQ ID NO: 657858 - DNA, 25 bp, Rattus norvegicus
ttacaatagtgtgagcggtggaaac

SEQ ID NO: 657859 - DNA, 25 bp, Rattus norvegicus
ttacaatattccagtccaagtggga

SEQ ID NO: 657860 - DNA, 25 bp, Rattus norvegicus
ttacaatattcctgtccaagtggga

SEQ ID NO: 657861 - DNA, 25 bp, Rattus norvegicus
ttacaatcctccctgctttgcctta

SEQ ID NO: 657862 - DNA, 25 bp, Rattus norvegicus
ttacaatcctccgtgctttgcctta

SEQ ID NO: 657863 - DNA, 25 bp, Rattus norvegicus
ttacaatctcgtcagcctcaacagc

SEQ ID NO: 657864 - DNA, 25 bp, Rattus norvegicus
ttacaatctcgtgagcctcaacagc

SEQ ID NO: 657865 - DNA, 25 bp, Rattus norvegicus
ttacaatcttgtattgctcggccag

SEQ ID NO: 657866 - DNA, 25 bp, Rattus norvegicus
ttacaatcttgttttgctcggccag

SEQ ID NO: 657867 - DNA, 25 bp, Rattus norvegicus
ttacaatcttttatacacctgcccc

SEQ ID NO: 657868 - DNA, 25 bp, Rattus norvegicus
ttacaatcttttttacacctgcccc

SEQ ID NO: 657869 - DNA, 25 bp, Rattus norvegicus
ttacaatgatcgacgcatggctctc

SEQ ID NO: 657870 - DNA, 25 bp, Rattus norvegicus
ttacaatgatcgtcgcatggctctc

SEQ ID NO: 657871 - DNA, 25 bp, Rattus norvegicus
ttacaatggcggaacatctgcagca

SEQ ID NO: 657872 - DNA, 25 bp, Rattus norvegicus
ttacaatggcggtacatctgcagca

SEQ ID NO: 657873 - DNA, 25 bp, Rattus norvegicus
ttacaatgtcaacaggccatccatc

SEQ ID NO: 657874 - DNA, 25 bp, Rattus norvegicus
ttacaatgtcaagaggccatccatc

SEQ ID NO: 657875 - DNA, 25 bp, Rattus norvegicus
ttacaattccaaaagcagtggaaac

SEQ ID NO: 657876 - DNA, 25 bp, Rattus norvegicus
ttacaattccaatagcagtggaaac

SEQ ID NO: 657877 - DNA, 25 bp, Rattus norvegicus
ttacaattccatcgaaatcccagcc

SEQ ID NO: 657878 - DNA, 25 bp, Rattus norvegicus
ttacaattccatggaaatcccagcc

SEQ ID NO: 657879 - DNA, 25 bp, Rattus norvegicus
ttacaattgcacacaggatccgaag

SEQ ID NO: 657880 - DNA, 25 bp, Rattus norvegicus
ttacaattgcactcaggatccgaag

SEQ ID NO: 657881 - DNA, 25 bp, Rattus norvegicus
ttacacaaacttcctgtctgcttag

SEQ ID NO: 657882 - DNA, 25 bp, Rattus norvegicus
ttacacaaacttgctgtctgcttag

SEQ ID NO: 657883 - DNA, 25 bp, Rattus norvegicus
ttacacaactcacatttgctcagcc

SEQ ID NO: 657884 - DNA, 25 bp, Rattus norvegicus
ttacacaactcagatttgctcagcc

SEQ ID NO: 657885 - DNA, 25 bp, Rattus norvegicus
ttacacaagtggacctgaggctgcc

SEQ ID NO: 657886 - DNA, 25 bp, Rattus norvegicus
ttacacaagtggtcctgaggctgcc

SEQ ID NO: 657887 - DNA, 25 bp, Rattus norvegicus
ttacacaatgcaaaggccagcgctc

SEQ ID NO: 657888 - DNA, 25 bp, Rattus norvegicus
ttacacaatgcataggccagcgctc

SEQ ID NO: 657889 - DNA, 25 bp, Rattus norvegicus
ttacacaccgccaccataaaggagt

SEQ ID NO: 657890 - DNA, 25 bp, Rattus norvegicus
ttacacaccgcctccataaaggagt

SEQ ID NO: 657891 - DNA, 25 bp, Rattus norvegicus
ttacacacgtcaatttgtgacacag

SEQ ID NO: 657892 - DNA, 25 bp, Rattus norvegicus
ttacacacgtcattttgtgacacag

SEQ ID NO: 657893 - DNA, 25 bp, Rattus norvegicus
ttacacactcacaaaacgcttttct

SEQ ID NO: 657894 - DNA, 25 bp, Rattus norvegicus
ttacacactcactaaacgcttttct

SEQ ID NO: 657895 - DNA, 25 bp, Rattus norvegicus
ttacacagacaaacagggccagcct

SEQ ID NO: 657896 - DNA, 25 bp, Rattus norvegicus
ttacacagacaatcagggccagcct

SEQ ID NO: 657897 - DNA, 25 bp, Rattus norvegicus
ttacacagaccgaactaagccaaag

SEQ ID NO: 657898 - DNA, 25 bp, Rattus norvegicus
ttacacagaccgtactaagccaaag

SEQ ID NO: 657899 - DNA, 25 bp, Rattus norvegicus
ttacacagcaccattcaaccatgca

SEQ ID NO: 657900 - DNA, 25 bp, Rattus norvegicus
ttacacagcacctttcaaccatgca

SEQ ID NO: 657901 - DNA, 25 bp, Rattus norvegicus
ttacacagcgagattcagaagatga

SEQ ID NO: 657902 - DNA, 25 bp, Rattus norvegicus
ttacacagcgagtttcagaagatga

SEQ ID NO: 657903 - DNA, 25 bp, Rattus norvegicus
ttacacagcttcacttatgaccaag

SEQ ID NO: 657904 - DNA, 25 bp, Rattus norvegicus
ttacacagcttctcttatgaccaag

SEQ ID NO: 657905 - DNA, 25 bp, Rattus norvegicus
ttacacagtcatccaaagagcagag

SEQ ID NO: 657906 - DNA, 25 bp, Rattus norvegicus
ttacacagtcatgcaaagagcagag

SEQ ID NO: 657907 - DNA, 25 bp, Rattus norvegicus
ttacacatatgcctcaacaccagat

SEQ ID NO: 657908 - DNA, 25 bp, Rattus norvegicus
ttacacatatgcgtcaacaccagat

SEQ ID NO: 657909 - DNA, 25 bp, Rattus norvegicus
ttacacatcgttcggttatgaaacc

SEQ ID NO: 657910 - DNA, 25 bp, Rattus norvegicus
ttacacatcgttgggttatgaaacc

SEQ ID NO: 657911 - DNA, 25 bp, Rattus norvegicus
ttacacatctgtatacgcacaccag

SEQ ID NO: 657912 - DNA, 25 bp, Rattus norvegicus
ttacacatctgtttacgcacaccag

SEQ ID NO: 657913 - DNA, 25 bp, Rattus norvegicus
ttacacatgagaatccacactggcg

SEQ ID NO: 657914 - DNA, 25 bp, Rattus norvegicus
ttacacatgagattccacactggcg

SEQ ID NO: 657915 - DNA, 25 bp, Rattus norvegicus
ttacacatgcctcgaatgcagccaa

SEQ ID NO: 657916 - DNA, 25 bp, Rattus norvegicus
ttacacatgcctggaatgcagccaa

SEQ ID NO: 657917 - DNA, 25 bp, Rattus norvegicus
ttacacatgcgtctgtcctctcaga

SEQ ID NO: 657918 - DNA, 25 bp, Rattus norvegicus
ttacacatgcgtgtgtcctctcaga

SEQ ID NO: 657919 - DNA, 25 bp, Rattus norvegicus
ttacacatgttcaccagtctcgtca

SEQ ID NO: 657920 - DNA, 25 bp, Rattus norvegicus
ttacacatgttctccagtctcgtca

SEQ ID NO: 657921 - DNA, 25 bp, Rattus norvegicus
ttacacattgatatctttcacttca

SEQ ID NO: 657922 - DNA, 25 bp, Rattus norvegicus
ttacacattgatttctttcacttca

SEQ ID NO: 657923 - DNA, 25 bp, Rattus norvegicus
ttacacatttatcgtcaggcacatg

SEQ ID NO: 657924 - DNA, 25 bp, Rattus norvegicus
ttacacatttatggtcaggcacatg

SEQ ID NO: 657925 - DNA, 25 bp, Rattus norvegicus
ttacaccaacaaccagactgacatc

SEQ ID NO: 657926 - DNA, 25 bp, Rattus norvegicus
ttacaccaacaagcagactgacatc

SEQ ID NO: 657927 - DNA, 25 bp, Rattus norvegicus
ttacaccacacacagatcttctaag

SEQ ID NO: 657928 - DNA, 25 bp, Rattus norvegicus
ttacaccacacagagatcttctaag

SEQ ID NO: 657929 - DNA, 25 bp, Rattus norvegicus
ttacaccacccaaaatgctttgcat

SEQ ID NO: 657930 - DNA, 25 bp, Rattus norvegicus
ttacaccacccataatgctttgcat

SEQ ID NO: 657931 - DNA, 25 bp, Rattus norvegicus
ttacaccaggtgaagcttgtccttg

SEQ ID NO: 657932 - DNA, 25 bp, Rattus norvegicus
ttacaccaggtgtagcttgtccttg

SEQ ID NO: 657933 - DNA, 25 bp, Rattus norvegicus
ttacaccagtataaactccaacagt

SEQ ID NO: 657934 - DNA, 25 bp, Rattus norvegicus
ttacaccagtattaactccaacagt

SEQ ID NO: 657935 - DNA, 25 bp, Rattus norvegicus
ttacaccatccccacgggaggagat

SEQ ID NO: 657936 - DNA, 25 bp, Rattus norvegicus
ttacaccatcccgacgggaggagat

SEQ ID NO: 657937 - DNA, 25 bp, Rattus norvegicus
ttacacccacagacgacagacactg

SEQ ID NO: 657938 - DNA, 25 bp, Rattus norvegicus
ttacacccacagtcgacagacactg

SEQ ID NO: 657939 - DNA, 25 bp, Rattus norvegicus
ttacacccacccaatggactgtagt

SEQ ID NO: 657940 - DNA, 25 bp, Rattus norvegicus
ttacacccaccctatggactgtagt

SEQ ID NO: 657941 - DNA, 25 bp, Rattus norvegicus
ttacacccagatccagaagttcagt

SEQ ID NO: 657942 - DNA, 25 bp, Rattus norvegicus
ttacacccagatgcagaagttcagt

SEQ ID NO: 657943 - DNA, 25 bp, Rattus norvegicus
ttacacccagggactggtgcagaca

SEQ ID NO: 657944 - DNA, 25 bp, Rattus norvegicus
ttacacccagggtctggtgcagaca

SEQ ID NO: 657945 - DNA, 25 bp, Rattus norvegicus
ttacacccagttagaaagccatctc

SEQ ID NO: 657946 - DNA, 25 bp, Rattus norvegicus
ttacacccagtttgaaagccatctc

SEQ ID NO: 657947 - DNA, 25 bp, Rattus norvegicus
ttacacccatccatttgttcaagag

SEQ ID NO: 657948 - DNA, 25 bp, Rattus norvegicus
ttacacccatccttttgttcaagag

SEQ ID NO: 657949 - DNA, 25 bp, Rattus norvegicus
ttacaccccagaatccccaatggag

SEQ ID NO: 657950 - DNA, 25 bp, Rattus norvegicus
ttacaccccagattccccaatggag

SEQ ID NO: 657951 - DNA, 25 bp, Rattus norvegicus
ttacacccctgacacagagcaaaag

SEQ ID NO: 657952 - DNA, 25 bp, Rattus norvegicus
ttacacccctgagacagagcaaaag

SEQ ID NO: 657953 - DNA, 25 bp, Rattus norvegicus
ttacacccttggacaggaatggtat

SEQ ID NO: 657954 - DNA, 25 bp, Rattus norvegicus
ttacacccttggtcaggaatggtat

SEQ ID NO: 657955 - DNA, 25 bp, Rattus norvegicus
ttacaccgaccacttgccctgtgtt

SEQ ID NO: 657956 - DNA, 25 bp, Rattus norvegicus
ttacaccgaccagttgccctgtgtt

SEQ ID NO: 657957 - DNA, 25 bp, Rattus norvegicus
ttacaccgggtaaaacatcatgcct

SEQ ID NO: 657958 - DNA, 25 bp, Rattus norvegicus
ttacaccgggtataacatcatgcct

SEQ ID NO: 657959 - DNA, 25 bp, Rattus norvegicus
ttacacctaattcagctaccctgga

SEQ ID NO: 657960 - DNA, 25 bp, Rattus norvegicus
ttacacctaattgagctaccctgga

SEQ ID NO: 657961 - DNA, 25 bp, Rattus norvegicus
ttacacctagttcaccaggctctga

SEQ ID NO: 657962 - DNA, 25 bp, Rattus norvegicus
ttacacctagttgaccaggctctga

SEQ ID NO: 657963 - DNA, 25 bp, Rattus norvegicus
ttacacctgctcaccacagtttgca

SEQ ID NO: 657964 - DNA, 25 bp, Rattus norvegicus
ttacacctgctcctcaaattttgat

SEQ ID NO: 657965 - DNA, 25 bp, Rattus norvegicus
ttacacctgctcgtcaaattttgat

SEQ ID NO: 657966 - DNA, 25 bp, Rattus norvegicus
ttacacctgctctccacagtttgca

SEQ ID NO: 657967 - DNA, 25 bp, Rattus norvegicus
ttacacctgggtctggactcacata

SEQ ID NO: 657968 - DNA, 25 bp, Rattus norvegicus
ttacacctgggtgtggactcacata

SEQ ID NO: 657969 - DNA, 25 bp, Rattus norvegicus
ttacaccttacacctttctggcctg

SEQ ID NO: 657970 - DNA, 25 bp, Rattus norvegicus
ttacaccttacagctttctggcctg

SEQ ID NO: 657971 - DNA, 25 bp, Rattus norvegicus
ttacacctttaaaacaatgacatga

SEQ ID NO: 657972 - DNA, 25 bp, Rattus norvegicus
ttacacctttaatacaatgacatga

SEQ ID NO: 657973 - DNA, 25 bp, Rattus norvegicus
ttacacgacaacatcttggctcttc

SEQ ID NO: 657974 - DNA, 25 bp, Rattus norvegicus
ttacacgacaacttcttggctcttc

SEQ ID NO: 657975 - DNA, 25 bp, Rattus norvegicus
ttacacgtatctaactgtcttctct

SEQ ID NO: 657976 - DNA, 25 bp, Rattus norvegicus
ttacacgtatcttactgtcttctct

SEQ ID NO: 657977 - DNA, 25 bp, Rattus norvegicus
ttacacgtctccaacttcagtggtg

SEQ ID NO: 657978 - DNA, 25 bp, Rattus norvegicus
ttacacgtctcctacttcagtggtg

SEQ ID NO: 657979 - DNA, 25 bp, Rattus norvegicus
ttacacgtgaatagtcaccagccct

SEQ ID NO: 657980 - DNA, 25 bp, Rattus norvegicus
ttacacgtgaattgtcaccagccct

SEQ ID NO: 657981 - DNA, 25 bp, Rattus norvegicus
ttacacgtgcgcatctgatggagga

SEQ ID NO: 657982 - DNA, 25 bp, Rattus norvegicus
ttacacgtgcgcttctgatggagga

SEQ ID NO: 657983 - DNA, 25 bp, Rattus norvegicus
ttacacgtttacatcggcgggcaga

SEQ ID NO: 657984 - DNA, 25 bp, Rattus norvegicus
ttacacgtttacttcggcgggcaga

SEQ ID NO: 657985 - DNA, 25 bp, Rattus norvegicus
ttacactaggtgctcaggcctctgg

SEQ ID NO: 657986 - DNA, 25 bp, Rattus norvegicus
ttacactaggtggtcaggcctctgg

SEQ ID NO: 657987 - DNA, 25 bp, Rattus norvegicus
ttacactcaggacgacagtattgtg

SEQ ID NO: 657988 - DNA, 25 bp, Rattus norvegicus
ttacactcaggaggacagtattgtg

SEQ ID NO: 657989 - DNA, 25 bp, Rattus norvegicus
ttacactcgctgctctcaataaaga

SEQ ID NO: 657990 - DNA, 25 bp, Rattus norvegicus
ttacactcgctggtctcaataaaga

SEQ ID NO: 657991 - DNA, 25 bp, Rattus norvegicus
ttacactctattatcactgcacatt

SEQ ID NO: 657992 - DNA, 25 bp, Rattus norvegicus
ttacactctattttcactgcacatt

SEQ ID NO: 657993 - DNA, 25 bp, Rattus norvegicus
ttacactgcaagcaaaggaaaccag

SEQ ID NO: 657994 - DNA, 25 bp, Rattus norvegicus
ttacactgcaaggaaaggaaaccag

SEQ ID NO: 657995 - DNA, 25 bp, Rattus norvegicus
ttacactgccacattgtccttataa

SEQ ID NO: 657996 - DNA, 25 bp, Rattus norvegicus
ttacactgccactttgtccttataa

SEQ ID NO: 657997 - DNA, 25 bp, Rattus norvegicus
ttacactgtgcacaggccttttata

SEQ ID NO: 657998 - DNA, 25 bp, Rattus norvegicus
ttacactgtgcagaggccttttata

SEQ ID NO: 657999 - DNA, 25 bp, Rattus norvegicus
ttacactgtgttccttgcctggagt

SEQ ID NO: 658000 - DNA, 25 bp, Rattus norvegicus
ttacactgtgttgcttgcctggagt

SEQ ID NO: 658001 - DNA, 25 bp, Rattus norvegicus
ttacactgttgtcactccattactg

SEQ ID NO: 658002 - DNA, 25 bp, Rattus norvegicus
ttacactgttgtgactccattactg

SEQ ID NO: 658003 - DNA, 25 bp, Rattus norvegicus
ttacacttagctactggcttccagt

SEQ ID NO: 658004 - DNA, 25 bp, Rattus norvegicus
ttacacttagcttctggcttccagt

SEQ ID NO: 658005 - DNA, 25 bp, Rattus norvegicus
ttacacttgagaacagtcatgactt

SEQ ID NO: 658006 - DNA, 25 bp, Rattus norvegicus
ttacacttgagatcagtcatgactt

SEQ ID NO: 658007 - DNA, 25 bp, Rattus norvegicus
ttacactttataagcgtagccattt

SEQ ID NO: 658008 - DNA, 25 bp, Rattus norvegicus
ttacactttatatgcgtagccattt

SEQ ID NO: 658009 - DNA, 25 bp, Rattus norvegicus
ttacagaaccatatgcagcctcaat

SEQ ID NO: 658010 - DNA, 25 bp, Rattus norvegicus
ttacagaaccatttgcagcctcaat

SEQ ID NO: 658011 - DNA, 25 bp, Rattus norvegicus
ttacagaagtagattttgttcatga

SEQ ID NO: 658012 - DNA, 25 bp, Rattus norvegicus
ttacagaagtagtttttgttcatga

SEQ ID NO: 658013 - DNA, 25 bp, Rattus norvegicus
ttacagaagttaagcatggcaccat

SEQ ID NO: 658014 - DNA, 25 bp, Rattus norvegicus
ttacagaagttatgcatggcaccat

SEQ ID NO: 658015 - DNA, 25 bp, Rattus norvegicus
ttacagacagttctcagccactatg

SEQ ID NO: 658016 - DNA, 25 bp, Rattus norvegicus
ttacagacagttgtcagccactatg

SEQ ID NO: 658017 - DNA, 25 bp, Rattus norvegicus
ttacagacatttccacaggctgctc

SEQ ID NO: 658018 - DNA, 25 bp, Rattus norvegicus
ttacagacatttgcacaggctgctc

SEQ ID NO: 658019 - DNA, 25 bp, Rattus norvegicus
ttacagacccaccagttaagacaaa

SEQ ID NO: 658020 - DNA, 25 bp, Rattus norvegicus
ttacagacccacgagttaagacaaa

SEQ ID NO: 658021 - DNA, 25 bp, Rattus norvegicus
ttacagacgattacgctttgacccc

SEQ ID NO: 658022 - DNA, 25 bp, Rattus norvegicus
ttacagacgatttcgctttgacccc

SEQ ID NO: 658023 - DNA, 25 bp, Rattus norvegicus
ttacagacgcagaaggtggccataa

SEQ ID NO: 658024 - DNA, 25 bp, Rattus norvegicus
ttacagacgcagtaggtggccataa

SEQ ID NO: 658025 - DNA, 25 bp, Rattus norvegicus
ttacagactcttccccacaaaatga

SEQ ID NO: 658026 - DNA, 25 bp, Rattus norvegicus
ttacagactcttgcccacaaaatga

SEQ ID NO: 658027 - DNA, 25 bp, Rattus norvegicus
ttacagagcagaccgtgtctcaggt

SEQ ID NO: 658028 - DNA, 25 bp, Rattus norvegicus
ttacagagcagagcgtgtctcaggt

SEQ ID NO: 658029 - DNA, 25 bp, Rattus norvegicus
ttacagagccctccctatatgttca

SEQ ID NO: 658030 - DNA, 25 bp, Rattus norvegicus
ttacagagccctgcctatatgttca

SEQ ID NO: 658031 - DNA, 25 bp, Rattus norvegicus
ttacagagcctaacgctggcgtgaa

SEQ ID NO: 658032 - DNA, 25 bp, Rattus norvegicus
ttacagagcctatcgctggcgtgaa

SEQ ID NO: 658033 - DNA, 25 bp, Rattus norvegicus
ttacagagctctaccagatgcagtc

SEQ ID NO: 658034 - DNA, 25 bp, Rattus norvegicus
ttacagagctcttccagatgcagtc

SEQ ID NO: 658035 - DNA, 25 bp, Rattus norvegicus
ttacagagctgcatggcgaagcaag

SEQ ID NO: 658036 - DNA, 25 bp, Rattus norvegicus
ttacagagctgcttggcgaagcaag

SEQ ID NO: 658037 - DNA, 25 bp, Rattus norvegicus
ttacagatagccagttcccacttgc

SEQ ID NO: 658038 - DNA, 25 bp, Rattus norvegicus
ttacagatagcctgttcccacttgc

SEQ ID NO: 658039 - DNA, 25 bp, Rattus norvegicus
ttacagatcggtcgccttggttctt

SEQ ID NO: 658040 - DNA, 25 bp, Rattus norvegicus
ttacagatcggtggccttggttctt

SEQ ID NO: 658041 - DNA, 25 bp, Rattus norvegicus
ttacagatgactacttgcagcaccc

SEQ ID NO: 658042 - DNA, 25 bp, Rattus norvegicus
ttacagatgacttcttgcagcaccc

SEQ ID NO: 658043 - DNA, 25 bp, Rattus norvegicus
ttacagatgtgtcagcatgttccct

SEQ ID NO: 658044 - DNA, 25 bp, Rattus norvegicus
ttacagatgtgtgagcatgttccct

SEQ ID NO: 658045 - DNA, 25 bp, Rattus norvegicus
ttacagcactgtacataccttctta

SEQ ID NO: 658046 - DNA, 25 bp, Rattus norvegicus
ttacagcactgttcataccttctta

SEQ ID NO: 658047 - DNA, 25 bp, Rattus norvegicus
ttacagcagacactcctgggacaca

SEQ ID NO: 658048 - DNA, 25 bp, Rattus norvegicus
ttacagcagacagtcctgggacaca

SEQ ID NO: 658049 - DNA, 25 bp, Rattus norvegicus
ttacagcagactcctcagagacaaa

SEQ ID NO: 658050 - DNA, 25 bp, Rattus norvegicus
ttacagcagactgctcagagacaaa

SEQ ID NO: 658051 - DNA, 25 bp, Rattus norvegicus
ttacagcaggctacagttcatcata

SEQ ID NO: 658052 - DNA, 25 bp, Rattus norvegicus
ttacagcaggcttcagttcatcata

SEQ ID NO: 658053 - DNA, 25 bp, Rattus norvegicus
ttacagcatcctacaatctcagtga

SEQ ID NO: 658054 - DNA, 25 bp, Rattus norvegicus
ttacagcatccttcaatctcagtga

SEQ ID NO: 658055 - DNA, 25 bp, Rattus norvegicus
ttacagcatcgccatggacaagatc

SEQ ID NO: 658056 - DNA, 25 bp, Rattus norvegicus
ttacagcatcgcgatggacaagatc

SEQ ID NO: 658057 - DNA, 25 bp, Rattus norvegicus
ttacagcatggcatcacctttctaa

SEQ ID NO: 658058 - DNA, 25 bp, Rattus norvegicus
ttacagcatggcttcacctttctaa

SEQ ID NO: 658059 - DNA, 25 bp, Rattus norvegicus
ttacagccagatacggtgatagccc

SEQ ID NO: 658060 - DNA, 25 bp, Rattus norvegicus
ttacagccagattcggtgatagccc

SEQ ID NO: 658061 - DNA, 25 bp, Rattus norvegicus
ttacagccatatccacagtttgcca

SEQ ID NO: 658062 - DNA, 25 bp, Rattus norvegicus
ttacagccatatgcacagtttgcca

SEQ ID NO: 658063 - DNA, 25 bp, Rattus norvegicus
ttacagccggtaacagaccttggaa

SEQ ID NO: 658064 - DNA, 25 bp, Rattus norvegicus
ttacagccggtatcagaccttggaa

SEQ ID NO: 658065 - DNA, 25 bp, Rattus norvegicus
ttacagcctctgagtctaaacaagc

SEQ ID NO: 658066 - DNA, 25 bp, Rattus norvegicus
ttacagcctctgtgtctaaacaagc

SEQ ID NO: 658067 - DNA, 25 bp, Rattus norvegicus
ttacagccttatcagacatccagca

SEQ ID NO: 658068 - DNA, 25 bp, Rattus norvegicus
ttacagccttatgagacatccagca

SEQ ID NO: 658069 - DNA, 25 bp, Rattus norvegicus
ttacagcgaatacctgccgacgcgc

SEQ ID NO: 658070 - DNA, 25 bp, Rattus norvegicus
ttacagcgaatagctgccgacgcgc

SEQ ID NO: 658071 - DNA, 25 bp, Rattus norvegicus
ttacagcggcagcaggtcctctgag

SEQ ID NO: 658072 - DNA, 25 bp, Rattus norvegicus
ttacagcggcaggaggtcctctgag

SEQ ID NO: 658073 - DNA, 25 bp, Rattus norvegicus
ttacagctcctgaaggtgccagcat

SEQ ID NO: 658074 - DNA, 25 bp, Rattus norvegicus
ttacagctcctgtaggtgccagcat

SEQ ID NO: 658075 - DNA, 25 bp, Rattus norvegicus
ttacagctctcactggatttgacag

SEQ ID NO: 658076 - DNA, 25 bp, Rattus norvegicus
ttacagctctcagtggatttgacag

SEQ ID NO: 658077 - DNA, 25 bp, Rattus norvegicus
ttacagctgagacaggaccgccggc

SEQ ID NO: 658078 - DNA, 25 bp, Rattus norvegicus
ttacagctgagagaggaccgccggc

SEQ ID NO: 658079 - DNA, 25 bp, Rattus norvegicus
ttacagctgcaaatggcattaccat

SEQ ID NO: 658080 - DNA, 25 bp, Rattus norvegicus
ttacagctgcaattggcattaccat

SEQ ID NO: 658081 - DNA, 25 bp, Rattus norvegicus
ttacagcttcctacaggctcagaat

SEQ ID NO: 658082 - DNA, 25 bp, Rattus norvegicus
ttacagcttccttcaggctcagaat

SEQ ID NO: 658083 - DNA, 25 bp, Rattus norvegicus
ttacagcttctaaagactcattagt

SEQ ID NO: 658084 - DNA, 25 bp, Rattus norvegicus
ttacagcttctatagactcattagt

SEQ ID NO: 658085 - DNA, 25 bp, Rattus norvegicus
ttacaggaaccgcagcaccatatcc

SEQ ID NO: 658086 - DNA, 25 bp, Rattus norvegicus
ttacaggaaccggagcaccatatcc

SEQ ID NO: 658087 - DNA, 25 bp, Rattus norvegicus
ttacaggaatcacatttgggcgcgt

SEQ ID NO: 658088 - DNA, 25 bp, Rattus norvegicus
ttacaggaatcagatttgggcgcgt

SEQ ID NO: 658089 - DNA, 25 bp, Rattus norvegicus
ttacaggaatttcacacggctgatt

SEQ ID NO: 658090 - DNA, 25 bp, Rattus norvegicus
ttacaggaatttgacacggctgatt

SEQ ID NO: 658091 - DNA, 25 bp, Rattus norvegicus
ttacaggacccaatgctggcaaaac

SEQ ID NO: 658092 - DNA, 25 bp, Rattus norvegicus
ttacaggacccattgctggcaaaac

SEQ ID NO: 658093 - DNA, 25 bp, Rattus norvegicus
ttacaggacttgactcgctttggag

SEQ ID NO: 658094 - DNA, 25 bp, Rattus norvegicus
ttacaggacttgtctcgctttggag

SEQ ID NO: 658095 - DNA, 25 bp, Rattus norvegicus
ttacaggatcaaatgctcacccaaa

SEQ ID NO: 658096 - DNA, 25 bp, Rattus norvegicus
ttacaggatcaattgctcacccaaa

SEQ ID NO: 658097 - DNA, 25 bp, Rattus norvegicus
ttacaggattctcgtggacacacca

SEQ ID NO: 658098 - DNA, 25 bp, Rattus norvegicus
ttacaggattctggtggacacacca

SEQ ID NO: 658099 - DNA, 25 bp, Rattus norvegicus
ttacaggcaaccacagtggctgctt

SEQ ID NO: 658100 - DNA, 25 bp, Rattus norvegicus
ttacaggcaacctcagtggctgctt

SEQ ID NO: 658101 - DNA, 25 bp, Rattus norvegicus
ttacaggcacttctgagctgcattg

SEQ ID NO: 658102 - DNA, 25 bp, Rattus norvegicus
ttacaggcacttgtgagctgcattg

SEQ ID NO: 658103 - DNA, 25 bp, Rattus norvegicus
ttacaggcatgacaccccaggtttg

SEQ ID NO: 658104 - DNA, 25 bp, Rattus norvegicus
ttacaggcatgagaccccaggtttg

SEQ ID NO: 658105 - DNA, 25 bp, Rattus norvegicus
ttacaggccacccttgtggttggca

SEQ ID NO: 658106 - DNA, 25 bp, Rattus norvegicus
ttacaggccaccgttgtggttggca

SEQ ID NO: 658107 - DNA, 25 bp, Rattus norvegicus
ttacaggctaaacttctctttccca

SEQ ID NO: 658108 - DNA, 25 bp, Rattus norvegicus
ttacaggctaaagttctctttccca

SEQ ID NO: 658109 - DNA, 25 bp, Rattus norvegicus
ttacaggctgcccagaattcgggaa

SEQ ID NO: 658110 - DNA, 25 bp, Rattus norvegicus
ttacaggctgccgagaattcgggaa

SEQ ID NO: 658111 - DNA, 25 bp, Rattus norvegicus
ttacagggaagaccatcacgctcga

SEQ ID NO: 658112 - DNA, 25 bp, Rattus norvegicus
ttacagggaagagcatcacgctcga

SEQ ID NO: 658113 - DNA, 25 bp, Rattus norvegicus
ttacagggtcaacagcaagtgcatt

SEQ ID NO: 658114 - DNA, 25 bp, Rattus norvegicus
ttacagggtcaagagcaagtgcatt

SEQ ID NO: 658115 - DNA, 25 bp, Rattus norvegicus
ttacaggtacaacagaagtcttcat

SEQ ID NO: 658116 - DNA, 25 bp, Rattus norvegicus
ttacaggtacaagagaagtcttcat

SEQ ID NO: 658117 - DNA, 25 bp, Rattus norvegicus
ttacaggtcacacgacattctggtg

SEQ ID NO: 658118 - DNA, 25 bp, Rattus norvegicus
ttacaggtcacaggacattctggtg

SEQ ID NO: 658119 - DNA, 25 bp, Rattus norvegicus
ttacaggtcaggcaatgaagagtcc

SEQ ID NO: 658120 - DNA, 25 bp, Rattus norvegicus
ttacaggtcaggctctcaacaggca

SEQ ID NO: 658121 - DNA, 25 bp, Rattus norvegicus
ttacaggtcagggaatgaagagtcc

SEQ ID NO: 658122 - DNA, 25 bp, Rattus norvegicus
ttacaggtcagggtctcaacaggca

SEQ ID NO: 658123 - DNA, 25 bp, Rattus norvegicus
ttacaggtcatgctggttgctgcca

SEQ ID NO: 658124 - DNA, 25 bp, Rattus norvegicus
ttacaggtcatggtggttgctgcca

SEQ ID NO: 658125 - DNA, 25 bp, Rattus norvegicus
ttacaggtccagctaacttcccagt

SEQ ID NO: 658126 - DNA, 25 bp, Rattus norvegicus
ttacaggtccaggtaacttcccagt

SEQ ID NO: 658127 - DNA, 25 bp, Rattus norvegicus
ttacaggtctcaagtcttctctgca

SEQ ID NO: 658128 - DNA, 25 bp, Rattus norvegicus
ttacaggtctcatgtcttctctgca

SEQ ID NO: 658129 - DNA, 25 bp, Rattus norvegicus
ttacaggtgtgtcccacgacgtcta

SEQ ID NO: 658130 - DNA, 25 bp, Rattus norvegicus
ttacaggtgtgtgccacgacgtcta

SEQ ID NO: 658131 - DNA, 25 bp, Rattus norvegicus
ttacagtaaacaagccccagctctt

SEQ ID NO: 658132 - DNA, 25 bp, Rattus norvegicus
ttacagtaaacatgccccagctctt

SEQ ID NO: 658133 - DNA, 25 bp, Rattus norvegicus
ttacagtacccaccgggcatgctgg

SEQ ID NO: 658134 - DNA, 25 bp, Rattus norvegicus
ttacagtacccagcgggcatgctgg

SEQ ID NO: 658135 - DNA, 25 bp, Rattus norvegicus
ttacagtaccttccgcacatacctg

SEQ ID NO: 658136 - DNA, 25 bp, Rattus norvegicus
ttacagtaccttgcgcacatacctg

SEQ ID NO: 658137 - DNA, 25 bp, Rattus norvegicus
ttacagtacttcacattttcaaatg

SEQ ID NO: 658138 - DNA, 25 bp, Rattus norvegicus
ttacagtacttctcattttcaaatg

SEQ ID NO: 658139 - DNA, 25 bp, Rattus norvegicus
ttacagtagaaaacttcctcgtccg

SEQ ID NO: 658140 - DNA, 25 bp, Rattus norvegicus
ttacagtagaaatcttcctcgtccg

SEQ ID NO: 658141 - DNA, 25 bp, Rattus norvegicus
ttacagtagcttcccagtgctgcat

SEQ ID NO: 658142 - DNA, 25 bp, Rattus norvegicus
ttacagtagcttgccagtgctgcat

SEQ ID NO: 658143 - DNA, 25 bp, Rattus norvegicus
ttacagtcaaacacagtgacatggt

SEQ ID NO: 658144 - DNA, 25 bp, Rattus norvegicus
ttacagtcaaactcagtgacatggt

SEQ ID NO: 658145 - DNA, 25 bp, Rattus norvegicus
ttacagtcagaaaagccacgaggct

SEQ ID NO: 658146 - DNA, 25 bp, Rattus norvegicus
ttacagtcagaatagccacgaggct

SEQ ID NO: 658147 - DNA, 25 bp, Rattus norvegicus
ttacagtcatcaacattcctttctc

SEQ ID NO: 658148 - DNA, 25 bp, Rattus norvegicus
ttacagtcatcaccatagctctgca

SEQ ID NO: 658149 - DNA, 25 bp, Rattus norvegicus
ttacagtcatcagcatagctctgca

SEQ ID NO: 658150 - DNA, 25 bp, Rattus norvegicus
ttacagtcatcatcattcctttctc

SEQ ID NO: 658151 - DNA, 25 bp, Rattus norvegicus
ttacagtccgtaacagtagctaaat

SEQ ID NO: 658152 - DNA, 25 bp, Rattus norvegicus
ttacagtccgtatcagtagctaaat

SEQ ID NO: 658153 - DNA, 25 bp, Rattus norvegicus
ttacagtcctgtaccatgaatcttg

SEQ ID NO: 658154 - DNA, 25 bp, Rattus norvegicus
ttacagtcctgttccatgaatcttg

SEQ ID NO: 658155 - DNA, 25 bp, Rattus norvegicus
ttacagtctagccttttcagtccag

SEQ ID NO: 658156 - DNA, 25 bp, Rattus norvegicus
ttacagtctagcgttttcagtccag

SEQ ID NO: 658157 - DNA, 25 bp, Rattus norvegicus
ttacagtgaaataccggcctttgcc

SEQ ID NO: 658158 - DNA, 25 bp, Rattus norvegicus
ttacagtgaaattccggcctttgcc

SEQ ID NO: 658159 - DNA, 25 bp, Rattus norvegicus
ttacagtgcatcagattcgttggct

SEQ ID NO: 658160 - DNA, 25 bp, Rattus norvegicus
ttacagtgcatctgattcgttggct

SEQ ID NO: 658161 - DNA, 25 bp, Rattus norvegicus
ttacagtgccatctgtgcttgcaga

SEQ ID NO: 658162 - DNA, 25 bp, Rattus norvegicus
ttacagtgccatgtgtgcttgcaga

SEQ ID NO: 658163 - DNA, 25 bp, Rattus norvegicus
ttacagtggctgcttgtgtcctatg

SEQ ID NO: 658164 - DNA, 25 bp, Rattus norvegicus
ttacagtggctggttgtgtcctatg

SEQ ID NO: 658165 - DNA, 25 bp, Rattus norvegicus
ttacagtgtcaacctaagcctggcc

SEQ ID NO: 658166 - DNA, 25 bp, Rattus norvegicus
ttacagtgtcaagctaagcctggcc

SEQ ID NO: 658167 - DNA, 25 bp, Rattus norvegicus
ttacagttcaggcttgttccacgca

SEQ ID NO: 658168 - DNA, 25 bp, Rattus norvegicus
ttacagttcagggttgttccacgca

SEQ ID NO: 658169 - DNA, 25 bp, Rattus norvegicus
ttacagttcctgaggcagtcggtga

SEQ ID NO: 658170 - DNA, 25 bp, Rattus norvegicus
ttacagttcctgtggcagtcggtga

SEQ ID NO: 658171 - DNA, 25 bp, Rattus norvegicus
ttacagttctgcctgcccaatattc

SEQ ID NO: 658172 - DNA, 25 bp, Rattus norvegicus
ttacagttctgcgtgcccaatattc

SEQ ID NO: 658173 - DNA, 25 bp, Rattus norvegicus
ttacagttgacaccccgagtccatg

SEQ ID NO: 658174 - DNA, 25 bp, Rattus norvegicus
ttacagttgacagcccgagtccatg

SEQ ID NO: 658175 - DNA, 25 bp, Rattus norvegicus
ttacagttgcctatggccttacctg

SEQ ID NO: 658176 - DNA, 25 bp, Rattus norvegicus
ttacagttgcctttggccttacctg

SEQ ID NO: 658177 - DNA, 25 bp, Rattus norvegicus
ttacagttgctgctcaatttcccag

SEQ ID NO: 658178 - DNA, 25 bp, Rattus norvegicus
ttacagttgctggtcaatttcccag

SEQ ID NO: 658179 - DNA, 25 bp, Rattus norvegicus
ttacagttgtgaacctaacccaggg

SEQ ID NO: 658180 - DNA, 25 bp, Rattus norvegicus
ttacagttgtgatcctaacccaggg

SEQ ID NO: 658181 - DNA, 25 bp, Rattus norvegicus
ttacagtttgctcccacaataaaat

SEQ ID NO: 658182 - DNA, 25 bp, Rattus norvegicus
ttacagtttgctgccacaataaaat

SEQ ID NO: 658183 - DNA, 25 bp, Rattus norvegicus
ttacagttttgcagccacgtgacgg

SEQ ID NO: 658184 - DNA, 25 bp, Rattus norvegicus
ttacagttttgctgccacgtgacgg

SEQ ID NO: 658185 - DNA, 25 bp, Rattus norvegicus
ttacataaggccacggtcatcactc

SEQ ID NO: 658186 - DNA, 25 bp, Rattus norvegicus
ttacataaggcctcggtcatcactc

SEQ ID NO: 658187 - DNA, 25 bp, Rattus norvegicus
ttacataccctaacagtcaggccct

SEQ ID NO: 658188 - DNA, 25 bp, Rattus norvegicus
ttacataccctatcagtcaggccct

SEQ ID NO: 658189 - DNA, 25 bp, Rattus norvegicus
ttacatacccttagggcctaccagg

SEQ ID NO: 658190 - DNA, 25 bp, Rattus norvegicus
ttacataccctttgggcctaccagg

SEQ ID NO: 658191 - DNA, 25 bp, Rattus norvegicus
ttacatacctcaacgctagtcagtg

SEQ ID NO: 658192 - DNA, 25 bp, Rattus norvegicus
ttacatacctcatcgctagtcagtg

SEQ ID NO: 658193 - DNA, 25 bp, Rattus norvegicus
ttacatacgattcgcctgttaaggc

SEQ ID NO: 658194 - DNA, 25 bp, Rattus norvegicus
ttacatacgattggcctgttaaggc

SEQ ID NO: 658195 - DNA, 25 bp, Rattus norvegicus
ttacatactcaaactggtcagccct

SEQ ID NO: 658196 - DNA, 25 bp, Rattus norvegicus
ttacatactcaatctggtcagccct

SEQ ID NO: 658197 - DNA, 25 bp, Rattus norvegicus
ttacatactgctaccacaaatgctt

SEQ ID NO: 658198 - DNA, 25 bp, Rattus norvegicus
ttacatactgcttccacaaatgctt

SEQ ID NO: 658199 - DNA, 25 bp, Rattus norvegicus
ttacatagaaccagggaccagggca

SEQ ID NO: 658200 - DNA, 25 bp, Rattus norvegicus
ttacatagaacctgggaccagggca

SEQ ID NO: 658201 - DNA, 25 bp, Rattus norvegicus
ttacataggacactaagctcccctg

SEQ ID NO: 658202 - DNA, 25 bp, Rattus norvegicus
ttacataggacagtaagctcccctg

SEQ ID NO: 658203 - DNA, 25 bp, Rattus norvegicus
ttacataggcccagatattaagtat

SEQ ID NO: 658204 - DNA, 25 bp, Rattus norvegicus
ttacataggccctgatattaagtat

SEQ ID NO: 658205 - DNA, 25 bp, Rattus norvegicus
ttacataggcctagtgggtgcatct

SEQ ID NO: 658206 - DNA, 25 bp, Rattus norvegicus
ttacataggccttgtgggtgcatct

SEQ ID NO: 658207 - DNA, 25 bp, Rattus norvegicus
ttacatatacatcatggccgccatc

SEQ ID NO: 658208 - DNA, 25 bp, Rattus norvegicus
ttacatatacatgatggccgccatc

SEQ ID NO: 658209 - DNA, 25 bp, Rattus norvegicus
ttacatatcacgaacatcccacagt

SEQ ID NO: 658210 - DNA, 25 bp, Rattus norvegicus
ttacatatcacgtacatcccacagt

SEQ ID NO: 658211 - DNA, 25 bp, Rattus norvegicus
ttacatatgcacaaaccaacttcta

SEQ ID NO: 658212 - DNA, 25 bp, Rattus norvegicus
ttacatatgcactaaccaacttcta

SEQ ID NO: 658213 - DNA, 25 bp, Rattus norvegicus
ttacatcatagtcggagctgtctgt

SEQ ID NO: 658214 - DNA, 25 bp, Rattus norvegicus
ttacatcatagtgggagctgtctgt

SEQ ID NO: 658215 - DNA, 25 bp, Rattus norvegicus
ttacatccagagctggtctccgttg

SEQ ID NO: 658216 - DNA, 25 bp, Rattus norvegicus
ttacatccagaggtggtctccgttg

SEQ ID NO: 658217 - DNA, 25 bp, Rattus norvegicus
ttacatccaggtactctgacaggaa

SEQ ID NO: 658218 - DNA, 25 bp, Rattus norvegicus
ttacatccaggttctctgacaggaa

SEQ ID NO: 658219 - DNA, 25 bp, Rattus norvegicus
ttacatcccagccacttttatttat

SEQ ID NO: 658220 - DNA, 25 bp, Rattus norvegicus
ttacatcccagcgacttttatttat

SEQ ID NO: 658221 - DNA, 25 bp, Rattus norvegicus
ttacatccccttcagtgcttatggt

SEQ ID NO: 658222 - DNA, 25 bp, Rattus norvegicus
ttacatccccttgagtgcttatggt

SEQ ID NO: 658223 - DNA, 25 bp, Rattus norvegicus
ttacatccctgtacctgtagactta

SEQ ID NO: 658224 - DNA, 25 bp, Rattus norvegicus
ttacatccctgttcctgtagactta

SEQ ID NO: 658225 - DNA, 25 bp, Rattus norvegicus
ttacatcgcacccattggctaagga

SEQ ID NO: 658226 - DNA, 25 bp, Rattus norvegicus
ttacatcgcaccgattggctaagga

SEQ ID NO: 658227 - DNA, 25 bp, Rattus norvegicus
ttacatcgccgtcgtccgttgtgag

SEQ ID NO: 658228 - DNA, 25 bp, Rattus norvegicus
ttacatcgccgtggtccgttgtgag

SEQ ID NO: 658229 - DNA, 25 bp, Rattus norvegicus
ttacatctagcaacaagtccacttg

SEQ ID NO: 658230 - DNA, 25 bp, Rattus norvegicus
ttacatctagcatcaagtccacttg

SEQ ID NO: 658231 - DNA, 25 bp, Rattus norvegicus
ttacatctccccagatcaggttctt

SEQ ID NO: 658232 - DNA, 25 bp, Rattus norvegicus
ttacatctcccctgatcaggttctt

SEQ ID NO: 658233 - DNA, 25 bp, Rattus norvegicus
ttacatctcttaaagactggcatgg

SEQ ID NO: 658234 - DNA, 25 bp, Rattus norvegicus
ttacatctcttatagactggcatgg

SEQ ID NO: 658235 - DNA, 25 bp, Rattus norvegicus
ttacatgattaaacccctaccaggg

SEQ ID NO: 658236 - DNA, 25 bp, Rattus norvegicus
ttacatgattaatcccctaccaggg

SEQ ID NO: 658237 - DNA, 25 bp, Rattus norvegicus
ttacatgcaccaaggaccctcttga

SEQ ID NO: 658238 - DNA, 25 bp, Rattus norvegicus
ttacatgcaccatggaccctcttga

SEQ ID NO: 658239 - DNA, 25 bp, Rattus norvegicus
ttacatgccacacgtatgcagatcc

SEQ ID NO: 658240 - DNA, 25 bp, Rattus norvegicus
ttacatgccacaggtatgcagatcc

SEQ ID NO: 658241 - DNA, 25 bp, Rattus norvegicus
ttacatgccatgagggccttgccaa

SEQ ID NO: 658242 - DNA, 25 bp, Rattus norvegicus
ttacatgccatgtgggccttgccaa

SEQ ID NO: 658243 - DNA, 25 bp, Rattus norvegicus
ttacatgctcatactgcttctctgt

SEQ ID NO: 658244 - DNA, 25 bp, Rattus norvegicus
ttacatgctcattctgcttctctgt

SEQ ID NO: 658245 - DNA, 25 bp, Rattus norvegicus
ttacatgctttcagtggagtgcccc

SEQ ID NO: 658246 - DNA, 25 bp, Rattus norvegicus
ttacatgctttctgtggagtgcccc

SEQ ID NO: 658247 - DNA, 25 bp, Rattus norvegicus
ttacatggacttcggtcccggtgca

SEQ ID NO: 658248 - DNA, 25 bp, Rattus norvegicus
ttacatggacttgggtcccggtgca

SEQ ID NO: 658249 - DNA, 25 bp, Rattus norvegicus
ttacatggcaggaatatgtcatctc

SEQ ID NO: 658250 - DNA, 25 bp, Rattus norvegicus
ttacatggcaggtatatgtcatctc

SEQ ID NO: 658251 - DNA, 25 bp, Rattus norvegicus
ttacatggcatcaggcaggctttcc

SEQ ID NO: 658252 - DNA, 25 bp, Rattus norvegicus
ttacatggcatctggcaggctttcc

SEQ ID NO: 658253 - DNA, 25 bp, Rattus norvegicus
ttacatggctatcttctcctttttc

SEQ ID NO: 658254 - DNA, 25 bp, Rattus norvegicus
ttacatggctatgttctcctttttc

SEQ ID NO: 658255 - DNA, 25 bp, Rattus norvegicus
ttacatggcttcatctacctccagg

SEQ ID NO: 658256 - DNA, 25 bp, Rattus norvegicus
ttacatggcttccacttacctaaga

SEQ ID NO: 658257 - DNA, 25 bp, Rattus norvegicus
ttacatggcttcgacttacctaaga

SEQ ID NO: 658258 - DNA, 25 bp, Rattus norvegicus
ttacatggcttcttctacctccagg

SEQ ID NO: 658259 - DNA, 25 bp, Rattus norvegicus
ttacatgggatgctcacacagccgg

SEQ ID NO: 658260 - DNA, 25 bp, Rattus norvegicus
ttacatgggatggtcacacagccgg

SEQ ID NO: 658261 - DNA, 25 bp, Rattus norvegicus
ttacatggtgtcagcccggcatttt

SEQ ID NO: 658262 - DNA, 25 bp, Rattus norvegicus
ttacatggtgtctgcccggcatttt

SEQ ID NO: 658263 - DNA, 25 bp, Rattus norvegicus
ttacatgtatatattgatatgtggc

SEQ ID NO: 658264 - DNA, 25 bp, Rattus norvegicus
ttacatgtatattttgatatgtggc

SEQ ID NO: 658265 - DNA, 25 bp, Rattus norvegicus
ttacatgtatgaaccacgcccttaa

SEQ ID NO: 658266 - DNA, 25 bp, Rattus norvegicus
ttacatgtatgatccacgcccttaa

SEQ ID NO: 658267 - DNA, 25 bp, Rattus norvegicus
ttacatgtcctgatgccctgtgatt

SEQ ID NO: 658268 - DNA, 25 bp, Rattus norvegicus
ttacatgtcctgttgccctgtgatt

SEQ ID NO: 658269 - DNA, 25 bp, Rattus norvegicus
ttacatgtgtcaatctcaagcttct

SEQ ID NO: 658270 - DNA, 25 bp, Rattus norvegicus
ttacatgtgtcattctcaagcttct

SEQ ID NO: 658271 - DNA, 25 bp, Rattus norvegicus
ttacatgttagaagcggccagctca

SEQ ID NO: 658272 - DNA, 25 bp, Rattus norvegicus
ttacatgttagatgcggccagctca

SEQ ID NO: 658273 - DNA, 25 bp, Rattus norvegicus
ttacatgttcagaggccacaccgtt

SEQ ID NO: 658274 - DNA, 25 bp, Rattus norvegicus
ttacatgttcagtggccacaccgtt

SEQ ID NO: 658275 - DNA, 25 bp, Rattus norvegicus
ttacattaaggtccaattgattgcc

SEQ ID NO: 658276 - DNA, 25 bp, Rattus norvegicus
ttacattaaggtgcaattgattgcc

SEQ ID NO: 658277 - DNA, 25 bp, Rattus norvegicus
ttacattagctcagtcaccatctgg

SEQ ID NO: 658278 - DNA, 25 bp, Rattus norvegicus
ttacattagctctgtcaccatctgg

SEQ ID NO: 658279 - DNA, 25 bp, Rattus norvegicus
ttacattatagtatgggctccagcc

SEQ ID NO: 658280 - DNA, 25 bp, Rattus norvegicus
ttacattatagtttgggctccagcc

SEQ ID NO: 658281 - DNA, 25 bp, Rattus norvegicus
ttacattccagtactggctgggcag

SEQ ID NO: 658282 - DNA, 25 bp, Rattus norvegicus
ttacattccagttctggctgggcag

SEQ ID NO: 658283 - DNA, 25 bp, Rattus norvegicus
ttacattccatccacagtgccaaga

SEQ ID NO: 658284 - DNA, 25 bp, Rattus norvegicus
ttacattccatcgacagtgccaaga

SEQ ID NO: 658285 - DNA, 25 bp, Rattus norvegicus
ttacattctcagctgtctcctaaag

SEQ ID NO: 658286 - DNA, 25 bp, Rattus norvegicus
ttacattctcaggtgtctcctaaag

SEQ ID NO: 658287 - DNA, 25 bp, Rattus norvegicus
ttacattgagcacgtgctgctgcac

SEQ ID NO: 658288 - DNA, 25 bp, Rattus norvegicus
ttacattgagcaggtgctgctgcac

SEQ ID NO: 658289 - DNA, 25 bp, Rattus norvegicus
ttacattgccccacaacgcatttta

SEQ ID NO: 658290 - DNA, 25 bp, Rattus norvegicus
ttacattgcccctcaacgcatttta

SEQ ID NO: 658291 - DNA, 25 bp, Rattus norvegicus
ttacattgcttaaatcagatcactt

SEQ ID NO: 658292 - DNA, 25 bp, Rattus norvegicus
ttacattgcttatatcagatcactt

SEQ ID NO: 658293 - DNA, 25 bp, Rattus norvegicus
ttacattgctttacctggcagcctc

SEQ ID NO: 658294 - DNA, 25 bp, Rattus norvegicus
ttacattgcttttcctggcagcctc

SEQ ID NO: 658295 - DNA, 25 bp, Rattus norvegicus
ttacattggtccagtacactgcttc

SEQ ID NO: 658296 - DNA, 25 bp, Rattus norvegicus
ttacattggtcctgtacactgcttc

SEQ ID NO: 658297 - DNA, 25 bp, Rattus norvegicus
ttacattggttcagtcttcacactt

SEQ ID NO: 658298 - DNA, 25 bp, Rattus norvegicus
ttacattggttctgtcttcacactt

SEQ ID NO: 658299 - DNA, 25 bp, Rattus norvegicus
ttacatttcaaacgctgtctcgcac

SEQ ID NO: 658300 - DNA, 25 bp, Rattus norvegicus
ttacatttcaaaggctgtctcgcac

SEQ ID NO: 658301 - DNA, 25 bp, Rattus norvegicus
ttacatttctgtcctagtgtctcct

SEQ ID NO: 658302 - DNA, 25 bp, Rattus norvegicus
ttacatttctgtgctagtgtctcct

SEQ ID NO: 658303 - DNA, 25 bp, Rattus norvegicus
ttacattttgtacttcctctttggg

SEQ ID NO: 658304 - DNA, 25 bp, Rattus norvegicus
ttacattttgtagttcctctttggg

SEQ ID NO: 658305 - DNA, 25 bp, Rattus norvegicus
ttaccaaaacatattcacggccatg

SEQ ID NO: 658306 - DNA, 25 bp, Rattus norvegicus
ttaccaaaacattttcacggccatg

SEQ ID NO: 658307 - DNA, 25 bp, Rattus norvegicus
ttaccaaaacctacgtgacatcctt

SEQ ID NO: 658308 - DNA, 25 bp, Rattus norvegicus
ttaccaaaaccttcgtgacatcctt

SEQ ID NO: 658309 - DNA, 25 bp, Rattus norvegicus
ttaccaaaatcactcttcagccctt

SEQ ID NO: 658310 - DNA, 25 bp, Rattus norvegicus
ttaccaaaatcagtcttcagccctt

SEQ ID NO: 658311 - DNA, 25 bp, Rattus norvegicus
ttaccaaacggtcctggccagagca

SEQ ID NO: 658312 - DNA, 25 bp, Rattus norvegicus
ttaccaaacggtgctggccagagca

SEQ ID NO: 658313 - DNA, 25 bp, Rattus norvegicus
ttaccaaagattacccatagtttga

SEQ ID NO: 658314 - DNA, 25 bp, Rattus norvegicus
ttaccaaagatttcccatagtttga

SEQ ID NO: 658315 - DNA, 25 bp, Rattus norvegicus
ttaccaaatcaaccatcgtctcaga

SEQ ID NO: 658316 - DNA, 25 bp, Rattus norvegicus
ttaccaaatcaagcatcgtctcaga

SEQ ID NO: 658317 - DNA, 25 bp, Rattus norvegicus
ttaccaacctgacatcaccgaatgt

SEQ ID NO: 658318 - DNA, 25 bp, Rattus norvegicus
ttaccaacctgagatcaccgaatgt

SEQ ID NO: 658319 - DNA, 25 bp, Rattus norvegicus
ttaccaaccttcctgtgggactgga

SEQ ID NO: 658320 - DNA, 25 bp, Rattus norvegicus
ttaccaaccttcgtgtgggactgga

SEQ ID NO: 658321 - DNA, 25 bp, Rattus norvegicus
ttaccaactcatagactgtgctctg

SEQ ID NO: 658322 - DNA, 25 bp, Rattus norvegicus
ttaccaactcattgactgtgctctg

SEQ ID NO: 658323 - DNA, 25 bp, Rattus norvegicus
ttaccaactctcacctgtgtgtcag

SEQ ID NO: 658324 - DNA, 25 bp, Rattus norvegicus
ttaccaactctctcctgtgtgtcag

SEQ ID NO: 658325 - DNA, 25 bp, Rattus norvegicus
ttaccaacttcaatttcctgaggcg

SEQ ID NO: 658326 - DNA, 25 bp, Rattus norvegicus
ttaccaacttcattttcctgaggcg

SEQ ID NO: 658327 - DNA, 25 bp, Rattus norvegicus
ttaccaagccctcactgtacagaaa

SEQ ID NO: 658328 - DNA, 25 bp, Rattus norvegicus
ttaccaagccctgactgtacagaaa

SEQ ID NO: 658329 - DNA, 25 bp, Rattus norvegicus
ttaccaagctggagagtgcactgcg

SEQ ID NO: 658330 - DNA, 25 bp, Rattus norvegicus
ttaccaagctggtgagtgcactgcg

SEQ ID NO: 658331 - DNA, 25 bp, Rattus norvegicus
ttaccaaggaccacagacgccagca

SEQ ID NO: 658332 - DNA, 25 bp, Rattus norvegicus
ttaccaaggacctcagacgccagca

SEQ ID NO: 658333 - DNA, 25 bp, Rattus norvegicus
ttaccaagttctattacgccatctc

SEQ ID NO: 658334 - DNA, 25 bp, Rattus norvegicus
ttaccaagttcttttacgccatctc

SEQ ID NO: 658335 - DNA, 25 bp, Rattus norvegicus
ttaccaatcataacctcgcaaggag

SEQ ID NO: 658336 - DNA, 25 bp, Rattus norvegicus
ttaccaatcatatcctcgcaaggag

SEQ ID NO: 658337 - DNA, 25 bp, Rattus norvegicus
ttaccaatcctgaagtggtcatcaa

SEQ ID NO: 658338 - DNA, 25 bp, Rattus norvegicus
ttaccaatcctgtagtggtcatcaa

SEQ ID NO: 658339 - DNA, 25 bp, Rattus norvegicus
ttaccaatctcccagggcccagaga

SEQ ID NO: 658340 - DNA, 25 bp, Rattus norvegicus
ttaccaatctccgagggcccagaga

SEQ ID NO: 658341 - DNA, 25 bp, Rattus norvegicus
ttaccaatgactagctgggtgattc

SEQ ID NO: 658342 - DNA, 25 bp, Rattus norvegicus
ttaccaatgacttgctgggtgattc

SEQ ID NO: 658343 - DNA, 25 bp, Rattus norvegicus
ttaccaatggatctgctgacagccc

SEQ ID NO: 658344 - DNA, 25 bp, Rattus norvegicus
ttaccaatggatgtgctgacagccc

SEQ ID NO: 658345 - DNA, 25 bp, Rattus norvegicus
ttaccaatgttacgaatcttcatga

SEQ ID NO: 658346 - DNA, 25 bp, Rattus norvegicus
ttaccaatgttaggaatcttcatga

SEQ ID NO: 658347 - DNA, 25 bp, Rattus norvegicus
ttaccaattcggatgctctgggcta

SEQ ID NO: 658348 - DNA, 25 bp, Rattus norvegicus
ttaccaattcggttgctctgggcta

SEQ ID NO: 658349 - DNA, 25 bp, Rattus norvegicus
ttaccacaactgctgactctggctg

SEQ ID NO: 658350 - DNA, 25 bp, Rattus norvegicus
ttaccacaactggtgactctggctg

SEQ ID NO: 658351 - DNA, 25 bp, Rattus norvegicus
ttaccacatattagagtcatatagc

SEQ ID NO: 658352 - DNA, 25 bp, Rattus norvegicus
ttaccacatatttgagtcatatagc

SEQ ID NO: 658353 - DNA, 25 bp, Rattus norvegicus
ttaccacattgcctgcctgagacaa

SEQ ID NO: 658354 - DNA, 25 bp, Rattus norvegicus
ttaccacattgcgtgcctgagacaa

SEQ ID NO: 658355 - DNA, 25 bp, Rattus norvegicus
ttaccaccagcacaagtgcccttaa

SEQ ID NO: 658356 - DNA, 25 bp, Rattus norvegicus
ttaccaccagcagaagtgcccttaa

SEQ ID NO: 658357 - DNA, 25 bp, Rattus norvegicus
ttaccaccatggatacccttactga

SEQ ID NO: 658358 - DNA, 25 bp, Rattus norvegicus
ttaccaccatggttacccttactga

SEQ ID NO: 658359 - DNA, 25 bp, Rattus norvegicus
ttaccacccggcatctggagaagat

SEQ ID NO: 658360 - DNA, 25 bp, Rattus norvegicus
ttaccacccggcttctggagaagat

SEQ ID NO: 658361 - DNA, 25 bp, Rattus norvegicus
ttaccacctattatagccgtcgagc

SEQ ID NO: 658362 - DNA, 25 bp, Rattus norvegicus
ttaccacctattttagccgtcgagc

SEQ ID NO: 658363 - DNA, 25 bp, Rattus norvegicus
ttaccacgagtgactgggcatgcta

SEQ ID NO: 658364 - DNA, 25 bp, Rattus norvegicus
ttaccacgagtgtctgggcatgcta

SEQ ID NO: 658365 - DNA, 25 bp, Rattus norvegicus
ttaccactcagcagcttgacaagca

SEQ ID NO: 658366 - DNA, 25 bp, Rattus norvegicus
ttaccactcagctgcttgacaagca

SEQ ID NO: 658367 - DNA, 25 bp, Rattus norvegicus
ttaccactggccacaagactctttt

SEQ ID NO: 658368 - DNA, 25 bp, Rattus norvegicus
ttaccactggcctcaagactctttt

SEQ ID NO: 658369 - DNA, 25 bp, Rattus norvegicus
ttaccactgtttccttttccaggga

SEQ ID NO: 658370 - DNA, 25 bp, Rattus norvegicus
ttaccactgtttgcttttccaggga

SEQ ID NO: 658371 - DNA, 25 bp, Rattus norvegicus
ttaccacttagcagtgtgctgggcg

SEQ ID NO: 658372 - DNA, 25 bp, Rattus norvegicus
ttaccacttagctgtgtgctgggcg

SEQ ID NO: 658373 - DNA, 25 bp, Rattus norvegicus
ttaccacttcatcctttatcttctg

SEQ ID NO: 658374 - DNA, 25 bp, Rattus norvegicus
ttaccacttcatgctttatcttctg

SEQ ID NO: 658375 - DNA, 25 bp, Rattus norvegicus
ttaccacttggccaatgtgtccact

SEQ ID NO: 658376 - DNA, 25 bp, Rattus norvegicus
ttaccacttggcgaatgtgtccact

SEQ ID NO: 658377 - DNA, 25 bp, Rattus norvegicus
ttaccacttggtagatgccgttaaa

SEQ ID NO: 658378 - DNA, 25 bp, Rattus norvegicus
ttaccacttggttgatgccgttaaa

SEQ ID NO: 658379 - DNA, 25 bp, Rattus norvegicus
ttaccactttggacagttgctccca

SEQ ID NO: 658380 - DNA, 25 bp, Rattus norvegicus
ttaccactttggtcagttgctccca

SEQ ID NO: 658381 - DNA, 25 bp, Rattus norvegicus
ttaccagaacttcatcaccagagag

SEQ ID NO: 658382 - DNA, 25 bp, Rattus norvegicus
ttaccagaacttgatcaccagagag

SEQ ID NO: 658383 - DNA, 25 bp, Rattus norvegicus
ttaccagaagacacgaatcctcctc

SEQ ID NO: 658384 - DNA, 25 bp, Rattus norvegicus
ttaccagaagactcgaatcctcctc

SEQ ID NO: 658385 - DNA, 25 bp, Rattus norvegicus
ttaccagaaggcacccactaaggag

SEQ ID NO: 658386 - DNA, 25 bp, Rattus norvegicus
ttaccagaaggctcccactaaggag

SEQ ID NO: 658387 - DNA, 25 bp, Rattus norvegicus
ttaccagaagttctcccaggagctg

SEQ ID NO: 658388 - DNA, 25 bp, Rattus norvegicus
ttaccagaagttgtcccaggagctg

SEQ ID NO: 658389 - DNA, 25 bp, Rattus norvegicus
ttaccagacaagcactagatcacaa

SEQ ID NO: 658390 - DNA, 25 bp, Rattus norvegicus
ttaccagacaaggactagatcacaa

SEQ ID NO: 658391 - DNA, 25 bp, Rattus norvegicus
ttaccagacattaaaggcaagccca

SEQ ID NO: 658392 - DNA, 25 bp, Rattus norvegicus
ttaccagacatttaaggcaagccca

SEQ ID NO: 658393 - DNA, 25 bp, Rattus norvegicus
ttaccagactacagacttctccgga

SEQ ID NO: 658394 - DNA, 25 bp, Rattus norvegicus
ttaccagactactgacttctccgga

SEQ ID NO: 658395 - DNA, 25 bp, Rattus norvegicus
ttaccagactgtcggcctgcagggc

SEQ ID NO: 658396 - DNA, 25 bp, Rattus norvegicus
ttaccagactgtgggcctgcagggc

SEQ ID NO: 658397 - DNA, 25 bp, Rattus norvegicus
ttaccagacttcaagagcatctcgc

SEQ ID NO: 658398 - DNA, 25 bp, Rattus norvegicus
ttaccagacttctagagcatctcgc

SEQ ID NO: 658399 - DNA, 25 bp, Rattus norvegicus
ttaccagacttgctggttctccatt

SEQ ID NO: 658400 - DNA, 25 bp, Rattus norvegicus
ttaccagacttggtggttctccatt

SEQ ID NO: 658401 - DNA, 25 bp, Rattus norvegicus
ttaccagagaggcagctaatttcca

SEQ ID NO: 658402 - DNA, 25 bp, Rattus norvegicus
ttaccagagagggagctaatttcca

SEQ ID NO: 658403 - DNA, 25 bp, Rattus norvegicus
ttaccagagccgaggtgcctgctgc

SEQ ID NO: 658404 - DNA, 25 bp, Rattus norvegicus
ttaccagagccgtggtgcctgctgc

SEQ ID NO: 658405 - DNA, 25 bp, Rattus norvegicus
ttaccagatgatatgcctttgcctt

SEQ ID NO: 658406 - DNA, 25 bp, Rattus norvegicus
ttaccagatgatttgcctttgcctt

SEQ ID NO: 658407 - DNA, 25 bp, Rattus norvegicus
ttaccagattacacgtctccagtag

SEQ ID NO: 658408 - DNA, 25 bp, Rattus norvegicus
ttaccagattactcgtctccagtag

SEQ ID NO: 658409 - DNA, 25 bp, Rattus norvegicus
ttaccagattccagttttctatccc

SEQ ID NO: 658410 - DNA, 25 bp, Rattus norvegicus
ttaccagattcctgttttctatccc

SEQ ID NO: 658411 - DNA, 25 bp, Rattus norvegicus
ttaccagcatacctacagccatgag

SEQ ID NO: 658412 - DNA, 25 bp, Rattus norvegicus
ttaccagcatacgtacagccatgag

SEQ ID NO: 658413 - DNA, 25 bp, Rattus norvegicus
ttaccagcatgaacgacacactctt

SEQ ID NO: 658414 - DNA, 25 bp, Rattus norvegicus
ttaccagcatgatcgacacactctt

SEQ ID NO: 658415 - DNA, 25 bp, Rattus norvegicus
ttaccagccctacagtatacagtct

SEQ ID NO: 658416 - DNA, 25 bp, Rattus norvegicus
ttaccagccctagagtatacagtct

SEQ ID NO: 658417 - DNA, 25 bp, Rattus norvegicus
ttaccagcctcacatgtgttcagct

SEQ ID NO: 658418 - DNA, 25 bp, Rattus norvegicus
ttaccagcctcagatgtgttcagct

SEQ ID NO: 658419 - DNA, 25 bp, Rattus norvegicus
ttaccagcctttccaaagcaggagt

SEQ ID NO: 658420 - DNA, 25 bp, Rattus norvegicus
ttaccagcctttgcaaagcaggagt

SEQ ID NO: 658421 - DNA, 25 bp, Rattus norvegicus
ttaccagctcagacgatggaacggt

SEQ ID NO: 658422 - DNA, 25 bp, Rattus norvegicus
ttaccagctcagtcgatggaacggt

SEQ ID NO: 658423 - DNA, 25 bp, Rattus norvegicus
ttaccagctgtgacgagagcacctc

SEQ ID NO: 658424 - DNA, 25 bp, Rattus norvegicus
ttaccagctgtgtcgagagcacctc

SEQ ID NO: 658425 - DNA, 25 bp, Rattus norvegicus
ttaccagcttatcacaagcacaggg

SEQ ID NO: 658426 - DNA, 25 bp, Rattus norvegicus
ttaccagcttatgacaagcacaggg

SEQ ID NO: 658427 - DNA, 25 bp, Rattus norvegicus
ttaccaggaccacagctctgttcct

SEQ ID NO: 658428 - DNA, 25 bp, Rattus norvegicus
ttaccaggaccagagctctgttcct

SEQ ID NO: 658429 - DNA, 25 bp, Rattus norvegicus
ttaccaggctggaggaactcttctc

SEQ ID NO: 658430 - DNA, 25 bp, Rattus norvegicus
ttaccaggctggtggaactcttctc

SEQ ID NO: 658431 - DNA, 25 bp, Rattus norvegicus
ttaccaggtaagcaagtcgtgcgcc

SEQ ID NO: 658432 - DNA, 25 bp, Rattus norvegicus
ttaccaggtaaggaagtcgtgcgcc

SEQ ID NO: 658433 - DNA, 25 bp, Rattus norvegicus
ttaccaggtattccaactcttcttg

SEQ ID NO: 658434 - DNA, 25 bp, Rattus norvegicus
ttaccaggtattgcaactcttcttg

SEQ ID NO: 658435 - DNA, 25 bp, Rattus norvegicus
ttaccagtaaacacggttgtcaaat

SEQ ID NO: 658436 - DNA, 25 bp, Rattus norvegicus
ttaccagtaaactcggttgtcaaat

SEQ ID NO: 658437 - DNA, 25 bp, Rattus norvegicus
ttaccagtaagtagctcatcacgag

SEQ ID NO: 658438 - DNA, 25 bp, Rattus norvegicus
ttaccagtaagttgctcatcacgag

SEQ ID NO: 658439 - DNA, 25 bp, Rattus norvegicus
ttaccagtacataaaggcacaattt

SEQ ID NO: 658440 - DNA, 25 bp, Rattus norvegicus
ttaccagtacattaaggcacaattt

SEQ ID NO: 658441 - DNA, 25 bp, Rattus norvegicus
ttaccagtcagaacagctcttcctc

SEQ ID NO: 658442 - DNA, 25 bp, Rattus norvegicus
ttaccagtcagatcagctcttcctc

SEQ ID NO: 658443 - DNA, 25 bp, Rattus norvegicus
ttaccagtcagcaaacttgtgtgtt

SEQ ID NO: 658444 - DNA, 25 bp, Rattus norvegicus
ttaccagtcagctaacttgtgtgtt

SEQ ID NO: 658445 - DNA, 25 bp, Rattus norvegicus
ttaccagtcatacgcccggtgagga

SEQ ID NO: 658446 - DNA, 25 bp, Rattus norvegicus
ttaccagtcataggcccggtgagga

SEQ ID NO: 658447 - DNA, 25 bp, Rattus norvegicus
ttaccagtccagagacatcgccatg

SEQ ID NO: 658448 - DNA, 25 bp, Rattus norvegicus
ttaccagtccagtgacatcgccatg

SEQ ID NO: 658449 - DNA, 25 bp, Rattus norvegicus
ttaccagtctccaaacatgcatcgg

SEQ ID NO: 658450 - DNA, 25 bp, Rattus norvegicus
ttaccagtctcctaacatgcatcgg

SEQ ID NO: 658451 - DNA, 25 bp, Rattus norvegicus
ttaccagtgacccatctcttcagta

SEQ ID NO: 658452 - DNA, 25 bp, Rattus norvegicus
ttaccagtgaccgatctcttcagta

SEQ ID NO: 658453 - DNA, 25 bp, Rattus norvegicus
ttaccagtgatcacctgtgtcttag

SEQ ID NO: 658454 - DNA, 25 bp, Rattus norvegicus
ttaccagtgatctcctgtgtcttag

SEQ ID NO: 658455 - DNA, 25 bp, Rattus norvegicus
ttaccagtgcccagatgcagacctg

SEQ ID NO: 658456 - DNA, 25 bp, Rattus norvegicus
ttaccagtgccctgatgcagacctg

SEQ ID NO: 658457 - DNA, 25 bp, Rattus norvegicus
ttaccagtgctgcttgggaccaatc

SEQ ID NO: 658458 - DNA, 25 bp, Rattus norvegicus
ttaccagtgctggttgggaccaatc

SEQ ID NO: 658459 - DNA, 25 bp, Rattus norvegicus
ttaccagtggctatgggtccacagt

SEQ ID NO: 658460 - DNA, 25 bp, Rattus norvegicus
ttaccagtggctttgggtccacagt

SEQ ID NO: 658461 - DNA, 25 bp, Rattus norvegicus
ttaccagtgtccattttcatccaag

SEQ ID NO: 658462 - DNA, 25 bp, Rattus norvegicus
ttaccagtgtcctttttcatccaag

SEQ ID NO: 658463 - DNA, 25 bp, Rattus norvegicus
ttaccagttgtgaagaacacagtca

SEQ ID NO: 658464 - DNA, 25 bp, Rattus norvegicus
ttaccagttgtgtagaacacagtca

SEQ ID NO: 658465 - DNA, 25 bp, Rattus norvegicus
ttaccatccatacaacaccaggact

SEQ ID NO: 658466 - DNA, 25 bp, Rattus norvegicus
ttaccatccatagaacaccaggact

SEQ ID NO: 658467 - DNA, 25 bp, Rattus norvegicus
ttaccatcctacactccggaattaa

SEQ ID NO: 658468 - DNA, 25 bp, Rattus norvegicus
ttaccatcctactctccggaattaa

SEQ ID NO: 658469 - DNA, 25 bp, Rattus norvegicus
ttaccatctctcatctctttgtgtg

SEQ ID NO: 658470 - DNA, 25 bp, Rattus norvegicus
ttaccatctctcttctctttgtgtg

SEQ ID NO: 658471 - DNA, 25 bp, Rattus norvegicus
ttaccatgcatgaccagcttgactt

SEQ ID NO: 658472 - DNA, 25 bp, Rattus norvegicus
ttaccatgcatgattgctgctgtcc

SEQ ID NO: 658473 - DNA, 25 bp, Rattus norvegicus
ttaccatgcatgtccagcttgactt

SEQ ID NO: 658474 - DNA, 25 bp, Rattus norvegicus
ttaccatgcatgtttgctgctgtcc

SEQ ID NO: 658475 - DNA, 25 bp, Rattus norvegicus
ttaccatgccttactccaaggaagc

SEQ ID NO: 658476 - DNA, 25 bp, Rattus norvegicus
ttaccatgcctttctccaaggaagc

SEQ ID NO: 658477 - DNA, 25 bp, Rattus norvegicus
ttaccatgcttaaatccaggattcc

SEQ ID NO: 658478 - DNA, 25 bp, Rattus norvegicus
ttaccatgcttatatccaggattcc

SEQ ID NO: 658479 - DNA, 25 bp, Rattus norvegicus
ttaccatggagcacatgcaccggga

SEQ ID NO: 658480 - DNA, 25 bp, Rattus norvegicus
ttaccatggagctcatgcaccggga

SEQ ID NO: 658481 - DNA, 25 bp, Rattus norvegicus
ttaccatggccaaacgtagaccttg

SEQ ID NO: 658482 - DNA, 25 bp, Rattus norvegicus
ttaccatggccatacgtagaccttg

SEQ ID NO: 658483 - DNA, 25 bp, Rattus norvegicus
ttaccatggtgcagtctgaccttaa

SEQ ID NO: 658484 - DNA, 25 bp, Rattus norvegicus
ttaccatggtgctgtctgaccttaa

SEQ ID NO: 658485 - DNA, 25 bp, Rattus norvegicus
ttaccatggtgtaaatcatctgaag

SEQ ID NO: 658486 - DNA, 25 bp, Rattus norvegicus
ttaccatggtgttaatcatctgaag

SEQ ID NO: 658487 - DNA, 25 bp, Rattus norvegicus
ttaccatgtacaagcctgacgcctg

SEQ ID NO: 658488 - DNA, 25 bp, Rattus norvegicus
ttaccatgtacacacccagatgatc

SEQ ID NO: 658489 - DNA, 25 bp, Rattus norvegicus
ttaccatgtacagacccagatgatc

SEQ ID NO: 658490 - DNA, 25 bp, Rattus norvegicus
ttaccatgtacatgcctgacgcctg

SEQ ID NO: 658491 - DNA, 25 bp, Rattus norvegicus
ttaccatgtctccttagcaaacgtg

SEQ ID NO: 658492 - DNA, 25 bp, Rattus norvegicus
ttaccatgtctcgttagcaaacgtg

SEQ ID NO: 658493 - DNA, 25 bp, Rattus norvegicus
ttaccatgtgctacttgaagaacct

SEQ ID NO: 658494 - DNA, 25 bp, Rattus norvegicus
ttaccatgtgctagacagtgttgta

SEQ ID NO: 658495 - DNA, 25 bp, Rattus norvegicus
ttaccatgtgcttcttgaagaacct

SEQ ID NO: 658496 - DNA, 25 bp, Rattus norvegicus
ttaccatgtgcttgacagtgttgta

SEQ ID NO: 658497 - DNA, 25 bp, Rattus norvegicus
ttaccatgttttctttgcagatatc

SEQ ID NO: 658498 - DNA, 25 bp, Rattus norvegicus
ttaccatgttttgtttgcagatatc

SEQ ID NO: 658499 - DNA, 25 bp, Rattus norvegicus
ttaccattccatagaaatctcagtg

SEQ ID NO: 658500 - DNA, 25 bp, Rattus norvegicus
ttaccattccattgaaatctcagtg

SEQ ID NO: 658501 - DNA, 25 bp, Rattus norvegicus
ttaccattctggactttctgggcca

SEQ ID NO: 658502 - DNA, 25 bp, Rattus norvegicus
ttaccattctggtctttctgggcca

SEQ ID NO: 658503 - DNA, 25 bp, Rattus norvegicus
ttaccattgggccagcttaatgttt

SEQ ID NO: 658504 - DNA, 25 bp, Rattus norvegicus
ttaccattgggcgagcttaatgttt

SEQ ID NO: 658505 - DNA, 25 bp, Rattus norvegicus
ttaccatttcacatcagacggtcct

SEQ ID NO: 658506 - DNA, 25 bp, Rattus norvegicus
ttaccatttcacttcagacggtcct

SEQ ID NO: 658507 - DNA, 25 bp, Rattus norvegicus
ttaccattttaaccaatggagaagc

SEQ ID NO: 658508 - DNA, 25 bp, Rattus norvegicus
ttaccattttaagcaatggagaagc

SEQ ID NO: 658509 - DNA, 25 bp, Rattus norvegicus
ttaccatttttcaaccaagcctttg

SEQ ID NO: 658510 - DNA, 25 bp, Rattus norvegicus
ttaccatttttctaccaagcctttg

SEQ ID NO: 658511 - DNA, 25 bp, Rattus norvegicus
ttacccaaacccacggtatccatgg

SEQ ID NO: 658512 - DNA, 25 bp, Rattus norvegicus
ttacccaaaccctcggtatccatgg

SEQ ID NO: 658513 - DNA, 25 bp, Rattus norvegicus
ttacccaagactccgtgttttacag

SEQ ID NO: 658514 - DNA, 25 bp, Rattus norvegicus
ttacccaagactgcgtgttttacag

SEQ ID NO: 658515 - DNA, 25 bp, Rattus norvegicus
ttacccaagccactgcaagtttcag

SEQ ID NO: 658516 - DNA, 25 bp, Rattus norvegicus
ttacccaagccagtgcaagtttcag

SEQ ID NO: 658517 - DNA, 25 bp, Rattus norvegicus
ttacccaagtaactgcctttccaag

SEQ ID NO: 658518 - DNA, 25 bp, Rattus norvegicus
ttacccaagtaagtgcctttccaag

SEQ ID NO: 658519 - DNA, 25 bp, Rattus norvegicus
ttacccacactaacagctactacaa

SEQ ID NO: 658520 - DNA, 25 bp, Rattus norvegicus
ttacccacactatcagctactacaa

SEQ ID NO: 658521 - DNA, 25 bp, Rattus norvegicus
ttacccacagccaggacagtgtttt

SEQ ID NO: 658522 - DNA, 25 bp, Rattus norvegicus
ttacccacagcctggacagtgtttt

SEQ ID NO: 658523 - DNA, 25 bp, Rattus norvegicus
ttacccacatcactcttcagaggaa

SEQ ID NO: 658524 - DNA, 25 bp, Rattus norvegicus
ttacccacatcagtcttcagaggaa

SEQ ID NO: 658525 - DNA, 25 bp, Rattus norvegicus
ttacccacccagatctatgttcttt

SEQ ID NO: 658526 - DNA, 25 bp, Rattus norvegicus
ttacccacccagttctatgttcttt

SEQ ID NO: 658527 - DNA, 25 bp, Rattus norvegicus
ttacccacgaacacaaatctcagac

SEQ ID NO: 658528 - DNA, 25 bp, Rattus norvegicus
ttacccacgaactcaaatctcagac

SEQ ID NO: 658529 - DNA, 25 bp, Rattus norvegicus
ttacccacgcttatcatggaaacat

SEQ ID NO: 658530 - DNA, 25 bp, Rattus norvegicus
ttacccacgcttttcatggaaacat

SEQ ID NO: 658531 - DNA, 25 bp, Rattus norvegicus
ttacccacgggactttatcaattag

SEQ ID NO: 658532 - DNA, 25 bp, Rattus norvegicus
ttacccacgggagtttatcaattag

SEQ ID NO: 658533 - DNA, 25 bp, Rattus norvegicus
ttacccacgtgcatggtcggatgta

SEQ ID NO: 658534 - DNA, 25 bp, Rattus norvegicus
ttacccacgtgcttggtcggatgta

SEQ ID NO: 658535 - DNA, 25 bp, Rattus norvegicus
ttacccactgaaacatctccctaga

SEQ ID NO: 658536 - DNA, 25 bp, Rattus norvegicus
ttacccactgaatcatctccctaga

SEQ ID NO: 658537 - DNA, 25 bp, Rattus norvegicus
ttacccactgggacaggagtttctg

SEQ ID NO: 658538 - DNA, 25 bp, Rattus norvegicus
ttacccactgggtcaggagtttctg

SEQ ID NO: 658539 - DNA, 25 bp, Rattus norvegicus
ttacccagaagaatgactcgcctct

SEQ ID NO: 658540 - DNA, 25 bp, Rattus norvegicus
ttacccagaagattgactcgcctct

SEQ ID NO: 658541 - DNA, 25 bp, Rattus norvegicus
ttacccagacggaccactgcaggaa

SEQ ID NO: 658542 - DNA, 25 bp, Rattus norvegicus
ttacccagacggtccactgcaggaa

SEQ ID NO: 658543 - DNA, 25 bp, Rattus norvegicus
ttacccagagttatcctttgcatgt

SEQ ID NO: 658544 - DNA, 25 bp, Rattus norvegicus
ttacccagagttttcctttgcatgt

SEQ ID NO: 658545 - DNA, 25 bp, Rattus norvegicus
ttacccagcatgctcagggacctga

SEQ ID NO: 658546 - DNA, 25 bp, Rattus norvegicus
ttacccagcatggtcagggacctga

SEQ ID NO: 658547 - DNA, 25 bp, Rattus norvegicus
ttacccagctggactgcttggattt

SEQ ID NO: 658548 - DNA, 25 bp, Rattus norvegicus
ttacccagctggtctgcttggattt

SEQ ID NO: 658549 - DNA, 25 bp, Rattus norvegicus
ttacccaggagacacggttgtccat

SEQ ID NO: 658550 - DNA, 25 bp, Rattus norvegicus
ttacccaggagacctcacatacaaa

SEQ ID NO: 658551 - DNA, 25 bp, Rattus norvegicus
ttacccaggagagacggttgtccat

SEQ ID NO: 658552 - DNA, 25 bp, Rattus norvegicus
ttacccaggagagctcacatacaaa

SEQ ID NO: 658553 - DNA, 25 bp, Rattus norvegicus
ttacccaggctccttgctaccagtt

SEQ ID NO: 658554 - DNA, 25 bp, Rattus norvegicus
ttacccaggctcgttgctaccagtt

SEQ ID NO: 658555 - DNA, 25 bp, Rattus norvegicus
ttacccagggatcagcaccaacttg

SEQ ID NO: 658556 - DNA, 25 bp, Rattus norvegicus
ttacccagggatgagcaccaacttg

SEQ ID NO: 658557 - DNA, 25 bp, Rattus norvegicus
ttacccagggtgactgtggaccaca

SEQ ID NO: 658558 - DNA, 25 bp, Rattus norvegicus
ttacccagggtgtctgtggaccaca

SEQ ID NO: 658559 - DNA, 25 bp, Rattus norvegicus
ttacccaggtcaatccacaattcaa

SEQ ID NO: 658560 - DNA, 25 bp, Rattus norvegicus
ttacccaggtcattccacaattcaa

SEQ ID NO: 658561 - DNA, 25 bp, Rattus norvegicus
ttacccagtcccaggtgatccatgg

SEQ ID NO: 658562 - DNA, 25 bp, Rattus norvegicus
ttacccagtccctggtgatccatgg

SEQ ID NO: 658563 - DNA, 25 bp, Rattus norvegicus
ttacccagtcttcttttcatagaat

SEQ ID NO: 658564 - DNA, 25 bp, Rattus norvegicus
ttacccagtcttgttttcatagaat

SEQ ID NO: 658565 - DNA, 25 bp, Rattus norvegicus
ttacccataaaaccctcaaagcact

SEQ ID NO: 658566 - DNA, 25 bp, Rattus norvegicus
ttacccataaaagcctcaaagcact

SEQ ID NO: 658567 - DNA, 25 bp, Rattus norvegicus
ttacccataatgaaggaatctcagt

SEQ ID NO: 658568 - DNA, 25 bp, Rattus norvegicus
ttacccataatgtaggaatctcagt

SEQ ID NO: 658569 - DNA, 25 bp, Rattus norvegicus
ttacccataggtatccaatatcaag

SEQ ID NO: 658570 - DNA, 25 bp, Rattus norvegicus
ttacccataggtttccaatatcaag

SEQ ID NO: 658571 - DNA, 25 bp, Rattus norvegicus
ttacccatcatgcaacctgtctaaa

SEQ ID NO: 658572 - DNA, 25 bp, Rattus norvegicus
ttacccatcatggaacctgtctaaa

SEQ ID NO: 658573 - DNA, 25 bp, Rattus norvegicus
ttacccatgccgagcactggaggat

SEQ ID NO: 658574 - DNA, 25 bp, Rattus norvegicus
ttacccatgccgtgcactggaggat

SEQ ID NO: 658575 - DNA, 25 bp, Rattus norvegicus
ttacccatgctgacagagacgcttg

SEQ ID NO: 658576 - DNA, 25 bp, Rattus norvegicus
ttacccatgctgtcagagacgcttg

SEQ ID NO: 658577 - DNA, 25 bp, Rattus norvegicus
ttacccattggactcatgacctttt

SEQ ID NO: 658578 - DNA, 25 bp, Rattus norvegicus
ttacccattggagtcatgacctttt

SEQ ID NO: 658579 - DNA, 25 bp, Rattus norvegicus
ttacccatttctcatatccatttct

SEQ ID NO: 658580 - DNA, 25 bp, Rattus norvegicus
ttacccatttctgatatccatttct

SEQ ID NO: 658581 - DNA, 25 bp, Rattus norvegicus
ttacccatttgacgcaagatatttc

SEQ ID NO: 658582 - DNA, 25 bp, Rattus norvegicus
ttacccatttgaggcaagatatttc

SEQ ID NO: 658583 - DNA, 25 bp, Rattus norvegicus
ttacccattttgaggtcctccatca

SEQ ID NO: 658584 - DNA, 25 bp, Rattus norvegicus
ttacccattttgtggtcctccatca

SEQ ID NO: 658585 - DNA, 25 bp, Rattus norvegicus
ttaccccaaaggctgacggtctctt

SEQ ID NO: 658586 - DNA, 25 bp, Rattus norvegicus
ttaccccaaagggtgacggtctctt

SEQ ID NO: 658587 - DNA, 25 bp, Rattus norvegicus
ttaccccaccggacgatgcatggaa

SEQ ID NO: 658588 - DNA, 25 bp, Rattus norvegicus
ttaccccaccggtcgatgcatggaa

SEQ ID NO: 658589 - DNA, 25 bp, Rattus norvegicus
ttaccccagaatcacagtgaagcca

SEQ ID NO: 658590 - DNA, 25 bp, Rattus norvegicus
ttaccccagaatgacagtgaagcca

SEQ ID NO: 658591 - DNA, 25 bp, Rattus norvegicus
ttaccccagagcaaccactaaatga

SEQ ID NO: 658592 - DNA, 25 bp, Rattus norvegicus
ttaccccagagctaccactaaatga

SEQ ID NO: 658593 - DNA, 25 bp, Rattus norvegicus
ttaccccagtatcctttttcggaat

SEQ ID NO: 658594 - DNA, 25 bp, Rattus norvegicus
ttaccccagtatgctttttcggaat

SEQ ID NO: 658595 - DNA, 25 bp, Rattus norvegicus
ttaccccatgtgcagtcatcaggaa

SEQ ID NO: 658596 - DNA, 25 bp, Rattus norvegicus
ttaccccatgtggagtcatcaggaa

SEQ ID NO: 658597 - DNA, 25 bp, Rattus norvegicus
ttaccccatgttcacagtggctgag

SEQ ID NO: 658598 - DNA, 25 bp, Rattus norvegicus
ttaccccatgttgacagtggctgag

SEQ ID NO: 658599 - DNA, 25 bp, Rattus norvegicus
ttaccccatttcaagtttgtcctct

SEQ ID NO: 658600 - DNA, 25 bp, Rattus norvegicus
ttaccccatttctagtttgtcctct

SEQ ID NO: 658601 - DNA, 25 bp, Rattus norvegicus
ttaccccgaggacacttccaggaag

SEQ ID NO: 658602 - DNA, 25 bp, Rattus norvegicus
ttaccccgaggagacttccaggaag

SEQ ID NO: 658603 - DNA, 25 bp, Rattus norvegicus
ttaccccggctgaacactggcaagt

SEQ ID NO: 658604 - DNA, 25 bp, Rattus norvegicus
ttaccccggctgtacactggcaagt

SEQ ID NO: 658605 - DNA, 25 bp, Rattus norvegicus
ttaccccggtacagagaaatgcttt

SEQ ID NO: 658606 - DNA, 25 bp, Rattus norvegicus
ttaccccggtactgagaaatgcttt

SEQ ID NO: 658607 - DNA, 25 bp, Rattus norvegicus
ttacccctattaagaagctctccca

SEQ ID NO: 658608 - DNA, 25 bp, Rattus norvegicus
ttacccctattatgaagctctccca

SEQ ID NO: 658609 - DNA, 25 bp, Rattus norvegicus
ttacccctcacaatcagttcttaac

SEQ ID NO: 658610 - DNA, 25 bp, Rattus norvegicus
ttacccctcacattcagttcttaac

SEQ ID NO: 658611 - DNA, 25 bp, Rattus norvegicus
ttacccctcaccagatggagtgaca

SEQ ID NO: 658612 - DNA, 25 bp, Rattus norvegicus
ttacccctcacctgatggagtgaca

SEQ ID NO: 658613 - DNA, 25 bp, Rattus norvegicus
ttacccctgaagctgttcttaacac

SEQ ID NO: 658614 - DNA, 25 bp, Rattus norvegicus
ttacccctgaaggtgttcttaacac

SEQ ID NO: 658615 - DNA, 25 bp, Rattus norvegicus
ttacccctgtatctcttaagctgta

SEQ ID NO: 658616 - DNA, 25 bp, Rattus norvegicus
ttacccctgtatgtcttaagctgta

SEQ ID NO: 658617 - DNA, 25 bp, Rattus norvegicus
ttacccctgtctatcaagggttgtg

SEQ ID NO: 658618 - DNA, 25 bp, Rattus norvegicus
ttacccctgtctttcaagggttgtg

SEQ ID NO: 658619 - DNA, 25 bp, Rattus norvegicus
ttacccctgtgccttactttatgga

SEQ ID NO: 658620 - DNA, 25 bp, Rattus norvegicus
ttacccctgtgcgttactttatgga

SEQ ID NO: 658621 - DNA, 25 bp, Rattus norvegicus
ttaccccttgatattatttgccttg

SEQ ID NO: 658622 - DNA, 25 bp, Rattus norvegicus
ttaccccttgattttatttgccttg

SEQ ID NO: 658623 - DNA, 25 bp, Rattus norvegicus
ttaccccttgctatagtggatgtgt

SEQ ID NO: 658624 - DNA, 25 bp, Rattus norvegicus
ttaccccttgctttagtggatgtgt

SEQ ID NO: 658625 - DNA, 25 bp, Rattus norvegicus
ttacccgaagacaggacttgtatcc

SEQ ID NO: 658626 - DNA, 25 bp, Rattus norvegicus
ttacccgaagactggacttgtatcc

SEQ ID NO: 658627 - DNA, 25 bp, Rattus norvegicus
ttacccgaatcaccaagatactttg

SEQ ID NO: 658628 - DNA, 25 bp, Rattus norvegicus
ttacccgaatcagcaagatactttg

SEQ ID NO: 658629 - DNA, 25 bp, Rattus norvegicus
ttacccgacacaattctaatctctt

SEQ ID NO: 658630 - DNA, 25 bp, Rattus norvegicus
ttacccgacacatttctaatctctt

SEQ ID NO: 658631 - DNA, 25 bp, Rattus norvegicus
ttacccgagctgatttgggaacact

SEQ ID NO: 658632 - DNA, 25 bp, Rattus norvegicus
ttacccgagctgttttgggaacact

SEQ ID NO: 658633 - DNA, 25 bp, Rattus norvegicus
ttacccgccatcctacagtattatt

SEQ ID NO: 658634 - DNA, 25 bp, Rattus norvegicus
ttacccgccatcgtacagtattatt

SEQ ID NO: 658635 - DNA, 25 bp, Rattus norvegicus
ttacccggacgaacgggaaggtctg

SEQ ID NO: 658636 - DNA, 25 bp, Rattus norvegicus
ttacccggacgatcgggaaggtctg

SEQ ID NO: 658637 - DNA, 25 bp, Rattus norvegicus
ttacccgtatggcattcccatgcgg

SEQ ID NO: 658638 - DNA, 25 bp, Rattus norvegicus
ttacccgtatgggattcccatgcgg

SEQ ID NO: 658639 - DNA, 25 bp, Rattus norvegicus
ttacccgtccagaagtcagaagtct

SEQ ID NO: 658640 - DNA, 25 bp, Rattus norvegicus
ttacccgtccagtagtcagaagtct

SEQ ID NO: 658641 - DNA, 25 bp, Rattus norvegicus
ttacccgtcgggagagatgctcctg

SEQ ID NO: 658642 - DNA, 25 bp, Rattus norvegicus
ttacccgtcgggtgagatgctcctg

SEQ ID NO: 658643 - DNA, 25 bp, Rattus norvegicus
ttacccgtgtgtacacagtgtccta

SEQ ID NO: 658644 - DNA, 25 bp, Rattus norvegicus
ttacccgtgtgtcctatgtccagaa

SEQ ID NO: 658645 - DNA, 25 bp, Rattus norvegicus
ttacccgtgtgtgctatgtccagaa

SEQ ID NO: 658646 - DNA, 25 bp, Rattus norvegicus
ttacccgtgtgttcacagtgtccta

SEQ ID NO: 658647 - DNA, 25 bp, Rattus norvegicus
ttaccctaagcaaccacatattcga

SEQ ID NO: 658648 - DNA, 25 bp, Rattus norvegicus
ttaccctaagcatccacatattcga

SEQ ID NO: 658649 - DNA, 25 bp, Rattus norvegicus
ttaccctaagtgaaggtacccacag

SEQ ID NO: 658650 - DNA, 25 bp, Rattus norvegicus
ttaccctaagtgtaggtacccacag

SEQ ID NO: 658651 - DNA, 25 bp, Rattus norvegicus
ttaccctactctagaataaccacca

SEQ ID NO: 658652 - DNA, 25 bp, Rattus norvegicus
ttaccctactcttgaataaccacca

SEQ ID NO: 658653 - DNA, 25 bp, Rattus norvegicus
ttaccctagccaagtacactgtcat

SEQ ID NO: 658654 - DNA, 25 bp, Rattus norvegicus
ttaccctagccatgtacactgtcat

SEQ ID NO: 658655 - DNA, 25 bp, Rattus norvegicus
ttaccctataataccaatatccaag

SEQ ID NO: 658656 - DNA, 25 bp, Rattus norvegicus
ttaccctataattccaatatccaag

SEQ ID NO: 658657 - DNA, 25 bp, Rattus norvegicus
ttaccctatgggatgatccttctag

SEQ ID NO: 658658 - DNA, 25 bp, Rattus norvegicus
ttaccctatgggttgatccttctag

SEQ ID NO: 658659 - DNA, 25 bp, Rattus norvegicus
ttaccctcacatcgttcacagctat

SEQ ID NO: 658660 - DNA, 25 bp, Rattus norvegicus
ttaccctcacatggttcacagctat

SEQ ID NO: 658661 - DNA, 25 bp, Rattus norvegicus
ttaccctccattctctttctaagaa

SEQ ID NO: 658662 - DNA, 25 bp, Rattus norvegicus
ttaccctccattgtctttctaagaa

SEQ ID NO: 658663 - DNA, 25 bp, Rattus norvegicus
ttaccctccgaacctctggatgggt

SEQ ID NO: 658664 - DNA, 25 bp, Rattus norvegicus
ttaccctccgaagctctggatgggt

SEQ ID NO: 658665 - DNA, 25 bp, Rattus norvegicus
ttaccctctcagaaagtaccagaag

SEQ ID NO: 658666 - DNA, 25 bp, Rattus norvegicus
ttaccctctcagtaagtaccagaag

SEQ ID NO: 658667 - DNA, 25 bp, Rattus norvegicus
ttaccctctcccatactgagtacat

SEQ ID NO: 658668 - DNA, 25 bp, Rattus norvegicus
ttaccctctcccttactgagtacat

SEQ ID NO: 658669 - DNA, 25 bp, Rattus norvegicus
ttaccctctgtgactttattgtgcc

SEQ ID NO: 658670 - DNA, 25 bp, Rattus norvegicus
ttaccctctgtgtctttattgtgcc

SEQ ID NO: 658671 - DNA, 25 bp, Rattus norvegicus
ttaccctcttgcctctatagagaaa

SEQ ID NO: 658672 - DNA, 25 bp, Rattus norvegicus
ttaccctcttgcgtctatagagaaa

SEQ ID NO: 658673 - DNA, 25 bp, Rattus norvegicus
ttaccctgaacactctgactggata

SEQ ID NO: 658674 - DNA, 25 bp, Rattus norvegicus
ttaccctgaacagtctgactggata

SEQ ID NO: 658675 - DNA, 25 bp, Rattus norvegicus
ttaccctgaagtaaactcgaaagca

SEQ ID NO: 658676 - DNA, 25 bp, Rattus norvegicus
ttaccctgaagttaactcgaaagca

SEQ ID NO: 658677 - DNA, 25 bp, Rattus norvegicus
ttaccctgacaccaaagccgtggat

SEQ ID NO: 658678 - DNA, 25 bp, Rattus norvegicus
ttaccctgacacgaaagccgtggat

SEQ ID NO: 658679 - DNA, 25 bp, Rattus norvegicus
ttaccctgagatccgtatgttctaa

SEQ ID NO: 658680 - DNA, 25 bp, Rattus norvegicus
ttaccctgagatgcgtatgttctaa

SEQ ID NO: 658681 - DNA, 25 bp, Rattus norvegicus
ttaccctgaggtagtgctgattaca

SEQ ID NO: 658682 - DNA, 25 bp, Rattus norvegicus
ttaccctgaggttgtgctgattaca

SEQ ID NO: 658683 - DNA, 25 bp, Rattus norvegicus
ttaccctgctgtcagaaccactggg

SEQ ID NO: 658684 - DNA, 25 bp, Rattus norvegicus
ttaccctgctgtgagaaccactggg

SEQ ID NO: 658685 - DNA, 25 bp, Rattus norvegicus
ttaccctggaacaactcaacgagct

SEQ ID NO: 658686 - DNA, 25 bp, Rattus norvegicus
ttaccctggaactactcaacgagct

SEQ ID NO: 658687 - DNA, 25 bp, Rattus norvegicus
ttaccctggtctcgattctctgctg

SEQ ID NO: 658688 - DNA, 25 bp, Rattus norvegicus
ttaccctggtctggattctctgctg

SEQ ID NO: 658689 - DNA, 25 bp, Rattus norvegicus
ttaccctgtacacctgtatctctat

SEQ ID NO: 658690 - DNA, 25 bp, Rattus norvegicus
ttaccctgtacagctgtatctctat

SEQ ID NO: 658691 - DNA, 25 bp, Rattus norvegicus
ttaccctgtcctacttgtatacaaa

SEQ ID NO: 658692 - DNA, 25 bp, Rattus norvegicus
ttaccctgtccttcttgtatacaaa

SEQ ID NO: 658693 - DNA, 25 bp, Rattus norvegicus
ttacccttacttactggccatagat

SEQ ID NO: 658694 - DNA, 25 bp, Rattus norvegicus
ttacccttactttctggccatagat

SEQ ID NO: 658695 - DNA, 25 bp, Rattus norvegicus
ttacccttagcacatcagcattcgt

SEQ ID NO: 658696 - DNA, 25 bp, Rattus norvegicus
ttacccttagcagatcagcattcgt

SEQ ID NO: 658697 - DNA, 25 bp, Rattus norvegicus
ttacccttcagtacatatcacagcg

SEQ ID NO: 658698 - DNA, 25 bp, Rattus norvegicus
ttacccttcagttcatatcacagcg

SEQ ID NO: 658699 - DNA, 25 bp, Rattus norvegicus
ttacccttccctccagatacatgat

SEQ ID NO: 658700 - DNA, 25 bp, Rattus norvegicus
ttacccttccctgcagatacatgat

SEQ ID NO: 658701 - DNA, 25 bp, Rattus norvegicus
ttacccttctgccaggttcagtggt

SEQ ID NO: 658702 - DNA, 25 bp, Rattus norvegicus
ttacccttctgcgaggttcagtggt

SEQ ID NO: 658703 - DNA, 25 bp, Rattus norvegicus
ttacccttgaagctccttcggatgc

SEQ ID NO: 658704 - DNA, 25 bp, Rattus norvegicus
ttacccttgaaggtccttcggatgc

SEQ ID NO: 658705 - DNA, 25 bp, Rattus norvegicus
ttacccttgtggacatggctgtgga

SEQ ID NO: 658706 - DNA, 25 bp, Rattus norvegicus
ttacccttgtggtcatggctgtgga

SEQ ID NO: 658707 - DNA, 25 bp, Rattus norvegicus
ttaccctttcatccaagaagctcac

SEQ ID NO: 658708 - DNA, 25 bp, Rattus norvegicus
ttaccctttcatgcaagaagctcac

SEQ ID NO: 658709 - DNA, 25 bp, Rattus norvegicus
ttaccctttctaagcattgccatta

SEQ ID NO: 658710 - DNA, 25 bp, Rattus norvegicus
ttaccctttctatgcattgccatta

SEQ ID NO: 658711 - DNA, 25 bp, Rattus norvegicus
ttacccttttgaaaggtttcgcact

SEQ ID NO: 658712 - DNA, 25 bp, Rattus norvegicus
ttacccttttgataggtttcgcact

SEQ ID NO: 658713 - DNA, 25 bp, Rattus norvegicus
ttaccgaaccagaactccagcacaa

SEQ ID NO: 658714 - DNA, 25 bp, Rattus norvegicus
ttaccgaaccagtactccagcacaa

SEQ ID NO: 658715 - DNA, 25 bp, Rattus norvegicus
ttaccgaaggacaagaaatttccag

SEQ ID NO: 658716 - DNA, 25 bp, Rattus norvegicus
ttaccgaaggactagaaatttccag

SEQ ID NO: 658717 - DNA, 25 bp, Rattus norvegicus
ttaccgacactcagtaacctgcttc

SEQ ID NO: 658718 - DNA, 25 bp, Rattus norvegicus
ttaccgacactctgtaacctgcttc

SEQ ID NO: 658719 - DNA, 25 bp, Rattus norvegicus
ttaccgacggatatatgctgccaga

SEQ ID NO: 658720 - DNA, 25 bp, Rattus norvegicus
ttaccgacggatttatgctgccaga

SEQ ID NO: 658721 - DNA, 25 bp, Rattus norvegicus
ttaccgactattaaccagggatggc

SEQ ID NO: 658722 - DNA, 25 bp, Rattus norvegicus
ttaccgactatttaccagggatggc

SEQ ID NO: 658723 - DNA, 25 bp, Rattus norvegicus
ttaccgactgtaacctgagactatg

SEQ ID NO: 658724 - DNA, 25 bp, Rattus norvegicus
ttaccgactgtatcctgagactatg

SEQ ID NO: 658725 - DNA, 25 bp, Rattus norvegicus
ttaccgagctcacatgacggcatgg

SEQ ID NO: 658726 - DNA, 25 bp, Rattus norvegicus
ttaccgagctcagatgacggcatgg

SEQ ID NO: 658727 - DNA, 25 bp, Rattus norvegicus
ttaccgagctcccagactggtcata

SEQ ID NO: 658728 - DNA, 25 bp, Rattus norvegicus
ttaccgagctccgagactggtcata

SEQ ID NO: 658729 - DNA, 25 bp, Rattus norvegicus
ttaccgatgcccaaaagaaagccca

SEQ ID NO: 658730 - DNA, 25 bp, Rattus norvegicus
ttaccgatgccctaaagaaagccca

SEQ ID NO: 658731 - DNA, 25 bp, Rattus norvegicus
ttaccgattttcaacaaagtgcatg

SEQ ID NO: 658732 - DNA, 25 bp, Rattus norvegicus
ttaccgattttctacaaagtgcatg

SEQ ID NO: 658733 - DNA, 25 bp, Rattus norvegicus
ttaccgcaaactatacctcttctga

SEQ ID NO: 658734 - DNA, 25 bp, Rattus norvegicus
ttaccgcaaactttacctcttctga

SEQ ID NO: 658735 - DNA, 25 bp, Rattus norvegicus
ttaccgccaatgagctgttgttcct

SEQ ID NO: 658736 - DNA, 25 bp, Rattus norvegicus
ttaccgccaatgtgctgttgttcct

SEQ ID NO: 658737 - DNA, 25 bp, Rattus norvegicus
ttaccgccaggtacctttttgatat

SEQ ID NO: 658738 - DNA, 25 bp, Rattus norvegicus
ttaccgccaggtatgttaaatgcat

SEQ ID NO: 658739 - DNA, 25 bp, Rattus norvegicus
ttaccgccaggttcctttttgatat

SEQ ID NO: 658740 - DNA, 25 bp, Rattus norvegicus
ttaccgccaggtttgttaaatgcat

SEQ ID NO: 658741 - DNA, 25 bp, Rattus norvegicus
ttaccgctcatcaatatccagaagt

SEQ ID NO: 658742 - DNA, 25 bp, Rattus norvegicus
ttaccgctcatctatatccagaagt

SEQ ID NO: 658743 - DNA, 25 bp, Rattus norvegicus
ttaccgcttagcatcttttaagaga

SEQ ID NO: 658744 - DNA, 25 bp, Rattus norvegicus
ttaccgcttagcttcttttaagaga

SEQ ID NO: 658745 - DNA, 25 bp, Rattus norvegicus
ttaccggaaccgctttctgagaaat

SEQ ID NO: 658746 - DNA, 25 bp, Rattus norvegicus
ttaccggaaccggtttctgagaaat

SEQ ID NO: 658747 - DNA, 25 bp, Rattus norvegicus
ttaccggagggcagtgactatcgta

SEQ ID NO: 658748 - DNA, 25 bp, Rattus norvegicus
ttaccggagggctgtgactatcgta

SEQ ID NO: 658749 - DNA, 25 bp, Rattus norvegicus
ttaccggataaaccgccttctcaga

SEQ ID NO: 658750 - DNA, 25 bp, Rattus norvegicus
ttaccggataaagcgccttctcaga

SEQ ID NO: 658751 - DNA, 25 bp, Rattus norvegicus
ttaccggatcttcaacacctggctg

SEQ ID NO: 658752 - DNA, 25 bp, Rattus norvegicus
ttaccggatcttgaacacctggctg

SEQ ID NO: 658753 - DNA, 25 bp, Rattus norvegicus
ttaccggatgagctccaggccagtg

SEQ ID NO: 658754 - DNA, 25 bp, Rattus norvegicus
ttaccggatgaggtccaggccagtg

SEQ ID NO: 658755 - DNA, 25 bp, Rattus norvegicus
ttaccggctctcagtggaagtctat

SEQ ID NO: 658756 - DNA, 25 bp, Rattus norvegicus
ttaccggctctctgtggaagtctat

SEQ ID NO: 658757 - DNA, 25 bp, Rattus norvegicus
ttaccgggaggtatgcatcgacaga

SEQ ID NO: 658758 - DNA, 25 bp, Rattus norvegicus
ttaccgggaggtttgcatcgacaga

SEQ ID NO: 658759 - DNA, 25 bp, Rattus norvegicus
ttaccgggccttcgtgcacgagcga

SEQ ID NO: 658760 - DNA, 25 bp, Rattus norvegicus
ttaccgggccttggtgcacgagcga

SEQ ID NO: 658761 - DNA, 25 bp, Rattus norvegicus
ttaccgggctcaatttggaacggat

SEQ ID NO: 658762 - DNA, 25 bp, Rattus norvegicus
ttaccgggctcattttggaacggat

SEQ ID NO: 658763 - DNA, 25 bp, Rattus norvegicus
ttaccgggtgccaatattagtagac

SEQ ID NO: 658764 - DNA, 25 bp, Rattus norvegicus
ttaccgggtgcctatattagtagac

SEQ ID NO: 658765 - DNA, 25 bp, Rattus norvegicus
ttaccggtatcaatatcaggcactg

SEQ ID NO: 658766 - DNA, 25 bp, Rattus norvegicus
ttaccggtatcattatcaggcactg

SEQ ID NO: 658767 - DNA, 25 bp, Rattus norvegicus
ttaccggtccatcgtggaggctctt

SEQ ID NO: 658768 - DNA, 25 bp, Rattus norvegicus
ttaccggtccatggtggaggctctt

SEQ ID NO: 658769 - DNA, 25 bp, Rattus norvegicus
ttaccgtagtctcaggcaccttagg

SEQ ID NO: 658770 - DNA, 25 bp, Rattus norvegicus
ttaccgtagtctgaggcaccttagg

SEQ ID NO: 658771 - DNA, 25 bp, Rattus norvegicus
ttaccgtcagggatgatgtggaatc

SEQ ID NO: 658772 - DNA, 25 bp, Rattus norvegicus
ttaccgtcagggttgatgtggaatc

SEQ ID NO: 658773 - DNA, 25 bp, Rattus norvegicus
ttaccgtctgggaaccagcttgtag

SEQ ID NO: 658774 - DNA, 25 bp, Rattus norvegicus
ttaccgtctgggtaccagcttgtag

SEQ ID NO: 658775 - DNA, 25 bp, Rattus norvegicus
ttaccgtgcacactttgccaacaga

SEQ ID NO: 658776 - DNA, 25 bp, Rattus norvegicus
ttaccgtgcacagtttgccaacaga

SEQ ID NO: 658777 - DNA, 25 bp, Rattus norvegicus
ttaccgtggcatctgtggctccagt

SEQ ID NO: 658778 - DNA, 25 bp, Rattus norvegicus
ttaccgtggcatgtgtggctccagt

SEQ ID NO: 658779 - DNA, 25 bp, Rattus norvegicus
ttaccgtggtcaccaggagtccttc

SEQ ID NO: 658780 - DNA, 25 bp, Rattus norvegicus
ttaccgtggtcagcaggagtccttc

SEQ ID NO: 658781 - DNA, 25 bp, Rattus norvegicus
ttacctaagagtacctcagcttctc

SEQ ID NO: 658782 - DNA, 25 bp, Rattus norvegicus
ttacctaagagttcctcagcttctc

SEQ ID NO: 658783 - DNA, 25 bp, Rattus norvegicus
ttacctaatgaacacagggacctct

SEQ ID NO: 658784 - DNA, 25 bp, Rattus norvegicus
ttacctaatgaagacagggacctct

SEQ ID NO: 658785 - DNA, 25 bp, Rattus norvegicus
ttacctacatttctttcctttacat

SEQ ID NO: 658786 - DNA, 25 bp, Rattus norvegicus
ttacctacatttgtttcctttacat

SEQ ID NO: 658787 - DNA, 25 bp, Rattus norvegicus
ttacctaccaagcttgtagcgccac

SEQ ID NO: 658788 - DNA, 25 bp, Rattus norvegicus
ttacctaccaaggttgtagcgccac

SEQ ID NO: 658789 - DNA, 25 bp, Rattus norvegicus
ttacctaccccacactaaggaagat

SEQ ID NO: 658790 - DNA, 25 bp, Rattus norvegicus
ttacctaccccagactaaggaagat

SEQ ID NO: 658791 - DNA, 25 bp, Rattus norvegicus
ttacctagactgagtgtggacaaaa

SEQ ID NO: 658792 - DNA, 25 bp, Rattus norvegicus
ttacctagactgtgtgtggacaaaa

SEQ ID NO: 658793 - DNA, 25 bp, Rattus norvegicus
ttacctagagttctctgcttctatg

SEQ ID NO: 658794 - DNA, 25 bp, Rattus norvegicus
ttacctagagttgtctgcttctatg

SEQ ID NO: 658795 - DNA, 25 bp, Rattus norvegicus
ttacctagcaccatagcaaccagga

SEQ ID NO: 658796 - DNA, 25 bp, Rattus norvegicus
ttacctagcaccattgacataccga

SEQ ID NO: 658797 - DNA, 25 bp, Rattus norvegicus
ttacctagcaccttagcaaccagga

SEQ ID NO: 658798 - DNA, 25 bp, Rattus norvegicus
ttacctagcacctttgacataccga

SEQ ID NO: 658799 - DNA, 25 bp, Rattus norvegicus
ttacctaggcgcatgtgagagatca

SEQ ID NO: 658800 - DNA, 25 bp, Rattus norvegicus
ttacctaggcgcttgtgagagatca

SEQ ID NO: 658801 - DNA, 25 bp, Rattus norvegicus
ttacctagggctcagactcagttgt

SEQ ID NO: 658802 - DNA, 25 bp, Rattus norvegicus
ttacctagggctgagactcagttgt

SEQ ID NO: 658803 - DNA, 25 bp, Rattus norvegicus
ttacctagtgggagtggttcacatt

SEQ ID NO: 658804 - DNA, 25 bp, Rattus norvegicus
ttacctagtgggtgtggttcacatt

SEQ ID NO: 658805 - DNA, 25 bp, Rattus norvegicus
ttacctataccgaaggcgccagcag

SEQ ID NO: 658806 - DNA, 25 bp, Rattus norvegicus
ttacctataccgtaggcgccagcag

SEQ ID NO: 658807 - DNA, 25 bp, Rattus norvegicus
ttacctatatttcctccaacttcgt

SEQ ID NO: 658808 - DNA, 25 bp, Rattus norvegicus
ttacctatatttgctccaacttcgt

SEQ ID NO: 658809 - DNA, 25 bp, Rattus norvegicus
ttacctatccttatattctggacaa

SEQ ID NO: 658810 - DNA, 25 bp, Rattus norvegicus
ttacctatccttttattctggacaa

SEQ ID NO: 658811 - DNA, 25 bp, Rattus norvegicus
ttacctatctcacacatctggtcaa

SEQ ID NO: 658812 - DNA, 25 bp, Rattus norvegicus
ttacctatctcagacatctggtcaa

SEQ ID NO: 658813 - DNA, 25 bp, Rattus norvegicus
ttacctatctgcatttaccatccag

SEQ ID NO: 658814 - DNA, 25 bp, Rattus norvegicus
ttacctatctgcttttaccatccag

SEQ ID NO: 658815 - DNA, 25 bp, Rattus norvegicus
ttacctatgaatctccctgtacctt

SEQ ID NO: 658816 - DNA, 25 bp, Rattus norvegicus
ttacctatgaatgtccctgtacctt

SEQ ID NO: 658817 - DNA, 25 bp, Rattus norvegicus
ttacctatgccaaaacagatttctt

SEQ ID NO: 658818 - DNA, 25 bp, Rattus norvegicus
ttacctatgccataacagatttctt

SEQ ID NO: 658819 - DNA, 25 bp, Rattus norvegicus
ttacctatggccacctactgtgctt

SEQ ID NO: 658820 - DNA, 25 bp, Rattus norvegicus
ttacctatggcctcctactgtgctt

SEQ ID NO: 658821 - DNA, 25 bp, Rattus norvegicus
ttacctatttcacctctaagtcaga

SEQ ID NO: 658822 - DNA, 25 bp, Rattus norvegicus
ttacctatttcagctctaagtcaga

SEQ ID NO: 658823 - DNA, 25 bp, Rattus norvegicus
ttacctcaaaaaactctgttgggat

SEQ ID NO: 658824 - DNA, 25 bp, Rattus norvegicus
ttacctcaaaaatctctgttgggat

SEQ ID NO: 658825 - DNA, 25 bp, Rattus norvegicus
ttacctcagcagattatcctgtcta

SEQ ID NO: 658826 - DNA, 25 bp, Rattus norvegicus
ttacctcagcagctagcaacatagt

SEQ ID NO: 658827 - DNA, 25 bp, Rattus norvegicus
ttacctcagcaggtagcaacatagt

SEQ ID NO: 658828 - DNA, 25 bp, Rattus norvegicus
ttacctcagcagtttatcctgtcta

SEQ ID NO: 658829 - DNA, 25 bp, Rattus norvegicus
ttacctcagcgtcctgtcaggttag

SEQ ID NO: 658830 - DNA, 25 bp, Rattus norvegicus
ttacctcagcgtgctgtcaggttag

SEQ ID NO: 658831 - DNA, 25 bp, Rattus norvegicus
ttacctcagctcacttcaggacaaa

SEQ ID NO: 658832 - DNA, 25 bp, Rattus norvegicus
ttacctcagctctcttcaggacaaa

SEQ ID NO: 658833 - DNA, 25 bp, Rattus norvegicus
ttacctcaggagaatggctgctatg

SEQ ID NO: 658834 - DNA, 25 bp, Rattus norvegicus
ttacctcaggagtatggctgctatg

SEQ ID NO: 658835 - DNA, 25 bp, Rattus norvegicus
ttacctcagtagatagtgggcctca

SEQ ID NO: 658836 - DNA, 25 bp, Rattus norvegicus
ttacctcagtagttagtgggcctca

SEQ ID NO: 658837 - DNA, 25 bp, Rattus norvegicus
ttacctcagtttactccccaagcag

SEQ ID NO: 658838 - DNA, 25 bp, Rattus norvegicus
ttacctcagttttctccccaagcag

SEQ ID NO: 658839 - DNA, 25 bp, Rattus norvegicus
ttacctccacatcttaactttcacg

SEQ ID NO: 658840 - DNA, 25 bp, Rattus norvegicus
ttacctccacatgttaactttcacg

SEQ ID NO: 658841 - DNA, 25 bp, Rattus norvegicus
ttacctccatgaagactcgtgacag

SEQ ID NO: 658842 - DNA, 25 bp, Rattus norvegicus
ttacctccatgatgactcgtgacag

SEQ ID NO: 658843 - DNA, 25 bp, Rattus norvegicus
ttacctcccaacatcatatgcgttt

SEQ ID NO: 658844 - DNA, 25 bp, Rattus norvegicus
ttacctcccaacttcatatgcgttt

SEQ ID NO: 658845 - DNA, 25 bp, Rattus norvegicus
ttacctccgtaactgtgactcatac

SEQ ID NO: 658846 - DNA, 25 bp, Rattus norvegicus
ttacctccgtaagtgtgactcatac

SEQ ID NO: 658847 - DNA, 25 bp, Rattus norvegicus
ttacctcctcttaactagacctgca

SEQ ID NO: 658848 - DNA, 25 bp, Rattus norvegicus
ttacctcctctttactagacctgca

SEQ ID NO: 658849 - DNA, 25 bp, Rattus norvegicus
ttacctcctgctcttttgttactga

SEQ ID NO: 658850 - DNA, 25 bp, Rattus norvegicus
ttacctcctgctgttttgttactga

SEQ ID NO: 658851 - DNA, 25 bp, Rattus norvegicus
ttacctcctgttacttagagctgga

SEQ ID NO: 658852 - DNA, 25 bp, Rattus norvegicus
ttacctcctgtttcttagagctgga

SEQ ID NO: 658853 - DNA, 25 bp, Rattus norvegicus
ttacctcctttaacaaggcctcaat

SEQ ID NO: 658854 - DNA, 25 bp, Rattus norvegicus
ttacctcctttatcaaggcctcaat

SEQ ID NO: 658855 - DNA, 25 bp, Rattus norvegicus
ttacctcgaggtatagacacaagtt

SEQ ID NO: 658856 - DNA, 25 bp, Rattus norvegicus
ttacctcgaggtttagacacaagtt

SEQ ID NO: 658857 - DNA, 25 bp, Rattus norvegicus
ttacctcgctacaaaacacttgctt

SEQ ID NO: 658858 - DNA, 25 bp, Rattus norvegicus
ttacctcgctactaaacacttgctt

SEQ ID NO: 658859 - DNA, 25 bp, Rattus norvegicus
ttacctctccgaccttcttggaaaa

SEQ ID NO: 658860 - DNA, 25 bp, Rattus norvegicus
ttacctctccgagcttcttggaaaa

SEQ ID NO: 658861 - DNA, 25 bp, Rattus norvegicus
ttacctctcctgagtatttgccagt

SEQ ID NO: 658862 - DNA, 25 bp, Rattus norvegicus
ttacctctcctgtgtatttgccagt

SEQ ID NO: 658863 - DNA, 25 bp, Rattus norvegicus
ttacctctctgaaggcctttattag

SEQ ID NO: 658864 - DNA, 25 bp, Rattus norvegicus
ttacctctctgatggcctttattag

SEQ ID NO: 658865 - DNA, 25 bp, Rattus norvegicus
ttacctctgaccagtacaaggcctg

SEQ ID NO: 658866 - DNA, 25 bp, Rattus norvegicus
ttacctctgacctgtacaaggcctg

SEQ ID NO: 658867 - DNA, 25 bp, Rattus norvegicus
ttacctctggaaatgctttactagc

SEQ ID NO: 658868 - DNA, 25 bp, Rattus norvegicus
ttacctctggaattgctttactagc

SEQ ID NO: 658869 - DNA, 25 bp, Rattus norvegicus
ttacctctgtgtatttaatattgac

SEQ ID NO: 658870 - DNA, 25 bp, Rattus norvegicus
ttacctctgtgtttttaatattgac

SEQ ID NO: 658871 - DNA, 25 bp, Rattus norvegicus
ttacctcttatcacgtgtgtggcag

SEQ ID NO: 658872 - DNA, 25 bp, Rattus norvegicus
ttacctcttatctcgtgtgtggcag

SEQ ID NO: 658873 - DNA, 25 bp, Rattus norvegicus
ttacctcttctcaagtgtactcagg

SEQ ID NO: 658874 - DNA, 25 bp, Rattus norvegicus
ttacctcttctctagtgtactcagg

SEQ ID NO: 658875 - DNA, 25 bp, Rattus norvegicus
ttacctgaacagctagagaccttgt

SEQ ID NO: 658876 - DNA, 25 bp, Rattus norvegicus
ttacctgaacaggtagagaccttgt

SEQ ID NO: 658877 - DNA, 25 bp, Rattus norvegicus
ttacctgaactcacatactcattct

SEQ ID NO: 658878 - DNA, 25 bp, Rattus norvegicus
ttacctgaactctcatactcattct

SEQ ID NO: 658879 - DNA, 25 bp, Rattus norvegicus
ttacctgaatacatggccacactca

SEQ ID NO: 658880 - DNA, 25 bp, Rattus norvegicus
ttacctgaatacttggccacactca

SEQ ID NO: 658881 - DNA, 25 bp, Rattus norvegicus
ttacctgacagcctcttcattaaag

SEQ ID NO: 658882 - DNA, 25 bp, Rattus norvegicus
ttacctgacagcgtcttcattaaag

SEQ ID NO: 658883 - DNA, 25 bp, Rattus norvegicus
ttacctgaccaaacctctgtataca

SEQ ID NO: 658884 - DNA, 25 bp, Rattus norvegicus
ttacctgaccaatcctctgtataca

SEQ ID NO: 658885 - DNA, 25 bp, Rattus norvegicus
ttacctgactccagagcctgttgtg

SEQ ID NO: 658886 - DNA, 25 bp, Rattus norvegicus
ttacctgactcctgagcctgttgtg

SEQ ID NO: 658887 - DNA, 25 bp, Rattus norvegicus
ttacctgagacactttctatggccc

SEQ ID NO: 658888 - DNA, 25 bp, Rattus norvegicus
ttacctgagacagtttctatggccc

SEQ ID NO: 658889 - DNA, 25 bp, Rattus norvegicus
ttacctgaggaaccatctgacacct

SEQ ID NO: 658890 - DNA, 25 bp, Rattus norvegicus
ttacctgaggaagcatctgacacct

SEQ ID NO: 658891 - DNA, 25 bp, Rattus norvegicus
ttacctgaggcccttgcttcagtat

SEQ ID NO: 658892 - DNA, 25 bp, Rattus norvegicus
ttacctgaggccgttgcttcagtat

SEQ ID NO: 658893 - DNA, 25 bp, Rattus norvegicus
ttacctgcacttcatataagccaat

SEQ ID NO: 658894 - DNA, 25 bp, Rattus norvegicus
ttacctgcacttgatataagccaat

SEQ ID NO: 658895 - DNA, 25 bp, Rattus norvegicus
ttacctgcagacaaaaatacccatg

SEQ ID NO: 658896 - DNA, 25 bp, Rattus norvegicus
ttacctgcagactaaaatacccatg

SEQ ID NO: 658897 - DNA, 25 bp, Rattus norvegicus
ttacctgcatccatccatgagggtg

SEQ ID NO: 658898 - DNA, 25 bp, Rattus norvegicus
ttacctgcatcccagctcagagacg

SEQ ID NO: 658899 - DNA, 25 bp, Rattus norvegicus
ttacctgcatccgagctcagagacg

SEQ ID NO: 658900 - DNA, 25 bp, Rattus norvegicus
ttacctgcatccttccatgagggtg

SEQ ID NO: 658901 - DNA, 25 bp, Rattus norvegicus
ttacctgcatgtaagactgcaccgt

SEQ ID NO: 658902 - DNA, 25 bp, Rattus norvegicus
ttacctgcatgttagactgcaccgt

SEQ ID NO: 658903 - DNA, 25 bp, Rattus norvegicus
ttacctgcctggctttttatctgcc

SEQ ID NO: 658904 - DNA, 25 bp, Rattus norvegicus
ttacctgcctgggtttttatctgcc

SEQ ID NO: 658905 - DNA, 25 bp, Rattus norvegicus
ttacctgcgcggcacgctatgtcta

SEQ ID NO: 658906 - DNA, 25 bp, Rattus norvegicus
ttacctgcgcgggacgctatgtcta

SEQ ID NO: 658907 - DNA, 25 bp, Rattus norvegicus
ttacctgcggcaccgggtagcacag

SEQ ID NO: 658908 - DNA, 25 bp, Rattus norvegicus
ttacctgcggcagcgggtagcacag

SEQ ID NO: 658909 - DNA, 25 bp, Rattus norvegicus
ttacctgctctcaagaacatcagtc

SEQ ID NO: 658910 - DNA, 25 bp, Rattus norvegicus
ttacctgctctctagaacatcagtc

SEQ ID NO: 658911 - DNA, 25 bp, Rattus norvegicus
ttacctgctgttagtgtgcgtgtgt

SEQ ID NO: 658912 - DNA, 25 bp, Rattus norvegicus
ttacctgctgtttgtgtgcgtgtgt

SEQ ID NO: 658913 - DNA, 25 bp, Rattus norvegicus
ttacctgcttggcaaaatattgaat

SEQ ID NO: 658914 - DNA, 25 bp, Rattus norvegicus
ttacctgcttgggaaaatattgaat

SEQ ID NO: 658915 - DNA, 25 bp, Rattus norvegicus
ttacctgctttcctcaatgtcttgt

SEQ ID NO: 658916 - DNA, 25 bp, Rattus norvegicus
ttacctgctttcgtcaatgtcttgt

SEQ ID NO: 658917 - DNA, 25 bp, Rattus norvegicus
ttacctggaactcgtcctgtgttgg

SEQ ID NO: 658918 - DNA, 25 bp, Rattus norvegicus
ttacctggaactggtcctgtgttgg

SEQ ID NO: 658919 - DNA, 25 bp, Rattus norvegicus
ttacctggacaaagtgctaacgcac

SEQ ID NO: 658920 - DNA, 25 bp, Rattus norvegicus
ttacctggacaatgtgctaacgcac

SEQ ID NO: 658921 - DNA, 25 bp, Rattus norvegicus
ttacctggacatagcttctgacact

SEQ ID NO: 658922 - DNA, 25 bp, Rattus norvegicus
ttacctggacattgcttctgacact

SEQ ID NO: 658923 - DNA, 25 bp, Rattus norvegicus
ttacctggaggtatatgatgaaccg

SEQ ID NO: 658924 - DNA, 25 bp, Rattus norvegicus
ttacctggaggtttatgatgaaccg

SEQ ID NO: 658925 - DNA, 25 bp, Rattus norvegicus
ttacctggataacacacacttagat

SEQ ID NO: 658926 - DNA, 25 bp, Rattus norvegicus
ttacctggataagacacacttagat

SEQ ID NO: 658927 - DNA, 25 bp, Rattus norvegicus
ttacctggcatcacgaaggctgtag

SEQ ID NO: 658928 - DNA, 25 bp, Rattus norvegicus
ttacctggcatctcgaaggctgtag

SEQ ID NO: 658929 - DNA, 25 bp, Rattus norvegicus
ttacctggccctagaaatgtgtgag

SEQ ID NO: 658930 - DNA, 25 bp, Rattus norvegicus
ttacctggcccttgaaatgtgtgag

SEQ ID NO: 658931 - DNA, 25 bp, Rattus norvegicus
ttacctggctaacccttaattgttg

SEQ ID NO: 658932 - DNA, 25 bp, Rattus norvegicus
ttacctggctaagccttaattgttg

SEQ ID NO: 658933 - DNA, 25 bp, Rattus norvegicus
ttacctgggacaacttgtttttcaa

SEQ ID NO: 658934 - DNA, 25 bp, Rattus norvegicus
ttacctgggacatcttgtttttcaa

SEQ ID NO: 658935 - DNA, 25 bp, Rattus norvegicus
ttacctgggaccagagtgggcacac

SEQ ID NO: 658936 - DNA, 25 bp, Rattus norvegicus
ttacctgggacctgagtgggcacac

SEQ ID NO: 658937 - DNA, 25 bp, Rattus norvegicus
ttacctgggccgcatcgaaatcatg

SEQ ID NO: 658938 - DNA, 25 bp, Rattus norvegicus
ttacctgggccggatcgaaatcatg

SEQ ID NO: 658939 - DNA, 25 bp, Rattus norvegicus
ttacctgggtacatagggcacgtgt

SEQ ID NO: 658940 - DNA, 25 bp, Rattus norvegicus
ttacctgggtacttagggcacgtgt

SEQ ID NO: 658941 - DNA, 25 bp, Rattus norvegicus
ttacctgggttcacattgctcttct

SEQ ID NO: 658942 - DNA, 25 bp, Rattus norvegicus
ttacctgggttctcattgctcttct

SEQ ID NO: 658943 - DNA, 25 bp, Rattus norvegicus
ttacctggtcagactggtgaccgag

SEQ ID NO: 658944 - DNA, 25 bp, Rattus norvegicus
ttacctggtcagtctggtgaccgag

SEQ ID NO: 658945 - DNA, 25 bp, Rattus norvegicus
ttacctggtcctagcctgagcttgg

SEQ ID NO: 658946 - DNA, 25 bp, Rattus norvegicus
ttacctggtccttgcctgagcttgg

SEQ ID NO: 658947 - DNA, 25 bp, Rattus norvegicus
ttacctggttgcctcttttagatca

SEQ ID NO: 658948 - DNA, 25 bp, Rattus norvegicus
ttacctggttgcgtcttttagatca

SEQ ID NO: 658949 - DNA, 25 bp, Rattus norvegicus
ttacctgtacatagcaactgtcggg

SEQ ID NO: 658950 - DNA, 25 bp, Rattus norvegicus
ttacctgtacattgcaactgtcggg

SEQ ID NO: 658951 - DNA, 25 bp, Rattus norvegicus
ttacctgtcaaaccagggtggcgat

SEQ ID NO: 658952 - DNA, 25 bp, Rattus norvegicus
ttacctgtcaaagcagggtggcgat

SEQ ID NO: 658953 - DNA, 25 bp, Rattus norvegicus
ttacctgtcacgcaaaagcttcaga

SEQ ID NO: 658954 - DNA, 25 bp, Rattus norvegicus
ttacctgtcacggaaaagcttcaga

SEQ ID NO: 658955 - DNA, 25 bp, Rattus norvegicus
ttacctgtccatagctaaggtccac

SEQ ID NO: 658956 - DNA, 25 bp, Rattus norvegicus
ttacctgtccattgctaaggtccac

SEQ ID NO: 658957 - DNA, 25 bp, Rattus norvegicus
ttacctgtgacacttcctttgcaga

SEQ ID NO: 658958 - DNA, 25 bp, Rattus norvegicus
ttacctgtgacagttcctttgcaga

SEQ ID NO: 658959 - DNA, 25 bp, Rattus norvegicus
ttacctgtgacgcttcttcctaaaa

SEQ ID NO: 658960 - DNA, 25 bp, Rattus norvegicus
ttacctgtgacggttcttcctaaaa

SEQ ID NO: 658961 - DNA, 25 bp, Rattus norvegicus
ttacctgtgattaagccatttgact

SEQ ID NO: 658962 - DNA, 25 bp, Rattus norvegicus
ttacctgtgatttagccatttgact

SEQ ID NO: 658963 - DNA, 25 bp, Rattus norvegicus
ttacctgtgccactgacaccaaaaa

SEQ ID NO: 658964 - DNA, 25 bp, Rattus norvegicus
ttacctgtgccagtgacaccaaaaa

SEQ ID NO: 658965 - DNA, 25 bp, Rattus norvegicus
ttacctgtgccgaggagtgtgactt

SEQ ID NO: 658966 - DNA, 25 bp, Rattus norvegicus
ttacctgtgccgtggagtgtgactt

SEQ ID NO: 658967 - DNA, 25 bp, Rattus norvegicus
ttacctgtggatatggtctgaccaa

SEQ ID NO: 658968 - DNA, 25 bp, Rattus norvegicus
ttacctgtggatttggtctgaccaa

SEQ ID NO: 658969 - DNA, 25 bp, Rattus norvegicus
ttacctgtggccacgttcataacaa

SEQ ID NO: 658970 - DNA, 25 bp, Rattus norvegicus
ttacctgtggcctcgttcataacaa

SEQ ID NO: 658971 - DNA, 25 bp, Rattus norvegicus
ttacctgtgggtactggattaaatc

SEQ ID NO: 658972 - DNA, 25 bp, Rattus norvegicus
ttacctgtgggttctggattaaatc

SEQ ID NO: 658973 - DNA, 25 bp, Rattus norvegicus
ttacctgtggtgacagctgggcttt

SEQ ID NO: 658974 - DNA, 25 bp, Rattus norvegicus
ttacctgtggtgtcagctgggcttt

SEQ ID NO: 658975 - DNA, 25 bp, Rattus norvegicus
ttacctgttgagagcacttcctact

SEQ ID NO: 658976 - DNA, 25 bp, Rattus norvegicus
ttacctgttgagtgcacttcctact

SEQ ID NO: 658977 - DNA, 25 bp, Rattus norvegicus
ttacctgtttttcctccaagtatga

SEQ ID NO: 658978 - DNA, 25 bp, Rattus norvegicus
ttacctgtttttgctccaagtatga

SEQ ID NO: 658979 - DNA, 25 bp, Rattus norvegicus
ttaccttaccgaacgagatgcccga

SEQ ID NO: 658980 - DNA, 25 bp, Rattus norvegicus
ttaccttaccgatcgagatgcccga

SEQ ID NO: 658981 - DNA, 25 bp, Rattus norvegicus
ttaccttagacaccccaactttggg

SEQ ID NO: 658982 - DNA, 25 bp, Rattus norvegicus
ttaccttagacagcccaactttggg

SEQ ID NO: 658983 - DNA, 25 bp, Rattus norvegicus
ttaccttcaaatcacaaaacttcgg

SEQ ID NO: 658984 - DNA, 25 bp, Rattus norvegicus
ttaccttcaaatgacaaaacttcgg

SEQ ID NO: 658985 - DNA, 25 bp, Rattus norvegicus
ttaccttcaagcaaaactcgtgccg

SEQ ID NO: 658986 - DNA, 25 bp, Rattus norvegicus
ttaccttcaagcatttgctctgagg

SEQ ID NO: 658987 - DNA, 25 bp, Rattus norvegicus
ttaccttcaagctaaactcgtgccg

SEQ ID NO: 658988 - DNA, 25 bp, Rattus norvegicus
ttaccttcaagcttttgctctgagg

SEQ ID NO: 658989 - DNA, 25 bp, Rattus norvegicus
ttaccttcacttcttatcaagtcag

SEQ ID NO: 658990 - DNA, 25 bp, Rattus norvegicus
ttaccttcacttgttatcaagtcag

SEQ ID NO: 658991 - DNA, 25 bp, Rattus norvegicus
ttaccttcagaacagcgcttagctg

SEQ ID NO: 658992 - DNA, 25 bp, Rattus norvegicus
ttaccttcagaagagcgcttagctg

SEQ ID NO: 658993 - DNA, 25 bp, Rattus norvegicus
ttaccttcaggcctgtgtgtcagcc

SEQ ID NO: 658994 - DNA, 25 bp, Rattus norvegicus
ttaccttcaggcgtgtgtgtcagcc

SEQ ID NO: 658995 - DNA, 25 bp, Rattus norvegicus
ttaccttcaggtccaaacaggcaag

SEQ ID NO: 658996 - DNA, 25 bp, Rattus norvegicus
ttaccttcaggtgcaaacaggcaag

SEQ ID NO: 658997 - DNA, 25 bp, Rattus norvegicus
ttaccttcataacctgtgtatccat

SEQ ID NO: 658998 - DNA, 25 bp, Rattus norvegicus
ttaccttcataagctgtgtatccat

SEQ ID NO: 658999 - DNA, 25 bp, Rattus norvegicus
ttaccttccacccatggttgtaaag

SEQ ID NO: 659000 - DNA, 25 bp, Rattus norvegicus
ttaccttccaccgatggttgtaaag

SEQ ID NO: 659001 - DNA, 25 bp, Rattus norvegicus
ttaccttcctaccagctcttcaggg

SEQ ID NO: 659002 - DNA, 25 bp, Rattus norvegicus
ttaccttcctacgagctcttcaggg

SEQ ID NO: 659003 - DNA, 25 bp, Rattus norvegicus
ttaccttcctagaggatgtcccagt

SEQ ID NO: 659004 - DNA, 25 bp, Rattus norvegicus
ttaccttcctagtggatgtcccagt

SEQ ID NO: 659005 - DNA, 25 bp, Rattus norvegicus
ttaccttcctctagtagcgaagatg

SEQ ID NO: 659006 - DNA, 25 bp, Rattus norvegicus
ttaccttcctctctagttagcatta

SEQ ID NO: 659007 - DNA, 25 bp, Rattus norvegicus
ttaccttcctctgtagttagcatta

SEQ ID NO: 659008 - DNA, 25 bp, Rattus norvegicus
ttaccttcctcttgtagcgaagatg

SEQ ID NO: 659009 - DNA, 25 bp, Rattus norvegicus
ttaccttccttcaccagagacagaa

SEQ ID NO: 659010 - DNA, 25 bp, Rattus norvegicus
ttaccttccttctccagagacagaa

SEQ ID NO: 659011 - DNA, 25 bp, Rattus norvegicus
ttaccttcgggacaaatggccactg

SEQ ID NO: 659012 - DNA, 25 bp, Rattus norvegicus
ttaccttcgggagaaatggccactg

SEQ ID NO: 659013 - DNA, 25 bp, Rattus norvegicus
ttaccttcgttgacacagccgcgtc

SEQ ID NO: 659014 - DNA, 25 bp, Rattus norvegicus
ttaccttcgttgtcacagccgcgtc

SEQ ID NO: 659015 - DNA, 25 bp, Rattus norvegicus
ttaccttctcttcctacaatagcag

SEQ ID NO: 659016 - DNA, 25 bp, Rattus norvegicus
ttaccttctcttgctacaatagcag

SEQ ID NO: 659017 - DNA, 25 bp, Rattus norvegicus
ttaccttctgaaccagcatccaatg

SEQ ID NO: 659018 - DNA, 25 bp, Rattus norvegicus
ttaccttctgaagcagcatccaatg

SEQ ID NO: 659019 - DNA, 25 bp, Rattus norvegicus
ttaccttctgtaacaagtgtcaata

SEQ ID NO: 659020 - DNA, 25 bp, Rattus norvegicus
ttaccttctgtatcaagtgtcaata

SEQ ID NO: 659021 - DNA, 25 bp, Rattus norvegicus
ttaccttgactgcattctcagagcc

SEQ ID NO: 659022 - DNA, 25 bp, Rattus norvegicus
ttaccttgactggattctcagagcc

SEQ ID NO: 659023 - DNA, 25 bp, Rattus norvegicus
ttaccttgccttctcttggtcatac

SEQ ID NO: 659024 - DNA, 25 bp, Rattus norvegicus
ttaccttgccttgtcttggtcatac

SEQ ID NO: 659025 - DNA, 25 bp, Rattus norvegicus
ttaccttgctacaattacacccttt

SEQ ID NO: 659026 - DNA, 25 bp, Rattus norvegicus
ttaccttgctactattacacccttt

SEQ ID NO: 659027 - DNA, 25 bp, Rattus norvegicus
ttaccttgctttctcctggagggca

SEQ ID NO: 659028 - DNA, 25 bp, Rattus norvegicus
ttaccttgctttgtcctggagggca

SEQ ID NO: 659029 - DNA, 25 bp, Rattus norvegicus
ttaccttggagaagccttgaggcgg

SEQ ID NO: 659030 - DNA, 25 bp, Rattus norvegicus
ttaccttggagatgccttgaggcgg

SEQ ID NO: 659031 - DNA, 25 bp, Rattus norvegicus
ttaccttgggttatcctcggattca

SEQ ID NO: 659032 - DNA, 25 bp, Rattus norvegicus
ttaccttgggttttcctcggattca

SEQ ID NO: 659033 - DNA, 25 bp, Rattus norvegicus
ttacctttaattcccatatcctctg

SEQ ID NO: 659034 - DNA, 25 bp, Rattus norvegicus
ttacctttaattgccatatcctctg

SEQ ID NO: 659035 - DNA, 25 bp, Rattus norvegicus
ttacctttaggcctgacttctacag

SEQ ID NO: 659036 - DNA, 25 bp, Rattus norvegicus
ttacctttaggcgtgacttctacag

SEQ ID NO: 659037 - DNA, 25 bp, Rattus norvegicus
ttacctttcaaacaccacggacatg

SEQ ID NO: 659038 - DNA, 25 bp, Rattus norvegicus
ttacctttcaaagaccacggacatg

SEQ ID NO: 659039 - DNA, 25 bp, Rattus norvegicus
ttacctttcaacagctccagtgtag

SEQ ID NO: 659040 - DNA, 25 bp, Rattus norvegicus
ttacctttcaactgctccagtgtag

SEQ ID NO: 659041 - DNA, 25 bp, Rattus norvegicus
ttacctttcccaagccgaattattt

SEQ ID NO: 659042 - DNA, 25 bp, Rattus norvegicus
ttacctttcccatgccgaattattt

SEQ ID NO: 659043 - DNA, 25 bp, Rattus norvegicus
ttacctttcctaagggctcctgtaa

SEQ ID NO: 659044 - DNA, 25 bp, Rattus norvegicus
ttacctttcctacagacttctacag

SEQ ID NO: 659045 - DNA, 25 bp, Rattus norvegicus
ttacctttcctagagacttctacag

SEQ ID NO: 659046 - DNA, 25 bp, Rattus norvegicus
ttacctttcctatgggctcctgtaa

SEQ ID NO: 659047 - DNA, 25 bp, Rattus norvegicus
ttacctttctaacactttctcccat

SEQ ID NO: 659048 - DNA, 25 bp, Rattus norvegicus
ttacctttctaagactttctcccat

SEQ ID NO: 659049 - DNA, 25 bp, Rattus norvegicus
ttacctttgcttcaggtgcttggta

SEQ ID NO: 659050 - DNA, 25 bp, Rattus norvegicus
ttacctttgcttgaggtgcttggta

SEQ ID NO: 659051 - DNA, 25 bp, Rattus norvegicus
ttacctttgggccttgcatgattaa

SEQ ID NO: 659052 - DNA, 25 bp, Rattus norvegicus
ttacctttgggcgttgcatgattaa

SEQ ID NO: 659053 - DNA, 25 bp, Rattus norvegicus
ttaccttttttcagatgactagcaa

SEQ ID NO: 659054 - DNA, 25 bp, Rattus norvegicus
ttaccttttttctgatgactagcaa

SEQ ID NO: 659055 - DNA, 25 bp, Rattus norvegicus
ttacgaaccctgaggtcaccagaaa

SEQ ID NO: 659056 - DNA, 25 bp, Rattus norvegicus
ttacgaaccctgtggtcaccagaaa

SEQ ID NO: 659057 - DNA, 25 bp, Rattus norvegicus
ttacgaagataaaaggccacacaaa

SEQ ID NO: 659058 - DNA, 25 bp, Rattus norvegicus
ttacgaagataataggccacacaaa

SEQ ID NO: 659059 - DNA, 25 bp, Rattus norvegicus
ttacgaatgctcacgcagaggctct

SEQ ID NO: 659060 - DNA, 25 bp, Rattus norvegicus
ttacgaatgctctcgcagaggctct

SEQ ID NO: 659061 - DNA, 25 bp, Rattus norvegicus
ttacgacaagtactaccagacgcca

SEQ ID NO: 659062 - DNA, 25 bp, Rattus norvegicus
ttacgacaagtagtaccagacgcca

SEQ ID NO: 659063 - DNA, 25 bp, Rattus norvegicus
ttacgacacagtactgcggactctg

SEQ ID NO: 659064 - DNA, 25 bp, Rattus norvegicus
ttacgacacagttctgcggactctg

SEQ ID NO: 659065 - DNA, 25 bp, Rattus norvegicus
ttacgacagcgtcacaaagccagac

SEQ ID NO: 659066 - DNA, 25 bp, Rattus norvegicus
ttacgacagcgtgacaaagccagac

SEQ ID NO: 659067 - DNA, 25 bp, Rattus norvegicus
ttacgacagtctcttggtacatagg

SEQ ID NO: 659068 - DNA, 25 bp, Rattus norvegicus
ttacgacagtctgttggtacatagg

SEQ ID NO: 659069 - DNA, 25 bp, Rattus norvegicus
ttacgaccaccaaccacaaagtgag

SEQ ID NO: 659070 - DNA, 25 bp, Rattus norvegicus
ttacgaccaccatccacaaagtgag

SEQ ID NO: 659071 - DNA, 25 bp, Rattus norvegicus
ttacgacccgaacgagagcttttat

SEQ ID NO: 659072 - DNA, 25 bp, Rattus norvegicus
ttacgacccgaaggagagcttttat

SEQ ID NO: 659073 - DNA, 25 bp, Rattus norvegicus
ttacgacctgagagtcttgggcata

SEQ ID NO: 659074 - DNA, 25 bp, Rattus norvegicus
ttacgacctgagtgtcttgggcata

SEQ ID NO: 659075 - DNA, 25 bp, Rattus norvegicus
ttacgacgtatgatttgcttgtttc

SEQ ID NO: 659076 - DNA, 25 bp, Rattus norvegicus
ttacgacgtatgttttgcttgtttc

SEQ ID NO: 659077 - DNA, 25 bp, Rattus norvegicus
ttacgacgtgaccttggctgggcat

SEQ ID NO: 659078 - DNA, 25 bp, Rattus norvegicus
ttacgacgtgacgttggctgggcat

SEQ ID NO: 659079 - DNA, 25 bp, Rattus norvegicus
ttacgagttctaagcctgtcaagtg

SEQ ID NO: 659080 - DNA, 25 bp, Rattus norvegicus
ttacgagttctatgcctgtcaagtg

SEQ ID NO: 659081 - DNA, 25 bp, Rattus norvegicus
ttacgatgaaggctgcagctgtgct

SEQ ID NO: 659082 - DNA, 25 bp, Rattus norvegicus
ttacgatgaagggtgcagctgtgct

SEQ ID NO: 659083 - DNA, 25 bp, Rattus norvegicus
ttacgatgccatacacgtcggagct

SEQ ID NO: 659084 - DNA, 25 bp, Rattus norvegicus
ttacgatgccattcacgtcggagct

SEQ ID NO: 659085 - DNA, 25 bp, Rattus norvegicus
ttacgattgtgtatctcagactgag

SEQ ID NO: 659086 - DNA, 25 bp, Rattus norvegicus
ttacgattgtgtttctcagactgag

SEQ ID NO: 659087 - DNA, 25 bp, Rattus norvegicus
ttacgatttctaatgagggtcctat

SEQ ID NO: 659088 - DNA, 25 bp, Rattus norvegicus
ttacgatttctattgagggtcctat

SEQ ID NO: 659089 - DNA, 25 bp, Rattus norvegicus
ttacgcaacagtatccctcgtgggc

SEQ ID NO: 659090 - DNA, 25 bp, Rattus norvegicus
ttacgcaacagtttccctcgtgggc

SEQ ID NO: 659091 - DNA, 25 bp, Rattus norvegicus
ttacgcaactcccaggcatcaatgt

SEQ ID NO: 659092 - DNA, 25 bp, Rattus norvegicus
ttacgcaactccgaggcatcaatgt

SEQ ID NO: 659093 - DNA, 25 bp, Rattus norvegicus
ttacgcagatttcccagcagaagaa

SEQ ID NO: 659094 - DNA, 25 bp, Rattus norvegicus
ttacgcagatttgccagcagaagaa

SEQ ID NO: 659095 - DNA, 25 bp, Rattus norvegicus
ttacgcatcctcagacacacgtaga

SEQ ID NO: 659096 - DNA, 25 bp, Rattus norvegicus
ttacgcatcctctgacacacgtaga

SEQ ID NO: 659097 - DNA, 25 bp, Rattus norvegicus
ttacgcatgctcagtggtggtggat

SEQ ID NO: 659098 - DNA, 25 bp, Rattus norvegicus
ttacgcatgctctgtggtggtggat

SEQ ID NO: 659099 - DNA, 25 bp, Rattus norvegicus
ttacgcattaacactggactcctgt

SEQ ID NO: 659100 - DNA, 25 bp, Rattus norvegicus
ttacgcattaactctggactcctgt

SEQ ID NO: 659101 - DNA, 25 bp, Rattus norvegicus
ttacgccagggtagtctgcggttca

SEQ ID NO: 659102 - DNA, 25 bp, Rattus norvegicus
ttacgccagggttgtctgcggttca

SEQ ID NO: 659103 - DNA, 25 bp, Rattus norvegicus
ttacgcctagacagagtttggtttt

SEQ ID NO: 659104 - DNA, 25 bp, Rattus norvegicus
ttacgcctagactgagtttggtttt

SEQ ID NO: 659105 - DNA, 25 bp, Rattus norvegicus
ttacgcctgtgtagatggaaaacca

SEQ ID NO: 659106 - DNA, 25 bp, Rattus norvegicus
ttacgcctgtgttgatggaaaacca

SEQ ID NO: 659107 - DNA, 25 bp, Rattus norvegicus
ttacgccttggacaaattccaccca

SEQ ID NO: 659108 - DNA, 25 bp, Rattus norvegicus
ttacgccttggagaaattccaccca

SEQ ID NO: 659109 - DNA, 25 bp, Rattus norvegicus
ttacgcgattggaattttgggccct

SEQ ID NO: 659110 - DNA, 25 bp, Rattus norvegicus
ttacgcgattggtattttgggccct

SEQ ID NO: 659111 - DNA, 25 bp, Rattus norvegicus
ttacgctcagtcacaaagctttgca

SEQ ID NO: 659112 - DNA, 25 bp, Rattus norvegicus
ttacgctcagtctcaaagctttgca

SEQ ID NO: 659113 - DNA, 25 bp, Rattus norvegicus
ttacgctgagccattgctgggcaac

SEQ ID NO: 659114 - DNA, 25 bp, Rattus norvegicus
ttacgctgagcctttgctgggcaac

SEQ ID NO: 659115 - DNA, 25 bp, Rattus norvegicus
ttacgcttagcactccgtgatacta

SEQ ID NO: 659116 - DNA, 25 bp, Rattus norvegicus
ttacgcttagcagtccgtgatacta

SEQ ID NO: 659117 - DNA, 25 bp, Rattus norvegicus
ttacgcttaggaacttcggtcacca

SEQ ID NO: 659118 - DNA, 25 bp, Rattus norvegicus
ttacgcttaggatcttcggtcacca

SEQ ID NO: 659119 - DNA, 25 bp, Rattus norvegicus
ttacgcttcactctgatctgtgtgc

SEQ ID NO: 659120 - DNA, 25 bp, Rattus norvegicus
ttacgcttcactgtgatctgtgtgc

SEQ ID NO: 659121 - DNA, 25 bp, Rattus norvegicus
ttacggaacctcatcacagatctgt

SEQ ID NO: 659122 - DNA, 25 bp, Rattus norvegicus
ttacggaacctcttcacagatctgt

SEQ ID NO: 659123 - DNA, 25 bp, Rattus norvegicus
ttacggacacggagatcatgacact

SEQ ID NO: 659124 - DNA, 25 bp, Rattus norvegicus
ttacggacacggtgatcatgacact

SEQ ID NO: 659125 - DNA, 25 bp, Rattus norvegicus
ttacggactgatcctacctgagaat

SEQ ID NO: 659126 - DNA, 25 bp, Rattus norvegicus
ttacggactgatgctacctgagaat

SEQ ID NO: 659127 - DNA, 25 bp, Rattus norvegicus
ttacggagacgcctccaagtttgca

SEQ ID NO: 659128 - DNA, 25 bp, Rattus norvegicus
ttacggagacgcgtccaagtttgca

SEQ ID NO: 659129 - DNA, 25 bp, Rattus norvegicus
ttacggagccaaaagctggtacaat

SEQ ID NO: 659130 - DNA, 25 bp, Rattus norvegicus
ttacggagccaaccatctacggttg

SEQ ID NO: 659131 - DNA, 25 bp, Rattus norvegicus
ttacggagccaagcatctacggttg

SEQ ID NO: 659132 - DNA, 25 bp, Rattus norvegicus
ttacggagccaatagctggtacaat

SEQ ID NO: 659133 - DNA, 25 bp, Rattus norvegicus
ttacggagcctgctctacgcatgtt

SEQ ID NO: 659134 - DNA, 25 bp, Rattus norvegicus
ttacggagcctggtctacgcatgtt

SEQ ID NO: 659135 - DNA, 25 bp, Rattus norvegicus
ttacggaggagcaaacaggccattc

SEQ ID NO: 659136 - DNA, 25 bp, Rattus norvegicus
ttacggaggagctaacaggccattc

SEQ ID NO: 659137 - DNA, 25 bp, Rattus norvegicus
ttacggcacctcaccaaggaagaga

SEQ ID NO: 659138 - DNA, 25 bp, Rattus norvegicus
ttacggcacctctccaaggaagaga

SEQ ID NO: 659139 - DNA, 25 bp, Rattus norvegicus
ttacggcagggtctacacagctgac

SEQ ID NO: 659140 - DNA, 25 bp, Rattus norvegicus
ttacggcagggtgtacacagctgac

SEQ ID NO: 659141 - DNA, 25 bp, Rattus norvegicus
ttacggccatgtactgtgagcttgc

SEQ ID NO: 659142 - DNA, 25 bp, Rattus norvegicus
ttacggccatgttctgtgagcttgc

SEQ ID NO: 659143 - DNA, 25 bp, Rattus norvegicus
ttacggcctctgaagtggcaggaat

SEQ ID NO: 659144 - DNA, 25 bp, Rattus norvegicus
ttacggcctctgtagtggcaggaat

SEQ ID NO: 659145 - DNA, 25 bp, Rattus norvegicus
ttacggcctgatacctttagaccca

SEQ ID NO: 659146 - DNA, 25 bp, Rattus norvegicus
ttacggcctgattcctttagaccca

SEQ ID NO: 659147 - DNA, 25 bp, Rattus norvegicus
ttacggcgattaaaagcacggcaca

SEQ ID NO: 659148 - DNA, 25 bp, Rattus norvegicus
ttacggcgattataagcacggcaca

SEQ ID NO: 659149 - DNA, 25 bp, Rattus norvegicus
ttacggctgtggaatcagtagtgta

SEQ ID NO: 659150 - DNA, 25 bp, Rattus norvegicus
ttacggctgtggtatcagtagtgta

SEQ ID NO: 659151 - DNA, 25 bp, Rattus norvegicus
ttacggcttcggaggtcacaggcag

SEQ ID NO: 659152 - DNA, 25 bp, Rattus norvegicus
ttacggcttcggtggtcacaggcag

SEQ ID NO: 659153 - DNA, 25 bp, Rattus norvegicus
ttacgggacaccaggtagctggttc

SEQ ID NO: 659154 - DNA, 25 bp, Rattus norvegicus
ttacgggacacctggtagctggttc

SEQ ID NO: 659155 - DNA, 25 bp, Rattus norvegicus
ttacgggcatggcacaagttaggaa

SEQ ID NO: 659156 - DNA, 25 bp, Rattus norvegicus
ttacgggcatgggacaagttaggaa

SEQ ID NO: 659157 - DNA, 25 bp, Rattus norvegicus
ttacgggccaggctctgaactgctc

SEQ ID NO: 659158 - DNA, 25 bp, Rattus norvegicus
ttacgggccagggtctgaactgctc

SEQ ID NO: 659159 - DNA, 25 bp, Rattus norvegicus
ttacgggcccagagaacgcggtaca

SEQ ID NO: 659160 - DNA, 25 bp, Rattus norvegicus
ttacgggcccagtgaacgcggtaca

SEQ ID NO: 659161 - DNA, 25 bp, Rattus norvegicus
ttacgggtacttacttcacgcgagc

SEQ ID NO: 659162 - DNA, 25 bp, Rattus norvegicus
ttacgggtactttcttcacgcgagc

SEQ ID NO: 659163 - DNA, 25 bp, Rattus norvegicus
ttacgggtatggacacagccccaaa

SEQ ID NO: 659164 - DNA, 25 bp, Rattus norvegicus
ttacgggtatggtcacagccccaaa

SEQ ID NO: 659165 - DNA, 25 bp, Rattus norvegicus
ttacgggtcttcataagatgttctg

SEQ ID NO: 659166 - DNA, 25 bp, Rattus norvegicus
ttacgggtcttcttaagatgttctg

SEQ ID NO: 659167 - DNA, 25 bp, Rattus norvegicus
ttacggtgccaacggattcagcctg

SEQ ID NO: 659168 - DNA, 25 bp, Rattus norvegicus
ttacggtgccaagggattcagcctg

SEQ ID NO: 659169 - DNA, 25 bp, Rattus norvegicus
ttacggtgtcctaggcagtgacgca

SEQ ID NO: 659170 - DNA, 25 bp, Rattus norvegicus
ttacggtgtccttggcagtgacgca

SEQ ID NO: 659171 - DNA, 25 bp, Rattus norvegicus
ttacggtgtctccatgtcgggctca

SEQ ID NO: 659172 - DNA, 25 bp, Rattus norvegicus
ttacggtgtctcgatgtcgggctca

SEQ ID NO: 659173 - DNA, 25 bp, Rattus norvegicus
ttacggtttcctactgggcctgtgt

SEQ ID NO: 659174 - DNA, 25 bp, Rattus norvegicus
ttacggtttccttctgggcctgtgt

SEQ ID NO: 659175 - DNA, 25 bp, Rattus norvegicus
ttacgtaagacgcactcctggagta

SEQ ID NO: 659176 - DNA, 25 bp, Rattus norvegicus
ttacgtaagacggactcctggagta

SEQ ID NO: 659177 - DNA, 25 bp, Rattus norvegicus
ttacgtacagtgatgtctcagccag

SEQ ID NO: 659178 - DNA, 25 bp, Rattus norvegicus
ttacgtacagtgttgtctcagccag

SEQ ID NO: 659179 - DNA, 25 bp, Rattus norvegicus
ttacgtaccagaactccctgagtgg

SEQ ID NO: 659180 - DNA, 25 bp, Rattus norvegicus
ttacgtaccagatctccctgagtgg

SEQ ID NO: 659181 - DNA, 25 bp, Rattus norvegicus
ttacgtactggtaagttcttgagcc

SEQ ID NO: 659182 - DNA, 25 bp, Rattus norvegicus
ttacgtactggttagttcttgagcc

SEQ ID NO: 659183 - DNA, 25 bp, Rattus norvegicus
ttacgtacttctaaggttggcctat

SEQ ID NO: 659184 - DNA, 25 bp, Rattus norvegicus
ttacgtacttcttaggttggcctat

SEQ ID NO: 659185 - DNA, 25 bp, Rattus norvegicus
ttacgtagcgaacggacgcccgcgc

SEQ ID NO: 659186 - DNA, 25 bp, Rattus norvegicus
ttacgtagcgaagggacgcccgcgc

SEQ ID NO: 659187 - DNA, 25 bp, Rattus norvegicus
ttacgtagttaaccgtgcagccttt

SEQ ID NO: 659188 - DNA, 25 bp, Rattus norvegicus
ttacgtagttaagcgtgcagccttt

SEQ ID NO: 659189 - DNA, 25 bp, Rattus norvegicus
ttacgtccactaaggaaaatagtac

SEQ ID NO: 659190 - DNA, 25 bp, Rattus norvegicus
ttacgtccactatggaaaatagtac

SEQ ID NO: 659191 - DNA, 25 bp, Rattus norvegicus
ttacgtccaggaaagtgcaccagtg

SEQ ID NO: 659192 - DNA, 25 bp, Rattus norvegicus
ttacgtccaggatagtgcaccagtg

SEQ ID NO: 659193 - DNA, 25 bp, Rattus norvegicus
ttacgtcccactcaacagaaccaag

SEQ ID NO: 659194 - DNA, 25 bp, Rattus norvegicus
ttacgtcccactgaacagaaccaag

SEQ ID NO: 659195 - DNA, 25 bp, Rattus norvegicus
ttacgtcctgatcaagtggccgatt

SEQ ID NO: 659196 - DNA, 25 bp, Rattus norvegicus
ttacgtcctgatgaagtggccgatt

SEQ ID NO: 659197 - DNA, 25 bp, Rattus norvegicus
ttacgtctatagctccgtccagaaa

SEQ ID NO: 659198 - DNA, 25 bp, Rattus norvegicus
ttacgtctataggtccgtccagaaa

SEQ ID NO: 659199 - DNA, 25 bp, Rattus norvegicus
ttacgtctcctgactttgagcgttc

SEQ ID NO: 659200 - DNA, 25 bp, Rattus norvegicus
ttacgtctcctgtctttgagcgttc

SEQ ID NO: 659201 - DNA, 25 bp, Rattus norvegicus
ttacgtgcacctccctaggaggtaa

SEQ ID NO: 659202 - DNA, 25 bp, Rattus norvegicus
ttacgtgcacctgcctaggaggtaa

SEQ ID NO: 659203 - DNA, 25 bp, Rattus norvegicus
ttacgtgcgttcaaaccagcttgag

SEQ ID NO: 659204 - DNA, 25 bp, Rattus norvegicus
ttacgtgcgttctaaccagcttgag

SEQ ID NO: 659205 - DNA, 25 bp, Rattus norvegicus
ttacgtgctggcatgggcattttac

SEQ ID NO: 659206 - DNA, 25 bp, Rattus norvegicus
ttacgtgctggcttgggcattttac

SEQ ID NO: 659207 - DNA, 25 bp, Rattus norvegicus
ttacgtgctgtacgaatggttcctt

SEQ ID NO: 659208 - DNA, 25 bp, Rattus norvegicus
ttacgtgctgtaggaatggttcctt

SEQ ID NO: 659209 - DNA, 25 bp, Rattus norvegicus
ttacgtgcttgcacgtgttcggttc

SEQ ID NO: 659210 - DNA, 25 bp, Rattus norvegicus
ttacgtgcttgctcgtgttcggttc

SEQ ID NO: 659211 - DNA, 25 bp, Rattus norvegicus
ttacgtggacacattctatgttagt

SEQ ID NO: 659212 - DNA, 25 bp, Rattus norvegicus
ttacgtggacactttctatgttagt

SEQ ID NO: 659213 - DNA, 25 bp, Rattus norvegicus
ttacgtggaggcatggccactgtca

SEQ ID NO: 659214 - DNA, 25 bp, Rattus norvegicus
ttacgtggaggcttggccactgtca

SEQ ID NO: 659215 - DNA, 25 bp, Rattus norvegicus
ttacgtggctctctgaatggcggtc

SEQ ID NO: 659216 - DNA, 25 bp, Rattus norvegicus
ttacgtggctctgtgaatggcggtc

SEQ ID NO: 659217 - DNA, 25 bp, Rattus norvegicus
ttacgtgggcagacaggcagatcct

SEQ ID NO: 659218 - DNA, 25 bp, Rattus norvegicus
ttacgtgggcagtcaggcagatcct

SEQ ID NO: 659219 - DNA, 25 bp, Rattus norvegicus
ttacgtgtagtcagtccgcctaaac

SEQ ID NO: 659220 - DNA, 25 bp, Rattus norvegicus
ttacgtgtagtctgtccgcctaaac

SEQ ID NO: 659221 - DNA, 25 bp, Rattus norvegicus
ttacgtgtcaagagagctgctccgc

SEQ ID NO: 659222 - DNA, 25 bp, Rattus norvegicus
ttacgtgtcaagtgagctgctccgc

SEQ ID NO: 659223 - DNA, 25 bp, Rattus norvegicus
ttacgtgtgccaagaagaccctgat

SEQ ID NO: 659224 - DNA, 25 bp, Rattus norvegicus
ttacgtgtgccatgaagaccctgat

SEQ ID NO: 659225 - DNA, 25 bp, Rattus norvegicus
ttacgtttccatccgaaggagcaag

SEQ ID NO: 659226 - DNA, 25 bp, Rattus norvegicus
ttacgtttccatgcgaaggagcaag

SEQ ID NO: 659227 - DNA, 25 bp, Rattus norvegicus
ttactaaagtgacttccccttctag

SEQ ID NO: 659228 - DNA, 25 bp, Rattus norvegicus
ttactaaagtgagttccccttctag

SEQ ID NO: 659229 - DNA, 25 bp, Rattus norvegicus
ttactaacaccccagtagaacctga

SEQ ID NO: 659230 - DNA, 25 bp, Rattus norvegicus
ttactaacacccgagtagaacctga

SEQ ID NO: 659231 - DNA, 25 bp, Rattus norvegicus
ttactaaccaagcaggctgtcccta

SEQ ID NO: 659232 - DNA, 25 bp, Rattus norvegicus
ttactaaccaaggaggctgtcccta

SEQ ID NO: 659233 - DNA, 25 bp, Rattus norvegicus
ttactaactacaccatctcccaatg

SEQ ID NO: 659234 - DNA, 25 bp, Rattus norvegicus
ttactaactacagcatctcccaatg

SEQ ID NO: 659235 - DNA, 25 bp, Rattus norvegicus
ttactaatatctccagcaccaagca

SEQ ID NO: 659236 - DNA, 25 bp, Rattus norvegicus
ttactaatatctgcagcaccaagca

SEQ ID NO: 659237 - DNA, 25 bp, Rattus norvegicus
ttactaatctctccatgggtaccac

SEQ ID NO: 659238 - DNA, 25 bp, Rattus norvegicus
ttactaatctctgcatgggtaccac

SEQ ID NO: 659239 - DNA, 25 bp, Rattus norvegicus
ttactaatgctaagggctggcccag

SEQ ID NO: 659240 - DNA, 25 bp, Rattus norvegicus
ttactaatgctatgggctggcccag

SEQ ID NO: 659241 - DNA, 25 bp, Rattus norvegicus
ttactaattcctagttcgctgtgtt

SEQ ID NO: 659242 - DNA, 25 bp, Rattus norvegicus
ttactaattccttgttcgctgtgtt

SEQ ID NO: 659243 - DNA, 25 bp, Rattus norvegicus
ttactacaatggagactctgccggc

SEQ ID NO: 659244 - DNA, 25 bp, Rattus norvegicus
ttactacaatggtgactctgccggc

SEQ ID NO: 659245 - DNA, 25 bp, Rattus norvegicus
ttactacagagacatccttgggcct

SEQ ID NO: 659246 - DNA, 25 bp, Rattus norvegicus
ttactacagagagatccttgggcct

SEQ ID NO: 659247 - DNA, 25 bp, Rattus norvegicus
ttactacatcatagtgggctgccag

SEQ ID NO: 659248 - DNA, 25 bp, Rattus norvegicus
ttactacatcattgtgggctgccag

SEQ ID NO: 659249 - DNA, 25 bp, Rattus norvegicus
ttactacatctcaccggtttgcaga

SEQ ID NO: 659250 - DNA, 25 bp, Rattus norvegicus
ttactacatctctccggtttgcaga

SEQ ID NO: 659251 - DNA, 25 bp, Rattus norvegicus
ttactacatgccagtgtggtgccaa

SEQ ID NO: 659252 - DNA, 25 bp, Rattus norvegicus
ttactacatgcctgtgtggtgccaa

SEQ ID NO: 659253 - DNA, 25 bp, Rattus norvegicus
ttactaccagccaagcctgactgag

SEQ ID NO: 659254 - DNA, 25 bp, Rattus norvegicus
ttactaccagcctagcctgactgag

SEQ ID NO: 659255 - DNA, 25 bp, Rattus norvegicus
ttactaccctctcttttcagtcaac

SEQ ID NO: 659256 - DNA, 25 bp, Rattus norvegicus
ttactaccctctgttttcagtcaac

SEQ ID NO: 659257 - DNA, 25 bp, Rattus norvegicus
ttactacgacatagccaggcaccag

SEQ ID NO: 659258 - DNA, 25 bp, Rattus norvegicus
ttactacgacattgccaggcaccag

SEQ ID NO: 659259 - DNA, 25 bp, Rattus norvegicus
ttactacgttacatacccacttctg

SEQ ID NO: 659260 - DNA, 25 bp, Rattus norvegicus
ttactacgttacttacccacttctg

SEQ ID NO: 659261 - DNA, 25 bp, Rattus norvegicus
ttactactaggtacagatctctggc

SEQ ID NO: 659262 - DNA, 25 bp, Rattus norvegicus
ttactactaggttcagatctctggc

SEQ ID NO: 659263 - DNA, 25 bp, Rattus norvegicus
ttactactcgagaccaattcttaga

SEQ ID NO: 659264 - DNA, 25 bp, Rattus norvegicus
ttactactcgagtccaattcttaga

SEQ ID NO: 659265 - DNA, 25 bp, Rattus norvegicus
ttactacttgtgagacttggtcctt

SEQ ID NO: 659266 - DNA, 25 bp, Rattus norvegicus
ttactacttgtgtgacttggtcctt

SEQ ID NO: 659267 - DNA, 25 bp, Rattus norvegicus
ttactagacctgcagaccacttcaa

SEQ ID NO: 659268 - DNA, 25 bp, Rattus norvegicus
ttactagacctggagaccacttcaa

SEQ ID NO: 659269 - DNA, 25 bp, Rattus norvegicus
ttactagcaagtctgccttctgcag

SEQ ID NO: 659270 - DNA, 25 bp, Rattus norvegicus
ttactagcaagtgtgccttctgcag

SEQ ID NO: 659271 - DNA, 25 bp, Rattus norvegicus
ttactagcactaatcctcagagggc

SEQ ID NO: 659272 - DNA, 25 bp, Rattus norvegicus
ttactagcactattcctcagagggc

SEQ ID NO: 659273 - DNA, 25 bp, Rattus norvegicus
ttactagcagctacagcacggtctg

SEQ ID NO: 659274 - DNA, 25 bp, Rattus norvegicus
ttactagcagcttcagcacggtctg

SEQ ID NO: 659275 - DNA, 25 bp, Rattus norvegicus
ttactagtcattccgtgccatcagg

SEQ ID NO: 659276 - DNA, 25 bp, Rattus norvegicus
ttactagtcattgcgtgccatcagg

SEQ ID NO: 659277 - DNA, 25 bp, Rattus norvegicus
ttactagtccatacagcaccttcaa

SEQ ID NO: 659278 - DNA, 25 bp, Rattus norvegicus
ttactagtccattcagcaccttcaa

SEQ ID NO: 659279 - DNA, 25 bp, Rattus norvegicus
ttactataaacacatctgctccctc

SEQ ID NO: 659280 - DNA, 25 bp, Rattus norvegicus
ttactataaacagatctgctccctc

SEQ ID NO: 659281 - DNA, 25 bp, Rattus norvegicus
ttactataatgtaccacctcagccc

SEQ ID NO: 659282 - DNA, 25 bp, Rattus norvegicus
ttactataatgttccacctcagccc

SEQ ID NO: 659283 - DNA, 25 bp, Rattus norvegicus
ttactatacaccaagtgcccactgt

SEQ ID NO: 659284 - DNA, 25 bp, Rattus norvegicus
ttactatacacctagtgcccactgt

SEQ ID NO: 659285 - DNA, 25 bp, Rattus norvegicus
ttactatcacagattgcctacgtgg

SEQ ID NO: 659286 - DNA, 25 bp, Rattus norvegicus
ttactatcacagtttgcctacgtgg

SEQ ID NO: 659287 - DNA, 25 bp, Rattus norvegicus
ttactatcatctaatgctgctggaa

SEQ ID NO: 659288 - DNA, 25 bp, Rattus norvegicus
ttactatcatcttatgctgctggaa

SEQ ID NO: 659289 - DNA, 25 bp, Rattus norvegicus
ttactatccaaaacctattgtccaa

SEQ ID NO: 659290 - DNA, 25 bp, Rattus norvegicus
ttactatccaaatcctattgtccaa

SEQ ID NO: 659291 - DNA, 25 bp, Rattus norvegicus
ttactatcccaccactatcattcta

SEQ ID NO: 659292 - DNA, 25 bp, Rattus norvegicus
ttactatcccacgactatcattcta

SEQ ID NO: 659293 - DNA, 25 bp, Rattus norvegicus
ttactatgggcaaggtggaatgagt

SEQ ID NO: 659294 - DNA, 25 bp, Rattus norvegicus
ttactatgggcatggtggaatgagt

SEQ ID NO: 659295 - DNA, 25 bp, Rattus norvegicus
ttactatgtaataaccgcctccaac

SEQ ID NO: 659296 - DNA, 25 bp, Rattus norvegicus
ttactatgtaattaccgcctccaac

SEQ ID NO: 659297 - DNA, 25 bp, Rattus norvegicus
ttactattgcttaaatttggctttt

SEQ ID NO: 659298 - DNA, 25 bp, Rattus norvegicus
ttactattgctttaatttggctttt

SEQ ID NO: 659299 - DNA, 25 bp, Rattus norvegicus
ttactatttcctctgttgtattttc

SEQ ID NO: 659300 - DNA, 25 bp, Rattus norvegicus
ttactatttcctgtgttgtattttc

SEQ ID NO: 659301 - DNA, 25 bp, Rattus norvegicus
ttactatttctcatctgcctttggc

SEQ ID NO: 659302 - DNA, 25 bp, Rattus norvegicus
ttactatttctcttctgcctttggc

SEQ ID NO: 659303 - DNA, 25 bp, Rattus norvegicus
ttactatttcttacctacttagaca

SEQ ID NO: 659304 - DNA, 25 bp, Rattus norvegicus
ttactatttctttcctacttagaca

SEQ ID NO: 659305 - DNA, 25 bp, Rattus norvegicus
ttactattttagaccctgccagtca

SEQ ID NO: 659306 - DNA, 25 bp, Rattus norvegicus
ttactattttagtccctgccagtca

SEQ ID NO: 659307 - DNA, 25 bp, Rattus norvegicus
ttactcaaaagcatcccactagtgg

SEQ ID NO: 659308 - DNA, 25 bp, Rattus norvegicus
ttactcaaaagcttcccactagtgg

SEQ ID NO: 659309 - DNA, 25 bp, Rattus norvegicus
ttactcaactctcaaccttcaaaaa

SEQ ID NO: 659310 - DNA, 25 bp, Rattus norvegicus
ttactcaactctgaaccttcaaaaa

SEQ ID NO: 659311 - DNA, 25 bp, Rattus norvegicus
ttactcacacctcctcagcagatag

SEQ ID NO: 659312 - DNA, 25 bp, Rattus norvegicus
ttactcacacctgctcagcagatag

SEQ ID NO: 659313 - DNA, 25 bp, Rattus norvegicus
ttactcacagccctttggtttttca

SEQ ID NO: 659314 - DNA, 25 bp, Rattus norvegicus
ttactcacagccgtttggtttttca

SEQ ID NO: 659315 - DNA, 25 bp, Rattus norvegicus
ttactcaccgagaggccctgcagca

SEQ ID NO: 659316 - DNA, 25 bp, Rattus norvegicus
ttactcaccgagtggccctgcagca

SEQ ID NO: 659317 - DNA, 25 bp, Rattus norvegicus
ttactcaccgtcaaatcctgtgtga

SEQ ID NO: 659318 - DNA, 25 bp, Rattus norvegicus
ttactcaccgtctaatcctgtgtga

SEQ ID NO: 659319 - DNA, 25 bp, Rattus norvegicus
ttactcacctaaatcagcagcgctg

SEQ ID NO: 659320 - DNA, 25 bp, Rattus norvegicus
ttactcacctaattcagcagcgctg

SEQ ID NO: 659321 - DNA, 25 bp, Rattus norvegicus
ttactcacctgtaagtgcaacccac

SEQ ID NO: 659322 - DNA, 25 bp, Rattus norvegicus
ttactcacctgttagtgcaacccac

SEQ ID NO: 659323 - DNA, 25 bp, Rattus norvegicus
ttactcacttgaccacttctaattg

SEQ ID NO: 659324 - DNA, 25 bp, Rattus norvegicus
ttactcacttgagcacttctaattg

SEQ ID NO: 659325 - DNA, 25 bp, Rattus norvegicus
ttactcagcctcaactcttatattt

SEQ ID NO: 659326 - DNA, 25 bp, Rattus norvegicus
ttactcagcctctactcttatattt

SEQ ID NO: 659327 - DNA, 25 bp, Rattus norvegicus
ttactcagcgcgaggttgttggcca

SEQ ID NO: 659328 - DNA, 25 bp, Rattus norvegicus
ttactcagcgcgtggttgttggcca

SEQ ID NO: 659329 - DNA, 25 bp, Rattus norvegicus
ttactcagctttacacttgtgccat

SEQ ID NO: 659330 - DNA, 25 bp, Rattus norvegicus
ttactcagcttttcacttgtgccat

SEQ ID NO: 659331 - DNA, 25 bp, Rattus norvegicus
ttactcaggaatataccctctctcc

SEQ ID NO: 659332 - DNA, 25 bp, Rattus norvegicus
ttactcaggaatttaccctctctcc

SEQ ID NO: 659333 - DNA, 25 bp, Rattus norvegicus
ttactcaggatcagtttgagcccca

SEQ ID NO: 659334 - DNA, 25 bp, Rattus norvegicus
ttactcaggatctgtttgagcccca

SEQ ID NO: 659335 - DNA, 25 bp, Rattus norvegicus
ttactcagtagtctcaccttgggac

SEQ ID NO: 659336 - DNA, 25 bp, Rattus norvegicus
ttactcagtagtgtcaccttgggac

SEQ ID NO: 659337 - DNA, 25 bp, Rattus norvegicus
ttactcagtggcatcttctggaaca

SEQ ID NO: 659338 - DNA, 25 bp, Rattus norvegicus
ttactcagtggcttcttctggaaca

SEQ ID NO: 659339 - DNA, 25 bp, Rattus norvegicus
ttactcatattcattttgctttagg

SEQ ID NO: 659340 - DNA, 25 bp, Rattus norvegicus
ttactcatattctttttgctttagg

SEQ ID NO: 659341 - DNA, 25 bp, Rattus norvegicus
ttactcatggtcaccctgggacatg

SEQ ID NO: 659342 - DNA, 25 bp, Rattus norvegicus
ttactcatggtctccctgggacatg

SEQ ID NO: 659343 - DNA, 25 bp, Rattus norvegicus
ttactcattaggacacaggcttcaa

SEQ ID NO: 659344 - DNA, 25 bp, Rattus norvegicus
ttactcattaggtcacaggcttcaa

SEQ ID NO: 659345 - DNA, 25 bp, Rattus norvegicus
ttactccaatgtcgggctggctgca

SEQ ID NO: 659346 - DNA, 25 bp, Rattus norvegicus
ttactccaatgtggggctggctgca

SEQ ID NO: 659347 - DNA, 25 bp, Rattus norvegicus
ttactccacagtccactggtctagg

SEQ ID NO: 659348 - DNA, 25 bp, Rattus norvegicus
ttactccacagtgcactggtctagg

SEQ ID NO: 659349 - DNA, 25 bp, Rattus norvegicus
ttactccacggtaccaggctattat

SEQ ID NO: 659350 - DNA, 25 bp, Rattus norvegicus
ttactccacggttccaggctattat

SEQ ID NO: 659351 - DNA, 25 bp, Rattus norvegicus
ttactccactcaatctggctagact

SEQ ID NO: 659352 - DNA, 25 bp, Rattus norvegicus
ttactccactcattctggctagact

SEQ ID NO: 659353 - DNA, 25 bp, Rattus norvegicus
ttactccactgaactgcccatatga

SEQ ID NO: 659354 - DNA, 25 bp, Rattus norvegicus
ttactccactgatctgcccatatga

SEQ ID NO: 659355 - DNA, 25 bp, Rattus norvegicus
ttactccagcgacctctaggtggct

SEQ ID NO: 659356 - DNA, 25 bp, Rattus norvegicus
ttactccagcgagctctaggtggct

SEQ ID NO: 659357 - DNA, 25 bp, Rattus norvegicus
ttactccaggcgcttttggcttaag

SEQ ID NO: 659358 - DNA, 25 bp, Rattus norvegicus
ttactccaggcggttttggcttaag

SEQ ID NO: 659359 - DNA, 25 bp, Rattus norvegicus
ttactccatagtactgccaccagtg

SEQ ID NO: 659360 - DNA, 25 bp, Rattus norvegicus
ttactccatagttctgccaccagtg

SEQ ID NO: 659361 - DNA, 25 bp, Rattus norvegicus
ttactccatattattccttacaggg

SEQ ID NO: 659362 - DNA, 25 bp, Rattus norvegicus
ttactccatatttttccttacaggg

SEQ ID NO: 659363 - DNA, 25 bp, Rattus norvegicus
ttactcccagcacaggcatgccatg

SEQ ID NO: 659364 - DNA, 25 bp, Rattus norvegicus
ttactcccagcagaggcatgccatg

SEQ ID NO: 659365 - DNA, 25 bp, Rattus norvegicus
ttactcccagttctttcctcaagga

SEQ ID NO: 659366 - DNA, 25 bp, Rattus norvegicus
ttactcccagttgtttcctcaagga

SEQ ID NO: 659367 - DNA, 25 bp, Rattus norvegicus
ttactccccagcagttgtttggaca

SEQ ID NO: 659368 - DNA, 25 bp, Rattus norvegicus
ttactccccagctgttgtttggaca

SEQ ID NO: 659369 - DNA, 25 bp, Rattus norvegicus
ttactccctcacagatgctaaatgt

SEQ ID NO: 659370 - DNA, 25 bp, Rattus norvegicus
ttactccctcactgatgctaaatgt

SEQ ID NO: 659371 - DNA, 25 bp, Rattus norvegicus
ttactccggccccgttttgtagctg

SEQ ID NO: 659372 - DNA, 25 bp, Rattus norvegicus
ttactccggcccggttttgtagctg

SEQ ID NO: 659373 - DNA, 25 bp, Rattus norvegicus
ttactcctacggctcagtctagaag

SEQ ID NO: 659374 - DNA, 25 bp, Rattus norvegicus
ttactcctacgggtcagtctagaag

SEQ ID NO: 659375 - DNA, 25 bp, Rattus norvegicus
ttactcctactgcagttctctaatc

SEQ ID NO: 659376 - DNA, 25 bp, Rattus norvegicus
ttactcctactggagttctctaatc

SEQ ID NO: 659377 - DNA, 25 bp, Rattus norvegicus
ttactcctagaaaggtgagccacct

SEQ ID NO: 659378 - DNA, 25 bp, Rattus norvegicus
ttactcctagaatggtgagccacct

SEQ ID NO: 659379 - DNA, 25 bp, Rattus norvegicus
ttactcctcagaaagctatggcagc

SEQ ID NO: 659380 - DNA, 25 bp, Rattus norvegicus
ttactcctcagatagctatggcagc

SEQ ID NO: 659381 - DNA, 25 bp, Rattus norvegicus
ttactcctgcctactactgtggaaa

SEQ ID NO: 659382 - DNA, 25 bp, Rattus norvegicus
ttactcctgccttctactgtggaaa

SEQ ID NO: 659383 - DNA, 25 bp, Rattus norvegicus
ttactcctgtcacctaatggcttcc

SEQ ID NO: 659384 - DNA, 25 bp, Rattus norvegicus
ttactcctgtcagctaatggcttcc

SEQ ID NO: 659385 - DNA, 25 bp, Rattus norvegicus
ttactcctgttcagaaactctcatg

SEQ ID NO: 659386 - DNA, 25 bp, Rattus norvegicus
ttactcctgttctgaaactctcatg

SEQ ID NO: 659387 - DNA, 25 bp, Rattus norvegicus
ttactccttcatacctattttacaa

SEQ ID NO: 659388 - DNA, 25 bp, Rattus norvegicus
ttactccttcattcctattttacaa

SEQ ID NO: 659389 - DNA, 25 bp, Rattus norvegicus
ttactccttttgaaccctgatcaaa

SEQ ID NO: 659390 - DNA, 25 bp, Rattus norvegicus
ttactccttttgtaccctgatcaaa

SEQ ID NO: 659391 - DNA, 25 bp, Rattus norvegicus
ttactcgccctcaggtaagattagg

SEQ ID NO: 659392 - DNA, 25 bp, Rattus norvegicus
ttactcgccctctggtaagattagg

SEQ ID NO: 659393 - DNA, 25 bp, Rattus norvegicus
ttactcgctgttacctgcacttaag

SEQ ID NO: 659394 - DNA, 25 bp, Rattus norvegicus
ttactcgctgtttcctgcacttaag

SEQ ID NO: 659395 - DNA, 25 bp, Rattus norvegicus
ttactcgcttctattccgggctaaa

SEQ ID NO: 659396 - DNA, 25 bp, Rattus norvegicus
ttactcgcttcttttccgggctaaa

SEQ ID NO: 659397 - DNA, 25 bp, Rattus norvegicus
ttactcgggccgagtctctcttccg

SEQ ID NO: 659398 - DNA, 25 bp, Rattus norvegicus
ttactcgggccgtgtctctcttccg

SEQ ID NO: 659399 - DNA, 25 bp, Rattus norvegicus
ttactcggtgtaataacgctcctct

SEQ ID NO: 659400 - DNA, 25 bp, Rattus norvegicus
ttactcggtgtattaacgctcctct

SEQ ID NO: 659401 - DNA, 25 bp, Rattus norvegicus
ttactctaaaacagggtgctgcttc

SEQ ID NO: 659402 - DNA, 25 bp, Rattus norvegicus
ttactctaaaactgggtgctgcttc

SEQ ID NO: 659403 - DNA, 25 bp, Rattus norvegicus
ttactctatgctctttgttttattg

SEQ ID NO: 659404 - DNA, 25 bp, Rattus norvegicus
ttactctatgctgtttgttttattg

SEQ ID NO: 659405 - DNA, 25 bp, Rattus norvegicus
ttactctccaagctgcgcgtaggat

SEQ ID NO: 659406 - DNA, 25 bp, Rattus norvegicus
ttactctccaaggtgcgcgtaggat

SEQ ID NO: 659407 - DNA, 25 bp, Rattus norvegicus
ttactctcctcaacaagagctgcag

SEQ ID NO: 659408 - DNA, 25 bp, Rattus norvegicus
ttactctcctcatcaagagctgcag

SEQ ID NO: 659409 - DNA, 25 bp, Rattus norvegicus
ttactctccttccaaaacgatgcca

SEQ ID NO: 659410 - DNA, 25 bp, Rattus norvegicus
ttactctccttcgaaaacgatgcca

SEQ ID NO: 659411 - DNA, 25 bp, Rattus norvegicus
ttactctcggctcgtgcttactaga

SEQ ID NO: 659412 - DNA, 25 bp, Rattus norvegicus
ttactctcggctggtgcttactaga

SEQ ID NO: 659413 - DNA, 25 bp, Rattus norvegicus
ttactctctaccagggcttggctca

SEQ ID NO: 659414 - DNA, 25 bp, Rattus norvegicus
ttactctctacctgggcttggctca

SEQ ID NO: 659415 - DNA, 25 bp, Rattus norvegicus
ttactctctcctataggatcaggga

SEQ ID NO: 659416 - DNA, 25 bp, Rattus norvegicus
ttactctctcctttaggatcaggga

SEQ ID NO: 659417 - DNA, 25 bp, Rattus norvegicus
ttactctctctgcacaggatgggct

SEQ ID NO: 659418 - DNA, 25 bp, Rattus norvegicus
ttactctctctggacaggatgggct

SEQ ID NO: 659419 - DNA, 25 bp, Rattus norvegicus
ttactctcttatcctcttcggctgg

SEQ ID NO: 659420 - DNA, 25 bp, Rattus norvegicus
ttactctcttatgctcttcggctgg

SEQ ID NO: 659421 - DNA, 25 bp, Rattus norvegicus
ttactctgaattagcattgatgcgg

SEQ ID NO: 659422 - DNA, 25 bp, Rattus norvegicus
ttactctgaatttgcattgatgcgg

SEQ ID NO: 659423 - DNA, 25 bp, Rattus norvegicus
ttactctgagttagacttgctgggc

SEQ ID NO: 659424 - DNA, 25 bp, Rattus norvegicus
ttactctgagtttgacttgctgggc

SEQ ID NO: 659425 - DNA, 25 bp, Rattus norvegicus
ttactctgcaacactgagaaaccag

SEQ ID NO: 659426 - DNA, 25 bp, Rattus norvegicus
ttactctgcaactctgagaaaccag

SEQ ID NO: 659427 - DNA, 25 bp, Rattus norvegicus
ttactctgcagtcggaatgtcctga

SEQ ID NO: 659428 - DNA, 25 bp, Rattus norvegicus
ttactctgcagtgggaatgtcctga

SEQ ID NO: 659429 - DNA, 25 bp, Rattus norvegicus
ttactctgccacagccttaagccaa

SEQ ID NO: 659430 - DNA, 25 bp, Rattus norvegicus
ttactctgccactgccttaagccaa

SEQ ID NO: 659431 - DNA, 25 bp, Rattus norvegicus
ttactctgcctccagatagcgggtt

SEQ ID NO: 659432 - DNA, 25 bp, Rattus norvegicus
ttactctgcctcgagatagcgggtt

SEQ ID NO: 659433 - DNA, 25 bp, Rattus norvegicus
ttactctgctgcctagattgggaca

SEQ ID NO: 659434 - DNA, 25 bp, Rattus norvegicus
ttactctgctgcgtagattgggaca

SEQ ID NO: 659435 - DNA, 25 bp, Rattus norvegicus
ttactctgggacataacagctgaat

SEQ ID NO: 659436 - DNA, 25 bp, Rattus norvegicus
ttactctgggacttaacagctgaat

SEQ ID NO: 659437 - DNA, 25 bp, Rattus norvegicus
ttactctgtaggacgagtctggtta

SEQ ID NO: 659438 - DNA, 25 bp, Rattus norvegicus
ttactctgtaggtcgagtctggtta

SEQ ID NO: 659439 - DNA, 25 bp, Rattus norvegicus
ttactctgtagtacgctgtgaaaac

SEQ ID NO: 659440 - DNA, 25 bp, Rattus norvegicus
ttactctgtagttcgctgtgaaaac

SEQ ID NO: 659441 - DNA, 25 bp, Rattus norvegicus
ttactctgtgctagtcactcggcgg

SEQ ID NO: 659442 - DNA, 25 bp, Rattus norvegicus
ttactctgtgctcccctgagctgca

SEQ ID NO: 659443 - DNA, 25 bp, Rattus norvegicus
ttactctgtgctgccctgagctgca

SEQ ID NO: 659444 - DNA, 25 bp, Rattus norvegicus
ttactctgtgcttgtcactcggcgg

SEQ ID NO: 659445 - DNA, 25 bp, Rattus norvegicus
ttactctgttccagctttagactcc

SEQ ID NO: 659446 - DNA, 25 bp, Rattus norvegicus
ttactctgttccattgctaccaaaa

SEQ ID NO: 659447 - DNA, 25 bp, Rattus norvegicus
ttactctgttcctgctttagactcc

SEQ ID NO: 659448 - DNA, 25 bp, Rattus norvegicus
ttactctgttcctttgctaccaaaa

SEQ ID NO: 659449 - DNA, 25 bp, Rattus norvegicus
ttactcttactcaatcatctcctta

SEQ ID NO: 659450 - DNA, 25 bp, Rattus norvegicus
ttactcttactctatcatctcctta

SEQ ID NO: 659451 - DNA, 25 bp, Rattus norvegicus
ttactcttactgaccggtgtccgga

SEQ ID NO: 659452 - DNA, 25 bp, Rattus norvegicus
ttactcttactgtccggtgtccgga

SEQ ID NO: 659453 - DNA, 25 bp, Rattus norvegicus
ttactcttcaaaaccccagttctgt

SEQ ID NO: 659454 - DNA, 25 bp, Rattus norvegicus
ttactcttcaaatccccagttctgt

SEQ ID NO: 659455 - DNA, 25 bp, Rattus norvegicus
ttactcttccttcggcaaatccagg

SEQ ID NO: 659456 - DNA, 25 bp, Rattus norvegicus
ttactcttccttctctttgctgctt

SEQ ID NO: 659457 - DNA, 25 bp, Rattus norvegicus
ttactcttccttgggcaaatccagg

SEQ ID NO: 659458 - DNA, 25 bp, Rattus norvegicus
ttactcttccttgtctttgctgctt

SEQ ID NO: 659459 - DNA, 25 bp, Rattus norvegicus
ttactcttctcaccccatctagaga

SEQ ID NO: 659460 - DNA, 25 bp, Rattus norvegicus
ttactcttctcagcccatctagaga

SEQ ID NO: 659461 - DNA, 25 bp, Rattus norvegicus
ttactcttgggtatacaggcctcat

SEQ ID NO: 659462 - DNA, 25 bp, Rattus norvegicus
ttactcttgggtttacaggcctcat

SEQ ID NO: 659463 - DNA, 25 bp, Rattus norvegicus
ttactctttgttagctcagacattg

SEQ ID NO: 659464 - DNA, 25 bp, Rattus norvegicus
ttactctttgtttgctcagacattg

SEQ ID NO: 659465 - DNA, 25 bp, Rattus norvegicus
ttactgaaccttagtggactggcac

SEQ ID NO: 659466 - DNA, 25 bp, Rattus norvegicus
ttactgaacctttgtggactggcac

SEQ ID NO: 659467 - DNA, 25 bp, Rattus norvegicus
ttactgaactttccaggctgcgccg

SEQ ID NO: 659468 - DNA, 25 bp, Rattus norvegicus
ttactgaactttgcaggctgcgccg

SEQ ID NO: 659469 - DNA, 25 bp, Rattus norvegicus
ttactgaaggacatccctggaaaat

SEQ ID NO: 659470 - DNA, 25 bp, Rattus norvegicus
ttactgaaggacttccctggaaaat

SEQ ID NO: 659471 - DNA, 25 bp, Rattus norvegicus
ttactgaccataaaccctcgtttgt

SEQ ID NO: 659472 - DNA, 25 bp, Rattus norvegicus
ttactgaccatataccctcgtttgt

SEQ ID NO: 659473 - DNA, 25 bp, Rattus norvegicus
ttactgactttgcttggcagtggaa

SEQ ID NO: 659474 - DNA, 25 bp, Rattus norvegicus
ttactgactttggttggcagtggaa

SEQ ID NO: 659475 - DNA, 25 bp, Rattus norvegicus
ttactgagcagccttattgaataaa

SEQ ID NO: 659476 - DNA, 25 bp, Rattus norvegicus
ttactgagcagcgttattgaataaa

SEQ ID NO: 659477 - DNA, 25 bp, Rattus norvegicus
ttactgagtccaattaagccaatag

SEQ ID NO: 659478 - DNA, 25 bp, Rattus norvegicus
ttactgagtccatttaagccaatag

SEQ ID NO: 659479 - DNA, 25 bp, Rattus norvegicus
ttactgatagcacgcctctcacctt

SEQ ID NO: 659480 - DNA, 25 bp, Rattus norvegicus
ttactgatagcaggcctctcacctt

SEQ ID NO: 659481 - DNA, 25 bp, Rattus norvegicus
ttactgatcaggcatgtgggttgct

SEQ ID NO: 659482 - DNA, 25 bp, Rattus norvegicus
ttactgatcagggatgtgggttgct

SEQ ID NO: 659483 - DNA, 25 bp, Rattus norvegicus
ttactgatgtggctgctggcaatga

SEQ ID NO: 659484 - DNA, 25 bp, Rattus norvegicus
ttactgatgtgggtgctggcaatga

SEQ ID NO: 659485 - DNA, 25 bp, Rattus norvegicus
ttactgcaactacacctagccggag

SEQ ID NO: 659486 - DNA, 25 bp, Rattus norvegicus
ttactgcaactagacctagccggag

SEQ ID NO: 659487 - DNA, 25 bp, Rattus norvegicus
ttactgcacaaactcaccctggctt

SEQ ID NO: 659488 - DNA, 25 bp, Rattus norvegicus
ttactgcacaaagtcaccctggctt

SEQ ID NO: 659489 - DNA, 25 bp, Rattus norvegicus
ttactgcacttcacacctcattgta

SEQ ID NO: 659490 - DNA, 25 bp, Rattus norvegicus
ttactgcacttctcacctcattgta

SEQ ID NO: 659491 - DNA, 25 bp, Rattus norvegicus
ttactgcagaaacttcctgggcgat

SEQ ID NO: 659492 - DNA, 25 bp, Rattus norvegicus
ttactgcagaaagttcctgggcgat

SEQ ID NO: 659493 - DNA, 25 bp, Rattus norvegicus
ttactgcaggccatcaatcctagca

SEQ ID NO: 659494 - DNA, 25 bp, Rattus norvegicus
ttactgcaggccttcaatcctagca

SEQ ID NO: 659495 - DNA, 25 bp, Rattus norvegicus
ttactgcagtggatccaggtggccc

SEQ ID NO: 659496 - DNA, 25 bp, Rattus norvegicus
ttactgcagtggttccaggtggccc

SEQ ID NO: 659497 - DNA, 25 bp, Rattus norvegicus
ttactgcatcggcattcatctacta

SEQ ID NO: 659498 - DNA, 25 bp, Rattus norvegicus
ttactgcatcgggattcatctacta

SEQ ID NO: 659499 - DNA, 25 bp, Rattus norvegicus
ttactgcatgaaactcctggaagaa

SEQ ID NO: 659500 - DNA, 25 bp, Rattus norvegicus
ttactgcatgaatctcctggaagaa

SEQ ID NO: 659501 - DNA, 25 bp, Rattus norvegicus
ttactgccacctcttgtaacatggt

SEQ ID NO: 659502 - DNA, 25 bp, Rattus norvegicus
ttactgccacctgttgtaacatggt

SEQ ID NO: 659503 - DNA, 25 bp, Rattus norvegicus
ttactgccacggagaatgccctttt

SEQ ID NO: 659504 - DNA, 25 bp, Rattus norvegicus
ttactgccacggtgaatgccctttt

SEQ ID NO: 659505 - DNA, 25 bp, Rattus norvegicus
ttactgccatacacgactctacaga

SEQ ID NO: 659506 - DNA, 25 bp, Rattus norvegicus
ttactgccatactcgactctacaga

SEQ ID NO: 659507 - DNA, 25 bp, Rattus norvegicus
ttactgccccaacaaaccaagtgtg

SEQ ID NO: 659508 - DNA, 25 bp, Rattus norvegicus
ttactgccccaagaaaccaagtgtg

SEQ ID NO: 659509 - DNA, 25 bp, Rattus norvegicus
ttactgccctggcacagagtagctt

SEQ ID NO: 659510 - DNA, 25 bp, Rattus norvegicus
ttactgccctgggacagagtagctt

SEQ ID NO: 659511 - DNA, 25 bp, Rattus norvegicus
ttactgccctttcgtcaacaaccag

SEQ ID NO: 659512 - DNA, 25 bp, Rattus norvegicus
ttactgccctttggtcaacaaccag

SEQ ID NO: 659513 - DNA, 25 bp, Rattus norvegicus
ttactgccttccctgcaatgggact

SEQ ID NO: 659514 - DNA, 25 bp, Rattus norvegicus
ttactgccttccgtgcaatgggact

SEQ ID NO: 659515 - DNA, 25 bp, Rattus norvegicus
ttactgcgacagacatgtgcgttgt

SEQ ID NO: 659516 - DNA, 25 bp, Rattus norvegicus
ttactgcgacagtcatgtgcgttgt

SEQ ID NO: 659517 - DNA, 25 bp, Rattus norvegicus
ttactgctcacaaactttataaggg

SEQ ID NO: 659518 - DNA, 25 bp, Rattus norvegicus
ttactgctcacatactttataaggg

SEQ ID NO: 659519 - DNA, 25 bp, Rattus norvegicus
ttactgctggatctaaggcttacac

SEQ ID NO: 659520 - DNA, 25 bp, Rattus norvegicus
ttactgctggatgtaaggcttacac

SEQ ID NO: 659521 - DNA, 25 bp, Rattus norvegicus
ttactgctgtacctttcatcggtgg

SEQ ID NO: 659522 - DNA, 25 bp, Rattus norvegicus
ttactgctgtacgtttcatcggtgg

SEQ ID NO: 659523 - DNA, 25 bp, Rattus norvegicus
ttactgctgtcaacactgcttaaaa

SEQ ID NO: 659524 - DNA, 25 bp, Rattus norvegicus
ttactgctgtcatcactgcttaaaa

SEQ ID NO: 659525 - DNA, 25 bp, Rattus norvegicus
ttactgctgtgtctcacactgctac

SEQ ID NO: 659526 - DNA, 25 bp, Rattus norvegicus
ttactgctgtgtgtcacactgctac

SEQ ID NO: 659527 - DNA, 25 bp, Rattus norvegicus
ttactgcttatcacctgtgttgtct

SEQ ID NO: 659528 - DNA, 25 bp, Rattus norvegicus
ttactgcttatctcctgtgttgtct

SEQ ID NO: 659529 - DNA, 25 bp, Rattus norvegicus
ttactgcttcctagtttttcctggt

SEQ ID NO: 659530 - DNA, 25 bp, Rattus norvegicus
ttactgcttccttgtttttcctggt

SEQ ID NO: 659531 - DNA, 25 bp, Rattus norvegicus
ttactggacagaccgtggtatccca

SEQ ID NO: 659532 - DNA, 25 bp, Rattus norvegicus
ttactggacagagcgtggtatccca

SEQ ID NO: 659533 - DNA, 25 bp, Rattus norvegicus
ttactggacttcatcttgatacttg

SEQ ID NO: 659534 - DNA, 25 bp, Rattus norvegicus
ttactggacttcttcttgatacttg

SEQ ID NO: 659535 - DNA, 25 bp, Rattus norvegicus
ttactggagggcatgaggccttcta

SEQ ID NO: 659536 - DNA, 25 bp, Rattus norvegicus
ttactggagggcttgaggccttcta

SEQ ID NO: 659537 - DNA, 25 bp, Rattus norvegicus
ttactggagtcacagaacctctgcc

SEQ ID NO: 659538 - DNA, 25 bp, Rattus norvegicus
ttactggagtcagagaacctctgcc

SEQ ID NO: 659539 - DNA, 25 bp, Rattus norvegicus
ttactggatcagagcgtcacgggag

SEQ ID NO: 659540 - DNA, 25 bp, Rattus norvegicus
ttactggatcagtgcgtcacgggag

SEQ ID NO: 659541 - DNA, 25 bp, Rattus norvegicus
ttactggatccaccaaactgcgctt

SEQ ID NO: 659542 - DNA, 25 bp, Rattus norvegicus
ttactggatccagcaaactgcgctt

SEQ ID NO: 659543 - DNA, 25 bp, Rattus norvegicus
ttactggcaggcatcatctctgtgg

SEQ ID NO: 659544 - DNA, 25 bp, Rattus norvegicus
ttactggcaggcttcatctctgtgg

SEQ ID NO: 659545 - DNA, 25 bp, Rattus norvegicus
ttactggcatggaatcattcctagg

SEQ ID NO: 659546 - DNA, 25 bp, Rattus norvegicus
ttactggcatggtatcattcctagg

SEQ ID NO: 659547 - DNA, 25 bp, Rattus norvegicus
ttactggcccggatttcagaggcaa

SEQ ID NO: 659548 - DNA, 25 bp, Rattus norvegicus
ttactggcccggttttcagaggcaa

SEQ ID NO: 659549 - DNA, 25 bp, Rattus norvegicus
ttactggctcagagcaatccttctg

SEQ ID NO: 659550 - DNA, 25 bp, Rattus norvegicus
ttactggctcagtgcaatccttctg

SEQ ID NO: 659551 - DNA, 25 bp, Rattus norvegicus
ttactggctctgcaatcttccagat

SEQ ID NO: 659552 - DNA, 25 bp, Rattus norvegicus
ttactggctctggaatcttccagat

SEQ ID NO: 659553 - DNA, 25 bp, Rattus norvegicus
ttactggctgtacaccattttctgt

SEQ ID NO: 659554 - DNA, 25 bp, Rattus norvegicus
ttactggctgtagaccattttctgt

SEQ ID NO: 659555 - DNA, 25 bp, Rattus norvegicus
ttactggctgtgactcttgggagca

SEQ ID NO: 659556 - DNA, 25 bp, Rattus norvegicus
ttactggctgtgtctcttgggagca

SEQ ID NO: 659557 - DNA, 25 bp, Rattus norvegicus
ttactggtaacaatcttcctctctg

SEQ ID NO: 659558 - DNA, 25 bp, Rattus norvegicus
ttactggtaacattcttcctctctg

SEQ ID NO: 659559 - DNA, 25 bp, Rattus norvegicus
ttactggtccagacagatcctcttt

SEQ ID NO: 659560 - DNA, 25 bp, Rattus norvegicus
ttactggtccagtcagatcctcttt

SEQ ID NO: 659561 - DNA, 25 bp, Rattus norvegicus
ttactggtgcgcacatctgctcatc

SEQ ID NO: 659562 - DNA, 25 bp, Rattus norvegicus
ttactggtgcgctcatctgctcatc

SEQ ID NO: 659563 - DNA, 25 bp, Rattus norvegicus
ttactggtgcttcagcttcagcggt

SEQ ID NO: 659564 - DNA, 25 bp, Rattus norvegicus
ttactggtgcttgagcttcagcggt

SEQ ID NO: 659565 - DNA, 25 bp, Rattus norvegicus
ttactggtgggcagtgacttgcaaa

SEQ ID NO: 659566 - DNA, 25 bp, Rattus norvegicus
ttactggtgggctgtgacttgcaaa

SEQ ID NO: 659567 - DNA, 25 bp, Rattus norvegicus
ttactggttacacgcaagccgaggc

SEQ ID NO: 659568 - DNA, 25 bp, Rattus norvegicus
ttactggttacaggcaagccgaggc

SEQ ID NO: 659569 - DNA, 25 bp, Rattus norvegicus
ttactgtaacaaactcctccataga

SEQ ID NO: 659570 - DNA, 25 bp, Rattus norvegicus
ttactgtaacaatctcctccataga

SEQ ID NO: 659571 - DNA, 25 bp, Rattus norvegicus
ttactgtacacaatcactctgttcc

SEQ ID NO: 659572 - DNA, 25 bp, Rattus norvegicus
ttactgtacacattcactctgttcc

SEQ ID NO: 659573 - DNA, 25 bp, Rattus norvegicus
ttactgtactcactgtcaactttcc

SEQ ID NO: 659574 - DNA, 25 bp, Rattus norvegicus
ttactgtactcagtgtcaactttcc

SEQ ID NO: 659575 - DNA, 25 bp, Rattus norvegicus
ttactgtagaatctccttcacctcg

SEQ ID NO: 659576 - DNA, 25 bp, Rattus norvegicus
ttactgtagaatgtccttcacctcg

SEQ ID NO: 659577 - DNA, 25 bp, Rattus norvegicus
ttactgtatcctccggaactctcaa

SEQ ID NO: 659578 - DNA, 25 bp, Rattus norvegicus
ttactgtatcctgcggaactctcaa

SEQ ID NO: 659579 - DNA, 25 bp, Rattus norvegicus
ttactgtcattgacatcgaatccca

SEQ ID NO: 659580 - DNA, 25 bp, Rattus norvegicus
ttactgtcattgtcatcgaatccca

SEQ ID NO: 659581 - DNA, 25 bp, Rattus norvegicus
ttactgtccactactaagcacatgc

SEQ ID NO: 659582 - DNA, 25 bp, Rattus norvegicus
ttactgtccactagtcaggaaggat

SEQ ID NO: 659583 - DNA, 25 bp, Rattus norvegicus
ttactgtccacttctaagcacatgc

SEQ ID NO: 659584 - DNA, 25 bp, Rattus norvegicus
ttactgtccacttgtcaggaaggat

SEQ ID NO: 659585 - DNA, 25 bp, Rattus norvegicus
ttactgtccattagcaagacttcca

SEQ ID NO: 659586 - DNA, 25 bp, Rattus norvegicus
ttactgtccatttgcaagacttcca

SEQ ID NO: 659587 - DNA, 25 bp, Rattus norvegicus
ttactgtcccagagtggtgccttac

SEQ ID NO: 659588 - DNA, 25 bp, Rattus norvegicus
ttactgtcccagtgtggtgccttac

SEQ ID NO: 659589 - DNA, 25 bp, Rattus norvegicus
ttactgtcgagacggcttagtgctc

SEQ ID NO: 659590 - DNA, 25 bp, Rattus norvegicus
ttactgtcgagagggcttagtgctc

SEQ ID NO: 659591 - DNA, 25 bp, Rattus norvegicus
ttactgtctgtcatagtctgtggct

SEQ ID NO: 659592 - DNA, 25 bp, Rattus norvegicus
ttactgtctgtcttagtctgtggct

SEQ ID NO: 659593 - DNA, 25 bp, Rattus norvegicus
ttactgtcttcccttgtacataggc

SEQ ID NO: 659594 - DNA, 25 bp, Rattus norvegicus
ttactgtcttccgttgtacataggc

SEQ ID NO: 659595 - DNA, 25 bp, Rattus norvegicus
ttactgtctttccactttctaacta

SEQ ID NO: 659596 - DNA, 25 bp, Rattus norvegicus
ttactgtctttcgactttctaacta

SEQ ID NO: 659597 - DNA, 25 bp, Rattus norvegicus
ttactgtgaactcttgtctcttgga

SEQ ID NO: 659598 - DNA, 25 bp, Rattus norvegicus
ttactgtgaactgttgtctcttgga

SEQ ID NO: 659599 - DNA, 25 bp, Rattus norvegicus
ttactgtgacatcctttcacgtgtc

SEQ ID NO: 659600 - DNA, 25 bp, Rattus norvegicus
ttactgtgacatgctttcacgtgtc

SEQ ID NO: 659601 - DNA, 25 bp, Rattus norvegicus
ttactgtgcaagcagaccgtccatc

SEQ ID NO: 659602 - DNA, 25 bp, Rattus norvegicus
ttactgtgcaaggagaccgtccatc

SEQ ID NO: 659603 - DNA, 25 bp, Rattus norvegicus
ttactgtgccaccaagacatgcctt

SEQ ID NO: 659604 - DNA, 25 bp, Rattus norvegicus
ttactgtgccacgaagacatgcctt

SEQ ID NO: 659605 - DNA, 25 bp, Rattus norvegicus
ttactgtgcgtgctcaggccctgag

SEQ ID NO: 659606 - DNA, 25 bp, Rattus norvegicus
ttactgtgcgtggtcaggccctgag

SEQ ID NO: 659607 - DNA, 25 bp, Rattus norvegicus
ttactgtggcccatgggctttaatg

SEQ ID NO: 659608 - DNA, 25 bp, Rattus norvegicus
ttactgtggcccttgggctttaatg

SEQ ID NO: 659609 - DNA, 25 bp, Rattus norvegicus
ttactgtgtcacactggctgtccta

SEQ ID NO: 659610 - DNA, 25 bp, Rattus norvegicus
ttactgtgtcactctggctgtccta

SEQ ID NO: 659611 - DNA, 25 bp, Rattus norvegicus
ttactgttcatcagactaagggaca

SEQ ID NO: 659612 - DNA, 25 bp, Rattus norvegicus
ttactgttcatctgactaagggaca

SEQ ID NO: 659613 - DNA, 25 bp, Rattus norvegicus
ttactgttctttacccaaaaatgat

SEQ ID NO: 659614 - DNA, 25 bp, Rattus norvegicus
ttactgttcttttcccaaaaatgat

SEQ ID NO: 659615 - DNA, 25 bp, Rattus norvegicus
ttactgttgacactgcctcggtaca

SEQ ID NO: 659616 - DNA, 25 bp, Rattus norvegicus
ttactgttgacagtgcctcggtaca

SEQ ID NO: 659617 - DNA, 25 bp, Rattus norvegicus
ttactgttgggcagtctcttaaacc

SEQ ID NO: 659618 - DNA, 25 bp, Rattus norvegicus
ttactgttgggctgtctcttaaacc

SEQ ID NO: 659619 - DNA, 25 bp, Rattus norvegicus
ttactgtttctaacctgttgggctc

SEQ ID NO: 659620 - DNA, 25 bp, Rattus norvegicus
ttactgtttctatcctgttgggctc

SEQ ID NO: 659621 - DNA, 25 bp, Rattus norvegicus
ttacttaccccactgaatgcagtct

SEQ ID NO: 659622 - DNA, 25 bp, Rattus norvegicus
ttacttaccccagtgaatgcagtct

SEQ ID NO: 659623 - DNA, 25 bp, Rattus norvegicus
ttacttaccttgcataagctcgtgg

SEQ ID NO: 659624 - DNA, 25 bp, Rattus norvegicus
ttacttaccttggataagctcgtgg

SEQ ID NO: 659625 - DNA, 25 bp, Rattus norvegicus
ttacttacttccacaacccagtgtt

SEQ ID NO: 659626 - DNA, 25 bp, Rattus norvegicus
ttacttacttcctcaacccagtgtt

SEQ ID NO: 659627 - DNA, 25 bp, Rattus norvegicus
ttacttagccggcacacaggtcgag

SEQ ID NO: 659628 - DNA, 25 bp, Rattus norvegicus
ttacttagccgggacacaggtcgag

SEQ ID NO: 659629 - DNA, 25 bp, Rattus norvegicus
ttacttagctcaccgatgttccagc

SEQ ID NO: 659630 - DNA, 25 bp, Rattus norvegicus
ttacttagctcagcgatgttccagc

SEQ ID NO: 659631 - DNA, 25 bp, Rattus norvegicus
ttacttagtgccctgcattctaggc

SEQ ID NO: 659632 - DNA, 25 bp, Rattus norvegicus
ttacttagtgccgtgcattctaggc

SEQ ID NO: 659633 - DNA, 25 bp, Rattus norvegicus
ttacttatcaataccctgtctaaag

SEQ ID NO: 659634 - DNA, 25 bp, Rattus norvegicus
ttacttatcaattccctgtctaaag

SEQ ID NO: 659635 - DNA, 25 bp, Rattus norvegicus
ttacttatcgagatggcctgcgggc

SEQ ID NO: 659636 - DNA, 25 bp, Rattus norvegicus
ttacttatcgagttggcctgcgggc

SEQ ID NO: 659637 - DNA, 25 bp, Rattus norvegicus
ttacttatgtgccaagcctgccgag

SEQ ID NO: 659638 - DNA, 25 bp, Rattus norvegicus
ttacttatgtgcgaagcctgccgag

SEQ ID NO: 659639 - DNA, 25 bp, Rattus norvegicus
ttacttcaagacacctaacagactg

SEQ ID NO: 659640 - DNA, 25 bp, Rattus norvegicus
ttacttcaagactcctaacagactg

SEQ ID NO: 659641 - DNA, 25 bp, Rattus norvegicus
ttacttcacacgctcagtggaactc

SEQ ID NO: 659642 - DNA, 25 bp, Rattus norvegicus
ttacttcacacggtcagtggaactc

SEQ ID NO: 659643 - DNA, 25 bp, Rattus norvegicus
ttacttcaccaaaggcaagcgaggc

SEQ ID NO: 659644 - DNA, 25 bp, Rattus norvegicus
ttacttcaccaatggcaagcgaggc

SEQ ID NO: 659645 - DNA, 25 bp, Rattus norvegicus
ttacttcacgtccaggagcagagca

SEQ ID NO: 659646 - DNA, 25 bp, Rattus norvegicus
ttacttcacgtcgaggagcagagca

SEQ ID NO: 659647 - DNA, 25 bp, Rattus norvegicus
ttacttcagtgtattctgtcctgtt

SEQ ID NO: 659648 - DNA, 25 bp, Rattus norvegicus
ttacttcagtgttttctgtcctgtt

SEQ ID NO: 659649 - DNA, 25 bp, Rattus norvegicus
ttacttcataaaatactgttgttct

SEQ ID NO: 659650 - DNA, 25 bp, Rattus norvegicus
ttacttcataaattactgttgttct

SEQ ID NO: 659651 - DNA, 25 bp, Rattus norvegicus
ttacttcatgaaagttttgcccgaa

SEQ ID NO: 659652 - DNA, 25 bp, Rattus norvegicus
ttacttcatgaatgttttgcccgaa

SEQ ID NO: 659653 - DNA, 25 bp, Rattus norvegicus
ttacttcattcacgttacccaggct

SEQ ID NO: 659654 - DNA, 25 bp, Rattus norvegicus
ttacttcattcaggttacccaggct

SEQ ID NO: 659655 - DNA, 25 bp, Rattus norvegicus
ttacttcatttcagggctctctcca

SEQ ID NO: 659656 - DNA, 25 bp, Rattus norvegicus
ttacttcatttctgggctctctcca

SEQ ID NO: 659657 - DNA, 25 bp, Rattus norvegicus
ttacttcccggtcctcattgtccat

SEQ ID NO: 659658 - DNA, 25 bp, Rattus norvegicus
ttacttcccggtgctcattgtccat

SEQ ID NO: 659659 - DNA, 25 bp, Rattus norvegicus
ttacttcccgtcagtggtggatgga

SEQ ID NO: 659660 - DNA, 25 bp, Rattus norvegicus
ttacttcccgtctgtggtggatgga

SEQ ID NO: 659661 - DNA, 25 bp, Rattus norvegicus
ttacttccctctcagcaaatgtttg

SEQ ID NO: 659662 - DNA, 25 bp, Rattus norvegicus
ttacttccctctgagcaaatgtttg

SEQ ID NO: 659663 - DNA, 25 bp, Rattus norvegicus
ttacttccggaaaattcaagcaaag

SEQ ID NO: 659664 - DNA, 25 bp, Rattus norvegicus
ttacttccggaatattcaagcaaag

SEQ ID NO: 659665 - DNA, 25 bp, Rattus norvegicus
ttacttcctcaacccagtgtttgac

SEQ ID NO: 659666 - DNA, 25 bp, Rattus norvegicus
ttacttcctcaagccagtgtttgac

SEQ ID NO: 659667 - DNA, 25 bp, Rattus norvegicus
ttacttcctggaccgtgtgggccat

SEQ ID NO: 659668 - DNA, 25 bp, Rattus norvegicus
ttacttcctggagcgtgtgggccat

SEQ ID NO: 659669 - DNA, 25 bp, Rattus norvegicus
ttacttcctgtgactttgttttgca

SEQ ID NO: 659670 - DNA, 25 bp, Rattus norvegicus
ttacttcctgtgtctttgttttgca

SEQ ID NO: 659671 - DNA, 25 bp, Rattus norvegicus
ttacttccttttagtccactacaag

SEQ ID NO: 659672 - DNA, 25 bp, Rattus norvegicus
ttacttcctttttgtccactacaag

SEQ ID NO: 659673 - DNA, 25 bp, Rattus norvegicus
ttacttctccacaaatgccttgtgt

SEQ ID NO: 659674 - DNA, 25 bp, Rattus norvegicus
ttacttctccactaatgccttgtgt

SEQ ID NO: 659675 - DNA, 25 bp, Rattus norvegicus
ttacttctctcgcactttgcagtgc

SEQ ID NO: 659676 - DNA, 25 bp, Rattus norvegicus
ttacttctctcggactttgcagtgc

SEQ ID NO: 659677 - DNA, 25 bp, Rattus norvegicus
ttacttctctgtagccatgaccaag

SEQ ID NO: 659678 - DNA, 25 bp, Rattus norvegicus
ttacttctctgttgccatgaccaag

SEQ ID NO: 659679 - DNA, 25 bp, Rattus norvegicus
ttacttctgccactccagatttcac

SEQ ID NO: 659680 - DNA, 25 bp, Rattus norvegicus
ttacttctgccagtccagatttcac

SEQ ID NO: 659681 - DNA, 25 bp, Rattus norvegicus
ttacttctggatattggcactgcat

SEQ ID NO: 659682 - DNA, 25 bp, Rattus norvegicus
ttacttctggattttggcactgcat

SEQ ID NO: 659683 - DNA, 25 bp, Rattus norvegicus
ttacttctgttgcttctaagctgta

SEQ ID NO: 659684 - DNA, 25 bp, Rattus norvegicus
ttacttctgttggttctaagctgta

SEQ ID NO: 659685 - DNA, 25 bp, Rattus norvegicus
ttacttcttctaatcagagatgcag

SEQ ID NO: 659686 - DNA, 25 bp, Rattus norvegicus
ttacttcttctattcagagatgcag

SEQ ID NO: 659687 - DNA, 25 bp, Rattus norvegicus
ttacttctttcaacacgtgactcac

SEQ ID NO: 659688 - DNA, 25 bp, Rattus norvegicus
ttacttctttcatcacgtgactcac

SEQ ID NO: 659689 - DNA, 25 bp, Rattus norvegicus
ttacttctttgacgctccagagatg

SEQ ID NO: 659690 - DNA, 25 bp, Rattus norvegicus
ttacttctttgaggctccagagatg

SEQ ID NO: 659691 - DNA, 25 bp, Rattus norvegicus
ttacttgaacgcagggatctaactc

SEQ ID NO: 659692 - DNA, 25 bp, Rattus norvegicus
ttacttgaacgctgggatctaactc

SEQ ID NO: 659693 - DNA, 25 bp, Rattus norvegicus
ttacttgacaacactcgcacttgta

SEQ ID NO: 659694 - DNA, 25 bp, Rattus norvegicus
ttacttgacaactctcgcacttgta

SEQ ID NO: 659695 - DNA, 25 bp, Rattus norvegicus
ttacttgacagtatataatgaccct

SEQ ID NO: 659696 - DNA, 25 bp, Rattus norvegicus
ttacttgacagtttataatgaccct

SEQ ID NO: 659697 - DNA, 25 bp, Rattus norvegicus
ttacttgaccaaagagcttactcac

SEQ ID NO: 659698 - DNA, 25 bp, Rattus norvegicus
ttacttgaccaatgagcttactcac

SEQ ID NO: 659699 - DNA, 25 bp, Rattus norvegicus
ttacttgatcctctaactcccaacg

SEQ ID NO: 659700 - DNA, 25 bp, Rattus norvegicus
ttacttgatcctgtaactcccaacg

SEQ ID NO: 659701 - DNA, 25 bp, Rattus norvegicus
ttacttgatgcccttactccaaatc

SEQ ID NO: 659702 - DNA, 25 bp, Rattus norvegicus
ttacttgatgccgttactccaaatc

SEQ ID NO: 659703 - DNA, 25 bp, Rattus norvegicus
ttacttgattctaacctataggctt

SEQ ID NO: 659704 - DNA, 25 bp, Rattus norvegicus
ttacttgattcttacctataggctt

SEQ ID NO: 659705 - DNA, 25 bp, Rattus norvegicus
ttacttgccctgagaacttttggag

SEQ ID NO: 659706 - DNA, 25 bp, Rattus norvegicus
ttacttgccctgtgaacttttggag

SEQ ID NO: 659707 - DNA, 25 bp, Rattus norvegicus
ttacttgctctaaacttggcttctg

SEQ ID NO: 659708 - DNA, 25 bp, Rattus norvegicus
ttacttgctctatacttggcttctg

SEQ ID NO: 659709 - DNA, 25 bp, Rattus norvegicus
ttacttgcttggagcctatgacttg

SEQ ID NO: 659710 - DNA, 25 bp, Rattus norvegicus
ttacttgcttggctttgtgacacca

SEQ ID NO: 659711 - DNA, 25 bp, Rattus norvegicus
ttacttgcttgggtttgtgacacca

SEQ ID NO: 659712 - DNA, 25 bp, Rattus norvegicus
ttacttgcttggtgcctatgacttg

SEQ ID NO: 659713 - DNA, 25 bp, Rattus norvegicus
ttacttggacttacagcataaatac

SEQ ID NO: 659714 - DNA, 25 bp, Rattus norvegicus
ttacttggactttcagcataaatac

SEQ ID NO: 659715 - DNA, 25 bp, Rattus norvegicus
ttacttgggctcatcagcacttgat

SEQ ID NO: 659716 - DNA, 25 bp, Rattus norvegicus
ttacttgggctcttcagcacttgat

SEQ ID NO: 659717 - DNA, 25 bp, Rattus norvegicus
ttacttggtagaagcagccatggac

SEQ ID NO: 659718 - DNA, 25 bp, Rattus norvegicus
ttacttggtagatgcagccatggac

SEQ ID NO: 659719 - DNA, 25 bp, Rattus norvegicus
ttacttggtgtaattccccactcgt

SEQ ID NO: 659720 - DNA, 25 bp, Rattus norvegicus
ttacttggtgtatttccccactcgt

SEQ ID NO: 659721 - DNA, 25 bp, Rattus norvegicus
ttacttggtttccttctgtggtatt

SEQ ID NO: 659722 - DNA, 25 bp, Rattus norvegicus
ttacttggtttcgttctgtggtatt

SEQ ID NO: 659723 - DNA, 25 bp, Rattus norvegicus
ttacttgtaattatgcgataggcct

SEQ ID NO: 659724 - DNA, 25 bp, Rattus norvegicus
ttacttgtaattttgcgataggcct

SEQ ID NO: 659725 - DNA, 25 bp, Rattus norvegicus
ttacttgtatatctgcctcccacta

SEQ ID NO: 659726 - DNA, 25 bp, Rattus norvegicus
ttacttgtatatgtgcctcccacta

SEQ ID NO: 659727 - DNA, 25 bp, Rattus norvegicus
ttacttgtccctaagttgaggcttt

SEQ ID NO: 659728 - DNA, 25 bp, Rattus norvegicus
ttacttgtcccttagttgaggcttt

SEQ ID NO: 659729 - DNA, 25 bp, Rattus norvegicus
ttacttgtctttctaggtcctttca

SEQ ID NO: 659730 - DNA, 25 bp, Rattus norvegicus
ttacttgtctttgtaggtcctttca

SEQ ID NO: 659731 - DNA, 25 bp, Rattus norvegicus
ttacttgttggaacgcagggacctg

SEQ ID NO: 659732 - DNA, 25 bp, Rattus norvegicus
ttacttgttggatcgcagggacctg

SEQ ID NO: 659733 - DNA, 25 bp, Rattus norvegicus
ttacttgttttcattatgtcccctg

SEQ ID NO: 659734 - DNA, 25 bp, Rattus norvegicus
ttacttgttttctttatgtcccctg

SEQ ID NO: 659735 - DNA, 25 bp, Rattus norvegicus
ttactttaaactactgtctcatttt

SEQ ID NO: 659736 - DNA, 25 bp, Rattus norvegicus
ttactttaaacttctgtctcatttt

SEQ ID NO: 659737 - DNA, 25 bp, Rattus norvegicus
ttactttaaatgactgtcacccagc

SEQ ID NO: 659738 - DNA, 25 bp, Rattus norvegicus
ttactttaaatgtctgtcacccagc

SEQ ID NO: 659739 - DNA, 25 bp, Rattus norvegicus
ttactttaaattagtcttgtgagat

SEQ ID NO: 659740 - DNA, 25 bp, Rattus norvegicus
ttactttaaatttgtcttgtgagat

SEQ ID NO: 659741 - DNA, 25 bp, Rattus norvegicus
ttactttaagctactgttcctcctg

SEQ ID NO: 659742 - DNA, 25 bp, Rattus norvegicus
ttactttaagcttctgttcctcctg

SEQ ID NO: 659743 - DNA, 25 bp, Rattus norvegicus
ttactttactccatgattagctcag

SEQ ID NO: 659744 - DNA, 25 bp, Rattus norvegicus
ttactttactccttgattagctcag

SEQ ID NO: 659745 - DNA, 25 bp, Rattus norvegicus
ttactttatctgattgtgactgtgc

SEQ ID NO: 659746 - DNA, 25 bp, Rattus norvegicus
ttactttatctgtttgtgactgtgc

SEQ ID NO: 659747 - DNA, 25 bp, Rattus norvegicus
ttactttcacataaccaacatcagg

SEQ ID NO: 659748 - DNA, 25 bp, Rattus norvegicus
ttactttcacattaccaacatcagg

SEQ ID NO: 659749 - DNA, 25 bp, Rattus norvegicus
ttactttcagacctggatgccagcc

SEQ ID NO: 659750 - DNA, 25 bp, Rattus norvegicus
ttactttcagacgtggatgccagcc

SEQ ID NO: 659751 - DNA, 25 bp, Rattus norvegicus
ttactttccaccagatacaatatag

SEQ ID NO: 659752 - DNA, 25 bp, Rattus norvegicus
ttactttccacctgatacaatatag

SEQ ID NO: 659753 - DNA, 25 bp, Rattus norvegicus
ttactttcccatctccagtgttatt

SEQ ID NO: 659754 - DNA, 25 bp, Rattus norvegicus
ttactttcccatgtccagtgttatt

SEQ ID NO: 659755 - DNA, 25 bp, Rattus norvegicus
ttactttccctacctttatgttgtg

SEQ ID NO: 659756 - DNA, 25 bp, Rattus norvegicus
ttactttccctagctttatgttgtg

SEQ ID NO: 659757 - DNA, 25 bp, Rattus norvegicus
ttactttccctcaatttctcagatt

SEQ ID NO: 659758 - DNA, 25 bp, Rattus norvegicus
ttactttccctctatttctcagatt

SEQ ID NO: 659759 - DNA, 25 bp, Rattus norvegicus
ttactttccttcactctttactatg

SEQ ID NO: 659760 - DNA, 25 bp, Rattus norvegicus
ttactttccttctctctttactatg

SEQ ID NO: 659761 - DNA, 25 bp, Rattus norvegicus
ttactttccttgcattaagacagct

SEQ ID NO: 659762 - DNA, 25 bp, Rattus norvegicus
ttactttccttggattaagacagct

SEQ ID NO: 659763 - DNA, 25 bp, Rattus norvegicus
ttactttcggctagaatacctggca

SEQ ID NO: 659764 - DNA, 25 bp, Rattus norvegicus
ttactttcggcttgaatacctggca

SEQ ID NO: 659765 - DNA, 25 bp, Rattus norvegicus
ttactttctcccatagagctggaca

SEQ ID NO: 659766 - DNA, 25 bp, Rattus norvegicus
ttactttctcccttagagctggaca

SEQ ID NO: 659767 - DNA, 25 bp, Rattus norvegicus
ttactttctgcccattgacaaacct

SEQ ID NO: 659768 - DNA, 25 bp, Rattus norvegicus
ttactttctgccgattgacaaacct

SEQ ID NO: 659769 - DNA, 25 bp, Rattus norvegicus
ttactttctttgcagcccctcttgt

SEQ ID NO: 659770 - DNA, 25 bp, Rattus norvegicus
ttactttctttggagcccctcttgt

SEQ ID NO: 659771 - DNA, 25 bp, Rattus norvegicus
ttactttgacctcgtcctggcaagg

SEQ ID NO: 659772 - DNA, 25 bp, Rattus norvegicus
ttactttgacctggtcctggcaagg

SEQ ID NO: 659773 - DNA, 25 bp, Rattus norvegicus
ttactttgagcaagacacttggatt

SEQ ID NO: 659774 - DNA, 25 bp, Rattus norvegicus
ttactttgagcatgacacttggatt

SEQ ID NO: 659775 - DNA, 25 bp, Rattus norvegicus
ttactttgctttccctgcttgaaat

SEQ ID NO: 659776 - DNA, 25 bp, Rattus norvegicus
ttactttgctttgcctgcttgaaat

SEQ ID NO: 659777 - DNA, 25 bp, Rattus norvegicus
ttactttgggtaccttctgagattt

SEQ ID NO: 659778 - DNA, 25 bp, Rattus norvegicus
ttactttgggtagcttctgagattt

SEQ ID NO: 659779 - DNA, 25 bp, Rattus norvegicus
ttactttgtggcattcctattgtca

SEQ ID NO: 659780 - DNA, 25 bp, Rattus norvegicus
ttactttgtggctttcctattgtca

SEQ ID NO: 659781 - DNA, 25 bp, Rattus norvegicus
ttacttttattacacttgcccggcg

SEQ ID NO: 659782 - DNA, 25 bp, Rattus norvegicus
ttacttttattagacttgcccggcg

SEQ ID NO: 659783 - DNA, 25 bp, Rattus norvegicus
ttacttttcactacgggcttaggca

SEQ ID NO: 659784 - DNA, 25 bp, Rattus norvegicus
ttacttttcacttcgggcttaggca

SEQ ID NO: 659785 - DNA, 25 bp, Rattus norvegicus
ttacttttcattctgatgcccacac

SEQ ID NO: 659786 - DNA, 25 bp, Rattus norvegicus
ttacttttcattgtgatgcccacac

SEQ ID NO: 659787 - DNA, 25 bp, Rattus norvegicus
ttacttttccagaactgtgccgggc

SEQ ID NO: 659788 - DNA, 25 bp, Rattus norvegicus
ttacttttccagtactgtgccgggc

SEQ ID NO: 659789 - DNA, 25 bp, Rattus norvegicus
ttacttttcctcacgtgccaacagt

SEQ ID NO: 659790 - DNA, 25 bp, Rattus norvegicus
ttacttttcctctcgtgccaacagt

SEQ ID NO: 659791 - DNA, 25 bp, Rattus norvegicus
ttacttttccttactctgtattctt

SEQ ID NO: 659792 - DNA, 25 bp, Rattus norvegicus
ttacttttcctttctctgtattctt

SEQ ID NO: 659793 - DNA, 25 bp, Rattus norvegicus
ttacttttctcccactgctgactga

SEQ ID NO: 659794 - DNA, 25 bp, Rattus norvegicus
ttacttttctccgactgctgactga

SEQ ID NO: 659795 - DNA, 25 bp, Rattus norvegicus
ttacttttggccaggatgcttcctc

SEQ ID NO: 659796 - DNA, 25 bp, Rattus norvegicus
ttacttttggcccttactcatgagg

SEQ ID NO: 659797 - DNA, 25 bp, Rattus norvegicus
ttacttttggccgttactcatgagg

SEQ ID NO: 659798 - DNA, 25 bp, Rattus norvegicus
ttacttttggcctggatgcttcctc

SEQ ID NO: 659799 - DNA, 25 bp, Rattus norvegicus
ttacttttgtccatccaggagcagc

SEQ ID NO: 659800 - DNA, 25 bp, Rattus norvegicus
ttacttttgtccttccaggagcagc

SEQ ID NO: 659801 - DNA, 25 bp, Rattus norvegicus
ttactttttgtgaagcagcgcttta

SEQ ID NO: 659802 - DNA, 25 bp, Rattus norvegicus
ttactttttgtgtagcagcgcttta

SEQ ID NO: 659803 - DNA, 25 bp, Rattus norvegicus
ttacttttttcaactttcaggacag

SEQ ID NO: 659804 - DNA, 25 bp, Rattus norvegicus
ttacttttttcatctttcaggacag

SEQ ID NO: 659805 - DNA, 25 bp, Rattus norvegicus
ttagaaaaccgcacacaaccggcac

SEQ ID NO: 659806 - DNA, 25 bp, Rattus norvegicus
ttagaaaaccgctcacaaccggcac

SEQ ID NO: 659807 - DNA, 25 bp, Rattus norvegicus
ttagaaaactcacagctggctgcct

SEQ ID NO: 659808 - DNA, 25 bp, Rattus norvegicus
ttagaaaactcagagctggctgcct

SEQ ID NO: 659809 - DNA, 25 bp, Rattus norvegicus
ttagaaaagctcatgtccactgcgg

SEQ ID NO: 659810 - DNA, 25 bp, Rattus norvegicus
ttagaaaagctcttgtccactgcgg

SEQ ID NO: 659811 - DNA, 25 bp, Rattus norvegicus
ttagaaaatagcatcccacctctgg

SEQ ID NO: 659812 - DNA, 25 bp, Rattus norvegicus
ttagaaaatagcttcccacctctgg

SEQ ID NO: 659813 - DNA, 25 bp, Rattus norvegicus
ttagaaacaaagaacagggctggac

SEQ ID NO: 659814 - DNA, 25 bp, Rattus norvegicus
ttagaaacaaagtacagggctggac

SEQ ID NO: 659815 - DNA, 25 bp, Rattus norvegicus
ttagaaacagtgctgctgctgtcgc

SEQ ID NO: 659816 - DNA, 25 bp, Rattus norvegicus
ttagaaacagtggtgctgctgtcgc

SEQ ID NO: 659817 - DNA, 25 bp, Rattus norvegicus
ttagaaacatgtactgtccccagac

SEQ ID NO: 659818 - DNA, 25 bp, Rattus norvegicus
ttagaaacatgttctgtccccagac

SEQ ID NO: 659819 - DNA, 25 bp, Rattus norvegicus
ttagaaaccacgagacaccgccttg

SEQ ID NO: 659820 - DNA, 25 bp, Rattus norvegicus
ttagaaaccacgtgacaccgccttg

SEQ ID NO: 659821 - DNA, 25 bp, Rattus norvegicus
ttagaaactggcatcggtccctgag

SEQ ID NO: 659822 - DNA, 25 bp, Rattus norvegicus
ttagaaactggcttcggtccctgag

SEQ ID NO: 659823 - DNA, 25 bp, Rattus norvegicus
ttagaaacttccctcatggcggtcc

SEQ ID NO: 659824 - DNA, 25 bp, Rattus norvegicus
ttagaaacttccgtcatggcggtcc

SEQ ID NO: 659825 - DNA, 25 bp, Rattus norvegicus
ttagaaagacgtccacgaccgggca

SEQ ID NO: 659826 - DNA, 25 bp, Rattus norvegicus
ttagaaagacgtgcacgaccgggca

SEQ ID NO: 659827 - DNA, 25 bp, Rattus norvegicus
ttagaaagccgcaatttggtcccgc

SEQ ID NO: 659828 - DNA, 25 bp, Rattus norvegicus
ttagaaagccgctatttggtcccgc

SEQ ID NO: 659829 - DNA, 25 bp, Rattus norvegicus
ttagaaagcctccaggctgggttgc

SEQ ID NO: 659830 - DNA, 25 bp, Rattus norvegicus
ttagaaagcctcgaggctgggttgc

SEQ ID NO: 659831 - DNA, 25 bp, Rattus norvegicus
ttagaaagcgctccctgccttctgg

SEQ ID NO: 659832 - DNA, 25 bp, Rattus norvegicus
ttagaaagcgctgcctgccttctgg

SEQ ID NO: 659833 - DNA, 25 bp, Rattus norvegicus
ttagaaagctttcctgcctgatacc

SEQ ID NO: 659834 - DNA, 25 bp, Rattus norvegicus
ttagaaagctttgctgcctgatacc

SEQ ID NO: 659835 - DNA, 25 bp, Rattus norvegicus
ttagaaatacacaccttcctcatgc

SEQ ID NO: 659836 - DNA, 25 bp, Rattus norvegicus
ttagaaatacactccttcctcatgc

SEQ ID NO: 659837 - DNA, 25 bp, Rattus norvegicus
ttagaaatatccataagcgcctgag

SEQ ID NO: 659838 - DNA, 25 bp, Rattus norvegicus
ttagaaatatccttaagcgcctgag

SEQ ID NO: 659839 - DNA, 25 bp, Rattus norvegicus
ttagaaatcactcggtcattcctcc

SEQ ID NO: 659840 - DNA, 25 bp, Rattus norvegicus
ttagaaatcactgggtcattcctcc

SEQ ID NO: 659841 - DNA, 25 bp, Rattus norvegicus
ttagaaatcctaaagtgtgggctgg

SEQ ID NO: 659842 - DNA, 25 bp, Rattus norvegicus
ttagaaatcctatagtgtgggctgg

SEQ ID NO: 659843 - DNA, 25 bp, Rattus norvegicus
ttagaaatccttatgtaccctcctt

SEQ ID NO: 659844 - DNA, 25 bp, Rattus norvegicus
ttagaaatccttttgtaccctcctt

SEQ ID NO: 659845 - DNA, 25 bp, Rattus norvegicus
ttagaaatctctcttcttctgcact

SEQ ID NO: 659846 - DNA, 25 bp, Rattus norvegicus
ttagaaatctctgttcttctgcact

SEQ ID NO: 659847 - DNA, 25 bp, Rattus norvegicus
ttagaaatctgtagccccttttttg

SEQ ID NO: 659848 - DNA, 25 bp, Rattus norvegicus
ttagaaatctgttgccccttttttg

SEQ ID NO: 659849 - DNA, 25 bp, Rattus norvegicus
ttagaaatgaaacctgcccctcaga

SEQ ID NO: 659850 - DNA, 25 bp, Rattus norvegicus
ttagaaatgaaagctgcccctcaga

SEQ ID NO: 659851 - DNA, 25 bp, Rattus norvegicus
ttagaaatgcagacttgtttaccac

SEQ ID NO: 659852 - DNA, 25 bp, Rattus norvegicus
ttagaaatgcagtcttgtttaccac

SEQ ID NO: 659853 - DNA, 25 bp, Rattus norvegicus
ttagaaatgcataatcgagacttat

SEQ ID NO: 659854 - DNA, 25 bp, Rattus norvegicus
ttagaaatgcattatcgagacttat

SEQ ID NO: 659855 - DNA, 25 bp, Rattus norvegicus
ttagaaatgtctcttgctgcgtccc

SEQ ID NO: 659856 - DNA, 25 bp, Rattus norvegicus
ttagaaatgtctgttgctgcgtccc

SEQ ID NO: 659857 - DNA, 25 bp, Rattus norvegicus
ttagaaatttctcattgatcttggg

SEQ ID NO: 659858 - DNA, 25 bp, Rattus norvegicus
ttagaaatttctgattgatcttggg

SEQ ID NO: 659859 - DNA, 25 bp, Rattus norvegicus
ttagaacaactaactgtacaccgtg

SEQ ID NO: 659860 - DNA, 25 bp, Rattus norvegicus
ttagaacaactatctgtacaccgtg

SEQ ID NO: 659861 - DNA, 25 bp, Rattus norvegicus
ttagaacacccactgaccatagcgc

SEQ ID NO: 659862 - DNA, 25 bp, Rattus norvegicus
ttagaacacccagtgaccatagcgc

SEQ ID NO: 659863 - DNA, 25 bp, Rattus norvegicus
ttagaacactatcgcttaagcaatc

SEQ ID NO: 659864 - DNA, 25 bp, Rattus norvegicus
ttagaacactatggcttaagcaatc

SEQ ID NO: 659865 - DNA, 25 bp, Rattus norvegicus
ttagaacactgtagtctgtcacccc

SEQ ID NO: 659866 - DNA, 25 bp, Rattus norvegicus
ttagaacactgttgtctgtcacccc

SEQ ID NO: 659867 - DNA, 25 bp, Rattus norvegicus
ttagaacacttcaagacccatccca

SEQ ID NO: 659868 - DNA, 25 bp, Rattus norvegicus
ttagaacacttctagacccatccca

SEQ ID NO: 659869 - DNA, 25 bp, Rattus norvegicus
ttagaacacttgacttcccaatcac

SEQ ID NO: 659870 - DNA, 25 bp, Rattus norvegicus
ttagaacacttgtcttcccaatcac

SEQ ID NO: 659871 - DNA, 25 bp, Rattus norvegicus
ttagaacatagactggcatggccat

SEQ ID NO: 659872 - DNA, 25 bp, Rattus norvegicus
ttagaacatagagtggcatggccat

SEQ ID NO: 659873 - DNA, 25 bp, Rattus norvegicus
ttagaacatggtactctacccagcc

SEQ ID NO: 659874 - DNA, 25 bp, Rattus norvegicus
ttagaacatggttctctacccagcc

SEQ ID NO: 659875 - DNA, 25 bp, Rattus norvegicus
ttagaacattctccccagaggtgtg

SEQ ID NO: 659876 - DNA, 25 bp, Rattus norvegicus
ttagaacattctgcccagaggtgtg

SEQ ID NO: 659877 - DNA, 25 bp, Rattus norvegicus
ttagaaccctggacaggagacccca

SEQ ID NO: 659878 - DNA, 25 bp, Rattus norvegicus
ttagaaccctggtcaggagacccca

SEQ ID NO: 659879 - DNA, 25 bp, Rattus norvegicus
ttagaaccgcaaccttgtgcactgt

SEQ ID NO: 659880 - DNA, 25 bp, Rattus norvegicus
ttagaaccgcaagcttgtgcactgt

SEQ ID NO: 659881 - DNA, 25 bp, Rattus norvegicus
ttagaacctgtgagaccacctgcat

SEQ ID NO: 659882 - DNA, 25 bp, Rattus norvegicus
ttagaacctgtgtgaccacctgcat

SEQ ID NO: 659883 - DNA, 25 bp, Rattus norvegicus
ttagaacggatgctgagccaggcca

SEQ ID NO: 659884 - DNA, 25 bp, Rattus norvegicus
ttagaacggatggtgagccaggcca

SEQ ID NO: 659885 - DNA, 25 bp, Rattus norvegicus
ttagaactactaaggccaccacatt

SEQ ID NO: 659886 - DNA, 25 bp, Rattus norvegicus
ttagaactactacttttgacaaaca

SEQ ID NO: 659887 - DNA, 25 bp, Rattus norvegicus
ttagaactactagttttgacaaaca

SEQ ID NO: 659888 - DNA, 25 bp, Rattus norvegicus
ttagaactactatggccaccacatt

SEQ ID NO: 659889 - DNA, 25 bp, Rattus norvegicus
ttagaactctgtcccaagtgtcatc

SEQ ID NO: 659890 - DNA, 25 bp, Rattus norvegicus
ttagaactctgtgccaagtgtcatc

SEQ ID NO: 659891 - DNA, 25 bp, Rattus norvegicus
ttagaactgagcaccactttcctac

SEQ ID NO: 659892 - DNA, 25 bp, Rattus norvegicus
ttagaactgagctccactttcctac

SEQ ID NO: 659893 - DNA, 25 bp, Rattus norvegicus
ttagaactgcatcgtctagcctcag

SEQ ID NO: 659894 - DNA, 25 bp, Rattus norvegicus
ttagaactgcatggtctagcctcag

SEQ ID NO: 659895 - DNA, 25 bp, Rattus norvegicus
ttagaactgcccacgccagtgacac

SEQ ID NO: 659896 - DNA, 25 bp, Rattus norvegicus
ttagaactgccctcgccagtgacac

SEQ ID NO: 659897 - DNA, 25 bp, Rattus norvegicus
ttagaactgtgcatgggacccgagt

SEQ ID NO: 659898 - DNA, 25 bp, Rattus norvegicus
ttagaactgtgcttgggacccgagt

SEQ ID NO: 659899 - DNA, 25 bp, Rattus norvegicus
ttagaacttagcactcatgaggaca

SEQ ID NO: 659900 - DNA, 25 bp, Rattus norvegicus
ttagaacttagctctcatgaggaca

SEQ ID NO: 659901 - DNA, 25 bp, Rattus norvegicus
ttagaactttgtaccagctctccac

SEQ ID NO: 659902 - DNA, 25 bp, Rattus norvegicus
ttagaactttgttccagctctccac

SEQ ID NO: 659903 - DNA, 25 bp, Rattus norvegicus
ttagaagaccatattccactgcctg

SEQ ID NO: 659904 - DNA, 25 bp, Rattus norvegicus
ttagaagaccattttccactgcctg

SEQ ID NO: 659905 - DNA, 25 bp, Rattus norvegicus
ttagaagacgtgaccacctccatat

SEQ ID NO: 659906 - DNA, 25 bp, Rattus norvegicus
ttagaagacgtgtccacctccatat

SEQ ID NO: 659907 - DNA, 25 bp, Rattus norvegicus
ttagaagagtgcagtgagtccctcc

SEQ ID NO: 659908 - DNA, 25 bp, Rattus norvegicus
ttagaagagtgctgtgagtccctcc

SEQ ID NO: 659909 - DNA, 25 bp, Rattus norvegicus
ttagaagcagccaaacaatgacttg

SEQ ID NO: 659910 - DNA, 25 bp, Rattus norvegicus
ttagaagcagccacctggtctcatg

SEQ ID NO: 659911 - DNA, 25 bp, Rattus norvegicus
ttagaagcagcctaacaatgacttg

SEQ ID NO: 659912 - DNA, 25 bp, Rattus norvegicus
ttagaagcagcctcctggtctcatg

SEQ ID NO: 659913 - DNA, 25 bp, Rattus norvegicus
ttagaagcagttcagcagtagacac

SEQ ID NO: 659914 - DNA, 25 bp, Rattus norvegicus
ttagaagcagttgagcagtagacac

SEQ ID NO: 659915 - DNA, 25 bp, Rattus norvegicus
ttagaagccagcaggacagacacgg

SEQ ID NO: 659916 - DNA, 25 bp, Rattus norvegicus
ttagaagccagccagaaccacacta

SEQ ID NO: 659917 - DNA, 25 bp, Rattus norvegicus
ttagaagccagcgagaaccacacta

SEQ ID NO: 659918 - DNA, 25 bp, Rattus norvegicus
ttagaagccagctggacagacacgg

SEQ ID NO: 659919 - DNA, 25 bp, Rattus norvegicus
ttagaagccctcctgctctacgtga

SEQ ID NO: 659920 - DNA, 25 bp, Rattus norvegicus
ttagaagccctcgtgctctacgtga

SEQ ID NO: 659921 - DNA, 25 bp, Rattus norvegicus
ttagaagccttccatcagtaaaatg

SEQ ID NO: 659922 - DNA, 25 bp, Rattus norvegicus
ttagaagccttcgatcagtaaaatg

SEQ ID NO: 659923 - DNA, 25 bp, Rattus norvegicus
ttagaagctgcccttttagctcccc

SEQ ID NO: 659924 - DNA, 25 bp, Rattus norvegicus
ttagaagctgccgttttagctcccc

SEQ ID NO: 659925 - DNA, 25 bp, Rattus norvegicus
ttagaaggaagccagccggcctttg

SEQ ID NO: 659926 - DNA, 25 bp, Rattus norvegicus
ttagaaggaagcgagccggcctttg

SEQ ID NO: 659927 - DNA, 25 bp, Rattus norvegicus
ttagaaggacctcggagacgcccct

SEQ ID NO: 659928 - DNA, 25 bp, Rattus norvegicus
ttagaaggacctgggagacgcccct

SEQ ID NO: 659929 - DNA, 25 bp, Rattus norvegicus
ttagaaggattgcagcgcagcgcct

SEQ ID NO: 659930 - DNA, 25 bp, Rattus norvegicus
ttagaaggattggagcgcagcgcct

SEQ ID NO: 659931 - DNA, 25 bp, Rattus norvegicus
ttagaagggagcatcctcctttcag

SEQ ID NO: 659932 - DNA, 25 bp, Rattus norvegicus
ttagaagggagcttcctcctttcag

SEQ ID NO: 659933 - DNA, 25 bp, Rattus norvegicus
ttagaaggtcgcactttcagttgct

SEQ ID NO: 659934 - DNA, 25 bp, Rattus norvegicus
ttagaaggtcgctctttcagttgct

SEQ ID NO: 659935 - DNA, 25 bp, Rattus norvegicus
ttagaagtacgcagagtggctccca

SEQ ID NO: 659936 - DNA, 25 bp, Rattus norvegicus
ttagaagtacgctgagtggctccca

SEQ ID NO: 659937 - DNA, 25 bp, Rattus norvegicus
ttagaagtgacaccccactggtaaa

SEQ ID NO: 659938 - DNA, 25 bp, Rattus norvegicus
ttagaagtgacagcccactggtaaa

SEQ ID NO: 659939 - DNA, 25 bp, Rattus norvegicus
ttagaagtgcaacccttacccctca

SEQ ID NO: 659940 - DNA, 25 bp, Rattus norvegicus
ttagaagtgcaagccttacccctca

SEQ ID NO: 659941 - DNA, 25 bp, Rattus norvegicus
ttagaagtgccccattcatcgagtg

SEQ ID NO: 659942 - DNA, 25 bp, Rattus norvegicus
ttagaagtgcccgattcatcgagtg

SEQ ID NO: 659943 - DNA, 25 bp, Rattus norvegicus
ttagaatccttactctacatttttt

SEQ ID NO: 659944 - DNA, 25 bp, Rattus norvegicus
ttagaatccttagtctacatttttt

SEQ ID NO: 659945 - DNA, 25 bp, Rattus norvegicus
ttagaatcgagtccctgtttgtggc

SEQ ID NO: 659946 - DNA, 25 bp, Rattus norvegicus
ttagaatcgagtgcctgtttgtggc

SEQ ID NO: 659947 - DNA, 25 bp, Rattus norvegicus
ttagaatctgtaaccctgtcagccc

SEQ ID NO: 659948 - DNA, 25 bp, Rattus norvegicus
ttagaatctgtatccctgtcagccc

SEQ ID NO: 659949 - DNA, 25 bp, Rattus norvegicus
ttagaatgacatcccttctgttttc

SEQ ID NO: 659950 - DNA, 25 bp, Rattus norvegicus
ttagaatgacatgccttctgttttc

SEQ ID NO: 659951 - DNA, 25 bp, Rattus norvegicus
ttagaatgaggcctccggactctgg

SEQ ID NO: 659952 - DNA, 25 bp, Rattus norvegicus
ttagaatgaggcgtccggactctgg

SEQ ID NO: 659953 - DNA, 25 bp, Rattus norvegicus
ttagaatgccgtactttcctgatct

SEQ ID NO: 659954 - DNA, 25 bp, Rattus norvegicus
ttagaatgccgttctttcctgatct

SEQ ID NO: 659955 - DNA, 25 bp, Rattus norvegicus
ttagaatgctccagccgggttttcg

SEQ ID NO: 659956 - DNA, 25 bp, Rattus norvegicus
ttagaatgctcctgccgggttttcg

SEQ ID NO: 659957 - DNA, 25 bp, Rattus norvegicus
ttagaatgctctaaaaccctccctg

SEQ ID NO: 659958 - DNA, 25 bp, Rattus norvegicus
ttagaatgctcttaaaccctccctg

SEQ ID NO: 659959 - DNA, 25 bp, Rattus norvegicus
ttagaatgctgaccttccacatggg

SEQ ID NO: 659960 - DNA, 25 bp, Rattus norvegicus
ttagaatgctgagcttccacatggg

SEQ ID NO: 659961 - DNA, 25 bp, Rattus norvegicus
ttagaattctctctcggccgaagca

SEQ ID NO: 659962 - DNA, 25 bp, Rattus norvegicus
ttagaattctctgtcggccgaagca

SEQ ID NO: 659963 - DNA, 25 bp, Rattus norvegicus
ttagaattgtgaagtgatgcctggg

SEQ ID NO: 659964 - DNA, 25 bp, Rattus norvegicus
ttagaattgtgatgtgatgcctggg

SEQ ID NO: 659965 - DNA, 25 bp, Rattus norvegicus
ttagacaattccaagctcacgagcc

SEQ ID NO: 659966 - DNA, 25 bp, Rattus norvegicus
ttagacaattcctagctcacgagcc

SEQ ID NO: 659967 - DNA, 25 bp, Rattus norvegicus
ttagacacagagacacgcccactaa

SEQ ID NO: 659968 - DNA, 25 bp, Rattus norvegicus
ttagacacagagtcacgcccactaa

SEQ ID NO: 659969 - DNA, 25 bp, Rattus norvegicus
ttagacacagggacactcttcggag

SEQ ID NO: 659970 - DNA, 25 bp, Rattus norvegicus
ttagacacagggtcactcttcggag

SEQ ID NO: 659971 - DNA, 25 bp, Rattus norvegicus
ttagacactgtgaggtcaacctctc

SEQ ID NO: 659972 - DNA, 25 bp, Rattus norvegicus
ttagacactgtgtggtcaacctctc

SEQ ID NO: 659973 - DNA, 25 bp, Rattus norvegicus
ttagacactgttacctgagaggatt

SEQ ID NO: 659974 - DNA, 25 bp, Rattus norvegicus
ttagacactgtttcctgagaggatt

SEQ ID NO: 659975 - DNA, 25 bp, Rattus norvegicus
ttagacacttgaaacctacgcagcc

SEQ ID NO: 659976 - DNA, 25 bp, Rattus norvegicus
ttagacacttgatacctacgcagcc

SEQ ID NO: 659977 - DNA, 25 bp, Rattus norvegicus
ttagacagaatcaccttccaatcct

SEQ ID NO: 659978 - DNA, 25 bp, Rattus norvegicus
ttagacagaatctccttccaatcct

SEQ ID NO: 659979 - DNA, 25 bp, Rattus norvegicus
ttagacaggtttatgctatgtagcc

SEQ ID NO: 659980 - DNA, 25 bp, Rattus norvegicus
ttagacaggtttttgctatgtagcc

SEQ ID NO: 659981 - DNA, 25 bp, Rattus norvegicus
ttagacagtgagacacccagagtac

SEQ ID NO: 659982 - DNA, 25 bp, Rattus norvegicus
ttagacagtgagtcacccagagtac

SEQ ID NO: 659983 - DNA, 25 bp, Rattus norvegicus
ttagacagttaactaaatggtggct

SEQ ID NO: 659984 - DNA, 25 bp, Rattus norvegicus
ttagacagttaagtaaatggtggct

SEQ ID NO: 659985 - DNA, 25 bp, Rattus norvegicus
ttagacatatgcatcttacacccac

SEQ ID NO: 659986 - DNA, 25 bp, Rattus norvegicus
ttagacatatgcttcttacacccac

SEQ ID NO: 659987 - DNA, 25 bp, Rattus norvegicus
ttagacatcgctcgcctgctgaaca

SEQ ID NO: 659988 - DNA, 25 bp, Rattus norvegicus
ttagacatcgctggcctgctgaaca

SEQ ID NO: 659989 - DNA, 25 bp, Rattus norvegicus
ttagacatcttcatacgggaggctt

SEQ ID NO: 659990 - DNA, 25 bp, Rattus norvegicus
ttagacatcttcttacgggaggctt

SEQ ID NO: 659991 - DNA, 25 bp, Rattus norvegicus
ttagacatggcaccatcagctcttc

SEQ ID NO: 659992 - DNA, 25 bp, Rattus norvegicus
ttagacatggcagcatcagctcttc

SEQ ID NO: 659993 - DNA, 25 bp, Rattus norvegicus
ttagacattcctcgcattaagcggg

SEQ ID NO: 659994 - DNA, 25 bp, Rattus norvegicus
ttagacattcctggcattaagcggg

SEQ ID NO: 659995 - DNA, 25 bp, Rattus norvegicus
ttagacattctaacgccttagcatg

SEQ ID NO: 659996 - DNA, 25 bp, Rattus norvegicus
ttagacattctatcgccttagcatg

SEQ ID NO: 659997 - DNA, 25 bp, Rattus norvegicus
ttagaccaaggtagtcacttccacc

SEQ ID NO: 659998 - DNA, 25 bp, Rattus norvegicus
ttagaccaaggttgtcacttccacc

SEQ ID NO: 659999 - DNA, 25 bp, Rattus norvegicus
ttagaccaagtcactgccagttttt

SEQ ID NO: 660000 - DNA, 25 bp, Rattus norvegicus
ttagaccaagtctctgccagttttt

SEQ ID NO: 660001 - DNA, 25 bp, Rattus norvegicus
ttagaccaatacaaacacctgcttt

SEQ ID NO: 660002 - DNA, 25 bp, Rattus norvegicus
ttagaccaatactaacacctgcttt

SEQ ID NO: 660003 - DNA, 25 bp, Rattus norvegicus
ttagaccagtgacgctgacgggaat

SEQ ID NO: 660004 - DNA, 25 bp, Rattus norvegicus
ttagaccagtgaggctgacgggaat

SEQ ID NO: 660005 - DNA, 25 bp, Rattus norvegicus
ttagacccaaacacacgttttgttg

SEQ ID NO: 660006 - DNA, 25 bp, Rattus norvegicus
ttagacccaaacatcttgccacttt

SEQ ID NO: 660007 - DNA, 25 bp, Rattus norvegicus
ttagacccaaactcacgttttgttg

SEQ ID NO: 660008 - DNA, 25 bp, Rattus norvegicus
ttagacccaaacttcttgccacttt

SEQ ID NO: 660009 - DNA, 25 bp, Rattus norvegicus
ttagacccagcaaggatgacgacga

SEQ ID NO: 660010 - DNA, 25 bp, Rattus norvegicus
ttagacccagcatggatgacgacga

SEQ ID NO: 660011 - DNA, 25 bp, Rattus norvegicus
ttagacccagcgatgcaaggcttgt

SEQ ID NO: 660012 - DNA, 25 bp, Rattus norvegicus
ttagacccagcgttgcaaggcttgt

SEQ ID NO: 660013 - DNA, 25 bp, Rattus norvegicus
ttagacctccccacagctggaatgc

SEQ ID NO: 660014 - DNA, 25 bp, Rattus norvegicus
ttagacctcccctcagctggaatgc

SEQ ID NO: 660015 - DNA, 25 bp, Rattus norvegicus
ttagacctcctgcagattttgtatg

SEQ ID NO: 660016 - DNA, 25 bp, Rattus norvegicus
ttagacctcctggagattttgtatg

SEQ ID NO: 660017 - DNA, 25 bp, Rattus norvegicus
ttagacctcgtcacttgtaacaggg

SEQ ID NO: 660018 - DNA, 25 bp, Rattus norvegicus
ttagacctcgtctcttgtaacaggg

SEQ ID NO: 660019 - DNA, 25 bp, Rattus norvegicus
ttagacctgcatatgcatcccacat

SEQ ID NO: 660020 - DNA, 25 bp, Rattus norvegicus
ttagacctgcatttgcatcccacat

SEQ ID NO: 660021 - DNA, 25 bp, Rattus norvegicus
ttagacctgctgcatgagtcactgc

SEQ ID NO: 660022 - DNA, 25 bp, Rattus norvegicus
ttagacctgctggatgagtcactgc

SEQ ID NO: 660023 - DNA, 25 bp, Rattus norvegicus
ttagacctgggtactgatccttcta

SEQ ID NO: 660024 - DNA, 25 bp, Rattus norvegicus
ttagacctgggttctgatccttcta

SEQ ID NO: 660025 - DNA, 25 bp, Rattus norvegicus
ttagacgctaatagtccggctgcat

SEQ ID NO: 660026 - DNA, 25 bp, Rattus norvegicus
ttagacgctaattgtccggctgcat

SEQ ID NO: 660027 - DNA, 25 bp, Rattus norvegicus
ttagacggcctcatccaaaagaaca

SEQ ID NO: 660028 - DNA, 25 bp, Rattus norvegicus
ttagacggcctcttccaaaagaaca

SEQ ID NO: 660029 - DNA, 25 bp, Rattus norvegicus
ttagacgggaggactcttccaccag

SEQ ID NO: 660030 - DNA, 25 bp, Rattus norvegicus
ttagacgggaggtctcttccaccag

SEQ ID NO: 660031 - DNA, 25 bp, Rattus norvegicus
ttagacggttttcctgcctgacata

SEQ ID NO: 660032 - DNA, 25 bp, Rattus norvegicus
ttagacggttttgctgcctgacata

SEQ ID NO: 660033 - DNA, 25 bp, Rattus norvegicus
ttagactatcttcaaaccaaaccaa

SEQ ID NO: 660034 - DNA, 25 bp, Rattus norvegicus
ttagactatcttgaaaccaaaccaa

SEQ ID NO: 660035 - DNA, 25 bp, Rattus norvegicus
ttagactatgtcatcaacctgtgtg

SEQ ID NO: 660036 - DNA, 25 bp, Rattus norvegicus
ttagactatgtcttcaacctgtgtg

SEQ ID NO: 660037 - DNA, 25 bp, Rattus norvegicus
ttagactcagacagaatgcttcagg

SEQ ID NO: 660038 - DNA, 25 bp, Rattus norvegicus
ttagactcagactgaatgcttcagg

SEQ ID NO: 660039 - DNA, 25 bp, Rattus norvegicus
ttagactccatgagtaggccgtttg

SEQ ID NO: 660040 - DNA, 25 bp, Rattus norvegicus
ttagactccatgtgtaggccgtttg

SEQ ID NO: 660041 - DNA, 25 bp, Rattus norvegicus
ttagactctcaaacaagtcccatcc

SEQ ID NO: 660042 - DNA, 25 bp, Rattus norvegicus
ttagactctcaatcaagtcccatcc

SEQ ID NO: 660043 - DNA, 25 bp, Rattus norvegicus
ttagactctcgtcagaaagggtgct

SEQ ID NO: 660044 - DNA, 25 bp, Rattus norvegicus
ttagactctcgtgagaaagggtgct

SEQ ID NO: 660045 - DNA, 25 bp, Rattus norvegicus
ttagactctgcactgtccaccatgt

SEQ ID NO: 660046 - DNA, 25 bp, Rattus norvegicus
ttagactctgcagtgtccaccatgt

SEQ ID NO: 660047 - DNA, 25 bp, Rattus norvegicus
ttagactctttccacagatgtggta

SEQ ID NO: 660048 - DNA, 25 bp, Rattus norvegicus
ttagactctttcgacagatgtggta

SEQ ID NO: 660049 - DNA, 25 bp, Rattus norvegicus
ttagactgaggcagcacacactcgt

SEQ ID NO: 660050 - DNA, 25 bp, Rattus norvegicus
ttagactgaggctgcacacactcgt

SEQ ID NO: 660051 - DNA, 25 bp, Rattus norvegicus
ttagactgcaggagccctacattgg

SEQ ID NO: 660052 - DNA, 25 bp, Rattus norvegicus
ttagactgcaggtgccctacattgg

SEQ ID NO: 660053 - DNA, 25 bp, Rattus norvegicus
ttagactgcagtaaggtgggaccac

SEQ ID NO: 660054 - DNA, 25 bp, Rattus norvegicus
ttagactgcagttaggtgggaccac

SEQ ID NO: 660055 - DNA, 25 bp, Rattus norvegicus
ttagacttcattctcatgcaccatg

SEQ ID NO: 660056 - DNA, 25 bp, Rattus norvegicus
ttagacttcattgtcatgcaccatg

SEQ ID NO: 660057 - DNA, 25 bp, Rattus norvegicus
ttagacttggtcacagaggacctgg

SEQ ID NO: 660058 - DNA, 25 bp, Rattus norvegicus
ttagacttggtctcagaggacctgg

SEQ ID NO: 660059 - DNA, 25 bp, Rattus norvegicus
ttagacttgtcccagtttccgaagc

SEQ ID NO: 660060 - DNA, 25 bp, Rattus norvegicus
ttagacttgtccgagtttccgaagc

SEQ ID NO: 660061 - DNA, 25 bp, Rattus norvegicus
ttagacttgtctatcagcatccgat

SEQ ID NO: 660062 - DNA, 25 bp, Rattus norvegicus
ttagacttgtctttcagcatccgat

SEQ ID NO: 660063 - DNA, 25 bp, Rattus norvegicus
ttagacttttgacttgaacttgatt

SEQ ID NO: 660064 - DNA, 25 bp, Rattus norvegicus
ttagacttttgagttgaacttgatt

SEQ ID NO: 660065 - DNA, 25 bp, Rattus norvegicus
ttagagaagtcaatccagccgccta

SEQ ID NO: 660066 - DNA, 25 bp, Rattus norvegicus
ttagagaagtcattccagccgccta

SEQ ID NO: 660067 - DNA, 25 bp, Rattus norvegicus
ttagagaatcgcaccagtgaccctt

SEQ ID NO: 660068 - DNA, 25 bp, Rattus norvegicus
ttagagaatcgctccagtgaccctt

SEQ ID NO: 660069 - DNA, 25 bp, Rattus norvegicus
ttagagacgattacaagcggaggcg

SEQ ID NO: 660070 - DNA, 25 bp, Rattus norvegicus
ttagagacgatttcaagcggaggcg

SEQ ID NO: 660071 - DNA, 25 bp, Rattus norvegicus
ttagagactccaacgtggttcagtt

SEQ ID NO: 660072 - DNA, 25 bp, Rattus norvegicus
ttagagactccatcgtggttcagtt

SEQ ID NO: 660073 - DNA, 25 bp, Rattus norvegicus
ttagagagaatgatgcccagctggc

SEQ ID NO: 660074 - DNA, 25 bp, Rattus norvegicus
ttagagagaatgttgcccagctggc

SEQ ID NO: 660075 - DNA, 25 bp, Rattus norvegicus
ttagagagcagaactgtccacagat

SEQ ID NO: 660076 - DNA, 25 bp, Rattus norvegicus
ttagagagcagatctgtccacagat

SEQ ID NO: 660077 - DNA, 25 bp, Rattus norvegicus
ttagagagcctgaggtctcccagct

SEQ ID NO: 660078 - DNA, 25 bp, Rattus norvegicus
ttagagagcctgtggtctcccagct

SEQ ID NO: 660079 - DNA, 25 bp, Rattus norvegicus
ttagagagttacctgtcttttttct

SEQ ID NO: 660080 - DNA, 25 bp, Rattus norvegicus
ttagagagttacgtgtcttttttct

SEQ ID NO: 660081 - DNA, 25 bp, Rattus norvegicus
ttagagatccagaggtcgacgccgt

SEQ ID NO: 660082 - DNA, 25 bp, Rattus norvegicus
ttagagatccagtggtcgacgccgt

SEQ ID NO: 660083 - DNA, 25 bp, Rattus norvegicus
ttagagatgagcattgtttcccatt

SEQ ID NO: 660084 - DNA, 25 bp, Rattus norvegicus
ttagagatgagctttgtttcccatt

SEQ ID NO: 660085 - DNA, 25 bp, Rattus norvegicus
ttagagatgcccatttacggcctga

SEQ ID NO: 660086 - DNA, 25 bp, Rattus norvegicus
ttagagatgcccttttacggcctga

SEQ ID NO: 660087 - DNA, 25 bp, Rattus norvegicus
ttagagatgtcgacagcactgcttc

SEQ ID NO: 660088 - DNA, 25 bp, Rattus norvegicus
ttagagatgtcgtcagcactgcttc

SEQ ID NO: 660089 - DNA, 25 bp, Rattus norvegicus
ttagagcaacatctgggtgccctgc

SEQ ID NO: 660090 - DNA, 25 bp, Rattus norvegicus
ttagagcaacatgtgggtgccctgc

SEQ ID NO: 660091 - DNA, 25 bp, Rattus norvegicus
ttagagcacagcctcattccttgtt

SEQ ID NO: 660092 - DNA, 25 bp, Rattus norvegicus
ttagagcacagcgtcattccttgtt

SEQ ID NO: 660093 - DNA, 25 bp, Rattus norvegicus
ttagagcacggactccgtccagttg

SEQ ID NO: 660094 - DNA, 25 bp, Rattus norvegicus
ttagagcacggagtccgtccagttg

SEQ ID NO: 660095 - DNA, 25 bp, Rattus norvegicus
ttagagcagcatcttcagtttggat

SEQ ID NO: 660096 - DNA, 25 bp, Rattus norvegicus
ttagagcagcatgttcagtttggat

SEQ ID NO: 660097 - DNA, 25 bp, Rattus norvegicus
ttagagcagggcactccgagtgaca

SEQ ID NO: 660098 - DNA, 25 bp, Rattus norvegicus
ttagagcagggctctccgagtgaca

SEQ ID NO: 660099 - DNA, 25 bp, Rattus norvegicus
ttagagcagtcgcaagcccagctgg

SEQ ID NO: 660100 - DNA, 25 bp, Rattus norvegicus
ttagagcagtcggaagcccagctgg

SEQ ID NO: 660101 - DNA, 25 bp, Rattus norvegicus
ttagagcatcaaacacaggaaccat

SEQ ID NO: 660102 - DNA, 25 bp, Rattus norvegicus
ttagagcatcaatcacaggaaccat

SEQ ID NO: 660103 - DNA, 25 bp, Rattus norvegicus
ttagagcattttccgcatgtctggc

SEQ ID NO: 660104 - DNA, 25 bp, Rattus norvegicus
ttagagcattttgcgcatgtctggc

SEQ ID NO: 660105 - DNA, 25 bp, Rattus norvegicus
ttagagccaatccttatcccgaagt

SEQ ID NO: 660106 - DNA, 25 bp, Rattus norvegicus
ttagagccaatcgttatcccgaagt

SEQ ID NO: 660107 - DNA, 25 bp, Rattus norvegicus
ttagagccacaacggcttgctctgc

SEQ ID NO: 660108 - DNA, 25 bp, Rattus norvegicus
ttagagccacaagggcttgctctgc

SEQ ID NO: 660109 - DNA, 25 bp, Rattus norvegicus
ttagagccacttctgcctgtcattg

SEQ ID NO: 660110 - DNA, 25 bp, Rattus norvegicus
ttagagccacttgtgcctgtcattg

SEQ ID NO: 660111 - DNA, 25 bp, Rattus norvegicus
ttagagccgagtcacacggctgccc

SEQ ID NO: 660112 - DNA, 25 bp, Rattus norvegicus
ttagagccgagtgacacggctgccc

SEQ ID NO: 660113 - DNA, 25 bp, Rattus norvegicus
ttagagcctaacctgacccgcaagg

SEQ ID NO: 660114 - DNA, 25 bp, Rattus norvegicus
ttagagcctaacgtgacccgcaagg

SEQ ID NO: 660115 - DNA, 25 bp, Rattus norvegicus
ttagagcctggtccaaatgggcaac

SEQ ID NO: 660116 - DNA, 25 bp, Rattus norvegicus
ttagagcctggtgcaaatgggcaac

SEQ ID NO: 660117 - DNA, 25 bp, Rattus norvegicus
ttagagctccgacgaagactttccg

SEQ ID NO: 660118 - DNA, 25 bp, Rattus norvegicus
ttagagctccgaggaagactttccg

SEQ ID NO: 660119 - DNA, 25 bp, Rattus norvegicus
ttagagctctcacgagcccgtgcct

SEQ ID NO: 660120 - DNA, 25 bp, Rattus norvegicus
ttagagctctcaggagcccgtgcct

SEQ ID NO: 660121 - DNA, 25 bp, Rattus norvegicus
ttagagctcttaaaactttcttaag

SEQ ID NO: 660122 - DNA, 25 bp, Rattus norvegicus
ttagagctcttataactttcttaag

SEQ ID NO: 660123 - DNA, 25 bp, Rattus norvegicus
ttagagctgccaacaccaacatgac

SEQ ID NO: 660124 - DNA, 25 bp, Rattus norvegicus
ttagagctgccatcaccaacatgac

SEQ ID NO: 660125 - DNA, 25 bp, Rattus norvegicus
ttagagctgctgattgtgaatctca

SEQ ID NO: 660126 - DNA, 25 bp, Rattus norvegicus
ttagagctgctgtttgtgaatctca

SEQ ID NO: 660127 - DNA, 25 bp, Rattus norvegicus
ttagagctttagactttcctataag

SEQ ID NO: 660128 - DNA, 25 bp, Rattus norvegicus
ttagagctttagtctttcctataag

SEQ ID NO: 660129 - DNA, 25 bp, Rattus norvegicus
ttagaggaagcccatgacctcttct

SEQ ID NO: 660130 - DNA, 25 bp, Rattus norvegicus
ttagaggaagccgatgacctcttct

SEQ ID NO: 660131 - DNA, 25 bp, Rattus norvegicus
ttagaggaccaactctgcttgctgt

SEQ ID NO: 660132 - DNA, 25 bp, Rattus norvegicus
ttagaggaccaagtctgcttgctgt

SEQ ID NO: 660133 - DNA, 25 bp, Rattus norvegicus
ttagaggatctcagggttgaaccca

SEQ ID NO: 660134 - DNA, 25 bp, Rattus norvegicus
ttagaggatctctgggttgaaccca

SEQ ID NO: 660135 - DNA, 25 bp, Rattus norvegicus
ttagaggatggcaaagacccctccc

SEQ ID NO: 660136 - DNA, 25 bp, Rattus norvegicus
ttagaggatggctaagacccctccc

SEQ ID NO: 660137 - DNA, 25 bp, Rattus norvegicus
ttagaggcattcatgttcttcccca

SEQ ID NO: 660138 - DNA, 25 bp, Rattus norvegicus
ttagaggcattcttgttcttcccca

SEQ ID NO: 660139 - DNA, 25 bp, Rattus norvegicus
ttagaggctgacacatcccagagcg

SEQ ID NO: 660140 - DNA, 25 bp, Rattus norvegicus
ttagaggctgactcatcccagagcg

SEQ ID NO: 660141 - DNA, 25 bp, Rattus norvegicus
ttagaggcttttctggctctcaggg

SEQ ID NO: 660142 - DNA, 25 bp, Rattus norvegicus
ttagaggcttttgtggctctcaggg

SEQ ID NO: 660143 - DNA, 25 bp, Rattus norvegicus
ttagaggtatgtcccaccgtgtcca

SEQ ID NO: 660144 - DNA, 25 bp, Rattus norvegicus
ttagaggtatgtgccaccgtgtcca

SEQ ID NO: 660145 - DNA, 25 bp, Rattus norvegicus
ttagaggtccacagctttgacacac

SEQ ID NO: 660146 - DNA, 25 bp, Rattus norvegicus
ttagaggtccactgctttgacacac

SEQ ID NO: 660147 - DNA, 25 bp, Rattus norvegicus
ttagaggtcctcactctaactcagg

SEQ ID NO: 660148 - DNA, 25 bp, Rattus norvegicus
ttagaggtcctctctctaactcagg

SEQ ID NO: 660149 - DNA, 25 bp, Rattus norvegicus
ttagaggtccttagccaacaatcag

SEQ ID NO: 660150 - DNA, 25 bp, Rattus norvegicus
ttagaggtcctttgccaacaatcag

SEQ ID NO: 660151 - DNA, 25 bp, Rattus norvegicus
ttagaggtctccacggttccacaaa

SEQ ID NO: 660152 - DNA, 25 bp, Rattus norvegicus
ttagaggtctcctcggttccacaaa

SEQ ID NO: 660153 - DNA, 25 bp, Rattus norvegicus
ttagaggtgtgcatcgccatgctta

SEQ ID NO: 660154 - DNA, 25 bp, Rattus norvegicus
ttagaggtgtgcttcgccatgctta

SEQ ID NO: 660155 - DNA, 25 bp, Rattus norvegicus
ttagagtaataccacacagcgtaag

SEQ ID NO: 660156 - DNA, 25 bp, Rattus norvegicus
ttagagtaatacgacacagcgtaag

SEQ ID NO: 660157 - DNA, 25 bp, Rattus norvegicus
ttagagtacctcatttctcacttac

SEQ ID NO: 660158 - DNA, 25 bp, Rattus norvegicus
ttagagtacctcttttctcacttac

SEQ ID NO: 660159 - DNA, 25 bp, Rattus norvegicus
ttagagtagctcataccggtgcctg

SEQ ID NO: 660160 - DNA, 25 bp, Rattus norvegicus
ttagagtagctcttaccggtgcctg

SEQ ID NO: 660161 - DNA, 25 bp, Rattus norvegicus
ttagagtatcccattgctatctgct

SEQ ID NO: 660162 - DNA, 25 bp, Rattus norvegicus
ttagagtatccctttgctatctgct

SEQ ID NO: 660163 - DNA, 25 bp, Rattus norvegicus
ttagagtccacacactgagggccct

SEQ ID NO: 660164 - DNA, 25 bp, Rattus norvegicus
ttagagtccacagactgagggccct

SEQ ID NO: 660165 - DNA, 25 bp, Rattus norvegicus
ttagagtcctttacttccatgagga

SEQ ID NO: 660166 - DNA, 25 bp, Rattus norvegicus
ttagagtccttttcttccatgagga

SEQ ID NO: 660167 - DNA, 25 bp, Rattus norvegicus
ttagagtctcaaaaccagtggcatg

SEQ ID NO: 660168 - DNA, 25 bp, Rattus norvegicus
ttagagtctcaataccagtggcatg

SEQ ID NO: 660169 - DNA, 25 bp, Rattus norvegicus
ttagagttcaacacctgtttccttc

SEQ ID NO: 660170 - DNA, 25 bp, Rattus norvegicus
ttagagttcaactcctgtttccttc

SEQ ID NO: 660171 - DNA, 25 bp, Rattus norvegicus
ttagagttcccacgcaagaccggtt

SEQ ID NO: 660172 - DNA, 25 bp, Rattus norvegicus
ttagagttcccaggcaagaccggtt

SEQ ID NO: 660173 - DNA, 25 bp, Rattus norvegicus
ttagagttgagcatcctgatgtgta

SEQ ID NO: 660174 - DNA, 25 bp, Rattus norvegicus
ttagagttgagcttcctgatgtgta

SEQ ID NO: 660175 - DNA, 25 bp, Rattus norvegicus
ttagagtttctcatgctgcaacaaa

SEQ ID NO: 660176 - DNA, 25 bp, Rattus norvegicus
ttagagtttctcttgctgcaacaaa

SEQ ID NO: 660177 - DNA, 25 bp, Rattus norvegicus
ttagatacagtcagtctcctccaac

SEQ ID NO: 660178 - DNA, 25 bp, Rattus norvegicus
ttagatacagtctgtctcctccaac

SEQ ID NO: 660179 - DNA, 25 bp, Rattus norvegicus
ttagatacctgtctgcacacaatgc

SEQ ID NO: 660180 - DNA, 25 bp, Rattus norvegicus
ttagatacctgtgtgcacacaatgc

SEQ ID NO: 660181 - DNA, 25 bp, Rattus norvegicus
ttagatactctgacttggcctggaa

SEQ ID NO: 660182 - DNA, 25 bp, Rattus norvegicus
ttagatactctgtcttggcctggaa

SEQ ID NO: 660183 - DNA, 25 bp, Rattus norvegicus
ttagatactttaattcccgaataag

SEQ ID NO: 660184 - DNA, 25 bp, Rattus norvegicus
ttagatactttatttcccgaataag

SEQ ID NO: 660185 - DNA, 25 bp, Rattus norvegicus
ttagatagaaacactgggcagagac

SEQ ID NO: 660186 - DNA, 25 bp, Rattus norvegicus
ttagatagaaactctgggcagagac

SEQ ID NO: 660187 - DNA, 25 bp, Rattus norvegicus
ttagatagtaaacgcctctcacccc

SEQ ID NO: 660188 - DNA, 25 bp, Rattus norvegicus
ttagatagtaaaggcctctcacccc

SEQ ID NO: 660189 - DNA, 25 bp, Rattus norvegicus
ttagatatctaaacccactctggcc

SEQ ID NO: 660190 - DNA, 25 bp, Rattus norvegicus
ttagatatctaatcccactctggcc

SEQ ID NO: 660191 - DNA, 25 bp, Rattus norvegicus
ttagatattgcaccctttcactcca

SEQ ID NO: 660192 - DNA, 25 bp, Rattus norvegicus
ttagatattgcagcctttcactcca

SEQ ID NO: 660193 - DNA, 25 bp, Rattus norvegicus
ttagatcaactactcaacgccctca

SEQ ID NO: 660194 - DNA, 25 bp, Rattus norvegicus
ttagatcaactagtcaacgccctca

SEQ ID NO: 660195 - DNA, 25 bp, Rattus norvegicus
ttagatcagaggcatgcactatcac

SEQ ID NO: 660196 - DNA, 25 bp, Rattus norvegicus
ttagatcagagggatgcactatcac

SEQ ID NO: 660197 - DNA, 25 bp, Rattus norvegicus
ttagatcagctcaagcagcagcgct

SEQ ID NO: 660198 - DNA, 25 bp, Rattus norvegicus
ttagatcagctctagcagcagcgct

SEQ ID NO: 660199 - DNA, 25 bp, Rattus norvegicus
ttagatcagtaccttgcgatggccc

SEQ ID NO: 660200 - DNA, 25 bp, Rattus norvegicus
ttagatcagtacgttgcgatggccc

SEQ ID NO: 660201 - DNA, 25 bp, Rattus norvegicus
ttagatcagtggacctcatccttcc

SEQ ID NO: 660202 - DNA, 25 bp, Rattus norvegicus
ttagatcagtggtcctcatccttcc

SEQ ID NO: 660203 - DNA, 25 bp, Rattus norvegicus
ttagatccactgcgtcacgttacct

SEQ ID NO: 660204 - DNA, 25 bp, Rattus norvegicus
ttagatccactgggtcacgttacct

SEQ ID NO: 660205 - DNA, 25 bp, Rattus norvegicus
ttagatccaggacagcttgtgctat

SEQ ID NO: 660206 - DNA, 25 bp, Rattus norvegicus
ttagatccaggagagcttgtgctat

SEQ ID NO: 660207 - DNA, 25 bp, Rattus norvegicus
ttagatccagtgaaccgtagcaggt

SEQ ID NO: 660208 - DNA, 25 bp, Rattus norvegicus
ttagatccagtgtaccgtagcaggt

SEQ ID NO: 660209 - DNA, 25 bp, Rattus norvegicus
ttagatccctatatctccactagaa

SEQ ID NO: 660210 - DNA, 25 bp, Rattus norvegicus
ttagatccctatttctccactagaa

SEQ ID NO: 660211 - DNA, 25 bp, Rattus norvegicus
ttagatcccttcacggtaatgtctg

SEQ ID NO: 660212 - DNA, 25 bp, Rattus norvegicus
ttagatcccttctcggtaatgtctg

SEQ ID NO: 660213 - DNA, 25 bp, Rattus norvegicus
ttagatctaaagacaccgggtgctt

SEQ ID NO: 660214 - DNA, 25 bp, Rattus norvegicus
ttagatctaaagtcaccgggtgctt

SEQ ID NO: 660215 - DNA, 25 bp, Rattus norvegicus
ttagatctatttccccttttctcct

SEQ ID NO: 660216 - DNA, 25 bp, Rattus norvegicus
ttagatctatttgcccttttctcct

SEQ ID NO: 660217 - DNA, 25 bp, Rattus norvegicus
ttagatctcgctacatttacataca

SEQ ID NO: 660218 - DNA, 25 bp, Rattus norvegicus
ttagatctcgcttcatttacataca

SEQ ID NO: 660219 - DNA, 25 bp, Rattus norvegicus
ttagatctgagtccatcgccttcat

SEQ ID NO: 660220 - DNA, 25 bp, Rattus norvegicus
ttagatctgagtgcatcgccttcat

SEQ ID NO: 660221 - DNA, 25 bp, Rattus norvegicus
ttagatctttaaccttgcagctgcc

SEQ ID NO: 660222 - DNA, 25 bp, Rattus norvegicus
ttagatctttaagcttgcagctgcc

SEQ ID NO: 660223 - DNA, 25 bp, Rattus norvegicus
ttagatgaagaacgccctgggctac

SEQ ID NO: 660224 - DNA, 25 bp, Rattus norvegicus
ttagatgaagaaggccctgggctac

SEQ ID NO: 660225 - DNA, 25 bp, Rattus norvegicus
ttagatgagtagcagaagccacttt

SEQ ID NO: 660226 - DNA, 25 bp, Rattus norvegicus
ttagatgagtaggagaagccacttt

SEQ ID NO: 660227 - DNA, 25 bp, Rattus norvegicus
ttagatgcactgcagcctctcggtt

SEQ ID NO: 660228 - DNA, 25 bp, Rattus norvegicus
ttagatgcactggagcctctcggtt

SEQ ID NO: 660229 - DNA, 25 bp, Rattus norvegicus
ttagatgccctcattgttctcttgg

SEQ ID NO: 660230 - DNA, 25 bp, Rattus norvegicus
ttagatgccctctttgttctcttgg

SEQ ID NO: 660231 - DNA, 25 bp, Rattus norvegicus
ttagatgccgctaagttccacatgg

SEQ ID NO: 660232 - DNA, 25 bp, Rattus norvegicus
ttagatgccgcttagttccacatgg

SEQ ID NO: 660233 - DNA, 25 bp, Rattus norvegicus
ttagatgcgagcctgttctacttcc

SEQ ID NO: 660234 - DNA, 25 bp, Rattus norvegicus
ttagatgcgagcgtgttctacttcc

SEQ ID NO: 660235 - DNA, 25 bp, Rattus norvegicus
ttagatgctcaaaagggtcctgacc

SEQ ID NO: 660236 - DNA, 25 bp, Rattus norvegicus
ttagatgctcaatagggtcctgacc

SEQ ID NO: 660237 - DNA, 25 bp, Rattus norvegicus
ttagatgctctactgtactctgggc

SEQ ID NO: 660238 - DNA, 25 bp, Rattus norvegicus
ttagatgctctagtgtactctgggc

SEQ ID NO: 660239 - DNA, 25 bp, Rattus norvegicus
ttagatggctccaggatctgatgcc

SEQ ID NO: 660240 - DNA, 25 bp, Rattus norvegicus
ttagatggctcctggatctgatgcc

SEQ ID NO: 660241 - DNA, 25 bp, Rattus norvegicus
ttagatggctctaggccagagtcct

SEQ ID NO: 660242 - DNA, 25 bp, Rattus norvegicus
ttagatggctcttggccagagtcct

SEQ ID NO: 660243 - DNA, 25 bp, Rattus norvegicus
ttagatgggcatccctcagtgcgat

SEQ ID NO: 660244 - DNA, 25 bp, Rattus norvegicus
ttagatgggcatgcctcagtgcgat

SEQ ID NO: 660245 - DNA, 25 bp, Rattus norvegicus
ttagatgggttcacttatgctgtga

SEQ ID NO: 660246 - DNA, 25 bp, Rattus norvegicus
ttagatgggttctcttatgctgtga

SEQ ID NO: 660247 - DNA, 25 bp, Rattus norvegicus
ttagatggtatacctgattcgtgtt

SEQ ID NO: 660248 - DNA, 25 bp, Rattus norvegicus
ttagatggtatagctgattcgtgtt

SEQ ID NO: 660249 - DNA, 25 bp, Rattus norvegicus
ttagatgtcacaaagccacctggca

SEQ ID NO: 660250 - DNA, 25 bp, Rattus norvegicus
ttagatgtcacatagccacctggca

SEQ ID NO: 660251 - DNA, 25 bp, Rattus norvegicus
ttagatgtcatcacagctagtgtga

SEQ ID NO: 660252 - DNA, 25 bp, Rattus norvegicus
ttagatgtcatctcagctagtgtga

SEQ ID NO: 660253 - DNA, 25 bp, Rattus norvegicus
ttagatgtcatgagcttccgatccc

SEQ ID NO: 660254 - DNA, 25 bp, Rattus norvegicus
ttagatgtcatgtgcttccgatccc

SEQ ID NO: 660255 - DNA, 25 bp, Rattus norvegicus
ttagatgtctaaatggtggctcctc

SEQ ID NO: 660256 - DNA, 25 bp, Rattus norvegicus
ttagatgtctaattggtggctcctc

SEQ ID NO: 660257 - DNA, 25 bp, Rattus norvegicus
ttagatgtctgtcctttctccgtgg

SEQ ID NO: 660258 - DNA, 25 bp, Rattus norvegicus
ttagatgtctgtgctttctccgtgg

SEQ ID NO: 660259 - DNA, 25 bp, Rattus norvegicus
ttagatgtgggtcgctcagtccaga

SEQ ID NO: 660260 - DNA, 25 bp, Rattus norvegicus
ttagatgtgggtggctcagtccaga

SEQ ID NO: 660261 - DNA, 25 bp, Rattus norvegicus
ttagatgtggtgacattcttcttgc

SEQ ID NO: 660262 - DNA, 25 bp, Rattus norvegicus
ttagatgtggtgtcattcttcttgc

SEQ ID NO: 660263 - DNA, 25 bp, Rattus norvegicus
ttagattcacatcaccattcctttc

SEQ ID NO: 660264 - DNA, 25 bp, Rattus norvegicus
ttagattcacatgaccattcctttc

SEQ ID NO: 660265 - DNA, 25 bp, Rattus norvegicus
ttagattcacttaccaatgccatag

SEQ ID NO: 660266 - DNA, 25 bp, Rattus norvegicus
ttagattcactttccaatgccatag

SEQ ID NO: 660267 - DNA, 25 bp, Rattus norvegicus
ttagattcccagactagagccctca

SEQ ID NO: 660268 - DNA, 25 bp, Rattus norvegicus
ttagattcccagtctagagccctca

SEQ ID NO: 660269 - DNA, 25 bp, Rattus norvegicus
ttagattcctatagctcatacaccc

SEQ ID NO: 660270 - DNA, 25 bp, Rattus norvegicus
ttagattcctattgctcatacaccc

SEQ ID NO: 660271 - DNA, 25 bp, Rattus norvegicus
ttagattcctctactttattgcaat

SEQ ID NO: 660272 - DNA, 25 bp, Rattus norvegicus
ttagattcctcttctttattgcaat

SEQ ID NO: 660273 - DNA, 25 bp, Rattus norvegicus
ttagattcgtttcggcctagacgcc

SEQ ID NO: 660274 - DNA, 25 bp, Rattus norvegicus
ttagattcgtttgggcctagacgcc

SEQ ID NO: 660275 - DNA, 25 bp, Rattus norvegicus
ttagattctggccaagcataagctt

SEQ ID NO: 660276 - DNA, 25 bp, Rattus norvegicus
ttagattctggcgaagcataagctt

SEQ ID NO: 660277 - DNA, 25 bp, Rattus norvegicus
ttagattcttttcctgtcctagagc

SEQ ID NO: 660278 - DNA, 25 bp, Rattus norvegicus
ttagattcttttgctgtcctagagc

SEQ ID NO: 660279 - DNA, 25 bp, Rattus norvegicus
ttagatttgctaacgggacagaaaa

SEQ ID NO: 660280 - DNA, 25 bp, Rattus norvegicus
ttagatttgctatcgggacagaaaa

SEQ ID NO: 660281 - DNA, 25 bp, Rattus norvegicus
ttagatttggatactccagctcctg

SEQ ID NO: 660282 - DNA, 25 bp, Rattus norvegicus
ttagatttggattctccagctcctg

SEQ ID NO: 660283 - DNA, 25 bp, Rattus norvegicus
ttagattttctgaggacgtttataa

SEQ ID NO: 660284 - DNA, 25 bp, Rattus norvegicus
ttagattttctgtggacgtttataa

SEQ ID NO: 660285 - DNA, 25 bp, Rattus norvegicus
ttagatttttctattcctctgtggg

SEQ ID NO: 660286 - DNA, 25 bp, Rattus norvegicus
ttagatttttcttttcctctgtggg

SEQ ID NO: 660287 - DNA, 25 bp, Rattus norvegicus
ttagcaaaggtgagcttttccagta

SEQ ID NO: 660288 - DNA, 25 bp, Rattus norvegicus
ttagcaaaggtgtgcttttccagta

SEQ ID NO: 660289 - DNA, 25 bp, Rattus norvegicus
ttagcaacaccaccattgggcattg

SEQ ID NO: 660290 - DNA, 25 bp, Rattus norvegicus
ttagcaacaccagcattgggcattg

SEQ ID NO: 660291 - DNA, 25 bp, Rattus norvegicus
ttagcaacacctacaagatcccatt

SEQ ID NO: 660292 - DNA, 25 bp, Rattus norvegicus
ttagcaacaccttcaagatcccatt

SEQ ID NO: 660293 - DNA, 25 bp, Rattus norvegicus
ttagcaacgactcctgctggtgtgt

SEQ ID NO: 660294 - DNA, 25 bp, Rattus norvegicus
ttagcaacgactgctgctggtgtgt

SEQ ID NO: 660295 - DNA, 25 bp, Rattus norvegicus
ttagcaactgtgatctgtgaccctg

SEQ ID NO: 660296 - DNA, 25 bp, Rattus norvegicus
ttagcaactgtgttctgtgaccctg

SEQ ID NO: 660297 - DNA, 25 bp, Rattus norvegicus
ttagcaagaacaactgtccggcttc

SEQ ID NO: 660298 - DNA, 25 bp, Rattus norvegicus
ttagcaagaacatctgtccggcttc

SEQ ID NO: 660299 - DNA, 25 bp, Rattus norvegicus
ttagcaagctacatgtagcccagcg

SEQ ID NO: 660300 - DNA, 25 bp, Rattus norvegicus
ttagcaagctacttgtagcccagcg

SEQ ID NO: 660301 - DNA, 25 bp, Rattus norvegicus
ttagcaaggaccagggcctcacaga

SEQ ID NO: 660302 - DNA, 25 bp, Rattus norvegicus
ttagcaaggacctgggcctcacaga

SEQ ID NO: 660303 - DNA, 25 bp, Rattus norvegicus
ttagcaaggataaccacgcctttct

SEQ ID NO: 660304 - DNA, 25 bp, Rattus norvegicus
ttagcaaggatatccacgcctttct

SEQ ID NO: 660305 - DNA, 25 bp, Rattus norvegicus
ttagcaataactacacgcggacttg

SEQ ID NO: 660306 - DNA, 25 bp, Rattus norvegicus
ttagcaataacttcacgcggacttg

SEQ ID NO: 660307 - DNA, 25 bp, Rattus norvegicus
ttagcaatagagcttccaccctgta

SEQ ID NO: 660308 - DNA, 25 bp, Rattus norvegicus
ttagcaatagaggttccaccctgta

SEQ ID NO: 660309 - DNA, 25 bp, Rattus norvegicus
ttagcaatagtcagacccctcctca

SEQ ID NO: 660310 - DNA, 25 bp, Rattus norvegicus
ttagcaatagtctgacccctcctca

SEQ ID NO: 660311 - DNA, 25 bp, Rattus norvegicus
ttagcaatatttccaggtacagata

SEQ ID NO: 660312 - DNA, 25 bp, Rattus norvegicus
ttagcaatatttgcaggtacagata

SEQ ID NO: 660313 - DNA, 25 bp, Rattus norvegicus
ttagcaatcctgatcatctgctcca

SEQ ID NO: 660314 - DNA, 25 bp, Rattus norvegicus
ttagcaatcctgttcatctgctcca

SEQ ID NO: 660315 - DNA, 25 bp, Rattus norvegicus
ttagcaatctccagtcagccataag

SEQ ID NO: 660316 - DNA, 25 bp, Rattus norvegicus
ttagcaatctcctgtcagccataag

SEQ ID NO: 660317 - DNA, 25 bp, Rattus norvegicus
ttagcaatggatcctctccttggga

SEQ ID NO: 660318 - DNA, 25 bp, Rattus norvegicus
ttagcaatggatgctctccttggga

SEQ ID NO: 660319 - DNA, 25 bp, Rattus norvegicus
ttagcaatttggaatggtattcccc

SEQ ID NO: 660320 - DNA, 25 bp, Rattus norvegicus
ttagcaatttggtatggtattcccc

SEQ ID NO: 660321 - DNA, 25 bp, Rattus norvegicus
ttagcacacttcatcttgcctgaaa

SEQ ID NO: 660322 - DNA, 25 bp, Rattus norvegicus
ttagcacacttcttcttgcctgaaa

SEQ ID NO: 660323 - DNA, 25 bp, Rattus norvegicus
ttagcacatagtcgcctcaggatga

SEQ ID NO: 660324 - DNA, 25 bp, Rattus norvegicus
ttagcacatagtggcctcaggatga

SEQ ID NO: 660325 - DNA, 25 bp, Rattus norvegicus
ttagcacatatacaatcaccagagg

SEQ ID NO: 660326 - DNA, 25 bp, Rattus norvegicus
ttagcacatatagaatcaccagagg

SEQ ID NO: 660327 - DNA, 25 bp, Rattus norvegicus
ttagcacatcagaggcagagcccgg

SEQ ID NO: 660328 - DNA, 25 bp, Rattus norvegicus
ttagcacatcagtggcagagcccgg

SEQ ID NO: 660329 - DNA, 25 bp, Rattus norvegicus
ttagcaccaaacctacaaggaccgc

SEQ ID NO: 660330 - DNA, 25 bp, Rattus norvegicus
ttagcaccaaacgtacaaggaccgc

SEQ ID NO: 660331 - DNA, 25 bp, Rattus norvegicus
ttagcaccagagactccacgaatgt

SEQ ID NO: 660332 - DNA, 25 bp, Rattus norvegicus
ttagcaccagagtctccacgaatgt

SEQ ID NO: 660333 - DNA, 25 bp, Rattus norvegicus
ttagcaccagcacgctcgctcaggg

SEQ ID NO: 660334 - DNA, 25 bp, Rattus norvegicus
ttagcaccagcaggctcgctcaggg

SEQ ID NO: 660335 - DNA, 25 bp, Rattus norvegicus
ttagcaccagtacctgactctgtgt

SEQ ID NO: 660336 - DNA, 25 bp, Rattus norvegicus
ttagcaccagtagctgactctgtgt

SEQ ID NO: 660337 - DNA, 25 bp, Rattus norvegicus
ttagcacccaagaatgcatgcatgc

SEQ ID NO: 660338 - DNA, 25 bp, Rattus norvegicus
ttagcacccaagtatgcatgcatgc

SEQ ID NO: 660339 - DNA, 25 bp, Rattus norvegicus
ttagcacccacacagcgtgactgag

SEQ ID NO: 660340 - DNA, 25 bp, Rattus norvegicus
ttagcacccacagagcgtgactgag

SEQ ID NO: 660341 - DNA, 25 bp, Rattus norvegicus
ttagcacctcaaagtcagtttcctc

SEQ ID NO: 660342 - DNA, 25 bp, Rattus norvegicus
ttagcacctcaatgtcagtttcctc

SEQ ID NO: 660343 - DNA, 25 bp, Rattus norvegicus
ttagcacctcagatctggcacagag

SEQ ID NO: 660344 - DNA, 25 bp, Rattus norvegicus
ttagcacctcagttctggcacagag

SEQ ID NO: 660345 - DNA, 25 bp, Rattus norvegicus
ttagcacctgtgagctcccagaaac

SEQ ID NO: 660346 - DNA, 25 bp, Rattus norvegicus
ttagcacctgtgtgctcccagaaac

SEQ ID NO: 660347 - DNA, 25 bp, Rattus norvegicus
ttagcacctttaacatggtctccgg

SEQ ID NO: 660348 - DNA, 25 bp, Rattus norvegicus
ttagcacctttatcatggtctccgg

SEQ ID NO: 660349 - DNA, 25 bp, Rattus norvegicus
ttagcacgtgggactgtgggccaaa

SEQ ID NO: 660350 - DNA, 25 bp, Rattus norvegicus
ttagcacgtgggtctgtgggccaaa

SEQ ID NO: 660351 - DNA, 25 bp, Rattus norvegicus
ttagcactccgtccccatagtgaat

SEQ ID NO: 660352 - DNA, 25 bp, Rattus norvegicus
ttagcactccgtgcccatagtgaat

SEQ ID NO: 660353 - DNA, 25 bp, Rattus norvegicus
ttagcactctacagctgagcgacgt

SEQ ID NO: 660354 - DNA, 25 bp, Rattus norvegicus
ttagcactctactgctgagcgacgt

SEQ ID NO: 660355 - DNA, 25 bp, Rattus norvegicus
ttagcactgctccttagttcatggt

SEQ ID NO: 660356 - DNA, 25 bp, Rattus norvegicus
ttagcactgctcgttagttcatggt

SEQ ID NO: 660357 - DNA, 25 bp, Rattus norvegicus
ttagcacttaatctttcttacccca

SEQ ID NO: 660358 - DNA, 25 bp, Rattus norvegicus
ttagcacttaatgtttcttacccca

SEQ ID NO: 660359 - DNA, 25 bp, Rattus norvegicus
ttagcacttgccagctcagacaaag

SEQ ID NO: 660360 - DNA, 25 bp, Rattus norvegicus
ttagcacttgcctgctcagacaaag

SEQ ID NO: 660361 - DNA, 25 bp, Rattus norvegicus
ttagcactttgtaccgtgtcctgtg

SEQ ID NO: 660362 - DNA, 25 bp, Rattus norvegicus
ttagcactttgttccgtgtcctgtg

SEQ ID NO: 660363 - DNA, 25 bp, Rattus norvegicus
ttagcagaagccaaagccggacacc

SEQ ID NO: 660364 - DNA, 25 bp, Rattus norvegicus
ttagcagaagcctaagccggacacc

SEQ ID NO: 660365 - DNA, 25 bp, Rattus norvegicus
ttagcagactgtcgtagcacacact

SEQ ID NO: 660366 - DNA, 25 bp, Rattus norvegicus
ttagcagactgtggtagcacacact

SEQ ID NO: 660367 - DNA, 25 bp, Rattus norvegicus
ttagcagagcggcaaggacagatca

SEQ ID NO: 660368 - DNA, 25 bp, Rattus norvegicus
ttagcagagcgggaaggacagatca

SEQ ID NO: 660369 - DNA, 25 bp, Rattus norvegicus
ttagcagcaatgattctcagacttc

SEQ ID NO: 660370 - DNA, 25 bp, Rattus norvegicus
ttagcagcaatgtttctcagacttc

SEQ ID NO: 660371 - DNA, 25 bp, Rattus norvegicus
ttagcagcacatcgttactcaattt

SEQ ID NO: 660372 - DNA, 25 bp, Rattus norvegicus
ttagcagcacatggttactcaattt

SEQ ID NO: 660373 - DNA, 25 bp, Rattus norvegicus
ttagcagcagccatagaaaccattg

SEQ ID NO: 660374 - DNA, 25 bp, Rattus norvegicus
ttagcagcagccttagaaaccattg

SEQ ID NO: 660375 - DNA, 25 bp, Rattus norvegicus
ttagcagcatcaagctgtacatgag

SEQ ID NO: 660376 - DNA, 25 bp, Rattus norvegicus
ttagcagcatcatgctgtacatgag

SEQ ID NO: 660377 - DNA, 25 bp, Rattus norvegicus
ttagcagccaagcagggcgctcact

SEQ ID NO: 660378 - DNA, 25 bp, Rattus norvegicus
ttagcagccaaggagggcgctcact

SEQ ID NO: 660379 - DNA, 25 bp, Rattus norvegicus
ttagcagcccaaacctcaagttgtg

SEQ ID NO: 660380 - DNA, 25 bp, Rattus norvegicus
ttagcagcccaatcctcaagttgtg

SEQ ID NO: 660381 - DNA, 25 bp, Rattus norvegicus
ttagcagcctgtcgttactgacctg

SEQ ID NO: 660382 - DNA, 25 bp, Rattus norvegicus
ttagcagcctgtggttactgacctg

SEQ ID NO: 660383 - DNA, 25 bp, Rattus norvegicus
ttagcagcgaccatccgatgtacct

SEQ ID NO: 660384 - DNA, 25 bp, Rattus norvegicus
ttagcagcgaccttccgatgtacct

SEQ ID NO: 660385 - DNA, 25 bp, Rattus norvegicus
ttagcagctgagactggccaggagt

SEQ ID NO: 660386 - DNA, 25 bp, Rattus norvegicus
ttagcagctgagtctggccaggagt

SEQ ID NO: 660387 - DNA, 25 bp, Rattus norvegicus
ttagcagctgtaatgtgaaccatga

SEQ ID NO: 660388 - DNA, 25 bp, Rattus norvegicus
ttagcagctgtattgtgaaccatga

SEQ ID NO: 660389 - DNA, 25 bp, Rattus norvegicus
ttagcaggagtaaccactgcccgaa

SEQ ID NO: 660390 - DNA, 25 bp, Rattus norvegicus
ttagcaggagtatccactgcccgaa

SEQ ID NO: 660391 - DNA, 25 bp, Rattus norvegicus
ttagcaggatggatggcatgactta

SEQ ID NO: 660392 - DNA, 25 bp, Rattus norvegicus
ttagcaggatggttggcatgactta

SEQ ID NO: 660393 - DNA, 25 bp, Rattus norvegicus
ttagcaggcaagatttttctccttt

SEQ ID NO: 660394 - DNA, 25 bp, Rattus norvegicus
ttagcaggcaagttttttctccttt

SEQ ID NO: 660395 - DNA, 25 bp, Rattus norvegicus
ttagcaggccctctccgaggagttg

SEQ ID NO: 660396 - DNA, 25 bp, Rattus norvegicus
ttagcaggccctgtccgaggagttg

SEQ ID NO: 660397 - DNA, 25 bp, Rattus norvegicus
ttagcaggcctaatcgttttaaaag

SEQ ID NO: 660398 - DNA, 25 bp, Rattus norvegicus
ttagcaggcctattcgttttaaaag

SEQ ID NO: 660399 - DNA, 25 bp, Rattus norvegicus
ttagcagtactaaacccgtcaggca

SEQ ID NO: 660400 - DNA, 25 bp, Rattus norvegicus
ttagcagtactatacccgtcaggca

SEQ ID NO: 660401 - DNA, 25 bp, Rattus norvegicus
ttagcagtctgaccatttttcccct

SEQ ID NO: 660402 - DNA, 25 bp, Rattus norvegicus
ttagcagtctgagcatttttcccct

SEQ ID NO: 660403 - DNA, 25 bp, Rattus norvegicus
ttagcagtctggcatcctagaatct

SEQ ID NO: 660404 - DNA, 25 bp, Rattus norvegicus
ttagcagtctgggatcctagaatct

SEQ ID NO: 660405 - DNA, 25 bp, Rattus norvegicus
ttagcagtgcttccctcgggagtga

SEQ ID NO: 660406 - DNA, 25 bp, Rattus norvegicus
ttagcagtgcttgcctcgggagtga

SEQ ID NO: 660407 - DNA, 25 bp, Rattus norvegicus
ttagcagtgtatccacctaccataa

SEQ ID NO: 660408 - DNA, 25 bp, Rattus norvegicus
ttagcagtgtatgcacctaccataa

SEQ ID NO: 660409 - DNA, 25 bp, Rattus norvegicus
ttagcagttgaaccagcatgctgtg

SEQ ID NO: 660410 - DNA, 25 bp, Rattus norvegicus
ttagcagttgaagcagcatgctgtg

SEQ ID NO: 660411 - DNA, 25 bp, Rattus norvegicus
ttagcagttgctcacgtgtcttggg

SEQ ID NO: 660412 - DNA, 25 bp, Rattus norvegicus
ttagcagttgctgacgtgtcttggg

SEQ ID NO: 660413 - DNA, 25 bp, Rattus norvegicus
ttagcagtttgccaccagaagtctg

SEQ ID NO: 660414 - DNA, 25 bp, Rattus norvegicus
ttagcagtttgcgaccagaagtctg

SEQ ID NO: 660415 - DNA, 25 bp, Rattus norvegicus
ttagcataatctcggaatggtcctg

SEQ ID NO: 660416 - DNA, 25 bp, Rattus norvegicus
ttagcataatctgggaatggtcctg

SEQ ID NO: 660417 - DNA, 25 bp, Rattus norvegicus
ttagcataccagatcgcccagtttg

SEQ ID NO: 660418 - DNA, 25 bp, Rattus norvegicus
ttagcataccagttcgcccagtttg

SEQ ID NO: 660419 - DNA, 25 bp, Rattus norvegicus
ttagcatagggcaccttaaaccttt

SEQ ID NO: 660420 - DNA, 25 bp, Rattus norvegicus
ttagcatagggctccttaaaccttt

SEQ ID NO: 660421 - DNA, 25 bp, Rattus norvegicus
ttagcatatgtcagtgatctcagca

SEQ ID NO: 660422 - DNA, 25 bp, Rattus norvegicus
ttagcatatgtctgtgatctcagca

SEQ ID NO: 660423 - DNA, 25 bp, Rattus norvegicus
ttagcatcacaccacatagtcattc

SEQ ID NO: 660424 - DNA, 25 bp, Rattus norvegicus
ttagcatcacacgacatagtcattc

SEQ ID NO: 660425 - DNA, 25 bp, Rattus norvegicus
ttagcatcacccatggtgggctggg

SEQ ID NO: 660426 - DNA, 25 bp, Rattus norvegicus
ttagcatcacccttggtgggctggg

SEQ ID NO: 660427 - DNA, 25 bp, Rattus norvegicus
ttagcatcacgtcaaggttcccttg

SEQ ID NO: 660428 - DNA, 25 bp, Rattus norvegicus
ttagcatcacgtgaaggttcccttg

SEQ ID NO: 660429 - DNA, 25 bp, Rattus norvegicus
ttagcatcgcagacatttcaggttc

SEQ ID NO: 660430 - DNA, 25 bp, Rattus norvegicus
ttagcatcgcagtcatttcaggttc

SEQ ID NO: 660431 - DNA, 25 bp, Rattus norvegicus
ttagcatctcagagctctggaggca

SEQ ID NO: 660432 - DNA, 25 bp, Rattus norvegicus
ttagcatctcagtgctctggaggca

SEQ ID NO: 660433 - DNA, 25 bp, Rattus norvegicus
ttagcatctgttatgaggctcccat

SEQ ID NO: 660434 - DNA, 25 bp, Rattus norvegicus
ttagcatctgttttgaggctcccat

SEQ ID NO: 660435 - DNA, 25 bp, Rattus norvegicus
ttagcatcttttacccttggctttg

SEQ ID NO: 660436 - DNA, 25 bp, Rattus norvegicus
ttagcatctttttcccttggctttg

SEQ ID NO: 660437 - DNA, 25 bp, Rattus norvegicus
ttagcatgcataaaacaccgggttt

SEQ ID NO: 660438 - DNA, 25 bp, Rattus norvegicus
ttagcatgcatataacaccgggttt

SEQ ID NO: 660439 - DNA, 25 bp, Rattus norvegicus
ttagcatggatcaggagggtaactc

SEQ ID NO: 660440 - DNA, 25 bp, Rattus norvegicus
ttagcatggatctggagggtaactc

SEQ ID NO: 660441 - DNA, 25 bp, Rattus norvegicus
ttagcatgtactaccttgtgcctgc

SEQ ID NO: 660442 - DNA, 25 bp, Rattus norvegicus
ttagcatgtacttccttgtgcctgc

SEQ ID NO: 660443 - DNA, 25 bp, Rattus norvegicus
ttagcatgtgttctgtccagcctgt

SEQ ID NO: 660444 - DNA, 25 bp, Rattus norvegicus
ttagcatgtgttgtgtccagcctgt

SEQ ID NO: 660445 - DNA, 25 bp, Rattus norvegicus
ttagcattaccccatgtgttgatcg

SEQ ID NO: 660446 - DNA, 25 bp, Rattus norvegicus
ttagcattacccgatgtgttgatcg

SEQ ID NO: 660447 - DNA, 25 bp, Rattus norvegicus
ttagcattagggataaacccagcac

SEQ ID NO: 660448 - DNA, 25 bp, Rattus norvegicus
ttagcattagggttaaacccagcac

SEQ ID NO: 660449 - DNA, 25 bp, Rattus norvegicus
ttagcattatggaatcaaattattg

SEQ ID NO: 660450 - DNA, 25 bp, Rattus norvegicus
ttagcattatggtatcaaattattg

SEQ ID NO: 660451 - DNA, 25 bp, Rattus norvegicus
ttagcattcatgaggtgccctgcaa

SEQ ID NO: 660452 - DNA, 25 bp, Rattus norvegicus
ttagcattcatgtggtgccctgcaa

SEQ ID NO: 660453 - DNA, 25 bp, Rattus norvegicus
ttagcattcttgctgtatcttcttg

SEQ ID NO: 660454 - DNA, 25 bp, Rattus norvegicus
ttagcattcttggtgtatcttcttg

SEQ ID NO: 660455 - DNA, 25 bp, Rattus norvegicus
ttagcattgaaacggtagaagcgat

SEQ ID NO: 660456 - DNA, 25 bp, Rattus norvegicus
ttagcattgaaagggtagaagcgat

SEQ ID NO: 660457 - DNA, 25 bp, Rattus norvegicus
ttagcattgagaaaggtccccagtt

SEQ ID NO: 660458 - DNA, 25 bp, Rattus norvegicus
ttagcattgagataggtccccagtt

SEQ ID NO: 660459 - DNA, 25 bp, Rattus norvegicus
ttagcattgcccaccctcgagactg

SEQ ID NO: 660460 - DNA, 25 bp, Rattus norvegicus
ttagcattgccctccctcgagactg

SEQ ID NO: 660461 - DNA, 25 bp, Rattus norvegicus
ttagcatttcaacttcctggtcctg

SEQ ID NO: 660462 - DNA, 25 bp, Rattus norvegicus
ttagcatttcaagttcctggtcctg

SEQ ID NO: 660463 - DNA, 25 bp, Rattus norvegicus
ttagcatttgatctctggtcagggt

SEQ ID NO: 660464 - DNA, 25 bp, Rattus norvegicus
ttagcatttgatgtctggtcagggt

SEQ ID NO: 660465 - DNA, 25 bp, Rattus norvegicus
ttagccaactggcaccttttgaagt

SEQ ID NO: 660466 - DNA, 25 bp, Rattus norvegicus
ttagccaactgggaccttttgaagt

SEQ ID NO: 660467 - DNA, 25 bp, Rattus norvegicus
ttagccaagcaaactcaaacagtct

SEQ ID NO: 660468 - DNA, 25 bp, Rattus norvegicus
ttagccaagcaatctcaaacagtct

SEQ ID NO: 660469 - DNA, 25 bp, Rattus norvegicus
ttagccaatgcaacggtgaactcac

SEQ ID NO: 660470 - DNA, 25 bp, Rattus norvegicus
ttagccaatgcatcggtgaactcac

SEQ ID NO: 660471 - DNA, 25 bp, Rattus norvegicus
ttagccaatgccaacccagaagtgc

SEQ ID NO: 660472 - DNA, 25 bp, Rattus norvegicus
ttagccaatgcctacccagaagtgc

SEQ ID NO: 660473 - DNA, 25 bp, Rattus norvegicus
ttagccacactgagcatcctagaga

SEQ ID NO: 660474 - DNA, 25 bp, Rattus norvegicus
ttagccacactgtgcatcctagaga

SEQ ID NO: 660475 - DNA, 25 bp, Rattus norvegicus
ttagccacagtgaaacagtttcctt

SEQ ID NO: 660476 - DNA, 25 bp, Rattus norvegicus
ttagccacagtgtaacagtttcctt

SEQ ID NO: 660477 - DNA, 25 bp, Rattus norvegicus
ttagccacatctatggtgtttcgtg

SEQ ID NO: 660478 - DNA, 25 bp, Rattus norvegicus
ttagccacatctttggtgtttcgtg

SEQ ID NO: 660479 - DNA, 25 bp, Rattus norvegicus
ttagccaccaccaacatcaataaca

SEQ ID NO: 660480 - DNA, 25 bp, Rattus norvegicus
ttagccaccacctacatcaataaca

SEQ ID NO: 660481 - DNA, 25 bp, Rattus norvegicus
ttagccaccatacttcccaaacaat

SEQ ID NO: 660482 - DNA, 25 bp, Rattus norvegicus
ttagccaccatagttcccaaacaat

SEQ ID NO: 660483 - DNA, 25 bp, Rattus norvegicus
ttagccaccattactgtctttgttc

SEQ ID NO: 660484 - DNA, 25 bp, Rattus norvegicus
ttagccaccatttctgtctttgttc

SEQ ID NO: 660485 - DNA, 25 bp, Rattus norvegicus
ttagccacccgtaagccaggcatgg

SEQ ID NO: 660486 - DNA, 25 bp, Rattus norvegicus
ttagccacccgttagccaggcatgg

SEQ ID NO: 660487 - DNA, 25 bp, Rattus norvegicus
ttagccacgggacttcggatataaa

SEQ ID NO: 660488 - DNA, 25 bp, Rattus norvegicus
ttagccacgggagttcggatataaa

SEQ ID NO: 660489 - DNA, 25 bp, Rattus norvegicus
ttagccactaaaattcgctggaggg

SEQ ID NO: 660490 - DNA, 25 bp, Rattus norvegicus
ttagccactaaatttcgctggaggg

SEQ ID NO: 660491 - DNA, 25 bp, Rattus norvegicus
ttagccactatcactacagcccaga

SEQ ID NO: 660492 - DNA, 25 bp, Rattus norvegicus
ttagccactatctctacagcccaga

SEQ ID NO: 660493 - DNA, 25 bp, Rattus norvegicus
ttagccagaagtagggccagatcat

SEQ ID NO: 660494 - DNA, 25 bp, Rattus norvegicus
ttagccagaagttgggccagatcat

SEQ ID NO: 660495 - DNA, 25 bp, Rattus norvegicus
ttagccagatgtcccagccagattc

SEQ ID NO: 660496 - DNA, 25 bp, Rattus norvegicus
ttagccagatgtgccagccagattc

SEQ ID NO: 660497 - DNA, 25 bp, Rattus norvegicus
ttagccagcataccacattcgtgta

SEQ ID NO: 660498 - DNA, 25 bp, Rattus norvegicus
ttagccagcatagcacattcgtgta

SEQ ID NO: 660499 - DNA, 25 bp, Rattus norvegicus
ttagccagcgctcccgaggattcag

SEQ ID NO: 660500 - DNA, 25 bp, Rattus norvegicus
ttagccagcgctgccgaggattcag

SEQ ID NO: 660501 - DNA, 25 bp, Rattus norvegicus
ttagccagggccagaggcagctgtt

SEQ ID NO: 660502 - DNA, 25 bp, Rattus norvegicus
ttagccagggcctgaggcagctgtt

SEQ ID NO: 660503 - DNA, 25 bp, Rattus norvegicus
ttagccagtcctcccagggcagata

SEQ ID NO: 660504 - DNA, 25 bp, Rattus norvegicus
ttagccagtcctgccagggcagata

SEQ ID NO: 660505 - DNA, 25 bp, Rattus norvegicus
ttagccagtgcacggcacagaccca

SEQ ID NO: 660506 - DNA, 25 bp, Rattus norvegicus
ttagccagtgcagggcacagaccca

SEQ ID NO: 660507 - DNA, 25 bp, Rattus norvegicus
ttagccatcgctatgtgattttccg

SEQ ID NO: 660508 - DNA, 25 bp, Rattus norvegicus
ttagccatcgctttgtgattttccg

SEQ ID NO: 660509 - DNA, 25 bp, Rattus norvegicus
ttagccatctcaatcagtgtctgtc

SEQ ID NO: 660510 - DNA, 25 bp, Rattus norvegicus
ttagccatctcattcagtgtctgtc

SEQ ID NO: 660511 - DNA, 25 bp, Rattus norvegicus
ttagccatcttgatactcttggaga

SEQ ID NO: 660512 - DNA, 25 bp, Rattus norvegicus
ttagccatcttgttactcttggaga

SEQ ID NO: 660513 - DNA, 25 bp, Rattus norvegicus
ttagccatgatgagtgtcttcctca

SEQ ID NO: 660514 - DNA, 25 bp, Rattus norvegicus
ttagccatgatgtgtgtcttcctca

SEQ ID NO: 660515 - DNA, 25 bp, Rattus norvegicus
ttagccatgctacagctgtctctgc

SEQ ID NO: 660516 - DNA, 25 bp, Rattus norvegicus
ttagccatgctagagctgtctctgc

SEQ ID NO: 660517 - DNA, 25 bp, Rattus norvegicus
ttagccatgtttagtgttttcacct

SEQ ID NO: 660518 - DNA, 25 bp, Rattus norvegicus
ttagccatgttttgtgttttcacct

SEQ ID NO: 660519 - DNA, 25 bp, Rattus norvegicus
ttagccattcctcatatcttaccac

SEQ ID NO: 660520 - DNA, 25 bp, Rattus norvegicus
ttagccattcctgatatcttaccac

SEQ ID NO: 660521 - DNA, 25 bp, Rattus norvegicus
ttagccattgttagtttgcccaaga

SEQ ID NO: 660522 - DNA, 25 bp, Rattus norvegicus
ttagccattgtttgtttgcccaaga

SEQ ID NO: 660523 - DNA, 25 bp, Rattus norvegicus
ttagccatttctatagcatcccaat

SEQ ID NO: 660524 - DNA, 25 bp, Rattus norvegicus
ttagccatttctttagcatcccaat

SEQ ID NO: 660525 - DNA, 25 bp, Rattus norvegicus
ttagcccaacaacttcattccgttg

SEQ ID NO: 660526 - DNA, 25 bp, Rattus norvegicus
ttagcccaacaagttcattccgttg

SEQ ID NO: 660527 - DNA, 25 bp, Rattus norvegicus
ttagcccaagcacccgaggaacagt

SEQ ID NO: 660528 - DNA, 25 bp, Rattus norvegicus
ttagcccaagcagccgaggaacagt

SEQ ID NO: 660529 - DNA, 25 bp, Rattus norvegicus
ttagcccaaggacatagttcagagc

SEQ ID NO: 660530 - DNA, 25 bp, Rattus norvegicus
ttagcccaaggagatagttcagagc

SEQ ID NO: 660531 - DNA, 25 bp, Rattus norvegicus
ttagcccaagggaggctttacccat

SEQ ID NO: 660532 - DNA, 25 bp, Rattus norvegicus
ttagcccaagggtggctttacccat

SEQ ID NO: 660533 - DNA, 25 bp, Rattus norvegicus
ttagcccaattacaagcaagtcctt

SEQ ID NO: 660534 - DNA, 25 bp, Rattus norvegicus
ttagcccaattagaagcaagtcctt

SEQ ID NO: 660535 - DNA, 25 bp, Rattus norvegicus
ttagcccacataccctgtaacttat

SEQ ID NO: 660536 - DNA, 25 bp, Rattus norvegicus
ttagcccacatagcctgtaacttat

SEQ ID NO: 660537 - DNA, 25 bp, Rattus norvegicus
ttagcccacctcaatatggtgctgg

SEQ ID NO: 660538 - DNA, 25 bp, Rattus norvegicus
ttagcccacctctatatggtgctgg

SEQ ID NO: 660539 - DNA, 25 bp, Rattus norvegicus
ttagcccagaagattgtctcagaat

SEQ ID NO: 660540 - DNA, 25 bp, Rattus norvegicus
ttagcccagaagtttgtctcagaat

SEQ ID NO: 660541 - DNA, 25 bp, Rattus norvegicus
ttagcccagattcctgttcacgttt

SEQ ID NO: 660542 - DNA, 25 bp, Rattus norvegicus
ttagcccagattgctgttcacgttt

SEQ ID NO: 660543 - DNA, 25 bp, Rattus norvegicus
ttagcccatgcaatgtgtgtataca

SEQ ID NO: 660544 - DNA, 25 bp, Rattus norvegicus
ttagcccatgcattgtgtgtataca

SEQ ID NO: 660545 - DNA, 25 bp, Rattus norvegicus
ttagcccatgggaagctgcaagtct

SEQ ID NO: 660546 - DNA, 25 bp, Rattus norvegicus
ttagcccatgggtagctgcaagtct

SEQ ID NO: 660547 - DNA, 25 bp, Rattus norvegicus
ttagcccattggatgtgcctataga

SEQ ID NO: 660548 - DNA, 25 bp, Rattus norvegicus
ttagcccattggttgtgcctataga

SEQ ID NO: 660549 - DNA, 25 bp, Rattus norvegicus
ttagccccaagaaccaaccaaagag

SEQ ID NO: 660550 - DNA, 25 bp, Rattus norvegicus
ttagccccaagatccaaccaaagag

SEQ ID NO: 660551 - DNA, 25 bp, Rattus norvegicus
ttagcccctcccaaatcagaaaaat

SEQ ID NO: 660552 - DNA, 25 bp, Rattus norvegicus
ttagcccctccctaatcagaaaaat

SEQ ID NO: 660553 - DNA, 25 bp, Rattus norvegicus
ttagcccctgttctcaatctcgaag

SEQ ID NO: 660554 - DNA, 25 bp, Rattus norvegicus
ttagcccctgttgtcaatctcgaag

SEQ ID NO: 660555 - DNA, 25 bp, Rattus norvegicus
ttagcccctttccataatctttggt

SEQ ID NO: 660556 - DNA, 25 bp, Rattus norvegicus
ttagcccctttcgataatctttggt

SEQ ID NO: 660557 - DNA, 25 bp, Rattus norvegicus
ttagcccgccagatgaaggccaaga

SEQ ID NO: 660558 - DNA, 25 bp, Rattus norvegicus
ttagcccgccagttgaaggccaaga

SEQ ID NO: 660559 - DNA, 25 bp, Rattus norvegicus
ttagcccggcatctccgaagcggag

SEQ ID NO: 660560 - DNA, 25 bp, Rattus norvegicus
ttagcccggcatgtccgaagcggag

SEQ ID NO: 660561 - DNA, 25 bp, Rattus norvegicus
ttagcccggtcacagttagcatttt

SEQ ID NO: 660562 - DNA, 25 bp, Rattus norvegicus
ttagcccggtcagagttagcatttt

SEQ ID NO: 660563 - DNA, 25 bp, Rattus norvegicus
ttagccctacgcactcttattaaag

SEQ ID NO: 660564 - DNA, 25 bp, Rattus norvegicus
ttagccctacgctctcttattaaag

SEQ ID NO: 660565 - DNA, 25 bp, Rattus norvegicus
ttagccctcatgaaaacacaaacca

SEQ ID NO: 660566 - DNA, 25 bp, Rattus norvegicus
ttagccctcatgtaaacacaaacca

SEQ ID NO: 660567 - DNA, 25 bp, Rattus norvegicus
ttagccctcctacatgtgagtgttg

SEQ ID NO: 660568 - DNA, 25 bp, Rattus norvegicus
ttagccctcctagatgtgagtgttg

SEQ ID NO: 660569 - DNA, 25 bp, Rattus norvegicus
ttagccctgatgctgtgccaatggt

SEQ ID NO: 660570 - DNA, 25 bp, Rattus norvegicus
ttagccctgatggtgtgccaatggt

SEQ ID NO: 660571 - DNA, 25 bp, Rattus norvegicus
ttagccctggaaaccgtcttcaaag

SEQ ID NO: 660572 - DNA, 25 bp, Rattus norvegicus
ttagccctggaatccgtcttcaaag

SEQ ID NO: 660573 - DNA, 25 bp, Rattus norvegicus
ttagccctggagatacgctgtgtca

SEQ ID NO: 660574 - DNA, 25 bp, Rattus norvegicus
ttagccctggagttacgctgtgtca

SEQ ID NO: 660575 - DNA, 25 bp, Rattus norvegicus
ttagccctggcaccagcactggcag

SEQ ID NO: 660576 - DNA, 25 bp, Rattus norvegicus
ttagccctggcagcagcactggcag

SEQ ID NO: 660577 - DNA, 25 bp, Rattus norvegicus
ttagccctgtgtagtatacctccaa

SEQ ID NO: 660578 - DNA, 25 bp, Rattus norvegicus
ttagccctgtgttgtatacctccaa

SEQ ID NO: 660579 - DNA, 25 bp, Rattus norvegicus
ttagcccttaagaaggtcacaccag

SEQ ID NO: 660580 - DNA, 25 bp, Rattus norvegicus
ttagcccttaagtaggtcacaccag

SEQ ID NO: 660581 - DNA, 25 bp, Rattus norvegicus
ttagcccttctaagagttcctgagc

SEQ ID NO: 660582 - DNA, 25 bp, Rattus norvegicus
ttagcccttctatgagttcctgagc

SEQ ID NO: 660583 - DNA, 25 bp, Rattus norvegicus
ttagccctttgaaaagccacaatga

SEQ ID NO: 660584 - DNA, 25 bp, Rattus norvegicus
ttagccctttgataagccacaatga

SEQ ID NO: 660585 - DNA, 25 bp, Rattus norvegicus
ttagcccttttactcacaattcata

SEQ ID NO: 660586 - DNA, 25 bp, Rattus norvegicus
ttagcccttttagtcacaattcata

SEQ ID NO: 660587 - DNA, 25 bp, Rattus norvegicus
ttagccgacaggcaaatgccatttc

SEQ ID NO: 660588 - DNA, 25 bp, Rattus norvegicus
ttagccgacagggaaatgccatttc

SEQ ID NO: 660589 - DNA, 25 bp, Rattus norvegicus
ttagccgaggccaacgccgaaccga

SEQ ID NO: 660590 - DNA, 25 bp, Rattus norvegicus
ttagccgaggcctacgccgaaccga

SEQ ID NO: 660591 - DNA, 25 bp, Rattus norvegicus
ttagccgccacgaaacctacactgt

SEQ ID NO: 660592 - DNA, 25 bp, Rattus norvegicus
ttagccgccacgtaacctacactgt

SEQ ID NO: 660593 - DNA, 25 bp, Rattus norvegicus
ttagccgctgcccatgcagagctgg

SEQ ID NO: 660594 - DNA, 25 bp, Rattus norvegicus
ttagccgctgccgatgcagagctgg

SEQ ID NO: 660595 - DNA, 25 bp, Rattus norvegicus
ttagccggacttaagccacctcaac

SEQ ID NO: 660596 - DNA, 25 bp, Rattus norvegicus
ttagccggactttagccacctcaac

SEQ ID NO: 660597 - DNA, 25 bp, Rattus norvegicus
ttagccgttgttatcttcctattgc

SEQ ID NO: 660598 - DNA, 25 bp, Rattus norvegicus
ttagccgttgttttcttcctattgc

SEQ ID NO: 660599 - DNA, 25 bp, Rattus norvegicus
ttagcctaaacacatcacaaccatc

SEQ ID NO: 660600 - DNA, 25 bp, Rattus norvegicus
ttagcctaaacagatcacaaccatc

SEQ ID NO: 660601 - DNA, 25 bp, Rattus norvegicus
ttagcctactcaacactgtagaagt

SEQ ID NO: 660602 - DNA, 25 bp, Rattus norvegicus
ttagcctactcatcactgtagaagt

SEQ ID NO: 660603 - DNA, 25 bp, Rattus norvegicus
ttagcctagcaccttctgtttctta

SEQ ID NO: 660604 - DNA, 25 bp, Rattus norvegicus
ttagcctagcacgttctgtttctta

SEQ ID NO: 660605 - DNA, 25 bp, Rattus norvegicus
ttagcctaggaaatttcagacacac

SEQ ID NO: 660606 - DNA, 25 bp, Rattus norvegicus
ttagcctaggaattttcagacacac

SEQ ID NO: 660607 - DNA, 25 bp, Rattus norvegicus
ttagcctatagtaatgaaccccagt

SEQ ID NO: 660608 - DNA, 25 bp, Rattus norvegicus
ttagcctatagttatgaaccccagt

SEQ ID NO: 660609 - DNA, 25 bp, Rattus norvegicus
ttagcctatgctcactccggtaaag

SEQ ID NO: 660610 - DNA, 25 bp, Rattus norvegicus
ttagcctatgctgactccggtaaag

SEQ ID NO: 660611 - DNA, 25 bp, Rattus norvegicus
ttagcctattatacatgcagtcagt

SEQ ID NO: 660612 - DNA, 25 bp, Rattus norvegicus
ttagcctattattcatgcagtcagt

SEQ ID NO: 660613 - DNA, 25 bp, Rattus norvegicus
ttagcctcagcaacaagccctgggt

SEQ ID NO: 660614 - DNA, 25 bp, Rattus norvegicus
ttagcctcagcatcaagccctgggt

SEQ ID NO: 660615 - DNA, 25 bp, Rattus norvegicus
ttagcctcgctcaaattagatatta

SEQ ID NO: 660616 - DNA, 25 bp, Rattus norvegicus
ttagcctcgctctaattagatatta

SEQ ID NO: 660617 - DNA, 25 bp, Rattus norvegicus
ttagcctctacaacaactgccagtt

SEQ ID NO: 660618 - DNA, 25 bp, Rattus norvegicus
ttagcctctacatcaactgccagtt

SEQ ID NO: 660619 - DNA, 25 bp, Rattus norvegicus
ttagcctctaccaattgcactgttg

SEQ ID NO: 660620 - DNA, 25 bp, Rattus norvegicus
ttagcctctacctattgcactgttg

SEQ ID NO: 660621 - DNA, 25 bp, Rattus norvegicus
ttagcctctcttcaaggcatgccgt

SEQ ID NO: 660622 - DNA, 25 bp, Rattus norvegicus
ttagcctctcttgaaggcatgccgt

SEQ ID NO: 660623 - DNA, 25 bp, Rattus norvegicus
ttagcctgactgaccttgttatttc

SEQ ID NO: 660624 - DNA, 25 bp, Rattus norvegicus
ttagcctgactgtccttgttatttc

SEQ ID NO: 660625 - DNA, 25 bp, Rattus norvegicus
ttagcctgcaataaccctgtctcga

SEQ ID NO: 660626 - DNA, 25 bp, Rattus norvegicus
ttagcctgcaattaccctgtctcga

SEQ ID NO: 660627 - DNA, 25 bp, Rattus norvegicus
ttagcctgcattagtagccctaaca

SEQ ID NO: 660628 - DNA, 25 bp, Rattus norvegicus
ttagcctgcatttgtagccctaaca

SEQ ID NO: 660629 - DNA, 25 bp, Rattus norvegicus
ttagcctgcctcaccactgtaatgc

SEQ ID NO: 660630 - DNA, 25 bp, Rattus norvegicus
ttagcctgcctctccactgtaatgc

SEQ ID NO: 660631 - DNA, 25 bp, Rattus norvegicus
ttagcctggaagcaatcactgtctt

SEQ ID NO: 660632 - DNA, 25 bp, Rattus norvegicus
ttagcctggaaggaatcactgtctt

SEQ ID NO: 660633 - DNA, 25 bp, Rattus norvegicus
ttagcctggaatagttgtaaacaca

SEQ ID NO: 660634 - DNA, 25 bp, Rattus norvegicus
ttagcctggaattgttgtaaacaca

SEQ ID NO: 660635 - DNA, 25 bp, Rattus norvegicus
ttagcctggaccagattcttcacaa

SEQ ID NO: 660636 - DNA, 25 bp, Rattus norvegicus
ttagcctggacctgattcttcacaa

SEQ ID NO: 660637 - DNA, 25 bp, Rattus norvegicus
ttagcctggtccctgacgggttaag

SEQ ID NO: 660638 - DNA, 25 bp, Rattus norvegicus
ttagcctggtccgtgacgggttaag

SEQ ID NO: 660639 - DNA, 25 bp, Rattus norvegicus
ttagcctgtccaagcctgagacttc

SEQ ID NO: 660640 - DNA, 25 bp, Rattus norvegicus
ttagcctgtccatgcctgagacttc

SEQ ID NO: 660641 - DNA, 25 bp, Rattus norvegicus
ttagcctgtcctccaacttgctgta

SEQ ID NO: 660642 - DNA, 25 bp, Rattus norvegicus
ttagcctgtcctgcaacttgctgta

SEQ ID NO: 660643 - DNA, 25 bp, Rattus norvegicus
ttagccttcaccctggcattggtac

SEQ ID NO: 660644 - DNA, 25 bp, Rattus norvegicus
ttagccttcaccgtggcattggtac

SEQ ID NO: 660645 - DNA, 25 bp, Rattus norvegicus
ttagccttcctcagttttgcctttt

SEQ ID NO: 660646 - DNA, 25 bp, Rattus norvegicus
ttagccttcctctgttttgcctttt

SEQ ID NO: 660647 - DNA, 25 bp, Rattus norvegicus
ttagccttccttactcataatgcat

SEQ ID NO: 660648 - DNA, 25 bp, Rattus norvegicus
ttagccttccttccaaactgtacat

SEQ ID NO: 660649 - DNA, 25 bp, Rattus norvegicus
ttagccttccttgcaaactgtacat

SEQ ID NO: 660650 - DNA, 25 bp, Rattus norvegicus
ttagccttcctttctcataatgcat

SEQ ID NO: 660651 - DNA, 25 bp, Rattus norvegicus
ttagccttctctatgtccagatttc

SEQ ID NO: 660652 - DNA, 25 bp, Rattus norvegicus
ttagccttctctttgtccagatttc

SEQ ID NO: 660653 - DNA, 25 bp, Rattus norvegicus
ttagccttgcaaccggttctttgta

SEQ ID NO: 660654 - DNA, 25 bp, Rattus norvegicus
ttagccttgcaagcggttctttgta

SEQ ID NO: 660655 - DNA, 25 bp, Rattus norvegicus
ttagcctttcgtaaccgtgtgttat

SEQ ID NO: 660656 - DNA, 25 bp, Rattus norvegicus
ttagcctttcgttaccgtgtgttat

SEQ ID NO: 660657 - DNA, 25 bp, Rattus norvegicus
ttagcgactgtcaacatacattctc

SEQ ID NO: 660658 - DNA, 25 bp, Rattus norvegicus
ttagcgactgtctacatacattctc

SEQ ID NO: 660659 - DNA, 25 bp, Rattus norvegicus
ttagcgagtctgaacgttaccaccc

SEQ ID NO: 660660 - DNA, 25 bp, Rattus norvegicus
ttagcgagtctgtacgttaccaccc

SEQ ID NO: 660661 - DNA, 25 bp, Rattus norvegicus
ttagcgatctccaccaatttggaat

SEQ ID NO: 660662 - DNA, 25 bp, Rattus norvegicus
ttagcgatctcctccaatttggaat

SEQ ID NO: 660663 - DNA, 25 bp, Rattus norvegicus
ttagcgccaaagagctagccgagct

SEQ ID NO: 660664 - DNA, 25 bp, Rattus norvegicus
ttagcgccaaagtgctagccgagct

SEQ ID NO: 660665 - DNA, 25 bp, Rattus norvegicus
ttagcgccacacacataacctgtga

SEQ ID NO: 660666 - DNA, 25 bp, Rattus norvegicus
ttagcgccacactcataacctgtga

SEQ ID NO: 660667 - DNA, 25 bp, Rattus norvegicus
ttagcgccagttcttaggtcatttg

SEQ ID NO: 660668 - DNA, 25 bp, Rattus norvegicus
ttagcgccagttgttaggtcatttg

SEQ ID NO: 660669 - DNA, 25 bp, Rattus norvegicus
ttagcgccctgcaggtgaagctggc

SEQ ID NO: 660670 - DNA, 25 bp, Rattus norvegicus
ttagcgccctgctggtgaagctggc

SEQ ID NO: 660671 - DNA, 25 bp, Rattus norvegicus
ttagcgcgtgtaaagttctgtgcat

SEQ ID NO: 660672 - DNA, 25 bp, Rattus norvegicus
ttagcgcgtgtatagttctgtgcat

SEQ ID NO: 660673 - DNA, 25 bp, Rattus norvegicus
ttagcgctctctacatgaaacctgc

SEQ ID NO: 660674 - DNA, 25 bp, Rattus norvegicus
ttagcgctctcttcatgaaacctgc

SEQ ID NO: 660675 - DNA, 25 bp, Rattus norvegicus
ttagcggacacccagttgcagatgt

SEQ ID NO: 660676 - DNA, 25 bp, Rattus norvegicus
ttagcggacaccgagttgcagatgt

SEQ ID NO: 660677 - DNA, 25 bp, Rattus norvegicus
ttagcggcagagctggactcactgt

SEQ ID NO: 660678 - DNA, 25 bp, Rattus norvegicus
ttagcggcagaggtggactcactgt

SEQ ID NO: 660679 - DNA, 25 bp, Rattus norvegicus
ttagcgggaaccagcctaggccttg

SEQ ID NO: 660680 - DNA, 25 bp, Rattus norvegicus
ttagcgggaacctgcctaggccttg

SEQ ID NO: 660681 - DNA, 25 bp, Rattus norvegicus
ttagcgggtcacacacggagcacaa

SEQ ID NO: 660682 - DNA, 25 bp, Rattus norvegicus
ttagcgggtcactcacggagcacaa

SEQ ID NO: 660683 - DNA, 25 bp, Rattus norvegicus
ttagcgtagcatcgtaagcactgaa

SEQ ID NO: 660684 - DNA, 25 bp, Rattus norvegicus
ttagcgtagcatggtaagcactgaa

SEQ ID NO: 660685 - DNA, 25 bp, Rattus norvegicus
ttagcgtcgtctacttgcacatgaa

SEQ ID NO: 660686 - DNA, 25 bp, Rattus norvegicus
ttagcgtcgtcttcttgcacatgaa

SEQ ID NO: 660687 - DNA, 25 bp, Rattus norvegicus
ttagcgtctaatacccatgaacatg

SEQ ID NO: 660688 - DNA, 25 bp, Rattus norvegicus
ttagcgtctaattcccatgaacatg

SEQ ID NO: 660689 - DNA, 25 bp, Rattus norvegicus
ttagcgtgtgccaaagtgactgtga

SEQ ID NO: 660690 - DNA, 25 bp, Rattus norvegicus
ttagcgtgtgcctaagtgactgtga

SEQ ID NO: 660691 - DNA, 25 bp, Rattus norvegicus
ttagcgttatgccttcctgtgaaaa

SEQ ID NO: 660692 - DNA, 25 bp, Rattus norvegicus
ttagcgttatgcgttcctgtgaaaa

SEQ ID NO: 660693 - DNA, 25 bp, Rattus norvegicus
ttagcgttcttactccacttctggg

SEQ ID NO: 660694 - DNA, 25 bp, Rattus norvegicus
ttagcgttcttagtccacttctggg

SEQ ID NO: 660695 - DNA, 25 bp, Rattus norvegicus
ttagcgttggttaagctagggttcg

SEQ ID NO: 660696 - DNA, 25 bp, Rattus norvegicus
ttagcgttggtttagctagggttcg

SEQ ID NO: 660697 - DNA, 25 bp, Rattus norvegicus
ttagctaaaaacaggccatcctcct

SEQ ID NO: 660698 - DNA, 25 bp, Rattus norvegicus
ttagctaaaaactggccatcctcct

SEQ ID NO: 660699 - DNA, 25 bp, Rattus norvegicus
ttagctaactagacctgttttgttg

SEQ ID NO: 660700 - DNA, 25 bp, Rattus norvegicus
ttagctaactagtcctgttttgttg

SEQ ID NO: 660701 - DNA, 25 bp, Rattus norvegicus
ttagctaagattatgcccttccatc

SEQ ID NO: 660702 - DNA, 25 bp, Rattus norvegicus
ttagctaagattttgcccttccatc

SEQ ID NO: 660703 - DNA, 25 bp, Rattus norvegicus
ttagctacatctacagtctgcaaca

SEQ ID NO: 660704 - DNA, 25 bp, Rattus norvegicus
ttagctacatcttcagtctgcaaca

SEQ ID NO: 660705 - DNA, 25 bp, Rattus norvegicus
ttagctacatttatcttgccttgaa

SEQ ID NO: 660706 - DNA, 25 bp, Rattus norvegicus
ttagctacatttttcttgccttgaa

SEQ ID NO: 660707 - DNA, 25 bp, Rattus norvegicus
ttagctacctctctcctgaaagatg

SEQ ID NO: 660708 - DNA, 25 bp, Rattus norvegicus
ttagctacctctgtcctgaaagatg

SEQ ID NO: 660709 - DNA, 25 bp, Rattus norvegicus
ttagctactacgagggaagacccct

SEQ ID NO: 660710 - DNA, 25 bp, Rattus norvegicus
ttagctactacgtgggaagacccct

SEQ ID NO: 660711 - DNA, 25 bp, Rattus norvegicus
ttagctagacccaggtcatttaggg

SEQ ID NO: 660712 - DNA, 25 bp, Rattus norvegicus
ttagctagaccctggtcatttaggg

SEQ ID NO: 660713 - DNA, 25 bp, Rattus norvegicus
ttagctagcatgcacagggccctgg

SEQ ID NO: 660714 - DNA, 25 bp, Rattus norvegicus
ttagctagcatggacagggccctgg

SEQ ID NO: 660715 - DNA, 25 bp, Rattus norvegicus
ttagctagctggctgtacacctttc

SEQ ID NO: 660716 - DNA, 25 bp, Rattus norvegicus
ttagctagctgggtgtacacctttc

SEQ ID NO: 660717 - DNA, 25 bp, Rattus norvegicus
ttagctagtccacccctgaagaaaa

SEQ ID NO: 660718 - DNA, 25 bp, Rattus norvegicus
ttagctagtccagccctgaagaaaa

SEQ ID NO: 660719 - DNA, 25 bp, Rattus norvegicus
ttagctagtctcaagccagagcctg

SEQ ID NO: 660720 - DNA, 25 bp, Rattus norvegicus
ttagctagtctctagccagagcctg

SEQ ID NO: 660721 - DNA, 25 bp, Rattus norvegicus
ttagctagttgtaaatacctctgta

SEQ ID NO: 660722 - DNA, 25 bp, Rattus norvegicus
ttagctagttgttaatacctctgta

SEQ ID NO: 660723 - DNA, 25 bp, Rattus norvegicus
ttagctataaggcttgccttcatcc

SEQ ID NO: 660724 - DNA, 25 bp, Rattus norvegicus
ttagctataagggttgccttcatcc

SEQ ID NO: 660725 - DNA, 25 bp, Rattus norvegicus
ttagctatcacgcaatgccacatat

SEQ ID NO: 660726 - DNA, 25 bp, Rattus norvegicus
ttagctatcacggaatgccacatat

SEQ ID NO: 660727 - DNA, 25 bp, Rattus norvegicus
ttagctatcctgactttgctcctta

SEQ ID NO: 660728 - DNA, 25 bp, Rattus norvegicus
ttagctatcctgtctttgctcctta

SEQ ID NO: 660729 - DNA, 25 bp, Rattus norvegicus
ttagctatgttacgctgtgctgcat

SEQ ID NO: 660730 - DNA, 25 bp, Rattus norvegicus
ttagctatgttaggctgtgctgcat

SEQ ID NO: 660731 - DNA, 25 bp, Rattus norvegicus
ttagctattccgctctgcagcgttg

SEQ ID NO: 660732 - DNA, 25 bp, Rattus norvegicus
ttagctattccggtctgcagcgttg

SEQ ID NO: 660733 - DNA, 25 bp, Rattus norvegicus
ttagctcaaatcactagggcacttt

SEQ ID NO: 660734 - DNA, 25 bp, Rattus norvegicus
ttagctcaaatctctagggcacttt

SEQ ID NO: 660735 - DNA, 25 bp, Rattus norvegicus
ttagctcaacctaccaaacactggg

SEQ ID NO: 660736 - DNA, 25 bp, Rattus norvegicus
ttagctcaaccttccaaacactggg

SEQ ID NO: 660737 - DNA, 25 bp, Rattus norvegicus
ttagctcactgaaacactgtctctg

SEQ ID NO: 660738 - DNA, 25 bp, Rattus norvegicus
ttagctcactgaatgctgagtgggt

SEQ ID NO: 660739 - DNA, 25 bp, Rattus norvegicus
ttagctcactgatacactgtctctg

SEQ ID NO: 660740 - DNA, 25 bp, Rattus norvegicus
ttagctcactgattgctgagtgggt

SEQ ID NO: 660741 - DNA, 25 bp, Rattus norvegicus
ttagctcactgtacatcctttttac

SEQ ID NO: 660742 - DNA, 25 bp, Rattus norvegicus
ttagctcactgttcatcctttttac

SEQ ID NO: 660743 - DNA, 25 bp, Rattus norvegicus
ttagctcagaggcagacttccagaa

SEQ ID NO: 660744 - DNA, 25 bp, Rattus norvegicus
ttagctcagagggagacttccagaa

SEQ ID NO: 660745 - DNA, 25 bp, Rattus norvegicus
ttagctcagcggcttgcctagcgag

SEQ ID NO: 660746 - DNA, 25 bp, Rattus norvegicus
ttagctcagcgggttgcctagcgag

SEQ ID NO: 660747 - DNA, 25 bp, Rattus norvegicus
ttagctcaggagattcgatgttttg

SEQ ID NO: 660748 - DNA, 25 bp, Rattus norvegicus
ttagctcaggagtttcgatgttttg

SEQ ID NO: 660749 - DNA, 25 bp, Rattus norvegicus
ttagctcataaaccacctgtgactc

SEQ ID NO: 660750 - DNA, 25 bp, Rattus norvegicus
ttagctcataaagcacctgtgactc

SEQ ID NO: 660751 - DNA, 25 bp, Rattus norvegicus
ttagctcatctgctactgccaagat

SEQ ID NO: 660752 - DNA, 25 bp, Rattus norvegicus
ttagctcatctggtactgccaagat

SEQ ID NO: 660753 - DNA, 25 bp, Rattus norvegicus
ttagctccagagcattggacaccct

SEQ ID NO: 660754 - DNA, 25 bp, Rattus norvegicus
ttagctccagaggattggacaccct

SEQ ID NO: 660755 - DNA, 25 bp, Rattus norvegicus
ttagctccatgtatggctacctcag

SEQ ID NO: 660756 - DNA, 25 bp, Rattus norvegicus
ttagctccatgtttggctacctcag

SEQ ID NO: 660757 - DNA, 25 bp, Rattus norvegicus
ttagctcccaacatgaaacaactga

SEQ ID NO: 660758 - DNA, 25 bp, Rattus norvegicus
ttagctcccaacttgaaacaactga

SEQ ID NO: 660759 - DNA, 25 bp, Rattus norvegicus
ttagctcctgagagctgtgtctgca

SEQ ID NO: 660760 - DNA, 25 bp, Rattus norvegicus
ttagctcctgagtgctgtgtctgca

SEQ ID NO: 660761 - DNA, 25 bp, Rattus norvegicus
ttagctcgatgcatgatgtctgtgt

SEQ ID NO: 660762 - DNA, 25 bp, Rattus norvegicus
ttagctcgatgcttgatgtctgtgt

SEQ ID NO: 660763 - DNA, 25 bp, Rattus norvegicus
ttagctcgatttatggaccaacaga

SEQ ID NO: 660764 - DNA, 25 bp, Rattus norvegicus
ttagctcgatttttggaccaacaga

SEQ ID NO: 660765 - DNA, 25 bp, Rattus norvegicus
ttagctcgcgtgagttactttcaag

SEQ ID NO: 660766 - DNA, 25 bp, Rattus norvegicus
ttagctcgcgtgtgttactttcaag

SEQ ID NO: 660767 - DNA, 25 bp, Rattus norvegicus
ttagctcggctgcatcgggcatctg

SEQ ID NO: 660768 - DNA, 25 bp, Rattus norvegicus
ttagctcggctggatcgggcatctg

SEQ ID NO: 660769 - DNA, 25 bp, Rattus norvegicus
ttagctctagtgaagcggctccctt

SEQ ID NO: 660770 - DNA, 25 bp, Rattus norvegicus
ttagctctagtgtagcggctccctt

SEQ ID NO: 660771 - DNA, 25 bp, Rattus norvegicus
ttagctctcaacatctgaaacctca

SEQ ID NO: 660772 - DNA, 25 bp, Rattus norvegicus
ttagctctcaacttctgaaacctca

SEQ ID NO: 660773 - DNA, 25 bp, Rattus norvegicus
ttagctctcatgatttgcctgttac

SEQ ID NO: 660774 - DNA, 25 bp, Rattus norvegicus
ttagctctcatgttttgcctgttac

SEQ ID NO: 660775 - DNA, 25 bp, Rattus norvegicus
ttagctctctgcacatccacttcag

SEQ ID NO: 660776 - DNA, 25 bp, Rattus norvegicus
ttagctctctgctcatccacttcag

SEQ ID NO: 660777 - DNA, 25 bp, Rattus norvegicus
ttagctctgaggagacacgaccctg

SEQ ID NO: 660778 - DNA, 25 bp, Rattus norvegicus
ttagctctgaggtgacacgaccctg

SEQ ID NO: 660779 - DNA, 25 bp, Rattus norvegicus
ttagctctgatgctaaccccagggc

SEQ ID NO: 660780 - DNA, 25 bp, Rattus norvegicus
ttagctctgatggtaaccccagggc

SEQ ID NO: 660781 - DNA, 25 bp, Rattus norvegicus
ttagctctgcacatggatctgccat

SEQ ID NO: 660782 - DNA, 25 bp, Rattus norvegicus
ttagctctgcacttggatctgccat

SEQ ID NO: 660783 - DNA, 25 bp, Rattus norvegicus
ttagctctgctgattgtgggacaca

SEQ ID NO: 660784 - DNA, 25 bp, Rattus norvegicus
ttagctctgctgtttgtgggacaca

SEQ ID NO: 660785 - DNA, 25 bp, Rattus norvegicus
ttagctctgtgaatcctctgactct

SEQ ID NO: 660786 - DNA, 25 bp, Rattus norvegicus
ttagctctgtgattcctctgactct

SEQ ID NO: 660787 - DNA, 25 bp, Rattus norvegicus
ttagctcttgctagtacctgaaaga

SEQ ID NO: 660788 - DNA, 25 bp, Rattus norvegicus
ttagctcttgcttgtacctgaaaga

SEQ ID NO: 660789 - DNA, 25 bp, Rattus norvegicus
ttagctcttggtacattcgtttttc

SEQ ID NO: 660790 - DNA, 25 bp, Rattus norvegicus
ttagctcttggttcattcgtttttc

SEQ ID NO: 660791 - DNA, 25 bp, Rattus norvegicus
ttagctcttgttctataggccaggc

SEQ ID NO: 660792 - DNA, 25 bp, Rattus norvegicus
ttagctcttgttgtataggccaggc

SEQ ID NO: 660793 - DNA, 25 bp, Rattus norvegicus
ttagctgaagacatcctccgaaaga

SEQ ID NO: 660794 - DNA, 25 bp, Rattus norvegicus
ttagctgaagacttcctccgaaaga

SEQ ID NO: 660795 - DNA, 25 bp, Rattus norvegicus
ttagctgaagtaactcggatggcca

SEQ ID NO: 660796 - DNA, 25 bp, Rattus norvegicus
ttagctgaagtatctcggatggcca

SEQ ID NO: 660797 - DNA, 25 bp, Rattus norvegicus
ttagctgacttccagacacaggagt

SEQ ID NO: 660798 - DNA, 25 bp, Rattus norvegicus
ttagctgacttcgagacacaggagt

SEQ ID NO: 660799 - DNA, 25 bp, Rattus norvegicus
ttagctgactttccgattttatgca

SEQ ID NO: 660800 - DNA, 25 bp, Rattus norvegicus
ttagctgactttgcgattttatgca

SEQ ID NO: 660801 - DNA, 25 bp, Rattus norvegicus
ttagctgatttgatgactgtctgac

SEQ ID NO: 660802 - DNA, 25 bp, Rattus norvegicus
ttagctgatttgttgactgtctgac

SEQ ID NO: 660803 - DNA, 25 bp, Rattus norvegicus
ttagctgcattcatcctgtcaggtc

SEQ ID NO: 660804 - DNA, 25 bp, Rattus norvegicus
ttagctgcattcttcctgtcaggtc

SEQ ID NO: 660805 - DNA, 25 bp, Rattus norvegicus
ttagctgccaccaatgactttgcca

SEQ ID NO: 660806 - DNA, 25 bp, Rattus norvegicus
ttagctgccacctatgactttgcca

SEQ ID NO: 660807 - DNA, 25 bp, Rattus norvegicus
ttagctgcctatccctgttgctcaa

SEQ ID NO: 660808 - DNA, 25 bp, Rattus norvegicus
ttagctgcctatgcctgttgctcaa

SEQ ID NO: 660809 - DNA, 25 bp, Rattus norvegicus
ttagctgcttacctatgtctcctgt

SEQ ID NO: 660810 - DNA, 25 bp, Rattus norvegicus
ttagctgcttacgtatgtctcctgt

SEQ ID NO: 660811 - DNA, 25 bp, Rattus norvegicus
ttagctgcttgtaatgttaccatgt

SEQ ID NO: 660812 - DNA, 25 bp, Rattus norvegicus
ttagctgcttgttatgttaccatgt

SEQ ID NO: 660813 - DNA, 25 bp, Rattus norvegicus
ttagctgcttttacagaagaccctg

SEQ ID NO: 660814 - DNA, 25 bp, Rattus norvegicus
ttagctgctttttcagaagaccctg

SEQ ID NO: 660815 - DNA, 25 bp, Rattus norvegicus
ttagctggccagaacctttgaataa

SEQ ID NO: 660816 - DNA, 25 bp, Rattus norvegicus
ttagctggccagtacctttgaataa

SEQ ID NO: 660817 - DNA, 25 bp, Rattus norvegicus
ttagctggctctagggtttaggtta

SEQ ID NO: 660818 - DNA, 25 bp, Rattus norvegicus
ttagctggctcttgggtttaggtta

SEQ ID NO: 660819 - DNA, 25 bp, Rattus norvegicus
ttagctggtaaacgcacctgatact

SEQ ID NO: 660820 - DNA, 25 bp, Rattus norvegicus
ttagctggtaaaggcacctgatact

SEQ ID NO: 660821 - DNA, 25 bp, Rattus norvegicus
ttagctgtattcagtgtgcctctgc

SEQ ID NO: 660822 - DNA, 25 bp, Rattus norvegicus
ttagctgtattctgtgtgcctctgc

SEQ ID NO: 660823 - DNA, 25 bp, Rattus norvegicus
ttagctgtcataattctctgtcctc

SEQ ID NO: 660824 - DNA, 25 bp, Rattus norvegicus
ttagctgtcatatttctctgtcctc

SEQ ID NO: 660825 - DNA, 25 bp, Rattus norvegicus
ttagctgtccagaactccttttgtt

SEQ ID NO: 660826 - DNA, 25 bp, Rattus norvegicus
ttagctgtccagtactccttttgtt

SEQ ID NO: 660827 - DNA, 25 bp, Rattus norvegicus
ttagctgtcctcacacggcaataca

SEQ ID NO: 660828 - DNA, 25 bp, Rattus norvegicus
ttagctgtcctctcacggcaataca

SEQ ID NO: 660829 - DNA, 25 bp, Rattus norvegicus
ttagctgtgcccaagtgactgacca

SEQ ID NO: 660830 - DNA, 25 bp, Rattus norvegicus
ttagctgtgccctagtgactgacca

SEQ ID NO: 660831 - DNA, 25 bp, Rattus norvegicus
ttagctgtgctgacaactttggaaa

SEQ ID NO: 660832 - DNA, 25 bp, Rattus norvegicus
ttagctgtgctgtcaactttggaaa

SEQ ID NO: 660833 - DNA, 25 bp, Rattus norvegicus
ttagctgtgcttaccgttatgttta

SEQ ID NO: 660834 - DNA, 25 bp, Rattus norvegicus
ttagctgtgctttccgttatgttta

SEQ ID NO: 660835 - DNA, 25 bp, Rattus norvegicus
ttagctgtgtgcagtagccgtgtag

SEQ ID NO: 660836 - DNA, 25 bp, Rattus norvegicus
ttagctgtgtgctgtagccgtgtag

SEQ ID NO: 660837 - DNA, 25 bp, Rattus norvegicus
ttagctgttaagctggcgtgttgca

SEQ ID NO: 660838 - DNA, 25 bp, Rattus norvegicus
ttagctgttaaggtggcgtgttgca

SEQ ID NO: 660839 - DNA, 25 bp, Rattus norvegicus
ttagctgttcctagataattctgag

SEQ ID NO: 660840 - DNA, 25 bp, Rattus norvegicus
ttagctgttccttgataattctgag

SEQ ID NO: 660841 - DNA, 25 bp, Rattus norvegicus
ttagctgttgtgagctgtcttcagt

SEQ ID NO: 660842 - DNA, 25 bp, Rattus norvegicus
ttagctgttgtgtgctgtcttcagt

SEQ ID NO: 660843 - DNA, 25 bp, Rattus norvegicus
ttagcttacacccatgtctgaatag

SEQ ID NO: 660844 - DNA, 25 bp, Rattus norvegicus
ttagcttacaccgatgtctgaatag

SEQ ID NO: 660845 - DNA, 25 bp, Rattus norvegicus
ttagcttagtggactgtggtggtct

SEQ ID NO: 660846 - DNA, 25 bp, Rattus norvegicus
ttagcttagtggtctgtggtggtct

SEQ ID NO: 660847 - DNA, 25 bp, Rattus norvegicus
ttagcttcactcattccctggtggc

SEQ ID NO: 660848 - DNA, 25 bp, Rattus norvegicus
ttagcttcactctttccctggtggc

SEQ ID NO: 660849 - DNA, 25 bp, Rattus norvegicus
ttagcttcagtcatccagccattag

SEQ ID NO: 660850 - DNA, 25 bp, Rattus norvegicus
ttagcttcagtcttccagccattag

SEQ ID NO: 660851 - DNA, 25 bp, Rattus norvegicus
ttagcttccaaaacaactctatggt

SEQ ID NO: 660852 - DNA, 25 bp, Rattus norvegicus
ttagcttccaaatcaactctatggt

SEQ ID NO: 660853 - DNA, 25 bp, Rattus norvegicus
ttagcttccaacatccagtaactgc

SEQ ID NO: 660854 - DNA, 25 bp, Rattus norvegicus
ttagcttccaacttccagtaactgc

SEQ ID NO: 660855 - DNA, 25 bp, Rattus norvegicus
ttagcttcccgcagctgggagaatc

SEQ ID NO: 660856 - DNA, 25 bp, Rattus norvegicus
ttagcttcccgctgctgggagaatc

SEQ ID NO: 660857 - DNA, 25 bp, Rattus norvegicus
ttagcttcctgcacactcattttga

SEQ ID NO: 660858 - DNA, 25 bp, Rattus norvegicus
ttagcttcctgctcactcattttga

SEQ ID NO: 660859 - DNA, 25 bp, Rattus norvegicus
ttagcttcctttcagttggccagaa

SEQ ID NO: 660860 - DNA, 25 bp, Rattus norvegicus
ttagcttcctttgagttggccagaa

SEQ ID NO: 660861 - DNA, 25 bp, Rattus norvegicus
ttagcttcggctcccggcttgggtg

SEQ ID NO: 660862 - DNA, 25 bp, Rattus norvegicus
ttagcttcggctgccggcttgggtg

SEQ ID NO: 660863 - DNA, 25 bp, Rattus norvegicus
ttagcttctctcacgttttagcttt

SEQ ID NO: 660864 - DNA, 25 bp, Rattus norvegicus
ttagcttctctctcgttttagcttt

SEQ ID NO: 660865 - DNA, 25 bp, Rattus norvegicus
ttagcttctgccaataactctggat

SEQ ID NO: 660866 - DNA, 25 bp, Rattus norvegicus
ttagcttctgccacaggacagtagg

SEQ ID NO: 660867 - DNA, 25 bp, Rattus norvegicus
ttagcttctgcctataactctggat

SEQ ID NO: 660868 - DNA, 25 bp, Rattus norvegicus
ttagcttctgcctcaggacagtagg

SEQ ID NO: 660869 - DNA, 25 bp, Rattus norvegicus
ttagcttctgtacctgcttgtcaca

SEQ ID NO: 660870 - DNA, 25 bp, Rattus norvegicus
ttagcttctgtagctgcttgtcaca

SEQ ID NO: 660871 - DNA, 25 bp, Rattus norvegicus
ttagcttcttaacagtctcctcttt

SEQ ID NO: 660872 - DNA, 25 bp, Rattus norvegicus
ttagcttcttaagagtctcctcttt

SEQ ID NO: 660873 - DNA, 25 bp, Rattus norvegicus
ttagcttgcctaagtttacctcaac

SEQ ID NO: 660874 - DNA, 25 bp, Rattus norvegicus
ttagcttgcctatgtttacctcaac

SEQ ID NO: 660875 - DNA, 25 bp, Rattus norvegicus
ttagcttgctcaccacagtgcaggc

SEQ ID NO: 660876 - DNA, 25 bp, Rattus norvegicus
ttagcttgctcagcacagtgcaggc

SEQ ID NO: 660877 - DNA, 25 bp, Rattus norvegicus
ttagcttggcctcatgacagtcata

SEQ ID NO: 660878 - DNA, 25 bp, Rattus norvegicus
ttagcttggcctgatgacagtcata

SEQ ID NO: 660879 - DNA, 25 bp, Rattus norvegicus
ttagcttgtcttaatgtatccatga

SEQ ID NO: 660880 - DNA, 25 bp, Rattus norvegicus
ttagcttgtctttatgtatccatga

SEQ ID NO: 660881 - DNA, 25 bp, Rattus norvegicus
ttagctttacttacagtgagagacc

SEQ ID NO: 660882 - DNA, 25 bp, Rattus norvegicus
ttagctttactttcagtgagagacc

SEQ ID NO: 660883 - DNA, 25 bp, Rattus norvegicus
ttagctttagccatattcggcactg

SEQ ID NO: 660884 - DNA, 25 bp, Rattus norvegicus
ttagctttagccttattcggcactg

SEQ ID NO: 660885 - DNA, 25 bp, Rattus norvegicus
ttagctttcatacctctagactcgt

SEQ ID NO: 660886 - DNA, 25 bp, Rattus norvegicus
ttagctttcatagctctagactcgt

SEQ ID NO: 660887 - DNA, 25 bp, Rattus norvegicus
ttagctttcttgctacggttgtcat

SEQ ID NO: 660888 - DNA, 25 bp, Rattus norvegicus
ttagctttcttggtacggttgtcat

SEQ ID NO: 660889 - DNA, 25 bp, Rattus norvegicus
ttagctttgagcacggcatggcggc

SEQ ID NO: 660890 - DNA, 25 bp, Rattus norvegicus
ttagctttgagctcggcatggcggc

SEQ ID NO: 660891 - DNA, 25 bp, Rattus norvegicus
ttagctttgataacttgacccatgg

SEQ ID NO: 660892 - DNA, 25 bp, Rattus norvegicus
ttagctttgatatcttgacccatgg

SEQ ID NO: 660893 - DNA, 25 bp, Rattus norvegicus
ttagctttgcccagagcacagtcgt

SEQ ID NO: 660894 - DNA, 25 bp, Rattus norvegicus
ttagctttgccctgagcacagtcgt

SEQ ID NO: 660895 - DNA, 25 bp, Rattus norvegicus
ttagctttggccaatgcagtctcca

SEQ ID NO: 660896 - DNA, 25 bp, Rattus norvegicus
ttagctttggcctatgcagtctcca

SEQ ID NO: 660897 - DNA, 25 bp, Rattus norvegicus
ttagctttgttcacggtcttcgaag

SEQ ID NO: 660898 - DNA, 25 bp, Rattus norvegicus
ttagctttgttctcggtcttcgaag

SEQ ID NO: 660899 - DNA, 25 bp, Rattus norvegicus
ttagcttttttccaactgccctttg

SEQ ID NO: 660900 - DNA, 25 bp, Rattus norvegicus
ttagcttttttcgaactgccctttg

SEQ ID NO: 660901 - DNA, 25 bp, Rattus norvegicus
ttaggaaaagccagcctcgcacttg

SEQ ID NO: 660902 - DNA, 25 bp, Rattus norvegicus
ttaggaaaagcctgcctcgcacttg

SEQ ID NO: 660903 - DNA, 25 bp, Rattus norvegicus
ttaggaaacgccaacaccatacctg

SEQ ID NO: 660904 - DNA, 25 bp, Rattus norvegicus
ttaggaaacgcctacaccatacctg

SEQ ID NO: 660905 - DNA, 25 bp, Rattus norvegicus
ttaggaaactcccagactcttccac

SEQ ID NO: 660906 - DNA, 25 bp, Rattus norvegicus
ttaggaaactccgagactcttccac

SEQ ID NO: 660907 - DNA, 25 bp, Rattus norvegicus
ttaggaaccagcatgcagcatttag

SEQ ID NO: 660908 - DNA, 25 bp, Rattus norvegicus
ttaggaaccagcttgcagcatttag

SEQ ID NO: 660909 - DNA, 25 bp, Rattus norvegicus
ttaggaaccggccagtcttcctggg

SEQ ID NO: 660910 - DNA, 25 bp, Rattus norvegicus
ttaggaaccggcgagtcttcctggg

SEQ ID NO: 660911 - DNA, 25 bp, Rattus norvegicus
ttaggaactggtaggacacctcacc

SEQ ID NO: 660912 - DNA, 25 bp, Rattus norvegicus
ttaggaactggttggacacctcacc

SEQ ID NO: 660913 - DNA, 25 bp, Rattus norvegicus
ttaggaacttaaacgtctctctgtc

SEQ ID NO: 660914 - DNA, 25 bp, Rattus norvegicus
ttaggaacttaatcgtctctctgtc

SEQ ID NO: 660915 - DNA, 25 bp, Rattus norvegicus
ttaggaaggcagaccctgagctgag

SEQ ID NO: 660916 - DNA, 25 bp, Rattus norvegicus
ttaggaaggcagtccctgagctgag

SEQ ID NO: 660917 - DNA, 25 bp, Rattus norvegicus
ttaggaaggcatcctatcctgtccc

SEQ ID NO: 660918 - DNA, 25 bp, Rattus norvegicus
ttaggaaggcatgctatcctgtccc

SEQ ID NO: 660919 - DNA, 25 bp, Rattus norvegicus
ttaggaagtcgtatctcgtgtgtaa

SEQ ID NO: 660920 - DNA, 25 bp, Rattus norvegicus
ttaggaagtcgtttctcgtgtgtaa

SEQ ID NO: 660921 - DNA, 25 bp, Rattus norvegicus
ttaggaagtgccaagagcccaggcc

SEQ ID NO: 660922 - DNA, 25 bp, Rattus norvegicus
ttaggaagtgcctagagcccaggcc

SEQ ID NO: 660923 - DNA, 25 bp, Rattus norvegicus
ttaggaagtgctcccgctcttgacc

SEQ ID NO: 660924 - DNA, 25 bp, Rattus norvegicus
ttaggaagtgctgccgctcttgacc

SEQ ID NO: 660925 - DNA, 25 bp, Rattus norvegicus
ttaggaagttagacctcagagaact

SEQ ID NO: 660926 - DNA, 25 bp, Rattus norvegicus
ttaggaagttagtcctcagagaact

SEQ ID NO: 660927 - DNA, 25 bp, Rattus norvegicus
ttaggaagttgtcgcccatgagcac

SEQ ID NO: 660928 - DNA, 25 bp, Rattus norvegicus
ttaggaagttgtggcccatgagcac

SEQ ID NO: 660929 - DNA, 25 bp, Rattus norvegicus
ttaggaatcattacatccatgtctt

SEQ ID NO: 660930 - DNA, 25 bp, Rattus norvegicus
ttaggaatcatttcatccatgtctt

SEQ ID NO: 660931 - DNA, 25 bp, Rattus norvegicus
ttaggaatccaaagcacctcctcag

SEQ ID NO: 660932 - DNA, 25 bp, Rattus norvegicus
ttaggaatccaatgcacctcctcag

SEQ ID NO: 660933 - DNA, 25 bp, Rattus norvegicus
ttaggaatccaccaaagaccatcat

SEQ ID NO: 660934 - DNA, 25 bp, Rattus norvegicus
ttaggaatccacgaaagaccatcat

SEQ ID NO: 660935 - DNA, 25 bp, Rattus norvegicus
ttaggaatgacaccagtagcagtaa

SEQ ID NO: 660936 - DNA, 25 bp, Rattus norvegicus
ttaggaatgacagcagtagcagtaa

SEQ ID NO: 660937 - DNA, 25 bp, Rattus norvegicus
ttaggaatgcctctgtgccatgcct

SEQ ID NO: 660938 - DNA, 25 bp, Rattus norvegicus
ttaggaatgcctgtgtgccatgcct

SEQ ID NO: 660939 - DNA, 25 bp, Rattus norvegicus
ttaggaatgcttcgcctctggcagg

SEQ ID NO: 660940 - DNA, 25 bp, Rattus norvegicus
ttaggaatgcttggcctctggcagg

SEQ ID NO: 660941 - DNA, 25 bp, Rattus norvegicus
ttaggaatttagacccctctctttg

SEQ ID NO: 660942 - DNA, 25 bp, Rattus norvegicus
ttaggaatttagtcccctctctttg

SEQ ID NO: 660943 - DNA, 25 bp, Rattus norvegicus
ttaggacactttatgctgcaagatt

SEQ ID NO: 660944 - DNA, 25 bp, Rattus norvegicus
ttaggacactttttgctgcaagatt

SEQ ID NO: 660945 - DNA, 25 bp, Rattus norvegicus
ttaggacagtggctctttgcgtatc

SEQ ID NO: 660946 - DNA, 25 bp, Rattus norvegicus
ttaggacagtgggtctttgcgtatc

SEQ ID NO: 660947 - DNA, 25 bp, Rattus norvegicus
ttaggacatcttcctacatctgtgt

SEQ ID NO: 660948 - DNA, 25 bp, Rattus norvegicus
ttaggacatcttgctacatctgtgt

SEQ ID NO: 660949 - DNA, 25 bp, Rattus norvegicus
ttaggaccaaacctgtcaccgtatt

SEQ ID NO: 660950 - DNA, 25 bp, Rattus norvegicus
ttaggaccaaacgtgtcaccgtatt

SEQ ID NO: 660951 - DNA, 25 bp, Rattus norvegicus
ttaggaccagctatttattgtaata

SEQ ID NO: 660952 - DNA, 25 bp, Rattus norvegicus
ttaggaccagctttttattgtaata

SEQ ID NO: 660953 - DNA, 25 bp, Rattus norvegicus
ttaggaccaggaacatcagctctct

SEQ ID NO: 660954 - DNA, 25 bp, Rattus norvegicus
ttaggaccaggatcatcagctctct

SEQ ID NO: 660955 - DNA, 25 bp, Rattus norvegicus
ttaggaccagttctagtgaattgct

SEQ ID NO: 660956 - DNA, 25 bp, Rattus norvegicus
ttaggaccagttgtagtgaattgct

SEQ ID NO: 660957 - DNA, 25 bp, Rattus norvegicus
ttaggaccatggaactgcatgagtt

SEQ ID NO: 660958 - DNA, 25 bp, Rattus norvegicus
ttaggaccatggtactgcatgagtt

SEQ ID NO: 660959 - DNA, 25 bp, Rattus norvegicus
ttaggaccattgcaggtgacgcagt

SEQ ID NO: 660960 - DNA, 25 bp, Rattus norvegicus
ttaggaccattggaggtgacgcagt

SEQ ID NO: 660961 - DNA, 25 bp, Rattus norvegicus
ttaggacccctaatcattcatttat

SEQ ID NO: 660962 - DNA, 25 bp, Rattus norvegicus
ttaggacccctattcattcatttat

SEQ ID NO: 660963 - DNA, 25 bp, Rattus norvegicus
ttaggaccctgtcccgactgcagtg

SEQ ID NO: 660964 - DNA, 25 bp, Rattus norvegicus
ttaggaccctgtgccgactgcagtg

SEQ ID NO: 660965 - DNA, 25 bp, Rattus norvegicus
ttaggaccgtggcactctgatggct

SEQ ID NO: 660966 - DNA, 25 bp, Rattus norvegicus
ttaggaccgtgggactctgatggct

SEQ ID NO: 660967 - DNA, 25 bp, Rattus norvegicus
ttaggacctccaaagacgtttccac

SEQ ID NO: 660968 - DNA, 25 bp, Rattus norvegicus
ttaggacctccatagacgtttccac

SEQ ID NO: 660969 - DNA, 25 bp, Rattus norvegicus
ttaggaccttgcagctgctattgca

SEQ ID NO: 660970 - DNA, 25 bp, Rattus norvegicus
ttaggaccttgctgctgctattgca

SEQ ID NO: 660971 - DNA, 25 bp, Rattus norvegicus
ttaggactcagcaacgttcacattt

SEQ ID NO: 660972 - DNA, 25 bp, Rattus norvegicus
ttaggactcagcatgggatggaccc

SEQ ID NO: 660973 - DNA, 25 bp, Rattus norvegicus
ttaggactcagctacgttcacattt

SEQ ID NO: 660974 - DNA, 25 bp, Rattus norvegicus
ttaggactcagcttgggatggaccc

SEQ ID NO: 660975 - DNA, 25 bp, Rattus norvegicus
ttaggactcatcattcccggcagaa

SEQ ID NO: 660976 - DNA, 25 bp, Rattus norvegicus
ttaggactcatctttcccggcagaa

SEQ ID NO: 660977 - DNA, 25 bp, Rattus norvegicus
ttaggactgcagatgatcgcccact

SEQ ID NO: 660978 - DNA, 25 bp, Rattus norvegicus
ttaggactgcagttgatcgcccact

SEQ ID NO: 660979 - DNA, 25 bp, Rattus norvegicus
ttaggacttccaaccaaccaaacat

SEQ ID NO: 660980 - DNA, 25 bp, Rattus norvegicus
ttaggacttccatccaaccaaacat

SEQ ID NO: 660981 - DNA, 25 bp, Rattus norvegicus
ttaggacttttgagttccagccctg

SEQ ID NO: 660982 - DNA, 25 bp, Rattus norvegicus
ttaggacttttgtgttccagccctg

SEQ ID NO: 660983 - DNA, 25 bp, Rattus norvegicus
ttaggagaagcccatccagttccag

SEQ ID NO: 660984 - DNA, 25 bp, Rattus norvegicus
ttaggagaagccgatccagttccag

SEQ ID NO: 660985 - DNA, 25 bp, Rattus norvegicus
ttaggagagatgacctcaggcctgt

SEQ ID NO: 660986 - DNA, 25 bp, Rattus norvegicus
ttaggagagatgtcctcaggcctgt

SEQ ID NO: 660987 - DNA, 25 bp, Rattus norvegicus
ttaggagcatccactgctgggtctt

SEQ ID NO: 660988 - DNA, 25 bp, Rattus norvegicus
ttaggagcatcctctgctgggtctt

SEQ ID NO: 660989 - DNA, 25 bp, Rattus norvegicus
ttaggagccatgctctctgctctca

SEQ ID NO: 660990 - DNA, 25 bp, Rattus norvegicus
ttaggagccatggtctctgctctca

SEQ ID NO: 660991 - DNA, 25 bp, Rattus norvegicus
ttaggagcctttccattcagtttcc

SEQ ID NO: 660992 - DNA, 25 bp, Rattus norvegicus
ttaggagcctttcccttgtagcaga

SEQ ID NO: 660993 - DNA, 25 bp, Rattus norvegicus
ttaggagcctttgcattcagtttcc

SEQ ID NO: 660994 - DNA, 25 bp, Rattus norvegicus
ttaggagcctttgccttgtagcaga

SEQ ID NO: 660995 - DNA, 25 bp, Rattus norvegicus
ttaggagctccgaacttacaagtgc

SEQ ID NO: 660996 - DNA, 25 bp, Rattus norvegicus
ttaggagctccgtacttacaagtgc

SEQ ID NO: 660997 - DNA, 25 bp, Rattus norvegicus
ttaggagctgttactaaaccaaatc

SEQ ID NO: 660998 - DNA, 25 bp, Rattus norvegicus
ttaggagctgtttctaaaccaaatc

SEQ ID NO: 660999 - DNA, 25 bp, Rattus norvegicus
ttaggaggactcactgatccctgag

SEQ ID NO: 661000 - DNA, 25 bp, Rattus norvegicus
ttaggaggactctctgatccctgag

SEQ ID NO: 661001 - DNA, 25 bp, Rattus norvegicus
ttaggagggactcttcttcccactc

SEQ ID NO: 661002 - DNA, 25 bp, Rattus norvegicus
ttaggagggactgttcttcccactc

SEQ ID NO: 661003 - DNA, 25 bp, Rattus norvegicus
ttaggagtcagcactcttgggttca

SEQ ID NO: 661004 - DNA, 25 bp, Rattus norvegicus
ttaggagtcagctctcttgggttca

SEQ ID NO: 661005 - DNA, 25 bp, Rattus norvegicus
ttaggagtcccactgctgtttcttg

SEQ ID NO: 661006 - DNA, 25 bp, Rattus norvegicus
ttaggagtcccagtgctgtttcttg

SEQ ID NO: 661007 - DNA, 25 bp, Rattus norvegicus
ttaggataagccatcccactttctt

SEQ ID NO: 661008 - DNA, 25 bp, Rattus norvegicus
ttaggataagccttcccactttctt

SEQ ID NO: 661009 - DNA, 25 bp, Rattus norvegicus
ttaggatataggagcgggtgacagc

SEQ ID NO: 661010 - DNA, 25 bp, Rattus norvegicus
ttaggatataggtgcgggtgacagc

SEQ ID NO: 661011 - DNA, 25 bp, Rattus norvegicus
ttaggatccagtcagaaagctcttg

SEQ ID NO: 661012 - DNA, 25 bp, Rattus norvegicus
ttaggatccagtgagaaagctcttg

SEQ ID NO: 661013 - DNA, 25 bp, Rattus norvegicus
ttaggatctaagactttgccgcctt

SEQ ID NO: 661014 - DNA, 25 bp, Rattus norvegicus
ttaggatctaagtctttgccgcctt

SEQ ID NO: 661015 - DNA, 25 bp, Rattus norvegicus
ttaggatgcaaaacgccaacttaat

SEQ ID NO: 661016 - DNA, 25 bp, Rattus norvegicus
ttaggatgcaaatcgccaacttaat

SEQ ID NO: 661017 - DNA, 25 bp, Rattus norvegicus
ttaggatggcatccgttgagcccct

SEQ ID NO: 661018 - DNA, 25 bp, Rattus norvegicus
ttaggatggcatgcgttgagcccct

SEQ ID NO: 661019 - DNA, 25 bp, Rattus norvegicus
ttaggatggcgcagtgtacgtaatt

SEQ ID NO: 661020 - DNA, 25 bp, Rattus norvegicus
ttaggatggcgctgtgtacgtaatt

SEQ ID NO: 661021 - DNA, 25 bp, Rattus norvegicus
ttaggattcgatctccagcacagca

SEQ ID NO: 661022 - DNA, 25 bp, Rattus norvegicus
ttaggattcgatgtccagcacagca

SEQ ID NO: 661023 - DNA, 25 bp, Rattus norvegicus
ttaggatttcacatctgaccgcatc

SEQ ID NO: 661024 - DNA, 25 bp, Rattus norvegicus
ttaggatttcacttctgaccgcatc

SEQ ID NO: 661025 - DNA, 25 bp, Rattus norvegicus
ttaggcaaaaccctgatcgtcacca

SEQ ID NO: 661026 - DNA, 25 bp, Rattus norvegicus
ttaggcaaaaccgtgatcgtcacca

SEQ ID NO: 661027 - DNA, 25 bp, Rattus norvegicus
ttaggcaaattcagtttttccaaag

SEQ ID NO: 661028 - DNA, 25 bp, Rattus norvegicus
ttaggcaaattctgtttttccaaag

SEQ ID NO: 661029 - DNA, 25 bp, Rattus norvegicus
ttaggcaacaaacggtctctccagc

SEQ ID NO: 661030 - DNA, 25 bp, Rattus norvegicus
ttaggcaacaaagggtctctccagc

SEQ ID NO: 661031 - DNA, 25 bp, Rattus norvegicus
ttaggcaacctaacatcctggtctc

SEQ ID NO: 661032 - DNA, 25 bp, Rattus norvegicus
ttaggcaacctatcatcctggtctc

SEQ ID NO: 661033 - DNA, 25 bp, Rattus norvegicus
ttaggcacctcccttaacattacaa

SEQ ID NO: 661034 - DNA, 25 bp, Rattus norvegicus
ttaggcacctccgttaacattacaa

SEQ ID NO: 661035 - DNA, 25 bp, Rattus norvegicus
ttaggcacctttcttggcacatgag

SEQ ID NO: 661036 - DNA, 25 bp, Rattus norvegicus
ttaggcacctttgttggcacatgag

SEQ ID NO: 661037 - DNA, 25 bp, Rattus norvegicus
ttaggcactcatctatttggtcccc

SEQ ID NO: 661038 - DNA, 25 bp, Rattus norvegicus
ttaggcactcatgtatttggtcccc

SEQ ID NO: 661039 - DNA, 25 bp, Rattus norvegicus
ttaggcactcggctgggaatctcca

SEQ ID NO: 661040 - DNA, 25 bp, Rattus norvegicus
ttaggcactcgggtgggaatctcca

SEQ ID NO: 661041 - DNA, 25 bp, Rattus norvegicus
ttaggcactgttatcttccactcaa

SEQ ID NO: 661042 - DNA, 25 bp, Rattus norvegicus
ttaggcactgttttcttccactcaa

SEQ ID NO: 661043 - DNA, 25 bp, Rattus norvegicus
ttaggcagagttaccatcttccctg

SEQ ID NO: 661044 - DNA, 25 bp, Rattus norvegicus
ttaggcagagtttccatcttccctg

SEQ ID NO: 661045 - DNA, 25 bp, Rattus norvegicus
ttaggcagcagacgctataccagca

SEQ ID NO: 661046 - DNA, 25 bp, Rattus norvegicus
ttaggcagcagaggctataccagca

SEQ ID NO: 661047 - DNA, 25 bp, Rattus norvegicus
ttaggcagccacatttgatgttaat

SEQ ID NO: 661048 - DNA, 25 bp, Rattus norvegicus
ttaggcagccacttttgatgttaat

SEQ ID NO: 661049 - DNA, 25 bp, Rattus norvegicus
ttaggcagctttcctcacaaggtga

SEQ ID NO: 661050 - DNA, 25 bp, Rattus norvegicus
ttaggcagctttgctcacaaggtga

SEQ ID NO: 661051 - DNA, 25 bp, Rattus norvegicus
ttaggcagtattagaccaccaccct

SEQ ID NO: 661052 - DNA, 25 bp, Rattus norvegicus
ttaggcagtatttgaccaccaccct

SEQ ID NO: 661053 - DNA, 25 bp, Rattus norvegicus
ttaggcagtgtcctgggagtcttcc

SEQ ID NO: 661054 - DNA, 25 bp, Rattus norvegicus
ttaggcagtgtcgtgggagtcttcc

SEQ ID NO: 661055 - DNA, 25 bp, Rattus norvegicus
ttaggcatacgtccaaggcaaacat

SEQ ID NO: 661056 - DNA, 25 bp, Rattus norvegicus
ttaggcatacgtgcaaggcaaacat

SEQ ID NO: 661057 - DNA, 25 bp, Rattus norvegicus
ttaggcatactgctgttcccgtgaa

SEQ ID NO: 661058 - DNA, 25 bp, Rattus norvegicus
ttaggcatactggtgttcccgtgaa

SEQ ID NO: 661059 - DNA, 25 bp, Rattus norvegicus
ttaggcatagcgcattggcttcaaa

SEQ ID NO: 661060 - DNA, 25 bp, Rattus norvegicus
ttaggcatagcggattggcttcaaa

SEQ ID NO: 661061 - DNA, 25 bp, Rattus norvegicus
ttaggcatcatgagcaccatgggat

SEQ ID NO: 661062 - DNA, 25 bp, Rattus norvegicus
ttaggcatcatgtgcaccatgggat

SEQ ID NO: 661063 - DNA, 25 bp, Rattus norvegicus
ttaggcatctaacaggttctcctga

SEQ ID NO: 661064 - DNA, 25 bp, Rattus norvegicus
ttaggcatctaagaggttctcctga

SEQ ID NO: 661065 - DNA, 25 bp, Rattus norvegicus
ttaggcattcgtcttcatcgttaag

SEQ ID NO: 661066 - DNA, 25 bp, Rattus norvegicus
ttaggcattcgtgttcatcgttaag

SEQ ID NO: 661067 - DNA, 25 bp, Rattus norvegicus
ttaggcatttgcattctttcttgtt

SEQ ID NO: 661068 - DNA, 25 bp, Rattus norvegicus
ttaggcatttgctttctttcttgtt

SEQ ID NO: 661069 - DNA, 25 bp, Rattus norvegicus
ttaggccaaacccactacatggaat

SEQ ID NO: 661070 - DNA, 25 bp, Rattus norvegicus
ttaggccaaaccgactacatggaat

SEQ ID NO: 661071 - DNA, 25 bp, Rattus norvegicus
ttaggccactgtcatagtttctacc

SEQ ID NO: 661072 - DNA, 25 bp, Rattus norvegicus
ttaggccactgtgatagtttctacc

SEQ ID NO: 661073 - DNA, 25 bp, Rattus norvegicus
ttaggcccactcatgtggagaggca

SEQ ID NO: 661074 - DNA, 25 bp, Rattus norvegicus
ttaggcccactcttgtggagaggca

SEQ ID NO: 661075 - DNA, 25 bp, Rattus norvegicus
ttaggcccagctatgtgtacagagg

SEQ ID NO: 661076 - DNA, 25 bp, Rattus norvegicus
ttaggcccagctttgtgtacagagg

SEQ ID NO: 661077 - DNA, 25 bp, Rattus norvegicus
ttaggccccaacaccagggaactgg

SEQ ID NO: 661078 - DNA, 25 bp, Rattus norvegicus
ttaggccccaactccagggaactgg

SEQ ID NO: 661079 - DNA, 25 bp, Rattus norvegicus
ttaggccccaggagggtcacccctg

SEQ ID NO: 661080 - DNA, 25 bp, Rattus norvegicus
ttaggccccaggtgggtcacccctg

SEQ ID NO: 661081 - DNA, 25 bp, Rattus norvegicus
ttaggccctagaatcatatccagag

SEQ ID NO: 661082 - DNA, 25 bp, Rattus norvegicus
ttaggccctagattcatatccagag

SEQ ID NO: 661083 - DNA, 25 bp, Rattus norvegicus
ttaggcccttgaccatctccaggac

SEQ ID NO: 661084 - DNA, 25 bp, Rattus norvegicus
ttaggcccttgagcatctccaggac

SEQ ID NO: 661085 - DNA, 25 bp, Rattus norvegicus
ttaggccgccgacatggcagctgcc

SEQ ID NO: 661086 - DNA, 25 bp, Rattus norvegicus
ttaggccgccgagatggcagctgcc

SEQ ID NO: 661087 - DNA, 25 bp, Rattus norvegicus
ttaggcctacacagaaaatcccagt

SEQ ID NO: 661088 - DNA, 25 bp, Rattus norvegicus
ttaggcctacactgaaaatcccagt

SEQ ID NO: 661089 - DNA, 25 bp, Rattus norvegicus
ttaggcctcaccaagagcctggttt

SEQ ID NO: 661090 - DNA, 25 bp, Rattus norvegicus
ttaggcctcaccagttcttgggcaa

SEQ ID NO: 661091 - DNA, 25 bp, Rattus norvegicus
ttaggcctcacctagagcctggttt

SEQ ID NO: 661092 - DNA, 25 bp, Rattus norvegicus
ttaggcctcacctgttcttgggcaa

SEQ ID NO: 661093 - DNA, 25 bp, Rattus norvegicus
ttaggcctcagcaatatttgggact

SEQ ID NO: 661094 - DNA, 25 bp, Rattus norvegicus
ttaggcctcagctatatttgggact

SEQ ID NO: 661095 - DNA, 25 bp, Rattus norvegicus
ttaggcctccacaaactcctgaagc

SEQ ID NO: 661096 - DNA, 25 bp, Rattus norvegicus
ttaggcctccactaactcctgaagc

SEQ ID NO: 661097 - DNA, 25 bp, Rattus norvegicus
ttaggcctcctcattacaggatcat

SEQ ID NO: 661098 - DNA, 25 bp, Rattus norvegicus
ttaggcctcctctttacaggatcat

SEQ ID NO: 661099 - DNA, 25 bp, Rattus norvegicus
ttaggcctcgctcctgaaagaaccg

SEQ ID NO: 661100 - DNA, 25 bp, Rattus norvegicus
ttaggcctcgctgctgaaagaaccg

SEQ ID NO: 661101 - DNA, 25 bp, Rattus norvegicus
ttaggcctctttcacccagtgtgga

SEQ ID NO: 661102 - DNA, 25 bp, Rattus norvegicus
ttaggcctctttgacccagtgtgga

SEQ ID NO: 661103 - DNA, 25 bp, Rattus norvegicus
ttaggcctgaacagcttgagtctgc

SEQ ID NO: 661104 - DNA, 25 bp, Rattus norvegicus
ttaggcctgaactgcttgagtctgc

SEQ ID NO: 661105 - DNA, 25 bp, Rattus norvegicus
ttaggcctgccaacctgcctgcttg

SEQ ID NO: 661106 - DNA, 25 bp, Rattus norvegicus
ttaggcctgccatcctgcctgcttg

SEQ ID NO: 661107 - DNA, 25 bp, Rattus norvegicus
ttaggcctgtagactgcacctcaga

SEQ ID NO: 661108 - DNA, 25 bp, Rattus norvegicus
ttaggcctgtagtctgcacctcaga

SEQ ID NO: 661109 - DNA, 25 bp, Rattus norvegicus
ttaggcctgttgaaaatctaccaca

SEQ ID NO: 661110 - DNA, 25 bp, Rattus norvegicus
ttaggcctgttgtaaatctaccaca

SEQ ID NO: 661111 - DNA, 25 bp, Rattus norvegicus
ttaggccttactactccaagcagaa

SEQ ID NO: 661112 - DNA, 25 bp, Rattus norvegicus
ttaggccttacttctccaagcagaa

SEQ ID NO: 661113 - DNA, 25 bp, Rattus norvegicus
ttaggccttagacctgtggtatcag

SEQ ID NO: 661114 - DNA, 25 bp, Rattus norvegicus
ttaggccttagagctgtggtatcag

SEQ ID NO: 661115 - DNA, 25 bp, Rattus norvegicus
ttaggccttctcatatgacttttag

SEQ ID NO: 661116 - DNA, 25 bp, Rattus norvegicus
ttaggccttctcttatgacttttag

SEQ ID NO: 661117 - DNA, 25 bp, Rattus norvegicus
ttaggccttttgactatttgttcag

SEQ ID NO: 661118 - DNA, 25 bp, Rattus norvegicus
ttaggccttttgtctatttgttcag

SEQ ID NO: 661119 - DNA, 25 bp, Rattus norvegicus
ttaggcgagcctaattgcccgtgga

SEQ ID NO: 661120 - DNA, 25 bp, Rattus norvegicus
ttaggcgagccttattgcccgtgga

SEQ ID NO: 661121 - DNA, 25 bp, Rattus norvegicus
ttaggcgcttggattcctgggaata

SEQ ID NO: 661122 - DNA, 25 bp, Rattus norvegicus
ttaggcgcttggtttcctgggaata

SEQ ID NO: 661123 - DNA, 25 bp, Rattus norvegicus
ttaggcggtaatcctgggagcacca

SEQ ID NO: 661124 - DNA, 25 bp, Rattus norvegicus
ttaggcggtaatgctgggagcacca

SEQ ID NO: 661125 - DNA, 25 bp, Rattus norvegicus
ttaggctaagatctgctgctccaag

SEQ ID NO: 661126 - DNA, 25 bp, Rattus norvegicus
ttaggctaagatgtgctgctccaag

SEQ ID NO: 661127 - DNA, 25 bp, Rattus norvegicus
ttaggctaggaaccaggtcccagca

SEQ ID NO: 661128 - DNA, 25 bp, Rattus norvegicus
ttaggctaggaagcaggtcccagca

SEQ ID NO: 661129 - DNA, 25 bp, Rattus norvegicus
ttaggctaggagacatgtaacattg

SEQ ID NO: 661130 - DNA, 25 bp, Rattus norvegicus
ttaggctaggagtcatgtaacattg

SEQ ID NO: 661131 - DNA, 25 bp, Rattus norvegicus
ttaggctatccaaaacctcacgttc

SEQ ID NO: 661132 - DNA, 25 bp, Rattus norvegicus
ttaggctatccataacctcacgttc

SEQ ID NO: 661133 - DNA, 25 bp, Rattus norvegicus
ttaggctatggcctggtctgtgccc

SEQ ID NO: 661134 - DNA, 25 bp, Rattus norvegicus
ttaggctatggcgtggtctgtgccc

SEQ ID NO: 661135 - DNA, 25 bp, Rattus norvegicus
ttaggctccacaaccttggctcaat

SEQ ID NO: 661136 - DNA, 25 bp, Rattus norvegicus
ttaggctccacatccttggctcaat

SEQ ID NO: 661137 - DNA, 25 bp, Rattus norvegicus
ttaggctccctcagtggtgtctact

SEQ ID NO: 661138 - DNA, 25 bp, Rattus norvegicus
ttaggctccctctgtggtgtctact

SEQ ID NO: 661139 - DNA, 25 bp, Rattus norvegicus
ttaggctgaactcccagactgagtc

SEQ ID NO: 661140 - DNA, 25 bp, Rattus norvegicus
ttaggctgaactgccagactgagtc

SEQ ID NO: 661141 - DNA, 25 bp, Rattus norvegicus
ttaggctgagtacaaggccgacctt

SEQ ID NO: 661142 - DNA, 25 bp, Rattus norvegicus
ttaggctgagtagaaggccgacctt

SEQ ID NO: 661143 - DNA, 25 bp, Rattus norvegicus
ttaggctgatttcaagtccaactga

SEQ ID NO: 661144 - DNA, 25 bp, Rattus norvegicus
ttaggctgatttgaagtccaactga

SEQ ID NO: 661145 - DNA, 25 bp, Rattus norvegicus
ttaggctgccttagagtactacaca

SEQ ID NO: 661146 - DNA, 25 bp, Rattus norvegicus
ttaggctgcctttgagtactacaca

SEQ ID NO: 661147 - DNA, 25 bp, Rattus norvegicus
ttaggctggcctaattttaatttgt

SEQ ID NO: 661148 - DNA, 25 bp, Rattus norvegicus
ttaggctggccttattttaatttgt

SEQ ID NO: 661149 - DNA, 25 bp, Rattus norvegicus
ttaggctggcttcgtaatgtccggc

SEQ ID NO: 661150 - DNA, 25 bp, Rattus norvegicus
ttaggctggcttggtaatgtccggc

SEQ ID NO: 661151 - DNA, 25 bp, Rattus norvegicus
ttaggctgtcagactcctggacatg

SEQ ID NO: 661152 - DNA, 25 bp, Rattus norvegicus
ttaggctgtcagtctcctggacatg

SEQ ID NO: 661153 - DNA, 25 bp, Rattus norvegicus
ttaggctgtgaaccatatcgtgtat

SEQ ID NO: 661154 - DNA, 25 bp, Rattus norvegicus
ttaggctgtgaagcatatcgtgtat

SEQ ID NO: 661155 - DNA, 25 bp, Rattus norvegicus
ttaggctgtggcatcactggactac

SEQ ID NO: 661156 - DNA, 25 bp, Rattus norvegicus
ttaggctgtggcttcactggactac

SEQ ID NO: 661157 - DNA, 25 bp, Rattus norvegicus
ttaggcttccggactcccaaaatgt

SEQ ID NO: 661158 - DNA, 25 bp, Rattus norvegicus
ttaggcttccggtctcccaaaatgt

SEQ ID NO: 661159 - DNA, 25 bp, Rattus norvegicus
ttaggcttcgagacaaccaggagga

SEQ ID NO: 661160 - DNA, 25 bp, Rattus norvegicus
ttaggcttcgagtcaaccaggagga

SEQ ID NO: 661161 - DNA, 25 bp, Rattus norvegicus
ttaggctttggtacttgttgttcgc

SEQ ID NO: 661162 - DNA, 25 bp, Rattus norvegicus
ttaggctttggttcttgttgttcgc

SEQ ID NO: 661163 - DNA, 25 bp, Rattus norvegicus
ttagggaacatgaaagctcctttgg

SEQ ID NO: 661164 - DNA, 25 bp, Rattus norvegicus
ttagggaacatgtaagctcctttgg

SEQ ID NO: 661165 - DNA, 25 bp, Rattus norvegicus
ttagggaagatcaaggccagctcag

SEQ ID NO: 661166 - DNA, 25 bp, Rattus norvegicus
ttagggaagatctaggccagctcag

SEQ ID NO: 661167 - DNA, 25 bp, Rattus norvegicus
ttagggaatctcatggtcccaccta

SEQ ID NO: 661168 - DNA, 25 bp, Rattus norvegicus
ttagggaatctcttggtcccaccta

SEQ ID NO: 661169 - DNA, 25 bp, Rattus norvegicus
ttagggacactgacccactgtccca

SEQ ID NO: 661170 - DNA, 25 bp, Rattus norvegicus
ttagggacactgtcccactgtccca

SEQ ID NO: 661171 - DNA, 25 bp, Rattus norvegicus
ttagggacagcactatcaacacgtg

SEQ ID NO: 661172 - DNA, 25 bp, Rattus norvegicus
ttagggacagcagtatcaacacgtg

SEQ ID NO: 661173 - DNA, 25 bp, Rattus norvegicus
ttagggacatctcatccagtcggga

SEQ ID NO: 661174 - DNA, 25 bp, Rattus norvegicus
ttagggacatctgatccagtcggga

SEQ ID NO: 661175 - DNA, 25 bp, Rattus norvegicus
ttagggactgaccatttctgctgag

SEQ ID NO: 661176 - DNA, 25 bp, Rattus norvegicus
ttagggactgacgatttctgctgag

SEQ ID NO: 661177 - DNA, 25 bp, Rattus norvegicus
ttagggaggagccacactctgccta

SEQ ID NO: 661178 - DNA, 25 bp, Rattus norvegicus
ttagggaggagcgacactctgccta

SEQ ID NO: 661179 - DNA, 25 bp, Rattus norvegicus
ttagggaggtatattgagacaggct

SEQ ID NO: 661180 - DNA, 25 bp, Rattus norvegicus
ttagggaggtattttgagacaggct

SEQ ID NO: 661181 - DNA, 25 bp, Rattus norvegicus
ttagggatctggacttccggtacga

SEQ ID NO: 661182 - DNA, 25 bp, Rattus norvegicus
ttagggatctggtcttccggtacga

SEQ ID NO: 661183 - DNA, 25 bp, Rattus norvegicus
ttagggatggcacaccagagtctgt

SEQ ID NO: 661184 - DNA, 25 bp, Rattus norvegicus
ttagggatggcagaccagagtctgt

SEQ ID NO: 661185 - DNA, 25 bp, Rattus norvegicus
ttagggcacagaccactgacagtta

SEQ ID NO: 661186 - DNA, 25 bp, Rattus norvegicus
ttagggcacagagcactgacagtta

SEQ ID NO: 661187 - DNA, 25 bp, Rattus norvegicus
ttagggcacttaattttactctttg

SEQ ID NO: 661188 - DNA, 25 bp, Rattus norvegicus
ttagggcacttatttttactctttg

SEQ ID NO: 661189 - DNA, 25 bp, Rattus norvegicus
ttagggcagcggatcgcagacagat

SEQ ID NO: 661190 - DNA, 25 bp, Rattus norvegicus
ttagggcagcggttcgcagacagat

SEQ ID NO: 661191 - DNA, 25 bp, Rattus norvegicus
ttagggcaggctcatacttctatct

SEQ ID NO: 661192 - DNA, 25 bp, Rattus norvegicus
ttagggcaggctgatacttctatct

SEQ ID NO: 661193 - DNA, 25 bp, Rattus norvegicus
ttagggcatctgcacataagctgtg

SEQ ID NO: 661194 - DNA, 25 bp, Rattus norvegicus
ttagggcatctggacataagctgtg

SEQ ID NO: 661195 - DNA, 25 bp, Rattus norvegicus
ttagggccacaaaaaaccgcacaag

SEQ ID NO: 661196 - DNA, 25 bp, Rattus norvegicus
ttagggccacaataaaccgcacaag

SEQ ID NO: 661197 - DNA, 25 bp, Rattus norvegicus
ttagggccagaaatgccagagcctc

SEQ ID NO: 661198 - DNA, 25 bp, Rattus norvegicus
ttagggccagaattgccagagcctc

SEQ ID NO: 661199 - DNA, 25 bp, Rattus norvegicus
ttagggccagagctttcagggcctt

SEQ ID NO: 661200 - DNA, 25 bp, Rattus norvegicus
ttagggccagaggtttcagggcctt

SEQ ID NO: 661201 - DNA, 25 bp, Rattus norvegicus
ttagggccagtgctctcagaaacaa

SEQ ID NO: 661202 - DNA, 25 bp, Rattus norvegicus
ttagggccagtggtctcagaaacaa

SEQ ID NO: 661203 - DNA, 25 bp, Rattus norvegicus
ttagggccgggaactctcagattct

SEQ ID NO: 661204 - DNA, 25 bp, Rattus norvegicus
ttagggccgggatctctcagattct

SEQ ID NO: 661205 - DNA, 25 bp, Rattus norvegicus
ttagggcctttccagatgaatgtga

SEQ ID NO: 661206 - DNA, 25 bp, Rattus norvegicus
ttagggcctttcgagatgaatgtga

SEQ ID NO: 661207 - DNA, 25 bp, Rattus norvegicus
ttagggcgcaagatctggtagctta

SEQ ID NO: 661208 - DNA, 25 bp, Rattus norvegicus
ttagggcgcaagttctggtagctta

SEQ ID NO: 661209 - DNA, 25 bp, Rattus norvegicus
ttagggctaaacacctgtccttgga

SEQ ID NO: 661210 - DNA, 25 bp, Rattus norvegicus
ttagggctaaactcctgtccttgga

SEQ ID NO: 661211 - DNA, 25 bp, Rattus norvegicus
ttagggctacccacgacagagaaat

SEQ ID NO: 661212 - DNA, 25 bp, Rattus norvegicus
ttagggctaccctcgacagagaaat

SEQ ID NO: 661213 - DNA, 25 bp, Rattus norvegicus
ttagggcttgtgattcctgtaacat

SEQ ID NO: 661214 - DNA, 25 bp, Rattus norvegicus
ttagggcttgtgtttcctgtaacat

SEQ ID NO: 661215 - DNA, 25 bp, Rattus norvegicus
ttagggctttacacataatgggcaa

SEQ ID NO: 661216 - DNA, 25 bp, Rattus norvegicus
ttagggctttactcataatgggcaa

SEQ ID NO: 661217 - DNA, 25 bp, Rattus norvegicus
ttagggtaaggcagtcctccaggac

SEQ ID NO: 661218 - DNA, 25 bp, Rattus norvegicus
ttagggtaaggctgtcctccaggac

SEQ ID NO: 661219 - DNA, 25 bp, Rattus norvegicus
ttagggtacagtacagctcaaagga

SEQ ID NO: 661220 - DNA, 25 bp, Rattus norvegicus
ttagggtacagttcagctcaaagga

SEQ ID NO: 661221 - DNA, 25 bp, Rattus norvegicus
ttagggtcagacatgctacaaaacc

SEQ ID NO: 661222 - DNA, 25 bp, Rattus norvegicus
ttagggtcagacttgctacaaaacc

SEQ ID NO: 661223 - DNA, 25 bp, Rattus norvegicus
ttagggtccacaactttgaaaacgt

SEQ ID NO: 661224 - DNA, 25 bp, Rattus norvegicus
ttagggtccacatctttgaaaacgt

SEQ ID NO: 661225 - DNA, 25 bp, Rattus norvegicus
ttagggtccctgaggaagcccaaca

SEQ ID NO: 661226 - DNA, 25 bp, Rattus norvegicus
ttagggtccctgtggaagcccaaca

SEQ ID NO: 661227 - DNA, 25 bp, Rattus norvegicus
ttagggtcgggcatcatcaaggatt

SEQ ID NO: 661228 - DNA, 25 bp, Rattus norvegicus
ttagggtcgggcttcatcaaggatt

SEQ ID NO: 661229 - DNA, 25 bp, Rattus norvegicus
ttagggtcggttctgagcctgctac

SEQ ID NO: 661230 - DNA, 25 bp, Rattus norvegicus
ttagggtcggttgtgagcctgctac

SEQ ID NO: 661231 - DNA, 25 bp, Rattus norvegicus
ttagggtgaagtatccaggcccctg

SEQ ID NO: 661232 - DNA, 25 bp, Rattus norvegicus
ttagggtgaagtttccaggcccctg

SEQ ID NO: 661233 - DNA, 25 bp, Rattus norvegicus
ttagggtggactctgtgctcttcaa

SEQ ID NO: 661234 - DNA, 25 bp, Rattus norvegicus
ttagggtggactgtgtgctcttcaa

SEQ ID NO: 661235 - DNA, 25 bp, Rattus norvegicus
ttagggtggtccagtgaaggcctgt

SEQ ID NO: 661236 - DNA, 25 bp, Rattus norvegicus
ttagggtggtcctgtgaaggcctgt

SEQ ID NO: 661237 - DNA, 25 bp, Rattus norvegicus
ttagggttatgtacccatttcacat

SEQ ID NO: 661238 - DNA, 25 bp, Rattus norvegicus
ttagggttatgttcccatttcacat

SEQ ID NO: 661239 - DNA, 25 bp, Rattus norvegicus
ttagggttctccagacagtcctgaa

SEQ ID NO: 661240 - DNA, 25 bp, Rattus norvegicus
ttagggttctcctgacagtcctgaa

SEQ ID NO: 661241 - DNA, 25 bp, Rattus norvegicus
ttagggttgactctgtgcctaaccc

SEQ ID NO: 661242 - DNA, 25 bp, Rattus norvegicus
ttagggttgactgtgtgcctaaccc

SEQ ID NO: 661243 - DNA, 25 bp, Rattus norvegicus
ttagggttgggccagcccctgcact

SEQ ID NO: 661244 - DNA, 25 bp, Rattus norvegicus
ttagggttgggcgagcccctgcact

SEQ ID NO: 661245 - DNA, 25 bp, Rattus norvegicus
ttagggttgtcacgcctttcctcct

SEQ ID NO: 661246 - DNA, 25 bp, Rattus norvegicus
ttagggttgtcaggcctttcctcct

SEQ ID NO: 661247 - DNA, 25 bp, Rattus norvegicus
ttagggtttctcagcttttccagaa

SEQ ID NO: 661248 - DNA, 25 bp, Rattus norvegicus
ttagggtttctctgcttttccagaa

SEQ ID NO: 661249 - DNA, 25 bp, Rattus norvegicus
ttagggtttgccagcattctttgga

SEQ ID NO: 661250 - DNA, 25 bp, Rattus norvegicus
ttagggtttgcctgcattctttgga

SEQ ID NO: 661251 - DNA, 25 bp, Rattus norvegicus
ttaggtaacctaagggtgcccacgg

SEQ ID NO: 661252 - DNA, 25 bp, Rattus norvegicus
ttaggtaacctatgggtgcccacgg

SEQ ID NO: 661253 - DNA, 25 bp, Rattus norvegicus
ttaggtaagctgagggccttgtcct

SEQ ID NO: 661254 - DNA, 25 bp, Rattus norvegicus
ttaggtaagctgtgggccttgtcct

SEQ ID NO: 661255 - DNA, 25 bp, Rattus norvegicus
ttaggtaagggcaactctcttcagt

SEQ ID NO: 661256 - DNA, 25 bp, Rattus norvegicus
ttaggtaagggctactctcttcagt

SEQ ID NO: 661257 - DNA, 25 bp, Rattus norvegicus
ttaggtaccacgcacagggcctgaa

SEQ ID NO: 661258 - DNA, 25 bp, Rattus norvegicus
ttaggtaccacggacagggcctgaa

SEQ ID NO: 661259 - DNA, 25 bp, Rattus norvegicus
ttaggtaccactcacgacccacagg

SEQ ID NO: 661260 - DNA, 25 bp, Rattus norvegicus
ttaggtaccactgacgacccacagg

SEQ ID NO: 661261 - DNA, 25 bp, Rattus norvegicus
ttaggtagagcacggcacaccactc

SEQ ID NO: 661262 - DNA, 25 bp, Rattus norvegicus
ttaggtagagcagggcacaccactc

SEQ ID NO: 661263 - DNA, 25 bp, Rattus norvegicus
ttaggtagctataacccgcgcattt

SEQ ID NO: 661264 - DNA, 25 bp, Rattus norvegicus
ttaggtagctattacccgcgcattt

SEQ ID NO: 661265 - DNA, 25 bp, Rattus norvegicus
ttaggtaggcaccttagccccaaag

SEQ ID NO: 661266 - DNA, 25 bp, Rattus norvegicus
ttaggtaggcacgttagccccaaag

SEQ ID NO: 661267 - DNA, 25 bp, Rattus norvegicus
ttaggtaggcccaggacctgacctg

SEQ ID NO: 661268 - DNA, 25 bp, Rattus norvegicus
ttaggtaggccctggacctgacctg

SEQ ID NO: 661269 - DNA, 25 bp, Rattus norvegicus
ttaggtatcagtcaacaagagtgaa

SEQ ID NO: 661270 - DNA, 25 bp, Rattus norvegicus
ttaggtatcagtgaacaagagtgaa

SEQ ID NO: 661271 - DNA, 25 bp, Rattus norvegicus
ttaggtatctttctagtcaataaaa

SEQ ID NO: 661272 - DNA, 25 bp, Rattus norvegicus
ttaggtatctttgtagtcaataaaa

SEQ ID NO: 661273 - DNA, 25 bp, Rattus norvegicus
ttaggtatgagaaggagcgacagct

SEQ ID NO: 661274 - DNA, 25 bp, Rattus norvegicus
ttaggtatgagatggagcgacagct

SEQ ID NO: 661275 - DNA, 25 bp, Rattus norvegicus
ttaggtcaatggaacgtcgcctgcc

SEQ ID NO: 661276 - DNA, 25 bp, Rattus norvegicus
ttaggtcaatggtacgtcgcctgcc

SEQ ID NO: 661277 - DNA, 25 bp, Rattus norvegicus
ttaggtcactacactctgctactgg

SEQ ID NO: 661278 - DNA, 25 bp, Rattus norvegicus
ttaggtcactactctctgctactgg

SEQ ID NO: 661279 - DNA, 25 bp, Rattus norvegicus
ttaggtcagtaacccttgagaggca

SEQ ID NO: 661280 - DNA, 25 bp, Rattus norvegicus
ttaggtcagtaagccttgagaggca

SEQ ID NO: 661281 - DNA, 25 bp, Rattus norvegicus
ttaggtcccagcagttctcaataaa

SEQ ID NO: 661282 - DNA, 25 bp, Rattus norvegicus
ttaggtcccagctgttctcaataaa

SEQ ID NO: 661283 - DNA, 25 bp, Rattus norvegicus
ttaggtccctatctcttattaactg

SEQ ID NO: 661284 - DNA, 25 bp, Rattus norvegicus
ttaggtccctatgtcttattaactg

SEQ ID NO: 661285 - DNA, 25 bp, Rattus norvegicus
ttaggtccctttccacgtggcgata

SEQ ID NO: 661286 - DNA, 25 bp, Rattus norvegicus
ttaggtccctttgcacgtggcgata

SEQ ID NO: 661287 - DNA, 25 bp, Rattus norvegicus
ttaggtccgcgcctgcgaaccagaa

SEQ ID NO: 661288 - DNA, 25 bp, Rattus norvegicus
ttaggtccgcgcgtgcgaaccagaa

SEQ ID NO: 661289 - DNA, 25 bp, Rattus norvegicus
ttaggtcctcacacaattccttaca

SEQ ID NO: 661290 - DNA, 25 bp, Rattus norvegicus
ttaggtcctcactcaattccttaca

SEQ ID NO: 661291 - DNA, 25 bp, Rattus norvegicus
ttaggtccttggatggtcatctcca

SEQ ID NO: 661292 - DNA, 25 bp, Rattus norvegicus
ttaggtccttggttggtcatctcca

SEQ ID NO: 661293 - DNA, 25 bp, Rattus norvegicus
ttaggtctacatagctccttgctgt

SEQ ID NO: 661294 - DNA, 25 bp, Rattus norvegicus
ttaggtctacattgctccttgctgt

SEQ ID NO: 661295 - DNA, 25 bp, Rattus norvegicus
ttaggtctcagaccctgttacccat

SEQ ID NO: 661296 - DNA, 25 bp, Rattus norvegicus
ttaggtctcagagcctgttacccat

SEQ ID NO: 661297 - DNA, 25 bp, Rattus norvegicus
ttaggtctcagtcagggaaggatcc

SEQ ID NO: 661298 - DNA, 25 bp, Rattus norvegicus
ttaggtctcagtgagggaaggatcc

SEQ ID NO: 661299 - DNA, 25 bp, Rattus norvegicus
ttaggtctcctgagtgactcttgct

SEQ ID NO: 661300 - DNA, 25 bp, Rattus norvegicus
ttaggtctcctgtgtgactcttgct

SEQ ID NO: 661301 - DNA, 25 bp, Rattus norvegicus
ttaggtctggccacacttttgcctt

SEQ ID NO: 661302 - DNA, 25 bp, Rattus norvegicus
ttaggtctggcctcacttttgcctt

SEQ ID NO: 661303 - DNA, 25 bp, Rattus norvegicus
ttaggtctttcactaagctcccttg

SEQ ID NO: 661304 - DNA, 25 bp, Rattus norvegicus
ttaggtctttcagtaagctcccttg

SEQ ID NO: 661305 - DNA, 25 bp, Rattus norvegicus
ttaggtgacactcccaggttgcttc

SEQ ID NO: 661306 - DNA, 25 bp, Rattus norvegicus
ttaggtgacactgccaggttgcttc

SEQ ID NO: 661307 - DNA, 25 bp, Rattus norvegicus
ttaggtgacgtcctcagacctggat

SEQ ID NO: 661308 - DNA, 25 bp, Rattus norvegicus
ttaggtgacgtcgtcagacctggat

SEQ ID NO: 661309 - DNA, 25 bp, Rattus norvegicus
ttaggtgagttgcaaaggccccagt

SEQ ID NO: 661310 - DNA, 25 bp, Rattus norvegicus
ttaggtgagttggaaaggccccagt

SEQ ID NO: 661311 - DNA, 25 bp, Rattus norvegicus
ttaggtgatatgcactgatgtgaat

SEQ ID NO: 661312 - DNA, 25 bp, Rattus norvegicus
ttaggtgatatggactgatgtgaat

SEQ ID NO: 661313 - DNA, 25 bp, Rattus norvegicus
ttaggtgcaagcactctgtaactct

SEQ ID NO: 661314 - DNA, 25 bp, Rattus norvegicus
ttaggtgcaagctctctgtaactct

SEQ ID NO: 661315 - DNA, 25 bp, Rattus norvegicus
ttaggtgcattccttggaggctgct

SEQ ID NO: 661316 - DNA, 25 bp, Rattus norvegicus
ttaggtgcattcgttggaggctgct

SEQ ID NO: 661317 - DNA, 25 bp, Rattus norvegicus
ttaggtgccttcagctctctgcaac

SEQ ID NO: 661318 - DNA, 25 bp, Rattus norvegicus
ttaggtgccttctgctctctgcaac

SEQ ID NO: 661319 - DNA, 25 bp, Rattus norvegicus
ttaggtggacacaccagcactgttc

SEQ ID NO: 661320 - DNA, 25 bp, Rattus norvegicus
ttaggtggacactccagcactgttc

SEQ ID NO: 661321 - DNA, 25 bp, Rattus norvegicus
ttaggtggagcccagattgcatctc

SEQ ID NO: 661322 - DNA, 25 bp, Rattus norvegicus
ttaggtggagccgagattgcatctc

SEQ ID NO: 661323 - DNA, 25 bp, Rattus norvegicus
ttaggtgtagttccctgggtcctag

SEQ ID NO: 661324 - DNA, 25 bp, Rattus norvegicus
ttaggtgtagttgcctgggtcctag

SEQ ID NO: 661325 - DNA, 25 bp, Rattus norvegicus
ttaggtgtatgcaaccatatctggt

SEQ ID NO: 661326 - DNA, 25 bp, Rattus norvegicus
ttaggtgtatgctaccatatctggt

SEQ ID NO: 661327 - DNA, 25 bp, Rattus norvegicus
ttaggtgtcaggcttcctccaagag

SEQ ID NO: 661328 - DNA, 25 bp, Rattus norvegicus
ttaggtgtcagggttcctccaagag

SEQ ID NO: 661329 - DNA, 25 bp, Rattus norvegicus
ttaggtgtccttcttatctttggct

SEQ ID NO: 661330 - DNA, 25 bp, Rattus norvegicus
ttaggtgtccttgttatctttggct

SEQ ID NO: 661331 - DNA, 25 bp, Rattus norvegicus
ttaggtgtgattcccgtgacaggac

SEQ ID NO: 661332 - DNA, 25 bp, Rattus norvegicus
ttaggtgtgattgccgtgacaggac

SEQ ID NO: 661333 - DNA, 25 bp, Rattus norvegicus
ttaggtgttggaatctgcctgatga

SEQ ID NO: 661334 - DNA, 25 bp, Rattus norvegicus
ttaggtgttggattctgcctgatga

SEQ ID NO: 661335 - DNA, 25 bp, Rattus norvegicus
ttaggtgtttagatcccatacgcaa

SEQ ID NO: 661336 - DNA, 25 bp, Rattus norvegicus
ttaggtgtttagttcccatacgcaa

SEQ ID NO: 661337 - DNA, 25 bp, Rattus norvegicus
ttaggttaatacatgtgctgcatga

SEQ ID NO: 661338 - DNA, 25 bp, Rattus norvegicus
ttaggttaatacttgtgctgcatga

SEQ ID NO: 661339 - DNA, 25 bp, Rattus norvegicus
ttaggttacccaactgacactgcgg

SEQ ID NO: 661340 - DNA, 25 bp, Rattus norvegicus
ttaggttacccatctgacactgcgg

SEQ ID NO: 661341 - DNA, 25 bp, Rattus norvegicus
ttaggttaccttcgccaacccactg

SEQ ID NO: 661342 - DNA, 25 bp, Rattus norvegicus
ttaggttaccttggccaacccactg

SEQ ID NO: 661343 - DNA, 25 bp, Rattus norvegicus
ttaggttacttcctcccgacttgat

SEQ ID NO: 661344 - DNA, 25 bp, Rattus norvegicus
ttaggttacttcgtcccgacttgat

SEQ ID NO: 661345 - DNA, 25 bp, Rattus norvegicus
ttaggttagggcacctgtaggtctt

SEQ ID NO: 661346 - DNA, 25 bp, Rattus norvegicus
ttaggttagggctcctgtaggtctt

SEQ ID NO: 661347 - DNA, 25 bp, Rattus norvegicus
ttaggttcatctactctgactgagt

SEQ ID NO: 661348 - DNA, 25 bp, Rattus norvegicus
ttaggttcatcttctctgactgagt

SEQ ID NO: 661349 - DNA, 25 bp, Rattus norvegicus
ttaggttctgtcattcctacttctc

SEQ ID NO: 661350 - DNA, 25 bp, Rattus norvegicus
ttaggttctgtctttcctacttctc

SEQ ID NO: 661351 - DNA, 25 bp, Rattus norvegicus
ttaggttgcatcactggaccaaggc

SEQ ID NO: 661352 - DNA, 25 bp, Rattus norvegicus
ttaggttgcatctctggaccaaggc

SEQ ID NO: 661353 - DNA, 25 bp, Rattus norvegicus
ttaggtttcctcaactgcagatcag

SEQ ID NO: 661354 - DNA, 25 bp, Rattus norvegicus
ttaggtttcctctactgcagatcag

SEQ ID NO: 661355 - DNA, 25 bp, Rattus norvegicus
ttaggtttgtctcccttaacattag

SEQ ID NO: 661356 - DNA, 25 bp, Rattus norvegicus
ttaggtttgtctgccttaacattag

SEQ ID NO: 661357 - DNA, 25 bp, Rattus norvegicus
ttaggttttgccatctccaggtatc

SEQ ID NO: 661358 - DNA, 25 bp, Rattus norvegicus
ttaggttttgccttctccaggtatc

SEQ ID NO: 661359 - DNA, 25 bp, Rattus norvegicus
ttagtaaaagtcagtatgcccggca

SEQ ID NO: 661360 - DNA, 25 bp, Rattus norvegicus
ttagtaaaagtctgtatgcccggca

SEQ ID NO: 661361 - DNA, 25 bp, Rattus norvegicus
ttagtaaccgccacttgaaccagtg

SEQ ID NO: 661362 - DNA, 25 bp, Rattus norvegicus
ttagtaaccgcctcttgaaccagtg

SEQ ID NO: 661363 - DNA, 25 bp, Rattus norvegicus
ttagtaacgatcacaacctaccacc

SEQ ID NO: 661364 - DNA, 25 bp, Rattus norvegicus
ttagtaacgatctcaacctaccacc

SEQ ID NO: 661365 - DNA, 25 bp, Rattus norvegicus
ttagtaactctgctgaagacccatt

SEQ ID NO: 661366 - DNA, 25 bp, Rattus norvegicus
ttagtaactctggtgaagacccatt

SEQ ID NO: 661367 - DNA, 25 bp, Rattus norvegicus
ttagtaacttgcagaccgcaccggg

SEQ ID NO: 661368 - DNA, 25 bp, Rattus norvegicus
ttagtaacttgctgaccgcaccggg

SEQ ID NO: 661369 - DNA, 25 bp, Rattus norvegicus
ttagtaatgatgctcttttttcccc

SEQ ID NO: 661370 - DNA, 25 bp, Rattus norvegicus
ttagtaatgatggtcttttttcccc

SEQ ID NO: 661371 - DNA, 25 bp, Rattus norvegicus
ttagtaatttcgactgtgtcttcat

SEQ ID NO: 661372 - DNA, 25 bp, Rattus norvegicus
ttagtaatttcgtctgtgtcttcat

SEQ ID NO: 661373 - DNA, 25 bp, Rattus norvegicus
ttagtacaagtaacaaggctccgtt

SEQ ID NO: 661374 - DNA, 25 bp, Rattus norvegicus
ttagtacaagtatcaaggctccgtt

SEQ ID NO: 661375 - DNA, 25 bp, Rattus norvegicus
ttagtacacctcacctaatatgcac

SEQ ID NO: 661376 - DNA, 25 bp, Rattus norvegicus
ttagtacacctctcctaatatgcac

SEQ ID NO: 661377 - DNA, 25 bp, Rattus norvegicus
ttagtacaggatattcacccatgtg

SEQ ID NO: 661378 - DNA, 25 bp, Rattus norvegicus
ttagtacaggattttcacccatgtg

SEQ ID NO: 661379 - DNA, 25 bp, Rattus norvegicus
ttagtaccaagcactgacagagtcc

SEQ ID NO: 661380 - DNA, 25 bp, Rattus norvegicus
ttagtaccaagctctgacagagtcc

SEQ ID NO: 661381 - DNA, 25 bp, Rattus norvegicus
ttagtaccactactcacacctgcat

SEQ ID NO: 661382 - DNA, 25 bp, Rattus norvegicus
ttagtaccactagtcacacctgcat

SEQ ID NO: 661383 - DNA, 25 bp, Rattus norvegicus
ttagtacctctactgtggaccagtc

SEQ ID NO: 661384 - DNA, 25 bp, Rattus norvegicus
ttagtacctctagtgtggaccagtc

SEQ ID NO: 661385 - DNA, 25 bp, Rattus norvegicus
ttagtacctgtgaacaactgctgtt

SEQ ID NO: 661386 - DNA, 25 bp, Rattus norvegicus
ttagtacctgtgtacaactgctgtt

SEQ ID NO: 661387 - DNA, 25 bp, Rattus norvegicus
ttagtacggctgatgcgagcccagc

SEQ ID NO: 661388 - DNA, 25 bp, Rattus norvegicus
ttagtacggctgttgcgagcccagc

SEQ ID NO: 661389 - DNA, 25 bp, Rattus norvegicus
ttagtacggttgactttgaactgtg

SEQ ID NO: 661390 - DNA, 25 bp, Rattus norvegicus
ttagtacggttgtctttgaactgtg

SEQ ID NO: 661391 - DNA, 25 bp, Rattus norvegicus
ttagtacgtgttatgattcccttgt

SEQ ID NO: 661392 - DNA, 25 bp, Rattus norvegicus
ttagtacgtgttttgattcccttgt

SEQ ID NO: 661393 - DNA, 25 bp, Rattus norvegicus
ttagtactaaaaaggctgcaggtgc

SEQ ID NO: 661394 - DNA, 25 bp, Rattus norvegicus
ttagtactaaaatggctgcaggtgc

SEQ ID NO: 661395 - DNA, 25 bp, Rattus norvegicus
ttagtactctcacaacagctctcct

SEQ ID NO: 661396 - DNA, 25 bp, Rattus norvegicus
ttagtactctcagaacagctctcct

SEQ ID NO: 661397 - DNA, 25 bp, Rattus norvegicus
ttagtactttgaacgcatacacgta

SEQ ID NO: 661398 - DNA, 25 bp, Rattus norvegicus
ttagtactttgatcgcatacacgta

SEQ ID NO: 661399 - DNA, 25 bp, Rattus norvegicus
ttagtagccgatattgccagggcct

SEQ ID NO: 661400 - DNA, 25 bp, Rattus norvegicus
ttagtagccgattttgccagggcct

SEQ ID NO: 661401 - DNA, 25 bp, Rattus norvegicus
ttagtaggagtcatctgacccctga

SEQ ID NO: 661402 - DNA, 25 bp, Rattus norvegicus
ttagtaggagtcttctgacccctga

SEQ ID NO: 661403 - DNA, 25 bp, Rattus norvegicus
ttagtagggacaacttctcctgttc

SEQ ID NO: 661404 - DNA, 25 bp, Rattus norvegicus
ttagtagggacatcttctcctgttc

SEQ ID NO: 661405 - DNA, 25 bp, Rattus norvegicus
ttagtagtggccagcgtcctatggg

SEQ ID NO: 661406 - DNA, 25 bp, Rattus norvegicus
ttagtagtggcctgcgtcctatggg

SEQ ID NO: 661407 - DNA, 25 bp, Rattus norvegicus
ttagtagttgtaccagagacctctg

SEQ ID NO: 661408 - DNA, 25 bp, Rattus norvegicus
ttagtagttgtagcagagacctctg

SEQ ID NO: 661409 - DNA, 25 bp, Rattus norvegicus
ttagtagtttcacagccattgccgc

SEQ ID NO: 661410 - DNA, 25 bp, Rattus norvegicus
ttagtagtttcagagccattgccgc

SEQ ID NO: 661411 - DNA, 25 bp, Rattus norvegicus
ttagtatatgccctgaatctgttgt

SEQ ID NO: 661412 - DNA, 25 bp, Rattus norvegicus
ttagtatatgccgtgaatctgttgt

SEQ ID NO: 661413 - DNA, 25 bp, Rattus norvegicus
ttagtatcctccactcaaggcagac

SEQ ID NO: 661414 - DNA, 25 bp, Rattus norvegicus
ttagtatcctcctctcaaggcagac

SEQ ID NO: 661415 - DNA, 25 bp, Rattus norvegicus
ttagtatcttggcagatcatctgta

SEQ ID NO: 661416 - DNA, 25 bp, Rattus norvegicus
ttagtatcttgggagatcatctgta

SEQ ID NO: 661417 - DNA, 25 bp, Rattus norvegicus
ttagtatgccagattgacccgaaca

SEQ ID NO: 661418 - DNA, 25 bp, Rattus norvegicus
ttagtatgccagtttgacccgaaca

SEQ ID NO: 661419 - DNA, 25 bp, Rattus norvegicus
ttagtattctggagggcttacaaca

SEQ ID NO: 661420 - DNA, 25 bp, Rattus norvegicus
ttagtattctggtgggcttacaaca

SEQ ID NO: 661421 - DNA, 25 bp, Rattus norvegicus
ttagtattttgtagtgaccacccct

SEQ ID NO: 661422 - DNA, 25 bp, Rattus norvegicus
ttagtattttgttgtgaccacccct

SEQ ID NO: 661423 - DNA, 25 bp, Rattus norvegicus
ttagtcaacagtattggccatcccc

SEQ ID NO: 661424 - DNA, 25 bp, Rattus norvegicus
ttagtcaacagttttggccatcccc

SEQ ID NO: 661425 - DNA, 25 bp, Rattus norvegicus
ttagtcaactttccttgtcccattg

SEQ ID NO: 661426 - DNA, 25 bp, Rattus norvegicus
ttagtcaactttgcttgtcccattg

SEQ ID NO: 661427 - DNA, 25 bp, Rattus norvegicus
ttagtcaagaatccctcccgtttgt

SEQ ID NO: 661428 - DNA, 25 bp, Rattus norvegicus
ttagtcaagaatgcctcccgtttgt

SEQ ID NO: 661429 - DNA, 25 bp, Rattus norvegicus
ttagtcaagctacaacaggtttgga

SEQ ID NO: 661430 - DNA, 25 bp, Rattus norvegicus
ttagtcaagctagaacaggtttgga

SEQ ID NO: 661431 - DNA, 25 bp, Rattus norvegicus
ttagtcacagctctctactctttct

SEQ ID NO: 661432 - DNA, 25 bp, Rattus norvegicus
ttagtcacagctgtctactctttct

SEQ ID NO: 661433 - DNA, 25 bp, Rattus norvegicus
ttagtcactgtcacttcattttaag

SEQ ID NO: 661434 - DNA, 25 bp, Rattus norvegicus
ttagtcactgtctcttcattttaag

SEQ ID NO: 661435 - DNA, 25 bp, Rattus norvegicus
ttagtcactttactacctccactgc

SEQ ID NO: 661436 - DNA, 25 bp, Rattus norvegicus
ttagtcactttagtacctccactgc

SEQ ID NO: 661437 - DNA, 25 bp, Rattus norvegicus
ttagtcagagttccctttacagttc

SEQ ID NO: 661438 - DNA, 25 bp, Rattus norvegicus
ttagtcagagttgcctttacagttc

SEQ ID NO: 661439 - DNA, 25 bp, Rattus norvegicus
ttagtcagcaagatttaatttcaac

SEQ ID NO: 661440 - DNA, 25 bp, Rattus norvegicus
ttagtcagcaagttttaatttcaac

SEQ ID NO: 661441 - DNA, 25 bp, Rattus norvegicus
ttagtcataaacactgaagctggca

SEQ ID NO: 661442 - DNA, 25 bp, Rattus norvegicus
ttagtcataaactctgaagctggca

SEQ ID NO: 661443 - DNA, 25 bp, Rattus norvegicus
ttagtcatacgtaccagccacatac

SEQ ID NO: 661444 - DNA, 25 bp, Rattus norvegicus
ttagtcatacgttccagccacatac

SEQ ID NO: 661445 - DNA, 25 bp, Rattus norvegicus
ttagtcatcagtaacatctggagac

SEQ ID NO: 661446 - DNA, 25 bp, Rattus norvegicus
ttagtcatcagttacatctggagac

SEQ ID NO: 661447 - DNA, 25 bp, Rattus norvegicus
ttagtcatcatcattgctgcaccag

SEQ ID NO: 661448 - DNA, 25 bp, Rattus norvegicus
ttagtcatcatctttgctgcaccag

SEQ ID NO: 661449 - DNA, 25 bp, Rattus norvegicus
ttagtcattatgattgctcccttga

SEQ ID NO: 661450 - DNA, 25 bp, Rattus norvegicus
ttagtcattatgtttgctcccttga

SEQ ID NO: 661451 - DNA, 25 bp, Rattus norvegicus
ttagtccaaagccaactcaacgtct

SEQ ID NO: 661452 - DNA, 25 bp, Rattus norvegicus
ttagtccaaagcgaactcaacgtct

SEQ ID NO: 661453 - DNA, 25 bp, Rattus norvegicus
ttagtccaatggctgttgtttaaat

SEQ ID NO: 661454 - DNA, 25 bp, Rattus norvegicus
ttagtccaatgggtgttgtttaaat

SEQ ID NO: 661455 - DNA, 25 bp, Rattus norvegicus
ttagtccatgctcactcttaaatag

SEQ ID NO: 661456 - DNA, 25 bp, Rattus norvegicus
ttagtccatgctgactcttaaatag

SEQ ID NO: 661457 - DNA, 25 bp, Rattus norvegicus
ttagtcccaacacaggttctaccca

SEQ ID NO: 661458 - DNA, 25 bp, Rattus norvegicus
ttagtcccaacagaggttctaccca

SEQ ID NO: 661459 - DNA, 25 bp, Rattus norvegicus
ttagtcccatacacaccagcaaatg

SEQ ID NO: 661460 - DNA, 25 bp, Rattus norvegicus
ttagtcccatactcaccagcaaatg

SEQ ID NO: 661461 - DNA, 25 bp, Rattus norvegicus
ttagtccccaagcagagcattccag

SEQ ID NO: 661462 - DNA, 25 bp, Rattus norvegicus
ttagtccccaaggagagcattccag

SEQ ID NO: 661463 - DNA, 25 bp, Rattus norvegicus
ttagtcccctgtctcctttgctcag

SEQ ID NO: 661464 - DNA, 25 bp, Rattus norvegicus
ttagtcccctgtgtcctttgctcag

SEQ ID NO: 661465 - DNA, 25 bp, Rattus norvegicus
ttagtcccctttaaatgtggtgtct

SEQ ID NO: 661466 - DNA, 25 bp, Rattus norvegicus
ttagtccccttttaatgtggtgtct

SEQ ID NO: 661467 - DNA, 25 bp, Rattus norvegicus
ttagtcccgctgcaagtacatggct

SEQ ID NO: 661468 - DNA, 25 bp, Rattus norvegicus
ttagtcccgctggaagtacatggct

SEQ ID NO: 661469 - DNA, 25 bp, Rattus norvegicus
ttagtcccggttccttttagcctct

SEQ ID NO: 661470 - DNA, 25 bp, Rattus norvegicus
ttagtcccggttgcttttagcctct

SEQ ID NO: 661471 - DNA, 25 bp, Rattus norvegicus
ttagtccctgtgctaaatacattcc

SEQ ID NO: 661472 - DNA, 25 bp, Rattus norvegicus
ttagtccctgtggtaaatacattcc

SEQ ID NO: 661473 - DNA, 25 bp, Rattus norvegicus
ttagtcccttatccaatcagttgaa

SEQ ID NO: 661474 - DNA, 25 bp, Rattus norvegicus
ttagtcccttatgcaatcagttgaa

SEQ ID NO: 661475 - DNA, 25 bp, Rattus norvegicus
ttagtccgctgcagcctcaatccgg

SEQ ID NO: 661476 - DNA, 25 bp, Rattus norvegicus
ttagtccgctgctgcctcaatccgg

SEQ ID NO: 661477 - DNA, 25 bp, Rattus norvegicus
ttagtcctacacctagtcaaactct

SEQ ID NO: 661478 - DNA, 25 bp, Rattus norvegicus
ttagtcctacacgtagtcaaactct

SEQ ID NO: 661479 - DNA, 25 bp, Rattus norvegicus
ttagtcctacttccaaattgatttt

SEQ ID NO: 661480 - DNA, 25 bp, Rattus norvegicus
ttagtcctacttgcaaattgatttt

SEQ ID NO: 661481 - DNA, 25 bp, Rattus norvegicus
ttagtcctgatgcttatctcggtgt

SEQ ID NO: 661482 - DNA, 25 bp, Rattus norvegicus
ttagtcctgatggttatctcggtgt

SEQ ID NO: 661483 - DNA, 25 bp, Rattus norvegicus
ttagtcctgtggagtgtttctgcct

SEQ ID NO: 661484 - DNA, 25 bp, Rattus norvegicus
ttagtcctgtggtgtgtttctgcct

SEQ ID NO: 661485 - DNA, 25 bp, Rattus norvegicus
ttagtccttgtgactctgtgtgata

SEQ ID NO: 661486 - DNA, 25 bp, Rattus norvegicus
ttagtccttgtgtctctgtgtgata

SEQ ID NO: 661487 - DNA, 25 bp, Rattus norvegicus
ttagtcctttggaagctttggcttt

SEQ ID NO: 661488 - DNA, 25 bp, Rattus norvegicus
ttagtcctttggtagctttggcttt

SEQ ID NO: 661489 - DNA, 25 bp, Rattus norvegicus
ttagtcgattcacgtcctccttcca

SEQ ID NO: 661490 - DNA, 25 bp, Rattus norvegicus
ttagtcgattcaggtcctccttcca

SEQ ID NO: 661491 - DNA, 25 bp, Rattus norvegicus
ttagtcgccctaatacgtgcagcag

SEQ ID NO: 661492 - DNA, 25 bp, Rattus norvegicus
ttagtcgccctattacgtgcagcag

SEQ ID NO: 661493 - DNA, 25 bp, Rattus norvegicus
ttagtcgctcgtctccggctggcag

SEQ ID NO: 661494 - DNA, 25 bp, Rattus norvegicus
ttagtcgctcgtgtccggctggcag

SEQ ID NO: 661495 - DNA, 25 bp, Rattus norvegicus
ttagtcgcttggacccagtgattat

SEQ ID NO: 661496 - DNA, 25 bp, Rattus norvegicus
ttagtcgcttggtcccagtgattat

SEQ ID NO: 661497 - DNA, 25 bp, Rattus norvegicus
ttagtcggcctcagtcaagattgca

SEQ ID NO: 661498 - DNA, 25 bp, Rattus norvegicus
ttagtcggcctctgtcaagattgca

SEQ ID NO: 661499 - DNA, 25 bp, Rattus norvegicus
ttagtcggctgcagctgggacatgc

SEQ ID NO: 661500 - DNA, 25 bp, Rattus norvegicus
ttagtcggctgctgctgggacatgc

SEQ ID NO: 661501 - DNA, 25 bp, Rattus norvegicus
ttagtctacccacagatgctcctga

SEQ ID NO: 661502 - DNA, 25 bp, Rattus norvegicus
ttagtctacccagagatgctcctga

SEQ ID NO: 661503 - DNA, 25 bp, Rattus norvegicus
ttagtctcagcgaggcgacaacacc

SEQ ID NO: 661504 - DNA, 25 bp, Rattus norvegicus
ttagtctcagcgtggcgacaacacc

SEQ ID NO: 661505 - DNA, 25 bp, Rattus norvegicus
ttagtctcattaccatcacactcca

SEQ ID NO: 661506 - DNA, 25 bp, Rattus norvegicus
ttagtctcattagcatcacactcca

SEQ ID NO: 661507 - DNA, 25 bp, Rattus norvegicus
ttagtctccacgacattttaacaag

SEQ ID NO: 661508 - DNA, 25 bp, Rattus norvegicus
ttagtctccacgtcattttaacaag

SEQ ID NO: 661509 - DNA, 25 bp, Rattus norvegicus
ttagtctccggtatgcatcagctgc

SEQ ID NO: 661510 - DNA, 25 bp, Rattus norvegicus
ttagtctccggtttgcatcagctgc

SEQ ID NO: 661511 - DNA, 25 bp, Rattus norvegicus
ttagtctcctctaccgaatgtagag

SEQ ID NO: 661512 - DNA, 25 bp, Rattus norvegicus
ttagtctcctcttccgaatgtagag

SEQ ID NO: 661513 - DNA, 25 bp, Rattus norvegicus
ttagtctcggagcaaacggtgcaga

SEQ ID NO: 661514 - DNA, 25 bp, Rattus norvegicus
ttagtctcggaggaaacggtgcaga

SEQ ID NO: 661515 - DNA, 25 bp, Rattus norvegicus
ttagtctctcagcttgacctttcga

SEQ ID NO: 661516 - DNA, 25 bp, Rattus norvegicus
ttagtctctcaggttgacctttcga

SEQ ID NO: 661517 - DNA, 25 bp, Rattus norvegicus
ttagtctcttacatatccttgattg

SEQ ID NO: 661518 - DNA, 25 bp, Rattus norvegicus
ttagtctcttacttatccttgattg

SEQ ID NO: 661519 - DNA, 25 bp, Rattus norvegicus
ttagtctgcactctgtccatgacca

SEQ ID NO: 661520 - DNA, 25 bp, Rattus norvegicus
ttagtctgcactgtgtccatgacca

SEQ ID NO: 661521 - DNA, 25 bp, Rattus norvegicus
ttagtctgcagccataaccaccctg

SEQ ID NO: 661522 - DNA, 25 bp, Rattus norvegicus
ttagtctgcagcgataaccaccctg

SEQ ID NO: 661523 - DNA, 25 bp, Rattus norvegicus
ttagtctgctttctgctcagtgctg

SEQ ID NO: 661524 - DNA, 25 bp, Rattus norvegicus
ttagtctgctttcttctacaaccca

SEQ ID NO: 661525 - DNA, 25 bp, Rattus norvegicus
ttagtctgctttgtgctcagtgctg

SEQ ID NO: 661526 - DNA, 25 bp, Rattus norvegicus
ttagtctgctttgttctacaaccca

SEQ ID NO: 661527 - DNA, 25 bp, Rattus norvegicus
ttagtctggaacatcagccgggcat

SEQ ID NO: 661528 - DNA, 25 bp, Rattus norvegicus
ttagtctggaacttcagccgggcat

SEQ ID NO: 661529 - DNA, 25 bp, Rattus norvegicus
ttagtctggatacccgctgtgtccc

SEQ ID NO: 661530 - DNA, 25 bp, Rattus norvegicus
ttagtctggatagccgctgtgtccc

SEQ ID NO: 661531 - DNA, 25 bp, Rattus norvegicus
ttagtcttccagagattggcccaac

SEQ ID NO: 661532 - DNA, 25 bp, Rattus norvegicus
ttagtcttccagtgattggcccaac

SEQ ID NO: 661533 - DNA, 25 bp, Rattus norvegicus
ttagtcttcttcctacgtgggtaga

SEQ ID NO: 661534 - DNA, 25 bp, Rattus norvegicus
ttagtcttcttcgtacgtgggtaga

SEQ ID NO: 661535 - DNA, 25 bp, Rattus norvegicus
ttagtcttggtgacctcccttactt

SEQ ID NO: 661536 - DNA, 25 bp, Rattus norvegicus
ttagtcttggtgtcctcccttactt

SEQ ID NO: 661537 - DNA, 25 bp, Rattus norvegicus
ttagtctttgcaaatggatctgtca

SEQ ID NO: 661538 - DNA, 25 bp, Rattus norvegicus
ttagtctttgcatatggatctgtca

SEQ ID NO: 661539 - DNA, 25 bp, Rattus norvegicus
ttagtgaaaataatcctgctgaggc

SEQ ID NO: 661540 - DNA, 25 bp, Rattus norvegicus
ttagtgaaaatattcctgctgaggc

SEQ ID NO: 661541 - DNA, 25 bp, Rattus norvegicus
ttagtgaactgtcggaacgccttcg

SEQ ID NO: 661542 - DNA, 25 bp, Rattus norvegicus
ttagtgaactgtgggaacgccttcg

SEQ ID NO: 661543 - DNA, 25 bp, Rattus norvegicus
ttagtgaagccaagacctgcgtcaa

SEQ ID NO: 661544 - DNA, 25 bp, Rattus norvegicus
ttagtgaagccatgacctgcgtcaa

SEQ ID NO: 661545 - DNA, 25 bp, Rattus norvegicus
ttagtgaaggcccagccatttgcag

SEQ ID NO: 661546 - DNA, 25 bp, Rattus norvegicus
ttagtgaaggccgagccatttgcag

SEQ ID NO: 661547 - DNA, 25 bp, Rattus norvegicus
ttagtgaaggcgctgtcctggtctc

SEQ ID NO: 661548 - DNA, 25 bp, Rattus norvegicus
ttagtgaaggcggtgtcctggtctc

SEQ ID NO: 661549 - DNA, 25 bp, Rattus norvegicus
ttagtgacagtgagtcccaggactt

SEQ ID NO: 661550 - DNA, 25 bp, Rattus norvegicus
ttagtgacagtgtgtcccaggactt

SEQ ID NO: 661551 - DNA, 25 bp, Rattus norvegicus
ttagtgactttcagggatgttaccc

SEQ ID NO: 661552 - DNA, 25 bp, Rattus norvegicus
ttagtgactttctgggatgttaccc

SEQ ID NO: 661553 - DNA, 25 bp, Rattus norvegicus
ttagtgagcgccctggcttctcaac

SEQ ID NO: 661554 - DNA, 25 bp, Rattus norvegicus
ttagtgagcgccgtggcttctcaac

SEQ ID NO: 661555 - DNA, 25 bp, Rattus norvegicus
ttagtgagcgctcccacctatcgtg

SEQ ID NO: 661556 - DNA, 25 bp, Rattus norvegicus
ttagtgagcgctgccacctatcgtg

SEQ ID NO: 661557 - DNA, 25 bp, Rattus norvegicus
ttagtgaggtctaaggcatccaccc

SEQ ID NO: 661558 - DNA, 25 bp, Rattus norvegicus
ttagtgaggtcttaggcatccaccc

SEQ ID NO: 661559 - DNA, 25 bp, Rattus norvegicus
ttagtgatcaccatctgtccgtcgg

SEQ ID NO: 661560 - DNA, 25 bp, Rattus norvegicus
ttagtgatcaccttctgtccgtcgg

SEQ ID NO: 661561 - DNA, 25 bp, Rattus norvegicus
ttagtgatgctaatgtgcgcccctg

SEQ ID NO: 661562 - DNA, 25 bp, Rattus norvegicus
ttagtgatgctattgtgcgcccctg

SEQ ID NO: 661563 - DNA, 25 bp, Rattus norvegicus
ttagtgatgctgattcctacaccgt

SEQ ID NO: 661564 - DNA, 25 bp, Rattus norvegicus
ttagtgatgctgtttcctacaccgt

SEQ ID NO: 661565 - DNA, 25 bp, Rattus norvegicus
ttagtgatggctccttcctgcattc

SEQ ID NO: 661566 - DNA, 25 bp, Rattus norvegicus
ttagtgatggctgcttcctgcattc

SEQ ID NO: 661567 - DNA, 25 bp, Rattus norvegicus
ttagtgattacaacagcatgctctg

SEQ ID NO: 661568 - DNA, 25 bp, Rattus norvegicus
ttagtgattacatcagcatgctctg

SEQ ID NO: 661569 - DNA, 25 bp, Rattus norvegicus
ttagtgcaattccagggacccgtgt

SEQ ID NO: 661570 - DNA, 25 bp, Rattus norvegicus
ttagtgcaattcgagggacccgtgt

SEQ ID NO: 661571 - DNA, 25 bp, Rattus norvegicus
ttagtgcagagacccgttcgcgcta

SEQ ID NO: 661572 - DNA, 25 bp, Rattus norvegicus
ttagtgcagagagccgttcgcgcta

SEQ ID NO: 661573 - DNA, 25 bp, Rattus norvegicus
ttagtgcagtacagctttgccatgt

SEQ ID NO: 661574 - DNA, 25 bp, Rattus norvegicus
ttagtgcagtactgctttgccatgt

SEQ ID NO: 661575 - DNA, 25 bp, Rattus norvegicus
ttagtgcatctcactgtatgtacag

SEQ ID NO: 661576 - DNA, 25 bp, Rattus norvegicus
ttagtgcatctctctgtatgtacag

SEQ ID NO: 661577 - DNA, 25 bp, Rattus norvegicus
ttagtgccagtacacaagcctgtcc

SEQ ID NO: 661578 - DNA, 25 bp, Rattus norvegicus
ttagtgccagtagacaagcctgtcc

SEQ ID NO: 661579 - DNA, 25 bp, Rattus norvegicus
ttagtgcccccccttgaagcaataa

SEQ ID NO: 661580 - DNA, 25 bp, Rattus norvegicus
ttagtgccccccgttgaagcaataa

SEQ ID NO: 661581 - DNA, 25 bp, Rattus norvegicus
ttagtgccctggcacggccagatat

SEQ ID NO: 661582 - DNA, 25 bp, Rattus norvegicus
ttagtgccctgggacggccagatat

SEQ ID NO: 661583 - DNA, 25 bp, Rattus norvegicus
ttagtgcgcaccagggctccaagta

SEQ ID NO: 661584 - DNA, 25 bp, Rattus norvegicus
ttagtgcgcacctgggctccaagta

SEQ ID NO: 661585 - DNA, 25 bp, Rattus norvegicus
ttagtgctacttcacattcctcctc

SEQ ID NO: 661586 - DNA, 25 bp, Rattus norvegicus
ttagtgctacttgacattcctcctc

SEQ ID NO: 661587 - DNA, 25 bp, Rattus norvegicus
ttagtgctcaatctgggagggccca

SEQ ID NO: 661588 - DNA, 25 bp, Rattus norvegicus
ttagtgctcaatgtgggagggccca

SEQ ID NO: 661589 - DNA, 25 bp, Rattus norvegicus
ttagtgctccctcataaatgatgtt

SEQ ID NO: 661590 - DNA, 25 bp, Rattus norvegicus
ttagtgctccctgataaatgatgtt

SEQ ID NO: 661591 - DNA, 25 bp, Rattus norvegicus
ttagtgctcgttcagatgtccatct

SEQ ID NO: 661592 - DNA, 25 bp, Rattus norvegicus
ttagtgctcgttgagatgtccatct

SEQ ID NO: 661593 - DNA, 25 bp, Rattus norvegicus
ttagtgctgagactgcggagtgtgt

SEQ ID NO: 661594 - DNA, 25 bp, Rattus norvegicus
ttagtgctgagagtgcggagtgtgt

SEQ ID NO: 661595 - DNA, 25 bp, Rattus norvegicus
ttagtgctgcaccagactcttgtgt

SEQ ID NO: 661596 - DNA, 25 bp, Rattus norvegicus
ttagtgctgcacgagactcttgtgt

SEQ ID NO: 661597 - DNA, 25 bp, Rattus norvegicus
ttagtgctggcacctgacactgtct

SEQ ID NO: 661598 - DNA, 25 bp, Rattus norvegicus
ttagtgctggcagctgacactgtct

SEQ ID NO: 661599 - DNA, 25 bp, Rattus norvegicus
ttagtgcttcccaccatatgactta

SEQ ID NO: 661600 - DNA, 25 bp, Rattus norvegicus
ttagtgcttccctccatatgactta

SEQ ID NO: 661601 - DNA, 25 bp, Rattus norvegicus
ttagtgcttttacttatgccccacc

SEQ ID NO: 661602 - DNA, 25 bp, Rattus norvegicus
ttagtgcttttagttatgccccacc

SEQ ID NO: 661603 - DNA, 25 bp, Rattus norvegicus
ttagtggaacaccagcagaaggtac

SEQ ID NO: 661604 - DNA, 25 bp, Rattus norvegicus
ttagtggaacacgagcagaaggtac

SEQ ID NO: 661605 - DNA, 25 bp, Rattus norvegicus
ttagtggaccctcaaaagtgatatt

SEQ ID NO: 661606 - DNA, 25 bp, Rattus norvegicus
ttagtggaccctgaaaagtgatatt

SEQ ID NO: 661607 - DNA, 25 bp, Rattus norvegicus
ttagtggatggcacctgttcctaat

SEQ ID NO: 661608 - DNA, 25 bp, Rattus norvegicus
ttagtggatggctcctgttcctaat

SEQ ID NO: 661609 - DNA, 25 bp, Rattus norvegicus
ttagtggcagccattacatattaag

SEQ ID NO: 661610 - DNA, 25 bp, Rattus norvegicus
ttagtggcagcctttacatattaag

SEQ ID NO: 661611 - DNA, 25 bp, Rattus norvegicus
ttagtggccccacggtacaaaatgg

SEQ ID NO: 661612 - DNA, 25 bp, Rattus norvegicus
ttagtggccccagggtacaaaatgg

SEQ ID NO: 661613 - DNA, 25 bp, Rattus norvegicus
ttagtggccgagacagtcacacgac

SEQ ID NO: 661614 - DNA, 25 bp, Rattus norvegicus
ttagtggccgagtcagtcacacgac

SEQ ID NO: 661615 - DNA, 25 bp, Rattus norvegicus
ttagtggctcttccagcccagtaaa

SEQ ID NO: 661616 - DNA, 25 bp, Rattus norvegicus
ttagtggctcttgcagcccagtaaa

SEQ ID NO: 661617 - DNA, 25 bp, Rattus norvegicus
ttagtggctgccattcttggcacat

SEQ ID NO: 661618 - DNA, 25 bp, Rattus norvegicus
ttagtggctgcctttcttggcacat

SEQ ID NO: 661619 - DNA, 25 bp, Rattus norvegicus
ttagtggtgggaactttcctgaata

SEQ ID NO: 661620 - DNA, 25 bp, Rattus norvegicus
ttagtggtgggatctttcctgaata

SEQ ID NO: 661621 - DNA, 25 bp, Rattus norvegicus
ttagtggttgaactgtctagcattc

SEQ ID NO: 661622 - DNA, 25 bp, Rattus norvegicus
ttagtggttgaagtgtctagcattc

SEQ ID NO: 661623 - DNA, 25 bp, Rattus norvegicus
ttagtggttgggaacacgcgctgcc

SEQ ID NO: 661624 - DNA, 25 bp, Rattus norvegicus
ttagtggttgggtacacgcgctgcc

SEQ ID NO: 661625 - DNA, 25 bp, Rattus norvegicus
ttagtggtttcccatgtaacacaca

SEQ ID NO: 661626 - DNA, 25 bp, Rattus norvegicus
ttagtggtttccgatgtaacacaca

SEQ ID NO: 661627 - DNA, 25 bp, Rattus norvegicus
ttagtggttttaaggctcagagaca

SEQ ID NO: 661628 - DNA, 25 bp, Rattus norvegicus
ttagtggttttatggctcagagaca

SEQ ID NO: 661629 - DNA, 25 bp, Rattus norvegicus
ttagtgtaaacaccgctcacatcac

SEQ ID NO: 661630 - DNA, 25 bp, Rattus norvegicus
ttagtgtaaacagcgctcacatcac

SEQ ID NO: 661631 - DNA, 25 bp, Rattus norvegicus
ttagtgtactctctacttgatcaga

SEQ ID NO: 661632 - DNA, 25 bp, Rattus norvegicus
ttagtgtactctgtacttgatcaga

SEQ ID NO: 661633 - DNA, 25 bp, Rattus norvegicus
ttagtgtactttagctgtgtatttc

SEQ ID NO: 661634 - DNA, 25 bp, Rattus norvegicus
ttagtgtacttttgctgtgtatttc

SEQ ID NO: 661635 - DNA, 25 bp, Rattus norvegicus
ttagtgtcacagacctacagcttag

SEQ ID NO: 661636 - DNA, 25 bp, Rattus norvegicus
ttagtgtcacagtcctacagcttag

SEQ ID NO: 661637 - DNA, 25 bp, Rattus norvegicus
ttagtgtcctaactttcccacagat

SEQ ID NO: 661638 - DNA, 25 bp, Rattus norvegicus
ttagtgtcctaagtttcccacagat

SEQ ID NO: 661639 - DNA, 25 bp, Rattus norvegicus
ttagtgtcctcaacgggtctgatac

SEQ ID NO: 661640 - DNA, 25 bp, Rattus norvegicus
ttagtgtcctcatcgggtctgatac

SEQ ID NO: 661641 - DNA, 25 bp, Rattus norvegicus
ttagtgtcctccaccagaccgtgag

SEQ ID NO: 661642 - DNA, 25 bp, Rattus norvegicus
ttagtgtcctcctccagaccgtgag

SEQ ID NO: 661643 - DNA, 25 bp, Rattus norvegicus
ttagtgtgccttaccctttatgcag

SEQ ID NO: 661644 - DNA, 25 bp, Rattus norvegicus
ttagtgtgcctttccctttatgcag

SEQ ID NO: 661645 - DNA, 25 bp, Rattus norvegicus
ttagtgtgtctcacaatggttccat

SEQ ID NO: 661646 - DNA, 25 bp, Rattus norvegicus
ttagtgtgtctctcaatggttccat

SEQ ID NO: 661647 - DNA, 25 bp, Rattus norvegicus
ttagtgtgttaaacctctcctgctt

SEQ ID NO: 661648 - DNA, 25 bp, Rattus norvegicus
ttagtgtgttaatcctctcctgctt

SEQ ID NO: 661649 - DNA, 25 bp, Rattus norvegicus
ttagtgttaacacccttcctcatgg

SEQ ID NO: 661650 - DNA, 25 bp, Rattus norvegicus
ttagtgttaacagccttcctcatgg

SEQ ID NO: 661651 - DNA, 25 bp, Rattus norvegicus
ttagtgttcgtcagcttctttacct

SEQ ID NO: 661652 - DNA, 25 bp, Rattus norvegicus
ttagtgttcgtctgcttctttacct

SEQ ID NO: 661653 - DNA, 25 bp, Rattus norvegicus
ttagtgttgctcagttccatggttc

SEQ ID NO: 661654 - DNA, 25 bp, Rattus norvegicus
ttagtgttgctctgttccatggttc

SEQ ID NO: 661655 - DNA, 25 bp, Rattus norvegicus
ttagtgtttcatctcaggccttcag

SEQ ID NO: 661656 - DNA, 25 bp, Rattus norvegicus
ttagtgtttcatgtcaggccttcag

SEQ ID NO: 661657 - DNA, 25 bp, Rattus norvegicus
ttagtgtttgtcagggcgtggacct

SEQ ID NO: 661658 - DNA, 25 bp, Rattus norvegicus
ttagtgtttgtctgggcgtggacct

SEQ ID NO: 661659 - DNA, 25 bp, Rattus norvegicus
ttagttaaaattcctgtgcctccag

SEQ ID NO: 661660 - DNA, 25 bp, Rattus norvegicus
ttagttaaaattgctgtgcctccag

SEQ ID NO: 661661 - DNA, 25 bp, Rattus norvegicus
ttagttaagcatcttactctctaac

SEQ ID NO: 661662 - DNA, 25 bp, Rattus norvegicus
ttagttaagcatgttactctctaac

SEQ ID NO: 661663 - DNA, 25 bp, Rattus norvegicus
ttagttacacgtcccttctagggac

SEQ ID NO: 661664 - DNA, 25 bp, Rattus norvegicus
ttagttacacgtgccttctagggac

SEQ ID NO: 661665 - DNA, 25 bp, Rattus norvegicus
ttagttacactcattgctgcaatat

SEQ ID NO: 661666 - DNA, 25 bp, Rattus norvegicus
ttagttacactctttgctgcaatat

SEQ ID NO: 661667 - DNA, 25 bp, Rattus norvegicus
ttagttacagttcagggcaggcccc

SEQ ID NO: 661668 - DNA, 25 bp, Rattus norvegicus
ttagttacagttgagggcaggcccc

SEQ ID NO: 661669 - DNA, 25 bp, Rattus norvegicus
ttagttacccagatgcttgagtgca

SEQ ID NO: 661670 - DNA, 25 bp, Rattus norvegicus
ttagttacccagttgcttgagtgca

SEQ ID NO: 661671 - DNA, 25 bp, Rattus norvegicus
ttagttacctaacactgcactcact

SEQ ID NO: 661672 - DNA, 25 bp, Rattus norvegicus
ttagttacctaagactgcactcact

SEQ ID NO: 661673 - DNA, 25 bp, Rattus norvegicus
ttagttagactcacacccagctgtt

SEQ ID NO: 661674 - DNA, 25 bp, Rattus norvegicus
ttagttagactctcacccagctgtt

SEQ ID NO: 661675 - DNA, 25 bp, Rattus norvegicus
ttagttatactcaacagacgtttta

SEQ ID NO: 661676 - DNA, 25 bp, Rattus norvegicus
ttagttatactctacagacgtttta

SEQ ID NO: 661677 - DNA, 25 bp, Rattus norvegicus
ttagttatgctaattcctgctgtat

SEQ ID NO: 661678 - DNA, 25 bp, Rattus norvegicus
ttagttatgctatttcctgctgtat

SEQ ID NO: 661679 - DNA, 25 bp, Rattus norvegicus
ttagttatgtctatcattggccacg

SEQ ID NO: 661680 - DNA, 25 bp, Rattus norvegicus
ttagttatgtctttcattggccacg

SEQ ID NO: 661681 - DNA, 25 bp, Rattus norvegicus
ttagttatttttcccagcagcgtga

SEQ ID NO: 661682 - DNA, 25 bp, Rattus norvegicus
ttagttatttttgccagcagcgtga

SEQ ID NO: 661683 - DNA, 25 bp, Rattus norvegicus
ttagttcacggtcgcctcagactag

SEQ ID NO: 661684 - DNA, 25 bp, Rattus norvegicus
ttagttcacggtggcctcagactag

SEQ ID NO: 661685 - DNA, 25 bp, Rattus norvegicus
ttagttcagctaaagtttttgttaa

SEQ ID NO: 661686 - DNA, 25 bp, Rattus norvegicus
ttagttcagctatagtttttgttaa

SEQ ID NO: 661687 - DNA, 25 bp, Rattus norvegicus
ttagttcaggcacacacttgtggct

SEQ ID NO: 661688 - DNA, 25 bp, Rattus norvegicus
ttagttcaggcagacacttgtggct

SEQ ID NO: 661689 - DNA, 25 bp, Rattus norvegicus
ttagttcagttcacgttttctgtcc

SEQ ID NO: 661690 - DNA, 25 bp, Rattus norvegicus
ttagttcagttctcgttttctgtcc

SEQ ID NO: 661691 - DNA, 25 bp, Rattus norvegicus
ttagttcataggatggcaggccagg

SEQ ID NO: 661692 - DNA, 25 bp, Rattus norvegicus
ttagttcataggttggcaggccagg

SEQ ID NO: 661693 - DNA, 25 bp, Rattus norvegicus
ttagttcatgttattactgcccctg

SEQ ID NO: 661694 - DNA, 25 bp, Rattus norvegicus
ttagttcatgtttttactgcccctg

SEQ ID NO: 661695 - DNA, 25 bp, Rattus norvegicus
ttagttccagggaatcaaaatcgct

SEQ ID NO: 661696 - DNA, 25 bp, Rattus norvegicus
ttagttccagggtatcaaaatcgct

SEQ ID NO: 661697 - DNA, 25 bp, Rattus norvegicus
ttagttcccttgaggtccaggtaag

SEQ ID NO: 661698 - DNA, 25 bp, Rattus norvegicus
ttagttcccttgtggtccaggtaag

SEQ ID NO: 661699 - DNA, 25 bp, Rattus norvegicus
ttagttccgacacgacacattgctt

SEQ ID NO: 661700 - DNA, 25 bp, Rattus norvegicus
ttagttccgacaggacacattgctt

SEQ ID NO: 661701 - DNA, 25 bp, Rattus norvegicus
ttagttcctcaacgctctggctgct

SEQ ID NO: 661702 - DNA, 25 bp, Rattus norvegicus
ttagttcctcaaggctctggctgct

SEQ ID NO: 661703 - DNA, 25 bp, Rattus norvegicus
ttagttcctccacggcatagtccag

SEQ ID NO: 661704 - DNA, 25 bp, Rattus norvegicus
ttagttcctccagggcatagtccag

SEQ ID NO: 661705 - DNA, 25 bp, Rattus norvegicus
ttagttcctgtgcatcatttgatga

SEQ ID NO: 661706 - DNA, 25 bp, Rattus norvegicus
ttagttcctgtggatcatttgatga

SEQ ID NO: 661707 - DNA, 25 bp, Rattus norvegicus
ttagttccttatctgcgccccaaag

SEQ ID NO: 661708 - DNA, 25 bp, Rattus norvegicus
ttagttccttatgtgcgccccaaag

SEQ ID NO: 661709 - DNA, 25 bp, Rattus norvegicus
ttagttcgagccaccgcaatagagc

SEQ ID NO: 661710 - DNA, 25 bp, Rattus norvegicus
ttagttcgagcctccgcaatagagc

SEQ ID NO: 661711 - DNA, 25 bp, Rattus norvegicus
ttagttcgtttaccgggacgagctg

SEQ ID NO: 661712 - DNA, 25 bp, Rattus norvegicus
ttagttcgtttagcgggacgagctg

SEQ ID NO: 661713 - DNA, 25 bp, Rattus norvegicus
ttagttctcaacactgtcattcatg

SEQ ID NO: 661714 - DNA, 25 bp, Rattus norvegicus
ttagttctcaactctgtcattcatg

SEQ ID NO: 661715 - DNA, 25 bp, Rattus norvegicus
ttagttctcctaacttagcctctga

SEQ ID NO: 661716 - DNA, 25 bp, Rattus norvegicus
ttagttctcctacttccacaatgtg

SEQ ID NO: 661717 - DNA, 25 bp, Rattus norvegicus
ttagttctcctagttccacaatgtg

SEQ ID NO: 661718 - DNA, 25 bp, Rattus norvegicus
ttagttctcctatcttagcctctga

SEQ ID NO: 661719 - DNA, 25 bp, Rattus norvegicus
ttagttctgtccaagatctcttgca

SEQ ID NO: 661720 - DNA, 25 bp, Rattus norvegicus
ttagttctgtcctagatctcttgca

SEQ ID NO: 661721 - DNA, 25 bp, Rattus norvegicus
ttagttcttagtctggttcacccct

SEQ ID NO: 661722 - DNA, 25 bp, Rattus norvegicus
ttagttcttagtgtggttcacccct

SEQ ID NO: 661723 - DNA, 25 bp, Rattus norvegicus
ttagttcttggcagaagtccacctg

SEQ ID NO: 661724 - DNA, 25 bp, Rattus norvegicus
ttagttcttggctgaagtccacctg

SEQ ID NO: 661725 - DNA, 25 bp, Rattus norvegicus
ttagttcttgtaaggcctgtattca

SEQ ID NO: 661726 - DNA, 25 bp, Rattus norvegicus
ttagttcttgtatggcctgtattca

SEQ ID NO: 661727 - DNA, 25 bp, Rattus norvegicus
ttagttcttgttcttctttcggtga

SEQ ID NO: 661728 - DNA, 25 bp, Rattus norvegicus
ttagttcttgttgttctttcggtga

SEQ ID NO: 661729 - DNA, 25 bp, Rattus norvegicus
ttagttctttctctgccctgatatt

SEQ ID NO: 661730 - DNA, 25 bp, Rattus norvegicus
ttagttctttctgtgccctgatatt

SEQ ID NO: 661731 - DNA, 25 bp, Rattus norvegicus
ttagttgacctccacaccagctaag

SEQ ID NO: 661732 - DNA, 25 bp, Rattus norvegicus
ttagttgacctcgacaccagctaag

SEQ ID NO: 661733 - DNA, 25 bp, Rattus norvegicus
ttagttgagcctagtcattcttcgc

SEQ ID NO: 661734 - DNA, 25 bp, Rattus norvegicus
ttagttgagccttgtcattcttcgc

SEQ ID NO: 661735 - DNA, 25 bp, Rattus norvegicus
ttagttgccgttcaaggagcctccg

SEQ ID NO: 661736 - DNA, 25 bp, Rattus norvegicus
ttagttgccgttgaaggagcctccg

SEQ ID NO: 661737 - DNA, 25 bp, Rattus norvegicus
ttagttgccttcacgttttaattgg

SEQ ID NO: 661738 - DNA, 25 bp, Rattus norvegicus
ttagttgccttctcgttttaattgg

SEQ ID NO: 661739 - DNA, 25 bp, Rattus norvegicus
ttagttgctcagctgatgcacgcct

SEQ ID NO: 661740 - DNA, 25 bp, Rattus norvegicus
ttagttgctcaggtgatgcacgcct

SEQ ID NO: 661741 - DNA, 25 bp, Rattus norvegicus
ttagttgcttagattccccatcagt

SEQ ID NO: 661742 - DNA, 25 bp, Rattus norvegicus
ttagttgcttagtttccccatcagt

SEQ ID NO: 661743 - DNA, 25 bp, Rattus norvegicus
ttagttgctttgaagccaaggctgg

SEQ ID NO: 661744 - DNA, 25 bp, Rattus norvegicus
ttagttgctttgtagccaaggctgg

SEQ ID NO: 661745 - DNA, 25 bp, Rattus norvegicus
ttagttggctttctacctgtggcac

SEQ ID NO: 661746 - DNA, 25 bp, Rattus norvegicus
ttagttggctttgtacctgtggcac

SEQ ID NO: 661747 - DNA, 25 bp, Rattus norvegicus
ttagttgggttcacagagtctcctg

SEQ ID NO: 661748 - DNA, 25 bp, Rattus norvegicus
ttagttgggttctcagagtctcctg

SEQ ID NO: 661749 - DNA, 25 bp, Rattus norvegicus
ttagttgtccccaacgtcatgggca

SEQ ID NO: 661750 - DNA, 25 bp, Rattus norvegicus
ttagttgtcccctacgtcatgggca

SEQ ID NO: 661751 - DNA, 25 bp, Rattus norvegicus
ttagttgtgaatactggctctccag

SEQ ID NO: 661752 - DNA, 25 bp, Rattus norvegicus
ttagttgtgaattctggctctccag

SEQ ID NO: 661753 - DNA, 25 bp, Rattus norvegicus
ttagtttaacttctgcacctttgct

SEQ ID NO: 661754 - DNA, 25 bp, Rattus norvegicus
ttagtttaacttgtgcacctttgct

SEQ ID NO: 661755 - DNA, 25 bp, Rattus norvegicus
ttagtttaccatctgcatcttttcc

SEQ ID NO: 661756 - DNA, 25 bp, Rattus norvegicus
ttagtttaccatgtgcatcttttcc

SEQ ID NO: 661757 - DNA, 25 bp, Rattus norvegicus
ttagtttacccaattctgcatctcc

SEQ ID NO: 661758 - DNA, 25 bp, Rattus norvegicus
ttagtttacccatttctgcatctcc

SEQ ID NO: 661759 - DNA, 25 bp, Rattus norvegicus
ttagtttatagacgagcctcctctg

SEQ ID NO: 661760 - DNA, 25 bp, Rattus norvegicus
ttagtttatagaggagcctcctctg

SEQ ID NO: 661761 - DNA, 25 bp, Rattus norvegicus
ttagtttatcagaagttcacctcga

SEQ ID NO: 661762 - DNA, 25 bp, Rattus norvegicus
ttagtttatcagtagttcacctcga

SEQ ID NO: 661763 - DNA, 25 bp, Rattus norvegicus
ttagtttccaaacaaggtttctctg

SEQ ID NO: 661764 - DNA, 25 bp, Rattus norvegicus
ttagtttccaaagaaggtttctctg

SEQ ID NO: 661765 - DNA, 25 bp, Rattus norvegicus
ttagtttccacactaaggtttgcct

SEQ ID NO: 661766 - DNA, 25 bp, Rattus norvegicus
ttagtttccacagtaaggtttgcct

SEQ ID NO: 661767 - DNA, 25 bp, Rattus norvegicus
ttagtttcccagcagattataagtg

SEQ ID NO: 661768 - DNA, 25 bp, Rattus norvegicus
ttagtttcccaggagattataagtg

SEQ ID NO: 661769 - DNA, 25 bp, Rattus norvegicus
ttagtttccctaatcatatccttgg

SEQ ID NO: 661770 - DNA, 25 bp, Rattus norvegicus
ttagtttccctattcatatccttgg

SEQ ID NO: 661771 - DNA, 25 bp, Rattus norvegicus
ttagtttcgaacacacggcggtcct

SEQ ID NO: 661772 - DNA, 25 bp, Rattus norvegicus
ttagtttcgaactcacggcggtcct

SEQ ID NO: 661773 - DNA, 25 bp, Rattus norvegicus
ttagtttctgccctcaggtggactc

SEQ ID NO: 661774 - DNA, 25 bp, Rattus norvegicus
ttagtttctgccgtcaggtggactc

SEQ ID NO: 661775 - DNA, 25 bp, Rattus norvegicus
ttagtttgaaccagtttccctctat

SEQ ID NO: 661776 - DNA, 25 bp, Rattus norvegicus
ttagtttgaacctgtttccctctat

SEQ ID NO: 661777 - DNA, 25 bp, Rattus norvegicus
ttagtttgacttccaccagtgtgtt

SEQ ID NO: 661778 - DNA, 25 bp, Rattus norvegicus
ttagtttgacttgcaccagtgtgtt

SEQ ID NO: 661779 - DNA, 25 bp, Rattus norvegicus
ttagtttgcagccttccgggtcagc

SEQ ID NO: 661780 - DNA, 25 bp, Rattus norvegicus
ttagtttgcagcgttccgggtcagc

SEQ ID NO: 661781 - DNA, 25 bp, Rattus norvegicus
ttagtttgctagctgccttaaggga

SEQ ID NO: 661782 - DNA, 25 bp, Rattus norvegicus
ttagtttgctaggtgccttaaggga

SEQ ID NO: 661783 - DNA, 25 bp, Rattus norvegicus
ttagtttggtgtatttgccctgcaa

SEQ ID NO: 661784 - DNA, 25 bp, Rattus norvegicus
ttagtttggtgtttttgccctgcaa

SEQ ID NO: 661785 - DNA, 25 bp, Rattus norvegicus
ttagttttacaaattccaagaggag

SEQ ID NO: 661786 - DNA, 25 bp, Rattus norvegicus
ttagttttacaatttccaagaggag

SEQ ID NO: 661787 - DNA, 25 bp, Rattus norvegicus
ttagttttatttaacacatctcatg

SEQ ID NO: 661788 - DNA, 25 bp, Rattus norvegicus
ttagttttattttacacatctcatg

SEQ ID NO: 661789 - DNA, 25 bp, Rattus norvegicus
ttagttttcaacacacagcggtctc

SEQ ID NO: 661790 - DNA, 25 bp, Rattus norvegicus
ttagttttcaactcacagcggtctc

SEQ ID NO: 661791 - DNA, 25 bp, Rattus norvegicus
ttagttttcagcacaccggtgggat

SEQ ID NO: 661792 - DNA, 25 bp, Rattus norvegicus
ttagttttcagctcaccggtgggat

SEQ ID NO: 661793 - DNA, 25 bp, Rattus norvegicus
ttagttttcagtaccttcatcccag

SEQ ID NO: 661794 - DNA, 25 bp, Rattus norvegicus
ttagttttcagtatccttgtgatgg

SEQ ID NO: 661795 - DNA, 25 bp, Rattus norvegicus
ttagttttcagttccttcatcccag

SEQ ID NO: 661796 - DNA, 25 bp, Rattus norvegicus
ttagttttcagtttccttgtgatgg

SEQ ID NO: 661797 - DNA, 25 bp, Rattus norvegicus
ttagttttccttcccatgagagcag

SEQ ID NO: 661798 - DNA, 25 bp, Rattus norvegicus
ttagttttccttgccatgagagcag

SEQ ID NO: 661799 - DNA, 25 bp, Rattus norvegicus
ttagttttctctcgctagtgggtgt

SEQ ID NO: 661800 - DNA, 25 bp, Rattus norvegicus
ttagttttctctggctagtgggtgt

SEQ ID NO: 661801 - DNA, 25 bp, Rattus norvegicus
ttagttttgctgattgtactccggc

SEQ ID NO: 661802 - DNA, 25 bp, Rattus norvegicus
ttagttttgctgtttgtactccggc

SEQ ID NO: 661803 - DNA, 25 bp, Rattus norvegicus
ttagttttggaacgccattcggctc

SEQ ID NO: 661804 - DNA, 25 bp, Rattus norvegicus
ttagttttggaaggccattcggctc

SEQ ID NO: 661805 - DNA, 25 bp, Rattus norvegicus
ttagttttgtttagtccagtccaag

SEQ ID NO: 661806 - DNA, 25 bp, Rattus norvegicus
ttagttttgttttgtccagtccaag

SEQ ID NO: 661807 - DNA, 25 bp, Rattus norvegicus
ttataaaaagatccacctccagccc

SEQ ID NO: 661808 - DNA, 25 bp, Rattus norvegicus
ttataaaaagatgcacctccagccc

SEQ ID NO: 661809 - DNA, 25 bp, Rattus norvegicus
ttataaaagtgtacctgtagagcag

SEQ ID NO: 661810 - DNA, 25 bp, Rattus norvegicus
ttataaaagtgttcctgtagagcag

SEQ ID NO: 661811 - DNA, 25 bp, Rattus norvegicus
ttataaacccagaatccttttgtga

SEQ ID NO: 661812 - DNA, 25 bp, Rattus norvegicus
ttataaacccagtatccttttgtga

SEQ ID NO: 661813 - DNA, 25 bp, Rattus norvegicus
ttataaactctgattcctagcctcc

SEQ ID NO: 661814 - DNA, 25 bp, Rattus norvegicus
ttataaactctgtttcctagcctcc

SEQ ID NO: 661815 - DNA, 25 bp, Rattus norvegicus
ttataaaggcagctgtcttcctgta

SEQ ID NO: 661816 - DNA, 25 bp, Rattus norvegicus
ttataaaggcaggtgtcttcctgta

SEQ ID NO: 661817 - DNA, 25 bp, Rattus norvegicus
ttataaataagtctccccaagatgg

SEQ ID NO: 661818 - DNA, 25 bp, Rattus norvegicus
ttataaataagtgtccccaagatgg

SEQ ID NO: 661819 - DNA, 25 bp, Rattus norvegicus
ttataaatctgaaccacagccctcc

SEQ ID NO: 661820 - DNA, 25 bp, Rattus norvegicus
ttataaatctgatccacagccctcc

SEQ ID NO: 661821 - DNA, 25 bp, Rattus norvegicus
ttataacaagaaatcagtgctcagt

SEQ ID NO: 661822 - DNA, 25 bp, Rattus norvegicus
ttataacaagaattcagtgctcagt

SEQ ID NO: 661823 - DNA, 25 bp, Rattus norvegicus
ttataaccacagaccatcgaaccaa

SEQ ID NO: 661824 - DNA, 25 bp, Rattus norvegicus
ttataaccacagtccatcgaaccaa

SEQ ID NO: 661825 - DNA, 25 bp, Rattus norvegicus
ttataacccatcagtgtcccaatgt

SEQ ID NO: 661826 - DNA, 25 bp, Rattus norvegicus
ttataacccatctgtgtcccaatgt

SEQ ID NO: 661827 - DNA, 25 bp, Rattus norvegicus
ttataacccgctcgtacctgaggcc

SEQ ID NO: 661828 - DNA, 25 bp, Rattus norvegicus
ttataacccgctggtacctgaggcc

SEQ ID NO: 661829 - DNA, 25 bp, Rattus norvegicus
ttataacctattcagatgagatgct

SEQ ID NO: 661830 - DNA, 25 bp, Rattus norvegicus
ttataacctattgagatgagatgct

SEQ ID NO: 661831 - DNA, 25 bp, Rattus norvegicus
ttataacgcagacggccgagggcct

SEQ ID NO: 661832 - DNA, 25 bp, Rattus norvegicus
ttataacgcagagggccgagggcct

SEQ ID NO: 661833 - DNA, 25 bp, Rattus norvegicus
ttataacgctgtatgtcatcacccc

SEQ ID NO: 661834 - DNA, 25 bp, Rattus norvegicus
ttataacgctgtttgtcatcacccc

SEQ ID NO: 661835 - DNA, 25 bp, Rattus norvegicus
ttataacgtcctataactctcactc

SEQ ID NO: 661836 - DNA, 25 bp, Rattus norvegicus
ttataacgtcctttaactctcactc

SEQ ID NO: 661837 - DNA, 25 bp, Rattus norvegicus
ttataactataacttccaggtctgc

SEQ ID NO: 661838 - DNA, 25 bp, Rattus norvegicus
ttataactataagttccaggtctgc

SEQ ID NO: 661839 - DNA, 25 bp, Rattus norvegicus
ttataactctctaggccttacttta

SEQ ID NO: 661840 - DNA, 25 bp, Rattus norvegicus
ttataactctcttggccttacttta

SEQ ID NO: 661841 - DNA, 25 bp, Rattus norvegicus
ttataagacccaaccttccaaggct

SEQ ID NO: 661842 - DNA, 25 bp, Rattus norvegicus
ttataagacccatccttccaaggct

SEQ ID NO: 661843 - DNA, 25 bp, Rattus norvegicus
ttataagagaccctgtcagcagaca

SEQ ID NO: 661844 - DNA, 25 bp, Rattus norvegicus
ttataagagaccgtgtcagcagaca

SEQ ID NO: 661845 - DNA, 25 bp, Rattus norvegicus
ttataagcatgtacctggccagaat

SEQ ID NO: 661846 - DNA, 25 bp, Rattus norvegicus
ttataagcatgttcctggccagaat

SEQ ID NO: 661847 - DNA, 25 bp, Rattus norvegicus
ttataagctgccatgtaacttgggt

SEQ ID NO: 661848 - DNA, 25 bp, Rattus norvegicus
ttataagctgccttgtaacttgggt

SEQ ID NO: 661849 - DNA, 25 bp, Rattus norvegicus
ttataagggatcactccccgcagat

SEQ ID NO: 661850 - DNA, 25 bp, Rattus norvegicus
ttataagggatctctccccgcagat

SEQ ID NO: 661851 - DNA, 25 bp, Rattus norvegicus
ttataatatctgaggacttagtact

SEQ ID NO: 661852 - DNA, 25 bp, Rattus norvegicus
ttataatatctgtggacttagtact

SEQ ID NO: 661853 - DNA, 25 bp, Rattus norvegicus
ttataatccgctccgcatgtctgcg

SEQ ID NO: 661854 - DNA, 25 bp, Rattus norvegicus
ttataatccgctgcgcatgtctgcg

SEQ ID NO: 661855 - DNA, 25 bp, Rattus norvegicus
ttataatgggctccgtcagggcaga

SEQ ID NO: 661856 - DNA, 25 bp, Rattus norvegicus
ttataatgggctgcgtcagggcaga

SEQ ID NO: 661857 - DNA, 25 bp, Rattus norvegicus
ttataatgtgctatcttctcctttg

SEQ ID NO: 661858 - DNA, 25 bp, Rattus norvegicus
ttataatgtgctttcttctcctttg

SEQ ID NO: 661859 - DNA, 25 bp, Rattus norvegicus
ttataattgtccattcttccagctc

SEQ ID NO: 661860 - DNA, 25 bp, Rattus norvegicus
ttataattgtcctttcttccagctc

SEQ ID NO: 661861 - DNA, 25 bp, Rattus norvegicus
ttataattgttcatgataccagttg

SEQ ID NO: 661862 - DNA, 25 bp, Rattus norvegicus
ttataattgttcttgataccagttg

SEQ ID NO: 661863 - DNA, 25 bp, Rattus norvegicus
ttataatttatgcagtttcagaaca

SEQ ID NO: 661864 - DNA, 25 bp, Rattus norvegicus
ttataatttatggagtttcagaaca

SEQ ID NO: 661865 - DNA, 25 bp, Rattus norvegicus
ttataatttattagcacccttggga

SEQ ID NO: 661866 - DNA, 25 bp, Rattus norvegicus
ttataatttatttgcacccttggga

SEQ ID NO: 661867 - DNA, 25 bp, Rattus norvegicus
ttataattttctctactgtcccacc

SEQ ID NO: 661868 - DNA, 25 bp, Rattus norvegicus
ttataattttctgtactgtcccacc

SEQ ID NO: 661869 - DNA, 25 bp, Rattus norvegicus
ttatacaaaggcctgctccccaagg

SEQ ID NO: 661870 - DNA, 25 bp, Rattus norvegicus
ttatacaaaggcgtgctccccaagg

SEQ ID NO: 661871 - DNA, 25 bp, Rattus norvegicus
ttatacaacaggactcaggctaaag

SEQ ID NO: 661872 - DNA, 25 bp, Rattus norvegicus
ttatacaacaggtctcaggctaaag

SEQ ID NO: 661873 - DNA, 25 bp, Rattus norvegicus
ttatacacacatcgcctcattgttc

SEQ ID NO: 661874 - DNA, 25 bp, Rattus norvegicus
ttatacacacatggcctcattgttc

SEQ ID NO: 661875 - DNA, 25 bp, Rattus norvegicus
ttatacacactccagttctaccatt

SEQ ID NO: 661876 - DNA, 25 bp, Rattus norvegicus
ttatacacactcgagttctaccatt

SEQ ID NO: 661877 - DNA, 25 bp, Rattus norvegicus
ttatacacataaatttctaccccaa

SEQ ID NO: 661878 - DNA, 25 bp, Rattus norvegicus
ttatacacataattttctaccccaa

SEQ ID NO: 661879 - DNA, 25 bp, Rattus norvegicus
ttatacactggaccgagggcatggc

SEQ ID NO: 661880 - DNA, 25 bp, Rattus norvegicus
ttatacactggagcgagggcatggc

SEQ ID NO: 661881 - DNA, 25 bp, Rattus norvegicus
ttatacacttatatctttgttttgc

SEQ ID NO: 661882 - DNA, 25 bp, Rattus norvegicus
ttatacacttatttctttgttttgc

SEQ ID NO: 661883 - DNA, 25 bp, Rattus norvegicus
ttatacagatgacgttctgaccctg

SEQ ID NO: 661884 - DNA, 25 bp, Rattus norvegicus
ttatacagatgaggttctgaccctg

SEQ ID NO: 661885 - DNA, 25 bp, Rattus norvegicus
ttatacatcaccacgttgacgtttc

SEQ ID NO: 661886 - DNA, 25 bp, Rattus norvegicus
ttatacatcacctcgttgacgtttc

SEQ ID NO: 661887 - DNA, 25 bp, Rattus norvegicus
ttatacattcctctaccttcataca

SEQ ID NO: 661888 - DNA, 25 bp, Rattus norvegicus
ttatacattcctgtaccttcataca

SEQ ID NO: 661889 - DNA, 25 bp, Rattus norvegicus
ttatacattctgatgtcccgtcatt

SEQ ID NO: 661890 - DNA, 25 bp, Rattus norvegicus
ttatacattctgttgtcccgtcatt

SEQ ID NO: 661891 - DNA, 25 bp, Rattus norvegicus
ttataccactcccttaagttcttca

SEQ ID NO: 661892 - DNA, 25 bp, Rattus norvegicus
ttataccactccgttaagttcttca

SEQ ID NO: 661893 - DNA, 25 bp, Rattus norvegicus
ttataccagatgcaacacctccagt

SEQ ID NO: 661894 - DNA, 25 bp, Rattus norvegicus
ttataccagatggaacacctccagt

SEQ ID NO: 661895 - DNA, 25 bp, Rattus norvegicus
ttatacccaaccctgtgtaatctgt

SEQ ID NO: 661896 - DNA, 25 bp, Rattus norvegicus
ttatacccaaccgtgtgtaatctgt

SEQ ID NO: 661897 - DNA, 25 bp, Rattus norvegicus
ttatacccttccagttttccagtgg

SEQ ID NO: 661898 - DNA, 25 bp, Rattus norvegicus
ttatacccttcctgttttccagtgg

SEQ ID NO: 661899 - DNA, 25 bp, Rattus norvegicus
ttatacctctgtaacctaaagccaa

SEQ ID NO: 661900 - DNA, 25 bp, Rattus norvegicus
ttatacctctgttacctaaagccaa

SEQ ID NO: 661901 - DNA, 25 bp, Rattus norvegicus
ttatacctgaaaccccaactactca

SEQ ID NO: 661902 - DNA, 25 bp, Rattus norvegicus
ttatacctgaaagcccaactactca

SEQ ID NO: 661903 - DNA, 25 bp, Rattus norvegicus
ttatacctggaaactgagctccaca

SEQ ID NO: 661904 - DNA, 25 bp, Rattus norvegicus
ttatacctggaatctgagctccaca

SEQ ID NO: 661905 - DNA, 25 bp, Rattus norvegicus
ttatacctggacacccaacaattgg

SEQ ID NO: 661906 - DNA, 25 bp, Rattus norvegicus
ttatacctggactcccaacaattgg

SEQ ID NO: 661907 - DNA, 25 bp, Rattus norvegicus
ttatacctgtatacatgttaccaat

SEQ ID NO: 661908 - DNA, 25 bp, Rattus norvegicus
ttatacctgtattcatgttaccaat

SEQ ID NO: 661909 - DNA, 25 bp, Rattus norvegicus
ttatacgaactaagactccgggctg

SEQ ID NO: 661910 - DNA, 25 bp, Rattus norvegicus
ttatacgaactatgactccgggctg

SEQ ID NO: 661911 - DNA, 25 bp, Rattus norvegicus
ttatacgcttatatttcttctgaaa

SEQ ID NO: 661912 - DNA, 25 bp, Rattus norvegicus
ttatacgcttatttttcttctgaaa

SEQ ID NO: 661913 - DNA, 25 bp, Rattus norvegicus
ttatacgttcacctcctggcaattc

SEQ ID NO: 661914 - DNA, 25 bp, Rattus norvegicus
ttatacgttcacgtcctggcaattc

SEQ ID NO: 661915 - DNA, 25 bp, Rattus norvegicus
ttatactagaatagccacttttgga

SEQ ID NO: 661916 - DNA, 25 bp, Rattus norvegicus
ttatactagaattgccacttttgga

SEQ ID NO: 661917 - DNA, 25 bp, Rattus norvegicus
ttatactccacacaagagaccctac

SEQ ID NO: 661918 - DNA, 25 bp, Rattus norvegicus
ttatactccacagaagagaccctac

SEQ ID NO: 661919 - DNA, 25 bp, Rattus norvegicus
ttatactcctccatagagcgacaac

SEQ ID NO: 661920 - DNA, 25 bp, Rattus norvegicus
ttatactcctccttagagcgacaac

SEQ ID NO: 661921 - DNA, 25 bp, Rattus norvegicus
ttatactccttgattatccacctgt

SEQ ID NO: 661922 - DNA, 25 bp, Rattus norvegicus
ttatactccttgtttatccacctgt

SEQ ID NO: 661923 - DNA, 25 bp, Rattus norvegicus
ttatactcgcctcggactgtagaac

SEQ ID NO: 661924 - DNA, 25 bp, Rattus norvegicus
ttatactcgcctgggactgtagaac

SEQ ID NO: 661925 - DNA, 25 bp, Rattus norvegicus
ttatactcttagacccgacatcatg

SEQ ID NO: 661926 - DNA, 25 bp, Rattus norvegicus
ttatactcttagtcccgacatcatg

SEQ ID NO: 661927 - DNA, 25 bp, Rattus norvegicus
ttatactctttccaactgtctctca

SEQ ID NO: 661928 - DNA, 25 bp, Rattus norvegicus
ttatactctttcgaactgtctctca

SEQ ID NO: 661929 - DNA, 25 bp, Rattus norvegicus
ttatactgctaacagtacctcaggg

SEQ ID NO: 661930 - DNA, 25 bp, Rattus norvegicus
ttatactgctaagagtacctcaggg

SEQ ID NO: 661931 - DNA, 25 bp, Rattus norvegicus
ttatactgctggactgaccttggag

SEQ ID NO: 661932 - DNA, 25 bp, Rattus norvegicus
ttatactgctggtctgaccttggag

SEQ ID NO: 661933 - DNA, 25 bp, Rattus norvegicus
ttatactgtactcggtctgccggaa

SEQ ID NO: 661934 - DNA, 25 bp, Rattus norvegicus
ttatactgtactgggtctgccggaa

SEQ ID NO: 661935 - DNA, 25 bp, Rattus norvegicus
ttatacttgacccatgcttactgct

SEQ ID NO: 661936 - DNA, 25 bp, Rattus norvegicus
ttatacttgaccgatgcttactgct

SEQ ID NO: 661937 - DNA, 25 bp, Rattus norvegicus
ttatacttgatcctttttccgacct

SEQ ID NO: 661938 - DNA, 25 bp, Rattus norvegicus
ttatacttgatcgtttttccgacct

SEQ ID NO: 661939 - DNA, 25 bp, Rattus norvegicus
ttatactttattcaaggctcgcctt

SEQ ID NO: 661940 - DNA, 25 bp, Rattus norvegicus
ttatactttattgaaggctcgcctt

SEQ ID NO: 661941 - DNA, 25 bp, Rattus norvegicus
ttatactttgcaatccacttacctc

SEQ ID NO: 661942 - DNA, 25 bp, Rattus norvegicus
ttatactttgcattccacttacctc

SEQ ID NO: 661943 - DNA, 25 bp, Rattus norvegicus
ttatacttttacacaatgtccaggt

SEQ ID NO: 661944 - DNA, 25 bp, Rattus norvegicus
ttatacttttactcaatgtccaggt

SEQ ID NO: 661945 - DNA, 25 bp, Rattus norvegicus
ttatagaccactcgccctgtagtca

SEQ ID NO: 661946 - DNA, 25 bp, Rattus norvegicus
ttatagaccactggccctgtagtca

SEQ ID NO: 661947 - DNA, 25 bp, Rattus norvegicus
ttatagacccttattgctgttcaaa

SEQ ID NO: 661948 - DNA, 25 bp, Rattus norvegicus
ttatagaccctttttgctgttcaaa

SEQ ID NO: 661949 - DNA, 25 bp, Rattus norvegicus
ttatagactattatggaaccagact

SEQ ID NO: 661950 - DNA, 25 bp, Rattus norvegicus
ttatagactattttggaaccagact

SEQ ID NO: 661951 - DNA, 25 bp, Rattus norvegicus
ttatagattctgcttttggccggaa

SEQ ID NO: 661952 - DNA, 25 bp, Rattus norvegicus
ttatagattctggttttggccggaa

SEQ ID NO: 661953 - DNA, 25 bp, Rattus norvegicus
ttatagcaatgcagtcccaccctta

SEQ ID NO: 661954 - DNA, 25 bp, Rattus norvegicus
ttatagcaatgctgtcccaccctta

SEQ ID NO: 661955 - DNA, 25 bp, Rattus norvegicus
ttatagcaccttatgtctatgccct

SEQ ID NO: 661956 - DNA, 25 bp, Rattus norvegicus
ttatagcaccttttgtctatgccct

SEQ ID NO: 661957 - DNA, 25 bp, Rattus norvegicus
ttatagcacgggatcctgtgggcca

SEQ ID NO: 661958 - DNA, 25 bp, Rattus norvegicus
ttatagcacgggttcctgtgggcca

SEQ ID NO: 661959 - DNA, 25 bp, Rattus norvegicus
ttatagcagcaacaaccccaggaca

SEQ ID NO: 661960 - DNA, 25 bp, Rattus norvegicus
ttatagcagcaagaaccccaggaca

SEQ ID NO: 661961 - DNA, 25 bp, Rattus norvegicus
ttatagccgcaccaaggctgtggtc

SEQ ID NO: 661962 - DNA, 25 bp, Rattus norvegicus
ttatagccgcacgaaggctgtggtc

SEQ ID NO: 661963 - DNA, 25 bp, Rattus norvegicus
ttatagcctagactcttggacctct

SEQ ID NO: 661964 - DNA, 25 bp, Rattus norvegicus
ttatagcctagagtcttggacctct

SEQ ID NO: 661965 - DNA, 25 bp, Rattus norvegicus
ttatagcctccaagtgcagctgtat

SEQ ID NO: 661966 - DNA, 25 bp, Rattus norvegicus
ttatagcctccatgtgcagctgtat

SEQ ID NO: 661967 - DNA, 25 bp, Rattus norvegicus
ttatagctacagatcgctcttcagc

SEQ ID NO: 661968 - DNA, 25 bp, Rattus norvegicus
ttatagctacagttcgctcttcagc

SEQ ID NO: 661969 - DNA, 25 bp, Rattus norvegicus
ttatagctctcaaagcccatctttc

SEQ ID NO: 661970 - DNA, 25 bp, Rattus norvegicus
ttatagctctcacctgtcctgtgta

SEQ ID NO: 661971 - DNA, 25 bp, Rattus norvegicus
ttatagctctcagctgtcctgtgta

SEQ ID NO: 661972 - DNA, 25 bp, Rattus norvegicus
ttatagctctcatagcccatctttc

SEQ ID NO: 661973 - DNA, 25 bp, Rattus norvegicus
ttatagctggccaactgctccttaa

SEQ ID NO: 661974 - DNA, 25 bp, Rattus norvegicus
ttatagctggcctactgctccttaa

SEQ ID NO: 661975 - DNA, 25 bp, Rattus norvegicus
ttatagctgtgtatggcctgtacta

SEQ ID NO: 661976 - DNA, 25 bp, Rattus norvegicus
ttatagctgtgtttggcctgtacta

SEQ ID NO: 661977 - DNA, 25 bp, Rattus norvegicus
ttataggaacccagaagtcacttca

SEQ ID NO: 661978 - DNA, 25 bp, Rattus norvegicus
ttataggaaccctgaagtcacttca

SEQ ID NO: 661979 - DNA, 25 bp, Rattus norvegicus
ttataggaatccaacttccgtctgc

SEQ ID NO: 661980 - DNA, 25 bp, Rattus norvegicus
ttataggaatcctacttccgtctgc

SEQ ID NO: 661981 - DNA, 25 bp, Rattus norvegicus
ttataggactcaatcttagccatgc

SEQ ID NO: 661982 - DNA, 25 bp, Rattus norvegicus
ttataggactcattcttagccatgc

SEQ ID NO: 661983 - DNA, 25 bp, Rattus norvegicus
ttataggtccagaatccgtggcagc

SEQ ID NO: 661984 - DNA, 25 bp, Rattus norvegicus
ttataggtccagtatccgtggcagc

SEQ ID NO: 661985 - DNA, 25 bp, Rattus norvegicus
ttataggtgattacattccttacgt

SEQ ID NO: 661986 - DNA, 25 bp, Rattus norvegicus
ttataggtgatttcattccttacgt

SEQ ID NO: 661987 - DNA, 25 bp, Rattus norvegicus
ttatagtacggactctggccctgct

SEQ ID NO: 661988 - DNA, 25 bp, Rattus norvegicus
ttatagtacggagtctggccctgct

SEQ ID NO: 661989 - DNA, 25 bp, Rattus norvegicus
ttatagtctctgagggctcttgcat

SEQ ID NO: 661990 - DNA, 25 bp, Rattus norvegicus
ttatagtctctgtgggctcttgcat

SEQ ID NO: 661991 - DNA, 25 bp, Rattus norvegicus
ttatagtgacctatggaaacatcgt

SEQ ID NO: 661992 - DNA, 25 bp, Rattus norvegicus
ttatagtgacctttggaaacatcgt

SEQ ID NO: 661993 - DNA, 25 bp, Rattus norvegicus
ttatagtgtcaaccccagctggcag

SEQ ID NO: 661994 - DNA, 25 bp, Rattus norvegicus
ttatagtgtcaagcccagctggcag

SEQ ID NO: 661995 - DNA, 25 bp, Rattus norvegicus
ttatagtttaccctgcgagcttagc

SEQ ID NO: 661996 - DNA, 25 bp, Rattus norvegicus
ttatagtttaccgtgcgagcttagc

SEQ ID NO: 661997 - DNA, 25 bp, Rattus norvegicus
ttatagtttgctacccctaagatgc

SEQ ID NO: 661998 - DNA, 25 bp, Rattus norvegicus
ttatagtttgcttcccctaagatgc

SEQ ID NO: 661999 - DNA, 25 bp, Rattus norvegicus
ttatataaagcccactggaccccat

SEQ ID NO: 662000 - DNA, 25 bp, Rattus norvegicus
ttatataaagccgactggaccccat

SEQ ID NO: 662001 - DNA, 25 bp, Rattus norvegicus
ttatataaatttacccacatcatgg

SEQ ID NO: 662002 - DNA, 25 bp, Rattus norvegicus
ttatataaattttcccacatcatgg

SEQ ID NO: 662003 - DNA, 25 bp, Rattus norvegicus
ttatataacccgccccttttgtatg

SEQ ID NO: 662004 - DNA, 25 bp, Rattus norvegicus
ttatataacccggcccttttgtatg

SEQ ID NO: 662005 - DNA, 25 bp, Rattus norvegicus
ttatatacattcaggcctacagcta

SEQ ID NO: 662006 - DNA, 25 bp, Rattus norvegicus
ttatatacattctggcctacagcta

SEQ ID NO: 662007 - DNA, 25 bp, Rattus norvegicus
ttatatactgcaagtgttcactaaa

SEQ ID NO: 662008 - DNA, 25 bp, Rattus norvegicus
ttatatactgcatgtgttcactaaa

SEQ ID NO: 662009 - DNA, 25 bp, Rattus norvegicus
ttatatagtgtgatccaggatagcc

SEQ ID NO: 662010 - DNA, 25 bp, Rattus norvegicus
ttatatagtgtgttccaggatagcc

SEQ ID NO: 662011 - DNA, 25 bp, Rattus norvegicus
ttatatagttttctgatgctcagtt

SEQ ID NO: 662012 - DNA, 25 bp, Rattus norvegicus
ttatatagttttgtgatgctcagtt

SEQ ID NO: 662013 - DNA, 25 bp, Rattus norvegicus
ttatatatacttcaaggcaagcctg

SEQ ID NO: 662014 - DNA, 25 bp, Rattus norvegicus
ttatatatacttgaaggcaagcctg

SEQ ID NO: 662015 - DNA, 25 bp, Rattus norvegicus
ttatatatatctacaaagccccaag

SEQ ID NO: 662016 - DNA, 25 bp, Rattus norvegicus
ttatatatatcttcaaagccccaag

SEQ ID NO: 662017 - DNA, 25 bp, Rattus norvegicus
ttatatatcaccctttagatcttga

SEQ ID NO: 662018 - DNA, 25 bp, Rattus norvegicus
ttatatatcaccgtttagatcttga

SEQ ID NO: 662019 - DNA, 25 bp, Rattus norvegicus
ttatatcacacgctcccaaaggatc

SEQ ID NO: 662020 - DNA, 25 bp, Rattus norvegicus
ttatatcacacggtcccaaaggatc

SEQ ID NO: 662021 - DNA, 25 bp, Rattus norvegicus
ttatatcaggtgagccatttctcta

SEQ ID NO: 662022 - DNA, 25 bp, Rattus norvegicus
ttatatcaggtgtgccatttctcta

SEQ ID NO: 662023 - DNA, 25 bp, Rattus norvegicus
ttatatccagtcacgacaagcacta

SEQ ID NO: 662024 - DNA, 25 bp, Rattus norvegicus
ttatatccagtctcgacaagcacta

SEQ ID NO: 662025 - DNA, 25 bp, Rattus norvegicus
ttatatcctgttatacacctccctg

SEQ ID NO: 662026 - DNA, 25 bp, Rattus norvegicus
ttatatcctgttttacacctccctg

SEQ ID NO: 662027 - DNA, 25 bp, Rattus norvegicus
ttatatccttttacactttgccatg

SEQ ID NO: 662028 - DNA, 25 bp, Rattus norvegicus
ttatatccttttcccttggtagcct

SEQ ID NO: 662029 - DNA, 25 bp, Rattus norvegicus
ttatatccttttgccttggtagcct

SEQ ID NO: 662030 - DNA, 25 bp, Rattus norvegicus
ttatatcctttttcactttgccatg

SEQ ID NO: 662031 - DNA, 25 bp, Rattus norvegicus
ttatatctagtcactccctactgta

SEQ ID NO: 662032 - DNA, 25 bp, Rattus norvegicus
ttatatctagtctctccctactgta

SEQ ID NO: 662033 - DNA, 25 bp, Rattus norvegicus
ttatatctatgtcaccttcctggga

SEQ ID NO: 662034 - DNA, 25 bp, Rattus norvegicus
ttatatctatgtgaccttcctggga

SEQ ID NO: 662035 - DNA, 25 bp, Rattus norvegicus
ttatatctgtctattctgggctggg

SEQ ID NO: 662036 - DNA, 25 bp, Rattus norvegicus
ttatatctgtcttttctgggctggg

SEQ ID NO: 662037 - DNA, 25 bp, Rattus norvegicus
ttatatctgtgtctccaggatcctg

SEQ ID NO: 662038 - DNA, 25 bp, Rattus norvegicus
ttatatctgtgtgtccaggatcctg

SEQ ID NO: 662039 - DNA, 25 bp, Rattus norvegicus
ttatatcttggacctgcagatcgcc

SEQ ID NO: 662040 - DNA, 25 bp, Rattus norvegicus
ttatatcttggagctgcagatcgcc

SEQ ID NO: 662041 - DNA, 25 bp, Rattus norvegicus
ttatatgacataccctgttgacagt

SEQ ID NO: 662042 - DNA, 25 bp, Rattus norvegicus
ttatatgacatagcctgttgacagt

SEQ ID NO: 662043 - DNA, 25 bp, Rattus norvegicus
ttatatgaggacatccaactggtat

SEQ ID NO: 662044 - DNA, 25 bp, Rattus norvegicus
ttatatgaggacttccaactggtat

SEQ ID NO: 662045 - DNA, 25 bp, Rattus norvegicus
ttatatgcacagacctcacaggtgt

SEQ ID NO: 662046 - DNA, 25 bp, Rattus norvegicus
ttatatgcacagtcctcacaggtgt

SEQ ID NO: 662047 - DNA, 25 bp, Rattus norvegicus
ttatatgcagctcatgtcggtgcct

SEQ ID NO: 662048 - DNA, 25 bp, Rattus norvegicus
ttatatgcagctgatgtcggtgcct

SEQ ID NO: 662049 - DNA, 25 bp, Rattus norvegicus
ttatatgcatcgagatcctctcttc

SEQ ID NO: 662050 - DNA, 25 bp, Rattus norvegicus
ttatatgcatcgtgatcctctcttc

SEQ ID NO: 662051 - DNA, 25 bp, Rattus norvegicus
ttatatgccacaatagagctctatg

SEQ ID NO: 662052 - DNA, 25 bp, Rattus norvegicus
ttatatgccacaccatcacacagag

SEQ ID NO: 662053 - DNA, 25 bp, Rattus norvegicus
ttatatgccacagcatcacacagag

SEQ ID NO: 662054 - DNA, 25 bp, Rattus norvegicus
ttatatgccacattagagctctatg

SEQ ID NO: 662055 - DNA, 25 bp, Rattus norvegicus
ttatatgcccctaagcaacacttct

SEQ ID NO: 662056 - DNA, 25 bp, Rattus norvegicus
ttatatgccccttagcaacacttct

SEQ ID NO: 662057 - DNA, 25 bp, Rattus norvegicus
ttatatgtaagcagccctgggcgac

SEQ ID NO: 662058 - DNA, 25 bp, Rattus norvegicus
ttatatgtaagctgccctgggcgac

SEQ ID NO: 662059 - DNA, 25 bp, Rattus norvegicus
ttatatgtagacagggctgcgtcaa

SEQ ID NO: 662060 - DNA, 25 bp, Rattus norvegicus
ttatatgtagactgggctgcgtcaa

SEQ ID NO: 662061 - DNA, 25 bp, Rattus norvegicus
ttatatgtcataagttcctgtctga

SEQ ID NO: 662062 - DNA, 25 bp, Rattus norvegicus
ttatatgtcatatgttcctgtctga

SEQ ID NO: 662063 - DNA, 25 bp, Rattus norvegicus
ttatatgtcctgatctttgcaaccc

SEQ ID NO: 662064 - DNA, 25 bp, Rattus norvegicus
ttatatgtcctgttctttgcaaccc

SEQ ID NO: 662065 - DNA, 25 bp, Rattus norvegicus
ttatatgtgctgaatcttgcctgtt

SEQ ID NO: 662066 - DNA, 25 bp, Rattus norvegicus
ttatatgtgctgtatcttgcctgtt

SEQ ID NO: 662067 - DNA, 25 bp, Rattus norvegicus
ttatatgttccaagaagcctctcct

SEQ ID NO: 662068 - DNA, 25 bp, Rattus norvegicus
ttatatgttccatgaagcctctcct

SEQ ID NO: 662069 - DNA, 25 bp, Rattus norvegicus
ttatatgtttcccaaaattcctttg

SEQ ID NO: 662070 - DNA, 25 bp, Rattus norvegicus
ttatatgtttccgaaaattcctttg

SEQ ID NO: 662071 - DNA, 25 bp, Rattus norvegicus
ttatattagatcacttccaaagggt

SEQ ID NO: 662072 - DNA, 25 bp, Rattus norvegicus
ttatattagatctcttccaaagggt

SEQ ID NO: 662073 - DNA, 25 bp, Rattus norvegicus
ttatattcccagatgtcttcttccc

SEQ ID NO: 662074 - DNA, 25 bp, Rattus norvegicus
ttatattcccagttgtcttcttccc

SEQ ID NO: 662075 - DNA, 25 bp, Rattus norvegicus
ttatattccctgaactgcggatgct

SEQ ID NO: 662076 - DNA, 25 bp, Rattus norvegicus
ttatattccctgtactgcggatgct

SEQ ID NO: 662077 - DNA, 25 bp, Rattus norvegicus
ttatattcccttaaaggccttgaat

SEQ ID NO: 662078 - DNA, 25 bp, Rattus norvegicus
ttatattcccttacgactttgtatt

SEQ ID NO: 662079 - DNA, 25 bp, Rattus norvegicus
ttatattccctttaaggccttgaat

SEQ ID NO: 662080 - DNA, 25 bp, Rattus norvegicus
ttatattccctttcgactttgtatt

SEQ ID NO: 662081 - DNA, 25 bp, Rattus norvegicus
ttatattcctaactgctgagcagcc

SEQ ID NO: 662082 - DNA, 25 bp, Rattus norvegicus
ttatattcctaagtgctgagcagcc

SEQ ID NO: 662083 - DNA, 25 bp, Rattus norvegicus
ttatattgatttcctatcccatccc

SEQ ID NO: 662084 - DNA, 25 bp, Rattus norvegicus
ttatattgatttgctatcccatccc

SEQ ID NO: 662085 - DNA, 25 bp, Rattus norvegicus
ttatattgccatcgcgtgggctgcg

SEQ ID NO: 662086 - DNA, 25 bp, Rattus norvegicus
ttatattgccatggcgtgggctgcg

SEQ ID NO: 662087 - DNA, 25 bp, Rattus norvegicus
ttatattgcccactttactcattcc

SEQ ID NO: 662088 - DNA, 25 bp, Rattus norvegicus
ttatattgcccagtttactcattcc

SEQ ID NO: 662089 - DNA, 25 bp, Rattus norvegicus
ttatattgcgggaatgcttggtaat

SEQ ID NO: 662090 - DNA, 25 bp, Rattus norvegicus
ttatattgcgggtatgcttggtaat

SEQ ID NO: 662091 - DNA, 25 bp, Rattus norvegicus
ttatattgtttgcatccggttgccc

SEQ ID NO: 662092 - DNA, 25 bp, Rattus norvegicus
ttatattgtttggatccggttgccc

SEQ ID NO: 662093 - DNA, 25 bp, Rattus norvegicus
ttatatttacttccataattggcca

SEQ ID NO: 662094 - DNA, 25 bp, Rattus norvegicus
ttatatttacttgcataattggcca

SEQ ID NO: 662095 - DNA, 25 bp, Rattus norvegicus
ttatatttattcctcatcccagacg

SEQ ID NO: 662096 - DNA, 25 bp, Rattus norvegicus
ttatatttattcgtcatcccagacg

SEQ ID NO: 662097 - DNA, 25 bp, Rattus norvegicus
ttatatttcctcactcttcatttta

SEQ ID NO: 662098 - DNA, 25 bp, Rattus norvegicus
ttatatttcctccaattcctgatcc

SEQ ID NO: 662099 - DNA, 25 bp, Rattus norvegicus
ttatatttcctcgaattcctgatcc

SEQ ID NO: 662100 - DNA, 25 bp, Rattus norvegicus
ttatatttcctctctcttcatttta

SEQ ID NO: 662101 - DNA, 25 bp, Rattus norvegicus
ttatatttctgactgaccaggcaag

SEQ ID NO: 662102 - DNA, 25 bp, Rattus norvegicus
ttatatttctgagtgaccaggcaag

SEQ ID NO: 662103 - DNA, 25 bp, Rattus norvegicus
ttatatttgattaaagcacgctttg

SEQ ID NO: 662104 - DNA, 25 bp, Rattus norvegicus
ttatatttgatttaagcacgctttg

SEQ ID NO: 662105 - DNA, 25 bp, Rattus norvegicus
ttatattttattacagttcctggtg

SEQ ID NO: 662106 - DNA, 25 bp, Rattus norvegicus
ttatattttatttcagttcctggtg

SEQ ID NO: 662107 - DNA, 25 bp, Rattus norvegicus
ttatcaaatcttatcctcccgtatt

SEQ ID NO: 662108 - DNA, 25 bp, Rattus norvegicus
ttatcaaatcttttcctcccgtatt

SEQ ID NO: 662109 - DNA, 25 bp, Rattus norvegicus
ttatcaaatgccaacaccggatccc

SEQ ID NO: 662110 - DNA, 25 bp, Rattus norvegicus
ttatcaaatgcctacaccggatccc

SEQ ID NO: 662111 - DNA, 25 bp, Rattus norvegicus
ttatcaaccacaacatctctgtagc

SEQ ID NO: 662112 - DNA, 25 bp, Rattus norvegicus
ttatcaaccacatcatctctgtagc

SEQ ID NO: 662113 - DNA, 25 bp, Rattus norvegicus
ttatcaaccagcctgagaagcccct

SEQ ID NO: 662114 - DNA, 25 bp, Rattus norvegicus
ttatcaaccagcgtgagaagcccct

SEQ ID NO: 662115 - DNA, 25 bp, Rattus norvegicus
ttatcaactgaaaaccccatagccc

SEQ ID NO: 662116 - DNA, 25 bp, Rattus norvegicus
ttatcaactgaataccccatagccc

SEQ ID NO: 662117 - DNA, 25 bp, Rattus norvegicus
ttatcaatattcctgggctgctgct

SEQ ID NO: 662118 - DNA, 25 bp, Rattus norvegicus
ttatcaatattcgtgggctgctgct

SEQ ID NO: 662119 - DNA, 25 bp, Rattus norvegicus
ttatcaatctagctttctcagctgc

SEQ ID NO: 662120 - DNA, 25 bp, Rattus norvegicus
ttatcaatctaggtttctcagctgc

SEQ ID NO: 662121 - DNA, 25 bp, Rattus norvegicus
ttatcaatggctatatcctccctta

SEQ ID NO: 662122 - DNA, 25 bp, Rattus norvegicus
ttatcaatggctttatcctccctta

SEQ ID NO: 662123 - DNA, 25 bp, Rattus norvegicus
ttatcaatgtagctgtgaactccat

SEQ ID NO: 662124 - DNA, 25 bp, Rattus norvegicus
ttatcaatgtaggtgtgaactccat

SEQ ID NO: 662125 - DNA, 25 bp, Rattus norvegicus
ttatcacaacatcctttgaccctag

SEQ ID NO: 662126 - DNA, 25 bp, Rattus norvegicus
ttatcacaacatgctttgaccctag

SEQ ID NO: 662127 - DNA, 25 bp, Rattus norvegicus
ttatcacacagtccggagaccgaaa

SEQ ID NO: 662128 - DNA, 25 bp, Rattus norvegicus
ttatcacacagtgcggagaccgaaa

SEQ ID NO: 662129 - DNA, 25 bp, Rattus norvegicus
ttatcacactgccaccacctttgtt

SEQ ID NO: 662130 - DNA, 25 bp, Rattus norvegicus
ttatcacactgcgaccacctttgtt

SEQ ID NO: 662131 - DNA, 25 bp, Rattus norvegicus
ttatcacagacaaggagaaggcgga

SEQ ID NO: 662132 - DNA, 25 bp, Rattus norvegicus
ttatcacagacatggagaaggcgga

SEQ ID NO: 662133 - DNA, 25 bp, Rattus norvegicus
ttatcacagcaccatgggcttcctt

SEQ ID NO: 662134 - DNA, 25 bp, Rattus norvegicus
ttatcacagcacgatgggcttcctt

SEQ ID NO: 662135 - DNA, 25 bp, Rattus norvegicus
ttatcacagcctcgaactcatccta

SEQ ID NO: 662136 - DNA, 25 bp, Rattus norvegicus
ttatcacagcctggaactcatccta

SEQ ID NO: 662137 - DNA, 25 bp, Rattus norvegicus
ttatcacagctacctccatggaagt

SEQ ID NO: 662138 - DNA, 25 bp, Rattus norvegicus
ttatcacagctagctccatggaagt

SEQ ID NO: 662139 - DNA, 25 bp, Rattus norvegicus
ttatcacagctcctttctaggacac

SEQ ID NO: 662140 - DNA, 25 bp, Rattus norvegicus
ttatcacagctcgtttctaggacac

SEQ ID NO: 662141 - DNA, 25 bp, Rattus norvegicus
ttatcacagtatatcgaccgacccg

SEQ ID NO: 662142 - DNA, 25 bp, Rattus norvegicus
ttatcacagtatttcgaccgacccg

SEQ ID NO: 662143 - DNA, 25 bp, Rattus norvegicus
ttatcaccaacgaccccaagaaagt

SEQ ID NO: 662144 - DNA, 25 bp, Rattus norvegicus
ttatcaccaacgtccccaagaaagt

SEQ ID NO: 662145 - DNA, 25 bp, Rattus norvegicus
ttatcaccagttagtctgccttgca

SEQ ID NO: 662146 - DNA, 25 bp, Rattus norvegicus
ttatcaccagtttgtctgccttgca

SEQ ID NO: 662147 - DNA, 25 bp, Rattus norvegicus
ttatcaccattaaaaccacttccac

SEQ ID NO: 662148 - DNA, 25 bp, Rattus norvegicus
ttatcaccattataaccacttccac

SEQ ID NO: 662149 - DNA, 25 bp, Rattus norvegicus
ttatcacccgcccagctaaggagtt

SEQ ID NO: 662150 - DNA, 25 bp, Rattus norvegicus
ttatcacccgccgagctaaggagtt

SEQ ID NO: 662151 - DNA, 25 bp, Rattus norvegicus
ttatcacccttcacgtggttttggg

SEQ ID NO: 662152 - DNA, 25 bp, Rattus norvegicus
ttatcacccttctcgtggttttggg

SEQ ID NO: 662153 - DNA, 25 bp, Rattus norvegicus
ttatcacctctcactgagggcagag

SEQ ID NO: 662154 - DNA, 25 bp, Rattus norvegicus
ttatcacctctctctgagggcagag

SEQ ID NO: 662155 - DNA, 25 bp, Rattus norvegicus
ttatcacggaggactccttagaccc

SEQ ID NO: 662156 - DNA, 25 bp, Rattus norvegicus
ttatcacggaggtctccttagaccc

SEQ ID NO: 662157 - DNA, 25 bp, Rattus norvegicus
ttatcacgtcacatagctcttcata

SEQ ID NO: 662158 - DNA, 25 bp, Rattus norvegicus
ttatcacgtcacttagctcttcata

SEQ ID NO: 662159 - DNA, 25 bp, Rattus norvegicus
ttatcacgttgactgtactttggca

SEQ ID NO: 662160 - DNA, 25 bp, Rattus norvegicus
ttatcacgttgagtgtactttggca

SEQ ID NO: 662161 - DNA, 25 bp, Rattus norvegicus
ttatcactacctctattcccattac

SEQ ID NO: 662162 - DNA, 25 bp, Rattus norvegicus
ttatcactacctgtattcccattac

SEQ ID NO: 662163 - DNA, 25 bp, Rattus norvegicus
ttatcactatttcttgtcgtcccgg

SEQ ID NO: 662164 - DNA, 25 bp, Rattus norvegicus
ttatcactatttgttgtcgtcccgg

SEQ ID NO: 662165 - DNA, 25 bp, Rattus norvegicus
ttatcagaagggactctgctttccc

SEQ ID NO: 662166 - DNA, 25 bp, Rattus norvegicus
ttatcagaagggtctctgctttccc

SEQ ID NO: 662167 - DNA, 25 bp, Rattus norvegicus
ttatcagacactcctgctcttaacc

SEQ ID NO: 662168 - DNA, 25 bp, Rattus norvegicus
ttatcagacactgctgctcttaacc

SEQ ID NO: 662169 - DNA, 25 bp, Rattus norvegicus
ttatcagatcccaaagagcagctag

SEQ ID NO: 662170 - DNA, 25 bp, Rattus norvegicus
ttatcagatccctaagagcagctag

SEQ ID NO: 662171 - DNA, 25 bp, Rattus norvegicus
ttatcagcaaacaagactcttcaaa

SEQ ID NO: 662172 - DNA, 25 bp, Rattus norvegicus
ttatcagcaaactagactcttcaaa

SEQ ID NO: 662173 - DNA, 25 bp, Rattus norvegicus
ttatcagcatttcttggtcattgga

SEQ ID NO: 662174 - DNA, 25 bp, Rattus norvegicus
ttatcagcatttgttggtcattgga

SEQ ID NO: 662175 - DNA, 25 bp, Rattus norvegicus
ttatcagccagtctgagtctgtctg

SEQ ID NO: 662176 - DNA, 25 bp, Rattus norvegicus
ttatcagccagtgtgagtctgtctg

SEQ ID NO: 662177 - DNA, 25 bp, Rattus norvegicus
ttatcagccctcctaggtcatacaa

SEQ ID NO: 662178 - DNA, 25 bp, Rattus norvegicus
ttatcagccctcgtaggtcatacaa

SEQ ID NO: 662179 - DNA, 25 bp, Rattus norvegicus
ttatcagccctgactgcattggagc

SEQ ID NO: 662180 - DNA, 25 bp, Rattus norvegicus
ttatcagccctgtctgcattggagc

SEQ ID NO: 662181 - DNA, 25 bp, Rattus norvegicus
ttatcagcttccatagtacgggtcc

SEQ ID NO: 662182 - DNA, 25 bp, Rattus norvegicus
ttatcagcttccttagtacgggtcc

SEQ ID NO: 662183 - DNA, 25 bp, Rattus norvegicus
ttatcaggacacagtcactggactg

SEQ ID NO: 662184 - DNA, 25 bp, Rattus norvegicus
ttatcaggacactgtcactggactg

SEQ ID NO: 662185 - DNA, 25 bp, Rattus norvegicus
ttatcagggacaaccaggctcaggc

SEQ ID NO: 662186 - DNA, 25 bp, Rattus norvegicus
ttatcagggacatccaggctcaggc

SEQ ID NO: 662187 - DNA, 25 bp, Rattus norvegicus
ttatcaggtctccatgctctgtgat

SEQ ID NO: 662188 - DNA, 25 bp, Rattus norvegicus
ttatcaggtctcgatgctctgtgat

SEQ ID NO: 662189 - DNA, 25 bp, Rattus norvegicus
ttatcaggtgacatcagggccccag

SEQ ID NO: 662190 - DNA, 25 bp, Rattus norvegicus
ttatcaggtgacttcagggccccag

SEQ ID NO: 662191 - DNA, 25 bp, Rattus norvegicus
ttatcagtccttcgcattctctggt

SEQ ID NO: 662192 - DNA, 25 bp, Rattus norvegicus
ttatcagtccttggcattctctggt

SEQ ID NO: 662193 - DNA, 25 bp, Rattus norvegicus
ttatcatcactcagctcttctttga

SEQ ID NO: 662194 - DNA, 25 bp, Rattus norvegicus
ttatcatcactctgctcttctttga

SEQ ID NO: 662195 - DNA, 25 bp, Rattus norvegicus
ttatcatctcagagtcagctcatgg

SEQ ID NO: 662196 - DNA, 25 bp, Rattus norvegicus
ttatcatctcagtgtcagctcatgg

SEQ ID NO: 662197 - DNA, 25 bp, Rattus norvegicus
ttatcatgcaaaaacatcctctttt

SEQ ID NO: 662198 - DNA, 25 bp, Rattus norvegicus
ttatcatgcaaatacatcctctttt

SEQ ID NO: 662199 - DNA, 25 bp, Rattus norvegicus
ttatcatgtcctagggttgctggtt

SEQ ID NO: 662200 - DNA, 25 bp, Rattus norvegicus
ttatcatgtccttgggttgctggtt

SEQ ID NO: 662201 - DNA, 25 bp, Rattus norvegicus
ttatcattaaaaccacccttgtgcc

SEQ ID NO: 662202 - DNA, 25 bp, Rattus norvegicus
ttatcattaaaagcacccttgtgcc

SEQ ID NO: 662203 - DNA, 25 bp, Rattus norvegicus
ttatcattgatcctttcctgtggca

SEQ ID NO: 662204 - DNA, 25 bp, Rattus norvegicus
ttatcattgatcgtttcctgtggca

SEQ ID NO: 662205 - DNA, 25 bp, Rattus norvegicus
ttatcattgtcccactcatttccac

SEQ ID NO: 662206 - DNA, 25 bp, Rattus norvegicus
ttatcattgtccgactcatttccac

SEQ ID NO: 662207 - DNA, 25 bp, Rattus norvegicus
ttatccaaagatagccactctagag

SEQ ID NO: 662208 - DNA, 25 bp, Rattus norvegicus
ttatccaaagattgccactctagag

SEQ ID NO: 662209 - DNA, 25 bp, Rattus norvegicus
ttatccaatggccagtccttaagta

SEQ ID NO: 662210 - DNA, 25 bp, Rattus norvegicus
ttatccaatggcgagtccttaagta

SEQ ID NO: 662211 - DNA, 25 bp, Rattus norvegicus
ttatccaccacgatcacagcctgta

SEQ ID NO: 662212 - DNA, 25 bp, Rattus norvegicus
ttatccaccacgttcacagcctgta

SEQ ID NO: 662213 - DNA, 25 bp, Rattus norvegicus
ttatccaccactacgcagatgcttg

SEQ ID NO: 662214 - DNA, 25 bp, Rattus norvegicus
ttatccaccacttcgcagatgcttg

SEQ ID NO: 662215 - DNA, 25 bp, Rattus norvegicus
ttatccaccataattagagctgcag

SEQ ID NO: 662216 - DNA, 25 bp, Rattus norvegicus
ttatccaccatatttagagctgcag

SEQ ID NO: 662217 - DNA, 25 bp, Rattus norvegicus
ttatccagacataaaccccgtgttg

SEQ ID NO: 662218 - DNA, 25 bp, Rattus norvegicus
ttatccagacattaaccccgtgttg

SEQ ID NO: 662219 - DNA, 25 bp, Rattus norvegicus
ttatccagaggcctttgtgggttcc

SEQ ID NO: 662220 - DNA, 25 bp, Rattus norvegicus
ttatccagaggcgtttgtgggttcc

SEQ ID NO: 662221 - DNA, 25 bp, Rattus norvegicus
ttatccagattgatttacttatgca

SEQ ID NO: 662222 - DNA, 25 bp, Rattus norvegicus
ttatccagattgttttacttatgca

SEQ ID NO: 662223 - DNA, 25 bp, Rattus norvegicus
ttatccagcaccactacattgttca

SEQ ID NO: 662224 - DNA, 25 bp, Rattus norvegicus
ttatccagcacctctacattgttca

SEQ ID NO: 662225 - DNA, 25 bp, Rattus norvegicus
ttatccagcataataagcactgcgt

SEQ ID NO: 662226 - DNA, 25 bp, Rattus norvegicus
ttatccagcatattaagcactgcgt

SEQ ID NO: 662227 - DNA, 25 bp, Rattus norvegicus
ttatccaggctaaggcggtctccgt

SEQ ID NO: 662228 - DNA, 25 bp, Rattus norvegicus
ttatccaggctatggcggtctccgt

SEQ ID NO: 662229 - DNA, 25 bp, Rattus norvegicus
ttatccaggcttcaagtcagtgcaa

SEQ ID NO: 662230 - DNA, 25 bp, Rattus norvegicus
ttatccaggcttgaagtcagtgcaa

SEQ ID NO: 662231 - DNA, 25 bp, Rattus norvegicus
ttatccagtctgagtgccaaagcca

SEQ ID NO: 662232 - DNA, 25 bp, Rattus norvegicus
ttatccagtctgctgttctgtacag

SEQ ID NO: 662233 - DNA, 25 bp, Rattus norvegicus
ttatccagtctggtgttctgtacag

SEQ ID NO: 662234 - DNA, 25 bp, Rattus norvegicus
ttatccagtctgtgtgccaaagcca

SEQ ID NO: 662235 - DNA, 25 bp, Rattus norvegicus
ttatccagttttcccttccctaaat

SEQ ID NO: 662236 - DNA, 25 bp, Rattus norvegicus
ttatccagttttgccttccctaaat

SEQ ID NO: 662237 - DNA, 25 bp, Rattus norvegicus
ttatccatcctgaatctccacgttt

SEQ ID NO: 662238 - DNA, 25 bp, Rattus norvegicus
ttatccatcctgtatctccacgttt

SEQ ID NO: 662239 - DNA, 25 bp, Rattus norvegicus
ttatccatctccagctaagactcat

SEQ ID NO: 662240 - DNA, 25 bp, Rattus norvegicus
ttatccatctcctgctaagactcat

SEQ ID NO: 662241 - DNA, 25 bp, Rattus norvegicus
ttatccattggcactgtgggagtca

SEQ ID NO: 662242 - DNA, 25 bp, Rattus norvegicus
ttatccattggctctgtgggagtca

SEQ ID NO: 662243 - DNA, 25 bp, Rattus norvegicus
ttatccatttgtacactgctatgtg

SEQ ID NO: 662244 - DNA, 25 bp, Rattus norvegicus
ttatccatttgttcactgctatgtg

SEQ ID NO: 662245 - DNA, 25 bp, Rattus norvegicus
ttatcccacagcagcccgaaagttt

SEQ ID NO: 662246 - DNA, 25 bp, Rattus norvegicus
ttatcccacagctgcccgaaagttt

SEQ ID NO: 662247 - DNA, 25 bp, Rattus norvegicus
ttatcccactatacttactgtccaa

SEQ ID NO: 662248 - DNA, 25 bp, Rattus norvegicus
ttatcccactattcttactgtccaa

SEQ ID NO: 662249 - DNA, 25 bp, Rattus norvegicus
ttatcccagcacagggcagtgcaga

SEQ ID NO: 662250 - DNA, 25 bp, Rattus norvegicus
ttatcccagcactgggcagtgcaga

SEQ ID NO: 662251 - DNA, 25 bp, Rattus norvegicus
ttatcccagcccaagtgaagacaga

SEQ ID NO: 662252 - DNA, 25 bp, Rattus norvegicus
ttatcccagccctagtgaagacaga

SEQ ID NO: 662253 - DNA, 25 bp, Rattus norvegicus
ttatcccagggcacgcttccgtgct

SEQ ID NO: 662254 - DNA, 25 bp, Rattus norvegicus
ttatcccagggctcgcttccgtgct

SEQ ID NO: 662255 - DNA, 25 bp, Rattus norvegicus
ttatcccatattaattacggctgag

SEQ ID NO: 662256 - DNA, 25 bp, Rattus norvegicus
ttatcccatatttattacggctgag

SEQ ID NO: 662257 - DNA, 25 bp, Rattus norvegicus
ttatcccatgatctaaggacacctg

SEQ ID NO: 662258 - DNA, 25 bp, Rattus norvegicus
ttatcccatgatgtaaggacacctg

SEQ ID NO: 662259 - DNA, 25 bp, Rattus norvegicus
ttatcccatttacaccatcctaagt

SEQ ID NO: 662260 - DNA, 25 bp, Rattus norvegicus
ttatcccatttagaccatcctaagt

SEQ ID NO: 662261 - DNA, 25 bp, Rattus norvegicus
ttatccccaaacctgaatttcctag

SEQ ID NO: 662262 - DNA, 25 bp, Rattus norvegicus
ttatccccaaacgtgaatttcctag

SEQ ID NO: 662263 - DNA, 25 bp, Rattus norvegicus
ttatccccagacatggcacctggaa

SEQ ID NO: 662264 - DNA, 25 bp, Rattus norvegicus
ttatccccagacttggcacctggaa

SEQ ID NO: 662265 - DNA, 25 bp, Rattus norvegicus
ttatccccataaaaccagtgttgtt

SEQ ID NO: 662266 - DNA, 25 bp, Rattus norvegicus
ttatccccataataccagtgttgtt

SEQ ID NO: 662267 - DNA, 25 bp, Rattus norvegicus
ttatccccatgcacagaaacgctca

SEQ ID NO: 662268 - DNA, 25 bp, Rattus norvegicus
ttatccccatgctcagaaacgctca

SEQ ID NO: 662269 - DNA, 25 bp, Rattus norvegicus
ttatccccgagacccacagtaaaca

SEQ ID NO: 662270 - DNA, 25 bp, Rattus norvegicus
ttatccccgagagccacagtaaaca

SEQ ID NO: 662271 - DNA, 25 bp, Rattus norvegicus
ttatccccgagtcgagtatggcttc

SEQ ID NO: 662272 - DNA, 25 bp, Rattus norvegicus
ttatccccgagtggagtatggcttc

SEQ ID NO: 662273 - DNA, 25 bp, Rattus norvegicus
ttatcccgatttcgcgtcatgatga

SEQ ID NO: 662274 - DNA, 25 bp, Rattus norvegicus
ttatcccgatttggcgtcatgatga

SEQ ID NO: 662275 - DNA, 25 bp, Rattus norvegicus
ttatcccggaaaactcagcagctga

SEQ ID NO: 662276 - DNA, 25 bp, Rattus norvegicus
ttatcccggaaatctcagcagctga

SEQ ID NO: 662277 - DNA, 25 bp, Rattus norvegicus
ttatcccggcacctgttgaaagcga

SEQ ID NO: 662278 - DNA, 25 bp, Rattus norvegicus
ttatcccggcacgtgttgaaagcga

SEQ ID NO: 662279 - DNA, 25 bp, Rattus norvegicus
ttatcccgtaccatatctgtatcta

SEQ ID NO: 662280 - DNA, 25 bp, Rattus norvegicus
ttatcccgtaccttatctgtatcta

SEQ ID NO: 662281 - DNA, 25 bp, Rattus norvegicus
ttatccctcaatagctttcttcaca

SEQ ID NO: 662282 - DNA, 25 bp, Rattus norvegicus
ttatccctcaattgctttcttcaca

SEQ ID NO: 662283 - DNA, 25 bp, Rattus norvegicus
ttatccctccttcaatctaaacaga

SEQ ID NO: 662284 - DNA, 25 bp, Rattus norvegicus
ttatccctccttgaatctaaacaga

SEQ ID NO: 662285 - DNA, 25 bp, Rattus norvegicus
ttatccctctgtaagtgctgtttgg

SEQ ID NO: 662286 - DNA, 25 bp, Rattus norvegicus
ttatccctctgttagtgctgtttgg

SEQ ID NO: 662287 - DNA, 25 bp, Rattus norvegicus
ttatccctgagcctgacaaaattga

SEQ ID NO: 662288 - DNA, 25 bp, Rattus norvegicus
ttatccctgagcgtgacaaaattga

SEQ ID NO: 662289 - DNA, 25 bp, Rattus norvegicus
ttatccctgattcgtaccctggctg

SEQ ID NO: 662290 - DNA, 25 bp, Rattus norvegicus
ttatccctgattggtaccctggctg

SEQ ID NO: 662291 - DNA, 25 bp, Rattus norvegicus
ttatccctgcctaacagctgtgaac

SEQ ID NO: 662292 - DNA, 25 bp, Rattus norvegicus
ttatccctgcctatatcatctttag

SEQ ID NO: 662293 - DNA, 25 bp, Rattus norvegicus
ttatccctgccttacagctgtgaac

SEQ ID NO: 662294 - DNA, 25 bp, Rattus norvegicus
ttatccctgcctttatcatctttag

SEQ ID NO: 662295 - DNA, 25 bp, Rattus norvegicus
ttatccctgggcactgctgacagca

SEQ ID NO: 662296 - DNA, 25 bp, Rattus norvegicus
ttatccctgggctctgctgacagca

SEQ ID NO: 662297 - DNA, 25 bp, Rattus norvegicus
ttatcccttgttccaaaagcgtcga

SEQ ID NO: 662298 - DNA, 25 bp, Rattus norvegicus
ttatcccttgttgcaaaagcgtcga

SEQ ID NO: 662299 - DNA, 25 bp, Rattus norvegicus
ttatccctttggaggacaagtgtgt

SEQ ID NO: 662300 - DNA, 25 bp, Rattus norvegicus
ttatccctttggtggacaagtgtgt

SEQ ID NO: 662301 - DNA, 25 bp, Rattus norvegicus
ttatccgatcttattactgtacatt

SEQ ID NO: 662302 - DNA, 25 bp, Rattus norvegicus
ttatccgatctttttactgtacatt

SEQ ID NO: 662303 - DNA, 25 bp, Rattus norvegicus
ttatccggagacaaactcagcctta

SEQ ID NO: 662304 - DNA, 25 bp, Rattus norvegicus
ttatccggagactaactcagcctta

SEQ ID NO: 662305 - DNA, 25 bp, Rattus norvegicus
ttatccgtagataaccgtagtgttt

SEQ ID NO: 662306 - DNA, 25 bp, Rattus norvegicus
ttatccgtagattaccgtagtgttt

SEQ ID NO: 662307 - DNA, 25 bp, Rattus norvegicus
ttatccgttcctcaagccacaaggt

SEQ ID NO: 662308 - DNA, 25 bp, Rattus norvegicus
ttatccgttcctgaagccacaaggt

SEQ ID NO: 662309 - DNA, 25 bp, Rattus norvegicus
ttatcctaaaggcatccccaaagct

SEQ ID NO: 662310 - DNA, 25 bp, Rattus norvegicus
ttatcctaaagggatccccaaagct

SEQ ID NO: 662311 - DNA, 25 bp, Rattus norvegicus
ttatcctaaatcacgcctcagactg

SEQ ID NO: 662312 - DNA, 25 bp, Rattus norvegicus
ttatcctaaatctcgcctcagactg

SEQ ID NO: 662313 - DNA, 25 bp, Rattus norvegicus
ttatcctaaattatacacagtgtac

SEQ ID NO: 662314 - DNA, 25 bp, Rattus norvegicus
ttatcctaaattttacacagtgtac

SEQ ID NO: 662315 - DNA, 25 bp, Rattus norvegicus
ttatcctaacttcagagctgggtat

SEQ ID NO: 662316 - DNA, 25 bp, Rattus norvegicus
ttatcctaacttgagagctgggtat

SEQ ID NO: 662317 - DNA, 25 bp, Rattus norvegicus
ttatcctagtgcagggtacaaccct

SEQ ID NO: 662318 - DNA, 25 bp, Rattus norvegicus
ttatcctagtgctgggtacaaccct

SEQ ID NO: 662319 - DNA, 25 bp, Rattus norvegicus
ttatcctcatggcacgggagctgca

SEQ ID NO: 662320 - DNA, 25 bp, Rattus norvegicus
ttatcctcatgggacgggagctgca

SEQ ID NO: 662321 - DNA, 25 bp, Rattus norvegicus
ttatcctcattgatgtccggcgtgt

SEQ ID NO: 662322 - DNA, 25 bp, Rattus norvegicus
ttatcctcattgttgtccggcgtgt

SEQ ID NO: 662323 - DNA, 25 bp, Rattus norvegicus
ttatcctcatttcaattgcattctg

SEQ ID NO: 662324 - DNA, 25 bp, Rattus norvegicus
ttatcctcatttgaattgcattctg

SEQ ID NO: 662325 - DNA, 25 bp, Rattus norvegicus
ttatcctcccagacacatacaaatg

SEQ ID NO: 662326 - DNA, 25 bp, Rattus norvegicus
ttatcctcccagtcacatacaaatg

SEQ ID NO: 662327 - DNA, 25 bp, Rattus norvegicus
ttatcctccgaactttacctacaag

SEQ ID NO: 662328 - DNA, 25 bp, Rattus norvegicus
ttatcctccgaagtttacctacaag

SEQ ID NO: 662329 - DNA, 25 bp, Rattus norvegicus
ttatcctcctttcccaaagtcataa

SEQ ID NO: 662330 - DNA, 25 bp, Rattus norvegicus
ttatcctcctttgccaaagtcataa

SEQ ID NO: 662331 - DNA, 25 bp, Rattus norvegicus
ttatcctcggcgataagacaagagc

SEQ ID NO: 662332 - DNA, 25 bp, Rattus norvegicus
ttatcctcggcgttaagacaagagc

SEQ ID NO: 662333 - DNA, 25 bp, Rattus norvegicus
ttatcctctatgagtggactcctcg

SEQ ID NO: 662334 - DNA, 25 bp, Rattus norvegicus
ttatcctctatgtgtggactcctcg

SEQ ID NO: 662335 - DNA, 25 bp, Rattus norvegicus
ttatcctctcttatcctttgtcttc

SEQ ID NO: 662336 - DNA, 25 bp, Rattus norvegicus
ttatcctctcttttcctttgtcttc

SEQ ID NO: 662337 - DNA, 25 bp, Rattus norvegicus
ttatcctctgttcaagggcaccagg

SEQ ID NO: 662338 - DNA, 25 bp, Rattus norvegicus
ttatcctctgttgaagggcaccagg

SEQ ID NO: 662339 - DNA, 25 bp, Rattus norvegicus
ttatcctcttgtctattcactcctc

SEQ ID NO: 662340 - DNA, 25 bp, Rattus norvegicus
ttatcctcttgtgtattcactcctc

SEQ ID NO: 662341 - DNA, 25 bp, Rattus norvegicus
ttatcctgagcccaactttagctgg

SEQ ID NO: 662342 - DNA, 25 bp, Rattus norvegicus
ttatcctgagccgaactttagctgg

SEQ ID NO: 662343 - DNA, 25 bp, Rattus norvegicus
ttatcctgtcttccttaatctttgt

SEQ ID NO: 662344 - DNA, 25 bp, Rattus norvegicus
ttatcctgtcttgcttaatctttgt

SEQ ID NO: 662345 - DNA, 25 bp, Rattus norvegicus
ttatcctgtggcaaacaacctgttt

SEQ ID NO: 662346 - DNA, 25 bp, Rattus norvegicus
ttatcctgtggctaacaacctgttt

SEQ ID NO: 662347 - DNA, 25 bp, Rattus norvegicus
ttatccttacaaagtgtgctttgtg

SEQ ID NO: 662348 - DNA, 25 bp, Rattus norvegicus
ttatccttacaatgtgtgctttgtg

SEQ ID NO: 662349 - DNA, 25 bp, Rattus norvegicus
ttatccttcctgcttccgtgtggaa

SEQ ID NO: 662350 - DNA, 25 bp, Rattus norvegicus
ttatccttcctggttccgtgtggaa

SEQ ID NO: 662351 - DNA, 25 bp, Rattus norvegicus
ttatccttctccatacgtcatttta

SEQ ID NO: 662352 - DNA, 25 bp, Rattus norvegicus
ttatccttctccttacgtcatttta

SEQ ID NO: 662353 - DNA, 25 bp, Rattus norvegicus
ttatccttctgaaggtggtctatcc

SEQ ID NO: 662354 - DNA, 25 bp, Rattus norvegicus
ttatccttctgatggtggtctatcc

SEQ ID NO: 662355 - DNA, 25 bp, Rattus norvegicus
ttatccttcttcatgagcgtcttgg

SEQ ID NO: 662356 - DNA, 25 bp, Rattus norvegicus
ttatccttcttcttgagcgtcttgg

SEQ ID NO: 662357 - DNA, 25 bp, Rattus norvegicus
ttatccttctttagttcgcagaccg

SEQ ID NO: 662358 - DNA, 25 bp, Rattus norvegicus
ttatccttcttttgttcgcagaccg

SEQ ID NO: 662359 - DNA, 25 bp, Rattus norvegicus
ttatccttgaagaagggcacactct

SEQ ID NO: 662360 - DNA, 25 bp, Rattus norvegicus
ttatccttgaagtagggcacactct

SEQ ID NO: 662361 - DNA, 25 bp, Rattus norvegicus
ttatccttttctactattcctttca

SEQ ID NO: 662362 - DNA, 25 bp, Rattus norvegicus
ttatccttttcttctattcctttca

SEQ ID NO: 662363 - DNA, 25 bp, Rattus norvegicus
ttatcctttttaatgacacattcag

SEQ ID NO: 662364 - DNA, 25 bp, Rattus norvegicus
ttatcctttttattgacacattcag

SEQ ID NO: 662365 - DNA, 25 bp, Rattus norvegicus
ttatcgactcttcccttgcagtgga

SEQ ID NO: 662366 - DNA, 25 bp, Rattus norvegicus
ttatcgactcttgccttgcagtgga

SEQ ID NO: 662367 - DNA, 25 bp, Rattus norvegicus
ttatcgactgcaaccagcctgtgga

SEQ ID NO: 662368 - DNA, 25 bp, Rattus norvegicus
ttatcgactgcatccagcctgtgga

SEQ ID NO: 662369 - DNA, 25 bp, Rattus norvegicus
ttatcgatccgaagagtctccatgg

SEQ ID NO: 662370 - DNA, 25 bp, Rattus norvegicus
ttatcgatccgatgagtctccatgg

SEQ ID NO: 662371 - DNA, 25 bp, Rattus norvegicus
ttatcgatcgaccaaaaaccaattg

SEQ ID NO: 662372 - DNA, 25 bp, Rattus norvegicus
ttatcgatcgacgaaaaaccaattg

SEQ ID NO: 662373 - DNA, 25 bp, Rattus norvegicus
ttatcgccactgaaaacctgaaggt

SEQ ID NO: 662374 - DNA, 25 bp, Rattus norvegicus
ttatcgccactgtaaacctgaaggt

SEQ ID NO: 662375 - DNA, 25 bp, Rattus norvegicus
ttatcgccccaaaagagtccagcag

SEQ ID NO: 662376 - DNA, 25 bp, Rattus norvegicus
ttatcgccccaatagagtccagcag

SEQ ID NO: 662377 - DNA, 25 bp, Rattus norvegicus
ttatcgctatggccctggcgcacgc

SEQ ID NO: 662378 - DNA, 25 bp, Rattus norvegicus
ttatcgctatgggcctggcgcacgc

SEQ ID NO: 662379 - DNA, 25 bp, Rattus norvegicus
ttatcggagagtccggcagagccct

SEQ ID NO: 662380 - DNA, 25 bp, Rattus norvegicus
ttatcggagagtgcggcagagccct

SEQ ID NO: 662381 - DNA, 25 bp, Rattus norvegicus
ttatcggcatccacaacgcgctcat

SEQ ID NO: 662382 - DNA, 25 bp, Rattus norvegicus
ttatcggcatcctcaacgcgctcat

SEQ ID NO: 662383 - DNA, 25 bp, Rattus norvegicus
ttatcggtttccactgccgcgggag

SEQ ID NO: 662384 - DNA, 25 bp, Rattus norvegicus
ttatcggtttcctctgccgcgggag

SEQ ID NO: 662385 - DNA, 25 bp, Rattus norvegicus
ttatcgtatgtaaacccactcctgc

SEQ ID NO: 662386 - DNA, 25 bp, Rattus norvegicus
ttatcgtatgtatacccactcctgc

SEQ ID NO: 662387 - DNA, 25 bp, Rattus norvegicus
ttatcgttgctgatgctggtgctag

SEQ ID NO: 662388 - DNA, 25 bp, Rattus norvegicus
ttatcgttgctgttgctggtgctag

SEQ ID NO: 662389 - DNA, 25 bp, Rattus norvegicus
ttatctaatcatagccttgtcggac

SEQ ID NO: 662390 - DNA, 25 bp, Rattus norvegicus
ttatctaatcattgccttgtcggac

SEQ ID NO: 662391 - DNA, 25 bp, Rattus norvegicus
ttatctacagctcagttagccctgg

SEQ ID NO: 662392 - DNA, 25 bp, Rattus norvegicus
ttatctacagctgagttagccctgg

SEQ ID NO: 662393 - DNA, 25 bp, Rattus norvegicus
ttatctacatgtaccccaccagaaa

SEQ ID NO: 662394 - DNA, 25 bp, Rattus norvegicus
ttatctacatgttccccaccagaaa

SEQ ID NO: 662395 - DNA, 25 bp, Rattus norvegicus
ttatctacatttcctgttaaactgt

SEQ ID NO: 662396 - DNA, 25 bp, Rattus norvegicus
ttatctacatttgctgttaaactgt

SEQ ID NO: 662397 - DNA, 25 bp, Rattus norvegicus
ttatctacggaaatcatagctgggc

SEQ ID NO: 662398 - DNA, 25 bp, Rattus norvegicus
ttatctacggaattcatagctgggc

SEQ ID NO: 662399 - DNA, 25 bp, Rattus norvegicus
ttatctactaccagattttggcgcc

SEQ ID NO: 662400 - DNA, 25 bp, Rattus norvegicus
ttatctactacctgattttggcgcc

SEQ ID NO: 662401 - DNA, 25 bp, Rattus norvegicus
ttatctactattcctaaattggcat

SEQ ID NO: 662402 - DNA, 25 bp, Rattus norvegicus
ttatctactattgctaaattggcat

SEQ ID NO: 662403 - DNA, 25 bp, Rattus norvegicus
ttatctactcccaggttctcttcaa

SEQ ID NO: 662404 - DNA, 25 bp, Rattus norvegicus
ttatctactccctggttctcttcaa

SEQ ID NO: 662405 - DNA, 25 bp, Rattus norvegicus
ttatctactgctatctcaccaagaa

SEQ ID NO: 662406 - DNA, 25 bp, Rattus norvegicus
ttatctactgctttctcaccaagaa

SEQ ID NO: 662407 - DNA, 25 bp, Rattus norvegicus
ttatctactgtgaggtgtggcctgt

SEQ ID NO: 662408 - DNA, 25 bp, Rattus norvegicus
ttatctactgtgtggtgtggcctgt

SEQ ID NO: 662409 - DNA, 25 bp, Rattus norvegicus
ttatctatcagcaactccgcatgga

SEQ ID NO: 662410 - DNA, 25 bp, Rattus norvegicus
ttatctatcagctactccgcatgga

SEQ ID NO: 662411 - DNA, 25 bp, Rattus norvegicus
ttatctcaagttcctgaggtgccaa

SEQ ID NO: 662412 - DNA, 25 bp, Rattus norvegicus
ttatctcaagttgctgaggtgccaa

SEQ ID NO: 662413 - DNA, 25 bp, Rattus norvegicus
ttatctcagagtatacatttctttt

SEQ ID NO: 662414 - DNA, 25 bp, Rattus norvegicus
ttatctcagagtttacatttctttt

SEQ ID NO: 662415 - DNA, 25 bp, Rattus norvegicus
ttatctcagattactccagctatcc

SEQ ID NO: 662416 - DNA, 25 bp, Rattus norvegicus
ttatctcagatttctccagctatcc

SEQ ID NO: 662417 - DNA, 25 bp, Rattus norvegicus
ttatctccacacataattccactgt

SEQ ID NO: 662418 - DNA, 25 bp, Rattus norvegicus
ttatctccacacttaattccactgt

SEQ ID NO: 662419 - DNA, 25 bp, Rattus norvegicus
ttatctcccactatggccttgaact

SEQ ID NO: 662420 - DNA, 25 bp, Rattus norvegicus
ttatctcccactttggccttgaact

SEQ ID NO: 662421 - DNA, 25 bp, Rattus norvegicus
ttatctccgaggcatgctgtgtagt

SEQ ID NO: 662422 - DNA, 25 bp, Rattus norvegicus
ttatctccgagggatgctgtgtagt

SEQ ID NO: 662423 - DNA, 25 bp, Rattus norvegicus
ttatctccgttcagcaggtcacgtt

SEQ ID NO: 662424 - DNA, 25 bp, Rattus norvegicus
ttatctccgttctgcaggtcacgtt

SEQ ID NO: 662425 - DNA, 25 bp, Rattus norvegicus
ttatctccgtttagccagggtacag

SEQ ID NO: 662426 - DNA, 25 bp, Rattus norvegicus
ttatctccgttttgccagggtacag

SEQ ID NO: 662427 - DNA, 25 bp, Rattus norvegicus
ttatctcctgaaaaaaggcccaaag

SEQ ID NO: 662428 - DNA, 25 bp, Rattus norvegicus
ttatctcctgaataaaggcccaaag

SEQ ID NO: 662429 - DNA, 25 bp, Rattus norvegicus
ttatctccttccctgtaggtgacag

SEQ ID NO: 662430 - DNA, 25 bp, Rattus norvegicus
ttatctccttccgtgtaggtgacag

SEQ ID NO: 662431 - DNA, 25 bp, Rattus norvegicus
ttatctcggctgagcgacggtagct

SEQ ID NO: 662432 - DNA, 25 bp, Rattus norvegicus
ttatctcggctgtgcgacggtagct

SEQ ID NO: 662433 - DNA, 25 bp, Rattus norvegicus
ttatctcgtttccttttcatctttg

SEQ ID NO: 662434 - DNA, 25 bp, Rattus norvegicus
ttatctcgtttcgttttcatctttg

SEQ ID NO: 662435 - DNA, 25 bp, Rattus norvegicus
ttatctctcagcagacccgaggcaa

SEQ ID NO: 662436 - DNA, 25 bp, Rattus norvegicus
ttatctctcagctgacccgaggcaa

SEQ ID NO: 662437 - DNA, 25 bp, Rattus norvegicus
ttatctctctgtcttcttccgaaaa

SEQ ID NO: 662438 - DNA, 25 bp, Rattus norvegicus
ttatctctctgtgttcttccgaaaa

SEQ ID NO: 662439 - DNA, 25 bp, Rattus norvegicus
ttatctctgaagattgtcctctgac

SEQ ID NO: 662440 - DNA, 25 bp, Rattus norvegicus
ttatctctgaagtttgtcctctgac

SEQ ID NO: 662441 - DNA, 25 bp, Rattus norvegicus
ttatctctgaatatgtcctcacggc

SEQ ID NO: 662442 - DNA, 25 bp, Rattus norvegicus
ttatctctgaatttgtcctcacggc

SEQ ID NO: 662443 - DNA, 25 bp, Rattus norvegicus
ttatctctgcagcaaggttctcttg

SEQ ID NO: 662444 - DNA, 25 bp, Rattus norvegicus
ttatctctgcaggaaggttctcttg

SEQ ID NO: 662445 - DNA, 25 bp, Rattus norvegicus
ttatctctgcttactcacttgtgga

SEQ ID NO: 662446 - DNA, 25 bp, Rattus norvegicus
ttatctctgcttatcccacctaggg

SEQ ID NO: 662447 - DNA, 25 bp, Rattus norvegicus
ttatctctgcttcgacacctgagca

SEQ ID NO: 662448 - DNA, 25 bp, Rattus norvegicus
ttatctctgcttggacacctgagca

SEQ ID NO: 662449 - DNA, 25 bp, Rattus norvegicus
ttatctctgctttctcacttgtgga

SEQ ID NO: 662450 - DNA, 25 bp, Rattus norvegicus
ttatctctgcttttcccacctaggg

SEQ ID NO: 662451 - DNA, 25 bp, Rattus norvegicus
ttatctctggagatacacctgggcc

SEQ ID NO: 662452 - DNA, 25 bp, Rattus norvegicus
ttatctctggagttacacctgggcc

SEQ ID NO: 662453 - DNA, 25 bp, Rattus norvegicus
ttatctcttgaactgccgtgtggtc

SEQ ID NO: 662454 - DNA, 25 bp, Rattus norvegicus
ttatctcttgaagtgccgtgtggtc

SEQ ID NO: 662455 - DNA, 25 bp, Rattus norvegicus
ttatctctttcaacagccaatcagg

SEQ ID NO: 662456 - DNA, 25 bp, Rattus norvegicus
ttatctctttcatcagccaatcagg

SEQ ID NO: 662457 - DNA, 25 bp, Rattus norvegicus
ttatctgaagctatctgcaagggta

SEQ ID NO: 662458 - DNA, 25 bp, Rattus norvegicus
ttatctgaagctttctgcaagggta

SEQ ID NO: 662459 - DNA, 25 bp, Rattus norvegicus
ttatctgacatgaaggccccaaaat

SEQ ID NO: 662460 - DNA, 25 bp, Rattus norvegicus
ttatctgacatgtaggccccaaaat

SEQ ID NO: 662461 - DNA, 25 bp, Rattus norvegicus
ttatctgacattccagctttctagg

SEQ ID NO: 662462 - DNA, 25 bp, Rattus norvegicus
ttatctgacattgcagctttctagg

SEQ ID NO: 662463 - DNA, 25 bp, Rattus norvegicus
ttatctgaccccaaagccctgttat

SEQ ID NO: 662464 - DNA, 25 bp, Rattus norvegicus
ttatctgacccctaagccctgttat

SEQ ID NO: 662465 - DNA, 25 bp, Rattus norvegicus
ttatctgagagtattctcccatccc

SEQ ID NO: 662466 - DNA, 25 bp, Rattus norvegicus
ttatctgagagttttctcccatccc

SEQ ID NO: 662467 - DNA, 25 bp, Rattus norvegicus
ttatctgagctcatgcaaacacgtt

SEQ ID NO: 662468 - DNA, 25 bp, Rattus norvegicus
ttatctgagctcttgcaaacacgtt

SEQ ID NO: 662469 - DNA, 25 bp, Rattus norvegicus
ttatctgaggacctgtgggcatccc

SEQ ID NO: 662470 - DNA, 25 bp, Rattus norvegicus
ttatctgaggacgtgtgggcatccc

SEQ ID NO: 662471 - DNA, 25 bp, Rattus norvegicus
ttatctgaggctcccaacttctcca

SEQ ID NO: 662472 - DNA, 25 bp, Rattus norvegicus
ttatctgaggctgccaacttctcca

SEQ ID NO: 662473 - DNA, 25 bp, Rattus norvegicus
ttatctgcaaaaaccggtcaactgt

SEQ ID NO: 662474 - DNA, 25 bp, Rattus norvegicus
ttatctgcaaaatccggtcaactgt

SEQ ID NO: 662475 - DNA, 25 bp, Rattus norvegicus
ttatctgccacaaggacgcctgagt

SEQ ID NO: 662476 - DNA, 25 bp, Rattus norvegicus
ttatctgccacatggacgcctgagt

SEQ ID NO: 662477 - DNA, 25 bp, Rattus norvegicus
ttatctgccctgcaaagtctaacaa

SEQ ID NO: 662478 - DNA, 25 bp, Rattus norvegicus
ttatctgccctggaaagtctaacaa

SEQ ID NO: 662479 - DNA, 25 bp, Rattus norvegicus
ttatctgcctggacatttgtggaag

SEQ ID NO: 662480 - DNA, 25 bp, Rattus norvegicus
ttatctgcctggtcatttgtggaag

SEQ ID NO: 662481 - DNA, 25 bp, Rattus norvegicus
ttatctgcgagcactgccagtgtat

SEQ ID NO: 662482 - DNA, 25 bp, Rattus norvegicus
ttatctgcgagctctgccagtgtat

SEQ ID NO: 662483 - DNA, 25 bp, Rattus norvegicus
ttatctgcgccccaaagaggtagaa

SEQ ID NO: 662484 - DNA, 25 bp, Rattus norvegicus
ttatctgcgcccgaaagaggtagaa

SEQ ID NO: 662485 - DNA, 25 bp, Rattus norvegicus
ttatctgctaacacatccaggcggt

SEQ ID NO: 662486 - DNA, 25 bp, Rattus norvegicus
ttatctgctaactcatccaggcggt

SEQ ID NO: 662487 - DNA, 25 bp, Rattus norvegicus
ttatctgctggcaccattgtgtcca

SEQ ID NO: 662488 - DNA, 25 bp, Rattus norvegicus
ttatctgctggctccattgtgtcca

SEQ ID NO: 662489 - DNA, 25 bp, Rattus norvegicus
ttatctgctttaattcctttgtcct

SEQ ID NO: 662490 - DNA, 25 bp, Rattus norvegicus
ttatctgctttatttcctttgtcct

SEQ ID NO: 662491 - DNA, 25 bp, Rattus norvegicus
ttatctgctttgagggccaactgtg

SEQ ID NO: 662492 - DNA, 25 bp, Rattus norvegicus
ttatctgctttgtgggccaactgtg

SEQ ID NO: 662493 - DNA, 25 bp, Rattus norvegicus
ttatctggcttcaccttaatctcta

SEQ ID NO: 662494 - DNA, 25 bp, Rattus norvegicus
ttatctggcttctccttaatctcta

SEQ ID NO: 662495 - DNA, 25 bp, Rattus norvegicus
ttatctgggcttagtgttctacttg

SEQ ID NO: 662496 - DNA, 25 bp, Rattus norvegicus
ttatctgggctttgtgttctacttg

SEQ ID NO: 662497 - DNA, 25 bp, Rattus norvegicus
ttatctggtgctcggctagtgatga

SEQ ID NO: 662498 - DNA, 25 bp, Rattus norvegicus
ttatctggtgctgggctagtgatga

SEQ ID NO: 662499 - DNA, 25 bp, Rattus norvegicus
ttatctggtgtaatccttttctaaa

SEQ ID NO: 662500 - DNA, 25 bp, Rattus norvegicus
ttatctggtgtattccttttctaaa

SEQ ID NO: 662501 - DNA, 25 bp, Rattus norvegicus
ttatctgtacttcctcactgtgtga

SEQ ID NO: 662502 - DNA, 25 bp, Rattus norvegicus
ttatctgtacttgctcactgtgtga

SEQ ID NO: 662503 - DNA, 25 bp, Rattus norvegicus
ttatctgtccatataaatgaccaca

SEQ ID NO: 662504 - DNA, 25 bp, Rattus norvegicus
ttatctgtccatttaaatgaccaca

SEQ ID NO: 662505 - DNA, 25 bp, Rattus norvegicus
ttatctgtgaatactgagcctcgcc

SEQ ID NO: 662506 - DNA, 25 bp, Rattus norvegicus
ttatctgtgaattctgagcctcgcc

SEQ ID NO: 662507 - DNA, 25 bp, Rattus norvegicus
ttatctgtgagtactgagcccctag

SEQ ID NO: 662508 - DNA, 25 bp, Rattus norvegicus
ttatctgtgagttctgagcccctag

SEQ ID NO: 662509 - DNA, 25 bp, Rattus norvegicus
ttatctgtgggtacacgtgcgtgtg

SEQ ID NO: 662510 - DNA, 25 bp, Rattus norvegicus
ttatctgtgggttcacgtgcgtgtg

SEQ ID NO: 662511 - DNA, 25 bp, Rattus norvegicus
ttatctgtgttactccatgcgtcct

SEQ ID NO: 662512 - DNA, 25 bp, Rattus norvegicus
ttatctgtgttagtccatgcgtcct

SEQ ID NO: 662513 - DNA, 25 bp, Rattus norvegicus
ttatctgttaagacccacgcctgaa

SEQ ID NO: 662514 - DNA, 25 bp, Rattus norvegicus
ttatctgttaagtcccacgcctgaa

SEQ ID NO: 662515 - DNA, 25 bp, Rattus norvegicus
ttatctgttcccatatctgatcagg

SEQ ID NO: 662516 - DNA, 25 bp, Rattus norvegicus
ttatctgttcccttatctgatcagg

SEQ ID NO: 662517 - DNA, 25 bp, Rattus norvegicus
ttatcttaagatcacatttctcaga

SEQ ID NO: 662518 - DNA, 25 bp, Rattus norvegicus
ttatcttaagatgacatttctcaga

SEQ ID NO: 662519 - DNA, 25 bp, Rattus norvegicus
ttatcttaataaccaccgtggattc

SEQ ID NO: 662520 - DNA, 25 bp, Rattus norvegicus
ttatcttaataagcaccgtggattc

SEQ ID NO: 662521 - DNA, 25 bp, Rattus norvegicus
ttatcttaatgtctgtccgcaccgc

SEQ ID NO: 662522 - DNA, 25 bp, Rattus norvegicus
ttatcttaatgtgtgtccgcaccgc

SEQ ID NO: 662523 - DNA, 25 bp, Rattus norvegicus
ttatcttacttcaccccaactattt

SEQ ID NO: 662524 - DNA, 25 bp, Rattus norvegicus
ttatcttacttctccccaactattt

SEQ ID NO: 662525 - DNA, 25 bp, Rattus norvegicus
ttatcttcagttactgcggctttga

SEQ ID NO: 662526 - DNA, 25 bp, Rattus norvegicus
ttatcttcagtttctgcggctttga

SEQ ID NO: 662527 - DNA, 25 bp, Rattus norvegicus
ttatcttcatctatgtcggctttcg

SEQ ID NO: 662528 - DNA, 25 bp, Rattus norvegicus
ttatcttcatctttgtcggctttcg

SEQ ID NO: 662529 - DNA, 25 bp, Rattus norvegicus
ttatcttccagaatttcctgggaga

SEQ ID NO: 662530 - DNA, 25 bp, Rattus norvegicus
ttatcttccagattttcctgggaga

SEQ ID NO: 662531 - DNA, 25 bp, Rattus norvegicus
ttatcttcccttccctttgtatcta

SEQ ID NO: 662532 - DNA, 25 bp, Rattus norvegicus
ttatcttcccttgcctttgtatcta

SEQ ID NO: 662533 - DNA, 25 bp, Rattus norvegicus
ttatcttccgatactgtgctggcag

SEQ ID NO: 662534 - DNA, 25 bp, Rattus norvegicus
ttatcttccgattctgtgctggcag

SEQ ID NO: 662535 - DNA, 25 bp, Rattus norvegicus
ttatcttcctatcgtgcttgtggtc

SEQ ID NO: 662536 - DNA, 25 bp, Rattus norvegicus
ttatcttcctatggtgcttgtggtc

SEQ ID NO: 662537 - DNA, 25 bp, Rattus norvegicus
ttatcttcctgaacttgattcccag

SEQ ID NO: 662538 - DNA, 25 bp, Rattus norvegicus
ttatcttcctgatcttgattcccag

SEQ ID NO: 662539 - DNA, 25 bp, Rattus norvegicus
ttatcttcctgcctttaatgtccga

SEQ ID NO: 662540 - DNA, 25 bp, Rattus norvegicus
ttatcttcctgcgtttaatgtccga

SEQ ID NO: 662541 - DNA, 25 bp, Rattus norvegicus
ttatcttctccaacgtctgcaagtt

SEQ ID NO: 662542 - DNA, 25 bp, Rattus norvegicus
ttatcttctccatcgtctgcaagtt

SEQ ID NO: 662543 - DNA, 25 bp, Rattus norvegicus
ttatcttctcctcctgtctggtgaa

SEQ ID NO: 662544 - DNA, 25 bp, Rattus norvegicus
ttatcttctcctgctgtctggtgaa

SEQ ID NO: 662545 - DNA, 25 bp, Rattus norvegicus
ttatcttgaaagagggtccctgtcc

SEQ ID NO: 662546 - DNA, 25 bp, Rattus norvegicus
ttatcttgaaagtgggtccctgtcc

SEQ ID NO: 662547 - DNA, 25 bp, Rattus norvegicus
ttatcttgaggacctaaggcctgtc

SEQ ID NO: 662548 - DNA, 25 bp, Rattus norvegicus
ttatcttgaggagctaaggcctgtc

SEQ ID NO: 662549 - DNA, 25 bp, Rattus norvegicus
ttatcttgctttctttgtctcctac

SEQ ID NO: 662550 - DNA, 25 bp, Rattus norvegicus
ttatcttgctttgtttgtctcctac

SEQ ID NO: 662551 - DNA, 25 bp, Rattus norvegicus
ttatcttgggccaatgcttctgggt

SEQ ID NO: 662552 - DNA, 25 bp, Rattus norvegicus
ttatcttgggcctatgcttctgggt

SEQ ID NO: 662553 - DNA, 25 bp, Rattus norvegicus
ttatcttgtctacgttagaggttta

SEQ ID NO: 662554 - DNA, 25 bp, Rattus norvegicus
ttatcttgtctaggttagaggttta

SEQ ID NO: 662555 - DNA, 25 bp, Rattus norvegicus
ttatctttcaccagggacatgctgc

SEQ ID NO: 662556 - DNA, 25 bp, Rattus norvegicus
ttatctttcacctgggacatgctgc

SEQ ID NO: 662557 - DNA, 25 bp, Rattus norvegicus
ttatctttccctcttagtcgcaagg

SEQ ID NO: 662558 - DNA, 25 bp, Rattus norvegicus
ttatctttccctgttagtcgcaagg

SEQ ID NO: 662559 - DNA, 25 bp, Rattus norvegicus
ttatctttcctaatactgcactaat

SEQ ID NO: 662560 - DNA, 25 bp, Rattus norvegicus
ttatctttcctattactgcactaat

SEQ ID NO: 662561 - DNA, 25 bp, Rattus norvegicus
ttatctttctacctctctttctatc

SEQ ID NO: 662562 - DNA, 25 bp, Rattus norvegicus
ttatctttctacgtctctttctatc

SEQ ID NO: 662563 - DNA, 25 bp, Rattus norvegicus
ttatctttctgactgctggccttaa

SEQ ID NO: 662564 - DNA, 25 bp, Rattus norvegicus
ttatctttctgagtgctggccttaa

SEQ ID NO: 662565 - DNA, 25 bp, Rattus norvegicus
ttatctttgcctataatctcccaca

SEQ ID NO: 662566 - DNA, 25 bp, Rattus norvegicus
ttatctttgcctttaatctcccaca

SEQ ID NO: 662567 - DNA, 25 bp, Rattus norvegicus
ttatctttggtcaatcctcttcctc

SEQ ID NO: 662568 - DNA, 25 bp, Rattus norvegicus
ttatctttggtctatcctcttcctc

SEQ ID NO: 662569 - DNA, 25 bp, Rattus norvegicus
ttatcttttaccaagtctcaggatg

SEQ ID NO: 662570 - DNA, 25 bp, Rattus norvegicus
ttatcttttacctagtctcaggatg

SEQ ID NO: 662571 - DNA, 25 bp, Rattus norvegicus
ttatcttttttcaactctgtctcgc

SEQ ID NO: 662572 - DNA, 25 bp, Rattus norvegicus
ttatcttttttctactctgtctcgc

SEQ ID NO: 662573 - DNA, 25 bp, Rattus norvegicus
ttatcttttttgaactaattctaag

SEQ ID NO: 662574 - DNA, 25 bp, Rattus norvegicus
ttatcttttttgtactaattctaag

SEQ ID NO: 662575 - DNA, 25 bp, Rattus norvegicus
ttatgaaaaaatcgtctgtccctaa

SEQ ID NO: 662576 - DNA, 25 bp, Rattus norvegicus
ttatgaaaaaatggtctgtccctaa

SEQ ID NO: 662577 - DNA, 25 bp, Rattus norvegicus
ttatgaaacccacggagtgggctcc

SEQ ID NO: 662578 - DNA, 25 bp, Rattus norvegicus
ttatgaaacccagggagtgggctcc

SEQ ID NO: 662579 - DNA, 25 bp, Rattus norvegicus
ttatgaaagctcctagcccttgtgt

SEQ ID NO: 662580 - DNA, 25 bp, Rattus norvegicus
ttatgaaagctcgtagcccttgtgt

SEQ ID NO: 662581 - DNA, 25 bp, Rattus norvegicus
ttatgaaagtgacccacggccgcga

SEQ ID NO: 662582 - DNA, 25 bp, Rattus norvegicus
ttatgaaagtgagccacggccgcga

SEQ ID NO: 662583 - DNA, 25 bp, Rattus norvegicus
ttatgaacattacgaaaaccacctt

SEQ ID NO: 662584 - DNA, 25 bp, Rattus norvegicus
ttatgaacattaggaaaaccacctt

SEQ ID NO: 662585 - DNA, 25 bp, Rattus norvegicus
ttatgaaccacacattctccttgac

SEQ ID NO: 662586 - DNA, 25 bp, Rattus norvegicus
ttatgaaccacagattctccttgac

SEQ ID NO: 662587 - DNA, 25 bp, Rattus norvegicus
ttatgaaccttaaccaccattctct

SEQ ID NO: 662588 - DNA, 25 bp, Rattus norvegicus
ttatgaaccttatccaccattctct

SEQ ID NO: 662589 - DNA, 25 bp, Rattus norvegicus
ttatgaaccttcctagggcactgtg

SEQ ID NO: 662590 - DNA, 25 bp, Rattus norvegicus
ttatgaaccttcgtagggcactgtg

SEQ ID NO: 662591 - DNA, 25 bp, Rattus norvegicus
ttatgaactgttccactacccaaac

SEQ ID NO: 662592 - DNA, 25 bp, Rattus norvegicus
ttatgaactgttgcactacccaaac

SEQ ID NO: 662593 - DNA, 25 bp, Rattus norvegicus
ttatgaagacctagcccatggtgat

SEQ ID NO: 662594 - DNA, 25 bp, Rattus norvegicus
ttatgaagaccttgcccatggtgat

SEQ ID NO: 662595 - DNA, 25 bp, Rattus norvegicus
ttatgaagcccacatgaaccatcct

SEQ ID NO: 662596 - DNA, 25 bp, Rattus norvegicus
ttatgaagcccagatgaaccatcct

SEQ ID NO: 662597 - DNA, 25 bp, Rattus norvegicus
ttatgaaggaggctcgtcgccgcaa

SEQ ID NO: 662598 - DNA, 25 bp, Rattus norvegicus
ttatgaaggagggtcgtcgccgcaa

SEQ ID NO: 662599 - DNA, 25 bp, Rattus norvegicus
ttatgaagggccaccgtggtaccca

SEQ ID NO: 662600 - DNA, 25 bp, Rattus norvegicus
ttatgaagggcctccgtggtaccca

SEQ ID NO: 662601 - DNA, 25 bp, Rattus norvegicus
ttatgaagggctaggtcacttgtca

SEQ ID NO: 662602 - DNA, 25 bp, Rattus norvegicus
ttatgaagggcttggtcacttgtca

SEQ ID NO: 662603 - DNA, 25 bp, Rattus norvegicus
ttatgaagtcataatctggcaaata

SEQ ID NO: 662604 - DNA, 25 bp, Rattus norvegicus
ttatgaagtcattatctggcaaata

SEQ ID NO: 662605 - DNA, 25 bp, Rattus norvegicus
ttatgaagttgaccttccagagtgc

SEQ ID NO: 662606 - DNA, 25 bp, Rattus norvegicus
ttatgaagttgagcttccagagtgc

SEQ ID NO: 662607 - DNA, 25 bp, Rattus norvegicus
ttatgaatcccacctttgttgccag

SEQ ID NO: 662608 - DNA, 25 bp, Rattus norvegicus
ttatgaatcccagctttgttgccag

SEQ ID NO: 662609 - DNA, 25 bp, Rattus norvegicus
ttatgaatcttactatctgccctcc

SEQ ID NO: 662610 - DNA, 25 bp, Rattus norvegicus
ttatgaatcttagtatctgccctcc

SEQ ID NO: 662611 - DNA, 25 bp, Rattus norvegicus
ttatgaatgcgtccagccttctata

SEQ ID NO: 662612 - DNA, 25 bp, Rattus norvegicus
ttatgaatgcgtgcagccttctata

SEQ ID NO: 662613 - DNA, 25 bp, Rattus norvegicus
ttatgaatgtgtcaggcctgttccc

SEQ ID NO: 662614 - DNA, 25 bp, Rattus norvegicus
ttatgaatgtgtgaggcctgttccc

SEQ ID NO: 662615 - DNA, 25 bp, Rattus norvegicus
ttatgaatttaaccttccctccgct

SEQ ID NO: 662616 - DNA, 25 bp, Rattus norvegicus
ttatgaatttaagcttccctccgct

SEQ ID NO: 662617 - DNA, 25 bp, Rattus norvegicus
ttatgacacatgcttccatccagaa

SEQ ID NO: 662618 - DNA, 25 bp, Rattus norvegicus
ttatgacacatggttccatccagaa

SEQ ID NO: 662619 - DNA, 25 bp, Rattus norvegicus
ttatgacacttcattacacgcctga

SEQ ID NO: 662620 - DNA, 25 bp, Rattus norvegicus
ttatgacacttctttacacgcctga

SEQ ID NO: 662621 - DNA, 25 bp, Rattus norvegicus
ttatgacatggtcccttcagatcct

SEQ ID NO: 662622 - DNA, 25 bp, Rattus norvegicus
ttatgacatggtgccttcagatcct

SEQ ID NO: 662623 - DNA, 25 bp, Rattus norvegicus
ttatgaccagatcctacctgattgt

SEQ ID NO: 662624 - DNA, 25 bp, Rattus norvegicus
ttatgaccagatgctacctgattgt

SEQ ID NO: 662625 - DNA, 25 bp, Rattus norvegicus
ttatgacctcctccttccctaataa

SEQ ID NO: 662626 - DNA, 25 bp, Rattus norvegicus
ttatgacctcctgcttccctaataa

SEQ ID NO: 662627 - DNA, 25 bp, Rattus norvegicus
ttatgacggcaaccgatgatcccta

SEQ ID NO: 662628 - DNA, 25 bp, Rattus norvegicus
ttatgacggcaagcgatgatcccta

SEQ ID NO: 662629 - DNA, 25 bp, Rattus norvegicus
ttatgactaacccattgagacacag

SEQ ID NO: 662630 - DNA, 25 bp, Rattus norvegicus
ttatgactaaccgattgagacacag

SEQ ID NO: 662631 - DNA, 25 bp, Rattus norvegicus
ttatgactagtcatggaaaattgat

SEQ ID NO: 662632 - DNA, 25 bp, Rattus norvegicus
ttatgactagtcttggaaaattgat

SEQ ID NO: 662633 - DNA, 25 bp, Rattus norvegicus
ttatgacttcagctcgccttcctca

SEQ ID NO: 662634 - DNA, 25 bp, Rattus norvegicus
ttatgacttcaggtcgccttcctca

SEQ ID NO: 662635 - DNA, 25 bp, Rattus norvegicus
ttatgacttcctacccaagttcaag

SEQ ID NO: 662636 - DNA, 25 bp, Rattus norvegicus
ttatgacttccttcccaagttcaag

SEQ ID NO: 662637 - DNA, 25 bp, Rattus norvegicus
ttatgactttgcctggcttcacggt

SEQ ID NO: 662638 - DNA, 25 bp, Rattus norvegicus
ttatgactttgcgtggcttcacggt

SEQ ID NO: 662639 - DNA, 25 bp, Rattus norvegicus
ttatgagaggcacagtccgaccccg

SEQ ID NO: 662640 - DNA, 25 bp, Rattus norvegicus
ttatgagaggcagagtccgaccccg

SEQ ID NO: 662641 - DNA, 25 bp, Rattus norvegicus
ttatgagattaacgccagtctgggc

SEQ ID NO: 662642 - DNA, 25 bp, Rattus norvegicus
ttatgagattaaggccagtctgggc

SEQ ID NO: 662643 - DNA, 25 bp, Rattus norvegicus
ttatgagcaagtccccgtgggaact

SEQ ID NO: 662644 - DNA, 25 bp, Rattus norvegicus
ttatgagcaagtgcccgtgggaact

SEQ ID NO: 662645 - DNA, 25 bp, Rattus norvegicus
ttatgagccccacggatgggcacaa

SEQ ID NO: 662646 - DNA, 25 bp, Rattus norvegicus
ttatgagccccagggatgggcacaa

SEQ ID NO: 662647 - DNA, 25 bp, Rattus norvegicus
ttatgagccttcagcccaagacgaa

SEQ ID NO: 662648 - DNA, 25 bp, Rattus norvegicus
ttatgagccttctgcccaagacgaa

SEQ ID NO: 662649 - DNA, 25 bp, Rattus norvegicus
ttatgaggacatacttcccactggg

SEQ ID NO: 662650 - DNA, 25 bp, Rattus norvegicus
ttatgaggacattcttcccactggg

SEQ ID NO: 662651 - DNA, 25 bp, Rattus norvegicus
ttatgaggcaggagtcccagcacga

SEQ ID NO: 662652 - DNA, 25 bp, Rattus norvegicus
ttatgaggcaggtgtcccagcacga

SEQ ID NO: 662653 - DNA, 25 bp, Rattus norvegicus
ttatgaggtcagagcccagagggct

SEQ ID NO: 662654 - DNA, 25 bp, Rattus norvegicus
ttatgaggtcagtgcccagagggct

SEQ ID NO: 662655 - DNA, 25 bp, Rattus norvegicus
ttatgaggtcctcctttgtccttaa

SEQ ID NO: 662656 - DNA, 25 bp, Rattus norvegicus
ttatgaggtcctgctttgtccttaa

SEQ ID NO: 662657 - DNA, 25 bp, Rattus norvegicus
ttatgaggttcccaatgtttcttcc

SEQ ID NO: 662658 - DNA, 25 bp, Rattus norvegicus
ttatgaggttccgaatgtttcttcc

SEQ ID NO: 662659 - DNA, 25 bp, Rattus norvegicus
ttatgagtgggacaccccagtcccc

SEQ ID NO: 662660 - DNA, 25 bp, Rattus norvegicus
ttatgagtgggagaccccagtcccc

SEQ ID NO: 662661 - DNA, 25 bp, Rattus norvegicus
ttatgagtgggcacagcgaccctgg

SEQ ID NO: 662662 - DNA, 25 bp, Rattus norvegicus
ttatgagtgggctcagcgaccctgg

SEQ ID NO: 662663 - DNA, 25 bp, Rattus norvegicus
ttatgagtttaactacccttccaat

SEQ ID NO: 662664 - DNA, 25 bp, Rattus norvegicus
ttatgagtttaagtacccttccaat

SEQ ID NO: 662665 - DNA, 25 bp, Rattus norvegicus
ttatgatcagatagccccttctgag

SEQ ID NO: 662666 - DNA, 25 bp, Rattus norvegicus
ttatgatcagattgccccttctgag

SEQ ID NO: 662667 - DNA, 25 bp, Rattus norvegicus
ttatgatcccatactgaaatgcagt

SEQ ID NO: 662668 - DNA, 25 bp, Rattus norvegicus
ttatgatcccattctgaaatgcagt

SEQ ID NO: 662669 - DNA, 25 bp, Rattus norvegicus
ttatgatccttcaggcttcaatggc

SEQ ID NO: 662670 - DNA, 25 bp, Rattus norvegicus
ttatgatccttctggcttcaatggc

SEQ ID NO: 662671 - DNA, 25 bp, Rattus norvegicus
ttatgatgaccaacagtgtgaagtc

SEQ ID NO: 662672 - DNA, 25 bp, Rattus norvegicus
ttatgatgaccatcagtgtgaagtc

SEQ ID NO: 662673 - DNA, 25 bp, Rattus norvegicus
ttatgatggcttagggcctgctgac

SEQ ID NO: 662674 - DNA, 25 bp, Rattus norvegicus
ttatgatggctttgggcctgctgac

SEQ ID NO: 662675 - DNA, 25 bp, Rattus norvegicus
ttatgatgtaacactatccttcctt

SEQ ID NO: 662676 - DNA, 25 bp, Rattus norvegicus
ttatgatgtaactctatccttcctt

SEQ ID NO: 662677 - DNA, 25 bp, Rattus norvegicus
ttatgatgtcaactttcaagcaaca

SEQ ID NO: 662678 - DNA, 25 bp, Rattus norvegicus
ttatgatgtcaagtttcaagcaaca

SEQ ID NO: 662679 - DNA, 25 bp, Rattus norvegicus
ttatgatgtgcgcacaccttctttt

SEQ ID NO: 662680 - DNA, 25 bp, Rattus norvegicus
ttatgatgtgcggacaccttctttt

SEQ ID NO: 662681 - DNA, 25 bp, Rattus norvegicus
ttatgattatgtctgcccttgggct

SEQ ID NO: 662682 - DNA, 25 bp, Rattus norvegicus
ttatgattatgtgtgcccttgggct

SEQ ID NO: 662683 - DNA, 25 bp, Rattus norvegicus
ttatgattgctgaaccgacccatgt

SEQ ID NO: 662684 - DNA, 25 bp, Rattus norvegicus
ttatgattgctgtaccgacccatgt

SEQ ID NO: 662685 - DNA, 25 bp, Rattus norvegicus
ttatgattttagattctctcctgct

SEQ ID NO: 662686 - DNA, 25 bp, Rattus norvegicus
ttatgattttagtttctctcctgct

SEQ ID NO: 662687 - DNA, 25 bp, Rattus norvegicus
ttatgcaacctccttctgatgtatc

SEQ ID NO: 662688 - DNA, 25 bp, Rattus norvegicus
ttatgcaacctcgttctgatgtatc

SEQ ID NO: 662689 - DNA, 25 bp, Rattus norvegicus
ttatgcaatgttcctcgtgtcactg

SEQ ID NO: 662690 - DNA, 25 bp, Rattus norvegicus
ttatgcaatgttgctcgtgtcactg

SEQ ID NO: 662691 - DNA, 25 bp, Rattus norvegicus
ttatgcacaggacagacagcggcgt

SEQ ID NO: 662692 - DNA, 25 bp, Rattus norvegicus
ttatgcacaggagagacagcggcgt

SEQ ID NO: 662693 - DNA, 25 bp, Rattus norvegicus
ttatgcaccctacgtggagcccagt

SEQ ID NO: 662694 - DNA, 25 bp, Rattus norvegicus
ttatgcaccctaggtggagcccagt

SEQ ID NO: 662695 - DNA, 25 bp, Rattus norvegicus
ttatgcacgaggagctggcacggaa

SEQ ID NO: 662696 - DNA, 25 bp, Rattus norvegicus
ttatgcacgaggtgctggcacggaa

SEQ ID NO: 662697 - DNA, 25 bp, Rattus norvegicus
ttatgcactgtgactttggtttata

SEQ ID NO: 662698 - DNA, 25 bp, Rattus norvegicus
ttatgcactgtgtctttggtttata

SEQ ID NO: 662699 - DNA, 25 bp, Rattus norvegicus
ttatgcactttgaatcaccgtccca

SEQ ID NO: 662700 - DNA, 25 bp, Rattus norvegicus
ttatgcactttgaccttcagcaagg

SEQ ID NO: 662701 - DNA, 25 bp, Rattus norvegicus
ttatgcactttgtatcaccgtccca

SEQ ID NO: 662702 - DNA, 25 bp, Rattus norvegicus
ttatgcactttgtccttcagcaagg

SEQ ID NO: 662703 - DNA, 25 bp, Rattus norvegicus
ttatgcagacacatacacaccacca

SEQ ID NO: 662704 - DNA, 25 bp, Rattus norvegicus
ttatgcagacacttacacaccacca

SEQ ID NO: 662705 - DNA, 25 bp, Rattus norvegicus
ttatgcagtactcggcactagtcag

SEQ ID NO: 662706 - DNA, 25 bp, Rattus norvegicus
ttatgcagtactgggcactagtcag

SEQ ID NO: 662707 - DNA, 25 bp, Rattus norvegicus
ttatgcagtcttatgatttcacacg

SEQ ID NO: 662708 - DNA, 25 bp, Rattus norvegicus
ttatgcagtcttttgatttcacacg

SEQ ID NO: 662709 - DNA, 25 bp, Rattus norvegicus
ttatgcagtgctaactttcagcata

SEQ ID NO: 662710 - DNA, 25 bp, Rattus norvegicus
ttatgcagtgcttactttcagcata

SEQ ID NO: 662711 - DNA, 25 bp, Rattus norvegicus
ttatgcatctgtccggttcgtttgt

SEQ ID NO: 662712 - DNA, 25 bp, Rattus norvegicus
ttatgcatctgtgcggttcgtttgt

SEQ ID NO: 662713 - DNA, 25 bp, Rattus norvegicus
ttatgcatgcggctgtttttattac

SEQ ID NO: 662714 - DNA, 25 bp, Rattus norvegicus
ttatgcatgcgggtgtttttattac

SEQ ID NO: 662715 - DNA, 25 bp, Rattus norvegicus
ttatgcatggttcactgttgcccag

SEQ ID NO: 662716 - DNA, 25 bp, Rattus norvegicus
ttatgcatggttgactgttgcccag

SEQ ID NO: 662717 - DNA, 25 bp, Rattus norvegicus
ttatgccaaaggaaatcccgcaccc

SEQ ID NO: 662718 - DNA, 25 bp, Rattus norvegicus
ttatgccaaaggtaatcccgcaccc

SEQ ID NO: 662719 - DNA, 25 bp, Rattus norvegicus
ttatgccaacatctcatgacactga

SEQ ID NO: 662720 - DNA, 25 bp, Rattus norvegicus
ttatgccaacatgtcatgacactga

SEQ ID NO: 662721 - DNA, 25 bp, Rattus norvegicus
ttatgccaacttactccttttcaag

SEQ ID NO: 662722 - DNA, 25 bp, Rattus norvegicus
ttatgccaactttctccttttcaag

SEQ ID NO: 662723 - DNA, 25 bp, Rattus norvegicus
ttatgccagcctctcctagagggaa

SEQ ID NO: 662724 - DNA, 25 bp, Rattus norvegicus
ttatgccagcctgtcctagagggaa

SEQ ID NO: 662725 - DNA, 25 bp, Rattus norvegicus
ttatgccatgcgacactctggcgcg

SEQ ID NO: 662726 - DNA, 25 bp, Rattus norvegicus
ttatgccatgcgtcactctggcgcg

SEQ ID NO: 662727 - DNA, 25 bp, Rattus norvegicus
ttatgccattggacaacagtttttt

SEQ ID NO: 662728 - DNA, 25 bp, Rattus norvegicus
ttatgccattggtcaacagtttttt

SEQ ID NO: 662729 - DNA, 25 bp, Rattus norvegicus
ttatgcccatttaatggttcccatg

SEQ ID NO: 662730 - DNA, 25 bp, Rattus norvegicus
ttatgcccattttatggttcccatg

SEQ ID NO: 662731 - DNA, 25 bp, Rattus norvegicus
ttatgccccgcaccagagagggtaa

SEQ ID NO: 662732 - DNA, 25 bp, Rattus norvegicus
ttatgccccgcagcagagagggtaa

SEQ ID NO: 662733 - DNA, 25 bp, Rattus norvegicus
ttatgccccgctacatttgcataaa

SEQ ID NO: 662734 - DNA, 25 bp, Rattus norvegicus
ttatgccccgcttcatttgcataaa

SEQ ID NO: 662735 - DNA, 25 bp, Rattus norvegicus
ttatgcccgattccaatgattcgcc

SEQ ID NO: 662736 - DNA, 25 bp, Rattus norvegicus
ttatgcccgattgcaatgattcgcc

SEQ ID NO: 662737 - DNA, 25 bp, Rattus norvegicus
ttatgccctatgactgctgtgccag

SEQ ID NO: 662738 - DNA, 25 bp, Rattus norvegicus
ttatgccctatgtctgctgtgccag

SEQ ID NO: 662739 - DNA, 25 bp, Rattus norvegicus
ttatgccctggactacagctcatag

SEQ ID NO: 662740 - DNA, 25 bp, Rattus norvegicus
ttatgccctggagtacagctcatag

SEQ ID NO: 662741 - DNA, 25 bp, Rattus norvegicus
ttatgccgcctgctgccagctggct

SEQ ID NO: 662742 - DNA, 25 bp, Rattus norvegicus
ttatgccgcctggtgccagctggct

SEQ ID NO: 662743 - DNA, 25 bp, Rattus norvegicus
ttatgccggcgtatagtagttttgt

SEQ ID NO: 662744 - DNA, 25 bp, Rattus norvegicus
ttatgccggcgtttagtagttttgt

SEQ ID NO: 662745 - DNA, 25 bp, Rattus norvegicus
ttatgcctagagacaccccaaagaa

SEQ ID NO: 662746 - DNA, 25 bp, Rattus norvegicus
ttatgcctagagtcaccccaaagaa

SEQ ID NO: 662747 - DNA, 25 bp, Rattus norvegicus
ttatgcctattcaggccagcggaaa

SEQ ID NO: 662748 - DNA, 25 bp, Rattus norvegicus
ttatgcctattctggccagcggaaa

SEQ ID NO: 662749 - DNA, 25 bp, Rattus norvegicus
ttatgcctcctccatttcaattaaa

SEQ ID NO: 662750 - DNA, 25 bp, Rattus norvegicus
ttatgcctcctcgatttcaattaaa

SEQ ID NO: 662751 - DNA, 25 bp, Rattus norvegicus
ttatgcctcctgaaactaagcttgg

SEQ ID NO: 662752 - DNA, 25 bp, Rattus norvegicus
ttatgcctcctgtaactaagcttgg

SEQ ID NO: 662753 - DNA, 25 bp, Rattus norvegicus
ttatgcctctgaagccaagttctga

SEQ ID NO: 662754 - DNA, 25 bp, Rattus norvegicus
ttatgcctctgatgccaagttctga

SEQ ID NO: 662755 - DNA, 25 bp, Rattus norvegicus
ttatgccttctccagggcaagggaa

SEQ ID NO: 662756 - DNA, 25 bp, Rattus norvegicus
ttatgccttctcgagggcaagggaa

SEQ ID NO: 662757 - DNA, 25 bp, Rattus norvegicus
ttatgcctttgtacacatggagcgg

SEQ ID NO: 662758 - DNA, 25 bp, Rattus norvegicus
ttatgcctttgttcacatggagcgg

SEQ ID NO: 662759 - DNA, 25 bp, Rattus norvegicus
ttatgcgactgtccctggttttagg

SEQ ID NO: 662760 - DNA, 25 bp, Rattus norvegicus
ttatgcgactgtgcctggttttagg

SEQ ID NO: 662761 - DNA, 25 bp, Rattus norvegicus
ttatgcgatctacctcatcgtcatt

SEQ ID NO: 662762 - DNA, 25 bp, Rattus norvegicus
ttatgcgatctagctcatcgtcatt

SEQ ID NO: 662763 - DNA, 25 bp, Rattus norvegicus
ttatgcgcaactctttggctccatt

SEQ ID NO: 662764 - DNA, 25 bp, Rattus norvegicus
ttatgcgcaactgtttggctccatt

SEQ ID NO: 662765 - DNA, 25 bp, Rattus norvegicus
ttatgcgcagctactctatgacaga

SEQ ID NO: 662766 - DNA, 25 bp, Rattus norvegicus
ttatgcgcagcttctctatgacaga

SEQ ID NO: 662767 - DNA, 25 bp, Rattus norvegicus
ttatgcgcgaacaaggcccctggat

SEQ ID NO: 662768 - DNA, 25 bp, Rattus norvegicus
ttatgcgcgaactaggcccctggat

SEQ ID NO: 662769 - DNA, 25 bp, Rattus norvegicus
ttatgcgggactacaagagggccct

SEQ ID NO: 662770 - DNA, 25 bp, Rattus norvegicus
ttatgcgggacttcaagagggccct

SEQ ID NO: 662771 - DNA, 25 bp, Rattus norvegicus
ttatgcggttctaccatgaaacaga

SEQ ID NO: 662772 - DNA, 25 bp, Rattus norvegicus
ttatgcggttcttccatgaaacaga

SEQ ID NO: 662773 - DNA, 25 bp, Rattus norvegicus
ttatgcggttttcaagcccttccca

SEQ ID NO: 662774 - DNA, 25 bp, Rattus norvegicus
ttatgcggttttgaagcccttccca

SEQ ID NO: 662775 - DNA, 25 bp, Rattus norvegicus
ttatgctaagcactgcctaggccag

SEQ ID NO: 662776 - DNA, 25 bp, Rattus norvegicus
ttatgctaagcagtgcctaggccag

SEQ ID NO: 662777 - DNA, 25 bp, Rattus norvegicus
ttatgctacataaacttttatctgc

SEQ ID NO: 662778 - DNA, 25 bp, Rattus norvegicus
ttatgctacatatacttttatctgc

SEQ ID NO: 662779 - DNA, 25 bp, Rattus norvegicus
ttatgctaccacacttttccctttt

SEQ ID NO: 662780 - DNA, 25 bp, Rattus norvegicus
ttatgctaccactcttttccctttt

SEQ ID NO: 662781 - DNA, 25 bp, Rattus norvegicus
ttatgctatcctacactgggagctt

SEQ ID NO: 662782 - DNA, 25 bp, Rattus norvegicus
ttatgctatccttcactgggagctt

SEQ ID NO: 662783 - DNA, 25 bp, Rattus norvegicus
ttatgctcaaggagctacctcacct

SEQ ID NO: 662784 - DNA, 25 bp, Rattus norvegicus
ttatgctcaaggtgctacctcacct

SEQ ID NO: 662785 - DNA, 25 bp, Rattus norvegicus
ttatgctcacaccacagctggagag

SEQ ID NO: 662786 - DNA, 25 bp, Rattus norvegicus
ttatgctcacacgacagctggagag

SEQ ID NO: 662787 - DNA, 25 bp, Rattus norvegicus
ttatgctcatagacacccaggctgg

SEQ ID NO: 662788 - DNA, 25 bp, Rattus norvegicus
ttatgctcatagtcacccaggctgg

SEQ ID NO: 662789 - DNA, 25 bp, Rattus norvegicus
ttatgctcggacatttaacctgact

SEQ ID NO: 662790 - DNA, 25 bp, Rattus norvegicus
ttatgctcggacttttaacctgact

SEQ ID NO: 662791 - DNA, 25 bp, Rattus norvegicus
ttatgctctcatatgggaaggtgtg

SEQ ID NO: 662792 - DNA, 25 bp, Rattus norvegicus
ttatgctctcatttgggaaggtgtg

SEQ ID NO: 662793 - DNA, 25 bp, Rattus norvegicus
ttatgctctgggaacagctgacaag

SEQ ID NO: 662794 - DNA, 25 bp, Rattus norvegicus
ttatgctctgggtacagctgacaag

SEQ ID NO: 662795 - DNA, 25 bp, Rattus norvegicus
ttatgctctgttactgacccaatat

SEQ ID NO: 662796 - DNA, 25 bp, Rattus norvegicus
ttatgctctgtttctgacccaatat

SEQ ID NO: 662797 - DNA, 25 bp, Rattus norvegicus
ttatgctgactgataatgcagacgc

SEQ ID NO: 662798 - DNA, 25 bp, Rattus norvegicus
ttatgctgactgttaatgcagacgc

SEQ ID NO: 662799 - DNA, 25 bp, Rattus norvegicus
ttatgctgatctccaattgaattga

SEQ ID NO: 662800 - DNA, 25 bp, Rattus norvegicus
ttatgctgatctgcaattgaattga

SEQ ID NO: 662801 - DNA, 25 bp, Rattus norvegicus
ttatgctgcattaccttgattccca

SEQ ID NO: 662802 - DNA, 25 bp, Rattus norvegicus
ttatgctgcatttccttgattccca

SEQ ID NO: 662803 - DNA, 25 bp, Rattus norvegicus
ttatgctgctggaagcttaaagaga

SEQ ID NO: 662804 - DNA, 25 bp, Rattus norvegicus
ttatgctgctggtagcttaaagaga

SEQ ID NO: 662805 - DNA, 25 bp, Rattus norvegicus
ttatgctggagcagggttttaacaa

SEQ ID NO: 662806 - DNA, 25 bp, Rattus norvegicus
ttatgctggagctgggttttaacaa

SEQ ID NO: 662807 - DNA, 25 bp, Rattus norvegicus
ttatgctgtatgatcctcctcgaat

SEQ ID NO: 662808 - DNA, 25 bp, Rattus norvegicus
ttatgctgtatgttcctcctcgaat

SEQ ID NO: 662809 - DNA, 25 bp, Rattus norvegicus
ttatgctgtgtcaggtgccctcaac

SEQ ID NO: 662810 - DNA, 25 bp, Rattus norvegicus
ttatgctgtgtctggtgccctcaac

SEQ ID NO: 662811 - DNA, 25 bp, Rattus norvegicus
ttatgcttagagatcagcccgagtg

SEQ ID NO: 662812 - DNA, 25 bp, Rattus norvegicus
ttatgcttagagttcagcccgagtg

SEQ ID NO: 662813 - DNA, 25 bp, Rattus norvegicus
ttatgcttccttctagctgccagtt

SEQ ID NO: 662814 - DNA, 25 bp, Rattus norvegicus
ttatgcttccttgtagctgccagtt

SEQ ID NO: 662815 - DNA, 25 bp, Rattus norvegicus
ttatgcttgattctactgtgtcttc

SEQ ID NO: 662816 - DNA, 25 bp, Rattus norvegicus
ttatgcttgattgtactgtgtcttc

SEQ ID NO: 662817 - DNA, 25 bp, Rattus norvegicus
ttatgcttgcagacttgtttggaaa

SEQ ID NO: 662818 - DNA, 25 bp, Rattus norvegicus
ttatgcttgcagtcttgtttggaaa

SEQ ID NO: 662819 - DNA, 25 bp, Rattus norvegicus
ttatgctttacccagatgatgctgc

SEQ ID NO: 662820 - DNA, 25 bp, Rattus norvegicus
ttatgctttaccgagatgatgctgc

SEQ ID NO: 662821 - DNA, 25 bp, Rattus norvegicus
ttatgctttccaagtgtgtagtgcg

SEQ ID NO: 662822 - DNA, 25 bp, Rattus norvegicus
ttatgctttccatgtgtgtagtgcg

SEQ ID NO: 662823 - DNA, 25 bp, Rattus norvegicus
ttatgctttgatcctccaagtgtcc

SEQ ID NO: 662824 - DNA, 25 bp, Rattus norvegicus
ttatgctttgatgctccaagtgtcc

SEQ ID NO: 662825 - DNA, 25 bp, Rattus norvegicus
ttatggaaccagactcacgagactc

SEQ ID NO: 662826 - DNA, 25 bp, Rattus norvegicus
ttatggaaccagtctcacgagactc

SEQ ID NO: 662827 - DNA, 25 bp, Rattus norvegicus
ttatggacccatcactctgactaca

SEQ ID NO: 662828 - DNA, 25 bp, Rattus norvegicus
ttatggacccatgactctgactaca

SEQ ID NO: 662829 - DNA, 25 bp, Rattus norvegicus
ttatggactctcattgccgttcaaa

SEQ ID NO: 662830 - DNA, 25 bp, Rattus norvegicus
ttatggactctctttgccgttcaaa

SEQ ID NO: 662831 - DNA, 25 bp, Rattus norvegicus
ttatggactcttagcccttctgaca

SEQ ID NO: 662832 - DNA, 25 bp, Rattus norvegicus
ttatggactctttgcccttctgaca

SEQ ID NO: 662833 - DNA, 25 bp, Rattus norvegicus
ttatggactgtcattgggaccgaca

SEQ ID NO: 662834 - DNA, 25 bp, Rattus norvegicus
ttatggactgtctttgggaccgaca

SEQ ID NO: 662835 - DNA, 25 bp, Rattus norvegicus
ttatggacttttccagagtgtctga

SEQ ID NO: 662836 - DNA, 25 bp, Rattus norvegicus
ttatggacttttgcagagtgtctga

SEQ ID NO: 662837 - DNA, 25 bp, Rattus norvegicus
ttatggagagaaacaagtcagcccc

SEQ ID NO: 662838 - DNA, 25 bp, Rattus norvegicus
ttatggagagaatcaagtcagcccc

SEQ ID NO: 662839 - DNA, 25 bp, Rattus norvegicus
ttatggagccatcccattttatact

SEQ ID NO: 662840 - DNA, 25 bp, Rattus norvegicus
ttatggagccatgccattttatact

SEQ ID NO: 662841 - DNA, 25 bp, Rattus norvegicus
ttatggaggcgacagaggtggctat

SEQ ID NO: 662842 - DNA, 25 bp, Rattus norvegicus
ttatggaggcgagagaggtggctat

SEQ ID NO: 662843 - DNA, 25 bp, Rattus norvegicus
ttatggagggcacggccgacttttc

SEQ ID NO: 662844 - DNA, 25 bp, Rattus norvegicus
ttatggagggcagggccgacttttc

SEQ ID NO: 662845 - DNA, 25 bp, Rattus norvegicus
ttatggaggtgtcagtgcccgtaca

SEQ ID NO: 662846 - DNA, 25 bp, Rattus norvegicus
ttatggaggtgtgagtgcccgtaca

SEQ ID NO: 662847 - DNA, 25 bp, Rattus norvegicus
ttatggagtcctactttctctagtg

SEQ ID NO: 662848 - DNA, 25 bp, Rattus norvegicus
ttatggagtccttctttctctagtg

SEQ ID NO: 662849 - DNA, 25 bp, Rattus norvegicus
ttatggatctccaagaggtcacatt

SEQ ID NO: 662850 - DNA, 25 bp, Rattus norvegicus
ttatggatctcctagaggtcacatt

SEQ ID NO: 662851 - DNA, 25 bp, Rattus norvegicus
ttatggatcttgcttatggcctggt

SEQ ID NO: 662852 - DNA, 25 bp, Rattus norvegicus
ttatggatcttggttatggcctggt

SEQ ID NO: 662853 - DNA, 25 bp, Rattus norvegicus
ttatggatgcaaatcactgaggaat

SEQ ID NO: 662854 - DNA, 25 bp, Rattus norvegicus
ttatggatgcaattcactgaggaat

SEQ ID NO: 662855 - DNA, 25 bp, Rattus norvegicus
ttatggatggttaagcccggcccac

SEQ ID NO: 662856 - DNA, 25 bp, Rattus norvegicus
ttatggatggtttagcccggcccac

SEQ ID NO: 662857 - DNA, 25 bp, Rattus norvegicus
ttatggcacccaacagcaagcagga

SEQ ID NO: 662858 - DNA, 25 bp, Rattus norvegicus
ttatggcacccatcagcaagcagga

SEQ ID NO: 662859 - DNA, 25 bp, Rattus norvegicus
ttatggcagaaactcctctcaagga

SEQ ID NO: 662860 - DNA, 25 bp, Rattus norvegicus
ttatggcagaaagtcctctcaagga

SEQ ID NO: 662861 - DNA, 25 bp, Rattus norvegicus
ttatggcatttgctataaccggcta

SEQ ID NO: 662862 - DNA, 25 bp, Rattus norvegicus
ttatggcatttggtataaccggcta

SEQ ID NO: 662863 - DNA, 25 bp, Rattus norvegicus
ttatggccagccagttgcacaataa

SEQ ID NO: 662864 - DNA, 25 bp, Rattus norvegicus
ttatggccagcctgttgcacaataa

SEQ ID NO: 662865 - DNA, 25 bp, Rattus norvegicus
ttatggccatcaatgtagttgtagc

SEQ ID NO: 662866 - DNA, 25 bp, Rattus norvegicus
ttatggccatcattgtagttgtagc

SEQ ID NO: 662867 - DNA, 25 bp, Rattus norvegicus
ttatggccctacaattcccaattac

SEQ ID NO: 662868 - DNA, 25 bp, Rattus norvegicus
ttatggccctactattcccaattac

SEQ ID NO: 662869 - DNA, 25 bp, Rattus norvegicus
ttatggcctcatccattggaagctg

SEQ ID NO: 662870 - DNA, 25 bp, Rattus norvegicus
ttatggcctcatgcattggaagctg

SEQ ID NO: 662871 - DNA, 25 bp, Rattus norvegicus
ttatggcggaagaaatgaaagacga

SEQ ID NO: 662872 - DNA, 25 bp, Rattus norvegicus
ttatggcggaagtaatgaaagacga

SEQ ID NO: 662873 - DNA, 25 bp, Rattus norvegicus
ttatggcgtggacaggttcagcaat

SEQ ID NO: 662874 - DNA, 25 bp, Rattus norvegicus
ttatggcgtggagaggttcagcaat

SEQ ID NO: 662875 - DNA, 25 bp, Rattus norvegicus
ttatggctaccaaccaaaatagtct

SEQ ID NO: 662876 - DNA, 25 bp, Rattus norvegicus
ttatggctaccatccaaaatagtct

SEQ ID NO: 662877 - DNA, 25 bp, Rattus norvegicus
ttatggctccctattcgttgatctc

SEQ ID NO: 662878 - DNA, 25 bp, Rattus norvegicus
ttatggctcccttttcgttgatctc

SEQ ID NO: 662879 - DNA, 25 bp, Rattus norvegicus
ttatggctggagaggcacgtcttat

SEQ ID NO: 662880 - DNA, 25 bp, Rattus norvegicus
ttatggctggagtggcacgtcttat

SEQ ID NO: 662881 - DNA, 25 bp, Rattus norvegicus
ttatggctgtacacctgccgtagta

SEQ ID NO: 662882 - DNA, 25 bp, Rattus norvegicus
ttatggctgtactcctgccgtagta

SEQ ID NO: 662883 - DNA, 25 bp, Rattus norvegicus
ttatggcttgcaactctttgacctc

SEQ ID NO: 662884 - DNA, 25 bp, Rattus norvegicus
ttatggcttgcatctctttgacctc

SEQ ID NO: 662885 - DNA, 25 bp, Rattus norvegicus
ttatggctttcaagctctccatcaa

SEQ ID NO: 662886 - DNA, 25 bp, Rattus norvegicus
ttatggctttcatgctctccatcaa

SEQ ID NO: 662887 - DNA, 25 bp, Rattus norvegicus
ttatgggacgtcacagagggatcac

SEQ ID NO: 662888 - DNA, 25 bp, Rattus norvegicus
ttatgggacgtctcagagggatcac

SEQ ID NO: 662889 - DNA, 25 bp, Rattus norvegicus
ttatgggagtgtcgactccttgcct

SEQ ID NO: 662890 - DNA, 25 bp, Rattus norvegicus
ttatgggagtgtggactccttgcct

SEQ ID NO: 662891 - DNA, 25 bp, Rattus norvegicus
ttatgggatgcaccaggcctcttgg

SEQ ID NO: 662892 - DNA, 25 bp, Rattus norvegicus
ttatgggatgcagcaggcctcttgg

SEQ ID NO: 662893 - DNA, 25 bp, Rattus norvegicus
ttatgggatgggacactgcctccaa

SEQ ID NO: 662894 - DNA, 25 bp, Rattus norvegicus
ttatgggatgggtcactgcctccaa

SEQ ID NO: 662895 - DNA, 25 bp, Rattus norvegicus
ttatgggattgcctcctctgccagc

SEQ ID NO: 662896 - DNA, 25 bp, Rattus norvegicus
ttatgggattgcgtcctctgccagc

SEQ ID NO: 662897 - DNA, 25 bp, Rattus norvegicus
ttatgggcaacacctattctctgac

SEQ ID NO: 662898 - DNA, 25 bp, Rattus norvegicus
ttatgggcaacagctattctctgac

SEQ ID NO: 662899 - DNA, 25 bp, Rattus norvegicus
ttatgggcatatccagctccctgaa

SEQ ID NO: 662900 - DNA, 25 bp, Rattus norvegicus
ttatgggcatatgcagctccctgaa

SEQ ID NO: 662901 - DNA, 25 bp, Rattus norvegicus
ttatgggccaacataatctatgaca

SEQ ID NO: 662902 - DNA, 25 bp, Rattus norvegicus
ttatgggccaacttaatctatgaca

SEQ ID NO: 662903 - DNA, 25 bp, Rattus norvegicus
ttatgggccaccatctttcgaagga

SEQ ID NO: 662904 - DNA, 25 bp, Rattus norvegicus
ttatgggccaccttctttcgaagga

SEQ ID NO: 662905 - DNA, 25 bp, Rattus norvegicus
ttatggtacattcctgctctgtgct

SEQ ID NO: 662906 - DNA, 25 bp, Rattus norvegicus
ttatggtacattgctgctctgtgct

SEQ ID NO: 662907 - DNA, 25 bp, Rattus norvegicus
ttatggtagaacactctctctctct

SEQ ID NO: 662908 - DNA, 25 bp, Rattus norvegicus
ttatggtagaactctctctctctct

SEQ ID NO: 662909 - DNA, 25 bp, Rattus norvegicus
ttatggtataagaacactgtggaaa

SEQ ID NO: 662910 - DNA, 25 bp, Rattus norvegicus
ttatggtataagtacactgtggaaa

SEQ ID NO: 662911 - DNA, 25 bp, Rattus norvegicus
ttatggtcccagagctcaataccca

SEQ ID NO: 662912 - DNA, 25 bp, Rattus norvegicus
ttatggtcccagtgctcaataccca

SEQ ID NO: 662913 - DNA, 25 bp, Rattus norvegicus
ttatggtcctagaaagccttaaaat

SEQ ID NO: 662914 - DNA, 25 bp, Rattus norvegicus
ttatggtcctagagcgatggctttg

SEQ ID NO: 662915 - DNA, 25 bp, Rattus norvegicus
ttatggtcctagtaagccttaaaat

SEQ ID NO: 662916 - DNA, 25 bp, Rattus norvegicus
ttatggtcctagtgcgatggctttg

SEQ ID NO: 662917 - DNA, 25 bp, Rattus norvegicus
ttatggtcctcaacaggctcagaga

SEQ ID NO: 662918 - DNA, 25 bp, Rattus norvegicus
ttatggtcctcatcaggctcagaga

SEQ ID NO: 662919 - DNA, 25 bp, Rattus norvegicus
ttatggtcgcaaagctgcttgtcct

SEQ ID NO: 662920 - DNA, 25 bp, Rattus norvegicus
ttatggtcgcaatgctgcttgtcct

SEQ ID NO: 662921 - DNA, 25 bp, Rattus norvegicus
ttatggtctgtgatcgtagctctga

SEQ ID NO: 662922 - DNA, 25 bp, Rattus norvegicus
ttatggtctgtgttcgtagctctga

SEQ ID NO: 662923 - DNA, 25 bp, Rattus norvegicus
ttatggtgcttgacgtctgtaaaca

SEQ ID NO: 662924 - DNA, 25 bp, Rattus norvegicus
ttatggtgcttgtcgtctgtaaaca

SEQ ID NO: 662925 - DNA, 25 bp, Rattus norvegicus
ttatggtggcttaggtctctgcatt

SEQ ID NO: 662926 - DNA, 25 bp, Rattus norvegicus
ttatggtggctttggtctctgcatt

SEQ ID NO: 662927 - DNA, 25 bp, Rattus norvegicus
ttatggttcatccttatttcctcct

SEQ ID NO: 662928 - DNA, 25 bp, Rattus norvegicus
ttatggttcatcgttatttcctcct

SEQ ID NO: 662929 - DNA, 25 bp, Rattus norvegicus
ttatggttctgccactaccagggag

SEQ ID NO: 662930 - DNA, 25 bp, Rattus norvegicus
ttatggttctgcgactaccagggag

SEQ ID NO: 662931 - DNA, 25 bp, Rattus norvegicus
ttatggttgagaacgggttccacaa

SEQ ID NO: 662932 - DNA, 25 bp, Rattus norvegicus
ttatggttgagatcgggttccacaa

SEQ ID NO: 662933 - DNA, 25 bp, Rattus norvegicus
ttatggttgcccatggttttgtaat

SEQ ID NO: 662934 - DNA, 25 bp, Rattus norvegicus
ttatggttgcccttggttttgtaat

SEQ ID NO: 662935 - DNA, 25 bp, Rattus norvegicus
ttatggttgtagagttgctgaagca

SEQ ID NO: 662936 - DNA, 25 bp, Rattus norvegicus
ttatggttgtagtgttgctgaagca

SEQ ID NO: 662937 - DNA, 25 bp, Rattus norvegicus
ttatgtaaatacagccctggtgtct

SEQ ID NO: 662938 - DNA, 25 bp, Rattus norvegicus
ttatgtaaatactgccctggtgtct

SEQ ID NO: 662939 - DNA, 25 bp, Rattus norvegicus
ttatgtaacactacgtatcagaccg

SEQ ID NO: 662940 - DNA, 25 bp, Rattus norvegicus
ttatgtaacacttcgtatcagaccg

SEQ ID NO: 662941 - DNA, 25 bp, Rattus norvegicus
ttatgtaacagcacaccattttatt

SEQ ID NO: 662942 - DNA, 25 bp, Rattus norvegicus
ttatgtaacagctcaccattttatt

SEQ ID NO: 662943 - DNA, 25 bp, Rattus norvegicus
ttatgtaagcccatccggagccacc

SEQ ID NO: 662944 - DNA, 25 bp, Rattus norvegicus
ttatgtaagcccttccggagccacc

SEQ ID NO: 662945 - DNA, 25 bp, Rattus norvegicus
ttatgtaagtgtccctgagggtgcc

SEQ ID NO: 662946 - DNA, 25 bp, Rattus norvegicus
ttatgtaagtgtgcctgagggtgcc

SEQ ID NO: 662947 - DNA, 25 bp, Rattus norvegicus
ttatgtaatactcccatttccaagc

SEQ ID NO: 662948 - DNA, 25 bp, Rattus norvegicus
ttatgtaatactgccatttccaagc

SEQ ID NO: 662949 - DNA, 25 bp, Rattus norvegicus
ttatgtaatggtccccccttaggcg

SEQ ID NO: 662950 - DNA, 25 bp, Rattus norvegicus
ttatgtaatggtgcccccttaggcg

SEQ ID NO: 662951 - DNA, 25 bp, Rattus norvegicus
ttatgtaattctcccattggtgtgt

SEQ ID NO: 662952 - DNA, 25 bp, Rattus norvegicus
ttatgtaattctgccattggtgtgt

SEQ ID NO: 662953 - DNA, 25 bp, Rattus norvegicus
ttatgtacaattactgcttgctttt

SEQ ID NO: 662954 - DNA, 25 bp, Rattus norvegicus
ttatgtacaatttctgcttgctttt

SEQ ID NO: 662955 - DNA, 25 bp, Rattus norvegicus
ttatgtacagtccacgcactattgc

SEQ ID NO: 662956 - DNA, 25 bp, Rattus norvegicus
ttatgtacagtcgacgcactattgc

SEQ ID NO: 662957 - DNA, 25 bp, Rattus norvegicus
ttatgtaccttaaacagcttgcccc

SEQ ID NO: 662958 - DNA, 25 bp, Rattus norvegicus
ttatgtaccttatacagcttgcccc

SEQ ID NO: 662959 - DNA, 25 bp, Rattus norvegicus
ttatgtaccttgagcaggccctgtt

SEQ ID NO: 662960 - DNA, 25 bp, Rattus norvegicus
ttatgtaccttgtgcaggccctgtt

SEQ ID NO: 662961 - DNA, 25 bp, Rattus norvegicus
ttatgtacgccaataagcacctcca

SEQ ID NO: 662962 - DNA, 25 bp, Rattus norvegicus
ttatgtacgccattaagcacctcca

SEQ ID NO: 662963 - DNA, 25 bp, Rattus norvegicus
ttatgtactaatatgccctcctagc

SEQ ID NO: 662964 - DNA, 25 bp, Rattus norvegicus
ttatgtactaatttgccctcctagc

SEQ ID NO: 662965 - DNA, 25 bp, Rattus norvegicus
ttatgtagccctctctatccgggaa

SEQ ID NO: 662966 - DNA, 25 bp, Rattus norvegicus
ttatgtagccctgtctatccgggaa

SEQ ID NO: 662967 - DNA, 25 bp, Rattus norvegicus
ttatgtagcgttagtacccgtttgc

SEQ ID NO: 662968 - DNA, 25 bp, Rattus norvegicus
ttatgtagcgtttgtacccgtttgc

SEQ ID NO: 662969 - DNA, 25 bp, Rattus norvegicus
ttatgtagtatcatccctgctcaca

SEQ ID NO: 662970 - DNA, 25 bp, Rattus norvegicus
ttatgtagtatcttccctgctcaca

SEQ ID NO: 662971 - DNA, 25 bp, Rattus norvegicus
ttatgtatgatacctgtcccagtag

SEQ ID NO: 662972 - DNA, 25 bp, Rattus norvegicus
ttatgtatgatagctgtcccagtag

SEQ ID NO: 662973 - DNA, 25 bp, Rattus norvegicus
ttatgtatggttatgccttcctacc

SEQ ID NO: 662974 - DNA, 25 bp, Rattus norvegicus
ttatgtatggttttgccttcctacc

SEQ ID NO: 662975 - DNA, 25 bp, Rattus norvegicus
ttatgtattcccacctagtcgacta

SEQ ID NO: 662976 - DNA, 25 bp, Rattus norvegicus
ttatgtattccctcctagtcgacta

SEQ ID NO: 662977 - DNA, 25 bp, Rattus norvegicus
ttatgtatttttctgcactaggcgc

SEQ ID NO: 662978 - DNA, 25 bp, Rattus norvegicus
ttatgtatttttgtgcactaggcgc

SEQ ID NO: 662979 - DNA, 25 bp, Rattus norvegicus
ttatgtcaatctcgctacttttcta

SEQ ID NO: 662980 - DNA, 25 bp, Rattus norvegicus
ttatgtcaatctggctacttttcta

SEQ ID NO: 662981 - DNA, 25 bp, Rattus norvegicus
ttatgtcaccggcagcaccatagtg

SEQ ID NO: 662982 - DNA, 25 bp, Rattus norvegicus
ttatgtcaccgggagcaccatagtg

SEQ ID NO: 662983 - DNA, 25 bp, Rattus norvegicus
ttatgtcagacaccccacaatagcc

SEQ ID NO: 662984 - DNA, 25 bp, Rattus norvegicus
ttatgtcagacagcccacaatagcc

SEQ ID NO: 662985 - DNA, 25 bp, Rattus norvegicus
ttatgtcagcatcgcagagctcctg

SEQ ID NO: 662986 - DNA, 25 bp, Rattus norvegicus
ttatgtcagcatggcagagctcctg

SEQ ID NO: 662987 - DNA, 25 bp, Rattus norvegicus
ttatgtcatatgctggtatttcatg

SEQ ID NO: 662988 - DNA, 25 bp, Rattus norvegicus
ttatgtcatatggtggtatttcatg

SEQ ID NO: 662989 - DNA, 25 bp, Rattus norvegicus
ttatgtccgggactaaaggtggcca

SEQ ID NO: 662990 - DNA, 25 bp, Rattus norvegicus
ttatgtccgggagtaaaggtggcca

SEQ ID NO: 662991 - DNA, 25 bp, Rattus norvegicus
ttatgtcgagagaactttgccaggg

SEQ ID NO: 662992 - DNA, 25 bp, Rattus norvegicus
ttatgtcgagagtactttgccaggg

SEQ ID NO: 662993 - DNA, 25 bp, Rattus norvegicus
ttatgtcgatgcaggacctccaact

SEQ ID NO: 662994 - DNA, 25 bp, Rattus norvegicus
ttatgtcgatgctggacctccaact

SEQ ID NO: 662995 - DNA, 25 bp, Rattus norvegicus
ttatgtcggcatcacctagagccat

SEQ ID NO: 662996 - DNA, 25 bp, Rattus norvegicus
ttatgtcggcatgacctagagccat

SEQ ID NO: 662997 - DNA, 25 bp, Rattus norvegicus
ttatgtctaaatctctgctaacaga

SEQ ID NO: 662998 - DNA, 25 bp, Rattus norvegicus
ttatgtctaaatgtctgctaacaga

SEQ ID NO: 662999 - DNA, 25 bp, Rattus norvegicus
ttatgtctattgacctttcctctag

SEQ ID NO: 663000 - DNA, 25 bp, Rattus norvegicus
ttatgtctattgtcctttcctctag

SEQ ID NO: 663001 - DNA, 25 bp, Rattus norvegicus
ttatgtctcaggctcttagtggcaa

SEQ ID NO: 663002 - DNA, 25 bp, Rattus norvegicus
ttatgtctcagggtcttagtggcaa

SEQ ID NO: 663003 - DNA, 25 bp, Rattus norvegicus
ttatgtctctctagtgttcttgttt

SEQ ID NO: 663004 - DNA, 25 bp, Rattus norvegicus
ttatgtctctcttgtgttcttgttt

SEQ ID NO: 663005 - DNA, 25 bp, Rattus norvegicus
ttatgtctgctcatcctcagaaggg

SEQ ID NO: 663006 - DNA, 25 bp, Rattus norvegicus
ttatgtctgctcttcctcagaaggg

SEQ ID NO: 663007 - DNA, 25 bp, Rattus norvegicus
ttatgtctgtagctggtcttactct

SEQ ID NO: 663008 - DNA, 25 bp, Rattus norvegicus
ttatgtctgtaggtggtcttactct

SEQ ID NO: 663009 - DNA, 25 bp, Rattus norvegicus
ttatgtcttccacggggtcgggata

SEQ ID NO: 663010 - DNA, 25 bp, Rattus norvegicus
ttatgtcttccactgctgattcgaa

SEQ ID NO: 663011 - DNA, 25 bp, Rattus norvegicus
ttatgtcttccagggggtcgggata

SEQ ID NO: 663012 - DNA, 25 bp, Rattus norvegicus
ttatgtcttccagtgctgattcgaa

SEQ ID NO: 663013 - DNA, 25 bp, Rattus norvegicus
ttatgtcttcccaacaagctaggat

SEQ ID NO: 663014 - DNA, 25 bp, Rattus norvegicus
ttatgtcttccctacaagctaggat

SEQ ID NO: 663015 - DNA, 25 bp, Rattus norvegicus
ttatgtctttaaccggtgggctgct

SEQ ID NO: 663016 - DNA, 25 bp, Rattus norvegicus
ttatgtctttaagcggtgggctgct

SEQ ID NO: 663017 - DNA, 25 bp, Rattus norvegicus
ttatgtctttgtcggtgagcggttc

SEQ ID NO: 663018 - DNA, 25 bp, Rattus norvegicus
ttatgtctttgtgggtgagcggttc

SEQ ID NO: 663019 - DNA, 25 bp, Rattus norvegicus
ttatgtgaaagcaaaacgaccggtt

SEQ ID NO: 663020 - DNA, 25 bp, Rattus norvegicus
ttatgtgaaagctaaacgaccggtt

SEQ ID NO: 663021 - DNA, 25 bp, Rattus norvegicus
ttatgtgaaggtcggctatcccatt

SEQ ID NO: 663022 - DNA, 25 bp, Rattus norvegicus
ttatgtgaaggtgggctatcccatt

SEQ ID NO: 663023 - DNA, 25 bp, Rattus norvegicus
ttatgtgaatcactcctttgcccct

SEQ ID NO: 663024 - DNA, 25 bp, Rattus norvegicus
ttatgtgaatcagtcctttgcccct

SEQ ID NO: 663025 - DNA, 25 bp, Rattus norvegicus
ttatgtgaattcctgggcctggctc

SEQ ID NO: 663026 - DNA, 25 bp, Rattus norvegicus
ttatgtgaattcgtgggcctggctc

SEQ ID NO: 663027 - DNA, 25 bp, Rattus norvegicus
ttatgtgagagaccagagcaccctc

SEQ ID NO: 663028 - DNA, 25 bp, Rattus norvegicus
ttatgtgagagagcagagcaccctc

SEQ ID NO: 663029 - DNA, 25 bp, Rattus norvegicus
ttatgtgatatgacgctgcaggtgg

SEQ ID NO: 663030 - DNA, 25 bp, Rattus norvegicus
ttatgtgatatgtcgctgcaggtgg

SEQ ID NO: 663031 - DNA, 25 bp, Rattus norvegicus
ttatgtgattttcaggccccttgac

SEQ ID NO: 663032 - DNA, 25 bp, Rattus norvegicus
ttatgtgattttgaggccccttgac

SEQ ID NO: 663033 - DNA, 25 bp, Rattus norvegicus
ttatgtgcacggacaaggaggaatc

SEQ ID NO: 663034 - DNA, 25 bp, Rattus norvegicus
ttatgtgcacggtcaaggaggaatc

SEQ ID NO: 663035 - DNA, 25 bp, Rattus norvegicus
ttatgtgcagagattcaccccttga

SEQ ID NO: 663036 - DNA, 25 bp, Rattus norvegicus
ttatgtgcagagtttcaccccttga

SEQ ID NO: 663037 - DNA, 25 bp, Rattus norvegicus
ttatgtgcagtgcaagcaccatccc

SEQ ID NO: 663038 - DNA, 25 bp, Rattus norvegicus
ttatgtgcagtggaagcaccatccc

SEQ ID NO: 663039 - DNA, 25 bp, Rattus norvegicus
ttatgtgcgtgcatcgtttgcattt

SEQ ID NO: 663040 - DNA, 25 bp, Rattus norvegicus
ttatgtgcgtgcttcgtttgcattt

SEQ ID NO: 663041 - DNA, 25 bp, Rattus norvegicus
ttatgtgctcataaaattgctgaaa

SEQ ID NO: 663042 - DNA, 25 bp, Rattus norvegicus
ttatgtgctcattaaattgctgaaa

SEQ ID NO: 663043 - DNA, 25 bp, Rattus norvegicus
ttatgtggacacaacaatggctgcc

SEQ ID NO: 663044 - DNA, 25 bp, Rattus norvegicus
ttatgtggacactacaatggctgcc

SEQ ID NO: 663045 - DNA, 25 bp, Rattus norvegicus
ttatgtggcgcaactttgctcaacc

SEQ ID NO: 663046 - DNA, 25 bp, Rattus norvegicus
ttatgtggcgcatctttgctcaacc

SEQ ID NO: 663047 - DNA, 25 bp, Rattus norvegicus
ttatgtgggaataggactccagtcc

SEQ ID NO: 663048 - DNA, 25 bp, Rattus norvegicus
ttatgtgggaattggactccagtcc

SEQ ID NO: 663049 - DNA, 25 bp, Rattus norvegicus
ttatgtgggtcacaaacaactggag

SEQ ID NO: 663050 - DNA, 25 bp, Rattus norvegicus
ttatgtgggtcagaaacaactggag

SEQ ID NO: 663051 - DNA, 25 bp, Rattus norvegicus
ttatgtggtaccatgtctctagaca

SEQ ID NO: 663052 - DNA, 25 bp, Rattus norvegicus
ttatgtggtaccttgtctctagaca

SEQ ID NO: 663053 - DNA, 25 bp, Rattus norvegicus
ttatgtggtccacttaagaggctac

SEQ ID NO: 663054 - DNA, 25 bp, Rattus norvegicus
ttatgtggtccagttaagaggctac

SEQ ID NO: 663055 - DNA, 25 bp, Rattus norvegicus
ttatgtggttgacacctcagcgccg

SEQ ID NO: 663056 - DNA, 25 bp, Rattus norvegicus
ttatgtggttgagacctcagcgccg

SEQ ID NO: 663057 - DNA, 25 bp, Rattus norvegicus
ttatgtgtatatatgtgtgcctatg

SEQ ID NO: 663058 - DNA, 25 bp, Rattus norvegicus
ttatgtgtatatttgtgtgcctatg

SEQ ID NO: 663059 - DNA, 25 bp, Rattus norvegicus
ttatgtgtcagcagcctgtctaaga

SEQ ID NO: 663060 - DNA, 25 bp, Rattus norvegicus
ttatgtgtcagctgcctgtctaaga

SEQ ID NO: 663061 - DNA, 25 bp, Rattus norvegicus
ttatgtgtcatcaggaccgtccatt

SEQ ID NO: 663062 - DNA, 25 bp, Rattus norvegicus
ttatgtgtcatcatgggctgcttct

SEQ ID NO: 663063 - DNA, 25 bp, Rattus norvegicus
ttatgtgtcatctggaccgtccatt

SEQ ID NO: 663064 - DNA, 25 bp, Rattus norvegicus
ttatgtgtcatcttgggctgcttct

SEQ ID NO: 663065 - DNA, 25 bp, Rattus norvegicus
ttatgtgtggttatagtttctcttg

SEQ ID NO: 663066 - DNA, 25 bp, Rattus norvegicus
ttatgtgtggttttagtttctcttg

SEQ ID NO: 663067 - DNA, 25 bp, Rattus norvegicus
ttatgtgtgtgaagcagcctgtgct

SEQ ID NO: 663068 - DNA, 25 bp, Rattus norvegicus
ttatgtgtgtgatgcagcctgtgct

SEQ ID NO: 663069 - DNA, 25 bp, Rattus norvegicus
ttatgtgtgtggacgctttgcttac

SEQ ID NO: 663070 - DNA, 25 bp, Rattus norvegicus
ttatgtgtgtggtcgctttgcttac

SEQ ID NO: 663071 - DNA, 25 bp, Rattus norvegicus
ttatgtgttggcagctactagtcgc

SEQ ID NO: 663072 - DNA, 25 bp, Rattus norvegicus
ttatgtgttggctgctactagtcgc

SEQ ID NO: 663073 - DNA, 25 bp, Rattus norvegicus
ttatgtgttgtgaatctcgctttat

SEQ ID NO: 663074 - DNA, 25 bp, Rattus norvegicus
ttatgtgttgtgtatctcgctttat

SEQ ID NO: 663075 - DNA, 25 bp, Rattus norvegicus
ttatgttactttatgctgctggctc

SEQ ID NO: 663076 - DNA, 25 bp, Rattus norvegicus
ttatgttactttttgctgctggctc

SEQ ID NO: 663077 - DNA, 25 bp, Rattus norvegicus
ttatgttcaaggcagacccaataag

SEQ ID NO: 663078 - DNA, 25 bp, Rattus norvegicus
ttatgttcaagggagacccaataag

SEQ ID NO: 663079 - DNA, 25 bp, Rattus norvegicus
ttatgttcccatcatcttcaacagg

SEQ ID NO: 663080 - DNA, 25 bp, Rattus norvegicus
ttatgttcccatgatcttcaacagg

SEQ ID NO: 663081 - DNA, 25 bp, Rattus norvegicus
ttatgttccctacgctggtcttgaa

SEQ ID NO: 663082 - DNA, 25 bp, Rattus norvegicus
ttatgttccctaggctggtcttgaa

SEQ ID NO: 663083 - DNA, 25 bp, Rattus norvegicus
ttatgttctcaaagcctcttaatca

SEQ ID NO: 663084 - DNA, 25 bp, Rattus norvegicus
ttatgttctcaatgcctcttaatca

SEQ ID NO: 663085 - DNA, 25 bp, Rattus norvegicus
ttatgttctttactcttttcactga

SEQ ID NO: 663086 - DNA, 25 bp, Rattus norvegicus
ttatgttctttagtcttttcactga

SEQ ID NO: 663087 - DNA, 25 bp, Rattus norvegicus
ttatgttctttgatgagcccaccag

SEQ ID NO: 663088 - DNA, 25 bp, Rattus norvegicus
ttatgttctttgttgagcccaccag

SEQ ID NO: 663089 - DNA, 25 bp, Rattus norvegicus
ttatgttgagagatgctgcctgcag

SEQ ID NO: 663090 - DNA, 25 bp, Rattus norvegicus
ttatgttgagagttgctgcctgcag

SEQ ID NO: 663091 - DNA, 25 bp, Rattus norvegicus
ttatgttgcccactgtgtttaatga

SEQ ID NO: 663092 - DNA, 25 bp, Rattus norvegicus
ttatgttgcccagtgtgtttaatga

SEQ ID NO: 663093 - DNA, 25 bp, Rattus norvegicus
ttatgttgccttaagcttcctgaaa

SEQ ID NO: 663094 - DNA, 25 bp, Rattus norvegicus
ttatgttgcctttagcttcctgaaa

SEQ ID NO: 663095 - DNA, 25 bp, Rattus norvegicus
ttatgttggctgcagtcctcaggat

SEQ ID NO: 663096 - DNA, 25 bp, Rattus norvegicus
ttatgttggctggagtcctcaggat

SEQ ID NO: 663097 - DNA, 25 bp, Rattus norvegicus
ttatgttgtaggagctccagttcaa

SEQ ID NO: 663098 - DNA, 25 bp, Rattus norvegicus
ttatgttgtaggtgctccagttcaa

SEQ ID NO: 663099 - DNA, 25 bp, Rattus norvegicus
ttatgttgtgagaagcagccccaga

SEQ ID NO: 663100 - DNA, 25 bp, Rattus norvegicus
ttatgttgtgagtagcagccccaga

SEQ ID NO: 663101 - DNA, 25 bp, Rattus norvegicus
ttatgtttctacacgggaacaaacg

SEQ ID NO: 663102 - DNA, 25 bp, Rattus norvegicus
ttatgtttctactcgggaacaaacg

SEQ ID NO: 663103 - DNA, 25 bp, Rattus norvegicus
ttatgtttctgtcaccggctcttct

SEQ ID NO: 663104 - DNA, 25 bp, Rattus norvegicus
ttatgtttctgtgaccggctcttct

SEQ ID NO: 663105 - DNA, 25 bp, Rattus norvegicus
ttatgtttcttacttactctactcg

SEQ ID NO: 663106 - DNA, 25 bp, Rattus norvegicus
ttatgtttcttagttactctactcg

SEQ ID NO: 663107 - DNA, 25 bp, Rattus norvegicus
ttatgtttcttgaatccagcccatt

SEQ ID NO: 663108 - DNA, 25 bp, Rattus norvegicus
ttatgtttcttgtatccagcccatt

SEQ ID NO: 663109 - DNA, 25 bp, Rattus norvegicus
ttatgttttaaccatcccctatctg

SEQ ID NO: 663110 - DNA, 25 bp, Rattus norvegicus
ttatgttttaacgatcccctatctg

SEQ ID NO: 663111 - DNA, 25 bp, Rattus norvegicus
ttattaaaacccagatctgcgccct

SEQ ID NO: 663112 - DNA, 25 bp, Rattus norvegicus
ttattaaaaccctgatctgcgccct

SEQ ID NO: 663113 - DNA, 25 bp, Rattus norvegicus
ttattaaactggccccatgatgcac

SEQ ID NO: 663114 - DNA, 25 bp, Rattus norvegicus
ttattaaactgggcccatgatgcac

SEQ ID NO: 663115 - DNA, 25 bp, Rattus norvegicus
ttattaaacttgcagccctttccgc

SEQ ID NO: 663116 - DNA, 25 bp, Rattus norvegicus
ttattaaacttggagccctttccgc

SEQ ID NO: 663117 - DNA, 25 bp, Rattus norvegicus
ttattaaagcaaattctcttcctga

SEQ ID NO: 663118 - DNA, 25 bp, Rattus norvegicus
ttattaaagcaatttctcttcctga

SEQ ID NO: 663119 - DNA, 25 bp, Rattus norvegicus
ttattaaatgctagctctcactgga

SEQ ID NO: 663120 - DNA, 25 bp, Rattus norvegicus
ttattaaatgcttgctctcactgga

SEQ ID NO: 663121 - DNA, 25 bp, Rattus norvegicus
ttattaaccctgatctacctggaat

SEQ ID NO: 663122 - DNA, 25 bp, Rattus norvegicus
ttattaaccctgttctacctggaat

SEQ ID NO: 663123 - DNA, 25 bp, Rattus norvegicus
ttattaacgcttaccatgccatgca

SEQ ID NO: 663124 - DNA, 25 bp, Rattus norvegicus
ttattaacgctttccatgccatgca

SEQ ID NO: 663125 - DNA, 25 bp, Rattus norvegicus
ttattaagtcttcggtggcaccaga

SEQ ID NO: 663126 - DNA, 25 bp, Rattus norvegicus
ttattaagtcttgggtggcaccaga

SEQ ID NO: 663127 - DNA, 25 bp, Rattus norvegicus
ttattacaacatcggtgagccttga

SEQ ID NO: 663128 - DNA, 25 bp, Rattus norvegicus
ttattacaacatgggtgagccttga

SEQ ID NO: 663129 - DNA, 25 bp, Rattus norvegicus
ttattaccgagtaatgcactttggg

SEQ ID NO: 663130 - DNA, 25 bp, Rattus norvegicus
ttattaccgagttatgcactttggg

SEQ ID NO: 663131 - DNA, 25 bp, Rattus norvegicus
ttattaccgtgtacagggccgggca

SEQ ID NO: 663132 - DNA, 25 bp, Rattus norvegicus
ttattaccgtgttcagggccgggca

SEQ ID NO: 663133 - DNA, 25 bp, Rattus norvegicus
ttattacgcccaatagcagcagacc

SEQ ID NO: 663134 - DNA, 25 bp, Rattus norvegicus
ttattacgcccattagcagcagacc

SEQ ID NO: 663135 - DNA, 25 bp, Rattus norvegicus
ttattactctccacgcggaatgtaa

SEQ ID NO: 663136 - DNA, 25 bp, Rattus norvegicus
ttattactctcctcgcggaatgtaa

SEQ ID NO: 663137 - DNA, 25 bp, Rattus norvegicus
ttattactgtagctgctgcagctcc

SEQ ID NO: 663138 - DNA, 25 bp, Rattus norvegicus
ttattactgtaggtgctgcagctcc

SEQ ID NO: 663139 - DNA, 25 bp, Rattus norvegicus
ttattactgtatcatggtcattgca

SEQ ID NO: 663140 - DNA, 25 bp, Rattus norvegicus
ttattactgtatgatggtcattgca

SEQ ID NO: 663141 - DNA, 25 bp, Rattus norvegicus
ttattacttatacctttctccaccc

SEQ ID NO: 663142 - DNA, 25 bp, Rattus norvegicus
ttattacttatagctttctccaccc

SEQ ID NO: 663143 - DNA, 25 bp, Rattus norvegicus
ttattagaggcacagctcggcccta

SEQ ID NO: 663144 - DNA, 25 bp, Rattus norvegicus
ttattagaggcagagctcggcccta

SEQ ID NO: 663145 - DNA, 25 bp, Rattus norvegicus
ttattagatgccctttccttaacca

SEQ ID NO: 663146 - DNA, 25 bp, Rattus norvegicus
ttattagatgccgtttccttaacca

SEQ ID NO: 663147 - DNA, 25 bp, Rattus norvegicus
ttattagcacctactgtatacacag

SEQ ID NO: 663148 - DNA, 25 bp, Rattus norvegicus
ttattagcaccttctgtatacacag

SEQ ID NO: 663149 - DNA, 25 bp, Rattus norvegicus
ttattagctggtcgtcgacctcgac

SEQ ID NO: 663150 - DNA, 25 bp, Rattus norvegicus
ttattagctggtggtcgacctcgac

SEQ ID NO: 663151 - DNA, 25 bp, Rattus norvegicus
ttattagctgtacccatctctgtct

SEQ ID NO: 663152 - DNA, 25 bp, Rattus norvegicus
ttattagctgtagccatctctgtct

SEQ ID NO: 663153 - DNA, 25 bp, Rattus norvegicus
ttattagggctaacggctccttcga

SEQ ID NO: 663154 - DNA, 25 bp, Rattus norvegicus
ttattagggctatcggctccttcga

SEQ ID NO: 663155 - DNA, 25 bp, Rattus norvegicus
ttattagggctgaggaaaaagactt

SEQ ID NO: 663156 - DNA, 25 bp, Rattus norvegicus
ttattagggctgtggaaaaagactt

SEQ ID NO: 663157 - DNA, 25 bp, Rattus norvegicus
ttattagtctttctatctcctgcca

SEQ ID NO: 663158 - DNA, 25 bp, Rattus norvegicus
ttattagtctttgtatctcctgcca

SEQ ID NO: 663159 - DNA, 25 bp, Rattus norvegicus
ttattatacaagaaaactcctcctt

SEQ ID NO: 663160 - DNA, 25 bp, Rattus norvegicus
ttattatacaagtaaactcctcctt

SEQ ID NO: 663161 - DNA, 25 bp, Rattus norvegicus
ttattatatacacaacctcctctct

SEQ ID NO: 663162 - DNA, 25 bp, Rattus norvegicus
ttattatatacagaacctcctctct

SEQ ID NO: 663163 - DNA, 25 bp, Rattus norvegicus
ttattatcagtcatcttgccttaaa

SEQ ID NO: 663164 - DNA, 25 bp, Rattus norvegicus
ttattatcagtcttcttgccttaaa

SEQ ID NO: 663165 - DNA, 25 bp, Rattus norvegicus
ttattatccctaagcattccagccg

SEQ ID NO: 663166 - DNA, 25 bp, Rattus norvegicus
ttattatccctatgcattccagccg

SEQ ID NO: 663167 - DNA, 25 bp, Rattus norvegicus
ttattatcttccattgactgtcctg

SEQ ID NO: 663168 - DNA, 25 bp, Rattus norvegicus
ttattatcttcctttgactgtcctg

SEQ ID NO: 663169 - DNA, 25 bp, Rattus norvegicus
ttattatcttctacctttcatgctc

SEQ ID NO: 663170 - DNA, 25 bp, Rattus norvegicus
ttattatcttcttcctttcatgctc

SEQ ID NO: 663171 - DNA, 25 bp, Rattus norvegicus
ttattatggtttcggctatgcggcc

SEQ ID NO: 663172 - DNA, 25 bp, Rattus norvegicus
ttattatggtttgggctatgcggcc

SEQ ID NO: 663173 - DNA, 25 bp, Rattus norvegicus
ttattattaggtaaagagcccccat

SEQ ID NO: 663174 - DNA, 25 bp, Rattus norvegicus
ttattattaggttaagagcccccat

SEQ ID NO: 663175 - DNA, 25 bp, Rattus norvegicus
ttattattcctcatgctggtcacta

SEQ ID NO: 663176 - DNA, 25 bp, Rattus norvegicus
ttattattcctcttgctggtcacta

SEQ ID NO: 663177 - DNA, 25 bp, Rattus norvegicus
ttattattgccacttttggcctcct

SEQ ID NO: 663178 - DNA, 25 bp, Rattus norvegicus
ttattattgccagttttggcctcct

SEQ ID NO: 663179 - DNA, 25 bp, Rattus norvegicus
ttattattttcaccgaagccaccac

SEQ ID NO: 663180 - DNA, 25 bp, Rattus norvegicus
ttattattttcagcgaagccaccac

SEQ ID NO: 663181 - DNA, 25 bp, Rattus norvegicus
ttattcaaagggattcaactgcgcc

SEQ ID NO: 663182 - DNA, 25 bp, Rattus norvegicus
ttattcaaagggtttcaactgcgcc

SEQ ID NO: 663183 - DNA, 25 bp, Rattus norvegicus
ttattcaacactagccttgcaggca

SEQ ID NO: 663184 - DNA, 25 bp, Rattus norvegicus
ttattcaacacttgccttgcaggca

SEQ ID NO: 663185 - DNA, 25 bp, Rattus norvegicus
ttattcaaccctattccactaggtc

SEQ ID NO: 663186 - DNA, 25 bp, Rattus norvegicus
ttattcaacccttttccactaggtc

SEQ ID NO: 663187 - DNA, 25 bp, Rattus norvegicus
ttattcacataaagcctaccacagg

SEQ ID NO: 663188 - DNA, 25 bp, Rattus norvegicus
ttattcacataatgcctaccacagg

SEQ ID NO: 663189 - DNA, 25 bp, Rattus norvegicus
ttattcacatgcatggagtcgccaa

SEQ ID NO: 663190 - DNA, 25 bp, Rattus norvegicus
ttattcacatgcttggagtcgccaa

SEQ ID NO: 663191 - DNA, 25 bp, Rattus norvegicus
ttattcacctctctggatcacgacc

SEQ ID NO: 663192 - DNA, 25 bp, Rattus norvegicus
ttattcacctctgtggatcacgacc

SEQ ID NO: 663193 - DNA, 25 bp, Rattus norvegicus
ttattcactctgatcacgatactgt

SEQ ID NO: 663194 - DNA, 25 bp, Rattus norvegicus
ttattcactctgttcacgatactgt

SEQ ID NO: 663195 - DNA, 25 bp, Rattus norvegicus
ttattcactttgaactagaatggac

SEQ ID NO: 663196 - DNA, 25 bp, Rattus norvegicus
ttattcactttgtactagaatggac

SEQ ID NO: 663197 - DNA, 25 bp, Rattus norvegicus
ttattcagatcccacacaccaatgg

SEQ ID NO: 663198 - DNA, 25 bp, Rattus norvegicus
ttattcagatccgacacaccaatgg

SEQ ID NO: 663199 - DNA, 25 bp, Rattus norvegicus
ttattcagccacagtccagcgtagc

SEQ ID NO: 663200 - DNA, 25 bp, Rattus norvegicus
ttattcagccactgtccagcgtagc

SEQ ID NO: 663201 - DNA, 25 bp, Rattus norvegicus
ttattcagccttcaaacccatgggc

SEQ ID NO: 663202 - DNA, 25 bp, Rattus norvegicus
ttattcagccttgaaacccatgggc

SEQ ID NO: 663203 - DNA, 25 bp, Rattus norvegicus
ttattcagggatcggcagttgcacg

SEQ ID NO: 663204 - DNA, 25 bp, Rattus norvegicus
ttattcagggatgggcagttgcacg

SEQ ID NO: 663205 - DNA, 25 bp, Rattus norvegicus
ttattcaggtagaggccccggaaca

SEQ ID NO: 663206 - DNA, 25 bp, Rattus norvegicus
ttattcaggtagtggccccggaaca

SEQ ID NO: 663207 - DNA, 25 bp, Rattus norvegicus
ttattcaggtatcgccttactccta

SEQ ID NO: 663208 - DNA, 25 bp, Rattus norvegicus
ttattcaggtatggccttactccta

SEQ ID NO: 663209 - DNA, 25 bp, Rattus norvegicus
ttattcatatgaccctaagcgcagt

SEQ ID NO: 663210 - DNA, 25 bp, Rattus norvegicus
ttattcatatgagcctaagcgcagt

SEQ ID NO: 663211 - DNA, 25 bp, Rattus norvegicus
ttattcatccttcaaaaccctactt

SEQ ID NO: 663212 - DNA, 25 bp, Rattus norvegicus
ttattcatccttgaaaaccctactt

SEQ ID NO: 663213 - DNA, 25 bp, Rattus norvegicus
ttattcatcgtaacagccagtgcaa

SEQ ID NO: 663214 - DNA, 25 bp, Rattus norvegicus
ttattcatcgtatcagccagtgcaa

SEQ ID NO: 663215 - DNA, 25 bp, Rattus norvegicus
ttattcatggtgacactccggttac

SEQ ID NO: 663216 - DNA, 25 bp, Rattus norvegicus
ttattcatggtgtcactccggttac

SEQ ID NO: 663217 - DNA, 25 bp, Rattus norvegicus
ttattcattcataccacatcatttt

SEQ ID NO: 663218 - DNA, 25 bp, Rattus norvegicus
ttattcattcattccacatcatttt

SEQ ID NO: 663219 - DNA, 25 bp, Rattus norvegicus
ttattcattctgactcgtggtcctt

SEQ ID NO: 663220 - DNA, 25 bp, Rattus norvegicus
ttattcattctgtctcgtggtcctt

SEQ ID NO: 663221 - DNA, 25 bp, Rattus norvegicus
ttattcattgtcacgctgctctttg

SEQ ID NO: 663222 - DNA, 25 bp, Rattus norvegicus
ttattcattgtctcgctgctctttg

SEQ ID NO: 663223 - DNA, 25 bp, Rattus norvegicus
ttattcattttactagatcccttct

SEQ ID NO: 663224 - DNA, 25 bp, Rattus norvegicus
ttattcattttagtagatcccttct

SEQ ID NO: 663225 - DNA, 25 bp, Rattus norvegicus
ttattccaagtcaccattttaccga

SEQ ID NO: 663226 - DNA, 25 bp, Rattus norvegicus
ttattccaagtctccattttaccga

SEQ ID NO: 663227 - DNA, 25 bp, Rattus norvegicus
ttattccacaaccaggctctgctgg

SEQ ID NO: 663228 - DNA, 25 bp, Rattus norvegicus
ttattccacaacgaggctctgctgg

SEQ ID NO: 663229 - DNA, 25 bp, Rattus norvegicus
ttattccagaagacactgaggtgtg

SEQ ID NO: 663230 - DNA, 25 bp, Rattus norvegicus
ttattccagaagtcactgaggtgtg

SEQ ID NO: 663231 - DNA, 25 bp, Rattus norvegicus
ttattccagctcagtattctccaac

SEQ ID NO: 663232 - DNA, 25 bp, Rattus norvegicus
ttattccagctctgtattctccaac

SEQ ID NO: 663233 - DNA, 25 bp, Rattus norvegicus
ttattccagtgcatgctccaggatt

SEQ ID NO: 663234 - DNA, 25 bp, Rattus norvegicus
ttattccagtgcttgctccaggatt

SEQ ID NO: 663235 - DNA, 25 bp, Rattus norvegicus
ttattccagtttctactacctcagg

SEQ ID NO: 663236 - DNA, 25 bp, Rattus norvegicus
ttattccagtttgtactacctcagg

SEQ ID NO: 663237 - DNA, 25 bp, Rattus norvegicus
ttattccatgacagcttgccctaag

SEQ ID NO: 663238 - DNA, 25 bp, Rattus norvegicus
ttattccatgactgcttgccctaag

SEQ ID NO: 663239 - DNA, 25 bp, Rattus norvegicus
ttattccattccattgatcagcctg

SEQ ID NO: 663240 - DNA, 25 bp, Rattus norvegicus
ttattccattcctttgatcagcctg

SEQ ID NO: 663241 - DNA, 25 bp, Rattus norvegicus
ttattcccaaacacttctttagcca

SEQ ID NO: 663242 - DNA, 25 bp, Rattus norvegicus
ttattcccaaactcttctttagcca

SEQ ID NO: 663243 - DNA, 25 bp, Rattus norvegicus
ttattcccaagcataaacagtgcct

SEQ ID NO: 663244 - DNA, 25 bp, Rattus norvegicus
ttattcccaagcctggatggccaga

SEQ ID NO: 663245 - DNA, 25 bp, Rattus norvegicus
ttattcccaagcgtggatggccaga

SEQ ID NO: 663246 - DNA, 25 bp, Rattus norvegicus
ttattcccaagcttaaacagtgcct

SEQ ID NO: 663247 - DNA, 25 bp, Rattus norvegicus
ttattcccagctcatcaggttgtat

SEQ ID NO: 663248 - DNA, 25 bp, Rattus norvegicus
ttattcccagctgatcaggttgtat

SEQ ID NO: 663249 - DNA, 25 bp, Rattus norvegicus
ttattccccagtaattttctagtct

SEQ ID NO: 663250 - DNA, 25 bp, Rattus norvegicus
ttattccccagttattttctagtct

SEQ ID NO: 663251 - DNA, 25 bp, Rattus norvegicus
ttattcccgcttagccaggatattt

SEQ ID NO: 663252 - DNA, 25 bp, Rattus norvegicus
ttattcccgctttgccaggatattt

SEQ ID NO: 663253 - DNA, 25 bp, Rattus norvegicus
ttattccctgaaccaagatcccaag

SEQ ID NO: 663254 - DNA, 25 bp, Rattus norvegicus
ttattccctgaagcaagatcccaag

SEQ ID NO: 663255 - DNA, 25 bp, Rattus norvegicus
ttattcccttgcaccaagtgtcttg

SEQ ID NO: 663256 - DNA, 25 bp, Rattus norvegicus
ttattcccttgctccaagtgtcttg

SEQ ID NO: 663257 - DNA, 25 bp, Rattus norvegicus
ttattccgatggaaggtgattcctc

SEQ ID NO: 663258 - DNA, 25 bp, Rattus norvegicus
ttattccgatggtaggtgattcctc

SEQ ID NO: 663259 - DNA, 25 bp, Rattus norvegicus
ttattcctaaacagcatggtcctta

SEQ ID NO: 663260 - DNA, 25 bp, Rattus norvegicus
ttattcctaaactgcatggtcctta

SEQ ID NO: 663261 - DNA, 25 bp, Rattus norvegicus
ttattcctaagaaaccctgaccctg

SEQ ID NO: 663262 - DNA, 25 bp, Rattus norvegicus
ttattcctaagataccctgaccctg

SEQ ID NO: 663263 - DNA, 25 bp, Rattus norvegicus
ttattcctactaatgtgcttgttac

SEQ ID NO: 663264 - DNA, 25 bp, Rattus norvegicus
ttattcctactattgtgcttgttac

SEQ ID NO: 663265 - DNA, 25 bp, Rattus norvegicus
ttattcctcactaatgcaacgcgat

SEQ ID NO: 663266 - DNA, 25 bp, Rattus norvegicus
ttattcctcacttatgcaacgcgat

SEQ ID NO: 663267 - DNA, 25 bp, Rattus norvegicus
ttattcctcctgaagatagatgatg

SEQ ID NO: 663268 - DNA, 25 bp, Rattus norvegicus
ttattcctcctgtagatagatgatg

SEQ ID NO: 663269 - DNA, 25 bp, Rattus norvegicus
ttattcctctgtacattgactaata

SEQ ID NO: 663270 - DNA, 25 bp, Rattus norvegicus
ttattcctctgttcattgactaata

SEQ ID NO: 663271 - DNA, 25 bp, Rattus norvegicus
ttattcctcttcacaaaagcctggg

SEQ ID NO: 663272 - DNA, 25 bp, Rattus norvegicus
ttattcctcttctcaaaagcctggg

SEQ ID NO: 663273 - DNA, 25 bp, Rattus norvegicus
ttattcctttatctgctgagcattt

SEQ ID NO: 663274 - DNA, 25 bp, Rattus norvegicus
ttattcctttatgtgctgagcattt

SEQ ID NO: 663275 - DNA, 25 bp, Rattus norvegicus
ttattcgcatgcagcttcggagcaa

SEQ ID NO: 663276 - DNA, 25 bp, Rattus norvegicus
ttattcgcatgctgcttcggagcaa

SEQ ID NO: 663277 - DNA, 25 bp, Rattus norvegicus
ttattcgcccctctctgttaatttc

SEQ ID NO: 663278 - DNA, 25 bp, Rattus norvegicus
ttattcgcccctgtctgttaatttc

SEQ ID NO: 663279 - DNA, 25 bp, Rattus norvegicus
ttattcggagttccttacaggcgga

SEQ ID NO: 663280 - DNA, 25 bp, Rattus norvegicus
ttattcggagttgcttacaggcgga

SEQ ID NO: 663281 - DNA, 25 bp, Rattus norvegicus
ttattcggctagaggagcctggctc

SEQ ID NO: 663282 - DNA, 25 bp, Rattus norvegicus
ttattcggctagtggagcctggctc

SEQ ID NO: 663283 - DNA, 25 bp, Rattus norvegicus
ttattcggttctagctttggtgact

SEQ ID NO: 663284 - DNA, 25 bp, Rattus norvegicus
ttattcggttcttgctttggtgact

SEQ ID NO: 663285 - DNA, 25 bp, Rattus norvegicus
ttattcgtgataactcctcaatggc

SEQ ID NO: 663286 - DNA, 25 bp, Rattus norvegicus
ttattcgtgatatctcctcaatggc

SEQ ID NO: 663287 - DNA, 25 bp, Rattus norvegicus
ttattctaacagattgcacatttgt

SEQ ID NO: 663288 - DNA, 25 bp, Rattus norvegicus
ttattctaacagtttgcacatttgt

SEQ ID NO: 663289 - DNA, 25 bp, Rattus norvegicus
ttattctaggttcaatccctcgctt

SEQ ID NO: 663290 - DNA, 25 bp, Rattus norvegicus
ttattctaggttgaatccctcgctt

SEQ ID NO: 663291 - DNA, 25 bp, Rattus norvegicus
ttattctatctaataactgcctgag

SEQ ID NO: 663292 - DNA, 25 bp, Rattus norvegicus
ttattctatctattaactgcctgag

SEQ ID NO: 663293 - DNA, 25 bp, Rattus norvegicus
ttattctcaatgacctgagcagccc

SEQ ID NO: 663294 - DNA, 25 bp, Rattus norvegicus
ttattctcaatgtcctgagcagccc

SEQ ID NO: 663295 - DNA, 25 bp, Rattus norvegicus
ttattctccactaagcattcctaca

SEQ ID NO: 663296 - DNA, 25 bp, Rattus norvegicus
ttattctccacttagcattcctaca

SEQ ID NO: 663297 - DNA, 25 bp, Rattus norvegicus
ttattctccctaaattcttgctgtc

SEQ ID NO: 663298 - DNA, 25 bp, Rattus norvegicus
ttattctccctatattcttgctgtc

SEQ ID NO: 663299 - DNA, 25 bp, Rattus norvegicus
ttattctccctcagtgcttaattta

SEQ ID NO: 663300 - DNA, 25 bp, Rattus norvegicus
ttattctccctctgtgcttaattta

SEQ ID NO: 663301 - DNA, 25 bp, Rattus norvegicus
ttattctctcgtccgtttacttctc

SEQ ID NO: 663302 - DNA, 25 bp, Rattus norvegicus
ttattctctcgtgcgtttacttctc

SEQ ID NO: 663303 - DNA, 25 bp, Rattus norvegicus
ttattctctgacctcggcatgcatg

SEQ ID NO: 663304 - DNA, 25 bp, Rattus norvegicus
ttattctctgacgtcggcatgcatg

SEQ ID NO: 663305 - DNA, 25 bp, Rattus norvegicus
ttattctcttctactcagccagtta

SEQ ID NO: 663306 - DNA, 25 bp, Rattus norvegicus
ttattctcttcttctcagccagtta

SEQ ID NO: 663307 - DNA, 25 bp, Rattus norvegicus
ttattctgacttacacatacctgag

SEQ ID NO: 663308 - DNA, 25 bp, Rattus norvegicus
ttattctgactttcacatacctgag

SEQ ID NO: 663309 - DNA, 25 bp, Rattus norvegicus
ttattctgccagcaaagcctctggg

SEQ ID NO: 663310 - DNA, 25 bp, Rattus norvegicus
ttattctgccaggaaagcctctggg

SEQ ID NO: 663311 - DNA, 25 bp, Rattus norvegicus
ttattctgcctaacctctggctcca

SEQ ID NO: 663312 - DNA, 25 bp, Rattus norvegicus
ttattctgcctatcctctggctcca

SEQ ID NO: 663313 - DNA, 25 bp, Rattus norvegicus
ttattctgctcaatgccaccaacta

SEQ ID NO: 663314 - DNA, 25 bp, Rattus norvegicus
ttattctgctcattgccaccaacta

SEQ ID NO: 663315 - DNA, 25 bp, Rattus norvegicus
ttattctgctccagggtcagctaca

SEQ ID NO: 663316 - DNA, 25 bp, Rattus norvegicus
ttattctgctcctgggtcagctaca

SEQ ID NO: 663317 - DNA, 25 bp, Rattus norvegicus
ttattctgggctcgtgtggtatcac

SEQ ID NO: 663318 - DNA, 25 bp, Rattus norvegicus
ttattctgggctggtgtggtatcac

SEQ ID NO: 663319 - DNA, 25 bp, Rattus norvegicus
ttattctgtctcaaggtcatctctc

SEQ ID NO: 663320 - DNA, 25 bp, Rattus norvegicus
ttattctgtctctaggtcatctctc

SEQ ID NO: 663321 - DNA, 25 bp, Rattus norvegicus
ttattctgtgttaatcttccttccc

SEQ ID NO: 663322 - DNA, 25 bp, Rattus norvegicus
ttattctgtgtttatcttccttccc

SEQ ID NO: 663323 - DNA, 25 bp, Rattus norvegicus
ttattcttagatatctgggagatgc

SEQ ID NO: 663324 - DNA, 25 bp, Rattus norvegicus
ttattcttagatttctgggagatgc

SEQ ID NO: 663325 - DNA, 25 bp, Rattus norvegicus
ttattcttcaagaatgtggtatgga

SEQ ID NO: 663326 - DNA, 25 bp, Rattus norvegicus
ttattcttcaagtatgtggtatgga

SEQ ID NO: 663327 - DNA, 25 bp, Rattus norvegicus
ttattcttcctcaacaaatgcccat

SEQ ID NO: 663328 - DNA, 25 bp, Rattus norvegicus
ttattcttcctctacaaatgcccat

SEQ ID NO: 663329 - DNA, 25 bp, Rattus norvegicus
ttattcttcgctcttgtggcctgtg

SEQ ID NO: 663330 - DNA, 25 bp, Rattus norvegicus
ttattcttcgctgttgtggcctgtg

SEQ ID NO: 663331 - DNA, 25 bp, Rattus norvegicus
ttattcttggacagtactcttcgca

SEQ ID NO: 663332 - DNA, 25 bp, Rattus norvegicus
ttattcttggactgtactcttcgca

SEQ ID NO: 663333 - DNA, 25 bp, Rattus norvegicus
ttattcttttctagtacacacagaa

SEQ ID NO: 663334 - DNA, 25 bp, Rattus norvegicus
ttattcttttcttgtacacacagaa

SEQ ID NO: 663335 - DNA, 25 bp, Rattus norvegicus
ttattgaacagtcgattcccctacc

SEQ ID NO: 663336 - DNA, 25 bp, Rattus norvegicus
ttattgaacagtggattcccctacc

SEQ ID NO: 663337 - DNA, 25 bp, Rattus norvegicus
ttattgaagatcacgagccaagatt

SEQ ID NO: 663338 - DNA, 25 bp, Rattus norvegicus
ttattgaagatctcgagccaagatt

SEQ ID NO: 663339 - DNA, 25 bp, Rattus norvegicus
ttattgacagcacaccgtaccgaca

SEQ ID NO: 663340 - DNA, 25 bp, Rattus norvegicus
ttattgacagcagaccgtaccgaca

SEQ ID NO: 663341 - DNA, 25 bp, Rattus norvegicus
ttattgaccttgatctctgactcac

SEQ ID NO: 663342 - DNA, 25 bp, Rattus norvegicus
ttattgaccttgttctctgactcac

SEQ ID NO: 663343 - DNA, 25 bp, Rattus norvegicus
ttattgagacttcccattcactgaa

SEQ ID NO: 663344 - DNA, 25 bp, Rattus norvegicus
ttattgagacttgccattcactgaa

SEQ ID NO: 663345 - DNA, 25 bp, Rattus norvegicus
ttattgagagtgactgcttcccagg

SEQ ID NO: 663346 - DNA, 25 bp, Rattus norvegicus
ttattgagagtgtctgcttcccagg

SEQ ID NO: 663347 - DNA, 25 bp, Rattus norvegicus
ttattgagcgccaggaaggttcctc

SEQ ID NO: 663348 - DNA, 25 bp, Rattus norvegicus
ttattgagcgcctggaaggttcctc

SEQ ID NO: 663349 - DNA, 25 bp, Rattus norvegicus
ttattgatcatgatgctggctttta

SEQ ID NO: 663350 - DNA, 25 bp, Rattus norvegicus
ttattgatcatgttgctggctttta

SEQ ID NO: 663351 - DNA, 25 bp, Rattus norvegicus
ttattgatgaccacactgccattct

SEQ ID NO: 663352 - DNA, 25 bp, Rattus norvegicus
ttattgatgacctcactgccattct

SEQ ID NO: 663353 - DNA, 25 bp, Rattus norvegicus
ttattgatttccctgtctctccctc

SEQ ID NO: 663354 - DNA, 25 bp, Rattus norvegicus
ttattgatttccgtgtctctccctc

SEQ ID NO: 663355 - DNA, 25 bp, Rattus norvegicus
ttattgcatgcactgtgaccttggg

SEQ ID NO: 663356 - DNA, 25 bp, Rattus norvegicus
ttattgcatgcagtgtgaccttggg

SEQ ID NO: 663357 - DNA, 25 bp, Rattus norvegicus
ttattgcatttcaaaggaccccgcc

SEQ ID NO: 663358 - DNA, 25 bp, Rattus norvegicus
ttattgcatttctaaggaccccgcc

SEQ ID NO: 663359 - DNA, 25 bp, Rattus norvegicus
ttattgccaaacatcagtccaagga

SEQ ID NO: 663360 - DNA, 25 bp, Rattus norvegicus
ttattgccaaacttcagtccaagga

SEQ ID NO: 663361 - DNA, 25 bp, Rattus norvegicus
ttattgccaccgctgctataaacac

SEQ ID NO: 663362 - DNA, 25 bp, Rattus norvegicus
ttattgccaccggtgctataaacac

SEQ ID NO: 663363 - DNA, 25 bp, Rattus norvegicus
ttattgcccctcaagaattcttaag

SEQ ID NO: 663364 - DNA, 25 bp, Rattus norvegicus
ttattgcccctctagaattcttaag

SEQ ID NO: 663365 - DNA, 25 bp, Rattus norvegicus
ttattgccggtcagcaggatggcgt

SEQ ID NO: 663366 - DNA, 25 bp, Rattus norvegicus
ttattgccggtctgcaggatggcgt

SEQ ID NO: 663367 - DNA, 25 bp, Rattus norvegicus
ttattgcctcttaattactaccaag

SEQ ID NO: 663368 - DNA, 25 bp, Rattus norvegicus
ttattgcctctttattactaccaag

SEQ ID NO: 663369 - DNA, 25 bp, Rattus norvegicus
ttattgccttttctggagtttcctt

SEQ ID NO: 663370 - DNA, 25 bp, Rattus norvegicus
ttattgccttttgtggagtttcctt

SEQ ID NO: 663371 - DNA, 25 bp, Rattus norvegicus
ttattgctaaaacagtatgccgcca

SEQ ID NO: 663372 - DNA, 25 bp, Rattus norvegicus
ttattgctaaaagagtatgccgcca

SEQ ID NO: 663373 - DNA, 25 bp, Rattus norvegicus
ttattgctcaccatgtggccaacaa

SEQ ID NO: 663374 - DNA, 25 bp, Rattus norvegicus
ttattgctcaccttgtggccaacaa

SEQ ID NO: 663375 - DNA, 25 bp, Rattus norvegicus
ttattgctcagcatgtgctcgcatg

SEQ ID NO: 663376 - DNA, 25 bp, Rattus norvegicus
ttattgctcagcttgtgctcgcatg

SEQ ID NO: 663377 - DNA, 25 bp, Rattus norvegicus
ttattgctgtacatgtcgccgtgac

SEQ ID NO: 663378 - DNA, 25 bp, Rattus norvegicus
ttattgctgtacttgtcgccgtgac

SEQ ID NO: 663379 - DNA, 25 bp, Rattus norvegicus
ttattgcttgtaatgtaggaccttg

SEQ ID NO: 663380 - DNA, 25 bp, Rattus norvegicus
ttattgcttgtattgtaggaccttg

SEQ ID NO: 663381 - DNA, 25 bp, Rattus norvegicus
ttattgctttgtcgccaaccggaac

SEQ ID NO: 663382 - DNA, 25 bp, Rattus norvegicus
ttattgctttgtggccaaccggaac

SEQ ID NO: 663383 - DNA, 25 bp, Rattus norvegicus
ttattgctttttcgtctgaccagac

SEQ ID NO: 663384 - DNA, 25 bp, Rattus norvegicus
ttattgctttttggtctgaccagac

SEQ ID NO: 663385 - DNA, 25 bp, Rattus norvegicus
ttattggaggccagtggctaccagg

SEQ ID NO: 663386 - DNA, 25 bp, Rattus norvegicus
ttattggaggcctgtggctaccagg

SEQ ID NO: 663387 - DNA, 25 bp, Rattus norvegicus
ttattggagttcacctctcgagcca

SEQ ID NO: 663388 - DNA, 25 bp, Rattus norvegicus
ttattggagttctcctctcgagcca

SEQ ID NO: 663389 - DNA, 25 bp, Rattus norvegicus
ttattggatactcaccacctagtcc

SEQ ID NO: 663390 - DNA, 25 bp, Rattus norvegicus
ttattggatactgaccacctagtcc

SEQ ID NO: 663391 - DNA, 25 bp, Rattus norvegicus
ttattggatttgcttctgcgctcct

SEQ ID NO: 663392 - DNA, 25 bp, Rattus norvegicus
ttattggatttggttctgcgctcct

SEQ ID NO: 663393 - DNA, 25 bp, Rattus norvegicus
ttattggccagactactatcccctg

SEQ ID NO: 663394 - DNA, 25 bp, Rattus norvegicus
ttattggccagagtactatcccctg

SEQ ID NO: 663395 - DNA, 25 bp, Rattus norvegicus
ttattggctattcagtacggcactt

SEQ ID NO: 663396 - DNA, 25 bp, Rattus norvegicus
ttattggctattgagtacggcactt

SEQ ID NO: 663397 - DNA, 25 bp, Rattus norvegicus
ttattggctctgcacctcagggatt

SEQ ID NO: 663398 - DNA, 25 bp, Rattus norvegicus
ttattggctctggacctcagggatt

SEQ ID NO: 663399 - DNA, 25 bp, Rattus norvegicus
ttattgggaccaatgtgatctcggg

SEQ ID NO: 663400 - DNA, 25 bp, Rattus norvegicus
ttattgggaccattgtgatctcggg

SEQ ID NO: 663401 - DNA, 25 bp, Rattus norvegicus
ttattggtagagaccaggcgtgctg

SEQ ID NO: 663402 - DNA, 25 bp, Rattus norvegicus
ttattggtagagtccaggcgtgctg

SEQ ID NO: 663403 - DNA, 25 bp, Rattus norvegicus
ttattggtccaaccgcagaccggcg

SEQ ID NO: 663404 - DNA, 25 bp, Rattus norvegicus
ttattggtccaagcgcagaccggcg

SEQ ID NO: 663405 - DNA, 25 bp, Rattus norvegicus
ttattgtagacaccctgcagatcca

SEQ ID NO: 663406 - DNA, 25 bp, Rattus norvegicus
ttattgtagacagcctgcagatcca

SEQ ID NO: 663407 - DNA, 25 bp, Rattus norvegicus
ttattgtattttagggccccacact

SEQ ID NO: 663408 - DNA, 25 bp, Rattus norvegicus
ttattgtatttttgggccccacact

SEQ ID NO: 663409 - DNA, 25 bp, Rattus norvegicus
ttattgtcatcccatacagctctgg

SEQ ID NO: 663410 - DNA, 25 bp, Rattus norvegicus
ttattgtcatccgatacagctctgg

SEQ ID NO: 663411 - DNA, 25 bp, Rattus norvegicus
ttattgtcctgcagtgctgtctaat

SEQ ID NO: 663412 - DNA, 25 bp, Rattus norvegicus
ttattgtcctgctgtgctgtctaat

SEQ ID NO: 663413 - DNA, 25 bp, Rattus norvegicus
ttattgtcgtagaggaattccaggc

SEQ ID NO: 663414 - DNA, 25 bp, Rattus norvegicus
ttattgtcgtagtggaattccaggc

SEQ ID NO: 663415 - DNA, 25 bp, Rattus norvegicus
ttattgtctgagctaattttgtctc

SEQ ID NO: 663416 - DNA, 25 bp, Rattus norvegicus
ttattgtctgaggtaattttgtctc

SEQ ID NO: 663417 - DNA, 25 bp, Rattus norvegicus
ttattgtcttttcgaggtctgctct

SEQ ID NO: 663418 - DNA, 25 bp, Rattus norvegicus
ttattgtcttttggaggtctgctct

SEQ ID NO: 663419 - DNA, 25 bp, Rattus norvegicus
ttattgtgatttcctgtggccccag

SEQ ID NO: 663420 - DNA, 25 bp, Rattus norvegicus
ttattgtgatttgctgtggccccag

SEQ ID NO: 663421 - DNA, 25 bp, Rattus norvegicus
ttattgtgcactagcgcctgtcaga

SEQ ID NO: 663422 - DNA, 25 bp, Rattus norvegicus
ttattgtgcacttgcgcctgtcaga

SEQ ID NO: 663423 - DNA, 25 bp, Rattus norvegicus
ttattgtgccctcggacacgcttag

SEQ ID NO: 663424 - DNA, 25 bp, Rattus norvegicus
ttattgtgccctgggacacgcttag

SEQ ID NO: 663425 - DNA, 25 bp, Rattus norvegicus
ttattgtgggtgatggacctgccat

SEQ ID NO: 663426 - DNA, 25 bp, Rattus norvegicus
ttattgtgggtgttggacctgccat

SEQ ID NO: 663427 - DNA, 25 bp, Rattus norvegicus
ttattgtggttgcacttgtccttgt

SEQ ID NO: 663428 - DNA, 25 bp, Rattus norvegicus
ttattgtggttggacttgtccttgt

SEQ ID NO: 663429 - DNA, 25 bp, Rattus norvegicus
ttattgtgtcctacagggctatcca

SEQ ID NO: 663430 - DNA, 25 bp, Rattus norvegicus
ttattgtgtccttcagggctatcca

SEQ ID NO: 663431 - DNA, 25 bp, Rattus norvegicus
ttattgtgtgacacggagcctcggt

SEQ ID NO: 663432 - DNA, 25 bp, Rattus norvegicus
ttattgtgtgactcggagcctcggt

SEQ ID NO: 663433 - DNA, 25 bp, Rattus norvegicus
ttattgttatcccaggaccccagag

SEQ ID NO: 663434 - DNA, 25 bp, Rattus norvegicus
ttattgttatccgaggaccccagag

SEQ ID NO: 663435 - DNA, 25 bp, Rattus norvegicus
ttattgttcatgatgtcttctaccc

SEQ ID NO: 663436 - DNA, 25 bp, Rattus norvegicus
ttattgttcatgttgtcttctaccc

SEQ ID NO: 663437 - DNA, 25 bp, Rattus norvegicus
ttattgttggagctgcctgaggtta

SEQ ID NO: 663438 - DNA, 25 bp, Rattus norvegicus
ttattgttggaggtgcctgaggtta

SEQ ID NO: 663439 - DNA, 25 bp, Rattus norvegicus
ttattgttggtcaacatacgctccc

SEQ ID NO: 663440 - DNA, 25 bp, Rattus norvegicus
ttattgttggtctacatacgctccc

SEQ ID NO: 663441 - DNA, 25 bp, Rattus norvegicus
ttattgtttcctagcttggtcacag

SEQ ID NO: 663442 - DNA, 25 bp, Rattus norvegicus
ttattgtttccttgcttggtcacag

SEQ ID NO: 663443 - DNA, 25 bp, Rattus norvegicus
ttattgtttctgagccctaagccat

SEQ ID NO: 663444 - DNA, 25 bp, Rattus norvegicus
ttattgtttctgtgccctaagccat

SEQ ID NO: 663445 - DNA, 25 bp, Rattus norvegicus
ttattgttttctactatgtcttcac

SEQ ID NO: 663446 - DNA, 25 bp, Rattus norvegicus
ttattgttttcttctatgtcttcac

SEQ ID NO: 663447 - DNA, 25 bp, Rattus norvegicus
ttatttaaagtgagccgtgggtgga

SEQ ID NO: 663448 - DNA, 25 bp, Rattus norvegicus
ttatttaaagtgtgccgtgggtgga

SEQ ID NO: 663449 - DNA, 25 bp, Rattus norvegicus
ttatttaaggaacccagccccactg

SEQ ID NO: 663450 - DNA, 25 bp, Rattus norvegicus
ttatttaaggaagccagccccactg

SEQ ID NO: 663451 - DNA, 25 bp, Rattus norvegicus
ttatttaattctcttcctccacgtg

SEQ ID NO: 663452 - DNA, 25 bp, Rattus norvegicus
ttatttaattctgttcctccacgtg

SEQ ID NO: 663453 - DNA, 25 bp, Rattus norvegicus
ttatttacagcacatcctcaagtcc

SEQ ID NO: 663454 - DNA, 25 bp, Rattus norvegicus
ttatttacagcagatcctcaagtcc

SEQ ID NO: 663455 - DNA, 25 bp, Rattus norvegicus
ttatttacatgcacttttcccctgg

SEQ ID NO: 663456 - DNA, 25 bp, Rattus norvegicus
ttatttacatgctcttttcccctgg

SEQ ID NO: 663457 - DNA, 25 bp, Rattus norvegicus
ttatttacctctcgttctttccatg

SEQ ID NO: 663458 - DNA, 25 bp, Rattus norvegicus
ttatttacctctggttctttccatg

SEQ ID NO: 663459 - DNA, 25 bp, Rattus norvegicus
ttatttagagtcatggtgggccgcc

SEQ ID NO: 663460 - DNA, 25 bp, Rattus norvegicus
ttatttagagtcttggtgggccgcc

SEQ ID NO: 663461 - DNA, 25 bp, Rattus norvegicus
ttatttaggtccagcagctacattt

SEQ ID NO: 663462 - DNA, 25 bp, Rattus norvegicus
ttatttaggtcctgcagctacattt

SEQ ID NO: 663463 - DNA, 25 bp, Rattus norvegicus
ttatttagtttccttctccaccaca

SEQ ID NO: 663464 - DNA, 25 bp, Rattus norvegicus
ttatttagtttcgttctccaccaca

SEQ ID NO: 663465 - DNA, 25 bp, Rattus norvegicus
ttatttatatcacctggccgctgtt

SEQ ID NO: 663466 - DNA, 25 bp, Rattus norvegicus
ttatttatatcagctggccgctgtt

SEQ ID NO: 663467 - DNA, 25 bp, Rattus norvegicus
ttatttatgaggcttgccgggctcc

SEQ ID NO: 663468 - DNA, 25 bp, Rattus norvegicus
ttatttatgagggttgccgggctcc

SEQ ID NO: 663469 - DNA, 25 bp, Rattus norvegicus
ttatttatggccacgccttctggac

SEQ ID NO: 663470 - DNA, 25 bp, Rattus norvegicus
ttatttatggcctcgccttctggac

SEQ ID NO: 663471 - DNA, 25 bp, Rattus norvegicus
ttatttattaagcagcaccgtgatc

SEQ ID NO: 663472 - DNA, 25 bp, Rattus norvegicus
ttatttattaaggagcaccgtgatc

SEQ ID NO: 663473 - DNA, 25 bp, Rattus norvegicus
ttatttattcgcacctcctttggaa

SEQ ID NO: 663474 - DNA, 25 bp, Rattus norvegicus
ttatttattcgctcctcctttggaa

SEQ ID NO: 663475 - DNA, 25 bp, Rattus norvegicus
ttatttattcgtcacccatgagccc

SEQ ID NO: 663476 - DNA, 25 bp, Rattus norvegicus
ttatttattcgtgacccatgagccc

SEQ ID NO: 663477 - DNA, 25 bp, Rattus norvegicus
ttatttattgaaacccatactgtat

SEQ ID NO: 663478 - DNA, 25 bp, Rattus norvegicus
ttatttattgaatcccatactgtat

SEQ ID NO: 663479 - DNA, 25 bp, Rattus norvegicus
ttatttattgtccacctgcccattg

SEQ ID NO: 663480 - DNA, 25 bp, Rattus norvegicus
ttatttattgtcgacctgcccattg

SEQ ID NO: 663481 - DNA, 25 bp, Rattus norvegicus
ttatttatttccaagctctgggtaa

SEQ ID NO: 663482 - DNA, 25 bp, Rattus norvegicus
ttatttatttcctagctctgggtaa

SEQ ID NO: 663483 - DNA, 25 bp, Rattus norvegicus
ttatttattttgcagctgccccgcc

SEQ ID NO: 663484 - DNA, 25 bp, Rattus norvegicus
ttatttattttggagctgccccgcc

SEQ ID NO: 663485 - DNA, 25 bp, Rattus norvegicus
ttatttcactccacactgtacatca

SEQ ID NO: 663486 - DNA, 25 bp, Rattus norvegicus
ttatttcactcctcactgtacatca

SEQ ID NO: 663487 - DNA, 25 bp, Rattus norvegicus
ttatttcactgacggagctttcctc

SEQ ID NO: 663488 - DNA, 25 bp, Rattus norvegicus
ttatttcactgagggagctttcctc

SEQ ID NO: 663489 - DNA, 25 bp, Rattus norvegicus
ttatttcattccagtctcctatagc

SEQ ID NO: 663490 - DNA, 25 bp, Rattus norvegicus
ttatttcattcctgtctcctatagc

SEQ ID NO: 663491 - DNA, 25 bp, Rattus norvegicus
ttatttcatttacttttctctgtca

SEQ ID NO: 663492 - DNA, 25 bp, Rattus norvegicus
ttatttcatttagttttctctgtca

SEQ ID NO: 663493 - DNA, 25 bp, Rattus norvegicus
ttatttccacctccctataaagtgt

SEQ ID NO: 663494 - DNA, 25 bp, Rattus norvegicus
ttatttccacctgcctataaagtgt

SEQ ID NO: 663495 - DNA, 25 bp, Rattus norvegicus
ttatttccccatctacagcagggac

SEQ ID NO: 663496 - DNA, 25 bp, Rattus norvegicus
ttatttccccatgtacagcagggac

SEQ ID NO: 663497 - DNA, 25 bp, Rattus norvegicus
ttatttccccgacagagtttgttga

SEQ ID NO: 663498 - DNA, 25 bp, Rattus norvegicus
ttatttccccgagagagtttgttga

SEQ ID NO: 663499 - DNA, 25 bp, Rattus norvegicus
ttatttcccgttcctcagaagtaag

SEQ ID NO: 663500 - DNA, 25 bp, Rattus norvegicus
ttatttcccgttgctcagaagtaag

SEQ ID NO: 663501 - DNA, 25 bp, Rattus norvegicus
ttatttcctaccagtatccctttca

SEQ ID NO: 663502 - DNA, 25 bp, Rattus norvegicus
ttatttcctacctgtatccctttca

SEQ ID NO: 663503 - DNA, 25 bp, Rattus norvegicus
ttatttcctcttctcatgattttag

SEQ ID NO: 663504 - DNA, 25 bp, Rattus norvegicus
ttatttcctcttgtcatgattttag

SEQ ID NO: 663505 - DNA, 25 bp, Rattus norvegicus
ttatttccttgcctatactccatag

SEQ ID NO: 663506 - DNA, 25 bp, Rattus norvegicus
ttatttccttgcgtatactccatag

SEQ ID NO: 663507 - DNA, 25 bp, Rattus norvegicus
ttatttcgattcctgatttttcaaa

SEQ ID NO: 663508 - DNA, 25 bp, Rattus norvegicus
ttatttcgattcgtgatttttcaaa

SEQ ID NO: 663509 - DNA, 25 bp, Rattus norvegicus
ttatttcgccccaggtgctgaagaa

SEQ ID NO: 663510 - DNA, 25 bp, Rattus norvegicus
ttatttcgcccctggtgctgaagaa

SEQ ID NO: 663511 - DNA, 25 bp, Rattus norvegicus
ttatttcggaatccccaggaggcga

SEQ ID NO: 663512 - DNA, 25 bp, Rattus norvegicus
ttatttcggaatgcccaggaggcga

SEQ ID NO: 663513 - DNA, 25 bp, Rattus norvegicus
ttatttcggttgctttttcctcaca

SEQ ID NO: 663514 - DNA, 25 bp, Rattus norvegicus
ttatttcggttggtttttcctcaca

SEQ ID NO: 663515 - DNA, 25 bp, Rattus norvegicus
ttatttcgttatatgttggcacact

SEQ ID NO: 663516 - DNA, 25 bp, Rattus norvegicus
ttatttcgttatttgttggcacact

SEQ ID NO: 663517 - DNA, 25 bp, Rattus norvegicus
ttatttctaagtaaatgccacctga

SEQ ID NO: 663518 - DNA, 25 bp, Rattus norvegicus
ttatttctaagttaatgccacctga

SEQ ID NO: 663519 - DNA, 25 bp, Rattus norvegicus
ttatttctaccacccaagcctgctg

SEQ ID NO: 663520 - DNA, 25 bp, Rattus norvegicus
ttatttctaccagccaagcctgctg

SEQ ID NO: 663521 - DNA, 25 bp, Rattus norvegicus
ttatttctagcaaggacaatccgga

SEQ ID NO: 663522 - DNA, 25 bp, Rattus norvegicus
ttatttctagcatggacaatccgga

SEQ ID NO: 663523 - DNA, 25 bp, Rattus norvegicus
ttatttctcagactccgatttccaa

SEQ ID NO: 663524 - DNA, 25 bp, Rattus norvegicus
ttatttctcagagtccgatttccaa

SEQ ID NO: 663525 - DNA, 25 bp, Rattus norvegicus
ttatttctccagcataaggcccatc

SEQ ID NO: 663526 - DNA, 25 bp, Rattus norvegicus
ttatttctccaggataaggcccatc

SEQ ID NO: 663527 - DNA, 25 bp, Rattus norvegicus
ttatttctcccaatccttgtttatt

SEQ ID NO: 663528 - DNA, 25 bp, Rattus norvegicus
ttatttctcccattccttgtttatt

SEQ ID NO: 663529 - DNA, 25 bp, Rattus norvegicus
ttatttctctctattggtgaccaag

SEQ ID NO: 663530 - DNA, 25 bp, Rattus norvegicus
ttatttctctcttttggtgaccaag

SEQ ID NO: 663531 - DNA, 25 bp, Rattus norvegicus
ttatttctgctgaattctctcctgg

SEQ ID NO: 663532 - DNA, 25 bp, Rattus norvegicus
ttatttctgctgtattctctcctgg

SEQ ID NO: 663533 - DNA, 25 bp, Rattus norvegicus
ttatttctggacagactccgataaa

SEQ ID NO: 663534 - DNA, 25 bp, Rattus norvegicus
ttatttctggactgactccgataaa

SEQ ID NO: 663535 - DNA, 25 bp, Rattus norvegicus
ttatttctggtaactggccacttgg

SEQ ID NO: 663536 - DNA, 25 bp, Rattus norvegicus
ttatttctggtatctggccacttgg

SEQ ID NO: 663537 - DNA, 25 bp, Rattus norvegicus
ttatttcttccaaaggtcactcttg

SEQ ID NO: 663538 - DNA, 25 bp, Rattus norvegicus
ttatttcttccataggtcactcttg

SEQ ID NO: 663539 - DNA, 25 bp, Rattus norvegicus
ttatttcttcttcttgttgttatta

SEQ ID NO: 663540 - DNA, 25 bp, Rattus norvegicus
ttatttcttcttgttgttgttatta

SEQ ID NO: 663541 - DNA, 25 bp, Rattus norvegicus
ttatttgaaccaacattcccaccac

SEQ ID NO: 663542 - DNA, 25 bp, Rattus norvegicus
ttatttgaaccatcattcccaccac

SEQ ID NO: 663543 - DNA, 25 bp, Rattus norvegicus
ttatttgaagctctcttcccatggc

SEQ ID NO: 663544 - DNA, 25 bp, Rattus norvegicus
ttatttgaagctgtcttcccatggc

SEQ ID NO: 663545 - DNA, 25 bp, Rattus norvegicus
ttatttgaccagaaagcgccggatc

SEQ ID NO: 663546 - DNA, 25 bp, Rattus norvegicus
ttatttgaccagtaagcgccggatc

SEQ ID NO: 663547 - DNA, 25 bp, Rattus norvegicus
ttatttgaccccatctcctgagtcc

SEQ ID NO: 663548 - DNA, 25 bp, Rattus norvegicus
ttatttgaccccttctcctgagtcc

SEQ ID NO: 663549 - DNA, 25 bp, Rattus norvegicus
ttatttgaccttaggtttgcctctc

SEQ ID NO: 663550 - DNA, 25 bp, Rattus norvegicus
ttatttgacctttggtttgcctctc

SEQ ID NO: 663551 - DNA, 25 bp, Rattus norvegicus
ttatttgagcctacctacaccagat

SEQ ID NO: 663552 - DNA, 25 bp, Rattus norvegicus
ttatttgagccttcctacaccagat

SEQ ID NO: 663553 - DNA, 25 bp, Rattus norvegicus
ttatttgatccactacacatttcct

SEQ ID NO: 663554 - DNA, 25 bp, Rattus norvegicus
ttatttgatccagtacacatttcct

SEQ ID NO: 663555 - DNA, 25 bp, Rattus norvegicus
ttatttgatgggacagagctcagcc

SEQ ID NO: 663556 - DNA, 25 bp, Rattus norvegicus
ttatttgatgggtcagagctcagcc

SEQ ID NO: 663557 - DNA, 25 bp, Rattus norvegicus
ttatttgccaagacagccctggtac

SEQ ID NO: 663558 - DNA, 25 bp, Rattus norvegicus
ttatttgccaagtcagccctggtac

SEQ ID NO: 663559 - DNA, 25 bp, Rattus norvegicus
ttatttgccagcagtatgtctttaa

SEQ ID NO: 663560 - DNA, 25 bp, Rattus norvegicus
ttatttgccagctgtatgtctttaa

SEQ ID NO: 663561 - DNA, 25 bp, Rattus norvegicus
ttatttgccccgagtaagacattct

SEQ ID NO: 663562 - DNA, 25 bp, Rattus norvegicus
ttatttgccccgtgtaagacattct

SEQ ID NO: 663563 - DNA, 25 bp, Rattus norvegicus
ttatttgcccggaatctgctgattg

SEQ ID NO: 663564 - DNA, 25 bp, Rattus norvegicus
ttatttgcccggtatctgctgattg

SEQ ID NO: 663565 - DNA, 25 bp, Rattus norvegicus
ttatttgcctctaacaacctcagtg

SEQ ID NO: 663566 - DNA, 25 bp, Rattus norvegicus
ttatttgcctcttacaacctcagtg

SEQ ID NO: 663567 - DNA, 25 bp, Rattus norvegicus
ttatttggaccacgtacatgtacag

SEQ ID NO: 663568 - DNA, 25 bp, Rattus norvegicus
ttatttggaccaggtacatgtacag

SEQ ID NO: 663569 - DNA, 25 bp, Rattus norvegicus
ttatttggacttacaacttgttcaa

SEQ ID NO: 663570 - DNA, 25 bp, Rattus norvegicus
ttatttggacttaggattcaggttt

SEQ ID NO: 663571 - DNA, 25 bp, Rattus norvegicus
ttatttggactttcaacttgttcaa

SEQ ID NO: 663572 - DNA, 25 bp, Rattus norvegicus
ttatttggactttggattcaggttt

SEQ ID NO: 663573 - DNA, 25 bp, Rattus norvegicus
ttatttgggccactaaactttagat

SEQ ID NO: 663574 - DNA, 25 bp, Rattus norvegicus
ttatttgggccagtaaactttagat

SEQ ID NO: 663575 - DNA, 25 bp, Rattus norvegicus
ttatttgggctcctggttcaagcag

SEQ ID NO: 663576 - DNA, 25 bp, Rattus norvegicus
ttatttgggctcgtggttcaagcag

SEQ ID NO: 663577 - DNA, 25 bp, Rattus norvegicus
ttatttgggttcaatcactgatata

SEQ ID NO: 663578 - DNA, 25 bp, Rattus norvegicus
ttatttgggttctatcactgatata

SEQ ID NO: 663579 - DNA, 25 bp, Rattus norvegicus
ttatttggttctactcattcccagt

SEQ ID NO: 663580 - DNA, 25 bp, Rattus norvegicus
ttatttggttcttctcattcccagt

SEQ ID NO: 663581 - DNA, 25 bp, Rattus norvegicus
ttatttgtaactctggacttcccac

SEQ ID NO: 663582 - DNA, 25 bp, Rattus norvegicus
ttatttgtaactgtggacttcccac

SEQ ID NO: 663583 - DNA, 25 bp, Rattus norvegicus
ttatttgtacaaaggccttttcgtt

SEQ ID NO: 663584 - DNA, 25 bp, Rattus norvegicus
ttatttgtacaatggccttttcgtt

SEQ ID NO: 663585 - DNA, 25 bp, Rattus norvegicus
ttatttgtacggaaaatctggcttt

SEQ ID NO: 663586 - DNA, 25 bp, Rattus norvegicus
ttatttgtacggtaaatctggcttt

SEQ ID NO: 663587 - DNA, 25 bp, Rattus norvegicus
ttatttgtataccataattgggcca

SEQ ID NO: 663588 - DNA, 25 bp, Rattus norvegicus
ttatttgtatacgataattgggcca

SEQ ID NO: 663589 - DNA, 25 bp, Rattus norvegicus
ttatttgtccccactgaactctcga

SEQ ID NO: 663590 - DNA, 25 bp, Rattus norvegicus
ttatttgtcccctctgaactctcga

SEQ ID NO: 663591 - DNA, 25 bp, Rattus norvegicus
ttatttgtctgcatgcattcttgca

SEQ ID NO: 663592 - DNA, 25 bp, Rattus norvegicus
ttatttgtctgcttgcattcttgca

SEQ ID NO: 663593 - DNA, 25 bp, Rattus norvegicus
ttatttgttcgacgagtctctgatg

SEQ ID NO: 663594 - DNA, 25 bp, Rattus norvegicus
ttatttgttcgaggagtctctgatg

SEQ ID NO: 663595 - DNA, 25 bp, Rattus norvegicus
ttatttgttctgaagttccctctgc

SEQ ID NO: 663596 - DNA, 25 bp, Rattus norvegicus
ttatttgttctgtagttccctctgc

SEQ ID NO: 663597 - DNA, 25 bp, Rattus norvegicus
ttatttgtttcccaaaggccctgca

SEQ ID NO: 663598 - DNA, 25 bp, Rattus norvegicus
ttatttgtttccgaaaggccctgca

SEQ ID NO: 663599 - DNA, 25 bp, Rattus norvegicus
ttatttgtttttcctctcactaaaa

SEQ ID NO: 663600 - DNA, 25 bp, Rattus norvegicus
ttatttgtttttgctctcactaaaa

SEQ ID NO: 663601 - DNA, 25 bp, Rattus norvegicus
ttattttaatcacagcatgatgaga

SEQ ID NO: 663602 - DNA, 25 bp, Rattus norvegicus
ttattttaatcagagcatgatgaga

SEQ ID NO: 663603 - DNA, 25 bp, Rattus norvegicus
ttattttacattatagggctctaaa

SEQ ID NO: 663604 - DNA, 25 bp, Rattus norvegicus
ttattttacattttagggctctaaa

SEQ ID NO: 663605 - DNA, 25 bp, Rattus norvegicus
ttattttagctactggtacccaaga

SEQ ID NO: 663606 - DNA, 25 bp, Rattus norvegicus
ttattttagctagtggtacccaaga

SEQ ID NO: 663607 - DNA, 25 bp, Rattus norvegicus
ttattttatattcccgtcctgatcc

SEQ ID NO: 663608 - DNA, 25 bp, Rattus norvegicus
ttattttatattgccgtcctgatcc

SEQ ID NO: 663609 - DNA, 25 bp, Rattus norvegicus
ttattttcacgaagctcaccagcga

SEQ ID NO: 663610 - DNA, 25 bp, Rattus norvegicus
ttattttcacgatgctcaccagcga

SEQ ID NO: 663611 - DNA, 25 bp, Rattus norvegicus
ttattttcacttaaccataggttct

SEQ ID NO: 663612 - DNA, 25 bp, Rattus norvegicus
ttattttcactttaccataggttct

SEQ ID NO: 663613 - DNA, 25 bp, Rattus norvegicus
ttattttcaggtatttgagccgagc

SEQ ID NO: 663614 - DNA, 25 bp, Rattus norvegicus
ttattttcaggtttttgagccgagc

SEQ ID NO: 663615 - DNA, 25 bp, Rattus norvegicus
ttattttccagcatccagtgtcggc

SEQ ID NO: 663616 - DNA, 25 bp, Rattus norvegicus
ttattttccagcttccagtgtcggc

SEQ ID NO: 663617 - DNA, 25 bp, Rattus norvegicus
ttattttcccctcctatatactgtg

SEQ ID NO: 663618 - DNA, 25 bp, Rattus norvegicus
ttattttcccctgctatatactgtg

SEQ ID NO: 663619 - DNA, 25 bp, Rattus norvegicus
ttattttcccttcaatttcccactg

SEQ ID NO: 663620 - DNA, 25 bp, Rattus norvegicus
ttattttcccttctgtcggattgta

SEQ ID NO: 663621 - DNA, 25 bp, Rattus norvegicus
ttattttcccttgaatttcccactg

SEQ ID NO: 663622 - DNA, 25 bp, Rattus norvegicus
ttattttcccttgtgtcggattgta

SEQ ID NO: 663623 - DNA, 25 bp, Rattus norvegicus
ttattttcctcacgatccaaggctt

SEQ ID NO: 663624 - DNA, 25 bp, Rattus norvegicus
ttattttcctcaggatccaaggctt

SEQ ID NO: 663625 - DNA, 25 bp, Rattus norvegicus
ttattttcctgaacatttgcttgaa

SEQ ID NO: 663626 - DNA, 25 bp, Rattus norvegicus
ttattttcctgatcatttgcttgaa

SEQ ID NO: 663627 - DNA, 25 bp, Rattus norvegicus
ttattttctctgatgaggccctacc

SEQ ID NO: 663628 - DNA, 25 bp, Rattus norvegicus
ttattttctctgttgaggccctacc

SEQ ID NO: 663629 - DNA, 25 bp, Rattus norvegicus
ttattttgcaacaacctcaggacag

SEQ ID NO: 663630 - DNA, 25 bp, Rattus norvegicus
ttattttgcaactacctcaggacag

SEQ ID NO: 663631 - DNA, 25 bp, Rattus norvegicus
ttattttgcaatcctgggccagcta

SEQ ID NO: 663632 - DNA, 25 bp, Rattus norvegicus
ttattttgcaatgctgggccagcta

SEQ ID NO: 663633 - DNA, 25 bp, Rattus norvegicus
ttattttgccttaaacagctgggta

SEQ ID NO: 663634 - DNA, 25 bp, Rattus norvegicus
ttattttgccttatacccagtggta

SEQ ID NO: 663635 - DNA, 25 bp, Rattus norvegicus
ttattttgcctttaacagctgggta

SEQ ID NO: 663636 - DNA, 25 bp, Rattus norvegicus
ttattttgccttttacccagtggta

SEQ ID NO: 663637 - DNA, 25 bp, Rattus norvegicus
ttattttgggccatgccattgccct

SEQ ID NO: 663638 - DNA, 25 bp, Rattus norvegicus
ttattttgggccttgccattgccct

SEQ ID NO: 663639 - DNA, 25 bp, Rattus norvegicus
ttattttggtggctttcttttctct

SEQ ID NO: 663640 - DNA, 25 bp, Rattus norvegicus
ttattttggtgggtttcttttctct

SEQ ID NO: 663641 - DNA, 25 bp, Rattus norvegicus
ttattttgtataaactcacgagaac

SEQ ID NO: 663642 - DNA, 25 bp, Rattus norvegicus
ttattttgtatatactcacgagaac

SEQ ID NO: 663643 - DNA, 25 bp, Rattus norvegicus
ttattttgtgctagtacccgcctaa

SEQ ID NO: 663644 - DNA, 25 bp, Rattus norvegicus
ttattttgtgcttgtacccgcctaa

SEQ ID NO: 663645 - DNA, 25 bp, Rattus norvegicus
ttattttgtgttatccatccctcac

SEQ ID NO: 663646 - DNA, 25 bp, Rattus norvegicus
ttattttgtgttttccatccctcac

SEQ ID NO: 663647 - DNA, 25 bp, Rattus norvegicus
ttatttttacaaccaggcacccaaa

SEQ ID NO: 663648 - DNA, 25 bp, Rattus norvegicus
ttatttttacaagcaggcacccaaa

SEQ ID NO: 663649 - DNA, 25 bp, Rattus norvegicus
ttatttttacttataatgcttgagc

SEQ ID NO: 663650 - DNA, 25 bp, Rattus norvegicus
ttatttttacttttaatgcttgagc

SEQ ID NO: 663651 - DNA, 25 bp, Rattus norvegicus
ttatttttctccacttcgttgtgat

SEQ ID NO: 663652 - DNA, 25 bp, Rattus norvegicus
ttatttttctccatgagtcttgagg

SEQ ID NO: 663653 - DNA, 25 bp, Rattus norvegicus
ttatttttctcctcttcgttgtgat

SEQ ID NO: 663654 - DNA, 25 bp, Rattus norvegicus
ttatttttctccttgagtcttgagg

SEQ ID NO: 663655 - DNA, 25 bp, Rattus norvegicus
ttatttttctgtccacccgtgtaca

SEQ ID NO: 663656 - DNA, 25 bp, Rattus norvegicus
ttatttttctgtctgcatccttccc

SEQ ID NO: 663657 - DNA, 25 bp, Rattus norvegicus
ttatttttctgtgcacccgtgtaca

SEQ ID NO: 663658 - DNA, 25 bp, Rattus norvegicus
ttatttttctgtgtgcatccttccc

SEQ ID NO: 663659 - DNA, 25 bp, Rattus norvegicus
ttatttttgctgagggtgaccagga

SEQ ID NO: 663660 - DNA, 25 bp, Rattus norvegicus
ttatttttgctgtgggtgaccagga

SEQ ID NO: 663661 - DNA, 25 bp, Rattus norvegicus
ttattttttcatactccttggtgga

SEQ ID NO: 663662 - DNA, 25 bp, Rattus norvegicus
ttattttttcattctccttggtgga

SEQ ID NO: 663663 - DNA, 25 bp, Rattus norvegicus
ttattttttccccattagccacaag

SEQ ID NO: 663664 - DNA, 25 bp, Rattus norvegicus
ttattttttcccgattagccacaag

SEQ ID NO: 663665 - DNA, 25 bp, Rattus norvegicus
ttattttttcctcatgcgcatgtaa

SEQ ID NO: 663666 - DNA, 25 bp, Rattus norvegicus
ttattttttcctcctttagacttga

SEQ ID NO: 663667 - DNA, 25 bp, Rattus norvegicus
ttattttttcctgatgcgcatgtaa

SEQ ID NO: 663668 - DNA, 25 bp, Rattus norvegicus
ttattttttcctgctttagacttga

SEQ ID NO: 663669 - DNA, 25 bp, Rattus norvegicus
ttattttttggcagcgtctctgatg

SEQ ID NO: 663670 - DNA, 25 bp, Rattus norvegicus
ttattttttggctgcgtctctgatg

SEQ ID NO: 663671 - DNA, 25 bp, Rattus norvegicus
ttcaaaaaactgctaccttgtgtgc

SEQ ID NO: 663672 - DNA, 25 bp, Rattus norvegicus
ttcaaaaaactggtaccttgtgtgc

SEQ ID NO: 663673 - DNA, 25 bp, Rattus norvegicus
ttcaaaaaagcccatgtcacacacc

SEQ ID NO: 663674 - DNA, 25 bp, Rattus norvegicus
ttcaaaaaagccgatgtcacacacc

SEQ ID NO: 663675 - DNA, 25 bp, Rattus norvegicus
ttcaaaaagagcagccccttcctcg

SEQ ID NO: 663676 - DNA, 25 bp, Rattus norvegicus
ttcaaaaagagctgccccttcctcg

SEQ ID NO: 663677 - DNA, 25 bp, Rattus norvegicus
ttcaaaaatctcaagcgcgtggcca

SEQ ID NO: 663678 - DNA, 25 bp, Rattus norvegicus
ttcaaaaatctctagcgcgtggcca

SEQ ID NO: 663679 - DNA, 25 bp, Rattus norvegicus
ttcaaaacctttcctttgtgtgcaa

SEQ ID NO: 663680 - DNA, 25 bp, Rattus norvegicus
ttcaaaacctttgctttgtgtgcaa

SEQ ID NO: 663681 - DNA, 25 bp, Rattus norvegicus
ttcaaaactcaactctgtgcttgcc

SEQ ID NO: 663682 - DNA, 25 bp, Rattus norvegicus
ttcaaaactcaagtctgtgcttgcc

SEQ ID NO: 663683 - DNA, 25 bp, Rattus norvegicus
ttcaaaaggttcctcttggcttcca

SEQ ID NO: 663684 - DNA, 25 bp, Rattus norvegicus
ttcaaaaggttcgtcttggcttcca

SEQ ID NO: 663685 - DNA, 25 bp, Rattus norvegicus
ttcaaaagttaacaggccagcctgt

SEQ ID NO: 663686 - DNA, 25 bp, Rattus norvegicus
ttcaaaagttaagaggccagcctgt

SEQ ID NO: 663687 - DNA, 25 bp, Rattus norvegicus
ttcaaaatacctctgttcgatcttt

SEQ ID NO: 663688 - DNA, 25 bp, Rattus norvegicus
ttcaaaatacctgtgttcgatcttt

SEQ ID NO: 663689 - DNA, 25 bp, Rattus norvegicus
ttcaaaatactacaagccggcttca

SEQ ID NO: 663690 - DNA, 25 bp, Rattus norvegicus
ttcaaaatactagaagccggcttca

SEQ ID NO: 663691 - DNA, 25 bp, Rattus norvegicus
ttcaaaatactcatggccactgggc

SEQ ID NO: 663692 - DNA, 25 bp, Rattus norvegicus
ttcaaaatactcttggccactgggc

SEQ ID NO: 663693 - DNA, 25 bp, Rattus norvegicus
ttcaaaatctcacagtagccagttt

SEQ ID NO: 663694 - DNA, 25 bp, Rattus norvegicus
ttcaaaatctcagagtagccagttt

SEQ ID NO: 663695 - DNA, 25 bp, Rattus norvegicus
ttcaaaatctctcttgtcctgacag

SEQ ID NO: 663696 - DNA, 25 bp, Rattus norvegicus
ttcaaaatctctgttgtcctgacag

SEQ ID NO: 663697 - DNA, 25 bp, Rattus norvegicus
ttcaaaattaacagcctccttgcct

SEQ ID NO: 663698 - DNA, 25 bp, Rattus norvegicus
ttcaaaattaactgcctccttgcct

SEQ ID NO: 663699 - DNA, 25 bp, Rattus norvegicus
ttcaaaattcatcaccccgaggcta

SEQ ID NO: 663700 - DNA, 25 bp, Rattus norvegicus
ttcaaaattcatgaccccgaggcta

SEQ ID NO: 663701 - DNA, 25 bp, Rattus norvegicus
ttcaaacaatctcccctaactattc

SEQ ID NO: 663702 - DNA, 25 bp, Rattus norvegicus
ttcaaacaatctgccctaactattc

SEQ ID NO: 663703 - DNA, 25 bp, Rattus norvegicus
ttcaaacacgtcaggcttctggcac

SEQ ID NO: 663704 - DNA, 25 bp, Rattus norvegicus
ttcaaacacgtctggcttctggcac

SEQ ID NO: 663705 - DNA, 25 bp, Rattus norvegicus
ttcaaacagttaaccacttgcctcg

SEQ ID NO: 663706 - DNA, 25 bp, Rattus norvegicus
ttcaaacagttatccacttgcctcg

SEQ ID NO: 663707 - DNA, 25 bp, Rattus norvegicus
ttcaaacatttacctgtctctcttc

SEQ ID NO: 663708 - DNA, 25 bp, Rattus norvegicus
ttcaaacatttagctgtctctcttc

SEQ ID NO: 663709 - DNA, 25 bp, Rattus norvegicus
ttcaaacattttcccctcttgctta

SEQ ID NO: 663710 - DNA, 25 bp, Rattus norvegicus
ttcaaacattttgccctcttgctta

SEQ ID NO: 663711 - DNA, 25 bp, Rattus norvegicus
ttcaaaccactgaagctgccttagg

SEQ ID NO: 663712 - DNA, 25 bp, Rattus norvegicus
ttcaaaccactgtagctgccttagg

SEQ ID NO: 663713 - DNA, 25 bp, Rattus norvegicus
ttcaaaccagttccagaccaggcat

SEQ ID NO: 663714 - DNA, 25 bp, Rattus norvegicus
ttcaaaccagttgcagaccaggcat

SEQ ID NO: 663715 - DNA, 25 bp, Rattus norvegicus
ttcaaaccccaccactgtgtaagaa

SEQ ID NO: 663716 - DNA, 25 bp, Rattus norvegicus
ttcaaaccccacgactgtgtaagaa

SEQ ID NO: 663717 - DNA, 25 bp, Rattus norvegicus
ttcaaaccctacacaaaccagctta

SEQ ID NO: 663718 - DNA, 25 bp, Rattus norvegicus
ttcaaaccctactcaaaccagctta

SEQ ID NO: 663719 - DNA, 25 bp, Rattus norvegicus
ttcaaaccctccaaatgacagcgga

SEQ ID NO: 663720 - DNA, 25 bp, Rattus norvegicus
ttcaaaccctcctaatgacagcgga

SEQ ID NO: 663721 - DNA, 25 bp, Rattus norvegicus
ttcaaacgactaaagctgggctcct

SEQ ID NO: 663722 - DNA, 25 bp, Rattus norvegicus
ttcaaacgactatagctgggctcct

SEQ ID NO: 663723 - DNA, 25 bp, Rattus norvegicus
ttcaaacgctcaacctactgacaga

SEQ ID NO: 663724 - DNA, 25 bp, Rattus norvegicus
ttcaaacgctcatcctactgacaga

SEQ ID NO: 663725 - DNA, 25 bp, Rattus norvegicus
ttcaaacgtaaccatgtctccactg

SEQ ID NO: 663726 - DNA, 25 bp, Rattus norvegicus
ttcaaacgtaacgatgtctccactg

SEQ ID NO: 663727 - DNA, 25 bp, Rattus norvegicus
ttcaaacgtcttcctcgagaccaga

SEQ ID NO: 663728 - DNA, 25 bp, Rattus norvegicus
ttcaaacgtcttgctcgagaccaga

SEQ ID NO: 663729 - DNA, 25 bp, Rattus norvegicus
ttcaaacgtgacaacttaggctgtt

SEQ ID NO: 663730 - DNA, 25 bp, Rattus norvegicus
ttcaaacgtgactacttaggctgtt

SEQ ID NO: 663731 - DNA, 25 bp, Rattus norvegicus
ttcaaactcgaacgtttccctctgg

SEQ ID NO: 663732 - DNA, 25 bp, Rattus norvegicus
ttcaaactcgaaggtttccctctgg

SEQ ID NO: 663733 - DNA, 25 bp, Rattus norvegicus
ttcaaactgggcctcttttctaaag

SEQ ID NO: 663734 - DNA, 25 bp, Rattus norvegicus
ttcaaactgggcctggaattcgatg

SEQ ID NO: 663735 - DNA, 25 bp, Rattus norvegicus
ttcaaactgggcgtcttttctaaag

SEQ ID NO: 663736 - DNA, 25 bp, Rattus norvegicus
ttcaaactgggcgtggaattcgatg

SEQ ID NO: 663737 - DNA, 25 bp, Rattus norvegicus
ttcaaagactcaacacgccagatcc

SEQ ID NO: 663738 - DNA, 25 bp, Rattus norvegicus
ttcaaagactcatcacgccagatcc

SEQ ID NO: 663739 - DNA, 25 bp, Rattus norvegicus
ttcaaagagacaccgaagcctcctg

SEQ ID NO: 663740 - DNA, 25 bp, Rattus norvegicus
ttcaaagagacagcgaagcctcctg

SEQ ID NO: 663741 - DNA, 25 bp, Rattus norvegicus
ttcaaagagcagaccccagtaccgt

SEQ ID NO: 663742 - DNA, 25 bp, Rattus norvegicus
ttcaaagagcagtccccagtaccgt

SEQ ID NO: 663743 - DNA, 25 bp, Rattus norvegicus
ttcaaagagcgaaactgcccaagat

SEQ ID NO: 663744 - DNA, 25 bp, Rattus norvegicus
ttcaaagagcgatactgcccaagat

SEQ ID NO: 663745 - DNA, 25 bp, Rattus norvegicus
ttcaaagatcagctcctggaagcgt

SEQ ID NO: 663746 - DNA, 25 bp, Rattus norvegicus
ttcaaagatcaggtcctggaagcgt

SEQ ID NO: 663747 - DNA, 25 bp, Rattus norvegicus
ttcaaagatggacgcggcggctctc

SEQ ID NO: 663748 - DNA, 25 bp, Rattus norvegicus
ttcaaagatggaggcggcggctctc

SEQ ID NO: 663749 - DNA, 25 bp, Rattus norvegicus
ttcaaagcgcctatcccaggagaag

SEQ ID NO: 663750 - DNA, 25 bp, Rattus norvegicus
ttcaaagcgcctttcccaggagaag

SEQ ID NO: 663751 - DNA, 25 bp, Rattus norvegicus
ttcaaagcgtttcaccggctgcaga

SEQ ID NO: 663752 - DNA, 25 bp, Rattus norvegicus
ttcaaagcgtttgaccggctgcaga

SEQ ID NO: 663753 - DNA, 25 bp, Rattus norvegicus
ttcaaaggactaatactgtgggcag

SEQ ID NO: 663754 - DNA, 25 bp, Rattus norvegicus
ttcaaaggactattactgtgggcag

SEQ ID NO: 663755 - DNA, 25 bp, Rattus norvegicus
ttcaaaggccggagtgtgaacccct

SEQ ID NO: 663756 - DNA, 25 bp, Rattus norvegicus
ttcaaaggccggtgtgtgaacccct

SEQ ID NO: 663757 - DNA, 25 bp, Rattus norvegicus
ttcaaaggcgtcaaagtcaggcaga

SEQ ID NO: 663758 - DNA, 25 bp, Rattus norvegicus
ttcaaaggcgtctaagtcaggcaga

SEQ ID NO: 663759 - DNA, 25 bp, Rattus norvegicus
ttcaaagggcctcttacacaattcc

SEQ ID NO: 663760 - DNA, 25 bp, Rattus norvegicus
ttcaaagggcctgttacacaattcc

SEQ ID NO: 663761 - DNA, 25 bp, Rattus norvegicus
ttcaaagggctgaacatggtggtgc

SEQ ID NO: 663762 - DNA, 25 bp, Rattus norvegicus
ttcaaagggctgtacatggtggtgc

SEQ ID NO: 663763 - DNA, 25 bp, Rattus norvegicus
ttcaaagggtcacgcgtaagatatt

SEQ ID NO: 663764 - DNA, 25 bp, Rattus norvegicus
ttcaaagggtcaggcgtaagatatt

SEQ ID NO: 663765 - DNA, 25 bp, Rattus norvegicus
ttcaaaggtcagaagcccaaagcac

SEQ ID NO: 663766 - DNA, 25 bp, Rattus norvegicus
ttcaaaggtcagtagcccaaagcac

SEQ ID NO: 663767 - DNA, 25 bp, Rattus norvegicus
ttcaaaggtgctcaacagtgccatg

SEQ ID NO: 663768 - DNA, 25 bp, Rattus norvegicus
ttcaaaggtgctgaacagtgccatg

SEQ ID NO: 663769 - DNA, 25 bp, Rattus norvegicus
ttcaaagtccccattcttggatctg

SEQ ID NO: 663770 - DNA, 25 bp, Rattus norvegicus
ttcaaagtcccctttcttggatctg

SEQ ID NO: 663771 - DNA, 25 bp, Rattus norvegicus
ttcaaagtcttcagccagagtggtt

SEQ ID NO: 663772 - DNA, 25 bp, Rattus norvegicus
ttcaaagtcttccatcagcagtgat

SEQ ID NO: 663773 - DNA, 25 bp, Rattus norvegicus
ttcaaagtcttcgatcagcagtgat

SEQ ID NO: 663774 - DNA, 25 bp, Rattus norvegicus
ttcaaagtcttctgccagagtggtt

SEQ ID NO: 663775 - DNA, 25 bp, Rattus norvegicus
ttcaaagtctttaaactcaaatact

SEQ ID NO: 663776 - DNA, 25 bp, Rattus norvegicus
ttcaaagtcttttaactcaaatact

SEQ ID NO: 663777 - DNA, 25 bp, Rattus norvegicus
ttcaaagtgccgaggtctgcagtca

SEQ ID NO: 663778 - DNA, 25 bp, Rattus norvegicus
ttcaaagtgccgtggtctgcagtca

SEQ ID NO: 663779 - DNA, 25 bp, Rattus norvegicus
ttcaaagtgtccaagcattgctttt

SEQ ID NO: 663780 - DNA, 25 bp, Rattus norvegicus
ttcaaagtgtcctagcattgctttt

SEQ ID NO: 663781 - DNA, 25 bp, Rattus norvegicus
ttcaaagttagacgctacagccgca

SEQ ID NO: 663782 - DNA, 25 bp, Rattus norvegicus
ttcaaagttagaggctacagccgca

SEQ ID NO: 663783 - DNA, 25 bp, Rattus norvegicus
ttcaaagttcaaatccagccaggaa

SEQ ID NO: 663784 - DNA, 25 bp, Rattus norvegicus
ttcaaagttcaattccagccaggaa

SEQ ID NO: 663785 - DNA, 25 bp, Rattus norvegicus
ttcaaagttgtgaccctggacaccc

SEQ ID NO: 663786 - DNA, 25 bp, Rattus norvegicus
ttcaaagttgtgtccctggacaccc

SEQ ID NO: 663787 - DNA, 25 bp, Rattus norvegicus
ttcaaatactttcttctcccaactg

SEQ ID NO: 663788 - DNA, 25 bp, Rattus norvegicus
ttcaaatactttgttctcccaactg

SEQ ID NO: 663789 - DNA, 25 bp, Rattus norvegicus
ttcaaatcccaacctgcacggcagg

SEQ ID NO: 663790 - DNA, 25 bp, Rattus norvegicus
ttcaaatcccaagctgcacggcagg

SEQ ID NO: 663791 - DNA, 25 bp, Rattus norvegicus
ttcaaatgaagtactgtgcccctcc

SEQ ID NO: 663792 - DNA, 25 bp, Rattus norvegicus
ttcaaatgaagttctgtgcccctcc

SEQ ID NO: 663793 - DNA, 25 bp, Rattus norvegicus
ttcaaatgatagacagggctccctg

SEQ ID NO: 663794 - DNA, 25 bp, Rattus norvegicus
ttcaaatgatagtcagggctccctg

SEQ ID NO: 663795 - DNA, 25 bp, Rattus norvegicus
ttcaaatgccaaattccaatcgatt

SEQ ID NO: 663796 - DNA, 25 bp, Rattus norvegicus
ttcaaatgccaatttccaatcgatt

SEQ ID NO: 663797 - DNA, 25 bp, Rattus norvegicus
ttcaaatgtctcacacttgtgcagg

SEQ ID NO: 663798 - DNA, 25 bp, Rattus norvegicus
ttcaaatgtctctcacttgtgcagg

SEQ ID NO: 663799 - DNA, 25 bp, Rattus norvegicus
ttcaaatgttcaagttcgccacgcc

SEQ ID NO: 663800 - DNA, 25 bp, Rattus norvegicus
ttcaaatgttcatgttcgccacgcc

SEQ ID NO: 663801 - DNA, 25 bp, Rattus norvegicus
ttcaaattcttaactgctctgcctg

SEQ ID NO: 663802 - DNA, 25 bp, Rattus norvegicus
ttcaaattcttatctgctctgcctg

SEQ ID NO: 663803 - DNA, 25 bp, Rattus norvegicus
ttcaacaaacacatactggtcacat

SEQ ID NO: 663804 - DNA, 25 bp, Rattus norvegicus
ttcaacaaacacttactggtcacat

SEQ ID NO: 663805 - DNA, 25 bp, Rattus norvegicus
ttcaacaacagcacccacttcagtg

SEQ ID NO: 663806 - DNA, 25 bp, Rattus norvegicus
ttcaacaacagcactctaataccca

SEQ ID NO: 663807 - DNA, 25 bp, Rattus norvegicus
ttcaacaacagctcccacttcagtg

SEQ ID NO: 663808 - DNA, 25 bp, Rattus norvegicus
ttcaacaacagctctctaataccca

SEQ ID NO: 663809 - DNA, 25 bp, Rattus norvegicus
ttcaacaccagcctatccaaagtaa

SEQ ID NO: 663810 - DNA, 25 bp, Rattus norvegicus
ttcaacaccagcgtatccaaagtaa

SEQ ID NO: 663811 - DNA, 25 bp, Rattus norvegicus
ttcaacaccatcacaggccgagaag

SEQ ID NO: 663812 - DNA, 25 bp, Rattus norvegicus
ttcaacaccatctcaggccgagaag

SEQ ID NO: 663813 - DNA, 25 bp, Rattus norvegicus
ttcaacacgttccaactcacacagg

SEQ ID NO: 663814 - DNA, 25 bp, Rattus norvegicus
ttcaacacgttcgaactcacacagg

SEQ ID NO: 663815 - DNA, 25 bp, Rattus norvegicus
ttcaacaggatcatctggccagagc

SEQ ID NO: 663816 - DNA, 25 bp, Rattus norvegicus
ttcaacaggatcttctggccagagc

SEQ ID NO: 663817 - DNA, 25 bp, Rattus norvegicus
ttcaacaggtaacaaggtgcttctt

SEQ ID NO: 663818 - DNA, 25 bp, Rattus norvegicus
ttcaacaggtaagaaggtgcttctt

SEQ ID NO: 663819 - DNA, 25 bp, Rattus norvegicus
ttcaacatccacatctcaatactaa

SEQ ID NO: 663820 - DNA, 25 bp, Rattus norvegicus
ttcaacatccacttctcaatactaa

SEQ ID NO: 663821 - DNA, 25 bp, Rattus norvegicus
ttcaacatgagtaccatcgcctgga

SEQ ID NO: 663822 - DNA, 25 bp, Rattus norvegicus
ttcaacatgagttccatcgcctgga

SEQ ID NO: 663823 - DNA, 25 bp, Rattus norvegicus
ttcaacatgggcatacagctagaag

SEQ ID NO: 663824 - DNA, 25 bp, Rattus norvegicus
ttcaacatgggcttacagctagaag

SEQ ID NO: 663825 - DNA, 25 bp, Rattus norvegicus
ttcaacatggtgacatcttccggag

SEQ ID NO: 663826 - DNA, 25 bp, Rattus norvegicus
ttcaacatggtgtcatcttccggag

SEQ ID NO: 663827 - DNA, 25 bp, Rattus norvegicus
ttcaacatgttcctcccagagagag

SEQ ID NO: 663828 - DNA, 25 bp, Rattus norvegicus
ttcaacatgttcgtcccagagagag

SEQ ID NO: 663829 - DNA, 25 bp, Rattus norvegicus
ttcaacattgagactgctaaagcca

SEQ ID NO: 663830 - DNA, 25 bp, Rattus norvegicus
ttcaacattgagtctgctaaagcca

SEQ ID NO: 663831 - DNA, 25 bp, Rattus norvegicus
ttcaaccaaaacaaggatactctgc

SEQ ID NO: 663832 - DNA, 25 bp, Rattus norvegicus
ttcaaccaaaactaggatactctgc

SEQ ID NO: 663833 - DNA, 25 bp, Rattus norvegicus
ttcaaccaagacagcagcgaccagg

SEQ ID NO: 663834 - DNA, 25 bp, Rattus norvegicus
ttcaaccaagactgcagcgaccagg

SEQ ID NO: 663835 - DNA, 25 bp, Rattus norvegicus
ttcaaccacagcagcttacttgttc

SEQ ID NO: 663836 - DNA, 25 bp, Rattus norvegicus
ttcaaccacagctgcttacttgttc

SEQ ID NO: 663837 - DNA, 25 bp, Rattus norvegicus
ttcaaccacattatcatggcctttc

SEQ ID NO: 663838 - DNA, 25 bp, Rattus norvegicus
ttcaaccacattttcatggcctttc

SEQ ID NO: 663839 - DNA, 25 bp, Rattus norvegicus
ttcaaccactcaacacaatggccat

SEQ ID NO: 663840 - DNA, 25 bp, Rattus norvegicus
ttcaaccactcatcacaatggccat

SEQ ID NO: 663841 - DNA, 25 bp, Rattus norvegicus
ttcaaccagacacccattttcaaaa

SEQ ID NO: 663842 - DNA, 25 bp, Rattus norvegicus
ttcaaccagacagccattttcaaaa

SEQ ID NO: 663843 - DNA, 25 bp, Rattus norvegicus
ttcaaccagcagaacgttttttatg

SEQ ID NO: 663844 - DNA, 25 bp, Rattus norvegicus
ttcaaccagcagtacgttttttatg

SEQ ID NO: 663845 - DNA, 25 bp, Rattus norvegicus
ttcaaccattacacacagccgagct

SEQ ID NO: 663846 - DNA, 25 bp, Rattus norvegicus
ttcaaccattactcacagccgagct

SEQ ID NO: 663847 - DNA, 25 bp, Rattus norvegicus
ttcaaccattttatgtactgggcct

SEQ ID NO: 663848 - DNA, 25 bp, Rattus norvegicus
ttcaaccattttttgtactgggcct

SEQ ID NO: 663849 - DNA, 25 bp, Rattus norvegicus
ttcaacccaaagcacttcctagatg

SEQ ID NO: 663850 - DNA, 25 bp, Rattus norvegicus
ttcaacccaaaggacttcctagatg

SEQ ID NO: 663851 - DNA, 25 bp, Rattus norvegicus
ttcaacccatttctgtgtcctttct

SEQ ID NO: 663852 - DNA, 25 bp, Rattus norvegicus
ttcaacccatttgtgtgtcctttct

SEQ ID NO: 663853 - DNA, 25 bp, Rattus norvegicus
ttcaaccccagtctcctgaaggact

SEQ ID NO: 663854 - DNA, 25 bp, Rattus norvegicus
ttcaaccccagtgtcctgaaggact

SEQ ID NO: 663855 - DNA, 25 bp, Rattus norvegicus
ttcaacccctagcaattgtacaaat

SEQ ID NO: 663856 - DNA, 25 bp, Rattus norvegicus
ttcaacccctaggaattgtacaaat

SEQ ID NO: 663857 - DNA, 25 bp, Rattus norvegicus
ttcaacccggaaagacatatttatt

SEQ ID NO: 663858 - DNA, 25 bp, Rattus norvegicus
ttcaacccggaatgacatatttatt

SEQ ID NO: 663859 - DNA, 25 bp, Rattus norvegicus
ttcaaccgtgtgacgaaggcaccga

SEQ ID NO: 663860 - DNA, 25 bp, Rattus norvegicus
ttcaaccgtgtgtcgaaggcaccga

SEQ ID NO: 663861 - DNA, 25 bp, Rattus norvegicus
ttcaaccgttacctggacgtggtca

SEQ ID NO: 663862 - DNA, 25 bp, Rattus norvegicus
ttcaaccgttacgtggacgtggtca

SEQ ID NO: 663863 - DNA, 25 bp, Rattus norvegicus
ttcaacctctgcatctgggagccgg

SEQ ID NO: 663864 - DNA, 25 bp, Rattus norvegicus
ttcaacctctgcttctgggagccgg

SEQ ID NO: 663865 - DNA, 25 bp, Rattus norvegicus
ttcaacgcggctatgctggcgggca

SEQ ID NO: 663866 - DNA, 25 bp, Rattus norvegicus
ttcaacgcggctttgctggcgggca

SEQ ID NO: 663867 - DNA, 25 bp, Rattus norvegicus
ttcaacgcgttgatttctgtttggt

SEQ ID NO: 663868 - DNA, 25 bp, Rattus norvegicus
ttcaacgcgttgttttctgtttggt

SEQ ID NO: 663869 - DNA, 25 bp, Rattus norvegicus
ttcaacgggcatctgtagcctgaaa

SEQ ID NO: 663870 - DNA, 25 bp, Rattus norvegicus
ttcaacgggcatgtgtagcctgaaa

SEQ ID NO: 663871 - DNA, 25 bp, Rattus norvegicus
ttcaacggtttaacttcggctttct

SEQ ID NO: 663872 - DNA, 25 bp, Rattus norvegicus
ttcaacggtttatcttcggctttct

SEQ ID NO: 663873 - DNA, 25 bp, Rattus norvegicus
ttcaactactatagcctacactcag

SEQ ID NO: 663874 - DNA, 25 bp, Rattus norvegicus
ttcaactactattgcctacactcag

SEQ ID NO: 663875 - DNA, 25 bp, Rattus norvegicus
ttcaactcaagactggtccactggg

SEQ ID NO: 663876 - DNA, 25 bp, Rattus norvegicus
ttcaactcaagagtggtccactggg

SEQ ID NO: 663877 - DNA, 25 bp, Rattus norvegicus
ttcaactccacacggtcttgacggt

SEQ ID NO: 663878 - DNA, 25 bp, Rattus norvegicus
ttcaactccacagggtcttgacggt

SEQ ID NO: 663879 - DNA, 25 bp, Rattus norvegicus
ttcaactcccaacacatattttata

SEQ ID NO: 663880 - DNA, 25 bp, Rattus norvegicus
ttcaactcccaagacatattttata

SEQ ID NO: 663881 - DNA, 25 bp, Rattus norvegicus
ttcaactcccggcaaatgagccgcg

SEQ ID NO: 663882 - DNA, 25 bp, Rattus norvegicus
ttcaactcccgggaaatgagccgcg

SEQ ID NO: 663883 - DNA, 25 bp, Rattus norvegicus
ttcaactctcagcatgaggctcttt

SEQ ID NO: 663884 - DNA, 25 bp, Rattus norvegicus
ttcaactctcaggatgaggctcttt

SEQ ID NO: 663885 - DNA, 25 bp, Rattus norvegicus
ttcaactctcatatgcagggcagct

SEQ ID NO: 663886 - DNA, 25 bp, Rattus norvegicus
ttcaactctcatatgtttgcctctt

SEQ ID NO: 663887 - DNA, 25 bp, Rattus norvegicus
ttcaactctcatttgcagggcagct

SEQ ID NO: 663888 - DNA, 25 bp, Rattus norvegicus
ttcaactctcatttgtttgcctctt

SEQ ID NO: 663889 - DNA, 25 bp, Rattus norvegicus
ttcaactgagttaggaatattctag

SEQ ID NO: 663890 - DNA, 25 bp, Rattus norvegicus
ttcaactgagtttggaatattctag

SEQ ID NO: 663891 - DNA, 25 bp, Rattus norvegicus
ttcaactgattacacaaggcccgcc

SEQ ID NO: 663892 - DNA, 25 bp, Rattus norvegicus
ttcaactgattagacaaggcccgcc

SEQ ID NO: 663893 - DNA, 25 bp, Rattus norvegicus
ttcaactgcagcaccggtgtctaca

SEQ ID NO: 663894 - DNA, 25 bp, Rattus norvegicus
ttcaactgcagctccggtgtctaca

SEQ ID NO: 663895 - DNA, 25 bp, Rattus norvegicus
ttcaactgcgcccacggttaaggtg

SEQ ID NO: 663896 - DNA, 25 bp, Rattus norvegicus
ttcaactgcgccgacggttaaggtg

SEQ ID NO: 663897 - DNA, 25 bp, Rattus norvegicus
ttcaactgcttgaagggaccaccca

SEQ ID NO: 663898 - DNA, 25 bp, Rattus norvegicus
ttcaactgcttgtagggaccaccca

SEQ ID NO: 663899 - DNA, 25 bp, Rattus norvegicus
ttcaactggagtagccgccatcaga

SEQ ID NO: 663900 - DNA, 25 bp, Rattus norvegicus
ttcaactggagttgccgccatcaga

SEQ ID NO: 663901 - DNA, 25 bp, Rattus norvegicus
ttcaactgtgagcaccgatgcggat

SEQ ID NO: 663902 - DNA, 25 bp, Rattus norvegicus
ttcaactgtgaggaccgatgcggat

SEQ ID NO: 663903 - DNA, 25 bp, Rattus norvegicus
ttcaactgtgctcggctaaaatgcc

SEQ ID NO: 663904 - DNA, 25 bp, Rattus norvegicus
ttcaactgtgctgggctaaaatgcc

SEQ ID NO: 663905 - DNA, 25 bp, Rattus norvegicus
ttcaacttattgctagcactactct

SEQ ID NO: 663906 - DNA, 25 bp, Rattus norvegicus
ttcaacttattggtagcactactct

SEQ ID NO: 663907 - DNA, 25 bp, Rattus norvegicus
ttcaacttcactactatttttcgcc

SEQ ID NO: 663908 - DNA, 25 bp, Rattus norvegicus
ttcaacttcacttctatttttcgcc

SEQ ID NO: 663909 - DNA, 25 bp, Rattus norvegicus
ttcaacttcattccacccgggagaa

SEQ ID NO: 663910 - DNA, 25 bp, Rattus norvegicus
ttcaacttcattgcacccgggagaa

SEQ ID NO: 663911 - DNA, 25 bp, Rattus norvegicus
ttcaacttcctgctgaggacagcaa

SEQ ID NO: 663912 - DNA, 25 bp, Rattus norvegicus
ttcaacttcctggtgaggacagcaa

SEQ ID NO: 663913 - DNA, 25 bp, Rattus norvegicus
ttcaacttgcaaaggaactggagag

SEQ ID NO: 663914 - DNA, 25 bp, Rattus norvegicus
ttcaacttgcaatggaactggagag

SEQ ID NO: 663915 - DNA, 25 bp, Rattus norvegicus
ttcaacttgggcacatcagggcacc

SEQ ID NO: 663916 - DNA, 25 bp, Rattus norvegicus
ttcaacttgggctcatcagggcacc

SEQ ID NO: 663917 - DNA, 25 bp, Rattus norvegicus
ttcaacttgttcaaaaagcacttgg

SEQ ID NO: 663918 - DNA, 25 bp, Rattus norvegicus
ttcaacttgttctaaaagcacttgg

SEQ ID NO: 663919 - DNA, 25 bp, Rattus norvegicus
ttcaactttaaacctgtccacagct

SEQ ID NO: 663920 - DNA, 25 bp, Rattus norvegicus
ttcaactttaaagctgtccacagct

SEQ ID NO: 663921 - DNA, 25 bp, Rattus norvegicus
ttcaactttgacactgggcagtcca

SEQ ID NO: 663922 - DNA, 25 bp, Rattus norvegicus
ttcaactttgactctgggcagtcca

SEQ ID NO: 663923 - DNA, 25 bp, Rattus norvegicus
ttcaagaacgaaagccccagtggga

SEQ ID NO: 663924 - DNA, 25 bp, Rattus norvegicus
ttcaagaacgaaagtcccacgggcc

SEQ ID NO: 663925 - DNA, 25 bp, Rattus norvegicus
ttcaagaacgaatgccccagtggga

SEQ ID NO: 663926 - DNA, 25 bp, Rattus norvegicus
ttcaagaacgaatgtcccacgggcc

SEQ ID NO: 663927 - DNA, 25 bp, Rattus norvegicus
ttcaagaagtctctgttcctctccc

SEQ ID NO: 663928 - DNA, 25 bp, Rattus norvegicus
ttcaagaagtctgtgttcctctccc

SEQ ID NO: 663929 - DNA, 25 bp, Rattus norvegicus
ttcaagacactgatatttgtttgtt

SEQ ID NO: 663930 - DNA, 25 bp, Rattus norvegicus
ttcaagacactgttatttgtttgtt

SEQ ID NO: 663931 - DNA, 25 bp, Rattus norvegicus
ttcaagacagacagctccttcagct

SEQ ID NO: 663932 - DNA, 25 bp, Rattus norvegicus
ttcaagacagactgctccttcagct

SEQ ID NO: 663933 - DNA, 25 bp, Rattus norvegicus
ttcaagacatctatcccagagtgcc

SEQ ID NO: 663934 - DNA, 25 bp, Rattus norvegicus
ttcaagacatctttcccagagtgcc

SEQ ID NO: 663935 - DNA, 25 bp, Rattus norvegicus
ttcaagaccaagatcacacagcctc

SEQ ID NO: 663936 - DNA, 25 bp, Rattus norvegicus
ttcaagaccaagttcacacagcctc

SEQ ID NO: 663937 - DNA, 25 bp, Rattus norvegicus
ttcaagaccagccagtctgcaaaat

SEQ ID NO: 663938 - DNA, 25 bp, Rattus norvegicus
ttcaagaccagcgagtctgcaaaat

SEQ ID NO: 663939 - DNA, 25 bp, Rattus norvegicus
ttcaagaccatcctgcctttgtaag

SEQ ID NO: 663940 - DNA, 25 bp, Rattus norvegicus
ttcaagaccatcgtgcctttgtaag

SEQ ID NO: 663941 - DNA, 25 bp, Rattus norvegicus
ttcaagaccgttcactgggaagcct

SEQ ID NO: 663942 - DNA, 25 bp, Rattus norvegicus
ttcaagaccgttgactgggaagcct

SEQ ID NO: 663943 - DNA, 25 bp, Rattus norvegicus
ttcaagaccttcagcagtacctaga

SEQ ID NO: 663944 - DNA, 25 bp, Rattus norvegicus
ttcaagaccttctgcagtacctaga

SEQ ID NO: 663945 - DNA, 25 bp, Rattus norvegicus
ttcaagacttaacccacagtgggtt

SEQ ID NO: 663946 - DNA, 25 bp, Rattus norvegicus
ttcaagacttaagccacagtgggtt

SEQ ID NO: 663947 - DNA, 25 bp, Rattus norvegicus
ttcaagagctacaggcctggatggc

SEQ ID NO: 663948 - DNA, 25 bp, Rattus norvegicus
ttcaagagctactggcctggatggc

SEQ ID NO: 663949 - DNA, 25 bp, Rattus norvegicus
ttcaagaggctactgctgagcaggc

SEQ ID NO: 663950 - DNA, 25 bp, Rattus norvegicus
ttcaagaggctagtgctgagcaggc

SEQ ID NO: 663951 - DNA, 25 bp, Rattus norvegicus
ttcaagaggctcctgcggcagatga

SEQ ID NO: 663952 - DNA, 25 bp, Rattus norvegicus
ttcaagaggctcgtgcggcagatga

SEQ ID NO: 663953 - DNA, 25 bp, Rattus norvegicus
ttcaagaggtcaccagagaccaggc

SEQ ID NO: 663954 - DNA, 25 bp, Rattus norvegicus
ttcaagaggtcagcagagaccaggc

SEQ ID NO: 663955 - DNA, 25 bp, Rattus norvegicus
ttcaagagtgtgctccacttggcct

SEQ ID NO: 663956 - DNA, 25 bp, Rattus norvegicus
ttcaagagtgtggtccacttggcct

SEQ ID NO: 663957 - DNA, 25 bp, Rattus norvegicus
ttcaagatcatcaaccggcgctacg

SEQ ID NO: 663958 - DNA, 25 bp, Rattus norvegicus
ttcaagatcatctaccggcgctacg

SEQ ID NO: 663959 - DNA, 25 bp, Rattus norvegicus
ttcaagatccgccagagtcacagga

SEQ ID NO: 663960 - DNA, 25 bp, Rattus norvegicus
ttcaagatccgcgagagtcacagga

SEQ ID NO: 663961 - DNA, 25 bp, Rattus norvegicus
ttcaagatccgtacccagaagttaa

SEQ ID NO: 663962 - DNA, 25 bp, Rattus norvegicus
ttcaagatccgttcccagaagttaa

SEQ ID NO: 663963 - DNA, 25 bp, Rattus norvegicus
ttcaagatgcatccttttcgcgatg

SEQ ID NO: 663964 - DNA, 25 bp, Rattus norvegicus
ttcaagatgcatgcttttcgcgatg

SEQ ID NO: 663965 - DNA, 25 bp, Rattus norvegicus
ttcaagatgtctaacaatcctccct

SEQ ID NO: 663966 - DNA, 25 bp, Rattus norvegicus
ttcaagatgtcttacaatcctccct

SEQ ID NO: 663967 - DNA, 25 bp, Rattus norvegicus
ttcaagattgtacgcctctggcttt

SEQ ID NO: 663968 - DNA, 25 bp, Rattus norvegicus
ttcaagattgtaggcctctggcttt

SEQ ID NO: 663969 - DNA, 25 bp, Rattus norvegicus
ttcaagattttcaccatggcttttt

SEQ ID NO: 663970 - DNA, 25 bp, Rattus norvegicus
ttcaagattttctccatggcttttt

SEQ ID NO: 663971 - DNA, 25 bp, Rattus norvegicus
ttcaagcaccctcttgatcactggg

SEQ ID NO: 663972 - DNA, 25 bp, Rattus norvegicus
ttcaagcaccctgttgatcactggg

SEQ ID NO: 663973 - DNA, 25 bp, Rattus norvegicus
ttcaagcagaagaaataccattcat

SEQ ID NO: 663974 - DNA, 25 bp, Rattus norvegicus
ttcaagcagaagtaataccattcat

SEQ ID NO: 663975 - DNA, 25 bp, Rattus norvegicus
ttcaagcagctactccaaagggtta

SEQ ID NO: 663976 - DNA, 25 bp, Rattus norvegicus
ttcaagcagctagtccaaagggtta

SEQ ID NO: 663977 - DNA, 25 bp, Rattus norvegicus
ttcaagcagctcatcatctctggaa

SEQ ID NO: 663978 - DNA, 25 bp, Rattus norvegicus
ttcaagcagctcttcatctctggaa

SEQ ID NO: 663979 - DNA, 25 bp, Rattus norvegicus
ttcaagcattataaggccaagacac

SEQ ID NO: 663980 - DNA, 25 bp, Rattus norvegicus
ttcaagcattattaggccaagacac

SEQ ID NO: 663981 - DNA, 25 bp, Rattus norvegicus
ttcaagccacagaacatggcaccaa

SEQ ID NO: 663982 - DNA, 25 bp, Rattus norvegicus
ttcaagccacagtacatggcaccaa

SEQ ID NO: 663983 - DNA, 25 bp, Rattus norvegicus
ttcaagcccatcctcaattacatgg

SEQ ID NO: 663984 - DNA, 25 bp, Rattus norvegicus
ttcaagcccatcgtcaattacatgg

SEQ ID NO: 663985 - DNA, 25 bp, Rattus norvegicus
ttcaagccctctatggtgggcagca

SEQ ID NO: 663986 - DNA, 25 bp, Rattus norvegicus
ttcaagccctctttggtgggcagca

SEQ ID NO: 663987 - DNA, 25 bp, Rattus norvegicus
ttcaagccctgcacagtgatcgagg

SEQ ID NO: 663988 - DNA, 25 bp, Rattus norvegicus
ttcaagccctgctcagtgatcgagg

SEQ ID NO: 663989 - DNA, 25 bp, Rattus norvegicus
ttcaagcccttcacccagaaataaa

SEQ ID NO: 663990 - DNA, 25 bp, Rattus norvegicus
ttcaagcccttctcccagaaataaa

SEQ ID NO: 663991 - DNA, 25 bp, Rattus norvegicus
ttcaagcctcagatgcctttcaaga

SEQ ID NO: 663992 - DNA, 25 bp, Rattus norvegicus
ttcaagcctcagttgcctttcaaga

SEQ ID NO: 663993 - DNA, 25 bp, Rattus norvegicus
ttcaagcctggtattgtcccacggg

SEQ ID NO: 663994 - DNA, 25 bp, Rattus norvegicus
ttcaagcctggttttgtcccacggg

SEQ ID NO: 663995 - DNA, 25 bp, Rattus norvegicus
ttcaagcggcaccaacggcaggcgc

SEQ ID NO: 663996 - DNA, 25 bp, Rattus norvegicus
ttcaagcggcacgaacggcaggcgc

SEQ ID NO: 663997 - DNA, 25 bp, Rattus norvegicus
ttcaagctcagcaggtcaacaggac

SEQ ID NO: 663998 - DNA, 25 bp, Rattus norvegicus
ttcaagctcagcagtgcaggacaca

SEQ ID NO: 663999 - DNA, 25 bp, Rattus norvegicus
ttcaagctcagctggtcaacaggac

SEQ ID NO: 664000 - DNA, 25 bp, Rattus norvegicus
ttcaagctcagctgtgcaggacaca

SEQ ID NO: 664001 - DNA, 25 bp, Rattus norvegicus
ttcaagctccctccaacagtagggt

SEQ ID NO: 664002 - DNA, 25 bp, Rattus norvegicus
ttcaagctccctccagtttaagaaa

SEQ ID NO: 664003 - DNA, 25 bp, Rattus norvegicus
ttcaagctccctgcaacagtagggt

SEQ ID NO: 664004 - DNA, 25 bp, Rattus norvegicus
ttcaagctccctgcagtttaagaaa

SEQ ID NO: 664005 - DNA, 25 bp, Rattus norvegicus
ttcaagctctgaagacgagtgggtt

SEQ ID NO: 664006 - DNA, 25 bp, Rattus norvegicus
ttcaagctctgatgacgagtgggtt

SEQ ID NO: 664007 - DNA, 25 bp, Rattus norvegicus
ttcaagctgaggcagttccaaccct

SEQ ID NO: 664008 - DNA, 25 bp, Rattus norvegicus
ttcaagctgagggagttccaaccct

SEQ ID NO: 664009 - DNA, 25 bp, Rattus norvegicus
ttcaagcttttacagtccctcagtc

SEQ ID NO: 664010 - DNA, 25 bp, Rattus norvegicus
ttcaagcttttagagtccctcagtc

SEQ ID NO: 664011 - DNA, 25 bp, Rattus norvegicus
ttcaagctttttccattatccaacc

SEQ ID NO: 664012 - DNA, 25 bp, Rattus norvegicus
ttcaagctttttgcattatccaacc

SEQ ID NO: 664013 - DNA, 25 bp, Rattus norvegicus
ttcaaggaacagctgacccacctgg

SEQ ID NO: 664014 - DNA, 25 bp, Rattus norvegicus
ttcaaggaacaggtgacccacctgg

SEQ ID NO: 664015 - DNA, 25 bp, Rattus norvegicus
ttcaaggaatccacactggccagga

SEQ ID NO: 664016 - DNA, 25 bp, Rattus norvegicus
ttcaaggaatcccatgactcagcca

SEQ ID NO: 664017 - DNA, 25 bp, Rattus norvegicus
ttcaaggaatccgatgactcagcca

SEQ ID NO: 664018 - DNA, 25 bp, Rattus norvegicus
ttcaaggaatcctcactggccagga

SEQ ID NO: 664019 - DNA, 25 bp, Rattus norvegicus
ttcaaggacctcagttgcctgtagg

SEQ ID NO: 664020 - DNA, 25 bp, Rattus norvegicus
ttcaaggacctctgttgcctgtagg

SEQ ID NO: 664021 - DNA, 25 bp, Rattus norvegicus
ttcaaggacgctcgccagtctgtgg

SEQ ID NO: 664022 - DNA, 25 bp, Rattus norvegicus
ttcaaggacgctggccagtctgtgg

SEQ ID NO: 664023 - DNA, 25 bp, Rattus norvegicus
ttcaaggacggtaccttcgaccctg

SEQ ID NO: 664024 - DNA, 25 bp, Rattus norvegicus
ttcaaggacggttccttcgaccctg

SEQ ID NO: 664025 - DNA, 25 bp, Rattus norvegicus
ttcaaggactgcagtgtacaacact

SEQ ID NO: 664026 - DNA, 25 bp, Rattus norvegicus
ttcaaggactgctgtgtacaacact

SEQ ID NO: 664027 - DNA, 25 bp, Rattus norvegicus
ttcaaggagcggactcggagcctgc

SEQ ID NO: 664028 - DNA, 25 bp, Rattus norvegicus
ttcaaggagcggtctcggagcctgc

SEQ ID NO: 664029 - DNA, 25 bp, Rattus norvegicus
ttcaaggatcgcctgccaaggacat

SEQ ID NO: 664030 - DNA, 25 bp, Rattus norvegicus
ttcaaggatcgcgtgccaaggacat

SEQ ID NO: 664031 - DNA, 25 bp, Rattus norvegicus
ttcaaggatcttagggtttgtggcc

SEQ ID NO: 664032 - DNA, 25 bp, Rattus norvegicus
ttcaaggatctttgggtttgtggcc

SEQ ID NO: 664033 - DNA, 25 bp, Rattus norvegicus
ttcaaggatgtaccccttctactct

SEQ ID NO: 664034 - DNA, 25 bp, Rattus norvegicus
ttcaaggatgtagcccttctactct

SEQ ID NO: 664035 - DNA, 25 bp, Rattus norvegicus
ttcaaggcacaaacctaggcttagg

SEQ ID NO: 664036 - DNA, 25 bp, Rattus norvegicus
ttcaaggcacaatcctaggcttagg

SEQ ID NO: 664037 - DNA, 25 bp, Rattus norvegicus
ttcaaggcacgtcggaagaattttt

SEQ ID NO: 664038 - DNA, 25 bp, Rattus norvegicus
ttcaaggcacgtgggaagaattttt

SEQ ID NO: 664039 - DNA, 25 bp, Rattus norvegicus
ttcaaggcatcacatcgtggggcaa

SEQ ID NO: 664040 - DNA, 25 bp, Rattus norvegicus
ttcaaggcatcagatcgtggggcaa

SEQ ID NO: 664041 - DNA, 25 bp, Rattus norvegicus
ttcaaggcatcccagatttctttcc

SEQ ID NO: 664042 - DNA, 25 bp, Rattus norvegicus
ttcaaggcatccgagatttctttcc

SEQ ID NO: 664043 - DNA, 25 bp, Rattus norvegicus
ttcaaggcccacagtcttctctcat

SEQ ID NO: 664044 - DNA, 25 bp, Rattus norvegicus
ttcaaggcccactgtcttctctcat

SEQ ID NO: 664045 - DNA, 25 bp, Rattus norvegicus
ttcaaggccggtctgagtagctcat

SEQ ID NO: 664046 - DNA, 25 bp, Rattus norvegicus
ttcaaggccggtgtgagtagctcat

SEQ ID NO: 664047 - DNA, 25 bp, Rattus norvegicus
ttcaaggcggataagaaggcagctc

SEQ ID NO: 664048 - DNA, 25 bp, Rattus norvegicus
ttcaaggcggattagaaggcagctc

SEQ ID NO: 664049 - DNA, 25 bp, Rattus norvegicus
ttcaaggcggtgactttagagcatt

SEQ ID NO: 664050 - DNA, 25 bp, Rattus norvegicus
ttcaaggcggtgtctttagagcatt

SEQ ID NO: 664051 - DNA, 25 bp, Rattus norvegicus
ttcaaggctgtacctggtttccaga

SEQ ID NO: 664052 - DNA, 25 bp, Rattus norvegicus
ttcaaggctgtagctggtttccaga

SEQ ID NO: 664053 - DNA, 25 bp, Rattus norvegicus
ttcaaggctgttacaggagcccctg

SEQ ID NO: 664054 - DNA, 25 bp, Rattus norvegicus
ttcaaggctgtttcaggagcccctg

SEQ ID NO: 664055 - DNA, 25 bp, Rattus norvegicus
ttcaaggcttggatactcgtcagac

SEQ ID NO: 664056 - DNA, 25 bp, Rattus norvegicus
ttcaaggcttggttactcgtcagac

SEQ ID NO: 664057 - DNA, 25 bp, Rattus norvegicus
ttcaagggcgggattagtgccccat

SEQ ID NO: 664058 - DNA, 25 bp, Rattus norvegicus
ttcaagggcgggtttagtgccccat

SEQ ID NO: 664059 - DNA, 25 bp, Rattus norvegicus
ttcaagggcttcattgagctgttcc

SEQ ID NO: 664060 - DNA, 25 bp, Rattus norvegicus
ttcaagggcttctttgagctgttcc

SEQ ID NO: 664061 - DNA, 25 bp, Rattus norvegicus
ttcaagggtatcagctgcttggccc

SEQ ID NO: 664062 - DNA, 25 bp, Rattus norvegicus
ttcaagggtatctgctgcttggccc

SEQ ID NO: 664063 - DNA, 25 bp, Rattus norvegicus
ttcaaggtactgacctacgcatcat

SEQ ID NO: 664064 - DNA, 25 bp, Rattus norvegicus
ttcaaggtactgtcctacgcatcat

SEQ ID NO: 664065 - DNA, 25 bp, Rattus norvegicus
ttcaaggtcaacacaaggctcatgg

SEQ ID NO: 664066 - DNA, 25 bp, Rattus norvegicus
ttcaaggtcaactcaaggctcatgg

SEQ ID NO: 664067 - DNA, 25 bp, Rattus norvegicus
ttcaaggtcactcgtttggccagca

SEQ ID NO: 664068 - DNA, 25 bp, Rattus norvegicus
ttcaaggtcactggtttggccagca

SEQ ID NO: 664069 - DNA, 25 bp, Rattus norvegicus
ttcaaggtcagcactggcagttttc

SEQ ID NO: 664070 - DNA, 25 bp, Rattus norvegicus
ttcaaggtcagctctggcagttttc

SEQ ID NO: 664071 - DNA, 25 bp, Rattus norvegicus
ttcaaggtggagaccttccgcaaga

SEQ ID NO: 664072 - DNA, 25 bp, Rattus norvegicus
ttcaaggtggagtccttccgcaaga

SEQ ID NO: 664073 - DNA, 25 bp, Rattus norvegicus
ttcaagtaacacatcccagtgcctg

SEQ ID NO: 664074 - DNA, 25 bp, Rattus norvegicus
ttcaagtaacacttcccagtgcctg

SEQ ID NO: 664075 - DNA, 25 bp, Rattus norvegicus
ttcaagtactgacctttctccagcc

SEQ ID NO: 664076 - DNA, 25 bp, Rattus norvegicus
ttcaagtactgagctttctccagcc

SEQ ID NO: 664077 - DNA, 25 bp, Rattus norvegicus
ttcaagtagacaaccctagttccac

SEQ ID NO: 664078 - DNA, 25 bp, Rattus norvegicus
ttcaagtagacatccctagttccac

SEQ ID NO: 664079 - DNA, 25 bp, Rattus norvegicus
ttcaagtcacctctcaccaagtctt

SEQ ID NO: 664080 - DNA, 25 bp, Rattus norvegicus
ttcaagtcacctgtcaccaagtctt

SEQ ID NO: 664081 - DNA, 25 bp, Rattus norvegicus
ttcaagtcaggcctggtaccagata

SEQ ID NO: 664082 - DNA, 25 bp, Rattus norvegicus
ttcaagtcaggcgtggtaccagata

SEQ ID NO: 664083 - DNA, 25 bp, Rattus norvegicus
ttcaagtcatgccacagctgctata

SEQ ID NO: 664084 - DNA, 25 bp, Rattus norvegicus
ttcaagtcatgcgacagctgctata

SEQ ID NO: 664085 - DNA, 25 bp, Rattus norvegicus
ttcaagtccccaataacagtgctca

SEQ ID NO: 664086 - DNA, 25 bp, Rattus norvegicus
ttcaagtccccattaacagtgctca

SEQ ID NO: 664087 - DNA, 25 bp, Rattus norvegicus
ttcaagtcctgaccttaagggagct

SEQ ID NO: 664088 - DNA, 25 bp, Rattus norvegicus
ttcaagtcctgagcttaagggagct

SEQ ID NO: 664089 - DNA, 25 bp, Rattus norvegicus
ttcaagtcttacaaacctgagatcc

SEQ ID NO: 664090 - DNA, 25 bp, Rattus norvegicus
ttcaagtcttactaacctgagatcc

SEQ ID NO: 664091 - DNA, 25 bp, Rattus norvegicus
ttcaagtgagccctggaccaccctg

SEQ ID NO: 664092 - DNA, 25 bp, Rattus norvegicus
ttcaagtgagccgtggaccaccctg

SEQ ID NO: 664093 - DNA, 25 bp, Rattus norvegicus
ttcaagtggccgaggctcagcagag

SEQ ID NO: 664094 - DNA, 25 bp, Rattus norvegicus
ttcaagtggccgtggctcagcagag

SEQ ID NO: 664095 - DNA, 25 bp, Rattus norvegicus
ttcaagtggttgcttgtgtatcgaa

SEQ ID NO: 664096 - DNA, 25 bp, Rattus norvegicus
ttcaagtggttggttgtgtatcgaa

SEQ ID NO: 664097 - DNA, 25 bp, Rattus norvegicus
ttcaagtgtcccctgacagctattt

SEQ ID NO: 664098 - DNA, 25 bp, Rattus norvegicus
ttcaagtgtcccgtgacagctattt

SEQ ID NO: 664099 - DNA, 25 bp, Rattus norvegicus
ttcaagtgtgaacgctgctgtgagc

SEQ ID NO: 664100 - DNA, 25 bp, Rattus norvegicus
ttcaagtgtgaaggctgctgtgagc

SEQ ID NO: 664101 - DNA, 25 bp, Rattus norvegicus
ttcaagttcacgaatgcacaacatg

SEQ ID NO: 664102 - DNA, 25 bp, Rattus norvegicus
ttcaagttcacgtatgcacaacatg

SEQ ID NO: 664103 - DNA, 25 bp, Rattus norvegicus
ttcaagtttcccactcccaaataat

SEQ ID NO: 664104 - DNA, 25 bp, Rattus norvegicus
ttcaagtttccctctcccaaataat

SEQ ID NO: 664105 - DNA, 25 bp, Rattus norvegicus
ttcaagtttcttccccttaaagagt

SEQ ID NO: 664106 - DNA, 25 bp, Rattus norvegicus
ttcaagtttcttgcccttaaagagt

SEQ ID NO: 664107 - DNA, 25 bp, Rattus norvegicus
ttcaagttttctcgaggaccctaat

SEQ ID NO: 664108 - DNA, 25 bp, Rattus norvegicus
ttcaagttttctggaggaccctaat

SEQ ID NO: 664109 - DNA, 25 bp, Rattus norvegicus
ttcaataaatctcagcctcacaggc

SEQ ID NO: 664110 - DNA, 25 bp, Rattus norvegicus
ttcaataaatctgagcctcacaggc

SEQ ID NO: 664111 - DNA, 25 bp, Rattus norvegicus
ttcaataatcttaactccctgtcag

SEQ ID NO: 664112 - DNA, 25 bp, Rattus norvegicus
ttcaataatctttactccctgtcag

SEQ ID NO: 664113 - DNA, 25 bp, Rattus norvegicus
ttcaatacagaaaggaatcccctag

SEQ ID NO: 664114 - DNA, 25 bp, Rattus norvegicus
ttcaatacagaatggaatcccctag

SEQ ID NO: 664115 - DNA, 25 bp, Rattus norvegicus
ttcaatacccttatagatttcataa

SEQ ID NO: 664116 - DNA, 25 bp, Rattus norvegicus
ttcaatacccttttagatttcataa

SEQ ID NO: 664117 - DNA, 25 bp, Rattus norvegicus
ttcaatacgctcatcttcaatgcct

SEQ ID NO: 664118 - DNA, 25 bp, Rattus norvegicus
ttcaatacgctcttcttcaatgcct

SEQ ID NO: 664119 - DNA, 25 bp, Rattus norvegicus
ttcaatacttatactgcaacccctg

SEQ ID NO: 664120 - DNA, 25 bp, Rattus norvegicus
ttcaatacttattctgcaacccctg

SEQ ID NO: 664121 - DNA, 25 bp, Rattus norvegicus
ttcaatagagcaagccacagggcac

SEQ ID NO: 664122 - DNA, 25 bp, Rattus norvegicus
ttcaatagagcatgccacagggcac

SEQ ID NO: 664123 - DNA, 25 bp, Rattus norvegicus
ttcaatagctggatccaggcttctc

SEQ ID NO: 664124 - DNA, 25 bp, Rattus norvegicus
ttcaatagctggttccaggcttctc

SEQ ID NO: 664125 - DNA, 25 bp, Rattus norvegicus
ttcaatcaaaccagcttcgtgaccg

SEQ ID NO: 664126 - DNA, 25 bp, Rattus norvegicus
ttcaatcaaacctgcttcgtgaccg

SEQ ID NO: 664127 - DNA, 25 bp, Rattus norvegicus
ttcaatcaatgcatcataccactgc

SEQ ID NO: 664128 - DNA, 25 bp, Rattus norvegicus
ttcaatcaatgcttcataccactgc

SEQ ID NO: 664129 - DNA, 25 bp, Rattus norvegicus
ttcaatcaccctcctagggttcatc

SEQ ID NO: 664130 - DNA, 25 bp, Rattus norvegicus
ttcaatcaccctgctagggttcatc

SEQ ID NO: 664131 - DNA, 25 bp, Rattus norvegicus
ttcaatcaggacatcaggcgctctt

SEQ ID NO: 664132 - DNA, 25 bp, Rattus norvegicus
ttcaatcaggacttcaggcgctctt

SEQ ID NO: 664133 - DNA, 25 bp, Rattus norvegicus
ttcaatcatattagcccaacacgct

SEQ ID NO: 664134 - DNA, 25 bp, Rattus norvegicus
ttcaatcatatttgcccaacacgct

SEQ ID NO: 664135 - DNA, 25 bp, Rattus norvegicus
ttcaatcccacaacatcgatcatag

SEQ ID NO: 664136 - DNA, 25 bp, Rattus norvegicus
ttcaatcccacatcatcgatcatag

SEQ ID NO: 664137 - DNA, 25 bp, Rattus norvegicus
ttcaatcccttgacccaaattattc

SEQ ID NO: 664138 - DNA, 25 bp, Rattus norvegicus
ttcaatcccttgtcccaaattattc

SEQ ID NO: 664139 - DNA, 25 bp, Rattus norvegicus
ttcaatcctaggctttgattacctt

SEQ ID NO: 664140 - DNA, 25 bp, Rattus norvegicus
ttcaatcctagggtttgattacctt

SEQ ID NO: 664141 - DNA, 25 bp, Rattus norvegicus
ttcaatcgatacatcgttaccgtta

SEQ ID NO: 664142 - DNA, 25 bp, Rattus norvegicus
ttcaatcgatacttcgttaccgtta

SEQ ID NO: 664143 - DNA, 25 bp, Rattus norvegicus
ttcaatcgcttgatttcctgtttaa

SEQ ID NO: 664144 - DNA, 25 bp, Rattus norvegicus
ttcaatcgcttgttttcctgtttaa

SEQ ID NO: 664145 - DNA, 25 bp, Rattus norvegicus
ttcaatcgtggccagagtttctcag

SEQ ID NO: 664146 - DNA, 25 bp, Rattus norvegicus
ttcaatcgtggcgagagtttctcag

SEQ ID NO: 664147 - DNA, 25 bp, Rattus norvegicus
ttcaatcttgtcaattgggccacat

SEQ ID NO: 664148 - DNA, 25 bp, Rattus norvegicus
ttcaatcttgtctattgggccacat

SEQ ID NO: 664149 - DNA, 25 bp, Rattus norvegicus
ttcaatgagtagacctagtcgacct

SEQ ID NO: 664150 - DNA, 25 bp, Rattus norvegicus
ttcaatgagtagtcctagtcgacct

SEQ ID NO: 664151 - DNA, 25 bp, Rattus norvegicus
ttcaatgccctccaactggatgaca

SEQ ID NO: 664152 - DNA, 25 bp, Rattus norvegicus
ttcaatgccctcgaactggatgaca

SEQ ID NO: 664153 - DNA, 25 bp, Rattus norvegicus
ttcaatgcctccacttgtgtggata

SEQ ID NO: 664154 - DNA, 25 bp, Rattus norvegicus
ttcaatgcctcctcttgtgtggata

SEQ ID NO: 664155 - DNA, 25 bp, Rattus norvegicus
ttcaatgccttccatgctgatggga

SEQ ID NO: 664156 - DNA, 25 bp, Rattus norvegicus
ttcaatgccttcgatgctgatggga

SEQ ID NO: 664157 - DNA, 25 bp, Rattus norvegicus
ttcaatgctgttccactgatctgcc

SEQ ID NO: 664158 - DNA, 25 bp, Rattus norvegicus
ttcaatgctgttgcactgatctgcc

SEQ ID NO: 664159 - DNA, 25 bp, Rattus norvegicus
ttcaatggcgaacaactctgtctac

SEQ ID NO: 664160 - DNA, 25 bp, Rattus norvegicus
ttcaatggcgaagaactctgtctac

SEQ ID NO: 664161 - DNA, 25 bp, Rattus norvegicus
ttcaatggctcacccaagagctggt

SEQ ID NO: 664162 - DNA, 25 bp, Rattus norvegicus
ttcaatggctcagccaagagctggt

SEQ ID NO: 664163 - DNA, 25 bp, Rattus norvegicus
ttcaatggctgcagagtcacagaca

SEQ ID NO: 664164 - DNA, 25 bp, Rattus norvegicus
ttcaatggctgctgagtcacagaca

SEQ ID NO: 664165 - DNA, 25 bp, Rattus norvegicus
ttcaatggtagaatcgctgtcccct

SEQ ID NO: 664166 - DNA, 25 bp, Rattus norvegicus
ttcaatggtagattcgctgtcccct

SEQ ID NO: 664167 - DNA, 25 bp, Rattus norvegicus
ttcaatggtgagctcgaggactaca

SEQ ID NO: 664168 - DNA, 25 bp, Rattus norvegicus
ttcaatggtgaggtcgaggactaca

SEQ ID NO: 664169 - DNA, 25 bp, Rattus norvegicus
ttcaatgtatttagcaggaaaacct

SEQ ID NO: 664170 - DNA, 25 bp, Rattus norvegicus
ttcaatgtattttgcaggaaaacct

SEQ ID NO: 664171 - DNA, 25 bp, Rattus norvegicus
ttcaatgtccatactgctgtgttaa

SEQ ID NO: 664172 - DNA, 25 bp, Rattus norvegicus
ttcaatgtccattctgctgtgttaa

SEQ ID NO: 664173 - DNA, 25 bp, Rattus norvegicus
ttcaatgtctttagtccctgttcac

SEQ ID NO: 664174 - DNA, 25 bp, Rattus norvegicus
ttcaatgtcttttgtccctgttcac

SEQ ID NO: 664175 - DNA, 25 bp, Rattus norvegicus
ttcaatgtgccaaatggccccagtc

SEQ ID NO: 664176 - DNA, 25 bp, Rattus norvegicus
ttcaatgtgccatatggccccagtc

SEQ ID NO: 664177 - DNA, 25 bp, Rattus norvegicus
ttcaatgtggccctgaagcagtcac

SEQ ID NO: 664178 - DNA, 25 bp, Rattus norvegicus
ttcaatgtggccgtgaagcagtcac

SEQ ID NO: 664179 - DNA, 25 bp, Rattus norvegicus
ttcaatgttgtcctgagcgcagctc

SEQ ID NO: 664180 - DNA, 25 bp, Rattus norvegicus
ttcaatgttgtcgtgagcgcagctc

SEQ ID NO: 664181 - DNA, 25 bp, Rattus norvegicus
ttcaatgttttcctgtacataccaa

SEQ ID NO: 664182 - DNA, 25 bp, Rattus norvegicus
ttcaatgttttcgtgtacataccaa

SEQ ID NO: 664183 - DNA, 25 bp, Rattus norvegicus
ttcaattacagaagagggtcagtct

SEQ ID NO: 664184 - DNA, 25 bp, Rattus norvegicus
ttcaattacagatgagggtcagtct

SEQ ID NO: 664185 - DNA, 25 bp, Rattus norvegicus
ttcaattagtgtcaggccatcccct

SEQ ID NO: 664186 - DNA, 25 bp, Rattus norvegicus
ttcaattagtgtgaggccatcccct

SEQ ID NO: 664187 - DNA, 25 bp, Rattus norvegicus
ttcaattctacaagacctgagcccc

SEQ ID NO: 664188 - DNA, 25 bp, Rattus norvegicus
ttcaattctacatgacctgagcccc

SEQ ID NO: 664189 - DNA, 25 bp, Rattus norvegicus
ttcaattctgtgaatcccgtatcag

SEQ ID NO: 664190 - DNA, 25 bp, Rattus norvegicus
ttcaattctgtgtatcccgtatcag

SEQ ID NO: 664191 - DNA, 25 bp, Rattus norvegicus
ttcaattcttacataccctcagttc

SEQ ID NO: 664192 - DNA, 25 bp, Rattus norvegicus
ttcaattcttaccacccactaggtg

SEQ ID NO: 664193 - DNA, 25 bp, Rattus norvegicus
ttcaattcttacgacccactaggtg

SEQ ID NO: 664194 - DNA, 25 bp, Rattus norvegicus
ttcaattcttacttaccctcagttc

SEQ ID NO: 664195 - DNA, 25 bp, Rattus norvegicus
ttcaatttaccacccgatgacgtct

SEQ ID NO: 664196 - DNA, 25 bp, Rattus norvegicus
ttcaatttaccagccgatgacgtct

SEQ ID NO: 664197 - DNA, 25 bp, Rattus norvegicus
ttcaatttatgccaacgcttctaat

SEQ ID NO: 664198 - DNA, 25 bp, Rattus norvegicus
ttcaatttatgcgaacgcttctaat

SEQ ID NO: 664199 - DNA, 25 bp, Rattus norvegicus
ttcaatttcttcagaggctcttcca

SEQ ID NO: 664200 - DNA, 25 bp, Rattus norvegicus
ttcaatttcttctgaggctcttcca

SEQ ID NO: 664201 - DNA, 25 bp, Rattus norvegicus
ttcaatttgtcaacctgctacagcg

SEQ ID NO: 664202 - DNA, 25 bp, Rattus norvegicus
ttcaatttgtcatcctgctacagcg

SEQ ID NO: 664203 - DNA, 25 bp, Rattus norvegicus
ttcaattttcttaaccaggtcctgt

SEQ ID NO: 664204 - DNA, 25 bp, Rattus norvegicus
ttcaattttctttaccaggtcctgt

SEQ ID NO: 664205 - DNA, 25 bp, Rattus norvegicus
ttcaatttttccacacccattatcc

SEQ ID NO: 664206 - DNA, 25 bp, Rattus norvegicus
ttcaatttttcctcacccattatcc

SEQ ID NO: 664207 - DNA, 25 bp, Rattus norvegicus
ttcacaaagctgaacccaggctagt

SEQ ID NO: 664208 - DNA, 25 bp, Rattus norvegicus
ttcacaaagctgtacccaggctagt

SEQ ID NO: 664209 - DNA, 25 bp, Rattus norvegicus
ttcacaaagtccacattgcaccaag

SEQ ID NO: 664210 - DNA, 25 bp, Rattus norvegicus
ttcacaaagtcctcattgcaccaag

SEQ ID NO: 664211 - DNA, 25 bp, Rattus norvegicus
ttcacaaatataccacaacctcctg

SEQ ID NO: 664212 - DNA, 25 bp, Rattus norvegicus
ttcacaaatatagcacaacctcctg

SEQ ID NO: 664213 - DNA, 25 bp, Rattus norvegicus
ttcacaacaaggatccagactctct

SEQ ID NO: 664214 - DNA, 25 bp, Rattus norvegicus
ttcacaacaaggttccagactctct

SEQ ID NO: 664215 - DNA, 25 bp, Rattus norvegicus
ttcacaacccaacagtgggaagcct

SEQ ID NO: 664216 - DNA, 25 bp, Rattus norvegicus
ttcacaacccaagagtgggaagcct

SEQ ID NO: 664217 - DNA, 25 bp, Rattus norvegicus
ttcacaacggcaatctatctcagag

SEQ ID NO: 664218 - DNA, 25 bp, Rattus norvegicus
ttcacaacggcattctatctcagag

SEQ ID NO: 664219 - DNA, 25 bp, Rattus norvegicus
ttcacaagactgatacctggtacgt

SEQ ID NO: 664220 - DNA, 25 bp, Rattus norvegicus
ttcacaagactgttacctggtacgt

SEQ ID NO: 664221 - DNA, 25 bp, Rattus norvegicus
ttcacaagagcgacaggattcactg

SEQ ID NO: 664222 - DNA, 25 bp, Rattus norvegicus
ttcacaagagcgtcaggattcactg

SEQ ID NO: 664223 - DNA, 25 bp, Rattus norvegicus
ttcacaagctgtcgccgtggtggat

SEQ ID NO: 664224 - DNA, 25 bp, Rattus norvegicus
ttcacaagctgtggccgtggtggat

SEQ ID NO: 664225 - DNA, 25 bp, Rattus norvegicus
ttcacaagggacacaggctaactat

SEQ ID NO: 664226 - DNA, 25 bp, Rattus norvegicus
ttcacaagggactcaggctaactat

SEQ ID NO: 664227 - DNA, 25 bp, Rattus norvegicus
ttcacaagtcggagggacactctgc

SEQ ID NO: 664228 - DNA, 25 bp, Rattus norvegicus
ttcacaagtcggtgggacactctgc

SEQ ID NO: 664229 - DNA, 25 bp, Rattus norvegicus
ttcacaagtgtgactggcctactca

SEQ ID NO: 664230 - DNA, 25 bp, Rattus norvegicus
ttcacaagtgtgtctggcctactca

SEQ ID NO: 664231 - DNA, 25 bp, Rattus norvegicus
ttcacaagttctaatccctccgagg

SEQ ID NO: 664232 - DNA, 25 bp, Rattus norvegicus
ttcacaagttcttatccctccgagg

SEQ ID NO: 664233 - DNA, 25 bp, Rattus norvegicus
ttcacaatattaagcgccaagatct

SEQ ID NO: 664234 - DNA, 25 bp, Rattus norvegicus
ttcacaatattatgcgccaagatct

SEQ ID NO: 664235 - DNA, 25 bp, Rattus norvegicus
ttcacaatccccattacataaacgc

SEQ ID NO: 664236 - DNA, 25 bp, Rattus norvegicus
ttcacaatcccctttacataaacgc

SEQ ID NO: 664237 - DNA, 25 bp, Rattus norvegicus
ttcacaatgggcacctggaaatgtg

SEQ ID NO: 664238 - DNA, 25 bp, Rattus norvegicus
ttcacaatgggctcctggaaatgtg

SEQ ID NO: 664239 - DNA, 25 bp, Rattus norvegicus
ttcacaattcagacaaaatctaagg

SEQ ID NO: 664240 - DNA, 25 bp, Rattus norvegicus
ttcacaattcagtcaaaatctaagg

SEQ ID NO: 664241 - DNA, 25 bp, Rattus norvegicus
ttcacaattgacaagtaactccagc

SEQ ID NO: 664242 - DNA, 25 bp, Rattus norvegicus
ttcacaattgactagtaactccagc

SEQ ID NO: 664243 - DNA, 25 bp, Rattus norvegicus
ttcacacaaaatctcctgggcacag

SEQ ID NO: 664244 - DNA, 25 bp, Rattus norvegicus
ttcacacaaaatgtcctgggcacag

SEQ ID NO: 664245 - DNA, 25 bp, Rattus norvegicus
ttcacacaacgcacatgccaatgaa

SEQ ID NO: 664246 - DNA, 25 bp, Rattus norvegicus
ttcacacaacgctcatgccaatgaa

SEQ ID NO: 664247 - DNA, 25 bp, Rattus norvegicus
ttcacacacaaaacttccttctggt

SEQ ID NO: 664248 - DNA, 25 bp, Rattus norvegicus
ttcacacacaaatcttccttctggt

SEQ ID NO: 664249 - DNA, 25 bp, Rattus norvegicus
ttcacacacactcacgggtgtatgt

SEQ ID NO: 664250 - DNA, 25 bp, Rattus norvegicus
ttcacacacactgacgggtgtatgt

SEQ ID NO: 664251 - DNA, 25 bp, Rattus norvegicus
ttcacacagccaactttcccaaaaa

SEQ ID NO: 664252 - DNA, 25 bp, Rattus norvegicus
ttcacacagccatctttcccaaaaa

SEQ ID NO: 664253 - DNA, 25 bp, Rattus norvegicus
ttcacacaggccaatgtagcaatga

SEQ ID NO: 664254 - DNA, 25 bp, Rattus norvegicus
ttcacacaggcctatgtagcaatga

SEQ ID NO: 664255 - DNA, 25 bp, Rattus norvegicus
ttcacacagtctatatgtccagcct

SEQ ID NO: 664256 - DNA, 25 bp, Rattus norvegicus
ttcacacagtctttatgtccagcct

SEQ ID NO: 664257 - DNA, 25 bp, Rattus norvegicus
ttcacaccaaaaacagtgcagagta

SEQ ID NO: 664258 - DNA, 25 bp, Rattus norvegicus
ttcacaccaaaatcagtgcagagta

SEQ ID NO: 664259 - DNA, 25 bp, Rattus norvegicus
ttcacacccagtctaaaattcccaa

SEQ ID NO: 664260 - DNA, 25 bp, Rattus norvegicus
ttcacacccagtgtaaaattcccaa

SEQ ID NO: 664261 - DNA, 25 bp, Rattus norvegicus
ttcacacctcatagtacatcagcga

SEQ ID NO: 664262 - DNA, 25 bp, Rattus norvegicus
ttcacacctcattgtacatcagcga

SEQ ID NO: 664263 - DNA, 25 bp, Rattus norvegicus
ttcacacctctgatcaagactgatt

SEQ ID NO: 664264 - DNA, 25 bp, Rattus norvegicus
ttcacacctctgttcaagactgatt

SEQ ID NO: 664265 - DNA, 25 bp, Rattus norvegicus
ttcacacgagccagaagatccaccg

SEQ ID NO: 664266 - DNA, 25 bp, Rattus norvegicus
ttcacacgagcctgaagatccaccg

SEQ ID NO: 664267 - DNA, 25 bp, Rattus norvegicus
ttcacacgtgccaggcaagcactaa

SEQ ID NO: 664268 - DNA, 25 bp, Rattus norvegicus
ttcacacgtgcctggcaagcactaa

SEQ ID NO: 664269 - DNA, 25 bp, Rattus norvegicus
ttcacacgtgctagggcctcatcag

SEQ ID NO: 664270 - DNA, 25 bp, Rattus norvegicus
ttcacacgtgcttgggcctcatcag

SEQ ID NO: 664271 - DNA, 25 bp, Rattus norvegicus
ttcacacgtgttcacttgcagttca

SEQ ID NO: 664272 - DNA, 25 bp, Rattus norvegicus
ttcacacgtgttgacttgcagttca

SEQ ID NO: 664273 - DNA, 25 bp, Rattus norvegicus
ttcacactattccagatcacacttt

SEQ ID NO: 664274 - DNA, 25 bp, Rattus norvegicus
ttcacactattcgagatcacacttt

SEQ ID NO: 664275 - DNA, 25 bp, Rattus norvegicus
ttcacactccaacccctgtattgtt

SEQ ID NO: 664276 - DNA, 25 bp, Rattus norvegicus
ttcacactccaagccctgtattgtt

SEQ ID NO: 664277 - DNA, 25 bp, Rattus norvegicus
ttcacactccaccaaggcggtcacc

SEQ ID NO: 664278 - DNA, 25 bp, Rattus norvegicus
ttcacactccacgaaggcggtcacc

SEQ ID NO: 664279 - DNA, 25 bp, Rattus norvegicus
ttcacactgctgattggacctccct

SEQ ID NO: 664280 - DNA, 25 bp, Rattus norvegicus
ttcacactgctgtttggacctccct

SEQ ID NO: 664281 - DNA, 25 bp, Rattus norvegicus
ttcacactggagaggatctccccac

SEQ ID NO: 664282 - DNA, 25 bp, Rattus norvegicus
ttcacactggagtggatctccccac

SEQ ID NO: 664283 - DNA, 25 bp, Rattus norvegicus
ttcacactgtctcggtggcgacata

SEQ ID NO: 664284 - DNA, 25 bp, Rattus norvegicus
ttcacactgtctgggtggcgacata

SEQ ID NO: 664285 - DNA, 25 bp, Rattus norvegicus
ttcacagacctgctttgagttgctc

SEQ ID NO: 664286 - DNA, 25 bp, Rattus norvegicus
ttcacagacctggtttgagttgctc

SEQ ID NO: 664287 - DNA, 25 bp, Rattus norvegicus
ttcacagactctccccaatgttgag

SEQ ID NO: 664288 - DNA, 25 bp, Rattus norvegicus
ttcacagactctgcccaatgttgag

SEQ ID NO: 664289 - DNA, 25 bp, Rattus norvegicus
ttcacagagctgatgggtgccaggc

SEQ ID NO: 664290 - DNA, 25 bp, Rattus norvegicus
ttcacagagctgttgggtgccaggc

SEQ ID NO: 664291 - DNA, 25 bp, Rattus norvegicus
ttcacagaggcaagggttgggttca

SEQ ID NO: 664292 - DNA, 25 bp, Rattus norvegicus
ttcacagaggcatgggttgggttca

SEQ ID NO: 664293 - DNA, 25 bp, Rattus norvegicus
ttcacagagtttaggcatgcagttt

SEQ ID NO: 664294 - DNA, 25 bp, Rattus norvegicus
ttcacagagttttggcatgcagttt

SEQ ID NO: 664295 - DNA, 25 bp, Rattus norvegicus
ttcacagatgtcacttttctcatgc

SEQ ID NO: 664296 - DNA, 25 bp, Rattus norvegicus
ttcacagatgtctcttttctcatgc

SEQ ID NO: 664297 - DNA, 25 bp, Rattus norvegicus
ttcacagcaccaactgttcttggag

SEQ ID NO: 664298 - DNA, 25 bp, Rattus norvegicus
ttcacagcaccatctgttcttggag

SEQ ID NO: 664299 - DNA, 25 bp, Rattus norvegicus
ttcacagcagtcatagaactcccaa

SEQ ID NO: 664300 - DNA, 25 bp, Rattus norvegicus
ttcacagcagtcttagaactcccaa

SEQ ID NO: 664301 - DNA, 25 bp, Rattus norvegicus
ttcacagcatctcggtagagtagag

SEQ ID NO: 664302 - DNA, 25 bp, Rattus norvegicus
ttcacagcatctgggtagagtagag

SEQ ID NO: 664303 - DNA, 25 bp, Rattus norvegicus
ttcacagccaggaaaggatccaagc

SEQ ID NO: 664304 - DNA, 25 bp, Rattus norvegicus
ttcacagccaggtaaggatccaagc

SEQ ID NO: 664305 - DNA, 25 bp, Rattus norvegicus
ttcacagccatgctctgactgactg

SEQ ID NO: 664306 - DNA, 25 bp, Rattus norvegicus
ttcacagccatggtctgactgactg

SEQ ID NO: 664307 - DNA, 25 bp, Rattus norvegicus
ttcacagccgtccatgacagtagat

SEQ ID NO: 664308 - DNA, 25 bp, Rattus norvegicus
ttcacagccgtcgatgacagtagat

SEQ ID NO: 664309 - DNA, 25 bp, Rattus norvegicus
ttcacagcctacactcaagggacac

SEQ ID NO: 664310 - DNA, 25 bp, Rattus norvegicus
ttcacagcctactctcaagggacac

SEQ ID NO: 664311 - DNA, 25 bp, Rattus norvegicus
ttcacagcctccagacatgttctgt

SEQ ID NO: 664312 - DNA, 25 bp, Rattus norvegicus
ttcacagcctcctgacatgttctgt

SEQ ID NO: 664313 - DNA, 25 bp, Rattus norvegicus
ttcacagcgtttatggaaagcatag

SEQ ID NO: 664314 - DNA, 25 bp, Rattus norvegicus
ttcacagcgtttttggaaagcatag

SEQ ID NO: 664315 - DNA, 25 bp, Rattus norvegicus
ttcacagctcagacctggattctaa

SEQ ID NO: 664316 - DNA, 25 bp, Rattus norvegicus
ttcacagctcagagcactgggtact

SEQ ID NO: 664317 - DNA, 25 bp, Rattus norvegicus
ttcacagctcagtcctggattctaa

SEQ ID NO: 664318 - DNA, 25 bp, Rattus norvegicus
ttcacagctcagtgcactgggtact

SEQ ID NO: 664319 - DNA, 25 bp, Rattus norvegicus
ttcacagcttttccaaacatatctc

SEQ ID NO: 664320 - DNA, 25 bp, Rattus norvegicus
ttcacagcttttgcaaacatatctc

SEQ ID NO: 664321 - DNA, 25 bp, Rattus norvegicus
ttcacaggagagacccatgtatcca

SEQ ID NO: 664322 - DNA, 25 bp, Rattus norvegicus
ttcacaggagagtcccatgtatcca

SEQ ID NO: 664323 - DNA, 25 bp, Rattus norvegicus
ttcacaggaggaaccgtgtcctcat

SEQ ID NO: 664324 - DNA, 25 bp, Rattus norvegicus
ttcacaggaggatccgtgtcctcat

SEQ ID NO: 664325 - DNA, 25 bp, Rattus norvegicus
ttcacagggaacacatgccccaaac

SEQ ID NO: 664326 - DNA, 25 bp, Rattus norvegicus
ttcacagggaactcatgccccaaac

SEQ ID NO: 664327 - DNA, 25 bp, Rattus norvegicus
ttcacagggcatcaatttcctcatc

SEQ ID NO: 664328 - DNA, 25 bp, Rattus norvegicus
ttcacagggcatgaatttcctcatc

SEQ ID NO: 664329 - DNA, 25 bp, Rattus norvegicus
ttcacagggctgagcaaaggagaca

SEQ ID NO: 664330 - DNA, 25 bp, Rattus norvegicus
ttcacagggctgtgcaaaggagaca

SEQ ID NO: 664331 - DNA, 25 bp, Rattus norvegicus
ttcacagtactcaggctaccagcaa

SEQ ID NO: 664332 - DNA, 25 bp, Rattus norvegicus
ttcacagtactctggctaccagcaa

SEQ ID NO: 664333 - DNA, 25 bp, Rattus norvegicus
ttcacagtagtcagcctatttacag

SEQ ID NO: 664334 - DNA, 25 bp, Rattus norvegicus
ttcacagtagtctgcctatttacag

SEQ ID NO: 664335 - DNA, 25 bp, Rattus norvegicus
ttcacagtccaactcacaggcaaag

SEQ ID NO: 664336 - DNA, 25 bp, Rattus norvegicus
ttcacagtccaagtcacaggcaaag

SEQ ID NO: 664337 - DNA, 25 bp, Rattus norvegicus
ttcacagtctgcagagctccatcga

SEQ ID NO: 664338 - DNA, 25 bp, Rattus norvegicus
ttcacagtctgctgagctccatcga

SEQ ID NO: 664339 - DNA, 25 bp, Rattus norvegicus
ttcacagtggtgacctcaactcatc

SEQ ID NO: 664340 - DNA, 25 bp, Rattus norvegicus
ttcacagtggtgtcctcaactcatc

SEQ ID NO: 664341 - DNA, 25 bp, Rattus norvegicus
ttcacagttagcatgtgaggtcccc

SEQ ID NO: 664342 - DNA, 25 bp, Rattus norvegicus
ttcacagttagcttgtgaggtcccc

SEQ ID NO: 664343 - DNA, 25 bp, Rattus norvegicus
ttcacagttctgagtctgagtgctt

SEQ ID NO: 664344 - DNA, 25 bp, Rattus norvegicus
ttcacagttctgtgtctgagtgctt

SEQ ID NO: 664345 - DNA, 25 bp, Rattus norvegicus
ttcacagtttgaacatggctcatgt

SEQ ID NO: 664346 - DNA, 25 bp, Rattus norvegicus
ttcacagtttgatcatggctcatgt

SEQ ID NO: 664347 - DNA, 25 bp, Rattus norvegicus
ttcacataacctacttgcacagctg

SEQ ID NO: 664348 - DNA, 25 bp, Rattus norvegicus
ttcacataaccttcttgcacagctg

SEQ ID NO: 664349 - DNA, 25 bp, Rattus norvegicus
ttcacatagcaaaacaccccattag

SEQ ID NO: 664350 - DNA, 25 bp, Rattus norvegicus
ttcacatagcaatacaccccattag

SEQ ID NO: 664351 - DNA, 25 bp, Rattus norvegicus
ttcacatagttcattttcagccttg

SEQ ID NO: 664352 - DNA, 25 bp, Rattus norvegicus
ttcacatagttctttttcagccttg

SEQ ID NO: 664353 - DNA, 25 bp, Rattus norvegicus
ttcacatatatcacctgctaacatc

SEQ ID NO: 664354 - DNA, 25 bp, Rattus norvegicus
ttcacatatatctcctgctaacatc

SEQ ID NO: 664355 - DNA, 25 bp, Rattus norvegicus
ttcacatcacgcaacattctccagt

SEQ ID NO: 664356 - DNA, 25 bp, Rattus norvegicus
ttcacatcacgctacattctccagt

SEQ ID NO: 664357 - DNA, 25 bp, Rattus norvegicus
ttcacatcatctcccgaggaagtag

SEQ ID NO: 664358 - DNA, 25 bp, Rattus norvegicus
ttcacatcatctgccgaggaagtag

SEQ ID NO: 664359 - DNA, 25 bp, Rattus norvegicus
ttcacatcccaacgacatgtccatt

SEQ ID NO: 664360 - DNA, 25 bp, Rattus norvegicus
ttcacatcccaaggacatgtccatt

SEQ ID NO: 664361 - DNA, 25 bp, Rattus norvegicus
ttcacatctagaactgctttcccag

SEQ ID NO: 664362 - DNA, 25 bp, Rattus norvegicus
ttcacatctagatctgctttcccag

SEQ ID NO: 664363 - DNA, 25 bp, Rattus norvegicus
ttcacatctctcagcattttctaag

SEQ ID NO: 664364 - DNA, 25 bp, Rattus norvegicus
ttcacatctctctgcattttctaag

SEQ ID NO: 664365 - DNA, 25 bp, Rattus norvegicus
ttcacatctgtgagatctgcgagat

SEQ ID NO: 664366 - DNA, 25 bp, Rattus norvegicus
ttcacatctgtgtgatctgcgagat

SEQ ID NO: 664367 - DNA, 25 bp, Rattus norvegicus
ttcacatgaagcctcacctctgaga

SEQ ID NO: 664368 - DNA, 25 bp, Rattus norvegicus
ttcacatgaagcgtcacctctgaga

SEQ ID NO: 664369 - DNA, 25 bp, Rattus norvegicus
ttcacatgatacatcgctctaaatc

SEQ ID NO: 664370 - DNA, 25 bp, Rattus norvegicus
ttcacatgatacttcgctctaaatc

SEQ ID NO: 664371 - DNA, 25 bp, Rattus norvegicus
ttcacatgatgtcgtccagcaggtt

SEQ ID NO: 664372 - DNA, 25 bp, Rattus norvegicus
ttcacatgatgtggtccagcaggtt

SEQ ID NO: 664373 - DNA, 25 bp, Rattus norvegicus
ttcacatgcagcaagagacacccac

SEQ ID NO: 664374 - DNA, 25 bp, Rattus norvegicus
ttcacatgcagctagagacacccac

SEQ ID NO: 664375 - DNA, 25 bp, Rattus norvegicus
ttcacatgcccactggtgtatctct

SEQ ID NO: 664376 - DNA, 25 bp, Rattus norvegicus
ttcacatgcccagtggtgtatctct

SEQ ID NO: 664377 - DNA, 25 bp, Rattus norvegicus
ttcacatggcttcacatggcatgag

SEQ ID NO: 664378 - DNA, 25 bp, Rattus norvegicus
ttcacatggcttgacatggcatgag

SEQ ID NO: 664379 - DNA, 25 bp, Rattus norvegicus
ttcacatgggaaccttgcccgtgtt

SEQ ID NO: 664380 - DNA, 25 bp, Rattus norvegicus
ttcacatgggaagcttgcccgtgtt

SEQ ID NO: 664381 - DNA, 25 bp, Rattus norvegicus
ttcacatgtgagatttttggttgct

SEQ ID NO: 664382 - DNA, 25 bp, Rattus norvegicus
ttcacatgtgagttttttggttgct

SEQ ID NO: 664383 - DNA, 25 bp, Rattus norvegicus
ttcacatgtgtgagccctgggttct

SEQ ID NO: 664384 - DNA, 25 bp, Rattus norvegicus
ttcacatgtgtgtgccctgggttct

SEQ ID NO: 664385 - DNA, 25 bp, Rattus norvegicus
ttcacattcaagaggccgaggctca

SEQ ID NO: 664386 - DNA, 25 bp, Rattus norvegicus
ttcacattcaagtggccgaggctca

SEQ ID NO: 664387 - DNA, 25 bp, Rattus norvegicus
ttcacattccttatgctttcctttc

SEQ ID NO: 664388 - DNA, 25 bp, Rattus norvegicus
ttcacattccttccttgagacgggc

SEQ ID NO: 664389 - DNA, 25 bp, Rattus norvegicus
ttcacattccttgcttgagacgggc

SEQ ID NO: 664390 - DNA, 25 bp, Rattus norvegicus
ttcacattccttttgctttcctttc

SEQ ID NO: 664391 - DNA, 25 bp, Rattus norvegicus
ttcacattgtctacccctgatggca

SEQ ID NO: 664392 - DNA, 25 bp, Rattus norvegicus
ttcacattgtcttcccctgatggca

SEQ ID NO: 664393 - DNA, 25 bp, Rattus norvegicus
ttcacatttcccattgaaaagtact

SEQ ID NO: 664394 - DNA, 25 bp, Rattus norvegicus
ttcacatttccctttgaaaagtact

SEQ ID NO: 664395 - DNA, 25 bp, Rattus norvegicus
ttcaccaaagcgacttgggccaaga

SEQ ID NO: 664396 - DNA, 25 bp, Rattus norvegicus
ttcaccaaagcgtcttgggccaaga

SEQ ID NO: 664397 - DNA, 25 bp, Rattus norvegicus
ttcaccaacaggcaacttgtgcagt

SEQ ID NO: 664398 - DNA, 25 bp, Rattus norvegicus
ttcaccaacagggaacttgtgcagt

SEQ ID NO: 664399 - DNA, 25 bp, Rattus norvegicus
ttcaccaaccaaagacgtgtaatta

SEQ ID NO: 664400 - DNA, 25 bp, Rattus norvegicus
ttcaccaaccaatgacgtgtaatta

SEQ ID NO: 664401 - DNA, 25 bp, Rattus norvegicus
ttcaccaactggactcgaagactgt

SEQ ID NO: 664402 - DNA, 25 bp, Rattus norvegicus
ttcaccaactggtctcgaagactgt

SEQ ID NO: 664403 - DNA, 25 bp, Rattus norvegicus
ttcaccaagaagatcctgcacacgg

SEQ ID NO: 664404 - DNA, 25 bp, Rattus norvegicus
ttcaccaagaagttcctgcacacgg

SEQ ID NO: 664405 - DNA, 25 bp, Rattus norvegicus
ttcaccaagctgacctccaaactga

SEQ ID NO: 664406 - DNA, 25 bp, Rattus norvegicus
ttcaccaagctgtcctccaaactga

SEQ ID NO: 664407 - DNA, 25 bp, Rattus norvegicus
ttcaccaagtatatacccaaagctt

SEQ ID NO: 664408 - DNA, 25 bp, Rattus norvegicus
ttcaccaagtatttacccaaagctt

SEQ ID NO: 664409 - DNA, 25 bp, Rattus norvegicus
ttcaccaatagactcctgtatgctc

SEQ ID NO: 664410 - DNA, 25 bp, Rattus norvegicus
ttcaccaatagagtcctgtatgctc

SEQ ID NO: 664411 - DNA, 25 bp, Rattus norvegicus
ttcaccacagaaaccatccttgtta

SEQ ID NO: 664412 - DNA, 25 bp, Rattus norvegicus
ttcaccacagaatccatccttgtta

SEQ ID NO: 664413 - DNA, 25 bp, Rattus norvegicus
ttcaccacagccacgaagagcaata

SEQ ID NO: 664414 - DNA, 25 bp, Rattus norvegicus
ttcaccacagcctcgaagagcaata

SEQ ID NO: 664415 - DNA, 25 bp, Rattus norvegicus
ttcaccacccttctgcaaaagtttt

SEQ ID NO: 664416 - DNA, 25 bp, Rattus norvegicus
ttcaccacccttgtgcaaaagtttt

SEQ ID NO: 664417 - DNA, 25 bp, Rattus norvegicus
ttcaccaccggcacggacagtgagt

SEQ ID NO: 664418 - DNA, 25 bp, Rattus norvegicus
ttcaccaccggctcggacagtgagt

SEQ ID NO: 664419 - DNA, 25 bp, Rattus norvegicus
ttcaccacgcctatacttaaaatct

SEQ ID NO: 664420 - DNA, 25 bp, Rattus norvegicus
ttcaccacgcctttacttaaaatct

SEQ ID NO: 664421 - DNA, 25 bp, Rattus norvegicus
ttcaccacggccacgttgttgacga

SEQ ID NO: 664422 - DNA, 25 bp, Rattus norvegicus
ttcaccacggcctcgttgttgacga

SEQ ID NO: 664423 - DNA, 25 bp, Rattus norvegicus
ttcaccactgtccttgttttggaga

SEQ ID NO: 664424 - DNA, 25 bp, Rattus norvegicus
ttcaccactgtcgttgttttggaga

SEQ ID NO: 664425 - DNA, 25 bp, Rattus norvegicus
ttcaccagatctacagcctcttggg

SEQ ID NO: 664426 - DNA, 25 bp, Rattus norvegicus
ttcaccagatcttcagcctcttggg

SEQ ID NO: 664427 - DNA, 25 bp, Rattus norvegicus
ttcaccagatttattccttccttgc

SEQ ID NO: 664428 - DNA, 25 bp, Rattus norvegicus
ttcaccagattttttccttccttgc

SEQ ID NO: 664429 - DNA, 25 bp, Rattus norvegicus
ttcaccagcctccatatgatcaaag

SEQ ID NO: 664430 - DNA, 25 bp, Rattus norvegicus
ttcaccagcctcgatatgatcaaag

SEQ ID NO: 664431 - DNA, 25 bp, Rattus norvegicus
ttcaccagccttcccattgagtcag

SEQ ID NO: 664432 - DNA, 25 bp, Rattus norvegicus
ttcaccagccttgccattgagtcag

SEQ ID NO: 664433 - DNA, 25 bp, Rattus norvegicus
ttcaccaggtacacaactcttacaa

SEQ ID NO: 664434 - DNA, 25 bp, Rattus norvegicus
ttcaccaggtactcaactcttacaa

SEQ ID NO: 664435 - DNA, 25 bp, Rattus norvegicus
ttcaccaggtggcacacatgcactg

SEQ ID NO: 664436 - DNA, 25 bp, Rattus norvegicus
ttcaccaggtgggacacatgcactg

SEQ ID NO: 664437 - DNA, 25 bp, Rattus norvegicus
ttcaccagtcttccagccaaagttg

SEQ ID NO: 664438 - DNA, 25 bp, Rattus norvegicus
ttcaccagtcttgcagccaaagttg

SEQ ID NO: 664439 - DNA, 25 bp, Rattus norvegicus
ttcaccagtgtgattctatctagga

SEQ ID NO: 664440 - DNA, 25 bp, Rattus norvegicus
ttcaccagtgtgtttctatctagga

SEQ ID NO: 664441 - DNA, 25 bp, Rattus norvegicus
ttcaccatcagtcccaggcaaatat

SEQ ID NO: 664442 - DNA, 25 bp, Rattus norvegicus
ttcaccatcagtgccaggcaaatat

SEQ ID NO: 664443 - DNA, 25 bp, Rattus norvegicus
ttcaccatcgtcatcgtcggcatag

SEQ ID NO: 664444 - DNA, 25 bp, Rattus norvegicus
ttcaccatcgtcttcgtcggcatag

SEQ ID NO: 664445 - DNA, 25 bp, Rattus norvegicus
ttcaccatctccacgaaacattagt

SEQ ID NO: 664446 - DNA, 25 bp, Rattus norvegicus
ttcaccatctcctcgaaacattagt

SEQ ID NO: 664447 - DNA, 25 bp, Rattus norvegicus
ttcaccatctcgcttcttgaagtgg

SEQ ID NO: 664448 - DNA, 25 bp, Rattus norvegicus
ttcaccatctcggttcttgaagtgg

SEQ ID NO: 664449 - DNA, 25 bp, Rattus norvegicus
ttcaccatcttgaacagcacctgtg

SEQ ID NO: 664450 - DNA, 25 bp, Rattus norvegicus
ttcaccatcttgtacagcacctgtg

SEQ ID NO: 664451 - DNA, 25 bp, Rattus norvegicus
ttcaccatgcaacctgcttctgcaa

SEQ ID NO: 664452 - DNA, 25 bp, Rattus norvegicus
ttcaccatgcaagctgcttctgcaa

SEQ ID NO: 664453 - DNA, 25 bp, Rattus norvegicus
ttcaccatgctcaagagcatctgtg

SEQ ID NO: 664454 - DNA, 25 bp, Rattus norvegicus
ttcaccatgctctagagcatctgtg

SEQ ID NO: 664455 - DNA, 25 bp, Rattus norvegicus
ttcaccatggcccaactgatccaaa

SEQ ID NO: 664456 - DNA, 25 bp, Rattus norvegicus
ttcaccatggccgaactgatccaaa

SEQ ID NO: 664457 - DNA, 25 bp, Rattus norvegicus
ttcaccattgacctccttttcagta

SEQ ID NO: 664458 - DNA, 25 bp, Rattus norvegicus
ttcaccattgacgtccttttcagta

SEQ ID NO: 664459 - DNA, 25 bp, Rattus norvegicus
ttcaccatttaaaacgcctctttgc

SEQ ID NO: 664460 - DNA, 25 bp, Rattus norvegicus
ttcaccatttaatacgcctctttgc

SEQ ID NO: 664461 - DNA, 25 bp, Rattus norvegicus
ttcaccatttcaaccttaagttctc

SEQ ID NO: 664462 - DNA, 25 bp, Rattus norvegicus
ttcaccatttcatccttaagttctc

SEQ ID NO: 664463 - DNA, 25 bp, Rattus norvegicus
ttcaccatttctacatctgtttctt

SEQ ID NO: 664464 - DNA, 25 bp, Rattus norvegicus
ttcaccatttctctgttctgataat

SEQ ID NO: 664465 - DNA, 25 bp, Rattus norvegicus
ttcaccatttctgtgttctgataat

SEQ ID NO: 664466 - DNA, 25 bp, Rattus norvegicus
ttcaccatttcttcatctgtttctt

SEQ ID NO: 664467 - DNA, 25 bp, Rattus norvegicus
ttcacccaagggagtccaactctta

SEQ ID NO: 664468 - DNA, 25 bp, Rattus norvegicus
ttcacccaagggtgtccaactctta

SEQ ID NO: 664469 - DNA, 25 bp, Rattus norvegicus
ttcacccactgtatgtgccagaata

SEQ ID NO: 664470 - DNA, 25 bp, Rattus norvegicus
ttcacccactgtttgtgccagaata

SEQ ID NO: 664471 - DNA, 25 bp, Rattus norvegicus
ttcacccagacaacgcacatatgga

SEQ ID NO: 664472 - DNA, 25 bp, Rattus norvegicus
ttcacccagacatcgcacatatgga

SEQ ID NO: 664473 - DNA, 25 bp, Rattus norvegicus
ttcacccagaggatggccaggaaga

SEQ ID NO: 664474 - DNA, 25 bp, Rattus norvegicus
ttcacccagaggttggccaggaaga

SEQ ID NO: 664475 - DNA, 25 bp, Rattus norvegicus
ttcacccaggcaaggcatggtgggc

SEQ ID NO: 664476 - DNA, 25 bp, Rattus norvegicus
ttcacccaggcatggcatggtgggc

SEQ ID NO: 664477 - DNA, 25 bp, Rattus norvegicus
ttcacccagggactctgtgtaatgt

SEQ ID NO: 664478 - DNA, 25 bp, Rattus norvegicus
ttcacccagggagtctgtgtaatgt

SEQ ID NO: 664479 - DNA, 25 bp, Rattus norvegicus
ttcacccagggcctcagacttaaag

SEQ ID NO: 664480 - DNA, 25 bp, Rattus norvegicus
ttcacccagggcgtcagacttaaag

SEQ ID NO: 664481 - DNA, 25 bp, Rattus norvegicus
ttcaccccacagcaaggtgacattt

SEQ ID NO: 664482 - DNA, 25 bp, Rattus norvegicus
ttcaccccacaggaaggtgacattt

SEQ ID NO: 664483 - DNA, 25 bp, Rattus norvegicus
ttcaccccaccaagcaagatgttta

SEQ ID NO: 664484 - DNA, 25 bp, Rattus norvegicus
ttcaccccaccatgcaagatgttta

SEQ ID NO: 664485 - DNA, 25 bp, Rattus norvegicus
ttcaccccagagacttgcaatggac

SEQ ID NO: 664486 - DNA, 25 bp, Rattus norvegicus
ttcaccccagagtcttgcaatggac

SEQ ID NO: 664487 - DNA, 25 bp, Rattus norvegicus
ttcaccccagcaagcatcatgtgag

SEQ ID NO: 664488 - DNA, 25 bp, Rattus norvegicus
ttcaccccagcatgcatcatgtgag

SEQ ID NO: 664489 - DNA, 25 bp, Rattus norvegicus
ttcaccccagtaatcaaaaaacgct

SEQ ID NO: 664490 - DNA, 25 bp, Rattus norvegicus
ttcaccccagtattcaaaaaacgct

SEQ ID NO: 664491 - DNA, 25 bp, Rattus norvegicus
ttcaccccatatcactagagccagt

SEQ ID NO: 664492 - DNA, 25 bp, Rattus norvegicus
ttcaccccatatgactagagccagt

SEQ ID NO: 664493 - DNA, 25 bp, Rattus norvegicus
ttcaccccgatacgttttgcctcag

SEQ ID NO: 664494 - DNA, 25 bp, Rattus norvegicus
ttcaccccgataggttttgcctcag

SEQ ID NO: 664495 - DNA, 25 bp, Rattus norvegicus
ttcaccccgttgagttttgggtcag

SEQ ID NO: 664496 - DNA, 25 bp, Rattus norvegicus
ttcaccccgttgtgttttgggtcag

SEQ ID NO: 664497 - DNA, 25 bp, Rattus norvegicus
ttcacccctctacagacagatttaa

SEQ ID NO: 664498 - DNA, 25 bp, Rattus norvegicus
ttcacccctctagagacagatttaa

SEQ ID NO: 664499 - DNA, 25 bp, Rattus norvegicus
ttcacccggagcacatgaaaagctt

SEQ ID NO: 664500 - DNA, 25 bp, Rattus norvegicus
ttcacccggagctcatgaaaagctt

SEQ ID NO: 664501 - DNA, 25 bp, Rattus norvegicus
ttcaccctatcacagcttggctttc

SEQ ID NO: 664502 - DNA, 25 bp, Rattus norvegicus
ttcaccctatcagagcttggctttc

SEQ ID NO: 664503 - DNA, 25 bp, Rattus norvegicus
ttcaccctcctcaggttttgatttt

SEQ ID NO: 664504 - DNA, 25 bp, Rattus norvegicus
ttcaccctcctctggttttgatttt

SEQ ID NO: 664505 - DNA, 25 bp, Rattus norvegicus
ttcaccctctgcagagaagcacttg

SEQ ID NO: 664506 - DNA, 25 bp, Rattus norvegicus
ttcaccctctgctgagaagcacttg

SEQ ID NO: 664507 - DNA, 25 bp, Rattus norvegicus
ttcaccctggccaatacgatggagg

SEQ ID NO: 664508 - DNA, 25 bp, Rattus norvegicus
ttcaccctggcctatacgatggagg

SEQ ID NO: 664509 - DNA, 25 bp, Rattus norvegicus
ttcaccctgtgaactccagcaaaga

SEQ ID NO: 664510 - DNA, 25 bp, Rattus norvegicus
ttcaccctgtgatctccagcaaaga

SEQ ID NO: 664511 - DNA, 25 bp, Rattus norvegicus
ttcacccttccacttaaaacacgag

SEQ ID NO: 664512 - DNA, 25 bp, Rattus norvegicus
ttcacccttccagttaaaacacgag

SEQ ID NO: 664513 - DNA, 25 bp, Rattus norvegicus
ttcaccgaatggcagtgcctcagtc

SEQ ID NO: 664514 - DNA, 25 bp, Rattus norvegicus
ttcaccgaatgggagtgcctcagtc

SEQ ID NO: 664515 - DNA, 25 bp, Rattus norvegicus
ttcaccgagcacacgcagagtcagg

SEQ ID NO: 664516 - DNA, 25 bp, Rattus norvegicus
ttcaccgagcactcgcagagtcagg

SEQ ID NO: 664517 - DNA, 25 bp, Rattus norvegicus
ttcaccgcactgaaccagaaacata

SEQ ID NO: 664518 - DNA, 25 bp, Rattus norvegicus
ttcaccgcactgtaccagaaacata

SEQ ID NO: 664519 - DNA, 25 bp, Rattus norvegicus
ttcaccgccaagctttcacagttga

SEQ ID NO: 664520 - DNA, 25 bp, Rattus norvegicus
ttcaccgccaaggtttcacagttga

SEQ ID NO: 664521 - DNA, 25 bp, Rattus norvegicus
ttcaccgctgtgcaggaccagtatt

SEQ ID NO: 664522 - DNA, 25 bp, Rattus norvegicus
ttcaccgctgtggaggaccagtatt

SEQ ID NO: 664523 - DNA, 25 bp, Rattus norvegicus
ttcaccgggtacacttagggcctga

SEQ ID NO: 664524 - DNA, 25 bp, Rattus norvegicus
ttcaccgggtactcttagggcctga

SEQ ID NO: 664525 - DNA, 25 bp, Rattus norvegicus
ttcaccgtgggcatctcggtaaaat

SEQ ID NO: 664526 - DNA, 25 bp, Rattus norvegicus
ttcaccgtgggcttctcggtaaaat

SEQ ID NO: 664527 - DNA, 25 bp, Rattus norvegicus
ttcaccgttcttcggctgttctaaa

SEQ ID NO: 664528 - DNA, 25 bp, Rattus norvegicus
ttcaccgttcttgggctgttctaaa

SEQ ID NO: 664529 - DNA, 25 bp, Rattus norvegicus
ttcaccgttgctcagcggctcggcg

SEQ ID NO: 664530 - DNA, 25 bp, Rattus norvegicus
ttcaccgttgctgagcggctcggcg

SEQ ID NO: 664531 - DNA, 25 bp, Rattus norvegicus
ttcacctaaagtatccttctctcat

SEQ ID NO: 664532 - DNA, 25 bp, Rattus norvegicus
ttcacctaaagtttccttctctcat

SEQ ID NO: 664533 - DNA, 25 bp, Rattus norvegicus
ttcacctatgaaagcaccactcaga

SEQ ID NO: 664534 - DNA, 25 bp, Rattus norvegicus
ttcacctatgaatgcaccactcaga

SEQ ID NO: 664535 - DNA, 25 bp, Rattus norvegicus
ttcacctccaagcactgggcttagg

SEQ ID NO: 664536 - DNA, 25 bp, Rattus norvegicus
ttcacctccaaggactgggcttagg

SEQ ID NO: 664537 - DNA, 25 bp, Rattus norvegicus
ttcacctccacaacagaatacactt

SEQ ID NO: 664538 - DNA, 25 bp, Rattus norvegicus
ttcacctccacatcagaatacactt

SEQ ID NO: 664539 - DNA, 25 bp, Rattus norvegicus
ttcacctccagaattccagtagtca

SEQ ID NO: 664540 - DNA, 25 bp, Rattus norvegicus
ttcacctccagatttccagtagtca

SEQ ID NO: 664541 - DNA, 25 bp, Rattus norvegicus
ttcacctcctgccttacagatgtaa

SEQ ID NO: 664542 - DNA, 25 bp, Rattus norvegicus
ttcacctcctgcgttacagatgtaa

SEQ ID NO: 664543 - DNA, 25 bp, Rattus norvegicus
ttcacctcgctgaaatcccagagtt

SEQ ID NO: 664544 - DNA, 25 bp, Rattus norvegicus
ttcacctcgctgtaatcccagagtt

SEQ ID NO: 664545 - DNA, 25 bp, Rattus norvegicus
ttcacctctgtgacagtcctggcac

SEQ ID NO: 664546 - DNA, 25 bp, Rattus norvegicus
ttcacctctgtgtcagtcctggcac

SEQ ID NO: 664547 - DNA, 25 bp, Rattus norvegicus
ttcacctcttctcgcgtgggagatg

SEQ ID NO: 664548 - DNA, 25 bp, Rattus norvegicus
ttcacctcttctggcgtgggagatg

SEQ ID NO: 664549 - DNA, 25 bp, Rattus norvegicus
ttcacctgactcccgtataatatgc

SEQ ID NO: 664550 - DNA, 25 bp, Rattus norvegicus
ttcacctgactcgcgtataatatgc

SEQ ID NO: 664551 - DNA, 25 bp, Rattus norvegicus
ttcacctgagctcctttatttcaaa

SEQ ID NO: 664552 - DNA, 25 bp, Rattus norvegicus
ttcacctgagctgctttatttcaaa

SEQ ID NO: 664553 - DNA, 25 bp, Rattus norvegicus
ttcacctgaggacagtgctgccaga

SEQ ID NO: 664554 - DNA, 25 bp, Rattus norvegicus
ttcacctgaggagagtgctgccaga

SEQ ID NO: 664555 - DNA, 25 bp, Rattus norvegicus
ttcacctgctcacagccaatgggaa

SEQ ID NO: 664556 - DNA, 25 bp, Rattus norvegicus
ttcacctgctcagagccaatgggaa

SEQ ID NO: 664557 - DNA, 25 bp, Rattus norvegicus
ttcacctgctgaccagagcctttag

SEQ ID NO: 664558 - DNA, 25 bp, Rattus norvegicus
ttcacctgctgagcagagcctttag

SEQ ID NO: 664559 - DNA, 25 bp, Rattus norvegicus
ttcacctgggtaagcatcaaccaca

SEQ ID NO: 664560 - DNA, 25 bp, Rattus norvegicus
ttcacctgggtatgcatcaaccaca

SEQ ID NO: 664561 - DNA, 25 bp, Rattus norvegicus
ttcacctgtaaactgcatcactttt

SEQ ID NO: 664562 - DNA, 25 bp, Rattus norvegicus
ttcacctgtaaagtgcatcactttt

SEQ ID NO: 664563 - DNA, 25 bp, Rattus norvegicus
ttcaccttcaatcctacatccggaa

SEQ ID NO: 664564 - DNA, 25 bp, Rattus norvegicus
ttcaccttcaatgctacatccggaa

SEQ ID NO: 664565 - DNA, 25 bp, Rattus norvegicus
ttcaccttcaccaggcgggaggaca

SEQ ID NO: 664566 - DNA, 25 bp, Rattus norvegicus
ttcaccttcacctggcgggaggaca

SEQ ID NO: 664567 - DNA, 25 bp, Rattus norvegicus
ttcaccttcaggcagcaatactcat

SEQ ID NO: 664568 - DNA, 25 bp, Rattus norvegicus
ttcaccttcagggagcaatactcat

SEQ ID NO: 664569 - DNA, 25 bp, Rattus norvegicus
ttcaccttccctatgacaaagctgg

SEQ ID NO: 664570 - DNA, 25 bp, Rattus norvegicus
ttcaccttccctttgacaaagctgg

SEQ ID NO: 664571 - DNA, 25 bp, Rattus norvegicus
ttcaccttcgtgatggcggtggtca

SEQ ID NO: 664572 - DNA, 25 bp, Rattus norvegicus
ttcaccttcgtgttggcggtggtca

SEQ ID NO: 664573 - DNA, 25 bp, Rattus norvegicus
ttcaccttctaaatgacctgtttgt

SEQ ID NO: 664574 - DNA, 25 bp, Rattus norvegicus
ttcaccttctaattgacctgtttgt

SEQ ID NO: 664575 - DNA, 25 bp, Rattus norvegicus
ttcaccttgaaactccacgttgggt

SEQ ID NO: 664576 - DNA, 25 bp, Rattus norvegicus
ttcaccttgaaagtccacgttgggt

SEQ ID NO: 664577 - DNA, 25 bp, Rattus norvegicus
ttcaccttggataccttgttaaaag

SEQ ID NO: 664578 - DNA, 25 bp, Rattus norvegicus
ttcaccttggattccttgttaaaag

SEQ ID NO: 664579 - DNA, 25 bp, Rattus norvegicus
ttcaccttgtcgctcttagcataat

SEQ ID NO: 664580 - DNA, 25 bp, Rattus norvegicus
ttcaccttgtcggtcttagcataat

SEQ ID NO: 664581 - DNA, 25 bp, Rattus norvegicus
ttcacctttgtgaggctagaaattt

SEQ ID NO: 664582 - DNA, 25 bp, Rattus norvegicus
ttcacctttgtgtggctagaaattt

SEQ ID NO: 664583 - DNA, 25 bp, Rattus norvegicus
ttcacgacctctcatgttgtccgca

SEQ ID NO: 664584 - DNA, 25 bp, Rattus norvegicus
ttcacgacctctgatgttgtccgca

SEQ ID NO: 664585 - DNA, 25 bp, Rattus norvegicus
ttcacgacgctgaatggctccctga

SEQ ID NO: 664586 - DNA, 25 bp, Rattus norvegicus
ttcacgacgctgtatggctccctga

SEQ ID NO: 664587 - DNA, 25 bp, Rattus norvegicus
ttcacgagttctacaatcgcactga

SEQ ID NO: 664588 - DNA, 25 bp, Rattus norvegicus
ttcacgagttcttcaatcgcactga

SEQ ID NO: 664589 - DNA, 25 bp, Rattus norvegicus
ttcacgatacgacgattatgaccga

SEQ ID NO: 664590 - DNA, 25 bp, Rattus norvegicus
ttcacgatacgaggattatgaccga

SEQ ID NO: 664591 - DNA, 25 bp, Rattus norvegicus
ttcacgcacttcctgacgggtgtgt

SEQ ID NO: 664592 - DNA, 25 bp, Rattus norvegicus
ttcacgcacttcgtgacgggtgtgt

SEQ ID NO: 664593 - DNA, 25 bp, Rattus norvegicus
ttcacgctgaagctagtggccgagc

SEQ ID NO: 664594 - DNA, 25 bp, Rattus norvegicus
ttcacgctgaaggtagtggccgagc

SEQ ID NO: 664595 - DNA, 25 bp, Rattus norvegicus
ttcacgcttgatctttatgctccag

SEQ ID NO: 664596 - DNA, 25 bp, Rattus norvegicus
ttcacgcttgatgtttatgctccag

SEQ ID NO: 664597 - DNA, 25 bp, Rattus norvegicus
ttcacggagaccacgcttttagagt

SEQ ID NO: 664598 - DNA, 25 bp, Rattus norvegicus
ttcacggagacctcgcttttagagt

SEQ ID NO: 664599 - DNA, 25 bp, Rattus norvegicus
ttcacggagagcatgtaaaccttgg

SEQ ID NO: 664600 - DNA, 25 bp, Rattus norvegicus
ttcacggagagcttgtaaaccttgg

SEQ ID NO: 664601 - DNA, 25 bp, Rattus norvegicus
ttcacggattcccaagaaacagagg

SEQ ID NO: 664602 - DNA, 25 bp, Rattus norvegicus
ttcacggattccgaagaaacagagg

SEQ ID NO: 664603 - DNA, 25 bp, Rattus norvegicus
ttcacggcagtcaggtgggagttat

SEQ ID NO: 664604 - DNA, 25 bp, Rattus norvegicus
ttcacggcagtctggtgggagttat

SEQ ID NO: 664605 - DNA, 25 bp, Rattus norvegicus
ttcacggcatagaagggctcggagt

SEQ ID NO: 664606 - DNA, 25 bp, Rattus norvegicus
ttcacggcatagtagggctcggagt

SEQ ID NO: 664607 - DNA, 25 bp, Rattus norvegicus
ttcacggctgagcagtctttccaaa

SEQ ID NO: 664608 - DNA, 25 bp, Rattus norvegicus
ttcacggctgaggagtctttccaaa

SEQ ID NO: 664609 - DNA, 25 bp, Rattus norvegicus
ttcacggcttgtcagtgttttcact

SEQ ID NO: 664610 - DNA, 25 bp, Rattus norvegicus
ttcacggcttgtgagtgttttcact

SEQ ID NO: 664611 - DNA, 25 bp, Rattus norvegicus
ttcacgggcaagctggtcctggtta

SEQ ID NO: 664612 - DNA, 25 bp, Rattus norvegicus
ttcacgggcaaggtggtcctggtta

SEQ ID NO: 664613 - DNA, 25 bp, Rattus norvegicus
ttcacgggccctatgtcagtgtacg

SEQ ID NO: 664614 - DNA, 25 bp, Rattus norvegicus
ttcacgggccctttgtcagtgtacg

SEQ ID NO: 664615 - DNA, 25 bp, Rattus norvegicus
ttcacgggcgagcatctgatggttc

SEQ ID NO: 664616 - DNA, 25 bp, Rattus norvegicus
ttcacgggcgaggatctgatggttc

SEQ ID NO: 664617 - DNA, 25 bp, Rattus norvegicus
ttcacggtccaaccagtctggacaa

SEQ ID NO: 664618 - DNA, 25 bp, Rattus norvegicus
ttcacggtccaagcagtctggacaa

SEQ ID NO: 664619 - DNA, 25 bp, Rattus norvegicus
ttcacggtccagcttcatgtaggat

SEQ ID NO: 664620 - DNA, 25 bp, Rattus norvegicus
ttcacggtccaggttcatgtaggat

SEQ ID NO: 664621 - DNA, 25 bp, Rattus norvegicus
ttcacggtgatgacttcctttcatg

SEQ ID NO: 664622 - DNA, 25 bp, Rattus norvegicus
ttcacggtgatgtcttcctttcatg

SEQ ID NO: 664623 - DNA, 25 bp, Rattus norvegicus
ttcacggttatgcacggcacacgct

SEQ ID NO: 664624 - DNA, 25 bp, Rattus norvegicus
ttcacggttatggacggcacacgct

SEQ ID NO: 664625 - DNA, 25 bp, Rattus norvegicus
ttcacggtttaacacaggacacaat

SEQ ID NO: 664626 - DNA, 25 bp, Rattus norvegicus
ttcacggtttaagacaggacacaat

SEQ ID NO: 664627 - DNA, 25 bp, Rattus norvegicus
ttcacggtttctcgttcttaagcac

SEQ ID NO: 664628 - DNA, 25 bp, Rattus norvegicus
ttcacggtttctggttcttaagcac

SEQ ID NO: 664629 - DNA, 25 bp, Rattus norvegicus
ttcacgtcagtgagtaaccaagcac

SEQ ID NO: 664630 - DNA, 25 bp, Rattus norvegicus
ttcacgtcagtgtgtaaccaagcac

SEQ ID NO: 664631 - DNA, 25 bp, Rattus norvegicus
ttcacgtcgcatcactgtgagcagt

SEQ ID NO: 664632 - DNA, 25 bp, Rattus norvegicus
ttcacgtcgcatgactgtgagcagt

SEQ ID NO: 664633 - DNA, 25 bp, Rattus norvegicus
ttcacgtctgccaaccatgtgtgtt

SEQ ID NO: 664634 - DNA, 25 bp, Rattus norvegicus
ttcacgtctgcctaccatgtgtgtt

SEQ ID NO: 664635 - DNA, 25 bp, Rattus norvegicus
ttcacgtgcaatagaacgcttcatt

SEQ ID NO: 664636 - DNA, 25 bp, Rattus norvegicus
ttcacgtgcaattgaacgcttcatt

SEQ ID NO: 664637 - DNA, 25 bp, Rattus norvegicus
ttcacgtggaagaacttggcgtagt

SEQ ID NO: 664638 - DNA, 25 bp, Rattus norvegicus
ttcacgtggaagtacttggcgtagt

SEQ ID NO: 664639 - DNA, 25 bp, Rattus norvegicus
ttcacgtggcctagtcttgtgtaga

SEQ ID NO: 664640 - DNA, 25 bp, Rattus norvegicus
ttcacgtggccttgtcttgtgtaga

SEQ ID NO: 664641 - DNA, 25 bp, Rattus norvegicus
ttcacgtttcatcaccaactggtag

SEQ ID NO: 664642 - DNA, 25 bp, Rattus norvegicus
ttcacgtttcatgaccaactggtag

SEQ ID NO: 664643 - DNA, 25 bp, Rattus norvegicus
ttcactaaccctatgcttccacagt

SEQ ID NO: 664644 - DNA, 25 bp, Rattus norvegicus
ttcactaaccctttgcttccacagt

SEQ ID NO: 664645 - DNA, 25 bp, Rattus norvegicus
ttcactacccatcggtgttcattta

SEQ ID NO: 664646 - DNA, 25 bp, Rattus norvegicus
ttcactacccatgggtgttcattta

SEQ ID NO: 664647 - DNA, 25 bp, Rattus norvegicus
ttcactacctcgatttctctttctg

SEQ ID NO: 664648 - DNA, 25 bp, Rattus norvegicus
ttcactacctcgttttctctttctg

SEQ ID NO: 664649 - DNA, 25 bp, Rattus norvegicus
ttcactagcaacaatgtttcccaga

SEQ ID NO: 664650 - DNA, 25 bp, Rattus norvegicus
ttcactagcaactatgtttcccaga

SEQ ID NO: 664651 - DNA, 25 bp, Rattus norvegicus
ttcactagctctcggtggcctggaa

SEQ ID NO: 664652 - DNA, 25 bp, Rattus norvegicus
ttcactagctctgggtggcctggaa

SEQ ID NO: 664653 - DNA, 25 bp, Rattus norvegicus
ttcactatgtgaccttggctggctt

SEQ ID NO: 664654 - DNA, 25 bp, Rattus norvegicus
ttcactatgtgagcttggctggctt

SEQ ID NO: 664655 - DNA, 25 bp, Rattus norvegicus
ttcactcaatcccaggttacctaaa

SEQ ID NO: 664656 - DNA, 25 bp, Rattus norvegicus
ttcactcaatccgaggttacctaaa

SEQ ID NO: 664657 - DNA, 25 bp, Rattus norvegicus
ttcactcaccacatacatctcaaag

SEQ ID NO: 664658 - DNA, 25 bp, Rattus norvegicus
ttcactcaccacttacatctcaaag

SEQ ID NO: 664659 - DNA, 25 bp, Rattus norvegicus
ttcactcacccgcttctgtatgagc

SEQ ID NO: 664660 - DNA, 25 bp, Rattus norvegicus
ttcactcacccggttctgtatgagc

SEQ ID NO: 664661 - DNA, 25 bp, Rattus norvegicus
ttcactcagaagaccacgctgcacg

SEQ ID NO: 664662 - DNA, 25 bp, Rattus norvegicus
ttcactcagaagtccacgctgcacg

SEQ ID NO: 664663 - DNA, 25 bp, Rattus norvegicus
ttcactcagaggagcccataggaga

SEQ ID NO: 664664 - DNA, 25 bp, Rattus norvegicus
ttcactcagaggtgcccataggaga

SEQ ID NO: 664665 - DNA, 25 bp, Rattus norvegicus
ttcactcagggtatactttctagat

SEQ ID NO: 664666 - DNA, 25 bp, Rattus norvegicus
ttcactcagggtttactttctagat

SEQ ID NO: 664667 - DNA, 25 bp, Rattus norvegicus
ttcactcagtggagaaccctggcaa

SEQ ID NO: 664668 - DNA, 25 bp, Rattus norvegicus
ttcactcagtggtgaaccctggcaa

SEQ ID NO: 664669 - DNA, 25 bp, Rattus norvegicus
ttcactcatccgatgcctataaaat

SEQ ID NO: 664670 - DNA, 25 bp, Rattus norvegicus
ttcactcatccgttgcctataaaat

SEQ ID NO: 664671 - DNA, 25 bp, Rattus norvegicus
ttcactccagagcagcaggtctcag

SEQ ID NO: 664672 - DNA, 25 bp, Rattus norvegicus
ttcactccagaggagcaggtctcag

SEQ ID NO: 664673 - DNA, 25 bp, Rattus norvegicus
ttcactccagcaagtgggtcagtta

SEQ ID NO: 664674 - DNA, 25 bp, Rattus norvegicus
ttcactccagcatgtgggtcagtta

SEQ ID NO: 664675 - DNA, 25 bp, Rattus norvegicus
ttcactccatggaagctggcagctt

SEQ ID NO: 664676 - DNA, 25 bp, Rattus norvegicus
ttcactccatggtagctggcagctt

SEQ ID NO: 664677 - DNA, 25 bp, Rattus norvegicus
ttcactccatgtcctgttttccaga

SEQ ID NO: 664678 - DNA, 25 bp, Rattus norvegicus
ttcactccatgtgctgttttccaga

SEQ ID NO: 664679 - DNA, 25 bp, Rattus norvegicus
ttcactcccaccagtcttaagaagt

SEQ ID NO: 664680 - DNA, 25 bp, Rattus norvegicus
ttcactcccacctgtcttaagaagt

SEQ ID NO: 664681 - DNA, 25 bp, Rattus norvegicus
ttcactcccagtacaacagtcttat

SEQ ID NO: 664682 - DNA, 25 bp, Rattus norvegicus
ttcactcccagttcaacagtcttat

SEQ ID NO: 664683 - DNA, 25 bp, Rattus norvegicus
ttcactcccctgcaatttgaaattg

SEQ ID NO: 664684 - DNA, 25 bp, Rattus norvegicus
ttcactcccctggaatttgaaattg

SEQ ID NO: 664685 - DNA, 25 bp, Rattus norvegicus
ttcactccgcgtagaaagtttgtct

SEQ ID NO: 664686 - DNA, 25 bp, Rattus norvegicus
ttcactccgcgttgaaagtttgtct

SEQ ID NO: 664687 - DNA, 25 bp, Rattus norvegicus
ttcactcctgacaccagttctaaat

SEQ ID NO: 664688 - DNA, 25 bp, Rattus norvegicus
ttcactcctgactccagttctaaat

SEQ ID NO: 664689 - DNA, 25 bp, Rattus norvegicus
ttcactcctttaccattgtccaaat

SEQ ID NO: 664690 - DNA, 25 bp, Rattus norvegicus
ttcactcctttagcattgtccaaat

SEQ ID NO: 664691 - DNA, 25 bp, Rattus norvegicus
ttcactcgcactaagcctatgctta

SEQ ID NO: 664692 - DNA, 25 bp, Rattus norvegicus
ttcactcgcacttagcctatgctta

SEQ ID NO: 664693 - DNA, 25 bp, Rattus norvegicus
ttcactcggaagaagtcaaatgtct

SEQ ID NO: 664694 - DNA, 25 bp, Rattus norvegicus
ttcactcggaagtagtcaaatgtct

SEQ ID NO: 664695 - DNA, 25 bp, Rattus norvegicus
ttcactcggcaacgtatgttattct

SEQ ID NO: 664696 - DNA, 25 bp, Rattus norvegicus
ttcactcggcaaggtatgttattct

SEQ ID NO: 664697 - DNA, 25 bp, Rattus norvegicus
ttcactcgggatattcatgtttgtt

SEQ ID NO: 664698 - DNA, 25 bp, Rattus norvegicus
ttcactcgggattttcatgtttgtt

SEQ ID NO: 664699 - DNA, 25 bp, Rattus norvegicus
ttcactcggtgcaggctgccagggt

SEQ ID NO: 664700 - DNA, 25 bp, Rattus norvegicus
ttcactcggtgctggctgccagggt

SEQ ID NO: 664701 - DNA, 25 bp, Rattus norvegicus
ttcactcgtgtgatgcagaaaactt

SEQ ID NO: 664702 - DNA, 25 bp, Rattus norvegicus
ttcactcgtgtgttgcagaaaactt

SEQ ID NO: 664703 - DNA, 25 bp, Rattus norvegicus
ttcactctcactactgactgggaac

SEQ ID NO: 664704 - DNA, 25 bp, Rattus norvegicus
ttcactctcacttctgactgggaac

SEQ ID NO: 664705 - DNA, 25 bp, Rattus norvegicus
ttcactctgcatctggaaacataat

SEQ ID NO: 664706 - DNA, 25 bp, Rattus norvegicus
ttcactctgcatgtggaaacataat

SEQ ID NO: 664707 - DNA, 25 bp, Rattus norvegicus
ttcactctggccattggctaaggag

SEQ ID NO: 664708 - DNA, 25 bp, Rattus norvegicus
ttcactctggcctttggctaaggag

SEQ ID NO: 664709 - DNA, 25 bp, Rattus norvegicus
ttcactctgtaccactctatatcaa

SEQ ID NO: 664710 - DNA, 25 bp, Rattus norvegicus
ttcactctgtacgactctatatcaa

SEQ ID NO: 664711 - DNA, 25 bp, Rattus norvegicus
ttcactctgttgagacgaggtggcg

SEQ ID NO: 664712 - DNA, 25 bp, Rattus norvegicus
ttcactctgttgtgacgaggtggcg

SEQ ID NO: 664713 - DNA, 25 bp, Rattus norvegicus
ttcactcttgcactggacccaggct

SEQ ID NO: 664714 - DNA, 25 bp, Rattus norvegicus
ttcactcttgcagtggacccaggct

SEQ ID NO: 664715 - DNA, 25 bp, Rattus norvegicus
ttcactcttggaagtattttcactc

SEQ ID NO: 664716 - DNA, 25 bp, Rattus norvegicus
ttcactcttggatgtattttcactc

SEQ ID NO: 664717 - DNA, 25 bp, Rattus norvegicus
ttcactcttggcattgtcctggcta

SEQ ID NO: 664718 - DNA, 25 bp, Rattus norvegicus
ttcactcttggctttgtcctggcta

SEQ ID NO: 664719 - DNA, 25 bp, Rattus norvegicus
ttcactcttttcatttctcttctgt

SEQ ID NO: 664720 - DNA, 25 bp, Rattus norvegicus
ttcactcttttcttttctcttctgt

SEQ ID NO: 664721 - DNA, 25 bp, Rattus norvegicus
ttcactgaactactcaatgcgggat

SEQ ID NO: 664722 - DNA, 25 bp, Rattus norvegicus
ttcactgaactagtcaatgcgggat

SEQ ID NO: 664723 - DNA, 25 bp, Rattus norvegicus
ttcactgaccctccaggacaagagt

SEQ ID NO: 664724 - DNA, 25 bp, Rattus norvegicus
ttcactgaccctgcaggacaagagt

SEQ ID NO: 664725 - DNA, 25 bp, Rattus norvegicus
ttcactgagagcaccattgcgcctc

SEQ ID NO: 664726 - DNA, 25 bp, Rattus norvegicus
ttcactgagagctccattgcgcctc

SEQ ID NO: 664727 - DNA, 25 bp, Rattus norvegicus
ttcactgagtggatcctaagctgtt

SEQ ID NO: 664728 - DNA, 25 bp, Rattus norvegicus
ttcactgagtggttcctaagctgtt

SEQ ID NO: 664729 - DNA, 25 bp, Rattus norvegicus
ttcactgatcttccttatccctggt

SEQ ID NO: 664730 - DNA, 25 bp, Rattus norvegicus
ttcactgatcttgcttatccctggt

SEQ ID NO: 664731 - DNA, 25 bp, Rattus norvegicus
ttcactgatgtgaatgcctttctgg

SEQ ID NO: 664732 - DNA, 25 bp, Rattus norvegicus
ttcactgatgtgtatgcctttctgg

SEQ ID NO: 664733 - DNA, 25 bp, Rattus norvegicus
ttcactgcagtccatctagcgcgta

SEQ ID NO: 664734 - DNA, 25 bp, Rattus norvegicus
ttcactgcagtcgatctagcgcgta

SEQ ID NO: 664735 - DNA, 25 bp, Rattus norvegicus
ttcactgcctagcattggctgtcct

SEQ ID NO: 664736 - DNA, 25 bp, Rattus norvegicus
ttcactgcctaggattggctgtcct

SEQ ID NO: 664737 - DNA, 25 bp, Rattus norvegicus
ttcactgccttcagttcagtgggag

SEQ ID NO: 664738 - DNA, 25 bp, Rattus norvegicus
ttcactgccttctgttcagtgggag

SEQ ID NO: 664739 - DNA, 25 bp, Rattus norvegicus
ttcactgcggagatctaccggcgga

SEQ ID NO: 664740 - DNA, 25 bp, Rattus norvegicus
ttcactgcggagttctaccggcgga

SEQ ID NO: 664741 - DNA, 25 bp, Rattus norvegicus
ttcactgcgggacacagtccgggcc

SEQ ID NO: 664742 - DNA, 25 bp, Rattus norvegicus
ttcactgcgggagacagtccgggcc

SEQ ID NO: 664743 - DNA, 25 bp, Rattus norvegicus
ttcactgcggtgacctggattcagc

SEQ ID NO: 664744 - DNA, 25 bp, Rattus norvegicus
ttcactgcggtgtcctggattcagc

SEQ ID NO: 664745 - DNA, 25 bp, Rattus norvegicus
ttcactgctcataaatctgccttga

SEQ ID NO: 664746 - DNA, 25 bp, Rattus norvegicus
ttcactgctcattaatctgccttga

SEQ ID NO: 664747 - DNA, 25 bp, Rattus norvegicus
ttcactgctctgagctacccaaaga

SEQ ID NO: 664748 - DNA, 25 bp, Rattus norvegicus
ttcactgctctgtgctacccaaaga

SEQ ID NO: 664749 - DNA, 25 bp, Rattus norvegicus
ttcactgctgaacctgggagctatg

SEQ ID NO: 664750 - DNA, 25 bp, Rattus norvegicus
ttcactgctgaagctgggagctatg

SEQ ID NO: 664751 - DNA, 25 bp, Rattus norvegicus
ttcactgctgtaactattcccatcg

SEQ ID NO: 664752 - DNA, 25 bp, Rattus norvegicus
ttcactgctgtatctattcccatcg

SEQ ID NO: 664753 - DNA, 25 bp, Rattus norvegicus
ttcactggaaacctttcacttcacc

SEQ ID NO: 664754 - DNA, 25 bp, Rattus norvegicus
ttcactggaaacgtttcacttcacc

SEQ ID NO: 664755 - DNA, 25 bp, Rattus norvegicus
ttcactggacatatcctgctggtta

SEQ ID NO: 664756 - DNA, 25 bp, Rattus norvegicus
ttcactggacatttcctgctggtta

SEQ ID NO: 664757 - DNA, 25 bp, Rattus norvegicus
ttcactggattcaggcttgtttgga

SEQ ID NO: 664758 - DNA, 25 bp, Rattus norvegicus
ttcactggattctggcttgtttgga

SEQ ID NO: 664759 - DNA, 25 bp, Rattus norvegicus
ttcactggccaccagtcagacatca

SEQ ID NO: 664760 - DNA, 25 bp, Rattus norvegicus
ttcactggccacgagtcagacatca

SEQ ID NO: 664761 - DNA, 25 bp, Rattus norvegicus
ttcactggccctatctcaataaagt

SEQ ID NO: 664762 - DNA, 25 bp, Rattus norvegicus
ttcactggccctttctcaataaagt

SEQ ID NO: 664763 - DNA, 25 bp, Rattus norvegicus
ttcactggccgcctctttggctgag

SEQ ID NO: 664764 - DNA, 25 bp, Rattus norvegicus
ttcactggccgcgtctttggctgag

SEQ ID NO: 664765 - DNA, 25 bp, Rattus norvegicus
ttcactggcctgagtcagcagcatt

SEQ ID NO: 664766 - DNA, 25 bp, Rattus norvegicus
ttcactggcctgtgtcagcagcatt

SEQ ID NO: 664767 - DNA, 25 bp, Rattus norvegicus
ttcactgggtaccaagagatgcaca

SEQ ID NO: 664768 - DNA, 25 bp, Rattus norvegicus
ttcactgggtacgaagagatgcaca

SEQ ID NO: 664769 - DNA, 25 bp, Rattus norvegicus
ttcactgggtttaggtgatcaccaa

SEQ ID NO: 664770 - DNA, 25 bp, Rattus norvegicus
ttcactgggttttggtgatcaccaa

SEQ ID NO: 664771 - DNA, 25 bp, Rattus norvegicus
ttcactggtaatccctttccatgct

SEQ ID NO: 664772 - DNA, 25 bp, Rattus norvegicus
ttcactggtaatgcctttccatgct

SEQ ID NO: 664773 - DNA, 25 bp, Rattus norvegicus
ttcactgtacctcagcgtgcaactc

SEQ ID NO: 664774 - DNA, 25 bp, Rattus norvegicus
ttcactgtacctgagcgtgcaactc

SEQ ID NO: 664775 - DNA, 25 bp, Rattus norvegicus
ttcactgtacttcgtctgcagaacc

SEQ ID NO: 664776 - DNA, 25 bp, Rattus norvegicus
ttcactgtacttggtctgcagaacc

SEQ ID NO: 664777 - DNA, 25 bp, Rattus norvegicus
ttcactgtagcccaacctatataat

SEQ ID NO: 664778 - DNA, 25 bp, Rattus norvegicus
ttcactgtagccgaacctatataat

SEQ ID NO: 664779 - DNA, 25 bp, Rattus norvegicus
ttcactgtagctctcctcacaggaa

SEQ ID NO: 664780 - DNA, 25 bp, Rattus norvegicus
ttcactgtagctgtcctcacaggaa

SEQ ID NO: 664781 - DNA, 25 bp, Rattus norvegicus
ttcactgtagtaccaggttttcact

SEQ ID NO: 664782 - DNA, 25 bp, Rattus norvegicus
ttcactgtagtagcaggttttcact

SEQ ID NO: 664783 - DNA, 25 bp, Rattus norvegicus
ttcactgtatcgaggacaccaggca

SEQ ID NO: 664784 - DNA, 25 bp, Rattus norvegicus
ttcactgtatcgtggacaccaggca

SEQ ID NO: 664785 - DNA, 25 bp, Rattus norvegicus
ttcactgtgcccaaaaggtcctgag

SEQ ID NO: 664786 - DNA, 25 bp, Rattus norvegicus
ttcactgtgccctaaaggtcctgag

SEQ ID NO: 664787 - DNA, 25 bp, Rattus norvegicus
ttcactgtgtacacactggtacatt

SEQ ID NO: 664788 - DNA, 25 bp, Rattus norvegicus
ttcactgtgtactcactggtacatt

SEQ ID NO: 664789 - DNA, 25 bp, Rattus norvegicus
ttcactgtgtggactcatcctttat

SEQ ID NO: 664790 - DNA, 25 bp, Rattus norvegicus
ttcactgtgtggtctcatcctttat

SEQ ID NO: 664791 - DNA, 25 bp, Rattus norvegicus
ttcactgttaaaagctgctgaggct

SEQ ID NO: 664792 - DNA, 25 bp, Rattus norvegicus
ttcactgttaaatgctgctgaggct

SEQ ID NO: 664793 - DNA, 25 bp, Rattus norvegicus
ttcactgttacccttgactattgtc

SEQ ID NO: 664794 - DNA, 25 bp, Rattus norvegicus
ttcactgttaccgttgactattgtc

SEQ ID NO: 664795 - DNA, 25 bp, Rattus norvegicus
ttcactgttcgcctagtcggtttag

SEQ ID NO: 664796 - DNA, 25 bp, Rattus norvegicus
ttcactgttcgcgtagtcggtttag

SEQ ID NO: 664797 - DNA, 25 bp, Rattus norvegicus
ttcacttaagcactcagcatcatcc

SEQ ID NO: 664798 - DNA, 25 bp, Rattus norvegicus
ttcacttaagcagtcagcatcatcc

SEQ ID NO: 664799 - DNA, 25 bp, Rattus norvegicus
ttcacttaccatcaccactgacaat

SEQ ID NO: 664800 - DNA, 25 bp, Rattus norvegicus
ttcacttaccatgaccactgacaat

SEQ ID NO: 664801 - DNA, 25 bp, Rattus norvegicus
ttcacttacttgaaggatcccgcag

SEQ ID NO: 664802 - DNA, 25 bp, Rattus norvegicus
ttcacttacttgtaggatcccgcag

SEQ ID NO: 664803 - DNA, 25 bp, Rattus norvegicus
ttcacttagcagcagagctggctga

SEQ ID NO: 664804 - DNA, 25 bp, Rattus norvegicus
ttcacttagcaggagagctggctga

SEQ ID NO: 664805 - DNA, 25 bp, Rattus norvegicus
ttcacttagtctcggtattggccta

SEQ ID NO: 664806 - DNA, 25 bp, Rattus norvegicus
ttcacttagtctgggtattggccta

SEQ ID NO: 664807 - DNA, 25 bp, Rattus norvegicus
ttcacttatttaatccatcggtaga

SEQ ID NO: 664808 - DNA, 25 bp, Rattus norvegicus
ttcacttatttattccatcggtaga

SEQ ID NO: 664809 - DNA, 25 bp, Rattus norvegicus
ttcacttatttgaggcggctggagt

SEQ ID NO: 664810 - DNA, 25 bp, Rattus norvegicus
ttcacttatttgtggcggctggagt

SEQ ID NO: 664811 - DNA, 25 bp, Rattus norvegicus
ttcacttcacctatgtgtggctaga

SEQ ID NO: 664812 - DNA, 25 bp, Rattus norvegicus
ttcacttcacctttgtgtggctaga

SEQ ID NO: 664813 - DNA, 25 bp, Rattus norvegicus
ttcacttcaggcacttcaagataca

SEQ ID NO: 664814 - DNA, 25 bp, Rattus norvegicus
ttcacttcaggctcttcaagataca

SEQ ID NO: 664815 - DNA, 25 bp, Rattus norvegicus
ttcacttccacaccgagtcggaata

SEQ ID NO: 664816 - DNA, 25 bp, Rattus norvegicus
ttcacttccacagcgagtcggaata

SEQ ID NO: 664817 - DNA, 25 bp, Rattus norvegicus
ttcacttccagactaccctcataat

SEQ ID NO: 664818 - DNA, 25 bp, Rattus norvegicus
ttcacttccagagtaccctcataat

SEQ ID NO: 664819 - DNA, 25 bp, Rattus norvegicus
ttcacttcgaaacctgctatttggc

SEQ ID NO: 664820 - DNA, 25 bp, Rattus norvegicus
ttcacttcgaaagctgctatttggc

SEQ ID NO: 664821 - DNA, 25 bp, Rattus norvegicus
ttcacttcggtcacttgggaagcca

SEQ ID NO: 664822 - DNA, 25 bp, Rattus norvegicus
ttcacttcggtctcttgggaagcca

SEQ ID NO: 664823 - DNA, 25 bp, Rattus norvegicus
ttcacttcgtggaacactaccgcga

SEQ ID NO: 664824 - DNA, 25 bp, Rattus norvegicus
ttcacttcgtggtacactaccgcga

SEQ ID NO: 664825 - DNA, 25 bp, Rattus norvegicus
ttcacttctaaactggccctgctag

SEQ ID NO: 664826 - DNA, 25 bp, Rattus norvegicus
ttcacttctaaagtggccctgctag

SEQ ID NO: 664827 - DNA, 25 bp, Rattus norvegicus
ttcacttctattccccacataaaat

SEQ ID NO: 664828 - DNA, 25 bp, Rattus norvegicus
ttcacttctattgcccacataaaat

SEQ ID NO: 664829 - DNA, 25 bp, Rattus norvegicus
ttcacttctcaaaaaatcgggtcat

SEQ ID NO: 664830 - DNA, 25 bp, Rattus norvegicus
ttcacttctcaataaatcgggtcat

SEQ ID NO: 664831 - DNA, 25 bp, Rattus norvegicus
ttcacttctgccatctgtaaactgc

SEQ ID NO: 664832 - DNA, 25 bp, Rattus norvegicus
ttcacttctgccttctgtaaactgc

SEQ ID NO: 664833 - DNA, 25 bp, Rattus norvegicus
ttcacttctggtacctgtgtcttta

SEQ ID NO: 664834 - DNA, 25 bp, Rattus norvegicus
ttcacttctggttcctgtgtcttta

SEQ ID NO: 664835 - DNA, 25 bp, Rattus norvegicus
ttcacttctgtgctttcttggattt

SEQ ID NO: 664836 - DNA, 25 bp, Rattus norvegicus
ttcacttctgtggtttcttggattt

SEQ ID NO: 664837 - DNA, 25 bp, Rattus norvegicus
ttcacttcttcccaaaaatccacat

SEQ ID NO: 664838 - DNA, 25 bp, Rattus norvegicus
ttcacttcttccgaaaaatccacat

SEQ ID NO: 664839 - DNA, 25 bp, Rattus norvegicus
ttcacttcttttcagcctcattgta

SEQ ID NO: 664840 - DNA, 25 bp, Rattus norvegicus
ttcacttcttttgagcctcattgta

SEQ ID NO: 664841 - DNA, 25 bp, Rattus norvegicus
ttcacttgacacctacacatgcgtg

SEQ ID NO: 664842 - DNA, 25 bp, Rattus norvegicus
ttcacttgacacgtacacatgcgtg

SEQ ID NO: 664843 - DNA, 25 bp, Rattus norvegicus
ttcacttgagtcctagtcttactgt

SEQ ID NO: 664844 - DNA, 25 bp, Rattus norvegicus
ttcacttgagtcgtagtcttactgt

SEQ ID NO: 664845 - DNA, 25 bp, Rattus norvegicus
ttcacttgccctagtattctattgg

SEQ ID NO: 664846 - DNA, 25 bp, Rattus norvegicus
ttcacttgcccttgtattctattgg

SEQ ID NO: 664847 - DNA, 25 bp, Rattus norvegicus
ttcacttgctatctggatgcgggtc

SEQ ID NO: 664848 - DNA, 25 bp, Rattus norvegicus
ttcacttgctatgtggatgcgggtc

SEQ ID NO: 664849 - DNA, 25 bp, Rattus norvegicus
ttcacttgcttcacaactgaccctg

SEQ ID NO: 664850 - DNA, 25 bp, Rattus norvegicus
ttcacttgcttctcaactgaccctg

SEQ ID NO: 664851 - DNA, 25 bp, Rattus norvegicus
ttcacttgctttcttccttactctg

SEQ ID NO: 664852 - DNA, 25 bp, Rattus norvegicus
ttcacttgctttgttccttactctg

SEQ ID NO: 664853 - DNA, 25 bp, Rattus norvegicus
ttcacttggccgatgtggtatgcaa

SEQ ID NO: 664854 - DNA, 25 bp, Rattus norvegicus
ttcacttggccgttgtggtatgcaa

SEQ ID NO: 664855 - DNA, 25 bp, Rattus norvegicus
ttcacttgggatcccttggacctgg

SEQ ID NO: 664856 - DNA, 25 bp, Rattus norvegicus
ttcacttgggatgccttggacctgg

SEQ ID NO: 664857 - DNA, 25 bp, Rattus norvegicus
ttcacttgggtgattcgcctccaaa

SEQ ID NO: 664858 - DNA, 25 bp, Rattus norvegicus
ttcacttgggtgtttcgcctccaaa

SEQ ID NO: 664859 - DNA, 25 bp, Rattus norvegicus
ttcacttggttcattttgtttcaca

SEQ ID NO: 664860 - DNA, 25 bp, Rattus norvegicus
ttcacttggttctttttgtttcaca

SEQ ID NO: 664861 - DNA, 25 bp, Rattus norvegicus
ttcactttacatcctcttatacaga

SEQ ID NO: 664862 - DNA, 25 bp, Rattus norvegicus
ttcactttacatgctcttatacaga

SEQ ID NO: 664863 - DNA, 25 bp, Rattus norvegicus
ttcactttcctcctggacactatta

SEQ ID NO: 664864 - DNA, 25 bp, Rattus norvegicus
ttcactttcctcgtggacactatta

SEQ ID NO: 664865 - DNA, 25 bp, Rattus norvegicus
ttcactttcctgaacccagaaccag

SEQ ID NO: 664866 - DNA, 25 bp, Rattus norvegicus
ttcactttcctgtacccagaaccag

SEQ ID NO: 664867 - DNA, 25 bp, Rattus norvegicus
ttcactttcgctctgggatttctca

SEQ ID NO: 664868 - DNA, 25 bp, Rattus norvegicus
ttcactttcgctgtgggatttctca

SEQ ID NO: 664869 - DNA, 25 bp, Rattus norvegicus
ttcactttgaacaaagccatcctag

SEQ ID NO: 664870 - DNA, 25 bp, Rattus norvegicus
ttcactttgaactaagccatcctag

SEQ ID NO: 664871 - DNA, 25 bp, Rattus norvegicus
ttcactttgcccataacacttgcct

SEQ ID NO: 664872 - DNA, 25 bp, Rattus norvegicus
ttcactttgcccttaacacttgcct

SEQ ID NO: 664873 - DNA, 25 bp, Rattus norvegicus
ttcactttggaaacacagcaggcag

SEQ ID NO: 664874 - DNA, 25 bp, Rattus norvegicus
ttcactttggaatcacagcaggcag

SEQ ID NO: 664875 - DNA, 25 bp, Rattus norvegicus
ttcactttgtgcaacctgacgagga

SEQ ID NO: 664876 - DNA, 25 bp, Rattus norvegicus
ttcactttgtgctacctgacgagga

SEQ ID NO: 664877 - DNA, 25 bp, Rattus norvegicus
ttcacttttctcattggcccagggc

SEQ ID NO: 664878 - DNA, 25 bp, Rattus norvegicus
ttcacttttctctttggcccagggc

SEQ ID NO: 664879 - DNA, 25 bp, Rattus norvegicus
ttcacttttgcaaggttccacagag

SEQ ID NO: 664880 - DNA, 25 bp, Rattus norvegicus
ttcacttttgcatggttccacagag

SEQ ID NO: 664881 - DNA, 25 bp, Rattus norvegicus
ttcacttttgggatgtacatttaat

SEQ ID NO: 664882 - DNA, 25 bp, Rattus norvegicus
ttcacttttgggttgtacatttaat

SEQ ID NO: 664883 - DNA, 25 bp, Rattus norvegicus
ttcacttttgttattatctacctct

SEQ ID NO: 664884 - DNA, 25 bp, Rattus norvegicus
ttcacttttgtttttatctacctct

SEQ ID NO: 664885 - DNA, 25 bp, Rattus norvegicus
ttcactttttttcctcccactctaa

SEQ ID NO: 664886 - DNA, 25 bp, Rattus norvegicus
ttcactttttttgctcccactctaa

SEQ ID NO: 664887 - DNA, 25 bp, Rattus norvegicus
ttcagaaaatccaccacggacttgc

SEQ ID NO: 664888 - DNA, 25 bp, Rattus norvegicus
ttcagaaaatcctccacggacttgc

SEQ ID NO: 664889 - DNA, 25 bp, Rattus norvegicus
ttcagaaacaccagttccctaaggc

SEQ ID NO: 664890 - DNA, 25 bp, Rattus norvegicus
ttcagaaacacctgttccctaaggc

SEQ ID NO: 664891 - DNA, 25 bp, Rattus norvegicus
ttcagaaagcatacatggtaacagt

SEQ ID NO: 664892 - DNA, 25 bp, Rattus norvegicus
ttcagaaagcattcatggtaacagt

SEQ ID NO: 664893 - DNA, 25 bp, Rattus norvegicus
ttcagaaaggccagaagtgccaaga

SEQ ID NO: 664894 - DNA, 25 bp, Rattus norvegicus
ttcagaaaggcctgaagtgccaaga

SEQ ID NO: 664895 - DNA, 25 bp, Rattus norvegicus
ttcagaaatcctcgctggacgtagt

SEQ ID NO: 664896 - DNA, 25 bp, Rattus norvegicus
ttcagaaatcctggctggacgtagt

SEQ ID NO: 664897 - DNA, 25 bp, Rattus norvegicus
ttcagaaatcttactgcttgccttt

SEQ ID NO: 664898 - DNA, 25 bp, Rattus norvegicus
ttcagaaatctttctgcttgccttt

SEQ ID NO: 664899 - DNA, 25 bp, Rattus norvegicus
ttcagaacacacacaagtcccatgg

SEQ ID NO: 664900 - DNA, 25 bp, Rattus norvegicus
ttcagaacacactcaagtcccatgg

SEQ ID NO: 664901 - DNA, 25 bp, Rattus norvegicus
ttcagaacactgactttcacctact

SEQ ID NO: 664902 - DNA, 25 bp, Rattus norvegicus
ttcagaacactgtctttcacctact

SEQ ID NO: 664903 - DNA, 25 bp, Rattus norvegicus
ttcagaacccacattggtggaggca

SEQ ID NO: 664904 - DNA, 25 bp, Rattus norvegicus
ttcagaacccactttggtggaggca

SEQ ID NO: 664905 - DNA, 25 bp, Rattus norvegicus
ttcagaacccagattctggcattat

SEQ ID NO: 664906 - DNA, 25 bp, Rattus norvegicus
ttcagaacccagtttctggcattat

SEQ ID NO: 664907 - DNA, 25 bp, Rattus norvegicus
ttcagaacggtaaccggtcccgaga

SEQ ID NO: 664908 - DNA, 25 bp, Rattus norvegicus
ttcagaacggtatccggtcccgaga

SEQ ID NO: 664909 - DNA, 25 bp, Rattus norvegicus
ttcagaactatcatgtccctgctgg

SEQ ID NO: 664910 - DNA, 25 bp, Rattus norvegicus
ttcagaactatcttgtccctgctgg

SEQ ID NO: 664911 - DNA, 25 bp, Rattus norvegicus
ttcagaactgacagaccacagggtc

SEQ ID NO: 664912 - DNA, 25 bp, Rattus norvegicus
ttcagaactgactgaccacagggtc

SEQ ID NO: 664913 - DNA, 25 bp, Rattus norvegicus
ttcagaacttaccaggccccaaagg

SEQ ID NO: 664914 - DNA, 25 bp, Rattus norvegicus
ttcagaacttacgaggccccaaagg

SEQ ID NO: 664915 - DNA, 25 bp, Rattus norvegicus
ttcagaagacgcagagcttctcctg

SEQ ID NO: 664916 - DNA, 25 bp, Rattus norvegicus
ttcagaagacgctgagcttctcctg

SEQ ID NO: 664917 - DNA, 25 bp, Rattus norvegicus
ttcagaagcctaacctgacctcgga

SEQ ID NO: 664918 - DNA, 25 bp, Rattus norvegicus
ttcagaagcctatcctgacctcgga

SEQ ID NO: 664919 - DNA, 25 bp, Rattus norvegicus
ttcagaagcttgacgtctccagtgc

SEQ ID NO: 664920 - DNA, 25 bp, Rattus norvegicus
ttcagaagcttgtcgtctccagtgc

SEQ ID NO: 664921 - DNA, 25 bp, Rattus norvegicus
ttcagaagggtgaagcccgtaactt

SEQ ID NO: 664922 - DNA, 25 bp, Rattus norvegicus
ttcagaagggtgtagcccgtaactt

SEQ ID NO: 664923 - DNA, 25 bp, Rattus norvegicus
ttcagaagtatcaccaaggccatgg

SEQ ID NO: 664924 - DNA, 25 bp, Rattus norvegicus
ttcagaagtatctccaaggccatgg

SEQ ID NO: 664925 - DNA, 25 bp, Rattus norvegicus
ttcagaagttttcccacagcacctg

SEQ ID NO: 664926 - DNA, 25 bp, Rattus norvegicus
ttcagaagttttgccacagcacctg

SEQ ID NO: 664927 - DNA, 25 bp, Rattus norvegicus
ttcagaatcctaactctgcactcat

SEQ ID NO: 664928 - DNA, 25 bp, Rattus norvegicus
ttcagaatcctatctctgcactcat

SEQ ID NO: 664929 - DNA, 25 bp, Rattus norvegicus
ttcagaatctttctgggcgctcgga

SEQ ID NO: 664930 - DNA, 25 bp, Rattus norvegicus
ttcagaatctttgtgggcgctcgga

SEQ ID NO: 664931 - DNA, 25 bp, Rattus norvegicus
ttcagaatgcttatgcgcccttgac

SEQ ID NO: 664932 - DNA, 25 bp, Rattus norvegicus
ttcagaatgcttttgcgcccttgac

SEQ ID NO: 664933 - DNA, 25 bp, Rattus norvegicus
ttcagaatggcaacctacttccttt

SEQ ID NO: 664934 - DNA, 25 bp, Rattus norvegicus
ttcagaatggcatcctacttccttt

SEQ ID NO: 664935 - DNA, 25 bp, Rattus norvegicus
ttcagaattctcagacttacatcga

SEQ ID NO: 664936 - DNA, 25 bp, Rattus norvegicus
ttcagaattctctgacttacatcga

SEQ ID NO: 664937 - DNA, 25 bp, Rattus norvegicus
ttcagaattctgactgttcctcctc

SEQ ID NO: 664938 - DNA, 25 bp, Rattus norvegicus
ttcagaattctgtctgttcctcctc

SEQ ID NO: 664939 - DNA, 25 bp, Rattus norvegicus
ttcagacaacttatcctacatttta

SEQ ID NO: 664940 - DNA, 25 bp, Rattus norvegicus
ttcagacaacttttcctacatttta

SEQ ID NO: 664941 - DNA, 25 bp, Rattus norvegicus
ttcagacaagttaccatgcctcgtt

SEQ ID NO: 664942 - DNA, 25 bp, Rattus norvegicus
ttcagacaagtttccatgcctcgtt

SEQ ID NO: 664943 - DNA, 25 bp, Rattus norvegicus
ttcagacaccacaccattagcaata

SEQ ID NO: 664944 - DNA, 25 bp, Rattus norvegicus
ttcagacaccactccattagcaata

SEQ ID NO: 664945 - DNA, 25 bp, Rattus norvegicus
ttcagacacccacagcagccttaga

SEQ ID NO: 664946 - DNA, 25 bp, Rattus norvegicus
ttcagacacccagagcagccttaga

SEQ ID NO: 664947 - DNA, 25 bp, Rattus norvegicus
ttcagacaccttaggcaactgggat

SEQ ID NO: 664948 - DNA, 25 bp, Rattus norvegicus
ttcagacacctttggcaactgggat

SEQ ID NO: 664949 - DNA, 25 bp, Rattus norvegicus
ttcagacagagtcagggcatccctc

SEQ ID NO: 664950 - DNA, 25 bp, Rattus norvegicus
ttcagacagagtgagggcatccctc

SEQ ID NO: 664951 - DNA, 25 bp, Rattus norvegicus
ttcagacagccacaactcacacttg

SEQ ID NO: 664952 - DNA, 25 bp, Rattus norvegicus
ttcagacagccagaactcacacttg

SEQ ID NO: 664953 - DNA, 25 bp, Rattus norvegicus
ttcagacagctgactcaagacgaaa

SEQ ID NO: 664954 - DNA, 25 bp, Rattus norvegicus
ttcagacagctgtctcaagacgaaa

SEQ ID NO: 664955 - DNA, 25 bp, Rattus norvegicus
ttcagacagcttagcttctactcag

SEQ ID NO: 664956 - DNA, 25 bp, Rattus norvegicus
ttcagacagctttgcttctactcag

SEQ ID NO: 664957 - DNA, 25 bp, Rattus norvegicus
ttcagacaggccatctgccgcgtgt

SEQ ID NO: 664958 - DNA, 25 bp, Rattus norvegicus
ttcagacaggccttctgccgcgtgt

SEQ ID NO: 664959 - DNA, 25 bp, Rattus norvegicus
ttcagacagtttcttttccctcaaa

SEQ ID NO: 664960 - DNA, 25 bp, Rattus norvegicus
ttcagacagtttgttttccctcaaa

SEQ ID NO: 664961 - DNA, 25 bp, Rattus norvegicus
ttcagacatcctcaggatcttccag

SEQ ID NO: 664962 - DNA, 25 bp, Rattus norvegicus
ttcagacatcctgaggatcttccag

SEQ ID NO: 664963 - DNA, 25 bp, Rattus norvegicus
ttcagacatggaccaacccgggagt

SEQ ID NO: 664964 - DNA, 25 bp, Rattus norvegicus
ttcagacatggagcaacccgggagt

SEQ ID NO: 664965 - DNA, 25 bp, Rattus norvegicus
ttcagacatttcaccatctacctaa

SEQ ID NO: 664966 - DNA, 25 bp, Rattus norvegicus
ttcagacatttctccatctacctaa

SEQ ID NO: 664967 - DNA, 25 bp, Rattus norvegicus
ttcagacatttgactgcctgttcca

SEQ ID NO: 664968 - DNA, 25 bp, Rattus norvegicus
ttcagacatttgtctgcctgttcca

SEQ ID NO: 664969 - DNA, 25 bp, Rattus norvegicus
ttcagaccatggaggacacgctgca

SEQ ID NO: 664970 - DNA, 25 bp, Rattus norvegicus
ttcagaccatggtggacacgctgca

SEQ ID NO: 664971 - DNA, 25 bp, Rattus norvegicus
ttcagacccactcaggatctgtctc

SEQ ID NO: 664972 - DNA, 25 bp, Rattus norvegicus
ttcagacccactgaggatctgtctc

SEQ ID NO: 664973 - DNA, 25 bp, Rattus norvegicus
ttcagaccctggaacccaagcagag

SEQ ID NO: 664974 - DNA, 25 bp, Rattus norvegicus
ttcagaccctggtacccaagcagag

SEQ ID NO: 664975 - DNA, 25 bp, Rattus norvegicus
ttcagaccgctacaatggaagactt

SEQ ID NO: 664976 - DNA, 25 bp, Rattus norvegicus
ttcagaccgctagaatggaagactt

SEQ ID NO: 664977 - DNA, 25 bp, Rattus norvegicus
ttcagaccttcaaaactgtggcctg

SEQ ID NO: 664978 - DNA, 25 bp, Rattus norvegicus
ttcagaccttcataactgtggcctg

SEQ ID NO: 664979 - DNA, 25 bp, Rattus norvegicus
ttcagacgaagcagagcgcctggaa

SEQ ID NO: 664980 - DNA, 25 bp, Rattus norvegicus
ttcagacgaagctgagcgcctggaa

SEQ ID NO: 664981 - DNA, 25 bp, Rattus norvegicus
ttcagacggattcgctcgcggaagt

SEQ ID NO: 664982 - DNA, 25 bp, Rattus norvegicus
ttcagacggattggctcgcggaagt

SEQ ID NO: 664983 - DNA, 25 bp, Rattus norvegicus
ttcagacggcacacaaacactggtg

SEQ ID NO: 664984 - DNA, 25 bp, Rattus norvegicus
ttcagacggcactcaaacactggtg

SEQ ID NO: 664985 - DNA, 25 bp, Rattus norvegicus
ttcagacggtgacgcggctcctgcc

SEQ ID NO: 664986 - DNA, 25 bp, Rattus norvegicus
ttcagacggtgaggcggctcctgcc

SEQ ID NO: 664987 - DNA, 25 bp, Rattus norvegicus
ttcagactcggtattccttacaata

SEQ ID NO: 664988 - DNA, 25 bp, Rattus norvegicus
ttcagactcggttttccttacaata

SEQ ID NO: 664989 - DNA, 25 bp, Rattus norvegicus
ttcagactctgtcccattcgttggg

SEQ ID NO: 664990 - DNA, 25 bp, Rattus norvegicus
ttcagactctgtgccattcgttggg

SEQ ID NO: 664991 - DNA, 25 bp, Rattus norvegicus
ttcagactgaagagaactgcgacag

SEQ ID NO: 664992 - DNA, 25 bp, Rattus norvegicus
ttcagactgaagtgaactgcgacag

SEQ ID NO: 664993 - DNA, 25 bp, Rattus norvegicus
ttcagactgcgtccctgccttgttg

SEQ ID NO: 664994 - DNA, 25 bp, Rattus norvegicus
ttcagactgcgtgcctgccttgttg

SEQ ID NO: 664995 - DNA, 25 bp, Rattus norvegicus
ttcagactgctgacacctgtccttc

SEQ ID NO: 664996 - DNA, 25 bp, Rattus norvegicus
ttcagactgctgtcacctgtccttc

SEQ ID NO: 664997 - DNA, 25 bp, Rattus norvegicus
ttcagactggccatcagagggcagc

SEQ ID NO: 664998 - DNA, 25 bp, Rattus norvegicus
ttcagactggccttcagagggcagc

SEQ ID NO: 664999 - DNA, 25 bp, Rattus norvegicus
ttcagacttcctcctctatcataaa

SEQ ID NO: 665000 - DNA, 25 bp, Rattus norvegicus
ttcagacttcctgctctatcataaa

SEQ ID NO: 665001 - DNA, 25 bp, Rattus norvegicus
ttcagacttgctatggccattgcag

SEQ ID NO: 665002 - DNA, 25 bp, Rattus norvegicus
ttcagacttgctttggccattgcag

SEQ ID NO: 665003 - DNA, 25 bp, Rattus norvegicus
ttcagagaacccatctgtgccagga

SEQ ID NO: 665004 - DNA, 25 bp, Rattus norvegicus
ttcagagaacccttctgtgccagga

SEQ ID NO: 665005 - DNA, 25 bp, Rattus norvegicus
ttcagagaacctatctgctcacggg

SEQ ID NO: 665006 - DNA, 25 bp, Rattus norvegicus
ttcagagaacctttctgctcacggg

SEQ ID NO: 665007 - DNA, 25 bp, Rattus norvegicus
ttcagagaacttctgagcccttcca

SEQ ID NO: 665008 - DNA, 25 bp, Rattus norvegicus
ttcagagaacttgtgagcccttcca

SEQ ID NO: 665009 - DNA, 25 bp, Rattus norvegicus
ttcagagacatcaagcaagttagag

SEQ ID NO: 665010 - DNA, 25 bp, Rattus norvegicus
ttcagagacatctagcaagttagag

SEQ ID NO: 665011 - DNA, 25 bp, Rattus norvegicus
ttcagagacatgagtgcaaggctga

SEQ ID NO: 665012 - DNA, 25 bp, Rattus norvegicus
ttcagagacatgctgccctcacagt

SEQ ID NO: 665013 - DNA, 25 bp, Rattus norvegicus
ttcagagacatggtgccctcacagt

SEQ ID NO: 665014 - DNA, 25 bp, Rattus norvegicus
ttcagagacatgtgtgcaaggctga

SEQ ID NO: 665015 - DNA, 25 bp, Rattus norvegicus
ttcagagaccggaccaacctcatca

SEQ ID NO: 665016 - DNA, 25 bp, Rattus norvegicus
ttcagagaccggtccaacctcatca

SEQ ID NO: 665017 - DNA, 25 bp, Rattus norvegicus
ttcagagacctacggccgaacatct

SEQ ID NO: 665018 - DNA, 25 bp, Rattus norvegicus
ttcagagacctagggccgaacatct

SEQ ID NO: 665019 - DNA, 25 bp, Rattus norvegicus
ttcagagacctccagtccgagggat

SEQ ID NO: 665020 - DNA, 25 bp, Rattus norvegicus
ttcagagacctcgagtccgagggat

SEQ ID NO: 665021 - DNA, 25 bp, Rattus norvegicus
ttcagagacgtcatctccagcgcag

SEQ ID NO: 665022 - DNA, 25 bp, Rattus norvegicus
ttcagagacgtcttctccagcgcag

SEQ ID NO: 665023 - DNA, 25 bp, Rattus norvegicus
ttcagagagcctccacgggtgattc

SEQ ID NO: 665024 - DNA, 25 bp, Rattus norvegicus
ttcagagagcctgcacgggtgattc

SEQ ID NO: 665025 - DNA, 25 bp, Rattus norvegicus
ttcagagagcttagggctggcagca

SEQ ID NO: 665026 - DNA, 25 bp, Rattus norvegicus
ttcagagagctttgggctggcagca

SEQ ID NO: 665027 - DNA, 25 bp, Rattus norvegicus
ttcagagagggcacaagagagacta

SEQ ID NO: 665028 - DNA, 25 bp, Rattus norvegicus
ttcagagagggctcaagagagacta

SEQ ID NO: 665029 - DNA, 25 bp, Rattus norvegicus
ttcagagaggtgcactgactccagt

SEQ ID NO: 665030 - DNA, 25 bp, Rattus norvegicus
ttcagagaggtggactgactccagt

SEQ ID NO: 665031 - DNA, 25 bp, Rattus norvegicus
ttcagagatcagacattcagggcgt

SEQ ID NO: 665032 - DNA, 25 bp, Rattus norvegicus
ttcagagatcagtcattcagggcgt

SEQ ID NO: 665033 - DNA, 25 bp, Rattus norvegicus
ttcagagcaagccaatgccaagtgc

SEQ ID NO: 665034 - DNA, 25 bp, Rattus norvegicus
ttcagagcaagcgaatgccaagtgc

SEQ ID NO: 665035 - DNA, 25 bp, Rattus norvegicus
ttcagagcaatccactactgccaga

SEQ ID NO: 665036 - DNA, 25 bp, Rattus norvegicus
ttcagagcaatcgactactgccaga

SEQ ID NO: 665037 - DNA, 25 bp, Rattus norvegicus
ttcagagcagcacccttgcaggaga

SEQ ID NO: 665038 - DNA, 25 bp, Rattus norvegicus
ttcagagcagcagccttgcaggaga

SEQ ID NO: 665039 - DNA, 25 bp, Rattus norvegicus
ttcagagcatccatctctcaggtta

SEQ ID NO: 665040 - DNA, 25 bp, Rattus norvegicus
ttcagagcatccttctctcaggtta

SEQ ID NO: 665041 - DNA, 25 bp, Rattus norvegicus
ttcagagccccgaatgcgtttgttt

SEQ ID NO: 665042 - DNA, 25 bp, Rattus norvegicus
ttcagagccccgtatgcgtttgttt

SEQ ID NO: 665043 - DNA, 25 bp, Rattus norvegicus
ttcagagctaggacccactgctgtg

SEQ ID NO: 665044 - DNA, 25 bp, Rattus norvegicus
ttcagagctaggtcccactgctgtg

SEQ ID NO: 665045 - DNA, 25 bp, Rattus norvegicus
ttcagagcttaccaccgaatggctt

SEQ ID NO: 665046 - DNA, 25 bp, Rattus norvegicus
ttcagagcttacgaccgaatggctt

SEQ ID NO: 665047 - DNA, 25 bp, Rattus norvegicus
ttcagaggacagactccatggacaa

SEQ ID NO: 665048 - DNA, 25 bp, Rattus norvegicus
ttcagaggacagtctccatggacaa

SEQ ID NO: 665049 - DNA, 25 bp, Rattus norvegicus
ttcagaggagagaatcaggctatct

SEQ ID NO: 665050 - DNA, 25 bp, Rattus norvegicus
ttcagaggagagtatcaggctatct

SEQ ID NO: 665051 - DNA, 25 bp, Rattus norvegicus
ttcagaggcagcagacaacctagtg

SEQ ID NO: 665052 - DNA, 25 bp, Rattus norvegicus
ttcagaggcagctgacaacctagtg

SEQ ID NO: 665053 - DNA, 25 bp, Rattus norvegicus
ttcagaggcggcacatggctatggt

SEQ ID NO: 665054 - DNA, 25 bp, Rattus norvegicus
ttcagaggcggctcatggctatggt

SEQ ID NO: 665055 - DNA, 25 bp, Rattus norvegicus
ttcagagggaggctcctcttcattc

SEQ ID NO: 665056 - DNA, 25 bp, Rattus norvegicus
ttcagagggagggtcctcttcattc

SEQ ID NO: 665057 - DNA, 25 bp, Rattus norvegicus
ttcagagggccacttcagtccagtg

SEQ ID NO: 665058 - DNA, 25 bp, Rattus norvegicus
ttcagagggccagttcagtccagtg

SEQ ID NO: 665059 - DNA, 25 bp, Rattus norvegicus
ttcagaggtccgagctacaaggcaa

SEQ ID NO: 665060 - DNA, 25 bp, Rattus norvegicus
ttcagaggtccgtgctacaaggcaa

SEQ ID NO: 665061 - DNA, 25 bp, Rattus norvegicus
ttcagaggtcctcgaggctggattt

SEQ ID NO: 665062 - DNA, 25 bp, Rattus norvegicus
ttcagaggtcctcgttcttggcaag

SEQ ID NO: 665063 - DNA, 25 bp, Rattus norvegicus
ttcagaggtcctggaggctggattt

SEQ ID NO: 665064 - DNA, 25 bp, Rattus norvegicus
ttcagaggtcctggttcttggcaag

SEQ ID NO: 665065 - DNA, 25 bp, Rattus norvegicus
ttcagaggtcttcgtgttcacattt

SEQ ID NO: 665066 - DNA, 25 bp, Rattus norvegicus
ttcagaggtcttggtgttcacattt

SEQ ID NO: 665067 - DNA, 25 bp, Rattus norvegicus
ttcagaggtgcgaaaaagcttttgt

SEQ ID NO: 665068 - DNA, 25 bp, Rattus norvegicus
ttcagaggtgcgtaaaagcttttgt

SEQ ID NO: 665069 - DNA, 25 bp, Rattus norvegicus
ttcagagtaaaacaaaggcaccaat

SEQ ID NO: 665070 - DNA, 25 bp, Rattus norvegicus
ttcagagtaaaagaaaggcaccaat

SEQ ID NO: 665071 - DNA, 25 bp, Rattus norvegicus
ttcagagtagtgatcccttcttgac

SEQ ID NO: 665072 - DNA, 25 bp, Rattus norvegicus
ttcagagtagtgttcccttcttgac

SEQ ID NO: 665073 - DNA, 25 bp, Rattus norvegicus
ttcagagtcctgaggcgtggtctgt

SEQ ID NO: 665074 - DNA, 25 bp, Rattus norvegicus
ttcagagtcctgtggcgtggtctgt

SEQ ID NO: 665075 - DNA, 25 bp, Rattus norvegicus
ttcagagtctatatgtgtgcactgg

SEQ ID NO: 665076 - DNA, 25 bp, Rattus norvegicus
ttcagagtctatttgtgtgcactgg

SEQ ID NO: 665077 - DNA, 25 bp, Rattus norvegicus
ttcagagtgaataagtagggcagct

SEQ ID NO: 665078 - DNA, 25 bp, Rattus norvegicus
ttcagagtgaattagtagggcagct

SEQ ID NO: 665079 - DNA, 25 bp, Rattus norvegicus
ttcagagtgcaaacaaatcctatgg

SEQ ID NO: 665080 - DNA, 25 bp, Rattus norvegicus
ttcagagtgcaatcaaatcctatgg

SEQ ID NO: 665081 - DNA, 25 bp, Rattus norvegicus
ttcagagtgcccaagccaagtgttt

SEQ ID NO: 665082 - DNA, 25 bp, Rattus norvegicus
ttcagagtgccctagccaagtgttt

SEQ ID NO: 665083 - DNA, 25 bp, Rattus norvegicus
ttcagagttcagcagatttaatcga

SEQ ID NO: 665084 - DNA, 25 bp, Rattus norvegicus
ttcagagttcaggagatttaatcga

SEQ ID NO: 665085 - DNA, 25 bp, Rattus norvegicus
ttcagagttgacagcttgtgctact

SEQ ID NO: 665086 - DNA, 25 bp, Rattus norvegicus
ttcagagttgactgcttgtgctact

SEQ ID NO: 665087 - DNA, 25 bp, Rattus norvegicus
ttcagagttttaacagctccctcag

SEQ ID NO: 665088 - DNA, 25 bp, Rattus norvegicus
ttcagagttttatcagctccctcag

SEQ ID NO: 665089 - DNA, 25 bp, Rattus norvegicus
ttcagataacccagggccaccttgg

SEQ ID NO: 665090 - DNA, 25 bp, Rattus norvegicus
ttcagataaccctgggccaccttgg

SEQ ID NO: 665091 - DNA, 25 bp, Rattus norvegicus
ttcagatagccaaacccgtcgatta

SEQ ID NO: 665092 - DNA, 25 bp, Rattus norvegicus
ttcagatagccatacccgtcgatta

SEQ ID NO: 665093 - DNA, 25 bp, Rattus norvegicus
ttcagatcagcgaggcagcatctct

SEQ ID NO: 665094 - DNA, 25 bp, Rattus norvegicus
ttcagatcagcgtggcagcatctct

SEQ ID NO: 665095 - DNA, 25 bp, Rattus norvegicus
ttcagatcccaaacctctaagtgct

SEQ ID NO: 665096 - DNA, 25 bp, Rattus norvegicus
ttcagatcccaatcctctaagtgct

SEQ ID NO: 665097 - DNA, 25 bp, Rattus norvegicus
ttcagatcccagacaccgcaagagg

SEQ ID NO: 665098 - DNA, 25 bp, Rattus norvegicus
ttcagatcccagcagccaacattat

SEQ ID NO: 665099 - DNA, 25 bp, Rattus norvegicus
ttcagatcccaggagccaacattat

SEQ ID NO: 665100 - DNA, 25 bp, Rattus norvegicus
ttcagatcccagtcaccgcaagagg

SEQ ID NO: 665101 - DNA, 25 bp, Rattus norvegicus
ttcagatccgtcaggaggctcctgg

SEQ ID NO: 665102 - DNA, 25 bp, Rattus norvegicus
ttcagatccgtctggaggctcctgg

SEQ ID NO: 665103 - DNA, 25 bp, Rattus norvegicus
ttcagatcctcactggacccagagg

SEQ ID NO: 665104 - DNA, 25 bp, Rattus norvegicus
ttcagatcctcagtggacccagagg

SEQ ID NO: 665105 - DNA, 25 bp, Rattus norvegicus
ttcagatctacaccctaatgcacag

SEQ ID NO: 665106 - DNA, 25 bp, Rattus norvegicus
ttcagatctacagcctaatgcacag

SEQ ID NO: 665107 - DNA, 25 bp, Rattus norvegicus
ttcagatctcagctcaggcgtcttt

SEQ ID NO: 665108 - DNA, 25 bp, Rattus norvegicus
ttcagatctcaggtcaggcgtcttt

SEQ ID NO: 665109 - DNA, 25 bp, Rattus norvegicus
ttcagatcttgaagcccagtaccca

SEQ ID NO: 665110 - DNA, 25 bp, Rattus norvegicus
ttcagatcttgatgcccagtaccca

SEQ ID NO: 665111 - DNA, 25 bp, Rattus norvegicus
ttcagatgaaggagaagtgcttgct

SEQ ID NO: 665112 - DNA, 25 bp, Rattus norvegicus
ttcagatgaaggtgaagtgcttgct

SEQ ID NO: 665113 - DNA, 25 bp, Rattus norvegicus
ttcagatgcccaccctgaggatgtt

SEQ ID NO: 665114 - DNA, 25 bp, Rattus norvegicus
ttcagatgcccagcctgaggatgtt

SEQ ID NO: 665115 - DNA, 25 bp, Rattus norvegicus
ttcagatgcttcagtctctcagtag

SEQ ID NO: 665116 - DNA, 25 bp, Rattus norvegicus
ttcagatgcttctgtctctcagtag

SEQ ID NO: 665117 - DNA, 25 bp, Rattus norvegicus
ttcagatggaaacgcccacgttctc

SEQ ID NO: 665118 - DNA, 25 bp, Rattus norvegicus
ttcagatggaaaggcccacgttctc

SEQ ID NO: 665119 - DNA, 25 bp, Rattus norvegicus
ttcagatggccaaattcaggattcc

SEQ ID NO: 665120 - DNA, 25 bp, Rattus norvegicus
ttcagatggccatattcaggattcc

SEQ ID NO: 665121 - DNA, 25 bp, Rattus norvegicus
ttcagatggctccaggtgctcctgc

SEQ ID NO: 665122 - DNA, 25 bp, Rattus norvegicus
ttcagatggctcgaggtgctcctgc

SEQ ID NO: 665123 - DNA, 25 bp, Rattus norvegicus
ttcagatgggtcctttttctctcac

SEQ ID NO: 665124 - DNA, 25 bp, Rattus norvegicus
ttcagatgggtcgtttttctctcac

SEQ ID NO: 665125 - DNA, 25 bp, Rattus norvegicus
ttcagatgtcctaggctcctgtggg

SEQ ID NO: 665126 - DNA, 25 bp, Rattus norvegicus
ttcagatgtccttggctcctgtggg

SEQ ID NO: 665127 - DNA, 25 bp, Rattus norvegicus
ttcagatgtctgcaaacaccaccac

SEQ ID NO: 665128 - DNA, 25 bp, Rattus norvegicus
ttcagatgtctggaaacaccaccac

SEQ ID NO: 665129 - DNA, 25 bp, Rattus norvegicus
ttcagatgtgtcatcgggcgctcta

SEQ ID NO: 665130 - DNA, 25 bp, Rattus norvegicus
ttcagatgtgtcttcgggcgctcta

SEQ ID NO: 665131 - DNA, 25 bp, Rattus norvegicus
ttcagattccttccttcattcagag

SEQ ID NO: 665132 - DNA, 25 bp, Rattus norvegicus
ttcagattccttgcttcattcagag

SEQ ID NO: 665133 - DNA, 25 bp, Rattus norvegicus
ttcagattgctaagttcctattttc

SEQ ID NO: 665134 - DNA, 25 bp, Rattus norvegicus
ttcagattgctatgttcctattttc

SEQ ID NO: 665135 - DNA, 25 bp, Rattus norvegicus
ttcagattgtaccagcttagctagc

SEQ ID NO: 665136 - DNA, 25 bp, Rattus norvegicus
ttcagattgtacgagcttagctagc

SEQ ID NO: 665137 - DNA, 25 bp, Rattus norvegicus
ttcagatttgttaggagttgacctt

SEQ ID NO: 665138 - DNA, 25 bp, Rattus norvegicus
ttcagatttgtttggagttgacctt

SEQ ID NO: 665139 - DNA, 25 bp, Rattus norvegicus
ttcagcaaaccaaaaatcctacctt

SEQ ID NO: 665140 - DNA, 25 bp, Rattus norvegicus
ttcagcaaaccataaatcctacctt

SEQ ID NO: 665141 - DNA, 25 bp, Rattus norvegicus
ttcagcaacgtccacttcagcagct

SEQ ID NO: 665142 - DNA, 25 bp, Rattus norvegicus
ttcagcaacgtcgacttcagcagct

SEQ ID NO: 665143 - DNA, 25 bp, Rattus norvegicus
ttcagcaagacaacatccgactcaa

SEQ ID NO: 665144 - DNA, 25 bp, Rattus norvegicus
ttcagcaagacatcatccgactcaa

SEQ ID NO: 665145 - DNA, 25 bp, Rattus norvegicus
ttcagcaagctcatcacgacctgag

SEQ ID NO: 665146 - DNA, 25 bp, Rattus norvegicus
ttcagcaagctcttcacgacctgag

SEQ ID NO: 665147 - DNA, 25 bp, Rattus norvegicus
ttcagcaagtatactgtctcagagg

SEQ ID NO: 665148 - DNA, 25 bp, Rattus norvegicus
ttcagcaagtattctgtctcagagg

SEQ ID NO: 665149 - DNA, 25 bp, Rattus norvegicus
ttcagcaatctgagcctgttgctcc

SEQ ID NO: 665150 - DNA, 25 bp, Rattus norvegicus
ttcagcaatctgtgcctgttgctcc

SEQ ID NO: 665151 - DNA, 25 bp, Rattus norvegicus
ttcagcaatggcacctattttacta

SEQ ID NO: 665152 - DNA, 25 bp, Rattus norvegicus
ttcagcaatggctcctattttacta

SEQ ID NO: 665153 - DNA, 25 bp, Rattus norvegicus
ttcagcacaaccctacatgtacata

SEQ ID NO: 665154 - DNA, 25 bp, Rattus norvegicus
ttcagcacaaccgtacatgtacata

SEQ ID NO: 665155 - DNA, 25 bp, Rattus norvegicus
ttcagcacagccaaaattacccttt

SEQ ID NO: 665156 - DNA, 25 bp, Rattus norvegicus
ttcagcacagcctaaattacccttt

SEQ ID NO: 665157 - DNA, 25 bp, Rattus norvegicus
ttcagcacattccttacaaacctac

SEQ ID NO: 665158 - DNA, 25 bp, Rattus norvegicus
ttcagcacattcgttacaaacctac

SEQ ID NO: 665159 - DNA, 25 bp, Rattus norvegicus
ttcagcaccaacaacttgcaaccag

SEQ ID NO: 665160 - DNA, 25 bp, Rattus norvegicus
ttcagcaccaactacttgcaaccag

SEQ ID NO: 665161 - DNA, 25 bp, Rattus norvegicus
ttcagcaccagccaaggccggagga

SEQ ID NO: 665162 - DNA, 25 bp, Rattus norvegicus
ttcagcaccagcgaaggccggagga

SEQ ID NO: 665163 - DNA, 25 bp, Rattus norvegicus
ttcagcacccacctggtaggtggtt

SEQ ID NO: 665164 - DNA, 25 bp, Rattus norvegicus
ttcagcacccacgtggtaggtggtt

SEQ ID NO: 665165 - DNA, 25 bp, Rattus norvegicus
ttcagcagaatgaagccctggcagc

SEQ ID NO: 665166 - DNA, 25 bp, Rattus norvegicus
ttcagcagaatgtagccctggcagc

SEQ ID NO: 665167 - DNA, 25 bp, Rattus norvegicus
ttcagcagacagcagacagcctcct

SEQ ID NO: 665168 - DNA, 25 bp, Rattus norvegicus
ttcagcagacaggagacagcctcct

SEQ ID NO: 665169 - DNA, 25 bp, Rattus norvegicus
ttcagcagactgatttcaagactca

SEQ ID NO: 665170 - DNA, 25 bp, Rattus norvegicus
ttcagcagactgctgcccactggtg

SEQ ID NO: 665171 - DNA, 25 bp, Rattus norvegicus
ttcagcagactggtgcccactggtg

SEQ ID NO: 665172 - DNA, 25 bp, Rattus norvegicus
ttcagcagactgttttcaagactca

SEQ ID NO: 665173 - DNA, 25 bp, Rattus norvegicus
ttcagcagagttcggctcctggagc

SEQ ID NO: 665174 - DNA, 25 bp, Rattus norvegicus
ttcagcagagttgggctcctggagc

SEQ ID NO: 665175 - DNA, 25 bp, Rattus norvegicus
ttcagcagcattcttcggcaggtaa

SEQ ID NO: 665176 - DNA, 25 bp, Rattus norvegicus
ttcagcagcattgttcggcaggtaa

SEQ ID NO: 665177 - DNA, 25 bp, Rattus norvegicus
ttcagcagcttcacattgtggacta

SEQ ID NO: 665178 - DNA, 25 bp, Rattus norvegicus
ttcagcagcttctcattgtggacta

SEQ ID NO: 665179 - DNA, 25 bp, Rattus norvegicus
ttcagcaggcacaccttgggttagc

SEQ ID NO: 665180 - DNA, 25 bp, Rattus norvegicus
ttcagcaggcactccttgggttagc

SEQ ID NO: 665181 - DNA, 25 bp, Rattus norvegicus
ttcagcagggagatcttccgtcatg

SEQ ID NO: 665182 - DNA, 25 bp, Rattus norvegicus
ttcagcagggagttcttccgtcatg

SEQ ID NO: 665183 - DNA, 25 bp, Rattus norvegicus
ttcagcaggtaacggtgtctaccac

SEQ ID NO: 665184 - DNA, 25 bp, Rattus norvegicus
ttcagcaggtaagggtgtctaccac

SEQ ID NO: 665185 - DNA, 25 bp, Rattus norvegicus
ttcagcagtacccacccggaagaac

SEQ ID NO: 665186 - DNA, 25 bp, Rattus norvegicus
ttcagcagtaccgacccggaagaac

SEQ ID NO: 665187 - DNA, 25 bp, Rattus norvegicus
ttcagcagtagaaacttcccattca

SEQ ID NO: 665188 - DNA, 25 bp, Rattus norvegicus
ttcagcagtagatacttcccattca

SEQ ID NO: 665189 - DNA, 25 bp, Rattus norvegicus
ttcagcagtctaatgagcggctcct

SEQ ID NO: 665190 - DNA, 25 bp, Rattus norvegicus
ttcagcagtctattgagcggctcct

SEQ ID NO: 665191 - DNA, 25 bp, Rattus norvegicus
ttcagcagtggcaattgcgactata

SEQ ID NO: 665192 - DNA, 25 bp, Rattus norvegicus
ttcagcagtggctattgcgactata

SEQ ID NO: 665193 - DNA, 25 bp, Rattus norvegicus
ttcagcagttctcgatggcagtcct

SEQ ID NO: 665194 - DNA, 25 bp, Rattus norvegicus
ttcagcagttctggatggcagtcct

SEQ ID NO: 665195 - DNA, 25 bp, Rattus norvegicus
ttcagcatcattaatcacatctcaa

SEQ ID NO: 665196 - DNA, 25 bp, Rattus norvegicus
ttcagcatcatttatcacatctcaa

SEQ ID NO: 665197 - DNA, 25 bp, Rattus norvegicus
ttcagcatccagaggagccgccctg

SEQ ID NO: 665198 - DNA, 25 bp, Rattus norvegicus
ttcagcatccagtggagccgccctg

SEQ ID NO: 665199 - DNA, 25 bp, Rattus norvegicus
ttcagcatcctgctcaacatttact

SEQ ID NO: 665200 - DNA, 25 bp, Rattus norvegicus
ttcagcatcctggtcaacatttact

SEQ ID NO: 665201 - DNA, 25 bp, Rattus norvegicus
ttcagcatctgtagcctccagggac

SEQ ID NO: 665202 - DNA, 25 bp, Rattus norvegicus
ttcagcatctgtattggccagtttc

SEQ ID NO: 665203 - DNA, 25 bp, Rattus norvegicus
ttcagcatctgttgcctccagggac

SEQ ID NO: 665204 - DNA, 25 bp, Rattus norvegicus
ttcagcatctgttttggccagtttc

SEQ ID NO: 665205 - DNA, 25 bp, Rattus norvegicus
ttcagcatgattctgtgctgcgcca

SEQ ID NO: 665206 - DNA, 25 bp, Rattus norvegicus
ttcagcatgattgtgtgctgcgcca

SEQ ID NO: 665207 - DNA, 25 bp, Rattus norvegicus
ttcagcatgggtctgccttcataaa

SEQ ID NO: 665208 - DNA, 25 bp, Rattus norvegicus
ttcagcatgggtgtgccttcataaa

SEQ ID NO: 665209 - DNA, 25 bp, Rattus norvegicus
ttcagcatgtgcctcttaggtcgca

SEQ ID NO: 665210 - DNA, 25 bp, Rattus norvegicus
ttcagcatgtgcgtcttaggtcgca

SEQ ID NO: 665211 - DNA, 25 bp, Rattus norvegicus
ttcagcatttccatcacacttgcag

SEQ ID NO: 665212 - DNA, 25 bp, Rattus norvegicus
ttcagcatttccttcacacttgcag

SEQ ID NO: 665213 - DNA, 25 bp, Rattus norvegicus
ttcagccaaagacttaaccaggttc

SEQ ID NO: 665214 - DNA, 25 bp, Rattus norvegicus
ttcagccaaagagttaaccaggttc

SEQ ID NO: 665215 - DNA, 25 bp, Rattus norvegicus
ttcagccaaagcctccctgtgggag

SEQ ID NO: 665216 - DNA, 25 bp, Rattus norvegicus
ttcagccaaagcgtccctgtgggag

SEQ ID NO: 665217 - DNA, 25 bp, Rattus norvegicus
ttcagccaaggcaaattccctaaga

SEQ ID NO: 665218 - DNA, 25 bp, Rattus norvegicus
ttcagccaaggctaattccctaaga

SEQ ID NO: 665219 - DNA, 25 bp, Rattus norvegicus
ttcagccaagttcaacaccactgga

SEQ ID NO: 665220 - DNA, 25 bp, Rattus norvegicus
ttcagccaagttgaacaccactgga

SEQ ID NO: 665221 - DNA, 25 bp, Rattus norvegicus
ttcagccaatacaagataagccact

SEQ ID NO: 665222 - DNA, 25 bp, Rattus norvegicus
ttcagccaatactagataagccact

SEQ ID NO: 665223 - DNA, 25 bp, Rattus norvegicus
ttcagccaccagcagcctgaggaat

SEQ ID NO: 665224 - DNA, 25 bp, Rattus norvegicus
ttcagccaccaggagcctgaggaat

SEQ ID NO: 665225 - DNA, 25 bp, Rattus norvegicus
ttcagccaccttcatgctcagagag

SEQ ID NO: 665226 - DNA, 25 bp, Rattus norvegicus
ttcagccaccttgatgctcagagag

SEQ ID NO: 665227 - DNA, 25 bp, Rattus norvegicus
ttcagccacgccatcaggaagattt

SEQ ID NO: 665228 - DNA, 25 bp, Rattus norvegicus
ttcagccacgccttcaggaagattt

SEQ ID NO: 665229 - DNA, 25 bp, Rattus norvegicus
ttcagccacttcctagcagctgtat

SEQ ID NO: 665230 - DNA, 25 bp, Rattus norvegicus
ttcagccacttcgtagcagctgtat

SEQ ID NO: 665231 - DNA, 25 bp, Rattus norvegicus
ttcagccactttctttatccttaca

SEQ ID NO: 665232 - DNA, 25 bp, Rattus norvegicus
ttcagccactttgtttatccttaca

SEQ ID NO: 665233 - DNA, 25 bp, Rattus norvegicus
ttcagccagcacaacctactgggat

SEQ ID NO: 665234 - DNA, 25 bp, Rattus norvegicus
ttcagccagcactacctactgggat

SEQ ID NO: 665235 - DNA, 25 bp, Rattus norvegicus
ttcagccagctcagcaactgcagtg

SEQ ID NO: 665236 - DNA, 25 bp, Rattus norvegicus
ttcagccagctctgcaactgcagtg

SEQ ID NO: 665237 - DNA, 25 bp, Rattus norvegicus
ttcagccaggagcatctcgtgatat

SEQ ID NO: 665238 - DNA, 25 bp, Rattus norvegicus
ttcagccaggaggatctcgtgatat

SEQ ID NO: 665239 - DNA, 25 bp, Rattus norvegicus
ttcagccaggcaccgatctaccgga

SEQ ID NO: 665240 - DNA, 25 bp, Rattus norvegicus
ttcagccaggcagcgatctaccgga

SEQ ID NO: 665241 - DNA, 25 bp, Rattus norvegicus
ttcagccagtatacattcctaacgg

SEQ ID NO: 665242 - DNA, 25 bp, Rattus norvegicus
ttcagccagtattcattcctaacgg

SEQ ID NO: 665243 - DNA, 25 bp, Rattus norvegicus
ttcagccagttccttgtgcctgtca

SEQ ID NO: 665244 - DNA, 25 bp, Rattus norvegicus
ttcagccagttcgttgtgcctgtca

SEQ ID NO: 665245 - DNA, 25 bp, Rattus norvegicus
ttcagccatgccatttctgcaacct

SEQ ID NO: 665246 - DNA, 25 bp, Rattus norvegicus
ttcagccatgccttttctgcaacct

SEQ ID NO: 665247 - DNA, 25 bp, Rattus norvegicus
ttcagccatggcagcgagcatcctg

SEQ ID NO: 665248 - DNA, 25 bp, Rattus norvegicus
ttcagccatggctgcgagcatcctg

SEQ ID NO: 665249 - DNA, 25 bp, Rattus norvegicus
ttcagcccagaacaggtggacctcc

SEQ ID NO: 665250 - DNA, 25 bp, Rattus norvegicus
ttcagcccagaagaggtggacctcc

SEQ ID NO: 665251 - DNA, 25 bp, Rattus norvegicus
ttcagcccaggaaccactggccagg

SEQ ID NO: 665252 - DNA, 25 bp, Rattus norvegicus
ttcagcccaggatccactggccagg

SEQ ID NO: 665253 - DNA, 25 bp, Rattus norvegicus
ttcagcccatcacgctgtggtttga

SEQ ID NO: 665254 - DNA, 25 bp, Rattus norvegicus
ttcagcccatcaggctgtggtttga

SEQ ID NO: 665255 - DNA, 25 bp, Rattus norvegicus
ttcagcccatcccaggtgcaggaac

SEQ ID NO: 665256 - DNA, 25 bp, Rattus norvegicus
ttcagcccatccgaggtgcaggaac

SEQ ID NO: 665257 - DNA, 25 bp, Rattus norvegicus
ttcagccccaaaatgagtcccagtg

SEQ ID NO: 665258 - DNA, 25 bp, Rattus norvegicus
ttcagccccaaattgagtcccagtg

SEQ ID NO: 665259 - DNA, 25 bp, Rattus norvegicus
ttcagccccgcaaaagtcggtcagc

SEQ ID NO: 665260 - DNA, 25 bp, Rattus norvegicus
ttcagccccgcataagtcggtcagc

SEQ ID NO: 665261 - DNA, 25 bp, Rattus norvegicus
ttcagcccctgacacgcagaataat

SEQ ID NO: 665262 - DNA, 25 bp, Rattus norvegicus
ttcagcccctgagacgcagaataat

SEQ ID NO: 665263 - DNA, 25 bp, Rattus norvegicus
ttcagcccctgcaatgtaacattta

SEQ ID NO: 665264 - DNA, 25 bp, Rattus norvegicus
ttcagcccctgcatcgaacaggaaa

SEQ ID NO: 665265 - DNA, 25 bp, Rattus norvegicus
ttcagcccctgctatgtaacattta

SEQ ID NO: 665266 - DNA, 25 bp, Rattus norvegicus
ttcagcccctgcttcgaacaggaaa

SEQ ID NO: 665267 - DNA, 25 bp, Rattus norvegicus
ttcagcccctttacttctgagagta

SEQ ID NO: 665268 - DNA, 25 bp, Rattus norvegicus
ttcagccccttttcttctgagagta

SEQ ID NO: 665269 - DNA, 25 bp, Rattus norvegicus
ttcagcccgactccgggtacgtttg

SEQ ID NO: 665270 - DNA, 25 bp, Rattus norvegicus
ttcagcccgactgcgggtacgtttg

SEQ ID NO: 665271 - DNA, 25 bp, Rattus norvegicus
ttcagccctaagcacccagtcatta

SEQ ID NO: 665272 - DNA, 25 bp, Rattus norvegicus
ttcagccctaaggacccagtcatta

SEQ ID NO: 665273 - DNA, 25 bp, Rattus norvegicus
ttcagccctagccaactatgttgta

SEQ ID NO: 665274 - DNA, 25 bp, Rattus norvegicus
ttcagccctagcgaactatgttgta

SEQ ID NO: 665275 - DNA, 25 bp, Rattus norvegicus
ttcagccctcagaggcaggccagga

SEQ ID NO: 665276 - DNA, 25 bp, Rattus norvegicus
ttcagccctcagtggcaggccagga

SEQ ID NO: 665277 - DNA, 25 bp, Rattus norvegicus
ttcagccctgtcactttagtttgct

SEQ ID NO: 665278 - DNA, 25 bp, Rattus norvegicus
ttcagccctgtctctttagtttgct

SEQ ID NO: 665279 - DNA, 25 bp, Rattus norvegicus
ttcagcccttccagtggctgttagg

SEQ ID NO: 665280 - DNA, 25 bp, Rattus norvegicus
ttcagcccttcctgtggctgttagg

SEQ ID NO: 665281 - DNA, 25 bp, Rattus norvegicus
ttcagcccttggagactgaggtcaa

SEQ ID NO: 665282 - DNA, 25 bp, Rattus norvegicus
ttcagcccttggtgactgaggtcaa

SEQ ID NO: 665283 - DNA, 25 bp, Rattus norvegicus
ttcagccgatgcagagccctgggca

SEQ ID NO: 665284 - DNA, 25 bp, Rattus norvegicus
ttcagccgatgctgagccctgggca

SEQ ID NO: 665285 - DNA, 25 bp, Rattus norvegicus
ttcagccgcagccaaatagcattga

SEQ ID NO: 665286 - DNA, 25 bp, Rattus norvegicus
ttcagccgcagcgaaatagcattga

SEQ ID NO: 665287 - DNA, 25 bp, Rattus norvegicus
ttcagccgctcgctggttgagagaa

SEQ ID NO: 665288 - DNA, 25 bp, Rattus norvegicus
ttcagccgctcggtggttgagagaa

SEQ ID NO: 665289 - DNA, 25 bp, Rattus norvegicus
ttcagcctaataacatcttcacaag

SEQ ID NO: 665290 - DNA, 25 bp, Rattus norvegicus
ttcagcctaatatcatcttcacaag

SEQ ID NO: 665291 - DNA, 25 bp, Rattus norvegicus
ttcagcctagcaagtggacctcagc

SEQ ID NO: 665292 - DNA, 25 bp, Rattus norvegicus
ttcagcctagcatgtggacctcagc

SEQ ID NO: 665293 - DNA, 25 bp, Rattus norvegicus
ttcagcctccaaagtgctaatacta

SEQ ID NO: 665294 - DNA, 25 bp, Rattus norvegicus
ttcagcctccaatgtgctaatacta

SEQ ID NO: 665295 - DNA, 25 bp, Rattus norvegicus
ttcagcctccagcaaactgagtctc

SEQ ID NO: 665296 - DNA, 25 bp, Rattus norvegicus
ttcagcctccaggaaactgagtctc

SEQ ID NO: 665297 - DNA, 25 bp, Rattus norvegicus
ttcagcctcctaagcatgtggatca

SEQ ID NO: 665298 - DNA, 25 bp, Rattus norvegicus
ttcagcctcctatgcatgtggatca

SEQ ID NO: 665299 - DNA, 25 bp, Rattus norvegicus
ttcagcctcgacacttaaggaactc

SEQ ID NO: 665300 - DNA, 25 bp, Rattus norvegicus
ttcagcctcgactcttaaggaactc

SEQ ID NO: 665301 - DNA, 25 bp, Rattus norvegicus
ttcagcctctccacgtagccggagg

SEQ ID NO: 665302 - DNA, 25 bp, Rattus norvegicus
ttcagcctctcctcgtagccggagg

SEQ ID NO: 665303 - DNA, 25 bp, Rattus norvegicus
ttcagcctctttcagaagcacaacg

SEQ ID NO: 665304 - DNA, 25 bp, Rattus norvegicus
ttcagcctctttgagaagcacaacg

SEQ ID NO: 665305 - DNA, 25 bp, Rattus norvegicus
ttcagcctgcttagttcactgtgcc

SEQ ID NO: 665306 - DNA, 25 bp, Rattus norvegicus
ttcagcctgctttgttcactgtgcc

SEQ ID NO: 665307 - DNA, 25 bp, Rattus norvegicus
ttcagccttccaactgcaaaaggga

SEQ ID NO: 665308 - DNA, 25 bp, Rattus norvegicus
ttcagccttccatctgcaaaaggga

SEQ ID NO: 665309 - DNA, 25 bp, Rattus norvegicus
ttcagccttcggaaatagcccttgt

SEQ ID NO: 665310 - DNA, 25 bp, Rattus norvegicus
ttcagccttcggtaatagcccttgt

SEQ ID NO: 665311 - DNA, 25 bp, Rattus norvegicus
ttcagccttgacaatcctgtaggtt

SEQ ID NO: 665312 - DNA, 25 bp, Rattus norvegicus
ttcagccttgactatcctgtaggtt

SEQ ID NO: 665313 - DNA, 25 bp, Rattus norvegicus
ttcagcctttcacctgtcgctgtga

SEQ ID NO: 665314 - DNA, 25 bp, Rattus norvegicus
ttcagcctttcagctgtcgctgtga

SEQ ID NO: 665315 - DNA, 25 bp, Rattus norvegicus
ttcagcctttcccaagagagactta

SEQ ID NO: 665316 - DNA, 25 bp, Rattus norvegicus
ttcagcctttccgaagagagactta

SEQ ID NO: 665317 - DNA, 25 bp, Rattus norvegicus
ttcagccttttcagcgtcagtgtga

SEQ ID NO: 665318 - DNA, 25 bp, Rattus norvegicus
ttcagccttttctgcgtcagtgtga

SEQ ID NO: 665319 - DNA, 25 bp, Rattus norvegicus
ttcagccttttgctacagtttcttt

SEQ ID NO: 665320 - DNA, 25 bp, Rattus norvegicus
ttcagccttttggtacagtttcttt

SEQ ID NO: 665321 - DNA, 25 bp, Rattus norvegicus
ttcagcgcctacattgattccatgg

SEQ ID NO: 665322 - DNA, 25 bp, Rattus norvegicus
ttcagcgcctactttgattccatgg

SEQ ID NO: 665323 - DNA, 25 bp, Rattus norvegicus
ttcagcggatctacacagttggagt

SEQ ID NO: 665324 - DNA, 25 bp, Rattus norvegicus
ttcagcggatcttcacagttggagt

SEQ ID NO: 665325 - DNA, 25 bp, Rattus norvegicus
ttcagcggattacccacctataagt

SEQ ID NO: 665326 - DNA, 25 bp, Rattus norvegicus
ttcagcggattagccacctataagt

SEQ ID NO: 665327 - DNA, 25 bp, Rattus norvegicus
ttcagcgggctgcagcttcaagagc

SEQ ID NO: 665328 - DNA, 25 bp, Rattus norvegicus
ttcagcgggctggagcttcaagagc

SEQ ID NO: 665329 - DNA, 25 bp, Rattus norvegicus
ttcagcggttacctctccaatgtgg

SEQ ID NO: 665330 - DNA, 25 bp, Rattus norvegicus
ttcagcggttacgtctccaatgtgg

SEQ ID NO: 665331 - DNA, 25 bp, Rattus norvegicus
ttcagcggttgacttttggtggtac

SEQ ID NO: 665332 - DNA, 25 bp, Rattus norvegicus
ttcagcggttgagttttggtggtac

SEQ ID NO: 665333 - DNA, 25 bp, Rattus norvegicus
ttcagcgtcattaggcggcagtgga

SEQ ID NO: 665334 - DNA, 25 bp, Rattus norvegicus
ttcagcgtcatttggcggcagtgga

SEQ ID NO: 665335 - DNA, 25 bp, Rattus norvegicus
ttcagcgtcctgactattgggatca

SEQ ID NO: 665336 - DNA, 25 bp, Rattus norvegicus
ttcagcgtcctgtctattgggatca

SEQ ID NO: 665337 - DNA, 25 bp, Rattus norvegicus
ttcagctaacagcactccacataac

SEQ ID NO: 665338 - DNA, 25 bp, Rattus norvegicus
ttcagctaacaggactccacataac

SEQ ID NO: 665339 - DNA, 25 bp, Rattus norvegicus
ttcagctacagcctgtatggcatct

SEQ ID NO: 665340 - DNA, 25 bp, Rattus norvegicus
ttcagctacagcgtgtatggcatct

SEQ ID NO: 665341 - DNA, 25 bp, Rattus norvegicus
ttcagctacaggctgaccagcgcaa

SEQ ID NO: 665342 - DNA, 25 bp, Rattus norvegicus
ttcagctacagggtgaccagcgcaa

SEQ ID NO: 665343 - DNA, 25 bp, Rattus norvegicus
ttcagctactagagtgttccaggcc

SEQ ID NO: 665344 - DNA, 25 bp, Rattus norvegicus
ttcagctactagtgtgttccaggcc

SEQ ID NO: 665345 - DNA, 25 bp, Rattus norvegicus
ttcagctagaacactgctcacacgt

SEQ ID NO: 665346 - DNA, 25 bp, Rattus norvegicus
ttcagctagaactctgctcacacgt

SEQ ID NO: 665347 - DNA, 25 bp, Rattus norvegicus
ttcagctagtagatccgcagattct

SEQ ID NO: 665348 - DNA, 25 bp, Rattus norvegicus
ttcagctagtagttccgcagattct

SEQ ID NO: 665349 - DNA, 25 bp, Rattus norvegicus
ttcagctcagccctcagtttgtgag

SEQ ID NO: 665350 - DNA, 25 bp, Rattus norvegicus
ttcagctcagccgtcagtttgtgag

SEQ ID NO: 665351 - DNA, 25 bp, Rattus norvegicus
ttcagctcagctactgcacatagga

SEQ ID NO: 665352 - DNA, 25 bp, Rattus norvegicus
ttcagctcagctatcctgacagaag

SEQ ID NO: 665353 - DNA, 25 bp, Rattus norvegicus
ttcagctcagcttctgcacatagga

SEQ ID NO: 665354 - DNA, 25 bp, Rattus norvegicus
ttcagctcagctttcctgacagaag

SEQ ID NO: 665355 - DNA, 25 bp, Rattus norvegicus
ttcagctcagggattgtctttgtac

SEQ ID NO: 665356 - DNA, 25 bp, Rattus norvegicus
ttcagctcagggtttgtctttgtac

SEQ ID NO: 665357 - DNA, 25 bp, Rattus norvegicus
ttcagctccagcagttaccactagg

SEQ ID NO: 665358 - DNA, 25 bp, Rattus norvegicus
ttcagctccagctgttaccactagg

SEQ ID NO: 665359 - DNA, 25 bp, Rattus norvegicus
ttcagctccagtaaagcctttgcag

SEQ ID NO: 665360 - DNA, 25 bp, Rattus norvegicus
ttcagctccagttaagcctttgcag

SEQ ID NO: 665361 - DNA, 25 bp, Rattus norvegicus
ttcagctccatcataaaggcagtgt

SEQ ID NO: 665362 - DNA, 25 bp, Rattus norvegicus
ttcagctccatcttaaaggcagtgt

SEQ ID NO: 665363 - DNA, 25 bp, Rattus norvegicus
ttcagctccctgcttgtccatgaag

SEQ ID NO: 665364 - DNA, 25 bp, Rattus norvegicus
ttcagctccctggttgtccatgaag

SEQ ID NO: 665365 - DNA, 25 bp, Rattus norvegicus
ttcagctccgcactgcgtttgacag

SEQ ID NO: 665366 - DNA, 25 bp, Rattus norvegicus
ttcagctccgcagtgcgtttgacag

SEQ ID NO: 665367 - DNA, 25 bp, Rattus norvegicus
ttcagctccgctcgaactgttgcag

SEQ ID NO: 665368 - DNA, 25 bp, Rattus norvegicus
ttcagctccgctggaactgttgcag

SEQ ID NO: 665369 - DNA, 25 bp, Rattus norvegicus
ttcagctcctacatgagttcctgct

SEQ ID NO: 665370 - DNA, 25 bp, Rattus norvegicus
ttcagctcctacttgagttcctgct

SEQ ID NO: 665371 - DNA, 25 bp, Rattus norvegicus
ttcagctcctgcacatgtggttaaa

SEQ ID NO: 665372 - DNA, 25 bp, Rattus norvegicus
ttcagctcctgcactgactggtgtg

SEQ ID NO: 665373 - DNA, 25 bp, Rattus norvegicus
ttcagctcctgctcatgtggttaaa

SEQ ID NO: 665374 - DNA, 25 bp, Rattus norvegicus
ttcagctcctgctctgactggtgtg

SEQ ID NO: 665375 - DNA, 25 bp, Rattus norvegicus
ttcagctcctggagcaagcaggtgc

SEQ ID NO: 665376 - DNA, 25 bp, Rattus norvegicus
ttcagctcctggtgcaagcaggtgc

SEQ ID NO: 665377 - DNA, 25 bp, Rattus norvegicus
ttcagctcgcaaaaactcttcaggg

SEQ ID NO: 665378 - DNA, 25 bp, Rattus norvegicus
ttcagctcgcaataactcttcaggg

SEQ ID NO: 665379 - DNA, 25 bp, Rattus norvegicus
ttcagctctcaactctgttctgcag

SEQ ID NO: 665380 - DNA, 25 bp, Rattus norvegicus
ttcagctctcaagtctgttctgcag

SEQ ID NO: 665381 - DNA, 25 bp, Rattus norvegicus
ttcagctgagaactcgatgccatat

SEQ ID NO: 665382 - DNA, 25 bp, Rattus norvegicus
ttcagctgagaagtcgatgccatat

SEQ ID NO: 665383 - DNA, 25 bp, Rattus norvegicus
ttcagctgaggtactccagtaacat

SEQ ID NO: 665384 - DNA, 25 bp, Rattus norvegicus
ttcagctgaggttctccagtaacat

SEQ ID NO: 665385 - DNA, 25 bp, Rattus norvegicus
ttcagctgctaactggcctgcaagc

SEQ ID NO: 665386 - DNA, 25 bp, Rattus norvegicus
ttcagctgctaagtggcctgcaagc

SEQ ID NO: 665387 - DNA, 25 bp, Rattus norvegicus
ttcagctgctgtcgaccacggagag

SEQ ID NO: 665388 - DNA, 25 bp, Rattus norvegicus
ttcagctgctgtggaccacggagag

SEQ ID NO: 665389 - DNA, 25 bp, Rattus norvegicus
ttcagctggaacaggaaccacagag

SEQ ID NO: 665390 - DNA, 25 bp, Rattus norvegicus
ttcagctggaactggaaccacagag

SEQ ID NO: 665391 - DNA, 25 bp, Rattus norvegicus
ttcagctggaagactatcgagccat

SEQ ID NO: 665392 - DNA, 25 bp, Rattus norvegicus
ttcagctggaagtctatcgagccat

SEQ ID NO: 665393 - DNA, 25 bp, Rattus norvegicus
ttcagctgtacaaaagttaggccgt

SEQ ID NO: 665394 - DNA, 25 bp, Rattus norvegicus
ttcagctgtacataagttaggccgt

SEQ ID NO: 665395 - DNA, 25 bp, Rattus norvegicus
ttcagctgtatcaccatgagagact

SEQ ID NO: 665396 - DNA, 25 bp, Rattus norvegicus
ttcagctgtatctccatgagagact

SEQ ID NO: 665397 - DNA, 25 bp, Rattus norvegicus
ttcagctgtcaactggagcacccag

SEQ ID NO: 665398 - DNA, 25 bp, Rattus norvegicus
ttcagctgtcaagtggagcacccag

SEQ ID NO: 665399 - DNA, 25 bp, Rattus norvegicus
ttcagcttactgaccagtcagggtt

SEQ ID NO: 665400 - DNA, 25 bp, Rattus norvegicus
ttcagcttactgtccagtcagggtt

SEQ ID NO: 665401 - DNA, 25 bp, Rattus norvegicus
ttcagcttatgaacaatgccccttg

SEQ ID NO: 665402 - DNA, 25 bp, Rattus norvegicus
ttcagcttatgatcaatgccccttg

SEQ ID NO: 665403 - DNA, 25 bp, Rattus norvegicus
ttcagcttcacccagcaggatatgc

SEQ ID NO: 665404 - DNA, 25 bp, Rattus norvegicus
ttcagcttcaccgagcaggatatgc

SEQ ID NO: 665405 - DNA, 25 bp, Rattus norvegicus
ttcagcttcacgctgatgaaaaacc

SEQ ID NO: 665406 - DNA, 25 bp, Rattus norvegicus
ttcagcttcacggtgatgaaaaacc

SEQ ID NO: 665407 - DNA, 25 bp, Rattus norvegicus
ttcagcttccctctgaggctacaga

SEQ ID NO: 665408 - DNA, 25 bp, Rattus norvegicus
ttcagcttccctgtgaggctacaga

SEQ ID NO: 665409 - DNA, 25 bp, Rattus norvegicus
ttcagcttcgacctgcacgatgatg

SEQ ID NO: 665410 - DNA, 25 bp, Rattus norvegicus
ttcagcttcgacgtgcacgatgatg

SEQ ID NO: 665411 - DNA, 25 bp, Rattus norvegicus
ttcagcttcgtcctgggcgtctttg

SEQ ID NO: 665412 - DNA, 25 bp, Rattus norvegicus
ttcagcttcgtcgtgggcgtctttg

SEQ ID NO: 665413 - DNA, 25 bp, Rattus norvegicus
ttcagcttcgttacctgttatgcac

SEQ ID NO: 665414 - DNA, 25 bp, Rattus norvegicus
ttcagcttcgtttcctgttatgcac

SEQ ID NO: 665415 - DNA, 25 bp, Rattus norvegicus
ttcagcttgccacaactttttgttg

SEQ ID NO: 665416 - DNA, 25 bp, Rattus norvegicus
ttcagcttgccagaactttttgttg

SEQ ID NO: 665417 - DNA, 25 bp, Rattus norvegicus
ttcagcttgtacagtgcacaccagg

SEQ ID NO: 665418 - DNA, 25 bp, Rattus norvegicus
ttcagcttgtactgtgcacaccagg

SEQ ID NO: 665419 - DNA, 25 bp, Rattus norvegicus
ttcagcttgtccaatacttttacct

SEQ ID NO: 665420 - DNA, 25 bp, Rattus norvegicus
ttcagcttgtcctatacttttacct

SEQ ID NO: 665421 - DNA, 25 bp, Rattus norvegicus
ttcagctttaccacctacaacagga

SEQ ID NO: 665422 - DNA, 25 bp, Rattus norvegicus
ttcagctttacctcctacaacagga

SEQ ID NO: 665423 - DNA, 25 bp, Rattus norvegicus
ttcagctttattaacatttttccat

SEQ ID NO: 665424 - DNA, 25 bp, Rattus norvegicus
ttcagctttatttacatttttccat

SEQ ID NO: 665425 - DNA, 25 bp, Rattus norvegicus
ttcagctttccaacctagggagtca

SEQ ID NO: 665426 - DNA, 25 bp, Rattus norvegicus
ttcagctttccatcctagggagtca

SEQ ID NO: 665427 - DNA, 25 bp, Rattus norvegicus
ttcagctttcctcaagttagttatg

SEQ ID NO: 665428 - DNA, 25 bp, Rattus norvegicus
ttcagctttcctgaagttagttatg

SEQ ID NO: 665429 - DNA, 25 bp, Rattus norvegicus
ttcagctttctcaagtattgcccag

SEQ ID NO: 665430 - DNA, 25 bp, Rattus norvegicus
ttcagctttctctagtattgcccag

SEQ ID NO: 665431 - DNA, 25 bp, Rattus norvegicus
ttcagctttgctcagtattactgtg

SEQ ID NO: 665432 - DNA, 25 bp, Rattus norvegicus
ttcagctttgctgagtattactgtg

SEQ ID NO: 665433 - DNA, 25 bp, Rattus norvegicus
ttcagctttgtaaataccggtttct

SEQ ID NO: 665434 - DNA, 25 bp, Rattus norvegicus
ttcagctttgtatataccggtttct

SEQ ID NO: 665435 - DNA, 25 bp, Rattus norvegicus
ttcagctttttgaacctcgctatct

SEQ ID NO: 665436 - DNA, 25 bp, Rattus norvegicus
ttcagctttttgtacctcgctatct

SEQ ID NO: 665437 - DNA, 25 bp, Rattus norvegicus
ttcaggaaaagccttggattgccct

SEQ ID NO: 665438 - DNA, 25 bp, Rattus norvegicus
ttcaggaaaagcgttggattgccct

SEQ ID NO: 665439 - DNA, 25 bp, Rattus norvegicus
ttcaggaaacagaagtcgccattgg

SEQ ID NO: 665440 - DNA, 25 bp, Rattus norvegicus
ttcaggaaacagtagtcgccattgg

SEQ ID NO: 665441 - DNA, 25 bp, Rattus norvegicus
ttcaggaacagtcactagcaccact

SEQ ID NO: 665442 - DNA, 25 bp, Rattus norvegicus
ttcaggaacagtgactagcaccact

SEQ ID NO: 665443 - DNA, 25 bp, Rattus norvegicus
ttcaggaacccactggacgtggcat

SEQ ID NO: 665444 - DNA, 25 bp, Rattus norvegicus
ttcaggaacccagtggacgtggcat

SEQ ID NO: 665445 - DNA, 25 bp, Rattus norvegicus
ttcaggaactggatgtggtttgtca

SEQ ID NO: 665446 - DNA, 25 bp, Rattus norvegicus
ttcaggaactggttgtggtttgtca

SEQ ID NO: 665447 - DNA, 25 bp, Rattus norvegicus
ttcaggaagcaacacacatctcatt

SEQ ID NO: 665448 - DNA, 25 bp, Rattus norvegicus
ttcaggaagcaagacacatctcatt

SEQ ID NO: 665449 - DNA, 25 bp, Rattus norvegicus
ttcaggaagcccacacaggtgcaaa

SEQ ID NO: 665450 - DNA, 25 bp, Rattus norvegicus
ttcaggaagccctcacaggtgcaaa

SEQ ID NO: 665451 - DNA, 25 bp, Rattus norvegicus
ttcaggaagcgccaataaacccatt

SEQ ID NO: 665452 - DNA, 25 bp, Rattus norvegicus
ttcaggaagcgcgaataaacccatt

SEQ ID NO: 665453 - DNA, 25 bp, Rattus norvegicus
ttcaggaaggcgcacacaccatagt

SEQ ID NO: 665454 - DNA, 25 bp, Rattus norvegicus
ttcaggaaggcggacacaccatagt

SEQ ID NO: 665455 - DNA, 25 bp, Rattus norvegicus
ttcaggaagtccacctttaattcag

SEQ ID NO: 665456 - DNA, 25 bp, Rattus norvegicus
ttcaggaagtcctcctttaattcag

SEQ ID NO: 665457 - DNA, 25 bp, Rattus norvegicus
ttcaggaatccccatgctttttatt

SEQ ID NO: 665458 - DNA, 25 bp, Rattus norvegicus
ttcaggaatcccgatgctttttatt

SEQ ID NO: 665459 - DNA, 25 bp, Rattus norvegicus
ttcaggacagtcagggcattgcagt

SEQ ID NO: 665460 - DNA, 25 bp, Rattus norvegicus
ttcaggacagtctgggcattgcagt

SEQ ID NO: 665461 - DNA, 25 bp, Rattus norvegicus
ttcaggaccctgcacatgctagaga

SEQ ID NO: 665462 - DNA, 25 bp, Rattus norvegicus
ttcaggaccctggacatgctagaga

SEQ ID NO: 665463 - DNA, 25 bp, Rattus norvegicus
ttcaggaccgtgaggctgtttggtt

SEQ ID NO: 665464 - DNA, 25 bp, Rattus norvegicus
ttcaggaccgtgtggctgtttggtt

SEQ ID NO: 665465 - DNA, 25 bp, Rattus norvegicus
ttcaggaccttgattgtcgaacatg

SEQ ID NO: 665466 - DNA, 25 bp, Rattus norvegicus
ttcaggaccttgtttgtcgaacatg

SEQ ID NO: 665467 - DNA, 25 bp, Rattus norvegicus
ttcaggactgaactgcgtgtgccac

SEQ ID NO: 665468 - DNA, 25 bp, Rattus norvegicus
ttcaggactgaagtgcgtgtgccac

SEQ ID NO: 665469 - DNA, 25 bp, Rattus norvegicus
ttcaggactgagctgtatcgccttc

SEQ ID NO: 665470 - DNA, 25 bp, Rattus norvegicus
ttcaggactgaggtgtatcgccttc

SEQ ID NO: 665471 - DNA, 25 bp, Rattus norvegicus
ttcaggagccggctccagcatgtcc

SEQ ID NO: 665472 - DNA, 25 bp, Rattus norvegicus
ttcaggagccgggtccagcatgtcc

SEQ ID NO: 665473 - DNA, 25 bp, Rattus norvegicus
ttcaggagggcacttttgactatat

SEQ ID NO: 665474 - DNA, 25 bp, Rattus norvegicus
ttcaggagggcagttttgactatat

SEQ ID NO: 665475 - DNA, 25 bp, Rattus norvegicus
ttcaggagggtgatgccacagccgc

SEQ ID NO: 665476 - DNA, 25 bp, Rattus norvegicus
ttcaggagggtgttgccacagccgc

SEQ ID NO: 665477 - DNA, 25 bp, Rattus norvegicus
ttcaggagtccgagttctccttcca

SEQ ID NO: 665478 - DNA, 25 bp, Rattus norvegicus
ttcaggagtccgtgttctccttcca

SEQ ID NO: 665479 - DNA, 25 bp, Rattus norvegicus
ttcaggagtgttacccagccatctg

SEQ ID NO: 665480 - DNA, 25 bp, Rattus norvegicus
ttcaggagtgtttcccagccatctg

SEQ ID NO: 665481 - DNA, 25 bp, Rattus norvegicus
ttcaggataaccaagtatgcatgga

SEQ ID NO: 665482 - DNA, 25 bp, Rattus norvegicus
ttcaggataacctagtatgcatgga

SEQ ID NO: 665483 - DNA, 25 bp, Rattus norvegicus
ttcaggatcattatcaccaaggcac

SEQ ID NO: 665484 - DNA, 25 bp, Rattus norvegicus
ttcaggatcattttcaccaaggcac

SEQ ID NO: 665485 - DNA, 25 bp, Rattus norvegicus
ttcaggatcctgcttccatgaggga

SEQ ID NO: 665486 - DNA, 25 bp, Rattus norvegicus
ttcaggatcctggttccatgaggga

SEQ ID NO: 665487 - DNA, 25 bp, Rattus norvegicus
ttcaggatcttgcaaccagaagagt

SEQ ID NO: 665488 - DNA, 25 bp, Rattus norvegicus
ttcaggatcttggaaccagaagagt

SEQ ID NO: 665489 - DNA, 25 bp, Rattus norvegicus
ttcaggatgccaaggtgaagtcggt

SEQ ID NO: 665490 - DNA, 25 bp, Rattus norvegicus
ttcaggatgccatggtgaagtcggt

SEQ ID NO: 665491 - DNA, 25 bp, Rattus norvegicus
ttcaggatgctaagtctgccttgcc

SEQ ID NO: 665492 - DNA, 25 bp, Rattus norvegicus
ttcaggatgctatgtctgccttgcc

SEQ ID NO: 665493 - DNA, 25 bp, Rattus norvegicus
ttcaggattcagctcaatgggtcat

SEQ ID NO: 665494 - DNA, 25 bp, Rattus norvegicus
ttcaggattcaggtcaatgggtcat

SEQ ID NO: 665495 - DNA, 25 bp, Rattus norvegicus
ttcaggatttgcacctgcgcacctg

SEQ ID NO: 665496 - DNA, 25 bp, Rattus norvegicus
ttcaggatttgctcctgcgcacctg

SEQ ID NO: 665497 - DNA, 25 bp, Rattus norvegicus
ttcaggcaaaacactgctcttggct

SEQ ID NO: 665498 - DNA, 25 bp, Rattus norvegicus
ttcaggcaaaactctgctcttggct

SEQ ID NO: 665499 - DNA, 25 bp, Rattus norvegicus
ttcaggcaacatactcttgtggtcc

SEQ ID NO: 665500 - DNA, 25 bp, Rattus norvegicus
ttcaggcaacattctcttgtggtcc

SEQ ID NO: 665501 - DNA, 25 bp, Rattus norvegicus
ttcaggcaatttactagctcaagta

SEQ ID NO: 665502 - DNA, 25 bp, Rattus norvegicus
ttcaggcaattttctagctcaagta

SEQ ID NO: 665503 - DNA, 25 bp, Rattus norvegicus
ttcaggcacagcagcggcaaggtca

SEQ ID NO: 665504 - DNA, 25 bp, Rattus norvegicus
ttcaggcacagctgcggcaaggtca

SEQ ID NO: 665505 - DNA, 25 bp, Rattus norvegicus
ttcaggcacctgcacaaatgtggca

SEQ ID NO: 665506 - DNA, 25 bp, Rattus norvegicus
ttcaggcacctggacaaatgtggca

SEQ ID NO: 665507 - DNA, 25 bp, Rattus norvegicus
ttcaggcaccttcggatttatcagc

SEQ ID NO: 665508 - DNA, 25 bp, Rattus norvegicus
ttcaggcaccttgggatttatcagc

SEQ ID NO: 665509 - DNA, 25 bp, Rattus norvegicus
ttcaggcactgtctgattcctagga

SEQ ID NO: 665510 - DNA, 25 bp, Rattus norvegicus
ttcaggcactgtgtgattcctagga

SEQ ID NO: 665511 - DNA, 25 bp, Rattus norvegicus
ttcaggcacttcaacccaggagaga

SEQ ID NO: 665512 - DNA, 25 bp, Rattus norvegicus
ttcaggcacttctacccaggagaga

SEQ ID NO: 665513 - DNA, 25 bp, Rattus norvegicus
ttcaggcagcagatacagtgtcatt

SEQ ID NO: 665514 - DNA, 25 bp, Rattus norvegicus
ttcaggcagcagttacagtgtcatt

SEQ ID NO: 665515 - DNA, 25 bp, Rattus norvegicus
ttcaggcatcttactactgctgttg

SEQ ID NO: 665516 - DNA, 25 bp, Rattus norvegicus
ttcaggcatctttctactgctgttg

SEQ ID NO: 665517 - DNA, 25 bp, Rattus norvegicus
ttcaggcccaaaccaagctgctgtt

SEQ ID NO: 665518 - DNA, 25 bp, Rattus norvegicus
ttcaggcccaaagcaagctgctgtt

SEQ ID NO: 665519 - DNA, 25 bp, Rattus norvegicus
ttcaggcccagccagatgctttgaa

SEQ ID NO: 665520 - DNA, 25 bp, Rattus norvegicus
ttcaggcccagcgagatgctttgaa

SEQ ID NO: 665521 - DNA, 25 bp, Rattus norvegicus
ttcaggcccggtccacgcagaggaa

SEQ ID NO: 665522 - DNA, 25 bp, Rattus norvegicus
ttcaggcccggtgcacgcagaggaa

SEQ ID NO: 665523 - DNA, 25 bp, Rattus norvegicus
ttcaggccctgtccatagagctcag

SEQ ID NO: 665524 - DNA, 25 bp, Rattus norvegicus
ttcaggccctgtgcatagagctcag

SEQ ID NO: 665525 - DNA, 25 bp, Rattus norvegicus
ttcaggccctttattgtatgtctcc

SEQ ID NO: 665526 - DNA, 25 bp, Rattus norvegicus
ttcaggcccttttttgtatgtctcc

SEQ ID NO: 665527 - DNA, 25 bp, Rattus norvegicus
ttcaggccgaaacgcatggctctgc

SEQ ID NO: 665528 - DNA, 25 bp, Rattus norvegicus
ttcaggccgaaaggcatggctctgc

SEQ ID NO: 665529 - DNA, 25 bp, Rattus norvegicus
ttcaggcctcaactcagacaggctt

SEQ ID NO: 665530 - DNA, 25 bp, Rattus norvegicus
ttcaggcctcaagtcagacaggctt

SEQ ID NO: 665531 - DNA, 25 bp, Rattus norvegicus
ttcaggcctgcacagaaatggtcat

SEQ ID NO: 665532 - DNA, 25 bp, Rattus norvegicus
ttcaggcctgcagagaaatggtcat

SEQ ID NO: 665533 - DNA, 25 bp, Rattus norvegicus
ttcaggcctgctatctagataatcc

SEQ ID NO: 665534 - DNA, 25 bp, Rattus norvegicus
ttcaggcctgctttctagataatcc

SEQ ID NO: 665535 - DNA, 25 bp, Rattus norvegicus
ttcaggcgacgacctgatggacccg

SEQ ID NO: 665536 - DNA, 25 bp, Rattus norvegicus
ttcaggcgacgagctgatggacccg

SEQ ID NO: 665537 - DNA, 25 bp, Rattus norvegicus
ttcaggcggcctactgatctgttta

SEQ ID NO: 665538 - DNA, 25 bp, Rattus norvegicus
ttcaggcggccttctgatctgttta

SEQ ID NO: 665539 - DNA, 25 bp, Rattus norvegicus
ttcaggcgggtcagcacacatgtcg

SEQ ID NO: 665540 - DNA, 25 bp, Rattus norvegicus
ttcaggcgggtctgcacacatgtcg

SEQ ID NO: 665541 - DNA, 25 bp, Rattus norvegicus
ttcaggctccgcaacagcagcagag

SEQ ID NO: 665542 - DNA, 25 bp, Rattus norvegicus
ttcaggctccgctacagcagcagag

SEQ ID NO: 665543 - DNA, 25 bp, Rattus norvegicus
ttcaggctcgtgaatgaggtcttca

SEQ ID NO: 665544 - DNA, 25 bp, Rattus norvegicus
ttcaggctcgtgtatgaggtcttca

SEQ ID NO: 665545 - DNA, 25 bp, Rattus norvegicus
ttcaggctctccaagatgtaaaaga

SEQ ID NO: 665546 - DNA, 25 bp, Rattus norvegicus
ttcaggctctcctagatgtaaaaga

SEQ ID NO: 665547 - DNA, 25 bp, Rattus norvegicus
ttcaggctgagcaggctccagggac

SEQ ID NO: 665548 - DNA, 25 bp, Rattus norvegicus
ttcaggctgagctggctccagggac

SEQ ID NO: 665549 - DNA, 25 bp, Rattus norvegicus
ttcaggctgaggacccagatactca

SEQ ID NO: 665550 - DNA, 25 bp, Rattus norvegicus
ttcaggctgaggtcccagatactca

SEQ ID NO: 665551 - DNA, 25 bp, Rattus norvegicus
ttcaggctgcagagacagttgccca

SEQ ID NO: 665552 - DNA, 25 bp, Rattus norvegicus
ttcaggctgcagtgacagttgccca

SEQ ID NO: 665553 - DNA, 25 bp, Rattus norvegicus
ttcaggctgcgacgaggagatcata

SEQ ID NO: 665554 - DNA, 25 bp, Rattus norvegicus
ttcaggctgcgaggaggagatcata

SEQ ID NO: 665555 - DNA, 25 bp, Rattus norvegicus
ttcaggctgctgacttgtaggaaca

SEQ ID NO: 665556 - DNA, 25 bp, Rattus norvegicus
ttcaggctgctgtcttgtaggaaca

SEQ ID NO: 665557 - DNA, 25 bp, Rattus norvegicus
ttcaggcttcaaacatggcgcagct

SEQ ID NO: 665558 - DNA, 25 bp, Rattus norvegicus
ttcaggcttcaatcatggcgcagct

SEQ ID NO: 665559 - DNA, 25 bp, Rattus norvegicus
ttcaggcttcatacctatgcaagac

SEQ ID NO: 665560 - DNA, 25 bp, Rattus norvegicus
ttcaggcttcattcctatgcaagac

SEQ ID NO: 665561 - DNA, 25 bp, Rattus norvegicus
ttcaggcttctgctttcaggcagca

SEQ ID NO: 665562 - DNA, 25 bp, Rattus norvegicus
ttcaggcttctggtttcaggcagca

SEQ ID NO: 665563 - DNA, 25 bp, Rattus norvegicus
ttcaggctttgtcgaggcggaggct

SEQ ID NO: 665564 - DNA, 25 bp, Rattus norvegicus
ttcaggctttgtggaggcggaggct

SEQ ID NO: 665565 - DNA, 25 bp, Rattus norvegicus
ttcagggaccctacatgcctttaag

SEQ ID NO: 665566 - DNA, 25 bp, Rattus norvegicus
ttcagggacccttcatgcctttaag

SEQ ID NO: 665567 - DNA, 25 bp, Rattus norvegicus
ttcagggacctgcatttacatttct

SEQ ID NO: 665568 - DNA, 25 bp, Rattus norvegicus
ttcagggacctggatttacatttct

SEQ ID NO: 665569 - DNA, 25 bp, Rattus norvegicus
ttcagggactgccactcagcttact

SEQ ID NO: 665570 - DNA, 25 bp, Rattus norvegicus
ttcagggactgcgactcagcttact

SEQ ID NO: 665571 - DNA, 25 bp, Rattus norvegicus
ttcagggagagaccgacacttgtct

SEQ ID NO: 665572 - DNA, 25 bp, Rattus norvegicus
ttcagggagagagcgacacttgtct

SEQ ID NO: 665573 - DNA, 25 bp, Rattus norvegicus
ttcagggagagcagctatgaccgat

SEQ ID NO: 665574 - DNA, 25 bp, Rattus norvegicus
ttcagggagagctgctatgaccgat

SEQ ID NO: 665575 - DNA, 25 bp, Rattus norvegicus
ttcagggaggacaaggccgcaagct

SEQ ID NO: 665576 - DNA, 25 bp, Rattus norvegicus
ttcagggaggactaggccgcaagct

SEQ ID NO: 665577 - DNA, 25 bp, Rattus norvegicus
ttcagggagggtccatttgtgccac

SEQ ID NO: 665578 - DNA, 25 bp, Rattus norvegicus
ttcagggagggtgcatttgtgccac

SEQ ID NO: 665579 - DNA, 25 bp, Rattus norvegicus
ttcagggatgacatggccactgcca

SEQ ID NO: 665580 - DNA, 25 bp, Rattus norvegicus
ttcagggatgacttggccactgcca

SEQ ID NO: 665581 - DNA, 25 bp, Rattus norvegicus
ttcagggatttgactaccaccattc

SEQ ID NO: 665582 - DNA, 25 bp, Rattus norvegicus
ttcagggatttgtctaccaccattc

SEQ ID NO: 665583 - DNA, 25 bp, Rattus norvegicus
ttcagggcaagcatagcaccaaggg

SEQ ID NO: 665584 - DNA, 25 bp, Rattus norvegicus
ttcagggcaagcttagcaccaaggg

SEQ ID NO: 665585 - DNA, 25 bp, Rattus norvegicus
ttcagggcacccaagggctcccggg

SEQ ID NO: 665586 - DNA, 25 bp, Rattus norvegicus
ttcagggcaccctagggctcccggg

SEQ ID NO: 665587 - DNA, 25 bp, Rattus norvegicus
ttcagggcattgaacgactctgtcg

SEQ ID NO: 665588 - DNA, 25 bp, Rattus norvegicus
ttcagggcattgtacgactctgtcg

SEQ ID NO: 665589 - DNA, 25 bp, Rattus norvegicus
ttcagggccacactaaactactcag

SEQ ID NO: 665590 - DNA, 25 bp, Rattus norvegicus
ttcagggccacagtaaactactcag

SEQ ID NO: 665591 - DNA, 25 bp, Rattus norvegicus
ttcagggccagtcccgtgcacagag

SEQ ID NO: 665592 - DNA, 25 bp, Rattus norvegicus
ttcagggccagtgccgtgcacagag

SEQ ID NO: 665593 - DNA, 25 bp, Rattus norvegicus
ttcagggcccctaatgcacgaggag

SEQ ID NO: 665594 - DNA, 25 bp, Rattus norvegicus
ttcagggccccttatgcacgaggag

SEQ ID NO: 665595 - DNA, 25 bp, Rattus norvegicus
ttcagggcctctcggctatcatctg

SEQ ID NO: 665596 - DNA, 25 bp, Rattus norvegicus
ttcagggcctctgggctatcatctg

SEQ ID NO: 665597 - DNA, 25 bp, Rattus norvegicus
ttcagggcctttacctggctggtag

SEQ ID NO: 665598 - DNA, 25 bp, Rattus norvegicus
ttcagggccttttcctggctggtag

SEQ ID NO: 665599 - DNA, 25 bp, Rattus norvegicus
ttcagggctccaacaccagggctgt

SEQ ID NO: 665600 - DNA, 25 bp, Rattus norvegicus
ttcagggctccatcaccagggctgt

SEQ ID NO: 665601 - DNA, 25 bp, Rattus norvegicus
ttcagggctctgagtatgtgcgtat

SEQ ID NO: 665602 - DNA, 25 bp, Rattus norvegicus
ttcagggctctgtgtatgtgcgtat

SEQ ID NO: 665603 - DNA, 25 bp, Rattus norvegicus
ttcagggctgcgagctcaagtacta

SEQ ID NO: 665604 - DNA, 25 bp, Rattus norvegicus
ttcagggctgcgtgctcaagtacta

SEQ ID NO: 665605 - DNA, 25 bp, Rattus norvegicus
ttcagggctgtaactcaggtggcct

SEQ ID NO: 665606 - DNA, 25 bp, Rattus norvegicus
ttcagggctgtatctcaggtggcct

SEQ ID NO: 665607 - DNA, 25 bp, Rattus norvegicus
ttcagggcttcgctgtagcagtgaa

SEQ ID NO: 665608 - DNA, 25 bp, Rattus norvegicus
ttcagggcttcggtgtagcagtgaa

SEQ ID NO: 665609 - DNA, 25 bp, Rattus norvegicus
ttcagggcttgacggtcccaccaag

SEQ ID NO: 665610 - DNA, 25 bp, Rattus norvegicus
ttcagggcttgagggtcccaccaag

SEQ ID NO: 665611 - DNA, 25 bp, Rattus norvegicus
ttcagggtaaacaatttgttgttat

SEQ ID NO: 665612 - DNA, 25 bp, Rattus norvegicus
ttcagggtaaactatttgttgttat

SEQ ID NO: 665613 - DNA, 25 bp, Rattus norvegicus
ttcagggtaactactctgtctctct

SEQ ID NO: 665614 - DNA, 25 bp, Rattus norvegicus
ttcagggtaacttctctgtctctct

SEQ ID NO: 665615 - DNA, 25 bp, Rattus norvegicus
ttcagggtagatctagcttccatat

SEQ ID NO: 665616 - DNA, 25 bp, Rattus norvegicus
ttcagggtagatgtagcttccatat

SEQ ID NO: 665617 - DNA, 25 bp, Rattus norvegicus
ttcagggtaggtacattaggttcag

SEQ ID NO: 665618 - DNA, 25 bp, Rattus norvegicus
ttcagggtaggttcattaggttcag

SEQ ID NO: 665619 - DNA, 25 bp, Rattus norvegicus
ttcagggtcaatcttaagtatatca

SEQ ID NO: 665620 - DNA, 25 bp, Rattus norvegicus
ttcagggtcaatgttaagtatatca

SEQ ID NO: 665621 - DNA, 25 bp, Rattus norvegicus
ttcagggtcattatcacagctttaa

SEQ ID NO: 665622 - DNA, 25 bp, Rattus norvegicus
ttcagggtcattttcacagctttaa

SEQ ID NO: 665623 - DNA, 25 bp, Rattus norvegicus
ttcagggtccagaccatttttgccc

SEQ ID NO: 665624 - DNA, 25 bp, Rattus norvegicus
ttcagggtccagtccatttttgccc

SEQ ID NO: 665625 - DNA, 25 bp, Rattus norvegicus
ttcagggtgtacacttgggtttcca

SEQ ID NO: 665626 - DNA, 25 bp, Rattus norvegicus
ttcagggtgtactcttgggtttcca

SEQ ID NO: 665627 - DNA, 25 bp, Rattus norvegicus
ttcagggtgtttcaactcccactgt

SEQ ID NO: 665628 - DNA, 25 bp, Rattus norvegicus
ttcagggtgtttgaactcccactgt

SEQ ID NO: 665629 - DNA, 25 bp, Rattus norvegicus
ttcagggttgaacatgtcccgctct

SEQ ID NO: 665630 - DNA, 25 bp, Rattus norvegicus
ttcagggttgaagatgtcccgctct

SEQ ID NO: 665631 - DNA, 25 bp, Rattus norvegicus
ttcaggtacctgagctgggacactc

SEQ ID NO: 665632 - DNA, 25 bp, Rattus norvegicus
ttcaggtacctgtgctgggacactc

SEQ ID NO: 665633 - DNA, 25 bp, Rattus norvegicus
ttcaggtcaccacggttgtcattca

SEQ ID NO: 665634 - DNA, 25 bp, Rattus norvegicus
ttcaggtcaccagggttgtcattca

SEQ ID NO: 665635 - DNA, 25 bp, Rattus norvegicus
ttcaggtcaggaagcatggctctgc

SEQ ID NO: 665636 - DNA, 25 bp, Rattus norvegicus
ttcaggtcaggatgcatggctctgc

SEQ ID NO: 665637 - DNA, 25 bp, Rattus norvegicus
ttcaggtcatgcagtctccagctta

SEQ ID NO: 665638 - DNA, 25 bp, Rattus norvegicus
ttcaggtcatgctgtctccagctta

SEQ ID NO: 665639 - DNA, 25 bp, Rattus norvegicus
ttcaggtccatccaaacctcaagag

SEQ ID NO: 665640 - DNA, 25 bp, Rattus norvegicus
ttcaggtccatcgaaacctcaagag

SEQ ID NO: 665641 - DNA, 25 bp, Rattus norvegicus
ttcaggtccattcttggtgctgtcc

SEQ ID NO: 665642 - DNA, 25 bp, Rattus norvegicus
ttcaggtccattgttggtgctgtcc

SEQ ID NO: 665643 - DNA, 25 bp, Rattus norvegicus
ttcaggtcggtgacatggacgctca

SEQ ID NO: 665644 - DNA, 25 bp, Rattus norvegicus
ttcaggtcggtgtcatggacgctca

SEQ ID NO: 665645 - DNA, 25 bp, Rattus norvegicus
ttcaggtcgtacacgggtcccagga

SEQ ID NO: 665646 - DNA, 25 bp, Rattus norvegicus
ttcaggtcgtactcgggtcccagga

SEQ ID NO: 665647 - DNA, 25 bp, Rattus norvegicus
ttcaggtctaaactggacagtcccc

SEQ ID NO: 665648 - DNA, 25 bp, Rattus norvegicus
ttcaggtctaaagtggacagtcccc

SEQ ID NO: 665649 - DNA, 25 bp, Rattus norvegicus
ttcaggtctgaacagctgctctagt

SEQ ID NO: 665650 - DNA, 25 bp, Rattus norvegicus
ttcaggtctgaagagctgctctagt

SEQ ID NO: 665651 - DNA, 25 bp, Rattus norvegicus
ttcaggtctgtcactcttgttacat

SEQ ID NO: 665652 - DNA, 25 bp, Rattus norvegicus
ttcaggtctgtctctcttgttacat

SEQ ID NO: 665653 - DNA, 25 bp, Rattus norvegicus
ttcaggtggcttaggcagagtctca

SEQ ID NO: 665654 - DNA, 25 bp, Rattus norvegicus
ttcaggtggctttggcagagtctca

SEQ ID NO: 665655 - DNA, 25 bp, Rattus norvegicus
ttcaggtggtagcttctatgtcgcc

SEQ ID NO: 665656 - DNA, 25 bp, Rattus norvegicus
ttcaggtggtaggttctatgtcgcc

SEQ ID NO: 665657 - DNA, 25 bp, Rattus norvegicus
ttcaggtggttgaaggtcaccaggt

SEQ ID NO: 665658 - DNA, 25 bp, Rattus norvegicus
ttcaggtggttgtaggtcaccaggt

SEQ ID NO: 665659 - DNA, 25 bp, Rattus norvegicus
ttcaggtgtcccaacactgggccat

SEQ ID NO: 665660 - DNA, 25 bp, Rattus norvegicus
ttcaggtgtccctacactgggccat

SEQ ID NO: 665661 - DNA, 25 bp, Rattus norvegicus
ttcaggttactgctcgtttgtcaca

SEQ ID NO: 665662 - DNA, 25 bp, Rattus norvegicus
ttcaggttactggtcgtttgtcaca

SEQ ID NO: 665663 - DNA, 25 bp, Rattus norvegicus
ttcaggttagcgacccggagagcac

SEQ ID NO: 665664 - DNA, 25 bp, Rattus norvegicus
ttcaggttagcgtcccggagagcac

SEQ ID NO: 665665 - DNA, 25 bp, Rattus norvegicus
ttcaggttaggccacagaactctct

SEQ ID NO: 665666 - DNA, 25 bp, Rattus norvegicus
ttcaggttaggcgacagaactctct

SEQ ID NO: 665667 - DNA, 25 bp, Rattus norvegicus
ttcaggttccccatactatgacaac

SEQ ID NO: 665668 - DNA, 25 bp, Rattus norvegicus
ttcaggttccccttactatgacaac

SEQ ID NO: 665669 - DNA, 25 bp, Rattus norvegicus
ttcaggttgggaaccgtcccaggtt

SEQ ID NO: 665670 - DNA, 25 bp, Rattus norvegicus
ttcaggttgggatccgtcccaggtt

SEQ ID NO: 665671 - DNA, 25 bp, Rattus norvegicus
ttcaggtttctgaggtgctcttaga

SEQ ID NO: 665672 - DNA, 25 bp, Rattus norvegicus
ttcaggtttctgagttctcaagctt

SEQ ID NO: 665673 - DNA, 25 bp, Rattus norvegicus
ttcaggtttctgtggtgctcttaga

SEQ ID NO: 665674 - DNA, 25 bp, Rattus norvegicus
ttcaggtttctgtgttctcaagctt

SEQ ID NO: 665675 - DNA, 25 bp, Rattus norvegicus
ttcaggtttttgagccgagccgagg

SEQ ID NO: 665676 - DNA, 25 bp, Rattus norvegicus
ttcaggtttttgtgccgagccgagg

SEQ ID NO: 665677 - DNA, 25 bp, Rattus norvegicus
ttcagtaaacatactttcctaaggt

SEQ ID NO: 665678 - DNA, 25 bp, Rattus norvegicus
ttcagtaaacattctttcctaaggt

SEQ ID NO: 665679 - DNA, 25 bp, Rattus norvegicus
ttcagtaaatccatcgtccaggcga

SEQ ID NO: 665680 - DNA, 25 bp, Rattus norvegicus
ttcagtaaatccttcgtccaggcga

SEQ ID NO: 665681 - DNA, 25 bp, Rattus norvegicus
ttcagtaacattcataaagccttgc

SEQ ID NO: 665682 - DNA, 25 bp, Rattus norvegicus
ttcagtaacattgataaagccttgc

SEQ ID NO: 665683 - DNA, 25 bp, Rattus norvegicus
ttcagtaataacatgggctcccgga

SEQ ID NO: 665684 - DNA, 25 bp, Rattus norvegicus
ttcagtaataacttgggctcccgga

SEQ ID NO: 665685 - DNA, 25 bp, Rattus norvegicus
ttcagtaataatccctcacctacac

SEQ ID NO: 665686 - DNA, 25 bp, Rattus norvegicus
ttcagtaataatgcctcacctacac

SEQ ID NO: 665687 - DNA, 25 bp, Rattus norvegicus
ttcagtaatggcctacctctgctca

SEQ ID NO: 665688 - DNA, 25 bp, Rattus norvegicus
ttcagtaatggcgtacctctgctca

SEQ ID NO: 665689 - DNA, 25 bp, Rattus norvegicus
ttcagtacatttcccctttttgcta

SEQ ID NO: 665690 - DNA, 25 bp, Rattus norvegicus
ttcagtacatttgccctttttgcta

SEQ ID NO: 665691 - DNA, 25 bp, Rattus norvegicus
ttcagtaccacaattctgctgaggg

SEQ ID NO: 665692 - DNA, 25 bp, Rattus norvegicus
ttcagtaccacatttctgctgaggg

SEQ ID NO: 665693 - DNA, 25 bp, Rattus norvegicus
ttcagtacctgaactcaaccgagca

SEQ ID NO: 665694 - DNA, 25 bp, Rattus norvegicus
ttcagtacctgatctcaaccgagca

SEQ ID NO: 665695 - DNA, 25 bp, Rattus norvegicus
ttcagtacctggaacctggaccata

SEQ ID NO: 665696 - DNA, 25 bp, Rattus norvegicus
ttcagtacctggtacctggaccata

SEQ ID NO: 665697 - DNA, 25 bp, Rattus norvegicus
ttcagtactggtatgtggctgtgcc

SEQ ID NO: 665698 - DNA, 25 bp, Rattus norvegicus
ttcagtactggtttgtggctgtgcc

SEQ ID NO: 665699 - DNA, 25 bp, Rattus norvegicus
ttcagtaggacacattggagcattc

SEQ ID NO: 665700 - DNA, 25 bp, Rattus norvegicus
ttcagtaggacagattggagcattc

SEQ ID NO: 665701 - DNA, 25 bp, Rattus norvegicus
ttcagtagtcagacaaatgccacat

SEQ ID NO: 665702 - DNA, 25 bp, Rattus norvegicus
ttcagtagtcagtcaaatgccacat

SEQ ID NO: 665703 - DNA, 25 bp, Rattus norvegicus
ttcagtagtctgaccatgagtggtt

SEQ ID NO: 665704 - DNA, 25 bp, Rattus norvegicus
ttcagtagtctgtccatgagtggtt

SEQ ID NO: 665705 - DNA, 25 bp, Rattus norvegicus
ttcagtatttccattcttattccag

SEQ ID NO: 665706 - DNA, 25 bp, Rattus norvegicus
ttcagtatttcctttcttattccag

SEQ ID NO: 665707 - DNA, 25 bp, Rattus norvegicus
ttcagtatttgcattctggttcaat

SEQ ID NO: 665708 - DNA, 25 bp, Rattus norvegicus
ttcagtatttgctttctggttcaat

SEQ ID NO: 665709 - DNA, 25 bp, Rattus norvegicus
ttcagtcaaaaactctgttgcacat

SEQ ID NO: 665710 - DNA, 25 bp, Rattus norvegicus
ttcagtcaaaaagtctgttgcacat

SEQ ID NO: 665711 - DNA, 25 bp, Rattus norvegicus
ttcagtcaaacacattcccagcctg

SEQ ID NO: 665712 - DNA, 25 bp, Rattus norvegicus
ttcagtcaaacagattcccagcctg

SEQ ID NO: 665713 - DNA, 25 bp, Rattus norvegicus
ttcagtcacactagagggacgcagt

SEQ ID NO: 665714 - DNA, 25 bp, Rattus norvegicus
ttcagtcacacttgagggacgcagt

SEQ ID NO: 665715 - DNA, 25 bp, Rattus norvegicus
ttcagtcacccaccgacggagaact

SEQ ID NO: 665716 - DNA, 25 bp, Rattus norvegicus
ttcagtcacccagcgacggagaact

SEQ ID NO: 665717 - DNA, 25 bp, Rattus norvegicus
ttcagtcacctcacacatcaaaata

SEQ ID NO: 665718 - DNA, 25 bp, Rattus norvegicus
ttcagtcacctctcacatcaaaata

SEQ ID NO: 665719 - DNA, 25 bp, Rattus norvegicus
ttcagtcacggcagctggatcttta

SEQ ID NO: 665720 - DNA, 25 bp, Rattus norvegicus
ttcagtcacggctgctggatcttta

SEQ ID NO: 665721 - DNA, 25 bp, Rattus norvegicus
ttcagtcactcacacaacacatgga

SEQ ID NO: 665722 - DNA, 25 bp, Rattus norvegicus
ttcagtcactcagacaacacatgga

SEQ ID NO: 665723 - DNA, 25 bp, Rattus norvegicus
ttcagtcactccagccaatcatgga

SEQ ID NO: 665724 - DNA, 25 bp, Rattus norvegicus
ttcagtcactcctgccaatcatgga

SEQ ID NO: 665725 - DNA, 25 bp, Rattus norvegicus
ttcagtcagatcaattgctccgagg

SEQ ID NO: 665726 - DNA, 25 bp, Rattus norvegicus
ttcagtcagatctattgctccgagg

SEQ ID NO: 665727 - DNA, 25 bp, Rattus norvegicus
ttcagtcagatgagccctcctgtga

SEQ ID NO: 665728 - DNA, 25 bp, Rattus norvegicus
ttcagtcagatgtgccctcctgtga

SEQ ID NO: 665729 - DNA, 25 bp, Rattus norvegicus
ttcagtcagcttccgagcacattcc

SEQ ID NO: 665730 - DNA, 25 bp, Rattus norvegicus
ttcagtcagcttgcgagcacattcc

SEQ ID NO: 665731 - DNA, 25 bp, Rattus norvegicus
ttcagtcagtcacgcaaccctgtta

SEQ ID NO: 665732 - DNA, 25 bp, Rattus norvegicus
ttcagtcagtcaggcaaccctgtta

SEQ ID NO: 665733 - DNA, 25 bp, Rattus norvegicus
ttcagtcatcgacttcagcatccag

SEQ ID NO: 665734 - DNA, 25 bp, Rattus norvegicus
ttcagtcatcgagttcagcatccag

SEQ ID NO: 665735 - DNA, 25 bp, Rattus norvegicus
ttcagtcatttgaggaaactttcta

SEQ ID NO: 665736 - DNA, 25 bp, Rattus norvegicus
ttcagtcatttgtggaaactttcta

SEQ ID NO: 665737 - DNA, 25 bp, Rattus norvegicus
ttcagtccaagccttgagctcctat

SEQ ID NO: 665738 - DNA, 25 bp, Rattus norvegicus
ttcagtccaagcgttgagctcctat

SEQ ID NO: 665739 - DNA, 25 bp, Rattus norvegicus
ttcagtccatctatcaggagcaggg

SEQ ID NO: 665740 - DNA, 25 bp, Rattus norvegicus
ttcagtccatctttcaggagcaggg

SEQ ID NO: 665741 - DNA, 25 bp, Rattus norvegicus
ttcagtcccgtcagcccgaggagag

SEQ ID NO: 665742 - DNA, 25 bp, Rattus norvegicus
ttcagtcccgtctgcccgaggagag

SEQ ID NO: 665743 - DNA, 25 bp, Rattus norvegicus
ttcagtccgtatcactacagccagt

SEQ ID NO: 665744 - DNA, 25 bp, Rattus norvegicus
ttcagtccgtatgactacagccagt

SEQ ID NO: 665745 - DNA, 25 bp, Rattus norvegicus
ttcagtcctagcattgtgctttttt

SEQ ID NO: 665746 - DNA, 25 bp, Rattus norvegicus
ttcagtcctagctttgtgctttttt

SEQ ID NO: 665747 - DNA, 25 bp, Rattus norvegicus
ttcagtcctcagagcaaggccatgg

SEQ ID NO: 665748 - DNA, 25 bp, Rattus norvegicus
ttcagtcctcagtgcaaggccatgg

SEQ ID NO: 665749 - DNA, 25 bp, Rattus norvegicus
ttcagtcctcggcatcacaaggagg

SEQ ID NO: 665750 - DNA, 25 bp, Rattus norvegicus
ttcagtcctcgggatcacaaggagg

SEQ ID NO: 665751 - DNA, 25 bp, Rattus norvegicus
ttcagtcctggacttcagcagagcc

SEQ ID NO: 665752 - DNA, 25 bp, Rattus norvegicus
ttcagtcctggagttcagcagagcc

SEQ ID NO: 665753 - DNA, 25 bp, Rattus norvegicus
ttcagtcctgtgattgtagttggct

SEQ ID NO: 665754 - DNA, 25 bp, Rattus norvegicus
ttcagtcctgtgtttgtagttggct

SEQ ID NO: 665755 - DNA, 25 bp, Rattus norvegicus
ttcagtccttagctctgccagaaag

SEQ ID NO: 665756 - DNA, 25 bp, Rattus norvegicus
ttcagtccttaggtctgccagaaag

SEQ ID NO: 665757 - DNA, 25 bp, Rattus norvegicus
ttcagtcctttcatgtgtcaatcct

SEQ ID NO: 665758 - DNA, 25 bp, Rattus norvegicus
ttcagtcctttcttgtgtcaatcct

SEQ ID NO: 665759 - DNA, 25 bp, Rattus norvegicus
ttcagtcgccaccttggattttgag

SEQ ID NO: 665760 - DNA, 25 bp, Rattus norvegicus
ttcagtcgccacgttggattttgag

SEQ ID NO: 665761 - DNA, 25 bp, Rattus norvegicus
ttcagtctaaacacaaggcccacgt

SEQ ID NO: 665762 - DNA, 25 bp, Rattus norvegicus
ttcagtctaaactcaaggcccacgt

SEQ ID NO: 665763 - DNA, 25 bp, Rattus norvegicus
ttcagtctcaagagaccaacttcaa

SEQ ID NO: 665764 - DNA, 25 bp, Rattus norvegicus
ttcagtctcaagtgaccaacttcaa

SEQ ID NO: 665765 - DNA, 25 bp, Rattus norvegicus
ttcagtctcagcaccatgagtgagg

SEQ ID NO: 665766 - DNA, 25 bp, Rattus norvegicus
ttcagtctcagctccatgagtgagg

SEQ ID NO: 665767 - DNA, 25 bp, Rattus norvegicus
ttcagtctccagcttggtgtgccat

SEQ ID NO: 665768 - DNA, 25 bp, Rattus norvegicus
ttcagtctccaggttggtgtgccat

SEQ ID NO: 665769 - DNA, 25 bp, Rattus norvegicus
ttcagtctccatacaagcatacaga

SEQ ID NO: 665770 - DNA, 25 bp, Rattus norvegicus
ttcagtctccattcaagcatacaga

SEQ ID NO: 665771 - DNA, 25 bp, Rattus norvegicus
ttcagtctcctcagcaaagtctgca

SEQ ID NO: 665772 - DNA, 25 bp, Rattus norvegicus
ttcagtctcctctgcaaagtctgca

SEQ ID NO: 665773 - DNA, 25 bp, Rattus norvegicus
ttcagtctcgtgctcagtattgtga

SEQ ID NO: 665774 - DNA, 25 bp, Rattus norvegicus
ttcagtctcgtggtcagtattgtga

SEQ ID NO: 665775 - DNA, 25 bp, Rattus norvegicus
ttcagtctctgtaatttatctcaac

SEQ ID NO: 665776 - DNA, 25 bp, Rattus norvegicus
ttcagtctctgttatttatctcaac

SEQ ID NO: 665777 - DNA, 25 bp, Rattus norvegicus
ttcagtctggacatcacacttacac

SEQ ID NO: 665778 - DNA, 25 bp, Rattus norvegicus
ttcagtctggacttcacacttacac

SEQ ID NO: 665779 - DNA, 25 bp, Rattus norvegicus
ttcagtctggtcacactaagttatc

SEQ ID NO: 665780 - DNA, 25 bp, Rattus norvegicus
ttcagtctggtctcactaagttatc

SEQ ID NO: 665781 - DNA, 25 bp, Rattus norvegicus
ttcagtctgtccaggccaccatgat

SEQ ID NO: 665782 - DNA, 25 bp, Rattus norvegicus
ttcagtctgtcctggccaccatgat

SEQ ID NO: 665783 - DNA, 25 bp, Rattus norvegicus
ttcagtctgttgctcctgatgcagc

SEQ ID NO: 665784 - DNA, 25 bp, Rattus norvegicus
ttcagtctgttggtcctgatgcagc

SEQ ID NO: 665785 - DNA, 25 bp, Rattus norvegicus
ttcagtcttcctcgtgaggctgaca

SEQ ID NO: 665786 - DNA, 25 bp, Rattus norvegicus
ttcagtcttcctggtgaggctgaca

SEQ ID NO: 665787 - DNA, 25 bp, Rattus norvegicus
ttcagtcttgcccagggtctagcag

SEQ ID NO: 665788 - DNA, 25 bp, Rattus norvegicus
ttcagtcttgccgagggtctagcag

SEQ ID NO: 665789 - DNA, 25 bp, Rattus norvegicus
ttcagtctttatatccaggcacaac

SEQ ID NO: 665790 - DNA, 25 bp, Rattus norvegicus
ttcagtctttatttccaggcacaac

SEQ ID NO: 665791 - DNA, 25 bp, Rattus norvegicus
ttcagtgaacacaaggcccaggact

SEQ ID NO: 665792 - DNA, 25 bp, Rattus norvegicus
ttcagtgaacactaggcccaggact

SEQ ID NO: 665793 - DNA, 25 bp, Rattus norvegicus
ttcagtgacctcactcctctagatt

SEQ ID NO: 665794 - DNA, 25 bp, Rattus norvegicus
ttcagtgacctctctcctctagatt

SEQ ID NO: 665795 - DNA, 25 bp, Rattus norvegicus
ttcagtgacgtcaggtcggaagcca

SEQ ID NO: 665796 - DNA, 25 bp, Rattus norvegicus
ttcagtgacgtctggtcggaagcca

SEQ ID NO: 665797 - DNA, 25 bp, Rattus norvegicus
ttcagtgactcacggctcagttcag

SEQ ID NO: 665798 - DNA, 25 bp, Rattus norvegicus
ttcagtgactcagggctcagttcag

SEQ ID NO: 665799 - DNA, 25 bp, Rattus norvegicus
ttcagtgactttccgaggccacagg

SEQ ID NO: 665800 - DNA, 25 bp, Rattus norvegicus
ttcagtgactttgcgaggccacagg

SEQ ID NO: 665801 - DNA, 25 bp, Rattus norvegicus
ttcagtgagacacaggcttcagcct

SEQ ID NO: 665802 - DNA, 25 bp, Rattus norvegicus
ttcagtgagacagaggcttcagcct

SEQ ID NO: 665803 - DNA, 25 bp, Rattus norvegicus
ttcagtgatagtcttcctccatcaa

SEQ ID NO: 665804 - DNA, 25 bp, Rattus norvegicus
ttcagtgatagtgttcctccatcaa

SEQ ID NO: 665805 - DNA, 25 bp, Rattus norvegicus
ttcagtgattcacataaagtggtct

SEQ ID NO: 665806 - DNA, 25 bp, Rattus norvegicus
ttcagtgattcagataaagtggtct

SEQ ID NO: 665807 - DNA, 25 bp, Rattus norvegicus
ttcagtgattgaatggctcctacgg

SEQ ID NO: 665808 - DNA, 25 bp, Rattus norvegicus
ttcagtgattgattggctcctacgg

SEQ ID NO: 665809 - DNA, 25 bp, Rattus norvegicus
ttcagtgatttaccccttttcctgt

SEQ ID NO: 665810 - DNA, 25 bp, Rattus norvegicus
ttcagtgatttagcccttttcctgt

SEQ ID NO: 665811 - DNA, 25 bp, Rattus norvegicus
ttcagtgcacacaccagtggcacac

SEQ ID NO: 665812 - DNA, 25 bp, Rattus norvegicus
ttcagtgcacactccagtggcacac

SEQ ID NO: 665813 - DNA, 25 bp, Rattus norvegicus
ttcagtgcacatcaagcccgtcagg

SEQ ID NO: 665814 - DNA, 25 bp, Rattus norvegicus
ttcagtgcacatgaagcccgtcagg

SEQ ID NO: 665815 - DNA, 25 bp, Rattus norvegicus
ttcagtgccccaattcagccatagg

SEQ ID NO: 665816 - DNA, 25 bp, Rattus norvegicus
ttcagtgccccatttcagccatagg

SEQ ID NO: 665817 - DNA, 25 bp, Rattus norvegicus
ttcagtgcgccacgaggaaagtcga

SEQ ID NO: 665818 - DNA, 25 bp, Rattus norvegicus
ttcagtgcgccaggaggaaagtcga

SEQ ID NO: 665819 - DNA, 25 bp, Rattus norvegicus
ttcagtgctcagcaccaacatggta

SEQ ID NO: 665820 - DNA, 25 bp, Rattus norvegicus
ttcagtgctcaggaccaacatggta

SEQ ID NO: 665821 - DNA, 25 bp, Rattus norvegicus
ttcagtgctcccctgaggaggaact

SEQ ID NO: 665822 - DNA, 25 bp, Rattus norvegicus
ttcagtgctcccgtgaggaggaact

SEQ ID NO: 665823 - DNA, 25 bp, Rattus norvegicus
ttcagtgctctcaggaacccttagg

SEQ ID NO: 665824 - DNA, 25 bp, Rattus norvegicus
ttcagtgctctctggaacccttagg

SEQ ID NO: 665825 - DNA, 25 bp, Rattus norvegicus
ttcagtgcttttagagtttctcatt

SEQ ID NO: 665826 - DNA, 25 bp, Rattus norvegicus
ttcagtgctttttgagtttctcatt

SEQ ID NO: 665827 - DNA, 25 bp, Rattus norvegicus
ttcagtggaactcgtgagtgactca

SEQ ID NO: 665828 - DNA, 25 bp, Rattus norvegicus
ttcagtggaactggtgagtgactca

SEQ ID NO: 665829 - DNA, 25 bp, Rattus norvegicus
ttcagtggactgattcttctcttgc

SEQ ID NO: 665830 - DNA, 25 bp, Rattus norvegicus
ttcagtggactgtttcttctcttgc

SEQ ID NO: 665831 - DNA, 25 bp, Rattus norvegicus
ttcagtggcctgaccgtggaagagt

SEQ ID NO: 665832 - DNA, 25 bp, Rattus norvegicus
ttcagtggcctgtccgtggaagagt

SEQ ID NO: 665833 - DNA, 25 bp, Rattus norvegicus
ttcagtgggaaaaggctcctgctgc

SEQ ID NO: 665834 - DNA, 25 bp, Rattus norvegicus
ttcagtgggaaatggctcctgctgc

SEQ ID NO: 665835 - DNA, 25 bp, Rattus norvegicus
ttcagtgggaagactgacctctgct

SEQ ID NO: 665836 - DNA, 25 bp, Rattus norvegicus
ttcagtgggaagtctgacctctgct

SEQ ID NO: 665837 - DNA, 25 bp, Rattus norvegicus
ttcagtgggctcattcgatggacat

SEQ ID NO: 665838 - DNA, 25 bp, Rattus norvegicus
ttcagtgggctctttcgatggacat

SEQ ID NO: 665839 - DNA, 25 bp, Rattus norvegicus
ttcagtgggtagagccaggcctgcc

SEQ ID NO: 665840 - DNA, 25 bp, Rattus norvegicus
ttcagtgggtagtgccaggcctgcc

SEQ ID NO: 665841 - DNA, 25 bp, Rattus norvegicus
ttcagtgtagatagaccctcatgcc

SEQ ID NO: 665842 - DNA, 25 bp, Rattus norvegicus
ttcagtgtagattgaccctcatgcc

SEQ ID NO: 665843 - DNA, 25 bp, Rattus norvegicus
ttcagtgtagcgattagtttattca

SEQ ID NO: 665844 - DNA, 25 bp, Rattus norvegicus
ttcagtgtagcgtttagtttattca

SEQ ID NO: 665845 - DNA, 25 bp, Rattus norvegicus
ttcagtgtagctaaacccatgttgt

SEQ ID NO: 665846 - DNA, 25 bp, Rattus norvegicus
ttcagtgtagcttaacccatgttgt

SEQ ID NO: 665847 - DNA, 25 bp, Rattus norvegicus
ttcagtgtcacaatctcttatccag

SEQ ID NO: 665848 - DNA, 25 bp, Rattus norvegicus
ttcagtgtcacattctcttatccag

SEQ ID NO: 665849 - DNA, 25 bp, Rattus norvegicus
ttcagtgtcactactccacaaaggc

SEQ ID NO: 665850 - DNA, 25 bp, Rattus norvegicus
ttcagtgtcacttctccacaaaggc

SEQ ID NO: 665851 - DNA, 25 bp, Rattus norvegicus
ttcagtgtccccaagcaaggatctt

SEQ ID NO: 665852 - DNA, 25 bp, Rattus norvegicus
ttcagtgtcccctagcaaggatctt

SEQ ID NO: 665853 - DNA, 25 bp, Rattus norvegicus
ttcagtgtccgtcacctgcttgggc

SEQ ID NO: 665854 - DNA, 25 bp, Rattus norvegicus
ttcagtgtccgtgacctgcttgggc

SEQ ID NO: 665855 - DNA, 25 bp, Rattus norvegicus
ttcagtgtcctaccggaatgcaagt

SEQ ID NO: 665856 - DNA, 25 bp, Rattus norvegicus
ttcagtgtcctagcggaatgcaagt

SEQ ID NO: 665857 - DNA, 25 bp, Rattus norvegicus
ttcagtgtcctcagacggcctggag

SEQ ID NO: 665858 - DNA, 25 bp, Rattus norvegicus
ttcagtgtcctctgacggcctggag

SEQ ID NO: 665859 - DNA, 25 bp, Rattus norvegicus
ttcagtgtccttagaaggccgccgt

SEQ ID NO: 665860 - DNA, 25 bp, Rattus norvegicus
ttcagtgtcctttgaaggccgccgt

SEQ ID NO: 665861 - DNA, 25 bp, Rattus norvegicus
ttcagtgtctcacatggcctcctgg

SEQ ID NO: 665862 - DNA, 25 bp, Rattus norvegicus
ttcagtgtctcagatggcctcctgg

SEQ ID NO: 665863 - DNA, 25 bp, Rattus norvegicus
ttcagtgtctgaactttgccttcga

SEQ ID NO: 665864 - DNA, 25 bp, Rattus norvegicus
ttcagtgtctgatctttgccttcga

SEQ ID NO: 665865 - DNA, 25 bp, Rattus norvegicus
ttcagtgtctgcattcggaagtgga

SEQ ID NO: 665866 - DNA, 25 bp, Rattus norvegicus
ttcagtgtctgctttcggaagtgga

SEQ ID NO: 665867 - DNA, 25 bp, Rattus norvegicus
ttcagtgtcttaaatgctcgcctta

SEQ ID NO: 665868 - DNA, 25 bp, Rattus norvegicus
ttcagtgtcttatatgctcgcctta

SEQ ID NO: 665869 - DNA, 25 bp, Rattus norvegicus
ttcagtgtgtttaatatcagagttg

SEQ ID NO: 665870 - DNA, 25 bp, Rattus norvegicus
ttcagtgtgttttatatcagagttg

SEQ ID NO: 665871 - DNA, 25 bp, Rattus norvegicus
ttcagtgtttctagacaacgacgtc

SEQ ID NO: 665872 - DNA, 25 bp, Rattus norvegicus
ttcagtgtttcttgacaacgacgtc

SEQ ID NO: 665873 - DNA, 25 bp, Rattus norvegicus
ttcagtgtttggaaccttcccagag

SEQ ID NO: 665874 - DNA, 25 bp, Rattus norvegicus
ttcagtgtttggtaccttcccagag

SEQ ID NO: 665875 - DNA, 25 bp, Rattus norvegicus
ttcagtgttttgagactactcagtc

SEQ ID NO: 665876 - DNA, 25 bp, Rattus norvegicus
ttcagtgttttgtgactactcagtc

SEQ ID NO: 665877 - DNA, 25 bp, Rattus norvegicus
ttcagttaaagtccacagtctgtta

SEQ ID NO: 665878 - DNA, 25 bp, Rattus norvegicus
ttcagttaaagtgcacagtctgtta

SEQ ID NO: 665879 - DNA, 25 bp, Rattus norvegicus
ttcagttaagtaatttgtatcccaa

SEQ ID NO: 665880 - DNA, 25 bp, Rattus norvegicus
ttcagttaagtattttgtatcccaa

SEQ ID NO: 665881 - DNA, 25 bp, Rattus norvegicus
ttcagttaagtcacagttccaaagg

SEQ ID NO: 665882 - DNA, 25 bp, Rattus norvegicus
ttcagttaagtctcagttccaaagg

SEQ ID NO: 665883 - DNA, 25 bp, Rattus norvegicus
ttcagttacctcctctggccggaag

SEQ ID NO: 665884 - DNA, 25 bp, Rattus norvegicus
ttcagttacctcgtctggccggaag

SEQ ID NO: 665885 - DNA, 25 bp, Rattus norvegicus
ttcagttactgcattatcatcttca

SEQ ID NO: 665886 - DNA, 25 bp, Rattus norvegicus
ttcagttactgctttatcatcttca

SEQ ID NO: 665887 - DNA, 25 bp, Rattus norvegicus
ttcagttagccgacaccagagtttt

SEQ ID NO: 665888 - DNA, 25 bp, Rattus norvegicus
ttcagttagccgtcaccagagtttt

SEQ ID NO: 665889 - DNA, 25 bp, Rattus norvegicus
ttcagttagggcagcattctcaccc

SEQ ID NO: 665890 - DNA, 25 bp, Rattus norvegicus
ttcagttagggctgcattctcaccc

SEQ ID NO: 665891 - DNA, 25 bp, Rattus norvegicus
ttcagttcagtaagtggcgtgttgc

SEQ ID NO: 665892 - DNA, 25 bp, Rattus norvegicus
ttcagttcagtatgtggcgtgttgc

SEQ ID NO: 665893 - DNA, 25 bp, Rattus norvegicus
ttcagttcatttacctgatcagagg

SEQ ID NO: 665894 - DNA, 25 bp, Rattus norvegicus
ttcagttcattttcctgatcagagg

SEQ ID NO: 665895 - DNA, 25 bp, Rattus norvegicus
ttcagttccaagctcagtgtggctt

SEQ ID NO: 665896 - DNA, 25 bp, Rattus norvegicus
ttcagttccaaggtcagtgtggctt

SEQ ID NO: 665897 - DNA, 25 bp, Rattus norvegicus
ttcagttcccagctggtacgatcac

SEQ ID NO: 665898 - DNA, 25 bp, Rattus norvegicus
ttcagttcccaggtggtacgatcac

SEQ ID NO: 665899 - DNA, 25 bp, Rattus norvegicus
ttcagttcctacagcaagctctata

SEQ ID NO: 665900 - DNA, 25 bp, Rattus norvegicus
ttcagttcctactgcaagctctata

SEQ ID NO: 665901 - DNA, 25 bp, Rattus norvegicus
ttcagttcctcaagttccagacacc

SEQ ID NO: 665902 - DNA, 25 bp, Rattus norvegicus
ttcagttcctcatgttccagacacc

SEQ ID NO: 665903 - DNA, 25 bp, Rattus norvegicus
ttcagttcctggcacccatatggta

SEQ ID NO: 665904 - DNA, 25 bp, Rattus norvegicus
ttcagttcctgggacccatatggta

SEQ ID NO: 665905 - DNA, 25 bp, Rattus norvegicus
ttcagttctaagatgcatctgccct

SEQ ID NO: 665906 - DNA, 25 bp, Rattus norvegicus
ttcagttctaagttgcatctgccct

SEQ ID NO: 665907 - DNA, 25 bp, Rattus norvegicus
ttcagttctcagagtcttgggacaa

SEQ ID NO: 665908 - DNA, 25 bp, Rattus norvegicus
ttcagttctcagtgtcttgggacaa

SEQ ID NO: 665909 - DNA, 25 bp, Rattus norvegicus
ttcagttctcatactgtacgccaca

SEQ ID NO: 665910 - DNA, 25 bp, Rattus norvegicus
ttcagttctcattctgtacgccaca

SEQ ID NO: 665911 - DNA, 25 bp, Rattus norvegicus
ttcagttctccaatcaaaagtcata

SEQ ID NO: 665912 - DNA, 25 bp, Rattus norvegicus
ttcagttctccattcaaaagtcata

SEQ ID NO: 665913 - DNA, 25 bp, Rattus norvegicus
ttcagttcttaaaaaccaggtgccg

SEQ ID NO: 665914 - DNA, 25 bp, Rattus norvegicus
ttcagttcttaaactcatgccaaaa

SEQ ID NO: 665915 - DNA, 25 bp, Rattus norvegicus
ttcagttcttaataaccaggtgccg

SEQ ID NO: 665916 - DNA, 25 bp, Rattus norvegicus
ttcagttcttaatctcatgccaaaa

SEQ ID NO: 665917 - DNA, 25 bp, Rattus norvegicus
ttcagttcttcaatgaagtccaggg

SEQ ID NO: 665918 - DNA, 25 bp, Rattus norvegicus
ttcagttcttcattgaagtccaggg

SEQ ID NO: 665919 - DNA, 25 bp, Rattus norvegicus
ttcagttgatgtctcttctctgtcc

SEQ ID NO: 665920 - DNA, 25 bp, Rattus norvegicus
ttcagttgatgtgtcttctctgtcc

SEQ ID NO: 665921 - DNA, 25 bp, Rattus norvegicus
ttcagttgcccgaggtagcgaggac

SEQ ID NO: 665922 - DNA, 25 bp, Rattus norvegicus
ttcagttgcccgtggtagcgaggac

SEQ ID NO: 665923 - DNA, 25 bp, Rattus norvegicus
ttcagttggcttaggtgggttttca

SEQ ID NO: 665924 - DNA, 25 bp, Rattus norvegicus
ttcagttggctttggtgggttttca

SEQ ID NO: 665925 - DNA, 25 bp, Rattus norvegicus
ttcagtttaaaccttgttagtgttg

SEQ ID NO: 665926 - DNA, 25 bp, Rattus norvegicus
ttcagtttaaacgttgttagtgttg

SEQ ID NO: 665927 - DNA, 25 bp, Rattus norvegicus
ttcagtttaacccttgcccatcata

SEQ ID NO: 665928 - DNA, 25 bp, Rattus norvegicus
ttcagtttaaccgttgcccatcata

SEQ ID NO: 665929 - DNA, 25 bp, Rattus norvegicus
ttcagtttacccatcagtgagccta

SEQ ID NO: 665930 - DNA, 25 bp, Rattus norvegicus
ttcagtttacccttcagtgagccta

SEQ ID NO: 665931 - DNA, 25 bp, Rattus norvegicus
ttcagtttatccacctcatcattaa

SEQ ID NO: 665932 - DNA, 25 bp, Rattus norvegicus
ttcagtttatcctcctcatcattaa

SEQ ID NO: 665933 - DNA, 25 bp, Rattus norvegicus
ttcagtttattccttctattcacga

SEQ ID NO: 665934 - DNA, 25 bp, Rattus norvegicus
ttcagtttattcgttctattcacga

SEQ ID NO: 665935 - DNA, 25 bp, Rattus norvegicus
ttcagtttcaggagcatacaccaga

SEQ ID NO: 665936 - DNA, 25 bp, Rattus norvegicus
ttcagtttcaggtgcatacaccaga

SEQ ID NO: 665937 - DNA, 25 bp, Rattus norvegicus
ttcagtttccagaaaccacagctca

SEQ ID NO: 665938 - DNA, 25 bp, Rattus norvegicus
ttcagtttccagacagccgtgtaga

SEQ ID NO: 665939 - DNA, 25 bp, Rattus norvegicus
ttcagtttccagacctggtatgcct

SEQ ID NO: 665940 - DNA, 25 bp, Rattus norvegicus
ttcagtttccagtaaccacagctca

SEQ ID NO: 665941 - DNA, 25 bp, Rattus norvegicus
ttcagtttccagtcagccgtgtaga

SEQ ID NO: 665942 - DNA, 25 bp, Rattus norvegicus
ttcagtttccagtcctggtatgcct

SEQ ID NO: 665943 - DNA, 25 bp, Rattus norvegicus
ttcagtttcctcatcactaaattag

SEQ ID NO: 665944 - DNA, 25 bp, Rattus norvegicus
ttcagtttcctcttcactaaattag

SEQ ID NO: 665945 - DNA, 25 bp, Rattus norvegicus
ttcagtttcctgcttagttcatcag

SEQ ID NO: 665946 - DNA, 25 bp, Rattus norvegicus
ttcagtttcctggttagttcatcag

SEQ ID NO: 665947 - DNA, 25 bp, Rattus norvegicus
ttcagtttcttcattttcagaccaa

SEQ ID NO: 665948 - DNA, 25 bp, Rattus norvegicus
ttcagtttcttctttttcagaccaa

SEQ ID NO: 665949 - DNA, 25 bp, Rattus norvegicus
ttcagtttcttgaggatttcaggca

SEQ ID NO: 665950 - DNA, 25 bp, Rattus norvegicus
ttcagtttcttgtggatttcaggca

SEQ ID NO: 665951 - DNA, 25 bp, Rattus norvegicus
ttcagtttctttcactggaacagta

SEQ ID NO: 665952 - DNA, 25 bp, Rattus norvegicus
ttcagtttctttgactggaacagta

SEQ ID NO: 665953 - DNA, 25 bp, Rattus norvegicus
ttcagtttgccaaatcagataccca

SEQ ID NO: 665954 - DNA, 25 bp, Rattus norvegicus
ttcagtttgccatatcagataccca

SEQ ID NO: 665955 - DNA, 25 bp, Rattus norvegicus
ttcagtttggaaaccatgcccctta

SEQ ID NO: 665956 - DNA, 25 bp, Rattus norvegicus
ttcagtttggaatccatgcccctta

SEQ ID NO: 665957 - DNA, 25 bp, Rattus norvegicus
ttcagtttggtcactctaatctaga

SEQ ID NO: 665958 - DNA, 25 bp, Rattus norvegicus
ttcagtttggtctctctaatctaga

SEQ ID NO: 665959 - DNA, 25 bp, Rattus norvegicus
ttcagtttgtcccattccgagatta

SEQ ID NO: 665960 - DNA, 25 bp, Rattus norvegicus
ttcagtttgtccgattccgagatta

SEQ ID NO: 665961 - DNA, 25 bp, Rattus norvegicus
ttcagttttcgcctttgttccacaa

SEQ ID NO: 665962 - DNA, 25 bp, Rattus norvegicus
ttcagttttcgcgtttgttccacaa

SEQ ID NO: 665963 - DNA, 25 bp, Rattus norvegicus
ttcagttttctcacgccctagtctt

SEQ ID NO: 665964 - DNA, 25 bp, Rattus norvegicus
ttcagttttctctcgccctagtctt

SEQ ID NO: 665965 - DNA, 25 bp, Rattus norvegicus
ttcagttttctgacactgccaaagc

SEQ ID NO: 665966 - DNA, 25 bp, Rattus norvegicus
ttcagttttctgtcactgccaaagc

SEQ ID NO: 665967 - DNA, 25 bp, Rattus norvegicus
ttcagttttcttagtgtcacttggg

SEQ ID NO: 665968 - DNA, 25 bp, Rattus norvegicus
ttcagttttctttgtgtcacttggg

SEQ ID NO: 665969 - DNA, 25 bp, Rattus norvegicus
ttcagttttgctacagggtgataca

SEQ ID NO: 665970 - DNA, 25 bp, Rattus norvegicus
ttcagttttgcttcagggtgataca

SEQ ID NO: 665971 - DNA, 25 bp, Rattus norvegicus
ttcataaaaattacacctgcaaggt

SEQ ID NO: 665972 - DNA, 25 bp, Rattus norvegicus
ttcataaaaatttcacctgcaaggt

SEQ ID NO: 665973 - DNA, 25 bp, Rattus norvegicus
ttcataaaacatatggtcctgcccc

SEQ ID NO: 665974 - DNA, 25 bp, Rattus norvegicus
ttcataaaacatttggtcctgcccc

SEQ ID NO: 665975 - DNA, 25 bp, Rattus norvegicus
ttcataaatctaaacccgtgtgtgt

SEQ ID NO: 665976 - DNA, 25 bp, Rattus norvegicus
ttcataaatctatacccgtgtgtgt

SEQ ID NO: 665977 - DNA, 25 bp, Rattus norvegicus
ttcataacccagctgtggaccacag

SEQ ID NO: 665978 - DNA, 25 bp, Rattus norvegicus
ttcataacccaggtgtggaccacag

SEQ ID NO: 665979 - DNA, 25 bp, Rattus norvegicus
ttcataagcacgactgatggccagc

SEQ ID NO: 665980 - DNA, 25 bp, Rattus norvegicus
ttcataagcacgtctgatggccagc

SEQ ID NO: 665981 - DNA, 25 bp, Rattus norvegicus
ttcataagccttcctctcaggagga

SEQ ID NO: 665982 - DNA, 25 bp, Rattus norvegicus
ttcataagccttgctctcaggagga

SEQ ID NO: 665983 - DNA, 25 bp, Rattus norvegicus
ttcataatgcgcctctaattccacc

SEQ ID NO: 665984 - DNA, 25 bp, Rattus norvegicus
ttcataatgcgcgtctaattccacc

SEQ ID NO: 665985 - DNA, 25 bp, Rattus norvegicus
ttcataatgtctagatccgctctcg

SEQ ID NO: 665986 - DNA, 25 bp, Rattus norvegicus
ttcataatgtcttgatccgctctcg

SEQ ID NO: 665987 - DNA, 25 bp, Rattus norvegicus
ttcatacagcacaacctcctagagt

SEQ ID NO: 665988 - DNA, 25 bp, Rattus norvegicus
ttcatacagcactacctcctagagt

SEQ ID NO: 665989 - DNA, 25 bp, Rattus norvegicus
ttcatacagggtaaagagctcatca

SEQ ID NO: 665990 - DNA, 25 bp, Rattus norvegicus
ttcatacagggtccttacgtatctg

SEQ ID NO: 665991 - DNA, 25 bp, Rattus norvegicus
ttcatacagggtgcttacgtatctg

SEQ ID NO: 665992 - DNA, 25 bp, Rattus norvegicus
ttcatacagggttaagagctcatca

SEQ ID NO: 665993 - DNA, 25 bp, Rattus norvegicus
ttcatacatctgaataccactcctc

SEQ ID NO: 665994 - DNA, 25 bp, Rattus norvegicus
ttcatacatctgtataccactcctc

SEQ ID NO: 665995 - DNA, 25 bp, Rattus norvegicus
ttcatacattcaactgtccggcaga

SEQ ID NO: 665996 - DNA, 25 bp, Rattus norvegicus
ttcatacattcatctgtccggcaga

SEQ ID NO: 665997 - DNA, 25 bp, Rattus norvegicus
ttcataccaaagatcccaagtcctt

SEQ ID NO: 665998 - DNA, 25 bp, Rattus norvegicus
ttcataccaaagttcccaagtcctt

SEQ ID NO: 665999 - DNA, 25 bp, Rattus norvegicus
ttcatacccactaactcttggaggg

SEQ ID NO: 666000 - DNA, 25 bp, Rattus norvegicus
ttcatacccacttactcttggaggg

SEQ ID NO: 666001 - DNA, 25 bp, Rattus norvegicus
ttcatacctgccaagcgtgttagaa

SEQ ID NO: 666002 - DNA, 25 bp, Rattus norvegicus
ttcatacctgcctagcgtgttagaa

SEQ ID NO: 666003 - DNA, 25 bp, Rattus norvegicus
ttcatactagtcactttctggccga

SEQ ID NO: 666004 - DNA, 25 bp, Rattus norvegicus
ttcatactagtctctttctggccga

SEQ ID NO: 666005 - DNA, 25 bp, Rattus norvegicus
ttcatactagttattgggtaactgt

SEQ ID NO: 666006 - DNA, 25 bp, Rattus norvegicus
ttcatactagtttttgggtaactgt

SEQ ID NO: 666007 - DNA, 25 bp, Rattus norvegicus
ttcatactgatgagaaactctttca

SEQ ID NO: 666008 - DNA, 25 bp, Rattus norvegicus
ttcatactgatgtgaaactctttca

SEQ ID NO: 666009 - DNA, 25 bp, Rattus norvegicus
ttcatactgggtcacgagccgagct

SEQ ID NO: 666010 - DNA, 25 bp, Rattus norvegicus
ttcatactgggtgacgagccgagct

SEQ ID NO: 666011 - DNA, 25 bp, Rattus norvegicus
ttcatacttgttatctgggatggag

SEQ ID NO: 666012 - DNA, 25 bp, Rattus norvegicus
ttcatacttgttttctgggatggag

SEQ ID NO: 666013 - DNA, 25 bp, Rattus norvegicus
ttcatactttgaatcccaaactaag

SEQ ID NO: 666014 - DNA, 25 bp, Rattus norvegicus
ttcatactttgattcccaaactaag

SEQ ID NO: 666015 - DNA, 25 bp, Rattus norvegicus
ttcatactttggattgatcacatat

SEQ ID NO: 666016 - DNA, 25 bp, Rattus norvegicus
ttcatactttggtttgatcacatat

SEQ ID NO: 666017 - DNA, 25 bp, Rattus norvegicus
ttcatagaagttcctgcagtccagt

SEQ ID NO: 666018 - DNA, 25 bp, Rattus norvegicus
ttcatagaagttgctgcagtccagt

SEQ ID NO: 666019 - DNA, 25 bp, Rattus norvegicus
ttcatagactttacctcaaatcctt

SEQ ID NO: 666020 - DNA, 25 bp, Rattus norvegicus
ttcatagacttttcctcaaatcctt

SEQ ID NO: 666021 - DNA, 25 bp, Rattus norvegicus
ttcatagccactaagacttacctct

SEQ ID NO: 666022 - DNA, 25 bp, Rattus norvegicus
ttcatagccacttagacttacctct

SEQ ID NO: 666023 - DNA, 25 bp, Rattus norvegicus
ttcatagccattaccatcatcagtt

SEQ ID NO: 666024 - DNA, 25 bp, Rattus norvegicus
ttcatagccatttccatcatcagtt

SEQ ID NO: 666025 - DNA, 25 bp, Rattus norvegicus
ttcatagccggtaccttccagaagg

SEQ ID NO: 666026 - DNA, 25 bp, Rattus norvegicus
ttcatagccggttccttccagaagg

SEQ ID NO: 666027 - DNA, 25 bp, Rattus norvegicus
ttcatagcctttattctagccattt

SEQ ID NO: 666028 - DNA, 25 bp, Rattus norvegicus
ttcatagccttttttctagccattt

SEQ ID NO: 666029 - DNA, 25 bp, Rattus norvegicus
ttcatagctctgactgtcatggaac

SEQ ID NO: 666030 - DNA, 25 bp, Rattus norvegicus
ttcatagctctgtctgtcatggaac

SEQ ID NO: 666031 - DNA, 25 bp, Rattus norvegicus
ttcatagcttcacaggacatccgga

SEQ ID NO: 666032 - DNA, 25 bp, Rattus norvegicus
ttcatagcttcaccgtcactgtgga

SEQ ID NO: 666033 - DNA, 25 bp, Rattus norvegicus
ttcatagcttcagaggacatccgga

SEQ ID NO: 666034 - DNA, 25 bp, Rattus norvegicus
ttcatagcttcagcgtcactgtgga

SEQ ID NO: 666035 - DNA, 25 bp, Rattus norvegicus
ttcatagtccggcttctcaaaagag

SEQ ID NO: 666036 - DNA, 25 bp, Rattus norvegicus
ttcatagtccgggttctcaaaagag

SEQ ID NO: 666037 - DNA, 25 bp, Rattus norvegicus
ttcatagtgccaacagagctgaggt

SEQ ID NO: 666038 - DNA, 25 bp, Rattus norvegicus
ttcatagtgccatcagagctgaggt

SEQ ID NO: 666039 - DNA, 25 bp, Rattus norvegicus
ttcatagtgttcagtgacccttgct

SEQ ID NO: 666040 - DNA, 25 bp, Rattus norvegicus
ttcatagtgttctgtgacccttgct

SEQ ID NO: 666041 - DNA, 25 bp, Rattus norvegicus
ttcatatatgatcctgggtcccagc

SEQ ID NO: 666042 - DNA, 25 bp, Rattus norvegicus
ttcatatatgatgctgggtcccagc

SEQ ID NO: 666043 - DNA, 25 bp, Rattus norvegicus
ttcatatcgtttaacgtggcctgcc

SEQ ID NO: 666044 - DNA, 25 bp, Rattus norvegicus
ttcatatcgttttacgtggcctgcc

SEQ ID NO: 666045 - DNA, 25 bp, Rattus norvegicus
ttcatatctgctatctttcctgtgt

SEQ ID NO: 666046 - DNA, 25 bp, Rattus norvegicus
ttcatatctgctttctttcctgtgt

SEQ ID NO: 666047 - DNA, 25 bp, Rattus norvegicus
ttcatatctggtcaacgtcataata

SEQ ID NO: 666048 - DNA, 25 bp, Rattus norvegicus
ttcatatctggtgaacgtcataata

SEQ ID NO: 666049 - DNA, 25 bp, Rattus norvegicus
ttcatatgactcagtaccaacccct

SEQ ID NO: 666050 - DNA, 25 bp, Rattus norvegicus
ttcatatgactctgtaccaacccct

SEQ ID NO: 666051 - DNA, 25 bp, Rattus norvegicus
ttcatattctcacatgttgtccttt

SEQ ID NO: 666052 - DNA, 25 bp, Rattus norvegicus
ttcatattctcagatgttgtccttt

SEQ ID NO: 666053 - DNA, 25 bp, Rattus norvegicus
ttcatatttcaaaaagactcacttt

SEQ ID NO: 666054 - DNA, 25 bp, Rattus norvegicus
ttcatatttcaataagactcacttt

SEQ ID NO: 666055 - DNA, 25 bp, Rattus norvegicus
ttcatatttgtaacttgtgccctat

SEQ ID NO: 666056 - DNA, 25 bp, Rattus norvegicus
ttcatatttgtatcttgtgccctat

SEQ ID NO: 666057 - DNA, 25 bp, Rattus norvegicus
ttcatcaaaccacggctgtctgtgg

SEQ ID NO: 666058 - DNA, 25 bp, Rattus norvegicus
ttcatcaaaccagggctgtctgtgg

SEQ ID NO: 666059 - DNA, 25 bp, Rattus norvegicus
ttcatcaacagcatagaccacaggg

SEQ ID NO: 666060 - DNA, 25 bp, Rattus norvegicus
ttcatcaacagcttagaccacaggg

SEQ ID NO: 666061 - DNA, 25 bp, Rattus norvegicus
ttcatcaatatcaactcgctcaggc

SEQ ID NO: 666062 - DNA, 25 bp, Rattus norvegicus
ttcatcaatatctactcgctcaggc

SEQ ID NO: 666063 - DNA, 25 bp, Rattus norvegicus
ttcatcacacaactcctcaggagca

SEQ ID NO: 666064 - DNA, 25 bp, Rattus norvegicus
ttcatcacacaagtcctcaggagca

SEQ ID NO: 666065 - DNA, 25 bp, Rattus norvegicus
ttcatcacacttctttaaatacatt

SEQ ID NO: 666066 - DNA, 25 bp, Rattus norvegicus
ttcatcacacttgtttaaatacatt

SEQ ID NO: 666067 - DNA, 25 bp, Rattus norvegicus
ttcatcagaccaattcatacccaga

SEQ ID NO: 666068 - DNA, 25 bp, Rattus norvegicus
ttcatcagaccatttcatacccaga

SEQ ID NO: 666069 - DNA, 25 bp, Rattus norvegicus
ttcatcagagttcgttttggagtta

SEQ ID NO: 666070 - DNA, 25 bp, Rattus norvegicus
ttcatcagagttggttttggagtta

SEQ ID NO: 666071 - DNA, 25 bp, Rattus norvegicus
ttcatcagcatcctgatcgtgcagt

SEQ ID NO: 666072 - DNA, 25 bp, Rattus norvegicus
ttcatcagcatcgtgatcgtgcagt

SEQ ID NO: 666073 - DNA, 25 bp, Rattus norvegicus
ttcatcagcatgcacgacgactcag

SEQ ID NO: 666074 - DNA, 25 bp, Rattus norvegicus
ttcatcagcatggacgacgactcag

SEQ ID NO: 666075 - DNA, 25 bp, Rattus norvegicus
ttcatcagccggattttgttattga

SEQ ID NO: 666076 - DNA, 25 bp, Rattus norvegicus
ttcatcagccggtttttgttattga

SEQ ID NO: 666077 - DNA, 25 bp, Rattus norvegicus
ttcatcagcgtgctaccactgggac

SEQ ID NO: 666078 - DNA, 25 bp, Rattus norvegicus
ttcatcagcgtggtaccactgggac

SEQ ID NO: 666079 - DNA, 25 bp, Rattus norvegicus
ttcatcagggctcctgaggtgctga

SEQ ID NO: 666080 - DNA, 25 bp, Rattus norvegicus
ttcatcagggctgctgaggtgctga

SEQ ID NO: 666081 - DNA, 25 bp, Rattus norvegicus
ttcatcagtcttcacgtggtattct

SEQ ID NO: 666082 - DNA, 25 bp, Rattus norvegicus
ttcatcagtcttgacgtggtattct

SEQ ID NO: 666083 - DNA, 25 bp, Rattus norvegicus
ttcatcatactacctcagtttccct

SEQ ID NO: 666084 - DNA, 25 bp, Rattus norvegicus
ttcatcatactagctcagtttccct

SEQ ID NO: 666085 - DNA, 25 bp, Rattus norvegicus
ttcatcatatttatgcctccccaac

SEQ ID NO: 666086 - DNA, 25 bp, Rattus norvegicus
ttcatcatatttttgcctccccaac

SEQ ID NO: 666087 - DNA, 25 bp, Rattus norvegicus
ttcatcatcatacgctccatctgtg

SEQ ID NO: 666088 - DNA, 25 bp, Rattus norvegicus
ttcatcatcataggctccatctgtg

SEQ ID NO: 666089 - DNA, 25 bp, Rattus norvegicus
ttcatcatctgcaggtttccttact

SEQ ID NO: 666090 - DNA, 25 bp, Rattus norvegicus
ttcatcatctgctggtttccttact

SEQ ID NO: 666091 - DNA, 25 bp, Rattus norvegicus
ttcatcatctttctctatccttgtg

SEQ ID NO: 666092 - DNA, 25 bp, Rattus norvegicus
ttcatcatctttgtctatccttgtg

SEQ ID NO: 666093 - DNA, 25 bp, Rattus norvegicus
ttcatcatgactctcttccttggga

SEQ ID NO: 666094 - DNA, 25 bp, Rattus norvegicus
ttcatcatgactgtcttccttggga

SEQ ID NO: 666095 - DNA, 25 bp, Rattus norvegicus
ttcatcatttgaaccatcttccagg

SEQ ID NO: 666096 - DNA, 25 bp, Rattus norvegicus
ttcatcatttgatccatcttccagg

SEQ ID NO: 666097 - DNA, 25 bp, Rattus norvegicus
ttcatcattttcatgctccttctta

SEQ ID NO: 666098 - DNA, 25 bp, Rattus norvegicus
ttcatcattttcttgctccttctta

SEQ ID NO: 666099 - DNA, 25 bp, Rattus norvegicus
ttcatcatttttcaggacagatctt

SEQ ID NO: 666100 - DNA, 25 bp, Rattus norvegicus
ttcatcatttttgaggacagatctt

SEQ ID NO: 666101 - DNA, 25 bp, Rattus norvegicus
ttcatccagcccagcatgctaaaat

SEQ ID NO: 666102 - DNA, 25 bp, Rattus norvegicus
ttcatccagccctgcatgctaaaat

SEQ ID NO: 666103 - DNA, 25 bp, Rattus norvegicus
ttcatccagggcatctctgtgatca

SEQ ID NO: 666104 - DNA, 25 bp, Rattus norvegicus
ttcatccagggcttctctgtgatca

SEQ ID NO: 666105 - DNA, 25 bp, Rattus norvegicus
ttcatccatcaaaaagccacactcg

SEQ ID NO: 666106 - DNA, 25 bp, Rattus norvegicus
ttcatccatcaataagccacactcg

SEQ ID NO: 666107 - DNA, 25 bp, Rattus norvegicus
ttcatcccactgctgttgcgataat

SEQ ID NO: 666108 - DNA, 25 bp, Rattus norvegicus
ttcatcccactggtgttgcgataat

SEQ ID NO: 666109 - DNA, 25 bp, Rattus norvegicus
ttcatcccagccatagagttctgga

SEQ ID NO: 666110 - DNA, 25 bp, Rattus norvegicus
ttcatcccagccttagagttctgga

SEQ ID NO: 666111 - DNA, 25 bp, Rattus norvegicus
ttcatccccagaacttggagggaga

SEQ ID NO: 666112 - DNA, 25 bp, Rattus norvegicus
ttcatccccagatcttggagggaga

SEQ ID NO: 666113 - DNA, 25 bp, Rattus norvegicus
ttcatcccctagaactgttttgtat

SEQ ID NO: 666114 - DNA, 25 bp, Rattus norvegicus
ttcatcccctagtactgttttgtat

SEQ ID NO: 666115 - DNA, 25 bp, Rattus norvegicus
ttcatccccttcacgataaagcaaa

SEQ ID NO: 666116 - DNA, 25 bp, Rattus norvegicus
ttcatccccttctcgataaagcaaa

SEQ ID NO: 666117 - DNA, 25 bp, Rattus norvegicus
ttcatccctaaacaaggctttccct

SEQ ID NO: 666118 - DNA, 25 bp, Rattus norvegicus
ttcatccctaaagaaggctttccct

SEQ ID NO: 666119 - DNA, 25 bp, Rattus norvegicus
ttcatccctaccaacctacagtttt

SEQ ID NO: 666120 - DNA, 25 bp, Rattus norvegicus
ttcatccctacctacctacagtttt

SEQ ID NO: 666121 - DNA, 25 bp, Rattus norvegicus
ttcatccctagtctttctctattca

SEQ ID NO: 666122 - DNA, 25 bp, Rattus norvegicus
ttcatccctagtgtttctctattca

SEQ ID NO: 666123 - DNA, 25 bp, Rattus norvegicus
ttcatccgaaggcaggttcaccagt

SEQ ID NO: 666124 - DNA, 25 bp, Rattus norvegicus
ttcatccgaagggaggttcaccagt

SEQ ID NO: 666125 - DNA, 25 bp, Rattus norvegicus
ttcatccgtaacctcgcggacaagg

SEQ ID NO: 666126 - DNA, 25 bp, Rattus norvegicus
ttcatccgtaacgtcgcggacaagg

SEQ ID NO: 666127 - DNA, 25 bp, Rattus norvegicus
ttcatcctaaacaaatacgtgccag

SEQ ID NO: 666128 - DNA, 25 bp, Rattus norvegicus
ttcatcctaaactaatacgtgccag

SEQ ID NO: 666129 - DNA, 25 bp, Rattus norvegicus
ttcatcctaaagacaagccctgggc

SEQ ID NO: 666130 - DNA, 25 bp, Rattus norvegicus
ttcatcctaaagtcaagccctgggc

SEQ ID NO: 666131 - DNA, 25 bp, Rattus norvegicus
ttcatcctctcccataactgggtat

SEQ ID NO: 666132 - DNA, 25 bp, Rattus norvegicus
ttcatcctctccgataactgggtat

SEQ ID NO: 666133 - DNA, 25 bp, Rattus norvegicus
ttcatcctcttcctcagtgctagtt

SEQ ID NO: 666134 - DNA, 25 bp, Rattus norvegicus
ttcatcctcttcgtcagtgctagtt

SEQ ID NO: 666135 - DNA, 25 bp, Rattus norvegicus
ttcatcctgagacactgctctgata

SEQ ID NO: 666136 - DNA, 25 bp, Rattus norvegicus
ttcatcctgagagactgctctgata

SEQ ID NO: 666137 - DNA, 25 bp, Rattus norvegicus
ttcatcctgcctccaatactgttgt

SEQ ID NO: 666138 - DNA, 25 bp, Rattus norvegicus
ttcatcctgcctgcaatactgttgt

SEQ ID NO: 666139 - DNA, 25 bp, Rattus norvegicus
ttcatcctgggaaggccacagtacc

SEQ ID NO: 666140 - DNA, 25 bp, Rattus norvegicus
ttcatcctgggaatagacctgctgg

SEQ ID NO: 666141 - DNA, 25 bp, Rattus norvegicus
ttcatcctgggatggccacagtacc

SEQ ID NO: 666142 - DNA, 25 bp, Rattus norvegicus
ttcatcctgggattagacctgctgg

SEQ ID NO: 666143 - DNA, 25 bp, Rattus norvegicus
ttcatcctgggtatcgtcttacttt

SEQ ID NO: 666144 - DNA, 25 bp, Rattus norvegicus
ttcatcctgggtttcgtcttacttt

SEQ ID NO: 666145 - DNA, 25 bp, Rattus norvegicus
ttcatccttatgatttagttggtgc

SEQ ID NO: 666146 - DNA, 25 bp, Rattus norvegicus
ttcatccttatgttttagttggtgc

SEQ ID NO: 666147 - DNA, 25 bp, Rattus norvegicus
ttcatccttattatcatccttcatc

SEQ ID NO: 666148 - DNA, 25 bp, Rattus norvegicus
ttcatccttattttcatccttcatc

SEQ ID NO: 666149 - DNA, 25 bp, Rattus norvegicus
ttcatccttcacactaagtttgtag

SEQ ID NO: 666150 - DNA, 25 bp, Rattus norvegicus
ttcatccttcactctaagtttgtag

SEQ ID NO: 666151 - DNA, 25 bp, Rattus norvegicus
ttcatcgaaggccttaccgaggtca

SEQ ID NO: 666152 - DNA, 25 bp, Rattus norvegicus
ttcatcgaaggcgttaccgaggtca

SEQ ID NO: 666153 - DNA, 25 bp, Rattus norvegicus
ttcatcgacaacaagctgcggcgtt

SEQ ID NO: 666154 - DNA, 25 bp, Rattus norvegicus
ttcatcgacaactagctgcggcgtt

SEQ ID NO: 666155 - DNA, 25 bp, Rattus norvegicus
ttcatcgaggtcaccacacaggagc

SEQ ID NO: 666156 - DNA, 25 bp, Rattus norvegicus
ttcatcgaggtctccacacaggagc

SEQ ID NO: 666157 - DNA, 25 bp, Rattus norvegicus
ttcatcgatcgaaggcatccgcatt

SEQ ID NO: 666158 - DNA, 25 bp, Rattus norvegicus
ttcatcgatcgatggcatccgcatt

SEQ ID NO: 666159 - DNA, 25 bp, Rattus norvegicus
ttcatcgccagaacccggtagtaac

SEQ ID NO: 666160 - DNA, 25 bp, Rattus norvegicus
ttcatcgccagatcccggtagtaac

SEQ ID NO: 666161 - DNA, 25 bp, Rattus norvegicus
ttcatcgccggtcgagtcccagggt

SEQ ID NO: 666162 - DNA, 25 bp, Rattus norvegicus
ttcatcgccggtggagtcccagggt

SEQ ID NO: 666163 - DNA, 25 bp, Rattus norvegicus
ttcatctaaatcacccctgcatagt

SEQ ID NO: 666164 - DNA, 25 bp, Rattus norvegicus
ttcatctaaatctcccctgcatagt

SEQ ID NO: 666165 - DNA, 25 bp, Rattus norvegicus
ttcatctacagcacatggaccggac

SEQ ID NO: 666166 - DNA, 25 bp, Rattus norvegicus
ttcatctacagctcatggaccggac

SEQ ID NO: 666167 - DNA, 25 bp, Rattus norvegicus
ttcatctacttcaacctgggtcagg

SEQ ID NO: 666168 - DNA, 25 bp, Rattus norvegicus
ttcatctacttctacctgggtcagg

SEQ ID NO: 666169 - DNA, 25 bp, Rattus norvegicus
ttcatctaggtaatcacatttaagg

SEQ ID NO: 666170 - DNA, 25 bp, Rattus norvegicus
ttcatctaggtattcacatttaagg

SEQ ID NO: 666171 - DNA, 25 bp, Rattus norvegicus
ttcatctatgcgaggctgcacgaca

SEQ ID NO: 666172 - DNA, 25 bp, Rattus norvegicus
ttcatctatgcgtggctgcacgaca

SEQ ID NO: 666173 - DNA, 25 bp, Rattus norvegicus
ttcatctccagcctgaaatggtcgg

SEQ ID NO: 666174 - DNA, 25 bp, Rattus norvegicus
ttcatctccagcgtgaaatggtcgg

SEQ ID NO: 666175 - DNA, 25 bp, Rattus norvegicus
ttcatctccaggaccggaccaatgg

SEQ ID NO: 666176 - DNA, 25 bp, Rattus norvegicus
ttcatctccaggtccggaccaatgg

SEQ ID NO: 666177 - DNA, 25 bp, Rattus norvegicus
ttcatctccattatcagctgttact

SEQ ID NO: 666178 - DNA, 25 bp, Rattus norvegicus
ttcatctccattttcagctgttact

SEQ ID NO: 666179 - DNA, 25 bp, Rattus norvegicus
ttcatctcccaacccacatgagaaa

SEQ ID NO: 666180 - DNA, 25 bp, Rattus norvegicus
ttcatctcccaagccacatgagaaa

SEQ ID NO: 666181 - DNA, 25 bp, Rattus norvegicus
ttcatctcctgcagcaagcacatga

SEQ ID NO: 666182 - DNA, 25 bp, Rattus norvegicus
ttcatctcctgctgcaagcacatga

SEQ ID NO: 666183 - DNA, 25 bp, Rattus norvegicus
ttcatctccttgatactccagacag

SEQ ID NO: 666184 - DNA, 25 bp, Rattus norvegicus
ttcatctccttgttactccagacag

SEQ ID NO: 666185 - DNA, 25 bp, Rattus norvegicus
ttcatctcgttaatgtcaacaacgg

SEQ ID NO: 666186 - DNA, 25 bp, Rattus norvegicus
ttcatctcgttattgtcaacaacgg

SEQ ID NO: 666187 - DNA, 25 bp, Rattus norvegicus
ttcatctctaccaaggctagccttt

SEQ ID NO: 666188 - DNA, 25 bp, Rattus norvegicus
ttcatctctacctaggctagccttt

SEQ ID NO: 666189 - DNA, 25 bp, Rattus norvegicus
ttcatctctcatatctgtgcaggga

SEQ ID NO: 666190 - DNA, 25 bp, Rattus norvegicus
ttcatctctcatttctgtgcaggga

SEQ ID NO: 666191 - DNA, 25 bp, Rattus norvegicus
ttcatctctgatcgagttttcccct

SEQ ID NO: 666192 - DNA, 25 bp, Rattus norvegicus
ttcatctctgatggagttttcccct

SEQ ID NO: 666193 - DNA, 25 bp, Rattus norvegicus
ttcatctctgctctagtgtactaca

SEQ ID NO: 666194 - DNA, 25 bp, Rattus norvegicus
ttcatctctgctgtagtgtactaca

SEQ ID NO: 666195 - DNA, 25 bp, Rattus norvegicus
ttcatctgccaacctcaaagccatg

SEQ ID NO: 666196 - DNA, 25 bp, Rattus norvegicus
ttcatctgccaagctcaaagccatg

SEQ ID NO: 666197 - DNA, 25 bp, Rattus norvegicus
ttcatctgcctaagtgggtatccac

SEQ ID NO: 666198 - DNA, 25 bp, Rattus norvegicus
ttcatctgcctatgtgggtatccac

SEQ ID NO: 666199 - DNA, 25 bp, Rattus norvegicus
ttcatctgctctacaccaattacag

SEQ ID NO: 666200 - DNA, 25 bp, Rattus norvegicus
ttcatctgctcttcaccaattacag

SEQ ID NO: 666201 - DNA, 25 bp, Rattus norvegicus
ttcatctggcaaaggtaacttcaca

SEQ ID NO: 666202 - DNA, 25 bp, Rattus norvegicus
ttcatctggcaatggtaacttcaca

SEQ ID NO: 666203 - DNA, 25 bp, Rattus norvegicus
ttcatctggcctcgaggcagcgagt

SEQ ID NO: 666204 - DNA, 25 bp, Rattus norvegicus
ttcatctggcctggaggcagcgagt

SEQ ID NO: 666205 - DNA, 25 bp, Rattus norvegicus
ttcatctgggaaatcatcactttcg

SEQ ID NO: 666206 - DNA, 25 bp, Rattus norvegicus
ttcatctgggaattcatcactttcg

SEQ ID NO: 666207 - DNA, 25 bp, Rattus norvegicus
ttcatctgtcctctccgcaagaata

SEQ ID NO: 666208 - DNA, 25 bp, Rattus norvegicus
ttcatctgtcctgtccgcaagaata

SEQ ID NO: 666209 - DNA, 25 bp, Rattus norvegicus
ttcatcttccccacagtgtgagcac

SEQ ID NO: 666210 - DNA, 25 bp, Rattus norvegicus
ttcatcttcccctcagtgtgagcac

SEQ ID NO: 666211 - DNA, 25 bp, Rattus norvegicus
ttcatcttctacagcgttctggtgg

SEQ ID NO: 666212 - DNA, 25 bp, Rattus norvegicus
ttcatcttctactgcgttctggtgg

SEQ ID NO: 666213 - DNA, 25 bp, Rattus norvegicus
ttcatcttgagaaaacagccacaac

SEQ ID NO: 666214 - DNA, 25 bp, Rattus norvegicus
ttcatcttgagataacagccacaac

SEQ ID NO: 666215 - DNA, 25 bp, Rattus norvegicus
ttcatcttgggaccgctgtacagca

SEQ ID NO: 666216 - DNA, 25 bp, Rattus norvegicus
ttcatcttgggagcgctgtacagca

SEQ ID NO: 666217 - DNA, 25 bp, Rattus norvegicus
ttcatcttgtgtctggttactgcct

SEQ ID NO: 666218 - DNA, 25 bp, Rattus norvegicus
ttcatcttgtgtgtggttactgcct

SEQ ID NO: 666219 - DNA, 25 bp, Rattus norvegicus
ttcatctttctgactcatgtgaggt

SEQ ID NO: 666220 - DNA, 25 bp, Rattus norvegicus
ttcatctttctgactgaggcttcca

SEQ ID NO: 666221 - DNA, 25 bp, Rattus norvegicus
ttcatctttctgtctcatgtgaggt

SEQ ID NO: 666222 - DNA, 25 bp, Rattus norvegicus
ttcatctttctgtctgaggcttcca

SEQ ID NO: 666223 - DNA, 25 bp, Rattus norvegicus
ttcatctttgtgagaagatcttctc

SEQ ID NO: 666224 - DNA, 25 bp, Rattus norvegicus
ttcatctttgtgtgaagatcttctc

SEQ ID NO: 666225 - DNA, 25 bp, Rattus norvegicus
ttcatgaaacctctgccctactgca

SEQ ID NO: 666226 - DNA, 25 bp, Rattus norvegicus
ttcatgaaacctgtgccctactgca

SEQ ID NO: 666227 - DNA, 25 bp, Rattus norvegicus
ttcatgaaaggaatctacagtcaga

SEQ ID NO: 666228 - DNA, 25 bp, Rattus norvegicus
ttcatgaaaggattctacagtcaga

SEQ ID NO: 666229 - DNA, 25 bp, Rattus norvegicus
ttcatgaacccacacccggaggata

SEQ ID NO: 666230 - DNA, 25 bp, Rattus norvegicus
ttcatgaacccagacccggaggata

SEQ ID NO: 666231 - DNA, 25 bp, Rattus norvegicus
ttcatgaagcgcctgggtcttccag

SEQ ID NO: 666232 - DNA, 25 bp, Rattus norvegicus
ttcatgaagcgcgtgggtcttccag

SEQ ID NO: 666233 - DNA, 25 bp, Rattus norvegicus
ttcatgaagcgtaaccccaagggac

SEQ ID NO: 666234 - DNA, 25 bp, Rattus norvegicus
ttcatgaagcgttaccccaagggac

SEQ ID NO: 666235 - DNA, 25 bp, Rattus norvegicus
ttcatgacaaatcacaccatcggcc

SEQ ID NO: 666236 - DNA, 25 bp, Rattus norvegicus
ttcatgacaaatgacaccatcggcc

SEQ ID NO: 666237 - DNA, 25 bp, Rattus norvegicus
ttcatgacacctaacacaagcacac

SEQ ID NO: 666238 - DNA, 25 bp, Rattus norvegicus
ttcatgacaccttacacaagcacac

SEQ ID NO: 666239 - DNA, 25 bp, Rattus norvegicus
ttcatgacagccctaattcccagtt

SEQ ID NO: 666240 - DNA, 25 bp, Rattus norvegicus
ttcatgacagccgtaattcccagtt

SEQ ID NO: 666241 - DNA, 25 bp, Rattus norvegicus
ttcatgacatagcaatgctgaccac

SEQ ID NO: 666242 - DNA, 25 bp, Rattus norvegicus
ttcatgacataggaatgctgaccac

SEQ ID NO: 666243 - DNA, 25 bp, Rattus norvegicus
ttcatgacccagcacacgtgcggct

SEQ ID NO: 666244 - DNA, 25 bp, Rattus norvegicus
ttcatgacccaggacacgtgcggct

SEQ ID NO: 666245 - DNA, 25 bp, Rattus norvegicus
ttcatgacctacagaggtagtgttt

SEQ ID NO: 666246 - DNA, 25 bp, Rattus norvegicus
ttcatgacctactgaggtagtgttt

SEQ ID NO: 666247 - DNA, 25 bp, Rattus norvegicus
ttcatgaccttacgcaggacttccc

SEQ ID NO: 666248 - DNA, 25 bp, Rattus norvegicus
ttcatgaccttaggcaggacttccc

SEQ ID NO: 666249 - DNA, 25 bp, Rattus norvegicus
ttcatgactctcaagacccacaaaa

SEQ ID NO: 666250 - DNA, 25 bp, Rattus norvegicus
ttcatgactctctagacccacaaaa

SEQ ID NO: 666251 - DNA, 25 bp, Rattus norvegicus
ttcatgaggcgacaggtcttcaaat

SEQ ID NO: 666252 - DNA, 25 bp, Rattus norvegicus
ttcatgaggcgagaggtcttcaaat

SEQ ID NO: 666253 - DNA, 25 bp, Rattus norvegicus
ttcatgaggctgctgtaggacttaa

SEQ ID NO: 666254 - DNA, 25 bp, Rattus norvegicus
ttcatgaggctggtgtaggacttaa

SEQ ID NO: 666255 - DNA, 25 bp, Rattus norvegicus
ttcatgagtacgcagcccctgtctg

SEQ ID NO: 666256 - DNA, 25 bp, Rattus norvegicus
ttcatgagtacggagcccctgtctg

SEQ ID NO: 666257 - DNA, 25 bp, Rattus norvegicus
ttcatgagtcagagcagtgtgagac

SEQ ID NO: 666258 - DNA, 25 bp, Rattus norvegicus
ttcatgagtcagtgcagtgtgagac

SEQ ID NO: 666259 - DNA, 25 bp, Rattus norvegicus
ttcatgatatcaaagctagactgtt

SEQ ID NO: 666260 - DNA, 25 bp, Rattus norvegicus
ttcatgatatcatagctagactgtt

SEQ ID NO: 666261 - DNA, 25 bp, Rattus norvegicus
ttcatgatcatcaagctgtggtggg

SEQ ID NO: 666262 - DNA, 25 bp, Rattus norvegicus
ttcatgatcatctagctgtggtggg

SEQ ID NO: 666263 - DNA, 25 bp, Rattus norvegicus
ttcatgatcccgatcagtcacggag

SEQ ID NO: 666264 - DNA, 25 bp, Rattus norvegicus
ttcatgatcccgttcagtcacggag

SEQ ID NO: 666265 - DNA, 25 bp, Rattus norvegicus
ttcatgatcggtcggatgctgctca

SEQ ID NO: 666266 - DNA, 25 bp, Rattus norvegicus
ttcatgatcggtgggatgctgctca

SEQ ID NO: 666267 - DNA, 25 bp, Rattus norvegicus
ttcatgatctacacactgtccagtc

SEQ ID NO: 666268 - DNA, 25 bp, Rattus norvegicus
ttcatgatctactcactgtccagtc

SEQ ID NO: 666269 - DNA, 25 bp, Rattus norvegicus
ttcatgattttcagccgattctggg

SEQ ID NO: 666270 - DNA, 25 bp, Rattus norvegicus
ttcatgattttctgccgattctggg

SEQ ID NO: 666271 - DNA, 25 bp, Rattus norvegicus
ttcatgcaaaacactttcggtcggt

SEQ ID NO: 666272 - DNA, 25 bp, Rattus norvegicus
ttcatgcaaaactctttcggtcggt

SEQ ID NO: 666273 - DNA, 25 bp, Rattus norvegicus
ttcatgcactttactgtttctaata

SEQ ID NO: 666274 - DNA, 25 bp, Rattus norvegicus
ttcatgcacttttctgtttctaata

SEQ ID NO: 666275 - DNA, 25 bp, Rattus norvegicus
ttcatgcatgcaatcctttctttgc

SEQ ID NO: 666276 - DNA, 25 bp, Rattus norvegicus
ttcatgcatgcattcctttctttgc

SEQ ID NO: 666277 - DNA, 25 bp, Rattus norvegicus
ttcatgcatgctagccttgtgtacc

SEQ ID NO: 666278 - DNA, 25 bp, Rattus norvegicus
ttcatgcatgcttgccttgtgtacc

SEQ ID NO: 666279 - DNA, 25 bp, Rattus norvegicus
ttcatgcattcaatttctttttctt

SEQ ID NO: 666280 - DNA, 25 bp, Rattus norvegicus
ttcatgcattcattttctttttctt

SEQ ID NO: 666281 - DNA, 25 bp, Rattus norvegicus
ttcatgcattccagtgcacagtggg

SEQ ID NO: 666282 - DNA, 25 bp, Rattus norvegicus
ttcatgcattcctgtgcacagtggg

SEQ ID NO: 666283 - DNA, 25 bp, Rattus norvegicus
ttcatgccacagaggccagactcga

SEQ ID NO: 666284 - DNA, 25 bp, Rattus norvegicus
ttcatgccacagtggccagactcga

SEQ ID NO: 666285 - DNA, 25 bp, Rattus norvegicus
ttcatgccagctcctaagctcaagg

SEQ ID NO: 666286 - DNA, 25 bp, Rattus norvegicus
ttcatgccagctgctaagctcaagg

SEQ ID NO: 666287 - DNA, 25 bp, Rattus norvegicus
ttcatgccaggacagcagaacagct

SEQ ID NO: 666288 - DNA, 25 bp, Rattus norvegicus
ttcatgccaggagagcagaacagct

SEQ ID NO: 666289 - DNA, 25 bp, Rattus norvegicus
ttcatgccagtcctcaaggttgtgc

SEQ ID NO: 666290 - DNA, 25 bp, Rattus norvegicus
ttcatgccagtcgtcaaggttgtgc

SEQ ID NO: 666291 - DNA, 25 bp, Rattus norvegicus
ttcatgccccagaacttagcctgta

SEQ ID NO: 666292 - DNA, 25 bp, Rattus norvegicus
ttcatgccccagtacttagcctgta

SEQ ID NO: 666293 - DNA, 25 bp, Rattus norvegicus
ttcatgccctagaaccagatagtgc

SEQ ID NO: 666294 - DNA, 25 bp, Rattus norvegicus
ttcatgccctagtaccagatagtgc

SEQ ID NO: 666295 - DNA, 25 bp, Rattus norvegicus
ttcatgccctctagaaggttctcgg

SEQ ID NO: 666296 - DNA, 25 bp, Rattus norvegicus
ttcatgccctcttgaaggttctcgg

SEQ ID NO: 666297 - DNA, 25 bp, Rattus norvegicus
ttcatgcccttcatacgatctgtga

SEQ ID NO: 666298 - DNA, 25 bp, Rattus norvegicus
ttcatgcccttcttacgatctgtga

SEQ ID NO: 666299 - DNA, 25 bp, Rattus norvegicus
ttcatgccgatcatagtaactacga

SEQ ID NO: 666300 - DNA, 25 bp, Rattus norvegicus
ttcatgccgatcttagtaactacga

SEQ ID NO: 666301 - DNA, 25 bp, Rattus norvegicus
ttcatgcctagtcgctacctaccat

SEQ ID NO: 666302 - DNA, 25 bp, Rattus norvegicus
ttcatgcctagtggctacctaccat

SEQ ID NO: 666303 - DNA, 25 bp, Rattus norvegicus
ttcatgccttcccaccttgtgagtt

SEQ ID NO: 666304 - DNA, 25 bp, Rattus norvegicus
ttcatgccttccgaccttgtgagtt

SEQ ID NO: 666305 - DNA, 25 bp, Rattus norvegicus
ttcatgccttttctcttgctgccaa

SEQ ID NO: 666306 - DNA, 25 bp, Rattus norvegicus
ttcatgccttttgtcttgctgccaa

SEQ ID NO: 666307 - DNA, 25 bp, Rattus norvegicus
ttcatgctacccctttcaggtgcag

SEQ ID NO: 666308 - DNA, 25 bp, Rattus norvegicus
ttcatgctacccgtttcaggtgcag

SEQ ID NO: 666309 - DNA, 25 bp, Rattus norvegicus
ttcatgctgcttcagttgccagatg

SEQ ID NO: 666310 - DNA, 25 bp, Rattus norvegicus
ttcatgctgcttgagttgccagatg

SEQ ID NO: 666311 - DNA, 25 bp, Rattus norvegicus
ttcatgctggatacattctctgatc

SEQ ID NO: 666312 - DNA, 25 bp, Rattus norvegicus
ttcatgctggattcattctctgatc

SEQ ID NO: 666313 - DNA, 25 bp, Rattus norvegicus
ttcatgcttaacacttctctatctg

SEQ ID NO: 666314 - DNA, 25 bp, Rattus norvegicus
ttcatgcttaactcttctctatctg

SEQ ID NO: 666315 - DNA, 25 bp, Rattus norvegicus
ttcatggacgtaccgtggtcacgga

SEQ ID NO: 666316 - DNA, 25 bp, Rattus norvegicus
ttcatggacgtagcgtggtcacgga

SEQ ID NO: 666317 - DNA, 25 bp, Rattus norvegicus
ttcatggactcgatcctttctgtgg

SEQ ID NO: 666318 - DNA, 25 bp, Rattus norvegicus
ttcatggactcgttcctttctgtgg

SEQ ID NO: 666319 - DNA, 25 bp, Rattus norvegicus
ttcatggaggtcctagcctttctta

SEQ ID NO: 666320 - DNA, 25 bp, Rattus norvegicus
ttcatggaggtcgtagcctttctta

SEQ ID NO: 666321 - DNA, 25 bp, Rattus norvegicus
ttcatggagtgccttgtcgatgccc

SEQ ID NO: 666322 - DNA, 25 bp, Rattus norvegicus
ttcatggagtgcgttgtcgatgccc

SEQ ID NO: 666323 - DNA, 25 bp, Rattus norvegicus
ttcatggataacaggtcaatgctaa

SEQ ID NO: 666324 - DNA, 25 bp, Rattus norvegicus
ttcatggataactggtcaatgctaa

SEQ ID NO: 666325 - DNA, 25 bp, Rattus norvegicus
ttcatggcacacacatcaggttgat

SEQ ID NO: 666326 - DNA, 25 bp, Rattus norvegicus
ttcatggcacactcatcaggttgat

SEQ ID NO: 666327 - DNA, 25 bp, Rattus norvegicus
ttcatggcatcaatggagcccaatt

SEQ ID NO: 666328 - DNA, 25 bp, Rattus norvegicus
ttcatggcatcattggagcccaatt

SEQ ID NO: 666329 - DNA, 25 bp, Rattus norvegicus
ttcatggccagaactccagatacga

SEQ ID NO: 666330 - DNA, 25 bp, Rattus norvegicus
ttcatggccagatctccagatacga

SEQ ID NO: 666331 - DNA, 25 bp, Rattus norvegicus
ttcatggccattattcttcttctag

SEQ ID NO: 666332 - DNA, 25 bp, Rattus norvegicus
ttcatggccatttttcttcttctag

SEQ ID NO: 666333 - DNA, 25 bp, Rattus norvegicus
ttcatggcctggcagccaagctcgg

SEQ ID NO: 666334 - DNA, 25 bp, Rattus norvegicus
ttcatggcctgggagccaagctcgg

SEQ ID NO: 666335 - DNA, 25 bp, Rattus norvegicus
ttcatggcgtttaaccgaggaaagc

SEQ ID NO: 666336 - DNA, 25 bp, Rattus norvegicus
ttcatggcgttttaccgaggaaagc

SEQ ID NO: 666337 - DNA, 25 bp, Rattus norvegicus
ttcatggctcatcctgaattccgga

SEQ ID NO: 666338 - DNA, 25 bp, Rattus norvegicus
ttcatggctcatgctgaattccgga

SEQ ID NO: 666339 - DNA, 25 bp, Rattus norvegicus
ttcatggctcgaattgagacccttg

SEQ ID NO: 666340 - DNA, 25 bp, Rattus norvegicus
ttcatggctcgatttgagacccttg

SEQ ID NO: 666341 - DNA, 25 bp, Rattus norvegicus
ttcatggctgtaagcacctggtgca

SEQ ID NO: 666342 - DNA, 25 bp, Rattus norvegicus
ttcatggctgtatgcacctggtgca

SEQ ID NO: 666343 - DNA, 25 bp, Rattus norvegicus
ttcatggctttgacctgcccgcggg

SEQ ID NO: 666344 - DNA, 25 bp, Rattus norvegicus
ttcatggctttgtcctgcccgcggg

SEQ ID NO: 666345 - DNA, 25 bp, Rattus norvegicus
ttcatgggaccaacacctccacaag

SEQ ID NO: 666346 - DNA, 25 bp, Rattus norvegicus
ttcatgggaccatcacctccacaag

SEQ ID NO: 666347 - DNA, 25 bp, Rattus norvegicus
ttcatgggactaactcatcgccttc

SEQ ID NO: 666348 - DNA, 25 bp, Rattus norvegicus
ttcatgggactatctcatcgccttc

SEQ ID NO: 666349 - DNA, 25 bp, Rattus norvegicus
ttcatgggccgcatgatgtggccac

SEQ ID NO: 666350 - DNA, 25 bp, Rattus norvegicus
ttcatgggccgcttgatgtggccac

SEQ ID NO: 666351 - DNA, 25 bp, Rattus norvegicus
ttcatgggtcccactttcaagaaac

SEQ ID NO: 666352 - DNA, 25 bp, Rattus norvegicus
ttcatgggtccctctttcaagaaac

SEQ ID NO: 666353 - DNA, 25 bp, Rattus norvegicus
ttcatggtccggaataaggtgtact

SEQ ID NO: 666354 - DNA, 25 bp, Rattus norvegicus
ttcatggtccggtataaggtgtact

SEQ ID NO: 666355 - DNA, 25 bp, Rattus norvegicus
ttcatggtcttacatcctgggctgg

SEQ ID NO: 666356 - DNA, 25 bp, Rattus norvegicus
ttcatggtcttagatcctgggctgg

SEQ ID NO: 666357 - DNA, 25 bp, Rattus norvegicus
ttcatggtctttacagaactctctc

SEQ ID NO: 666358 - DNA, 25 bp, Rattus norvegicus
ttcatggtcttttcagaactctctc

SEQ ID NO: 666359 - DNA, 25 bp, Rattus norvegicus
ttcatggtgcagatacgttcttcct

SEQ ID NO: 666360 - DNA, 25 bp, Rattus norvegicus
ttcatggtgcagttacgttcttcct

SEQ ID NO: 666361 - DNA, 25 bp, Rattus norvegicus
ttcatggttgagatttgctgtcccc

SEQ ID NO: 666362 - DNA, 25 bp, Rattus norvegicus
ttcatggttgagttttgctgtcccc

SEQ ID NO: 666363 - DNA, 25 bp, Rattus norvegicus
ttcatgtagaccctgatgtcgctga

SEQ ID NO: 666364 - DNA, 25 bp, Rattus norvegicus
ttcatgtagaccgtgatgtcgctga

SEQ ID NO: 666365 - DNA, 25 bp, Rattus norvegicus
ttcatgtataggagtggccacaagt

SEQ ID NO: 666366 - DNA, 25 bp, Rattus norvegicus
ttcatgtataggtgtggccacaagt

SEQ ID NO: 666367 - DNA, 25 bp, Rattus norvegicus
ttcatgtattttcagcatttttgct

SEQ ID NO: 666368 - DNA, 25 bp, Rattus norvegicus
ttcatgtattttgagcatttttgct

SEQ ID NO: 666369 - DNA, 25 bp, Rattus norvegicus
ttcatgtcactgatcccatgtggcc

SEQ ID NO: 666370 - DNA, 25 bp, Rattus norvegicus
ttcatgtcactgttcccatgtggcc

SEQ ID NO: 666371 - DNA, 25 bp, Rattus norvegicus
ttcatgtcacttatgctaccacaac

SEQ ID NO: 666372 - DNA, 25 bp, Rattus norvegicus
ttcatgtcacttttgctaccacaac

SEQ ID NO: 666373 - DNA, 25 bp, Rattus norvegicus
ttcatgtccacccaggtgacctggg

SEQ ID NO: 666374 - DNA, 25 bp, Rattus norvegicus
ttcatgtccaccgaggtgacctggg

SEQ ID NO: 666375 - DNA, 25 bp, Rattus norvegicus
ttcatgtcctttccgtcacgagaag

SEQ ID NO: 666376 - DNA, 25 bp, Rattus norvegicus
ttcatgtcctttgcgtcacgagaag

SEQ ID NO: 666377 - DNA, 25 bp, Rattus norvegicus
ttcatgtctattacccttccagata

SEQ ID NO: 666378 - DNA, 25 bp, Rattus norvegicus
ttcatgtctatttcccttccagata

SEQ ID NO: 666379 - DNA, 25 bp, Rattus norvegicus
ttcatgtgctgtacgccagagtgtg

SEQ ID NO: 666380 - DNA, 25 bp, Rattus norvegicus
ttcatgtgctgttcgccagagtgtg

SEQ ID NO: 666381 - DNA, 25 bp, Rattus norvegicus
ttcatgtggcatcccatgctgtgct

SEQ ID NO: 666382 - DNA, 25 bp, Rattus norvegicus
ttcatgtggcatgccatgctgtgct

SEQ ID NO: 666383 - DNA, 25 bp, Rattus norvegicus
ttcatgtggtttagggtgtttttct

SEQ ID NO: 666384 - DNA, 25 bp, Rattus norvegicus
ttcatgtggttttgggtgtttttct

SEQ ID NO: 666385 - DNA, 25 bp, Rattus norvegicus
ttcatgttatgccttaagtccaaaa

SEQ ID NO: 666386 - DNA, 25 bp, Rattus norvegicus
ttcatgttatgcgttaagtccaaaa

SEQ ID NO: 666387 - DNA, 25 bp, Rattus norvegicus
ttcatgttctcgctgcaagacagtg

SEQ ID NO: 666388 - DNA, 25 bp, Rattus norvegicus
ttcatgttctcggtgcaagacagtg

SEQ ID NO: 666389 - DNA, 25 bp, Rattus norvegicus
ttcatgtttaacaaaatgctaagga

SEQ ID NO: 666390 - DNA, 25 bp, Rattus norvegicus
ttcatgtttaactaaatgctaagga

SEQ ID NO: 666391 - DNA, 25 bp, Rattus norvegicus
ttcatgtttctcacaagtgtagtac

SEQ ID NO: 666392 - DNA, 25 bp, Rattus norvegicus
ttcatgtttctctcaagtgtagtac

SEQ ID NO: 666393 - DNA, 25 bp, Rattus norvegicus
ttcatgtttctgcttatccacggca

SEQ ID NO: 666394 - DNA, 25 bp, Rattus norvegicus
ttcatgtttctggttatccacggca

SEQ ID NO: 666395 - DNA, 25 bp, Rattus norvegicus
ttcatgtttcttctccatacgtcgg

SEQ ID NO: 666396 - DNA, 25 bp, Rattus norvegicus
ttcatgtttcttgtccatacgtcgg

SEQ ID NO: 666397 - DNA, 25 bp, Rattus norvegicus
ttcattaactgcagtgtgcttcctg

SEQ ID NO: 666398 - DNA, 25 bp, Rattus norvegicus
ttcattaactgctgtgtgcttcctg

SEQ ID NO: 666399 - DNA, 25 bp, Rattus norvegicus
ttcattacagagatttggcacccaa

SEQ ID NO: 666400 - DNA, 25 bp, Rattus norvegicus
ttcattacagagttttggcacccaa

SEQ ID NO: 666401 - DNA, 25 bp, Rattus norvegicus
ttcattaccatgaacctctgtcctt

SEQ ID NO: 666402 - DNA, 25 bp, Rattus norvegicus
ttcattaccatgtacctctgtcctt

SEQ ID NO: 666403 - DNA, 25 bp, Rattus norvegicus
ttcattagtctgctggatttcctgg

SEQ ID NO: 666404 - DNA, 25 bp, Rattus norvegicus
ttcattagtctggtggatttcctgg

SEQ ID NO: 666405 - DNA, 25 bp, Rattus norvegicus
ttcattagtttccaatggcctgtga

SEQ ID NO: 666406 - DNA, 25 bp, Rattus norvegicus
ttcattagtttcgaatggcctgtga

SEQ ID NO: 666407 - DNA, 25 bp, Rattus norvegicus
ttcattatcaacaatcccgatcgtt

SEQ ID NO: 666408 - DNA, 25 bp, Rattus norvegicus
ttcattatcaactatcccgatcgtt

SEQ ID NO: 666409 - DNA, 25 bp, Rattus norvegicus
ttcattattcacagacttgcccgat

SEQ ID NO: 666410 - DNA, 25 bp, Rattus norvegicus
ttcattattcactgacttgcccgat

SEQ ID NO: 666411 - DNA, 25 bp, Rattus norvegicus
ttcattattcagaacaccatagtgt

SEQ ID NO: 666412 - DNA, 25 bp, Rattus norvegicus
ttcattattcagtacaccatagtgt

SEQ ID NO: 666413 - DNA, 25 bp, Rattus norvegicus
ttcattcaaaagcttcaggtcctct

SEQ ID NO: 666414 - DNA, 25 bp, Rattus norvegicus
ttcattcaaaaggttcaggtcctct

SEQ ID NO: 666415 - DNA, 25 bp, Rattus norvegicus
ttcattcacaaacgccaggcactga

SEQ ID NO: 666416 - DNA, 25 bp, Rattus norvegicus
ttcattcacaaaggccaggcactga

SEQ ID NO: 666417 - DNA, 25 bp, Rattus norvegicus
ttcattcacccaaacttacttcatt

SEQ ID NO: 666418 - DNA, 25 bp, Rattus norvegicus
ttcattcacccatacttacttcatt

SEQ ID NO: 666419 - DNA, 25 bp, Rattus norvegicus
ttcattcactgtcctcacatttgag

SEQ ID NO: 666420 - DNA, 25 bp, Rattus norvegicus
ttcattcactgtgctcacatttgag

SEQ ID NO: 666421 - DNA, 25 bp, Rattus norvegicus
ttcattcatctaagcaagcttgcgt

SEQ ID NO: 666422 - DNA, 25 bp, Rattus norvegicus
ttcattcatctatgcaagcttgcgt

SEQ ID NO: 666423 - DNA, 25 bp, Rattus norvegicus
ttcattcatgaactctgctgcaaga

SEQ ID NO: 666424 - DNA, 25 bp, Rattus norvegicus
ttcattcatgaagtctgctgcaaga

SEQ ID NO: 666425 - DNA, 25 bp, Rattus norvegicus
ttcattcatgcgcatcaacccgctg

SEQ ID NO: 666426 - DNA, 25 bp, Rattus norvegicus
ttcattcatgcggatcaacccgctg

SEQ ID NO: 666427 - DNA, 25 bp, Rattus norvegicus
ttcattcattttctttcttgctgga

SEQ ID NO: 666428 - DNA, 25 bp, Rattus norvegicus
ttcattcattttgtttcttgctgga

SEQ ID NO: 666429 - DNA, 25 bp, Rattus norvegicus
ttcattcccaggacttttcctttca

SEQ ID NO: 666430 - DNA, 25 bp, Rattus norvegicus
ttcattcccaggtcttttcctttca

SEQ ID NO: 666431 - DNA, 25 bp, Rattus norvegicus
ttcattccccgactctgtgagatag

SEQ ID NO: 666432 - DNA, 25 bp, Rattus norvegicus
ttcattccccgagtctgtgagatag

SEQ ID NO: 666433 - DNA, 25 bp, Rattus norvegicus
ttcattccctgacaccatgcagtat

SEQ ID NO: 666434 - DNA, 25 bp, Rattus norvegicus
ttcattccctgagaccatgcagtat

SEQ ID NO: 666435 - DNA, 25 bp, Rattus norvegicus
ttcattcctatcaccagtgggaata

SEQ ID NO: 666436 - DNA, 25 bp, Rattus norvegicus
ttcattcctatctccagtgggaata

SEQ ID NO: 666437 - DNA, 25 bp, Rattus norvegicus
ttcattcctcaaaggtctccagaga

SEQ ID NO: 666438 - DNA, 25 bp, Rattus norvegicus
ttcattcctcaatggtctccagaga

SEQ ID NO: 666439 - DNA, 25 bp, Rattus norvegicus
ttcattcctccaatctgttattcag

SEQ ID NO: 666440 - DNA, 25 bp, Rattus norvegicus
ttcattcctccattctgttattcag

SEQ ID NO: 666441 - DNA, 25 bp, Rattus norvegicus
ttcattcctcccagacttgagaata

SEQ ID NO: 666442 - DNA, 25 bp, Rattus norvegicus
ttcattcctccctgacttgagaata

SEQ ID NO: 666443 - DNA, 25 bp, Rattus norvegicus
ttcattcctgcgcatgtagactgtg

SEQ ID NO: 666444 - DNA, 25 bp, Rattus norvegicus
ttcattcctgcggatgtagactgtg

SEQ ID NO: 666445 - DNA, 25 bp, Rattus norvegicus
ttcattcctggcagtttagaaaaaa

SEQ ID NO: 666446 - DNA, 25 bp, Rattus norvegicus
ttcattcctggctgtttagaaaaaa

SEQ ID NO: 666447 - DNA, 25 bp, Rattus norvegicus
ttcattcgctcaccgtgatgtgcag

SEQ ID NO: 666448 - DNA, 25 bp, Rattus norvegicus
ttcattcgctcagcgtgatgtgcag

SEQ ID NO: 666449 - DNA, 25 bp, Rattus norvegicus
ttcattcgtggaacatggttcttat

SEQ ID NO: 666450 - DNA, 25 bp, Rattus norvegicus
ttcattcgtggatcatggttcttat

SEQ ID NO: 666451 - DNA, 25 bp, Rattus norvegicus
ttcattctatggcacatgcttctgt

SEQ ID NO: 666452 - DNA, 25 bp, Rattus norvegicus
ttcattctatgggacatgcttctgt

SEQ ID NO: 666453 - DNA, 25 bp, Rattus norvegicus
ttcattctcagtatggaaccagcct

SEQ ID NO: 666454 - DNA, 25 bp, Rattus norvegicus
ttcattctcagtttggaaccagcct

SEQ ID NO: 666455 - DNA, 25 bp, Rattus norvegicus
ttcattctccttcagcattgagtac

SEQ ID NO: 666456 - DNA, 25 bp, Rattus norvegicus
ttcattctccttgagcattgagtac

SEQ ID NO: 666457 - DNA, 25 bp, Rattus norvegicus
ttcattctctgcagttttgtgttct

SEQ ID NO: 666458 - DNA, 25 bp, Rattus norvegicus
ttcattctctgcatctgactttctc

SEQ ID NO: 666459 - DNA, 25 bp, Rattus norvegicus
ttcattctctgctgttttgtgttct

SEQ ID NO: 666460 - DNA, 25 bp, Rattus norvegicus
ttcattctctgcttctgactttctc

SEQ ID NO: 666461 - DNA, 25 bp, Rattus norvegicus
ttcattctcttcagtcatttctcag

SEQ ID NO: 666462 - DNA, 25 bp, Rattus norvegicus
ttcattctcttctgtcatttctcag

SEQ ID NO: 666463 - DNA, 25 bp, Rattus norvegicus
ttcattctggacacatccgatgcat

SEQ ID NO: 666464 - DNA, 25 bp, Rattus norvegicus
ttcattctggactcatccgatgcat

SEQ ID NO: 666465 - DNA, 25 bp, Rattus norvegicus
ttcattctgtaacgcttgcttcgca

SEQ ID NO: 666466 - DNA, 25 bp, Rattus norvegicus
ttcattctgtaaggcttgcttcgca

SEQ ID NO: 666467 - DNA, 25 bp, Rattus norvegicus
ttcattctttgaacagatctcttct

SEQ ID NO: 666468 - DNA, 25 bp, Rattus norvegicus
ttcattctttgatcagatctcttct

SEQ ID NO: 666469 - DNA, 25 bp, Rattus norvegicus
ttcattgaagagatgctgtcacccc

SEQ ID NO: 666470 - DNA, 25 bp, Rattus norvegicus
ttcattgaagagttgctgtcacccc

SEQ ID NO: 666471 - DNA, 25 bp, Rattus norvegicus
ttcattgaagggatctcctgcacac

SEQ ID NO: 666472 - DNA, 25 bp, Rattus norvegicus
ttcattgaagggttctcctgcacac

SEQ ID NO: 666473 - DNA, 25 bp, Rattus norvegicus
ttcattgacaccacctccaaatttg

SEQ ID NO: 666474 - DNA, 25 bp, Rattus norvegicus
ttcattgacacctcctccaaatttg

SEQ ID NO: 666475 - DNA, 25 bp, Rattus norvegicus
ttcattgattgtccccctgatgatg

SEQ ID NO: 666476 - DNA, 25 bp, Rattus norvegicus
ttcattgattgtgcccctgatgatg

SEQ ID NO: 666477 - DNA, 25 bp, Rattus norvegicus
ttcattgcacgtccttaagccttat

SEQ ID NO: 666478 - DNA, 25 bp, Rattus norvegicus
ttcattgcacgtgcttaagccttat

SEQ ID NO: 666479 - DNA, 25 bp, Rattus norvegicus
ttcattgccagcagccacatcagta

SEQ ID NO: 666480 - DNA, 25 bp, Rattus norvegicus
ttcattgccagctgccacatcagta

SEQ ID NO: 666481 - DNA, 25 bp, Rattus norvegicus
ttcattgccccaatttgtggttctt

SEQ ID NO: 666482 - DNA, 25 bp, Rattus norvegicus
ttcattgccccattttgtggttctt

SEQ ID NO: 666483 - DNA, 25 bp, Rattus norvegicus
ttcattgcccttagcatggttcata

SEQ ID NO: 666484 - DNA, 25 bp, Rattus norvegicus
ttcattgccctttgcatggttcata

SEQ ID NO: 666485 - DNA, 25 bp, Rattus norvegicus
ttcattgcgggtatcctgtttgcta

SEQ ID NO: 666486 - DNA, 25 bp, Rattus norvegicus
ttcattgcgggtttcctgtttgcta

SEQ ID NO: 666487 - DNA, 25 bp, Rattus norvegicus
ttcattgctataacaggctctcctt

SEQ ID NO: 666488 - DNA, 25 bp, Rattus norvegicus
ttcattgctatatcaggctctcctt

SEQ ID NO: 666489 - DNA, 25 bp, Rattus norvegicus
ttcattgctctacaactacttggga

SEQ ID NO: 666490 - DNA, 25 bp, Rattus norvegicus
ttcattgctctagaactacttggga

SEQ ID NO: 666491 - DNA, 25 bp, Rattus norvegicus
ttcattgctgacaacaggcctcttg

SEQ ID NO: 666492 - DNA, 25 bp, Rattus norvegicus
ttcattgctgactacaggcctcttg

SEQ ID NO: 666493 - DNA, 25 bp, Rattus norvegicus
ttcattgctgggatggcttgggact

SEQ ID NO: 666494 - DNA, 25 bp, Rattus norvegicus
ttcattgctgggttggcttgggact

SEQ ID NO: 666495 - DNA, 25 bp, Rattus norvegicus
ttcattgctggtataactgctcctc

SEQ ID NO: 666496 - DNA, 25 bp, Rattus norvegicus
ttcattgctggtttaactgctcctc

SEQ ID NO: 666497 - DNA, 25 bp, Rattus norvegicus
ttcattgcttggctggtgaaaggcc

SEQ ID NO: 666498 - DNA, 25 bp, Rattus norvegicus
ttcattgcttgggtggtgaaaggcc

SEQ ID NO: 666499 - DNA, 25 bp, Rattus norvegicus
ttcattggcccgagataatttcagg

SEQ ID NO: 666500 - DNA, 25 bp, Rattus norvegicus
ttcattggcccgtgataatttcagg

SEQ ID NO: 666501 - DNA, 25 bp, Rattus norvegicus
ttcattggtgctagtctcctcacaa

SEQ ID NO: 666502 - DNA, 25 bp, Rattus norvegicus
ttcattggtgcttgtctcctcacaa

SEQ ID NO: 666503 - DNA, 25 bp, Rattus norvegicus
ttcattgtaaagatgggtgccatta

SEQ ID NO: 666504 - DNA, 25 bp, Rattus norvegicus
ttcattgtaaagttgggtgccatta

SEQ ID NO: 666505 - DNA, 25 bp, Rattus norvegicus
ttcattgtagaaaccttgatggcag

SEQ ID NO: 666506 - DNA, 25 bp, Rattus norvegicus
ttcattgtagaatccttgatggcag

SEQ ID NO: 666507 - DNA, 25 bp, Rattus norvegicus
ttcattgtctcgaagcttgtcagct

SEQ ID NO: 666508 - DNA, 25 bp, Rattus norvegicus
ttcattgtctcgtagcttgtcagct

SEQ ID NO: 666509 - DNA, 25 bp, Rattus norvegicus
ttcattgtgaagaagaaccctcgcc

SEQ ID NO: 666510 - DNA, 25 bp, Rattus norvegicus
ttcattgtgaagtagaaccctcgcc

SEQ ID NO: 666511 - DNA, 25 bp, Rattus norvegicus
ttcattgtggacattcagatcaggc

SEQ ID NO: 666512 - DNA, 25 bp, Rattus norvegicus
ttcattgtggactttcagatcaggc

SEQ ID NO: 666513 - DNA, 25 bp, Rattus norvegicus
ttcattgtgtcaacctcatccctta

SEQ ID NO: 666514 - DNA, 25 bp, Rattus norvegicus
ttcattgtgtcatcctcatccctta

SEQ ID NO: 666515 - DNA, 25 bp, Rattus norvegicus
ttcattgttgcccatgttctctaga

SEQ ID NO: 666516 - DNA, 25 bp, Rattus norvegicus
ttcattgttgccgatgttctctaga

SEQ ID NO: 666517 - DNA, 25 bp, Rattus norvegicus
ttcattgttgttctctactgcattt

SEQ ID NO: 666518 - DNA, 25 bp, Rattus norvegicus
ttcattgttgttgtctactgcattt

SEQ ID NO: 666519 - DNA, 25 bp, Rattus norvegicus
ttcatttaccaacttctggcctagg

SEQ ID NO: 666520 - DNA, 25 bp, Rattus norvegicus
ttcatttaccaagttctggcctagg

SEQ ID NO: 666521 - DNA, 25 bp, Rattus norvegicus
ttcatttactaactggtctgctcca

SEQ ID NO: 666522 - DNA, 25 bp, Rattus norvegicus
ttcatttactaagtggtctgctcca

SEQ ID NO: 666523 - DNA, 25 bp, Rattus norvegicus
ttcatttatattaatgtctaccatg

SEQ ID NO: 666524 - DNA, 25 bp, Rattus norvegicus
ttcatttatatttatgtctaccatg

SEQ ID NO: 666525 - DNA, 25 bp, Rattus norvegicus
ttcatttatgggacaccttgttcat

SEQ ID NO: 666526 - DNA, 25 bp, Rattus norvegicus
ttcatttatgggtcaccttgttcat

SEQ ID NO: 666527 - DNA, 25 bp, Rattus norvegicus
ttcatttcatgaacaatctccaagg

SEQ ID NO: 666528 - DNA, 25 bp, Rattus norvegicus
ttcatttcatgatcaatctccaagg

SEQ ID NO: 666529 - DNA, 25 bp, Rattus norvegicus
ttcatttcatttaggctggagccgc

SEQ ID NO: 666530 - DNA, 25 bp, Rattus norvegicus
ttcatttcattttggctggagccgc

SEQ ID NO: 666531 - DNA, 25 bp, Rattus norvegicus
ttcatttcccagaggcatatgatgt

SEQ ID NO: 666532 - DNA, 25 bp, Rattus norvegicus
ttcatttcccagtggcatatgatgt

SEQ ID NO: 666533 - DNA, 25 bp, Rattus norvegicus
ttcatttcccataaaccccacgagt

SEQ ID NO: 666534 - DNA, 25 bp, Rattus norvegicus
ttcatttcccatctaagagccctgc

SEQ ID NO: 666535 - DNA, 25 bp, Rattus norvegicus
ttcatttcccatgtaagagccctgc

SEQ ID NO: 666536 - DNA, 25 bp, Rattus norvegicus
ttcatttcccattaaccccacgagt

SEQ ID NO: 666537 - DNA, 25 bp, Rattus norvegicus
ttcatttccccgattctactgtgga

SEQ ID NO: 666538 - DNA, 25 bp, Rattus norvegicus
ttcatttccccgtttctactgtgga

SEQ ID NO: 666539 - DNA, 25 bp, Rattus norvegicus
ttcatttccgtgaagggcaccgaga

SEQ ID NO: 666540 - DNA, 25 bp, Rattus norvegicus
ttcatttccgtgtagggcaccgaga

SEQ ID NO: 666541 - DNA, 25 bp, Rattus norvegicus
ttcatttcgaccaataatcatttgc

SEQ ID NO: 666542 - DNA, 25 bp, Rattus norvegicus
ttcatttcgacctataatcatttgc

SEQ ID NO: 666543 - DNA, 25 bp, Rattus norvegicus
ttcatttctccgagactgacagcag

SEQ ID NO: 666544 - DNA, 25 bp, Rattus norvegicus
ttcatttctccgtgactgacagcag

SEQ ID NO: 666545 - DNA, 25 bp, Rattus norvegicus
ttcatttctctcagagtcctttctt

SEQ ID NO: 666546 - DNA, 25 bp, Rattus norvegicus
ttcatttctctcattcacacagcat

SEQ ID NO: 666547 - DNA, 25 bp, Rattus norvegicus
ttcatttctctctgagtcctttctt

SEQ ID NO: 666548 - DNA, 25 bp, Rattus norvegicus
ttcatttctctctttcacacagcat

SEQ ID NO: 666549 - DNA, 25 bp, Rattus norvegicus
ttcatttcttttaaaggcagggtct

SEQ ID NO: 666550 - DNA, 25 bp, Rattus norvegicus
ttcatttctttttaaggcagggtct

SEQ ID NO: 666551 - DNA, 25 bp, Rattus norvegicus
ttcatttgactgattcctccttttc

SEQ ID NO: 666552 - DNA, 25 bp, Rattus norvegicus
ttcatttgactgtttcctccttttc

SEQ ID NO: 666553 - DNA, 25 bp, Rattus norvegicus
ttcatttgaggtcaggcgccccaca

SEQ ID NO: 666554 - DNA, 25 bp, Rattus norvegicus
ttcatttgaggtgaggcgccccaca

SEQ ID NO: 666555 - DNA, 25 bp, Rattus norvegicus
ttcatttgatggaaccatgtgccat

SEQ ID NO: 666556 - DNA, 25 bp, Rattus norvegicus
ttcatttgatggtaccatgtgccat

SEQ ID NO: 666557 - DNA, 25 bp, Rattus norvegicus
ttcatttgctatatccttggacccc

SEQ ID NO: 666558 - DNA, 25 bp, Rattus norvegicus
ttcatttgctatttccttggacccc

SEQ ID NO: 666559 - DNA, 25 bp, Rattus norvegicus
ttcatttggacaaccccagtgcact

SEQ ID NO: 666560 - DNA, 25 bp, Rattus norvegicus
ttcatttggacatccccagtgcact

SEQ ID NO: 666561 - DNA, 25 bp, Rattus norvegicus
ttcatttggcctctgcggcgacaga

SEQ ID NO: 666562 - DNA, 25 bp, Rattus norvegicus
ttcatttggcctgtgcggcgacaga

SEQ ID NO: 666563 - DNA, 25 bp, Rattus norvegicus
ttcatttgtatccaaggtgctgaat

SEQ ID NO: 666564 - DNA, 25 bp, Rattus norvegicus
ttcatttgtatcgaaggtgctgaat

SEQ ID NO: 666565 - DNA, 25 bp, Rattus norvegicus
ttcatttgtgctatctattttcggg

SEQ ID NO: 666566 - DNA, 25 bp, Rattus norvegicus
ttcatttgtgctttctattttcggg

SEQ ID NO: 666567 - DNA, 25 bp, Rattus norvegicus
ttcatttgtgttatctgggacggac

SEQ ID NO: 666568 - DNA, 25 bp, Rattus norvegicus
ttcatttgtgttttctgggacggac

SEQ ID NO: 666569 - DNA, 25 bp, Rattus norvegicus
ttcattttaacccattccgaaccat

SEQ ID NO: 666570 - DNA, 25 bp, Rattus norvegicus
ttcattttaaccgattccgaaccat

SEQ ID NO: 666571 - DNA, 25 bp, Rattus norvegicus
ttcattttatggagtggtcccctct

SEQ ID NO: 666572 - DNA, 25 bp, Rattus norvegicus
ttcattttatggtgtggtcccctct

SEQ ID NO: 666573 - DNA, 25 bp, Rattus norvegicus
ttcattttatttcccttcttcgctg

SEQ ID NO: 666574 - DNA, 25 bp, Rattus norvegicus
ttcattttatttgccttcttcgctg

SEQ ID NO: 666575 - DNA, 25 bp, Rattus norvegicus
ttcattttccacaactgccatggta

SEQ ID NO: 666576 - DNA, 25 bp, Rattus norvegicus
ttcattttccactactgccatggta

SEQ ID NO: 666577 - DNA, 25 bp, Rattus norvegicus
ttcattttgcagaaccagtaggcct

SEQ ID NO: 666578 - DNA, 25 bp, Rattus norvegicus
ttcattttgcagtaccagtaggcct

SEQ ID NO: 666579 - DNA, 25 bp, Rattus norvegicus
ttcattttggcaccagtcctaaaga

SEQ ID NO: 666580 - DNA, 25 bp, Rattus norvegicus
ttcattttggcagcagtcctaaaga

SEQ ID NO: 666581 - DNA, 25 bp, Rattus norvegicus
ttcatttttcacattgcgggctgga

SEQ ID NO: 666582 - DNA, 25 bp, Rattus norvegicus
ttcatttttcactttgcgggctgga

SEQ ID NO: 666583 - DNA, 25 bp, Rattus norvegicus
ttcatttttctcaggccaaacccca

SEQ ID NO: 666584 - DNA, 25 bp, Rattus norvegicus
ttcatttttctctggccaaacccca

SEQ ID NO: 666585 - DNA, 25 bp, Rattus norvegicus
ttcattttttctaaagccagcagaa

SEQ ID NO: 666586 - DNA, 25 bp, Rattus norvegicus
ttcattttttctagtttagcactac

SEQ ID NO: 666587 - DNA, 25 bp, Rattus norvegicus
ttcattttttcttaagccagcagaa

SEQ ID NO: 666588 - DNA, 25 bp, Rattus norvegicus
ttcattttttcttgtttagcactac

SEQ ID NO: 666589 - DNA, 25 bp, Rattus norvegicus
ttccaaaaactccaaccactgcaat

SEQ ID NO: 666590 - DNA, 25 bp, Rattus norvegicus
ttccaaaaactccatggctaggtct

SEQ ID NO: 666591 - DNA, 25 bp, Rattus norvegicus
ttccaaaaactcgaaccactgcaat

SEQ ID NO: 666592 - DNA, 25 bp, Rattus norvegicus
ttccaaaaactcgatggctaggtct

SEQ ID NO: 666593 - DNA, 25 bp, Rattus norvegicus
ttccaaaaagctcgactaggtcctg

SEQ ID NO: 666594 - DNA, 25 bp, Rattus norvegicus
ttccaaaaagctggactaggtcctg

SEQ ID NO: 666595 - DNA, 25 bp, Rattus norvegicus
ttccaaaagcgtaccctgtgtgcct

SEQ ID NO: 666596 - DNA, 25 bp, Rattus norvegicus
ttccaaaagcgtcgcgcccaaattc

SEQ ID NO: 666597 - DNA, 25 bp, Rattus norvegicus
ttccaaaagcgtggcgcccaaattc

SEQ ID NO: 666598 - DNA, 25 bp, Rattus norvegicus
ttccaaaagcgttccctgtgtgcct

SEQ ID NO: 666599 - DNA, 25 bp, Rattus norvegicus
ttccaaaaggtcctgcagctctatc

SEQ ID NO: 666600 - DNA, 25 bp, Rattus norvegicus
ttccaaaaggtcgtgcagctctatc

SEQ ID NO: 666601 - DNA, 25 bp, Rattus norvegicus
ttccaaaccccaagaattgttcctg

SEQ ID NO: 666602 - DNA, 25 bp, Rattus norvegicus
ttccaaaccccatgaattgttcctg

SEQ ID NO: 666603 - DNA, 25 bp, Rattus norvegicus
ttccaaactccgaaaatctgctttt

SEQ ID NO: 666604 - DNA, 25 bp, Rattus norvegicus
ttccaaactccgtaaatctgctttt

SEQ ID NO: 666605 - DNA, 25 bp, Rattus norvegicus
ttccaaacttaactccctcaacagt

SEQ ID NO: 666606 - DNA, 25 bp, Rattus norvegicus
ttccaaacttaagtccctcaacagt

SEQ ID NO: 666607 - DNA, 25 bp, Rattus norvegicus
ttccaaactttgatccaggctgaca

SEQ ID NO: 666608 - DNA, 25 bp, Rattus norvegicus
ttccaaactttgttccaggctgaca

SEQ ID NO: 666609 - DNA, 25 bp, Rattus norvegicus
ttccaaagactacgtagcgccaggc

SEQ ID NO: 666610 - DNA, 25 bp, Rattus norvegicus
ttccaaagactaggtagcgccaggc

SEQ ID NO: 666611 - DNA, 25 bp, Rattus norvegicus
ttccaaagcttaaccacgggccgca

SEQ ID NO: 666612 - DNA, 25 bp, Rattus norvegicus
ttccaaagcttatccacgggccgca

SEQ ID NO: 666613 - DNA, 25 bp, Rattus norvegicus
ttccaaaggaaaagtccccatccct

SEQ ID NO: 666614 - DNA, 25 bp, Rattus norvegicus
ttccaaaggaaatgtccccatccct

SEQ ID NO: 666615 - DNA, 25 bp, Rattus norvegicus
ttccaaagtagtctttagctcatct

SEQ ID NO: 666616 - DNA, 25 bp, Rattus norvegicus
ttccaaagtagtgtttagctcatct

SEQ ID NO: 666617 - DNA, 25 bp, Rattus norvegicus
ttccaaagtgctcagccaaccagta

SEQ ID NO: 666618 - DNA, 25 bp, Rattus norvegicus
ttccaaagtgctgagccaaccagta

SEQ ID NO: 666619 - DNA, 25 bp, Rattus norvegicus
ttccaaataccaccatctgaacagc

SEQ ID NO: 666620 - DNA, 25 bp, Rattus norvegicus
ttccaaataccagcatctgaacagc

SEQ ID NO: 666621 - DNA, 25 bp, Rattus norvegicus
ttccaaatccttacgacctcaaaag

SEQ ID NO: 666622 - DNA, 25 bp, Rattus norvegicus
ttccaaatcctttcgacctcaaaag

SEQ ID NO: 666623 - DNA, 25 bp, Rattus norvegicus
ttccaaatgccgcaagcgcaagctg

SEQ ID NO: 666624 - DNA, 25 bp, Rattus norvegicus
ttccaaatgccggaagcgcaagctg

SEQ ID NO: 666625 - DNA, 25 bp, Rattus norvegicus
ttccaaattgccagagccatgcttc

SEQ ID NO: 666626 - DNA, 25 bp, Rattus norvegicus
ttccaaattgcctgagccatgcttc

SEQ ID NO: 666627 - DNA, 25 bp, Rattus norvegicus
ttccaaattgtcaccagtcaccgta

SEQ ID NO: 666628 - DNA, 25 bp, Rattus norvegicus
ttccaaattgtctccagtcaccgta

SEQ ID NO: 666629 - DNA, 25 bp, Rattus norvegicus
ttccaacacgcaaagaaggccctca

SEQ ID NO: 666630 - DNA, 25 bp, Rattus norvegicus
ttccaacacgcatagaaggccctca

SEQ ID NO: 666631 - DNA, 25 bp, Rattus norvegicus
ttccaacactgaccttgatcaagag

SEQ ID NO: 666632 - DNA, 25 bp, Rattus norvegicus
ttccaacactgagcttgatcaagag

SEQ ID NO: 666633 - DNA, 25 bp, Rattus norvegicus
ttccaacagcccaatgatggtgcca

SEQ ID NO: 666634 - DNA, 25 bp, Rattus norvegicus
ttccaacagccctatgatggtgcca

SEQ ID NO: 666635 - DNA, 25 bp, Rattus norvegicus
ttccaacatgtcacctctctcaatg

SEQ ID NO: 666636 - DNA, 25 bp, Rattus norvegicus
ttccaacatgtctcctctctcaatg

SEQ ID NO: 666637 - DNA, 25 bp, Rattus norvegicus
ttccaaccatacaaccaatttctta

SEQ ID NO: 666638 - DNA, 25 bp, Rattus norvegicus
ttccaaccatactaccaatttctta

SEQ ID NO: 666639 - DNA, 25 bp, Rattus norvegicus
ttccaacccagcattctgaagtgtc

SEQ ID NO: 666640 - DNA, 25 bp, Rattus norvegicus
ttccaacccagctttctgaagtgtc

SEQ ID NO: 666641 - DNA, 25 bp, Rattus norvegicus
ttccaaccccacagcaatgtagagg

SEQ ID NO: 666642 - DNA, 25 bp, Rattus norvegicus
ttccaaccccactgcaatgtagagg

SEQ ID NO: 666643 - DNA, 25 bp, Rattus norvegicus
ttccaacctcttcaggagttcttca

SEQ ID NO: 666644 - DNA, 25 bp, Rattus norvegicus
ttccaacctcttgaggagttcttca

SEQ ID NO: 666645 - DNA, 25 bp, Rattus norvegicus
ttccaacctttgcacagtccacaaa

SEQ ID NO: 666646 - DNA, 25 bp, Rattus norvegicus
ttccaacctttggacagtccacaaa

SEQ ID NO: 666647 - DNA, 25 bp, Rattus norvegicus
ttccaacgtcgcactgagggaggtt

SEQ ID NO: 666648 - DNA, 25 bp, Rattus norvegicus
ttccaacgtcgctctgagggaggtt

SEQ ID NO: 666649 - DNA, 25 bp, Rattus norvegicus
ttccaacgtctgcttgtccaaaatg

SEQ ID NO: 666650 - DNA, 25 bp, Rattus norvegicus
ttccaacgtctggttgtccaaaatg

SEQ ID NO: 666651 - DNA, 25 bp, Rattus norvegicus
ttccaacgtttaaattatgccaggt

SEQ ID NO: 666652 - DNA, 25 bp, Rattus norvegicus
ttccaacgtttatattatgccaggt

SEQ ID NO: 666653 - DNA, 25 bp, Rattus norvegicus
ttccaactacatacaggctttctac

SEQ ID NO: 666654 - DNA, 25 bp, Rattus norvegicus
ttccaactacattcaggctttctac

SEQ ID NO: 666655 - DNA, 25 bp, Rattus norvegicus
ttccaactgaaaactcccatttctc

SEQ ID NO: 666656 - DNA, 25 bp, Rattus norvegicus
ttccaactgaaatctcccatttctc

SEQ ID NO: 666657 - DNA, 25 bp, Rattus norvegicus
ttccaactgctcagggacccataaa

SEQ ID NO: 666658 - DNA, 25 bp, Rattus norvegicus
ttccaactgctctgggacccataaa

SEQ ID NO: 666659 - DNA, 25 bp, Rattus norvegicus
ttccaactggcacggactggaacaa

SEQ ID NO: 666660 - DNA, 25 bp, Rattus norvegicus
ttccaactggcagggactggaacaa

SEQ ID NO: 666661 - DNA, 25 bp, Rattus norvegicus
ttccaacttcaaatacttctaccac

SEQ ID NO: 666662 - DNA, 25 bp, Rattus norvegicus
ttccaacttcaattacttctaccac

SEQ ID NO: 666663 - DNA, 25 bp, Rattus norvegicus
ttccaacttctaatgatcaccactc

SEQ ID NO: 666664 - DNA, 25 bp, Rattus norvegicus
ttccaacttctattgatcaccactc

SEQ ID NO: 666665 - DNA, 25 bp, Rattus norvegicus
ttccaacttttcatcaacaaaaagg

SEQ ID NO: 666666 - DNA, 25 bp, Rattus norvegicus
ttccaacttttcttcaacaaaaagg

SEQ ID NO: 666667 - DNA, 25 bp, Rattus norvegicus
ttccaagaacaaagtagtccagctg

SEQ ID NO: 666668 - DNA, 25 bp, Rattus norvegicus
ttccaagaacaatgtagtccagctg

SEQ ID NO: 666669 - DNA, 25 bp, Rattus norvegicus
ttccaagacactaggacccctgcgt

SEQ ID NO: 666670 - DNA, 25 bp, Rattus norvegicus
ttccaagacacttggacccctgcgt

SEQ ID NO: 666671 - DNA, 25 bp, Rattus norvegicus
ttccaagacgggaacttccctgtgt

SEQ ID NO: 666672 - DNA, 25 bp, Rattus norvegicus
ttccaagacgggtacttccctgtgt

SEQ ID NO: 666673 - DNA, 25 bp, Rattus norvegicus
ttccaagagacaagctcagctcctg

SEQ ID NO: 666674 - DNA, 25 bp, Rattus norvegicus
ttccaagagacatgctcagctcctg

SEQ ID NO: 666675 - DNA, 25 bp, Rattus norvegicus
ttccaagagttcagccgtgtctatt

SEQ ID NO: 666676 - DNA, 25 bp, Rattus norvegicus
ttccaagagttctgccgtgtctatt

SEQ ID NO: 666677 - DNA, 25 bp, Rattus norvegicus
ttccaagatgttaatttgcaccaaa

SEQ ID NO: 666678 - DNA, 25 bp, Rattus norvegicus
ttccaagatgtttatttgcaccaaa

SEQ ID NO: 666679 - DNA, 25 bp, Rattus norvegicus
ttccaagcaagcaccagggtggtca

SEQ ID NO: 666680 - DNA, 25 bp, Rattus norvegicus
ttccaagcaagctccagggtggtca

SEQ ID NO: 666681 - DNA, 25 bp, Rattus norvegicus
ttccaagcacgtcttcaggtgggat

SEQ ID NO: 666682 - DNA, 25 bp, Rattus norvegicus
ttccaagcacgtgttcaggtgggat

SEQ ID NO: 666683 - DNA, 25 bp, Rattus norvegicus
ttccaagcattactttaacctccct

SEQ ID NO: 666684 - DNA, 25 bp, Rattus norvegicus
ttccaagcattagtttaacctccct

SEQ ID NO: 666685 - DNA, 25 bp, Rattus norvegicus
ttccaagccgttatcaacagggagt

SEQ ID NO: 666686 - DNA, 25 bp, Rattus norvegicus
ttccaagccgttttcaacagggagt

SEQ ID NO: 666687 - DNA, 25 bp, Rattus norvegicus
ttccaagcctgtattcccaagaatt

SEQ ID NO: 666688 - DNA, 25 bp, Rattus norvegicus
ttccaagcctgttttcccaagaatt

SEQ ID NO: 666689 - DNA, 25 bp, Rattus norvegicus
ttccaagctctacgtcacatcagga

SEQ ID NO: 666690 - DNA, 25 bp, Rattus norvegicus
ttccaagctctaggtcacatcagga

SEQ ID NO: 666691 - DNA, 25 bp, Rattus norvegicus
ttccaagcttcaacctagcttcaga

SEQ ID NO: 666692 - DNA, 25 bp, Rattus norvegicus
ttccaagcttcatcctagcttcaga

SEQ ID NO: 666693 - DNA, 25 bp, Rattus norvegicus
ttccaaggatcaaagctgtctacag

SEQ ID NO: 666694 - DNA, 25 bp, Rattus norvegicus
ttccaaggatcatagctgtctacag

SEQ ID NO: 666695 - DNA, 25 bp, Rattus norvegicus
ttccaaggattacaagtgcagcggg

SEQ ID NO: 666696 - DNA, 25 bp, Rattus norvegicus
ttccaaggattagaagtgcagcggg

SEQ ID NO: 666697 - DNA, 25 bp, Rattus norvegicus
ttccaaggctggctcttctgagaga

SEQ ID NO: 666698 - DNA, 25 bp, Rattus norvegicus
ttccaaggctgggtcttctgagaga

SEQ ID NO: 666699 - DNA, 25 bp, Rattus norvegicus
ttccaagggttaccctcctgaacag

SEQ ID NO: 666700 - DNA, 25 bp, Rattus norvegicus
ttccaagggttagcctcctgaacag

SEQ ID NO: 666701 - DNA, 25 bp, Rattus norvegicus
ttccaagggtttctcaatgtttcag

SEQ ID NO: 666702 - DNA, 25 bp, Rattus norvegicus
ttccaagggtttgtcaatgtttcag

SEQ ID NO: 666703 - DNA, 25 bp, Rattus norvegicus
ttccaaggttctctggatcctgtgt

SEQ ID NO: 666704 - DNA, 25 bp, Rattus norvegicus
ttccaaggttctgtggatcctgtgt

SEQ ID NO: 666705 - DNA, 25 bp, Rattus norvegicus
ttccaagtcactccccttttgaata

SEQ ID NO: 666706 - DNA, 25 bp, Rattus norvegicus
ttccaagtcactgcccttttgaata

SEQ ID NO: 666707 - DNA, 25 bp, Rattus norvegicus
ttccaagtgtgacccctgaagaagg

SEQ ID NO: 666708 - DNA, 25 bp, Rattus norvegicus
ttccaagtgtgagccctgaagaagg

SEQ ID NO: 666709 - DNA, 25 bp, Rattus norvegicus
ttccaagttacccacaaagagcatg

SEQ ID NO: 666710 - DNA, 25 bp, Rattus norvegicus
ttccaagttaccgacaaagagcatg

SEQ ID NO: 666711 - DNA, 25 bp, Rattus norvegicus
ttccaagttactattcctcatggtg

SEQ ID NO: 666712 - DNA, 25 bp, Rattus norvegicus
ttccaagttacttttcctcatggtg

SEQ ID NO: 666713 - DNA, 25 bp, Rattus norvegicus
ttccaagttattagggccaggacct

SEQ ID NO: 666714 - DNA, 25 bp, Rattus norvegicus
ttccaagttatttgggccaggacct

SEQ ID NO: 666715 - DNA, 25 bp, Rattus norvegicus
ttccaagttccacaagccggtaatg

SEQ ID NO: 666716 - DNA, 25 bp, Rattus norvegicus
ttccaagttccagaagccggtaatg

SEQ ID NO: 666717 - DNA, 25 bp, Rattus norvegicus
ttccaagttctgcaggttccatcag

SEQ ID NO: 666718 - DNA, 25 bp, Rattus norvegicus
ttccaagttctggaggttccatcag

SEQ ID NO: 666719 - DNA, 25 bp, Rattus norvegicus
ttccaatatgaaacgccaaggcaga

SEQ ID NO: 666720 - DNA, 25 bp, Rattus norvegicus
ttccaatatgaatcgccaaggcaga

SEQ ID NO: 666721 - DNA, 25 bp, Rattus norvegicus
ttccaatcccaactatgacctcaaa

SEQ ID NO: 666722 - DNA, 25 bp, Rattus norvegicus
ttccaatcccaagtatgacctcaaa

SEQ ID NO: 666723 - DNA, 25 bp, Rattus norvegicus
ttccaatcctatcctgtgacgagca

SEQ ID NO: 666724 - DNA, 25 bp, Rattus norvegicus
ttccaatcctatgctgtgacgagca

SEQ ID NO: 666725 - DNA, 25 bp, Rattus norvegicus
ttccaatccttaatcatcagctgct

SEQ ID NO: 666726 - DNA, 25 bp, Rattus norvegicus
ttccaatccttattcatcagctgct

SEQ ID NO: 666727 - DNA, 25 bp, Rattus norvegicus
ttccaatcctttagtaactcccttg

SEQ ID NO: 666728 - DNA, 25 bp, Rattus norvegicus
ttccaatccttttgtaactcccttg

SEQ ID NO: 666729 - DNA, 25 bp, Rattus norvegicus
ttccaatcgtctcgactgcagtgag

SEQ ID NO: 666730 - DNA, 25 bp, Rattus norvegicus
ttccaatcgtctggactgcagtgag

SEQ ID NO: 666731 - DNA, 25 bp, Rattus norvegicus
ttccaatgccagcagatccaatgct

SEQ ID NO: 666732 - DNA, 25 bp, Rattus norvegicus
ttccaatgccaggagatccaatgct

SEQ ID NO: 666733 - DNA, 25 bp, Rattus norvegicus
ttccaatgcctgcagggaccgaagt

SEQ ID NO: 666734 - DNA, 25 bp, Rattus norvegicus
ttccaatgcctggagggaccgaagt

SEQ ID NO: 666735 - DNA, 25 bp, Rattus norvegicus
ttccaattcactcaggcgattccca

SEQ ID NO: 666736 - DNA, 25 bp, Rattus norvegicus
ttccaattcactgaggcgattccca

SEQ ID NO: 666737 - DNA, 25 bp, Rattus norvegicus
ttccaattcatccatactacaccat

SEQ ID NO: 666738 - DNA, 25 bp, Rattus norvegicus
ttccaattcatcgatactacaccat

SEQ ID NO: 666739 - DNA, 25 bp, Rattus norvegicus
ttccaattcattccattgattacag

SEQ ID NO: 666740 - DNA, 25 bp, Rattus norvegicus
ttccaattcattgcattgattacag

SEQ ID NO: 666741 - DNA, 25 bp, Rattus norvegicus
ttccacaaaatcatcaccagcggtc

SEQ ID NO: 666742 - DNA, 25 bp, Rattus norvegicus
ttccacaaaatcttcaccagcggtc

SEQ ID NO: 666743 - DNA, 25 bp, Rattus norvegicus
ttccacaacggacttggccgcgagc

SEQ ID NO: 666744 - DNA, 25 bp, Rattus norvegicus
ttccacaacggagttggccgcgagc

SEQ ID NO: 666745 - DNA, 25 bp, Rattus norvegicus
ttccacaagtgtcctttcccagtgt

SEQ ID NO: 666746 - DNA, 25 bp, Rattus norvegicus
ttccacaagtgtgctttcccagtgt

SEQ ID NO: 666747 - DNA, 25 bp, Rattus norvegicus
ttccacacaggtagtgcccagggaa

SEQ ID NO: 666748 - DNA, 25 bp, Rattus norvegicus
ttccacacaggttgtgcccagggaa

SEQ ID NO: 666749 - DNA, 25 bp, Rattus norvegicus
ttccacaccagtcaggagggcacct

SEQ ID NO: 666750 - DNA, 25 bp, Rattus norvegicus
ttccacaccagtgaggagggcacct

SEQ ID NO: 666751 - DNA, 25 bp, Rattus norvegicus
ttccacaccctccagtgagcaagga

SEQ ID NO: 666752 - DNA, 25 bp, Rattus norvegicus
ttccacaccctcgagtgagcaagga

SEQ ID NO: 666753 - DNA, 25 bp, Rattus norvegicus
ttccacaccctgatggactgacgag

SEQ ID NO: 666754 - DNA, 25 bp, Rattus norvegicus
ttccacaccctgttggactgacgag

SEQ ID NO: 666755 - DNA, 25 bp, Rattus norvegicus
ttccacaccgtgaacataaccacag

SEQ ID NO: 666756 - DNA, 25 bp, Rattus norvegicus
ttccacaccgtgtacataaccacag

SEQ ID NO: 666757 - DNA, 25 bp, Rattus norvegicus
ttccacactaagatctctcaggctt

SEQ ID NO: 666758 - DNA, 25 bp, Rattus norvegicus
ttccacactaagttctctcaggctt

SEQ ID NO: 666759 - DNA, 25 bp, Rattus norvegicus
ttccacactagaaaatacgtatttt

SEQ ID NO: 666760 - DNA, 25 bp, Rattus norvegicus
ttccacactagataatacgtatttt

SEQ ID NO: 666761 - DNA, 25 bp, Rattus norvegicus
ttccacactgcaacgatccagtcga

SEQ ID NO: 666762 - DNA, 25 bp, Rattus norvegicus
ttccacactgcatcgatccagtcga

SEQ ID NO: 666763 - DNA, 25 bp, Rattus norvegicus
ttccacacttatctatcgcaacatg

SEQ ID NO: 666764 - DNA, 25 bp, Rattus norvegicus
ttccacacttatgtatcgcaacatg

SEQ ID NO: 666765 - DNA, 25 bp, Rattus norvegicus
ttccacacttgcctcagaagcaggt

SEQ ID NO: 666766 - DNA, 25 bp, Rattus norvegicus
ttccacacttgcgtcagaagcaggt

SEQ ID NO: 666767 - DNA, 25 bp, Rattus norvegicus
ttccacagaataactagtcccctta

SEQ ID NO: 666768 - DNA, 25 bp, Rattus norvegicus
ttccacagaatatctagtcccctta

SEQ ID NO: 666769 - DNA, 25 bp, Rattus norvegicus
ttccacagagagacctgaactgcag

SEQ ID NO: 666770 - DNA, 25 bp, Rattus norvegicus
ttccacagagagtcctgaactgcag

SEQ ID NO: 666771 - DNA, 25 bp, Rattus norvegicus
ttccacagattgatcgcctcaaggg

SEQ ID NO: 666772 - DNA, 25 bp, Rattus norvegicus
ttccacagattgttcgcctcaaggg

SEQ ID NO: 666773 - DNA, 25 bp, Rattus norvegicus
ttccacagccacagggatggagcag

SEQ ID NO: 666774 - DNA, 25 bp, Rattus norvegicus
ttccacagccactgggatggagcag

SEQ ID NO: 666775 - DNA, 25 bp, Rattus norvegicus
ttccacagctccaattgactctttt

SEQ ID NO: 666776 - DNA, 25 bp, Rattus norvegicus
ttccacagctcctattgactctttt

SEQ ID NO: 666777 - DNA, 25 bp, Rattus norvegicus
ttccacaggaagacacgtcggcagt

SEQ ID NO: 666778 - DNA, 25 bp, Rattus norvegicus
ttccacaggaagtcacgtcggcagt

SEQ ID NO: 666779 - DNA, 25 bp, Rattus norvegicus
ttccacagtctccacaaatcagcat

SEQ ID NO: 666780 - DNA, 25 bp, Rattus norvegicus
ttccacagtctcgacaaatcagcat

SEQ ID NO: 666781 - DNA, 25 bp, Rattus norvegicus
ttccacagtgcgacaaggttctcag

SEQ ID NO: 666782 - DNA, 25 bp, Rattus norvegicus
ttccacagtgcgtcaaggttctcag

SEQ ID NO: 666783 - DNA, 25 bp, Rattus norvegicus
ttccacagtttcagacttctatgtc

SEQ ID NO: 666784 - DNA, 25 bp, Rattus norvegicus
ttccacagtttctgacttctatgtc

SEQ ID NO: 666785 - DNA, 25 bp, Rattus norvegicus
ttccacatagctcctttactcacag

SEQ ID NO: 666786 - DNA, 25 bp, Rattus norvegicus
ttccacatagctgctttactcacag

SEQ ID NO: 666787 - DNA, 25 bp, Rattus norvegicus
ttccacatcctcaggcaaacaggga

SEQ ID NO: 666788 - DNA, 25 bp, Rattus norvegicus
ttccacatcctctggcaaacaggga

SEQ ID NO: 666789 - DNA, 25 bp, Rattus norvegicus
ttccacatctccagcaagcaatcaa

SEQ ID NO: 666790 - DNA, 25 bp, Rattus norvegicus
ttccacatctcctgcaagcaatcaa

SEQ ID NO: 666791 - DNA, 25 bp, Rattus norvegicus
ttccacatggagcacgacgtggtct

SEQ ID NO: 666792 - DNA, 25 bp, Rattus norvegicus
ttccacatggaggacgacgtggtct

SEQ ID NO: 666793 - DNA, 25 bp, Rattus norvegicus
ttccacatggcaagctagcgcaggt

SEQ ID NO: 666794 - DNA, 25 bp, Rattus norvegicus
ttccacatggcatgctagcgcaggt

SEQ ID NO: 666795 - DNA, 25 bp, Rattus norvegicus
ttccaccaatgtcagccatctcgag

SEQ ID NO: 666796 - DNA, 25 bp, Rattus norvegicus
ttccaccaatgtgagccatctcgag

SEQ ID NO: 666797 - DNA, 25 bp, Rattus norvegicus
ttccaccaattcacagctcttcaaa

SEQ ID NO: 666798 - DNA, 25 bp, Rattus norvegicus
ttccaccaattctcagctcttcaaa

SEQ ID NO: 666799 - DNA, 25 bp, Rattus norvegicus
ttccaccacagtacaggccaataat

SEQ ID NO: 666800 - DNA, 25 bp, Rattus norvegicus
ttccaccacagtagctgggtttcaa

SEQ ID NO: 666801 - DNA, 25 bp, Rattus norvegicus
ttccaccacagttcaggccaataat

SEQ ID NO: 666802 - DNA, 25 bp, Rattus norvegicus
ttccaccacagttgctgggtttcaa

SEQ ID NO: 666803 - DNA, 25 bp, Rattus norvegicus
ttccaccaccatccagagtgactgg

SEQ ID NO: 666804 - DNA, 25 bp, Rattus norvegicus
ttccaccaccatgcagagtgactgg

SEQ ID NO: 666805 - DNA, 25 bp, Rattus norvegicus
ttccaccacccacaacatgagttgt

SEQ ID NO: 666806 - DNA, 25 bp, Rattus norvegicus
ttccaccacccagaacatgagttgt

SEQ ID NO: 666807 - DNA, 25 bp, Rattus norvegicus
ttccaccagatgacattcttgcttt

SEQ ID NO: 666808 - DNA, 25 bp, Rattus norvegicus
ttccaccagatgtcattcttgcttt

SEQ ID NO: 666809 - DNA, 25 bp, Rattus norvegicus
ttccaccagctcaactgtgacattg

SEQ ID NO: 666810 - DNA, 25 bp, Rattus norvegicus
ttccaccagctctactgtgacattg

SEQ ID NO: 666811 - DNA, 25 bp, Rattus norvegicus
ttccaccagttccatgttgctaaag

SEQ ID NO: 666812 - DNA, 25 bp, Rattus norvegicus
ttccaccagttcgatgttgctaaag

SEQ ID NO: 666813 - DNA, 25 bp, Rattus norvegicus
ttccaccatctgagacttcagttcc

SEQ ID NO: 666814 - DNA, 25 bp, Rattus norvegicus
ttccaccatctgtgacttcagttcc

SEQ ID NO: 666815 - DNA, 25 bp, Rattus norvegicus
ttccaccatgttcacagcagcctta

SEQ ID NO: 666816 - DNA, 25 bp, Rattus norvegicus
ttccaccatgttgacagcagcctta

SEQ ID NO: 666817 - DNA, 25 bp, Rattus norvegicus
ttccacccagagaggagggccatgc

SEQ ID NO: 666818 - DNA, 25 bp, Rattus norvegicus
ttccacccagagtggagggccatgc

SEQ ID NO: 666819 - DNA, 25 bp, Rattus norvegicus
ttccacccagtgaatggatcgcact

SEQ ID NO: 666820 - DNA, 25 bp, Rattus norvegicus
ttccacccagtgtatggatcgcact

SEQ ID NO: 666821 - DNA, 25 bp, Rattus norvegicus
ttccaccccaggaaacaagagtcct

SEQ ID NO: 666822 - DNA, 25 bp, Rattus norvegicus
ttccaccccaggtaacaagagtcct

SEQ ID NO: 666823 - DNA, 25 bp, Rattus norvegicus
ttccaccctcttcctaagtgttgaa

SEQ ID NO: 666824 - DNA, 25 bp, Rattus norvegicus
ttccaccctcttgctaagtgttgaa

SEQ ID NO: 666825 - DNA, 25 bp, Rattus norvegicus
ttccaccctgtgcattcacgggtat

SEQ ID NO: 666826 - DNA, 25 bp, Rattus norvegicus
ttccaccctgtggattcacgggtat

SEQ ID NO: 666827 - DNA, 25 bp, Rattus norvegicus
ttccaccgagttaccttgttgataa

SEQ ID NO: 666828 - DNA, 25 bp, Rattus norvegicus
ttccaccgagtttccttgttgataa

SEQ ID NO: 666829 - DNA, 25 bp, Rattus norvegicus
ttccaccgggatatattactactgt

SEQ ID NO: 666830 - DNA, 25 bp, Rattus norvegicus
ttccaccgggatttattactactgt

SEQ ID NO: 666831 - DNA, 25 bp, Rattus norvegicus
ttccaccgggtgatctatgatattt

SEQ ID NO: 666832 - DNA, 25 bp, Rattus norvegicus
ttccaccgggtgttctatgatattt

SEQ ID NO: 666833 - DNA, 25 bp, Rattus norvegicus
ttccaccgtgctaggctacgaatta

SEQ ID NO: 666834 - DNA, 25 bp, Rattus norvegicus
ttccaccgtgcttggctacgaatta

SEQ ID NO: 666835 - DNA, 25 bp, Rattus norvegicus
ttccacctgagcattagcagccaac

SEQ ID NO: 666836 - DNA, 25 bp, Rattus norvegicus
ttccacctgagctttagcagccaac

SEQ ID NO: 666837 - DNA, 25 bp, Rattus norvegicus
ttccacctgccaattctacatgtat

SEQ ID NO: 666838 - DNA, 25 bp, Rattus norvegicus
ttccacctgccatttctacatgtat

SEQ ID NO: 666839 - DNA, 25 bp, Rattus norvegicus
ttccacctgctccaatatgttaaca

SEQ ID NO: 666840 - DNA, 25 bp, Rattus norvegicus
ttccacctgctcgaatatgttaaca

SEQ ID NO: 666841 - DNA, 25 bp, Rattus norvegicus
ttccacctggatctctagagctgtt

SEQ ID NO: 666842 - DNA, 25 bp, Rattus norvegicus
ttccacctggatgtctagagctgtt

SEQ ID NO: 666843 - DNA, 25 bp, Rattus norvegicus
ttccacctggctaatcagctgtgta

SEQ ID NO: 666844 - DNA, 25 bp, Rattus norvegicus
ttccacctggcttatcagctgtgta

SEQ ID NO: 666845 - DNA, 25 bp, Rattus norvegicus
ttccacctgggccatgcagctgggc

SEQ ID NO: 666846 - DNA, 25 bp, Rattus norvegicus
ttccacctgggcgatgcagctgggc

SEQ ID NO: 666847 - DNA, 25 bp, Rattus norvegicus
ttccaccttattactgttccaacat

SEQ ID NO: 666848 - DNA, 25 bp, Rattus norvegicus
ttccaccttatttctgttccaacat

SEQ ID NO: 666849 - DNA, 25 bp, Rattus norvegicus
ttccaccttctgagggaagtcttgg

SEQ ID NO: 666850 - DNA, 25 bp, Rattus norvegicus
ttccaccttctgtgggaagtcttgg

SEQ ID NO: 666851 - DNA, 25 bp, Rattus norvegicus
ttccacgaaacgatgttgcttccaa

SEQ ID NO: 666852 - DNA, 25 bp, Rattus norvegicus
ttccacgaaacgttgttgcttccaa

SEQ ID NO: 666853 - DNA, 25 bp, Rattus norvegicus
ttccacgagatccagccgtaaggca

SEQ ID NO: 666854 - DNA, 25 bp, Rattus norvegicus
ttccacgagatcgagccgtaaggca

SEQ ID NO: 666855 - DNA, 25 bp, Rattus norvegicus
ttccacgaggaaaagcgcccatttg

SEQ ID NO: 666856 - DNA, 25 bp, Rattus norvegicus
ttccacgaggaatagcgcccatttg

SEQ ID NO: 666857 - DNA, 25 bp, Rattus norvegicus
ttccacgataccaagtctcagcatg

SEQ ID NO: 666858 - DNA, 25 bp, Rattus norvegicus
ttccacgatacctagtctcagcatg

SEQ ID NO: 666859 - DNA, 25 bp, Rattus norvegicus
ttccacgggacaattttgacttcat

SEQ ID NO: 666860 - DNA, 25 bp, Rattus norvegicus
ttccacgggacatttttgacttcat

SEQ ID NO: 666861 - DNA, 25 bp, Rattus norvegicus
ttccacgggcacaggcagaaaattc

SEQ ID NO: 666862 - DNA, 25 bp, Rattus norvegicus
ttccacgggcactggcagaaaattc

SEQ ID NO: 666863 - DNA, 25 bp, Rattus norvegicus
ttccacgtggtgactgacttcaatg

SEQ ID NO: 666864 - DNA, 25 bp, Rattus norvegicus
ttccacgtggtgtctgacttcaatg

SEQ ID NO: 666865 - DNA, 25 bp, Rattus norvegicus
ttccacgtttatcaagtttagcttc

SEQ ID NO: 666866 - DNA, 25 bp, Rattus norvegicus
ttccacgtttatgaagtttagcttc

SEQ ID NO: 666867 - DNA, 25 bp, Rattus norvegicus
ttccactaccttaatgtgtccactc

SEQ ID NO: 666868 - DNA, 25 bp, Rattus norvegicus
ttccactacctttatgtgtccactc

SEQ ID NO: 666869 - DNA, 25 bp, Rattus norvegicus
ttccactacttacccagagttccaa

SEQ ID NO: 666870 - DNA, 25 bp, Rattus norvegicus
ttccactacttagccagagttccaa

SEQ ID NO: 666871 - DNA, 25 bp, Rattus norvegicus
ttccactcagtcatcaggagaccat

SEQ ID NO: 666872 - DNA, 25 bp, Rattus norvegicus
ttccactcagtcttcaggagaccat

SEQ ID NO: 666873 - DNA, 25 bp, Rattus norvegicus
ttccactcatcacatattcagcggg

SEQ ID NO: 666874 - DNA, 25 bp, Rattus norvegicus
ttccactcatcagatattcagcggg

SEQ ID NO: 666875 - DNA, 25 bp, Rattus norvegicus
ttccactccatgcaggagcggattt

SEQ ID NO: 666876 - DNA, 25 bp, Rattus norvegicus
ttccactccatggaggagcggattt

SEQ ID NO: 666877 - DNA, 25 bp, Rattus norvegicus
ttccactccctcacagtggtagaaa

SEQ ID NO: 666878 - DNA, 25 bp, Rattus norvegicus
ttccactccctctcagtggtagaaa

SEQ ID NO: 666879 - DNA, 25 bp, Rattus norvegicus
ttccactcgcgaatcgtaggccaaa

SEQ ID NO: 666880 - DNA, 25 bp, Rattus norvegicus
ttccactcgcgattcgtaggccaaa

SEQ ID NO: 666881 - DNA, 25 bp, Rattus norvegicus
ttccactcggctccagagtatccag

SEQ ID NO: 666882 - DNA, 25 bp, Rattus norvegicus
ttccactcggctgcagagtatccag

SEQ ID NO: 666883 - DNA, 25 bp, Rattus norvegicus
ttccactcgttcattgcagagggca

SEQ ID NO: 666884 - DNA, 25 bp, Rattus norvegicus
ttccactcgttctttgcagagggca

SEQ ID NO: 666885 - DNA, 25 bp, Rattus norvegicus
ttccactctctgaggtgtcagctga

SEQ ID NO: 666886 - DNA, 25 bp, Rattus norvegicus
ttccactctctgtggtgtcagctga

SEQ ID NO: 666887 - DNA, 25 bp, Rattus norvegicus
ttccactctgctattggctgtgaaa

SEQ ID NO: 666888 - DNA, 25 bp, Rattus norvegicus
ttccactctgcttttggctgtgaaa

SEQ ID NO: 666889 - DNA, 25 bp, Rattus norvegicus
ttccactgcggcatgcgcggtagca

SEQ ID NO: 666890 - DNA, 25 bp, Rattus norvegicus
ttccactgcggcttgcgcggtagca

SEQ ID NO: 666891 - DNA, 25 bp, Rattus norvegicus
ttccactgctagaaatcttgctcac

SEQ ID NO: 666892 - DNA, 25 bp, Rattus norvegicus
ttccactgctagtaatcttgctcac

SEQ ID NO: 666893 - DNA, 25 bp, Rattus norvegicus
ttccactggatcctcatttctcagt

SEQ ID NO: 666894 - DNA, 25 bp, Rattus norvegicus
ttccactggatcgtcatttctcagt

SEQ ID NO: 666895 - DNA, 25 bp, Rattus norvegicus
ttccactggctcaggcacacaaata

SEQ ID NO: 666896 - DNA, 25 bp, Rattus norvegicus
ttccactggctctggcacacaaata

SEQ ID NO: 666897 - DNA, 25 bp, Rattus norvegicus
ttccactgtagtaactctcttcctg

SEQ ID NO: 666898 - DNA, 25 bp, Rattus norvegicus
ttccactgtagttactctcttcctg

SEQ ID NO: 666899 - DNA, 25 bp, Rattus norvegicus
ttccactgtctccatgagctttaaa

SEQ ID NO: 666900 - DNA, 25 bp, Rattus norvegicus
ttccactgtctcgatgagctttaaa

SEQ ID NO: 666901 - DNA, 25 bp, Rattus norvegicus
ttccactgtgccaggagactgaaga

SEQ ID NO: 666902 - DNA, 25 bp, Rattus norvegicus
ttccactgtgcctggagactgaaga

SEQ ID NO: 666903 - DNA, 25 bp, Rattus norvegicus
ttccactgtggtctttcatttccca

SEQ ID NO: 666904 - DNA, 25 bp, Rattus norvegicus
ttccactgtggtgtttcatttccca

SEQ ID NO: 666905 - DNA, 25 bp, Rattus norvegicus
ttccacttgaatatggcaccggtat

SEQ ID NO: 666906 - DNA, 25 bp, Rattus norvegicus
ttccacttgaatttggcaccggtat

SEQ ID NO: 666907 - DNA, 25 bp, Rattus norvegicus
ttccacttgttgaggcagggtcttt

SEQ ID NO: 666908 - DNA, 25 bp, Rattus norvegicus
ttccacttgttgtggcagggtcttt

SEQ ID NO: 666909 - DNA, 25 bp, Rattus norvegicus
ttccactttttcctctgttcacaaa

SEQ ID NO: 666910 - DNA, 25 bp, Rattus norvegicus
ttccactttttcgtctgttcacaaa

SEQ ID NO: 666911 - DNA, 25 bp, Rattus norvegicus
ttccagaaaattcatgtcttccaga

SEQ ID NO: 666912 - DNA, 25 bp, Rattus norvegicus
ttccagaaaattgatgtcttccaga

SEQ ID NO: 666913 - DNA, 25 bp, Rattus norvegicus
ttccagaaacatccctctaggtgcc

SEQ ID NO: 666914 - DNA, 25 bp, Rattus norvegicus
ttccagaaacatgcctctaggtgcc

SEQ ID NO: 666915 - DNA, 25 bp, Rattus norvegicus
ttccagaaactacctaaccataata

SEQ ID NO: 666916 - DNA, 25 bp, Rattus norvegicus
ttccagaaactagctaaccataata

SEQ ID NO: 666917 - DNA, 25 bp, Rattus norvegicus
ttccagaacaaacagcacaccgcat

SEQ ID NO: 666918 - DNA, 25 bp, Rattus norvegicus
ttccagaacaaagagcacaccgcat

SEQ ID NO: 666919 - DNA, 25 bp, Rattus norvegicus
ttccagaacactccgcgttgtgctt

SEQ ID NO: 666920 - DNA, 25 bp, Rattus norvegicus
ttccagaacactgcgcgttgtgctt

SEQ ID NO: 666921 - DNA, 25 bp, Rattus norvegicus
ttccagaacaggcagatttacatga

SEQ ID NO: 666922 - DNA, 25 bp, Rattus norvegicus
ttccagaacagggagatttacatga

SEQ ID NO: 666923 - DNA, 25 bp, Rattus norvegicus
ttccagaacctaatcttcctagcca

SEQ ID NO: 666924 - DNA, 25 bp, Rattus norvegicus
ttccagaacctattcttcctagcca

SEQ ID NO: 666925 - DNA, 25 bp, Rattus norvegicus
ttccagaagcggcaacggctcagct

SEQ ID NO: 666926 - DNA, 25 bp, Rattus norvegicus
ttccagaagcgggaacggctcagct

SEQ ID NO: 666927 - DNA, 25 bp, Rattus norvegicus
ttccagaaggaccagcactgtgttc

SEQ ID NO: 666928 - DNA, 25 bp, Rattus norvegicus
ttccagaaggacgagcactgtgttc

SEQ ID NO: 666929 - DNA, 25 bp, Rattus norvegicus
ttccagaaggagcacccgatgacca

SEQ ID NO: 666930 - DNA, 25 bp, Rattus norvegicus
ttccagaaggaggacccgatgacca

SEQ ID NO: 666931 - DNA, 25 bp, Rattus norvegicus
ttccagaatccgcttgttactaagt

SEQ ID NO: 666932 - DNA, 25 bp, Rattus norvegicus
ttccagaatccggttgttactaagt

SEQ ID NO: 666933 - DNA, 25 bp, Rattus norvegicus
ttccagaatctgagtcactaagctg

SEQ ID NO: 666934 - DNA, 25 bp, Rattus norvegicus
ttccagaatctgtgtcactaagctg

SEQ ID NO: 666935 - DNA, 25 bp, Rattus norvegicus
ttccagaatgtgagaggccgagata

SEQ ID NO: 666936 - DNA, 25 bp, Rattus norvegicus
ttccagaatgtgtgaggccgagata

SEQ ID NO: 666937 - DNA, 25 bp, Rattus norvegicus
ttccagacaagcactatcccctagg

SEQ ID NO: 666938 - DNA, 25 bp, Rattus norvegicus
ttccagacaagctctatcccctagg

SEQ ID NO: 666939 - DNA, 25 bp, Rattus norvegicus
ttccagacaggaccttacacaccag

SEQ ID NO: 666940 - DNA, 25 bp, Rattus norvegicus
ttccagacaggagcttacacaccag

SEQ ID NO: 666941 - DNA, 25 bp, Rattus norvegicus
ttccagacatggatggaaggctcct

SEQ ID NO: 666942 - DNA, 25 bp, Rattus norvegicus
ttccagacatggctgctgtggctac

SEQ ID NO: 666943 - DNA, 25 bp, Rattus norvegicus
ttccagacatgggtgctgtggctac

SEQ ID NO: 666944 - DNA, 25 bp, Rattus norvegicus
ttccagacatggttggaaggctcct

SEQ ID NO: 666945 - DNA, 25 bp, Rattus norvegicus
ttccagaccaggaagcacacacaag

SEQ ID NO: 666946 - DNA, 25 bp, Rattus norvegicus
ttccagaccaggtagcacacacaag

SEQ ID NO: 666947 - DNA, 25 bp, Rattus norvegicus
ttccagaccattcacaagaccatta

SEQ ID NO: 666948 - DNA, 25 bp, Rattus norvegicus
ttccagaccattgacaagaccatta

SEQ ID NO: 666949 - DNA, 25 bp, Rattus norvegicus
ttccagacccttctctgtatagagt

SEQ ID NO: 666950 - DNA, 25 bp, Rattus norvegicus
ttccagacccttgtctgtatagagt

SEQ ID NO: 666951 - DNA, 25 bp, Rattus norvegicus
ttccagacgcagatgacgacgcatt

SEQ ID NO: 666952 - DNA, 25 bp, Rattus norvegicus
ttccagacgcagttgacgacgcatt

SEQ ID NO: 666953 - DNA, 25 bp, Rattus norvegicus
ttccagacggctcagtcatcatcaa

SEQ ID NO: 666954 - DNA, 25 bp, Rattus norvegicus
ttccagacggctgagtcatcatcaa

SEQ ID NO: 666955 - DNA, 25 bp, Rattus norvegicus
ttccagactggaatgctaatgtaat

SEQ ID NO: 666956 - DNA, 25 bp, Rattus norvegicus
ttccagactggattgctaatgtaat

SEQ ID NO: 666957 - DNA, 25 bp, Rattus norvegicus
ttccagactgggagatcagcagact

SEQ ID NO: 666958 - DNA, 25 bp, Rattus norvegicus
ttccagactgggtgatcagcagact

SEQ ID NO: 666959 - DNA, 25 bp, Rattus norvegicus
ttccagagaggaacggcctccaaaa

SEQ ID NO: 666960 - DNA, 25 bp, Rattus norvegicus
ttccagagaggatcggcctccaaaa

SEQ ID NO: 666961 - DNA, 25 bp, Rattus norvegicus
ttccagagcaccagcgcttacagcg

SEQ ID NO: 666962 - DNA, 25 bp, Rattus norvegicus
ttccagagcacctgcgcttacagcg

SEQ ID NO: 666963 - DNA, 25 bp, Rattus norvegicus
ttccagagcacgacgctcgggagaa

SEQ ID NO: 666964 - DNA, 25 bp, Rattus norvegicus
ttccagagcacgtcgctcgggagaa

SEQ ID NO: 666965 - DNA, 25 bp, Rattus norvegicus
ttccagagcctcagtggtaatggcc

SEQ ID NO: 666966 - DNA, 25 bp, Rattus norvegicus
ttccagagcctctgtggtaatggcc

SEQ ID NO: 666967 - DNA, 25 bp, Rattus norvegicus
ttccagagggacacagggccgacga

SEQ ID NO: 666968 - DNA, 25 bp, Rattus norvegicus
ttccagagggactcagggccgacga

SEQ ID NO: 666969 - DNA, 25 bp, Rattus norvegicus
ttccagagggcacagctctccaaat

SEQ ID NO: 666970 - DNA, 25 bp, Rattus norvegicus
ttccagagggcagagctctccaaat

SEQ ID NO: 666971 - DNA, 25 bp, Rattus norvegicus
ttccagagtaagagggccacagcat

SEQ ID NO: 666972 - DNA, 25 bp, Rattus norvegicus
ttccagagtaagtgggccacagcat

SEQ ID NO: 666973 - DNA, 25 bp, Rattus norvegicus
ttccagagtgttcggcaggacaagc

SEQ ID NO: 666974 - DNA, 25 bp, Rattus norvegicus
ttccagagtgttgggcaggacaagc

SEQ ID NO: 666975 - DNA, 25 bp, Rattus norvegicus
ttccagatagtccaattctgttctg

SEQ ID NO: 666976 - DNA, 25 bp, Rattus norvegicus
ttccagatagtcgaattctgttctg

SEQ ID NO: 666977 - DNA, 25 bp, Rattus norvegicus
ttccagatctcactcaacatcagtt

SEQ ID NO: 666978 - DNA, 25 bp, Rattus norvegicus
ttccagatctcagtcaacatcagtt

SEQ ID NO: 666979 - DNA, 25 bp, Rattus norvegicus
ttccagatctggcatccacgtgatg

SEQ ID NO: 666980 - DNA, 25 bp, Rattus norvegicus
ttccagatctgggatccacgtgatg

SEQ ID NO: 666981 - DNA, 25 bp, Rattus norvegicus
ttccagatgacgaccgagcagagca

SEQ ID NO: 666982 - DNA, 25 bp, Rattus norvegicus
ttccagatgacgtccgagcagagca

SEQ ID NO: 666983 - DNA, 25 bp, Rattus norvegicus
ttccagatgcccaggtgcctctagg

SEQ ID NO: 666984 - DNA, 25 bp, Rattus norvegicus
ttccagatgccctggtgcctctagg

SEQ ID NO: 666985 - DNA, 25 bp, Rattus norvegicus
ttccagatgtcgattgctgttgctt

SEQ ID NO: 666986 - DNA, 25 bp, Rattus norvegicus
ttccagatgtcgtttgctgttgctt

SEQ ID NO: 666987 - DNA, 25 bp, Rattus norvegicus
ttccagcaagcaacatccgagtcat

SEQ ID NO: 666988 - DNA, 25 bp, Rattus norvegicus
ttccagcaagcatcatccgagtcat

SEQ ID NO: 666989 - DNA, 25 bp, Rattus norvegicus
ttccagcaaggtccgcgtgcacttt

SEQ ID NO: 666990 - DNA, 25 bp, Rattus norvegicus
ttccagcaaggtgcgcgtgcacttt

SEQ ID NO: 666991 - DNA, 25 bp, Rattus norvegicus
ttccagcagaacacatgacccagat

SEQ ID NO: 666992 - DNA, 25 bp, Rattus norvegicus
ttccagcagaactcatgacccagat

SEQ ID NO: 666993 - DNA, 25 bp, Rattus norvegicus
ttccagcagggcactctcaggaagt

SEQ ID NO: 666994 - DNA, 25 bp, Rattus norvegicus
ttccagcagggctctctcaggaagt

SEQ ID NO: 666995 - DNA, 25 bp, Rattus norvegicus
ttccagcatccacataggagctcac

SEQ ID NO: 666996 - DNA, 25 bp, Rattus norvegicus
ttccagcatccagataggagctcac

SEQ ID NO: 666997 - DNA, 25 bp, Rattus norvegicus
ttccagccaaacactacatttcagg

SEQ ID NO: 666998 - DNA, 25 bp, Rattus norvegicus
ttccagccaaactctacatttcagg

SEQ ID NO: 666999 - DNA, 25 bp, Rattus norvegicus
ttccagccaactaaccagcagttta

SEQ ID NO: 667000 - DNA, 25 bp, Rattus norvegicus
ttccagccaacttaccagcagttta

SEQ ID NO: 667001 - DNA, 25 bp, Rattus norvegicus
ttccagccacgacccagaatttagt

SEQ ID NO: 667002 - DNA, 25 bp, Rattus norvegicus
ttccagccacgagccagaatttagt

SEQ ID NO: 667003 - DNA, 25 bp, Rattus norvegicus
ttccagccagctattattcctaaga

SEQ ID NO: 667004 - DNA, 25 bp, Rattus norvegicus
ttccagccagctctcggagtgaaga

SEQ ID NO: 667005 - DNA, 25 bp, Rattus norvegicus
ttccagccagctgtcggagtgaaga

SEQ ID NO: 667006 - DNA, 25 bp, Rattus norvegicus
ttccagccagcttttattcctaaga

SEQ ID NO: 667007 - DNA, 25 bp, Rattus norvegicus
ttccagccatagcttcacggtaagt

SEQ ID NO: 667008 - DNA, 25 bp, Rattus norvegicus
ttccagccataggttcacggtaagt

SEQ ID NO: 667009 - DNA, 25 bp, Rattus norvegicus
ttccagcccagacgtcaccataagt

SEQ ID NO: 667010 - DNA, 25 bp, Rattus norvegicus
ttccagcccagaggtcaccataagt

SEQ ID NO: 667011 - DNA, 25 bp, Rattus norvegicus
ttccagccccagatcacagatgact

SEQ ID NO: 667012 - DNA, 25 bp, Rattus norvegicus
ttccagccccagttcacagatgact

SEQ ID NO: 667013 - DNA, 25 bp, Rattus norvegicus
ttccagccccttcgtgatatcatga

SEQ ID NO: 667014 - DNA, 25 bp, Rattus norvegicus
ttccagccccttggtgatatcatga

SEQ ID NO: 667015 - DNA, 25 bp, Rattus norvegicus
ttccagccctccagaactgggtggt

SEQ ID NO: 667016 - DNA, 25 bp, Rattus norvegicus
ttccagccctcctgaactgggtggt

SEQ ID NO: 667017 - DNA, 25 bp, Rattus norvegicus
ttccagcctccacagaaactgaaat

SEQ ID NO: 667018 - DNA, 25 bp, Rattus norvegicus
ttccagcctccagagaaactgaaat

SEQ ID NO: 667019 - DNA, 25 bp, Rattus norvegicus
ttccagccttaccatggcgacgagg

SEQ ID NO: 667020 - DNA, 25 bp, Rattus norvegicus
ttccagccttacgatggcgacgagg

SEQ ID NO: 667021 - DNA, 25 bp, Rattus norvegicus
ttccagccttccaaataagttttag

SEQ ID NO: 667022 - DNA, 25 bp, Rattus norvegicus
ttccagccttcctaataagttttag

SEQ ID NO: 667023 - DNA, 25 bp, Rattus norvegicus
ttccagcgatttcgaccgagttcgg

SEQ ID NO: 667024 - DNA, 25 bp, Rattus norvegicus
ttccagcgatttggaccgagttcgg

SEQ ID NO: 667025 - DNA, 25 bp, Rattus norvegicus
ttccagcgctaccatgccaagtaag

SEQ ID NO: 667026 - DNA, 25 bp, Rattus norvegicus
ttccagcgctacgatgccaagtaag

SEQ ID NO: 667027 - DNA, 25 bp, Rattus norvegicus
ttccagcgggcgatttccgtggcga

SEQ ID NO: 667028 - DNA, 25 bp, Rattus norvegicus
ttccagcgggcgttttccgtggcga

SEQ ID NO: 667029 - DNA, 25 bp, Rattus norvegicus
ttccagcggtggacatatggtccat

SEQ ID NO: 667030 - DNA, 25 bp, Rattus norvegicus
ttccagcggtggtcatatggtccat

SEQ ID NO: 667031 - DNA, 25 bp, Rattus norvegicus
ttccagctcacaatcaattgaacga

SEQ ID NO: 667032 - DNA, 25 bp, Rattus norvegicus
ttccagctcacattcaattgaacga

SEQ ID NO: 667033 - DNA, 25 bp, Rattus norvegicus
ttccagctccagctcgggttcgggt

SEQ ID NO: 667034 - DNA, 25 bp, Rattus norvegicus
ttccagctccaggtcgggttcgggt

SEQ ID NO: 667035 - DNA, 25 bp, Rattus norvegicus
ttccagctctgccacatagcagaat

SEQ ID NO: 667036 - DNA, 25 bp, Rattus norvegicus
ttccagctctgccttagggagacat

SEQ ID NO: 667037 - DNA, 25 bp, Rattus norvegicus
ttccagctctgcgacatagcagaat

SEQ ID NO: 667038 - DNA, 25 bp, Rattus norvegicus
ttccagctctgcgttagggagacat

SEQ ID NO: 667039 - DNA, 25 bp, Rattus norvegicus
ttccagctcttcatgtcaactgcaa

SEQ ID NO: 667040 - DNA, 25 bp, Rattus norvegicus
ttccagctcttcttgtcaactgcaa

SEQ ID NO: 667041 - DNA, 25 bp, Rattus norvegicus
ttccagctgctgatactactagaca

SEQ ID NO: 667042 - DNA, 25 bp, Rattus norvegicus
ttccagctgctgttactactagaca

SEQ ID NO: 667043 - DNA, 25 bp, Rattus norvegicus
ttccagctggttcgcttttctgttt

SEQ ID NO: 667044 - DNA, 25 bp, Rattus norvegicus
ttccagctggttcttgccgatttgg

SEQ ID NO: 667045 - DNA, 25 bp, Rattus norvegicus
ttccagctggttggcttttctgttt

SEQ ID NO: 667046 - DNA, 25 bp, Rattus norvegicus
ttccagctggttgttgccgatttgg

SEQ ID NO: 667047 - DNA, 25 bp, Rattus norvegicus
ttccagctgtgccaccccaaagagg

SEQ ID NO: 667048 - DNA, 25 bp, Rattus norvegicus
ttccagctgtgcgaccccaaagagg

SEQ ID NO: 667049 - DNA, 25 bp, Rattus norvegicus
ttccagctgttgagccgtttcagaa

SEQ ID NO: 667050 - DNA, 25 bp, Rattus norvegicus
ttccagctgttgtgccgtttcagaa

SEQ ID NO: 667051 - DNA, 25 bp, Rattus norvegicus
ttccagcttcctacacagagatgac

SEQ ID NO: 667052 - DNA, 25 bp, Rattus norvegicus
ttccagcttccttcacagagatgac

SEQ ID NO: 667053 - DNA, 25 bp, Rattus norvegicus
ttccagctttccaagagcctgaggg

SEQ ID NO: 667054 - DNA, 25 bp, Rattus norvegicus
ttccagctttcctagagcctgaggg

SEQ ID NO: 667055 - DNA, 25 bp, Rattus norvegicus
ttccaggaaatcagtaaattcaatg

SEQ ID NO: 667056 - DNA, 25 bp, Rattus norvegicus
ttccaggaaatctgtaaattcaatg

SEQ ID NO: 667057 - DNA, 25 bp, Rattus norvegicus
ttccaggaacagctgcgttttcgtg

SEQ ID NO: 667058 - DNA, 25 bp, Rattus norvegicus
ttccaggaacaggtgcgttttcgtg

SEQ ID NO: 667059 - DNA, 25 bp, Rattus norvegicus
ttccaggaaggacgtttgctcagac

SEQ ID NO: 667060 - DNA, 25 bp, Rattus norvegicus
ttccaggaaggaggtttgctcagac

SEQ ID NO: 667061 - DNA, 25 bp, Rattus norvegicus
ttccaggactgtccattttcagggt

SEQ ID NO: 667062 - DNA, 25 bp, Rattus norvegicus
ttccaggactgtgcattttcagggt

SEQ ID NO: 667063 - DNA, 25 bp, Rattus norvegicus
ttccaggacttcacagcagcacgat

SEQ ID NO: 667064 - DNA, 25 bp, Rattus norvegicus
ttccaggacttctcagcagcacgat

SEQ ID NO: 667065 - DNA, 25 bp, Rattus norvegicus
ttccaggagcttctcacataaaaac

SEQ ID NO: 667066 - DNA, 25 bp, Rattus norvegicus
ttccaggagcttgtcacataaaaac

SEQ ID NO: 667067 - DNA, 25 bp, Rattus norvegicus
ttccaggatctgatcaccccaaatg

SEQ ID NO: 667068 - DNA, 25 bp, Rattus norvegicus
ttccaggatctgttcaccccaaatg

SEQ ID NO: 667069 - DNA, 25 bp, Rattus norvegicus
ttccaggatgtccaccgccatgtca

SEQ ID NO: 667070 - DNA, 25 bp, Rattus norvegicus
ttccaggatgtcgaccgccatgtca

SEQ ID NO: 667071 - DNA, 25 bp, Rattus norvegicus
ttccaggattcaaatctgttctcag

SEQ ID NO: 667072 - DNA, 25 bp, Rattus norvegicus
ttccaggattcatatctgttctcag

SEQ ID NO: 667073 - DNA, 25 bp, Rattus norvegicus
ttccaggccactaacagctatgtat

SEQ ID NO: 667074 - DNA, 25 bp, Rattus norvegicus
ttccaggccacttacagctatgtat

SEQ ID NO: 667075 - DNA, 25 bp, Rattus norvegicus
ttccaggcccccatgattattagac

SEQ ID NO: 667076 - DNA, 25 bp, Rattus norvegicus
ttccaggcccccttgattattagac

SEQ ID NO: 667077 - DNA, 25 bp, Rattus norvegicus
ttccaggcctgtatcaatgaccgag

SEQ ID NO: 667078 - DNA, 25 bp, Rattus norvegicus
ttccaggcctgtttcaatgaccgag

SEQ ID NO: 667079 - DNA, 25 bp, Rattus norvegicus
ttccaggccttcacttatttaaact

SEQ ID NO: 667080 - DNA, 25 bp, Rattus norvegicus
ttccaggccttctcttatttaaact

SEQ ID NO: 667081 - DNA, 25 bp, Rattus norvegicus
ttccaggctgccaagctcttttgaa

SEQ ID NO: 667082 - DNA, 25 bp, Rattus norvegicus
ttccaggctgcctagctcttttgaa

SEQ ID NO: 667083 - DNA, 25 bp, Rattus norvegicus
ttccaggcttgtatgagtttcatgt

SEQ ID NO: 667084 - DNA, 25 bp, Rattus norvegicus
ttccaggcttgtatgcacaactcat

SEQ ID NO: 667085 - DNA, 25 bp, Rattus norvegicus
ttccaggcttgtttgagtttcatgt

SEQ ID NO: 667086 - DNA, 25 bp, Rattus norvegicus
ttccaggcttgtttgcacaactcat

SEQ ID NO: 667087 - DNA, 25 bp, Rattus norvegicus
ttccaggctttcagtgacattatct

SEQ ID NO: 667088 - DNA, 25 bp, Rattus norvegicus
ttccaggctttctgtgacattatct

SEQ ID NO: 667089 - DNA, 25 bp, Rattus norvegicus
ttccagggacccatgtttaatttct

SEQ ID NO: 667090 - DNA, 25 bp, Rattus norvegicus
ttccagggacccttgtttaatttct

SEQ ID NO: 667091 - DNA, 25 bp, Rattus norvegicus
ttccagggcagacccaaggctacat

SEQ ID NO: 667092 - DNA, 25 bp, Rattus norvegicus
ttccagggcagagccaaggctacat

SEQ ID NO: 667093 - DNA, 25 bp, Rattus norvegicus
ttccagggctgcaagtttgaactca

SEQ ID NO: 667094 - DNA, 25 bp, Rattus norvegicus
ttccagggctgctagtttgaactca

SEQ ID NO: 667095 - DNA, 25 bp, Rattus norvegicus
ttccaggtaatacaatgccctcttc

SEQ ID NO: 667096 - DNA, 25 bp, Rattus norvegicus
ttccaggtaatagaatgccctcttc

SEQ ID NO: 667097 - DNA, 25 bp, Rattus norvegicus
ttccaggtacatcacaaggtcaaga

SEQ ID NO: 667098 - DNA, 25 bp, Rattus norvegicus
ttccaggtacatgacaaggtcaaga

SEQ ID NO: 667099 - DNA, 25 bp, Rattus norvegicus
ttccaggtagccactagaaggtaga

SEQ ID NO: 667100 - DNA, 25 bp, Rattus norvegicus
ttccaggtagcctctagaaggtaga

SEQ ID NO: 667101 - DNA, 25 bp, Rattus norvegicus
ttccaggtcagcagtactgctgtgg

SEQ ID NO: 667102 - DNA, 25 bp, Rattus norvegicus
ttccaggtcagctgtactgctgtgg

SEQ ID NO: 667103 - DNA, 25 bp, Rattus norvegicus
ttccaggtccagcactagtgggagc

SEQ ID NO: 667104 - DNA, 25 bp, Rattus norvegicus
ttccaggtccaggactagtgggagc

SEQ ID NO: 667105 - DNA, 25 bp, Rattus norvegicus
ttccaggtgcttaccgagccaagct

SEQ ID NO: 667106 - DNA, 25 bp, Rattus norvegicus
ttccaggtgctttccgagccaagct

SEQ ID NO: 667107 - DNA, 25 bp, Rattus norvegicus
ttccaggtgggtctcgtgcatacca

SEQ ID NO: 667108 - DNA, 25 bp, Rattus norvegicus
ttccaggtgggtgtcgtgcatacca

SEQ ID NO: 667109 - DNA, 25 bp, Rattus norvegicus
ttccaggtgtagctagcaaacccat

SEQ ID NO: 667110 - DNA, 25 bp, Rattus norvegicus
ttccaggtgtaggtagcaaacccat

SEQ ID NO: 667111 - DNA, 25 bp, Rattus norvegicus
ttccaggtgtctaaatctccagtct

SEQ ID NO: 667112 - DNA, 25 bp, Rattus norvegicus
ttccaggtgtcttaatctccagtct

SEQ ID NO: 667113 - DNA, 25 bp, Rattus norvegicus
ttccaggttaatcgccacacgtctc

SEQ ID NO: 667114 - DNA, 25 bp, Rattus norvegicus
ttccaggttaatggccacacgtctc

SEQ ID NO: 667115 - DNA, 25 bp, Rattus norvegicus
ttccaggttatgattttcccatgaa

SEQ ID NO: 667116 - DNA, 25 bp, Rattus norvegicus
ttccaggttatgtttttcccatgaa

SEQ ID NO: 667117 - DNA, 25 bp, Rattus norvegicus
ttccaggtttggatcattccttcct

SEQ ID NO: 667118 - DNA, 25 bp, Rattus norvegicus
ttccaggtttggttcattccttcct

SEQ ID NO: 667119 - DNA, 25 bp, Rattus norvegicus
ttccagtaaccaactggtggcttac

SEQ ID NO: 667120 - DNA, 25 bp, Rattus norvegicus
ttccagtaaccatctggtggcttac

SEQ ID NO: 667121 - DNA, 25 bp, Rattus norvegicus
ttccagtacagaagtgcttagccat

SEQ ID NO: 667122 - DNA, 25 bp, Rattus norvegicus
ttccagtacagatgtgcttagccat

SEQ ID NO: 667123 - DNA, 25 bp, Rattus norvegicus
ttccagtacgcacatgggctcgagc

SEQ ID NO: 667124 - DNA, 25 bp, Rattus norvegicus
ttccagtacgcagatgggctcgagc

SEQ ID NO: 667125 - DNA, 25 bp, Rattus norvegicus
ttccagtatctgcaatcctgcttcc

SEQ ID NO: 667126 - DNA, 25 bp, Rattus norvegicus
ttccagtatctggaatcctgcttcc

SEQ ID NO: 667127 - DNA, 25 bp, Rattus norvegicus
ttccagtatgacagccaaggccttt

SEQ ID NO: 667128 - DNA, 25 bp, Rattus norvegicus
ttccagtatgactgccaaggccttt

SEQ ID NO: 667129 - DNA, 25 bp, Rattus norvegicus
ttccagtcagtaatccaggctttga

SEQ ID NO: 667130 - DNA, 25 bp, Rattus norvegicus
ttccagtcagtattccaggctttga

SEQ ID NO: 667131 - DNA, 25 bp, Rattus norvegicus
ttccagtcatggaccagcattgtat

SEQ ID NO: 667132 - DNA, 25 bp, Rattus norvegicus
ttccagtcatggtccagcattgtat

SEQ ID NO: 667133 - DNA, 25 bp, Rattus norvegicus
ttccagtccactacgggctatgtag

SEQ ID NO: 667134 - DNA, 25 bp, Rattus norvegicus
ttccagtccacttcgggctatgtag

SEQ ID NO: 667135 - DNA, 25 bp, Rattus norvegicus
ttccagtcggtcctttcttctgtgt

SEQ ID NO: 667136 - DNA, 25 bp, Rattus norvegicus
ttccagtcggtcgtttcttctgtgt

SEQ ID NO: 667137 - DNA, 25 bp, Rattus norvegicus
ttccagtgagccaattctgtttcag

SEQ ID NO: 667138 - DNA, 25 bp, Rattus norvegicus
ttccagtgagcctattctgtttcag

SEQ ID NO: 667139 - DNA, 25 bp, Rattus norvegicus
ttccagtgccctatgtgagaagcaa

SEQ ID NO: 667140 - DNA, 25 bp, Rattus norvegicus
ttccagtgccctttgtgagaagcaa

SEQ ID NO: 667141 - DNA, 25 bp, Rattus norvegicus
ttccagtggagcatggatcccggcg

SEQ ID NO: 667142 - DNA, 25 bp, Rattus norvegicus
ttccagtggagcttggatcccggcg

SEQ ID NO: 667143 - DNA, 25 bp, Rattus norvegicus
ttccagttacatctcagccctttct

SEQ ID NO: 667144 - DNA, 25 bp, Rattus norvegicus
ttccagttacatgtcagccctttct

SEQ ID NO: 667145 - DNA, 25 bp, Rattus norvegicus
ttccagttagtaagtattgccacgg

SEQ ID NO: 667146 - DNA, 25 bp, Rattus norvegicus
ttccagttagtactagggtagccaa

SEQ ID NO: 667147 - DNA, 25 bp, Rattus norvegicus
ttccagttagtagtagggtagccaa

SEQ ID NO: 667148 - DNA, 25 bp, Rattus norvegicus
ttccagttagtatgtattgccacgg

SEQ ID NO: 667149 - DNA, 25 bp, Rattus norvegicus
ttccagttagtcaccaacttgactt

SEQ ID NO: 667150 - DNA, 25 bp, Rattus norvegicus
ttccagttagtctccaacttgactt

SEQ ID NO: 667151 - DNA, 25 bp, Rattus norvegicus
ttccagttcacacaggccatattcc

SEQ ID NO: 667152 - DNA, 25 bp, Rattus norvegicus
ttccagttcacagaggccatattcc

SEQ ID NO: 667153 - DNA, 25 bp, Rattus norvegicus
ttccagttcctgctaatctttctta

SEQ ID NO: 667154 - DNA, 25 bp, Rattus norvegicus
ttccagttcctgctgaaagcagctc

SEQ ID NO: 667155 - DNA, 25 bp, Rattus norvegicus
ttccagttcctggtaatctttctta

SEQ ID NO: 667156 - DNA, 25 bp, Rattus norvegicus
ttccagttcctggtgaaagcagctc

SEQ ID NO: 667157 - DNA, 25 bp, Rattus norvegicus
ttccagttctagaaaggctctccag

SEQ ID NO: 667158 - DNA, 25 bp, Rattus norvegicus
ttccagttctagtaaggctctccag

SEQ ID NO: 667159 - DNA, 25 bp, Rattus norvegicus
ttccagttctctatgcagcttcaag

SEQ ID NO: 667160 - DNA, 25 bp, Rattus norvegicus
ttccagttctctttgcagcttcaag

SEQ ID NO: 667161 - DNA, 25 bp, Rattus norvegicus
ttccagttcttacccaatgtcagat

SEQ ID NO: 667162 - DNA, 25 bp, Rattus norvegicus
ttccagttcttagccaatgtcagat

SEQ ID NO: 667163 - DNA, 25 bp, Rattus norvegicus
ttccagttgattaagctgatgcact

SEQ ID NO: 667164 - DNA, 25 bp, Rattus norvegicus
ttccagttgatttagctgatgcact

SEQ ID NO: 667165 - DNA, 25 bp, Rattus norvegicus
ttccagttgcttcctgttatccaga

SEQ ID NO: 667166 - DNA, 25 bp, Rattus norvegicus
ttccagttgcttgctgttatccaga

SEQ ID NO: 667167 - DNA, 25 bp, Rattus norvegicus
ttccagtttcttcctggttcttttt

SEQ ID NO: 667168 - DNA, 25 bp, Rattus norvegicus
ttccagtttcttgctggttcttttt

SEQ ID NO: 667169 - DNA, 25 bp, Rattus norvegicus
ttccagttttatacacgggcttttg

SEQ ID NO: 667170 - DNA, 25 bp, Rattus norvegicus
ttccagttttattcacgggcttttg

SEQ ID NO: 667171 - DNA, 25 bp, Rattus norvegicus
ttccataaccttagggagcctagac

SEQ ID NO: 667172 - DNA, 25 bp, Rattus norvegicus
ttccataacctttgggagcctagac

SEQ ID NO: 667173 - DNA, 25 bp, Rattus norvegicus
ttccataactttcccgacgtatttc

SEQ ID NO: 667174 - DNA, 25 bp, Rattus norvegicus
ttccataactttgccgacgtatttc

SEQ ID NO: 667175 - DNA, 25 bp, Rattus norvegicus
ttccataagggcagtttactccagc

SEQ ID NO: 667176 - DNA, 25 bp, Rattus norvegicus
ttccataagggctgtttactccagc

SEQ ID NO: 667177 - DNA, 25 bp, Rattus norvegicus
ttccataattttacgtttcccgatg

SEQ ID NO: 667178 - DNA, 25 bp, Rattus norvegicus
ttccataatttttcgtttcccgatg

SEQ ID NO: 667179 - DNA, 25 bp, Rattus norvegicus
ttccatacactgaaggtcccttttg

SEQ ID NO: 667180 - DNA, 25 bp, Rattus norvegicus
ttccatacactgtaggtcccttttg

SEQ ID NO: 667181 - DNA, 25 bp, Rattus norvegicus
ttccatacgcccaacttgagaatgc

SEQ ID NO: 667182 - DNA, 25 bp, Rattus norvegicus
ttccatacgccctacttgagaatgc

SEQ ID NO: 667183 - DNA, 25 bp, Rattus norvegicus
ttccatactcccaagtttactgcaa

SEQ ID NO: 667184 - DNA, 25 bp, Rattus norvegicus
ttccatactccctagtttactgcaa

SEQ ID NO: 667185 - DNA, 25 bp, Rattus norvegicus
ttccatagcctacgtgtttcttggg

SEQ ID NO: 667186 - DNA, 25 bp, Rattus norvegicus
ttccatagcctaggtgtttcttggg

SEQ ID NO: 667187 - DNA, 25 bp, Rattus norvegicus
ttccatagtctgatagtgcctctta

SEQ ID NO: 667188 - DNA, 25 bp, Rattus norvegicus
ttccatagtctgttagtgcctctta

SEQ ID NO: 667189 - DNA, 25 bp, Rattus norvegicus
ttccatataacaagagctgccccgg

SEQ ID NO: 667190 - DNA, 25 bp, Rattus norvegicus
ttccatataacatgagctgccccgg

SEQ ID NO: 667191 - DNA, 25 bp, Rattus norvegicus
ttccatatccgtatcataagccgac

SEQ ID NO: 667192 - DNA, 25 bp, Rattus norvegicus
ttccatatccgtttcataagccgac

SEQ ID NO: 667193 - DNA, 25 bp, Rattus norvegicus
ttccatatttttccattctgctcct

SEQ ID NO: 667194 - DNA, 25 bp, Rattus norvegicus
ttccatatttttgcattctgctcct

SEQ ID NO: 667195 - DNA, 25 bp, Rattus norvegicus
ttccatcaaggaagggtccactttg

SEQ ID NO: 667196 - DNA, 25 bp, Rattus norvegicus
ttccatcaaggatgggtccactttg

SEQ ID NO: 667197 - DNA, 25 bp, Rattus norvegicus
ttccatcaagttccatttttccgtc

SEQ ID NO: 667198 - DNA, 25 bp, Rattus norvegicus
ttccatcaagttgcatttttccgtc

SEQ ID NO: 667199 - DNA, 25 bp, Rattus norvegicus
ttccatcaccaccacataggtgagg

SEQ ID NO: 667200 - DNA, 25 bp, Rattus norvegicus
ttccatcaccacgacataggtgagg

SEQ ID NO: 667201 - DNA, 25 bp, Rattus norvegicus
ttccatcagaaactgcagcctgctc

SEQ ID NO: 667202 - DNA, 25 bp, Rattus norvegicus
ttccatcagaaagtgcagcctgctc

SEQ ID NO: 667203 - DNA, 25 bp, Rattus norvegicus
ttccatcagcctccagaagggagtc

SEQ ID NO: 667204 - DNA, 25 bp, Rattus norvegicus
ttccatcagcctgcagaagggagtc

SEQ ID NO: 667205 - DNA, 25 bp, Rattus norvegicus
ttccatcatccccagacaagtagtg

SEQ ID NO: 667206 - DNA, 25 bp, Rattus norvegicus
ttccatcatcccgagacaagtagtg

SEQ ID NO: 667207 - DNA, 25 bp, Rattus norvegicus
ttccatcatgaactgtgacgttgac

SEQ ID NO: 667208 - DNA, 25 bp, Rattus norvegicus
ttccatcatgaagtgtgacgttgac

SEQ ID NO: 667209 - DNA, 25 bp, Rattus norvegicus
ttccatccaactcttcttatgcaaa

SEQ ID NO: 667210 - DNA, 25 bp, Rattus norvegicus
ttccatccaactgttcttatgcaaa

SEQ ID NO: 667211 - DNA, 25 bp, Rattus norvegicus
ttccatccacgtaccagagaatcga

SEQ ID NO: 667212 - DNA, 25 bp, Rattus norvegicus
ttccatccacgttccagagaatcga

SEQ ID NO: 667213 - DNA, 25 bp, Rattus norvegicus
ttccatccactcatattttcttcat

SEQ ID NO: 667214 - DNA, 25 bp, Rattus norvegicus
ttccatccactcttattttcttcat

SEQ ID NO: 667215 - DNA, 25 bp, Rattus norvegicus
ttccatccagacaatgccgtgagta

SEQ ID NO: 667216 - DNA, 25 bp, Rattus norvegicus
ttccatccagactatgccgtgagta

SEQ ID NO: 667217 - DNA, 25 bp, Rattus norvegicus
ttccatcccattcataccagataag

SEQ ID NO: 667218 - DNA, 25 bp, Rattus norvegicus
ttccatcccattgataccagataag

SEQ ID NO: 667219 - DNA, 25 bp, Rattus norvegicus
ttccatcctatccagtcatatctaa

SEQ ID NO: 667220 - DNA, 25 bp, Rattus norvegicus
ttccatcctatcgagtcatatctaa

SEQ ID NO: 667221 - DNA, 25 bp, Rattus norvegicus
ttccatcgctccaaacatttgtgag

SEQ ID NO: 667222 - DNA, 25 bp, Rattus norvegicus
ttccatcgctcctaacatttgtgag

SEQ ID NO: 667223 - DNA, 25 bp, Rattus norvegicus
ttccatctcctgatgtttctggtca

SEQ ID NO: 667224 - DNA, 25 bp, Rattus norvegicus
ttccatctcctgttgtttctggtca

SEQ ID NO: 667225 - DNA, 25 bp, Rattus norvegicus
ttccatctctccaatactgggattg

SEQ ID NO: 667226 - DNA, 25 bp, Rattus norvegicus
ttccatctctcctatactgggattg

SEQ ID NO: 667227 - DNA, 25 bp, Rattus norvegicus
ttccatctctggacacttgaaacaa

SEQ ID NO: 667228 - DNA, 25 bp, Rattus norvegicus
ttccatctctggtcacttgaaacaa

SEQ ID NO: 667229 - DNA, 25 bp, Rattus norvegicus
ttccatctgggcatggtgaggcagt

SEQ ID NO: 667230 - DNA, 25 bp, Rattus norvegicus
ttccatctgggcttggtgaggcagt

SEQ ID NO: 667231 - DNA, 25 bp, Rattus norvegicus
ttccatcttgtgctcaggcctagag

SEQ ID NO: 667232 - DNA, 25 bp, Rattus norvegicus
ttccatcttgtggtcaggcctagag

SEQ ID NO: 667233 - DNA, 25 bp, Rattus norvegicus
ttccatctttccagatcacaacaag

SEQ ID NO: 667234 - DNA, 25 bp, Rattus norvegicus
ttccatctttcctgatcacaacaag

SEQ ID NO: 667235 - DNA, 25 bp, Rattus norvegicus
ttccatgaatggatgacccctgcgt

SEQ ID NO: 667236 - DNA, 25 bp, Rattus norvegicus
ttccatgaatggttgacccctgcgt

SEQ ID NO: 667237 - DNA, 25 bp, Rattus norvegicus
ttccatgacgcccttttgttgggag

SEQ ID NO: 667238 - DNA, 25 bp, Rattus norvegicus
ttccatgacgccgttttgttgggag

SEQ ID NO: 667239 - DNA, 25 bp, Rattus norvegicus
ttccatgagcctagagttgaccttg

SEQ ID NO: 667240 - DNA, 25 bp, Rattus norvegicus
ttccatgagccttgagttgaccttg

SEQ ID NO: 667241 - DNA, 25 bp, Rattus norvegicus
ttccatgataccctaagcaattatg

SEQ ID NO: 667242 - DNA, 25 bp, Rattus norvegicus
ttccatgataccgtaagcaattatg

SEQ ID NO: 667243 - DNA, 25 bp, Rattus norvegicus
ttccatgatgatcagtggccctggc

SEQ ID NO: 667244 - DNA, 25 bp, Rattus norvegicus
ttccatgatgatgagtggccctggc

SEQ ID NO: 667245 - DNA, 25 bp, Rattus norvegicus
ttccatgatgtgacttctaggttta

SEQ ID NO: 667246 - DNA, 25 bp, Rattus norvegicus
ttccatgatgtgtcttctaggttta

SEQ ID NO: 667247 - DNA, 25 bp, Rattus norvegicus
ttccatgattgacgcttctgtttgt

SEQ ID NO: 667248 - DNA, 25 bp, Rattus norvegicus
ttccatgattgaggcttctgtttgt

SEQ ID NO: 667249 - DNA, 25 bp, Rattus norvegicus
ttccatgcaaagctggtgtgcactt

SEQ ID NO: 667250 - DNA, 25 bp, Rattus norvegicus
ttccatgcaaaggtggtgtgcactt

SEQ ID NO: 667251 - DNA, 25 bp, Rattus norvegicus
ttccatgcaagacgtgggacatcct

SEQ ID NO: 667252 - DNA, 25 bp, Rattus norvegicus
ttccatgcaagaggtgggacatcct

SEQ ID NO: 667253 - DNA, 25 bp, Rattus norvegicus
ttccatgcatgtagctagccctgaa

SEQ ID NO: 667254 - DNA, 25 bp, Rattus norvegicus
ttccatgcatgttgctagccctgaa

SEQ ID NO: 667255 - DNA, 25 bp, Rattus norvegicus
ttccatgcctaaactcctgtgagaa

SEQ ID NO: 667256 - DNA, 25 bp, Rattus norvegicus
ttccatgcctaatctcctgtgagaa

SEQ ID NO: 667257 - DNA, 25 bp, Rattus norvegicus
ttccatgcctcccttttataataaa

SEQ ID NO: 667258 - DNA, 25 bp, Rattus norvegicus
ttccatgcctccgttttataataaa

SEQ ID NO: 667259 - DNA, 25 bp, Rattus norvegicus
ttccatgctcggagtgccacgggag

SEQ ID NO: 667260 - DNA, 25 bp, Rattus norvegicus
ttccatgctcggtgtgccacgggag

SEQ ID NO: 667261 - DNA, 25 bp, Rattus norvegicus
ttccatgctctaagcattgcattgt

SEQ ID NO: 667262 - DNA, 25 bp, Rattus norvegicus
ttccatgctctatgcattgcattgt

SEQ ID NO: 667263 - DNA, 25 bp, Rattus norvegicus
ttccatggacaaacagggccttctg

SEQ ID NO: 667264 - DNA, 25 bp, Rattus norvegicus
ttccatggacaatcagggccttctg

SEQ ID NO: 667265 - DNA, 25 bp, Rattus norvegicus
ttccatggaggacagaacccgcaga

SEQ ID NO: 667266 - DNA, 25 bp, Rattus norvegicus
ttccatggaggagagaacccgcaga

SEQ ID NO: 667267 - DNA, 25 bp, Rattus norvegicus
ttccatggatttattcaaggccatc

SEQ ID NO: 667268 - DNA, 25 bp, Rattus norvegicus
ttccatggattttttcaaggccatc

SEQ ID NO: 667269 - DNA, 25 bp, Rattus norvegicus
ttccatggccttctgtaaccttgtg

SEQ ID NO: 667270 - DNA, 25 bp, Rattus norvegicus
ttccatggccttgtgtaaccttgtg

SEQ ID NO: 667271 - DNA, 25 bp, Rattus norvegicus
ttccatggcttaacttgggagctct

SEQ ID NO: 667272 - DNA, 25 bp, Rattus norvegicus
ttccatggcttatcttgggagctct

SEQ ID NO: 667273 - DNA, 25 bp, Rattus norvegicus
ttccatgggagaaagggcaccggca

SEQ ID NO: 667274 - DNA, 25 bp, Rattus norvegicus
ttccatgggagatagggcaccggca

SEQ ID NO: 667275 - DNA, 25 bp, Rattus norvegicus
ttccatgggcatccgtgagagacag

SEQ ID NO: 667276 - DNA, 25 bp, Rattus norvegicus
ttccatgggcatgcgtgagagacag

SEQ ID NO: 667277 - DNA, 25 bp, Rattus norvegicus
ttccatgggcttattccacggccta

SEQ ID NO: 667278 - DNA, 25 bp, Rattus norvegicus
ttccatgggctttttccacggccta

SEQ ID NO: 667279 - DNA, 25 bp, Rattus norvegicus
ttccatgggttaaatgactgacctt

SEQ ID NO: 667280 - DNA, 25 bp, Rattus norvegicus
ttccatgggttatatgactgacctt

SEQ ID NO: 667281 - DNA, 25 bp, Rattus norvegicus
ttccatgggttgaggctggcccctg

SEQ ID NO: 667282 - DNA, 25 bp, Rattus norvegicus
ttccatgggttgtggctggcccctg

SEQ ID NO: 667283 - DNA, 25 bp, Rattus norvegicus
ttccatgtaaacctgctatgcggcg

SEQ ID NO: 667284 - DNA, 25 bp, Rattus norvegicus
ttccatgtaaacgtgctatgcggcg

SEQ ID NO: 667285 - DNA, 25 bp, Rattus norvegicus
ttccatgtacagactacctttgcct

SEQ ID NO: 667286 - DNA, 25 bp, Rattus norvegicus
ttccatgtacagtctacctttgcct

SEQ ID NO: 667287 - DNA, 25 bp, Rattus norvegicus
ttccatgtaggaagccgaggctggc

SEQ ID NO: 667288 - DNA, 25 bp, Rattus norvegicus
ttccatgtaggatgccgaggctggc

SEQ ID NO: 667289 - DNA, 25 bp, Rattus norvegicus
ttccatgtcgttaggctggcccaag

SEQ ID NO: 667290 - DNA, 25 bp, Rattus norvegicus
ttccatgtcgtttggctggcccaag

SEQ ID NO: 667291 - DNA, 25 bp, Rattus norvegicus
ttccatgtctagctgaagatcaaca

SEQ ID NO: 667292 - DNA, 25 bp, Rattus norvegicus
ttccatgtctaggtgaagatcaaca

SEQ ID NO: 667293 - DNA, 25 bp, Rattus norvegicus
ttccatgtctttctcacgattcaaa

SEQ ID NO: 667294 - DNA, 25 bp, Rattus norvegicus
ttccatgtctttgtcacgattcaaa

SEQ ID NO: 667295 - DNA, 25 bp, Rattus norvegicus
ttccatgtgaccattccgactttaa

SEQ ID NO: 667296 - DNA, 25 bp, Rattus norvegicus
ttccatgtgacctttccgactttaa

SEQ ID NO: 667297 - DNA, 25 bp, Rattus norvegicus
ttccatgtgcccatctcaagacatt

SEQ ID NO: 667298 - DNA, 25 bp, Rattus norvegicus
ttccatgtgcccttctcaagacatt

SEQ ID NO: 667299 - DNA, 25 bp, Rattus norvegicus
ttccatgtgtccatttctttctatg

SEQ ID NO: 667300 - DNA, 25 bp, Rattus norvegicus
ttccatgtgtccttttctttctatg

SEQ ID NO: 667301 - DNA, 25 bp, Rattus norvegicus
ttccatgttcctatttacctctaat

SEQ ID NO: 667302 - DNA, 25 bp, Rattus norvegicus
ttccatgttcctttttacctctaat

SEQ ID NO: 667303 - DNA, 25 bp, Rattus norvegicus
ttccatgttgtcagtgctgtgctac

SEQ ID NO: 667304 - DNA, 25 bp, Rattus norvegicus
ttccatgttgtctgtgctgtgctac

SEQ ID NO: 667305 - DNA, 25 bp, Rattus norvegicus
ttccattagaacaacgcttcttcgg

SEQ ID NO: 667306 - DNA, 25 bp, Rattus norvegicus
ttccattagaactacgcttcttcgg

SEQ ID NO: 667307 - DNA, 25 bp, Rattus norvegicus
ttccattcagttagcttccagtgat

SEQ ID NO: 667308 - DNA, 25 bp, Rattus norvegicus
ttccattcagtttgcttccagtgat

SEQ ID NO: 667309 - DNA, 25 bp, Rattus norvegicus
ttccattcatttctacactgtcatg

SEQ ID NO: 667310 - DNA, 25 bp, Rattus norvegicus
ttccattcatttgtacactgtcatg

SEQ ID NO: 667311 - DNA, 25 bp, Rattus norvegicus
ttccattctaagactgctttctgtc

SEQ ID NO: 667312 - DNA, 25 bp, Rattus norvegicus
ttccattctaagtctgctttctgtc

SEQ ID NO: 667313 - DNA, 25 bp, Rattus norvegicus
ttccattgccttagagtgttccacc

SEQ ID NO: 667314 - DNA, 25 bp, Rattus norvegicus
ttccattgcctttgagtgttccacc

SEQ ID NO: 667315 - DNA, 25 bp, Rattus norvegicus
ttccattggactatcttcccaggga

SEQ ID NO: 667316 - DNA, 25 bp, Rattus norvegicus
ttccattggactttcttcccaggga

SEQ ID NO: 667317 - DNA, 25 bp, Rattus norvegicus
ttccattggcatcgtggtcagcgat

SEQ ID NO: 667318 - DNA, 25 bp, Rattus norvegicus
ttccattggcatggtggtcagcgat

SEQ ID NO: 667319 - DNA, 25 bp, Rattus norvegicus
ttccattggccccacagaaatgaga

SEQ ID NO: 667320 - DNA, 25 bp, Rattus norvegicus
ttccattggcccgacagaaatgaga

SEQ ID NO: 667321 - DNA, 25 bp, Rattus norvegicus
ttccattgtagaagcattgacactt

SEQ ID NO: 667322 - DNA, 25 bp, Rattus norvegicus
ttccattgtagatgcattgacactt

SEQ ID NO: 667323 - DNA, 25 bp, Rattus norvegicus
ttccattgttcccaaggcaacttgg

SEQ ID NO: 667324 - DNA, 25 bp, Rattus norvegicus
ttccattgttccgaaggcaacttgg

SEQ ID NO: 667325 - DNA, 25 bp, Rattus norvegicus
ttccattgtttcatgcgacttgtgt

SEQ ID NO: 667326 - DNA, 25 bp, Rattus norvegicus
ttccattgtttcttgcgacttgtgt

SEQ ID NO: 667327 - DNA, 25 bp, Rattus norvegicus
ttccatttatccctgttattttagc

SEQ ID NO: 667328 - DNA, 25 bp, Rattus norvegicus
ttccatttatccgtgttattttagc

SEQ ID NO: 667329 - DNA, 25 bp, Rattus norvegicus
ttccatttcatgctttgtactaaac

SEQ ID NO: 667330 - DNA, 25 bp, Rattus norvegicus
ttccatttcatggtttgtactaaac

SEQ ID NO: 667331 - DNA, 25 bp, Rattus norvegicus
ttccatttccaaacagctggccatt

SEQ ID NO: 667332 - DNA, 25 bp, Rattus norvegicus
ttccatttccaatcagctggccatt

SEQ ID NO: 667333 - DNA, 25 bp, Rattus norvegicus
ttccatttctgtcttcctctgaaat

SEQ ID NO: 667334 - DNA, 25 bp, Rattus norvegicus
ttccatttctgtgttcctctgaaat

SEQ ID NO: 667335 - DNA, 25 bp, Rattus norvegicus
ttccatttgctgatcttcagagctg

SEQ ID NO: 667336 - DNA, 25 bp, Rattus norvegicus
ttccatttgctgttcttcagagctg

SEQ ID NO: 667337 - DNA, 25 bp, Rattus norvegicus
ttccattttaggatgctgtggccct

SEQ ID NO: 667338 - DNA, 25 bp, Rattus norvegicus
ttccattttaggttgctgtggccct

SEQ ID NO: 667339 - DNA, 25 bp, Rattus norvegicus
ttccattttccccattcactaaatt

SEQ ID NO: 667340 - DNA, 25 bp, Rattus norvegicus
ttccattttcccgattcactaaatt

SEQ ID NO: 667341 - DNA, 25 bp, Rattus norvegicus
ttccattttgctatcctgtagacac

SEQ ID NO: 667342 - DNA, 25 bp, Rattus norvegicus
ttccattttgctttcctgtagacac

SEQ ID NO: 667343 - DNA, 25 bp, Rattus norvegicus
ttccatttttacattccgcgaggag

SEQ ID NO: 667344 - DNA, 25 bp, Rattus norvegicus
ttccatttttactttccgcgaggag

SEQ ID NO: 667345 - DNA, 25 bp, Rattus norvegicus
ttccatttttatagaggcctctcac

SEQ ID NO: 667346 - DNA, 25 bp, Rattus norvegicus
ttccatttttattgaggcctctcac

SEQ ID NO: 667347 - DNA, 25 bp, Rattus norvegicus
ttccatttttggctatattttgtaa

SEQ ID NO: 667348 - DNA, 25 bp, Rattus norvegicus
ttccatttttgggtatattttgtaa

SEQ ID NO: 667349 - DNA, 25 bp, Rattus norvegicus
ttcccaaacagtctcgaaagcgatg

SEQ ID NO: 667350 - DNA, 25 bp, Rattus norvegicus
ttcccaaacagtgtcgaaagcgatg

SEQ ID NO: 667351 - DNA, 25 bp, Rattus norvegicus
ttcccaaactctaaggctgctacat

SEQ ID NO: 667352 - DNA, 25 bp, Rattus norvegicus
ttcccaaactcttaggctgctacat

SEQ ID NO: 667353 - DNA, 25 bp, Rattus norvegicus
ttcccaaactgtactattatcccgt

SEQ ID NO: 667354 - DNA, 25 bp, Rattus norvegicus
ttcccaaactgttctattatcccgt

SEQ ID NO: 667355 - DNA, 25 bp, Rattus norvegicus
ttcccaaattgcactgatgacagag

SEQ ID NO: 667356 - DNA, 25 bp, Rattus norvegicus
ttcccaaattgctctgatgacagag

SEQ ID NO: 667357 - DNA, 25 bp, Rattus norvegicus
ttcccaacactcaactctttgataa

SEQ ID NO: 667358 - DNA, 25 bp, Rattus norvegicus
ttcccaacactctactctttgataa

SEQ ID NO: 667359 - DNA, 25 bp, Rattus norvegicus
ttcccaacatacacttgtcccttgt

SEQ ID NO: 667360 - DNA, 25 bp, Rattus norvegicus
ttcccaacatactcttgtcccttgt

SEQ ID NO: 667361 - DNA, 25 bp, Rattus norvegicus
ttcccaaccagcaaaggccttggaa

SEQ ID NO: 667362 - DNA, 25 bp, Rattus norvegicus
ttcccaaccagctaaggccttggaa

SEQ ID NO: 667363 - DNA, 25 bp, Rattus norvegicus
ttcccaacccttaaagctaaatgcg

SEQ ID NO: 667364 - DNA, 25 bp, Rattus norvegicus
ttcccaaccctttaagctaaatgcg

SEQ ID NO: 667365 - DNA, 25 bp, Rattus norvegicus
ttcccaactgccataggctgctcgg

SEQ ID NO: 667366 - DNA, 25 bp, Rattus norvegicus
ttcccaactgccttaggctgctcgg

SEQ ID NO: 667367 - DNA, 25 bp, Rattus norvegicus
ttcccaagacccatctagagctgaa

SEQ ID NO: 667368 - DNA, 25 bp, Rattus norvegicus
ttcccaagacccttctagagctgaa

SEQ ID NO: 667369 - DNA, 25 bp, Rattus norvegicus
ttcccaagatgtcaaagtctctact

SEQ ID NO: 667370 - DNA, 25 bp, Rattus norvegicus
ttcccaagatgtgaaagtctctact

SEQ ID NO: 667371 - DNA, 25 bp, Rattus norvegicus
ttcccaagccacacagctgagaact

SEQ ID NO: 667372 - DNA, 25 bp, Rattus norvegicus
ttcccaagccactcagctgagaact

SEQ ID NO: 667373 - DNA, 25 bp, Rattus norvegicus
ttcccaagcctgatctgatcctgtt

SEQ ID NO: 667374 - DNA, 25 bp, Rattus norvegicus
ttcccaagcctgttctgatcctgtt

SEQ ID NO: 667375 - DNA, 25 bp, Rattus norvegicus
ttcccaagctccagtctaatgtttg

SEQ ID NO: 667376 - DNA, 25 bp, Rattus norvegicus
ttcccaagctcctgtctaatgtttg

SEQ ID NO: 667377 - DNA, 25 bp, Rattus norvegicus
ttcccaagctttccaataggatctg

SEQ ID NO: 667378 - DNA, 25 bp, Rattus norvegicus
ttcccaagctttgcaataggatctg

SEQ ID NO: 667379 - DNA, 25 bp, Rattus norvegicus
ttcccaagggagaggtgtcctacct

SEQ ID NO: 667380 - DNA, 25 bp, Rattus norvegicus
ttcccaagggagtggtgtcctacct

SEQ ID NO: 667381 - DNA, 25 bp, Rattus norvegicus
ttcccaagtagcactgcgccaagca

SEQ ID NO: 667382 - DNA, 25 bp, Rattus norvegicus
ttcccaagtagctctgcgccaagca

SEQ ID NO: 667383 - DNA, 25 bp, Rattus norvegicus
ttcccaagtgccctgtttacaaaca

SEQ ID NO: 667384 - DNA, 25 bp, Rattus norvegicus
ttcccaagtgccgtgtttacaaaca

SEQ ID NO: 667385 - DNA, 25 bp, Rattus norvegicus
ttcccaagtgtgctgtgccttatag

SEQ ID NO: 667386 - DNA, 25 bp, Rattus norvegicus
ttcccaagtgtggtgtgccttatag

SEQ ID NO: 667387 - DNA, 25 bp, Rattus norvegicus
ttcccaatacccatgcaatggcaat

SEQ ID NO: 667388 - DNA, 25 bp, Rattus norvegicus
ttcccaatacccttgcaatggcaat

SEQ ID NO: 667389 - DNA, 25 bp, Rattus norvegicus
ttcccaatccctattcaggtttaag

SEQ ID NO: 667390 - DNA, 25 bp, Rattus norvegicus
ttcccaatcccttttcaggtttaag

SEQ ID NO: 667391 - DNA, 25 bp, Rattus norvegicus
ttcccaatcttcctagacagctata

SEQ ID NO: 667392 - DNA, 25 bp, Rattus norvegicus
ttcccaatcttcgtagacagctata

SEQ ID NO: 667393 - DNA, 25 bp, Rattus norvegicus
ttcccaatggtgataaagttaaaca

SEQ ID NO: 667394 - DNA, 25 bp, Rattus norvegicus
ttcccaatggtgttaaagttaaaca

SEQ ID NO: 667395 - DNA, 25 bp, Rattus norvegicus
ttcccaatttggcttgcttcttgag

SEQ ID NO: 667396 - DNA, 25 bp, Rattus norvegicus
ttcccaatttgggttgcttcttgag

SEQ ID NO: 667397 - DNA, 25 bp, Rattus norvegicus
ttcccaattttgcttcttgccacaa

SEQ ID NO: 667398 - DNA, 25 bp, Rattus norvegicus
ttcccaattttggttcttgccacaa

SEQ ID NO: 667399 - DNA, 25 bp, Rattus norvegicus
ttcccaatttttacaaatcaaccag

SEQ ID NO: 667400 - DNA, 25 bp, Rattus norvegicus
ttcccaatttttccaggagctgcct

SEQ ID NO: 667401 - DNA, 25 bp, Rattus norvegicus
ttcccaatttttgcaggagctgcct

SEQ ID NO: 667402 - DNA, 25 bp, Rattus norvegicus
ttcccaattttttcaaatcaaccag

SEQ ID NO: 667403 - DNA, 25 bp, Rattus norvegicus
ttcccacaaacacccaatctttgat

SEQ ID NO: 667404 - DNA, 25 bp, Rattus norvegicus
ttcccacaaacagccaatctttgat

SEQ ID NO: 667405 - DNA, 25 bp, Rattus norvegicus
ttcccacaattactgctgcactgta

SEQ ID NO: 667406 - DNA, 25 bp, Rattus norvegicus
ttcccacaattagtgctgcactgta

SEQ ID NO: 667407 - DNA, 25 bp, Rattus norvegicus
ttcccacacacgatctttcagaatt

SEQ ID NO: 667408 - DNA, 25 bp, Rattus norvegicus
ttcccacacacgttctttcagaatt

SEQ ID NO: 667409 - DNA, 25 bp, Rattus norvegicus
ttcccacaccaacatatctgagtgc

SEQ ID NO: 667410 - DNA, 25 bp, Rattus norvegicus
ttcccacaccaagatatctgagtgc

SEQ ID NO: 667411 - DNA, 25 bp, Rattus norvegicus
ttcccacagcaaccttcagacagga

SEQ ID NO: 667412 - DNA, 25 bp, Rattus norvegicus
ttcccacagcaagcttcagacagga

SEQ ID NO: 667413 - DNA, 25 bp, Rattus norvegicus
ttcccacaggatcggcgatccaaca

SEQ ID NO: 667414 - DNA, 25 bp, Rattus norvegicus
ttcccacaggatgggcgatccaaca

SEQ ID NO: 667415 - DNA, 25 bp, Rattus norvegicus
ttcccacatataccctttacttaga

SEQ ID NO: 667416 - DNA, 25 bp, Rattus norvegicus
ttcccacatatagcctttacttaga

SEQ ID NO: 667417 - DNA, 25 bp, Rattus norvegicus
ttcccacatcaccttttccatgaaa

SEQ ID NO: 667418 - DNA, 25 bp, Rattus norvegicus
ttcccacatcacgttttccatgaaa

SEQ ID NO: 667419 - DNA, 25 bp, Rattus norvegicus
ttcccacatgcactagtgctcagag

SEQ ID NO: 667420 - DNA, 25 bp, Rattus norvegicus
ttcccacatgcagtagtgctcagag

SEQ ID NO: 667421 - DNA, 25 bp, Rattus norvegicus
ttcccacatggaagcctgtagccgt

SEQ ID NO: 667422 - DNA, 25 bp, Rattus norvegicus
ttcccacatggatgcctgtagccgt

SEQ ID NO: 667423 - DNA, 25 bp, Rattus norvegicus
ttcccaccacccatatggttcaaag

SEQ ID NO: 667424 - DNA, 25 bp, Rattus norvegicus
ttcccaccacccttatggttcaaag

SEQ ID NO: 667425 - DNA, 25 bp, Rattus norvegicus
ttcccaccagagcttggcacttaga

SEQ ID NO: 667426 - DNA, 25 bp, Rattus norvegicus
ttcccaccagaggttggcacttaga

SEQ ID NO: 667427 - DNA, 25 bp, Rattus norvegicus
ttcccaccagtgcatttacatgtag

SEQ ID NO: 667428 - DNA, 25 bp, Rattus norvegicus
ttcccaccagtggatttacatgtag

SEQ ID NO: 667429 - DNA, 25 bp, Rattus norvegicus
ttcccaccatgaagaactgaaatga

SEQ ID NO: 667430 - DNA, 25 bp, Rattus norvegicus
ttcccaccatgatgaactgaaatga

SEQ ID NO: 667431 - DNA, 25 bp, Rattus norvegicus
ttcccaccattcctgggttgacaga

SEQ ID NO: 667432 - DNA, 25 bp, Rattus norvegicus
ttcccaccattcgtgggttgacaga

SEQ ID NO: 667433 - DNA, 25 bp, Rattus norvegicus
ttcccaccatttatctactgatgct

SEQ ID NO: 667434 - DNA, 25 bp, Rattus norvegicus
ttcccaccatttttctactgatgct

SEQ ID NO: 667435 - DNA, 25 bp, Rattus norvegicus
ttcccaccccaaactttgttaatag

SEQ ID NO: 667436 - DNA, 25 bp, Rattus norvegicus
ttcccaccccaatctttgttaatag

SEQ ID NO: 667437 - DNA, 25 bp, Rattus norvegicus
ttcccaccccatcagagttagaata

SEQ ID NO: 667438 - DNA, 25 bp, Rattus norvegicus
ttcccaccccatgagagttagaata

SEQ ID NO: 667439 - DNA, 25 bp, Rattus norvegicus
ttcccaccgggcaagctcagggagg

SEQ ID NO: 667440 - DNA, 25 bp, Rattus norvegicus
ttcccaccgggctagctcagggagg

SEQ ID NO: 667441 - DNA, 25 bp, Rattus norvegicus
ttcccacctatcctgtggcacgtga

SEQ ID NO: 667442 - DNA, 25 bp, Rattus norvegicus
ttcccacctatcgtgtggcacgtga

SEQ ID NO: 667443 - DNA, 25 bp, Rattus norvegicus
ttcccacctggcagtaaaaacctga

SEQ ID NO: 667444 - DNA, 25 bp, Rattus norvegicus
ttcccacctggctgtaaaaacctga

SEQ ID NO: 667445 - DNA, 25 bp, Rattus norvegicus
ttcccacgaagcagatgtcgctggt

SEQ ID NO: 667446 - DNA, 25 bp, Rattus norvegicus
ttcccacgaagctgatgtcgctggt

SEQ ID NO: 667447 - DNA, 25 bp, Rattus norvegicus
ttcccacgcagtaattttatccttt

SEQ ID NO: 667448 - DNA, 25 bp, Rattus norvegicus
ttcccacgcagttattttatccttt

SEQ ID NO: 667449 - DNA, 25 bp, Rattus norvegicus
ttcccacggctcaagagtgtttctg

SEQ ID NO: 667450 - DNA, 25 bp, Rattus norvegicus
ttcccacggctctagagtgtttctg

SEQ ID NO: 667451 - DNA, 25 bp, Rattus norvegicus
ttcccacgtctgatgctggagaaga

SEQ ID NO: 667452 - DNA, 25 bp, Rattus norvegicus
ttcccacgtctgttgctggagaaga

SEQ ID NO: 667453 - DNA, 25 bp, Rattus norvegicus
ttcccactaaggaccgctgaaggac

SEQ ID NO: 667454 - DNA, 25 bp, Rattus norvegicus
ttcccactaaggtccgctgaaggac

SEQ ID NO: 667455 - DNA, 25 bp, Rattus norvegicus
ttcccactacccatggactaatata

SEQ ID NO: 667456 - DNA, 25 bp, Rattus norvegicus
ttcccactacccttggactaatata

SEQ ID NO: 667457 - DNA, 25 bp, Rattus norvegicus
ttcccactactgattcctagacatt

SEQ ID NO: 667458 - DNA, 25 bp, Rattus norvegicus
ttcccactactgtttcctagacatt

SEQ ID NO: 667459 - DNA, 25 bp, Rattus norvegicus
ttcccactcagactatcagtatcgc

SEQ ID NO: 667460 - DNA, 25 bp, Rattus norvegicus
ttcccactcagagtatcagtatcgc

SEQ ID NO: 667461 - DNA, 25 bp, Rattus norvegicus
ttcccactctgtccatttattgctt

SEQ ID NO: 667462 - DNA, 25 bp, Rattus norvegicus
ttcccactctgtgcatttattgctt

SEQ ID NO: 667463 - DNA, 25 bp, Rattus norvegicus
ttcccactcttcagaggtgtcctaa

SEQ ID NO: 667464 - DNA, 25 bp, Rattus norvegicus
ttcccactcttccttagggctggga

SEQ ID NO: 667465 - DNA, 25 bp, Rattus norvegicus
ttcccactcttcgttagggctggga

SEQ ID NO: 667466 - DNA, 25 bp, Rattus norvegicus
ttcccactcttctgaggtgtcctaa

SEQ ID NO: 667467 - DNA, 25 bp, Rattus norvegicus
ttcccactgctgattaaggcgttgc

SEQ ID NO: 667468 - DNA, 25 bp, Rattus norvegicus
ttcccactgctgtttaaggcgttgc

SEQ ID NO: 667469 - DNA, 25 bp, Rattus norvegicus
ttcccactgtaaacggatatgcctg

SEQ ID NO: 667470 - DNA, 25 bp, Rattus norvegicus
ttcccactgtaatcggatatgcctg

SEQ ID NO: 667471 - DNA, 25 bp, Rattus norvegicus
ttcccactgtacatcccttgtaaag

SEQ ID NO: 667472 - DNA, 25 bp, Rattus norvegicus
ttcccactgtacttcccttgtaaag

SEQ ID NO: 667473 - DNA, 25 bp, Rattus norvegicus
ttcccactgtgcaattagacccttt

SEQ ID NO: 667474 - DNA, 25 bp, Rattus norvegicus
ttcccactgtgctattagacccttt

SEQ ID NO: 667475 - DNA, 25 bp, Rattus norvegicus
ttcccacttcatctactgcgagtac

SEQ ID NO: 667476 - DNA, 25 bp, Rattus norvegicus
ttcccacttcatgtactgcgagtac

SEQ ID NO: 667477 - DNA, 25 bp, Rattus norvegicus
ttcccacttccacccatggaggagg

SEQ ID NO: 667478 - DNA, 25 bp, Rattus norvegicus
ttcccacttccagccatggaggagg

SEQ ID NO: 667479 - DNA, 25 bp, Rattus norvegicus
ttcccacttctgatagatggatgtc

SEQ ID NO: 667480 - DNA, 25 bp, Rattus norvegicus
ttcccacttctgatatgagcacaaa

SEQ ID NO: 667481 - DNA, 25 bp, Rattus norvegicus
ttcccacttctgttagatggatgtc

SEQ ID NO: 667482 - DNA, 25 bp, Rattus norvegicus
ttcccacttctgttatgagcacaaa

SEQ ID NO: 667483 - DNA, 25 bp, Rattus norvegicus
ttcccacttgctcgattccttggtg

SEQ ID NO: 667484 - DNA, 25 bp, Rattus norvegicus
ttcccacttgctggattccttggtg

SEQ ID NO: 667485 - DNA, 25 bp, Rattus norvegicus
ttcccacttttcatctcatagtaga

SEQ ID NO: 667486 - DNA, 25 bp, Rattus norvegicus
ttcccacttttcttctcatagtaga

SEQ ID NO: 667487 - DNA, 25 bp, Rattus norvegicus
ttcccagaaccaagctaggctctaa

SEQ ID NO: 667488 - DNA, 25 bp, Rattus norvegicus
ttcccagaaccatgctaggctctaa

SEQ ID NO: 667489 - DNA, 25 bp, Rattus norvegicus
ttcccagaactgagaacgctgagga

SEQ ID NO: 667490 - DNA, 25 bp, Rattus norvegicus
ttcccagaactgtgaacgctgagga

SEQ ID NO: 667491 - DNA, 25 bp, Rattus norvegicus
ttcccagaatgcaggtttttcccag

SEQ ID NO: 667492 - DNA, 25 bp, Rattus norvegicus
ttcccagaatgctggtttttcccag

SEQ ID NO: 667493 - DNA, 25 bp, Rattus norvegicus
ttcccagacagtaatactctccgaa

SEQ ID NO: 667494 - DNA, 25 bp, Rattus norvegicus
ttcccagacagttatactctccgaa

SEQ ID NO: 667495 - DNA, 25 bp, Rattus norvegicus
ttcccagacctactgtttgcgtaca

SEQ ID NO: 667496 - DNA, 25 bp, Rattus norvegicus
ttcccagacctagtgtttgcgtaca

SEQ ID NO: 667497 - DNA, 25 bp, Rattus norvegicus
ttcccagaccttcctaggtaggtgt

SEQ ID NO: 667498 - DNA, 25 bp, Rattus norvegicus
ttcccagaccttgctaggtaggtgt

SEQ ID NO: 667499 - DNA, 25 bp, Rattus norvegicus
ttcccagagcaaacatcggcaagtt

SEQ ID NO: 667500 - DNA, 25 bp, Rattus norvegicus
ttcccagagcaatcatcggcaagtt

SEQ ID NO: 667501 - DNA, 25 bp, Rattus norvegicus
ttcccagagcagcagctagagtgca

SEQ ID NO: 667502 - DNA, 25 bp, Rattus norvegicus
ttcccagagcaggagctagagtgca

SEQ ID NO: 667503 - DNA, 25 bp, Rattus norvegicus
ttcccagagctactaacacattacc

SEQ ID NO: 667504 - DNA, 25 bp, Rattus norvegicus
ttcccagagctagtaacacattacc

SEQ ID NO: 667505 - DNA, 25 bp, Rattus norvegicus
ttcccagagctgataattgccacaa

SEQ ID NO: 667506 - DNA, 25 bp, Rattus norvegicus
ttcccagagctgcagtaccaaataa

SEQ ID NO: 667507 - DNA, 25 bp, Rattus norvegicus
ttcccagagctggagtaccaaataa

SEQ ID NO: 667508 - DNA, 25 bp, Rattus norvegicus
ttcccagagctgttaattgccacaa

SEQ ID NO: 667509 - DNA, 25 bp, Rattus norvegicus
ttcccagaggaccagctagctctta

SEQ ID NO: 667510 - DNA, 25 bp, Rattus norvegicus
ttcccagaggacgagctagctctta

SEQ ID NO: 667511 - DNA, 25 bp, Rattus norvegicus
ttcccagaggcaacaaattcacttg

SEQ ID NO: 667512 - DNA, 25 bp, Rattus norvegicus
ttcccagaggcatcaaattcacttg

SEQ ID NO: 667513 - DNA, 25 bp, Rattus norvegicus
ttcccagagttacgagctgccttaa

SEQ ID NO: 667514 - DNA, 25 bp, Rattus norvegicus
ttcccagagttaggagctgccttaa

SEQ ID NO: 667515 - DNA, 25 bp, Rattus norvegicus
ttcccagatccgaggcgctttcagg

SEQ ID NO: 667516 - DNA, 25 bp, Rattus norvegicus
ttcccagatccgtggcgctttcagg

SEQ ID NO: 667517 - DNA, 25 bp, Rattus norvegicus
ttcccagatctgcactgtccatgta

SEQ ID NO: 667518 - DNA, 25 bp, Rattus norvegicus
ttcccagatctggactgtccatgta

SEQ ID NO: 667519 - DNA, 25 bp, Rattus norvegicus
ttcccagatgctcgatctcagtggc

SEQ ID NO: 667520 - DNA, 25 bp, Rattus norvegicus
ttcccagatgctggatctcagtggc

SEQ ID NO: 667521 - DNA, 25 bp, Rattus norvegicus
ttcccagatggcctcaatcagtttg

SEQ ID NO: 667522 - DNA, 25 bp, Rattus norvegicus
ttcccagatggcgtcaatcagtttg

SEQ ID NO: 667523 - DNA, 25 bp, Rattus norvegicus
ttcccagatggtcgtggtcactgca

SEQ ID NO: 667524 - DNA, 25 bp, Rattus norvegicus
ttcccagatggtggtggtcactgca

SEQ ID NO: 667525 - DNA, 25 bp, Rattus norvegicus
ttcccagcacacatacatgacagct

SEQ ID NO: 667526 - DNA, 25 bp, Rattus norvegicus
ttcccagcacacttacatgacagct

SEQ ID NO: 667527 - DNA, 25 bp, Rattus norvegicus
ttcccagcacatacatctctagtag

SEQ ID NO: 667528 - DNA, 25 bp, Rattus norvegicus
ttcccagcacattcatctctagtag

SEQ ID NO: 667529 - DNA, 25 bp, Rattus norvegicus
ttcccagcacccctgaaggaggtac

SEQ ID NO: 667530 - DNA, 25 bp, Rattus norvegicus
ttcccagcacccgtgaaggaggtac

SEQ ID NO: 667531 - DNA, 25 bp, Rattus norvegicus
ttcccagcacctactgactattatg

SEQ ID NO: 667532 - DNA, 25 bp, Rattus norvegicus
ttcccagcacctatagggcatctca

SEQ ID NO: 667533 - DNA, 25 bp, Rattus norvegicus
ttcccagcaccttctgactattatg

SEQ ID NO: 667534 - DNA, 25 bp, Rattus norvegicus
ttcccagcacctttagggcatctca

SEQ ID NO: 667535 - DNA, 25 bp, Rattus norvegicus
ttcccagcacggacttactgagagg

SEQ ID NO: 667536 - DNA, 25 bp, Rattus norvegicus
ttcccagcacggtcttactgagagg

SEQ ID NO: 667537 - DNA, 25 bp, Rattus norvegicus
ttcccagcaggcaatccaatgcagg

SEQ ID NO: 667538 - DNA, 25 bp, Rattus norvegicus
ttcccagcaggctatccaatgcagg

SEQ ID NO: 667539 - DNA, 25 bp, Rattus norvegicus
ttcccagcatccatagcggtagaga

SEQ ID NO: 667540 - DNA, 25 bp, Rattus norvegicus
ttcccagcatccttagcggtagaga

SEQ ID NO: 667541 - DNA, 25 bp, Rattus norvegicus
ttcccagcccatagatacagtgcac

SEQ ID NO: 667542 - DNA, 25 bp, Rattus norvegicus
ttcccagcccattgatacagtgcac

SEQ ID NO: 667543 - DNA, 25 bp, Rattus norvegicus
ttcccagccctcatggatatgtggt

SEQ ID NO: 667544 - DNA, 25 bp, Rattus norvegicus
ttcccagccctcttggatatgtggt

SEQ ID NO: 667545 - DNA, 25 bp, Rattus norvegicus
ttcccagccgacagctatttgaaga

SEQ ID NO: 667546 - DNA, 25 bp, Rattus norvegicus
ttcccagccgactgctatttgaaga

SEQ ID NO: 667547 - DNA, 25 bp, Rattus norvegicus
ttcccagcctgtaggcatgacaaat

SEQ ID NO: 667548 - DNA, 25 bp, Rattus norvegicus
ttcccagcctgttggcatgacaaat

SEQ ID NO: 667549 - DNA, 25 bp, Rattus norvegicus
ttcccagctcacaacacagacgtgt

SEQ ID NO: 667550 - DNA, 25 bp, Rattus norvegicus
ttcccagctcactacacagacgtgt

SEQ ID NO: 667551 - DNA, 25 bp, Rattus norvegicus
ttcccagctctgcaggttttggaca

SEQ ID NO: 667552 - DNA, 25 bp, Rattus norvegicus
ttcccagctctggaggttttggaca

SEQ ID NO: 667553 - DNA, 25 bp, Rattus norvegicus
ttcccagctgccaaccagtatttaa

SEQ ID NO: 667554 - DNA, 25 bp, Rattus norvegicus
ttcccagctgcctaccagtatttaa

SEQ ID NO: 667555 - DNA, 25 bp, Rattus norvegicus
ttcccagctggaactctgacaagag

SEQ ID NO: 667556 - DNA, 25 bp, Rattus norvegicus
ttcccagctggatctctgacaagag

SEQ ID NO: 667557 - DNA, 25 bp, Rattus norvegicus
ttcccagctggtcttctagaaacat

SEQ ID NO: 667558 - DNA, 25 bp, Rattus norvegicus
ttcccagctggtgttctagaaacat

SEQ ID NO: 667559 - DNA, 25 bp, Rattus norvegicus
ttcccagcttggctcagttacaaac

SEQ ID NO: 667560 - DNA, 25 bp, Rattus norvegicus
ttcccagcttgggtcagttacaaac

SEQ ID NO: 667561 - DNA, 25 bp, Rattus norvegicus
ttcccaggaaagcagcagtaggccc

SEQ ID NO: 667562 - DNA, 25 bp, Rattus norvegicus
ttcccaggaaaggagcagtaggccc

SEQ ID NO: 667563 - DNA, 25 bp, Rattus norvegicus
ttcccaggaaccagaaaggctctgt

SEQ ID NO: 667564 - DNA, 25 bp, Rattus norvegicus
ttcccaggaacctgaaaggctctgt

SEQ ID NO: 667565 - DNA, 25 bp, Rattus norvegicus
ttcccaggaagactatgaacacctt

SEQ ID NO: 667566 - DNA, 25 bp, Rattus norvegicus
ttcccaggaagagtatgaacacctt

SEQ ID NO: 667567 - DNA, 25 bp, Rattus norvegicus
ttcccaggaaggaaggcccaccttg

SEQ ID NO: 667568 - DNA, 25 bp, Rattus norvegicus
ttcccaggaaggtaggcccaccttg

SEQ ID NO: 667569 - DNA, 25 bp, Rattus norvegicus
ttcccaggatctccaggactacata

SEQ ID NO: 667570 - DNA, 25 bp, Rattus norvegicus
ttcccaggatctgcaggactacata

SEQ ID NO: 667571 - DNA, 25 bp, Rattus norvegicus
ttcccaggcagcaaggaccagagct

SEQ ID NO: 667572 - DNA, 25 bp, Rattus norvegicus
ttcccaggcagcctcctagaagatg

SEQ ID NO: 667573 - DNA, 25 bp, Rattus norvegicus
ttcccaggcagcgtcctagaagatg

SEQ ID NO: 667574 - DNA, 25 bp, Rattus norvegicus
ttcccaggcagctaggaccagagct

SEQ ID NO: 667575 - DNA, 25 bp, Rattus norvegicus
ttcccaggccagctgcattgtggat

SEQ ID NO: 667576 - DNA, 25 bp, Rattus norvegicus
ttcccaggccaggtgcattgtggat

SEQ ID NO: 667577 - DNA, 25 bp, Rattus norvegicus
ttcccaggctctcacagtgcatgtg

SEQ ID NO: 667578 - DNA, 25 bp, Rattus norvegicus
ttcccaggctctgacagtgcatgtg

SEQ ID NO: 667579 - DNA, 25 bp, Rattus norvegicus
ttcccagggagacctcatgtctgaa

SEQ ID NO: 667580 - DNA, 25 bp, Rattus norvegicus
ttcccagggagagctcatgtctgaa

SEQ ID NO: 667581 - DNA, 25 bp, Rattus norvegicus
ttcccagggctgcataatgagatca

SEQ ID NO: 667582 - DNA, 25 bp, Rattus norvegicus
ttcccagggctggataatgagatca

SEQ ID NO: 667583 - DNA, 25 bp, Rattus norvegicus
ttcccaggtcacattgcttcaataa

SEQ ID NO: 667584 - DNA, 25 bp, Rattus norvegicus
ttcccaggtcactttgcttcaataa

SEQ ID NO: 667585 - DNA, 25 bp, Rattus norvegicus
ttcccaggttcacacaacttgtcaa

SEQ ID NO: 667586 - DNA, 25 bp, Rattus norvegicus
ttcccaggttcagacaacttgtcaa

SEQ ID NO: 667587 - DNA, 25 bp, Rattus norvegicus
ttcccaggttgccacagtttctatg

SEQ ID NO: 667588 - DNA, 25 bp, Rattus norvegicus
ttcccaggttgcgacagtttctatg

SEQ ID NO: 667589 - DNA, 25 bp, Rattus norvegicus
ttcccagtaggaaacaagacgctgt

SEQ ID NO: 667590 - DNA, 25 bp, Rattus norvegicus
ttcccagtaggatacaagacgctgt

SEQ ID NO: 667591 - DNA, 25 bp, Rattus norvegicus
ttcccagtaggcctagtcatttagt

SEQ ID NO: 667592 - DNA, 25 bp, Rattus norvegicus
ttcccagtaggcgtagtcatttagt

SEQ ID NO: 667593 - DNA, 25 bp, Rattus norvegicus
ttcccagtcaaaacgatgaccaaag

SEQ ID NO: 667594 - DNA, 25 bp, Rattus norvegicus
ttcccagtcaaatcgatgaccaaag

SEQ ID NO: 667595 - DNA, 25 bp, Rattus norvegicus
ttcccagtccacactgacagtgcag

SEQ ID NO: 667596 - DNA, 25 bp, Rattus norvegicus
ttcccagtccactctgacagtgcag

SEQ ID NO: 667597 - DNA, 25 bp, Rattus norvegicus
ttcccagtcttcagtgtacagtttc

SEQ ID NO: 667598 - DNA, 25 bp, Rattus norvegicus
ttcccagtcttctgtgtacagtttc

SEQ ID NO: 667599 - DNA, 25 bp, Rattus norvegicus
ttcccagtgaccattatctgactca

SEQ ID NO: 667600 - DNA, 25 bp, Rattus norvegicus
ttcccagtgaccattctctttaaga

SEQ ID NO: 667601 - DNA, 25 bp, Rattus norvegicus
ttcccagtgacctttatctgactca

SEQ ID NO: 667602 - DNA, 25 bp, Rattus norvegicus
ttcccagtgacctttctctttaaga

SEQ ID NO: 667603 - DNA, 25 bp, Rattus norvegicus
ttcccagtgatccaaggcctcaggt

SEQ ID NO: 667604 - DNA, 25 bp, Rattus norvegicus
ttcccagtgatcgaaggcctcaggt

SEQ ID NO: 667605 - DNA, 25 bp, Rattus norvegicus
ttcccagtgtccctgaggagataag

SEQ ID NO: 667606 - DNA, 25 bp, Rattus norvegicus
ttcccagtgtccgtgaggagataag

SEQ ID NO: 667607 - DNA, 25 bp, Rattus norvegicus
ttcccagtgttaataatgatccagc

SEQ ID NO: 667608 - DNA, 25 bp, Rattus norvegicus
ttcccagtgttattaatgatccagc

SEQ ID NO: 667609 - DNA, 25 bp, Rattus norvegicus
ttcccagttgtgaatagccaccagc

SEQ ID NO: 667610 - DNA, 25 bp, Rattus norvegicus
ttcccagttgtgataggcctttgtc

SEQ ID NO: 667611 - DNA, 25 bp, Rattus norvegicus
ttcccagttgtgtatagccaccagc

SEQ ID NO: 667612 - DNA, 25 bp, Rattus norvegicus
ttcccagttgtgttaggcctttgtc

SEQ ID NO: 667613 - DNA, 25 bp, Rattus norvegicus
ttcccatatggcacctctgtaattt

SEQ ID NO: 667614 - DNA, 25 bp, Rattus norvegicus
ttcccatatggctcctctgtaattt

SEQ ID NO: 667615 - DNA, 25 bp, Rattus norvegicus
ttcccatcatccatagcacatgtaa

SEQ ID NO: 667616 - DNA, 25 bp, Rattus norvegicus
ttcccatcatccttagcacatgtaa

SEQ ID NO: 667617 - DNA, 25 bp, Rattus norvegicus
ttcccatcccagctgatagcatctt

SEQ ID NO: 667618 - DNA, 25 bp, Rattus norvegicus
ttcccatcccaggtgatagcatctt

SEQ ID NO: 667619 - DNA, 25 bp, Rattus norvegicus
ttcccatcccataattgtctgttca

SEQ ID NO: 667620 - DNA, 25 bp, Rattus norvegicus
ttcccatcccattattgtctgttca

SEQ ID NO: 667621 - DNA, 25 bp, Rattus norvegicus
ttcccatcctttaaaatctctacca

SEQ ID NO: 667622 - DNA, 25 bp, Rattus norvegicus
ttcccatccttttaaatctctacca

SEQ ID NO: 667623 - DNA, 25 bp, Rattus norvegicus
ttcccatctcctatcataatttaca

SEQ ID NO: 667624 - DNA, 25 bp, Rattus norvegicus
ttcccatctcctttcataatttaca

SEQ ID NO: 667625 - DNA, 25 bp, Rattus norvegicus
ttcccatctctacttttactataca

SEQ ID NO: 667626 - DNA, 25 bp, Rattus norvegicus
ttcccatctctagttttactataca

SEQ ID NO: 667627 - DNA, 25 bp, Rattus norvegicus
ttcccatctgctctttccataaatt

SEQ ID NO: 667628 - DNA, 25 bp, Rattus norvegicus
ttcccatctgctgtttccataaatt

SEQ ID NO: 667629 - DNA, 25 bp, Rattus norvegicus
ttcccatctggactgtaaagttaca

SEQ ID NO: 667630 - DNA, 25 bp, Rattus norvegicus
ttcccatctggagtgtaaagttaca

SEQ ID NO: 667631 - DNA, 25 bp, Rattus norvegicus
ttcccatctgtcagtagtatcactg

SEQ ID NO: 667632 - DNA, 25 bp, Rattus norvegicus
ttcccatctgtctgtagtatcactg

SEQ ID NO: 667633 - DNA, 25 bp, Rattus norvegicus
ttcccatcttgtcggcagattttaa

SEQ ID NO: 667634 - DNA, 25 bp, Rattus norvegicus
ttcccatcttgtgggcagattttaa

SEQ ID NO: 667635 - DNA, 25 bp, Rattus norvegicus
ttcccatgagcaaaatttcctgact

SEQ ID NO: 667636 - DNA, 25 bp, Rattus norvegicus
ttcccatgagcataatttcctgact

SEQ ID NO: 667637 - DNA, 25 bp, Rattus norvegicus
ttcccatgcggccaatcaggaaggc

SEQ ID NO: 667638 - DNA, 25 bp, Rattus norvegicus
ttcccatgcggcgaatcaggaaggc

SEQ ID NO: 667639 - DNA, 25 bp, Rattus norvegicus
ttcccatggcaaagagcagagtcat

SEQ ID NO: 667640 - DNA, 25 bp, Rattus norvegicus
ttcccatggcaatgagcagagtcat

SEQ ID NO: 667641 - DNA, 25 bp, Rattus norvegicus
ttcccatggtggacctttgtcctgc

SEQ ID NO: 667642 - DNA, 25 bp, Rattus norvegicus
ttcccatggtggtcctttgtcctgc

SEQ ID NO: 667643 - DNA, 25 bp, Rattus norvegicus
ttcccatgtcagacctgaggttgca

SEQ ID NO: 667644 - DNA, 25 bp, Rattus norvegicus
ttcccatgtcagtcctgaggttgca

SEQ ID NO: 667645 - DNA, 25 bp, Rattus norvegicus
ttcccatgtgtcagtggatggtccc

SEQ ID NO: 667646 - DNA, 25 bp, Rattus norvegicus
ttcccatgtgtctgtggatggtccc

SEQ ID NO: 667647 - DNA, 25 bp, Rattus norvegicus
ttcccattctttcatcgtcatggaa

SEQ ID NO: 667648 - DNA, 25 bp, Rattus norvegicus
ttcccattctttctgccaagagcct

SEQ ID NO: 667649 - DNA, 25 bp, Rattus norvegicus
ttcccattctttgatcgtcatggaa

SEQ ID NO: 667650 - DNA, 25 bp, Rattus norvegicus
ttcccattctttgtgccaagagcct

SEQ ID NO: 667651 - DNA, 25 bp, Rattus norvegicus
ttcccattgcaaatgtggctaggat

SEQ ID NO: 667652 - DNA, 25 bp, Rattus norvegicus
ttcccattgcaattgtggctaggat

SEQ ID NO: 667653 - DNA, 25 bp, Rattus norvegicus
ttcccatttagtatggcacttccac

SEQ ID NO: 667654 - DNA, 25 bp, Rattus norvegicus
ttcccatttagtttggcacttccac

SEQ ID NO: 667655 - DNA, 25 bp, Rattus norvegicus
ttcccatttggaaactctcgttcaa

SEQ ID NO: 667656 - DNA, 25 bp, Rattus norvegicus
ttcccatttggacgttgtttctctt

SEQ ID NO: 667657 - DNA, 25 bp, Rattus norvegicus
ttcccatttggaggttgtttctctt

SEQ ID NO: 667658 - DNA, 25 bp, Rattus norvegicus
ttcccatttggatactctcgttcaa

SEQ ID NO: 667659 - DNA, 25 bp, Rattus norvegicus
ttcccatttttcagcaacgattttt

SEQ ID NO: 667660 - DNA, 25 bp, Rattus norvegicus
ttcccatttttctgcaacgattttt

SEQ ID NO: 667661 - DNA, 25 bp, Rattus norvegicus
ttccccaaatgtcaatctttattag

SEQ ID NO: 667662 - DNA, 25 bp, Rattus norvegicus
ttccccaaatgtgaatctttattag

SEQ ID NO: 667663 - DNA, 25 bp, Rattus norvegicus
ttccccaaattacactcccatgtag

SEQ ID NO: 667664 - DNA, 25 bp, Rattus norvegicus
ttccccaaattagactcccatgtag

SEQ ID NO: 667665 - DNA, 25 bp, Rattus norvegicus
ttccccaacagcagcctaaatttta

SEQ ID NO: 667666 - DNA, 25 bp, Rattus norvegicus
ttccccaacagctgcctaaatttta

SEQ ID NO: 667667 - DNA, 25 bp, Rattus norvegicus
ttccccaaccctagacttctgaagt

SEQ ID NO: 667668 - DNA, 25 bp, Rattus norvegicus
ttccccaacccttgacttctgaagt

SEQ ID NO: 667669 - DNA, 25 bp, Rattus norvegicus
ttccccaaccgaccagaattttcat

SEQ ID NO: 667670 - DNA, 25 bp, Rattus norvegicus
ttccccaaccgagcagaattttcat

SEQ ID NO: 667671 - DNA, 25 bp, Rattus norvegicus
ttccccaaccgtcattttctattca

SEQ ID NO: 667672 - DNA, 25 bp, Rattus norvegicus
ttccccaaccgtgattttctattca

SEQ ID NO: 667673 - DNA, 25 bp, Rattus norvegicus
ttccccaagcttcgcctctgtgagg

SEQ ID NO: 667674 - DNA, 25 bp, Rattus norvegicus
ttccccaagcttggcctctgtgagg

SEQ ID NO: 667675 - DNA, 25 bp, Rattus norvegicus
ttccccaaggaaacagctcgccaaa

SEQ ID NO: 667676 - DNA, 25 bp, Rattus norvegicus
ttccccaaggaatcagctcgccaaa

SEQ ID NO: 667677 - DNA, 25 bp, Rattus norvegicus
ttccccaaggatccagtttacactt

SEQ ID NO: 667678 - DNA, 25 bp, Rattus norvegicus
ttccccaaggatgcagtttacactt

SEQ ID NO: 667679 - DNA, 25 bp, Rattus norvegicus
ttccccaagtacaagattcaaaggc

SEQ ID NO: 667680 - DNA, 25 bp, Rattus norvegicus
ttccccaagtactagattcaaaggc

SEQ ID NO: 667681 - DNA, 25 bp, Rattus norvegicus
ttccccacaactagtaccaatgtac

SEQ ID NO: 667682 - DNA, 25 bp, Rattus norvegicus
ttccccacaacttgtaccaatgtac

SEQ ID NO: 667683 - DNA, 25 bp, Rattus norvegicus
ttccccacactgctgtgacatgcgg

SEQ ID NO: 667684 - DNA, 25 bp, Rattus norvegicus
ttccccacactggtgtgacatgcgg

SEQ ID NO: 667685 - DNA, 25 bp, Rattus norvegicus
ttccccacagagattgagatgacgt

SEQ ID NO: 667686 - DNA, 25 bp, Rattus norvegicus
ttccccacagagtttgagatgacgt

SEQ ID NO: 667687 - DNA, 25 bp, Rattus norvegicus
ttccccacaggcaggcgctgggaca

SEQ ID NO: 667688 - DNA, 25 bp, Rattus norvegicus
ttccccacaggctggcgctgggaca

SEQ ID NO: 667689 - DNA, 25 bp, Rattus norvegicus
ttccccacagggagggcttgggaca

SEQ ID NO: 667690 - DNA, 25 bp, Rattus norvegicus
ttccccacagggtgggcttgggaca

SEQ ID NO: 667691 - DNA, 25 bp, Rattus norvegicus
ttccccacagtgcacctaaagatgt

SEQ ID NO: 667692 - DNA, 25 bp, Rattus norvegicus
ttccccacagtggacctaaagatgt

SEQ ID NO: 667693 - DNA, 25 bp, Rattus norvegicus
ttccccacagttagttgtcaccatg

SEQ ID NO: 667694 - DNA, 25 bp, Rattus norvegicus
ttccccacagtttgttgtcaccatg

SEQ ID NO: 667695 - DNA, 25 bp, Rattus norvegicus
ttccccaccacgatagtcatagagt

SEQ ID NO: 667696 - DNA, 25 bp, Rattus norvegicus
ttccccaccacgttagtcatagagt

SEQ ID NO: 667697 - DNA, 25 bp, Rattus norvegicus
ttccccaccataacattgtcaagtt

SEQ ID NO: 667698 - DNA, 25 bp, Rattus norvegicus
ttccccaccataatgttctactgta

SEQ ID NO: 667699 - DNA, 25 bp, Rattus norvegicus
ttccccaccatatcattgtcaagtt

SEQ ID NO: 667700 - DNA, 25 bp, Rattus norvegicus
ttccccaccatattgttctactgta

SEQ ID NO: 667701 - DNA, 25 bp, Rattus norvegicus
ttccccaccctcatatttttgctat

SEQ ID NO: 667702 - DNA, 25 bp, Rattus norvegicus
ttccccaccctcttatttttgctat

SEQ ID NO: 667703 - DNA, 25 bp, Rattus norvegicus
ttccccacctacctcaatagagtaa

SEQ ID NO: 667704 - DNA, 25 bp, Rattus norvegicus
ttccccacctacgtcaatagagtaa

SEQ ID NO: 667705 - DNA, 25 bp, Rattus norvegicus
ttccccactactctgatgcactata

SEQ ID NO: 667706 - DNA, 25 bp, Rattus norvegicus
ttccccactactgtgatgcactata

SEQ ID NO: 667707 - DNA, 25 bp, Rattus norvegicus
ttccccactgagcatcaatctttag

SEQ ID NO: 667708 - DNA, 25 bp, Rattus norvegicus
ttccccactgaggatcaatctttag

SEQ ID NO: 667709 - DNA, 25 bp, Rattus norvegicus
ttccccactgctcttcgtgtggtga

SEQ ID NO: 667710 - DNA, 25 bp, Rattus norvegicus
ttccccactgctgttcgtgtggtga

SEQ ID NO: 667711 - DNA, 25 bp, Rattus norvegicus
ttccccactttgcatactttttgat

SEQ ID NO: 667712 - DNA, 25 bp, Rattus norvegicus
ttccccactttggatactttttgat

SEQ ID NO: 667713 - DNA, 25 bp, Rattus norvegicus
ttccccagaaaaccacagagctatg

SEQ ID NO: 667714 - DNA, 25 bp, Rattus norvegicus
ttccccagaaaagcacagagctatg

SEQ ID NO: 667715 - DNA, 25 bp, Rattus norvegicus
ttccccagacctctgtttggaaaca

SEQ ID NO: 667716 - DNA, 25 bp, Rattus norvegicus
ttccccagacctgtgtttggaaaca

SEQ ID NO: 667717 - DNA, 25 bp, Rattus norvegicus
ttccccagaggaccagatttcacat

SEQ ID NO: 667718 - DNA, 25 bp, Rattus norvegicus
ttccccagaggagcagatttcacat

SEQ ID NO: 667719 - DNA, 25 bp, Rattus norvegicus
ttccccagagggaactttcattgct

SEQ ID NO: 667720 - DNA, 25 bp, Rattus norvegicus
ttccccagagggtactttcattgct

SEQ ID NO: 667721 - DNA, 25 bp, Rattus norvegicus
ttccccagcacaaggactgactttt

SEQ ID NO: 667722 - DNA, 25 bp, Rattus norvegicus
ttccccagcacatggactgactttt

SEQ ID NO: 667723 - DNA, 25 bp, Rattus norvegicus
ttccccagcctcatgaagcagaaga

SEQ ID NO: 667724 - DNA, 25 bp, Rattus norvegicus
ttccccagcctcttgaagcagaaga

SEQ ID NO: 667725 - DNA, 25 bp, Rattus norvegicus
ttccccagctagaaaacttcgttca

SEQ ID NO: 667726 - DNA, 25 bp, Rattus norvegicus
ttccccagctagtaaacttcgttca

SEQ ID NO: 667727 - DNA, 25 bp, Rattus norvegicus
ttccccaggatgctgacagtggcca

SEQ ID NO: 667728 - DNA, 25 bp, Rattus norvegicus
ttccccaggatggtgacagtggcca

SEQ ID NO: 667729 - DNA, 25 bp, Rattus norvegicus
ttccccaggcctctaagagcaagct

SEQ ID NO: 667730 - DNA, 25 bp, Rattus norvegicus
ttccccaggcctgtaagagcaagct

SEQ ID NO: 667731 - DNA, 25 bp, Rattus norvegicus
ttccccagggaccatcattggagtg

SEQ ID NO: 667732 - DNA, 25 bp, Rattus norvegicus
ttccccagggacgatcattggagtg

SEQ ID NO: 667733 - DNA, 25 bp, Rattus norvegicus
ttccccagggtaattaatatgaact

SEQ ID NO: 667734 - DNA, 25 bp, Rattus norvegicus
ttccccagggtatttaatatgaact

SEQ ID NO: 667735 - DNA, 25 bp, Rattus norvegicus
ttccccagtgaaacttcctaagtgt

SEQ ID NO: 667736 - DNA, 25 bp, Rattus norvegicus
ttccccagtgaatcttcctaagtgt

SEQ ID NO: 667737 - DNA, 25 bp, Rattus norvegicus
ttccccagtgggagcctgaagcttg

SEQ ID NO: 667738 - DNA, 25 bp, Rattus norvegicus
ttccccagtgggtgcctgaagcttg

SEQ ID NO: 667739 - DNA, 25 bp, Rattus norvegicus
ttccccagtgtgcttgaactcgaca

SEQ ID NO: 667740 - DNA, 25 bp, Rattus norvegicus
ttccccagtgtggttgaactcgaca

SEQ ID NO: 667741 - DNA, 25 bp, Rattus norvegicus
ttccccagttgtctttgcagtgagg

SEQ ID NO: 667742 - DNA, 25 bp, Rattus norvegicus
ttccccagttgtgtttgcagtgagg

SEQ ID NO: 667743 - DNA, 25 bp, Rattus norvegicus
ttccccataactcatgagcagcgtg

SEQ ID NO: 667744 - DNA, 25 bp, Rattus norvegicus
ttccccataactgatgagcagcgtg

SEQ ID NO: 667745 - DNA, 25 bp, Rattus norvegicus
ttccccatacacagaggtccgagag

SEQ ID NO: 667746 - DNA, 25 bp, Rattus norvegicus
ttccccatacactgaggtccgagag

SEQ ID NO: 667747 - DNA, 25 bp, Rattus norvegicus
ttccccataggacagtgagtgtaaa

SEQ ID NO: 667748 - DNA, 25 bp, Rattus norvegicus
ttccccataggagagtgagtgtaaa

SEQ ID NO: 667749 - DNA, 25 bp, Rattus norvegicus
ttccccataggtattcatgtatagc

SEQ ID NO: 667750 - DNA, 25 bp, Rattus norvegicus
ttccccataggttttcatgtatagc

SEQ ID NO: 667751 - DNA, 25 bp, Rattus norvegicus
ttccccatccttagtaaccatatgt

SEQ ID NO: 667752 - DNA, 25 bp, Rattus norvegicus
ttccccatccttcatgctaggatta

SEQ ID NO: 667753 - DNA, 25 bp, Rattus norvegicus
ttccccatccttgatgctaggatta

SEQ ID NO: 667754 - DNA, 25 bp, Rattus norvegicus
ttccccatcctttgtaaccatatgt

SEQ ID NO: 667755 - DNA, 25 bp, Rattus norvegicus
ttccccatctgtaaactgtagatat

SEQ ID NO: 667756 - DNA, 25 bp, Rattus norvegicus
ttccccatctgttaactgtagatat

SEQ ID NO: 667757 - DNA, 25 bp, Rattus norvegicus
ttccccatgcctagtttttggatga

SEQ ID NO: 667758 - DNA, 25 bp, Rattus norvegicus
ttccccatgccttgtttttggatga

SEQ ID NO: 667759 - DNA, 25 bp, Rattus norvegicus
ttccccatggccactaccagaaaaa

SEQ ID NO: 667760 - DNA, 25 bp, Rattus norvegicus
ttccccatggcctctaccagaaaaa

SEQ ID NO: 667761 - DNA, 25 bp, Rattus norvegicus
ttccccatgggcagttgaagataaa

SEQ ID NO: 667762 - DNA, 25 bp, Rattus norvegicus
ttccccatgggctgttgaagataaa

SEQ ID NO: 667763 - DNA, 25 bp, Rattus norvegicus
ttccccatggtactgtactgcgagc

SEQ ID NO: 667764 - DNA, 25 bp, Rattus norvegicus
ttccccatggtagtgtactgcgagc

SEQ ID NO: 667765 - DNA, 25 bp, Rattus norvegicus
ttccccattaacatctgttgatagc

SEQ ID NO: 667766 - DNA, 25 bp, Rattus norvegicus
ttccccattaacttctgttgatagc

SEQ ID NO: 667767 - DNA, 25 bp, Rattus norvegicus
ttccccattagcaaaccaacagacg

SEQ ID NO: 667768 - DNA, 25 bp, Rattus norvegicus
ttccccattagctaaccaacagacg

SEQ ID NO: 667769 - DNA, 25 bp, Rattus norvegicus
ttccccattccaagtgctggtttga

SEQ ID NO: 667770 - DNA, 25 bp, Rattus norvegicus
ttccccattccatgtgctggtttga

SEQ ID NO: 667771 - DNA, 25 bp, Rattus norvegicus
ttccccatttccctcaacagaggat

SEQ ID NO: 667772 - DNA, 25 bp, Rattus norvegicus
ttccccatttccgtcaacagaggat

SEQ ID NO: 667773 - DNA, 25 bp, Rattus norvegicus
ttccccgaaagcctcaaactgtgac

SEQ ID NO: 667774 - DNA, 25 bp, Rattus norvegicus
ttccccgaaagcgtcaaactgtgac

SEQ ID NO: 667775 - DNA, 25 bp, Rattus norvegicus
ttccccgaaatcaaagcttacatgt

SEQ ID NO: 667776 - DNA, 25 bp, Rattus norvegicus
ttccccgaaatctaagcttacatgt

SEQ ID NO: 667777 - DNA, 25 bp, Rattus norvegicus
ttccccgaacggagatggcatctga

SEQ ID NO: 667778 - DNA, 25 bp, Rattus norvegicus
ttccccgaacggtgatggcatctga

SEQ ID NO: 667779 - DNA, 25 bp, Rattus norvegicus
ttccccgaagccaggagtatacagt

SEQ ID NO: 667780 - DNA, 25 bp, Rattus norvegicus
ttccccgaagcctggagtatacagt

SEQ ID NO: 667781 - DNA, 25 bp, Rattus norvegicus
ttccccgaagctcaagatctctggt

SEQ ID NO: 667782 - DNA, 25 bp, Rattus norvegicus
ttccccgaagctgaagatctctggt

SEQ ID NO: 667783 - DNA, 25 bp, Rattus norvegicus
ttccccgaccgtctaagtggtgaga

SEQ ID NO: 667784 - DNA, 25 bp, Rattus norvegicus
ttccccgaccgtgtaagtggtgaga

SEQ ID NO: 667785 - DNA, 25 bp, Rattus norvegicus
ttccccgacgaccaagttcaaggat

SEQ ID NO: 667786 - DNA, 25 bp, Rattus norvegicus
ttccccgacgacgaagttcaaggat

SEQ ID NO: 667787 - DNA, 25 bp, Rattus norvegicus
ttccccgacttcacatggtgttttg

SEQ ID NO: 667788 - DNA, 25 bp, Rattus norvegicus
ttccccgacttctcatggtgttttg

SEQ ID NO: 667789 - DNA, 25 bp, Rattus norvegicus
ttccccgaggacatagccagtgcag

SEQ ID NO: 667790 - DNA, 25 bp, Rattus norvegicus
ttccccgaggacttagccagtgcag

SEQ ID NO: 667791 - DNA, 25 bp, Rattus norvegicus
ttccccgcacacataactgaagctg

SEQ ID NO: 667792 - DNA, 25 bp, Rattus norvegicus
ttccccgcacacttaactgaagctg

SEQ ID NO: 667793 - DNA, 25 bp, Rattus norvegicus
ttccccgcggtgctacgagattaga

SEQ ID NO: 667794 - DNA, 25 bp, Rattus norvegicus
ttccccgcggtggtacgagattaga

SEQ ID NO: 667795 - DNA, 25 bp, Rattus norvegicus
ttccccggccaactgaagacttgag

SEQ ID NO: 667796 - DNA, 25 bp, Rattus norvegicus
ttccccggccaagtgaagacttgag

SEQ ID NO: 667797 - DNA, 25 bp, Rattus norvegicus
ttccccgggtctactgtgtggtgga

SEQ ID NO: 667798 - DNA, 25 bp, Rattus norvegicus
ttccccgggtcttctgtgtggtgga

SEQ ID NO: 667799 - DNA, 25 bp, Rattus norvegicus
ttccccgtggtaatgttctggatct

SEQ ID NO: 667800 - DNA, 25 bp, Rattus norvegicus
ttccccgtggtattgttctggatct

SEQ ID NO: 667801 - DNA, 25 bp, Rattus norvegicus
ttccccgtgtcaccacagagtggag

SEQ ID NO: 667802 - DNA, 25 bp, Rattus norvegicus
ttccccgtgtcagcacagagtggag

SEQ ID NO: 667803 - DNA, 25 bp, Rattus norvegicus
ttccccgttgatataggctttcaca

SEQ ID NO: 667804 - DNA, 25 bp, Rattus norvegicus
ttccccgttgatttaggctttcaca

SEQ ID NO: 667805 - DNA, 25 bp, Rattus norvegicus
ttccccgtttgacctgaaattctgg

SEQ ID NO: 667806 - DNA, 25 bp, Rattus norvegicus
ttccccgtttgagctgaaattctgg

SEQ ID NO: 667807 - DNA, 25 bp, Rattus norvegicus
ttcccctaatgtccagagactgaag

SEQ ID NO: 667808 - DNA, 25 bp, Rattus norvegicus
ttcccctaatgtgcagagactgaag

SEQ ID NO: 667809 - DNA, 25 bp, Rattus norvegicus
ttcccctacagtctgcagatgcgga

SEQ ID NO: 667810 - DNA, 25 bp, Rattus norvegicus
ttcccctacagtgtgcagatgcgga

SEQ ID NO: 667811 - DNA, 25 bp, Rattus norvegicus
ttcccctacgcaagtgtgttccaca

SEQ ID NO: 667812 - DNA, 25 bp, Rattus norvegicus
ttcccctacgcatgtgtgttccaca

SEQ ID NO: 667813 - DNA, 25 bp, Rattus norvegicus
ttcccctagagtatttagccttgct

SEQ ID NO: 667814 - DNA, 25 bp, Rattus norvegicus
ttcccctagagtttttagccttgct

SEQ ID NO: 667815 - DNA, 25 bp, Rattus norvegicus
ttcccctcaaggatttgatttggag

SEQ ID NO: 667816 - DNA, 25 bp, Rattus norvegicus
ttcccctcaaggttttgatttggag

SEQ ID NO: 667817 - DNA, 25 bp, Rattus norvegicus
ttcccctcatttctttaacttcatg

SEQ ID NO: 667818 - DNA, 25 bp, Rattus norvegicus
ttcccctcatttgtttaacttcatg

SEQ ID NO: 667819 - DNA, 25 bp, Rattus norvegicus
ttcccctccattagcgtatttattt

SEQ ID NO: 667820 - DNA, 25 bp, Rattus norvegicus
ttcccctccatttgcgtatttattt

SEQ ID NO: 667821 - DNA, 25 bp, Rattus norvegicus
ttcccctcccacaaaatgtatggct

SEQ ID NO: 667822 - DNA, 25 bp, Rattus norvegicus
ttcccctcccactaaatgtatggct

SEQ ID NO: 667823 - DNA, 25 bp, Rattus norvegicus
ttcccctccggaagaagacgaacag

SEQ ID NO: 667824 - DNA, 25 bp, Rattus norvegicus
ttcccctccggatgaagacgaacag

SEQ ID NO: 667825 - DNA, 25 bp, Rattus norvegicus
ttcccctcgaaaccatgaagtatct

SEQ ID NO: 667826 - DNA, 25 bp, Rattus norvegicus
ttcccctcgaaagcatgaagtatct

SEQ ID NO: 667827 - DNA, 25 bp, Rattus norvegicus
ttcccctcgagaaaacagcgttgta

SEQ ID NO: 667828 - DNA, 25 bp, Rattus norvegicus
ttcccctcgagataacagcgttgta

SEQ ID NO: 667829 - DNA, 25 bp, Rattus norvegicus
ttcccctcggccacagaagtccatg

SEQ ID NO: 667830 - DNA, 25 bp, Rattus norvegicus
ttcccctcggcctcagaagtccatg

SEQ ID NO: 667831 - DNA, 25 bp, Rattus norvegicus
ttcccctctcttcttgtaagagttg

SEQ ID NO: 667832 - DNA, 25 bp, Rattus norvegicus
ttcccctctcttgttgtaagagttg

SEQ ID NO: 667833 - DNA, 25 bp, Rattus norvegicus
ttcccctctggaattctaactgtat

SEQ ID NO: 667834 - DNA, 25 bp, Rattus norvegicus
ttcccctctggatttctaactgtat

SEQ ID NO: 667835 - DNA, 25 bp, Rattus norvegicus
ttcccctctgtgctctaagcgtgtg

SEQ ID NO: 667836 - DNA, 25 bp, Rattus norvegicus
ttcccctctgtggtctaagcgtgtg

SEQ ID NO: 667837 - DNA, 25 bp, Rattus norvegicus
ttcccctcttctatgattatcctaa

SEQ ID NO: 667838 - DNA, 25 bp, Rattus norvegicus
ttcccctcttctttgattatcctaa

SEQ ID NO: 667839 - DNA, 25 bp, Rattus norvegicus
ttcccctgacgaaggctcttaagga

SEQ ID NO: 667840 - DNA, 25 bp, Rattus norvegicus
ttcccctgacgatggctcttaagga

SEQ ID NO: 667841 - DNA, 25 bp, Rattus norvegicus
ttcccctgactaagaaggacaactg

SEQ ID NO: 667842 - DNA, 25 bp, Rattus norvegicus
ttcccctgactatgaaggacaactg

SEQ ID NO: 667843 - DNA, 25 bp, Rattus norvegicus
ttcccctgagcaccctttaaattgg

SEQ ID NO: 667844 - DNA, 25 bp, Rattus norvegicus
ttcccctgagcagcctttaaattgg

SEQ ID NO: 667845 - DNA, 25 bp, Rattus norvegicus
ttcccctgaggacaagcaccggaga

SEQ ID NO: 667846 - DNA, 25 bp, Rattus norvegicus
ttcccctgaggagaagcaccggaga

SEQ ID NO: 667847 - DNA, 25 bp, Rattus norvegicus
ttcccctgaggcaatggagagtcct

SEQ ID NO: 667848 - DNA, 25 bp, Rattus norvegicus
ttcccctgaggctatggagagtcct

SEQ ID NO: 667849 - DNA, 25 bp, Rattus norvegicus
ttcccctgctctctgaaaagcattg

SEQ ID NO: 667850 - DNA, 25 bp, Rattus norvegicus
ttcccctgctctgtgaaaagcattg

SEQ ID NO: 667851 - DNA, 25 bp, Rattus norvegicus
ttcccctggaagagttttcttgtat

SEQ ID NO: 667852 - DNA, 25 bp, Rattus norvegicus
ttcccctggaagtgttttcttgtat

SEQ ID NO: 667853 - DNA, 25 bp, Rattus norvegicus
ttcccctggcgcagaatcttaaaag

SEQ ID NO: 667854 - DNA, 25 bp, Rattus norvegicus
ttcccctggcgctgaatcttaaaag

SEQ ID NO: 667855 - DNA, 25 bp, Rattus norvegicus
ttcccctgtacacattcctgagttt

SEQ ID NO: 667856 - DNA, 25 bp, Rattus norvegicus
ttcccctgtacagattcctgagttt

SEQ ID NO: 667857 - DNA, 25 bp, Rattus norvegicus
ttcccctgtccacaatgtggtgttc

SEQ ID NO: 667858 - DNA, 25 bp, Rattus norvegicus
ttcccctgtccagaatgtggtgttc

SEQ ID NO: 667859 - DNA, 25 bp, Rattus norvegicus
ttcccctgtcgaacaattgaagttg

SEQ ID NO: 667860 - DNA, 25 bp, Rattus norvegicus
ttcccctgtcgatcaattgaagttg

SEQ ID NO: 667861 - DNA, 25 bp, Rattus norvegicus
ttcccctgtggaaagcccgaagatg

SEQ ID NO: 667862 - DNA, 25 bp, Rattus norvegicus
ttcccctgtggactctgatgatgct

SEQ ID NO: 667863 - DNA, 25 bp, Rattus norvegicus
ttcccctgtggagtctgatgatgct

SEQ ID NO: 667864 - DNA, 25 bp, Rattus norvegicus
ttcccctgtggatagcccgaagatg

SEQ ID NO: 667865 - DNA, 25 bp, Rattus norvegicus
ttcccctgtttaccactgtggtcac

SEQ ID NO: 667866 - DNA, 25 bp, Rattus norvegicus
ttcccctgtttagcactgtggtcac

SEQ ID NO: 667867 - DNA, 25 bp, Rattus norvegicus
ttcccctgttttacttcttaagcag

SEQ ID NO: 667868 - DNA, 25 bp, Rattus norvegicus
ttcccctgtttttcttcttaagcag

SEQ ID NO: 667869 - DNA, 25 bp, Rattus norvegicus
ttccccttacacacggcggtgattt

SEQ ID NO: 667870 - DNA, 25 bp, Rattus norvegicus
ttccccttacactcggcggtgattt

SEQ ID NO: 667871 - DNA, 25 bp, Rattus norvegicus
ttccccttatgaagacgacgctctg

SEQ ID NO: 667872 - DNA, 25 bp, Rattus norvegicus
ttccccttatgatgacgacgctctg

SEQ ID NO: 667873 - DNA, 25 bp, Rattus norvegicus
ttccccttcatcagctaaagctgtg

SEQ ID NO: 667874 - DNA, 25 bp, Rattus norvegicus
ttccccttcatctgctaaagctgtg

SEQ ID NO: 667875 - DNA, 25 bp, Rattus norvegicus
ttccccttgaaaatggcttcagcag

SEQ ID NO: 667876 - DNA, 25 bp, Rattus norvegicus
ttccccttgaaattggcttcagcag

SEQ ID NO: 667877 - DNA, 25 bp, Rattus norvegicus
ttccccttgataacactcttgagca

SEQ ID NO: 667878 - DNA, 25 bp, Rattus norvegicus
ttccccttgatatcactcttgagca

SEQ ID NO: 667879 - DNA, 25 bp, Rattus norvegicus
ttccccttggacatttggctagaca

SEQ ID NO: 667880 - DNA, 25 bp, Rattus norvegicus
ttccccttggacttttggctagaca

SEQ ID NO: 667881 - DNA, 25 bp, Rattus norvegicus
ttccccttgtccaaggatctagtag

SEQ ID NO: 667882 - DNA, 25 bp, Rattus norvegicus
ttccccttgtcctaggatctagtag

SEQ ID NO: 667883 - DNA, 25 bp, Rattus norvegicus
ttccccttgtgcacaaccaataaag

SEQ ID NO: 667884 - DNA, 25 bp, Rattus norvegicus
ttccccttgtgctcaaccaataaag

SEQ ID NO: 667885 - DNA, 25 bp, Rattus norvegicus
ttcccctttactctttggccagcta

SEQ ID NO: 667886 - DNA, 25 bp, Rattus norvegicus
ttcccctttactgtttggccagcta

SEQ ID NO: 667887 - DNA, 25 bp, Rattus norvegicus
ttcccctttagtagtgtaaagcctg

SEQ ID NO: 667888 - DNA, 25 bp, Rattus norvegicus
ttcccctttagttgtgtaaagcctg

SEQ ID NO: 667889 - DNA, 25 bp, Rattus norvegicus
ttcccctttcatacagtttttccag

SEQ ID NO: 667890 - DNA, 25 bp, Rattus norvegicus
ttcccctttcattcagtttttccag

SEQ ID NO: 667891 - DNA, 25 bp, Rattus norvegicus
ttcccctttcttaaattgcttgtct

SEQ ID NO: 667892 - DNA, 25 bp, Rattus norvegicus
ttcccctttctttaattgcttgtct

SEQ ID NO: 667893 - DNA, 25 bp, Rattus norvegicus
ttcccctttgagcacaagtgttgca

SEQ ID NO: 667894 - DNA, 25 bp, Rattus norvegicus
ttcccctttgaggacaagtgttgca

SEQ ID NO: 667895 - DNA, 25 bp, Rattus norvegicus
ttcccctttgtccattagccagaag

SEQ ID NO: 667896 - DNA, 25 bp, Rattus norvegicus
ttcccctttgtcgattagccagaag

SEQ ID NO: 667897 - DNA, 25 bp, Rattus norvegicus
ttccccttttataagctctccatat

SEQ ID NO: 667898 - DNA, 25 bp, Rattus norvegicus
ttccccttttattagctctccatat

SEQ ID NO: 667899 - DNA, 25 bp, Rattus norvegicus
ttcccgacctgacatggtgcatctg

SEQ ID NO: 667900 - DNA, 25 bp, Rattus norvegicus
ttcccgacctgagatggtgcatctg

SEQ ID NO: 667901 - DNA, 25 bp, Rattus norvegicus
ttcccgactgacattacccgtgagg

SEQ ID NO: 667902 - DNA, 25 bp, Rattus norvegicus
ttcccgactgactttacccgtgagg

SEQ ID NO: 667903 - DNA, 25 bp, Rattus norvegicus
ttcccgactggacatgacaacgcta

SEQ ID NO: 667904 - DNA, 25 bp, Rattus norvegicus
ttcccgactggagatgacaacgcta

SEQ ID NO: 667905 - DNA, 25 bp, Rattus norvegicus
ttcccgagaagtccataaccataca

SEQ ID NO: 667906 - DNA, 25 bp, Rattus norvegicus
ttcccgagaagtgcataaccataca

SEQ ID NO: 667907 - DNA, 25 bp, Rattus norvegicus
ttcccgaggcaactcctaagacagc

SEQ ID NO: 667908 - DNA, 25 bp, Rattus norvegicus
ttcccgaggcaagtcctaagacagc

SEQ ID NO: 667909 - DNA, 25 bp, Rattus norvegicus
ttcccgatgaaaacagcagcacttt

SEQ ID NO: 667910 - DNA, 25 bp, Rattus norvegicus
ttcccgatgaaatcagcagcacttt

SEQ ID NO: 667911 - DNA, 25 bp, Rattus norvegicus
ttcccgatgacccatgctttattta

SEQ ID NO: 667912 - DNA, 25 bp, Rattus norvegicus
ttcccgatgaccgatgctttattta

SEQ ID NO: 667913 - DNA, 25 bp, Rattus norvegicus
ttcccgcactacatcatagctatgt

SEQ ID NO: 667914 - DNA, 25 bp, Rattus norvegicus
ttcccgcactacttcatagctatgt

SEQ ID NO: 667915 - DNA, 25 bp, Rattus norvegicus
ttcccgcactatatcagcaaaggca

SEQ ID NO: 667916 - DNA, 25 bp, Rattus norvegicus
ttcccgcactatttcagcaaaggca

SEQ ID NO: 667917 - DNA, 25 bp, Rattus norvegicus
ttcccgcagagaccaagtagcctat

SEQ ID NO: 667918 - DNA, 25 bp, Rattus norvegicus
ttcccgcagagagcaagtagcctat

SEQ ID NO: 667919 - DNA, 25 bp, Rattus norvegicus
ttcccgcagatcagcagtgtcaagg

SEQ ID NO: 667920 - DNA, 25 bp, Rattus norvegicus
ttcccgcagatctgcagtgtcaagg

SEQ ID NO: 667921 - DNA, 25 bp, Rattus norvegicus
ttcccgccagttatgtcatagctgc

SEQ ID NO: 667922 - DNA, 25 bp, Rattus norvegicus
ttcccgccagttttgtcatagctgc

SEQ ID NO: 667923 - DNA, 25 bp, Rattus norvegicus
ttcccgccctcgactatggtggcgg

SEQ ID NO: 667924 - DNA, 25 bp, Rattus norvegicus
ttcccgccctcgtctatggtggcgg

SEQ ID NO: 667925 - DNA, 25 bp, Rattus norvegicus
ttcccgctacggagctaatagagta

SEQ ID NO: 667926 - DNA, 25 bp, Rattus norvegicus
ttcccgctacggtgctaatagagta

SEQ ID NO: 667927 - DNA, 25 bp, Rattus norvegicus
ttcccgctgagaagggtgtagcccc

SEQ ID NO: 667928 - DNA, 25 bp, Rattus norvegicus
ttcccgctgagatgggtgtagcccc

SEQ ID NO: 667929 - DNA, 25 bp, Rattus norvegicus
ttcccgctgtagcaagatagcagaa

SEQ ID NO: 667930 - DNA, 25 bp, Rattus norvegicus
ttcccgctgtaggaagatagcagaa

SEQ ID NO: 667931 - DNA, 25 bp, Rattus norvegicus
ttcccggaaaccacttgtgctgtgt

SEQ ID NO: 667932 - DNA, 25 bp, Rattus norvegicus
ttcccggaaacctcttgtgctgtgt

SEQ ID NO: 667933 - DNA, 25 bp, Rattus norvegicus
ttcccggaatccaaagactgctatc

SEQ ID NO: 667934 - DNA, 25 bp, Rattus norvegicus
ttcccggaatcctaagactgctatc

SEQ ID NO: 667935 - DNA, 25 bp, Rattus norvegicus
ttcccggacagtacacctacaacag

SEQ ID NO: 667936 - DNA, 25 bp, Rattus norvegicus
ttcccggacagttcacctacaacag

SEQ ID NO: 667937 - DNA, 25 bp, Rattus norvegicus
ttcccggaggccatggatgagctgc

SEQ ID NO: 667938 - DNA, 25 bp, Rattus norvegicus
ttcccggaggccttggatgagctgc

SEQ ID NO: 667939 - DNA, 25 bp, Rattus norvegicus
ttcccggatccaaatgagtcaaact

SEQ ID NO: 667940 - DNA, 25 bp, Rattus norvegicus
ttcccggatccatatgagtcaaact

SEQ ID NO: 667941 - DNA, 25 bp, Rattus norvegicus
ttcccggcagtccagtacagtaact

SEQ ID NO: 667942 - DNA, 25 bp, Rattus norvegicus
ttcccggcagtcgagtacagtaact

SEQ ID NO: 667943 - DNA, 25 bp, Rattus norvegicus
ttcccgggcgacagccaaaaagcag

SEQ ID NO: 667944 - DNA, 25 bp, Rattus norvegicus
ttcccgggcgactgccaaaaagcag

SEQ ID NO: 667945 - DNA, 25 bp, Rattus norvegicus
ttcccgggcttgatgttaaggatgc

SEQ ID NO: 667946 - DNA, 25 bp, Rattus norvegicus
ttcccgggcttgttgttaaggatgc

SEQ ID NO: 667947 - DNA, 25 bp, Rattus norvegicus
ttcccgggggtgctgtcctcactca

SEQ ID NO: 667948 - DNA, 25 bp, Rattus norvegicus
ttcccgggggtggtgtcctcactca

SEQ ID NO: 667949 - DNA, 25 bp, Rattus norvegicus
ttcccgggttatcactctttccaag

SEQ ID NO: 667950 - DNA, 25 bp, Rattus norvegicus
ttcccgggttatgactctttccaag

SEQ ID NO: 667951 - DNA, 25 bp, Rattus norvegicus
ttcccggtctaccttactgtagaga

SEQ ID NO: 667952 - DNA, 25 bp, Rattus norvegicus
ttcccggtctacgttactgtagaga

SEQ ID NO: 667953 - DNA, 25 bp, Rattus norvegicus
ttcccggtggtcacctgaagttatt

SEQ ID NO: 667954 - DNA, 25 bp, Rattus norvegicus
ttcccggtggtctcctgaagttatt

SEQ ID NO: 667955 - DNA, 25 bp, Rattus norvegicus
ttcccgtaacagatgtttatgcagc

SEQ ID NO: 667956 - DNA, 25 bp, Rattus norvegicus
ttcccgtaacagttgtttatgcagc

SEQ ID NO: 667957 - DNA, 25 bp, Rattus norvegicus
ttcccgtagcgcacctggttgtaga

SEQ ID NO: 667958 - DNA, 25 bp, Rattus norvegicus
ttcccgtagcgctcctggttgtaga

SEQ ID NO: 667959 - DNA, 25 bp, Rattus norvegicus
ttcccgtagttgctctctgtgaaga

SEQ ID NO: 667960 - DNA, 25 bp, Rattus norvegicus
ttcccgtagttggtctctgtgaaga

SEQ ID NO: 667961 - DNA, 25 bp, Rattus norvegicus
ttcccgtcacggacactggtgaaat

SEQ ID NO: 667962 - DNA, 25 bp, Rattus norvegicus
ttcccgtcacggtcactggtgaaat

SEQ ID NO: 667963 - DNA, 25 bp, Rattus norvegicus
ttcccgtcactgattatgcaacaac

SEQ ID NO: 667964 - DNA, 25 bp, Rattus norvegicus
ttcccgtcactgtttatgcaacaac

SEQ ID NO: 667965 - DNA, 25 bp, Rattus norvegicus
ttcccgtcctggacattagttaaga

SEQ ID NO: 667966 - DNA, 25 bp, Rattus norvegicus
ttcccgtcctggtcattagttaaga

SEQ ID NO: 667967 - DNA, 25 bp, Rattus norvegicus
ttcccgtctaggacatcagtttcta

SEQ ID NO: 667968 - DNA, 25 bp, Rattus norvegicus
ttcccgtctaggtcatcagtttcta

SEQ ID NO: 667969 - DNA, 25 bp, Rattus norvegicus
ttcccgtctcccatgagtgaaagcg

SEQ ID NO: 667970 - DNA, 25 bp, Rattus norvegicus
ttcccgtctcccttgagtgaaagcg

SEQ ID NO: 667971 - DNA, 25 bp, Rattus norvegicus
ttcccgtctttactaaaacatccat

SEQ ID NO: 667972 - DNA, 25 bp, Rattus norvegicus
ttcccgtctttagtaaaacatccat

SEQ ID NO: 667973 - DNA, 25 bp, Rattus norvegicus
ttcccgtgcggtctttgccagaagt

SEQ ID NO: 667974 - DNA, 25 bp, Rattus norvegicus
ttcccgtgcggtgtttgccagaagt

SEQ ID NO: 667975 - DNA, 25 bp, Rattus norvegicus
ttcccgtgctccaggtatctgagaa

SEQ ID NO: 667976 - DNA, 25 bp, Rattus norvegicus
ttcccgtgctcctggtatctgagaa

SEQ ID NO: 667977 - DNA, 25 bp, Rattus norvegicus
ttcccgtgggttcttgtaccttgag

SEQ ID NO: 667978 - DNA, 25 bp, Rattus norvegicus
ttcccgtgggttgttgtaccttgag

SEQ ID NO: 667979 - DNA, 25 bp, Rattus norvegicus
ttcccgtgtcgtagagttttagctt

SEQ ID NO: 667980 - DNA, 25 bp, Rattus norvegicus
ttcccgtgtcgttgagttttagctt

SEQ ID NO: 667981 - DNA, 25 bp, Rattus norvegicus
ttcccgtgtggcagtacatagttgt

SEQ ID NO: 667982 - DNA, 25 bp, Rattus norvegicus
ttcccgtgtggctgtacatagttgt

SEQ ID NO: 667983 - DNA, 25 bp, Rattus norvegicus
ttcccgttagctacatgaccacaag

SEQ ID NO: 667984 - DNA, 25 bp, Rattus norvegicus
ttcccgttagcttcatgaccacaag

SEQ ID NO: 667985 - DNA, 25 bp, Rattus norvegicus
ttcccgttctgtccctttgtatatt

SEQ ID NO: 667986 - DNA, 25 bp, Rattus norvegicus
ttcccgttctgtgcctttgtatatt

SEQ ID NO: 667987 - DNA, 25 bp, Rattus norvegicus
ttcccgttctttctgtccagaggcg

SEQ ID NO: 667988 - DNA, 25 bp, Rattus norvegicus
ttcccgttctttgtgtccagaggcg

SEQ ID NO: 667989 - DNA, 25 bp, Rattus norvegicus
ttcccgttgggcactgatgaaaaaa

SEQ ID NO: 667990 - DNA, 25 bp, Rattus norvegicus
ttcccgttgggctctgatgaaaaaa

SEQ ID NO: 667991 - DNA, 25 bp, Rattus norvegicus
ttcccgtttggcactatggtttgtt

SEQ ID NO: 667992 - DNA, 25 bp, Rattus norvegicus
ttcccgtttggctctatggtttgtt

SEQ ID NO: 667993 - DNA, 25 bp, Rattus norvegicus
ttcccgttttctcagtgtcttcaat

SEQ ID NO: 667994 - DNA, 25 bp, Rattus norvegicus
ttcccgttttctgagtgtcttcaat

SEQ ID NO: 667995 - DNA, 25 bp, Rattus norvegicus
ttccctaacgtaagagcgctctaca

SEQ ID NO: 667996 - DNA, 25 bp, Rattus norvegicus
ttccctaacgtatgagcgctctaca

SEQ ID NO: 667997 - DNA, 25 bp, Rattus norvegicus
ttccctaagttgactattcttcctt

SEQ ID NO: 667998 - DNA, 25 bp, Rattus norvegicus
ttccctaagttgtctattcttcctt

SEQ ID NO: 667999 - DNA, 25 bp, Rattus norvegicus
ttccctaatcatatcttttcttctc

SEQ ID NO: 668000 - DNA, 25 bp, Rattus norvegicus
ttccctaatcatttcttttcttctc

SEQ ID NO: 668001 - DNA, 25 bp, Rattus norvegicus
ttccctacaggaaatgaagcttctc

SEQ ID NO: 668002 - DNA, 25 bp, Rattus norvegicus
ttccctacaggatatgaagcttctc

SEQ ID NO: 668003 - DNA, 25 bp, Rattus norvegicus
ttccctaccctaactgaagacttga

SEQ ID NO: 668004 - DNA, 25 bp, Rattus norvegicus
ttccctaccctatctgaagacttga

SEQ ID NO: 668005 - DNA, 25 bp, Rattus norvegicus
ttccctacgccaagaatcttctcaa

SEQ ID NO: 668006 - DNA, 25 bp, Rattus norvegicus
ttccctacgccatgaatcttctcaa

SEQ ID NO: 668007 - DNA, 25 bp, Rattus norvegicus
ttccctactacgctacttagcagtc

SEQ ID NO: 668008 - DNA, 25 bp, Rattus norvegicus
ttccctactacggtacttagcagtc

SEQ ID NO: 668009 - DNA, 25 bp, Rattus norvegicus
ttccctactcccagacatgtatata

SEQ ID NO: 668010 - DNA, 25 bp, Rattus norvegicus
ttccctactccctgacatgtatata

SEQ ID NO: 668011 - DNA, 25 bp, Rattus norvegicus
ttccctactcgaagccatagaaaca

SEQ ID NO: 668012 - DNA, 25 bp, Rattus norvegicus
ttccctactcgatgccatagaaaca

SEQ ID NO: 668013 - DNA, 25 bp, Rattus norvegicus
ttccctactctgattagactcacat

SEQ ID NO: 668014 - DNA, 25 bp, Rattus norvegicus
ttccctactctgtttagactcacat

SEQ ID NO: 668015 - DNA, 25 bp, Rattus norvegicus
ttccctagagccagcacatgtcgtg

SEQ ID NO: 668016 - DNA, 25 bp, Rattus norvegicus
ttccctagagcctgcacatgtcgtg

SEQ ID NO: 668017 - DNA, 25 bp, Rattus norvegicus
ttccctagaggaacagcgcatcaaa

SEQ ID NO: 668018 - DNA, 25 bp, Rattus norvegicus
ttccctagaggatcagcgcatcaaa

SEQ ID NO: 668019 - DNA, 25 bp, Rattus norvegicus
ttccctagccagaatgtcgcagaga

SEQ ID NO: 668020 - DNA, 25 bp, Rattus norvegicus
ttccctagccagtatgtcgcagaga

SEQ ID NO: 668021 - DNA, 25 bp, Rattus norvegicus
ttccctaggattcatgttgtggctt

SEQ ID NO: 668022 - DNA, 25 bp, Rattus norvegicus
ttccctaggattgatgttgtggctt

SEQ ID NO: 668023 - DNA, 25 bp, Rattus norvegicus
ttccctaggcacagtggtttggcag

SEQ ID NO: 668024 - DNA, 25 bp, Rattus norvegicus
ttccctaggcactgtggtttggcag

SEQ ID NO: 668025 - DNA, 25 bp, Rattus norvegicus
ttccctagtagcagtggctttgcac

SEQ ID NO: 668026 - DNA, 25 bp, Rattus norvegicus
ttccctagtagctgtggctttgcac

SEQ ID NO: 668027 - DNA, 25 bp, Rattus norvegicus
ttccctatacatatgtgaactaagt

SEQ ID NO: 668028 - DNA, 25 bp, Rattus norvegicus
ttccctatacatttgtgaactaagt

SEQ ID NO: 668029 - DNA, 25 bp, Rattus norvegicus
ttccctatagcacagatcccaaata

SEQ ID NO: 668030 - DNA, 25 bp, Rattus norvegicus
ttccctatagcagagatcccaaata

SEQ ID NO: 668031 - DNA, 25 bp, Rattus norvegicus
ttccctatattgctctcctcaaaaa

SEQ ID NO: 668032 - DNA, 25 bp, Rattus norvegicus
ttccctatattggtctcctcaaaaa

SEQ ID NO: 668033 - DNA, 25 bp, Rattus norvegicus
ttccctatatttatatgccatgtgt

SEQ ID NO: 668034 - DNA, 25 bp, Rattus norvegicus
ttccctatatttttatgccatgtgt

SEQ ID NO: 668035 - DNA, 25 bp, Rattus norvegicus
ttccctatcagactggatgtgcctt

SEQ ID NO: 668036 - DNA, 25 bp, Rattus norvegicus
ttccctatcagagtggatgtgcctt

SEQ ID NO: 668037 - DNA, 25 bp, Rattus norvegicus
ttccctatctcaagtaatcctcgta

SEQ ID NO: 668038 - DNA, 25 bp, Rattus norvegicus
ttccctatctcatgtaatcctcgta

SEQ ID NO: 668039 - DNA, 25 bp, Rattus norvegicus
ttccctatgaggcactggtcagttg

SEQ ID NO: 668040 - DNA, 25 bp, Rattus norvegicus
ttccctatgagggactggtcagttg

SEQ ID NO: 668041 - DNA, 25 bp, Rattus norvegicus
ttccctatggcgactcccctggtgt

SEQ ID NO: 668042 - DNA, 25 bp, Rattus norvegicus
ttccctatggcgtctcccctggtgt

SEQ ID NO: 668043 - DNA, 25 bp, Rattus norvegicus
ttccctatgtagagtatgtgctcct

SEQ ID NO: 668044 - DNA, 25 bp, Rattus norvegicus
ttccctatgtagtgtatgtgctcct

SEQ ID NO: 668045 - DNA, 25 bp, Rattus norvegicus
ttccctatgtctccaatatcctgag

SEQ ID NO: 668046 - DNA, 25 bp, Rattus norvegicus
ttccctatgtctgcaatatcctgag

SEQ ID NO: 668047 - DNA, 25 bp, Rattus norvegicus
ttccctcaaggactccaattacatc

SEQ ID NO: 668048 - DNA, 25 bp, Rattus norvegicus
ttccctcaaggagtccaattacatc

SEQ ID NO: 668049 - DNA, 25 bp, Rattus norvegicus
ttccctcagaatctgcggtggcgtt

SEQ ID NO: 668050 - DNA, 25 bp, Rattus norvegicus
ttccctcagaatgtgcggtggcgtt

SEQ ID NO: 668051 - DNA, 25 bp, Rattus norvegicus
ttccctcagaggctagttctggaca

SEQ ID NO: 668052 - DNA, 25 bp, Rattus norvegicus
ttccctcagaggctggagagaatga

SEQ ID NO: 668053 - DNA, 25 bp, Rattus norvegicus
ttccctcagagggtagttctggaca

SEQ ID NO: 668054 - DNA, 25 bp, Rattus norvegicus
ttccctcagagggtggagagaatga

SEQ ID NO: 668055 - DNA, 25 bp, Rattus norvegicus
ttccctcagatacactccagcatgg

SEQ ID NO: 668056 - DNA, 25 bp, Rattus norvegicus
ttccctcagatagactccagcatgg

SEQ ID NO: 668057 - DNA, 25 bp, Rattus norvegicus
ttccctcagctacctgggaaggttt

SEQ ID NO: 668058 - DNA, 25 bp, Rattus norvegicus
ttccctcagctagctgggaaggttt

SEQ ID NO: 668059 - DNA, 25 bp, Rattus norvegicus
ttccctcagggcaagcttgtgcata

SEQ ID NO: 668060 - DNA, 25 bp, Rattus norvegicus
ttccctcagggctagcttgtgcata

SEQ ID NO: 668061 - DNA, 25 bp, Rattus norvegicus
ttccctcatccgagtctgtatttaa

SEQ ID NO: 668062 - DNA, 25 bp, Rattus norvegicus
ttccctcatccgtgtctgtatttaa

SEQ ID NO: 668063 - DNA, 25 bp, Rattus norvegicus
ttccctcatgcacactgttggagtg

SEQ ID NO: 668064 - DNA, 25 bp, Rattus norvegicus
ttccctcatgcagactgttggagtg

SEQ ID NO: 668065 - DNA, 25 bp, Rattus norvegicus
ttccctcatttcattatcccgttat

SEQ ID NO: 668066 - DNA, 25 bp, Rattus norvegicus
ttccctcatttctttatcccgttat

SEQ ID NO: 668067 - DNA, 25 bp, Rattus norvegicus
ttccctccaaatctccagtattcat

SEQ ID NO: 668068 - DNA, 25 bp, Rattus norvegicus
ttccctccaaatgtccagtattcat

SEQ ID NO: 668069 - DNA, 25 bp, Rattus norvegicus
ttccctccaagaataccaaccaata

SEQ ID NO: 668070 - DNA, 25 bp, Rattus norvegicus
ttccctccaagattaccaaccaata

SEQ ID NO: 668071 - DNA, 25 bp, Rattus norvegicus
ttccctccagacctgcaggtcttat

SEQ ID NO: 668072 - DNA, 25 bp, Rattus norvegicus
ttccctccagacgtgcaggtcttat

SEQ ID NO: 668073 - DNA, 25 bp, Rattus norvegicus
ttccctccaggaaaaagattgctgt

SEQ ID NO: 668074 - DNA, 25 bp, Rattus norvegicus
ttccctccaggataaagattgctgt

SEQ ID NO: 668075 - DNA, 25 bp, Rattus norvegicus
ttccctccatctaaggcagtgtgtg

SEQ ID NO: 668076 - DNA, 25 bp, Rattus norvegicus
ttccctccatcttaggcagtgtgtg

SEQ ID NO: 668077 - DNA, 25 bp, Rattus norvegicus
ttccctccatgcagaagcttgcaga

SEQ ID NO: 668078 - DNA, 25 bp, Rattus norvegicus
ttccctccatgctgaagcttgcaga

SEQ ID NO: 668079 - DNA, 25 bp, Rattus norvegicus
ttccctccattgcagggccactcat

SEQ ID NO: 668080 - DNA, 25 bp, Rattus norvegicus
ttccctccattggagggccactcat

SEQ ID NO: 668081 - DNA, 25 bp, Rattus norvegicus
ttccctcccaatcgctctgagaata

SEQ ID NO: 668082 - DNA, 25 bp, Rattus norvegicus
ttccctcccaatggctctgagaata

SEQ ID NO: 668083 - DNA, 25 bp, Rattus norvegicus
ttccctcccagaaaacaatgccttg

SEQ ID NO: 668084 - DNA, 25 bp, Rattus norvegicus
ttccctcccagataacaatgccttg

SEQ ID NO: 668085 - DNA, 25 bp, Rattus norvegicus
ttccctcccatcagcagtgtcggga

SEQ ID NO: 668086 - DNA, 25 bp, Rattus norvegicus
ttccctcccatctgcagtgtcggga

SEQ ID NO: 668087 - DNA, 25 bp, Rattus norvegicus
ttccctccccagaacatttgtgaga

SEQ ID NO: 668088 - DNA, 25 bp, Rattus norvegicus
ttccctccccagtacatttgtgaga

SEQ ID NO: 668089 - DNA, 25 bp, Rattus norvegicus
ttccctccccgtaagtgacagtgaa

SEQ ID NO: 668090 - DNA, 25 bp, Rattus norvegicus
ttccctccccgttagtgacagtgaa

SEQ ID NO: 668091 - DNA, 25 bp, Rattus norvegicus
ttccctcccctgaatagtaatgaaa

SEQ ID NO: 668092 - DNA, 25 bp, Rattus norvegicus
ttccctcccctgtatagtaatgaaa

SEQ ID NO: 668093 - DNA, 25 bp, Rattus norvegicus
ttccctccctcgcataaaagcattg

SEQ ID NO: 668094 - DNA, 25 bp, Rattus norvegicus
ttccctccctcggataaaagcattg

SEQ ID NO: 668095 - DNA, 25 bp, Rattus norvegicus
ttccctccgctaatggagctcttga

SEQ ID NO: 668096 - DNA, 25 bp, Rattus norvegicus
ttccctccgctattggagctcttga

SEQ ID NO: 668097 - DNA, 25 bp, Rattus norvegicus
ttccctccgggaactgtgatggatt

SEQ ID NO: 668098 - DNA, 25 bp, Rattus norvegicus
ttccctccgggatctgtgatggatt

SEQ ID NO: 668099 - DNA, 25 bp, Rattus norvegicus
ttccctcctaagatggtgagtttcc

SEQ ID NO: 668100 - DNA, 25 bp, Rattus norvegicus
ttccctcctaagttggtgagtttcc

SEQ ID NO: 668101 - DNA, 25 bp, Rattus norvegicus
ttccctcctcaacccggtttagaat

SEQ ID NO: 668102 - DNA, 25 bp, Rattus norvegicus
ttccctcctcaagccggtttagaat

SEQ ID NO: 668103 - DNA, 25 bp, Rattus norvegicus
ttccctcctccaaactagaatttga

SEQ ID NO: 668104 - DNA, 25 bp, Rattus norvegicus
ttccctcctccatactagaatttga

SEQ ID NO: 668105 - DNA, 25 bp, Rattus norvegicus
ttccctcctctaatccatgatattg

SEQ ID NO: 668106 - DNA, 25 bp, Rattus norvegicus
ttccctcctctattccatgatattg

SEQ ID NO: 668107 - DNA, 25 bp, Rattus norvegicus
ttccctcctctgatgttgtatgtga

SEQ ID NO: 668108 - DNA, 25 bp, Rattus norvegicus
ttccctcctctgttgttgtatgtga

SEQ ID NO: 668109 - DNA, 25 bp, Rattus norvegicus
ttccctcctcttaactgaaactgaa

SEQ ID NO: 668110 - DNA, 25 bp, Rattus norvegicus
ttccctcctctttactgaaactgaa

SEQ ID NO: 668111 - DNA, 25 bp, Rattus norvegicus
ttccctcctgtccttagggcatgaa

SEQ ID NO: 668112 - DNA, 25 bp, Rattus norvegicus
ttccctcctgtcgttagggcatgaa

SEQ ID NO: 668113 - DNA, 25 bp, Rattus norvegicus
ttccctccttagctaatattctcaa

SEQ ID NO: 668114 - DNA, 25 bp, Rattus norvegicus
ttccctccttaggtaatattctcaa

SEQ ID NO: 668115 - DNA, 25 bp, Rattus norvegicus
ttccctccttctcggtgttcttcag

SEQ ID NO: 668116 - DNA, 25 bp, Rattus norvegicus
ttccctccttctgggtgttcttcag

SEQ ID NO: 668117 - DNA, 25 bp, Rattus norvegicus
ttccctcctttcaccaataaagtgt

SEQ ID NO: 668118 - DNA, 25 bp, Rattus norvegicus
ttccctcctttctccaataaagtgt

SEQ ID NO: 668119 - DNA, 25 bp, Rattus norvegicus
ttccctcctttgcacagtgttacaa

SEQ ID NO: 668120 - DNA, 25 bp, Rattus norvegicus
ttccctcctttggacagtgttacaa

SEQ ID NO: 668121 - DNA, 25 bp, Rattus norvegicus
ttccctcggatgcacattcttgaaa

SEQ ID NO: 668122 - DNA, 25 bp, Rattus norvegicus
ttccctcggatggacattcttgaaa

SEQ ID NO: 668123 - DNA, 25 bp, Rattus norvegicus
ttccctcgtgagagggcgcgcagat

SEQ ID NO: 668124 - DNA, 25 bp, Rattus norvegicus
ttccctcgtgagtgggcgcgcagat

SEQ ID NO: 668125 - DNA, 25 bp, Rattus norvegicus
ttccctctacccagatttcagtttt

SEQ ID NO: 668126 - DNA, 25 bp, Rattus norvegicus
ttccctctaccctgatttcagtttt

SEQ ID NO: 668127 - DNA, 25 bp, Rattus norvegicus
ttccctctagttccttccagtgaag

SEQ ID NO: 668128 - DNA, 25 bp, Rattus norvegicus
ttccctctagttgcttccagtgaag

SEQ ID NO: 668129 - DNA, 25 bp, Rattus norvegicus
ttccctctcagtcttgtctcaataa

SEQ ID NO: 668130 - DNA, 25 bp, Rattus norvegicus
ttccctctcagtgttgtctcaataa

SEQ ID NO: 668131 - DNA, 25 bp, Rattus norvegicus
ttccctctctcaagggctgtcaaaa

SEQ ID NO: 668132 - DNA, 25 bp, Rattus norvegicus
ttccctctctcatgggctgtcaaaa

SEQ ID NO: 668133 - DNA, 25 bp, Rattus norvegicus
ttccctctgagcatgtattccggac

SEQ ID NO: 668134 - DNA, 25 bp, Rattus norvegicus
ttccctctgagcttgtattccggac

SEQ ID NO: 668135 - DNA, 25 bp, Rattus norvegicus
ttccctctgatacaaattgccacat

SEQ ID NO: 668136 - DNA, 25 bp, Rattus norvegicus
ttccctctgatagaaattgccacat

SEQ ID NO: 668137 - DNA, 25 bp, Rattus norvegicus
ttccctctgcagaacagcagggctg

SEQ ID NO: 668138 - DNA, 25 bp, Rattus norvegicus
ttccctctgcagtacagcagggctg

SEQ ID NO: 668139 - DNA, 25 bp, Rattus norvegicus
ttccctctgccgagctctgagtact

SEQ ID NO: 668140 - DNA, 25 bp, Rattus norvegicus
ttccctctgccgtgctctgagtact

SEQ ID NO: 668141 - DNA, 25 bp, Rattus norvegicus
ttccctctgctgcaggcatttaaga

SEQ ID NO: 668142 - DNA, 25 bp, Rattus norvegicus
ttccctctgctggaggcatttaaga

SEQ ID NO: 668143 - DNA, 25 bp, Rattus norvegicus
ttccctcttaaactacatctcatac

SEQ ID NO: 668144 - DNA, 25 bp, Rattus norvegicus
ttccctcttaaagtacatctcatac

SEQ ID NO: 668145 - DNA, 25 bp, Rattus norvegicus
ttccctcttcacagctttgtgactc

SEQ ID NO: 668146 - DNA, 25 bp, Rattus norvegicus
ttccctcttcacataagccgaattt

SEQ ID NO: 668147 - DNA, 25 bp, Rattus norvegicus
ttccctcttcactgctttgtgactc

SEQ ID NO: 668148 - DNA, 25 bp, Rattus norvegicus
ttccctcttcacttaagccgaattt

SEQ ID NO: 668149 - DNA, 25 bp, Rattus norvegicus
ttccctcttccaaagcaagcatttg

SEQ ID NO: 668150 - DNA, 25 bp, Rattus norvegicus
ttccctcttccatagcaagcatttg

SEQ ID NO: 668151 - DNA, 25 bp, Rattus norvegicus
ttccctcttggaacaacactgtgaa

SEQ ID NO: 668152 - DNA, 25 bp, Rattus norvegicus
ttccctcttggatcaacactgtgaa

SEQ ID NO: 668153 - DNA, 25 bp, Rattus norvegicus
ttccctctttccatgaagtctcagt

SEQ ID NO: 668154 - DNA, 25 bp, Rattus norvegicus
ttccctctttccttgaagtctcagt

SEQ ID NO: 668155 - DNA, 25 bp, Rattus norvegicus
ttccctcttttaatttgtcattcag

SEQ ID NO: 668156 - DNA, 25 bp, Rattus norvegicus
ttccctcttttattttgtcattcag

SEQ ID NO: 668157 - DNA, 25 bp, Rattus norvegicus
ttccctgaaaagacatgactctact

SEQ ID NO: 668158 - DNA, 25 bp, Rattus norvegicus
ttccctgaaaagtcatgactctact

SEQ ID NO: 668159 - DNA, 25 bp, Rattus norvegicus
ttccctgaaccaaatcccatataac

SEQ ID NO: 668160 - DNA, 25 bp, Rattus norvegicus
ttccctgaaccatatcccatataac

SEQ ID NO: 668161 - DNA, 25 bp, Rattus norvegicus
ttccctgaacttctaattgtttaag

SEQ ID NO: 668162 - DNA, 25 bp, Rattus norvegicus
ttccctgaacttgtaattgtttaag

SEQ ID NO: 668163 - DNA, 25 bp, Rattus norvegicus
ttccctgaaggtcttctctgtaact

SEQ ID NO: 668164 - DNA, 25 bp, Rattus norvegicus
ttccctgaaggtgttctctgtaact

SEQ ID NO: 668165 - DNA, 25 bp, Rattus norvegicus
ttccctgacacaactcattttcttg

SEQ ID NO: 668166 - DNA, 25 bp, Rattus norvegicus
ttccctgacacatctcattttcttg

SEQ ID NO: 668167 - DNA, 25 bp, Rattus norvegicus
ttccctgaccctctcatcaaaggag

SEQ ID NO: 668168 - DNA, 25 bp, Rattus norvegicus
ttccctgaccctgtcatcaaaggag

SEQ ID NO: 668169 - DNA, 25 bp, Rattus norvegicus
ttccctgactctatgtgtaatccac

SEQ ID NO: 668170 - DNA, 25 bp, Rattus norvegicus
ttccctgactctcgagcacggacag

SEQ ID NO: 668171 - DNA, 25 bp, Rattus norvegicus
ttccctgactctggagcacggacag

SEQ ID NO: 668172 - DNA, 25 bp, Rattus norvegicus
ttccctgactctttgtgtaatccac

SEQ ID NO: 668173 - DNA, 25 bp, Rattus norvegicus
ttccctgactggactgtgagcacta

SEQ ID NO: 668174 - DNA, 25 bp, Rattus norvegicus
ttccctgactggtctgtgagcacta

SEQ ID NO: 668175 - DNA, 25 bp, Rattus norvegicus
ttccctgacttgctgctcataggca

SEQ ID NO: 668176 - DNA, 25 bp, Rattus norvegicus
ttccctgacttggtgctcataggca

SEQ ID NO: 668177 - DNA, 25 bp, Rattus norvegicus
ttccctgaggccctagaagcatatt

SEQ ID NO: 668178 - DNA, 25 bp, Rattus norvegicus
ttccctgaggccgtagaagcatatt

SEQ ID NO: 668179 - DNA, 25 bp, Rattus norvegicus
ttccctgagttaatcttcgctgttg

SEQ ID NO: 668180 - DNA, 25 bp, Rattus norvegicus
ttccctgagttattcttcgctgttg

SEQ ID NO: 668181 - DNA, 25 bp, Rattus norvegicus
ttccctgatatgagcttggtctcct

SEQ ID NO: 668182 - DNA, 25 bp, Rattus norvegicus
ttccctgatatgtgcttggtctcct

SEQ ID NO: 668183 - DNA, 25 bp, Rattus norvegicus
ttccctgattgaaattctgtgtctt

SEQ ID NO: 668184 - DNA, 25 bp, Rattus norvegicus
ttccctgattgactctccaacaaga

SEQ ID NO: 668185 - DNA, 25 bp, Rattus norvegicus
ttccctgattgagtctccaacaaga

SEQ ID NO: 668186 - DNA, 25 bp, Rattus norvegicus
ttccctgattgatattctgtgtctt

SEQ ID NO: 668187 - DNA, 25 bp, Rattus norvegicus
ttccctgatttgctcctgccaaaaa

SEQ ID NO: 668188 - DNA, 25 bp, Rattus norvegicus
ttccctgatttggtcctgccaaaaa

SEQ ID NO: 668189 - DNA, 25 bp, Rattus norvegicus
ttccctgattttcttgctccttgca

SEQ ID NO: 668190 - DNA, 25 bp, Rattus norvegicus
ttccctgattttgttgctccttgca

SEQ ID NO: 668191 - DNA, 25 bp, Rattus norvegicus
ttccctgcaccaagctcatagaaga

SEQ ID NO: 668192 - DNA, 25 bp, Rattus norvegicus
ttccctgcaccatgctcatagaaga

SEQ ID NO: 668193 - DNA, 25 bp, Rattus norvegicus
ttccctgcacgtcctggagaagagc

SEQ ID NO: 668194 - DNA, 25 bp, Rattus norvegicus
ttccctgcacgtgctggagaagagc

SEQ ID NO: 668195 - DNA, 25 bp, Rattus norvegicus
ttccctgccacgatggactatatac

SEQ ID NO: 668196 - DNA, 25 bp, Rattus norvegicus
ttccctgccacgttggactatatac

SEQ ID NO: 668197 - DNA, 25 bp, Rattus norvegicus
ttccctgccactcattcagtgagtg

SEQ ID NO: 668198 - DNA, 25 bp, Rattus norvegicus
ttccctgccactgattcagtgagtg

SEQ ID NO: 668199 - DNA, 25 bp, Rattus norvegicus
ttccctgcccctatatgaaagacct

SEQ ID NO: 668200 - DNA, 25 bp, Rattus norvegicus
ttccctgcccctttatgaaagacct

SEQ ID NO: 668201 - DNA, 25 bp, Rattus norvegicus
ttccctgccggtcaatcattgtcag

SEQ ID NO: 668202 - DNA, 25 bp, Rattus norvegicus
ttccctgccggtgaatcattgtcag

SEQ ID NO: 668203 - DNA, 25 bp, Rattus norvegicus
ttccctgcctcaattacttgttaaa

SEQ ID NO: 668204 - DNA, 25 bp, Rattus norvegicus
ttccctgcctcatttacttgttaaa

SEQ ID NO: 668205 - DNA, 25 bp, Rattus norvegicus
ttccctgcctttactgagggtaggg

SEQ ID NO: 668206 - DNA, 25 bp, Rattus norvegicus
ttccctgccttttctgagggtaggg

SEQ ID NO: 668207 - DNA, 25 bp, Rattus norvegicus
ttccctgcggatatttatagaggtc

SEQ ID NO: 668208 - DNA, 25 bp, Rattus norvegicus
ttccctgcggatttttatagaggtc

SEQ ID NO: 668209 - DNA, 25 bp, Rattus norvegicus
ttccctgctataaaatcgtgtaact

SEQ ID NO: 668210 - DNA, 25 bp, Rattus norvegicus
ttccctgctatataatcgtgtaact

SEQ ID NO: 668211 - DNA, 25 bp, Rattus norvegicus
ttccctgctctacaaagtccgtaag

SEQ ID NO: 668212 - DNA, 25 bp, Rattus norvegicus
ttccctgctctagaaagtccgtaag

SEQ ID NO: 668213 - DNA, 25 bp, Rattus norvegicus
ttccctgctgccaatgtggaggagc

SEQ ID NO: 668214 - DNA, 25 bp, Rattus norvegicus
ttccctgctgcctatgtggaggagc

SEQ ID NO: 668215 - DNA, 25 bp, Rattus norvegicus
ttccctgctgtcagtggagtcttcc

SEQ ID NO: 668216 - DNA, 25 bp, Rattus norvegicus
ttccctgctgtctgtggagtcttcc

SEQ ID NO: 668217 - DNA, 25 bp, Rattus norvegicus
ttccctgcttctctataaagaactt

SEQ ID NO: 668218 - DNA, 25 bp, Rattus norvegicus
ttccctgcttctgtataaagaactt

SEQ ID NO: 668219 - DNA, 25 bp, Rattus norvegicus
ttccctggaagcagctgagtgtcgc

SEQ ID NO: 668220 - DNA, 25 bp, Rattus norvegicus
ttccctggaagctgctgagtgtcgc

SEQ ID NO: 668221 - DNA, 25 bp, Rattus norvegicus
ttccctggaggtctttggtaatgct

SEQ ID NO: 668222 - DNA, 25 bp, Rattus norvegicus
ttccctggaggtgtttggtaatgct

SEQ ID NO: 668223 - DNA, 25 bp, Rattus norvegicus
ttccctggattgacactgtcccaat

SEQ ID NO: 668224 - DNA, 25 bp, Rattus norvegicus
ttccctggattgtcactgtcccaat

SEQ ID NO: 668225 - DNA, 25 bp, Rattus norvegicus
ttccctggcaggagttggtaggcac

SEQ ID NO: 668226 - DNA, 25 bp, Rattus norvegicus
ttccctggcaggtgttggtaggcac

SEQ ID NO: 668227 - DNA, 25 bp, Rattus norvegicus
ttccctggcctacctagatatttat

SEQ ID NO: 668228 - DNA, 25 bp, Rattus norvegicus
ttccctggcctagctagatatttat

SEQ ID NO: 668229 - DNA, 25 bp, Rattus norvegicus
ttccctggccttcaggaggagagct

SEQ ID NO: 668230 - DNA, 25 bp, Rattus norvegicus
ttccctggccttgaggaggagagct

SEQ ID NO: 668231 - DNA, 25 bp, Rattus norvegicus
ttccctggcgaacgcggaagcccga

SEQ ID NO: 668232 - DNA, 25 bp, Rattus norvegicus
ttccctggcgaaggcggaagcccga

SEQ ID NO: 668233 - DNA, 25 bp, Rattus norvegicus
ttccctggcgcaaggatgagacgca

SEQ ID NO: 668234 - DNA, 25 bp, Rattus norvegicus
ttccctggcgcatggatgagacgca

SEQ ID NO: 668235 - DNA, 25 bp, Rattus norvegicus
ttccctgggaaaaacgtgggcgccg

SEQ ID NO: 668236 - DNA, 25 bp, Rattus norvegicus
ttccctgggaaatacgtgggcgccg

SEQ ID NO: 668237 - DNA, 25 bp, Rattus norvegicus
ttccctgggactatgctcctaggag

SEQ ID NO: 668238 - DNA, 25 bp, Rattus norvegicus
ttccctgggactttgctcctaggag

SEQ ID NO: 668239 - DNA, 25 bp, Rattus norvegicus
ttccctgggaggcaacagtacgcgt

SEQ ID NO: 668240 - DNA, 25 bp, Rattus norvegicus
ttccctgggagggaacagtacgcgt

SEQ ID NO: 668241 - DNA, 25 bp, Rattus norvegicus
ttccctgggattagtccagctggga

SEQ ID NO: 668242 - DNA, 25 bp, Rattus norvegicus
ttccctgggatttgtccagctggga

SEQ ID NO: 668243 - DNA, 25 bp, Rattus norvegicus
ttccctgggcaaagctgcttccggt

SEQ ID NO: 668244 - DNA, 25 bp, Rattus norvegicus
ttccctgggcaatgctgcttccggt

SEQ ID NO: 668245 - DNA, 25 bp, Rattus norvegicus
ttccctgggtacaaaacctatatat

SEQ ID NO: 668246 - DNA, 25 bp, Rattus norvegicus
ttccctgggtactaaacctatatat

SEQ ID NO: 668247 - DNA, 25 bp, Rattus norvegicus
ttccctgggtgtatttctgtctctg

SEQ ID NO: 668248 - DNA, 25 bp, Rattus norvegicus
ttccctgggtgtttttctgtctctg

SEQ ID NO: 668249 - DNA, 25 bp, Rattus norvegicus
ttccctggtccactaacagataagg

SEQ ID NO: 668250 - DNA, 25 bp, Rattus norvegicus
ttccctggtccagtaacagataagg

SEQ ID NO: 668251 - DNA, 25 bp, Rattus norvegicus
ttccctggtcccaatgggaggccag

SEQ ID NO: 668252 - DNA, 25 bp, Rattus norvegicus
ttccctggtccctatgggaggccag

SEQ ID NO: 668253 - DNA, 25 bp, Rattus norvegicus
ttccctggtctaaatatatggacgt

SEQ ID NO: 668254 - DNA, 25 bp, Rattus norvegicus
ttccctggtctatatatatggacgt

SEQ ID NO: 668255 - DNA, 25 bp, Rattus norvegicus
ttccctggtgctaatcactgtaact

SEQ ID NO: 668256 - DNA, 25 bp, Rattus norvegicus
ttccctggtgcttatcactgtaact

SEQ ID NO: 668257 - DNA, 25 bp, Rattus norvegicus
ttccctggtgggaggtagactcgtc

SEQ ID NO: 668258 - DNA, 25 bp, Rattus norvegicus
ttccctggtgggtggtagactcgtc

SEQ ID NO: 668259 - DNA, 25 bp, Rattus norvegicus
ttccctgtaacaaggtctccgagat

SEQ ID NO: 668260 - DNA, 25 bp, Rattus norvegicus
ttccctgtaacatggtctccgagat

SEQ ID NO: 668261 - DNA, 25 bp, Rattus norvegicus
ttccctgtaatgcagctgcgtgatg

SEQ ID NO: 668262 - DNA, 25 bp, Rattus norvegicus
ttccctgtaatgctcctaaataaag

SEQ ID NO: 668263 - DNA, 25 bp, Rattus norvegicus
ttccctgtaatggagctgcgtgatg

SEQ ID NO: 668264 - DNA, 25 bp, Rattus norvegicus
ttccctgtaatggtcctaaataaag

SEQ ID NO: 668265 - DNA, 25 bp, Rattus norvegicus
ttccctgtaccaactgtcctgagtg

SEQ ID NO: 668266 - DNA, 25 bp, Rattus norvegicus
ttccctgtaccatctgtcctgagtg

SEQ ID NO: 668267 - DNA, 25 bp, Rattus norvegicus
ttccctgtacgaagtcaccgccaaa

SEQ ID NO: 668268 - DNA, 25 bp, Rattus norvegicus
ttccctgtacgatgtcaccgccaaa

SEQ ID NO: 668269 - DNA, 25 bp, Rattus norvegicus
ttccctgtactaaaggcccgtatat

SEQ ID NO: 668270 - DNA, 25 bp, Rattus norvegicus
ttccctgtactataggcccgtatat

SEQ ID NO: 668271 - DNA, 25 bp, Rattus norvegicus
ttccctgtagggagccatattggat

SEQ ID NO: 668272 - DNA, 25 bp, Rattus norvegicus
ttccctgtagggtgccatattggat

SEQ ID NO: 668273 - DNA, 25 bp, Rattus norvegicus
ttccctgtcaacctaattctatcaa

SEQ ID NO: 668274 - DNA, 25 bp, Rattus norvegicus
ttccctgtcaacgtaattctatcaa

SEQ ID NO: 668275 - DNA, 25 bp, Rattus norvegicus
ttccctgtcatgctcacctttagga

SEQ ID NO: 668276 - DNA, 25 bp, Rattus norvegicus
ttccctgtcatggtcacctttagga

SEQ ID NO: 668277 - DNA, 25 bp, Rattus norvegicus
ttccctgtccagagtatatgttgct

SEQ ID NO: 668278 - DNA, 25 bp, Rattus norvegicus
ttccctgtccagtgtatatgttgct

SEQ ID NO: 668279 - DNA, 25 bp, Rattus norvegicus
ttccctgtccatatcagttcattga

SEQ ID NO: 668280 - DNA, 25 bp, Rattus norvegicus
ttccctgtccatttcagttcattga

SEQ ID NO: 668281 - DNA, 25 bp, Rattus norvegicus
ttccctgtcgctcttgacggttaca

SEQ ID NO: 668282 - DNA, 25 bp, Rattus norvegicus
ttccctgtcgctgttgacggttaca

SEQ ID NO: 668283 - DNA, 25 bp, Rattus norvegicus
ttccctgtctccaaggatggtgaga

SEQ ID NO: 668284 - DNA, 25 bp, Rattus norvegicus
ttccctgtctcctaggatggtgaga

SEQ ID NO: 668285 - DNA, 25 bp, Rattus norvegicus
ttccctgtgaagacatccccagata

SEQ ID NO: 668286 - DNA, 25 bp, Rattus norvegicus
ttccctgtgaagtcatccccagata

SEQ ID NO: 668287 - DNA, 25 bp, Rattus norvegicus
ttccctgtgactcattttgatgtgc

SEQ ID NO: 668288 - DNA, 25 bp, Rattus norvegicus
ttccctgtgactgattttgatgtgc

SEQ ID NO: 668289 - DNA, 25 bp, Rattus norvegicus
ttccctgtgatgagcttatctgtgt

SEQ ID NO: 668290 - DNA, 25 bp, Rattus norvegicus
ttccctgtgatgtgcttatctgtgt

SEQ ID NO: 668291 - DNA, 25 bp, Rattus norvegicus
ttccctgtgcatcggacagctcact

SEQ ID NO: 668292 - DNA, 25 bp, Rattus norvegicus
ttccctgtgcatgggacagctcact

SEQ ID NO: 668293 - DNA, 25 bp, Rattus norvegicus
ttccctgtgggaagtcatcttgtct

SEQ ID NO: 668294 - DNA, 25 bp, Rattus norvegicus
ttccctgtgggactgtaatctctgt

SEQ ID NO: 668295 - DNA, 25 bp, Rattus norvegicus
ttccctgtgggagtgtaatctctgt

SEQ ID NO: 668296 - DNA, 25 bp, Rattus norvegicus
ttccctgtgggatgtcatcttgtct

SEQ ID NO: 668297 - DNA, 25 bp, Rattus norvegicus
ttccctgtgggtcgtgtccgaagtc

SEQ ID NO: 668298 - DNA, 25 bp, Rattus norvegicus
ttccctgtgggtggtgtccgaagtc

SEQ ID NO: 668299 - DNA, 25 bp, Rattus norvegicus
ttccctgtggttagtcatcagtaca

SEQ ID NO: 668300 - DNA, 25 bp, Rattus norvegicus
ttccctgtggtttgtcatcagtaca

SEQ ID NO: 668301 - DNA, 25 bp, Rattus norvegicus
ttccctgtgtccctatagtagtagc

SEQ ID NO: 668302 - DNA, 25 bp, Rattus norvegicus
ttccctgtgtccgtatagtagtagc

SEQ ID NO: 668303 - DNA, 25 bp, Rattus norvegicus
ttccctgtgtgtattctccagtgat

SEQ ID NO: 668304 - DNA, 25 bp, Rattus norvegicus
ttccctgtgtgttttctccagtgat

SEQ ID NO: 668305 - DNA, 25 bp, Rattus norvegicus
ttccctgtgttgcttatctggtttt

SEQ ID NO: 668306 - DNA, 25 bp, Rattus norvegicus
ttccctgtgttggttatctggtttt

SEQ ID NO: 668307 - DNA, 25 bp, Rattus norvegicus
ttccctgttcttcgttgctgcattt

SEQ ID NO: 668308 - DNA, 25 bp, Rattus norvegicus
ttccctgttcttggttgctgcattt

SEQ ID NO: 668309 - DNA, 25 bp, Rattus norvegicus
ttccctgttgagctgtgcgcggaca

SEQ ID NO: 668310 - DNA, 25 bp, Rattus norvegicus
ttccctgttgaggtgtgcgcggaca

SEQ ID NO: 668311 - DNA, 25 bp, Rattus norvegicus
ttccctgttgtcaccaagtgttatg

SEQ ID NO: 668312 - DNA, 25 bp, Rattus norvegicus
ttccctgttgtctccaagtgttatg

SEQ ID NO: 668313 - DNA, 25 bp, Rattus norvegicus
ttccctgtttacctatgactctcgg

SEQ ID NO: 668314 - DNA, 25 bp, Rattus norvegicus
ttccctgtttacgtatgactctcgg

SEQ ID NO: 668315 - DNA, 25 bp, Rattus norvegicus
ttcccttaagttattgtgacagtgc

SEQ ID NO: 668316 - DNA, 25 bp, Rattus norvegicus
ttcccttaagtttttgtgacagtgc

SEQ ID NO: 668317 - DNA, 25 bp, Rattus norvegicus
ttcccttacaatacgagcactaaag

SEQ ID NO: 668318 - DNA, 25 bp, Rattus norvegicus
ttcccttacaattcgagcactaaag

SEQ ID NO: 668319 - DNA, 25 bp, Rattus norvegicus
ttcccttaccaaacatgccatgtgt

SEQ ID NO: 668320 - DNA, 25 bp, Rattus norvegicus
ttcccttaccaatcatgccatgtgt

SEQ ID NO: 668321 - DNA, 25 bp, Rattus norvegicus
ttcccttaccttagcttcttttgat

SEQ ID NO: 668322 - DNA, 25 bp, Rattus norvegicus
ttcccttacctttgcttcttttgat

SEQ ID NO: 668323 - DNA, 25 bp, Rattus norvegicus
ttcccttactccagaagatgaggtt

SEQ ID NO: 668324 - DNA, 25 bp, Rattus norvegicus
ttcccttactcctgaagatgaggtt

SEQ ID NO: 668325 - DNA, 25 bp, Rattus norvegicus
ttcccttactgtcccatttgatggt

SEQ ID NO: 668326 - DNA, 25 bp, Rattus norvegicus
ttcccttactgtgccatttgatggt

SEQ ID NO: 668327 - DNA, 25 bp, Rattus norvegicus
ttcccttaggaaagacagcagtagc

SEQ ID NO: 668328 - DNA, 25 bp, Rattus norvegicus
ttcccttaggaatgacagcagtagc

SEQ ID NO: 668329 - DNA, 25 bp, Rattus norvegicus
ttcccttcacctaatcttcagtgat

SEQ ID NO: 668330 - DNA, 25 bp, Rattus norvegicus
ttcccttcaccttatcttcagtgat

SEQ ID NO: 668331 - DNA, 25 bp, Rattus norvegicus
ttcccttcacttacaacaacttaca

SEQ ID NO: 668332 - DNA, 25 bp, Rattus norvegicus
ttcccttcactttcaacaacttaca

SEQ ID NO: 668333 - DNA, 25 bp, Rattus norvegicus
ttcccttcagccatgtgaacatcgt

SEQ ID NO: 668334 - DNA, 25 bp, Rattus norvegicus
ttcccttcagccttgtgaacatcgt

SEQ ID NO: 668335 - DNA, 25 bp, Rattus norvegicus
ttcccttcaggaagagccgcacact

SEQ ID NO: 668336 - DNA, 25 bp, Rattus norvegicus
ttcccttcaggatgagccgcacact

SEQ ID NO: 668337 - DNA, 25 bp, Rattus norvegicus
ttcccttcatttatgttccatttgg

SEQ ID NO: 668338 - DNA, 25 bp, Rattus norvegicus
ttcccttcatttcaggctgatttgc

SEQ ID NO: 668339 - DNA, 25 bp, Rattus norvegicus
ttcccttcatttgaggctgatttgc

SEQ ID NO: 668340 - DNA, 25 bp, Rattus norvegicus
ttcccttcatttttgttccatttgg

SEQ ID NO: 668341 - DNA, 25 bp, Rattus norvegicus
ttcccttccaacagttctcaaaatc

SEQ ID NO: 668342 - DNA, 25 bp, Rattus norvegicus
ttcccttccaactgttctcaaaatc

SEQ ID NO: 668343 - DNA, 25 bp, Rattus norvegicus
ttcccttccactagtggtgacagag

SEQ ID NO: 668344 - DNA, 25 bp, Rattus norvegicus
ttcccttccacttgtggtgacagag

SEQ ID NO: 668345 - DNA, 25 bp, Rattus norvegicus
ttcccttccccaagagtgatggttt

SEQ ID NO: 668346 - DNA, 25 bp, Rattus norvegicus
ttcccttccccatgagtgatggttt

SEQ ID NO: 668347 - DNA, 25 bp, Rattus norvegicus
ttcccttccgagagcgggtaggtga

SEQ ID NO: 668348 - DNA, 25 bp, Rattus norvegicus
ttcccttccgagtgcgggtaggtga

SEQ ID NO: 668349 - DNA, 25 bp, Rattus norvegicus
ttcccttcctgtattgtttcaacat

SEQ ID NO: 668350 - DNA, 25 bp, Rattus norvegicus
ttcccttcctgttttgtttcaacat

SEQ ID NO: 668351 - DNA, 25 bp, Rattus norvegicus
ttcccttccttacacagttttctca

SEQ ID NO: 668352 - DNA, 25 bp, Rattus norvegicus
ttcccttccttactacattgcaagc

SEQ ID NO: 668353 - DNA, 25 bp, Rattus norvegicus
ttcccttccttagacagttttctca

SEQ ID NO: 668354 - DNA, 25 bp, Rattus norvegicus
ttcccttccttagtacattgcaagc

SEQ ID NO: 668355 - DNA, 25 bp, Rattus norvegicus
ttcccttccttcagtaggaggtagc

SEQ ID NO: 668356 - DNA, 25 bp, Rattus norvegicus
ttcccttccttcagtcttaaagcaa

SEQ ID NO: 668357 - DNA, 25 bp, Rattus norvegicus
ttcccttccttctgtaggaggtagc

SEQ ID NO: 668358 - DNA, 25 bp, Rattus norvegicus
ttcccttccttctgtcttaaagcaa

SEQ ID NO: 668359 - DNA, 25 bp, Rattus norvegicus
ttcccttcgaagcagtcgtgtgcat

SEQ ID NO: 668360 - DNA, 25 bp, Rattus norvegicus
ttcccttcgaaggagtcgtgtgcat

SEQ ID NO: 668361 - DNA, 25 bp, Rattus norvegicus
ttcccttcggcaatcgagtttaacg

SEQ ID NO: 668362 - DNA, 25 bp, Rattus norvegicus
ttcccttcggcattcgagtttaacg

SEQ ID NO: 668363 - DNA, 25 bp, Rattus norvegicus
ttcccttctatgctaaatctgtcta

SEQ ID NO: 668364 - DNA, 25 bp, Rattus norvegicus
ttcccttctatggtaaatctgtcta

SEQ ID NO: 668365 - DNA, 25 bp, Rattus norvegicus
ttcccttctgctctgccattttaaa

SEQ ID NO: 668366 - DNA, 25 bp, Rattus norvegicus
ttcccttctgctgtgccattttaaa

SEQ ID NO: 668367 - DNA, 25 bp, Rattus norvegicus
ttcccttctgtgatggactgcagtc

SEQ ID NO: 668368 - DNA, 25 bp, Rattus norvegicus
ttcccttctgtgttggactgcagtc

SEQ ID NO: 668369 - DNA, 25 bp, Rattus norvegicus
ttcccttctgttagatcctgtccat

SEQ ID NO: 668370 - DNA, 25 bp, Rattus norvegicus
ttcccttctgtttgatcctgtccat

SEQ ID NO: 668371 - DNA, 25 bp, Rattus norvegicus
ttcccttcttgcagaaagtctagat

SEQ ID NO: 668372 - DNA, 25 bp, Rattus norvegicus
ttcccttcttgctgaaagtctagat

SEQ ID NO: 668373 - DNA, 25 bp, Rattus norvegicus
ttcccttgaaccaggctgactaaaa

SEQ ID NO: 668374 - DNA, 25 bp, Rattus norvegicus
ttcccttgaacctggctgactaaaa

SEQ ID NO: 668375 - DNA, 25 bp, Rattus norvegicus
ttcccttgacaccagcttcatagaa

SEQ ID NO: 668376 - DNA, 25 bp, Rattus norvegicus
ttcccttgacacgagcttcatagaa

SEQ ID NO: 668377 - DNA, 25 bp, Rattus norvegicus
ttcccttgatctctgtgtcatttca

SEQ ID NO: 668378 - DNA, 25 bp, Rattus norvegicus
ttcccttgatctgtgtgtcatttca

SEQ ID NO: 668379 - DNA, 25 bp, Rattus norvegicus
ttcccttgcctactcagtagttcat

SEQ ID NO: 668380 - DNA, 25 bp, Rattus norvegicus
ttcccttgcctagtcagtagttcat

SEQ ID NO: 668381 - DNA, 25 bp, Rattus norvegicus
ttcccttgctccataatgctgattg

SEQ ID NO: 668382 - DNA, 25 bp, Rattus norvegicus
ttcccttgctccttaatgctgattg

SEQ ID NO: 668383 - DNA, 25 bp, Rattus norvegicus
ttcccttggcagctgacttgagaaa

SEQ ID NO: 668384 - DNA, 25 bp, Rattus norvegicus
ttcccttggcaggtgacttgagaaa

SEQ ID NO: 668385 - DNA, 25 bp, Rattus norvegicus
ttcccttgggttatttacatgtcag

SEQ ID NO: 668386 - DNA, 25 bp, Rattus norvegicus
ttcccttgggttttttacatgtcag

SEQ ID NO: 668387 - DNA, 25 bp, Rattus norvegicus
ttcccttgtcctagtcttagggagg

SEQ ID NO: 668388 - DNA, 25 bp, Rattus norvegicus
ttcccttgtccttgtcttagggagg

SEQ ID NO: 668389 - DNA, 25 bp, Rattus norvegicus
ttcccttgtcgtcacaaattcggta

SEQ ID NO: 668390 - DNA, 25 bp, Rattus norvegicus
ttcccttgtcgtgacaaattcggta

SEQ ID NO: 668391 - DNA, 25 bp, Rattus norvegicus
ttcccttgtgttaggctcgcaataa

SEQ ID NO: 668392 - DNA, 25 bp, Rattus norvegicus
ttcccttgtgtttggctcgcaataa

SEQ ID NO: 668393 - DNA, 25 bp, Rattus norvegicus
ttcccttgttggaatctgctcttaa

SEQ ID NO: 668394 - DNA, 25 bp, Rattus norvegicus
ttcccttgttggtatctgctcttaa

SEQ ID NO: 668395 - DNA, 25 bp, Rattus norvegicus
ttcccttgttttatagccaacttag

SEQ ID NO: 668396 - DNA, 25 bp, Rattus norvegicus
ttcccttgttttttagccaacttag

SEQ ID NO: 668397 - DNA, 25 bp, Rattus norvegicus
ttccctttagccacaacatttcaag

SEQ ID NO: 668398 - DNA, 25 bp, Rattus norvegicus
ttccctttagcctcaacatttcaag

SEQ ID NO: 668399 - DNA, 25 bp, Rattus norvegicus
ttccctttcagaccagttctaatgc

SEQ ID NO: 668400 - DNA, 25 bp, Rattus norvegicus
ttccctttcagagcagttctaatgc

SEQ ID NO: 668401 - DNA, 25 bp, Rattus norvegicus
ttccctttccagataatgacaaccg

SEQ ID NO: 668402 - DNA, 25 bp, Rattus norvegicus
ttccctttccagttaatgacaaccg

SEQ ID NO: 668403 - DNA, 25 bp, Rattus norvegicus
ttccctttcccaattgttaacacat

SEQ ID NO: 668404 - DNA, 25 bp, Rattus norvegicus
ttccctttcccatttgttaacacat

SEQ ID NO: 668405 - DNA, 25 bp, Rattus norvegicus
ttccctttgcccactgacggaagga

SEQ ID NO: 668406 - DNA, 25 bp, Rattus norvegicus
ttccctttgccctctgacggaagga

SEQ ID NO: 668407 - DNA, 25 bp, Rattus norvegicus
ttccctttgcttatgtgtgaccaca

SEQ ID NO: 668408 - DNA, 25 bp, Rattus norvegicus
ttccctttgcttttgtgtgaccaca

SEQ ID NO: 668409 - DNA, 25 bp, Rattus norvegicus
ttccctttggccatgtctttaagta

SEQ ID NO: 668410 - DNA, 25 bp, Rattus norvegicus
ttccctttggccttgtctttaagta

SEQ ID NO: 668411 - DNA, 25 bp, Rattus norvegicus
ttccctttgggaaatagtctctcgc

SEQ ID NO: 668412 - DNA, 25 bp, Rattus norvegicus
ttccctttgggatatagtctctcgc

SEQ ID NO: 668413 - DNA, 25 bp, Rattus norvegicus
ttccctttggtcagtagtgtgtttt

SEQ ID NO: 668414 - DNA, 25 bp, Rattus norvegicus
ttccctttggtctgtagtgtgtttt

SEQ ID NO: 668415 - DNA, 25 bp, Rattus norvegicus
ttccctttggttatgatcatctcct

SEQ ID NO: 668416 - DNA, 25 bp, Rattus norvegicus
ttccctttggttttgatcatctcct

SEQ ID NO: 668417 - DNA, 25 bp, Rattus norvegicus
ttccctttgtcaagcacagtctcat

SEQ ID NO: 668418 - DNA, 25 bp, Rattus norvegicus
ttccctttgtcatgcacagtctcat

SEQ ID NO: 668419 - DNA, 25 bp, Rattus norvegicus
ttccctttgtccctctgatgtctca

SEQ ID NO: 668420 - DNA, 25 bp, Rattus norvegicus
ttccctttgtccgtctgatgtctca

SEQ ID NO: 668421 - DNA, 25 bp, Rattus norvegicus
ttccctttgtgtagtgtggactcta

SEQ ID NO: 668422 - DNA, 25 bp, Rattus norvegicus
ttccctttgtgttgtgtggactcta

SEQ ID NO: 668423 - DNA, 25 bp, Rattus norvegicus
ttccctttgttcactgttatgttta

SEQ ID NO: 668424 - DNA, 25 bp, Rattus norvegicus
ttccctttgttctctgttatgttta

SEQ ID NO: 668425 - DNA, 25 bp, Rattus norvegicus
ttcccttttcataatacttcagtgt

SEQ ID NO: 668426 - DNA, 25 bp, Rattus norvegicus
ttcccttttcattatacttcagtgt

SEQ ID NO: 668427 - DNA, 25 bp, Rattus norvegicus
ttcccttttctcaacatacagtgct

SEQ ID NO: 668428 - DNA, 25 bp, Rattus norvegicus
ttcccttttctctacatacagtgct

SEQ ID NO: 668429 - DNA, 25 bp, Rattus norvegicus
ttcccttttcttcctgattgtggat

SEQ ID NO: 668430 - DNA, 25 bp, Rattus norvegicus
ttcccttttcttgctgattgtggat

SEQ ID NO: 668431 - DNA, 25 bp, Rattus norvegicus
ttcccttttgacaccgatgctatta

SEQ ID NO: 668432 - DNA, 25 bp, Rattus norvegicus
ttcccttttgactccgatgctatta

SEQ ID NO: 668433 - DNA, 25 bp, Rattus norvegicus
ttcccttttgctagtgcggctgtgg

SEQ ID NO: 668434 - DNA, 25 bp, Rattus norvegicus
ttcccttttgcttgtgcggctgtgg

SEQ ID NO: 668435 - DNA, 25 bp, Rattus norvegicus
ttccctttttggagtattatctgag

SEQ ID NO: 668436 - DNA, 25 bp, Rattus norvegicus
ttccctttttggtgtattatctgag

SEQ ID NO: 668437 - DNA, 25 bp, Rattus norvegicus
ttccgaacacagaaaggcccagagt

SEQ ID NO: 668438 - DNA, 25 bp, Rattus norvegicus
ttccgaacacagtaaggcccagagt

SEQ ID NO: 668439 - DNA, 25 bp, Rattus norvegicus
ttccgaacattcctcatcttgggac

SEQ ID NO: 668440 - DNA, 25 bp, Rattus norvegicus
ttccgaacattcgtcatcttgggac

SEQ ID NO: 668441 - DNA, 25 bp, Rattus norvegicus
ttccgaacttcccagatggctgaga

SEQ ID NO: 668442 - DNA, 25 bp, Rattus norvegicus
ttccgaacttccgagatggctgaga

SEQ ID NO: 668443 - DNA, 25 bp, Rattus norvegicus
ttccgaagaccgaacccagcggtgt

SEQ ID NO: 668444 - DNA, 25 bp, Rattus norvegicus
ttccgaagaccgtacccagcggtgt

SEQ ID NO: 668445 - DNA, 25 bp, Rattus norvegicus
ttccgaagcgttcccatttgtctca

SEQ ID NO: 668446 - DNA, 25 bp, Rattus norvegicus
ttccgaagcgttgccatttgtctca

SEQ ID NO: 668447 - DNA, 25 bp, Rattus norvegicus
ttccgaagggcaaccagatccaaga

SEQ ID NO: 668448 - DNA, 25 bp, Rattus norvegicus
ttccgaagggcatccagatccaaga

SEQ ID NO: 668449 - DNA, 25 bp, Rattus norvegicus
ttccgaatacatcccatgccttagt

SEQ ID NO: 668450 - DNA, 25 bp, Rattus norvegicus
ttccgaatacatgccatgccttagt

SEQ ID NO: 668451 - DNA, 25 bp, Rattus norvegicus
ttccgaattctcaagctggccagac

SEQ ID NO: 668452 - DNA, 25 bp, Rattus norvegicus
ttccgaattctctagctggccagac

SEQ ID NO: 668453 - DNA, 25 bp, Rattus norvegicus
ttccgacatgtaagtgcttgcctgc

SEQ ID NO: 668454 - DNA, 25 bp, Rattus norvegicus
ttccgacatgtatgtgcttgcctgc

SEQ ID NO: 668455 - DNA, 25 bp, Rattus norvegicus
ttccgaccctggattctcacaaagg

SEQ ID NO: 668456 - DNA, 25 bp, Rattus norvegicus
ttccgaccctggtttctcacaaagg

SEQ ID NO: 668457 - DNA, 25 bp, Rattus norvegicus
ttccgacctggcactatagcttttc

SEQ ID NO: 668458 - DNA, 25 bp, Rattus norvegicus
ttccgacctggctctatagcttttc

SEQ ID NO: 668459 - DNA, 25 bp, Rattus norvegicus
ttccgacctgtgactcaagaagaag

SEQ ID NO: 668460 - DNA, 25 bp, Rattus norvegicus
ttccgacctgtgtctcaagaagaag

SEQ ID NO: 668461 - DNA, 25 bp, Rattus norvegicus
ttccgactattcagccatgccaata

SEQ ID NO: 668462 - DNA, 25 bp, Rattus norvegicus
ttccgactattctgccatgccaata

SEQ ID NO: 668463 - DNA, 25 bp, Rattus norvegicus
ttccgactcgtactgaaagcctaga

SEQ ID NO: 668464 - DNA, 25 bp, Rattus norvegicus
ttccgactcgtagtgaaagcctaga

SEQ ID NO: 668465 - DNA, 25 bp, Rattus norvegicus
ttccgactctgaatgccaggcacga

SEQ ID NO: 668466 - DNA, 25 bp, Rattus norvegicus
ttccgactctgattgccaggcacga

SEQ ID NO: 668467 - DNA, 25 bp, Rattus norvegicus
ttccgactgaacctgtacgagctga

SEQ ID NO: 668468 - DNA, 25 bp, Rattus norvegicus
ttccgactgaacgtgtacgagctga

SEQ ID NO: 668469 - DNA, 25 bp, Rattus norvegicus
ttccgacttgctacttgcaacatag

SEQ ID NO: 668470 - DNA, 25 bp, Rattus norvegicus
ttccgacttgcttcttgcaacatag

SEQ ID NO: 668471 - DNA, 25 bp, Rattus norvegicus
ttccgagaccggaatccagatctaa

SEQ ID NO: 668472 - DNA, 25 bp, Rattus norvegicus
ttccgagaccggtatccagatctaa

SEQ ID NO: 668473 - DNA, 25 bp, Rattus norvegicus
ttccgagactagacgcccattgaat

SEQ ID NO: 668474 - DNA, 25 bp, Rattus norvegicus
ttccgagactagtcgcccattgaat

SEQ ID NO: 668475 - DNA, 25 bp, Rattus norvegicus
ttccgagactcccagaatggtggct

SEQ ID NO: 668476 - DNA, 25 bp, Rattus norvegicus
ttccgagactccgagaatggtggct

SEQ ID NO: 668477 - DNA, 25 bp, Rattus norvegicus
ttccgagagaccctagtaaagcttc

SEQ ID NO: 668478 - DNA, 25 bp, Rattus norvegicus
ttccgagagaccgtagtaaagcttc

SEQ ID NO: 668479 - DNA, 25 bp, Rattus norvegicus
ttccgagaggaaagagaccgtccca

SEQ ID NO: 668480 - DNA, 25 bp, Rattus norvegicus
ttccgagaggaatgagaccgtccca

SEQ ID NO: 668481 - DNA, 25 bp, Rattus norvegicus
ttccgagaggtgagtgcttcccaat

SEQ ID NO: 668482 - DNA, 25 bp, Rattus norvegicus
ttccgagaggtgtgtgcttcccaat

SEQ ID NO: 668483 - DNA, 25 bp, Rattus norvegicus
ttccgagagtcaagctgccgacagt

SEQ ID NO: 668484 - DNA, 25 bp, Rattus norvegicus
ttccgagagtcatgctgccgacagt

SEQ ID NO: 668485 - DNA, 25 bp, Rattus norvegicus
ttccgagagtgtactcccatgcaga

SEQ ID NO: 668486 - DNA, 25 bp, Rattus norvegicus
ttccgagagtgttctcccatgcaga

SEQ ID NO: 668487 - DNA, 25 bp, Rattus norvegicus
ttccgagatgtcctatgttcctgga

SEQ ID NO: 668488 - DNA, 25 bp, Rattus norvegicus
ttccgagatgtcgtatgttcctgga

SEQ ID NO: 668489 - DNA, 25 bp, Rattus norvegicus
ttccgagcaactaagcagcaaggac

SEQ ID NO: 668490 - DNA, 25 bp, Rattus norvegicus
ttccgagcaacttagcagcaaggac

SEQ ID NO: 668491 - DNA, 25 bp, Rattus norvegicus
ttccgagcatccacagcaaatttct

SEQ ID NO: 668492 - DNA, 25 bp, Rattus norvegicus
ttccgagcatccagcactatgagat

SEQ ID NO: 668493 - DNA, 25 bp, Rattus norvegicus
ttccgagcatcctcagcaaatttct

SEQ ID NO: 668494 - DNA, 25 bp, Rattus norvegicus
ttccgagcatcctgcactatgagat

SEQ ID NO: 668495 - DNA, 25 bp, Rattus norvegicus
ttccgagcatcgcagactcatgcaa

SEQ ID NO: 668496 - DNA, 25 bp, Rattus norvegicus
ttccgagcatcggagactcatgcaa

SEQ ID NO: 668497 - DNA, 25 bp, Rattus norvegicus
ttccgagcttgcaattaggtcactg

SEQ ID NO: 668498 - DNA, 25 bp, Rattus norvegicus
ttccgagcttgctattaggtcactg

SEQ ID NO: 668499 - DNA, 25 bp, Rattus norvegicus
ttccgaggaagcaaaggccgcgttg

SEQ ID NO: 668500 - DNA, 25 bp, Rattus norvegicus
ttccgaggaagctaaggccgcgttg

SEQ ID NO: 668501 - DNA, 25 bp, Rattus norvegicus
ttccgaggactaaagagcagcttct

SEQ ID NO: 668502 - DNA, 25 bp, Rattus norvegicus
ttccgaggactatagagcagcttct

SEQ ID NO: 668503 - DNA, 25 bp, Rattus norvegicus
ttccgaggatgcaccagtagcctgc

SEQ ID NO: 668504 - DNA, 25 bp, Rattus norvegicus
ttccgaggatgctccagtagcctgc

SEQ ID NO: 668505 - DNA, 25 bp, Rattus norvegicus
ttccgagtggcgaccttaagcccag

SEQ ID NO: 668506 - DNA, 25 bp, Rattus norvegicus
ttccgagtggcgtccttaagcccag

SEQ ID NO: 668507 - DNA, 25 bp, Rattus norvegicus
ttccgagtggctaggactgtacaga

SEQ ID NO: 668508 - DNA, 25 bp, Rattus norvegicus
ttccgagtggcttggactgtacaga

SEQ ID NO: 668509 - DNA, 25 bp, Rattus norvegicus
ttccgagttaacagaatggctcctc

SEQ ID NO: 668510 - DNA, 25 bp, Rattus norvegicus
ttccgagttaactgaatggctcctc

SEQ ID NO: 668511 - DNA, 25 bp, Rattus norvegicus
ttccgatatctcacgcaagttttat

SEQ ID NO: 668512 - DNA, 25 bp, Rattus norvegicus
ttccgatatctctcgcaagttttat

SEQ ID NO: 668513 - DNA, 25 bp, Rattus norvegicus
ttccgatgccaacttccagcctggg

SEQ ID NO: 668514 - DNA, 25 bp, Rattus norvegicus
ttccgatgccaagttccagcctggg

SEQ ID NO: 668515 - DNA, 25 bp, Rattus norvegicus
ttccgcaacggtccctgagatcaaa

SEQ ID NO: 668516 - DNA, 25 bp, Rattus norvegicus
ttccgcaacggtgcctgagatcaaa

SEQ ID NO: 668517 - DNA, 25 bp, Rattus norvegicus
ttccgcaaggctaaactgctgcact

SEQ ID NO: 668518 - DNA, 25 bp, Rattus norvegicus
ttccgcaaggcttaactgctgcact

SEQ ID NO: 668519 - DNA, 25 bp, Rattus norvegicus
ttccgcacaagcactgtgttaagat

SEQ ID NO: 668520 - DNA, 25 bp, Rattus norvegicus
ttccgcacaagctctgtgttaagat

SEQ ID NO: 668521 - DNA, 25 bp, Rattus norvegicus
ttccgcagtaaaaaattcctttcct

SEQ ID NO: 668522 - DNA, 25 bp, Rattus norvegicus
ttccgcagtaaataattcctttcct

SEQ ID NO: 668523 - DNA, 25 bp, Rattus norvegicus
ttccgcatcaccctggtacaagagg

SEQ ID NO: 668524 - DNA, 25 bp, Rattus norvegicus
ttccgcatcaccgtggtacaagagg

SEQ ID NO: 668525 - DNA, 25 bp, Rattus norvegicus
ttccgcatctgcacaatggctggca

SEQ ID NO: 668526 - DNA, 25 bp, Rattus norvegicus
ttccgcatctgctcaatggctggca

SEQ ID NO: 668527 - DNA, 25 bp, Rattus norvegicus
ttccgcatctgtcccatttaaattc

SEQ ID NO: 668528 - DNA, 25 bp, Rattus norvegicus
ttccgcatctgtgccatttaaattc

SEQ ID NO: 668529 - DNA, 25 bp, Rattus norvegicus
ttccgccatttacccacttgagtga

SEQ ID NO: 668530 - DNA, 25 bp, Rattus norvegicus
ttccgccatttagccacttgagtga

SEQ ID NO: 668531 - DNA, 25 bp, Rattus norvegicus
ttccgccatttgcatgtggtgggca

SEQ ID NO: 668532 - DNA, 25 bp, Rattus norvegicus
ttccgccatttggatgtggtgggca

SEQ ID NO: 668533 - DNA, 25 bp, Rattus norvegicus
ttccgcccaatacactctggagtgg

SEQ ID NO: 668534 - DNA, 25 bp, Rattus norvegicus
ttccgcccaatagactctggagtgg

SEQ ID NO: 668535 - DNA, 25 bp, Rattus norvegicus
ttccgcccagcaagcacattattat

SEQ ID NO: 668536 - DNA, 25 bp, Rattus norvegicus
ttccgcccagcatgcacattattat

SEQ ID NO: 668537 - DNA, 25 bp, Rattus norvegicus
ttccgccctaacacatggattgtga

SEQ ID NO: 668538 - DNA, 25 bp, Rattus norvegicus
ttccgccctaactcatggattgtga

SEQ ID NO: 668539 - DNA, 25 bp, Rattus norvegicus
ttccgccctgagcaccaatgagaga

SEQ ID NO: 668540 - DNA, 25 bp, Rattus norvegicus
ttccgccctgaggaccaatgagaga

SEQ ID NO: 668541 - DNA, 25 bp, Rattus norvegicus
ttccgccctgtgatcctgtgaatct

SEQ ID NO: 668542 - DNA, 25 bp, Rattus norvegicus
ttccgccctgtgttcctgtgaatct

SEQ ID NO: 668543 - DNA, 25 bp, Rattus norvegicus
ttccgcctcggaaaattttaactcg

SEQ ID NO: 668544 - DNA, 25 bp, Rattus norvegicus
ttccgcctcggataattttaactcg

SEQ ID NO: 668545 - DNA, 25 bp, Rattus norvegicus
ttccgcgacaaacgactcttttgca

SEQ ID NO: 668546 - DNA, 25 bp, Rattus norvegicus
ttccgcgacaaaggactcttttgca

SEQ ID NO: 668547 - DNA, 25 bp, Rattus norvegicus
ttccgcgcggcactgacctgagcga

SEQ ID NO: 668548 - DNA, 25 bp, Rattus norvegicus
ttccgcgcggcagtgacctgagcga

SEQ ID NO: 668549 - DNA, 25 bp, Rattus norvegicus
ttccgcggcatcctcgaggaccagt

SEQ ID NO: 668550 - DNA, 25 bp, Rattus norvegicus
ttccgcggcatcgtcgaggaccagt

SEQ ID NO: 668551 - DNA, 25 bp, Rattus norvegicus
ttccgcgttggaacacatacgtgta

SEQ ID NO: 668552 - DNA, 25 bp, Rattus norvegicus
ttccgcgttggatcacatacgtgta

SEQ ID NO: 668553 - DNA, 25 bp, Rattus norvegicus
ttccgctacttgcaaggcatgctag

SEQ ID NO: 668554 - DNA, 25 bp, Rattus norvegicus
ttccgctacttggaaggcatgctag

SEQ ID NO: 668555 - DNA, 25 bp, Rattus norvegicus
ttccgctagccaagagcctacgtgg

SEQ ID NO: 668556 - DNA, 25 bp, Rattus norvegicus
ttccgctagccatgagcctacgtgg

SEQ ID NO: 668557 - DNA, 25 bp, Rattus norvegicus
ttccgctcctttctatataacgcag

SEQ ID NO: 668558 - DNA, 25 bp, Rattus norvegicus
ttccgctcctttgtatataacgcag

SEQ ID NO: 668559 - DNA, 25 bp, Rattus norvegicus
ttccgctctgaacggctttctttga

SEQ ID NO: 668560 - DNA, 25 bp, Rattus norvegicus
ttccgctctgaagggctttctttga

SEQ ID NO: 668561 - DNA, 25 bp, Rattus norvegicus
ttccgctgaaagaattcccaacagt

SEQ ID NO: 668562 - DNA, 25 bp, Rattus norvegicus
ttccgctgaaagtattcccaacagt

SEQ ID NO: 668563 - DNA, 25 bp, Rattus norvegicus
ttccgctgccaactggatagtcatt

SEQ ID NO: 668564 - DNA, 25 bp, Rattus norvegicus
ttccgctgccaagtggatagtcatt

SEQ ID NO: 668565 - DNA, 25 bp, Rattus norvegicus
ttccgctgcttgattggttacctag

SEQ ID NO: 668566 - DNA, 25 bp, Rattus norvegicus
ttccgctgcttgtttggttacctag

SEQ ID NO: 668567 - DNA, 25 bp, Rattus norvegicus
ttccgctgtgccctagggtatgaat

SEQ ID NO: 668568 - DNA, 25 bp, Rattus norvegicus
ttccgctgtgccgtagggtatgaat

SEQ ID NO: 668569 - DNA, 25 bp, Rattus norvegicus
ttccgcttatagctaacagttcttg

SEQ ID NO: 668570 - DNA, 25 bp, Rattus norvegicus
ttccgcttataggtaacagttcttg

SEQ ID NO: 668571 - DNA, 25 bp, Rattus norvegicus
ttccgctttcagaatagttttgcaa

SEQ ID NO: 668572 - DNA, 25 bp, Rattus norvegicus
ttccgctttcagtatagttttgcaa

SEQ ID NO: 668573 - DNA, 25 bp, Rattus norvegicus
ttccgctttcatcacttttcttttt

SEQ ID NO: 668574 - DNA, 25 bp, Rattus norvegicus
ttccgctttcatgacttttcttttt

SEQ ID NO: 668575 - DNA, 25 bp, Rattus norvegicus
ttccggaaatgaccgtttcagtaat

SEQ ID NO: 668576 - DNA, 25 bp, Rattus norvegicus
ttccggaaatgagcgtttcagtaat

SEQ ID NO: 668577 - DNA, 25 bp, Rattus norvegicus
ttccggaagctgaactgctccttta

SEQ ID NO: 668578 - DNA, 25 bp, Rattus norvegicus
ttccggaagctgtactgctccttta

SEQ ID NO: 668579 - DNA, 25 bp, Rattus norvegicus
ttccggacccagctaaagggcaagt

SEQ ID NO: 668580 - DNA, 25 bp, Rattus norvegicus
ttccggacccaggtaaagggcaagt

SEQ ID NO: 668581 - DNA, 25 bp, Rattus norvegicus
ttccggactaaacgtgcagcttcca

SEQ ID NO: 668582 - DNA, 25 bp, Rattus norvegicus
ttccggactaaaggtgcagcttcca

SEQ ID NO: 668583 - DNA, 25 bp, Rattus norvegicus
ttccggactctcacaggtaaccaga

SEQ ID NO: 668584 - DNA, 25 bp, Rattus norvegicus
ttccggactctctcaggtaaccaga

SEQ ID NO: 668585 - DNA, 25 bp, Rattus norvegicus
ttccggagcatgaaactctggtttt

SEQ ID NO: 668586 - DNA, 25 bp, Rattus norvegicus
ttccggagcatgtaactctggtttt

SEQ ID NO: 668587 - DNA, 25 bp, Rattus norvegicus
ttccggagcctccacattagcataa

SEQ ID NO: 668588 - DNA, 25 bp, Rattus norvegicus
ttccggagcctcgacattagcataa

SEQ ID NO: 668589 - DNA, 25 bp, Rattus norvegicus
ttccggagggttatccaggagcttc

SEQ ID NO: 668590 - DNA, 25 bp, Rattus norvegicus
ttccggagggttttccaggagcttc

SEQ ID NO: 668591 - DNA, 25 bp, Rattus norvegicus
ttccggagtcccaagaggttccaca

SEQ ID NO: 668592 - DNA, 25 bp, Rattus norvegicus
ttccggagtccctagaggttccaca

SEQ ID NO: 668593 - DNA, 25 bp, Rattus norvegicus
ttccggatgctccaggccgaaggat

SEQ ID NO: 668594 - DNA, 25 bp, Rattus norvegicus
ttccggatgctcgaggccgaaggat

SEQ ID NO: 668595 - DNA, 25 bp, Rattus norvegicus
ttccggcaggctatgtatcatatca

SEQ ID NO: 668596 - DNA, 25 bp, Rattus norvegicus
ttccggcaggctttgtatcatatca

SEQ ID NO: 668597 - DNA, 25 bp, Rattus norvegicus
ttccggcaggtccaaggctcagaga

SEQ ID NO: 668598 - DNA, 25 bp, Rattus norvegicus
ttccggcaggtcgaaggctcagaga

SEQ ID NO: 668599 - DNA, 25 bp, Rattus norvegicus
ttccggcagtttcgctaccaggatg

SEQ ID NO: 668600 - DNA, 25 bp, Rattus norvegicus
ttccggcagtttggctaccaggatg

SEQ ID NO: 668601 - DNA, 25 bp, Rattus norvegicus
ttccggcatatcacatgaagctgga

SEQ ID NO: 668602 - DNA, 25 bp, Rattus norvegicus
ttccggcatatctcatgaagctgga

SEQ ID NO: 668603 - DNA, 25 bp, Rattus norvegicus
ttccggcatgttccagtcaagagtg

SEQ ID NO: 668604 - DNA, 25 bp, Rattus norvegicus
ttccggcatgttgcagtcaagagtg

SEQ ID NO: 668605 - DNA, 25 bp, Rattus norvegicus
ttccggcccatgaagcacataactt

SEQ ID NO: 668606 - DNA, 25 bp, Rattus norvegicus
ttccggcccatgtagcacataactt

SEQ ID NO: 668607 - DNA, 25 bp, Rattus norvegicus
ttccggcccgggagacaggttgcct

SEQ ID NO: 668608 - DNA, 25 bp, Rattus norvegicus
ttccggcccgggtgacaggttgcct

SEQ ID NO: 668609 - DNA, 25 bp, Rattus norvegicus
ttccggcgcataaagtcagcaaggt

SEQ ID NO: 668610 - DNA, 25 bp, Rattus norvegicus
ttccggcgcatatagtcagcaaggt

SEQ ID NO: 668611 - DNA, 25 bp, Rattus norvegicus
ttccggcgggatatcagagcccagt

SEQ ID NO: 668612 - DNA, 25 bp, Rattus norvegicus
ttccggcgggatttcagagcccagt

SEQ ID NO: 668613 - DNA, 25 bp, Rattus norvegicus
ttccggctctatcatgttccatgat

SEQ ID NO: 668614 - DNA, 25 bp, Rattus norvegicus
ttccggctctatcgacactgggtga

SEQ ID NO: 668615 - DNA, 25 bp, Rattus norvegicus
ttccggctctatgatgttccatgat

SEQ ID NO: 668616 - DNA, 25 bp, Rattus norvegicus
ttccggctctatggacactgggtga

SEQ ID NO: 668617 - DNA, 25 bp, Rattus norvegicus
ttccggcttctgacacatgctatgt

SEQ ID NO: 668618 - DNA, 25 bp, Rattus norvegicus
ttccggcttctgtcacatgctatgt

SEQ ID NO: 668619 - DNA, 25 bp, Rattus norvegicus
ttccgggaacatatccttatactgt

SEQ ID NO: 668620 - DNA, 25 bp, Rattus norvegicus
ttccgggaacatttccttatactgt

SEQ ID NO: 668621 - DNA, 25 bp, Rattus norvegicus
ttccgggacgcgcacgcatcttaga

SEQ ID NO: 668622 - DNA, 25 bp, Rattus norvegicus
ttccgggacgcggacgcatcttaga

SEQ ID NO: 668623 - DNA, 25 bp, Rattus norvegicus
ttccgggactcaaacactgcttagg

SEQ ID NO: 668624 - DNA, 25 bp, Rattus norvegicus
ttccgggactcatacactgcttagg

SEQ ID NO: 668625 - DNA, 25 bp, Rattus norvegicus
ttccgggagaaactggcctatgcca

SEQ ID NO: 668626 - DNA, 25 bp, Rattus norvegicus
ttccgggagaaagtggcctatgcca

SEQ ID NO: 668627 - DNA, 25 bp, Rattus norvegicus
ttccgggagcacatggttcgagaca

SEQ ID NO: 668628 - DNA, 25 bp, Rattus norvegicus
ttccgggagcacttggttcgagaca

SEQ ID NO: 668629 - DNA, 25 bp, Rattus norvegicus
ttccgggagctaatatttcactatg

SEQ ID NO: 668630 - DNA, 25 bp, Rattus norvegicus
ttccgggagctattatttcactatg

SEQ ID NO: 668631 - DNA, 25 bp, Rattus norvegicus
ttccgggagctgctgagcaaccaaa

SEQ ID NO: 668632 - DNA, 25 bp, Rattus norvegicus
ttccgggagctggtgagcaaccaaa

SEQ ID NO: 668633 - DNA, 25 bp, Rattus norvegicus
ttccgggatctcatgttcttatcaa

SEQ ID NO: 668634 - DNA, 25 bp, Rattus norvegicus
ttccgggatctcttgttcttatcaa

SEQ ID NO: 668635 - DNA, 25 bp, Rattus norvegicus
ttccgggatttccactttgtggcag

SEQ ID NO: 668636 - DNA, 25 bp, Rattus norvegicus
ttccgggatttcgactttgtggcag

SEQ ID NO: 668637 - DNA, 25 bp, Rattus norvegicus
ttccgggcctgaagcctatgaggaa

SEQ ID NO: 668638 - DNA, 25 bp, Rattus norvegicus
ttccgggcctgatgcctatgaggaa

SEQ ID NO: 668639 - DNA, 25 bp, Rattus norvegicus
ttccgggcgatcacaagcacaagga

SEQ ID NO: 668640 - DNA, 25 bp, Rattus norvegicus
ttccgggcgatctcaagcacaagga

SEQ ID NO: 668641 - DNA, 25 bp, Rattus norvegicus
ttccgggctcaaagacaagggttcg

SEQ ID NO: 668642 - DNA, 25 bp, Rattus norvegicus
ttccgggctcaatgacaagggttcg

SEQ ID NO: 668643 - DNA, 25 bp, Rattus norvegicus
ttccgggtacgactatgataaacat

SEQ ID NO: 668644 - DNA, 25 bp, Rattus norvegicus
ttccgggtacgagtatgataaacat

SEQ ID NO: 668645 - DNA, 25 bp, Rattus norvegicus
ttccgggtagaaagaaatggctcag

SEQ ID NO: 668646 - DNA, 25 bp, Rattus norvegicus
ttccgggtagaatgaaatggctcag

SEQ ID NO: 668647 - DNA, 25 bp, Rattus norvegicus
ttccgggttctaatctgttctaagg

SEQ ID NO: 668648 - DNA, 25 bp, Rattus norvegicus
ttccgggttctattctgttctaagg

SEQ ID NO: 668649 - DNA, 25 bp, Rattus norvegicus
ttccgggtttaccattattgggcat

SEQ ID NO: 668650 - DNA, 25 bp, Rattus norvegicus
ttccgggtttacgattattgggcat

SEQ ID NO: 668651 - DNA, 25 bp, Rattus norvegicus
ttccggtagcttattgcttgttttg

SEQ ID NO: 668652 - DNA, 25 bp, Rattus norvegicus
ttccggtagctttttgcttgttttg

SEQ ID NO: 668653 - DNA, 25 bp, Rattus norvegicus
ttccggtagtgccttgtgagctcat

SEQ ID NO: 668654 - DNA, 25 bp, Rattus norvegicus
ttccggtagtgcgttgtgagctcat

SEQ ID NO: 668655 - DNA, 25 bp, Rattus norvegicus
ttccggtatcttctcagtgagcaca

SEQ ID NO: 668656 - DNA, 25 bp, Rattus norvegicus
ttccggtatcttgtcagtgagcaca

SEQ ID NO: 668657 - DNA, 25 bp, Rattus norvegicus
ttccggtcagctctatggcctcaga

SEQ ID NO: 668658 - DNA, 25 bp, Rattus norvegicus
ttccggtcagctgtatggcctcaga

SEQ ID NO: 668659 - DNA, 25 bp, Rattus norvegicus
ttccggtcctgtcctgtacagatgc

SEQ ID NO: 668660 - DNA, 25 bp, Rattus norvegicus
ttccggtcctgtgctgtacagatgc

SEQ ID NO: 668661 - DNA, 25 bp, Rattus norvegicus
ttccggtctgagctatgctgggatc

SEQ ID NO: 668662 - DNA, 25 bp, Rattus norvegicus
ttccggtctgaggtatgctgggatc

SEQ ID NO: 668663 - DNA, 25 bp, Rattus norvegicus
ttccggtgatctatctcgattccat

SEQ ID NO: 668664 - DNA, 25 bp, Rattus norvegicus
ttccggtgatctttctcgattccat

SEQ ID NO: 668665 - DNA, 25 bp, Rattus norvegicus
ttccggtgcgtgcaatagccatgga

SEQ ID NO: 668666 - DNA, 25 bp, Rattus norvegicus
ttccggtgcgtggaatagccatgga

SEQ ID NO: 668667 - DNA, 25 bp, Rattus norvegicus
ttccggtgcttaaaagtttcttcag

SEQ ID NO: 668668 - DNA, 25 bp, Rattus norvegicus
ttccggtgcttataagtttcttcag

SEQ ID NO: 668669 - DNA, 25 bp, Rattus norvegicus
ttccggtggacacagacgagcgcat

SEQ ID NO: 668670 - DNA, 25 bp, Rattus norvegicus
ttccggtggacagagacgagcgcat

SEQ ID NO: 668671 - DNA, 25 bp, Rattus norvegicus
ttccggttcattatacttgattctt

SEQ ID NO: 668672 - DNA, 25 bp, Rattus norvegicus
ttccggttcattttacttgattctt

SEQ ID NO: 668673 - DNA, 25 bp, Rattus norvegicus
ttccggttcttacctacactttcta

SEQ ID NO: 668674 - DNA, 25 bp, Rattus norvegicus
ttccggttcttagctacactttcta

SEQ ID NO: 668675 - DNA, 25 bp, Rattus norvegicus
ttccggttgttgagcttgtctgagc

SEQ ID NO: 668676 - DNA, 25 bp, Rattus norvegicus
ttccggttgttgtgcttgtctgagc

SEQ ID NO: 668677 - DNA, 25 bp, Rattus norvegicus
ttccgtaacaccagtaagtccccat

SEQ ID NO: 668678 - DNA, 25 bp, Rattus norvegicus
ttccgtaacacctgtaagtccccat

SEQ ID NO: 668679 - DNA, 25 bp, Rattus norvegicus
ttccgtaagaccaaggcagctccct

SEQ ID NO: 668680 - DNA, 25 bp, Rattus norvegicus
ttccgtaagacctaggcagctccct

SEQ ID NO: 668681 - DNA, 25 bp, Rattus norvegicus
ttccgtacatctcggttcttaactg

SEQ ID NO: 668682 - DNA, 25 bp, Rattus norvegicus
ttccgtacatctgggttcttaactg

SEQ ID NO: 668683 - DNA, 25 bp, Rattus norvegicus
ttccgtagatcaccaggtagggcat

SEQ ID NO: 668684 - DNA, 25 bp, Rattus norvegicus
ttccgtagatcagcaggtagggcat

SEQ ID NO: 668685 - DNA, 25 bp, Rattus norvegicus
ttccgtagctctctctatgaagggt

SEQ ID NO: 668686 - DNA, 25 bp, Rattus norvegicus
ttccgtagctctgtctatgaagggt

SEQ ID NO: 668687 - DNA, 25 bp, Rattus norvegicus
ttccgtaggagcacctgttgccgag

SEQ ID NO: 668688 - DNA, 25 bp, Rattus norvegicus
ttccgtaggagctcctgttgccgag

SEQ ID NO: 668689 - DNA, 25 bp, Rattus norvegicus
ttccgtaggcctagctgtattttga

SEQ ID NO: 668690 - DNA, 25 bp, Rattus norvegicus
ttccgtaggccttgctgtattttga

SEQ ID NO: 668691 - DNA, 25 bp, Rattus norvegicus
ttccgtagggttccgcctggcccag

SEQ ID NO: 668692 - DNA, 25 bp, Rattus norvegicus
ttccgtagggttgcgcctggcccag

SEQ ID NO: 668693 - DNA, 25 bp, Rattus norvegicus
ttccgtatccgcacaaatttaacca

SEQ ID NO: 668694 - DNA, 25 bp, Rattus norvegicus
ttccgtatccgctcaaatttaacca

SEQ ID NO: 668695 - DNA, 25 bp, Rattus norvegicus
ttccgtatgtatctccttctcaagc

SEQ ID NO: 668696 - DNA, 25 bp, Rattus norvegicus
ttccgtatgtatgtccttctcaagc

SEQ ID NO: 668697 - DNA, 25 bp, Rattus norvegicus
ttccgtattcatcatatcgctgtgg

SEQ ID NO: 668698 - DNA, 25 bp, Rattus norvegicus
ttccgtattcatgatatcgctgtgg

SEQ ID NO: 668699 - DNA, 25 bp, Rattus norvegicus
ttccgtcatgttagacttggcctga

SEQ ID NO: 668700 - DNA, 25 bp, Rattus norvegicus
ttccgtcatgtttgacttggcctga

SEQ ID NO: 668701 - DNA, 25 bp, Rattus norvegicus
ttccgtcccagaattcagacttgga

SEQ ID NO: 668702 - DNA, 25 bp, Rattus norvegicus
ttccgtcccagatttcagacttgga

SEQ ID NO: 668703 - DNA, 25 bp, Rattus norvegicus
ttccgtcctgccaacagagtcgaaa

SEQ ID NO: 668704 - DNA, 25 bp, Rattus norvegicus
ttccgtcctgcctacagagtcgaaa

SEQ ID NO: 668705 - DNA, 25 bp, Rattus norvegicus
ttccgtccttgtaatcagcactggg

SEQ ID NO: 668706 - DNA, 25 bp, Rattus norvegicus
ttccgtccttgttatcagcactggg

SEQ ID NO: 668707 - DNA, 25 bp, Rattus norvegicus
ttccgtctaaggctttgcactttat

SEQ ID NO: 668708 - DNA, 25 bp, Rattus norvegicus
ttccgtctaagggtttgcactttat

SEQ ID NO: 668709 - DNA, 25 bp, Rattus norvegicus
ttccgtctatttacgcggtttactg

SEQ ID NO: 668710 - DNA, 25 bp, Rattus norvegicus
ttccgtctattttcgcggtttactg

SEQ ID NO: 668711 - DNA, 25 bp, Rattus norvegicus
ttccgtctcctgagtgtgtaataaa

SEQ ID NO: 668712 - DNA, 25 bp, Rattus norvegicus
ttccgtctcctgtgtgtgtaataaa

SEQ ID NO: 668713 - DNA, 25 bp, Rattus norvegicus
ttccgtctctgccactctcggagaa

SEQ ID NO: 668714 - DNA, 25 bp, Rattus norvegicus
ttccgtctctgcgactctcggagaa

SEQ ID NO: 668715 - DNA, 25 bp, Rattus norvegicus
ttccgtctgatcaatgacaccaagg

SEQ ID NO: 668716 - DNA, 25 bp, Rattus norvegicus
ttccgtctgatctatgacaccaagg

SEQ ID NO: 668717 - DNA, 25 bp, Rattus norvegicus
ttccgtctgccaagctcaaagcgaa

SEQ ID NO: 668718 - DNA, 25 bp, Rattus norvegicus
ttccgtctgccatgctcaaagcgaa

SEQ ID NO: 668719 - DNA, 25 bp, Rattus norvegicus
ttccgtctgtctcctcctttgaaag

SEQ ID NO: 668720 - DNA, 25 bp, Rattus norvegicus
ttccgtctgtctgctcctttgaaag

SEQ ID NO: 668721 - DNA, 25 bp, Rattus norvegicus
ttccgtcttaccctaactgggatga

SEQ ID NO: 668722 - DNA, 25 bp, Rattus norvegicus
ttccgtcttaccgtaactgggatga

SEQ ID NO: 668723 - DNA, 25 bp, Rattus norvegicus
ttccgtcttagtctcaaaaggtagt

SEQ ID NO: 668724 - DNA, 25 bp, Rattus norvegicus
ttccgtcttagtgtcaaaaggtagt

SEQ ID NO: 668725 - DNA, 25 bp, Rattus norvegicus
ttccgtgaggatcagcttctgtgct

SEQ ID NO: 668726 - DNA, 25 bp, Rattus norvegicus
ttccgtgaggatgagcttctgtgct

SEQ ID NO: 668727 - DNA, 25 bp, Rattus norvegicus
ttccgtgcagccctgtgcttggact

SEQ ID NO: 668728 - DNA, 25 bp, Rattus norvegicus
ttccgtgcagccgtgtgcttggact

SEQ ID NO: 668729 - DNA, 25 bp, Rattus norvegicus
ttccgtgcgcccacaatgaaagagc

SEQ ID NO: 668730 - DNA, 25 bp, Rattus norvegicus
ttccgtgcgccctcaatgaaagagc

SEQ ID NO: 668731 - DNA, 25 bp, Rattus norvegicus
ttccgtgctcggaccgggttgctgt

SEQ ID NO: 668732 - DNA, 25 bp, Rattus norvegicus
ttccgtgctcggtccgggttgctgt

SEQ ID NO: 668733 - DNA, 25 bp, Rattus norvegicus
ttccgtggctgacaatgcctcatca

SEQ ID NO: 668734 - DNA, 25 bp, Rattus norvegicus
ttccgtggctgagaatgcctcatca

SEQ ID NO: 668735 - DNA, 25 bp, Rattus norvegicus
ttccgtgtgaacagtttgtgtgtct

SEQ ID NO: 668736 - DNA, 25 bp, Rattus norvegicus
ttccgtgtgaactgtttgtgtgtct

SEQ ID NO: 668737 - DNA, 25 bp, Rattus norvegicus
ttccgtgtttacagtgagccgatca

SEQ ID NO: 668738 - DNA, 25 bp, Rattus norvegicus
ttccgtgtttactgtgagccgatca

SEQ ID NO: 668739 - DNA, 25 bp, Rattus norvegicus
ttccgttcctttataatcctatcag

SEQ ID NO: 668740 - DNA, 25 bp, Rattus norvegicus
ttccgttcctttttaatcctatcag

SEQ ID NO: 668741 - DNA, 25 bp, Rattus norvegicus
ttccgttcttttctctgatggcaca

SEQ ID NO: 668742 - DNA, 25 bp, Rattus norvegicus
ttccgttcttttgtctgatggcaca

SEQ ID NO: 668743 - DNA, 25 bp, Rattus norvegicus
ttccgttgcattcaggtaatccaga

SEQ ID NO: 668744 - DNA, 25 bp, Rattus norvegicus
ttccgttgcattgaggtaatccaga

SEQ ID NO: 668745 - DNA, 25 bp, Rattus norvegicus
ttccgttggcccagcgatgctgagt

SEQ ID NO: 668746 - DNA, 25 bp, Rattus norvegicus
ttccgttggccctgcgatgctgagt

SEQ ID NO: 668747 - DNA, 25 bp, Rattus norvegicus
ttccgttgggagctttttcagtcag

SEQ ID NO: 668748 - DNA, 25 bp, Rattus norvegicus
ttccgttgggaggtttttcagtcag

SEQ ID NO: 668749 - DNA, 25 bp, Rattus norvegicus
ttccgtttctgcagttatttccaca

SEQ ID NO: 668750 - DNA, 25 bp, Rattus norvegicus
ttccgtttctgctgttatttccaca

SEQ ID NO: 668751 - DNA, 25 bp, Rattus norvegicus
ttccgtttgacccagcacagaaata

SEQ ID NO: 668752 - DNA, 25 bp, Rattus norvegicus
ttccgtttgaccgagcacagaaata

SEQ ID NO: 668753 - DNA, 25 bp, Rattus norvegicus
ttccgtttggtaagtctaccgctga

SEQ ID NO: 668754 - DNA, 25 bp, Rattus norvegicus
ttccgtttggtatgtctaccgctga

SEQ ID NO: 668755 - DNA, 25 bp, Rattus norvegicus
ttccgttttaacaggctgtaattct

SEQ ID NO: 668756 - DNA, 25 bp, Rattus norvegicus
ttccgttttaactggctgtaattct

SEQ ID NO: 668757 - DNA, 25 bp, Rattus norvegicus
ttccgttttcgacctgagatcttga

SEQ ID NO: 668758 - DNA, 25 bp, Rattus norvegicus
ttccgttttcgagctgagatcttga

SEQ ID NO: 668759 - DNA, 25 bp, Rattus norvegicus
ttccgttttggtattatagtgtctg

SEQ ID NO: 668760 - DNA, 25 bp, Rattus norvegicus
ttccgttttggttttatagtgtctg

SEQ ID NO: 668761 - DNA, 25 bp, Rattus norvegicus
ttcctaaaggttcaggcccagtcct

SEQ ID NO: 668762 - DNA, 25 bp, Rattus norvegicus
ttcctaaaggttgaggcccagtcct

SEQ ID NO: 668763 - DNA, 25 bp, Rattus norvegicus
ttcctaaccaggatcattctgtatt

SEQ ID NO: 668764 - DNA, 25 bp, Rattus norvegicus
ttcctaaccaggttcattctgtatt

SEQ ID NO: 668765 - DNA, 25 bp, Rattus norvegicus
ttcctaaccattaatcaacgctggg

SEQ ID NO: 668766 - DNA, 25 bp, Rattus norvegicus
ttcctaaccatttatcaacgctggg

SEQ ID NO: 668767 - DNA, 25 bp, Rattus norvegicus
ttcctaacccagactcacagtttat

SEQ ID NO: 668768 - DNA, 25 bp, Rattus norvegicus
ttcctaacccagtctcacagtttat

SEQ ID NO: 668769 - DNA, 25 bp, Rattus norvegicus
ttcctaactcatacatgtactcctc

SEQ ID NO: 668770 - DNA, 25 bp, Rattus norvegicus
ttcctaactcattcatgtactcctc

SEQ ID NO: 668771 - DNA, 25 bp, Rattus norvegicus
ttcctaactctgaatttatgctctc

SEQ ID NO: 668772 - DNA, 25 bp, Rattus norvegicus
ttcctaactctgtatttatgctctc

SEQ ID NO: 668773 - DNA, 25 bp, Rattus norvegicus
ttcctaacttatataaacttggcat

SEQ ID NO: 668774 - DNA, 25 bp, Rattus norvegicus
ttcctaacttatttaaacttggcat

SEQ ID NO: 668775 - DNA, 25 bp, Rattus norvegicus
ttcctaagacctagtcctcaaactt

SEQ ID NO: 668776 - DNA, 25 bp, Rattus norvegicus
ttcctaagaccttgtcctcaaactt

SEQ ID NO: 668777 - DNA, 25 bp, Rattus norvegicus
ttcctaagggctccatacttcacag

SEQ ID NO: 668778 - DNA, 25 bp, Rattus norvegicus
ttcctaagggctgcatacttcacag

SEQ ID NO: 668779 - DNA, 25 bp, Rattus norvegicus
ttcctaagttgccagggagcacgta

SEQ ID NO: 668780 - DNA, 25 bp, Rattus norvegicus
ttcctaagttgcgagggagcacgta

SEQ ID NO: 668781 - DNA, 25 bp, Rattus norvegicus
ttcctaatgctgatcctcagcggat

SEQ ID NO: 668782 - DNA, 25 bp, Rattus norvegicus
ttcctaatgctgttcctcagcggat

SEQ ID NO: 668783 - DNA, 25 bp, Rattus norvegicus
ttcctaattcttactgtggtgtaag

SEQ ID NO: 668784 - DNA, 25 bp, Rattus norvegicus
ttcctaattctttctgtggtgtaag

SEQ ID NO: 668785 - DNA, 25 bp, Rattus norvegicus
ttcctaatttctcacccatctctat

SEQ ID NO: 668786 - DNA, 25 bp, Rattus norvegicus
ttcctaatttctgacccatctctat

SEQ ID NO: 668787 - DNA, 25 bp, Rattus norvegicus
ttcctacacaaacctccttgagagt

SEQ ID NO: 668788 - DNA, 25 bp, Rattus norvegicus
ttcctacacaaagctccttgagagt

SEQ ID NO: 668789 - DNA, 25 bp, Rattus norvegicus
ttcctacacatgactctgagccatg

SEQ ID NO: 668790 - DNA, 25 bp, Rattus norvegicus
ttcctacacatgtctctgagccatg

SEQ ID NO: 668791 - DNA, 25 bp, Rattus norvegicus
ttcctacagacaatccagggaccaa

SEQ ID NO: 668792 - DNA, 25 bp, Rattus norvegicus
ttcctacagacattccagggaccaa

SEQ ID NO: 668793 - DNA, 25 bp, Rattus norvegicus
ttcctacaggatataccccagtggc

SEQ ID NO: 668794 - DNA, 25 bp, Rattus norvegicus
ttcctacaggatttaccccagtggc

SEQ ID NO: 668795 - DNA, 25 bp, Rattus norvegicus
ttcctacaggccaaacccgagaagg

SEQ ID NO: 668796 - DNA, 25 bp, Rattus norvegicus
ttcctacaggcctaacccgagaagg

SEQ ID NO: 668797 - DNA, 25 bp, Rattus norvegicus
ttcctacagtgcacacggttcaacc

SEQ ID NO: 668798 - DNA, 25 bp, Rattus norvegicus
ttcctacagtgctcacggttcaacc

SEQ ID NO: 668799 - DNA, 25 bp, Rattus norvegicus
ttcctaccctacactgtaattttca

SEQ ID NO: 668800 - DNA, 25 bp, Rattus norvegicus
ttcctaccctactctgtaattttca

SEQ ID NO: 668801 - DNA, 25 bp, Rattus norvegicus
ttcctaccctcaatatttggaacat

SEQ ID NO: 668802 - DNA, 25 bp, Rattus norvegicus
ttcctaccctcattatttggaacat

SEQ ID NO: 668803 - DNA, 25 bp, Rattus norvegicus
ttcctacctggaccaaactatcctt

SEQ ID NO: 668804 - DNA, 25 bp, Rattus norvegicus
ttcctacctggagcaaactatcctt

SEQ ID NO: 668805 - DNA, 25 bp, Rattus norvegicus
ttcctacggtagactgttgccacag

SEQ ID NO: 668806 - DNA, 25 bp, Rattus norvegicus
ttcctacggtagtctgttgccacag

SEQ ID NO: 668807 - DNA, 25 bp, Rattus norvegicus
ttcctacgtgttccgcaggctgtaa

SEQ ID NO: 668808 - DNA, 25 bp, Rattus norvegicus
ttcctacgtgttgcgcaggctgtaa

SEQ ID NO: 668809 - DNA, 25 bp, Rattus norvegicus
ttcctacgttggacagctcaaagct

SEQ ID NO: 668810 - DNA, 25 bp, Rattus norvegicus
ttcctacgttggtcagctcaaagct

SEQ ID NO: 668811 - DNA, 25 bp, Rattus norvegicus
ttcctactagggagtactacagtct

SEQ ID NO: 668812 - DNA, 25 bp, Rattus norvegicus
ttcctactagggtgtactacagtct

SEQ ID NO: 668813 - DNA, 25 bp, Rattus norvegicus
ttcctacttcctctggccagatgag

SEQ ID NO: 668814 - DNA, 25 bp, Rattus norvegicus
ttcctacttcctgtggccagatgag

SEQ ID NO: 668815 - DNA, 25 bp, Rattus norvegicus
ttcctagaagccagacgcagcacac

SEQ ID NO: 668816 - DNA, 25 bp, Rattus norvegicus
ttcctagaagcctgacgcagcacac

SEQ ID NO: 668817 - DNA, 25 bp, Rattus norvegicus
ttcctagaatgtatgcttgcctctg

SEQ ID NO: 668818 - DNA, 25 bp, Rattus norvegicus
ttcctagaatgtttgcttgcctctg

SEQ ID NO: 668819 - DNA, 25 bp, Rattus norvegicus
ttcctagaatttcgaggcctcttca

SEQ ID NO: 668820 - DNA, 25 bp, Rattus norvegicus
ttcctagaatttggaggcctcttca

SEQ ID NO: 668821 - DNA, 25 bp, Rattus norvegicus
ttcctagagaacattccctgcagag

SEQ ID NO: 668822 - DNA, 25 bp, Rattus norvegicus
ttcctagagaactttccctgcagag

SEQ ID NO: 668823 - DNA, 25 bp, Rattus norvegicus
ttcctagaggataggattcccagca

SEQ ID NO: 668824 - DNA, 25 bp, Rattus norvegicus
ttcctagaggattggattcccagca

SEQ ID NO: 668825 - DNA, 25 bp, Rattus norvegicus
ttcctagagttgacatgccttcggc

SEQ ID NO: 668826 - DNA, 25 bp, Rattus norvegicus
ttcctagagttgtcatgccttcggc

SEQ ID NO: 668827 - DNA, 25 bp, Rattus norvegicus
ttcctagatgttccctcttcctgta

SEQ ID NO: 668828 - DNA, 25 bp, Rattus norvegicus
ttcctagatgttgcctcttcctgta

SEQ ID NO: 668829 - DNA, 25 bp, Rattus norvegicus
ttcctagattgcatctgctggtctt

SEQ ID NO: 668830 - DNA, 25 bp, Rattus norvegicus
ttcctagattgcttctgctggtctt

SEQ ID NO: 668831 - DNA, 25 bp, Rattus norvegicus
ttcctagcagacctttcatacctaa

SEQ ID NO: 668832 - DNA, 25 bp, Rattus norvegicus
ttcctagcagacgtttcatacctaa

SEQ ID NO: 668833 - DNA, 25 bp, Rattus norvegicus
ttcctagcattcatgttttcttctg

SEQ ID NO: 668834 - DNA, 25 bp, Rattus norvegicus
ttcctagcattcttgttttcttctg

SEQ ID NO: 668835 - DNA, 25 bp, Rattus norvegicus
ttcctagccgccagcagtgggaggt

SEQ ID NO: 668836 - DNA, 25 bp, Rattus norvegicus
ttcctagccgcctgcagtgggaggt

SEQ ID NO: 668837 - DNA, 25 bp, Rattus norvegicus
ttcctagcctgtccctatttgtgca

SEQ ID NO: 668838 - DNA, 25 bp, Rattus norvegicus
ttcctagcctgtgcctatttgtgca

SEQ ID NO: 668839 - DNA, 25 bp, Rattus norvegicus
ttcctagctcaccaaatacacaaac

SEQ ID NO: 668840 - DNA, 25 bp, Rattus norvegicus
ttcctagctcacgaaatacacaaac

SEQ ID NO: 668841 - DNA, 25 bp, Rattus norvegicus
ttcctagctttcagaacagcaaata

SEQ ID NO: 668842 - DNA, 25 bp, Rattus norvegicus
ttcctagctttctgaacagcaaata

SEQ ID NO: 668843 - DNA, 25 bp, Rattus norvegicus
ttcctaggaggacagttgcacaagt

SEQ ID NO: 668844 - DNA, 25 bp, Rattus norvegicus
ttcctaggaggagagttgcacaagt

SEQ ID NO: 668845 - DNA, 25 bp, Rattus norvegicus
ttcctagtaagtccacgtaagtcag

SEQ ID NO: 668846 - DNA, 25 bp, Rattus norvegicus
ttcctagtaagtgcacgtaagtcag

SEQ ID NO: 668847 - DNA, 25 bp, Rattus norvegicus
ttcctagtcagacggagctgccatc

SEQ ID NO: 668848 - DNA, 25 bp, Rattus norvegicus
ttcctagtcagagggagctgccatc

SEQ ID NO: 668849 - DNA, 25 bp, Rattus norvegicus
ttcctagtccctccagaacaactga

SEQ ID NO: 668850 - DNA, 25 bp, Rattus norvegicus
ttcctagtccctgcagaacaactga

SEQ ID NO: 668851 - DNA, 25 bp, Rattus norvegicus
ttcctagtcttaatcctaatctctt

SEQ ID NO: 668852 - DNA, 25 bp, Rattus norvegicus
ttcctagtcttattcctaatctctt

SEQ ID NO: 668853 - DNA, 25 bp, Rattus norvegicus
ttcctagtgaagcataccccacaca

SEQ ID NO: 668854 - DNA, 25 bp, Rattus norvegicus
ttcctagtgaaggataccccacaca

SEQ ID NO: 668855 - DNA, 25 bp, Rattus norvegicus
ttcctagtgactccgatgtttggca

SEQ ID NO: 668856 - DNA, 25 bp, Rattus norvegicus
ttcctagtgactgcgatgtttggca

SEQ ID NO: 668857 - DNA, 25 bp, Rattus norvegicus
ttcctagttgttcccttcagactca

SEQ ID NO: 668858 - DNA, 25 bp, Rattus norvegicus
ttcctagttgttgccttcagactca

SEQ ID NO: 668859 - DNA, 25 bp, Rattus norvegicus
ttcctagtttctccagcatatagta

SEQ ID NO: 668860 - DNA, 25 bp, Rattus norvegicus
ttcctagtttctgcagcatatagta

SEQ ID NO: 668861 - DNA, 25 bp, Rattus norvegicus
ttcctataaatcatccagtgcgtca

SEQ ID NO: 668862 - DNA, 25 bp, Rattus norvegicus
ttcctataaatcttccagtgcgtca

SEQ ID NO: 668863 - DNA, 25 bp, Rattus norvegicus
ttcctatacattctcaccatcattg

SEQ ID NO: 668864 - DNA, 25 bp, Rattus norvegicus
ttcctatacattgtcaccatcattg

SEQ ID NO: 668865 - DNA, 25 bp, Rattus norvegicus
ttcctatcacagagctgccatgatg

SEQ ID NO: 668866 - DNA, 25 bp, Rattus norvegicus
ttcctatcacagtgctgccatgatg

SEQ ID NO: 668867 - DNA, 25 bp, Rattus norvegicus
ttcctatcccatacttctacaagat

SEQ ID NO: 668868 - DNA, 25 bp, Rattus norvegicus
ttcctatcccattcttctacaagat

SEQ ID NO: 668869 - DNA, 25 bp, Rattus norvegicus
ttcctatcggctatcagactgctga

SEQ ID NO: 668870 - DNA, 25 bp, Rattus norvegicus
ttcctatcggctttcagactgctga

SEQ ID NO: 668871 - DNA, 25 bp, Rattus norvegicus
ttcctatctatcatcttcccctggt

SEQ ID NO: 668872 - DNA, 25 bp, Rattus norvegicus
ttcctatctatcttcttcccctggt

SEQ ID NO: 668873 - DNA, 25 bp, Rattus norvegicus
ttcctatcttccatcctttgtcact

SEQ ID NO: 668874 - DNA, 25 bp, Rattus norvegicus
ttcctatcttccttcctttgtcact

SEQ ID NO: 668875 - DNA, 25 bp, Rattus norvegicus
ttcctatgcaggatgtgaagccgca

SEQ ID NO: 668876 - DNA, 25 bp, Rattus norvegicus
ttcctatgcaggttgtgaagccgca

SEQ ID NO: 668877 - DNA, 25 bp, Rattus norvegicus
ttcctatgcccgagggcatgcatgt

SEQ ID NO: 668878 - DNA, 25 bp, Rattus norvegicus
ttcctatgcccgtgggcatgcatgt

SEQ ID NO: 668879 - DNA, 25 bp, Rattus norvegicus
ttcctatgctggactcctagtgtgc

SEQ ID NO: 668880 - DNA, 25 bp, Rattus norvegicus
ttcctatgctggtctcctagtgtgc

SEQ ID NO: 668881 - DNA, 25 bp, Rattus norvegicus
ttcctatggagtagcaatccccttt

SEQ ID NO: 668882 - DNA, 25 bp, Rattus norvegicus
ttcctatggagttgcaatccccttt

SEQ ID NO: 668883 - DNA, 25 bp, Rattus norvegicus
ttcctatggatgatgctatactggt

SEQ ID NO: 668884 - DNA, 25 bp, Rattus norvegicus
ttcctatggatgttgctatactggt

SEQ ID NO: 668885 - DNA, 25 bp, Rattus norvegicus
ttcctatgttagcttgatgtttctg

SEQ ID NO: 668886 - DNA, 25 bp, Rattus norvegicus
ttcctatgttaggttgatgtttctg

SEQ ID NO: 668887 - DNA, 25 bp, Rattus norvegicus
ttcctattagacctatgcatttatg

SEQ ID NO: 668888 - DNA, 25 bp, Rattus norvegicus
ttcctattagacgtatgcatttatg

SEQ ID NO: 668889 - DNA, 25 bp, Rattus norvegicus
ttcctattcttcctaaccgtgggag

SEQ ID NO: 668890 - DNA, 25 bp, Rattus norvegicus
ttcctattcttcgtaaccgtgggag

SEQ ID NO: 668891 - DNA, 25 bp, Rattus norvegicus
ttcctattgctcatccttgtggaaa

SEQ ID NO: 668892 - DNA, 25 bp, Rattus norvegicus
ttcctattgctcttccttgtggaaa

SEQ ID NO: 668893 - DNA, 25 bp, Rattus norvegicus
ttcctatttagaaacttgctggtat

SEQ ID NO: 668894 - DNA, 25 bp, Rattus norvegicus
ttcctatttagatacttgctggtat

SEQ ID NO: 668895 - DNA, 25 bp, Rattus norvegicus
ttcctatttatgagaccctgttcct

SEQ ID NO: 668896 - DNA, 25 bp, Rattus norvegicus
ttcctatttatgtgaccctgttcct

SEQ ID NO: 668897 - DNA, 25 bp, Rattus norvegicus
ttcctatttcctactctctgaagat

SEQ ID NO: 668898 - DNA, 25 bp, Rattus norvegicus
ttcctatttccttctctctgaagat

SEQ ID NO: 668899 - DNA, 25 bp, Rattus norvegicus
ttcctcaaaggtaacgtcatcgctg

SEQ ID NO: 668900 - DNA, 25 bp, Rattus norvegicus
ttcctcaaaggttacgtcatcgctg

SEQ ID NO: 668901 - DNA, 25 bp, Rattus norvegicus
ttcctcaacactcctactgctgctg

SEQ ID NO: 668902 - DNA, 25 bp, Rattus norvegicus
ttcctcaacactgctactgctgctg

SEQ ID NO: 668903 - DNA, 25 bp, Rattus norvegicus
ttcctcaacattatccggagaaaga

SEQ ID NO: 668904 - DNA, 25 bp, Rattus norvegicus
ttcctcaacattttccggagaaaga

SEQ ID NO: 668905 - DNA, 25 bp, Rattus norvegicus
ttcctcaaccggcagtggcaacagc

SEQ ID NO: 668906 - DNA, 25 bp, Rattus norvegicus
ttcctcaaccgggagtggcaacagc

SEQ ID NO: 668907 - DNA, 25 bp, Rattus norvegicus
ttcctcaacgaccaaatgctcttta

SEQ ID NO: 668908 - DNA, 25 bp, Rattus norvegicus
ttcctcaacgacgaaatgctcttta

SEQ ID NO: 668909 - DNA, 25 bp, Rattus norvegicus
ttcctcaacgttccttttggcctga

SEQ ID NO: 668910 - DNA, 25 bp, Rattus norvegicus
ttcctcaacgttgcttttggcctga

SEQ ID NO: 668911 - DNA, 25 bp, Rattus norvegicus
ttcctcaactttatcaggttcctgg

SEQ ID NO: 668912 - DNA, 25 bp, Rattus norvegicus
ttcctcaactttttcaggttcctgg

SEQ ID NO: 668913 - DNA, 25 bp, Rattus norvegicus
ttcctcaagaataccttgggctggt

SEQ ID NO: 668914 - DNA, 25 bp, Rattus norvegicus
ttcctcaagaattccttgggctggt

SEQ ID NO: 668915 - DNA, 25 bp, Rattus norvegicus
ttcctcaagagcagtgtttctgtct

SEQ ID NO: 668916 - DNA, 25 bp, Rattus norvegicus
ttcctcaagagctgtgtttctgtct

SEQ ID NO: 668917 - DNA, 25 bp, Rattus norvegicus
ttcctcaagcatcagctcacatctg

SEQ ID NO: 668918 - DNA, 25 bp, Rattus norvegicus
ttcctcaagcatgagctcacatctg

SEQ ID NO: 668919 - DNA, 25 bp, Rattus norvegicus
ttcctcaaggaactcgaactgactt

SEQ ID NO: 668920 - DNA, 25 bp, Rattus norvegicus
ttcctcaaggaagtcgaactgactt

SEQ ID NO: 668921 - DNA, 25 bp, Rattus norvegicus
ttcctcaagggcacgagcgttggat

SEQ ID NO: 668922 - DNA, 25 bp, Rattus norvegicus
ttcctcaagggctcgagcgttggat

SEQ ID NO: 668923 - DNA, 25 bp, Rattus norvegicus
ttcctcaagttgacctgtgatctct

SEQ ID NO: 668924 - DNA, 25 bp, Rattus norvegicus
ttcctcaagttgtcctgtgatctct

SEQ ID NO: 668925 - DNA, 25 bp, Rattus norvegicus
ttcctcacaagtattatacccacac

SEQ ID NO: 668926 - DNA, 25 bp, Rattus norvegicus
ttcctcacaagttttatacccacac

SEQ ID NO: 668927 - DNA, 25 bp, Rattus norvegicus
ttcctcacaattccctacctgaaat

SEQ ID NO: 668928 - DNA, 25 bp, Rattus norvegicus
ttcctcacaattgcctacctgaaat

SEQ ID NO: 668929 - DNA, 25 bp, Rattus norvegicus
ttcctcacacccagggaaatagctc

SEQ ID NO: 668930 - DNA, 25 bp, Rattus norvegicus
ttcctcacaccctgggaaatagctc

SEQ ID NO: 668931 - DNA, 25 bp, Rattus norvegicus
ttcctcacatcactctgtatggcaa

SEQ ID NO: 668932 - DNA, 25 bp, Rattus norvegicus
ttcctcacatcagtctgtatggcaa

SEQ ID NO: 668933 - DNA, 25 bp, Rattus norvegicus
ttcctcacattgacacttgttcctg

SEQ ID NO: 668934 - DNA, 25 bp, Rattus norvegicus
ttcctcacattgtcacttgttcctg

SEQ ID NO: 668935 - DNA, 25 bp, Rattus norvegicus
ttcctcacctggctgtagtgtgatg

SEQ ID NO: 668936 - DNA, 25 bp, Rattus norvegicus
ttcctcacctgggtgtagtgtgatg

SEQ ID NO: 668937 - DNA, 25 bp, Rattus norvegicus
ttcctcacgtgaattggccacagtt

SEQ ID NO: 668938 - DNA, 25 bp, Rattus norvegicus
ttcctcacgtgatttggccacagtt

SEQ ID NO: 668939 - DNA, 25 bp, Rattus norvegicus
ttcctcactcacacagaaaggtctg

SEQ ID NO: 668940 - DNA, 25 bp, Rattus norvegicus
ttcctcactcactcagaaaggtctg

SEQ ID NO: 668941 - DNA, 25 bp, Rattus norvegicus
ttcctcactttacctatcatatgct

SEQ ID NO: 668942 - DNA, 25 bp, Rattus norvegicus
ttcctcactttagctatcatatgct

SEQ ID NO: 668943 - DNA, 25 bp, Rattus norvegicus
ttcctcagacggatgcaaactgttg

SEQ ID NO: 668944 - DNA, 25 bp, Rattus norvegicus
ttcctcagacggttgcaaactgttg

SEQ ID NO: 668945 - DNA, 25 bp, Rattus norvegicus
ttcctcagaggacccggcagcagtt

SEQ ID NO: 668946 - DNA, 25 bp, Rattus norvegicus
ttcctcagaggagccggcagcagtt

SEQ ID NO: 668947 - DNA, 25 bp, Rattus norvegicus
ttcctcagcaacataaaccgggcat

SEQ ID NO: 668948 - DNA, 25 bp, Rattus norvegicus
ttcctcagcaacctcacaagtagtt

SEQ ID NO: 668949 - DNA, 25 bp, Rattus norvegicus
ttcctcagcaacgtcacaagtagtt

SEQ ID NO: 668950 - DNA, 25 bp, Rattus norvegicus
ttcctcagcaacttaaaccgggcat

SEQ ID NO: 668951 - DNA, 25 bp, Rattus norvegicus
ttcctcagcctaacctattaatgtg

SEQ ID NO: 668952 - DNA, 25 bp, Rattus norvegicus
ttcctcagcctatcctattaatgtg

SEQ ID NO: 668953 - DNA, 25 bp, Rattus norvegicus
ttcctcagcctcactttcaataaaa

SEQ ID NO: 668954 - DNA, 25 bp, Rattus norvegicus
ttcctcagcctctctttcaataaaa

SEQ ID NO: 668955 - DNA, 25 bp, Rattus norvegicus
ttcctcagctacactgtgggtggtt

SEQ ID NO: 668956 - DNA, 25 bp, Rattus norvegicus
ttcctcagctactctgtgggtggtt

SEQ ID NO: 668957 - DNA, 25 bp, Rattus norvegicus
ttcctcagggagcagtgtggttatt

SEQ ID NO: 668958 - DNA, 25 bp, Rattus norvegicus
ttcctcagggaggagtgtggttatt

SEQ ID NO: 668959 - DNA, 25 bp, Rattus norvegicus
ttcctcagggctaccacagtgacaa

SEQ ID NO: 668960 - DNA, 25 bp, Rattus norvegicus
ttcctcagggcttccacagtgacaa

SEQ ID NO: 668961 - DNA, 25 bp, Rattus norvegicus
ttcctcatcagtcaaattactcggt

SEQ ID NO: 668962 - DNA, 25 bp, Rattus norvegicus
ttcctcatcagtgaaattactcggt

SEQ ID NO: 668963 - DNA, 25 bp, Rattus norvegicus
ttcctcatcttcatgtagctctaag

SEQ ID NO: 668964 - DNA, 25 bp, Rattus norvegicus
ttcctcatcttcttgtagctctaag

SEQ ID NO: 668965 - DNA, 25 bp, Rattus norvegicus
ttcctcatgggtaccacttcagtag

SEQ ID NO: 668966 - DNA, 25 bp, Rattus norvegicus
ttcctcatgggtcttcctctaactg

SEQ ID NO: 668967 - DNA, 25 bp, Rattus norvegicus
ttcctcatgggtgttcctctaactg

SEQ ID NO: 668968 - DNA, 25 bp, Rattus norvegicus
ttcctcatgggttccacttcagtag

SEQ ID NO: 668969 - DNA, 25 bp, Rattus norvegicus
ttcctcattgagaaccatgacccct

SEQ ID NO: 668970 - DNA, 25 bp, Rattus norvegicus
ttcctcattgagtaccatgacccct

SEQ ID NO: 668971 - DNA, 25 bp, Rattus norvegicus
ttcctcattggcacagctgcttcta

SEQ ID NO: 668972 - DNA, 25 bp, Rattus norvegicus
ttcctcattggctcagctgcttcta

SEQ ID NO: 668973 - DNA, 25 bp, Rattus norvegicus
ttcctccaaaatacagcttcaaagt

SEQ ID NO: 668974 - DNA, 25 bp, Rattus norvegicus
ttcctccaaaattcagcttcaaagt

SEQ ID NO: 668975 - DNA, 25 bp, Rattus norvegicus
ttcctccaacagagacaactgtcct

SEQ ID NO: 668976 - DNA, 25 bp, Rattus norvegicus
ttcctccaacagtgacaactgtcct

SEQ ID NO: 668977 - DNA, 25 bp, Rattus norvegicus
ttcctccaacttcgtataacctttg

SEQ ID NO: 668978 - DNA, 25 bp, Rattus norvegicus
ttcctccaacttggtataacctttg

SEQ ID NO: 668979 - DNA, 25 bp, Rattus norvegicus
ttcctccaagacactgcgggtcaga

SEQ ID NO: 668980 - DNA, 25 bp, Rattus norvegicus
ttcctccaagactctgcgggtcaga

SEQ ID NO: 668981 - DNA, 25 bp, Rattus norvegicus
ttcctccaaggaaatgttctattcg

SEQ ID NO: 668982 - DNA, 25 bp, Rattus norvegicus
ttcctccaaggatatgttctattcg

SEQ ID NO: 668983 - DNA, 25 bp, Rattus norvegicus
ttcctccaataacctaagtgcctga

SEQ ID NO: 668984 - DNA, 25 bp, Rattus norvegicus
ttcctccaataagctaagtgcctga

SEQ ID NO: 668985 - DNA, 25 bp, Rattus norvegicus
ttcctccaatcacctagtagtctat

SEQ ID NO: 668986 - DNA, 25 bp, Rattus norvegicus
ttcctccaatcagctagtagtctat

SEQ ID NO: 668987 - DNA, 25 bp, Rattus norvegicus
ttcctccaatggaaagtctcctttc

SEQ ID NO: 668988 - DNA, 25 bp, Rattus norvegicus
ttcctccaatggtaagtctcctttc

SEQ ID NO: 668989 - DNA, 25 bp, Rattus norvegicus
ttcctccacaccatagtccaggata

SEQ ID NO: 668990 - DNA, 25 bp, Rattus norvegicus
ttcctccacaccttagtccaggata

SEQ ID NO: 668991 - DNA, 25 bp, Rattus norvegicus
ttcctccacctcagagagctgctga

SEQ ID NO: 668992 - DNA, 25 bp, Rattus norvegicus
ttcctccacctctgagagctgctga

SEQ ID NO: 668993 - DNA, 25 bp, Rattus norvegicus
ttcctccacgtgcttcacattgaat

SEQ ID NO: 668994 - DNA, 25 bp, Rattus norvegicus
ttcctccacgtggttcacattgaat

SEQ ID NO: 668995 - DNA, 25 bp, Rattus norvegicus
ttcctccagaaacgcacttacagtt

SEQ ID NO: 668996 - DNA, 25 bp, Rattus norvegicus
ttcctccagaaaggcacttacagtt

SEQ ID NO: 668997 - DNA, 25 bp, Rattus norvegicus
ttcctccagctgagggtgacccatt

SEQ ID NO: 668998 - DNA, 25 bp, Rattus norvegicus
ttcctccagctgtgggtgacccatt

SEQ ID NO: 668999 - DNA, 25 bp, Rattus norvegicus
ttcctccatatcctaaaccaaagca

SEQ ID NO: 669000 - DNA, 25 bp, Rattus norvegicus
ttcctccatatcgtaaaccaaagca

SEQ ID NO: 669001 - DNA, 25 bp, Rattus norvegicus
ttcctccatcggctcacaggctgag

SEQ ID NO: 669002 - DNA, 25 bp, Rattus norvegicus
ttcctccatcgggtcacaggctgag

SEQ ID NO: 669003 - DNA, 25 bp, Rattus norvegicus
ttcctccatctcaggcgggtatgat

SEQ ID NO: 669004 - DNA, 25 bp, Rattus norvegicus
ttcctccatctctggcgggtatgat

SEQ ID NO: 669005 - DNA, 25 bp, Rattus norvegicus
ttcctccatcttagacagtgtcgtg

SEQ ID NO: 669006 - DNA, 25 bp, Rattus norvegicus
ttcctccatctttgacagtgtcgtg

SEQ ID NO: 669007 - DNA, 25 bp, Rattus norvegicus
ttcctccatgaaatttatatcctat

SEQ ID NO: 669008 - DNA, 25 bp, Rattus norvegicus
ttcctccatgaattttatatcctat

SEQ ID NO: 669009 - DNA, 25 bp, Rattus norvegicus
ttcctccatgcaccatgatttcaga

SEQ ID NO: 669010 - DNA, 25 bp, Rattus norvegicus
ttcctccatgcagcatgatttcaga

SEQ ID NO: 669011 - DNA, 25 bp, Rattus norvegicus
ttcctcccaaagaacatcatcctaa

SEQ ID NO: 669012 - DNA, 25 bp, Rattus norvegicus
ttcctcccaaagtacatcatcctaa

SEQ ID NO: 669013 - DNA, 25 bp, Rattus norvegicus
ttcctcccactaagactcacatatg

SEQ ID NO: 669014 - DNA, 25 bp, Rattus norvegicus
ttcctcccactatgactcacatatg

SEQ ID NO: 669015 - DNA, 25 bp, Rattus norvegicus
ttcctcccagcccttgatttagaag

SEQ ID NO: 669016 - DNA, 25 bp, Rattus norvegicus
ttcctcccagccgttgatttagaag

SEQ ID NO: 669017 - DNA, 25 bp, Rattus norvegicus
ttcctccccaggatcaaaggactga

SEQ ID NO: 669018 - DNA, 25 bp, Rattus norvegicus
ttcctccccaggttcaaaggactga

SEQ ID NO: 669019 - DNA, 25 bp, Rattus norvegicus
ttcctccccattacaattgctttgt

SEQ ID NO: 669020 - DNA, 25 bp, Rattus norvegicus
ttcctccccatttcaattgctttgt

SEQ ID NO: 669021 - DNA, 25 bp, Rattus norvegicus
ttcctcccctttctgctgagtagtt

SEQ ID NO: 669022 - DNA, 25 bp, Rattus norvegicus
ttcctcccctttgtgctgagtagtt

SEQ ID NO: 669023 - DNA, 25 bp, Rattus norvegicus
ttcctcccgtccatggatagataca

SEQ ID NO: 669024 - DNA, 25 bp, Rattus norvegicus
ttcctcccgtccttggatagataca

SEQ ID NO: 669025 - DNA, 25 bp, Rattus norvegicus
ttcctccctcaacgttctattgaag

SEQ ID NO: 669026 - DNA, 25 bp, Rattus norvegicus
ttcctccctcaaggttctattgaag

SEQ ID NO: 669027 - DNA, 25 bp, Rattus norvegicus
ttcctccctctcagatatttgggtg

SEQ ID NO: 669028 - DNA, 25 bp, Rattus norvegicus
ttcctccctctctgatatttgggtg

SEQ ID NO: 669029 - DNA, 25 bp, Rattus norvegicus
ttcctccgatcacaggtgctaatgt

SEQ ID NO: 669030 - DNA, 25 bp, Rattus norvegicus
ttcctccgatcagaggtgctaatgt

SEQ ID NO: 669031 - DNA, 25 bp, Rattus norvegicus
ttcctccgctggatttgatcttttt

SEQ ID NO: 669032 - DNA, 25 bp, Rattus norvegicus
ttcctccgctggttttgatcttttt

SEQ ID NO: 669033 - DNA, 25 bp, Rattus norvegicus
ttcctccggctgagacttatactgg

SEQ ID NO: 669034 - DNA, 25 bp, Rattus norvegicus
ttcctccggctgtgacttatactgg

SEQ ID NO: 669035 - DNA, 25 bp, Rattus norvegicus
ttcctccgtcagacacagaagtgga

SEQ ID NO: 669036 - DNA, 25 bp, Rattus norvegicus
ttcctccgtcagtcacagaagtgga

SEQ ID NO: 669037 - DNA, 25 bp, Rattus norvegicus
ttcctccgtggacttcaaattgcat

SEQ ID NO: 669038 - DNA, 25 bp, Rattus norvegicus
ttcctccgtggagttcaaattgcat

SEQ ID NO: 669039 - DNA, 25 bp, Rattus norvegicus
ttcctccgtgttagttcagatcatc

SEQ ID NO: 669040 - DNA, 25 bp, Rattus norvegicus
ttcctccgtgtttgttcagatcatc

SEQ ID NO: 669041 - DNA, 25 bp, Rattus norvegicus
ttcctcctagacagcaggactgcgc

SEQ ID NO: 669042 - DNA, 25 bp, Rattus norvegicus
ttcctcctagactgcaggactgcgc

SEQ ID NO: 669043 - DNA, 25 bp, Rattus norvegicus
ttcctcctagctcgtcattaaaatg

SEQ ID NO: 669044 - DNA, 25 bp, Rattus norvegicus
ttcctcctagctggtcattaaaatg

SEQ ID NO: 669045 - DNA, 25 bp, Rattus norvegicus
ttcctcctaggcacacaaaggcgga

SEQ ID NO: 669046 - DNA, 25 bp, Rattus norvegicus
ttcctcctaggcctgatcatgtgat

SEQ ID NO: 669047 - DNA, 25 bp, Rattus norvegicus
ttcctcctaggcgtgatcatgtgat

SEQ ID NO: 669048 - DNA, 25 bp, Rattus norvegicus
ttcctcctaggctcacaaaggcgga

SEQ ID NO: 669049 - DNA, 25 bp, Rattus norvegicus
ttcctcctcaggatggtgttgctga

SEQ ID NO: 669050 - DNA, 25 bp, Rattus norvegicus
ttcctcctcaggttggtgttgctga

SEQ ID NO: 669051 - DNA, 25 bp, Rattus norvegicus
ttcctcctccgaatgtggtttccag

SEQ ID NO: 669052 - DNA, 25 bp, Rattus norvegicus
ttcctcctccgattgtggtttccag

SEQ ID NO: 669053 - DNA, 25 bp, Rattus norvegicus
ttcctcctccggagccaaaggataa

SEQ ID NO: 669054 - DNA, 25 bp, Rattus norvegicus
ttcctcctccggtgccaaaggataa

SEQ ID NO: 669055 - DNA, 25 bp, Rattus norvegicus
ttcctcctcctactgcaatttttca

SEQ ID NO: 669056 - DNA, 25 bp, Rattus norvegicus
ttcctcctcctagtgcaatttttca

SEQ ID NO: 669057 - DNA, 25 bp, Rattus norvegicus
ttcctcctcctcattgatagacaag

SEQ ID NO: 669058 - DNA, 25 bp, Rattus norvegicus
ttcctcctcctctttgatagacaag

SEQ ID NO: 669059 - DNA, 25 bp, Rattus norvegicus
ttcctcctcgtactcagtgtcatga

SEQ ID NO: 669060 - DNA, 25 bp, Rattus norvegicus
ttcctcctcgtagtcagtgtcatga

SEQ ID NO: 669061 - DNA, 25 bp, Rattus norvegicus
ttcctcctctacctttggccaatgg

SEQ ID NO: 669062 - DNA, 25 bp, Rattus norvegicus
ttcctcctctacgtttggccaatgg

SEQ ID NO: 669063 - DNA, 25 bp, Rattus norvegicus
ttcctcctctcacacatagtgcttt

SEQ ID NO: 669064 - DNA, 25 bp, Rattus norvegicus
ttcctcctctcagacatagtgcttt

SEQ ID NO: 669065 - DNA, 25 bp, Rattus norvegicus
ttcctcctcttaataattaaacttg

SEQ ID NO: 669066 - DNA, 25 bp, Rattus norvegicus
ttcctcctcttattaattaaacttg

SEQ ID NO: 669067 - DNA, 25 bp, Rattus norvegicus
ttcctcctgactcggccattgtttt

SEQ ID NO: 669068 - DNA, 25 bp, Rattus norvegicus
ttcctcctgactgggccattgtttt

SEQ ID NO: 669069 - DNA, 25 bp, Rattus norvegicus
ttcctcctgagcagcaaccatagta

SEQ ID NO: 669070 - DNA, 25 bp, Rattus norvegicus
ttcctcctgagctgcaaccatagta

SEQ ID NO: 669071 - DNA, 25 bp, Rattus norvegicus
ttcctcctgagtatccttctaagta

SEQ ID NO: 669072 - DNA, 25 bp, Rattus norvegicus
ttcctcctgagtcctagtgttaaca

SEQ ID NO: 669073 - DNA, 25 bp, Rattus norvegicus
ttcctcctgagtgctagtgttaaca

SEQ ID NO: 669074 - DNA, 25 bp, Rattus norvegicus
ttcctcctgagtttccttctaagta

SEQ ID NO: 669075 - DNA, 25 bp, Rattus norvegicus
ttcctcctgcacacctggtagagta

SEQ ID NO: 669076 - DNA, 25 bp, Rattus norvegicus
ttcctcctgcactcctggtagagta

SEQ ID NO: 669077 - DNA, 25 bp, Rattus norvegicus
ttcctcctggatatgcagcctgagc

SEQ ID NO: 669078 - DNA, 25 bp, Rattus norvegicus
ttcctcctggatttgcagcctgagc

SEQ ID NO: 669079 - DNA, 25 bp, Rattus norvegicus
ttcctcctggtgatgatgatgactt

SEQ ID NO: 669080 - DNA, 25 bp, Rattus norvegicus
ttcctcctggtgttgatgatgactt

SEQ ID NO: 669081 - DNA, 25 bp, Rattus norvegicus
ttcctcctgtcaagtcttgtacttg

SEQ ID NO: 669082 - DNA, 25 bp, Rattus norvegicus
ttcctcctgtcatgtcttgtacttg

SEQ ID NO: 669083 - DNA, 25 bp, Rattus norvegicus
ttcctcctgtgcctcaagttgatgg

SEQ ID NO: 669084 - DNA, 25 bp, Rattus norvegicus
ttcctcctgtgcgtcaagttgatgg

SEQ ID NO: 669085 - DNA, 25 bp, Rattus norvegicus
ttcctccttcggctcttggtgcctg

SEQ ID NO: 669086 - DNA, 25 bp, Rattus norvegicus
ttcctccttcgggtcttggtgcctg

SEQ ID NO: 669087 - DNA, 25 bp, Rattus norvegicus
ttcctccttgtgaagcttgacatta

SEQ ID NO: 669088 - DNA, 25 bp, Rattus norvegicus
ttcctccttgtgtagcttgacatta

SEQ ID NO: 669089 - DNA, 25 bp, Rattus norvegicus
ttcctcctttataatagttcgccca

SEQ ID NO: 669090 - DNA, 25 bp, Rattus norvegicus
ttcctcctttattatagttcgccca

SEQ ID NO: 669091 - DNA, 25 bp, Rattus norvegicus
ttcctcctttcaagtcctttatata

SEQ ID NO: 669092 - DNA, 25 bp, Rattus norvegicus
ttcctcctttcatgtcctttatata

SEQ ID NO: 669093 - DNA, 25 bp, Rattus norvegicus
ttcctcctttccagtaactctatat

SEQ ID NO: 669094 - DNA, 25 bp, Rattus norvegicus
ttcctcctttcctgtaactctatat

SEQ ID NO: 669095 - DNA, 25 bp, Rattus norvegicus
ttcctcctttgaatgcggcacttga

SEQ ID NO: 669096 - DNA, 25 bp, Rattus norvegicus
ttcctcctttgattgcggcacttga

SEQ ID NO: 669097 - DNA, 25 bp, Rattus norvegicus
ttcctccttttgacttattaactga

SEQ ID NO: 669098 - DNA, 25 bp, Rattus norvegicus
ttcctccttttgatccttcatagga

SEQ ID NO: 669099 - DNA, 25 bp, Rattus norvegicus
ttcctccttttgtcttattaactga

SEQ ID NO: 669100 - DNA, 25 bp, Rattus norvegicus
ttcctccttttgttccttcatagga

SEQ ID NO: 669101 - DNA, 25 bp, Rattus norvegicus
ttcctcgacgtgaagataccttgtg

SEQ ID NO: 669102 - DNA, 25 bp, Rattus norvegicus
ttcctcgacgtgtagataccttgtg

SEQ ID NO: 669103 - DNA, 25 bp, Rattus norvegicus
ttcctcgagaagaacttggttcctt

SEQ ID NO: 669104 - DNA, 25 bp, Rattus norvegicus
ttcctcgagaagtacttggttcctt

SEQ ID NO: 669105 - DNA, 25 bp, Rattus norvegicus
ttcctcgatctcacctggcagaaga

SEQ ID NO: 669106 - DNA, 25 bp, Rattus norvegicus
ttcctcgatctctcctggcagaaga

SEQ ID NO: 669107 - DNA, 25 bp, Rattus norvegicus
ttcctcgcctccctagaagagaatt

SEQ ID NO: 669108 - DNA, 25 bp, Rattus norvegicus
ttcctcgcctccgtagaagagaatt

SEQ ID NO: 669109 - DNA, 25 bp, Rattus norvegicus
ttcctcgcctttagggtgacacaac

SEQ ID NO: 669110 - DNA, 25 bp, Rattus norvegicus
ttcctcgccttttgggtgacacaac

SEQ ID NO: 669111 - DNA, 25 bp, Rattus norvegicus
ttcctcgcttagctgtgtaggccag

SEQ ID NO: 669112 - DNA, 25 bp, Rattus norvegicus
ttcctcgcttaggtgtgtaggccag

SEQ ID NO: 669113 - DNA, 25 bp, Rattus norvegicus
ttcctcggctgtctcaatgtcaaag

SEQ ID NO: 669114 - DNA, 25 bp, Rattus norvegicus
ttcctcggctgtgtcaatgtcaaag

SEQ ID NO: 669115 - DNA, 25 bp, Rattus norvegicus
ttcctcgggcagactgctgagttaa

SEQ ID NO: 669116 - DNA, 25 bp, Rattus norvegicus
ttcctcgggcagtctgctgagttaa

SEQ ID NO: 669117 - DNA, 25 bp, Rattus norvegicus
ttcctcgggctcctgaattcatttg

SEQ ID NO: 669118 - DNA, 25 bp, Rattus norvegicus
ttcctcgggctcgtgaattcatttg

SEQ ID NO: 669119 - DNA, 25 bp, Rattus norvegicus
ttcctcggtgctaacacactttaca

SEQ ID NO: 669120 - DNA, 25 bp, Rattus norvegicus
ttcctcggtgcttacacactttaca

SEQ ID NO: 669121 - DNA, 25 bp, Rattus norvegicus
ttcctcggtggtaaagaagacctgt

SEQ ID NO: 669122 - DNA, 25 bp, Rattus norvegicus
ttcctcggtggttaagaagacctgt

SEQ ID NO: 669123 - DNA, 25 bp, Rattus norvegicus
ttcctcggtgtgagaagtgctgtgc

SEQ ID NO: 669124 - DNA, 25 bp, Rattus norvegicus
ttcctcggtgtgtgaagtgctgtgc

SEQ ID NO: 669125 - DNA, 25 bp, Rattus norvegicus
ttcctcgtatccagagttctacagt

SEQ ID NO: 669126 - DNA, 25 bp, Rattus norvegicus
ttcctcgtatcctgagttctacagt

SEQ ID NO: 669127 - DNA, 25 bp, Rattus norvegicus
ttcctcgtcgcacgcttcactaagg

SEQ ID NO: 669128 - DNA, 25 bp, Rattus norvegicus
ttcctcgtcgcaggcttcactaagg

SEQ ID NO: 669129 - DNA, 25 bp, Rattus norvegicus
ttcctcgtgttgaagtgaccctcaa

SEQ ID NO: 669130 - DNA, 25 bp, Rattus norvegicus
ttcctcgtgttgtagtgaccctcaa

SEQ ID NO: 669131 - DNA, 25 bp, Rattus norvegicus
ttcctctaaggtacccatggtcgga

SEQ ID NO: 669132 - DNA, 25 bp, Rattus norvegicus
ttcctctaaggttcccatggtcgga

SEQ ID NO: 669133 - DNA, 25 bp, Rattus norvegicus
ttcctctacatgctctgcagggatg

SEQ ID NO: 669134 - DNA, 25 bp, Rattus norvegicus
ttcctctacatggtctgcagggatg

SEQ ID NO: 669135 - DNA, 25 bp, Rattus norvegicus
ttcctctactaaccgagtttgtttg

SEQ ID NO: 669136 - DNA, 25 bp, Rattus norvegicus
ttcctctactaagcgagtttgtttg

SEQ ID NO: 669137 - DNA, 25 bp, Rattus norvegicus
ttcctctactgtcggaaagccatgt

SEQ ID NO: 669138 - DNA, 25 bp, Rattus norvegicus
ttcctctactgtgggaaagccatgt

SEQ ID NO: 669139 - DNA, 25 bp, Rattus norvegicus
ttcctctagcacaaacatgctccaa

SEQ ID NO: 669140 - DNA, 25 bp, Rattus norvegicus
ttcctctagcactaacatgctccaa

SEQ ID NO: 669141 - DNA, 25 bp, Rattus norvegicus
ttcctctagtctccatgtgtgtgag

SEQ ID NO: 669142 - DNA, 25 bp, Rattus norvegicus
ttcctctagtctgcatgtgtgtgag

SEQ ID NO: 669143 - DNA, 25 bp, Rattus norvegicus
ttcctctatctcatgctgcattgct

SEQ ID NO: 669144 - DNA, 25 bp, Rattus norvegicus
ttcctctatctcttgctgcattgct

SEQ ID NO: 669145 - DNA, 25 bp, Rattus norvegicus
ttcctctattctatgtcactcttgt

SEQ ID NO: 669146 - DNA, 25 bp, Rattus norvegicus
ttcctctattctttgtcactcttgt

SEQ ID NO: 669147 - DNA, 25 bp, Rattus norvegicus
ttcctctcaagaattcctcaggcta

SEQ ID NO: 669148 - DNA, 25 bp, Rattus norvegicus
ttcctctcaagatttcctcaggcta

SEQ ID NO: 669149 - DNA, 25 bp, Rattus norvegicus
ttcctctcaagtactctaacacaga

SEQ ID NO: 669150 - DNA, 25 bp, Rattus norvegicus
ttcctctcaagttctctaacacaga

SEQ ID NO: 669151 - DNA, 25 bp, Rattus norvegicus
ttcctctccccaacagatatttaga

SEQ ID NO: 669152 - DNA, 25 bp, Rattus norvegicus
ttcctctccccaagttcaggtgatc

SEQ ID NO: 669153 - DNA, 25 bp, Rattus norvegicus
ttcctctccccatcagatatttaga

SEQ ID NO: 669154 - DNA, 25 bp, Rattus norvegicus
ttcctctccccatgttcaggtgatc

SEQ ID NO: 669155 - DNA, 25 bp, Rattus norvegicus
ttcctctccctactgacgtggctga

SEQ ID NO: 669156 - DNA, 25 bp, Rattus norvegicus
ttcctctccctagtgacgtggctga

SEQ ID NO: 669157 - DNA, 25 bp, Rattus norvegicus
ttcctctcctcaatatggttatctg

SEQ ID NO: 669158 - DNA, 25 bp, Rattus norvegicus
ttcctctcctcattatggttatctg

SEQ ID NO: 669159 - DNA, 25 bp, Rattus norvegicus
ttcctctccttgcacagaagctgga

SEQ ID NO: 669160 - DNA, 25 bp, Rattus norvegicus
ttcctctccttggacagaagctgga

SEQ ID NO: 669161 - DNA, 25 bp, Rattus norvegicus
ttcctctctcttaagctaggccagg

SEQ ID NO: 669162 - DNA, 25 bp, Rattus norvegicus
ttcctctctctttagctaggccagg

SEQ ID NO: 669163 - DNA, 25 bp, Rattus norvegicus
ttcctctctgagcaataaccgactg

SEQ ID NO: 669164 - DNA, 25 bp, Rattus norvegicus
ttcctctctgagctcatcatgagat

SEQ ID NO: 669165 - DNA, 25 bp, Rattus norvegicus
ttcctctctgaggaataaccgactg

SEQ ID NO: 669166 - DNA, 25 bp, Rattus norvegicus
ttcctctctgaggtcatcatgagat

SEQ ID NO: 669167 - DNA, 25 bp, Rattus norvegicus
ttcctctcttgcacttagtgatggc

SEQ ID NO: 669168 - DNA, 25 bp, Rattus norvegicus
ttcctctcttgctcttagtgatggc

SEQ ID NO: 669169 - DNA, 25 bp, Rattus norvegicus
ttcctctgaaggaacaaaaactgat

SEQ ID NO: 669170 - DNA, 25 bp, Rattus norvegicus
ttcctctgaaggtacaaaaactgat

SEQ ID NO: 669171 - DNA, 25 bp, Rattus norvegicus
ttcctctgaattatcctgttagcgt

SEQ ID NO: 669172 - DNA, 25 bp, Rattus norvegicus
ttcctctgaattttcctgttagcgt

SEQ ID NO: 669173 - DNA, 25 bp, Rattus norvegicus
ttcctctgaccaagttatcgctggc

SEQ ID NO: 669174 - DNA, 25 bp, Rattus norvegicus
ttcctctgaccatgttatcgctggc

SEQ ID NO: 669175 - DNA, 25 bp, Rattus norvegicus
ttcctctgactgcagctttccaaag

SEQ ID NO: 669176 - DNA, 25 bp, Rattus norvegicus
ttcctctgactggagctttccaaag

SEQ ID NO: 669177 - DNA, 25 bp, Rattus norvegicus
ttcctctgagtcaggcttcttatga

SEQ ID NO: 669178 - DNA, 25 bp, Rattus norvegicus
ttcctctgagtctggcttcttatga

SEQ ID NO: 669179 - DNA, 25 bp, Rattus norvegicus
ttcctctgagtgacgctatgcaaaa

SEQ ID NO: 669180 - DNA, 25 bp, Rattus norvegicus
ttcctctgagtgtcgctatgcaaaa

SEQ ID NO: 669181 - DNA, 25 bp, Rattus norvegicus
ttcctctgatacctctgctgtgctg

SEQ ID NO: 669182 - DNA, 25 bp, Rattus norvegicus
ttcctctgatacgtctgctgtgctg

SEQ ID NO: 669183 - DNA, 25 bp, Rattus norvegicus
ttcctctgcatgcatggcatggcta

SEQ ID NO: 669184 - DNA, 25 bp, Rattus norvegicus
ttcctctgcatggatggcatggcta

SEQ ID NO: 669185 - DNA, 25 bp, Rattus norvegicus
ttcctctgctcacaatgtctttatg

SEQ ID NO: 669186 - DNA, 25 bp, Rattus norvegicus
ttcctctgctcagaatgtctttatg

SEQ ID NO: 669187 - DNA, 25 bp, Rattus norvegicus
ttcctctgctttaggtgtttgtaca

SEQ ID NO: 669188 - DNA, 25 bp, Rattus norvegicus
ttcctctgcttttggtgtttgtaca

SEQ ID NO: 669189 - DNA, 25 bp, Rattus norvegicus
ttcctctggatgcactctgatgata

SEQ ID NO: 669190 - DNA, 25 bp, Rattus norvegicus
ttcctctggatggactctgatgata

SEQ ID NO: 669191 - DNA, 25 bp, Rattus norvegicus
ttcctctgtcttcgctaactctagt

SEQ ID NO: 669192 - DNA, 25 bp, Rattus norvegicus
ttcctctgtcttggctaactctagt

SEQ ID NO: 669193 - DNA, 25 bp, Rattus norvegicus
ttcctctgtgtcagccacttactag

SEQ ID NO: 669194 - DNA, 25 bp, Rattus norvegicus
ttcctctgtgtctgccacttactag

SEQ ID NO: 669195 - DNA, 25 bp, Rattus norvegicus
ttcctctgttggagctaatgaccaa

SEQ ID NO: 669196 - DNA, 25 bp, Rattus norvegicus
ttcctctgttggtgctaatgaccaa

SEQ ID NO: 669197 - DNA, 25 bp, Rattus norvegicus
ttcctcttaactatggctacttgtg

SEQ ID NO: 669198 - DNA, 25 bp, Rattus norvegicus
ttcctcttaactttggctacttgtg

SEQ ID NO: 669199 - DNA, 25 bp, Rattus norvegicus
ttcctcttaggactttaaatatacg

SEQ ID NO: 669200 - DNA, 25 bp, Rattus norvegicus
ttcctcttaggagtttaaatatacg

SEQ ID NO: 669201 - DNA, 25 bp, Rattus norvegicus
ttcctcttcaccatcagtgttgggt

SEQ ID NO: 669202 - DNA, 25 bp, Rattus norvegicus
ttcctcttcaccttcagtgttgggt

SEQ ID NO: 669203 - DNA, 25 bp, Rattus norvegicus
ttcctcttcatgaatgaccctaaga

SEQ ID NO: 669204 - DNA, 25 bp, Rattus norvegicus
ttcctcttcatgtatgaccctaaga

SEQ ID NO: 669205 - DNA, 25 bp, Rattus norvegicus
ttcctcttcccaaaccagggcagag

SEQ ID NO: 669206 - DNA, 25 bp, Rattus norvegicus
ttcctcttcccataccagggcagag

SEQ ID NO: 669207 - DNA, 25 bp, Rattus norvegicus
ttcctcttccgtctgttttgagtgt

SEQ ID NO: 669208 - DNA, 25 bp, Rattus norvegicus
ttcctcttccgtgtgttttgagtgt

SEQ ID NO: 669209 - DNA, 25 bp, Rattus norvegicus
ttcctcttcctgactgaatgacttg

SEQ ID NO: 669210 - DNA, 25 bp, Rattus norvegicus
ttcctcttcctgtctgaatgacttg

SEQ ID NO: 669211 - DNA, 25 bp, Rattus norvegicus
ttcctcttccttagtcttcacaaat

SEQ ID NO: 669212 - DNA, 25 bp, Rattus norvegicus
ttcctcttcctttgtcttcacaaat

SEQ ID NO: 669213 - DNA, 25 bp, Rattus norvegicus
ttcctcttctcaaagggattctgta

SEQ ID NO: 669214 - DNA, 25 bp, Rattus norvegicus
ttcctcttctcatagggattctgta

SEQ ID NO: 669215 - DNA, 25 bp, Rattus norvegicus
ttcctcttctccaagccttgaagat

SEQ ID NO: 669216 - DNA, 25 bp, Rattus norvegicus
ttcctcttctccatagactacttaa

SEQ ID NO: 669217 - DNA, 25 bp, Rattus norvegicus
ttcctcttctcctagccttgaagat

SEQ ID NO: 669218 - DNA, 25 bp, Rattus norvegicus
ttcctcttctccttagactacttaa

SEQ ID NO: 669219 - DNA, 25 bp, Rattus norvegicus
ttcctcttcttactttggcggtgta

SEQ ID NO: 669220 - DNA, 25 bp, Rattus norvegicus
ttcctcttcttagtttggcggtgta

SEQ ID NO: 669221 - DNA, 25 bp, Rattus norvegicus
ttcctcttcttgcttatttccttaa

SEQ ID NO: 669222 - DNA, 25 bp, Rattus norvegicus
ttcctcttcttggttatttccttaa

SEQ ID NO: 669223 - DNA, 25 bp, Rattus norvegicus
ttcctcttctttagagcctttctca

SEQ ID NO: 669224 - DNA, 25 bp, Rattus norvegicus
ttcctcttcttttgagcctttctca

SEQ ID NO: 669225 - DNA, 25 bp, Rattus norvegicus
ttcctcttgagcctcttctacagca

SEQ ID NO: 669226 - DNA, 25 bp, Rattus norvegicus
ttcctcttgagcgtcttctacagca

SEQ ID NO: 669227 - DNA, 25 bp, Rattus norvegicus
ttcctcttgatactcatcgcctggg

SEQ ID NO: 669228 - DNA, 25 bp, Rattus norvegicus
ttcctcttgatagtcatcgcctggg

SEQ ID NO: 669229 - DNA, 25 bp, Rattus norvegicus
ttcctcttggatattatctgtacat

SEQ ID NO: 669230 - DNA, 25 bp, Rattus norvegicus
ttcctcttggattttatctgtacat

SEQ ID NO: 669231 - DNA, 25 bp, Rattus norvegicus
ttcctcttggcgaaggcgctgcgga

SEQ ID NO: 669232 - DNA, 25 bp, Rattus norvegicus
ttcctcttggcgatgcagagatgat

SEQ ID NO: 669233 - DNA, 25 bp, Rattus norvegicus
ttcctcttggcgtaggcgctgcgga

SEQ ID NO: 669234 - DNA, 25 bp, Rattus norvegicus
ttcctcttggcgttgcagagatgat

SEQ ID NO: 669235 - DNA, 25 bp, Rattus norvegicus
ttcctctttattaaggtgtgctcta

SEQ ID NO: 669236 - DNA, 25 bp, Rattus norvegicus
ttcctctttatttaggtgtgctcta

SEQ ID NO: 669237 - DNA, 25 bp, Rattus norvegicus
ttcctctttcaccagtcgtgtatga

SEQ ID NO: 669238 - DNA, 25 bp, Rattus norvegicus
ttcctctttcacgagtcgtgtatga

SEQ ID NO: 669239 - DNA, 25 bp, Rattus norvegicus
ttcctctttccaccttgagatgtga

SEQ ID NO: 669240 - DNA, 25 bp, Rattus norvegicus
ttcctctttccagcttgagatgtga

SEQ ID NO: 669241 - DNA, 25 bp, Rattus norvegicus
ttcctctttccgagaactgaaaagg

SEQ ID NO: 669242 - DNA, 25 bp, Rattus norvegicus
ttcctctttccgtgaactgaaaagg

SEQ ID NO: 669243 - DNA, 25 bp, Rattus norvegicus
ttcctctttgatcaatgtaccctgt

SEQ ID NO: 669244 - DNA, 25 bp, Rattus norvegicus
ttcctctttgatgaatgtaccctgt

SEQ ID NO: 669245 - DNA, 25 bp, Rattus norvegicus
ttcctctttggaatcagtcacggct

SEQ ID NO: 669246 - DNA, 25 bp, Rattus norvegicus
ttcctctttggattcagtcacggct

SEQ ID NO: 669247 - DNA, 25 bp, Rattus norvegicus
ttcctctttggcacagtaaacctgg

SEQ ID NO: 669248 - DNA, 25 bp, Rattus norvegicus
ttcctctttggctcagtaaacctgg

SEQ ID NO: 669249 - DNA, 25 bp, Rattus norvegicus
ttcctcttttccatgcccagatagg

SEQ ID NO: 669250 - DNA, 25 bp, Rattus norvegicus
ttcctcttttccttgcccagatagg

SEQ ID NO: 669251 - DNA, 25 bp, Rattus norvegicus
ttcctcttttgtactcatggcttac

SEQ ID NO: 669252 - DNA, 25 bp, Rattus norvegicus
ttcctcttttgttctcatggcttac

SEQ ID NO: 669253 - DNA, 25 bp, Rattus norvegicus
ttcctcttttttcatggcatgccat

SEQ ID NO: 669254 - DNA, 25 bp, Rattus norvegicus
ttcctcttttttgatggcatgccat

SEQ ID NO: 669255 - DNA, 25 bp, Rattus norvegicus
ttcctgaaagtgatgactcttgttc

SEQ ID NO: 669256 - DNA, 25 bp, Rattus norvegicus
ttcctgaaagtgttgactcttgttc

SEQ ID NO: 669257 - DNA, 25 bp, Rattus norvegicus
ttcctgaaagttaacattgcagtag

SEQ ID NO: 669258 - DNA, 25 bp, Rattus norvegicus
ttcctgaaagtttacattgcagtag

SEQ ID NO: 669259 - DNA, 25 bp, Rattus norvegicus
ttcctgaaattcctgattgcaacaa

SEQ ID NO: 669260 - DNA, 25 bp, Rattus norvegicus
ttcctgaaattcgtgattgcaacaa

SEQ ID NO: 669261 - DNA, 25 bp, Rattus norvegicus
ttcctgaaattgatcctgctttgtg

SEQ ID NO: 669262 - DNA, 25 bp, Rattus norvegicus
ttcctgaaattgttcctgctttgtg

SEQ ID NO: 669263 - DNA, 25 bp, Rattus norvegicus
ttcctgaaccacaacttcgacaagt

SEQ ID NO: 669264 - DNA, 25 bp, Rattus norvegicus
ttcctgaaccactacttcgacaagt

SEQ ID NO: 669265 - DNA, 25 bp, Rattus norvegicus
ttcctgaacccgcacctgatgaaga

SEQ ID NO: 669266 - DNA, 25 bp, Rattus norvegicus
ttcctgaacccggacctgatgaaga

SEQ ID NO: 669267 - DNA, 25 bp, Rattus norvegicus
ttcctgaactagataccacttcttt

SEQ ID NO: 669268 - DNA, 25 bp, Rattus norvegicus
ttcctgaactagttaccacttcttt

SEQ ID NO: 669269 - DNA, 25 bp, Rattus norvegicus
ttcctgaagcacagcgccgtactta

SEQ ID NO: 669270 - DNA, 25 bp, Rattus norvegicus
ttcctgaagcactgcgccgtactta

SEQ ID NO: 669271 - DNA, 25 bp, Rattus norvegicus
ttcctgaagcttctggattcccaaa

SEQ ID NO: 669272 - DNA, 25 bp, Rattus norvegicus
ttcctgaagcttgtggattcccaaa

SEQ ID NO: 669273 - DNA, 25 bp, Rattus norvegicus
ttcctgaagggaagctcttgtttag

SEQ ID NO: 669274 - DNA, 25 bp, Rattus norvegicus
ttcctgaagggatgctcttgtttag

SEQ ID NO: 669275 - DNA, 25 bp, Rattus norvegicus
ttcctgaagtacagagtcactaaac

SEQ ID NO: 669276 - DNA, 25 bp, Rattus norvegicus
ttcctgaagtactgagtcactaaac

SEQ ID NO: 669277 - DNA, 25 bp, Rattus norvegicus
ttcctgaagtagaccacactaaaga

SEQ ID NO: 669278 - DNA, 25 bp, Rattus norvegicus
ttcctgaagtagtccacactaaaga

SEQ ID NO: 669279 - DNA, 25 bp, Rattus norvegicus
ttcctgaatgagcatttgccgctac

SEQ ID NO: 669280 - DNA, 25 bp, Rattus norvegicus
ttcctgaatgaggatttgccgctac

SEQ ID NO: 669281 - DNA, 25 bp, Rattus norvegicus
ttcctgaattctcgactctttcatt

SEQ ID NO: 669282 - DNA, 25 bp, Rattus norvegicus
ttcctgaattctggactctttcatt

SEQ ID NO: 669283 - DNA, 25 bp, Rattus norvegicus
ttcctgaccaatcacctgacggagg

SEQ ID NO: 669284 - DNA, 25 bp, Rattus norvegicus
ttcctgaccaatgacctgacggagg

SEQ ID NO: 669285 - DNA, 25 bp, Rattus norvegicus
ttcctgaccccaagaatgacttttg

SEQ ID NO: 669286 - DNA, 25 bp, Rattus norvegicus
ttcctgaccccatgaatgacttttg

SEQ ID NO: 669287 - DNA, 25 bp, Rattus norvegicus
ttcctgactgaactgacagacgtct

SEQ ID NO: 669288 - DNA, 25 bp, Rattus norvegicus
ttcctgactgaagtgacagacgtct

SEQ ID NO: 669289 - DNA, 25 bp, Rattus norvegicus
ttcctgactgacatcatcggctggc

SEQ ID NO: 669290 - DNA, 25 bp, Rattus norvegicus
ttcctgactgacttcatcggctggc

SEQ ID NO: 669291 - DNA, 25 bp, Rattus norvegicus
ttcctgagacccagaccttttggga

SEQ ID NO: 669292 - DNA, 25 bp, Rattus norvegicus
ttcctgagaccctgaccttttggga

SEQ ID NO: 669293 - DNA, 25 bp, Rattus norvegicus
ttcctgagagcaaccgggcatcgag

SEQ ID NO: 669294 - DNA, 25 bp, Rattus norvegicus
ttcctgagagcatccgggcatcgag

SEQ ID NO: 669295 - DNA, 25 bp, Rattus norvegicus
ttcctgagcaaccttcgacgagtag

SEQ ID NO: 669296 - DNA, 25 bp, Rattus norvegicus
ttcctgagcaacgttcgacgagtag

SEQ ID NO: 669297 - DNA, 25 bp, Rattus norvegicus
ttcctgagccacacagagctgttaa

SEQ ID NO: 669298 - DNA, 25 bp, Rattus norvegicus
ttcctgagccactcagagctgttaa

SEQ ID NO: 669299 - DNA, 25 bp, Rattus norvegicus
ttcctgagctctcgaagccaggcat

SEQ ID NO: 669300 - DNA, 25 bp, Rattus norvegicus
ttcctgagctctggaagccaggcat

SEQ ID NO: 669301 - DNA, 25 bp, Rattus norvegicus
ttcctgagttggagacaccctggga

SEQ ID NO: 669302 - DNA, 25 bp, Rattus norvegicus
ttcctgagttggtgacaccctggga

SEQ ID NO: 669303 - DNA, 25 bp, Rattus norvegicus
ttcctgatatcacacccagcggatt

SEQ ID NO: 669304 - DNA, 25 bp, Rattus norvegicus
ttcctgatatcagacccagcggatt

SEQ ID NO: 669305 - DNA, 25 bp, Rattus norvegicus
ttcctgatatcccttccattgttat

SEQ ID NO: 669306 - DNA, 25 bp, Rattus norvegicus
ttcctgatatccgttccattgttat

SEQ ID NO: 669307 - DNA, 25 bp, Rattus norvegicus
ttcctgatcatcaggtcatcttcat

SEQ ID NO: 669308 - DNA, 25 bp, Rattus norvegicus
ttcctgatcatctggtcatcttcat

SEQ ID NO: 669309 - DNA, 25 bp, Rattus norvegicus
ttcctgatcctgctgagcctgggag

SEQ ID NO: 669310 - DNA, 25 bp, Rattus norvegicus
ttcctgatcctggtgagcctgggag

SEQ ID NO: 669311 - DNA, 25 bp, Rattus norvegicus
ttcctgatccttccatggtgcagat

SEQ ID NO: 669312 - DNA, 25 bp, Rattus norvegicus
ttcctgatccttgcatggtgcagat

SEQ ID NO: 669313 - DNA, 25 bp, Rattus norvegicus
ttcctgatgaggctacaacggctcc

SEQ ID NO: 669314 - DNA, 25 bp, Rattus norvegicus
ttcctgatgagggtacaacggctcc

SEQ ID NO: 669315 - DNA, 25 bp, Rattus norvegicus
ttcctgatggacactcaacgctgca

SEQ ID NO: 669316 - DNA, 25 bp, Rattus norvegicus
ttcctgatggactctcaacgctgca

SEQ ID NO: 669317 - DNA, 25 bp, Rattus norvegicus
ttcctgattacactggctaatgccc

SEQ ID NO: 669318 - DNA, 25 bp, Rattus norvegicus
ttcctgattacagtggctaatgccc

SEQ ID NO: 669319 - DNA, 25 bp, Rattus norvegicus
ttcctgattctcatccgggactcaa

SEQ ID NO: 669320 - DNA, 25 bp, Rattus norvegicus
ttcctgattctcttccgggactcaa

SEQ ID NO: 669321 - DNA, 25 bp, Rattus norvegicus
ttcctgatttatccctttgagcctg

SEQ ID NO: 669322 - DNA, 25 bp, Rattus norvegicus
ttcctgatttatgcctttgagcctg

SEQ ID NO: 669323 - DNA, 25 bp, Rattus norvegicus
ttcctgcaccctctacataatgttt

SEQ ID NO: 669324 - DNA, 25 bp, Rattus norvegicus
ttcctgcaccctgtacataatgttt

SEQ ID NO: 669325 - DNA, 25 bp, Rattus norvegicus
ttcctgcacctcattgttcattatt

SEQ ID NO: 669326 - DNA, 25 bp, Rattus norvegicus
ttcctgcacctctttgttcattatt

SEQ ID NO: 669327 - DNA, 25 bp, Rattus norvegicus
ttcctgcagcctcgcagtcagagaa

SEQ ID NO: 669328 - DNA, 25 bp, Rattus norvegicus
ttcctgcagcctggcagtcagagaa

SEQ ID NO: 669329 - DNA, 25 bp, Rattus norvegicus
ttcctgcaggaccagaaagtgaaag

SEQ ID NO: 669330 - DNA, 25 bp, Rattus norvegicus
ttcctgcaggacgagaaagtgaaag

SEQ ID NO: 669331 - DNA, 25 bp, Rattus norvegicus
ttcctgcaggtgatttcatgtcttt

SEQ ID NO: 669332 - DNA, 25 bp, Rattus norvegicus
ttcctgcaggtgttttcatgtcttt

SEQ ID NO: 669333 - DNA, 25 bp, Rattus norvegicus
ttcctgcagtacatcccagtaggta

SEQ ID NO: 669334 - DNA, 25 bp, Rattus norvegicus
ttcctgcagtacttcccagtaggta

SEQ ID NO: 669335 - DNA, 25 bp, Rattus norvegicus
ttcctgcatcacaactatctcttgt

SEQ ID NO: 669336 - DNA, 25 bp, Rattus norvegicus
ttcctgcatcactactatctcttgt

SEQ ID NO: 669337 - DNA, 25 bp, Rattus norvegicus
ttcctgcattcccagaccagtaagg

SEQ ID NO: 669338 - DNA, 25 bp, Rattus norvegicus
ttcctgcattccgagaccagtaagg

SEQ ID NO: 669339 - DNA, 25 bp, Rattus norvegicus
ttcctgccaatcagagctctagatg

SEQ ID NO: 669340 - DNA, 25 bp, Rattus norvegicus
ttcctgccaatctgagctctagatg

SEQ ID NO: 669341 - DNA, 25 bp, Rattus norvegicus
ttcctgccaccacagtgacttattg

SEQ ID NO: 669342 - DNA, 25 bp, Rattus norvegicus
ttcctgccaccagagtgacttattg

SEQ ID NO: 669343 - DNA, 25 bp, Rattus norvegicus
ttcctgccaccgagaactgaacagt

SEQ ID NO: 669344 - DNA, 25 bp, Rattus norvegicus
ttcctgccaccgtgaactgaacagt

SEQ ID NO: 669345 - DNA, 25 bp, Rattus norvegicus
ttcctgccagccagatcttatgatg

SEQ ID NO: 669346 - DNA, 25 bp, Rattus norvegicus
ttcctgccagcctgatcttatgatg

SEQ ID NO: 669347 - DNA, 25 bp, Rattus norvegicus
ttcctgccaggaaagctcattgggc

SEQ ID NO: 669348 - DNA, 25 bp, Rattus norvegicus
ttcctgccaggacttaattgtcttt

SEQ ID NO: 669349 - DNA, 25 bp, Rattus norvegicus
ttcctgccaggagttaattgtcttt

SEQ ID NO: 669350 - DNA, 25 bp, Rattus norvegicus
ttcctgccaggatagctcattgggc

SEQ ID NO: 669351 - DNA, 25 bp, Rattus norvegicus
ttcctgccagtcatcaatggcgaag

SEQ ID NO: 669352 - DNA, 25 bp, Rattus norvegicus
ttcctgccagtcttcaatggcgaag

SEQ ID NO: 669353 - DNA, 25 bp, Rattus norvegicus
ttcctgccatccacacaagtctata

SEQ ID NO: 669354 - DNA, 25 bp, Rattus norvegicus
ttcctgccatcctcacaagtctata

SEQ ID NO: 669355 - DNA, 25 bp, Rattus norvegicus
ttcctgcccacgctaatggcggcgg

SEQ ID NO: 669356 - DNA, 25 bp, Rattus norvegicus
ttcctgcccacggtaatggcggcgg

SEQ ID NO: 669357 - DNA, 25 bp, Rattus norvegicus
ttcctgccctagagtgcttgcaagg

SEQ ID NO: 669358 - DNA, 25 bp, Rattus norvegicus
ttcctgccctagtgtgcttgcaagg

SEQ ID NO: 669359 - DNA, 25 bp, Rattus norvegicus
ttcctgccctgaatttcctcaatga

SEQ ID NO: 669360 - DNA, 25 bp, Rattus norvegicus
ttcctgccctgattttcctcaatga

SEQ ID NO: 669361 - DNA, 25 bp, Rattus norvegicus
ttcctgcccttcaaatgtttggtta

SEQ ID NO: 669362 - DNA, 25 bp, Rattus norvegicus
ttcctgcccttctaatgtttggtta

SEQ ID NO: 669363 - DNA, 25 bp, Rattus norvegicus
ttcctgcccttgagccttagttagt

SEQ ID NO: 669364 - DNA, 25 bp, Rattus norvegicus
ttcctgcccttgtgccttagttagt

SEQ ID NO: 669365 - DNA, 25 bp, Rattus norvegicus
ttcctgccggatacctgttgctggg

SEQ ID NO: 669366 - DNA, 25 bp, Rattus norvegicus
ttcctgccggattcctgttgctggg

SEQ ID NO: 669367 - DNA, 25 bp, Rattus norvegicus
ttcctgccgtccaggttatcagaca

SEQ ID NO: 669368 - DNA, 25 bp, Rattus norvegicus
ttcctgccgtcctggttatcagaca

SEQ ID NO: 669369 - DNA, 25 bp, Rattus norvegicus
ttcctgccgtttactaaccttagat

SEQ ID NO: 669370 - DNA, 25 bp, Rattus norvegicus
ttcctgccgttttctaaccttagat

SEQ ID NO: 669371 - DNA, 25 bp, Rattus norvegicus
ttcctgcctactcgagggcaacagg

SEQ ID NO: 669372 - DNA, 25 bp, Rattus norvegicus
ttcctgcctactggagggcaacagg

SEQ ID NO: 669373 - DNA, 25 bp, Rattus norvegicus
ttcctgcctcttacatccaataaag

SEQ ID NO: 669374 - DNA, 25 bp, Rattus norvegicus
ttcctgcctcttctgatctggataa

SEQ ID NO: 669375 - DNA, 25 bp, Rattus norvegicus
ttcctgcctcttgtgatctggataa

SEQ ID NO: 669376 - DNA, 25 bp, Rattus norvegicus
ttcctgcctctttcatccaataaag

SEQ ID NO: 669377 - DNA, 25 bp, Rattus norvegicus
ttcctgcctgttctgtactgggaca

SEQ ID NO: 669378 - DNA, 25 bp, Rattus norvegicus
ttcctgcctgttgtgtactgggaca

SEQ ID NO: 669379 - DNA, 25 bp, Rattus norvegicus
ttcctgccttctatgaaatggtcat

SEQ ID NO: 669380 - DNA, 25 bp, Rattus norvegicus
ttcctgccttctattttgagcccta

SEQ ID NO: 669381 - DNA, 25 bp, Rattus norvegicus
ttcctgccttctctaaatacctgta

SEQ ID NO: 669382 - DNA, 25 bp, Rattus norvegicus
ttcctgccttctgtaaatacctgta

SEQ ID NO: 669383 - DNA, 25 bp, Rattus norvegicus
ttcctgccttctttgaaatggtcat

SEQ ID NO: 669384 - DNA, 25 bp, Rattus norvegicus
ttcctgccttcttttttgagcccta

SEQ ID NO: 669385 - DNA, 25 bp, Rattus norvegicus
ttcctgccttgaaactcactgttaa

SEQ ID NO: 669386 - DNA, 25 bp, Rattus norvegicus
ttcctgccttgatactcactgttaa

SEQ ID NO: 669387 - DNA, 25 bp, Rattus norvegicus
ttcctgccttttctacagagttgct

SEQ ID NO: 669388 - DNA, 25 bp, Rattus norvegicus
ttcctgccttttctcattgtgacag

SEQ ID NO: 669389 - DNA, 25 bp, Rattus norvegicus
ttcctgccttttgtacagagttgct

SEQ ID NO: 669390 - DNA, 25 bp, Rattus norvegicus
ttcctgccttttgtcattgtgacag

SEQ ID NO: 669391 - DNA, 25 bp, Rattus norvegicus
ttcctgcgagaacctgcattggagt

SEQ ID NO: 669392 - DNA, 25 bp, Rattus norvegicus
ttcctgcgagaagctgcattggagt

SEQ ID NO: 669393 - DNA, 25 bp, Rattus norvegicus
ttcctgcgcacgaagaacagcatgt

SEQ ID NO: 669394 - DNA, 25 bp, Rattus norvegicus
ttcctgcgcacgtagaacagcatgt

SEQ ID NO: 669395 - DNA, 25 bp, Rattus norvegicus
ttcctgcggttcaacctagaatctg

SEQ ID NO: 669396 - DNA, 25 bp, Rattus norvegicus
ttcctgcggttctacctagaatctg

SEQ ID NO: 669397 - DNA, 25 bp, Rattus norvegicus
ttcctgctacacatcaccaagtaaa

SEQ ID NO: 669398 - DNA, 25 bp, Rattus norvegicus
ttcctgctacacttcaccaagtaaa

SEQ ID NO: 669399 - DNA, 25 bp, Rattus norvegicus
ttcctgctacataacttctgatgct

SEQ ID NO: 669400 - DNA, 25 bp, Rattus norvegicus
ttcctgctacattacttctgatgct

SEQ ID NO: 669401 - DNA, 25 bp, Rattus norvegicus
ttcctgctataaatcatctgctacc

SEQ ID NO: 669402 - DNA, 25 bp, Rattus norvegicus
ttcctgctataattcatctgctacc

SEQ ID NO: 669403 - DNA, 25 bp, Rattus norvegicus
ttcctgctatgcatctgtggttgag

SEQ ID NO: 669404 - DNA, 25 bp, Rattus norvegicus
ttcctgctatgcttctgtggttgag

SEQ ID NO: 669405 - DNA, 25 bp, Rattus norvegicus
ttcctgctctctattagcttcacta

SEQ ID NO: 669406 - DNA, 25 bp, Rattus norvegicus
ttcctgctctcttttagcttcacta

SEQ ID NO: 669407 - DNA, 25 bp, Rattus norvegicus
ttcctgctctgaacgcgtgaactgc

SEQ ID NO: 669408 - DNA, 25 bp, Rattus norvegicus
ttcctgctctgatcgcgtgaactgc

SEQ ID NO: 669409 - DNA, 25 bp, Rattus norvegicus
ttcctgctgcagcactgacatttgg

SEQ ID NO: 669410 - DNA, 25 bp, Rattus norvegicus
ttcctgctgcaggactgacatttgg

SEQ ID NO: 669411 - DNA, 25 bp, Rattus norvegicus
ttcctgctggaaacaacagtcttca

SEQ ID NO: 669412 - DNA, 25 bp, Rattus norvegicus
ttcctgctggaaatttagtttgtat

SEQ ID NO: 669413 - DNA, 25 bp, Rattus norvegicus
ttcctgctggaatcaacagtcttca

SEQ ID NO: 669414 - DNA, 25 bp, Rattus norvegicus
ttcctgctggaattttagtttgtat

SEQ ID NO: 669415 - DNA, 25 bp, Rattus norvegicus
ttcctgctggctaggaccaatgaaa

SEQ ID NO: 669416 - DNA, 25 bp, Rattus norvegicus
ttcctgctggcttggaccaatgaaa

SEQ ID NO: 669417 - DNA, 25 bp, Rattus norvegicus
ttcctgctgtccactatttttaatg

SEQ ID NO: 669418 - DNA, 25 bp, Rattus norvegicus
ttcctgctgtcctctatttttaatg

SEQ ID NO: 669419 - DNA, 25 bp, Rattus norvegicus
ttcctgctgttcacttgttttggta

SEQ ID NO: 669420 - DNA, 25 bp, Rattus norvegicus
ttcctgctgttctcttgttttggta

SEQ ID NO: 669421 - DNA, 25 bp, Rattus norvegicus
ttcctgcttagtcctgggtttatag

SEQ ID NO: 669422 - DNA, 25 bp, Rattus norvegicus
ttcctgcttagtgctgggtttatag

SEQ ID NO: 669423 - DNA, 25 bp, Rattus norvegicus
ttcctgcttcatcgtggatcctgaa

SEQ ID NO: 669424 - DNA, 25 bp, Rattus norvegicus
ttcctgcttcatggtggatcctgaa

SEQ ID NO: 669425 - DNA, 25 bp, Rattus norvegicus
ttcctgcttccaattctgagtgcat

SEQ ID NO: 669426 - DNA, 25 bp, Rattus norvegicus
ttcctgcttccatttctgagtgcat

SEQ ID NO: 669427 - DNA, 25 bp, Rattus norvegicus
ttcctgcttcggagatcaaggctag

SEQ ID NO: 669428 - DNA, 25 bp, Rattus norvegicus
ttcctgcttcggtgatcaaggctag

SEQ ID NO: 669429 - DNA, 25 bp, Rattus norvegicus
ttcctgcttcgtctgttgtcttcta

SEQ ID NO: 669430 - DNA, 25 bp, Rattus norvegicus
ttcctgcttcgtgtgttgtcttcta

SEQ ID NO: 669431 - DNA, 25 bp, Rattus norvegicus
ttcctgcttctactgtgaatactga

SEQ ID NO: 669432 - DNA, 25 bp, Rattus norvegicus
ttcctgcttctagtgtgaatactga

SEQ ID NO: 669433 - DNA, 25 bp, Rattus norvegicus
ttcctgcttgggaacctgcagtggg

SEQ ID NO: 669434 - DNA, 25 bp, Rattus norvegicus
ttcctgcttgggtacctgcagtggg

SEQ ID NO: 669435 - DNA, 25 bp, Rattus norvegicus
ttcctgcttgtgctgtggatgtgta

SEQ ID NO: 669436 - DNA, 25 bp, Rattus norvegicus
ttcctgcttgtggtgtggatgtgta

SEQ ID NO: 669437 - DNA, 25 bp, Rattus norvegicus
ttcctgctttttctcttggttggtt

SEQ ID NO: 669438 - DNA, 25 bp, Rattus norvegicus
ttcctgctttttgtcttggttggtt

SEQ ID NO: 669439 - DNA, 25 bp, Rattus norvegicus
ttcctggaacttagctcccaagagt

SEQ ID NO: 669440 - DNA, 25 bp, Rattus norvegicus
ttcctggaactttgctcccaagagt

SEQ ID NO: 669441 - DNA, 25 bp, Rattus norvegicus
ttcctggaaggcctcagtggagtcc

SEQ ID NO: 669442 - DNA, 25 bp, Rattus norvegicus
ttcctggaaggcgtcagtggagtcc

SEQ ID NO: 669443 - DNA, 25 bp, Rattus norvegicus
ttcctggaccacaattttgtacact

SEQ ID NO: 669444 - DNA, 25 bp, Rattus norvegicus
ttcctggaccactattttgtacact

SEQ ID NO: 669445 - DNA, 25 bp, Rattus norvegicus
ttcctggacctcaagcaatttttca

SEQ ID NO: 669446 - DNA, 25 bp, Rattus norvegicus
ttcctggacctctagcaatttttca

SEQ ID NO: 669447 - DNA, 25 bp, Rattus norvegicus
ttcctggacgcaacggtccatcttg

SEQ ID NO: 669448 - DNA, 25 bp, Rattus norvegicus
ttcctggacgcatcggtccatcttg

SEQ ID NO: 669449 - DNA, 25 bp, Rattus norvegicus
ttcctggagatccttcaggtcccat

SEQ ID NO: 669450 - DNA, 25 bp, Rattus norvegicus
ttcctggagatcgttcaggtcccat

SEQ ID NO: 669451 - DNA, 25 bp, Rattus norvegicus
ttcctggagccaactctgacaagat

SEQ ID NO: 669452 - DNA, 25 bp, Rattus norvegicus
ttcctggagccatctctgacaagat

SEQ ID NO: 669453 - DNA, 25 bp, Rattus norvegicus
ttcctggagcccagttagaacttaa

SEQ ID NO: 669454 - DNA, 25 bp, Rattus norvegicus
ttcctggagccctgttagaacttaa

SEQ ID NO: 669455 - DNA, 25 bp, Rattus norvegicus
ttcctggaggatctactgacggtgc

SEQ ID NO: 669456 - DNA, 25 bp, Rattus norvegicus
ttcctggaggatgtactgacggtgc

SEQ ID NO: 669457 - DNA, 25 bp, Rattus norvegicus
ttcctggaggccaagatctgtcttt

SEQ ID NO: 669458 - DNA, 25 bp, Rattus norvegicus
ttcctggaggcctagatctgtcttt

SEQ ID NO: 669459 - DNA, 25 bp, Rattus norvegicus
ttcctggatagcatctaaatttgtg

SEQ ID NO: 669460 - DNA, 25 bp, Rattus norvegicus
ttcctggatagcttctaaatttgtg

SEQ ID NO: 669461 - DNA, 25 bp, Rattus norvegicus
ttcctggatctacttcttgaacagt

SEQ ID NO: 669462 - DNA, 25 bp, Rattus norvegicus
ttcctggatctagttcttgaacagt

SEQ ID NO: 669463 - DNA, 25 bp, Rattus norvegicus
ttcctggattctatgtgttttctat

SEQ ID NO: 669464 - DNA, 25 bp, Rattus norvegicus
ttcctggattctttgtgttttctat

SEQ ID NO: 669465 - DNA, 25 bp, Rattus norvegicus
ttcctggcacagattctgggtggac

SEQ ID NO: 669466 - DNA, 25 bp, Rattus norvegicus
ttcctggcacagtttctgggtggac

SEQ ID NO: 669467 - DNA, 25 bp, Rattus norvegicus
ttcctggcagtcactgacatgtcta

SEQ ID NO: 669468 - DNA, 25 bp, Rattus norvegicus
ttcctggcagtctctgacatgtcta

SEQ ID NO: 669469 - DNA, 25 bp, Rattus norvegicus
ttcctggccaatcctagcacaaaag

SEQ ID NO: 669470 - DNA, 25 bp, Rattus norvegicus
ttcctggccaatgctagcacaaaag

SEQ ID NO: 669471 - DNA, 25 bp, Rattus norvegicus
ttcctggcccatataaagtacaaag

SEQ ID NO: 669472 - DNA, 25 bp, Rattus norvegicus
ttcctggcccatttaaagtacaaag

SEQ ID NO: 669473 - DNA, 25 bp, Rattus norvegicus
ttcctggccccaagagaaagttgat

SEQ ID NO: 669474 - DNA, 25 bp, Rattus norvegicus
ttcctggccccatgagaaagttgat

SEQ ID NO: 669475 - DNA, 25 bp, Rattus norvegicus
ttcctggcccctagggtgtaaatag

SEQ ID NO: 669476 - DNA, 25 bp, Rattus norvegicus
ttcctggccccttgggtgtaaatag

SEQ ID NO: 669477 - DNA, 25 bp, Rattus norvegicus
ttcctggccgagctggttactcaaa

SEQ ID NO: 669478 - DNA, 25 bp, Rattus norvegicus
ttcctggccgaggtggttactcaaa

SEQ ID NO: 669479 - DNA, 25 bp, Rattus norvegicus
ttcctggcctgaactaatctttctg

SEQ ID NO: 669480 - DNA, 25 bp, Rattus norvegicus
ttcctggcctgatctaatctttctg

SEQ ID NO: 669481 - DNA, 25 bp, Rattus norvegicus
ttcctggccttacaagatgcgtaga

SEQ ID NO: 669482 - DNA, 25 bp, Rattus norvegicus
ttcctggccttagaagatgcgtaga

SEQ ID NO: 669483 - DNA, 25 bp, Rattus norvegicus
ttcctggctactaagaaagttgggc

SEQ ID NO: 669484 - DNA, 25 bp, Rattus norvegicus
ttcctggctacttagaaagttgggc

SEQ ID NO: 669485 - DNA, 25 bp, Rattus norvegicus
ttcctggctcctaagtctgggaatg

SEQ ID NO: 669486 - DNA, 25 bp, Rattus norvegicus
ttcctggctccttagtctgggaatg

SEQ ID NO: 669487 - DNA, 25 bp, Rattus norvegicus
ttcctggcttagcagagaggctctc

SEQ ID NO: 669488 - DNA, 25 bp, Rattus norvegicus
ttcctggcttaggagagaggctctc

SEQ ID NO: 669489 - DNA, 25 bp, Rattus norvegicus
ttcctgggaagaactgacctggctc

SEQ ID NO: 669490 - DNA, 25 bp, Rattus norvegicus
ttcctgggaagatctgacctggctc

SEQ ID NO: 669491 - DNA, 25 bp, Rattus norvegicus
ttcctgggaaggagagtcacctgca

SEQ ID NO: 669492 - DNA, 25 bp, Rattus norvegicus
ttcctgggaaggtgagtcacctgca

SEQ ID NO: 669493 - DNA, 25 bp, Rattus norvegicus
ttcctgggaatccagagcctgcatt

SEQ ID NO: 669494 - DNA, 25 bp, Rattus norvegicus
ttcctgggaatcgagagcctgcatt

SEQ ID NO: 669495 - DNA, 25 bp, Rattus norvegicus
ttcctgggacagatggcttctctga

SEQ ID NO: 669496 - DNA, 25 bp, Rattus norvegicus
ttcctgggacagttggcttctctga

SEQ ID NO: 669497 - DNA, 25 bp, Rattus norvegicus
ttcctgggattgatgaagtgctgcc

SEQ ID NO: 669498 - DNA, 25 bp, Rattus norvegicus
ttcctgggattgttgaagtgctgcc

SEQ ID NO: 669499 - DNA, 25 bp, Rattus norvegicus
ttcctgggcattctggccgaggtcc

SEQ ID NO: 669500 - DNA, 25 bp, Rattus norvegicus
ttcctgggcattgtggccgaggtcc

SEQ ID NO: 669501 - DNA, 25 bp, Rattus norvegicus
ttcctgggccatcgtgagcattgtg

SEQ ID NO: 669502 - DNA, 25 bp, Rattus norvegicus
ttcctgggccatggtgagcattgtg

SEQ ID NO: 669503 - DNA, 25 bp, Rattus norvegicus
ttcctgggcccaacgtttgctgtgg

SEQ ID NO: 669504 - DNA, 25 bp, Rattus norvegicus
ttcctgggcccatcgtttgctgtgg

SEQ ID NO: 669505 - DNA, 25 bp, Rattus norvegicus
ttcctgggcccgacaggagagcctg

SEQ ID NO: 669506 - DNA, 25 bp, Rattus norvegicus
ttcctgggcccgtcaggagagcctg

SEQ ID NO: 669507 - DNA, 25 bp, Rattus norvegicus
ttcctgggtgccaagaagaccatgt

SEQ ID NO: 669508 - DNA, 25 bp, Rattus norvegicus
ttcctgggtgcctagaagaccatgt

SEQ ID NO: 669509 - DNA, 25 bp, Rattus norvegicus
ttcctggtaaatactgttgggccta

SEQ ID NO: 669510 - DNA, 25 bp, Rattus norvegicus
ttcctggtaaattctgttgggccta

SEQ ID NO: 669511 - DNA, 25 bp, Rattus norvegicus
ttcctggtcagccagagtcaacatg

SEQ ID NO: 669512 - DNA, 25 bp, Rattus norvegicus
ttcctggtcagcgagagtcaacatg

SEQ ID NO: 669513 - DNA, 25 bp, Rattus norvegicus
ttcctggtccagcatgatgcgtcta

SEQ ID NO: 669514 - DNA, 25 bp, Rattus norvegicus
ttcctggtccaggatgatgcgtcta

SEQ ID NO: 669515 - DNA, 25 bp, Rattus norvegicus
ttcctggtgactacggaaatcgccg

SEQ ID NO: 669516 - DNA, 25 bp, Rattus norvegicus
ttcctggtgacttcggaaatcgccg

SEQ ID NO: 669517 - DNA, 25 bp, Rattus norvegicus
ttcctggtgatcactaatgtgccgt

SEQ ID NO: 669518 - DNA, 25 bp, Rattus norvegicus
ttcctggtgatctctaatgtgccgt

SEQ ID NO: 669519 - DNA, 25 bp, Rattus norvegicus
ttcctggtgccaaggttcccacgtg

SEQ ID NO: 669520 - DNA, 25 bp, Rattus norvegicus
ttcctggtgccatggttcccacgtg

SEQ ID NO: 669521 - DNA, 25 bp, Rattus norvegicus
ttcctggtgctcaagggaccagtgt

SEQ ID NO: 669522 - DNA, 25 bp, Rattus norvegicus
ttcctggtgctctagggaccagtgt

SEQ ID NO: 669523 - DNA, 25 bp, Rattus norvegicus
ttcctggtggagctcctttaactat

SEQ ID NO: 669524 - DNA, 25 bp, Rattus norvegicus
ttcctggtggaggtcctttaactat

SEQ ID NO: 669525 - DNA, 25 bp, Rattus norvegicus
ttcctggtgttcaacctctcttgat

SEQ ID NO: 669526 - DNA, 25 bp, Rattus norvegicus
ttcctggtgttctacctctcttgat

SEQ ID NO: 669527 - DNA, 25 bp, Rattus norvegicus
ttcctggttccaatgggctaggctt

SEQ ID NO: 669528 - DNA, 25 bp, Rattus norvegicus
ttcctggttccattgggctaggctt

SEQ ID NO: 669529 - DNA, 25 bp, Rattus norvegicus
ttcctggttccccttggaacaagat

SEQ ID NO: 669530 - DNA, 25 bp, Rattus norvegicus
ttcctggttcccgttggaacaagat

SEQ ID NO: 669531 - DNA, 25 bp, Rattus norvegicus
ttcctggttgcaagaccctgtgcca

SEQ ID NO: 669532 - DNA, 25 bp, Rattus norvegicus
ttcctggttgcatgaccctgtgcca

SEQ ID NO: 669533 - DNA, 25 bp, Rattus norvegicus
ttcctgtaaacaatgcatccttccc

SEQ ID NO: 669534 - DNA, 25 bp, Rattus norvegicus
ttcctgtaaacattgcatccttccc

SEQ ID NO: 669535 - DNA, 25 bp, Rattus norvegicus
ttcctgtaatgtaagcctgcccatg

SEQ ID NO: 669536 - DNA, 25 bp, Rattus norvegicus
ttcctgtaatgttagcctgcccatg

SEQ ID NO: 669537 - DNA, 25 bp, Rattus norvegicus
ttcctgtacactctctcttttggga

SEQ ID NO: 669538 - DNA, 25 bp, Rattus norvegicus
ttcctgtacactgtctcttttggga

SEQ ID NO: 669539 - DNA, 25 bp, Rattus norvegicus
ttcctgtacagccttggatgtccag

SEQ ID NO: 669540 - DNA, 25 bp, Rattus norvegicus
ttcctgtacagcctttgtagggtta

SEQ ID NO: 669541 - DNA, 25 bp, Rattus norvegicus
ttcctgtacagcgttggatgtccag

SEQ ID NO: 669542 - DNA, 25 bp, Rattus norvegicus
ttcctgtacagcgtttgtagggtta

SEQ ID NO: 669543 - DNA, 25 bp, Rattus norvegicus
ttcctgtacctgacagtgggtcaca

SEQ ID NO: 669544 - DNA, 25 bp, Rattus norvegicus
ttcctgtacctgtcagtgggtcaca

SEQ ID NO: 669545 - DNA, 25 bp, Rattus norvegicus
ttcctgtactcgcttagcgtgtggc

SEQ ID NO: 669546 - DNA, 25 bp, Rattus norvegicus
ttcctgtactcggttagcgtgtggc

SEQ ID NO: 669547 - DNA, 25 bp, Rattus norvegicus
ttcctgtactgcattcagtctgtgt

SEQ ID NO: 669548 - DNA, 25 bp, Rattus norvegicus
ttcctgtactgctttcagtctgtgt

SEQ ID NO: 669549 - DNA, 25 bp, Rattus norvegicus
ttcctgtagtagacaggcgcagtct

SEQ ID NO: 669550 - DNA, 25 bp, Rattus norvegicus
ttcctgtagtagtcaggcgcagtct

SEQ ID NO: 669551 - DNA, 25 bp, Rattus norvegicus
ttcctgtatatcaatgctaacctgg

SEQ ID NO: 669552 - DNA, 25 bp, Rattus norvegicus
ttcctgtatatctatgctaacctgg

SEQ ID NO: 669553 - DNA, 25 bp, Rattus norvegicus
ttcctgtcaaccattcagcatagca

SEQ ID NO: 669554 - DNA, 25 bp, Rattus norvegicus
ttcctgtcaacctttcagcatagca

SEQ ID NO: 669555 - DNA, 25 bp, Rattus norvegicus
ttcctgtcactcagctttgatgaac

SEQ ID NO: 669556 - DNA, 25 bp, Rattus norvegicus
ttcctgtcactctgctttgatgaac

SEQ ID NO: 669557 - DNA, 25 bp, Rattus norvegicus
ttcctgtcacttccttggctaccag

SEQ ID NO: 669558 - DNA, 25 bp, Rattus norvegicus
ttcctgtcacttgcttggctaccag

SEQ ID NO: 669559 - DNA, 25 bp, Rattus norvegicus
ttcctgtcagacaccaaggagcctg

SEQ ID NO: 669560 - DNA, 25 bp, Rattus norvegicus
ttcctgtcagactccaaggagcctg

SEQ ID NO: 669561 - DNA, 25 bp, Rattus norvegicus
ttcctgtccactagcgaagcgctga

SEQ ID NO: 669562 - DNA, 25 bp, Rattus norvegicus
ttcctgtccacttgcgaagcgctga

SEQ ID NO: 669563 - DNA, 25 bp, Rattus norvegicus
ttcctgtccaggagaccgagtcaga

SEQ ID NO: 669564 - DNA, 25 bp, Rattus norvegicus
ttcctgtccaggtgaccgagtcaga

SEQ ID NO: 669565 - DNA, 25 bp, Rattus norvegicus
ttcctgtccattaacttacctgagt

SEQ ID NO: 669566 - DNA, 25 bp, Rattus norvegicus
ttcctgtccattctagtgcctgacc

SEQ ID NO: 669567 - DNA, 25 bp, Rattus norvegicus
ttcctgtccattgtagtgcctgacc

SEQ ID NO: 669568 - DNA, 25 bp, Rattus norvegicus
ttcctgtccatttacttacctgagt

SEQ ID NO: 669569 - DNA, 25 bp, Rattus norvegicus
ttcctgtccctaaggtgtttctgaa

SEQ ID NO: 669570 - DNA, 25 bp, Rattus norvegicus
ttcctgtccctacaatagttgggca

SEQ ID NO: 669571 - DNA, 25 bp, Rattus norvegicus
ttcctgtccctagaatagttgggca

SEQ ID NO: 669572 - DNA, 25 bp, Rattus norvegicus
ttcctgtccctatggtgtttctgaa

SEQ ID NO: 669573 - DNA, 25 bp, Rattus norvegicus
ttcctgtcctggaggcactggtcaa

SEQ ID NO: 669574 - DNA, 25 bp, Rattus norvegicus
ttcctgtcctggtggcactggtcaa

SEQ ID NO: 669575 - DNA, 25 bp, Rattus norvegicus
ttcctgtcctgtacaagttgctgca

SEQ ID NO: 669576 - DNA, 25 bp, Rattus norvegicus
ttcctgtcctgttcaagttgctgca

SEQ ID NO: 669577 - DNA, 25 bp, Rattus norvegicus
ttcctgtcgtccactcacagaagaa

SEQ ID NO: 669578 - DNA, 25 bp, Rattus norvegicus
ttcctgtcgtcctctcacagaagaa

SEQ ID NO: 669579 - DNA, 25 bp, Rattus norvegicus
ttcctgtctaacagctcatctataa

SEQ ID NO: 669580 - DNA, 25 bp, Rattus norvegicus
ttcctgtctaactgctcatctataa

SEQ ID NO: 669581 - DNA, 25 bp, Rattus norvegicus
ttcctgtctcagctttgtataaaca

SEQ ID NO: 669582 - DNA, 25 bp, Rattus norvegicus
ttcctgtctcaggtttgtataaaca

SEQ ID NO: 669583 - DNA, 25 bp, Rattus norvegicus
ttcctgtctctaaaattatctccga

SEQ ID NO: 669584 - DNA, 25 bp, Rattus norvegicus
ttcctgtctctataattatctccga

SEQ ID NO: 669585 - DNA, 25 bp, Rattus norvegicus
ttcctgtctctcaagatccttttaa

SEQ ID NO: 669586 - DNA, 25 bp, Rattus norvegicus
ttcctgtctctctagatccttttaa

SEQ ID NO: 669587 - DNA, 25 bp, Rattus norvegicus
ttcctgtcttccactggcgcttagg

SEQ ID NO: 669588 - DNA, 25 bp, Rattus norvegicus
ttcctgtcttcctctggcgcttagg

SEQ ID NO: 669589 - DNA, 25 bp, Rattus norvegicus
ttcctgtgaccaaggcttcattctg

SEQ ID NO: 669590 - DNA, 25 bp, Rattus norvegicus
ttcctgtgaccatggcttcattctg

SEQ ID NO: 669591 - DNA, 25 bp, Rattus norvegicus
ttcctgtgagacagctcatgctgcc

SEQ ID NO: 669592 - DNA, 25 bp, Rattus norvegicus
ttcctgtgagactgctcatgctgcc

SEQ ID NO: 669593 - DNA, 25 bp, Rattus norvegicus
ttcctgtgatgcaccttagtagttt

SEQ ID NO: 669594 - DNA, 25 bp, Rattus norvegicus
ttcctgtgatgcagcacctggctaa

SEQ ID NO: 669595 - DNA, 25 bp, Rattus norvegicus
ttcctgtgatgctccttagtagttt

SEQ ID NO: 669596 - DNA, 25 bp, Rattus norvegicus
ttcctgtgatgctgcacctggctaa

SEQ ID NO: 669597 - DNA, 25 bp, Rattus norvegicus
ttcctgtgcaggaagggccaccttc

SEQ ID NO: 669598 - DNA, 25 bp, Rattus norvegicus
ttcctgtgcaggtagggccaccttc

SEQ ID NO: 669599 - DNA, 25 bp, Rattus norvegicus
ttcctgtgccaccaaggtcgagtga

SEQ ID NO: 669600 - DNA, 25 bp, Rattus norvegicus
ttcctgtgccacgaaggtcgagtga

SEQ ID NO: 669601 - DNA, 25 bp, Rattus norvegicus
ttcctgtgccctacggtattgtttg

SEQ ID NO: 669602 - DNA, 25 bp, Rattus norvegicus
ttcctgtgcccttcggtattgtttg

SEQ ID NO: 669603 - DNA, 25 bp, Rattus norvegicus
ttcctgtgccttacaggcagcaagg

SEQ ID NO: 669604 - DNA, 25 bp, Rattus norvegicus
ttcctgtgcctttcaggcagcaagg

SEQ ID NO: 669605 - DNA, 25 bp, Rattus norvegicus
ttcctgtgcgtgaatctctgacaaa

SEQ ID NO: 669606 - DNA, 25 bp, Rattus norvegicus
ttcctgtgcgtgtatctctgacaaa

SEQ ID NO: 669607 - DNA, 25 bp, Rattus norvegicus
ttcctgtggagtcccattgcctatc

SEQ ID NO: 669608 - DNA, 25 bp, Rattus norvegicus
ttcctgtggagtgccattgcctatc

SEQ ID NO: 669609 - DNA, 25 bp, Rattus norvegicus
ttcctgtggcccattcagcaaaaaa

SEQ ID NO: 669610 - DNA, 25 bp, Rattus norvegicus
ttcctgtggccctttcagcaaaaaa

SEQ ID NO: 669611 - DNA, 25 bp, Rattus norvegicus
ttcctgtggccgatgaagtcatggt

SEQ ID NO: 669612 - DNA, 25 bp, Rattus norvegicus
ttcctgtggccgttgaagtcatggt

SEQ ID NO: 669613 - DNA, 25 bp, Rattus norvegicus
ttcctgtggcctcgttcagtcagct

SEQ ID NO: 669614 - DNA, 25 bp, Rattus norvegicus
ttcctgtggcctggttcagtcagct

SEQ ID NO: 669615 - DNA, 25 bp, Rattus norvegicus
ttcctgtggctgataggtcgacctg

SEQ ID NO: 669616 - DNA, 25 bp, Rattus norvegicus
ttcctgtggctgttaggtcgacctg

SEQ ID NO: 669617 - DNA, 25 bp, Rattus norvegicus
ttcctgtgggagatctggcttctga

SEQ ID NO: 669618 - DNA, 25 bp, Rattus norvegicus
ttcctgtgggagttctggcttctga

SEQ ID NO: 669619 - DNA, 25 bp, Rattus norvegicus
ttcctgtgtcctcctattgttttaa

SEQ ID NO: 669620 - DNA, 25 bp, Rattus norvegicus
ttcctgtgtcctgctattgttttaa

SEQ ID NO: 669621 - DNA, 25 bp, Rattus norvegicus
ttcctgtgtcttccctgttaatctg

SEQ ID NO: 669622 - DNA, 25 bp, Rattus norvegicus
ttcctgtgtcttgcctgttaatctg

SEQ ID NO: 669623 - DNA, 25 bp, Rattus norvegicus
ttcctgtgtggcctgttgtcctttc

SEQ ID NO: 669624 - DNA, 25 bp, Rattus norvegicus
ttcctgtgtggcgtgttgtcctttc

SEQ ID NO: 669625 - DNA, 25 bp, Rattus norvegicus
ttcctgtgtgtcagggagcctgtca

SEQ ID NO: 669626 - DNA, 25 bp, Rattus norvegicus
ttcctgtgtgtctgggagcctgtca

SEQ ID NO: 669627 - DNA, 25 bp, Rattus norvegicus
ttcctgtgtttactggcaagcgtct

SEQ ID NO: 669628 - DNA, 25 bp, Rattus norvegicus
ttcctgtgtttagtggcaagcgtct

SEQ ID NO: 669629 - DNA, 25 bp, Rattus norvegicus
ttcctgtgtttgcttaagtcctgtg

SEQ ID NO: 669630 - DNA, 25 bp, Rattus norvegicus
ttcctgtgtttggttaagtcctgtg

SEQ ID NO: 669631 - DNA, 25 bp, Rattus norvegicus
ttcctgtgttttatgctgcgtgtaa

SEQ ID NO: 669632 - DNA, 25 bp, Rattus norvegicus
ttcctgtgttttttgctgcgtgtaa

SEQ ID NO: 669633 - DNA, 25 bp, Rattus norvegicus
ttcctgttcagaatagatatttata

SEQ ID NO: 669634 - DNA, 25 bp, Rattus norvegicus
ttcctgttcagattagatatttata

SEQ ID NO: 669635 - DNA, 25 bp, Rattus norvegicus
ttcctgttcccgaggacttattcaa

SEQ ID NO: 669636 - DNA, 25 bp, Rattus norvegicus
ttcctgttcccgtggacttattcaa

SEQ ID NO: 669637 - DNA, 25 bp, Rattus norvegicus
ttcctgttccttatttgtttacata

SEQ ID NO: 669638 - DNA, 25 bp, Rattus norvegicus
ttcctgttccttttttgtttacata

SEQ ID NO: 669639 - DNA, 25 bp, Rattus norvegicus
ttcctgttcgtcaccttcctggaga

SEQ ID NO: 669640 - DNA, 25 bp, Rattus norvegicus
ttcctgttcgtctccttcctggaga

SEQ ID NO: 669641 - DNA, 25 bp, Rattus norvegicus
ttcctgttctctaactacacgtggg

SEQ ID NO: 669642 - DNA, 25 bp, Rattus norvegicus
ttcctgttctctctatttggtcaga

SEQ ID NO: 669643 - DNA, 25 bp, Rattus norvegicus
ttcctgttctctgtatttggtcaga

SEQ ID NO: 669644 - DNA, 25 bp, Rattus norvegicus
ttcctgttctcttactacacgtggg

SEQ ID NO: 669645 - DNA, 25 bp, Rattus norvegicus
ttcctgttgaaaactcttctctgcc

SEQ ID NO: 669646 - DNA, 25 bp, Rattus norvegicus
ttcctgttgaaatctcttctctgcc

SEQ ID NO: 669647 - DNA, 25 bp, Rattus norvegicus
ttcctgttgattatgagaacgtgag

SEQ ID NO: 669648 - DNA, 25 bp, Rattus norvegicus
ttcctgttgattttgagaacgtgag

SEQ ID NO: 669649 - DNA, 25 bp, Rattus norvegicus
ttcctgttgcatatcattggcctca

SEQ ID NO: 669650 - DNA, 25 bp, Rattus norvegicus
ttcctgttgcatttcattggcctca

SEQ ID NO: 669651 - DNA, 25 bp, Rattus norvegicus
ttcctgttggctattgggtagcact

SEQ ID NO: 669652 - DNA, 25 bp, Rattus norvegicus
ttcctgttggcttttgggtagcact

SEQ ID NO: 669653 - DNA, 25 bp, Rattus norvegicus
ttcctgttgtaaatgctttgaacca

SEQ ID NO: 669654 - DNA, 25 bp, Rattus norvegicus
ttcctgttgtaattgctttgaacca

SEQ ID NO: 669655 - DNA, 25 bp, Rattus norvegicus
ttcctgttgtatctggcctgtataa

SEQ ID NO: 669656 - DNA, 25 bp, Rattus norvegicus
ttcctgttgtatgtggcctgtataa

SEQ ID NO: 669657 - DNA, 25 bp, Rattus norvegicus
ttcctgtttcacaggctgttttagt

SEQ ID NO: 669658 - DNA, 25 bp, Rattus norvegicus
ttcctgtttcactggctgttttagt

SEQ ID NO: 669659 - DNA, 25 bp, Rattus norvegicus
ttcctgtttcctcccatttccggtg

SEQ ID NO: 669660 - DNA, 25 bp, Rattus norvegicus
ttcctgtttcctgccatttccggtg

SEQ ID NO: 669661 - DNA, 25 bp, Rattus norvegicus
ttcctgtttctgctactgtgataaa

SEQ ID NO: 669662 - DNA, 25 bp, Rattus norvegicus
ttcctgtttctggtactgtgataaa

SEQ ID NO: 669663 - DNA, 25 bp, Rattus norvegicus
ttcctgtttggtagccacttggcaa

SEQ ID NO: 669664 - DNA, 25 bp, Rattus norvegicus
ttcctgtttggttgccacttggcaa

SEQ ID NO: 669665 - DNA, 25 bp, Rattus norvegicus
ttcctgtttgtcctttgagttgcca

SEQ ID NO: 669666 - DNA, 25 bp, Rattus norvegicus
ttcctgtttgtcgtttgagttgcca

SEQ ID NO: 669667 - DNA, 25 bp, Rattus norvegicus
ttcctgtttgttcccactcatgaac

SEQ ID NO: 669668 - DNA, 25 bp, Rattus norvegicus
ttcctgtttgttctactgcctatga

SEQ ID NO: 669669 - DNA, 25 bp, Rattus norvegicus
ttcctgtttgttgccactcatgaac

SEQ ID NO: 669670 - DNA, 25 bp, Rattus norvegicus
ttcctgtttgttgtactgcctatga

SEQ ID NO: 669671 - DNA, 25 bp, Rattus norvegicus
ttccttaaacccagcactgtggagt

SEQ ID NO: 669672 - DNA, 25 bp, Rattus norvegicus
ttccttaaaccctgcactgtggagt

SEQ ID NO: 669673 - DNA, 25 bp, Rattus norvegicus
ttccttaacatcagtaatttatggg

SEQ ID NO: 669674 - DNA, 25 bp, Rattus norvegicus
ttccttaacatctgtaatttatggg

SEQ ID NO: 669675 - DNA, 25 bp, Rattus norvegicus
ttccttaaccagaattgcatgccag

SEQ ID NO: 669676 - DNA, 25 bp, Rattus norvegicus
ttccttaaccagtattgcatgccag

SEQ ID NO: 669677 - DNA, 25 bp, Rattus norvegicus
ttccttaatgagacgcgaacgctgt

SEQ ID NO: 669678 - DNA, 25 bp, Rattus norvegicus
ttccttaatgagtcgcgaacgctgt

SEQ ID NO: 669679 - DNA, 25 bp, Rattus norvegicus
ttccttaccgacatcagagacttta

SEQ ID NO: 669680 - DNA, 25 bp, Rattus norvegicus
ttccttaccgacttcagagacttta

SEQ ID NO: 669681 - DNA, 25 bp, Rattus norvegicus
ttccttactcttaccgacatgtatg

SEQ ID NO: 669682 - DNA, 25 bp, Rattus norvegicus
ttccttactctttccgacatgtatg

SEQ ID NO: 669683 - DNA, 25 bp, Rattus norvegicus
ttccttagccctaggtaatggttgg

SEQ ID NO: 669684 - DNA, 25 bp, Rattus norvegicus
ttccttagccctcagagcaagtggt

SEQ ID NO: 669685 - DNA, 25 bp, Rattus norvegicus
ttccttagccctcttagaagtgtgt

SEQ ID NO: 669686 - DNA, 25 bp, Rattus norvegicus
ttccttagccctgagagcaagtggt

SEQ ID NO: 669687 - DNA, 25 bp, Rattus norvegicus
ttccttagccctgttagaagtgtgt

SEQ ID NO: 669688 - DNA, 25 bp, Rattus norvegicus
ttccttagcccttggtaatggttgg

SEQ ID NO: 669689 - DNA, 25 bp, Rattus norvegicus
ttccttagcgttccaacttttcctg

SEQ ID NO: 669690 - DNA, 25 bp, Rattus norvegicus
ttccttagcgttgcaacttttcctg

SEQ ID NO: 669691 - DNA, 25 bp, Rattus norvegicus
ttccttaggcatactttgtaacagt

SEQ ID NO: 669692 - DNA, 25 bp, Rattus norvegicus
ttccttaggcattctttgtaacagt

SEQ ID NO: 669693 - DNA, 25 bp, Rattus norvegicus
ttccttagtgataacagacctcctg

SEQ ID NO: 669694 - DNA, 25 bp, Rattus norvegicus
ttccttagtgattacagacctcctg

SEQ ID NO: 669695 - DNA, 25 bp, Rattus norvegicus
ttccttagtttacccatttctgcat

SEQ ID NO: 669696 - DNA, 25 bp, Rattus norvegicus
ttccttagtttagccatttctgcat

SEQ ID NO: 669697 - DNA, 25 bp, Rattus norvegicus
ttccttatcaacatccaggctgctg

SEQ ID NO: 669698 - DNA, 25 bp, Rattus norvegicus
ttccttatcaacttccaggctgctg

SEQ ID NO: 669699 - DNA, 25 bp, Rattus norvegicus
ttccttatccttccaccagaagaga

SEQ ID NO: 669700 - DNA, 25 bp, Rattus norvegicus
ttccttatccttgcaccagaagaga

SEQ ID NO: 669701 - DNA, 25 bp, Rattus norvegicus
ttccttatctccatcagcagttcca

SEQ ID NO: 669702 - DNA, 25 bp, Rattus norvegicus
ttccttatctccttcagcagttcca

SEQ ID NO: 669703 - DNA, 25 bp, Rattus norvegicus
ttccttatgatcatgtccttacccc

SEQ ID NO: 669704 - DNA, 25 bp, Rattus norvegicus
ttccttatgatcttgtccttacccc

SEQ ID NO: 669705 - DNA, 25 bp, Rattus norvegicus
ttccttatgcagaaatcacacctcc

SEQ ID NO: 669706 - DNA, 25 bp, Rattus norvegicus
ttccttatgcagtaatcacacctcc

SEQ ID NO: 669707 - DNA, 25 bp, Rattus norvegicus
ttccttattgttactatctgcactt

SEQ ID NO: 669708 - DNA, 25 bp, Rattus norvegicus
ttccttattgtttctatctgcactt

SEQ ID NO: 669709 - DNA, 25 bp, Rattus norvegicus
ttccttatttttcttccatcgcaaa

SEQ ID NO: 669710 - DNA, 25 bp, Rattus norvegicus
ttccttatttttgttccatcgcaaa

SEQ ID NO: 669711 - DNA, 25 bp, Rattus norvegicus
ttccttcaaagccttcagtacctga

SEQ ID NO: 669712 - DNA, 25 bp, Rattus norvegicus
ttccttcaaagcgttcagtacctga

SEQ ID NO: 669713 - DNA, 25 bp, Rattus norvegicus
ttccttcaaagtaggctcgcaggct

SEQ ID NO: 669714 - DNA, 25 bp, Rattus norvegicus
ttccttcaaagttggctcgcaggct

SEQ ID NO: 669715 - DNA, 25 bp, Rattus norvegicus
ttccttcaaatcagaggcttgcctg

SEQ ID NO: 669716 - DNA, 25 bp, Rattus norvegicus
ttccttcaaatctgaggcttgcctg

SEQ ID NO: 669717 - DNA, 25 bp, Rattus norvegicus
ttccttcaactactcggtgctgcag

SEQ ID NO: 669718 - DNA, 25 bp, Rattus norvegicus
ttccttcaactagtcggtgctgcag

SEQ ID NO: 669719 - DNA, 25 bp, Rattus norvegicus
ttccttcaagacaaactcacagatg

SEQ ID NO: 669720 - DNA, 25 bp, Rattus norvegicus
ttccttcaagactaactcacagatg

SEQ ID NO: 669721 - DNA, 25 bp, Rattus norvegicus
ttccttcacctgctgacaggacagt

SEQ ID NO: 669722 - DNA, 25 bp, Rattus norvegicus
ttccttcacctggtgacaggacagt

SEQ ID NO: 669723 - DNA, 25 bp, Rattus norvegicus
ttccttcagctcacttgggtgctca

SEQ ID NO: 669724 - DNA, 25 bp, Rattus norvegicus
ttccttcagctctcttgggtgctca

SEQ ID NO: 669725 - DNA, 25 bp, Rattus norvegicus
ttccttcaggcgaacccttatctca

SEQ ID NO: 669726 - DNA, 25 bp, Rattus norvegicus
ttccttcaggcgtacccttatctca

SEQ ID NO: 669727 - DNA, 25 bp, Rattus norvegicus
ttccttcaggctccagttgactgac

SEQ ID NO: 669728 - DNA, 25 bp, Rattus norvegicus
ttccttcaggctgcagttgactgac

SEQ ID NO: 669729 - DNA, 25 bp, Rattus norvegicus
ttccttcatccgctgtactggtaaa

SEQ ID NO: 669730 - DNA, 25 bp, Rattus norvegicus
ttccttcatccggtgtactggtaaa

SEQ ID NO: 669731 - DNA, 25 bp, Rattus norvegicus
ttccttcattttaataacactatag

SEQ ID NO: 669732 - DNA, 25 bp, Rattus norvegicus
ttccttcatttttataacactatag

SEQ ID NO: 669733 - DNA, 25 bp, Rattus norvegicus
ttccttccaaggcttttaaatgctg

SEQ ID NO: 669734 - DNA, 25 bp, Rattus norvegicus
ttccttccaagggttttaaatgctg

SEQ ID NO: 669735 - DNA, 25 bp, Rattus norvegicus
ttccttccaccccagtaatctgtaa

SEQ ID NO: 669736 - DNA, 25 bp, Rattus norvegicus
ttccttccacccgagtaatctgtaa

SEQ ID NO: 669737 - DNA, 25 bp, Rattus norvegicus
ttccttccagaacagcactgcatat

SEQ ID NO: 669738 - DNA, 25 bp, Rattus norvegicus
ttccttccagaagagcactgcatat

SEQ ID NO: 669739 - DNA, 25 bp, Rattus norvegicus
ttccttccagatccttttgcaactg

SEQ ID NO: 669740 - DNA, 25 bp, Rattus norvegicus
ttccttccagatgcttttgcaactg

SEQ ID NO: 669741 - DNA, 25 bp, Rattus norvegicus
ttccttccagcaagggaggtcctgt

SEQ ID NO: 669742 - DNA, 25 bp, Rattus norvegicus
ttccttccagcatgggaggtcctgt

SEQ ID NO: 669743 - DNA, 25 bp, Rattus norvegicus
ttccttccaggcaattgactatgtt

SEQ ID NO: 669744 - DNA, 25 bp, Rattus norvegicus
ttccttccaggctattgactatgtt

SEQ ID NO: 669745 - DNA, 25 bp, Rattus norvegicus
ttccttccagttctacggtagtggc

SEQ ID NO: 669746 - DNA, 25 bp, Rattus norvegicus
ttccttccagttgtacggtagtggc

SEQ ID NO: 669747 - DNA, 25 bp, Rattus norvegicus
ttccttccatatcttgccccaaaat

SEQ ID NO: 669748 - DNA, 25 bp, Rattus norvegicus
ttccttccatatgttgccccaaaat

SEQ ID NO: 669749 - DNA, 25 bp, Rattus norvegicus
ttccttcccaaaatcatgttctcaa

SEQ ID NO: 669750 - DNA, 25 bp, Rattus norvegicus
ttccttcccaaattcatgttctcaa

SEQ ID NO: 669751 - DNA, 25 bp, Rattus norvegicus
ttccttcccagtatctaagtgcagg

SEQ ID NO: 669752 - DNA, 25 bp, Rattus norvegicus
ttccttcccagtttctaagtgcagg

SEQ ID NO: 669753 - DNA, 25 bp, Rattus norvegicus
ttccttcccctactatcagtttctg

SEQ ID NO: 669754 - DNA, 25 bp, Rattus norvegicus
ttccttcccctagtatcagtttctg

SEQ ID NO: 669755 - DNA, 25 bp, Rattus norvegicus
ttccttccctgtcttatgactcaat

SEQ ID NO: 669756 - DNA, 25 bp, Rattus norvegicus
ttccttccctgtgttatgactcaat

SEQ ID NO: 669757 - DNA, 25 bp, Rattus norvegicus
ttccttccggatagaatatgatacc

SEQ ID NO: 669758 - DNA, 25 bp, Rattus norvegicus
ttccttccggattgaatatgatacc

SEQ ID NO: 669759 - DNA, 25 bp, Rattus norvegicus
ttccttcctatgcaagtgggaaaca

SEQ ID NO: 669760 - DNA, 25 bp, Rattus norvegicus
ttccttcctatggaagtgggaaaca

SEQ ID NO: 669761 - DNA, 25 bp, Rattus norvegicus
ttccttcctcagcatcaaggatgta

SEQ ID NO: 669762 - DNA, 25 bp, Rattus norvegicus
ttccttcctcagcttcgtgtgaaat

SEQ ID NO: 669763 - DNA, 25 bp, Rattus norvegicus
ttccttcctcaggatcaaggatgta

SEQ ID NO: 669764 - DNA, 25 bp, Rattus norvegicus
ttccttcctcaggttcgtgtgaaat

SEQ ID NO: 669765 - DNA, 25 bp, Rattus norvegicus
ttccttcctctgaggtaaatagaaa

SEQ ID NO: 669766 - DNA, 25 bp, Rattus norvegicus
ttccttcctctgcatagaaaaccaa

SEQ ID NO: 669767 - DNA, 25 bp, Rattus norvegicus
ttccttcctctggatagaaaaccaa

SEQ ID NO: 669768 - DNA, 25 bp, Rattus norvegicus
ttccttcctctgtggtaaatagaaa

SEQ ID NO: 669769 - DNA, 25 bp, Rattus norvegicus
ttccttcctcttatggctggtgggc

SEQ ID NO: 669770 - DNA, 25 bp, Rattus norvegicus
ttccttcctcttttggctggtgggc

SEQ ID NO: 669771 - DNA, 25 bp, Rattus norvegicus
ttccttcctgagattccaagagaaa

SEQ ID NO: 669772 - DNA, 25 bp, Rattus norvegicus
ttccttcctgagtttccaagagaaa

SEQ ID NO: 669773 - DNA, 25 bp, Rattus norvegicus
ttccttcctggacttagggagtcac

SEQ ID NO: 669774 - DNA, 25 bp, Rattus norvegicus
ttccttcctggagttagggagtcac

SEQ ID NO: 669775 - DNA, 25 bp, Rattus norvegicus
ttccttcctggtaggttacaggctt

SEQ ID NO: 669776 - DNA, 25 bp, Rattus norvegicus
ttccttcctggtcgactgcagcaaa

SEQ ID NO: 669777 - DNA, 25 bp, Rattus norvegicus
ttccttcctggtggactgcagcaaa

SEQ ID NO: 669778 - DNA, 25 bp, Rattus norvegicus
ttccttcctggttggttacaggctt

SEQ ID NO: 669779 - DNA, 25 bp, Rattus norvegicus
ttccttcctgtacaatgtctcatgg

SEQ ID NO: 669780 - DNA, 25 bp, Rattus norvegicus
ttccttcctgtagaatgtctcatgg

SEQ ID NO: 669781 - DNA, 25 bp, Rattus norvegicus
ttccttcctttgatacagaattctg

SEQ ID NO: 669782 - DNA, 25 bp, Rattus norvegicus
ttccttcctttgttacagaattctg

SEQ ID NO: 669783 - DNA, 25 bp, Rattus norvegicus
ttccttccttttccggtggcagtaa

SEQ ID NO: 669784 - DNA, 25 bp, Rattus norvegicus
ttccttccttttcgatttctctcca

SEQ ID NO: 669785 - DNA, 25 bp, Rattus norvegicus
ttccttccttttgcggtggcagtaa

SEQ ID NO: 669786 - DNA, 25 bp, Rattus norvegicus
ttccttccttttggatttctctcca

SEQ ID NO: 669787 - DNA, 25 bp, Rattus norvegicus
ttccttcgccctacagaattagagt

SEQ ID NO: 669788 - DNA, 25 bp, Rattus norvegicus
ttccttcgcccttcagaattagagt

SEQ ID NO: 669789 - DNA, 25 bp, Rattus norvegicus
ttccttcgctgaaagccgtgtgccg

SEQ ID NO: 669790 - DNA, 25 bp, Rattus norvegicus
ttccttcgctgatagccgtgtgccg

SEQ ID NO: 669791 - DNA, 25 bp, Rattus norvegicus
ttccttcggagccagtgcttttaga

SEQ ID NO: 669792 - DNA, 25 bp, Rattus norvegicus
ttccttcggagcgagtgcttttaga

SEQ ID NO: 669793 - DNA, 25 bp, Rattus norvegicus
ttccttcggctcctttattggagtt

SEQ ID NO: 669794 - DNA, 25 bp, Rattus norvegicus
ttccttcggctcgtttattggagtt

SEQ ID NO: 669795 - DNA, 25 bp, Rattus norvegicus
ttccttcggtgtctttttgctagat

SEQ ID NO: 669796 - DNA, 25 bp, Rattus norvegicus
ttccttcggtgtgtttttgctagat

SEQ ID NO: 669797 - DNA, 25 bp, Rattus norvegicus
ttccttcgtagtaccaccagtgaag

SEQ ID NO: 669798 - DNA, 25 bp, Rattus norvegicus
ttccttcgtagttccaccagtgaag

SEQ ID NO: 669799 - DNA, 25 bp, Rattus norvegicus
ttccttcgtctcaggattactggac

SEQ ID NO: 669800 - DNA, 25 bp, Rattus norvegicus
ttccttcgtctctggattactggac

SEQ ID NO: 669801 - DNA, 25 bp, Rattus norvegicus
ttccttcgtgtgctctaacagttgt

SEQ ID NO: 669802 - DNA, 25 bp, Rattus norvegicus
ttccttcgtgtggtctaacagttgt

SEQ ID NO: 669803 - DNA, 25 bp, Rattus norvegicus
ttccttcgttctcaattttggagag

SEQ ID NO: 669804 - DNA, 25 bp, Rattus norvegicus
ttccttcgttctgaattttggagag

SEQ ID NO: 669805 - DNA, 25 bp, Rattus norvegicus
ttccttctactcagacgtgtctgga

SEQ ID NO: 669806 - DNA, 25 bp, Rattus norvegicus
ttccttctactcatgtgactttttt

SEQ ID NO: 669807 - DNA, 25 bp, Rattus norvegicus
ttccttctactctgacgtgtctgga

SEQ ID NO: 669808 - DNA, 25 bp, Rattus norvegicus
ttccttctactcttgtgactttttt

SEQ ID NO: 669809 - DNA, 25 bp, Rattus norvegicus
ttccttctagttctggactctggaa

SEQ ID NO: 669810 - DNA, 25 bp, Rattus norvegicus
ttccttctagttgtggactctggaa

SEQ ID NO: 669811 - DNA, 25 bp, Rattus norvegicus
ttccttctcatcacaggcatctaga

SEQ ID NO: 669812 - DNA, 25 bp, Rattus norvegicus
ttccttctcatccatgaacttcatt

SEQ ID NO: 669813 - DNA, 25 bp, Rattus norvegicus
ttccttctcatcgatgaacttcatt

SEQ ID NO: 669814 - DNA, 25 bp, Rattus norvegicus
ttccttctcatctcaggcatctaga

SEQ ID NO: 669815 - DNA, 25 bp, Rattus norvegicus
ttccttctcattccaagttatcctt

SEQ ID NO: 669816 - DNA, 25 bp, Rattus norvegicus
ttccttctcattgcaagttatcctt

SEQ ID NO: 669817 - DNA, 25 bp, Rattus norvegicus
ttccttctcctaccatgttacagag

SEQ ID NO: 669818 - DNA, 25 bp, Rattus norvegicus
ttccttctcctagcatgttacagag

SEQ ID NO: 669819 - DNA, 25 bp, Rattus norvegicus
ttccttctctcaaatatgtggtcat

SEQ ID NO: 669820 - DNA, 25 bp, Rattus norvegicus
ttccttctctcatatatgtggtcat

SEQ ID NO: 669821 - DNA, 25 bp, Rattus norvegicus
ttccttctctgcatatacacttact

SEQ ID NO: 669822 - DNA, 25 bp, Rattus norvegicus
ttccttctctgcttatacacttact

SEQ ID NO: 669823 - DNA, 25 bp, Rattus norvegicus
ttccttctgggacttctacgtagtg

SEQ ID NO: 669824 - DNA, 25 bp, Rattus norvegicus
ttccttctgggagttctacgtagtg

SEQ ID NO: 669825 - DNA, 25 bp, Rattus norvegicus
ttccttctggttcttggttcgccct

SEQ ID NO: 669826 - DNA, 25 bp, Rattus norvegicus
ttccttctggttgttggttcgccct

SEQ ID NO: 669827 - DNA, 25 bp, Rattus norvegicus
ttccttcttccacgactgctgtaaa

SEQ ID NO: 669828 - DNA, 25 bp, Rattus norvegicus
ttccttcttccaggactgctgtaaa

SEQ ID NO: 669829 - DNA, 25 bp, Rattus norvegicus
ttccttcttggaactgcttgtgaac

SEQ ID NO: 669830 - DNA, 25 bp, Rattus norvegicus
ttccttcttggacgaggtgtgcact

SEQ ID NO: 669831 - DNA, 25 bp, Rattus norvegicus
ttccttcttggaggaggtgtgcact

SEQ ID NO: 669832 - DNA, 25 bp, Rattus norvegicus
ttccttcttggatctgcttgtgaac

SEQ ID NO: 669833 - DNA, 25 bp, Rattus norvegicus
ttccttcttgtcaccagttaaagcc

SEQ ID NO: 669834 - DNA, 25 bp, Rattus norvegicus
ttccttcttgtcctccaaaatactt

SEQ ID NO: 669835 - DNA, 25 bp, Rattus norvegicus
ttccttcttgtcgtccaaaatactt

SEQ ID NO: 669836 - DNA, 25 bp, Rattus norvegicus
ttccttcttgtctccagttaaagcc

SEQ ID NO: 669837 - DNA, 25 bp, Rattus norvegicus
ttccttctttgcctttcatattcat

SEQ ID NO: 669838 - DNA, 25 bp, Rattus norvegicus
ttccttctttgcgtttcatattcat

SEQ ID NO: 669839 - DNA, 25 bp, Rattus norvegicus
ttccttctttgtcacactcattcaa

SEQ ID NO: 669840 - DNA, 25 bp, Rattus norvegicus
ttccttctttgtgacactcattcaa

SEQ ID NO: 669841 - DNA, 25 bp, Rattus norvegicus
ttccttcttttgcaccttggtcaat

SEQ ID NO: 669842 - DNA, 25 bp, Rattus norvegicus
ttccttcttttggaccttggtcaat

SEQ ID NO: 669843 - DNA, 25 bp, Rattus norvegicus
ttccttgaccctattatagattgag

SEQ ID NO: 669844 - DNA, 25 bp, Rattus norvegicus
ttccttgacccttttatagattgag

SEQ ID NO: 669845 - DNA, 25 bp, Rattus norvegicus
ttccttgacgggaccccgcattatt

SEQ ID NO: 669846 - DNA, 25 bp, Rattus norvegicus
ttccttgacgggtccccgcattatt

SEQ ID NO: 669847 - DNA, 25 bp, Rattus norvegicus
ttccttgactgtagcctggttatct

SEQ ID NO: 669848 - DNA, 25 bp, Rattus norvegicus
ttccttgactgttgcctggttatct

SEQ ID NO: 669849 - DNA, 25 bp, Rattus norvegicus
ttccttgagactcctgcgccatgag

SEQ ID NO: 669850 - DNA, 25 bp, Rattus norvegicus
ttccttgagactgctgcgccatgag

SEQ ID NO: 669851 - DNA, 25 bp, Rattus norvegicus
ttccttgagcaaccttttgttaact

SEQ ID NO: 669852 - DNA, 25 bp, Rattus norvegicus
ttccttgagcaagcttttgttaact

SEQ ID NO: 669853 - DNA, 25 bp, Rattus norvegicus
ttccttgagcatactgtacactaag

SEQ ID NO: 669854 - DNA, 25 bp, Rattus norvegicus
ttccttgagcattctgtacactaag

SEQ ID NO: 669855 - DNA, 25 bp, Rattus norvegicus
ttccttgagcccaacgtaaaagttg

SEQ ID NO: 669856 - DNA, 25 bp, Rattus norvegicus
ttccttgagccctacgtaaaagttg

SEQ ID NO: 669857 - DNA, 25 bp, Rattus norvegicus
ttccttgagtttctcaccagcgatg

SEQ ID NO: 669858 - DNA, 25 bp, Rattus norvegicus
ttccttgagtttgtcaccagcgatg

SEQ ID NO: 669859 - DNA, 25 bp, Rattus norvegicus
ttccttgatcagacagaaatcgatg

SEQ ID NO: 669860 - DNA, 25 bp, Rattus norvegicus
ttccttgatcagtcagaaatcgatg

SEQ ID NO: 669861 - DNA, 25 bp, Rattus norvegicus
ttccttgatcttccaactcttctta

SEQ ID NO: 669862 - DNA, 25 bp, Rattus norvegicus
ttccttgatcttgcaactcttctta

SEQ ID NO: 669863 - DNA, 25 bp, Rattus norvegicus
ttccttgcacgcaagctagtagctg

SEQ ID NO: 669864 - DNA, 25 bp, Rattus norvegicus
ttccttgcacgctagctagtagctg

SEQ ID NO: 669865 - DNA, 25 bp, Rattus norvegicus
ttccttgcagggacacttgattttt

SEQ ID NO: 669866 - DNA, 25 bp, Rattus norvegicus
ttccttgcagggtcacttgattttt

SEQ ID NO: 669867 - DNA, 25 bp, Rattus norvegicus
ttccttgcatcccatggtatattag

SEQ ID NO: 669868 - DNA, 25 bp, Rattus norvegicus
ttccttgcatccctacaaactgaga

SEQ ID NO: 669869 - DNA, 25 bp, Rattus norvegicus
ttccttgcatccgatggtatattag

SEQ ID NO: 669870 - DNA, 25 bp, Rattus norvegicus
ttccttgcatccgtacaaactgaga

SEQ ID NO: 669871 - DNA, 25 bp, Rattus norvegicus
ttccttgccagacccaaacacagag

SEQ ID NO: 669872 - DNA, 25 bp, Rattus norvegicus
ttccttgccagagccaaacacagag

SEQ ID NO: 669873 - DNA, 25 bp, Rattus norvegicus
ttccttgccagtatgatttcatatg

SEQ ID NO: 669874 - DNA, 25 bp, Rattus norvegicus
ttccttgccagtttgatttcatatg

SEQ ID NO: 669875 - DNA, 25 bp, Rattus norvegicus
ttccttgccattcttgggataatgc

SEQ ID NO: 669876 - DNA, 25 bp, Rattus norvegicus
ttccttgccattgttgggataatgc

SEQ ID NO: 669877 - DNA, 25 bp, Rattus norvegicus
ttccttgctgaacttgctactcggc

SEQ ID NO: 669878 - DNA, 25 bp, Rattus norvegicus
ttccttgctgaagttgctactcggc

SEQ ID NO: 669879 - DNA, 25 bp, Rattus norvegicus
ttccttgctgctcacattctgagaa

SEQ ID NO: 669880 - DNA, 25 bp, Rattus norvegicus
ttccttgctgctgacattctgagaa

SEQ ID NO: 669881 - DNA, 25 bp, Rattus norvegicus
ttccttgctggtcggtctgagcccc

SEQ ID NO: 669882 - DNA, 25 bp, Rattus norvegicus
ttccttgctggtgggtctgagcccc

SEQ ID NO: 669883 - DNA, 25 bp, Rattus norvegicus
ttccttgcttctccattgtacatgt

SEQ ID NO: 669884 - DNA, 25 bp, Rattus norvegicus
ttccttgcttctgcattgtacatgt

SEQ ID NO: 669885 - DNA, 25 bp, Rattus norvegicus
ttccttgctttcctctgagacagga

SEQ ID NO: 669886 - DNA, 25 bp, Rattus norvegicus
ttccttgctttcgtctgagacagga

SEQ ID NO: 669887 - DNA, 25 bp, Rattus norvegicus
ttccttggactacttgtctcctaag

SEQ ID NO: 669888 - DNA, 25 bp, Rattus norvegicus
ttccttggactagttgtctcctaag

SEQ ID NO: 669889 - DNA, 25 bp, Rattus norvegicus
ttccttggagccataaacactagct

SEQ ID NO: 669890 - DNA, 25 bp, Rattus norvegicus
ttccttggagccttaaacactagct

SEQ ID NO: 669891 - DNA, 25 bp, Rattus norvegicus
ttccttggaggaaaatcccttggtg

SEQ ID NO: 669892 - DNA, 25 bp, Rattus norvegicus
ttccttggaggataatcccttggtg

SEQ ID NO: 669893 - DNA, 25 bp, Rattus norvegicus
ttccttggattgagtggtacataca

SEQ ID NO: 669894 - DNA, 25 bp, Rattus norvegicus
ttccttggattgtgtggtacataca

SEQ ID NO: 669895 - DNA, 25 bp, Rattus norvegicus
ttccttggcaggcactcaactgcag

SEQ ID NO: 669896 - DNA, 25 bp, Rattus norvegicus
ttccttggcagggactcaactgcag

SEQ ID NO: 669897 - DNA, 25 bp, Rattus norvegicus
ttccttggcccaacaggacagatgc

SEQ ID NO: 669898 - DNA, 25 bp, Rattus norvegicus
ttccttggcccatcaggacagatgc

SEQ ID NO: 669899 - DNA, 25 bp, Rattus norvegicus
ttccttggccctactgagtgaataa

SEQ ID NO: 669900 - DNA, 25 bp, Rattus norvegicus
ttccttggcccttctgagtgaataa

SEQ ID NO: 669901 - DNA, 25 bp, Rattus norvegicus
ttccttggcctacatttcccttcag

SEQ ID NO: 669902 - DNA, 25 bp, Rattus norvegicus
ttccttggcctagatttcccttcag

SEQ ID NO: 669903 - DNA, 25 bp, Rattus norvegicus
ttccttgggctaaacgggtatctag

SEQ ID NO: 669904 - DNA, 25 bp, Rattus norvegicus
ttccttgggctatacgggtatctag

SEQ ID NO: 669905 - DNA, 25 bp, Rattus norvegicus
ttccttgggctgaacctaacgtaag

SEQ ID NO: 669906 - DNA, 25 bp, Rattus norvegicus
ttccttgggctgtacctaacgtaag

SEQ ID NO: 669907 - DNA, 25 bp, Rattus norvegicus
ttccttggtcaacataactctgaac

SEQ ID NO: 669908 - DNA, 25 bp, Rattus norvegicus
ttccttggtcaagataactctgaac

SEQ ID NO: 669909 - DNA, 25 bp, Rattus norvegicus
ttccttggtgcaatcccagttcagg

SEQ ID NO: 669910 - DNA, 25 bp, Rattus norvegicus
ttccttggtgcattcccagttcagg

SEQ ID NO: 669911 - DNA, 25 bp, Rattus norvegicus
ttccttgtcaagagtttccctgttc

SEQ ID NO: 669912 - DNA, 25 bp, Rattus norvegicus
ttccttgtcaagtgtttccctgttc

SEQ ID NO: 669913 - DNA, 25 bp, Rattus norvegicus
ttccttgtcctccaattactgtgat

SEQ ID NO: 669914 - DNA, 25 bp, Rattus norvegicus
ttccttgtcctcgaattactgtgat

SEQ ID NO: 669915 - DNA, 25 bp, Rattus norvegicus
ttccttgtccttattgtcccgagaa

SEQ ID NO: 669916 - DNA, 25 bp, Rattus norvegicus
ttccttgtccttcttcttgataatg

SEQ ID NO: 669917 - DNA, 25 bp, Rattus norvegicus
ttccttgtccttgttcttgataatg

SEQ ID NO: 669918 - DNA, 25 bp, Rattus norvegicus
ttccttgtcctttttgtcccgagaa

SEQ ID NO: 669919 - DNA, 25 bp, Rattus norvegicus
ttccttgtggtcatctttcctaaag

SEQ ID NO: 669920 - DNA, 25 bp, Rattus norvegicus
ttccttgtggtcttctttcctaaag

SEQ ID NO: 669921 - DNA, 25 bp, Rattus norvegicus
ttccttgtgttgactgctttgatgt

SEQ ID NO: 669922 - DNA, 25 bp, Rattus norvegicus
ttccttgtgttgtctgctttgatgt

SEQ ID NO: 669923 - DNA, 25 bp, Rattus norvegicus
ttccttgttggacaccctggtaaga

SEQ ID NO: 669924 - DNA, 25 bp, Rattus norvegicus
ttccttgttggagaccctggtaaga

SEQ ID NO: 669925 - DNA, 25 bp, Rattus norvegicus
ttcctttaaattacccactggtcat

SEQ ID NO: 669926 - DNA, 25 bp, Rattus norvegicus
ttcctttaaatttcccactggtcat

SEQ ID NO: 669927 - DNA, 25 bp, Rattus norvegicus
ttcctttacatcacataacacccaa

SEQ ID NO: 669928 - DNA, 25 bp, Rattus norvegicus
ttcctttacatctcataacacccaa

SEQ ID NO: 669929 - DNA, 25 bp, Rattus norvegicus
ttcctttacctgctagagagctctg

SEQ ID NO: 669930 - DNA, 25 bp, Rattus norvegicus
ttcctttacctggtagagagctctg

SEQ ID NO: 669931 - DNA, 25 bp, Rattus norvegicus
ttcctttagaaaagtccattaaaat

SEQ ID NO: 669932 - DNA, 25 bp, Rattus norvegicus
ttcctttagaaatgtccattaaaat

SEQ ID NO: 669933 - DNA, 25 bp, Rattus norvegicus
ttcctttagagaccttgccctctgc

SEQ ID NO: 669934 - DNA, 25 bp, Rattus norvegicus
ttcctttagagagcttgccctctgc

SEQ ID NO: 669935 - DNA, 25 bp, Rattus norvegicus
ttcctttagggcatacacaacatga

SEQ ID NO: 669936 - DNA, 25 bp, Rattus norvegicus
ttcctttagggcttacacaacatga

SEQ ID NO: 669937 - DNA, 25 bp, Rattus norvegicus
ttcctttatagcctcgggtgtgaag

SEQ ID NO: 669938 - DNA, 25 bp, Rattus norvegicus
ttcctttatagcgtcgggtgtgaag

SEQ ID NO: 669939 - DNA, 25 bp, Rattus norvegicus
ttcctttatcccacatatgcaatga

SEQ ID NO: 669940 - DNA, 25 bp, Rattus norvegicus
ttcctttatccctcatatgcaatga

SEQ ID NO: 669941 - DNA, 25 bp, Rattus norvegicus
ttcctttatggaattctcggtcctt

SEQ ID NO: 669942 - DNA, 25 bp, Rattus norvegicus
ttcctttatggatttctcggtcctt

SEQ ID NO: 669943 - DNA, 25 bp, Rattus norvegicus
ttcctttcaagaacgtggcccagag

SEQ ID NO: 669944 - DNA, 25 bp, Rattus norvegicus
ttcctttcaagatcgtggcccagag

SEQ ID NO: 669945 - DNA, 25 bp, Rattus norvegicus
ttcctttcaccaatttacactttca

SEQ ID NO: 669946 - DNA, 25 bp, Rattus norvegicus
ttcctttcaccattttacactttca

SEQ ID NO: 669947 - DNA, 25 bp, Rattus norvegicus
ttcctttcaggcctatgacttgcac

SEQ ID NO: 669948 - DNA, 25 bp, Rattus norvegicus
ttcctttcaggcgtatgacttgcac

SEQ ID NO: 669949 - DNA, 25 bp, Rattus norvegicus
ttcctttcagttcctcagaggtcgc

SEQ ID NO: 669950 - DNA, 25 bp, Rattus norvegicus
ttcctttcagttgctcagaggtcgc

SEQ ID NO: 669951 - DNA, 25 bp, Rattus norvegicus
ttcctttccaagcacaactcagttc

SEQ ID NO: 669952 - DNA, 25 bp, Rattus norvegicus
ttcctttccaaggacaactcagttc

SEQ ID NO: 669953 - DNA, 25 bp, Rattus norvegicus
ttcctttccaggacagatcgctaaa

SEQ ID NO: 669954 - DNA, 25 bp, Rattus norvegicus
ttcctttccaggtcagatcgctaaa

SEQ ID NO: 669955 - DNA, 25 bp, Rattus norvegicus
ttcctttccataagactggaatcaa

SEQ ID NO: 669956 - DNA, 25 bp, Rattus norvegicus
ttcctttccatacttgccccaaaag

SEQ ID NO: 669957 - DNA, 25 bp, Rattus norvegicus
ttcctttccatagttgccccaaaag

SEQ ID NO: 669958 - DNA, 25 bp, Rattus norvegicus
ttcctttccatatgactggaatcaa

SEQ ID NO: 669959 - DNA, 25 bp, Rattus norvegicus
ttcctttccctcagcagatgataca

SEQ ID NO: 669960 - DNA, 25 bp, Rattus norvegicus
ttcctttccctctgcagatgataca

SEQ ID NO: 669961 - DNA, 25 bp, Rattus norvegicus
ttcctttccgtgatcttaagccaaa

SEQ ID NO: 669962 - DNA, 25 bp, Rattus norvegicus
ttcctttccgtgttcttaagccaaa

SEQ ID NO: 669963 - DNA, 25 bp, Rattus norvegicus
ttcctttcctcaccaccagggtggg

SEQ ID NO: 669964 - DNA, 25 bp, Rattus norvegicus
ttcctttcctcagcaccagggtggg

SEQ ID NO: 669965 - DNA, 25 bp, Rattus norvegicus
ttcctttcctccattactattctga

SEQ ID NO: 669966 - DNA, 25 bp, Rattus norvegicus
ttcctttcctcctttactattctga

SEQ ID NO: 669967 - DNA, 25 bp, Rattus norvegicus
ttcctttcctctatctttcaagatt

SEQ ID NO: 669968 - DNA, 25 bp, Rattus norvegicus
ttcctttcctctcgagtcagtgaaa

SEQ ID NO: 669969 - DNA, 25 bp, Rattus norvegicus
ttcctttcctctggagtcagtgaaa

SEQ ID NO: 669970 - DNA, 25 bp, Rattus norvegicus
ttcctttcctctttctttcaagatt

SEQ ID NO: 669971 - DNA, 25 bp, Rattus norvegicus
ttcctttcggtacaaatggtccgca

SEQ ID NO: 669972 - DNA, 25 bp, Rattus norvegicus
ttcctttcggtagaaatggtccgca

SEQ ID NO: 669973 - DNA, 25 bp, Rattus norvegicus
ttcctttcgttgacattaaatattc

SEQ ID NO: 669974 - DNA, 25 bp, Rattus norvegicus
ttcctttcgttgtcattaaatattc

SEQ ID NO: 669975 - DNA, 25 bp, Rattus norvegicus
ttcctttctattcttgctactctca

SEQ ID NO: 669976 - DNA, 25 bp, Rattus norvegicus
ttcctttctattgttgctactctca

SEQ ID NO: 669977 - DNA, 25 bp, Rattus norvegicus
ttcctttctgccatacttgaggttt

SEQ ID NO: 669978 - DNA, 25 bp, Rattus norvegicus
ttcctttctgccttacttgaggttt

SEQ ID NO: 669979 - DNA, 25 bp, Rattus norvegicus
ttcctttctggtaggctaggtttat

SEQ ID NO: 669980 - DNA, 25 bp, Rattus norvegicus
ttcctttctggttggctaggtttat

SEQ ID NO: 669981 - DNA, 25 bp, Rattus norvegicus
ttcctttcttaccaggttaccactg

SEQ ID NO: 669982 - DNA, 25 bp, Rattus norvegicus
ttcctttcttacgaggttaccactg

SEQ ID NO: 669983 - DNA, 25 bp, Rattus norvegicus
ttcctttcttatatcgctttgtcca

SEQ ID NO: 669984 - DNA, 25 bp, Rattus norvegicus
ttcctttcttatttcgctttgtcca

SEQ ID NO: 669985 - DNA, 25 bp, Rattus norvegicus
ttcctttcttctactgtcctcttag

SEQ ID NO: 669986 - DNA, 25 bp, Rattus norvegicus
ttcctttcttcttctgtcctcttag

SEQ ID NO: 669987 - DNA, 25 bp, Rattus norvegicus
ttcctttctttcacaacaccagagg

SEQ ID NO: 669988 - DNA, 25 bp, Rattus norvegicus
ttcctttctttctcaacaccagagg

SEQ ID NO: 669989 - DNA, 25 bp, Rattus norvegicus
ttcctttgaactcagcaagctcagc

SEQ ID NO: 669990 - DNA, 25 bp, Rattus norvegicus
ttcctttgaactgagcaagctcagc

SEQ ID NO: 669991 - DNA, 25 bp, Rattus norvegicus
ttcctttgactcaagccgttcattt

SEQ ID NO: 669992 - DNA, 25 bp, Rattus norvegicus
ttcctttgactctagccgttcattt

SEQ ID NO: 669993 - DNA, 25 bp, Rattus norvegicus
ttcctttgagccagagcacatgagt

SEQ ID NO: 669994 - DNA, 25 bp, Rattus norvegicus
ttcctttgagcctgagcacatgagt

SEQ ID NO: 669995 - DNA, 25 bp, Rattus norvegicus
ttcctttgattcattccaaccatga

SEQ ID NO: 669996 - DNA, 25 bp, Rattus norvegicus
ttcctttgattctttccaaccatga

SEQ ID NO: 669997 - DNA, 25 bp, Rattus norvegicus
ttcctttgcacaagtgtctgggcat

SEQ ID NO: 669998 - DNA, 25 bp, Rattus norvegicus
ttcctttgcacatgtgtctgggcat

SEQ ID NO: 669999 - DNA, 25 bp, Rattus norvegicus
ttcctttgcagaagctcttgggagt

SEQ ID NO: 670000 - DNA, 25 bp, Rattus norvegicus
ttcctttgcagatgctcttgggagt

SEQ ID NO: 670001 - DNA, 25 bp, Rattus norvegicus
ttcctttgccaacctaagccttgtt

SEQ ID NO: 670002 - DNA, 25 bp, Rattus norvegicus
ttcctttgccaactagtgactatgt

SEQ ID NO: 670003 - DNA, 25 bp, Rattus norvegicus
ttcctttgccaagctaagccttgtt

SEQ ID NO: 670004 - DNA, 25 bp, Rattus norvegicus
ttcctttgccaagtagtgactatgt

SEQ ID NO: 670005 - DNA, 25 bp, Rattus norvegicus
ttcctttgccttctcactttttata

SEQ ID NO: 670006 - DNA, 25 bp, Rattus norvegicus
ttcctttgccttgtcactttttata

SEQ ID NO: 670007 - DNA, 25 bp, Rattus norvegicus
ttcctttgctacctcattagcaggg

SEQ ID NO: 670008 - DNA, 25 bp, Rattus norvegicus
ttcctttgctacgtcattagcaggg

SEQ ID NO: 670009 - DNA, 25 bp, Rattus norvegicus
ttcctttggagactcgcccttgtca

SEQ ID NO: 670010 - DNA, 25 bp, Rattus norvegicus
ttcctttggagagtcgcccttgtca

SEQ ID NO: 670011 - DNA, 25 bp, Rattus norvegicus
ttcctttggatactgtggctgccca

SEQ ID NO: 670012 - DNA, 25 bp, Rattus norvegicus
ttcctttggatagtgtggctgccca

SEQ ID NO: 670013 - DNA, 25 bp, Rattus norvegicus
ttcctttggattctgtgggcaccag

SEQ ID NO: 670014 - DNA, 25 bp, Rattus norvegicus
ttcctttggattgtgtgggcaccag

SEQ ID NO: 670015 - DNA, 25 bp, Rattus norvegicus
ttcctttggtcgcagcactagggag

SEQ ID NO: 670016 - DNA, 25 bp, Rattus norvegicus
ttcctttggtcggagcactagggag

SEQ ID NO: 670017 - DNA, 25 bp, Rattus norvegicus
ttcctttgtattattgccaccggtg

SEQ ID NO: 670018 - DNA, 25 bp, Rattus norvegicus
ttcctttgtatttttgccaccggtg

SEQ ID NO: 670019 - DNA, 25 bp, Rattus norvegicus
ttcctttgtttactctgtgctttcg

SEQ ID NO: 670020 - DNA, 25 bp, Rattus norvegicus
ttcctttgtttagtctgtgctttcg

SEQ ID NO: 670021 - DNA, 25 bp, Rattus norvegicus
ttccttttactgcacctgagactca

SEQ ID NO: 670022 - DNA, 25 bp, Rattus norvegicus
ttccttttactggacctgagactca

SEQ ID NO: 670023 - DNA, 25 bp, Rattus norvegicus
ttccttttaggaatgctgggtgctg

SEQ ID NO: 670024 - DNA, 25 bp, Rattus norvegicus
ttccttttaggattgctgggtgctg

SEQ ID NO: 670025 - DNA, 25 bp, Rattus norvegicus
ttccttttatctcttctatctgcca

SEQ ID NO: 670026 - DNA, 25 bp, Rattus norvegicus
ttccttttatctgttctatctgcca

SEQ ID NO: 670027 - DNA, 25 bp, Rattus norvegicus
ttccttttcacaataaatccacagt

SEQ ID NO: 670028 - DNA, 25 bp, Rattus norvegicus
ttccttttcacattaaatccacagt

SEQ ID NO: 670029 - DNA, 25 bp, Rattus norvegicus
ttccttttccagactgtctgtatgc

SEQ ID NO: 670030 - DNA, 25 bp, Rattus norvegicus
ttccttttccagcagtcgggattta

SEQ ID NO: 670031 - DNA, 25 bp, Rattus norvegicus
ttccttttccaggagtcgggattta

SEQ ID NO: 670032 - DNA, 25 bp, Rattus norvegicus
ttccttttccagtctgtctgtatgc

SEQ ID NO: 670033 - DNA, 25 bp, Rattus norvegicus
ttccttttcccacctattttctatg

SEQ ID NO: 670034 - DNA, 25 bp, Rattus norvegicus
ttccttttcccagctattttctatg

SEQ ID NO: 670035 - DNA, 25 bp, Rattus norvegicus
ttccttttccttatgtcaagtgcca

SEQ ID NO: 670036 - DNA, 25 bp, Rattus norvegicus
ttccttttccttttgtcaagtgcca

SEQ ID NO: 670037 - DNA, 25 bp, Rattus norvegicus
ttccttttcttcatagtttatcctg

SEQ ID NO: 670038 - DNA, 25 bp, Rattus norvegicus
ttccttttcttcttagtttatcctg

SEQ ID NO: 670039 - DNA, 25 bp, Rattus norvegicus
ttccttttgccaaggtcacgggtcg

SEQ ID NO: 670040 - DNA, 25 bp, Rattus norvegicus
ttccttttgccatggtcacgggtcg

SEQ ID NO: 670041 - DNA, 25 bp, Rattus norvegicus
ttccttttgtaaacctccacagaca

SEQ ID NO: 670042 - DNA, 25 bp, Rattus norvegicus
ttccttttgtaatcctccacagaca

SEQ ID NO: 670043 - DNA, 25 bp, Rattus norvegicus
ttccttttgttgcttcccattgtgt

SEQ ID NO: 670044 - DNA, 25 bp, Rattus norvegicus
ttccttttgttggttcccattgtgt

SEQ ID NO: 670045 - DNA, 25 bp, Rattus norvegicus
ttcctttttaagacactgtgatata

SEQ ID NO: 670046 - DNA, 25 bp, Rattus norvegicus
ttcctttttaagtcactgtgatata

SEQ ID NO: 670047 - DNA, 25 bp, Rattus norvegicus
ttcctttttctgatagtgttcgctg

SEQ ID NO: 670048 - DNA, 25 bp, Rattus norvegicus
ttcctttttctgttagtgttcgctg

SEQ ID NO: 670049 - DNA, 25 bp, Rattus norvegicus
ttcctttttgctattgagtcgctga

SEQ ID NO: 670050 - DNA, 25 bp, Rattus norvegicus
ttcctttttgcttttgagtcgctga

SEQ ID NO: 670051 - DNA, 25 bp, Rattus norvegicus
ttcctttttgttattgtcgtcgttg

SEQ ID NO: 670052 - DNA, 25 bp, Rattus norvegicus
ttcctttttgtttttgtcgtcgttg

SEQ ID NO: 670053 - DNA, 25 bp, Rattus norvegicus
ttccttttttccactgagagcttgt

SEQ ID NO: 670054 - DNA, 25 bp, Rattus norvegicus
ttccttttttcctctgagagcttgt

SEQ ID NO: 670055 - DNA, 25 bp, Rattus norvegicus
ttccttttttgcaagtgcttcagtt

SEQ ID NO: 670056 - DNA, 25 bp, Rattus norvegicus
ttccttttttgctagtgcttcagtt

SEQ ID NO: 670057 - DNA, 25 bp, Rattus norvegicus
ttcgaaacatgaagtctcctccttt

SEQ ID NO: 670058 - DNA, 25 bp, Rattus norvegicus
ttcgaaacatgatgtctcctccttt

SEQ ID NO: 670059 - DNA, 25 bp, Rattus norvegicus
ttcgaaactaatacttacagcaggt

SEQ ID NO: 670060 - DNA, 25 bp, Rattus norvegicus
ttcgaaactaattcttacagcaggt

SEQ ID NO: 670061 - DNA, 25 bp, Rattus norvegicus
ttcgaaagaaccagcagctgaccct

SEQ ID NO: 670062 - DNA, 25 bp, Rattus norvegicus
ttcgaaagaacctgcagctgaccct

SEQ ID NO: 670063 - DNA, 25 bp, Rattus norvegicus
ttcgaaaggcccactgagcgttcat

SEQ ID NO: 670064 - DNA, 25 bp, Rattus norvegicus
ttcgaaaggccctctgagcgttcat

SEQ ID NO: 670065 - DNA, 25 bp, Rattus norvegicus
ttcgaaatgggaagctccgtgtcgc

SEQ ID NO: 670066 - DNA, 25 bp, Rattus norvegicus
ttcgaaatgggatgctccgtgtcgc

SEQ ID NO: 670067 - DNA, 25 bp, Rattus norvegicus
ttcgaacactcaccctcattatttt

SEQ ID NO: 670068 - DNA, 25 bp, Rattus norvegicus
ttcgaacactcagcctcattatttt

SEQ ID NO: 670069 - DNA, 25 bp, Rattus norvegicus
ttcgaaccatggaccaggctctcaa

SEQ ID NO: 670070 - DNA, 25 bp, Rattus norvegicus
ttcgaaccatggtccaggctctcaa

SEQ ID NO: 670071 - DNA, 25 bp, Rattus norvegicus
ttcgaactccacctacttctgtaag

SEQ ID NO: 670072 - DNA, 25 bp, Rattus norvegicus
ttcgaactccacgtacttctgtaag

SEQ ID NO: 670073 - DNA, 25 bp, Rattus norvegicus
ttcgaacttgatatggctgaccctg

SEQ ID NO: 670074 - DNA, 25 bp, Rattus norvegicus
ttcgaacttgatttggctgaccctg

SEQ ID NO: 670075 - DNA, 25 bp, Rattus norvegicus
ttcgaagccgagacaccacgatgaa

SEQ ID NO: 670076 - DNA, 25 bp, Rattus norvegicus
ttcgaagccgagtcaccacgatgaa

SEQ ID NO: 670077 - DNA, 25 bp, Rattus norvegicus
ttcgaagctctcatctcacttggtg

SEQ ID NO: 670078 - DNA, 25 bp, Rattus norvegicus
ttcgaagctctcttctcacttggtg

SEQ ID NO: 670079 - DNA, 25 bp, Rattus norvegicus
ttcgaaggcctcaggaagtgactgc

SEQ ID NO: 670080 - DNA, 25 bp, Rattus norvegicus
ttcgaaggcctctggaagtgactgc

SEQ ID NO: 670081 - DNA, 25 bp, Rattus norvegicus
ttcgaagtatgccaagtcagcccac

SEQ ID NO: 670082 - DNA, 25 bp, Rattus norvegicus
ttcgaagtatgcgaagtcagcccac

SEQ ID NO: 670083 - DNA, 25 bp, Rattus norvegicus
ttcgaatactgacgccacaattgtg

SEQ ID NO: 670084 - DNA, 25 bp, Rattus norvegicus
ttcgaatactgaggccacaattgtg

SEQ ID NO: 670085 - DNA, 25 bp, Rattus norvegicus
ttcgaatcacttccctgtccaggat

SEQ ID NO: 670086 - DNA, 25 bp, Rattus norvegicus
ttcgaatcacttgcctgtccaggat

SEQ ID NO: 670087 - DNA, 25 bp, Rattus norvegicus
ttcgaatgcttacctttgacgcttc

SEQ ID NO: 670088 - DNA, 25 bp, Rattus norvegicus
ttcgaatgcttagctttgacgcttc

SEQ ID NO: 670089 - DNA, 25 bp, Rattus norvegicus
ttcgacaagtaccaggctgccatgg

SEQ ID NO: 670090 - DNA, 25 bp, Rattus norvegicus
ttcgacaagtacgaggctgccatgg

SEQ ID NO: 670091 - DNA, 25 bp, Rattus norvegicus
ttcgacacccagagtgtgtggaact

SEQ ID NO: 670092 - DNA, 25 bp, Rattus norvegicus
ttcgacacccagtgtgtgtggaact

SEQ ID NO: 670093 - DNA, 25 bp, Rattus norvegicus
ttcgaccagaggagcctgaggacga

SEQ ID NO: 670094 - DNA, 25 bp, Rattus norvegicus
ttcgaccagaggtgcctgaggacga

SEQ ID NO: 670095 - DNA, 25 bp, Rattus norvegicus
ttcgaccattatctgggccacaagg

SEQ ID NO: 670096 - DNA, 25 bp, Rattus norvegicus
ttcgaccattatgtgggccacaagg

SEQ ID NO: 670097 - DNA, 25 bp, Rattus norvegicus
ttcgaccctgacaacctggaaaagt

SEQ ID NO: 670098 - DNA, 25 bp, Rattus norvegicus
ttcgaccctgactacctggaaaagt

SEQ ID NO: 670099 - DNA, 25 bp, Rattus norvegicus
ttcgaccctggaagtgcttttagat

SEQ ID NO: 670100 - DNA, 25 bp, Rattus norvegicus
ttcgaccctggatgtgcttttagat

SEQ ID NO: 670101 - DNA, 25 bp, Rattus norvegicus
ttcgaccctggtcaatgatgcctac

SEQ ID NO: 670102 - DNA, 25 bp, Rattus norvegicus
ttcgaccctggtgaatgatgcctac

SEQ ID NO: 670103 - DNA, 25 bp, Rattus norvegicus
ttcgaccgcgtgaagatgggctttg

SEQ ID NO: 670104 - DNA, 25 bp, Rattus norvegicus
ttcgaccgcgtgtagatgggctttg

SEQ ID NO: 670105 - DNA, 25 bp, Rattus norvegicus
ttcgaccgtgacactggacccgcag

SEQ ID NO: 670106 - DNA, 25 bp, Rattus norvegicus
ttcgaccgtgactctggacccgcag

SEQ ID NO: 670107 - DNA, 25 bp, Rattus norvegicus
ttcgacctcgttaagtgccaatgtt

SEQ ID NO: 670108 - DNA, 25 bp, Rattus norvegicus
ttcgacctcgtttagtgccaatgtt

SEQ ID NO: 670109 - DNA, 25 bp, Rattus norvegicus
ttcgacctctccagtcaagcaagaa

SEQ ID NO: 670110 - DNA, 25 bp, Rattus norvegicus
ttcgacctctcctgtcaagcaagaa

SEQ ID NO: 670111 - DNA, 25 bp, Rattus norvegicus
ttcgacggtcgcagtcgcacactag

SEQ ID NO: 670112 - DNA, 25 bp, Rattus norvegicus
ttcgacggtcgctgtcgcacactag

SEQ ID NO: 670113 - DNA, 25 bp, Rattus norvegicus
ttcgacgtcaatagctctgtacttg

SEQ ID NO: 670114 - DNA, 25 bp, Rattus norvegicus
ttcgacgtcaattgctctgtacttg

SEQ ID NO: 670115 - DNA, 25 bp, Rattus norvegicus
ttcgactaccagaaatccgggcaat

SEQ ID NO: 670116 - DNA, 25 bp, Rattus norvegicus
ttcgactaccagtaatccgggcaat

SEQ ID NO: 670117 - DNA, 25 bp, Rattus norvegicus
ttcgactatctcctgttgggaacaa

SEQ ID NO: 670118 - DNA, 25 bp, Rattus norvegicus
ttcgactatctcgtgttgggaacaa

SEQ ID NO: 670119 - DNA, 25 bp, Rattus norvegicus
ttcgactcaaaccaaatggcagcca

SEQ ID NO: 670120 - DNA, 25 bp, Rattus norvegicus
ttcgactcaaacgaaatggcagcca

SEQ ID NO: 670121 - DNA, 25 bp, Rattus norvegicus
ttcgactccatcagtaacaacaagt

SEQ ID NO: 670122 - DNA, 25 bp, Rattus norvegicus
ttcgactccatctgtaacaacaagt

SEQ ID NO: 670123 - DNA, 25 bp, Rattus norvegicus
ttcgactctctgatcagctgtaaca

SEQ ID NO: 670124 - DNA, 25 bp, Rattus norvegicus
ttcgactctctgttcagctgtaaca

SEQ ID NO: 670125 - DNA, 25 bp, Rattus norvegicus
ttcgactctgtgcaaaggaagtgtg

SEQ ID NO: 670126 - DNA, 25 bp, Rattus norvegicus
ttcgactctgtggaaaggaagtgtg

SEQ ID NO: 670127 - DNA, 25 bp, Rattus norvegicus
ttcgactgacctagagtctggcgct

SEQ ID NO: 670128 - DNA, 25 bp, Rattus norvegicus
ttcgactgaccttgagtctggcgct

SEQ ID NO: 670129 - DNA, 25 bp, Rattus norvegicus
ttcgactgcgtgacccaggagtatg

SEQ ID NO: 670130 - DNA, 25 bp, Rattus norvegicus
ttcgactgcgtgtcccaggagtatg

SEQ ID NO: 670131 - DNA, 25 bp, Rattus norvegicus
ttcgactggactcccgtcatgagaa

SEQ ID NO: 670132 - DNA, 25 bp, Rattus norvegicus
ttcgactggactgccgtcatgagaa

SEQ ID NO: 670133 - DNA, 25 bp, Rattus norvegicus
ttcgacttcctgcaacacatggtta

SEQ ID NO: 670134 - DNA, 25 bp, Rattus norvegicus
ttcgacttcctggaacacatggtta

SEQ ID NO: 670135 - DNA, 25 bp, Rattus norvegicus
ttcgacttcgagcactgtctgttca

SEQ ID NO: 670136 - DNA, 25 bp, Rattus norvegicus
ttcgacttcgaggactgtctgttca

SEQ ID NO: 670137 - DNA, 25 bp, Rattus norvegicus
ttcgacttggctcggaggaaccttc

SEQ ID NO: 670138 - DNA, 25 bp, Rattus norvegicus
ttcgacttggctgggaggaaccttc

SEQ ID NO: 670139 - DNA, 25 bp, Rattus norvegicus
ttcgagacagccattggagcaccaa

SEQ ID NO: 670140 - DNA, 25 bp, Rattus norvegicus
ttcgagacagcctttggagcaccaa

SEQ ID NO: 670141 - DNA, 25 bp, Rattus norvegicus
ttcgagacagtcacaggcgactcca

SEQ ID NO: 670142 - DNA, 25 bp, Rattus norvegicus
ttcgagacagtctcaggcgactcca

SEQ ID NO: 670143 - DNA, 25 bp, Rattus norvegicus
ttcgagacctgcacctgctccatag

SEQ ID NO: 670144 - DNA, 25 bp, Rattus norvegicus
ttcgagacctgctcctgctccatag

SEQ ID NO: 670145 - DNA, 25 bp, Rattus norvegicus
ttcgagactctgacagcatcctgga

SEQ ID NO: 670146 - DNA, 25 bp, Rattus norvegicus
ttcgagactctgtcagcatcctgga

SEQ ID NO: 670147 - DNA, 25 bp, Rattus norvegicus
ttcgagacttcgacatcaggactca

SEQ ID NO: 670148 - DNA, 25 bp, Rattus norvegicus
ttcgagacttcgtcatcaggactca

SEQ ID NO: 670149 - DNA, 25 bp, Rattus norvegicus
ttcgagatccccaacaagatgctat

SEQ ID NO: 670150 - DNA, 25 bp, Rattus norvegicus
ttcgagatcccctacaagatgctat

SEQ ID NO: 670151 - DNA, 25 bp, Rattus norvegicus
ttcgagatcccgatggcagtgctga

SEQ ID NO: 670152 - DNA, 25 bp, Rattus norvegicus
ttcgagatcccgttggcagtgctga

SEQ ID NO: 670153 - DNA, 25 bp, Rattus norvegicus
ttcgagatctcactcaggctacatg

SEQ ID NO: 670154 - DNA, 25 bp, Rattus norvegicus
ttcgagatctcagtcaggctacatg

SEQ ID NO: 670155 - DNA, 25 bp, Rattus norvegicus
ttcgagcaaagtccatgcagtacct

SEQ ID NO: 670156 - DNA, 25 bp, Rattus norvegicus
ttcgagcaaagtgcatgcagtacct

SEQ ID NO: 670157 - DNA, 25 bp, Rattus norvegicus
ttcgagcaccaccaacgagcacagt

SEQ ID NO: 670158 - DNA, 25 bp, Rattus norvegicus
ttcgagcaccacgaacgagcacagt

SEQ ID NO: 670159 - DNA, 25 bp, Rattus norvegicus
ttcgagccactgcagggcgccatca

SEQ ID NO: 670160 - DNA, 25 bp, Rattus norvegicus
ttcgagccactggagggcgccatca

SEQ ID NO: 670161 - DNA, 25 bp, Rattus norvegicus
ttcgagccgctactggaagacatgc

SEQ ID NO: 670162 - DNA, 25 bp, Rattus norvegicus
ttcgagccgctagtggaagacatgc

SEQ ID NO: 670163 - DNA, 25 bp, Rattus norvegicus
ttcgagcggactaatctactttttg

SEQ ID NO: 670164 - DNA, 25 bp, Rattus norvegicus
ttcgagcggacttatctactttttg

SEQ ID NO: 670165 - DNA, 25 bp, Rattus norvegicus
ttcgagctactgatttgacttttaa

SEQ ID NO: 670166 - DNA, 25 bp, Rattus norvegicus
ttcgagctactgttttgacttttaa

SEQ ID NO: 670167 - DNA, 25 bp, Rattus norvegicus
ttcgagctgctgcagcactacgtgg

SEQ ID NO: 670168 - DNA, 25 bp, Rattus norvegicus
ttcgagctgctggagcactacgtgg

SEQ ID NO: 670169 - DNA, 25 bp, Rattus norvegicus
ttcgaggaatttctgcgctggcagc

SEQ ID NO: 670170 - DNA, 25 bp, Rattus norvegicus
ttcgaggaatttgtgcgctggcagc

SEQ ID NO: 670171 - DNA, 25 bp, Rattus norvegicus
ttcgaggacttcagcccggactcgt

SEQ ID NO: 670172 - DNA, 25 bp, Rattus norvegicus
ttcgaggacttctgcccggactcgt

SEQ ID NO: 670173 - DNA, 25 bp, Rattus norvegicus
ttcgaggagaggcacttttcaagta

SEQ ID NO: 670174 - DNA, 25 bp, Rattus norvegicus
ttcgaggagagggacttttcaagta

SEQ ID NO: 670175 - DNA, 25 bp, Rattus norvegicus
ttcgaggcccgtccccaaattggag

SEQ ID NO: 670176 - DNA, 25 bp, Rattus norvegicus
ttcgaggcccgtgcccaaattggag

SEQ ID NO: 670177 - DNA, 25 bp, Rattus norvegicus
ttcgaggcgtttcatcctcaagagg

SEQ ID NO: 670178 - DNA, 25 bp, Rattus norvegicus
ttcgaggcgtttgatcctcaagagg

SEQ ID NO: 670179 - DNA, 25 bp, Rattus norvegicus
ttcgaggctatacagttccacgttc

SEQ ID NO: 670180 - DNA, 25 bp, Rattus norvegicus
ttcgaggctatagagttccacgttc

SEQ ID NO: 670181 - DNA, 25 bp, Rattus norvegicus
ttcgaggctcagacttggtgcagga

SEQ ID NO: 670182 - DNA, 25 bp, Rattus norvegicus
ttcgaggctcagtcttggtgcagga

SEQ ID NO: 670183 - DNA, 25 bp, Rattus norvegicus
ttcgagggtcacagctttgttagct

SEQ ID NO: 670184 - DNA, 25 bp, Rattus norvegicus
ttcgagggtcactgctttgttagct

SEQ ID NO: 670185 - DNA, 25 bp, Rattus norvegicus
ttcgaggtcgttacagggattacac

SEQ ID NO: 670186 - DNA, 25 bp, Rattus norvegicus
ttcgaggtcgtttcagggattacac

SEQ ID NO: 670187 - DNA, 25 bp, Rattus norvegicus
ttcgaggtgcttaacaggaggccca

SEQ ID NO: 670188 - DNA, 25 bp, Rattus norvegicus
ttcgaggtgctttacaggaggccca

SEQ ID NO: 670189 - DNA, 25 bp, Rattus norvegicus
ttcgaggtgtccagagcccctgcaa

SEQ ID NO: 670190 - DNA, 25 bp, Rattus norvegicus
ttcgaggtgtcctgagcccctgcaa

SEQ ID NO: 670191 - DNA, 25 bp, Rattus norvegicus
ttcgaggtgtggaatctagcaatag

SEQ ID NO: 670192 - DNA, 25 bp, Rattus norvegicus
ttcgaggtgtggtatctagcaatag

SEQ ID NO: 670193 - DNA, 25 bp, Rattus norvegicus
ttcgagtgacggagtttccctcaaa

SEQ ID NO: 670194 - DNA, 25 bp, Rattus norvegicus
ttcgagtgacggtgtttccctcaaa

SEQ ID NO: 670195 - DNA, 25 bp, Rattus norvegicus
ttcgataaagaacgtggcacggccc

SEQ ID NO: 670196 - DNA, 25 bp, Rattus norvegicus
ttcgataaagaaggtggcacggccc

SEQ ID NO: 670197 - DNA, 25 bp, Rattus norvegicus
ttcgatactttccaacacaagcctt

SEQ ID NO: 670198 - DNA, 25 bp, Rattus norvegicus
ttcgatactttcgaacacaagcctt

SEQ ID NO: 670199 - DNA, 25 bp, Rattus norvegicus
ttcgatagttgaagtcgttctcgcc

SEQ ID NO: 670200 - DNA, 25 bp, Rattus norvegicus
ttcgatagttgatgtcgttctcgcc

SEQ ID NO: 670201 - DNA, 25 bp, Rattus norvegicus
ttcgatatcattctccttggtgcaa

SEQ ID NO: 670202 - DNA, 25 bp, Rattus norvegicus
ttcgatatcattgtccttggtgcaa

SEQ ID NO: 670203 - DNA, 25 bp, Rattus norvegicus
ttcgatcagctcaccatggcagaca

SEQ ID NO: 670204 - DNA, 25 bp, Rattus norvegicus
ttcgatcagctctccatggcagaca

SEQ ID NO: 670205 - DNA, 25 bp, Rattus norvegicus
ttcgatcagtcaaggccgatcattc

SEQ ID NO: 670206 - DNA, 25 bp, Rattus norvegicus
ttcgatcagtcatggccgatcattc

SEQ ID NO: 670207 - DNA, 25 bp, Rattus norvegicus
ttcgatccaacactggtggccaggc

SEQ ID NO: 670208 - DNA, 25 bp, Rattus norvegicus
ttcgatccaacagtggtggccaggc

SEQ ID NO: 670209 - DNA, 25 bp, Rattus norvegicus
ttcgatcctcgtcaggtgcaggtca

SEQ ID NO: 670210 - DNA, 25 bp, Rattus norvegicus
ttcgatcctcgtgaggtgcaggtca

SEQ ID NO: 670211 - DNA, 25 bp, Rattus norvegicus
ttcgatcggatcacaaagtaatatt

SEQ ID NO: 670212 - DNA, 25 bp, Rattus norvegicus
ttcgatcggatctcaaagtaatatt

SEQ ID NO: 670213 - DNA, 25 bp, Rattus norvegicus
ttcgatctccttcttgtgtgacgag

SEQ ID NO: 670214 - DNA, 25 bp, Rattus norvegicus
ttcgatctccttgttgtgtgacgag

SEQ ID NO: 670215 - DNA, 25 bp, Rattus norvegicus
ttcgatctttttccgctaccttatt

SEQ ID NO: 670216 - DNA, 25 bp, Rattus norvegicus
ttcgatctttttgcgctaccttatt

SEQ ID NO: 670217 - DNA, 25 bp, Rattus norvegicus
ttcgatgagtctagtttgcctacct

SEQ ID NO: 670218 - DNA, 25 bp, Rattus norvegicus
ttcgatgagtcttgtttgcctacct

SEQ ID NO: 670219 - DNA, 25 bp, Rattus norvegicus
ttcgatgccagcctgagctacataa

SEQ ID NO: 670220 - DNA, 25 bp, Rattus norvegicus
ttcgatgccagcgtgagctacataa

SEQ ID NO: 670221 - DNA, 25 bp, Rattus norvegicus
ttcgatggctgcaatcatgacggtg

SEQ ID NO: 670222 - DNA, 25 bp, Rattus norvegicus
ttcgatggctgctatcatgacggtg

SEQ ID NO: 670223 - DNA, 25 bp, Rattus norvegicus
ttcgatgtccttaacccaccagagc

SEQ ID NO: 670224 - DNA, 25 bp, Rattus norvegicus
ttcgatgtcctttacccaccagagc

SEQ ID NO: 670225 - DNA, 25 bp, Rattus norvegicus
ttcgattctcagcacccattagtag

SEQ ID NO: 670226 - DNA, 25 bp, Rattus norvegicus
ttcgattctcaggacccattagtag

SEQ ID NO: 670227 - DNA, 25 bp, Rattus norvegicus
ttcgattgttctaccaaggctcagg

SEQ ID NO: 670228 - DNA, 25 bp, Rattus norvegicus
ttcgattgttcttccaaggctcagg

SEQ ID NO: 670229 - DNA, 25 bp, Rattus norvegicus
ttcgatttccacactgagctgcagg

SEQ ID NO: 670230 - DNA, 25 bp, Rattus norvegicus
ttcgatttccactctgagctgcagg

SEQ ID NO: 670231 - DNA, 25 bp, Rattus norvegicus
ttcgatttgcccactgcgccttaat

SEQ ID NO: 670232 - DNA, 25 bp, Rattus norvegicus
ttcgatttgccctctgcgccttaat

SEQ ID NO: 670233 - DNA, 25 bp, Rattus norvegicus
ttcgcaaattttacttcccacgtga

SEQ ID NO: 670234 - DNA, 25 bp, Rattus norvegicus
ttcgcaaatttttcttcccacgtga

SEQ ID NO: 670235 - DNA, 25 bp, Rattus norvegicus
ttcgcaaccctgaccatcttgtttg

SEQ ID NO: 670236 - DNA, 25 bp, Rattus norvegicus
ttcgcaaccctgtccatcttgtttg

SEQ ID NO: 670237 - DNA, 25 bp, Rattus norvegicus
ttcgcaagggctcaggctcctggat

SEQ ID NO: 670238 - DNA, 25 bp, Rattus norvegicus
ttcgcaagggctgaggctcctggat

SEQ ID NO: 670239 - DNA, 25 bp, Rattus norvegicus
ttcgcacactgtactttactttcaa

SEQ ID NO: 670240 - DNA, 25 bp, Rattus norvegicus
ttcgcacactgttctttactttcaa

SEQ ID NO: 670241 - DNA, 25 bp, Rattus norvegicus
ttcgcacagcttctacctacagtga

SEQ ID NO: 670242 - DNA, 25 bp, Rattus norvegicus
ttcgcacagcttgtacctacagtga

SEQ ID NO: 670243 - DNA, 25 bp, Rattus norvegicus
ttcgcaccatgcaagttcggaagat

SEQ ID NO: 670244 - DNA, 25 bp, Rattus norvegicus
ttcgcaccatgctagttcggaagat

SEQ ID NO: 670245 - DNA, 25 bp, Rattus norvegicus
ttcgcaccgcgaaatttttctatct

SEQ ID NO: 670246 - DNA, 25 bp, Rattus norvegicus
ttcgcaccgcgatatttttctatct

SEQ ID NO: 670247 - DNA, 25 bp, Rattus norvegicus
ttcgcacctaaacgcgcatctgagg

SEQ ID NO: 670248 - DNA, 25 bp, Rattus norvegicus
ttcgcacctaaaggcgcatctgagg

SEQ ID NO: 670249 - DNA, 25 bp, Rattus norvegicus
ttcgcacctatgaagccaaaaccca

SEQ ID NO: 670250 - DNA, 25 bp, Rattus norvegicus
ttcgcacctatgtagccaaaaccca

SEQ ID NO: 670251 - DNA, 25 bp, Rattus norvegicus
ttcgcacggcgtcagcttttaagac

SEQ ID NO: 670252 - DNA, 25 bp, Rattus norvegicus
ttcgcacggcgtgagcttttaagac

SEQ ID NO: 670253 - DNA, 25 bp, Rattus norvegicus
ttcgcagaagccatctcagacttag

SEQ ID NO: 670254 - DNA, 25 bp, Rattus norvegicus
ttcgcagaagccttctcagacttag

SEQ ID NO: 670255 - DNA, 25 bp, Rattus norvegicus
ttcgcagaggttatcatatggtgac

SEQ ID NO: 670256 - DNA, 25 bp, Rattus norvegicus
ttcgcagaggttttcatatggtgac

SEQ ID NO: 670257 - DNA, 25 bp, Rattus norvegicus
ttcgcagcatctctcttactgttta

SEQ ID NO: 670258 - DNA, 25 bp, Rattus norvegicus
ttcgcagcatctgtcttactgttta

SEQ ID NO: 670259 - DNA, 25 bp, Rattus norvegicus
ttcgcagcctggctgtgggtcctca

SEQ ID NO: 670260 - DNA, 25 bp, Rattus norvegicus
ttcgcagcctgggtgtgggtcctca

SEQ ID NO: 670261 - DNA, 25 bp, Rattus norvegicus
ttcgcagctccgcactccaaagggt

SEQ ID NO: 670262 - DNA, 25 bp, Rattus norvegicus
ttcgcagctccggactccaaagggt

SEQ ID NO: 670263 - DNA, 25 bp, Rattus norvegicus
ttcgcagctgatctttgtactccat

SEQ ID NO: 670264 - DNA, 25 bp, Rattus norvegicus
ttcgcagctgatgtttgtactccat

SEQ ID NO: 670265 - DNA, 25 bp, Rattus norvegicus
ttcgcaggcagcattcagaacttta

SEQ ID NO: 670266 - DNA, 25 bp, Rattus norvegicus
ttcgcaggcagctttcagaacttta

SEQ ID NO: 670267 - DNA, 25 bp, Rattus norvegicus
ttcgcagtgacaagacttccctact

SEQ ID NO: 670268 - DNA, 25 bp, Rattus norvegicus
ttcgcagtgacatgacttccctact

SEQ ID NO: 670269 - DNA, 25 bp, Rattus norvegicus
ttcgcagttaccattttcacccgtg

SEQ ID NO: 670270 - DNA, 25 bp, Rattus norvegicus
ttcgcagttacctttttcacccgtg

SEQ ID NO: 670271 - DNA, 25 bp, Rattus norvegicus
ttcgcataaaggatcctgtactgtt

SEQ ID NO: 670272 - DNA, 25 bp, Rattus norvegicus
ttcgcataaaggttcctgtactgtt

SEQ ID NO: 670273 - DNA, 25 bp, Rattus norvegicus
ttcgcatagaggagcgcgcatccgg

SEQ ID NO: 670274 - DNA, 25 bp, Rattus norvegicus
ttcgcatagaggtgcgcgcatccgg

SEQ ID NO: 670275 - DNA, 25 bp, Rattus norvegicus
ttcgcatgcgatatcaggacccgga

SEQ ID NO: 670276 - DNA, 25 bp, Rattus norvegicus
ttcgcatgcgatttcaggacccgga

SEQ ID NO: 670277 - DNA, 25 bp, Rattus norvegicus
ttcgcatggcaactatacaaaacag

SEQ ID NO: 670278 - DNA, 25 bp, Rattus norvegicus
ttcgcatggcaagtatacaaaacag

SEQ ID NO: 670279 - DNA, 25 bp, Rattus norvegicus
ttcgccaaccccagaagctaagaag

SEQ ID NO: 670280 - DNA, 25 bp, Rattus norvegicus
ttcgccaacccctgaagctaagaag

SEQ ID NO: 670281 - DNA, 25 bp, Rattus norvegicus
ttcgccaagttgagtcaatccttag

SEQ ID NO: 670282 - DNA, 25 bp, Rattus norvegicus
ttcgccaagttgtgtcaatccttag

SEQ ID NO: 670283 - DNA, 25 bp, Rattus norvegicus
ttcgccaccctgacagtgatttaga

SEQ ID NO: 670284 - DNA, 25 bp, Rattus norvegicus
ttcgccaccctgtcagtgatttaga

SEQ ID NO: 670285 - DNA, 25 bp, Rattus norvegicus
ttcgccactaaaatcgctgctctgt

SEQ ID NO: 670286 - DNA, 25 bp, Rattus norvegicus
ttcgccactaaattcgctgctctgt

SEQ ID NO: 670287 - DNA, 25 bp, Rattus norvegicus
ttcgccacttccactataaatcaaa

SEQ ID NO: 670288 - DNA, 25 bp, Rattus norvegicus
ttcgccacttcctctataaatcaaa

SEQ ID NO: 670289 - DNA, 25 bp, Rattus norvegicus
ttcgccaggatccagatcagccgaa

SEQ ID NO: 670290 - DNA, 25 bp, Rattus norvegicus
ttcgccaggatcgagatcagccgaa

SEQ ID NO: 670291 - DNA, 25 bp, Rattus norvegicus
ttcgccatcgacattactctcgtaa

SEQ ID NO: 670292 - DNA, 25 bp, Rattus norvegicus
ttcgccatcgactttactctcgtaa

SEQ ID NO: 670293 - DNA, 25 bp, Rattus norvegicus
ttcgccatgtggatacagtactaat

SEQ ID NO: 670294 - DNA, 25 bp, Rattus norvegicus
ttcgccatgtggttacagtactaat

SEQ ID NO: 670295 - DNA, 25 bp, Rattus norvegicus
ttcgcccaggaaaacatcaagcttt

SEQ ID NO: 670296 - DNA, 25 bp, Rattus norvegicus
ttcgcccaggaatacatcaagcttt

SEQ ID NO: 670297 - DNA, 25 bp, Rattus norvegicus
ttcgcccatggacggcactatccga

SEQ ID NO: 670298 - DNA, 25 bp, Rattus norvegicus
ttcgcccatggagggcactatccga

SEQ ID NO: 670299 - DNA, 25 bp, Rattus norvegicus
ttcgcccctttactgggtgacataa

SEQ ID NO: 670300 - DNA, 25 bp, Rattus norvegicus
ttcgcccctttagtgggtgacataa

SEQ ID NO: 670301 - DNA, 25 bp, Rattus norvegicus
ttcgcccgcagccttgatctgcgga

SEQ ID NO: 670302 - DNA, 25 bp, Rattus norvegicus
ttcgcccgcagcgttgatctgcgga

SEQ ID NO: 670303 - DNA, 25 bp, Rattus norvegicus
ttcgccctatgaccgtggaatgtta

SEQ ID NO: 670304 - DNA, 25 bp, Rattus norvegicus
ttcgccctatgagcgtggaatgtta

SEQ ID NO: 670305 - DNA, 25 bp, Rattus norvegicus
ttcgccctgagacttcccagtaaag

SEQ ID NO: 670306 - DNA, 25 bp, Rattus norvegicus
ttcgccctgagagttcccagtaaag

SEQ ID NO: 670307 - DNA, 25 bp, Rattus norvegicus
ttcgccgaggagacttcattcatgt

SEQ ID NO: 670308 - DNA, 25 bp, Rattus norvegicus
ttcgccgaggagtcttcattcatgt

SEQ ID NO: 670309 - DNA, 25 bp, Rattus norvegicus
ttcgccggagacaatgaaggccaga

SEQ ID NO: 670310 - DNA, 25 bp, Rattus norvegicus
ttcgccggagactatgaaggccaga

SEQ ID NO: 670311 - DNA, 25 bp, Rattus norvegicus
ttcgccgggttgcagatgtcttccc

SEQ ID NO: 670312 - DNA, 25 bp, Rattus norvegicus
ttcgccgggttggagatgtcttccc

SEQ ID NO: 670313 - DNA, 25 bp, Rattus norvegicus
ttcgccgtcttcagtgtttttaaca

SEQ ID NO: 670314 - DNA, 25 bp, Rattus norvegicus
ttcgccgtcttctgtgtttttaaca

SEQ ID NO: 670315 - DNA, 25 bp, Rattus norvegicus
ttcgcctatgccagggctttggatg

SEQ ID NO: 670316 - DNA, 25 bp, Rattus norvegicus
ttcgcctatgcctgggctttggatg

SEQ ID NO: 670317 - DNA, 25 bp, Rattus norvegicus
ttcgcctgccagatacgtgaggagt

SEQ ID NO: 670318 - DNA, 25 bp, Rattus norvegicus
ttcgcctgccagttacgtgaggagt

SEQ ID NO: 670319 - DNA, 25 bp, Rattus norvegicus
ttcgcctggttcacacctcgatata

SEQ ID NO: 670320 - DNA, 25 bp, Rattus norvegicus
ttcgcctggttctcacctcgatata

SEQ ID NO: 670321 - DNA, 25 bp, Rattus norvegicus
ttcgcctgtctgacgactggagatg

SEQ ID NO: 670322 - DNA, 25 bp, Rattus norvegicus
ttcgcctgtctgtcgactggagatg

SEQ ID NO: 670323 - DNA, 25 bp, Rattus norvegicus
ttcgccttaaacaatggacactcta

SEQ ID NO: 670324 - DNA, 25 bp, Rattus norvegicus
ttcgccttaaactatggacactcta

SEQ ID NO: 670325 - DNA, 25 bp, Rattus norvegicus
ttcgccttaaatagttcccttggag

SEQ ID NO: 670326 - DNA, 25 bp, Rattus norvegicus
ttcgccttaaattgttcccttggag

SEQ ID NO: 670327 - DNA, 25 bp, Rattus norvegicus
ttcgccttcaacacggtcaacgtgg

SEQ ID NO: 670328 - DNA, 25 bp, Rattus norvegicus
ttcgccttcaactcggtcaacgtgg

SEQ ID NO: 670329 - DNA, 25 bp, Rattus norvegicus
ttcgccttcacccttctgggtcgga

SEQ ID NO: 670330 - DNA, 25 bp, Rattus norvegicus
ttcgccttcaccgttctgggtcgga

SEQ ID NO: 670331 - DNA, 25 bp, Rattus norvegicus
ttcgccttcgtcattgatacacgca

SEQ ID NO: 670332 - DNA, 25 bp, Rattus norvegicus
ttcgccttcgtctttgatacacgca

SEQ ID NO: 670333 - DNA, 25 bp, Rattus norvegicus
ttcgcgaaaagcatctccttcttgg

SEQ ID NO: 670334 - DNA, 25 bp, Rattus norvegicus
ttcgcgaaaagcttctccttcttgg

SEQ ID NO: 670335 - DNA, 25 bp, Rattus norvegicus
ttcgcgacgacacgacctggatgaa

SEQ ID NO: 670336 - DNA, 25 bp, Rattus norvegicus
ttcgcgacgacaggacctggatgaa

SEQ ID NO: 670337 - DNA, 25 bp, Rattus norvegicus
ttcgcgagggcgacagtcgactgct

SEQ ID NO: 670338 - DNA, 25 bp, Rattus norvegicus
ttcgcgagggcgtcagtcgactgct

SEQ ID NO: 670339 - DNA, 25 bp, Rattus norvegicus
ttcgcgatgttcacagaattccatt

SEQ ID NO: 670340 - DNA, 25 bp, Rattus norvegicus
ttcgcgatgttctcagaattccatt

SEQ ID NO: 670341 - DNA, 25 bp, Rattus norvegicus
ttcgcgatttaccatcctatcaagg

SEQ ID NO: 670342 - DNA, 25 bp, Rattus norvegicus
ttcgcgatttacgatcctatcaagg

SEQ ID NO: 670343 - DNA, 25 bp, Rattus norvegicus
ttcgcgctaccaatcgcacgaaaaa

SEQ ID NO: 670344 - DNA, 25 bp, Rattus norvegicus
ttcgcgctaccattcgcacgaaaaa

SEQ ID NO: 670345 - DNA, 25 bp, Rattus norvegicus
ttcgcgctgcgaaccacagacaggc

SEQ ID NO: 670346 - DNA, 25 bp, Rattus norvegicus
ttcgcgctgcgatccacagacaggc

SEQ ID NO: 670347 - DNA, 25 bp, Rattus norvegicus
ttcgcggaagccacagaagccaaga

SEQ ID NO: 670348 - DNA, 25 bp, Rattus norvegicus
ttcgcggaagcctcagaagccaaga

SEQ ID NO: 670349 - DNA, 25 bp, Rattus norvegicus
ttcgcggctctgcagcgcagccgaa

SEQ ID NO: 670350 - DNA, 25 bp, Rattus norvegicus
ttcgcggctctggagcgcagccgaa

SEQ ID NO: 670351 - DNA, 25 bp, Rattus norvegicus
ttcgcggttatgcaaaatttcagca

SEQ ID NO: 670352 - DNA, 25 bp, Rattus norvegicus
ttcgcggttatggaaaatttcagca

SEQ ID NO: 670353 - DNA, 25 bp, Rattus norvegicus
ttcgcgtctttgagcatgttcttca

SEQ ID NO: 670354 - DNA, 25 bp, Rattus norvegicus
ttcgcgtctttgtgcatgttcttca

SEQ ID NO: 670355 - DNA, 25 bp, Rattus norvegicus
ttcgctaaccacactgacaaggatg

SEQ ID NO: 670356 - DNA, 25 bp, Rattus norvegicus
ttcgctaaccactctgacaaggatg

SEQ ID NO: 670357 - DNA, 25 bp, Rattus norvegicus
ttcgctaccaggatgcggcgggtcc

SEQ ID NO: 670358 - DNA, 25 bp, Rattus norvegicus
ttcgctaccaggttgcggcgggtcc

SEQ ID NO: 670359 - DNA, 25 bp, Rattus norvegicus
ttcgctacctcaccctcaggaataa

SEQ ID NO: 670360 - DNA, 25 bp, Rattus norvegicus
ttcgctacctcagcctcaggaataa

SEQ ID NO: 670361 - DNA, 25 bp, Rattus norvegicus
ttcgctatgaccatgtactgccagg

SEQ ID NO: 670362 - DNA, 25 bp, Rattus norvegicus
ttcgctatgaccttgtactgccagg

SEQ ID NO: 670363 - DNA, 25 bp, Rattus norvegicus
ttcgctcacttaactgagcctttca

SEQ ID NO: 670364 - DNA, 25 bp, Rattus norvegicus
ttcgctcacttatctgagcctttca

SEQ ID NO: 670365 - DNA, 25 bp, Rattus norvegicus
ttcgctcagcttcggtgtttggcaa

SEQ ID NO: 670366 - DNA, 25 bp, Rattus norvegicus
ttcgctcagcttgggtgtttggcaa

SEQ ID NO: 670367 - DNA, 25 bp, Rattus norvegicus
ttcgctccaccaacatgtttcggaa

SEQ ID NO: 670368 - DNA, 25 bp, Rattus norvegicus
ttcgctccaccatcatgtttcggaa

SEQ ID NO: 670369 - DNA, 25 bp, Rattus norvegicus
ttcgctcccagtaccgtgaaaaaat

SEQ ID NO: 670370 - DNA, 25 bp, Rattus norvegicus
ttcgctcccagttccgtgaaaaaat

SEQ ID NO: 670371 - DNA, 25 bp, Rattus norvegicus
ttcgctccgtaaatgtcagcagcta

SEQ ID NO: 670372 - DNA, 25 bp, Rattus norvegicus
ttcgctccgtaattgtcagcagcta

SEQ ID NO: 670373 - DNA, 25 bp, Rattus norvegicus
ttcgctcggagcagtgtgaacgact

SEQ ID NO: 670374 - DNA, 25 bp, Rattus norvegicus
ttcgctcggagctgtgtgaacgact

SEQ ID NO: 670375 - DNA, 25 bp, Rattus norvegicus
ttcgctcggcctctcatttgcttgc

SEQ ID NO: 670376 - DNA, 25 bp, Rattus norvegicus
ttcgctcggcctgtcatttgcttgc

SEQ ID NO: 670377 - DNA, 25 bp, Rattus norvegicus
ttcgctcgtatacgccgatgttggc

SEQ ID NO: 670378 - DNA, 25 bp, Rattus norvegicus
ttcgctcgtataggccgatgttggc

SEQ ID NO: 670379 - DNA, 25 bp, Rattus norvegicus
ttcgctctcagtcgccggattagtt

SEQ ID NO: 670380 - DNA, 25 bp, Rattus norvegicus
ttcgctctcagtggccggattagtt

SEQ ID NO: 670381 - DNA, 25 bp, Rattus norvegicus
ttcgctctggagcagatttccaagg

SEQ ID NO: 670382 - DNA, 25 bp, Rattus norvegicus
ttcgctctggaggagatttccaagg

SEQ ID NO: 670383 - DNA, 25 bp, Rattus norvegicus
ttcgctgaaacaccataaagatgac

SEQ ID NO: 670384 - DNA, 25 bp, Rattus norvegicus
ttcgctgaaacagcataaagatgac

SEQ ID NO: 670385 - DNA, 25 bp, Rattus norvegicus
ttcgctgagagcatctacttctaaa

SEQ ID NO: 670386 - DNA, 25 bp, Rattus norvegicus
ttcgctgagagcttctacttctaaa

SEQ ID NO: 670387 - DNA, 25 bp, Rattus norvegicus
ttcgctgcatcgaccatggtagaga

SEQ ID NO: 670388 - DNA, 25 bp, Rattus norvegicus
ttcgctgcatcgtccatggtagaga

SEQ ID NO: 670389 - DNA, 25 bp, Rattus norvegicus
ttcgctgctaggcacctgaaggcag

SEQ ID NO: 670390 - DNA, 25 bp, Rattus norvegicus
ttcgctgctagggacctgaaggcag

SEQ ID NO: 670391 - DNA, 25 bp, Rattus norvegicus
ttcgctgctatgaccacatcatgaa

SEQ ID NO: 670392 - DNA, 25 bp, Rattus norvegicus
ttcgctgctatgtccacatcatgaa

SEQ ID NO: 670393 - DNA, 25 bp, Rattus norvegicus
ttcgctgctattcgagggtcagttt

SEQ ID NO: 670394 - DNA, 25 bp, Rattus norvegicus
ttcgctgctattggagggtcagttt

SEQ ID NO: 670395 - DNA, 25 bp, Rattus norvegicus
ttcgctgctttgcatgtgggttcat

SEQ ID NO: 670396 - DNA, 25 bp, Rattus norvegicus
ttcgctgctttggatgtgggttcat

SEQ ID NO: 670397 - DNA, 25 bp, Rattus norvegicus
ttcgctggactcatctctgaaggga

SEQ ID NO: 670398 - DNA, 25 bp, Rattus norvegicus
ttcgctggactcttctctgaaggga

SEQ ID NO: 670399 - DNA, 25 bp, Rattus norvegicus
ttcgctggccctaaagttttatctt

SEQ ID NO: 670400 - DNA, 25 bp, Rattus norvegicus
ttcgctggcccttaagttttatctt

SEQ ID NO: 670401 - DNA, 25 bp, Rattus norvegicus
ttcgctggctggcatcatggatgct

SEQ ID NO: 670402 - DNA, 25 bp, Rattus norvegicus
ttcgctggctgggatcatggatgct

SEQ ID NO: 670403 - DNA, 25 bp, Rattus norvegicus
ttcgctggtgcaccagcttccttca

SEQ ID NO: 670404 - DNA, 25 bp, Rattus norvegicus
ttcgctggtgcagcagcttccttca

SEQ ID NO: 670405 - DNA, 25 bp, Rattus norvegicus
ttcgctggttctcagactgactgag

SEQ ID NO: 670406 - DNA, 25 bp, Rattus norvegicus
ttcgctggttctgagactgactgag

SEQ ID NO: 670407 - DNA, 25 bp, Rattus norvegicus
ttcgctgtaagtaatcgccacggct

SEQ ID NO: 670408 - DNA, 25 bp, Rattus norvegicus
ttcgctgtaagttatcgccacggct

SEQ ID NO: 670409 - DNA, 25 bp, Rattus norvegicus
ttcgctgtcagcatgagtctgtgaa

SEQ ID NO: 670410 - DNA, 25 bp, Rattus norvegicus
ttcgctgtcagcttgagtctgtgaa

SEQ ID NO: 670411 - DNA, 25 bp, Rattus norvegicus
ttcgctgtgaccatgctgccaagct

SEQ ID NO: 670412 - DNA, 25 bp, Rattus norvegicus
ttcgctgtgaccttgctgccaagct

SEQ ID NO: 670413 - DNA, 25 bp, Rattus norvegicus
ttcgctgtggagagctggagcttct

SEQ ID NO: 670414 - DNA, 25 bp, Rattus norvegicus
ttcgctgtggagtgctggagcttct

SEQ ID NO: 670415 - DNA, 25 bp, Rattus norvegicus
ttcgcttagcgaaggccccagttat

SEQ ID NO: 670416 - DNA, 25 bp, Rattus norvegicus
ttcgcttagcgatggccccagttat

SEQ ID NO: 670417 - DNA, 25 bp, Rattus norvegicus
ttcgcttcaatcatggcctgtggtc

SEQ ID NO: 670418 - DNA, 25 bp, Rattus norvegicus
ttcgcttcaatcttggcctgtggtc

SEQ ID NO: 670419 - DNA, 25 bp, Rattus norvegicus
ttcgcttcatagaactggagcccgg

SEQ ID NO: 670420 - DNA, 25 bp, Rattus norvegicus
ttcgcttcatagtactggagcccgg

SEQ ID NO: 670421 - DNA, 25 bp, Rattus norvegicus
ttcgcttcgttcatccagcctggtg

SEQ ID NO: 670422 - DNA, 25 bp, Rattus norvegicus
ttcgcttcgttcttccagcctggtg

SEQ ID NO: 670423 - DNA, 25 bp, Rattus norvegicus
ttcgcttctcaccatgtgtaaggcg

SEQ ID NO: 670424 - DNA, 25 bp, Rattus norvegicus
ttcgcttctcacgatgtgtaaggcg

SEQ ID NO: 670425 - DNA, 25 bp, Rattus norvegicus
ttcgcttgaaacatctttcgatggg

SEQ ID NO: 670426 - DNA, 25 bp, Rattus norvegicus
ttcgcttgaaacttctttcgatggg

SEQ ID NO: 670427 - DNA, 25 bp, Rattus norvegicus
ttcgcttgggtgaattctccctctt

SEQ ID NO: 670428 - DNA, 25 bp, Rattus norvegicus
ttcgcttgggtgtattctccctctt

SEQ ID NO: 670429 - DNA, 25 bp, Rattus norvegicus
ttcgctttcatccacaagatccggc

SEQ ID NO: 670430 - DNA, 25 bp, Rattus norvegicus
ttcgctttcatcgacaagatccggc

SEQ ID NO: 670431 - DNA, 25 bp, Rattus norvegicus
ttcgctttgacccatggcctagaag

SEQ ID NO: 670432 - DNA, 25 bp, Rattus norvegicus
ttcgctttgaccgatggcctagaag

SEQ ID NO: 670433 - DNA, 25 bp, Rattus norvegicus
ttcgctttttctcgttattctcttg

SEQ ID NO: 670434 - DNA, 25 bp, Rattus norvegicus
ttcgctttttctggttattctcttg

SEQ ID NO: 670435 - DNA, 25 bp, Rattus norvegicus
ttcggaaccactccttggccagatg

SEQ ID NO: 670436 - DNA, 25 bp, Rattus norvegicus
ttcggaaccactgcttggccagatg

SEQ ID NO: 670437 - DNA, 25 bp, Rattus norvegicus
ttcggaactctgagcgagcacgtga

SEQ ID NO: 670438 - DNA, 25 bp, Rattus norvegicus
ttcggaactctgtgcgagcacgtga

SEQ ID NO: 670439 - DNA, 25 bp, Rattus norvegicus
ttcggaagcctcattcctaggtaag

SEQ ID NO: 670440 - DNA, 25 bp, Rattus norvegicus
ttcggaagcctctttcctaggtaag

SEQ ID NO: 670441 - DNA, 25 bp, Rattus norvegicus
ttcggaagctccaggctcttctagt

SEQ ID NO: 670442 - DNA, 25 bp, Rattus norvegicus
ttcggaagctcctggctcttctagt

SEQ ID NO: 670443 - DNA, 25 bp, Rattus norvegicus
ttcggaatcttcagagagccaatca

SEQ ID NO: 670444 - DNA, 25 bp, Rattus norvegicus
ttcggaatcttctgagagccaatca

SEQ ID NO: 670445 - DNA, 25 bp, Rattus norvegicus
ttcggaatggacacagtggccccta

SEQ ID NO: 670446 - DNA, 25 bp, Rattus norvegicus
ttcggaatggactcagtggccccta

SEQ ID NO: 670447 - DNA, 25 bp, Rattus norvegicus
ttcggaattacaagatagcgggaat

SEQ ID NO: 670448 - DNA, 25 bp, Rattus norvegicus
ttcggaattacatgatagcgggaat

SEQ ID NO: 670449 - DNA, 25 bp, Rattus norvegicus
ttcggacattgtcgagctgctgctc

SEQ ID NO: 670450 - DNA, 25 bp, Rattus norvegicus
ttcggacattgtggagctgctgctc

SEQ ID NO: 670451 - DNA, 25 bp, Rattus norvegicus
ttcggaccatttcctcaaagtgagt

SEQ ID NO: 670452 - DNA, 25 bp, Rattus norvegicus
ttcggaccatttgctcaaagtgagt

SEQ ID NO: 670453 - DNA, 25 bp, Rattus norvegicus
ttcggacgggtcatcaattgctcta

SEQ ID NO: 670454 - DNA, 25 bp, Rattus norvegicus
ttcggacgggtcttcaattgctcta

SEQ ID NO: 670455 - DNA, 25 bp, Rattus norvegicus
ttcggactcactcctctatgacgat

SEQ ID NO: 670456 - DNA, 25 bp, Rattus norvegicus
ttcggactcactgctctatgacgat

SEQ ID NO: 670457 - DNA, 25 bp, Rattus norvegicus
ttcggactcagtctgtatgttagac

SEQ ID NO: 670458 - DNA, 25 bp, Rattus norvegicus
ttcggactcagtgtgtatgttagac

SEQ ID NO: 670459 - DNA, 25 bp, Rattus norvegicus
ttcggactcgggaacaagaaagcag

SEQ ID NO: 670460 - DNA, 25 bp, Rattus norvegicus
ttcggactcgggtacaagaaagcag

SEQ ID NO: 670461 - DNA, 25 bp, Rattus norvegicus
ttcggacttacacagcccaaccatg

SEQ ID NO: 670462 - DNA, 25 bp, Rattus norvegicus
ttcggacttacagagcccaaccatg

SEQ ID NO: 670463 - DNA, 25 bp, Rattus norvegicus
ttcggagacaccacattcctgaata

SEQ ID NO: 670464 - DNA, 25 bp, Rattus norvegicus
ttcggagacacctcattcctgaata

SEQ ID NO: 670465 - DNA, 25 bp, Rattus norvegicus
ttcggagaccgacgctgttatcagc

SEQ ID NO: 670466 - DNA, 25 bp, Rattus norvegicus
ttcggagaccgaggctgttatcagc

SEQ ID NO: 670467 - DNA, 25 bp, Rattus norvegicus
ttcggagccatcctcctgtggagga

SEQ ID NO: 670468 - DNA, 25 bp, Rattus norvegicus
ttcggagccatcgtcctgtggagga

SEQ ID NO: 670469 - DNA, 25 bp, Rattus norvegicus
ttcggagcctacagcctggctgcgg

SEQ ID NO: 670470 - DNA, 25 bp, Rattus norvegicus
ttcggagcctactgcctggctgcgg

SEQ ID NO: 670471 - DNA, 25 bp, Rattus norvegicus
ttcggaggtcgaatgaccctttcat

SEQ ID NO: 670472 - DNA, 25 bp, Rattus norvegicus
ttcggaggtcgattgaccctttcat

SEQ ID NO: 670473 - DNA, 25 bp, Rattus norvegicus
ttcggagtcagtctgtctgtcgagc

SEQ ID NO: 670474 - DNA, 25 bp, Rattus norvegicus
ttcggagtcagtgtgtctgtcgagc

SEQ ID NO: 670475 - DNA, 25 bp, Rattus norvegicus
ttcggagtcccaagtttctctgtga

SEQ ID NO: 670476 - DNA, 25 bp, Rattus norvegicus
ttcggagtcccatgtttctctgtga

SEQ ID NO: 670477 - DNA, 25 bp, Rattus norvegicus
ttcggagtgagtaccttccaactgc

SEQ ID NO: 670478 - DNA, 25 bp, Rattus norvegicus
ttcggagtgagttccttccaactgc

SEQ ID NO: 670479 - DNA, 25 bp, Rattus norvegicus
ttcggatcacgcccggagtagaagc

SEQ ID NO: 670480 - DNA, 25 bp, Rattus norvegicus
ttcggatcacgcgcggagtagaagc

SEQ ID NO: 670481 - DNA, 25 bp, Rattus norvegicus
ttcggatgatctagaactctcctgc

SEQ ID NO: 670482 - DNA, 25 bp, Rattus norvegicus
ttcggatgatcttgaactctcctgc

SEQ ID NO: 670483 - DNA, 25 bp, Rattus norvegicus
ttcggatgctcaccactggcacaaa

SEQ ID NO: 670484 - DNA, 25 bp, Rattus norvegicus
ttcggatgctcagcactggcacaaa

SEQ ID NO: 670485 - DNA, 25 bp, Rattus norvegicus
ttcggcaaagccacagatcacactc

SEQ ID NO: 670486 - DNA, 25 bp, Rattus norvegicus
ttcggcaaagcctcagatcacactc

SEQ ID NO: 670487 - DNA, 25 bp, Rattus norvegicus
ttcggcaatgcgagctatttccagc

SEQ ID NO: 670488 - DNA, 25 bp, Rattus norvegicus
ttcggcaatgcgtgctatttccagc

SEQ ID NO: 670489 - DNA, 25 bp, Rattus norvegicus
ttcggcacgaggattcagggctaga

SEQ ID NO: 670490 - DNA, 25 bp, Rattus norvegicus
ttcggcacgaggtttcagggctaga

SEQ ID NO: 670491 - DNA, 25 bp, Rattus norvegicus
ttcggcacggctcgcaatgaagttt

SEQ ID NO: 670492 - DNA, 25 bp, Rattus norvegicus
ttcggcacggctggcaatgaagttt

SEQ ID NO: 670493 - DNA, 25 bp, Rattus norvegicus
ttcggcactggtaacttattgaggt

SEQ ID NO: 670494 - DNA, 25 bp, Rattus norvegicus
ttcggcactggttacttattgaggt

SEQ ID NO: 670495 - DNA, 25 bp, Rattus norvegicus
ttcggcagagctcttgtcaggttct

SEQ ID NO: 670496 - DNA, 25 bp, Rattus norvegicus
ttcggcagagctgttgtcaggttct

SEQ ID NO: 670497 - DNA, 25 bp, Rattus norvegicus
ttcggcagcggaactgggttgtcct

SEQ ID NO: 670498 - DNA, 25 bp, Rattus norvegicus
ttcggcagcggatctgggttgtcct

SEQ ID NO: 670499 - DNA, 25 bp, Rattus norvegicus
ttcggcatcgggaggcagcaagtca

SEQ ID NO: 670500 - DNA, 25 bp, Rattus norvegicus
ttcggcatcgggtggcagcaagtca

SEQ ID NO: 670501 - DNA, 25 bp, Rattus norvegicus
ttcggcatgaccatctcagagttcg

SEQ ID NO: 670502 - DNA, 25 bp, Rattus norvegicus
ttcggcatgaccttctcagagttcg

SEQ ID NO: 670503 - DNA, 25 bp, Rattus norvegicus
ttcggcatttgcagttcagtcatct

SEQ ID NO: 670504 - DNA, 25 bp, Rattus norvegicus
ttcggcatttgctgttcagtcatct

SEQ ID NO: 670505 - DNA, 25 bp, Rattus norvegicus
ttcggccaacagatttgccttcctg

SEQ ID NO: 670506 - DNA, 25 bp, Rattus norvegicus
ttcggccaacagttttgccttcctg

SEQ ID NO: 670507 - DNA, 25 bp, Rattus norvegicus
ttcggccacctgcatatgcacagtg

SEQ ID NO: 670508 - DNA, 25 bp, Rattus norvegicus
ttcggccacctggatatgcacagtg

SEQ ID NO: 670509 - DNA, 25 bp, Rattus norvegicus
ttcggccaggccacagagatgtggc

SEQ ID NO: 670510 - DNA, 25 bp, Rattus norvegicus
ttcggccaggcctcagagatgtggc

SEQ ID NO: 670511 - DNA, 25 bp, Rattus norvegicus
ttcggccattttctgctgtgtaaac

SEQ ID NO: 670512 - DNA, 25 bp, Rattus norvegicus
ttcggccattttgtgctgtgtaaac

SEQ ID NO: 670513 - DNA, 25 bp, Rattus norvegicus
ttcggcccggtcaatcatgaagaac

SEQ ID NO: 670514 - DNA, 25 bp, Rattus norvegicus
ttcggcccggtctatcatgaagaac

SEQ ID NO: 670515 - DNA, 25 bp, Rattus norvegicus
ttcggccctgatctttctggttaca

SEQ ID NO: 670516 - DNA, 25 bp, Rattus norvegicus
ttcggccctgatgtttctggttaca

SEQ ID NO: 670517 - DNA, 25 bp, Rattus norvegicus
ttcggcctcaaaccccgggttgtcg

SEQ ID NO: 670518 - DNA, 25 bp, Rattus norvegicus
ttcggcctcaaagcccgggttgtcg

SEQ ID NO: 670519 - DNA, 25 bp, Rattus norvegicus
ttcggcctcaagaagaggtggacat

SEQ ID NO: 670520 - DNA, 25 bp, Rattus norvegicus
ttcggcctcaagtagaggtggacat

SEQ ID NO: 670521 - DNA, 25 bp, Rattus norvegicus
ttcggcctcaggatggcaagatttt

SEQ ID NO: 670522 - DNA, 25 bp, Rattus norvegicus
ttcggcctcaggttggcaagatttt

SEQ ID NO: 670523 - DNA, 25 bp, Rattus norvegicus
ttcggcctcctaactttacagaagt

SEQ ID NO: 670524 - DNA, 25 bp, Rattus norvegicus
ttcggcctcctatctttacagaagt

SEQ ID NO: 670525 - DNA, 25 bp, Rattus norvegicus
ttcggcctcgaacggctgctgctat

SEQ ID NO: 670526 - DNA, 25 bp, Rattus norvegicus
ttcggcctcgaagggctgctgctat

SEQ ID NO: 670527 - DNA, 25 bp, Rattus norvegicus
ttcggccttaggagcatacctttga

SEQ ID NO: 670528 - DNA, 25 bp, Rattus norvegicus
ttcggccttaggtgcatacctttga

SEQ ID NO: 670529 - DNA, 25 bp, Rattus norvegicus
ttcggccttgcgctgagctcccggt

SEQ ID NO: 670530 - DNA, 25 bp, Rattus norvegicus
ttcggccttgcggtgagctcccggt

SEQ ID NO: 670531 - DNA, 25 bp, Rattus norvegicus
ttcggcctttacactcaggagggtt

SEQ ID NO: 670532 - DNA, 25 bp, Rattus norvegicus
ttcggcctttactctcaggagggtt

SEQ ID NO: 670533 - DNA, 25 bp, Rattus norvegicus
ttcggccttttcagtaattgatgct

SEQ ID NO: 670534 - DNA, 25 bp, Rattus norvegicus
ttcggccttttctgtaattgatgct

SEQ ID NO: 670535 - DNA, 25 bp, Rattus norvegicus
ttcggcgcagccagtacatcaggga

SEQ ID NO: 670536 - DNA, 25 bp, Rattus norvegicus
ttcggcgcagcctgtacatcaggga

SEQ ID NO: 670537 - DNA, 25 bp, Rattus norvegicus
ttcggcgcctcaaagccttgcacag

SEQ ID NO: 670538 - DNA, 25 bp, Rattus norvegicus
ttcggcgcctcatagccttgcacag

SEQ ID NO: 670539 - DNA, 25 bp, Rattus norvegicus
ttcggcggtttcaaccttctatcga

SEQ ID NO: 670540 - DNA, 25 bp, Rattus norvegicus
ttcggcggtttctaccttctatcga

SEQ ID NO: 670541 - DNA, 25 bp, Rattus norvegicus
ttcggctactacagcaagtcatcac

SEQ ID NO: 670542 - DNA, 25 bp, Rattus norvegicus
ttcggctactactgcaagtcatcac

SEQ ID NO: 670543 - DNA, 25 bp, Rattus norvegicus
ttcggctatcaacgtccacatatgc

SEQ ID NO: 670544 - DNA, 25 bp, Rattus norvegicus
ttcggctatcaaggtccacatatgc

SEQ ID NO: 670545 - DNA, 25 bp, Rattus norvegicus
ttcggctcagtaagcagagttctgt

SEQ ID NO: 670546 - DNA, 25 bp, Rattus norvegicus
ttcggctcagtatgcagagttctgt

SEQ ID NO: 670547 - DNA, 25 bp, Rattus norvegicus
ttcggctcggacacgtcggagagca

SEQ ID NO: 670548 - DNA, 25 bp, Rattus norvegicus
ttcggctcggactcgtcggagagca

SEQ ID NO: 670549 - DNA, 25 bp, Rattus norvegicus
ttcggctctcttacaggtatgtgtc

SEQ ID NO: 670550 - DNA, 25 bp, Rattus norvegicus
ttcggctctctttcaggtatgtgtc

SEQ ID NO: 670551 - DNA, 25 bp, Rattus norvegicus
ttcggctctgagctctaataatcaa

SEQ ID NO: 670552 - DNA, 25 bp, Rattus norvegicus
ttcggctctgaggtctaataatcaa

SEQ ID NO: 670553 - DNA, 25 bp, Rattus norvegicus
ttcggctgagggactggctctatta

SEQ ID NO: 670554 - DNA, 25 bp, Rattus norvegicus
ttcggctgagggtctggctctatta

SEQ ID NO: 670555 - DNA, 25 bp, Rattus norvegicus
ttcggctgccataggtgaccacgga

SEQ ID NO: 670556 - DNA, 25 bp, Rattus norvegicus
ttcggctgccattggtgaccacgga

SEQ ID NO: 670557 - DNA, 25 bp, Rattus norvegicus
ttcggctggagacgaaaccccactt

SEQ ID NO: 670558 - DNA, 25 bp, Rattus norvegicus
ttcggctggagaggaaaccccactt

SEQ ID NO: 670559 - DNA, 25 bp, Rattus norvegicus
ttcggcttccgacccagaaagaaca

SEQ ID NO: 670560 - DNA, 25 bp, Rattus norvegicus
ttcggcttccgagccagaaagaaca

SEQ ID NO: 670561 - DNA, 25 bp, Rattus norvegicus
ttcggcttgtctctctcctaaaaga

SEQ ID NO: 670562 - DNA, 25 bp, Rattus norvegicus
ttcggcttgtctgtctcctaaaaga

SEQ ID NO: 670563 - DNA, 25 bp, Rattus norvegicus
ttcgggaaacggctctagttctagg

SEQ ID NO: 670564 - DNA, 25 bp, Rattus norvegicus
ttcgggaaacgggtctagttctagg

SEQ ID NO: 670565 - DNA, 25 bp, Rattus norvegicus
ttcgggaaccctcctaattgataat

SEQ ID NO: 670566 - DNA, 25 bp, Rattus norvegicus
ttcgggaaccctgctaattgataat

SEQ ID NO: 670567 - DNA, 25 bp, Rattus norvegicus
ttcgggaaccgcaagaacctgaagc

SEQ ID NO: 670568 - DNA, 25 bp, Rattus norvegicus
ttcgggaaccgctagaacctgaagc

SEQ ID NO: 670569 - DNA, 25 bp, Rattus norvegicus
ttcgggaataaaaggcaattctcat

SEQ ID NO: 670570 - DNA, 25 bp, Rattus norvegicus
ttcgggaataaatggcaattctcat

SEQ ID NO: 670571 - DNA, 25 bp, Rattus norvegicus
ttcgggacaaacatcggctcagcgg

SEQ ID NO: 670572 - DNA, 25 bp, Rattus norvegicus
ttcgggacaaacttcggctcagcgg

SEQ ID NO: 670573 - DNA, 25 bp, Rattus norvegicus
ttcgggagaacaactgccttctgca

SEQ ID NO: 670574 - DNA, 25 bp, Rattus norvegicus
ttcgggagaacatctgccttctgca

SEQ ID NO: 670575 - DNA, 25 bp, Rattus norvegicus
ttcgggagaggccttctagtcctcg

SEQ ID NO: 670576 - DNA, 25 bp, Rattus norvegicus
ttcgggagaggcgttctagtcctcg

SEQ ID NO: 670577 - DNA, 25 bp, Rattus norvegicus
ttcgggagcgccaattcttttcaag

SEQ ID NO: 670578 - DNA, 25 bp, Rattus norvegicus
ttcgggagcgcctattcttttcaag

SEQ ID NO: 670579 - DNA, 25 bp, Rattus norvegicus
ttcgggcaggcgagcacatcaagct

SEQ ID NO: 670580 - DNA, 25 bp, Rattus norvegicus
ttcgggcaggcgtgcacatcaagct

SEQ ID NO: 670581 - DNA, 25 bp, Rattus norvegicus
ttcgggcatatcagccttgctaaga

SEQ ID NO: 670582 - DNA, 25 bp, Rattus norvegicus
ttcgggcatatctgccttgctaaga

SEQ ID NO: 670583 - DNA, 25 bp, Rattus norvegicus
ttcgggcccgctagtggtacctcaa

SEQ ID NO: 670584 - DNA, 25 bp, Rattus norvegicus
ttcgggcccgcttgtggtacctcaa

SEQ ID NO: 670585 - DNA, 25 bp, Rattus norvegicus
ttcgggccgaagattgctagcatgt

SEQ ID NO: 670586 - DNA, 25 bp, Rattus norvegicus
ttcgggccgaagtttgctagcatgt

SEQ ID NO: 670587 - DNA, 25 bp, Rattus norvegicus
ttcgggcgaagacaaacggatgcac

SEQ ID NO: 670588 - DNA, 25 bp, Rattus norvegicus
ttcgggcgaagagaaacggatgcac

SEQ ID NO: 670589 - DNA, 25 bp, Rattus norvegicus
ttcgggctcatcatttacttctcca

SEQ ID NO: 670590 - DNA, 25 bp, Rattus norvegicus
ttcgggctcatcttttacttctcca

SEQ ID NO: 670591 - DNA, 25 bp, Rattus norvegicus
ttcgggctgatcatccagcaggtgt

SEQ ID NO: 670592 - DNA, 25 bp, Rattus norvegicus
ttcgggctgatcttccagcaggtgt

SEQ ID NO: 670593 - DNA, 25 bp, Rattus norvegicus
ttcgggtagctgcaggactcttcca

SEQ ID NO: 670594 - DNA, 25 bp, Rattus norvegicus
ttcgggtagctggaggactcttcca

SEQ ID NO: 670595 - DNA, 25 bp, Rattus norvegicus
ttcgggtcacccaagcatgaaagta

SEQ ID NO: 670596 - DNA, 25 bp, Rattus norvegicus
ttcgggtcaccctagcatgaaagta

SEQ ID NO: 670597 - DNA, 25 bp, Rattus norvegicus
ttcgggtcttctctgcagtggaact

SEQ ID NO: 670598 - DNA, 25 bp, Rattus norvegicus
ttcgggtcttctgtgcagtggaact

SEQ ID NO: 670599 - DNA, 25 bp, Rattus norvegicus
ttcgggtgtgctcggcttcataata

SEQ ID NO: 670600 - DNA, 25 bp, Rattus norvegicus
ttcgggtgtgctgggcttcataata

SEQ ID NO: 670601 - DNA, 25 bp, Rattus norvegicus
ttcgggttacagcttttttgagcca

SEQ ID NO: 670602 - DNA, 25 bp, Rattus norvegicus
ttcgggttacaggttttttgagcca

SEQ ID NO: 670603 - DNA, 25 bp, Rattus norvegicus
ttcgggttccgcagggacgagccct

SEQ ID NO: 670604 - DNA, 25 bp, Rattus norvegicus
ttcgggttccgctgggacgagccct

SEQ ID NO: 670605 - DNA, 25 bp, Rattus norvegicus
ttcggtaacttacttctctctggga

SEQ ID NO: 670606 - DNA, 25 bp, Rattus norvegicus
ttcggtaacttagttctctctggga

SEQ ID NO: 670607 - DNA, 25 bp, Rattus norvegicus
ttcggtatctggacctgcctcggtg

SEQ ID NO: 670608 - DNA, 25 bp, Rattus norvegicus
ttcggtatctggtcctgcctcggtg

SEQ ID NO: 670609 - DNA, 25 bp, Rattus norvegicus
ttcggtcatgaaagcgcgtgaacgt

SEQ ID NO: 670610 - DNA, 25 bp, Rattus norvegicus
ttcggtcatgaatgcgcgtgaacgt

SEQ ID NO: 670611 - DNA, 25 bp, Rattus norvegicus
ttcggtcccggtccacgatcctggg

SEQ ID NO: 670612 - DNA, 25 bp, Rattus norvegicus
ttcggtcccggtgcacgatcctggg

SEQ ID NO: 670613 - DNA, 25 bp, Rattus norvegicus
ttcggtccgttcatctgtaagacag

SEQ ID NO: 670614 - DNA, 25 bp, Rattus norvegicus
ttcggtccgttcttctgtaagacag

SEQ ID NO: 670615 - DNA, 25 bp, Rattus norvegicus
ttcggtcctcaaacctgaaaagaca

SEQ ID NO: 670616 - DNA, 25 bp, Rattus norvegicus
ttcggtcctcaatcctgaaaagaca

SEQ ID NO: 670617 - DNA, 25 bp, Rattus norvegicus
ttcggtcctgaccaaagacaagttg

SEQ ID NO: 670618 - DNA, 25 bp, Rattus norvegicus
ttcggtcctgacgaaagacaagttg

SEQ ID NO: 670619 - DNA, 25 bp, Rattus norvegicus
ttcggtcgatggatgttgagtctca

SEQ ID NO: 670620 - DNA, 25 bp, Rattus norvegicus
ttcggtcgatggttgttgagtctca

SEQ ID NO: 670621 - DNA, 25 bp, Rattus norvegicus
ttcggtctacctctacctacgtggg

SEQ ID NO: 670622 - DNA, 25 bp, Rattus norvegicus
ttcggtctacctgtacctacgtggg

SEQ ID NO: 670623 - DNA, 25 bp, Rattus norvegicus
ttcggtctcttccacgacgcggcgg

SEQ ID NO: 670624 - DNA, 25 bp, Rattus norvegicus
ttcggtctcttcgacgacgcggcgg

SEQ ID NO: 670625 - DNA, 25 bp, Rattus norvegicus
ttcggtctggtcagtgtatcaggga

SEQ ID NO: 670626 - DNA, 25 bp, Rattus norvegicus
ttcggtctggtctgtgtatcaggga

SEQ ID NO: 670627 - DNA, 25 bp, Rattus norvegicus
ttcggtctggtgcacattagccttg

SEQ ID NO: 670628 - DNA, 25 bp, Rattus norvegicus
ttcggtctggtggacattagccttg

SEQ ID NO: 670629 - DNA, 25 bp, Rattus norvegicus
ttcggtcttcttagcactgttgaga

SEQ ID NO: 670630 - DNA, 25 bp, Rattus norvegicus
ttcggtcttctttgcactgttgaga

SEQ ID NO: 670631 - DNA, 25 bp, Rattus norvegicus
ttcggtgaccacatgaaccactgca

SEQ ID NO: 670632 - DNA, 25 bp, Rattus norvegicus
ttcggtgaccacttgaaccactgca

SEQ ID NO: 670633 - DNA, 25 bp, Rattus norvegicus
ttcggtgatgttattcccagcagca

SEQ ID NO: 670634 - DNA, 25 bp, Rattus norvegicus
ttcggtgatgtttttcccagcagca

SEQ ID NO: 670635 - DNA, 25 bp, Rattus norvegicus
ttcggtgcccagcagtgagctagtc

SEQ ID NO: 670636 - DNA, 25 bp, Rattus norvegicus
ttcggtgcccaggagtgagctagtc

SEQ ID NO: 670637 - DNA, 25 bp, Rattus norvegicus
ttcggtgcggacctcaatgtcaaga

SEQ ID NO: 670638 - DNA, 25 bp, Rattus norvegicus
ttcggtgcggacgtcaatgtcaaga

SEQ ID NO: 670639 - DNA, 25 bp, Rattus norvegicus
ttcggtgctacactggaggcccatg

SEQ ID NO: 670640 - DNA, 25 bp, Rattus norvegicus
ttcggtgctacagtggaggcccatg

SEQ ID NO: 670641 - DNA, 25 bp, Rattus norvegicus
ttcggtgctatcacctagtcaaatt

SEQ ID NO: 670642 - DNA, 25 bp, Rattus norvegicus
ttcggtgctatctcctagtcaaatt

SEQ ID NO: 670643 - DNA, 25 bp, Rattus norvegicus
ttcggtggcgttagcattagcctaa

SEQ ID NO: 670644 - DNA, 25 bp, Rattus norvegicus
ttcggtggcgtttgcattagcctaa

SEQ ID NO: 670645 - DNA, 25 bp, Rattus norvegicus
ttcggtggctctccgggatgacaca

SEQ ID NO: 670646 - DNA, 25 bp, Rattus norvegicus
ttcggtggctctgcgggatgacaca

SEQ ID NO: 670647 - DNA, 25 bp, Rattus norvegicus
ttcggtgtccaacaagccccgctta

SEQ ID NO: 670648 - DNA, 25 bp, Rattus norvegicus
ttcggtgtccaagaagccccgctta

SEQ ID NO: 670649 - DNA, 25 bp, Rattus norvegicus
ttcggtgtccagcagagccctattc

SEQ ID NO: 670650 - DNA, 25 bp, Rattus norvegicus
ttcggtgtccaggagagccctattc

SEQ ID NO: 670651 - DNA, 25 bp, Rattus norvegicus
ttcggtgtccctcttattgctgatg

SEQ ID NO: 670652 - DNA, 25 bp, Rattus norvegicus
ttcggtgtccctgttattgctgatg

SEQ ID NO: 670653 - DNA, 25 bp, Rattus norvegicus
ttcggtgtggaacctgaagcctgcc

SEQ ID NO: 670654 - DNA, 25 bp, Rattus norvegicus
ttcggtgtggaagctgaagcctgcc

SEQ ID NO: 670655 - DNA, 25 bp, Rattus norvegicus
ttcggtgttcccattttctggagac

SEQ ID NO: 670656 - DNA, 25 bp, Rattus norvegicus
ttcggtgttccctttttctggagac

SEQ ID NO: 670657 - DNA, 25 bp, Rattus norvegicus
ttcggttaagcccttgaggagcaaa

SEQ ID NO: 670658 - DNA, 25 bp, Rattus norvegicus
ttcggttaagccgttgaggagcaaa

SEQ ID NO: 670659 - DNA, 25 bp, Rattus norvegicus
ttcggttccaggctcccatgaagta

SEQ ID NO: 670660 - DNA, 25 bp, Rattus norvegicus
ttcggttccagggtcccatgaagta

SEQ ID NO: 670661 - DNA, 25 bp, Rattus norvegicus
ttcggttccggccacatggctaaac

SEQ ID NO: 670662 - DNA, 25 bp, Rattus norvegicus
ttcggttccggcgacatggctaaac

SEQ ID NO: 670663 - DNA, 25 bp, Rattus norvegicus
ttcggttcctggcaactctgaagaa

SEQ ID NO: 670664 - DNA, 25 bp, Rattus norvegicus
ttcggttcctgggaactctgaagaa

SEQ ID NO: 670665 - DNA, 25 bp, Rattus norvegicus
ttcggttcctgtaacttgagtccca

SEQ ID NO: 670666 - DNA, 25 bp, Rattus norvegicus
ttcggttcctgttacttgagtccca

SEQ ID NO: 670667 - DNA, 25 bp, Rattus norvegicus
ttcggttctctaattgtccaaggat

SEQ ID NO: 670668 - DNA, 25 bp, Rattus norvegicus
ttcggttctctatttgtccaaggat

SEQ ID NO: 670669 - DNA, 25 bp, Rattus norvegicus
ttcggttctggaacgtcttcagcaa

SEQ ID NO: 670670 - DNA, 25 bp, Rattus norvegicus
ttcggttctggatcgtcttcagcaa

SEQ ID NO: 670671 - DNA, 25 bp, Rattus norvegicus
ttcggttgccccagtatcagactga

SEQ ID NO: 670672 - DNA, 25 bp, Rattus norvegicus
ttcggttgcccctgtatcagactga

SEQ ID NO: 670673 - DNA, 25 bp, Rattus norvegicus
ttcggttgtcagaaggtgtcagctt

SEQ ID NO: 670674 - DNA, 25 bp, Rattus norvegicus
ttcggttgtcagtaggtgtcagctt

SEQ ID NO: 670675 - DNA, 25 bp, Rattus norvegicus
ttcggtttagttacgactcgcctgt

SEQ ID NO: 670676 - DNA, 25 bp, Rattus norvegicus
ttcggtttagtttcgactcgcctgt

SEQ ID NO: 670677 - DNA, 25 bp, Rattus norvegicus
ttcggtttcccaccttgactaccag

SEQ ID NO: 670678 - DNA, 25 bp, Rattus norvegicus
ttcggtttcccagcttgactaccag

SEQ ID NO: 670679 - DNA, 25 bp, Rattus norvegicus
ttcggtttttcaatttaagcaacag

SEQ ID NO: 670680 - DNA, 25 bp, Rattus norvegicus
ttcggtttttcattttaagcaacag

SEQ ID NO: 670681 - DNA, 25 bp, Rattus norvegicus
ttcgtaaagttcagatgagttcccc

SEQ ID NO: 670682 - DNA, 25 bp, Rattus norvegicus
ttcgtaaagttctgatgagttcccc

SEQ ID NO: 670683 - DNA, 25 bp, Rattus norvegicus
ttcgtaagacggcaacgcactcgtt

SEQ ID NO: 670684 - DNA, 25 bp, Rattus norvegicus
ttcgtaagacgggaacgcactcgtt

SEQ ID NO: 670685 - DNA, 25 bp, Rattus norvegicus
ttcgtacagctaaccccatagggaa

SEQ ID NO: 670686 - DNA, 25 bp, Rattus norvegicus
ttcgtacagctatccccatagggaa

SEQ ID NO: 670687 - DNA, 25 bp, Rattus norvegicus
ttcgtacagtctaaagtgggcagct

SEQ ID NO: 670688 - DNA, 25 bp, Rattus norvegicus
ttcgtacagtcttaagtgggcagct

SEQ ID NO: 670689 - DNA, 25 bp, Rattus norvegicus
ttcgtaccacaaactgtgttgcagt

SEQ ID NO: 670690 - DNA, 25 bp, Rattus norvegicus
ttcgtaccacaatctgtgttgcagt

SEQ ID NO: 670691 - DNA, 25 bp, Rattus norvegicus
ttcgtaccatctcggcctggaagac

SEQ ID NO: 670692 - DNA, 25 bp, Rattus norvegicus
ttcgtaccatctgggcctggaagac

SEQ ID NO: 670693 - DNA, 25 bp, Rattus norvegicus
ttcgtactacgcagtgggacggcga

SEQ ID NO: 670694 - DNA, 25 bp, Rattus norvegicus
ttcgtactacgctgtgggacggcga

SEQ ID NO: 670695 - DNA, 25 bp, Rattus norvegicus
ttcgtagagtatcccaagctgccca

SEQ ID NO: 670696 - DNA, 25 bp, Rattus norvegicus
ttcgtagagtatgccaagctgccca

SEQ ID NO: 670697 - DNA, 25 bp, Rattus norvegicus
ttcgtagtacgacttccaccacatt

SEQ ID NO: 670698 - DNA, 25 bp, Rattus norvegicus
ttcgtagtacgagttccaccacatt

SEQ ID NO: 670699 - DNA, 25 bp, Rattus norvegicus
ttcgtatccagaagccctgactagt

SEQ ID NO: 670700 - DNA, 25 bp, Rattus norvegicus
ttcgtatccagatgccctgactagt

SEQ ID NO: 670701 - DNA, 25 bp, Rattus norvegicus
ttcgtatgagcgcacattgttcaga

SEQ ID NO: 670702 - DNA, 25 bp, Rattus norvegicus
ttcgtatgagcggacattgttcaga

SEQ ID NO: 670703 - DNA, 25 bp, Rattus norvegicus
ttcgtatgcctaactcacctgtgtg

SEQ ID NO: 670704 - DNA, 25 bp, Rattus norvegicus
ttcgtatgcctatctcacctgtgtg

SEQ ID NO: 670705 - DNA, 25 bp, Rattus norvegicus
ttcgtattgtagacagcctcaccct

SEQ ID NO: 670706 - DNA, 25 bp, Rattus norvegicus
ttcgtattgtagtcagcctcaccct

SEQ ID NO: 670707 - DNA, 25 bp, Rattus norvegicus
ttcgtcaacactatccgcaagtgta

SEQ ID NO: 670708 - DNA, 25 bp, Rattus norvegicus
ttcgtcaacactttccgcaagtgta

SEQ ID NO: 670709 - DNA, 25 bp, Rattus norvegicus
ttcgtcaaccacaacatgagcgacc

SEQ ID NO: 670710 - DNA, 25 bp, Rattus norvegicus
ttcgtcaaccactacatgagcgacc

SEQ ID NO: 670711 - DNA, 25 bp, Rattus norvegicus
ttcgtcactagcatcgtgggttgga

SEQ ID NO: 670712 - DNA, 25 bp, Rattus norvegicus
ttcgtcactagcttcgtgggttgga

SEQ ID NO: 670713 - DNA, 25 bp, Rattus norvegicus
ttcgtccatgccaagaaggtcagct

SEQ ID NO: 670714 - DNA, 25 bp, Rattus norvegicus
ttcgtccatgcctagaaggtcagct

SEQ ID NO: 670715 - DNA, 25 bp, Rattus norvegicus
ttcgtccatttcatcccgcagtgag

SEQ ID NO: 670716 - DNA, 25 bp, Rattus norvegicus
ttcgtccatttcttcccgcagtgag

SEQ ID NO: 670717 - DNA, 25 bp, Rattus norvegicus
ttcgtcccagtgctctggatgcaga

SEQ ID NO: 670718 - DNA, 25 bp, Rattus norvegicus
ttcgtcccagtggtctggatgcaga

SEQ ID NO: 670719 - DNA, 25 bp, Rattus norvegicus
ttcgtcccatctaaagaactttgtt

SEQ ID NO: 670720 - DNA, 25 bp, Rattus norvegicus
ttcgtcccatcttaagaactttgtt

SEQ ID NO: 670721 - DNA, 25 bp, Rattus norvegicus
ttcgtccccagcagtttgtaaaggc

SEQ ID NO: 670722 - DNA, 25 bp, Rattus norvegicus
ttcgtccccagctgtttgtaaaggc

SEQ ID NO: 670723 - DNA, 25 bp, Rattus norvegicus
ttcgtcctcagactgttgcaaacac

SEQ ID NO: 670724 - DNA, 25 bp, Rattus norvegicus
ttcgtcctcagagtgttgcaaacac

SEQ ID NO: 670725 - DNA, 25 bp, Rattus norvegicus
ttcgtcctgagaaaagtgttctcta

SEQ ID NO: 670726 - DNA, 25 bp, Rattus norvegicus
ttcgtcctgagataagtgttctcta

SEQ ID NO: 670727 - DNA, 25 bp, Rattus norvegicus
ttcgtccttatccagccaagtgaac

SEQ ID NO: 670728 - DNA, 25 bp, Rattus norvegicus
ttcgtccttatcgagccaagtgaac

SEQ ID NO: 670729 - DNA, 25 bp, Rattus norvegicus
ttcgtccttattacaatgcagatcg

SEQ ID NO: 670730 - DNA, 25 bp, Rattus norvegicus
ttcgtccttatttcaatgcagatcg

SEQ ID NO: 670731 - DNA, 25 bp, Rattus norvegicus
ttcgtcctttgcagctcccaggtgg

SEQ ID NO: 670732 - DNA, 25 bp, Rattus norvegicus
ttcgtcctttgctgctcccaggtgg

SEQ ID NO: 670733 - DNA, 25 bp, Rattus norvegicus
ttcgtcgccccgaggtggtgccaca

SEQ ID NO: 670734 - DNA, 25 bp, Rattus norvegicus
ttcgtcgccccgtggtggtgccaca

SEQ ID NO: 670735 - DNA, 25 bp, Rattus norvegicus
ttcgtcgttattactgtcttcagtc

SEQ ID NO: 670736 - DNA, 25 bp, Rattus norvegicus
ttcgtcgttatttctgtcttcagtc

SEQ ID NO: 670737 - DNA, 25 bp, Rattus norvegicus
ttcgtctcggttccaacagaacgga

SEQ ID NO: 670738 - DNA, 25 bp, Rattus norvegicus
ttcgtctcggttgcaacagaacgga

SEQ ID NO: 670739 - DNA, 25 bp, Rattus norvegicus
ttcgtctctaaacttcaccctcaag

SEQ ID NO: 670740 - DNA, 25 bp, Rattus norvegicus
ttcgtctctaaagttcaccctcaag

SEQ ID NO: 670741 - DNA, 25 bp, Rattus norvegicus
ttcgtctctcctcctttaaagttaa

SEQ ID NO: 670742 - DNA, 25 bp, Rattus norvegicus
ttcgtctctcctgctttaaagttaa

SEQ ID NO: 670743 - DNA, 25 bp, Rattus norvegicus
ttcgtctgcagaagcgcggcacagg

SEQ ID NO: 670744 - DNA, 25 bp, Rattus norvegicus
ttcgtctgcagatgcgcggcacagg

SEQ ID NO: 670745 - DNA, 25 bp, Rattus norvegicus
ttcgtgaaaaccacagtgcctgtca

SEQ ID NO: 670746 - DNA, 25 bp, Rattus norvegicus
ttcgtgaaaacctcagtgcctgtca

SEQ ID NO: 670747 - DNA, 25 bp, Rattus norvegicus
ttcgtgacagacaaaggccgctacc

SEQ ID NO: 670748 - DNA, 25 bp, Rattus norvegicus
ttcgtgacagactaaggccgctacc

SEQ ID NO: 670749 - DNA, 25 bp, Rattus norvegicus
ttcgtgacagcccaagtctctaagt

SEQ ID NO: 670750 - DNA, 25 bp, Rattus norvegicus
ttcgtgacagccgaagtctctaagt

SEQ ID NO: 670751 - DNA, 25 bp, Rattus norvegicus
ttcgtgagacaacacattctacccc

SEQ ID NO: 670752 - DNA, 25 bp, Rattus norvegicus
ttcgtgagacaagacattctacccc

SEQ ID NO: 670753 - DNA, 25 bp, Rattus norvegicus
ttcgtgatgcaccttattatttttt

SEQ ID NO: 670754 - DNA, 25 bp, Rattus norvegicus
ttcgtgatgcacgttattatttttt

SEQ ID NO: 670755 - DNA, 25 bp, Rattus norvegicus
ttcgtgcaccgaatctctcacggaa

SEQ ID NO: 670756 - DNA, 25 bp, Rattus norvegicus
ttcgtgcaccgattctctcacggaa

SEQ ID NO: 670757 - DNA, 25 bp, Rattus norvegicus
ttcgtgcagcgcctgttccgcgacg

SEQ ID NO: 670758 - DNA, 25 bp, Rattus norvegicus
ttcgtgcagcgcgtgttccgcgacg

SEQ ID NO: 670759 - DNA, 25 bp, Rattus norvegicus
ttcgtgcccgcgacttgtgggtgtc

SEQ ID NO: 670760 - DNA, 25 bp, Rattus norvegicus
ttcgtgcccgcgtcttgtgggtgtc

SEQ ID NO: 670761 - DNA, 25 bp, Rattus norvegicus
ttcgtgctcttcatgttctttggaa

SEQ ID NO: 670762 - DNA, 25 bp, Rattus norvegicus
ttcgtgctcttcttgttctttggaa

SEQ ID NO: 670763 - DNA, 25 bp, Rattus norvegicus
ttcgtgctgtccctttgagagtaaa

SEQ ID NO: 670764 - DNA, 25 bp, Rattus norvegicus
ttcgtgctgtccgtttgagagtaaa

SEQ ID NO: 670765 - DNA, 25 bp, Rattus norvegicus
ttcgtgcttcgaaccacagtcatat

SEQ ID NO: 670766 - DNA, 25 bp, Rattus norvegicus
ttcgtgcttcgatccacagtcatat

SEQ ID NO: 670767 - DNA, 25 bp, Rattus norvegicus
ttcgtgcttcgtattagtgtttcca

SEQ ID NO: 670768 - DNA, 25 bp, Rattus norvegicus
ttcgtgcttcgttttagtgtttcca

SEQ ID NO: 670769 - DNA, 25 bp, Rattus norvegicus
ttcgtggaacctcgtcagtgggcct

SEQ ID NO: 670770 - DNA, 25 bp, Rattus norvegicus
ttcgtggaacctggtcagtgggcct

SEQ ID NO: 670771 - DNA, 25 bp, Rattus norvegicus
ttcgtggagcatatatctctctggg

SEQ ID NO: 670772 - DNA, 25 bp, Rattus norvegicus
ttcgtggagcatttatctctctggg

SEQ ID NO: 670773 - DNA, 25 bp, Rattus norvegicus
ttcgtggccatcataacatgtgctt

SEQ ID NO: 670774 - DNA, 25 bp, Rattus norvegicus
ttcgtggccatcttaacatgtgctt

SEQ ID NO: 670775 - DNA, 25 bp, Rattus norvegicus
ttcgtggctcccataagtttactat

SEQ ID NO: 670776 - DNA, 25 bp, Rattus norvegicus
ttcgtggctcccttaagtttactat

SEQ ID NO: 670777 - DNA, 25 bp, Rattus norvegicus
ttcgtggtacacctgatatacagat

SEQ ID NO: 670778 - DNA, 25 bp, Rattus norvegicus
ttcgtggtacacgtgatatacagat

SEQ ID NO: 670779 - DNA, 25 bp, Rattus norvegicus
ttcgtggtagcaccgaaccgaaagt

SEQ ID NO: 670780 - DNA, 25 bp, Rattus norvegicus
ttcgtggtagcagcgaaccgaaagt

SEQ ID NO: 670781 - DNA, 25 bp, Rattus norvegicus
ttcgtggtccaacgctttggccaag

SEQ ID NO: 670782 - DNA, 25 bp, Rattus norvegicus
ttcgtggtccaaggctttggccaag

SEQ ID NO: 670783 - DNA, 25 bp, Rattus norvegicus
ttcgtggtgctgaagggttccctca

SEQ ID NO: 670784 - DNA, 25 bp, Rattus norvegicus
ttcgtggtgctgtagggttccctca

SEQ ID NO: 670785 - DNA, 25 bp, Rattus norvegicus
ttcgtggtgtgtaggttcccgttct

SEQ ID NO: 670786 - DNA, 25 bp, Rattus norvegicus
ttcgtggtgtgttggttcccgttct

SEQ ID NO: 670787 - DNA, 25 bp, Rattus norvegicus
ttcgtgtacctgatcatcggcacat

SEQ ID NO: 670788 - DNA, 25 bp, Rattus norvegicus
ttcgtgtacctgttcatcggcacat

SEQ ID NO: 670789 - DNA, 25 bp, Rattus norvegicus
ttcgtgtagagaagctccaggacgt

SEQ ID NO: 670790 - DNA, 25 bp, Rattus norvegicus
ttcgtgtagagatgctccaggacgt

SEQ ID NO: 670791 - DNA, 25 bp, Rattus norvegicus
ttcgtgtcccgacagttctgtcgca

SEQ ID NO: 670792 - DNA, 25 bp, Rattus norvegicus
ttcgtgtcccgagagttctgtcgca

SEQ ID NO: 670793 - DNA, 25 bp, Rattus norvegicus
ttcgtgtcctccatgggctgtaaca

SEQ ID NO: 670794 - DNA, 25 bp, Rattus norvegicus
ttcgtgtcctccttgggctgtaaca

SEQ ID NO: 670795 - DNA, 25 bp, Rattus norvegicus
ttcgtgtcggtgctcttctggcttc

SEQ ID NO: 670796 - DNA, 25 bp, Rattus norvegicus
ttcgtgtcggtggtcttctggcttc

SEQ ID NO: 670797 - DNA, 25 bp, Rattus norvegicus
ttcgtgtctaccatcatactgtgtg

SEQ ID NO: 670798 - DNA, 25 bp, Rattus norvegicus
ttcgtgtctaccttcatactgtgtg

SEQ ID NO: 670799 - DNA, 25 bp, Rattus norvegicus
ttcgtgtctgaccagagaccccaga

SEQ ID NO: 670800 - DNA, 25 bp, Rattus norvegicus
ttcgtgtctgacgagagaccccaga

SEQ ID NO: 670801 - DNA, 25 bp, Rattus norvegicus
ttcgtgtcttctacagcagctatgc

SEQ ID NO: 670802 - DNA, 25 bp, Rattus norvegicus
ttcgtgtcttcttcagcagctatgc

SEQ ID NO: 670803 - DNA, 25 bp, Rattus norvegicus
ttcgtgtgtcaactatgtggctttc

SEQ ID NO: 670804 - DNA, 25 bp, Rattus norvegicus
ttcgtgtgtcaagtatgtggctttc

SEQ ID NO: 670805 - DNA, 25 bp, Rattus norvegicus
ttcgtgttcatcagcatgatcctgt

SEQ ID NO: 670806 - DNA, 25 bp, Rattus norvegicus
ttcgtgttcatccagactgcaggtc

SEQ ID NO: 670807 - DNA, 25 bp, Rattus norvegicus
ttcgtgttcatcgagactgcaggtc

SEQ ID NO: 670808 - DNA, 25 bp, Rattus norvegicus
ttcgtgttcatctgcatgatcctgt

SEQ ID NO: 670809 - DNA, 25 bp, Rattus norvegicus
ttcgtgttcctcagtacttgttctg

SEQ ID NO: 670810 - DNA, 25 bp, Rattus norvegicus
ttcgtgttcctctgtacttgttctg

SEQ ID NO: 670811 - DNA, 25 bp, Rattus norvegicus
ttcgtgttctggctgtgagtcatca

SEQ ID NO: 670812 - DNA, 25 bp, Rattus norvegicus
ttcgtgttctgggtgtgagtcatca

SEQ ID NO: 670813 - DNA, 25 bp, Rattus norvegicus
ttcgtgtttcctatatcaagccctt

SEQ ID NO: 670814 - DNA, 25 bp, Rattus norvegicus
ttcgtgtttcctttatcaagccctt

SEQ ID NO: 670815 - DNA, 25 bp, Rattus norvegicus
ttcgtgttttccagttttctctact

SEQ ID NO: 670816 - DNA, 25 bp, Rattus norvegicus
ttcgtgttttcctgttttctctact

SEQ ID NO: 670817 - DNA, 25 bp, Rattus norvegicus
ttcgttaagaacagtcctcctctct

SEQ ID NO: 670818 - DNA, 25 bp, Rattus norvegicus
ttcgttaagaactgtcctcctctct

SEQ ID NO: 670819 - DNA, 25 bp, Rattus norvegicus
ttcgttattgttcaggcaccatgac

SEQ ID NO: 670820 - DNA, 25 bp, Rattus norvegicus
ttcgttattgttgaggcaccatgac

SEQ ID NO: 670821 - DNA, 25 bp, Rattus norvegicus
ttcgttcaacctatgacaattcatc

SEQ ID NO: 670822 - DNA, 25 bp, Rattus norvegicus
ttcgttcaacctttgacaattcatc

SEQ ID NO: 670823 - DNA, 25 bp, Rattus norvegicus
ttcgttcactaaaccactcatctat

SEQ ID NO: 670824 - DNA, 25 bp, Rattus norvegicus
ttcgttcactaatccactcatctat

SEQ ID NO: 670825 - DNA, 25 bp, Rattus norvegicus
ttcgttccccagatctttagtgttg

SEQ ID NO: 670826 - DNA, 25 bp, Rattus norvegicus
ttcgttccccagttctttagtgttg

SEQ ID NO: 670827 - DNA, 25 bp, Rattus norvegicus
ttcgttcccgaaacttggctaaact

SEQ ID NO: 670828 - DNA, 25 bp, Rattus norvegicus
ttcgttcccgaatcttggctaaact

SEQ ID NO: 670829 - DNA, 25 bp, Rattus norvegicus
ttcgttccctccaccagaagaggaa

SEQ ID NO: 670830 - DNA, 25 bp, Rattus norvegicus
ttcgttccctcctccagaagaggaa

SEQ ID NO: 670831 - DNA, 25 bp, Rattus norvegicus
ttcgttccggacacagctgcacagg

SEQ ID NO: 670832 - DNA, 25 bp, Rattus norvegicus
ttcgttccggactcagctgcacagg

SEQ ID NO: 670833 - DNA, 25 bp, Rattus norvegicus
ttcgttcctaggagactaacagaat

SEQ ID NO: 670834 - DNA, 25 bp, Rattus norvegicus
ttcgttcctaggtgactaacagaat

SEQ ID NO: 670835 - DNA, 25 bp, Rattus norvegicus
ttcgttcctcttagcagagcaggga

SEQ ID NO: 670836 - DNA, 25 bp, Rattus norvegicus
ttcgttcctctttgcagagcaggga

SEQ ID NO: 670837 - DNA, 25 bp, Rattus norvegicus
ttcgttctgactaaacaaactgtgg

SEQ ID NO: 670838 - DNA, 25 bp, Rattus norvegicus
ttcgttctgacttaacaaactgtgg

SEQ ID NO: 670839 - DNA, 25 bp, Rattus norvegicus
ttcgttctgtagcacctctgtgagc

SEQ ID NO: 670840 - DNA, 25 bp, Rattus norvegicus
ttcgttctgtaggacctctgtgagc

SEQ ID NO: 670841 - DNA, 25 bp, Rattus norvegicus
ttcgttcttcagagattggcgttta

SEQ ID NO: 670842 - DNA, 25 bp, Rattus norvegicus
ttcgttcttcagtgattggcgttta

SEQ ID NO: 670843 - DNA, 25 bp, Rattus norvegicus
ttcgttcttctgaacaccgtaggga

SEQ ID NO: 670844 - DNA, 25 bp, Rattus norvegicus
ttcgttcttctgtacaccgtaggga

SEQ ID NO: 670845 - DNA, 25 bp, Rattus norvegicus
ttcgttgctcttatcctttgaatgt

SEQ ID NO: 670846 - DNA, 25 bp, Rattus norvegicus
ttcgttgctcttttcctttgaatgt

SEQ ID NO: 670847 - DNA, 25 bp, Rattus norvegicus
ttcgttggaccacggaccaccacat

SEQ ID NO: 670848 - DNA, 25 bp, Rattus norvegicus
ttcgttggaccagggaccaccacat

SEQ ID NO: 670849 - DNA, 25 bp, Rattus norvegicus
ttcgttggctttcgctgaatggcac

SEQ ID NO: 670850 - DNA, 25 bp, Rattus norvegicus
ttcgttggctttggctgaatggcac

SEQ ID NO: 670851 - DNA, 25 bp, Rattus norvegicus
ttcgttgggcatctcacaatcactt

SEQ ID NO: 670852 - DNA, 25 bp, Rattus norvegicus
ttcgttgggcatgtcacaatcactt

SEQ ID NO: 670853 - DNA, 25 bp, Rattus norvegicus
ttcgttgttgagaacctagccaggc

SEQ ID NO: 670854 - DNA, 25 bp, Rattus norvegicus
ttcgttgttgagtacctagccaggc

SEQ ID NO: 670855 - DNA, 25 bp, Rattus norvegicus
ttcgtttacaggacgtcttttctat

SEQ ID NO: 670856 - DNA, 25 bp, Rattus norvegicus
ttcgtttacaggtcgtcttttctat

SEQ ID NO: 670857 - DNA, 25 bp, Rattus norvegicus
ttcgtttagcataacactgttcctt

SEQ ID NO: 670858 - DNA, 25 bp, Rattus norvegicus
ttcgtttagcattacactgttcctt

SEQ ID NO: 670859 - DNA, 25 bp, Rattus norvegicus
ttcgtttgggttattggctcatgga

SEQ ID NO: 670860 - DNA, 25 bp, Rattus norvegicus
ttcgtttgggtttttggctcatgga

SEQ ID NO: 670861 - DNA, 25 bp, Rattus norvegicus
ttcgtttgtcctctctggtatgtgt

SEQ ID NO: 670862 - DNA, 25 bp, Rattus norvegicus
ttcgtttgtcctgtctggtatgtgt

SEQ ID NO: 670863 - DNA, 25 bp, Rattus norvegicus
ttcgtttgtgctatggtgccaggaa

SEQ ID NO: 670864 - DNA, 25 bp, Rattus norvegicus
ttcgtttgtgctttggtgccaggaa

SEQ ID NO: 670865 - DNA, 25 bp, Rattus norvegicus
ttcgttttaaatatgctcaccatgc

SEQ ID NO: 670866 - DNA, 25 bp, Rattus norvegicus
ttcgttttaaatttgctcaccatgc

SEQ ID NO: 670867 - DNA, 25 bp, Rattus norvegicus
ttcgttttaccactgtgaagctccg

SEQ ID NO: 670868 - DNA, 25 bp, Rattus norvegicus
ttcgttttaccagtgtgaagctccg

SEQ ID NO: 670869 - DNA, 25 bp, Rattus norvegicus
ttcgtttttcacattttctctccaa

SEQ ID NO: 670870 - DNA, 25 bp, Rattus norvegicus
ttcgtttttcactttttctctccaa

SEQ ID NO: 670871 - DNA, 25 bp, Rattus norvegicus
ttcgtttttcagaaagccccaggtg

SEQ ID NO: 670872 - DNA, 25 bp, Rattus norvegicus
ttcgtttttcagtaagccccaggtg

SEQ ID NO: 670873 - DNA, 25 bp, Rattus norvegicus
ttcgtttttcctactctaataccag

SEQ ID NO: 670874 - DNA, 25 bp, Rattus norvegicus
ttcgtttttccttctctaataccag

SEQ ID NO: 670875 - DNA, 25 bp, Rattus norvegicus
ttctaaaacttcacctggaccgttg

SEQ ID NO: 670876 - DNA, 25 bp, Rattus norvegicus
ttctaaaacttctcctggaccgttg

SEQ ID NO: 670877 - DNA, 25 bp, Rattus norvegicus
ttctaaaataaaatgcagggctgga

SEQ ID NO: 670878 - DNA, 25 bp, Rattus norvegicus
ttctaaaataaattgcagggctgga

SEQ ID NO: 670879 - DNA, 25 bp, Rattus norvegicus
ttctaaactcatctgtaatctcagg

SEQ ID NO: 670880 - DNA, 25 bp, Rattus norvegicus
ttctaaactcatgtgtaatctcagg

SEQ ID NO: 670881 - DNA, 25 bp, Rattus norvegicus
ttctaaagagccacgagtcccttat

SEQ ID NO: 670882 - DNA, 25 bp, Rattus norvegicus
ttctaaagagcctcgagtcccttat

SEQ ID NO: 670883 - DNA, 25 bp, Rattus norvegicus
ttctaaagccacctatgtctccagc

SEQ ID NO: 670884 - DNA, 25 bp, Rattus norvegicus
ttctaaagccacgtatgtctccagc

SEQ ID NO: 670885 - DNA, 25 bp, Rattus norvegicus
ttctaaagctagatcccacagtctc

SEQ ID NO: 670886 - DNA, 25 bp, Rattus norvegicus
ttctaaagctagttcccacagtctc

SEQ ID NO: 670887 - DNA, 25 bp, Rattus norvegicus
ttctaaagtggtccctgtacctcca

SEQ ID NO: 670888 - DNA, 25 bp, Rattus norvegicus
ttctaaagtggtgcctgtacctcca

SEQ ID NO: 670889 - DNA, 25 bp, Rattus norvegicus
ttctaaatacaaaaggccacctaat

SEQ ID NO: 670890 - DNA, 25 bp, Rattus norvegicus
ttctaaatacaataggccacctaat

SEQ ID NO: 670891 - DNA, 25 bp, Rattus norvegicus
ttctaaatgcttctgtatgtaaact

SEQ ID NO: 670892 - DNA, 25 bp, Rattus norvegicus
ttctaaatgcttgtgtatgtaaact

SEQ ID NO: 670893 - DNA, 25 bp, Rattus norvegicus
ttctaaattaagatatcccctcaag

SEQ ID NO: 670894 - DNA, 25 bp, Rattus norvegicus
ttctaaattaagttatcccctcaag

SEQ ID NO: 670895 - DNA, 25 bp, Rattus norvegicus
ttctaaattcaaagccctattgggc

SEQ ID NO: 670896 - DNA, 25 bp, Rattus norvegicus
ttctaaattcaatgccctattgggc

SEQ ID NO: 670897 - DNA, 25 bp, Rattus norvegicus
ttctaacacatcagactgctgctgg

SEQ ID NO: 670898 - DNA, 25 bp, Rattus norvegicus
ttctaacacatctgactgctgctgg

SEQ ID NO: 670899 - DNA, 25 bp, Rattus norvegicus
ttctaacactgactgcaatcagttt

SEQ ID NO: 670900 - DNA, 25 bp, Rattus norvegicus
ttctaacactgagtgcaatcagttt

SEQ ID NO: 670901 - DNA, 25 bp, Rattus norvegicus
ttctaacactgtactgagccgtctt

SEQ ID NO: 670902 - DNA, 25 bp, Rattus norvegicus
ttctaacactgttctgagccgtctt

SEQ ID NO: 670903 - DNA, 25 bp, Rattus norvegicus
ttctaacatgaaactgccatttaca

SEQ ID NO: 670904 - DNA, 25 bp, Rattus norvegicus
ttctaacatgaatctgccatttaca

SEQ ID NO: 670905 - DNA, 25 bp, Rattus norvegicus
ttctaacattcaagccgggtctact

SEQ ID NO: 670906 - DNA, 25 bp, Rattus norvegicus
ttctaacattcatgccgggtctact

SEQ ID NO: 670907 - DNA, 25 bp, Rattus norvegicus
ttctaaccaatcaaaaacggcatgt

SEQ ID NO: 670908 - DNA, 25 bp, Rattus norvegicus
ttctaaccaatctaaaacggcatgt

SEQ ID NO: 670909 - DNA, 25 bp, Rattus norvegicus
ttctaaccacttatcgctcaaagct

SEQ ID NO: 670910 - DNA, 25 bp, Rattus norvegicus
ttctaaccacttttcgctcaaagct

SEQ ID NO: 670911 - DNA, 25 bp, Rattus norvegicus
ttctaaccatccctcccaataaagg

SEQ ID NO: 670912 - DNA, 25 bp, Rattus norvegicus
ttctaaccatccgtcccaataaagg

SEQ ID NO: 670913 - DNA, 25 bp, Rattus norvegicus
ttctaaccatttacgccaataggaa

SEQ ID NO: 670914 - DNA, 25 bp, Rattus norvegicus
ttctaaccattttcgccaataggaa

SEQ ID NO: 670915 - DNA, 25 bp, Rattus norvegicus
ttctaacctacaagtgactctgcct

SEQ ID NO: 670916 - DNA, 25 bp, Rattus norvegicus
ttctaacctacatgtgactctgcct

SEQ ID NO: 670917 - DNA, 25 bp, Rattus norvegicus
ttctaacctagaccttaattttaat

SEQ ID NO: 670918 - DNA, 25 bp, Rattus norvegicus
ttctaacctagagcttaattttaat

SEQ ID NO: 670919 - DNA, 25 bp, Rattus norvegicus
ttctaacctataacccagggtgatc

SEQ ID NO: 670920 - DNA, 25 bp, Rattus norvegicus
ttctaacctatatcccagggtgatc

SEQ ID NO: 670921 - DNA, 25 bp, Rattus norvegicus
ttctaaccttcaattcactttgtcc

SEQ ID NO: 670922 - DNA, 25 bp, Rattus norvegicus
ttctaaccttcatttcactttgtcc

SEQ ID NO: 670923 - DNA, 25 bp, Rattus norvegicus
ttctaactctgaaaccacgggtgcc

SEQ ID NO: 670924 - DNA, 25 bp, Rattus norvegicus
ttctaactctgataccacgggtgcc

SEQ ID NO: 670925 - DNA, 25 bp, Rattus norvegicus
ttctaactgggtcgcttactgactt

SEQ ID NO: 670926 - DNA, 25 bp, Rattus norvegicus
ttctaactgggtggcttactgactt

SEQ ID NO: 670927 - DNA, 25 bp, Rattus norvegicus
ttctaacttggaacacttttcttat

SEQ ID NO: 670928 - DNA, 25 bp, Rattus norvegicus
ttctaacttggatcacttttcttat

SEQ ID NO: 670929 - DNA, 25 bp, Rattus norvegicus
ttctaacttggcacccttgggcatt

SEQ ID NO: 670930 - DNA, 25 bp, Rattus norvegicus
ttctaacttggctcccttgggcatt

SEQ ID NO: 670931 - DNA, 25 bp, Rattus norvegicus
ttctaacttgttcaactgtgttcct

SEQ ID NO: 670932 - DNA, 25 bp, Rattus norvegicus
ttctaacttgttgaactgtgttcct

SEQ ID NO: 670933 - DNA, 25 bp, Rattus norvegicus
ttctaagaaacaaccactccacgta

SEQ ID NO: 670934 - DNA, 25 bp, Rattus norvegicus
ttctaagaaacatccactccacgta

SEQ ID NO: 670935 - DNA, 25 bp, Rattus norvegicus
ttctaagaaagcatacctcccatct

SEQ ID NO: 670936 - DNA, 25 bp, Rattus norvegicus
ttctaagaaagcttacctcccatct

SEQ ID NO: 670937 - DNA, 25 bp, Rattus norvegicus
ttctaagaaatactcaaggtgtgtt

SEQ ID NO: 670938 - DNA, 25 bp, Rattus norvegicus
ttctaagaaatagtcaaggtgtgtt

SEQ ID NO: 670939 - DNA, 25 bp, Rattus norvegicus
ttctaagaatcaacctcctatcctg

SEQ ID NO: 670940 - DNA, 25 bp, Rattus norvegicus
ttctaagaatcatcctcctatcctg

SEQ ID NO: 670941 - DNA, 25 bp, Rattus norvegicus
ttctaagagactagcgacgcctcat

SEQ ID NO: 670942 - DNA, 25 bp, Rattus norvegicus
ttctaagagacttgcgacgcctcat

SEQ ID NO: 670943 - DNA, 25 bp, Rattus norvegicus
ttctaagaggctaacccagtgctcc

SEQ ID NO: 670944 - DNA, 25 bp, Rattus norvegicus
ttctaagaggcttacccagtgctcc

SEQ ID NO: 670945 - DNA, 25 bp, Rattus norvegicus
ttctaagccagaacaccatgtcatg

SEQ ID NO: 670946 - DNA, 25 bp, Rattus norvegicus
ttctaagccagatcaccatgtcatg

SEQ ID NO: 670947 - DNA, 25 bp, Rattus norvegicus
ttctaagcggttccgggactcccag

SEQ ID NO: 670948 - DNA, 25 bp, Rattus norvegicus
ttctaagcggttgcgggactcccag

SEQ ID NO: 670949 - DNA, 25 bp, Rattus norvegicus
ttctaaggaagcctatcttactggg

SEQ ID NO: 670950 - DNA, 25 bp, Rattus norvegicus
ttctaaggaagcgtatcttactggg

SEQ ID NO: 670951 - DNA, 25 bp, Rattus norvegicus
ttctaaggaggccacttgtcccctg

SEQ ID NO: 670952 - DNA, 25 bp, Rattus norvegicus
ttctaaggaggcgacttgtcccctg

SEQ ID NO: 670953 - DNA, 25 bp, Rattus norvegicus
ttctaaggcagaaacagccgttcat

SEQ ID NO: 670954 - DNA, 25 bp, Rattus norvegicus
ttctaaggcagatacagccgttcat

SEQ ID NO: 670955 - DNA, 25 bp, Rattus norvegicus
ttctaaggcaggcatcattatcccc

SEQ ID NO: 670956 - DNA, 25 bp, Rattus norvegicus
ttctaaggcagggatcattatcccc

SEQ ID NO: 670957 - DNA, 25 bp, Rattus norvegicus
ttctaaggcccactgtcttggcatt

SEQ ID NO: 670958 - DNA, 25 bp, Rattus norvegicus
ttctaaggcccagtgtcttggcatt

SEQ ID NO: 670959 - DNA, 25 bp, Rattus norvegicus
ttctaaggcttcaaccttcccttgc

SEQ ID NO: 670960 - DNA, 25 bp, Rattus norvegicus
ttctaaggcttctaccttcccttgc

SEQ ID NO: 670961 - DNA, 25 bp, Rattus norvegicus
ttctaaggttttctcttctcccttg

SEQ ID NO: 670962 - DNA, 25 bp, Rattus norvegicus
ttctaaggttttgtcttctcccttg

SEQ ID NO: 670963 - DNA, 25 bp, Rattus norvegicus
ttctaagtctggctttgccatataa

SEQ ID NO: 670964 - DNA, 25 bp, Rattus norvegicus
ttctaagtctgggtttgccatataa

SEQ ID NO: 670965 - DNA, 25 bp, Rattus norvegicus
ttctaagtgacaccaccagggcagt

SEQ ID NO: 670966 - DNA, 25 bp, Rattus norvegicus
ttctaagtgacagcaccagggcagt

SEQ ID NO: 670967 - DNA, 25 bp, Rattus norvegicus
ttctaagtgtcccacgcaatgctag

SEQ ID NO: 670968 - DNA, 25 bp, Rattus norvegicus
ttctaagtgtccgacgcaatgctag

SEQ ID NO: 670969 - DNA, 25 bp, Rattus norvegicus
ttctaagttaatcccacctgaaaga

SEQ ID NO: 670970 - DNA, 25 bp, Rattus norvegicus
ttctaagttaatgccacctgaaaga

SEQ ID NO: 670971 - DNA, 25 bp, Rattus norvegicus
ttctaagtttctccctcagccatta

SEQ ID NO: 670972 - DNA, 25 bp, Rattus norvegicus
ttctaagtttctgcctcagccatta

SEQ ID NO: 670973 - DNA, 25 bp, Rattus norvegicus
ttctaatactgtactctgtcatcct

SEQ ID NO: 670974 - DNA, 25 bp, Rattus norvegicus
ttctaatactgttctctgtcatcct

SEQ ID NO: 670975 - DNA, 25 bp, Rattus norvegicus
ttctaatatactaaccaagcctttg

SEQ ID NO: 670976 - DNA, 25 bp, Rattus norvegicus
ttctaatatacttaccaagcctttg

SEQ ID NO: 670977 - DNA, 25 bp, Rattus norvegicus
ttctaatcacggacttcacgccaag

SEQ ID NO: 670978 - DNA, 25 bp, Rattus norvegicus
ttctaatcacggtcttcacgccaag

SEQ ID NO: 670979 - DNA, 25 bp, Rattus norvegicus
ttctaatcactgaacttgggaggct

SEQ ID NO: 670980 - DNA, 25 bp, Rattus norvegicus
ttctaatcactgtacttgggaggct

SEQ ID NO: 670981 - DNA, 25 bp, Rattus norvegicus
ttctaatccactcgcacatcagcat

SEQ ID NO: 670982 - DNA, 25 bp, Rattus norvegicus
ttctaatccactggcacatcagcat

SEQ ID NO: 670983 - DNA, 25 bp, Rattus norvegicus
ttctaatccctgaagatgcggagtg

SEQ ID NO: 670984 - DNA, 25 bp, Rattus norvegicus
ttctaatccctgtagatgcggagtg

SEQ ID NO: 670985 - DNA, 25 bp, Rattus norvegicus
ttctaatcctgtaatctcctgcgca

SEQ ID NO: 670986 - DNA, 25 bp, Rattus norvegicus
ttctaatcctgttatctcctgcgca

SEQ ID NO: 670987 - DNA, 25 bp, Rattus norvegicus
ttctaatcttgtactcctgtgtgag

SEQ ID NO: 670988 - DNA, 25 bp, Rattus norvegicus
ttctaatcttgttctcctgtgtgag

SEQ ID NO: 670989 - DNA, 25 bp, Rattus norvegicus
ttctaatgatcaccactcatctcag

SEQ ID NO: 670990 - DNA, 25 bp, Rattus norvegicus
ttctaatgatcagcactcatctcag

SEQ ID NO: 670991 - DNA, 25 bp, Rattus norvegicus
ttctaatgcctgcttctcccagaaa

SEQ ID NO: 670992 - DNA, 25 bp, Rattus norvegicus
ttctaatgcctggttctcccagaaa

SEQ ID NO: 670993 - DNA, 25 bp, Rattus norvegicus
ttctaatggcacacacgtgtgtata

SEQ ID NO: 670994 - DNA, 25 bp, Rattus norvegicus
ttctaatggcactcacgtgtgtata

SEQ ID NO: 670995 - DNA, 25 bp, Rattus norvegicus
ttctaatggtgactccaggccagca

SEQ ID NO: 670996 - DNA, 25 bp, Rattus norvegicus
ttctaatggtgagtccaggccagca

SEQ ID NO: 670997 - DNA, 25 bp, Rattus norvegicus
ttctaatgttgcatgattcacccta

SEQ ID NO: 670998 - DNA, 25 bp, Rattus norvegicus
ttctaatgttgcttgattcacccta

SEQ ID NO: 670999 - DNA, 25 bp, Rattus norvegicus
ttctaatttttactggattccaaag

SEQ ID NO: 671000 - DNA, 25 bp, Rattus norvegicus
ttctaatttttagtggattccaaag

SEQ ID NO: 671001 - DNA, 25 bp, Rattus norvegicus
ttctaattttttcctgccagatctg

SEQ ID NO: 671002 - DNA, 25 bp, Rattus norvegicus
ttctaattttttgctgccagatctg

SEQ ID NO: 671003 - DNA, 25 bp, Rattus norvegicus
ttctacaagccccaattccattttt

SEQ ID NO: 671004 - DNA, 25 bp, Rattus norvegicus
ttctacaagcccgaattccattttt

SEQ ID NO: 671005 - DNA, 25 bp, Rattus norvegicus
ttctacaagcgcacgaaggcgggct

SEQ ID NO: 671006 - DNA, 25 bp, Rattus norvegicus
ttctacaagcgctcgaaggcgggct

SEQ ID NO: 671007 - DNA, 25 bp, Rattus norvegicus
ttctacaataatcacagtggactga

SEQ ID NO: 671008 - DNA, 25 bp, Rattus norvegicus
ttctacaataatgacagtggactga

SEQ ID NO: 671009 - DNA, 25 bp, Rattus norvegicus
ttctacacacaccttagctgactaa

SEQ ID NO: 671010 - DNA, 25 bp, Rattus norvegicus
ttctacacacacgttagctgactaa

SEQ ID NO: 671011 - DNA, 25 bp, Rattus norvegicus
ttctacacagaacattccccagggc

SEQ ID NO: 671012 - DNA, 25 bp, Rattus norvegicus
ttctacacagaagattccccagggc

SEQ ID NO: 671013 - DNA, 25 bp, Rattus norvegicus
ttctacacgcggcaagacactaggt

SEQ ID NO: 671014 - DNA, 25 bp, Rattus norvegicus
ttctacacgcgggaagacactaggt

SEQ ID NO: 671015 - DNA, 25 bp, Rattus norvegicus
ttctacactaaaattcatctgagag

SEQ ID NO: 671016 - DNA, 25 bp, Rattus norvegicus
ttctacactaaatttcatctgagag

SEQ ID NO: 671017 - DNA, 25 bp, Rattus norvegicus
ttctacactgtgcatgtgtcctcac

SEQ ID NO: 671018 - DNA, 25 bp, Rattus norvegicus
ttctacactgtggatgtgtcctcac

SEQ ID NO: 671019 - DNA, 25 bp, Rattus norvegicus
ttctacagaatccaaccagcaaatg

SEQ ID NO: 671020 - DNA, 25 bp, Rattus norvegicus
ttctacagaatcgaaccagcaaatg

SEQ ID NO: 671021 - DNA, 25 bp, Rattus norvegicus
ttctacaggacacgctttgactcat

SEQ ID NO: 671022 - DNA, 25 bp, Rattus norvegicus
ttctacaggacaggctttgactcat

SEQ ID NO: 671023 - DNA, 25 bp, Rattus norvegicus
ttctacatcttcaacttcctcaaat

SEQ ID NO: 671024 - DNA, 25 bp, Rattus norvegicus
ttctacatcttctacttcctcaaat

SEQ ID NO: 671025 - DNA, 25 bp, Rattus norvegicus
ttctacattgatcctgaatttgcag

SEQ ID NO: 671026 - DNA, 25 bp, Rattus norvegicus
ttctacattgatgctgaatttgcag

SEQ ID NO: 671027 - DNA, 25 bp, Rattus norvegicus
ttctaccaagctagcgtggcttgac

SEQ ID NO: 671028 - DNA, 25 bp, Rattus norvegicus
ttctaccaagctcctgtgactactc

SEQ ID NO: 671029 - DNA, 25 bp, Rattus norvegicus
ttctaccaagctgctgtgactactc

SEQ ID NO: 671030 - DNA, 25 bp, Rattus norvegicus
ttctaccaagcttgcgtggcttgac

SEQ ID NO: 671031 - DNA, 25 bp, Rattus norvegicus
ttctaccaagttctctagggtctcc

SEQ ID NO: 671032 - DNA, 25 bp, Rattus norvegicus
ttctaccaagttgtctagggtctcc

SEQ ID NO: 671033 - DNA, 25 bp, Rattus norvegicus
ttctaccatactaggaatcctgttg

SEQ ID NO: 671034 - DNA, 25 bp, Rattus norvegicus
ttctaccatacttggaatcctgttg

SEQ ID NO: 671035 - DNA, 25 bp, Rattus norvegicus
ttctaccattcacggattcccaaga

SEQ ID NO: 671036 - DNA, 25 bp, Rattus norvegicus
ttctaccattcagggattcccaaga

SEQ ID NO: 671037 - DNA, 25 bp, Rattus norvegicus
ttctaccatttacctaccacaagag

SEQ ID NO: 671038 - DNA, 25 bp, Rattus norvegicus
ttctaccatttagctaccacaagag

SEQ ID NO: 671039 - DNA, 25 bp, Rattus norvegicus
ttctacccagcgaagtacatggagt

SEQ ID NO: 671040 - DNA, 25 bp, Rattus norvegicus
ttctacccagcgtagtacatggagt

SEQ ID NO: 671041 - DNA, 25 bp, Rattus norvegicus
ttctaccccaagagcaagcactgtg

SEQ ID NO: 671042 - DNA, 25 bp, Rattus norvegicus
ttctaccccaagtgcaagcactgtg

SEQ ID NO: 671043 - DNA, 25 bp, Rattus norvegicus
ttctacccgacaccaaggcatatgg

SEQ ID NO: 671044 - DNA, 25 bp, Rattus norvegicus
ttctacccgacagcaaggcatatgg

SEQ ID NO: 671045 - DNA, 25 bp, Rattus norvegicus
ttctaccctcttacagttctgggaa

SEQ ID NO: 671046 - DNA, 25 bp, Rattus norvegicus
ttctaccctctttcagttctgggaa

SEQ ID NO: 671047 - DNA, 25 bp, Rattus norvegicus
ttctaccctgtactgctggcttgca

SEQ ID NO: 671048 - DNA, 25 bp, Rattus norvegicus
ttctaccctgtagtgctggcttgca

SEQ ID NO: 671049 - DNA, 25 bp, Rattus norvegicus
ttctaccctttcacgacagctgaaa

SEQ ID NO: 671050 - DNA, 25 bp, Rattus norvegicus
ttctaccctttctcgacagctgaaa

SEQ ID NO: 671051 - DNA, 25 bp, Rattus norvegicus
ttctacctaaggcacggaaccttgt

SEQ ID NO: 671052 - DNA, 25 bp, Rattus norvegicus
ttctacctaagggacggaaccttgt

SEQ ID NO: 671053 - DNA, 25 bp, Rattus norvegicus
ttctacctcagcactgttaacagtt

SEQ ID NO: 671054 - DNA, 25 bp, Rattus norvegicus
ttctacctcagcattgtatccagta

SEQ ID NO: 671055 - DNA, 25 bp, Rattus norvegicus
ttctacctcagctctgttaacagtt

SEQ ID NO: 671056 - DNA, 25 bp, Rattus norvegicus
ttctacctcagctttgtatccagta

SEQ ID NO: 671057 - DNA, 25 bp, Rattus norvegicus
ttctacctccttccaaagccaaggg

SEQ ID NO: 671058 - DNA, 25 bp, Rattus norvegicus
ttctacctccttgcaaagccaaggg

SEQ ID NO: 671059 - DNA, 25 bp, Rattus norvegicus
ttctacctctgtccctggagtctag

SEQ ID NO: 671060 - DNA, 25 bp, Rattus norvegicus
ttctacctctgtgcctggagtctag

SEQ ID NO: 671061 - DNA, 25 bp, Rattus norvegicus
ttctacctgactatcaaccactgaa

SEQ ID NO: 671062 - DNA, 25 bp, Rattus norvegicus
ttctacctgactttcaaccactgaa

SEQ ID NO: 671063 - DNA, 25 bp, Rattus norvegicus
ttctacctgcatatcctcagagaac

SEQ ID NO: 671064 - DNA, 25 bp, Rattus norvegicus
ttctacctgcatttcctcagagaac

SEQ ID NO: 671065 - DNA, 25 bp, Rattus norvegicus
ttctacctggccctgattttttata

SEQ ID NO: 671066 - DNA, 25 bp, Rattus norvegicus
ttctacctggccgtgattttttata

SEQ ID NO: 671067 - DNA, 25 bp, Rattus norvegicus
ttctacctgggtctatgccttagga

SEQ ID NO: 671068 - DNA, 25 bp, Rattus norvegicus
ttctacctgggtgtatgccttagga

SEQ ID NO: 671069 - DNA, 25 bp, Rattus norvegicus
ttctacctgttcagggcttcaaggc

SEQ ID NO: 671070 - DNA, 25 bp, Rattus norvegicus
ttctacctgttctgggcttcaaggc

SEQ ID NO: 671071 - DNA, 25 bp, Rattus norvegicus
ttctacgagacaccataggtcccct

SEQ ID NO: 671072 - DNA, 25 bp, Rattus norvegicus
ttctacgagacagcataggtcccct

SEQ ID NO: 671073 - DNA, 25 bp, Rattus norvegicus
ttctacgatgaacttagggttggaa

SEQ ID NO: 671074 - DNA, 25 bp, Rattus norvegicus
ttctacgatgaagttagggttggaa

SEQ ID NO: 671075 - DNA, 25 bp, Rattus norvegicus
ttctacgattctactgcatttcagg

SEQ ID NO: 671076 - DNA, 25 bp, Rattus norvegicus
ttctacgattcttctgcatttcagg

SEQ ID NO: 671077 - DNA, 25 bp, Rattus norvegicus
ttctacgcaacaatccaggctgacg

SEQ ID NO: 671078 - DNA, 25 bp, Rattus norvegicus
ttctacgcaacattccaggctgacg

SEQ ID NO: 671079 - DNA, 25 bp, Rattus norvegicus
ttctacgctcgtctcctttacaggg

SEQ ID NO: 671080 - DNA, 25 bp, Rattus norvegicus
ttctacgctcgtgtcctttacaggg

SEQ ID NO: 671081 - DNA, 25 bp, Rattus norvegicus
ttctacggccagatcacggtttttc

SEQ ID NO: 671082 - DNA, 25 bp, Rattus norvegicus
ttctacggccagttcacggtttttc

SEQ ID NO: 671083 - DNA, 25 bp, Rattus norvegicus
ttctacgtgagtactgcacatgcag

SEQ ID NO: 671084 - DNA, 25 bp, Rattus norvegicus
ttctacgtgagttctgcacatgcag

SEQ ID NO: 671085 - DNA, 25 bp, Rattus norvegicus
ttctacgtgcgtcaggactcttatc

SEQ ID NO: 671086 - DNA, 25 bp, Rattus norvegicus
ttctacgtgcgtgaggactcttatc

SEQ ID NO: 671087 - DNA, 25 bp, Rattus norvegicus
ttctacgtgctgagtccggacaacg

SEQ ID NO: 671088 - DNA, 25 bp, Rattus norvegicus
ttctacgtgctgtgtccggacaacg

SEQ ID NO: 671089 - DNA, 25 bp, Rattus norvegicus
ttctacgttccgagctcaggattaa

SEQ ID NO: 671090 - DNA, 25 bp, Rattus norvegicus
ttctacgttccgtgctcaggattaa

SEQ ID NO: 671091 - DNA, 25 bp, Rattus norvegicus
ttctactacaagaaagcggtcatcg

SEQ ID NO: 671092 - DNA, 25 bp, Rattus norvegicus
ttctactacaagtaagcggtcatcg

SEQ ID NO: 671093 - DNA, 25 bp, Rattus norvegicus
ttctactacagtccatgcgtgaaga

SEQ ID NO: 671094 - DNA, 25 bp, Rattus norvegicus
ttctactacagtgcatgcgtgaaga

SEQ ID NO: 671095 - DNA, 25 bp, Rattus norvegicus
ttctactatctcctctcaaacagta

SEQ ID NO: 671096 - DNA, 25 bp, Rattus norvegicus
ttctactatctcgtctcaaacagta

SEQ ID NO: 671097 - DNA, 25 bp, Rattus norvegicus
ttctactcaaagagccaaaggctac

SEQ ID NO: 671098 - DNA, 25 bp, Rattus norvegicus
ttctactcaaagtgccaaaggctac

SEQ ID NO: 671099 - DNA, 25 bp, Rattus norvegicus
ttctactcaagcctactgtggcggt

SEQ ID NO: 671100 - DNA, 25 bp, Rattus norvegicus
ttctactcaagcgtactgtggcggt

SEQ ID NO: 671101 - DNA, 25 bp, Rattus norvegicus
ttctactcagcgacacactcacatt

SEQ ID NO: 671102 - DNA, 25 bp, Rattus norvegicus
ttctactcagcgtcacactcacatt

SEQ ID NO: 671103 - DNA, 25 bp, Rattus norvegicus
ttctactccacacagatgctgctca

SEQ ID NO: 671104 - DNA, 25 bp, Rattus norvegicus
ttctactccacagagatgctgctca

SEQ ID NO: 671105 - DNA, 25 bp, Rattus norvegicus
ttctactcccatacccacgtggagg

SEQ ID NO: 671106 - DNA, 25 bp, Rattus norvegicus
ttctactcccattcccacgtggagg

SEQ ID NO: 671107 - DNA, 25 bp, Rattus norvegicus
ttctactcctttatgtaccgcttga

SEQ ID NO: 671108 - DNA, 25 bp, Rattus norvegicus
ttctactcctttttgtaccgcttga

SEQ ID NO: 671109 - DNA, 25 bp, Rattus norvegicus
ttctactctaggcagttcactctat

SEQ ID NO: 671110 - DNA, 25 bp, Rattus norvegicus
ttctactctagggagttcactctat

SEQ ID NO: 671111 - DNA, 25 bp, Rattus norvegicus
ttctactcttttcacgttcactctc

SEQ ID NO: 671112 - DNA, 25 bp, Rattus norvegicus
ttctactcttttgacgttcactctc

SEQ ID NO: 671113 - DNA, 25 bp, Rattus norvegicus
ttctactgaatcaccgtcatcgatc

SEQ ID NO: 671114 - DNA, 25 bp, Rattus norvegicus
ttctactgaatctccgtcatcgatc

SEQ ID NO: 671115 - DNA, 25 bp, Rattus norvegicus
ttctactgccaccacaggacgagaa

SEQ ID NO: 671116 - DNA, 25 bp, Rattus norvegicus
ttctactgccacgacaggacgagaa

SEQ ID NO: 671117 - DNA, 25 bp, Rattus norvegicus
ttctactgcttcagccaactggaag

SEQ ID NO: 671118 - DNA, 25 bp, Rattus norvegicus
ttctactgcttctgccaactggaag

SEQ ID NO: 671119 - DNA, 25 bp, Rattus norvegicus
ttctactgggcaaccgagagctcct

SEQ ID NO: 671120 - DNA, 25 bp, Rattus norvegicus
ttctactgggcatccgagagctcct

SEQ ID NO: 671121 - DNA, 25 bp, Rattus norvegicus
ttctactgtaacaattcctcgttcg

SEQ ID NO: 671122 - DNA, 25 bp, Rattus norvegicus
ttctactgtaactattcctcgttcg

SEQ ID NO: 671123 - DNA, 25 bp, Rattus norvegicus
ttctactgtctaccacttaagctca

SEQ ID NO: 671124 - DNA, 25 bp, Rattus norvegicus
ttctactgtctagcacttaagctca

SEQ ID NO: 671125 - DNA, 25 bp, Rattus norvegicus
ttctactgtgtgatatcctcatctt

SEQ ID NO: 671126 - DNA, 25 bp, Rattus norvegicus
ttctactgtgtgttatcctcatctt

SEQ ID NO: 671127 - DNA, 25 bp, Rattus norvegicus
ttctacttaaacaacttgttgtcag

SEQ ID NO: 671128 - DNA, 25 bp, Rattus norvegicus
ttctacttaaactacttgttgtcag

SEQ ID NO: 671129 - DNA, 25 bp, Rattus norvegicus
ttctacttaagaccaaaattccatg

SEQ ID NO: 671130 - DNA, 25 bp, Rattus norvegicus
ttctacttaagagcaaaattccatg

SEQ ID NO: 671131 - DNA, 25 bp, Rattus norvegicus
ttctacttacgcaattctacaactg

SEQ ID NO: 671132 - DNA, 25 bp, Rattus norvegicus
ttctacttacgctattctacaactg

SEQ ID NO: 671133 - DNA, 25 bp, Rattus norvegicus
ttctacttagaacgcctgactcgga

SEQ ID NO: 671134 - DNA, 25 bp, Rattus norvegicus
ttctacttagaaggcctgactcgga

SEQ ID NO: 671135 - DNA, 25 bp, Rattus norvegicus
ttctacttcagtcatgcggacacac

SEQ ID NO: 671136 - DNA, 25 bp, Rattus norvegicus
ttctacttcagtgatgcggacacac

SEQ ID NO: 671137 - DNA, 25 bp, Rattus norvegicus
ttctacttcccaagtgtgtctctat

SEQ ID NO: 671138 - DNA, 25 bp, Rattus norvegicus
ttctacttcccatgtgtgtctctat

SEQ ID NO: 671139 - DNA, 25 bp, Rattus norvegicus
ttctacttgcgtattcgcaggagca

SEQ ID NO: 671140 - DNA, 25 bp, Rattus norvegicus
ttctacttgcgttttcgcaggagca

SEQ ID NO: 671141 - DNA, 25 bp, Rattus norvegicus
ttctacttgggcagaaaatgggtcc

SEQ ID NO: 671142 - DNA, 25 bp, Rattus norvegicus
ttctacttgggctgaaaatgggtcc

SEQ ID NO: 671143 - DNA, 25 bp, Rattus norvegicus
ttctacttgggtaggcagtgtttga

SEQ ID NO: 671144 - DNA, 25 bp, Rattus norvegicus
ttctacttgggttggcagtgtttga

SEQ ID NO: 671145 - DNA, 25 bp, Rattus norvegicus
ttctacttgtagagtctgcacatca

SEQ ID NO: 671146 - DNA, 25 bp, Rattus norvegicus
ttctacttgtagtgtctgcacatca

SEQ ID NO: 671147 - DNA, 25 bp, Rattus norvegicus
ttctactttatgaacctgggtctga

SEQ ID NO: 671148 - DNA, 25 bp, Rattus norvegicus
ttctactttatgtacctgggtctga

SEQ ID NO: 671149 - DNA, 25 bp, Rattus norvegicus
ttctactttattaattgttcccttg

SEQ ID NO: 671150 - DNA, 25 bp, Rattus norvegicus
ttctactttatttattgttcccttg

SEQ ID NO: 671151 - DNA, 25 bp, Rattus norvegicus
ttctagaaaaatctccttgctcgtc

SEQ ID NO: 671152 - DNA, 25 bp, Rattus norvegicus
ttctagaaaaatgtccttgctcgtc

SEQ ID NO: 671153 - DNA, 25 bp, Rattus norvegicus
ttctagaaaaggaaggtcccagcac

SEQ ID NO: 671154 - DNA, 25 bp, Rattus norvegicus
ttctagaaaaggtaggtcccagcac

SEQ ID NO: 671155 - DNA, 25 bp, Rattus norvegicus
ttctagaagttcattttccctccgt

SEQ ID NO: 671156 - DNA, 25 bp, Rattus norvegicus
ttctagaagttctttttccctccgt

SEQ ID NO: 671157 - DNA, 25 bp, Rattus norvegicus
ttctagaagttgcaactgaccccgg

SEQ ID NO: 671158 - DNA, 25 bp, Rattus norvegicus
ttctagaagttggaactgaccccgg

SEQ ID NO: 671159 - DNA, 25 bp, Rattus norvegicus
ttctagacagtgaggcccgaggatc

SEQ ID NO: 671160 - DNA, 25 bp, Rattus norvegicus
ttctagacagtgtggcccgaggatc

SEQ ID NO: 671161 - DNA, 25 bp, Rattus norvegicus
ttctagactattatccacctccagt

SEQ ID NO: 671162 - DNA, 25 bp, Rattus norvegicus
ttctagactattttccacctccagt

SEQ ID NO: 671163 - DNA, 25 bp, Rattus norvegicus
ttctagactctaaatcctgttgatt

SEQ ID NO: 671164 - DNA, 25 bp, Rattus norvegicus
ttctagactctatatcctgttgatt

SEQ ID NO: 671165 - DNA, 25 bp, Rattus norvegicus
ttctagaggttcagtttctgagcca

SEQ ID NO: 671166 - DNA, 25 bp, Rattus norvegicus
ttctagaggttctgtttctgagcca

SEQ ID NO: 671167 - DNA, 25 bp, Rattus norvegicus
ttctagagtcttcgtgtccacggat

SEQ ID NO: 671168 - DNA, 25 bp, Rattus norvegicus
ttctagagtcttcttcattgttcag

SEQ ID NO: 671169 - DNA, 25 bp, Rattus norvegicus
ttctagagtcttggtgtccacggat

SEQ ID NO: 671170 - DNA, 25 bp, Rattus norvegicus
ttctagagtcttgttcattgttcag

SEQ ID NO: 671171 - DNA, 25 bp, Rattus norvegicus
ttctagatctcgatccaggtccaga

SEQ ID NO: 671172 - DNA, 25 bp, Rattus norvegicus
ttctagatctcgttccaggtccaga

SEQ ID NO: 671173 - DNA, 25 bp, Rattus norvegicus
ttctagatggacagagcaggtgcca

SEQ ID NO: 671174 - DNA, 25 bp, Rattus norvegicus
ttctagatggactgagcaggtgcca

SEQ ID NO: 671175 - DNA, 25 bp, Rattus norvegicus
ttctagcaaacaacacagcccttaa

SEQ ID NO: 671176 - DNA, 25 bp, Rattus norvegicus
ttctagcaaacatcacagcccttaa

SEQ ID NO: 671177 - DNA, 25 bp, Rattus norvegicus
ttctagcacagcatatgccaaggag

SEQ ID NO: 671178 - DNA, 25 bp, Rattus norvegicus
ttctagcacagcttatgccaaggag

SEQ ID NO: 671179 - DNA, 25 bp, Rattus norvegicus
ttctagcagacccaatccatattta

SEQ ID NO: 671180 - DNA, 25 bp, Rattus norvegicus
ttctagcagaccgaatccatattta

SEQ ID NO: 671181 - DNA, 25 bp, Rattus norvegicus
ttctagcagggacctcacagggact

SEQ ID NO: 671182 - DNA, 25 bp, Rattus norvegicus
ttctagcagggagctcacagggact

SEQ ID NO: 671183 - DNA, 25 bp, Rattus norvegicus
ttctagcccgagacaaaacagtcct

SEQ ID NO: 671184 - DNA, 25 bp, Rattus norvegicus
ttctagcccgagtcaaaacagtcct

SEQ ID NO: 671185 - DNA, 25 bp, Rattus norvegicus
ttctagcctcagcaaccctgtggaa

SEQ ID NO: 671186 - DNA, 25 bp, Rattus norvegicus
ttctagcctcaggaaccctgtggaa

SEQ ID NO: 671187 - DNA, 25 bp, Rattus norvegicus
ttctagcctcccagatacaaattcc

SEQ ID NO: 671188 - DNA, 25 bp, Rattus norvegicus
ttctagcctccctgatacaaattcc

SEQ ID NO: 671189 - DNA, 25 bp, Rattus norvegicus
ttctagcctggacctaatgtcttta

SEQ ID NO: 671190 - DNA, 25 bp, Rattus norvegicus
ttctagcctggagctaatgtcttta

SEQ ID NO: 671191 - DNA, 25 bp, Rattus norvegicus
ttctagccttcgaggacaccaggat

SEQ ID NO: 671192 - DNA, 25 bp, Rattus norvegicus
ttctagccttcgtggacaccaggat

SEQ ID NO: 671193 - DNA, 25 bp, Rattus norvegicus
ttctagctagacagtcacttctgac

SEQ ID NO: 671194 - DNA, 25 bp, Rattus norvegicus
ttctagctagactgtcacttctgac

SEQ ID NO: 671195 - DNA, 25 bp, Rattus norvegicus
ttctagctcactcagctggttgctc

SEQ ID NO: 671196 - DNA, 25 bp, Rattus norvegicus
ttctagctcactgagctggttgctc

SEQ ID NO: 671197 - DNA, 25 bp, Rattus norvegicus
ttctagctccccaaacaacctagag

SEQ ID NO: 671198 - DNA, 25 bp, Rattus norvegicus
ttctagctcccctaacaacctagag

SEQ ID NO: 671199 - DNA, 25 bp, Rattus norvegicus
ttctagctcctgaggtgcacatgca

SEQ ID NO: 671200 - DNA, 25 bp, Rattus norvegicus
ttctagctcctgtggtgcacatgca

SEQ ID NO: 671201 - DNA, 25 bp, Rattus norvegicus
ttctagctgtgtattgctttatatt

SEQ ID NO: 671202 - DNA, 25 bp, Rattus norvegicus
ttctagctgtgttttgctttatatt

SEQ ID NO: 671203 - DNA, 25 bp, Rattus norvegicus
ttctagcttcagattagtgggttaa

SEQ ID NO: 671204 - DNA, 25 bp, Rattus norvegicus
ttctagcttcagtttagtgggttaa

SEQ ID NO: 671205 - DNA, 25 bp, Rattus norvegicus
ttctaggaaactctgccaagccggt

SEQ ID NO: 671206 - DNA, 25 bp, Rattus norvegicus
ttctaggaaactgtgccaagccggt

SEQ ID NO: 671207 - DNA, 25 bp, Rattus norvegicus
ttctaggaccttaccattggagtgt

SEQ ID NO: 671208 - DNA, 25 bp, Rattus norvegicus
ttctaggacctttccattggagtgt

SEQ ID NO: 671209 - DNA, 25 bp, Rattus norvegicus
ttctaggagggtagaaatgcagtca

SEQ ID NO: 671210 - DNA, 25 bp, Rattus norvegicus
ttctaggagggttgaaatgcagtca

SEQ ID NO: 671211 - DNA, 25 bp, Rattus norvegicus
ttctaggcaagaagctcagcctttt

SEQ ID NO: 671212 - DNA, 25 bp, Rattus norvegicus
ttctaggcaagatgctcagcctttt

SEQ ID NO: 671213 - DNA, 25 bp, Rattus norvegicus
ttctaggcaggtccctcatctctga

SEQ ID NO: 671214 - DNA, 25 bp, Rattus norvegicus
ttctaggcaggtgcctcatctctga

SEQ ID NO: 671215 - DNA, 25 bp, Rattus norvegicus
ttctaggccagcaagggtctcactc

SEQ ID NO: 671216 - DNA, 25 bp, Rattus norvegicus
ttctaggccagccttggcattttat

SEQ ID NO: 671217 - DNA, 25 bp, Rattus norvegicus
ttctaggccagcgttggcattttat

SEQ ID NO: 671218 - DNA, 25 bp, Rattus norvegicus
ttctaggccagctagggtctcactc

SEQ ID NO: 671219 - DNA, 25 bp, Rattus norvegicus
ttctaggcctgcatgctagcaagta

SEQ ID NO: 671220 - DNA, 25 bp, Rattus norvegicus
ttctaggcctgcttgctagcaagta

SEQ ID NO: 671221 - DNA, 25 bp, Rattus norvegicus
ttctaggcctgtctttggatcgctt

SEQ ID NO: 671222 - DNA, 25 bp, Rattus norvegicus
ttctaggcctgtgtttggatcgctt

SEQ ID NO: 671223 - DNA, 25 bp, Rattus norvegicus
ttctaggcgtccagttgacccctca

SEQ ID NO: 671224 - DNA, 25 bp, Rattus norvegicus
ttctaggcgtcctgttgacccctca

SEQ ID NO: 671225 - DNA, 25 bp, Rattus norvegicus
ttctaggctggcaggcatgggacct

SEQ ID NO: 671226 - DNA, 25 bp, Rattus norvegicus
ttctaggctggctggcatgggacct

SEQ ID NO: 671227 - DNA, 25 bp, Rattus norvegicus
ttctagggagaacgagccgcttatt

SEQ ID NO: 671228 - DNA, 25 bp, Rattus norvegicus
ttctagggagaaggagccgcttatt

SEQ ID NO: 671229 - DNA, 25 bp, Rattus norvegicus
ttctagggattgacaggattctcac

SEQ ID NO: 671230 - DNA, 25 bp, Rattus norvegicus
ttctagggattgtcaggattctcac

SEQ ID NO: 671231 - DNA, 25 bp, Rattus norvegicus
ttctagggccccaaactggaccagg

SEQ ID NO: 671232 - DNA, 25 bp, Rattus norvegicus
ttctagggcccctaactggaccagg

SEQ ID NO: 671233 - DNA, 25 bp, Rattus norvegicus
ttctagggctatagaaaccagccat

SEQ ID NO: 671234 - DNA, 25 bp, Rattus norvegicus
ttctagggctattgaaaccagccat

SEQ ID NO: 671235 - DNA, 25 bp, Rattus norvegicus
ttctagggctgtactgtcccaaggt

SEQ ID NO: 671236 - DNA, 25 bp, Rattus norvegicus
ttctagggctgttctgtcccaaggt

SEQ ID NO: 671237 - DNA, 25 bp, Rattus norvegicus
ttctaggtgagccacaggacgacag

SEQ ID NO: 671238 - DNA, 25 bp, Rattus norvegicus
ttctaggtgagcgacaggacgacag

SEQ ID NO: 671239 - DNA, 25 bp, Rattus norvegicus
ttctaggtgcccaggacacttgcag

SEQ ID NO: 671240 - DNA, 25 bp, Rattus norvegicus
ttctaggtgccctggacacttgcag

SEQ ID NO: 671241 - DNA, 25 bp, Rattus norvegicus
ttctaggttatgataatggctttta

SEQ ID NO: 671242 - DNA, 25 bp, Rattus norvegicus
ttctaggttatgttaatggctttta

SEQ ID NO: 671243 - DNA, 25 bp, Rattus norvegicus
ttctagtagaccaagtactcccaca

SEQ ID NO: 671244 - DNA, 25 bp, Rattus norvegicus
ttctagtagacctagtactcccaca

SEQ ID NO: 671245 - DNA, 25 bp, Rattus norvegicus
ttctagtagtacatgaccggcttct

SEQ ID NO: 671246 - DNA, 25 bp, Rattus norvegicus
ttctagtagtacttgaccggcttct

SEQ ID NO: 671247 - DNA, 25 bp, Rattus norvegicus
ttctagtatttaaaccacggttgca

SEQ ID NO: 671248 - DNA, 25 bp, Rattus norvegicus
ttctagtatttataccacggttgca

SEQ ID NO: 671249 - DNA, 25 bp, Rattus norvegicus
ttctagtcagacatttccatggcta

SEQ ID NO: 671250 - DNA, 25 bp, Rattus norvegicus
ttctagtcagacttttccatggcta

SEQ ID NO: 671251 - DNA, 25 bp, Rattus norvegicus
ttctagtccttcattgtcttctagg

SEQ ID NO: 671252 - DNA, 25 bp, Rattus norvegicus
ttctagtccttctttgtcttctagg

SEQ ID NO: 671253 - DNA, 25 bp, Rattus norvegicus
ttctagtcgcctcttagacagcaga

SEQ ID NO: 671254 - DNA, 25 bp, Rattus norvegicus
ttctagtcgcctgttagacagcaga

SEQ ID NO: 671255 - DNA, 25 bp, Rattus norvegicus
ttctagtctcctcatctgattaaca

SEQ ID NO: 671256 - DNA, 25 bp, Rattus norvegicus
ttctagtctcctgatctgattaaca

SEQ ID NO: 671257 - DNA, 25 bp, Rattus norvegicus
ttctagtctctgcttgatatcttca

SEQ ID NO: 671258 - DNA, 25 bp, Rattus norvegicus
ttctagtctctggttgatatcttca

SEQ ID NO: 671259 - DNA, 25 bp, Rattus norvegicus
ttctagtgtaaaacatgcaagcgct

SEQ ID NO: 671260 - DNA, 25 bp, Rattus norvegicus
ttctagtgtaaatcatgcaagcgct

SEQ ID NO: 671261 - DNA, 25 bp, Rattus norvegicus
ttctagtttgtcatcaggaatcatc

SEQ ID NO: 671262 - DNA, 25 bp, Rattus norvegicus
ttctagtttgtcttcaggaatcatc

SEQ ID NO: 671263 - DNA, 25 bp, Rattus norvegicus
ttctataatcttaacccgggcatca

SEQ ID NO: 671264 - DNA, 25 bp, Rattus norvegicus
ttctataatctttacccgggcatca

SEQ ID NO: 671265 - DNA, 25 bp, Rattus norvegicus
ttctatacacacagatcccgagtac

SEQ ID NO: 671266 - DNA, 25 bp, Rattus norvegicus
ttctatacacactgatcccgagtac

SEQ ID NO: 671267 - DNA, 25 bp, Rattus norvegicus
ttctatacatcccaaagcccagtca

SEQ ID NO: 671268 - DNA, 25 bp, Rattus norvegicus
ttctatacatccgaaagcccagtca

SEQ ID NO: 671269 - DNA, 25 bp, Rattus norvegicus
ttctataccctgctgtctgaaacac

SEQ ID NO: 671270 - DNA, 25 bp, Rattus norvegicus
ttctataccctggtgtctgaaacac

SEQ ID NO: 671271 - DNA, 25 bp, Rattus norvegicus
ttctatacttacacggccctgcatg

SEQ ID NO: 671272 - DNA, 25 bp, Rattus norvegicus
ttctatacttactcggccctgcatg

SEQ ID NO: 671273 - DNA, 25 bp, Rattus norvegicus
ttctatagagttattctgagaatca

SEQ ID NO: 671274 - DNA, 25 bp, Rattus norvegicus
ttctatagagtttttctgagaatca

SEQ ID NO: 671275 - DNA, 25 bp, Rattus norvegicus
ttctatagccgcagcaccaggacat

SEQ ID NO: 671276 - DNA, 25 bp, Rattus norvegicus
ttctatagccgctgcaccaggacat

SEQ ID NO: 671277 - DNA, 25 bp, Rattus norvegicus
ttctatagtgggacacatggagttc

SEQ ID NO: 671278 - DNA, 25 bp, Rattus norvegicus
ttctatagtgggtcacatggagttc

SEQ ID NO: 671279 - DNA, 25 bp, Rattus norvegicus
ttctatataaccctcttcctctcat

SEQ ID NO: 671280 - DNA, 25 bp, Rattus norvegicus
ttctatataaccgtcttcctctcat

SEQ ID NO: 671281 - DNA, 25 bp, Rattus norvegicus
ttctatatcaacactggcactctgc

SEQ ID NO: 671282 - DNA, 25 bp, Rattus norvegicus
ttctatatcaactctggcactctgc

SEQ ID NO: 671283 - DNA, 25 bp, Rattus norvegicus
ttctatatccaaccttctgaagtag

SEQ ID NO: 671284 - DNA, 25 bp, Rattus norvegicus
ttctatatccaagcttctgaagtag

SEQ ID NO: 671285 - DNA, 25 bp, Rattus norvegicus
ttctatattatccttgacttgccga

SEQ ID NO: 671286 - DNA, 25 bp, Rattus norvegicus
ttctatattatcgttgacttgccga

SEQ ID NO: 671287 - DNA, 25 bp, Rattus norvegicus
ttctatattcagattggcattcata

SEQ ID NO: 671288 - DNA, 25 bp, Rattus norvegicus
ttctatattcagtttggcattcata

SEQ ID NO: 671289 - DNA, 25 bp, Rattus norvegicus
ttctatatttaactgcaggtgggag

SEQ ID NO: 671290 - DNA, 25 bp, Rattus norvegicus
ttctatatttaagtgcaggtgggag

SEQ ID NO: 671291 - DNA, 25 bp, Rattus norvegicus
ttctatcagaagatgctgggccaga

SEQ ID NO: 671292 - DNA, 25 bp, Rattus norvegicus
ttctatcagaagttgctgggccaga

SEQ ID NO: 671293 - DNA, 25 bp, Rattus norvegicus
ttctatcagctaatcttgtcctggg

SEQ ID NO: 671294 - DNA, 25 bp, Rattus norvegicus
ttctatcagctattcttgtcctggg

SEQ ID NO: 671295 - DNA, 25 bp, Rattus norvegicus
ttctatcagtgtagccctcctccag

SEQ ID NO: 671296 - DNA, 25 bp, Rattus norvegicus
ttctatcagtgttgccctcctccag

SEQ ID NO: 671297 - DNA, 25 bp, Rattus norvegicus
ttctatccaaaaactgcattccgag

SEQ ID NO: 671298 - DNA, 25 bp, Rattus norvegicus
ttctatccaaaatctgcattccgag

SEQ ID NO: 671299 - DNA, 25 bp, Rattus norvegicus
ttctatcccatcctctttagggaaa

SEQ ID NO: 671300 - DNA, 25 bp, Rattus norvegicus
ttctatcccatcgtctttagggaaa

SEQ ID NO: 671301 - DNA, 25 bp, Rattus norvegicus
ttctatccccatcattgcctaagat

SEQ ID NO: 671302 - DNA, 25 bp, Rattus norvegicus
ttctatccccatgattgcctaagat

SEQ ID NO: 671303 - DNA, 25 bp, Rattus norvegicus
ttctatccctacactctgagctggg

SEQ ID NO: 671304 - DNA, 25 bp, Rattus norvegicus
ttctatccctactctctgagctggg

SEQ ID NO: 671305 - DNA, 25 bp, Rattus norvegicus
ttctatccctgaaacatatcctggg

SEQ ID NO: 671306 - DNA, 25 bp, Rattus norvegicus
ttctatccctgatacatatcctggg

SEQ ID NO: 671307 - DNA, 25 bp, Rattus norvegicus
ttctatcctcctccacggcaaggag

SEQ ID NO: 671308 - DNA, 25 bp, Rattus norvegicus
ttctatcctcctgcacggcaaggag

SEQ ID NO: 671309 - DNA, 25 bp, Rattus norvegicus
ttctatcctgagctctttcgacatg

SEQ ID NO: 671310 - DNA, 25 bp, Rattus norvegicus
ttctatcctgaggtctttcgacatg

SEQ ID NO: 671311 - DNA, 25 bp, Rattus norvegicus
ttctatcgtgtaacttttgtggcct

SEQ ID NO: 671312 - DNA, 25 bp, Rattus norvegicus
ttctatcgtgtatcttttgtggcct

SEQ ID NO: 671313 - DNA, 25 bp, Rattus norvegicus
ttctatctactgcttcaccatgatg

SEQ ID NO: 671314 - DNA, 25 bp, Rattus norvegicus
ttctatctactggttcaccatgatg

SEQ ID NO: 671315 - DNA, 25 bp, Rattus norvegicus
ttctatctctgtcccgaaattccct

SEQ ID NO: 671316 - DNA, 25 bp, Rattus norvegicus
ttctatctctgtgccgaaattccct

SEQ ID NO: 671317 - DNA, 25 bp, Rattus norvegicus
ttctatctctttccactactgtatt

SEQ ID NO: 671318 - DNA, 25 bp, Rattus norvegicus
ttctatctctttgcactactgtatt

SEQ ID NO: 671319 - DNA, 25 bp, Rattus norvegicus
ttctatctgcagagcttctcttcat

SEQ ID NO: 671320 - DNA, 25 bp, Rattus norvegicus
ttctatctgcagtgcttctcttcat

SEQ ID NO: 671321 - DNA, 25 bp, Rattus norvegicus
ttctatctttatacctatcctggga

SEQ ID NO: 671322 - DNA, 25 bp, Rattus norvegicus
ttctatctttattcctatcctggga

SEQ ID NO: 671323 - DNA, 25 bp, Rattus norvegicus
ttctatgaccctataacccaagctg

SEQ ID NO: 671324 - DNA, 25 bp, Rattus norvegicus
ttctatgaccctttaacccaagctg

SEQ ID NO: 671325 - DNA, 25 bp, Rattus norvegicus
ttctatgagaccatgacctctggct

SEQ ID NO: 671326 - DNA, 25 bp, Rattus norvegicus
ttctatgagaccttgacctctggct

SEQ ID NO: 671327 - DNA, 25 bp, Rattus norvegicus
ttctatgatgtgctctctgaaagac

SEQ ID NO: 671328 - DNA, 25 bp, Rattus norvegicus
ttctatgatgtggtctctgaaagac

SEQ ID NO: 671329 - DNA, 25 bp, Rattus norvegicus
ttctatgcaaaactctacgtgtcac

SEQ ID NO: 671330 - DNA, 25 bp, Rattus norvegicus
ttctatgcaaaagtctacgtgtcac

SEQ ID NO: 671331 - DNA, 25 bp, Rattus norvegicus
ttctatgcataaccgctcgccagat

SEQ ID NO: 671332 - DNA, 25 bp, Rattus norvegicus
ttctatgcataagcgctcgccagat

SEQ ID NO: 671333 - DNA, 25 bp, Rattus norvegicus
ttctatgcgggtattcttagggctc

SEQ ID NO: 671334 - DNA, 25 bp, Rattus norvegicus
ttctatgcgggttttcttagggctc

SEQ ID NO: 671335 - DNA, 25 bp, Rattus norvegicus
ttctatgcgtctacctttatgaaag

SEQ ID NO: 671336 - DNA, 25 bp, Rattus norvegicus
ttctatgcgtcttcctttatgaaag

SEQ ID NO: 671337 - DNA, 25 bp, Rattus norvegicus
ttctatgctgtacatctttgtcttt

SEQ ID NO: 671338 - DNA, 25 bp, Rattus norvegicus
ttctatgctgtagatctttgtcttt

SEQ ID NO: 671339 - DNA, 25 bp, Rattus norvegicus
ttctatgctgtgacaatgccactct

SEQ ID NO: 671340 - DNA, 25 bp, Rattus norvegicus
ttctatgctgtgtcaatgccactct

SEQ ID NO: 671341 - DNA, 25 bp, Rattus norvegicus
ttctatggagctcggcacacaacat

SEQ ID NO: 671342 - DNA, 25 bp, Rattus norvegicus
ttctatggagctgggcacacaacat

SEQ ID NO: 671343 - DNA, 25 bp, Rattus norvegicus
ttctatggcctgacttgatgaagta

SEQ ID NO: 671344 - DNA, 25 bp, Rattus norvegicus
ttctatggcctgtcttgatgaagta

SEQ ID NO: 671345 - DNA, 25 bp, Rattus norvegicus
ttctatggctcacctgacacaatca

SEQ ID NO: 671346 - DNA, 25 bp, Rattus norvegicus
ttctatggctcagctgacacaatca

SEQ ID NO: 671347 - DNA, 25 bp, Rattus norvegicus
ttctatggctggagtacactttcct

SEQ ID NO: 671348 - DNA, 25 bp, Rattus norvegicus
ttctatggctggtgtacactttcct

SEQ ID NO: 671349 - DNA, 25 bp, Rattus norvegicus
ttctatggctgtagtaatcttttat

SEQ ID NO: 671350 - DNA, 25 bp, Rattus norvegicus
ttctatggctgttgtaatcttttat

SEQ ID NO: 671351 - DNA, 25 bp, Rattus norvegicus
ttctatggtgaaatctacttttcta

SEQ ID NO: 671352 - DNA, 25 bp, Rattus norvegicus
ttctatggtgaattctacttttcta

SEQ ID NO: 671353 - DNA, 25 bp, Rattus norvegicus
ttctatgtatatccattttggacac

SEQ ID NO: 671354 - DNA, 25 bp, Rattus norvegicus
ttctatgtatatgcattttggacac

SEQ ID NO: 671355 - DNA, 25 bp, Rattus norvegicus
ttctatgtatccctgctggtttgct

SEQ ID NO: 671356 - DNA, 25 bp, Rattus norvegicus
ttctatgtatccgtgctggtttgct

SEQ ID NO: 671357 - DNA, 25 bp, Rattus norvegicus
ttctatgtccgtcaaagctttgctt

SEQ ID NO: 671358 - DNA, 25 bp, Rattus norvegicus
ttctatgtccgtgaaagctttgctt

SEQ ID NO: 671359 - DNA, 25 bp, Rattus norvegicus
ttctatgtcgccagggtaacggagc

SEQ ID NO: 671360 - DNA, 25 bp, Rattus norvegicus
ttctatgtcgcctgggtaacggagc

SEQ ID NO: 671361 - DNA, 25 bp, Rattus norvegicus
ttctatgtcgtccagtgcatcgcca

SEQ ID NO: 671362 - DNA, 25 bp, Rattus norvegicus
ttctatgtcgtcgagtgcatcgcca

SEQ ID NO: 671363 - DNA, 25 bp, Rattus norvegicus
ttctatgtctgtctcttcattggca

SEQ ID NO: 671364 - DNA, 25 bp, Rattus norvegicus
ttctatgtctgtgtcttcattggca

SEQ ID NO: 671365 - DNA, 25 bp, Rattus norvegicus
ttctatgtcttgctagggtctcatt

SEQ ID NO: 671366 - DNA, 25 bp, Rattus norvegicus
ttctatgtcttggtagggtctcatt

SEQ ID NO: 671367 - DNA, 25 bp, Rattus norvegicus
ttctatgtgccaagatgaacttttc

SEQ ID NO: 671368 - DNA, 25 bp, Rattus norvegicus
ttctatgtgccatgatgaacttttc

SEQ ID NO: 671369 - DNA, 25 bp, Rattus norvegicus
ttctatgtggccatgaatcgcaggg

SEQ ID NO: 671370 - DNA, 25 bp, Rattus norvegicus
ttctatgtggccttgaatcgcaggg

SEQ ID NO: 671371 - DNA, 25 bp, Rattus norvegicus
ttctatgttggtatcagtggctgga

SEQ ID NO: 671372 - DNA, 25 bp, Rattus norvegicus
ttctatgttggtttcagtggctgga

SEQ ID NO: 671373 - DNA, 25 bp, Rattus norvegicus
ttctattaatcgcagttcaaacaag

SEQ ID NO: 671374 - DNA, 25 bp, Rattus norvegicus
ttctattaatcggagttcaaacaag

SEQ ID NO: 671375 - DNA, 25 bp, Rattus norvegicus
ttctattcaactacttgtggtgcat

SEQ ID NO: 671376 - DNA, 25 bp, Rattus norvegicus
ttctattcaacttcttgtggtgcat

SEQ ID NO: 671377 - DNA, 25 bp, Rattus norvegicus
ttctattcaagtaccctactggtca

SEQ ID NO: 671378 - DNA, 25 bp, Rattus norvegicus
ttctattcaagttccctactggtca

SEQ ID NO: 671379 - DNA, 25 bp, Rattus norvegicus
ttctattcagtgcagggccaggctc

SEQ ID NO: 671380 - DNA, 25 bp, Rattus norvegicus
ttctattcagtggagggccaggctc

SEQ ID NO: 671381 - DNA, 25 bp, Rattus norvegicus
ttctattccacaacgtcctgatttg

SEQ ID NO: 671382 - DNA, 25 bp, Rattus norvegicus
ttctattccacatcgtcctgatttg

SEQ ID NO: 671383 - DNA, 25 bp, Rattus norvegicus
ttctattcccagcacctaagatggc

SEQ ID NO: 671384 - DNA, 25 bp, Rattus norvegicus
ttctattcccaggacctaagatggc

SEQ ID NO: 671385 - DNA, 25 bp, Rattus norvegicus
ttctattctcaacggcaagattgcc

SEQ ID NO: 671386 - DNA, 25 bp, Rattus norvegicus
ttctattctcaagggcaagattgcc

SEQ ID NO: 671387 - DNA, 25 bp, Rattus norvegicus
ttctattgcctaccacagcgtcagt

SEQ ID NO: 671388 - DNA, 25 bp, Rattus norvegicus
ttctattgcctagcacagcgtcagt

SEQ ID NO: 671389 - DNA, 25 bp, Rattus norvegicus
ttctatttaggaagcaattcttttt

SEQ ID NO: 671390 - DNA, 25 bp, Rattus norvegicus
ttctatttaggatgcaattcttttt

SEQ ID NO: 671391 - DNA, 25 bp, Rattus norvegicus
ttctatttataacctgcctgtccac

SEQ ID NO: 671392 - DNA, 25 bp, Rattus norvegicus
ttctatttataagctgcctgtccac

SEQ ID NO: 671393 - DNA, 25 bp, Rattus norvegicus
ttctatttatataccttgcctaaaa

SEQ ID NO: 671394 - DNA, 25 bp, Rattus norvegicus
ttctatttatattccttgcctaaaa

SEQ ID NO: 671395 - DNA, 25 bp, Rattus norvegicus
ttctatttcattccagcctattcag

SEQ ID NO: 671396 - DNA, 25 bp, Rattus norvegicus
ttctatttcattgcagcctattcag

SEQ ID NO: 671397 - DNA, 25 bp, Rattus norvegicus
ttctatttctcaacaggcacaacgt

SEQ ID NO: 671398 - DNA, 25 bp, Rattus norvegicus
ttctatttctcatcaggcacaacgt

SEQ ID NO: 671399 - DNA, 25 bp, Rattus norvegicus
ttctatttgtttactccatcccgtc

SEQ ID NO: 671400 - DNA, 25 bp, Rattus norvegicus
ttctatttgttttctccatcccgtc

SEQ ID NO: 671401 - DNA, 25 bp, Rattus norvegicus
ttctattttattcttccttcttgta

SEQ ID NO: 671402 - DNA, 25 bp, Rattus norvegicus
ttctattttattgttccttcttgta

SEQ ID NO: 671403 - DNA, 25 bp, Rattus norvegicus
ttctattttgtcctgtcctaagtca

SEQ ID NO: 671404 - DNA, 25 bp, Rattus norvegicus
ttctattttgtcgtgtcctaagtca

SEQ ID NO: 671405 - DNA, 25 bp, Rattus norvegicus
ttctattttgtgatacctgggtgtc

SEQ ID NO: 671406 - DNA, 25 bp, Rattus norvegicus
ttctattttgtgttacctgggtgtc

SEQ ID NO: 671407 - DNA, 25 bp, Rattus norvegicus
ttctcaaaaatactgccaggtcttc

SEQ ID NO: 671408 - DNA, 25 bp, Rattus norvegicus
ttctcaaaaatagtgccaggtcttc

SEQ ID NO: 671409 - DNA, 25 bp, Rattus norvegicus
ttctcaaaattgatgagctgcttac

SEQ ID NO: 671410 - DNA, 25 bp, Rattus norvegicus
ttctcaaaattgttgagctgcttac

SEQ ID NO: 671411 - DNA, 25 bp, Rattus norvegicus
ttctcaaagcatattcaactcctcc

SEQ ID NO: 671412 - DNA, 25 bp, Rattus norvegicus
ttctcaaagcattttcaactcctcc

SEQ ID NO: 671413 - DNA, 25 bp, Rattus norvegicus
ttctcaaagcgactgttggtgactc

SEQ ID NO: 671414 - DNA, 25 bp, Rattus norvegicus
ttctcaaagcgagtgttggtgactc

SEQ ID NO: 671415 - DNA, 25 bp, Rattus norvegicus
ttctcaaataggagcatccccgtca

SEQ ID NO: 671416 - DNA, 25 bp, Rattus norvegicus
ttctcaaataggtgcatccccgtca

SEQ ID NO: 671417 - DNA, 25 bp, Rattus norvegicus
ttctcaacacgcctgatttcatcca

SEQ ID NO: 671418 - DNA, 25 bp, Rattus norvegicus
ttctcaacacgcgtgatttcatcca

SEQ ID NO: 671419 - DNA, 25 bp, Rattus norvegicus
ttctcaaccatgacttactactgca

SEQ ID NO: 671420 - DNA, 25 bp, Rattus norvegicus
ttctcaaccatgtcttactactgca

SEQ ID NO: 671421 - DNA, 25 bp, Rattus norvegicus
ttctcaacccttaatcagcatcaag

SEQ ID NO: 671422 - DNA, 25 bp, Rattus norvegicus
ttctcaaccctttatcagcatcaag

SEQ ID NO: 671423 - DNA, 25 bp, Rattus norvegicus
ttctcaacctttcctagaacactgt

SEQ ID NO: 671424 - DNA, 25 bp, Rattus norvegicus
ttctcaacctttgctagaacactgt

SEQ ID NO: 671425 - DNA, 25 bp, Rattus norvegicus
ttctcaacggctacaggcgctttga

SEQ ID NO: 671426 - DNA, 25 bp, Rattus norvegicus
ttctcaacggcttcaggcgctttga

SEQ ID NO: 671427 - DNA, 25 bp, Rattus norvegicus
ttctcaagaatgcactttccttact

SEQ ID NO: 671428 - DNA, 25 bp, Rattus norvegicus
ttctcaagaatggactttccttact

SEQ ID NO: 671429 - DNA, 25 bp, Rattus norvegicus
ttctcaagacaaacatgctgctgca

SEQ ID NO: 671430 - DNA, 25 bp, Rattus norvegicus
ttctcaagacaatcatgctgctgca

SEQ ID NO: 671431 - DNA, 25 bp, Rattus norvegicus
ttctcaagactgctacactggctgt

SEQ ID NO: 671432 - DNA, 25 bp, Rattus norvegicus
ttctcaagactggtacactggctgt

SEQ ID NO: 671433 - DNA, 25 bp, Rattus norvegicus
ttctcaagacttcgcctggtagcac

SEQ ID NO: 671434 - DNA, 25 bp, Rattus norvegicus
ttctcaagacttggcctggtagcac

SEQ ID NO: 671435 - DNA, 25 bp, Rattus norvegicus
ttctcaagcggcaagcctcattaca

SEQ ID NO: 671436 - DNA, 25 bp, Rattus norvegicus
ttctcaagcggctagcctcattaca

SEQ ID NO: 671437 - DNA, 25 bp, Rattus norvegicus
ttctcaagcttacgcatggcacaat

SEQ ID NO: 671438 - DNA, 25 bp, Rattus norvegicus
ttctcaagcttaggcatggcacaat

SEQ ID NO: 671439 - DNA, 25 bp, Rattus norvegicus
ttctcaagggccacaaatgactcca

SEQ ID NO: 671440 - DNA, 25 bp, Rattus norvegicus
ttctcaagggcctcaaatgactcca

SEQ ID NO: 671441 - DNA, 25 bp, Rattus norvegicus
ttctcaaggtgtatcccactattac

SEQ ID NO: 671442 - DNA, 25 bp, Rattus norvegicus
ttctcaaggtgtttcccactattac

SEQ ID NO: 671443 - DNA, 25 bp, Rattus norvegicus
ttctcaaggttgcatttcgcaccct

SEQ ID NO: 671444 - DNA, 25 bp, Rattus norvegicus
ttctcaaggttggatttcgcaccct

SEQ ID NO: 671445 - DNA, 25 bp, Rattus norvegicus
ttctcaagtagtcccaagccctgat

SEQ ID NO: 671446 - DNA, 25 bp, Rattus norvegicus
ttctcaagtagtgccaagccctgat

SEQ ID NO: 671447 - DNA, 25 bp, Rattus norvegicus
ttctcaagtccacactgtcaatgtc

SEQ ID NO: 671448 - DNA, 25 bp, Rattus norvegicus
ttctcaagtccagactgtcaatgtc

SEQ ID NO: 671449 - DNA, 25 bp, Rattus norvegicus
ttctcaatccatcggacatatgagt

SEQ ID NO: 671450 - DNA, 25 bp, Rattus norvegicus
ttctcaatccatgggacatatgagt

SEQ ID NO: 671451 - DNA, 25 bp, Rattus norvegicus
ttctcaatgtttactctgcggtctg

SEQ ID NO: 671452 - DNA, 25 bp, Rattus norvegicus
ttctcaatgttttctctgcggtctg

SEQ ID NO: 671453 - DNA, 25 bp, Rattus norvegicus
ttctcaattattctagctgggcgtg

SEQ ID NO: 671454 - DNA, 25 bp, Rattus norvegicus
ttctcaattattgtagctgggcgtg

SEQ ID NO: 671455 - DNA, 25 bp, Rattus norvegicus
ttctcacaatgtattagctgcctac

SEQ ID NO: 671456 - DNA, 25 bp, Rattus norvegicus
ttctcacaatgttttagctgcctac

SEQ ID NO: 671457 - DNA, 25 bp, Rattus norvegicus
ttctcacacatcaggctgggcagga

SEQ ID NO: 671458 - DNA, 25 bp, Rattus norvegicus
ttctcacacatctggctgggcagga

SEQ ID NO: 671459 - DNA, 25 bp, Rattus norvegicus
ttctcacagcttcggttctctattt

SEQ ID NO: 671460 - DNA, 25 bp, Rattus norvegicus
ttctcacagcttgggttctctattt

SEQ ID NO: 671461 - DNA, 25 bp, Rattus norvegicus
ttctcacagggcaacgtatcgtcat

SEQ ID NO: 671462 - DNA, 25 bp, Rattus norvegicus
ttctcacagggctacgtatcgtcat

SEQ ID NO: 671463 - DNA, 25 bp, Rattus norvegicus
ttctcacagtcaatctgtcttgctc

SEQ ID NO: 671464 - DNA, 25 bp, Rattus norvegicus
ttctcacagtcattctgtcttgctc

SEQ ID NO: 671465 - DNA, 25 bp, Rattus norvegicus
ttctcacagtttcacttagagctga

SEQ ID NO: 671466 - DNA, 25 bp, Rattus norvegicus
ttctcacagtttgacttagagctga

SEQ ID NO: 671467 - DNA, 25 bp, Rattus norvegicus
ttctcacataatcactggctggttt

SEQ ID NO: 671468 - DNA, 25 bp, Rattus norvegicus
ttctcacataatgactggctggttt

SEQ ID NO: 671469 - DNA, 25 bp, Rattus norvegicus
ttctcaccagctccaaagtgttttg

SEQ ID NO: 671470 - DNA, 25 bp, Rattus norvegicus
ttctcaccagctgcaaagtgttttg

SEQ ID NO: 671471 - DNA, 25 bp, Rattus norvegicus
ttctcaccagggagagacccgaggt

SEQ ID NO: 671472 - DNA, 25 bp, Rattus norvegicus
ttctcaccagggtgagacccgaggt

SEQ ID NO: 671473 - DNA, 25 bp, Rattus norvegicus
ttctcaccagttagcatcttacagg

SEQ ID NO: 671474 - DNA, 25 bp, Rattus norvegicus
ttctcaccagtttgcatcttacagg

SEQ ID NO: 671475 - DNA, 25 bp, Rattus norvegicus
ttctcaccatctagtggctcaggat

SEQ ID NO: 671476 - DNA, 25 bp, Rattus norvegicus
ttctcaccatcttgtggctcaggat

SEQ ID NO: 671477 - DNA, 25 bp, Rattus norvegicus
ttctcaccatgtctaaggcggcggg

SEQ ID NO: 671478 - DNA, 25 bp, Rattus norvegicus
ttctcaccatgtgtaaggcggcggg

SEQ ID NO: 671479 - DNA, 25 bp, Rattus norvegicus
ttctcacccacacttaattgcagct

SEQ ID NO: 671480 - DNA, 25 bp, Rattus norvegicus
ttctcacccacagttaattgcagct

SEQ ID NO: 671481 - DNA, 25 bp, Rattus norvegicus
ttctcacccgtaaggcttttcaaat

SEQ ID NO: 671482 - DNA, 25 bp, Rattus norvegicus
ttctcacccgtatggcttttcaaat

SEQ ID NO: 671483 - DNA, 25 bp, Rattus norvegicus
ttctcacccttaaagaacctgtgca

SEQ ID NO: 671484 - DNA, 25 bp, Rattus norvegicus
ttctcacccttatagaacctgtgca

SEQ ID NO: 671485 - DNA, 25 bp, Rattus norvegicus
ttctcacccttgacgagatgccagt

SEQ ID NO: 671486 - DNA, 25 bp, Rattus norvegicus
ttctcacccttgtcgagatgccagt

SEQ ID NO: 671487 - DNA, 25 bp, Rattus norvegicus
ttctcacctccaaaggcactgctgt

SEQ ID NO: 671488 - DNA, 25 bp, Rattus norvegicus
ttctcacctccataggcactgctgt

SEQ ID NO: 671489 - DNA, 25 bp, Rattus norvegicus
ttctcacctgataggcttatcagaa

SEQ ID NO: 671490 - DNA, 25 bp, Rattus norvegicus
ttctcacctgattggcttatcagaa

SEQ ID NO: 671491 - DNA, 25 bp, Rattus norvegicus
ttctcacctgtacccatggatttaa

SEQ ID NO: 671492 - DNA, 25 bp, Rattus norvegicus
ttctcacctgtagccatggatttaa

SEQ ID NO: 671493 - DNA, 25 bp, Rattus norvegicus
ttctcacctgtcaatcatactgtta

SEQ ID NO: 671494 - DNA, 25 bp, Rattus norvegicus
ttctcacctgtctatcatactgtta

SEQ ID NO: 671495 - DNA, 25 bp, Rattus norvegicus
ttctcacctgtgatagcatctctct

SEQ ID NO: 671496 - DNA, 25 bp, Rattus norvegicus
ttctcacctgtgttagcatctctct

SEQ ID NO: 671497 - DNA, 25 bp, Rattus norvegicus
ttctcaccttaacttgactttgctc

SEQ ID NO: 671498 - DNA, 25 bp, Rattus norvegicus
ttctcaccttaagttgactttgctc

SEQ ID NO: 671499 - DNA, 25 bp, Rattus norvegicus
ttctcaccttcaagtctgacggagt

SEQ ID NO: 671500 - DNA, 25 bp, Rattus norvegicus
ttctcaccttcatgtctgacggagt

SEQ ID NO: 671501 - DNA, 25 bp, Rattus norvegicus
ttctcacgctcacgccggaagaata

SEQ ID NO: 671502 - DNA, 25 bp, Rattus norvegicus
ttctcacgctcaggccggaagaata

SEQ ID NO: 671503 - DNA, 25 bp, Rattus norvegicus
ttctcacggcccagaaacatacata

SEQ ID NO: 671504 - DNA, 25 bp, Rattus norvegicus
ttctcacggccctgaaacatacata

SEQ ID NO: 671505 - DNA, 25 bp, Rattus norvegicus
ttctcacgtggccaggagtccaagt

SEQ ID NO: 671506 - DNA, 25 bp, Rattus norvegicus
ttctcacgtggcgaggagtccaagt

SEQ ID NO: 671507 - DNA, 25 bp, Rattus norvegicus
ttctcactaatgatgctaccatgca

SEQ ID NO: 671508 - DNA, 25 bp, Rattus norvegicus
ttctcactaatgttgctaccatgca

SEQ ID NO: 671509 - DNA, 25 bp, Rattus norvegicus
ttctcactcctgaaggctctagaaa

SEQ ID NO: 671510 - DNA, 25 bp, Rattus norvegicus
ttctcactcctgtaggctctagaaa

SEQ ID NO: 671511 - DNA, 25 bp, Rattus norvegicus
ttctcactgactagacgctgtgtaa

SEQ ID NO: 671512 - DNA, 25 bp, Rattus norvegicus
ttctcactgacttgacgctgtgtaa

SEQ ID NO: 671513 - DNA, 25 bp, Rattus norvegicus
ttctcactgctgaggctgttctaca

SEQ ID NO: 671514 - DNA, 25 bp, Rattus norvegicus
ttctcactgctgtggctgttctaca

SEQ ID NO: 671515 - DNA, 25 bp, Rattus norvegicus
ttctcactggccaagggtgactctg

SEQ ID NO: 671516 - DNA, 25 bp, Rattus norvegicus
ttctcactggcctagggtgactctg

SEQ ID NO: 671517 - DNA, 25 bp, Rattus norvegicus
ttctcactggctcggaaaccttaga

SEQ ID NO: 671518 - DNA, 25 bp, Rattus norvegicus
ttctcactggctgggaaaccttaga

SEQ ID NO: 671519 - DNA, 25 bp, Rattus norvegicus
ttctcactgggtcggcagagcagca

SEQ ID NO: 671520 - DNA, 25 bp, Rattus norvegicus
ttctcactgggtgggcagagcagca

SEQ ID NO: 671521 - DNA, 25 bp, Rattus norvegicus
ttctcactgtcacgcagcagcttaa

SEQ ID NO: 671522 - DNA, 25 bp, Rattus norvegicus
ttctcactgtcaggcagcagcttaa

SEQ ID NO: 671523 - DNA, 25 bp, Rattus norvegicus
ttctcactgtttctcatgggacgtt

SEQ ID NO: 671524 - DNA, 25 bp, Rattus norvegicus
ttctcactgtttgtcatgggacgtt

SEQ ID NO: 671525 - DNA, 25 bp, Rattus norvegicus
ttctcacttcatacagcaactctaa

SEQ ID NO: 671526 - DNA, 25 bp, Rattus norvegicus
ttctcacttcattcagcaactctaa

SEQ ID NO: 671527 - DNA, 25 bp, Rattus norvegicus
ttctcacttggccttaaactatgtt

SEQ ID NO: 671528 - DNA, 25 bp, Rattus norvegicus
ttctcacttggcgttaaactatgtt

SEQ ID NO: 671529 - DNA, 25 bp, Rattus norvegicus
ttctcacttggtcgaagctctctac

SEQ ID NO: 671530 - DNA, 25 bp, Rattus norvegicus
ttctcacttggtggaagctctctac

SEQ ID NO: 671531 - DNA, 25 bp, Rattus norvegicus
ttctcactttaacaattcttttcta

SEQ ID NO: 671532 - DNA, 25 bp, Rattus norvegicus
ttctcactttaagaattcttttcta

SEQ ID NO: 671533 - DNA, 25 bp, Rattus norvegicus
ttctcagaagttccctcagtaccta

SEQ ID NO: 671534 - DNA, 25 bp, Rattus norvegicus
ttctcagaagttgcctcagtaccta

SEQ ID NO: 671535 - DNA, 25 bp, Rattus norvegicus
ttctcagacagaaagggccccatgc

SEQ ID NO: 671536 - DNA, 25 bp, Rattus norvegicus
ttctcagacagatagggccccatgc

SEQ ID NO: 671537 - DNA, 25 bp, Rattus norvegicus
ttctcagacctgaacggacacatca

SEQ ID NO: 671538 - DNA, 25 bp, Rattus norvegicus
ttctcagacctgtacggacacatca

SEQ ID NO: 671539 - DNA, 25 bp, Rattus norvegicus
ttctcagacttcatttttccttacc

SEQ ID NO: 671540 - DNA, 25 bp, Rattus norvegicus
ttctcagacttcttttttccttacc

SEQ ID NO: 671541 - DNA, 25 bp, Rattus norvegicus
ttctcagagctgaaccgcttggtga

SEQ ID NO: 671542 - DNA, 25 bp, Rattus norvegicus
ttctcagagctgtaccgcttggtga

SEQ ID NO: 671543 - DNA, 25 bp, Rattus norvegicus
ttctcagaggcccaactaagcagct

SEQ ID NO: 671544 - DNA, 25 bp, Rattus norvegicus
ttctcagaggccgaactaagcagct

SEQ ID NO: 671545 - DNA, 25 bp, Rattus norvegicus
ttctcagagggactcctgtggctct

SEQ ID NO: 671546 - DNA, 25 bp, Rattus norvegicus
ttctcagagggagtcctgtggctct

SEQ ID NO: 671547 - DNA, 25 bp, Rattus norvegicus
ttctcagatgtcacccgtggttgac

SEQ ID NO: 671548 - DNA, 25 bp, Rattus norvegicus
ttctcagatgtctcccgtggttgac

SEQ ID NO: 671549 - DNA, 25 bp, Rattus norvegicus
ttctcagattttaacaggcttggat

SEQ ID NO: 671550 - DNA, 25 bp, Rattus norvegicus
ttctcagatttttacaggcttggat

SEQ ID NO: 671551 - DNA, 25 bp, Rattus norvegicus
ttctcagcaaccctaatggattcaa

SEQ ID NO: 671552 - DNA, 25 bp, Rattus norvegicus
ttctcagcaaccgtaatggattcaa

SEQ ID NO: 671553 - DNA, 25 bp, Rattus norvegicus
ttctcagcacacaaacagcaattta

SEQ ID NO: 671554 - DNA, 25 bp, Rattus norvegicus
ttctcagcacactaacagcaattta

SEQ ID NO: 671555 - DNA, 25 bp, Rattus norvegicus
ttctcagcacttcctgtgtctgtat

SEQ ID NO: 671556 - DNA, 25 bp, Rattus norvegicus
ttctcagcacttgctgtgtctgtat

SEQ ID NO: 671557 - DNA, 25 bp, Rattus norvegicus
ttctcagcagagagctttatctgtt

SEQ ID NO: 671558 - DNA, 25 bp, Rattus norvegicus
ttctcagcagagtgctttatctgtt

SEQ ID NO: 671559 - DNA, 25 bp, Rattus norvegicus
ttctcagcagccaccttctagctgg

SEQ ID NO: 671560 - DNA, 25 bp, Rattus norvegicus
ttctcagcagcctccttctagctgg

SEQ ID NO: 671561 - DNA, 25 bp, Rattus norvegicus
ttctcagcaggtcggattaacactg

SEQ ID NO: 671562 - DNA, 25 bp, Rattus norvegicus
ttctcagcaggtgggattaacactg

SEQ ID NO: 671563 - DNA, 25 bp, Rattus norvegicus
ttctcagcatccacggtgtgggtca

SEQ ID NO: 671564 - DNA, 25 bp, Rattus norvegicus
ttctcagcatcctcggtgtgggtca

SEQ ID NO: 671565 - DNA, 25 bp, Rattus norvegicus
ttctcagccactatatgttacctct

SEQ ID NO: 671566 - DNA, 25 bp, Rattus norvegicus
ttctcagccactttatgttacctct

SEQ ID NO: 671567 - DNA, 25 bp, Rattus norvegicus
ttctcagccaggatagtagctttgc

SEQ ID NO: 671568 - DNA, 25 bp, Rattus norvegicus
ttctcagccaggttagtagctttgc

SEQ ID NO: 671569 - DNA, 25 bp, Rattus norvegicus
ttctcagcccacatgatttactttt

SEQ ID NO: 671570 - DNA, 25 bp, Rattus norvegicus
ttctcagcccacttgatttactttt

SEQ ID NO: 671571 - DNA, 25 bp, Rattus norvegicus
ttctcagcctatcagcgttaaggga

SEQ ID NO: 671572 - DNA, 25 bp, Rattus norvegicus
ttctcagcctatgagcgttaaggga

SEQ ID NO: 671573 - DNA, 25 bp, Rattus norvegicus
ttctcagccttgcttcctaaatcat

SEQ ID NO: 671574 - DNA, 25 bp, Rattus norvegicus
ttctcagccttggttcctaaatcat

SEQ ID NO: 671575 - DNA, 25 bp, Rattus norvegicus
ttctcagcctttatcacatgatgga

SEQ ID NO: 671576 - DNA, 25 bp, Rattus norvegicus
ttctcagcctttttcacatgatgga

SEQ ID NO: 671577 - DNA, 25 bp, Rattus norvegicus
ttctcagcgatgaaagggcctaggt

SEQ ID NO: 671578 - DNA, 25 bp, Rattus norvegicus
ttctcagcgatgtaagggcctaggt

SEQ ID NO: 671579 - DNA, 25 bp, Rattus norvegicus
ttctcagctctaagggttggagtca

SEQ ID NO: 671580 - DNA, 25 bp, Rattus norvegicus
ttctcagctctatgggttggagtca

SEQ ID NO: 671581 - DNA, 25 bp, Rattus norvegicus
ttctcagctctgaaggacatctgta

SEQ ID NO: 671582 - DNA, 25 bp, Rattus norvegicus
ttctcagctctgctgttgatggtca

SEQ ID NO: 671583 - DNA, 25 bp, Rattus norvegicus
ttctcagctctggtgttgatggtca

SEQ ID NO: 671584 - DNA, 25 bp, Rattus norvegicus
ttctcagctctgtaggacatctgta

SEQ ID NO: 671585 - DNA, 25 bp, Rattus norvegicus
ttctcagctgaaaccattctggcag

SEQ ID NO: 671586 - DNA, 25 bp, Rattus norvegicus
ttctcagctgaatccattctggcag

SEQ ID NO: 671587 - DNA, 25 bp, Rattus norvegicus
ttctcaggacagagcttccagagca

SEQ ID NO: 671588 - DNA, 25 bp, Rattus norvegicus
ttctcaggacagcaagggaatggac

SEQ ID NO: 671589 - DNA, 25 bp, Rattus norvegicus
ttctcaggacaggaagggaatggac

SEQ ID NO: 671590 - DNA, 25 bp, Rattus norvegicus
ttctcaggacagtgcttccagagca

SEQ ID NO: 671591 - DNA, 25 bp, Rattus norvegicus
ttctcaggacgcagcattgcagcca

SEQ ID NO: 671592 - DNA, 25 bp, Rattus norvegicus
ttctcaggacgctgcattgcagcca

SEQ ID NO: 671593 - DNA, 25 bp, Rattus norvegicus
ttctcaggctacattgctccataca

SEQ ID NO: 671594 - DNA, 25 bp, Rattus norvegicus
ttctcaggctactttgctccataca

SEQ ID NO: 671595 - DNA, 25 bp, Rattus norvegicus
ttctcaggctgaccacactgggaag

SEQ ID NO: 671596 - DNA, 25 bp, Rattus norvegicus
ttctcaggctgagcacactgggaag

SEQ ID NO: 671597 - DNA, 25 bp, Rattus norvegicus
ttctcaggtctgctttacggtaaga

SEQ ID NO: 671598 - DNA, 25 bp, Rattus norvegicus
ttctcaggtctggtttacggtaaga

SEQ ID NO: 671599 - DNA, 25 bp, Rattus norvegicus
ttctcagtacttctcacttctcaga

SEQ ID NO: 671600 - DNA, 25 bp, Rattus norvegicus
ttctcagtacttgtcacttctcaga

SEQ ID NO: 671601 - DNA, 25 bp, Rattus norvegicus
ttctcagtccccagctgtaaaagct

SEQ ID NO: 671602 - DNA, 25 bp, Rattus norvegicus
ttctcagtcccctgctgtaaaagct

SEQ ID NO: 671603 - DNA, 25 bp, Rattus norvegicus
ttctcagtgcacagctccctgcagg

SEQ ID NO: 671604 - DNA, 25 bp, Rattus norvegicus
ttctcagtgcactgctccctgcagg

SEQ ID NO: 671605 - DNA, 25 bp, Rattus norvegicus
ttctcagtgcccacctcaagaggtt

SEQ ID NO: 671606 - DNA, 25 bp, Rattus norvegicus
ttctcagtgccctcctcaagaggtt

SEQ ID NO: 671607 - DNA, 25 bp, Rattus norvegicus
ttctcagtgctgagtcattccaaat

SEQ ID NO: 671608 - DNA, 25 bp, Rattus norvegicus
ttctcagtgctgtgtcattccaaat

SEQ ID NO: 671609 - DNA, 25 bp, Rattus norvegicus
ttctcagtgtgtctctcaccatgta

SEQ ID NO: 671610 - DNA, 25 bp, Rattus norvegicus
ttctcagtgtgtgtctcaccatgta

SEQ ID NO: 671611 - DNA, 25 bp, Rattus norvegicus
ttctcagttctgcagagtgctccag

SEQ ID NO: 671612 - DNA, 25 bp, Rattus norvegicus
ttctcagttctggagagtgctccag

SEQ ID NO: 671613 - DNA, 25 bp, Rattus norvegicus
ttctcagttcttaccggcttgcgcg

SEQ ID NO: 671614 - DNA, 25 bp, Rattus norvegicus
ttctcagttctttccggcttgcgcg

SEQ ID NO: 671615 - DNA, 25 bp, Rattus norvegicus
ttctcataaccaaggcctcgtatat

SEQ ID NO: 671616 - DNA, 25 bp, Rattus norvegicus
ttctcataaccatggcctcgtatat

SEQ ID NO: 671617 - DNA, 25 bp, Rattus norvegicus
ttctcataccttccctgcagaggtg

SEQ ID NO: 671618 - DNA, 25 bp, Rattus norvegicus
ttctcataccttgcctgcagaggtg

SEQ ID NO: 671619 - DNA, 25 bp, Rattus norvegicus
ttctcatcaagtcctctaacaaacc

SEQ ID NO: 671620 - DNA, 25 bp, Rattus norvegicus
ttctcatcaagtgctctaacaaacc

SEQ ID NO: 671621 - DNA, 25 bp, Rattus norvegicus
ttctcatcacaaagtagcccatctg

SEQ ID NO: 671622 - DNA, 25 bp, Rattus norvegicus
ttctcatcacaatgtagcccatctg

SEQ ID NO: 671623 - DNA, 25 bp, Rattus norvegicus
ttctcatcacctacattgagctgat

SEQ ID NO: 671624 - DNA, 25 bp, Rattus norvegicus
ttctcatcaccttcattgagctgat

SEQ ID NO: 671625 - DNA, 25 bp, Rattus norvegicus
ttctcatcactccaaatcttttaag

SEQ ID NO: 671626 - DNA, 25 bp, Rattus norvegicus
ttctcatcactcgaaatcttttaag

SEQ ID NO: 671627 - DNA, 25 bp, Rattus norvegicus
ttctcatcagagaagcaccacctca

SEQ ID NO: 671628 - DNA, 25 bp, Rattus norvegicus
ttctcatcagagtagcaccacctca

SEQ ID NO: 671629 - DNA, 25 bp, Rattus norvegicus
ttctcatcagcgctcttcaagtgaa

SEQ ID NO: 671630 - DNA, 25 bp, Rattus norvegicus
ttctcatcagcggtcttcaagtgaa

SEQ ID NO: 671631 - DNA, 25 bp, Rattus norvegicus
ttctcatcatttacttcttgtgctc

SEQ ID NO: 671632 - DNA, 25 bp, Rattus norvegicus
ttctcatcattttcttcttgtgctc

SEQ ID NO: 671633 - DNA, 25 bp, Rattus norvegicus
ttctcatcccagcacgacggtcaga

SEQ ID NO: 671634 - DNA, 25 bp, Rattus norvegicus
ttctcatcccaggacgacggtcaga

SEQ ID NO: 671635 - DNA, 25 bp, Rattus norvegicus
ttctcatcccttcaagctggttgaa

SEQ ID NO: 671636 - DNA, 25 bp, Rattus norvegicus
ttctcatcccttgaagctggttgaa

SEQ ID NO: 671637 - DNA, 25 bp, Rattus norvegicus
ttctcatctatgcaggcctggtgca

SEQ ID NO: 671638 - DNA, 25 bp, Rattus norvegicus
ttctcatctatggaggcctggtgca

SEQ ID NO: 671639 - DNA, 25 bp, Rattus norvegicus
ttctcatctgctactctgtcgtgaa

SEQ ID NO: 671640 - DNA, 25 bp, Rattus norvegicus
ttctcatctgcttctctgtcgtgaa

SEQ ID NO: 671641 - DNA, 25 bp, Rattus norvegicus
ttctcatgaacaccttcctagtaaa

SEQ ID NO: 671642 - DNA, 25 bp, Rattus norvegicus
ttctcatgaacagcttcctagtaaa

SEQ ID NO: 671643 - DNA, 25 bp, Rattus norvegicus
ttctcatgaatgaaaggcccaggct

SEQ ID NO: 671644 - DNA, 25 bp, Rattus norvegicus
ttctcatgaatgtaaggcccaggct

SEQ ID NO: 671645 - DNA, 25 bp, Rattus norvegicus
ttctcatgagttagccgttttcact

SEQ ID NO: 671646 - DNA, 25 bp, Rattus norvegicus
ttctcatgagtttgccgttttcact

SEQ ID NO: 671647 - DNA, 25 bp, Rattus norvegicus
ttctcatgcaggcttatcgctggat

SEQ ID NO: 671648 - DNA, 25 bp, Rattus norvegicus
ttctcatgcagggttatcgctggat

SEQ ID NO: 671649 - DNA, 25 bp, Rattus norvegicus
ttctcatgccatcggtcatagtgaa

SEQ ID NO: 671650 - DNA, 25 bp, Rattus norvegicus
ttctcatgccatgggtcatagtgaa

SEQ ID NO: 671651 - DNA, 25 bp, Rattus norvegicus
ttctcatgctgtcgactgacctttg

SEQ ID NO: 671652 - DNA, 25 bp, Rattus norvegicus
ttctcatgctgtggactgacctttg

SEQ ID NO: 671653 - DNA, 25 bp, Rattus norvegicus
ttctcatgcttacctgaagttctcc

SEQ ID NO: 671654 - DNA, 25 bp, Rattus norvegicus
ttctcatgcttagctgaagttctcc

SEQ ID NO: 671655 - DNA, 25 bp, Rattus norvegicus
ttctcatgtaacagtcctcaaccat

SEQ ID NO: 671656 - DNA, 25 bp, Rattus norvegicus
ttctcatgtaactgtcctcaaccat

SEQ ID NO: 671657 - DNA, 25 bp, Rattus norvegicus
ttctcatgtaggagatcagcagact

SEQ ID NO: 671658 - DNA, 25 bp, Rattus norvegicus
ttctcatgtaggtgatcagcagact

SEQ ID NO: 671659 - DNA, 25 bp, Rattus norvegicus
ttctcatgtgtgacctgtgtgtgct

SEQ ID NO: 671660 - DNA, 25 bp, Rattus norvegicus
ttctcatgtgtgtcctgtgtgtgct

SEQ ID NO: 671661 - DNA, 25 bp, Rattus norvegicus
ttctcatgttccctggaggtgacag

SEQ ID NO: 671662 - DNA, 25 bp, Rattus norvegicus
ttctcatgttccgtggaggtgacag

SEQ ID NO: 671663 - DNA, 25 bp, Rattus norvegicus
ttctcattaccaatttcttctccat

SEQ ID NO: 671664 - DNA, 25 bp, Rattus norvegicus
ttctcattaccattttcttctccat

SEQ ID NO: 671665 - DNA, 25 bp, Rattus norvegicus
ttctcattatgtaaccttggtggcc

SEQ ID NO: 671666 - DNA, 25 bp, Rattus norvegicus
ttctcattatgttaccttggtggcc

SEQ ID NO: 671667 - DNA, 25 bp, Rattus norvegicus
ttctcattcccactgtttctgtata

SEQ ID NO: 671668 - DNA, 25 bp, Rattus norvegicus
ttctcattcccagtgtttctgtata

SEQ ID NO: 671669 - DNA, 25 bp, Rattus norvegicus
ttctcattgaggagcttcctggctg

SEQ ID NO: 671670 - DNA, 25 bp, Rattus norvegicus
ttctcattgaggtgcttcctggctg

SEQ ID NO: 671671 - DNA, 25 bp, Rattus norvegicus
ttctcatttcttcatgccttcaggc

SEQ ID NO: 671672 - DNA, 25 bp, Rattus norvegicus
ttctcatttcttgatgccttcaggc

SEQ ID NO: 671673 - DNA, 25 bp, Rattus norvegicus
ttctcatttgctaaaggtttgctta

SEQ ID NO: 671674 - DNA, 25 bp, Rattus norvegicus
ttctcatttgcttaaggtttgctta

SEQ ID NO: 671675 - DNA, 25 bp, Rattus norvegicus
ttctcatttggacattctctcctga

SEQ ID NO: 671676 - DNA, 25 bp, Rattus norvegicus
ttctcatttggagattctctcctga

SEQ ID NO: 671677 - DNA, 25 bp, Rattus norvegicus
ttctccaaagatccggtggcactca

SEQ ID NO: 671678 - DNA, 25 bp, Rattus norvegicus
ttctccaaagatgcggtggcactca

SEQ ID NO: 671679 - DNA, 25 bp, Rattus norvegicus
ttctccaaaggcagttgagtttcgt

SEQ ID NO: 671680 - DNA, 25 bp, Rattus norvegicus
ttctccaaaggctgttgagtttcgt

SEQ ID NO: 671681 - DNA, 25 bp, Rattus norvegicus
ttctccaaattaagtcgtttagtga

SEQ ID NO: 671682 - DNA, 25 bp, Rattus norvegicus
ttctccaaattatgtcgtttagtga

SEQ ID NO: 671683 - DNA, 25 bp, Rattus norvegicus
ttctccaaattgagtgtgcccaggc

SEQ ID NO: 671684 - DNA, 25 bp, Rattus norvegicus
ttctccaaattgtgtgtgcccaggc

SEQ ID NO: 671685 - DNA, 25 bp, Rattus norvegicus
ttctccaacggcctgtgattactac

SEQ ID NO: 671686 - DNA, 25 bp, Rattus norvegicus
ttctccaacggcgtgtgattactac

SEQ ID NO: 671687 - DNA, 25 bp, Rattus norvegicus
ttctccaacttaatactgctacggg

SEQ ID NO: 671688 - DNA, 25 bp, Rattus norvegicus
ttctccaacttattactgctacggg

SEQ ID NO: 671689 - DNA, 25 bp, Rattus norvegicus
ttctccaagaagacctgggcagctt

SEQ ID NO: 671690 - DNA, 25 bp, Rattus norvegicus
ttctccaagaagtcctgggcagctt

SEQ ID NO: 671691 - DNA, 25 bp, Rattus norvegicus
ttctccaagtagcagcaactccggc

SEQ ID NO: 671692 - DNA, 25 bp, Rattus norvegicus
ttctccaagtaggagcaactccggc

SEQ ID NO: 671693 - DNA, 25 bp, Rattus norvegicus
ttctccaatctcaggaaacaccgca

SEQ ID NO: 671694 - DNA, 25 bp, Rattus norvegicus
ttctccaatctctggaaacaccgca

SEQ ID NO: 671695 - DNA, 25 bp, Rattus norvegicus
ttctccacagagagctggtttcctc

SEQ ID NO: 671696 - DNA, 25 bp, Rattus norvegicus
ttctccacagagtgctggtttcctc

SEQ ID NO: 671697 - DNA, 25 bp, Rattus norvegicus
ttctccacagggaaaagcgttgtca

SEQ ID NO: 671698 - DNA, 25 bp, Rattus norvegicus
ttctccacagggtaaagcgttgtca

SEQ ID NO: 671699 - DNA, 25 bp, Rattus norvegicus
ttctccacatttaccgatgacgcca

SEQ ID NO: 671700 - DNA, 25 bp, Rattus norvegicus
ttctccacattttccgatgacgcca

SEQ ID NO: 671701 - DNA, 25 bp, Rattus norvegicus
ttctccaccctgctttcttaagtag

SEQ ID NO: 671702 - DNA, 25 bp, Rattus norvegicus
ttctccaccctggtttcttaagtag

SEQ ID NO: 671703 - DNA, 25 bp, Rattus norvegicus
ttctccacctccattgtttgttggt

SEQ ID NO: 671704 - DNA, 25 bp, Rattus norvegicus
ttctccacctcctttgtttgttggt

SEQ ID NO: 671705 - DNA, 25 bp, Rattus norvegicus
ttctccactcttcctttacacatga

SEQ ID NO: 671706 - DNA, 25 bp, Rattus norvegicus
ttctccactcttgctttacacatga

SEQ ID NO: 671707 - DNA, 25 bp, Rattus norvegicus
ttctccacttacacagcctatttat

SEQ ID NO: 671708 - DNA, 25 bp, Rattus norvegicus
ttctccacttactcagcctatttat

SEQ ID NO: 671709 - DNA, 25 bp, Rattus norvegicus
ttctccactttcagagccagatgac

SEQ ID NO: 671710 - DNA, 25 bp, Rattus norvegicus
ttctccactttctgagccagatgac

SEQ ID NO: 671711 - DNA, 25 bp, Rattus norvegicus
ttctccagaatcatgcaccaaactg

SEQ ID NO: 671712 - DNA, 25 bp, Rattus norvegicus
ttctccagaatcttgcaccaaactg

SEQ ID NO: 671713 - DNA, 25 bp, Rattus norvegicus
ttctccagagcacgcatgtcattta

SEQ ID NO: 671714 - DNA, 25 bp, Rattus norvegicus
ttctccagagcaggcatgtcattta

SEQ ID NO: 671715 - DNA, 25 bp, Rattus norvegicus
ttctccagaggtcggtggccgatca

SEQ ID NO: 671716 - DNA, 25 bp, Rattus norvegicus
ttctccagaggtgggtggccgatca

SEQ ID NO: 671717 - DNA, 25 bp, Rattus norvegicus
ttctccagagtcaaatccggatctt

SEQ ID NO: 671718 - DNA, 25 bp, Rattus norvegicus
ttctccagagtctaatccggatctt

SEQ ID NO: 671719 - DNA, 25 bp, Rattus norvegicus
ttctccagatgcctacaggtgcagt

SEQ ID NO: 671720 - DNA, 25 bp, Rattus norvegicus
ttctccagatgcgtacaggtgcagt

SEQ ID NO: 671721 - DNA, 25 bp, Rattus norvegicus
ttctccagcagccatgtcaggccag

SEQ ID NO: 671722 - DNA, 25 bp, Rattus norvegicus
ttctccagcagcgatgtcaggccag

SEQ ID NO: 671723 - DNA, 25 bp, Rattus norvegicus
ttctccagccttccagatcatttag

SEQ ID NO: 671724 - DNA, 25 bp, Rattus norvegicus
ttctccagccttgcagatcatttag

SEQ ID NO: 671725 - DNA, 25 bp, Rattus norvegicus
ttctccagcgtacaagcagcattca

SEQ ID NO: 671726 - DNA, 25 bp, Rattus norvegicus
ttctccagcgtagaagcagcattca

SEQ ID NO: 671727 - DNA, 25 bp, Rattus norvegicus
ttctccagctgaaggtcccagtgaa

SEQ ID NO: 671728 - DNA, 25 bp, Rattus norvegicus
ttctccagctgatggtcccagtgaa

SEQ ID NO: 671729 - DNA, 25 bp, Rattus norvegicus
ttctccaggaacagcgacaggaggg

SEQ ID NO: 671730 - DNA, 25 bp, Rattus norvegicus
ttctccaggaactgcgacaggaggg

SEQ ID NO: 671731 - DNA, 25 bp, Rattus norvegicus
ttctccaggccgacaagtctaagaa

SEQ ID NO: 671732 - DNA, 25 bp, Rattus norvegicus
ttctccaggccgtcaagtctaagaa

SEQ ID NO: 671733 - DNA, 25 bp, Rattus norvegicus
ttctccaggcgtccagatggcatgt

SEQ ID NO: 671734 - DNA, 25 bp, Rattus norvegicus
ttctccaggcgtgcagatggcatgt

SEQ ID NO: 671735 - DNA, 25 bp, Rattus norvegicus
ttctccaggctgacttgacacatac

SEQ ID NO: 671736 - DNA, 25 bp, Rattus norvegicus
ttctccaggctgtcttgacacatac

SEQ ID NO: 671737 - DNA, 25 bp, Rattus norvegicus
ttctccagggccctgttcaatacag

SEQ ID NO: 671738 - DNA, 25 bp, Rattus norvegicus
ttctccagggccgtgttcaatacag

SEQ ID NO: 671739 - DNA, 25 bp, Rattus norvegicus
ttctccagtgaacccaggtatctgt

SEQ ID NO: 671740 - DNA, 25 bp, Rattus norvegicus
ttctccagtgaagccaggtatctgt

SEQ ID NO: 671741 - DNA, 25 bp, Rattus norvegicus
ttctccagtgctaggcaaaactctg

SEQ ID NO: 671742 - DNA, 25 bp, Rattus norvegicus
ttctccagtgcttggcaaaactctg

SEQ ID NO: 671743 - DNA, 25 bp, Rattus norvegicus
ttctccagtgttctttcatacatcc

SEQ ID NO: 671744 - DNA, 25 bp, Rattus norvegicus
ttctccagtgttgtttcatacatcc

SEQ ID NO: 671745 - DNA, 25 bp, Rattus norvegicus
ttctccagtttcaccctgatgaagt

SEQ ID NO: 671746 - DNA, 25 bp, Rattus norvegicus
ttctccagtttccattgttggttta

SEQ ID NO: 671747 - DNA, 25 bp, Rattus norvegicus
ttctccagtttcgattgttggttta

SEQ ID NO: 671748 - DNA, 25 bp, Rattus norvegicus
ttctccagtttctccctgatgaagt

SEQ ID NO: 671749 - DNA, 25 bp, Rattus norvegicus
ttctccataaccagggcaactgctg

SEQ ID NO: 671750 - DNA, 25 bp, Rattus norvegicus
ttctccataacctgggcaactgctg

SEQ ID NO: 671751 - DNA, 25 bp, Rattus norvegicus
ttctccatacacagacctctgcaga

SEQ ID NO: 671752 - DNA, 25 bp, Rattus norvegicus
ttctccatacactgacctctgcaga

SEQ ID NO: 671753 - DNA, 25 bp, Rattus norvegicus
ttctccatacgtcggctaaagcagt

SEQ ID NO: 671754 - DNA, 25 bp, Rattus norvegicus
ttctccatacgtgggctaaagcagt

SEQ ID NO: 671755 - DNA, 25 bp, Rattus norvegicus
ttctccatagggattggcgcttgcc

SEQ ID NO: 671756 - DNA, 25 bp, Rattus norvegicus
ttctccatagggtttggcgcttgcc

SEQ ID NO: 671757 - DNA, 25 bp, Rattus norvegicus
ttctccatcacgatagggtgcgttg

SEQ ID NO: 671758 - DNA, 25 bp, Rattus norvegicus
ttctccatcacgttagggtgcgttg

SEQ ID NO: 671759 - DNA, 25 bp, Rattus norvegicus
ttctccatcagtaggcgaagcagga

SEQ ID NO: 671760 - DNA, 25 bp, Rattus norvegicus
ttctccatcagttggcgaagcagga

SEQ ID NO: 671761 - DNA, 25 bp, Rattus norvegicus
ttctccatcggtctccattctctgt

SEQ ID NO: 671762 - DNA, 25 bp, Rattus norvegicus
ttctccatcggtgtccattctctgt

SEQ ID NO: 671763 - DNA, 25 bp, Rattus norvegicus
ttctccatcgtcagtggcacatgcg

SEQ ID NO: 671764 - DNA, 25 bp, Rattus norvegicus
ttctccatcgtctgtggcacatgcg

SEQ ID NO: 671765 - DNA, 25 bp, Rattus norvegicus
ttctccatctagatgtgacctcctg

SEQ ID NO: 671766 - DNA, 25 bp, Rattus norvegicus
ttctccatctagttgtgacctcctg

SEQ ID NO: 671767 - DNA, 25 bp, Rattus norvegicus
ttctccatctcgctgataatgcagg

SEQ ID NO: 671768 - DNA, 25 bp, Rattus norvegicus
ttctccatctcggtgataatgcagg

SEQ ID NO: 671769 - DNA, 25 bp, Rattus norvegicus
ttctccatggaacccattgagtgat

SEQ ID NO: 671770 - DNA, 25 bp, Rattus norvegicus
ttctccatggaagccattgagtgat

SEQ ID NO: 671771 - DNA, 25 bp, Rattus norvegicus
ttctccatgggaccgaattttatgt

SEQ ID NO: 671772 - DNA, 25 bp, Rattus norvegicus
ttctccatgggagcgaattttatgt

SEQ ID NO: 671773 - DNA, 25 bp, Rattus norvegicus
ttctccatgtaacatgttttccaat

SEQ ID NO: 671774 - DNA, 25 bp, Rattus norvegicus
ttctccatgtaagatgttttccaat

SEQ ID NO: 671775 - DNA, 25 bp, Rattus norvegicus
ttctccatgtctagagagccagtct

SEQ ID NO: 671776 - DNA, 25 bp, Rattus norvegicus
ttctccatgtcttgagagccagtct

SEQ ID NO: 671777 - DNA, 25 bp, Rattus norvegicus
ttctccattaccatgtctgtctgga

SEQ ID NO: 671778 - DNA, 25 bp, Rattus norvegicus
ttctccattaccttgtctgtctgga

SEQ ID NO: 671779 - DNA, 25 bp, Rattus norvegicus
ttctccattatgattctctgctcac

SEQ ID NO: 671780 - DNA, 25 bp, Rattus norvegicus
ttctccattatgtttctctgctcac

SEQ ID NO: 671781 - DNA, 25 bp, Rattus norvegicus
ttctcccaaatgctaggtggactct

SEQ ID NO: 671782 - DNA, 25 bp, Rattus norvegicus
ttctcccaaatggtaggtggactct

SEQ ID NO: 671783 - DNA, 25 bp, Rattus norvegicus
ttctcccacagcagtttcacaggaa

SEQ ID NO: 671784 - DNA, 25 bp, Rattus norvegicus
ttctcccacagctgtttcacaggaa

SEQ ID NO: 671785 - DNA, 25 bp, Rattus norvegicus
ttctcccactttctccaagatgaag

SEQ ID NO: 671786 - DNA, 25 bp, Rattus norvegicus
ttctcccactttgtccaagatgaag

SEQ ID NO: 671787 - DNA, 25 bp, Rattus norvegicus
ttctcccagaacatcatacccgagt

SEQ ID NO: 671788 - DNA, 25 bp, Rattus norvegicus
ttctcccagaacttcatacccgagt

SEQ ID NO: 671789 - DNA, 25 bp, Rattus norvegicus
ttctcccagaggaggccggtgcaaa

SEQ ID NO: 671790 - DNA, 25 bp, Rattus norvegicus
ttctcccagaggtggccggtgcaaa

SEQ ID NO: 671791 - DNA, 25 bp, Rattus norvegicus
ttctcccaggaacgccctgaggttt

SEQ ID NO: 671792 - DNA, 25 bp, Rattus norvegicus
ttctcccaggaaggccctgaggttt

SEQ ID NO: 671793 - DNA, 25 bp, Rattus norvegicus
ttctcccaggttctatgttatgtca

SEQ ID NO: 671794 - DNA, 25 bp, Rattus norvegicus
ttctcccaggttgtatgttatgtca

SEQ ID NO: 671795 - DNA, 25 bp, Rattus norvegicus
ttctcccagtgtaccatgtagcatg

SEQ ID NO: 671796 - DNA, 25 bp, Rattus norvegicus
ttctcccagtgttccatgtagcatg

SEQ ID NO: 671797 - DNA, 25 bp, Rattus norvegicus
ttctcccatgagatctgtgtgatag

SEQ ID NO: 671798 - DNA, 25 bp, Rattus norvegicus
ttctcccatgagttctgtgtgatag

SEQ ID NO: 671799 - DNA, 25 bp, Rattus norvegicus
ttctcccatgctatgtctgaacagt

SEQ ID NO: 671800 - DNA, 25 bp, Rattus norvegicus
ttctcccatgctttgtctgaacagt

SEQ ID NO: 671801 - DNA, 25 bp, Rattus norvegicus
ttctccccaacactaagacctgtaa

SEQ ID NO: 671802 - DNA, 25 bp, Rattus norvegicus
ttctccccaacagtaagacctgtaa

SEQ ID NO: 671803 - DNA, 25 bp, Rattus norvegicus
ttctccccaatgaactactcactat

SEQ ID NO: 671804 - DNA, 25 bp, Rattus norvegicus
ttctccccaatgtactactcactat

SEQ ID NO: 671805 - DNA, 25 bp, Rattus norvegicus
ttctccccagagctttctttgtatc

SEQ ID NO: 671806 - DNA, 25 bp, Rattus norvegicus
ttctccccagaggtttctttgtatc

SEQ ID NO: 671807 - DNA, 25 bp, Rattus norvegicus
ttctccccgacaataatgatgccta

SEQ ID NO: 671808 - DNA, 25 bp, Rattus norvegicus
ttctccccgacattaatgatgccta

SEQ ID NO: 671809 - DNA, 25 bp, Rattus norvegicus
ttctccccggcgcttagtgctgaga

SEQ ID NO: 671810 - DNA, 25 bp, Rattus norvegicus
ttctccccggcggttagtgctgaga

SEQ ID NO: 671811 - DNA, 25 bp, Rattus norvegicus
ttctccccggtgaggagtctctggt

SEQ ID NO: 671812 - DNA, 25 bp, Rattus norvegicus
ttctccccggtgtggagtctctggt

SEQ ID NO: 671813 - DNA, 25 bp, Rattus norvegicus
ttctccccggttaggtctgattgat

SEQ ID NO: 671814 - DNA, 25 bp, Rattus norvegicus
ttctccccggtttggtctgattgat

SEQ ID NO: 671815 - DNA, 25 bp, Rattus norvegicus
ttctcccctcaaatggaccttaaga

SEQ ID NO: 671816 - DNA, 25 bp, Rattus norvegicus
ttctcccctcaattggaccttaaga

SEQ ID NO: 671817 - DNA, 25 bp, Rattus norvegicus
ttctcccctcacaagtcaggaaagc

SEQ ID NO: 671818 - DNA, 25 bp, Rattus norvegicus
ttctcccctcactagtcaggaaagc

SEQ ID NO: 671819 - DNA, 25 bp, Rattus norvegicus
ttctcccctctgacgttttatataa

SEQ ID NO: 671820 - DNA, 25 bp, Rattus norvegicus
ttctcccctctgtcgttttatataa

SEQ ID NO: 671821 - DNA, 25 bp, Rattus norvegicus
ttctcccctgatctgagttttgttt

SEQ ID NO: 671822 - DNA, 25 bp, Rattus norvegicus
ttctcccctgatgtgagttttgttt

SEQ ID NO: 671823 - DNA, 25 bp, Rattus norvegicus
ttctcccctgcgctatgtggacatt

SEQ ID NO: 671824 - DNA, 25 bp, Rattus norvegicus
ttctcccctgcggtatgtggacatt

SEQ ID NO: 671825 - DNA, 25 bp, Rattus norvegicus
ttctcccctgtgagtcctgggcatt

SEQ ID NO: 671826 - DNA, 25 bp, Rattus norvegicus
ttctcccctgtgtgtcctgggcatt

SEQ ID NO: 671827 - DNA, 25 bp, Rattus norvegicus
ttctccccttctccagcagtgttgg

SEQ ID NO: 671828 - DNA, 25 bp, Rattus norvegicus
ttctccccttctgcagcagtgttgg

SEQ ID NO: 671829 - DNA, 25 bp, Rattus norvegicus
ttctcccctttcaaggtcaatggtg

SEQ ID NO: 671830 - DNA, 25 bp, Rattus norvegicus
ttctcccctttctaggtcaatggtg

SEQ ID NO: 671831 - DNA, 25 bp, Rattus norvegicus
ttctcccgagcccagcacgaaggtt

SEQ ID NO: 671832 - DNA, 25 bp, Rattus norvegicus
ttctcccgagccgagcacgaaggtt

SEQ ID NO: 671833 - DNA, 25 bp, Rattus norvegicus
ttctcccgcctaagaaatgaatgct

SEQ ID NO: 671834 - DNA, 25 bp, Rattus norvegicus
ttctcccgcctatgaaatgaatgct

SEQ ID NO: 671835 - DNA, 25 bp, Rattus norvegicus
ttctcccgcgagcaggccgtgcaga

SEQ ID NO: 671836 - DNA, 25 bp, Rattus norvegicus
ttctcccgcgaggaggccgtgcaga

SEQ ID NO: 671837 - DNA, 25 bp, Rattus norvegicus
ttctcccggtcacggattcccgagg

SEQ ID NO: 671838 - DNA, 25 bp, Rattus norvegicus
ttctcccggtcagggattcccgagg

SEQ ID NO: 671839 - DNA, 25 bp, Rattus norvegicus
ttctcccgtgagaagatggacctga

SEQ ID NO: 671840 - DNA, 25 bp, Rattus norvegicus
ttctcccgtgagtagatggacctga

SEQ ID NO: 671841 - DNA, 25 bp, Rattus norvegicus
ttctccctaaacacgtttgttcctg

SEQ ID NO: 671842 - DNA, 25 bp, Rattus norvegicus
ttctccctaaactcgtttgttcctg

SEQ ID NO: 671843 - DNA, 25 bp, Rattus norvegicus
ttctccctagaaaccgtagagtggg

SEQ ID NO: 671844 - DNA, 25 bp, Rattus norvegicus
ttctccctagaacagtatgcgtcag

SEQ ID NO: 671845 - DNA, 25 bp, Rattus norvegicus
ttctccctagaagagtatgcgtcag

SEQ ID NO: 671846 - DNA, 25 bp, Rattus norvegicus
ttctccctagaatccgtagagtggg

SEQ ID NO: 671847 - DNA, 25 bp, Rattus norvegicus
ttctccctatctcttaatgcttatg

SEQ ID NO: 671848 - DNA, 25 bp, Rattus norvegicus
ttctccctatctgttaatgcttatg

SEQ ID NO: 671849 - DNA, 25 bp, Rattus norvegicus
ttctccctattcatccaggaagcag

SEQ ID NO: 671850 - DNA, 25 bp, Rattus norvegicus
ttctccctattcttccaggaagcag

SEQ ID NO: 671851 - DNA, 25 bp, Rattus norvegicus
ttctccctcagaaacatggcgaact

SEQ ID NO: 671852 - DNA, 25 bp, Rattus norvegicus
ttctccctcagatacatggcgaact

SEQ ID NO: 671853 - DNA, 25 bp, Rattus norvegicus
ttctccctcagtatgatgcagtgta

SEQ ID NO: 671854 - DNA, 25 bp, Rattus norvegicus
ttctccctcagtttgatgcagtgta

SEQ ID NO: 671855 - DNA, 25 bp, Rattus norvegicus
ttctccctccttagtgagctaagta

SEQ ID NO: 671856 - DNA, 25 bp, Rattus norvegicus
ttctccctcctttgtgagctaagta

SEQ ID NO: 671857 - DNA, 25 bp, Rattus norvegicus
ttctccctctagcacaagcaaacat

SEQ ID NO: 671858 - DNA, 25 bp, Rattus norvegicus
ttctccctctaggacaagcaaacat

SEQ ID NO: 671859 - DNA, 25 bp, Rattus norvegicus
ttctccctgaacagcagtctggcac

SEQ ID NO: 671860 - DNA, 25 bp, Rattus norvegicus
ttctccctgaactgcagtctggcac

SEQ ID NO: 671861 - DNA, 25 bp, Rattus norvegicus
ttctccctgccaaatcggtggaaca

SEQ ID NO: 671862 - DNA, 25 bp, Rattus norvegicus
ttctccctgccatatcggtggaaca

SEQ ID NO: 671863 - DNA, 25 bp, Rattus norvegicus
ttctccctgcttcatattaccgtag

SEQ ID NO: 671864 - DNA, 25 bp, Rattus norvegicus
ttctccctgcttgatattaccgtag

SEQ ID NO: 671865 - DNA, 25 bp, Rattus norvegicus
ttctccctggagatcagagtattca

SEQ ID NO: 671866 - DNA, 25 bp, Rattus norvegicus
ttctccctggagttcagagtattca

SEQ ID NO: 671867 - DNA, 25 bp, Rattus norvegicus
ttctccctggcaagaccatttcatg

SEQ ID NO: 671868 - DNA, 25 bp, Rattus norvegicus
ttctccctggcatgaccatttcatg

SEQ ID NO: 671869 - DNA, 25 bp, Rattus norvegicus
ttctccctggtgcacgccatgaatg

SEQ ID NO: 671870 - DNA, 25 bp, Rattus norvegicus
ttctccctggtggacgccatgaatg

SEQ ID NO: 671871 - DNA, 25 bp, Rattus norvegicus
ttctccctgtaaaacctatcacttg

SEQ ID NO: 671872 - DNA, 25 bp, Rattus norvegicus
ttctccctgtaatacctatcacttg

SEQ ID NO: 671873 - DNA, 25 bp, Rattus norvegicus
ttctcccttaaacacaagggaagcg

SEQ ID NO: 671874 - DNA, 25 bp, Rattus norvegicus
ttctcccttaaagacaagggaagcg

SEQ ID NO: 671875 - DNA, 25 bp, Rattus norvegicus
ttctcccttcctaactggaattttg

SEQ ID NO: 671876 - DNA, 25 bp, Rattus norvegicus
ttctcccttccttactggaattttg

SEQ ID NO: 671877 - DNA, 25 bp, Rattus norvegicus
ttctccctttggacttaggatctga

SEQ ID NO: 671878 - DNA, 25 bp, Rattus norvegicus
ttctccctttggtcttaggatctga

SEQ ID NO: 671879 - DNA, 25 bp, Rattus norvegicus
ttctccctttttctaattgcactac

SEQ ID NO: 671880 - DNA, 25 bp, Rattus norvegicus
ttctccctttttgtaattgcactac

SEQ ID NO: 671881 - DNA, 25 bp, Rattus norvegicus
ttctccgaagttcgcatctgacact

SEQ ID NO: 671882 - DNA, 25 bp, Rattus norvegicus
ttctccgaagttggcatctgacact

SEQ ID NO: 671883 - DNA, 25 bp, Rattus norvegicus
ttctccgaattgaagattcaactgc

SEQ ID NO: 671884 - DNA, 25 bp, Rattus norvegicus
ttctccgaattgtagattcaactgc

SEQ ID NO: 671885 - DNA, 25 bp, Rattus norvegicus
ttctccgaatttccatgatcttcaa

SEQ ID NO: 671886 - DNA, 25 bp, Rattus norvegicus
ttctccgaatttgcatgatcttcaa

SEQ ID NO: 671887 - DNA, 25 bp, Rattus norvegicus
ttctccgagacacgttcaaaagctt

SEQ ID NO: 671888 - DNA, 25 bp, Rattus norvegicus
ttctccgagacaggttcaaaagctt

SEQ ID NO: 671889 - DNA, 25 bp, Rattus norvegicus
ttctccgaggaacaactgaagccac

SEQ ID NO: 671890 - DNA, 25 bp, Rattus norvegicus
ttctccgaggaagaactgaagccac

SEQ ID NO: 671891 - DNA, 25 bp, Rattus norvegicus
ttctccgagggtatggttcaacaag

SEQ ID NO: 671892 - DNA, 25 bp, Rattus norvegicus
ttctccgagggtttggttcaacaag

SEQ ID NO: 671893 - DNA, 25 bp, Rattus norvegicus
ttctccgagttcagaacctttggga

SEQ ID NO: 671894 - DNA, 25 bp, Rattus norvegicus
ttctccgagttctgaacctttggga

SEQ ID NO: 671895 - DNA, 25 bp, Rattus norvegicus
ttctccgccagactgacatgaacta

SEQ ID NO: 671896 - DNA, 25 bp, Rattus norvegicus
ttctccgccagagtgacatgaacta

SEQ ID NO: 671897 - DNA, 25 bp, Rattus norvegicus
ttctccgctgtcagtagcaactctg

SEQ ID NO: 671898 - DNA, 25 bp, Rattus norvegicus
ttctccgctgtctgtagcaactctg

SEQ ID NO: 671899 - DNA, 25 bp, Rattus norvegicus
ttctccgctttcactcagaaatgag

SEQ ID NO: 671900 - DNA, 25 bp, Rattus norvegicus
ttctccgctttctctcagaaatgag

SEQ ID NO: 671901 - DNA, 25 bp, Rattus norvegicus
ttctccggaaagcttgggtgcctct

SEQ ID NO: 671902 - DNA, 25 bp, Rattus norvegicus
ttctccggaaaggttgggtgcctct

SEQ ID NO: 671903 - DNA, 25 bp, Rattus norvegicus
ttctccggagtactggtgacatgtc

SEQ ID NO: 671904 - DNA, 25 bp, Rattus norvegicus
ttctccggagtagtggtgacatgtc

SEQ ID NO: 671905 - DNA, 25 bp, Rattus norvegicus
ttctccgggcagcagcgaaagacgc

SEQ ID NO: 671906 - DNA, 25 bp, Rattus norvegicus
ttctccgggcaggagcgaaagacgc

SEQ ID NO: 671907 - DNA, 25 bp, Rattus norvegicus
ttctccgggctaagagcgtatgccc

SEQ ID NO: 671908 - DNA, 25 bp, Rattus norvegicus
ttctccgggctatgagcgtatgccc

SEQ ID NO: 671909 - DNA, 25 bp, Rattus norvegicus
ttctccggtatcagatccagcaaac

SEQ ID NO: 671910 - DNA, 25 bp, Rattus norvegicus
ttctccggtatctgatccagcaaac

SEQ ID NO: 671911 - DNA, 25 bp, Rattus norvegicus
ttctccggtgacagtatgccaattc

SEQ ID NO: 671912 - DNA, 25 bp, Rattus norvegicus
ttctccggtgactgtatgccaattc

SEQ ID NO: 671913 - DNA, 25 bp, Rattus norvegicus
ttctccggtgtgagcttatgtgatg

SEQ ID NO: 671914 - DNA, 25 bp, Rattus norvegicus
ttctccggtgtgtgcttatgtgatg

SEQ ID NO: 671915 - DNA, 25 bp, Rattus norvegicus
ttctccgtactaacttctgtatctt

SEQ ID NO: 671916 - DNA, 25 bp, Rattus norvegicus
ttctccgtactatcttctgtatctt

SEQ ID NO: 671917 - DNA, 25 bp, Rattus norvegicus
ttctccgtcgaactcttcatttcag

SEQ ID NO: 671918 - DNA, 25 bp, Rattus norvegicus
ttctccgtcgaagtcttcatttcag

SEQ ID NO: 671919 - DNA, 25 bp, Rattus norvegicus
ttctccgtcttgctgccagggtcaa

SEQ ID NO: 671920 - DNA, 25 bp, Rattus norvegicus
ttctccgtcttggtgccagggtcaa

SEQ ID NO: 671921 - DNA, 25 bp, Rattus norvegicus
ttctccgtgagaaatttccttgtga

SEQ ID NO: 671922 - DNA, 25 bp, Rattus norvegicus
ttctccgtgagatatttccttgtga

SEQ ID NO: 671923 - DNA, 25 bp, Rattus norvegicus
ttctccgtggctaactggtttcagt

SEQ ID NO: 671924 - DNA, 25 bp, Rattus norvegicus
ttctccgtggcttactggtttcagt

SEQ ID NO: 671925 - DNA, 25 bp, Rattus norvegicus
ttctccgtgggaccaggaatccttt

SEQ ID NO: 671926 - DNA, 25 bp, Rattus norvegicus
ttctccgtgggagcaggaatccttt

SEQ ID NO: 671927 - DNA, 25 bp, Rattus norvegicus
ttctccgtgtacaagcctcagatgg

SEQ ID NO: 671928 - DNA, 25 bp, Rattus norvegicus
ttctccgtgtactagcctcagatgg

SEQ ID NO: 671929 - DNA, 25 bp, Rattus norvegicus
ttctcctaccatcctttctatgtga

SEQ ID NO: 671930 - DNA, 25 bp, Rattus norvegicus
ttctcctaccatgctttctatgtga

SEQ ID NO: 671931 - DNA, 25 bp, Rattus norvegicus
ttctcctactttcataacctggcta

SEQ ID NO: 671932 - DNA, 25 bp, Rattus norvegicus
ttctcctactttgataacctggcta

SEQ ID NO: 671933 - DNA, 25 bp, Rattus norvegicus
ttctcctagcaactctgagacgctt

SEQ ID NO: 671934 - DNA, 25 bp, Rattus norvegicus
ttctcctagcaagtctgagacgctt

SEQ ID NO: 671935 - DNA, 25 bp, Rattus norvegicus
ttctcctaggaacctttcttctggg

SEQ ID NO: 671936 - DNA, 25 bp, Rattus norvegicus
ttctcctaggaactatcggaccatg

SEQ ID NO: 671937 - DNA, 25 bp, Rattus norvegicus
ttctcctaggaagctttcttctggg

SEQ ID NO: 671938 - DNA, 25 bp, Rattus norvegicus
ttctcctaggaagtatcggaccatg

SEQ ID NO: 671939 - DNA, 25 bp, Rattus norvegicus
ttctcctaggagacactttctgtgc

SEQ ID NO: 671940 - DNA, 25 bp, Rattus norvegicus
ttctcctaggagctttttcttcttt

SEQ ID NO: 671941 - DNA, 25 bp, Rattus norvegicus
ttctcctaggaggtttttcttcttt

SEQ ID NO: 671942 - DNA, 25 bp, Rattus norvegicus
ttctcctaggagtcactttctgtgc

SEQ ID NO: 671943 - DNA, 25 bp, Rattus norvegicus
ttctcctatgaactggtaccagggc

SEQ ID NO: 671944 - DNA, 25 bp, Rattus norvegicus
ttctcctatgaagtggtaccagggc

SEQ ID NO: 671945 - DNA, 25 bp, Rattus norvegicus
ttctcctatgccaccgagggcgaga

SEQ ID NO: 671946 - DNA, 25 bp, Rattus norvegicus
ttctcctatgcctccgagggcgaga

SEQ ID NO: 671947 - DNA, 25 bp, Rattus norvegicus
ttctcctatgctcgtgagcaggcct

SEQ ID NO: 671948 - DNA, 25 bp, Rattus norvegicus
ttctcctatgctggtgagcaggcct

SEQ ID NO: 671949 - DNA, 25 bp, Rattus norvegicus
ttctcctatgtgctcgatggtcatc

SEQ ID NO: 671950 - DNA, 25 bp, Rattus norvegicus
ttctcctatgtggtcgatggtcatc

SEQ ID NO: 671951 - DNA, 25 bp, Rattus norvegicus
ttctcctcaaacatgtcctttgtag

SEQ ID NO: 671952 - DNA, 25 bp, Rattus norvegicus
ttctcctcaaacttgtcctttgtag

SEQ ID NO: 671953 - DNA, 25 bp, Rattus norvegicus
ttctcctcaactctcggtggacgtc

SEQ ID NO: 671954 - DNA, 25 bp, Rattus norvegicus
ttctcctcaactgtcggtggacgtc

SEQ ID NO: 671955 - DNA, 25 bp, Rattus norvegicus
ttctcctcactcatccttaaagtgc

SEQ ID NO: 671956 - DNA, 25 bp, Rattus norvegicus
ttctcctcactcttccttaaagtgc

SEQ ID NO: 671957 - DNA, 25 bp, Rattus norvegicus
ttctcctcactgcagcgaagcacaa

SEQ ID NO: 671958 - DNA, 25 bp, Rattus norvegicus
ttctcctcactggagcgaagcacaa

SEQ ID NO: 671959 - DNA, 25 bp, Rattus norvegicus
ttctcctcaggaaatcgcagctcct

SEQ ID NO: 671960 - DNA, 25 bp, Rattus norvegicus
ttctcctcaggatatcgcagctcct

SEQ ID NO: 671961 - DNA, 25 bp, Rattus norvegicus
ttctcctccaacattctttagattc

SEQ ID NO: 671962 - DNA, 25 bp, Rattus norvegicus
ttctcctccaactttctttagattc

SEQ ID NO: 671963 - DNA, 25 bp, Rattus norvegicus
ttctcctccagtccccagtgtgtgt

SEQ ID NO: 671964 - DNA, 25 bp, Rattus norvegicus
ttctcctccagtgcccagtgtgtgt

SEQ ID NO: 671965 - DNA, 25 bp, Rattus norvegicus
ttctcctcccagatggcgccagttg

SEQ ID NO: 671966 - DNA, 25 bp, Rattus norvegicus
ttctcctcccagttggcgccagttg

SEQ ID NO: 671967 - DNA, 25 bp, Rattus norvegicus
ttctcctccgtgaaaaactgtgtcc

SEQ ID NO: 671968 - DNA, 25 bp, Rattus norvegicus
ttctcctccgtgtaaaactgtgtcc

SEQ ID NO: 671969 - DNA, 25 bp, Rattus norvegicus
ttctcctcctcacaatatgctgtga

SEQ ID NO: 671970 - DNA, 25 bp, Rattus norvegicus
ttctcctcctcagaatatgctgtga

SEQ ID NO: 671971 - DNA, 25 bp, Rattus norvegicus
ttctcctcctccaaccaagtttatt

SEQ ID NO: 671972 - DNA, 25 bp, Rattus norvegicus
ttctcctcctcccattgaaagtgat

SEQ ID NO: 671973 - DNA, 25 bp, Rattus norvegicus
ttctcctcctccgattgaaagtgat

SEQ ID NO: 671974 - DNA, 25 bp, Rattus norvegicus
ttctcctcctcctaccaagtttatt

SEQ ID NO: 671975 - DNA, 25 bp, Rattus norvegicus
ttctcctcggctctatacactctga

SEQ ID NO: 671976 - DNA, 25 bp, Rattus norvegicus
ttctcctcggctgtatacactctga

SEQ ID NO: 671977 - DNA, 25 bp, Rattus norvegicus
ttctcctctaacacctgcggtggca

SEQ ID NO: 671978 - DNA, 25 bp, Rattus norvegicus
ttctcctctaactcctgcggtggca

SEQ ID NO: 671979 - DNA, 25 bp, Rattus norvegicus
ttctcctctcagcaattccaaatga

SEQ ID NO: 671980 - DNA, 25 bp, Rattus norvegicus
ttctcctctcaggaattccaaatga

SEQ ID NO: 671981 - DNA, 25 bp, Rattus norvegicus
ttctcctctctgaagcctgggaaga

SEQ ID NO: 671982 - DNA, 25 bp, Rattus norvegicus
ttctcctctctgtagcctgggaaga

SEQ ID NO: 671983 - DNA, 25 bp, Rattus norvegicus
ttctcctctcttagtgtctatgttt

SEQ ID NO: 671984 - DNA, 25 bp, Rattus norvegicus
ttctcctctctttgtgtctatgttt

SEQ ID NO: 671985 - DNA, 25 bp, Rattus norvegicus
ttctcctcttgaagtcctgtgaaca

SEQ ID NO: 671986 - DNA, 25 bp, Rattus norvegicus
ttctcctcttgatgtcctgtgaaca

SEQ ID NO: 671987 - DNA, 25 bp, Rattus norvegicus
ttctcctcttgtatgcagctatgct

SEQ ID NO: 671988 - DNA, 25 bp, Rattus norvegicus
ttctcctcttgtttgcagctatgct

SEQ ID NO: 671989 - DNA, 25 bp, Rattus norvegicus
ttctcctctttccaaattctttcta

SEQ ID NO: 671990 - DNA, 25 bp, Rattus norvegicus
ttctcctctttcgaaattctttcta

SEQ ID NO: 671991 - DNA, 25 bp, Rattus norvegicus
ttctcctgagaacctgtgtcacctc

SEQ ID NO: 671992 - DNA, 25 bp, Rattus norvegicus
ttctcctgagaagctgtgtcacctc

SEQ ID NO: 671993 - DNA, 25 bp, Rattus norvegicus
ttctcctgagagatgaccttaaaat

SEQ ID NO: 671994 - DNA, 25 bp, Rattus norvegicus
ttctcctgagagttgaccttaaaat

SEQ ID NO: 671995 - DNA, 25 bp, Rattus norvegicus
ttctcctgagatagtggtataccag

SEQ ID NO: 671996 - DNA, 25 bp, Rattus norvegicus
ttctcctgagattgtggtataccag

SEQ ID NO: 671997 - DNA, 25 bp, Rattus norvegicus
ttctcctgctaaacctgttgtaatg

SEQ ID NO: 671998 - DNA, 25 bp, Rattus norvegicus
ttctcctgctaatcctgttgtaatg

SEQ ID NO: 671999 - DNA, 25 bp, Rattus norvegicus
ttctcctgctatacctcattaaaca

SEQ ID NO: 672000 - DNA, 25 bp, Rattus norvegicus
ttctcctgctattcctcattaaaca

SEQ ID NO: 672001 - DNA, 25 bp, Rattus norvegicus
ttctcctgctgacctgaggctatga

SEQ ID NO: 672002 - DNA, 25 bp, Rattus norvegicus
ttctcctgctgagctgaggctatga

SEQ ID NO: 672003 - DNA, 25 bp, Rattus norvegicus
ttctcctgctgtcctgataggccga

SEQ ID NO: 672004 - DNA, 25 bp, Rattus norvegicus
ttctcctgctgtgctgataggccga

SEQ ID NO: 672005 - DNA, 25 bp, Rattus norvegicus
ttctcctgcttaagaacacgtcttt

SEQ ID NO: 672006 - DNA, 25 bp, Rattus norvegicus
ttctcctgcttatgaacacgtcttt

SEQ ID NO: 672007 - DNA, 25 bp, Rattus norvegicus
ttctcctggactcctgtgaatgagg

SEQ ID NO: 672008 - DNA, 25 bp, Rattus norvegicus
ttctcctggactgctgtgaatgagg

SEQ ID NO: 672009 - DNA, 25 bp, Rattus norvegicus
ttctcctggcaacttagggcaacag

SEQ ID NO: 672010 - DNA, 25 bp, Rattus norvegicus
ttctcctggcaagttagggcaacag

SEQ ID NO: 672011 - DNA, 25 bp, Rattus norvegicus
ttctcctgggaaatcaagcactgca

SEQ ID NO: 672012 - DNA, 25 bp, Rattus norvegicus
ttctcctgggaattcaagcactgca

SEQ ID NO: 672013 - DNA, 25 bp, Rattus norvegicus
ttctcctgggagattttcatcatgt

SEQ ID NO: 672014 - DNA, 25 bp, Rattus norvegicus
ttctcctgggagtttttcatcatgt

SEQ ID NO: 672015 - DNA, 25 bp, Rattus norvegicus
ttctcctgggtgaacagtcctgggc

SEQ ID NO: 672016 - DNA, 25 bp, Rattus norvegicus
ttctcctgggtgagggcacttgtga

SEQ ID NO: 672017 - DNA, 25 bp, Rattus norvegicus
ttctcctgggtgtacagtcctgggc

SEQ ID NO: 672018 - DNA, 25 bp, Rattus norvegicus
ttctcctgggtgtgggcacttgtga

SEQ ID NO: 672019 - DNA, 25 bp, Rattus norvegicus
ttctcctgtcttctttgtcttcatt

SEQ ID NO: 672020 - DNA, 25 bp, Rattus norvegicus
ttctcctgtcttgtttgtcttcatt

SEQ ID NO: 672021 - DNA, 25 bp, Rattus norvegicus
ttctcctgtgaaactgtctaggaac

SEQ ID NO: 672022 - DNA, 25 bp, Rattus norvegicus
ttctcctgtgaatctgtctaggaac

SEQ ID NO: 672023 - DNA, 25 bp, Rattus norvegicus
ttctcctgtgccatgactggatcaa

SEQ ID NO: 672024 - DNA, 25 bp, Rattus norvegicus
ttctcctgtgccttgactggatcaa

SEQ ID NO: 672025 - DNA, 25 bp, Rattus norvegicus
ttctcctgtgtcctgcaggtggctc

SEQ ID NO: 672026 - DNA, 25 bp, Rattus norvegicus
ttctcctgtgtcgtgcaggtggctc

SEQ ID NO: 672027 - DNA, 25 bp, Rattus norvegicus
ttctcctgttgcaccatcggataaa

SEQ ID NO: 672028 - DNA, 25 bp, Rattus norvegicus
ttctcctgttgctccatcggataaa

SEQ ID NO: 672029 - DNA, 25 bp, Rattus norvegicus
ttctcctgttgtaattcttgtctcg

SEQ ID NO: 672030 - DNA, 25 bp, Rattus norvegicus
ttctcctgttgttattcttgtctcg

SEQ ID NO: 672031 - DNA, 25 bp, Rattus norvegicus
ttctccttaaaactgtttcacaagt

SEQ ID NO: 672032 - DNA, 25 bp, Rattus norvegicus
ttctccttaaaagtgtttcacaagt

SEQ ID NO: 672033 - DNA, 25 bp, Rattus norvegicus
ttctccttagcccatatttgtttct

SEQ ID NO: 672034 - DNA, 25 bp, Rattus norvegicus
ttctccttagccgatatttgtttct

SEQ ID NO: 672035 - DNA, 25 bp, Rattus norvegicus
ttctccttaggcctttcacaggtag

SEQ ID NO: 672036 - DNA, 25 bp, Rattus norvegicus
ttctccttaggcgtttcacaggtag

SEQ ID NO: 672037 - DNA, 25 bp, Rattus norvegicus
ttctccttcaaaatggcgcatcgtg

SEQ ID NO: 672038 - DNA, 25 bp, Rattus norvegicus
ttctccttcaaattggcgcatcgtg

SEQ ID NO: 672039 - DNA, 25 bp, Rattus norvegicus
ttctccttcaacaaaggaactcagg

SEQ ID NO: 672040 - DNA, 25 bp, Rattus norvegicus
ttctccttcaactaaggaactcagg

SEQ ID NO: 672041 - DNA, 25 bp, Rattus norvegicus
ttctccttcctcagtttcaagtaga

SEQ ID NO: 672042 - DNA, 25 bp, Rattus norvegicus
ttctccttcctctgtttcaagtaga

SEQ ID NO: 672043 - DNA, 25 bp, Rattus norvegicus
ttctccttcgcgctggaacaagaca

SEQ ID NO: 672044 - DNA, 25 bp, Rattus norvegicus
ttctccttcgcggtggaacaagaca

SEQ ID NO: 672045 - DNA, 25 bp, Rattus norvegicus
ttctccttctctcggtaccaactga

SEQ ID NO: 672046 - DNA, 25 bp, Rattus norvegicus
ttctccttctctgggtaccaactga

SEQ ID NO: 672047 - DNA, 25 bp, Rattus norvegicus
ttctccttctgtaactgttttccta

SEQ ID NO: 672048 - DNA, 25 bp, Rattus norvegicus
ttctccttctgtactcagtggttat

SEQ ID NO: 672049 - DNA, 25 bp, Rattus norvegicus
ttctccttctgtagccttattatta

SEQ ID NO: 672050 - DNA, 25 bp, Rattus norvegicus
ttctccttctgttactgttttccta

SEQ ID NO: 672051 - DNA, 25 bp, Rattus norvegicus
ttctccttctgttctcagtggttat

SEQ ID NO: 672052 - DNA, 25 bp, Rattus norvegicus
ttctccttctgttgccttattatta

SEQ ID NO: 672053 - DNA, 25 bp, Rattus norvegicus
ttctccttgcaacctggattcacac

SEQ ID NO: 672054 - DNA, 25 bp, Rattus norvegicus
ttctccttgcaagctggattcacac

SEQ ID NO: 672055 - DNA, 25 bp, Rattus norvegicus
ttctccttggaaatgctgggcctgt

SEQ ID NO: 672056 - DNA, 25 bp, Rattus norvegicus
ttctccttggaattgctgggcctgt

SEQ ID NO: 672057 - DNA, 25 bp, Rattus norvegicus
ttctcctttcatacagtttccatgg

SEQ ID NO: 672058 - DNA, 25 bp, Rattus norvegicus
ttctcctttcattcagtttccatgg

SEQ ID NO: 672059 - DNA, 25 bp, Rattus norvegicus
ttctcctttgctacttgactcaggt

SEQ ID NO: 672060 - DNA, 25 bp, Rattus norvegicus
ttctcctttgcttcttgactcaggt

SEQ ID NO: 672061 - DNA, 25 bp, Rattus norvegicus
ttctcctttgtgactgtgtatccag

SEQ ID NO: 672062 - DNA, 25 bp, Rattus norvegicus
ttctcctttgtgtctgtgtatccag

SEQ ID NO: 672063 - DNA, 25 bp, Rattus norvegicus
ttctccttttctcggaagacaaatt

SEQ ID NO: 672064 - DNA, 25 bp, Rattus norvegicus
ttctccttttctgggaagacaaatt

SEQ ID NO: 672065 - DNA, 25 bp, Rattus norvegicus
ttctccttttgcattaatggtccca

SEQ ID NO: 672066 - DNA, 25 bp, Rattus norvegicus
ttctccttttgctttaatggtccca

SEQ ID NO: 672067 - DNA, 25 bp, Rattus norvegicus
ttctcgaaaccaccctgtgtacaaa

SEQ ID NO: 672068 - DNA, 25 bp, Rattus norvegicus
ttctcgaaaccagcctgtgtacaaa

SEQ ID NO: 672069 - DNA, 25 bp, Rattus norvegicus
ttctcgaagctgaaacctcttgtcg

SEQ ID NO: 672070 - DNA, 25 bp, Rattus norvegicus
ttctcgaagctgtaacctcttgtcg

SEQ ID NO: 672071 - DNA, 25 bp, Rattus norvegicus
ttctcgacccttcaaggcaggcctg

SEQ ID NO: 672072 - DNA, 25 bp, Rattus norvegicus
ttctcgacccttgaaggcaggcctg

SEQ ID NO: 672073 - DNA, 25 bp, Rattus norvegicus
ttctcgaccgaaacgtggctgtcta

SEQ ID NO: 672074 - DNA, 25 bp, Rattus norvegicus
ttctcgaccgaatcgtggctgtcta

SEQ ID NO: 672075 - DNA, 25 bp, Rattus norvegicus
ttctcgagtaccagacatccaacat

SEQ ID NO: 672076 - DNA, 25 bp, Rattus norvegicus
ttctcgagtacctgacatccaacat

SEQ ID NO: 672077 - DNA, 25 bp, Rattus norvegicus
ttctcgagttctaccacagtgaatc

SEQ ID NO: 672078 - DNA, 25 bp, Rattus norvegicus
ttctcgagttcttccacagtgaatc

SEQ ID NO: 672079 - DNA, 25 bp, Rattus norvegicus
ttctcgatctttacttctgatttct

SEQ ID NO: 672080 - DNA, 25 bp, Rattus norvegicus
ttctcgatcttttcttctgatttct

SEQ ID NO: 672081 - DNA, 25 bp, Rattus norvegicus
ttctcgattcctatgcttggttgat

SEQ ID NO: 672082 - DNA, 25 bp, Rattus norvegicus
ttctcgattcctttgcttggttgat

SEQ ID NO: 672083 - DNA, 25 bp, Rattus norvegicus
ttctcgccaccgcaaggaggtagac

SEQ ID NO: 672084 - DNA, 25 bp, Rattus norvegicus
ttctcgccaccggaaggaggtagac

SEQ ID NO: 672085 - DNA, 25 bp, Rattus norvegicus
ttctcgccattcacctggatttagt

SEQ ID NO: 672086 - DNA, 25 bp, Rattus norvegicus
ttctcgccattctcctggatttagt

SEQ ID NO: 672087 - DNA, 25 bp, Rattus norvegicus
ttctcgcccctgacggtgagcgcgg

SEQ ID NO: 672088 - DNA, 25 bp, Rattus norvegicus
ttctcgcccctgtcggtgagcgcgg

SEQ ID NO: 672089 - DNA, 25 bp, Rattus norvegicus
ttctcgcctaggcagttgaccaaag

SEQ ID NO: 672090 - DNA, 25 bp, Rattus norvegicus
ttctcgcctagggagttgaccaaag

SEQ ID NO: 672091 - DNA, 25 bp, Rattus norvegicus
ttctcgcctatgattttcttctttg

SEQ ID NO: 672092 - DNA, 25 bp, Rattus norvegicus
ttctcgcctatgtttttcttctttg

SEQ ID NO: 672093 - DNA, 25 bp, Rattus norvegicus
ttctcgctgcaaatgtgctgctcaa

SEQ ID NO: 672094 - DNA, 25 bp, Rattus norvegicus
ttctcgctgcaattgtgctgctcaa

SEQ ID NO: 672095 - DNA, 25 bp, Rattus norvegicus
ttctcgctgctgacggatggtgtga

SEQ ID NO: 672096 - DNA, 25 bp, Rattus norvegicus
ttctcgctgctgtcggatggtgtga

SEQ ID NO: 672097 - DNA, 25 bp, Rattus norvegicus
ttctcgctggtaacatagcccagtg

SEQ ID NO: 672098 - DNA, 25 bp, Rattus norvegicus
ttctcgctggtatcatagcccagtg

SEQ ID NO: 672099 - DNA, 25 bp, Rattus norvegicus
ttctcgcttagtccagtgatgtcct

SEQ ID NO: 672100 - DNA, 25 bp, Rattus norvegicus
ttctcgcttagtgcagtgatgtcct

SEQ ID NO: 672101 - DNA, 25 bp, Rattus norvegicus
ttctcggaccatacaactgcagatt

SEQ ID NO: 672102 - DNA, 25 bp, Rattus norvegicus
ttctcggaccattcaactgcagatt

SEQ ID NO: 672103 - DNA, 25 bp, Rattus norvegicus
ttctcggacctcaagcgaatacaag

SEQ ID NO: 672104 - DNA, 25 bp, Rattus norvegicus
ttctcggacctctagcgaatacaag

SEQ ID NO: 672105 - DNA, 25 bp, Rattus norvegicus
ttctcggagccactttgagactgtc

SEQ ID NO: 672106 - DNA, 25 bp, Rattus norvegicus
ttctcggagccagtttgagactgtc

SEQ ID NO: 672107 - DNA, 25 bp, Rattus norvegicus
ttctcggcagagactgttttccaaa

SEQ ID NO: 672108 - DNA, 25 bp, Rattus norvegicus
ttctcggcagagtctgttttccaaa

SEQ ID NO: 672109 - DNA, 25 bp, Rattus norvegicus
ttctcggccctgacagaagtgcttt

SEQ ID NO: 672110 - DNA, 25 bp, Rattus norvegicus
ttctcggccctgtcagaagtgcttt

SEQ ID NO: 672111 - DNA, 25 bp, Rattus norvegicus
ttctcggccggcagcggttcaatga

SEQ ID NO: 672112 - DNA, 25 bp, Rattus norvegicus
ttctcggccggctgcggttcaatga

SEQ ID NO: 672113 - DNA, 25 bp, Rattus norvegicus
ttctcggccgtcaggaagccgccgg

SEQ ID NO: 672114 - DNA, 25 bp, Rattus norvegicus
ttctcggccgtctggaagccgccgg

SEQ ID NO: 672115 - DNA, 25 bp, Rattus norvegicus
ttctcggcgcagacatgacaacagg

SEQ ID NO: 672116 - DNA, 25 bp, Rattus norvegicus
ttctcggcgcagtcatgacaacagg

SEQ ID NO: 672117 - DNA, 25 bp, Rattus norvegicus
ttctcggcggacagactgaagttgg

SEQ ID NO: 672118 - DNA, 25 bp, Rattus norvegicus
ttctcggcggactgactgaagttgg

SEQ ID NO: 672119 - DNA, 25 bp, Rattus norvegicus
ttctcgggcctgagaagtccatcca

SEQ ID NO: 672120 - DNA, 25 bp, Rattus norvegicus
ttctcgggcctgtgaagtccatcca

SEQ ID NO: 672121 - DNA, 25 bp, Rattus norvegicus
ttctcgggctttctacactaggtct

SEQ ID NO: 672122 - DNA, 25 bp, Rattus norvegicus
ttctcgggctttgtacactaggtct

SEQ ID NO: 672123 - DNA, 25 bp, Rattus norvegicus
ttctcggggcgtctgcgtctccagt

SEQ ID NO: 672124 - DNA, 25 bp, Rattus norvegicus
ttctcggggcgtgtgcgtctccagt

SEQ ID NO: 672125 - DNA, 25 bp, Rattus norvegicus
ttctcgggtgggatgaggaattcac

SEQ ID NO: 672126 - DNA, 25 bp, Rattus norvegicus
ttctcgggtgggttgaggaattcac

SEQ ID NO: 672127 - DNA, 25 bp, Rattus norvegicus
ttctcggtcgttagttctctcaaaa

SEQ ID NO: 672128 - DNA, 25 bp, Rattus norvegicus
ttctcggtcgtttgttctctcaaaa

SEQ ID NO: 672129 - DNA, 25 bp, Rattus norvegicus
ttctcgtgagctaaggcccaagccc

SEQ ID NO: 672130 - DNA, 25 bp, Rattus norvegicus
ttctcgtgagcttaggcccaagccc

SEQ ID NO: 672131 - DNA, 25 bp, Rattus norvegicus
ttctcgtgatggcacaggttctcta

SEQ ID NO: 672132 - DNA, 25 bp, Rattus norvegicus
ttctcgtgatgggacaggttctcta

SEQ ID NO: 672133 - DNA, 25 bp, Rattus norvegicus
ttctcgtgctcgctcaaacatttaa

SEQ ID NO: 672134 - DNA, 25 bp, Rattus norvegicus
ttctcgtgctcggtcaaacatttaa

SEQ ID NO: 672135 - DNA, 25 bp, Rattus norvegicus
ttctcgtgtatactttcaggtctca

SEQ ID NO: 672136 - DNA, 25 bp, Rattus norvegicus
ttctcgtgtatagtttcaggtctca

SEQ ID NO: 672137 - DNA, 25 bp, Rattus norvegicus
ttctcgtgttatcaagacctacctc

SEQ ID NO: 672138 - DNA, 25 bp, Rattus norvegicus
ttctcgtgttatgaagacctacctc

SEQ ID NO: 672139 - DNA, 25 bp, Rattus norvegicus
ttctcgtgtttcaggaagggttctt

SEQ ID NO: 672140 - DNA, 25 bp, Rattus norvegicus
ttctcgtgtttctggaagggttctt

SEQ ID NO: 672141 - DNA, 25 bp, Rattus norvegicus
ttctctaacattaggatctgtcctg

SEQ ID NO: 672142 - DNA, 25 bp, Rattus norvegicus
ttctctaacatttggatctgtcctg

SEQ ID NO: 672143 - DNA, 25 bp, Rattus norvegicus
ttctctaaccctcgattgccggaga

SEQ ID NO: 672144 - DNA, 25 bp, Rattus norvegicus
ttctctaaccctggattgccggaga

SEQ ID NO: 672145 - DNA, 25 bp, Rattus norvegicus
ttctctaaggcgacagccagcagct

SEQ ID NO: 672146 - DNA, 25 bp, Rattus norvegicus
ttctctaaggcgtcagccagcagct

SEQ ID NO: 672147 - DNA, 25 bp, Rattus norvegicus
ttctctaatttcatggcctggagtg

SEQ ID NO: 672148 - DNA, 25 bp, Rattus norvegicus
ttctctaatttcatgtccacttggg

SEQ ID NO: 672149 - DNA, 25 bp, Rattus norvegicus
ttctctaatttcttggcctggagtg

SEQ ID NO: 672150 - DNA, 25 bp, Rattus norvegicus
ttctctaatttcttgtccacttggg

SEQ ID NO: 672151 - DNA, 25 bp, Rattus norvegicus
ttctctacaaggaccagggctacca

SEQ ID NO: 672152 - DNA, 25 bp, Rattus norvegicus
ttctctacaaggtccagggctacca

SEQ ID NO: 672153 - DNA, 25 bp, Rattus norvegicus
ttctctacacttaccaggctgttgt

SEQ ID NO: 672154 - DNA, 25 bp, Rattus norvegicus
ttctctacactttccaggctgttgt

SEQ ID NO: 672155 - DNA, 25 bp, Rattus norvegicus
ttctctacagagactttgtttcaaa

SEQ ID NO: 672156 - DNA, 25 bp, Rattus norvegicus
ttctctacagagtctttgtttcaaa

SEQ ID NO: 672157 - DNA, 25 bp, Rattus norvegicus
ttctctacagatagccctggcagtt

SEQ ID NO: 672158 - DNA, 25 bp, Rattus norvegicus
ttctctacagattgccctggcagtt

SEQ ID NO: 672159 - DNA, 25 bp, Rattus norvegicus
ttctctaccacactttttctgcagg

SEQ ID NO: 672160 - DNA, 25 bp, Rattus norvegicus
ttctctaccacagtttttctgcagg

SEQ ID NO: 672161 - DNA, 25 bp, Rattus norvegicus
ttctctacccatagggttcctgctc

SEQ ID NO: 672162 - DNA, 25 bp, Rattus norvegicus
ttctctacccattgggttcctgctc

SEQ ID NO: 672163 - DNA, 25 bp, Rattus norvegicus
ttctctaccctgcagtttctatata

SEQ ID NO: 672164 - DNA, 25 bp, Rattus norvegicus
ttctctaccctggagtttctatata

SEQ ID NO: 672165 - DNA, 25 bp, Rattus norvegicus
ttctctaccgaccacgtgcatggga

SEQ ID NO: 672166 - DNA, 25 bp, Rattus norvegicus
ttctctaccgacgacgtgcatggga

SEQ ID NO: 672167 - DNA, 25 bp, Rattus norvegicus
ttctctactctgaggacatagtcga

SEQ ID NO: 672168 - DNA, 25 bp, Rattus norvegicus
ttctctactctgatctgtctgtggg

SEQ ID NO: 672169 - DNA, 25 bp, Rattus norvegicus
ttctctactctgtggacatagtcga

SEQ ID NO: 672170 - DNA, 25 bp, Rattus norvegicus
ttctctactctgttctgtctgtggg

SEQ ID NO: 672171 - DNA, 25 bp, Rattus norvegicus
ttctctactgacacacgcattttat

SEQ ID NO: 672172 - DNA, 25 bp, Rattus norvegicus
ttctctactgactcacgcattttat

SEQ ID NO: 672173 - DNA, 25 bp, Rattus norvegicus
ttctctactgccatatctggattgt

SEQ ID NO: 672174 - DNA, 25 bp, Rattus norvegicus
ttctctactgccttatctggattgt

SEQ ID NO: 672175 - DNA, 25 bp, Rattus norvegicus
ttctctactttgagttcctggtgat

SEQ ID NO: 672176 - DNA, 25 bp, Rattus norvegicus
ttctctactttgtgttcctggtgat

SEQ ID NO: 672177 - DNA, 25 bp, Rattus norvegicus
ttctctagaagtattcctatctctg

SEQ ID NO: 672178 - DNA, 25 bp, Rattus norvegicus
ttctctagaagttttcctatctctg

SEQ ID NO: 672179 - DNA, 25 bp, Rattus norvegicus
ttctctagagggactaggtctgccc

SEQ ID NO: 672180 - DNA, 25 bp, Rattus norvegicus
ttctctagagggtctaggtctgccc

SEQ ID NO: 672181 - DNA, 25 bp, Rattus norvegicus
ttctctagcactcctctattgttag

SEQ ID NO: 672182 - DNA, 25 bp, Rattus norvegicus
ttctctagcactgctctattgttag

SEQ ID NO: 672183 - DNA, 25 bp, Rattus norvegicus
ttctctagcctcatggatgccgacg

SEQ ID NO: 672184 - DNA, 25 bp, Rattus norvegicus
ttctctagcctcttggatgccgacg

SEQ ID NO: 672185 - DNA, 25 bp, Rattus norvegicus
ttctctaggcttctacaccaggtgt

SEQ ID NO: 672186 - DNA, 25 bp, Rattus norvegicus
ttctctaggcttgtacaccaggtgt

SEQ ID NO: 672187 - DNA, 25 bp, Rattus norvegicus
ttctctagggctaattgctctgcat

SEQ ID NO: 672188 - DNA, 25 bp, Rattus norvegicus
ttctctagggcttattgctctgcat

SEQ ID NO: 672189 - DNA, 25 bp, Rattus norvegicus
ttctctagtatgcatgaagcccaga

SEQ ID NO: 672190 - DNA, 25 bp, Rattus norvegicus
ttctctagtatggatgaagcccaga

SEQ ID NO: 672191 - DNA, 25 bp, Rattus norvegicus
ttctctagtctgatcctttgggaag

SEQ ID NO: 672192 - DNA, 25 bp, Rattus norvegicus
ttctctagtctgttcctttgggaag

SEQ ID NO: 672193 - DNA, 25 bp, Rattus norvegicus
ttctctatagccacccagggaatga

SEQ ID NO: 672194 - DNA, 25 bp, Rattus norvegicus
ttctctatagcctcccagggaatga

SEQ ID NO: 672195 - DNA, 25 bp, Rattus norvegicus
ttctctatctaccttccagcagatg

SEQ ID NO: 672196 - DNA, 25 bp, Rattus norvegicus
ttctctatctacgttccagcagatg

SEQ ID NO: 672197 - DNA, 25 bp, Rattus norvegicus
ttctctatctgcctccatactggtg

SEQ ID NO: 672198 - DNA, 25 bp, Rattus norvegicus
ttctctatctgcgtccatactggtg

SEQ ID NO: 672199 - DNA, 25 bp, Rattus norvegicus
ttctctatgcacagctgcgatcaca

SEQ ID NO: 672200 - DNA, 25 bp, Rattus norvegicus
ttctctatgcactgctgcgatcaca

SEQ ID NO: 672201 - DNA, 25 bp, Rattus norvegicus
ttctctattttcatccttctttcca

SEQ ID NO: 672202 - DNA, 25 bp, Rattus norvegicus
ttctctattttcttccttctttcca

SEQ ID NO: 672203 - DNA, 25 bp, Rattus norvegicus
ttctctcaaagactcccaacattag

SEQ ID NO: 672204 - DNA, 25 bp, Rattus norvegicus
ttctctcaaagagtcccaacattag

SEQ ID NO: 672205 - DNA, 25 bp, Rattus norvegicus
ttctctcaccttcaaagactcgaca

SEQ ID NO: 672206 - DNA, 25 bp, Rattus norvegicus
ttctctcaccttgaaagactcgaca

SEQ ID NO: 672207 - DNA, 25 bp, Rattus norvegicus
ttctctcactcaactttctttatat

SEQ ID NO: 672208 - DNA, 25 bp, Rattus norvegicus
ttctctcactcatctttctttatat

SEQ ID NO: 672209 - DNA, 25 bp, Rattus norvegicus
ttctctcagaaccaagcgggcattg

SEQ ID NO: 672210 - DNA, 25 bp, Rattus norvegicus
ttctctcagaacgaagcgggcattg

SEQ ID NO: 672211 - DNA, 25 bp, Rattus norvegicus
ttctctcaggccatatgacaattgg

SEQ ID NO: 672212 - DNA, 25 bp, Rattus norvegicus
ttctctcaggccttatgacaattgg

SEQ ID NO: 672213 - DNA, 25 bp, Rattus norvegicus
ttctctcagtgcctggaggatgcag

SEQ ID NO: 672214 - DNA, 25 bp, Rattus norvegicus
ttctctcagtgcgtggaggatgcag

SEQ ID NO: 672215 - DNA, 25 bp, Rattus norvegicus
ttctctcagtttcttgaatgctcag

SEQ ID NO: 672216 - DNA, 25 bp, Rattus norvegicus
ttctctcagtttgttgaatgctcag

SEQ ID NO: 672217 - DNA, 25 bp, Rattus norvegicus
ttctctcatccacggttgagggtct

SEQ ID NO: 672218 - DNA, 25 bp, Rattus norvegicus
ttctctcatccagggttgagggtct

SEQ ID NO: 672219 - DNA, 25 bp, Rattus norvegicus
ttctctccacggctattgctaggat

SEQ ID NO: 672220 - DNA, 25 bp, Rattus norvegicus
ttctctccacgggtattgctaggat

SEQ ID NO: 672221 - DNA, 25 bp, Rattus norvegicus
ttctctccagctctaaccttgtata

SEQ ID NO: 672222 - DNA, 25 bp, Rattus norvegicus
ttctctccagctgtaaccttgtata

SEQ ID NO: 672223 - DNA, 25 bp, Rattus norvegicus
ttctctccatgcctaactcgggcag

SEQ ID NO: 672224 - DNA, 25 bp, Rattus norvegicus
ttctctccatgcgtaactcgggcag

SEQ ID NO: 672225 - DNA, 25 bp, Rattus norvegicus
ttctctccattcatagctgtagtca

SEQ ID NO: 672226 - DNA, 25 bp, Rattus norvegicus
ttctctccattcttagctgtagtca

SEQ ID NO: 672227 - DNA, 25 bp, Rattus norvegicus
ttctctccattgcttcttagaagtc

SEQ ID NO: 672228 - DNA, 25 bp, Rattus norvegicus
ttctctccattggttcttagaagtc

SEQ ID NO: 672229 - DNA, 25 bp, Rattus norvegicus
ttctctccccatattttaacgagcg

SEQ ID NO: 672230 - DNA, 25 bp, Rattus norvegicus
ttctctccccattttttaacgagcg

SEQ ID NO: 672231 - DNA, 25 bp, Rattus norvegicus
ttctctccccgtaagggtgtgaacg

SEQ ID NO: 672232 - DNA, 25 bp, Rattus norvegicus
ttctctccccgttagggtgtgaacg

SEQ ID NO: 672233 - DNA, 25 bp, Rattus norvegicus
ttctctcccctcaaaacctgggagg

SEQ ID NO: 672234 - DNA, 25 bp, Rattus norvegicus
ttctctcccctctaaacctgggagg

SEQ ID NO: 672235 - DNA, 25 bp, Rattus norvegicus
ttctctcccggccagtggctgagct

SEQ ID NO: 672236 - DNA, 25 bp, Rattus norvegicus
ttctctcccggcgagtggctgagct

SEQ ID NO: 672237 - DNA, 25 bp, Rattus norvegicus
ttctctccctttccaataggcagat

SEQ ID NO: 672238 - DNA, 25 bp, Rattus norvegicus
ttctctccctttgcaataggcagat

SEQ ID NO: 672239 - DNA, 25 bp, Rattus norvegicus
ttctctccgaacatgcataaataac

SEQ ID NO: 672240 - DNA, 25 bp, Rattus norvegicus
ttctctccgaacttgcataaataac

SEQ ID NO: 672241 - DNA, 25 bp, Rattus norvegicus
ttctctccggagatcagtttaaagt

SEQ ID NO: 672242 - DNA, 25 bp, Rattus norvegicus
ttctctccggagttcagtttaaagt

SEQ ID NO: 672243 - DNA, 25 bp, Rattus norvegicus
ttctctccgggcaggagctggccga

SEQ ID NO: 672244 - DNA, 25 bp, Rattus norvegicus
ttctctccgggctggagctggccga

SEQ ID NO: 672245 - DNA, 25 bp, Rattus norvegicus
ttctctccggttagttatctgcagt

SEQ ID NO: 672246 - DNA, 25 bp, Rattus norvegicus
ttctctccggtttgttatctgcagt

SEQ ID NO: 672247 - DNA, 25 bp, Rattus norvegicus
ttctctccgtatattctgaacacag

SEQ ID NO: 672248 - DNA, 25 bp, Rattus norvegicus
ttctctccgtattttctgaacacag

SEQ ID NO: 672249 - DNA, 25 bp, Rattus norvegicus
ttctctcctaccatcagagtcatgg

SEQ ID NO: 672250 - DNA, 25 bp, Rattus norvegicus
ttctctcctaccttcagagtcatgg

SEQ ID NO: 672251 - DNA, 25 bp, Rattus norvegicus
ttctctcctataatttgttcctgca

SEQ ID NO: 672252 - DNA, 25 bp, Rattus norvegicus
ttctctcctatattttgttcctgca

SEQ ID NO: 672253 - DNA, 25 bp, Rattus norvegicus
ttctctcctatccacaatagcttgt

SEQ ID NO: 672254 - DNA, 25 bp, Rattus norvegicus
ttctctcctatcgacaatagcttgt

SEQ ID NO: 672255 - DNA, 25 bp, Rattus norvegicus
ttctctcctattagttcttcttcaa

SEQ ID NO: 672256 - DNA, 25 bp, Rattus norvegicus
ttctctcctatttgttcttcttcaa

SEQ ID NO: 672257 - DNA, 25 bp, Rattus norvegicus
ttctctcctctaagtcttttctgtc

SEQ ID NO: 672258 - DNA, 25 bp, Rattus norvegicus
ttctctcctctatgtcttttctgtc

SEQ ID NO: 672259 - DNA, 25 bp, Rattus norvegicus
ttctctcctgagctgccaaatcgaa

SEQ ID NO: 672260 - DNA, 25 bp, Rattus norvegicus
ttctctcctgaggtgccaaatcgaa

SEQ ID NO: 672261 - DNA, 25 bp, Rattus norvegicus
ttctctcctggaagctcttgattat

SEQ ID NO: 672262 - DNA, 25 bp, Rattus norvegicus
ttctctcctggacagcatctctggg

SEQ ID NO: 672263 - DNA, 25 bp, Rattus norvegicus
ttctctcctggagagcatctctggg

SEQ ID NO: 672264 - DNA, 25 bp, Rattus norvegicus
ttctctcctggatgctcttgattat

SEQ ID NO: 672265 - DNA, 25 bp, Rattus norvegicus
ttctctcctggccagttaattggtt

SEQ ID NO: 672266 - DNA, 25 bp, Rattus norvegicus
ttctctcctggcctttaaaatttag

SEQ ID NO: 672267 - DNA, 25 bp, Rattus norvegicus
ttctctcctggcgagttaattggtt

SEQ ID NO: 672268 - DNA, 25 bp, Rattus norvegicus
ttctctcctggcgtttaaaatttag

SEQ ID NO: 672269 - DNA, 25 bp, Rattus norvegicus
ttctctcctgtcaaggttttcatga

SEQ ID NO: 672270 - DNA, 25 bp, Rattus norvegicus
ttctctcctgtctaggttttcatga

SEQ ID NO: 672271 - DNA, 25 bp, Rattus norvegicus
ttctctcgagagattcctgcagaca

SEQ ID NO: 672272 - DNA, 25 bp, Rattus norvegicus
ttctctcgagagtttcctgcagaca

SEQ ID NO: 672273 - DNA, 25 bp, Rattus norvegicus
ttctctcgagcaccattgaccgaac

SEQ ID NO: 672274 - DNA, 25 bp, Rattus norvegicus
ttctctcgagcagcattgaccgaac

SEQ ID NO: 672275 - DNA, 25 bp, Rattus norvegicus
ttctctcggctcatacactcgtatg

SEQ ID NO: 672276 - DNA, 25 bp, Rattus norvegicus
ttctctcggctcttacactcgtatg

SEQ ID NO: 672277 - DNA, 25 bp, Rattus norvegicus
ttctctcgtctgaggctgaccaagg

SEQ ID NO: 672278 - DNA, 25 bp, Rattus norvegicus
ttctctcgtctgtggctgaccaagg

SEQ ID NO: 672279 - DNA, 25 bp, Rattus norvegicus
ttctctctagaaatctgttccttga

SEQ ID NO: 672280 - DNA, 25 bp, Rattus norvegicus
ttctctctagaacatctctgctgtt

SEQ ID NO: 672281 - DNA, 25 bp, Rattus norvegicus
ttctctctagaagatctctgctgtt

SEQ ID NO: 672282 - DNA, 25 bp, Rattus norvegicus
ttctctctagaattctgttccttga

SEQ ID NO: 672283 - DNA, 25 bp, Rattus norvegicus
ttctctctataactcccatctttgg

SEQ ID NO: 672284 - DNA, 25 bp, Rattus norvegicus
ttctctctataagtcccatctttgg

SEQ ID NO: 672285 - DNA, 25 bp, Rattus norvegicus
ttctctctcagacccctttgcagag

SEQ ID NO: 672286 - DNA, 25 bp, Rattus norvegicus
ttctctctcagagccctttgcagag

SEQ ID NO: 672287 - DNA, 25 bp, Rattus norvegicus
ttctctctccagacttgattacagg

SEQ ID NO: 672288 - DNA, 25 bp, Rattus norvegicus
ttctctctccagtcttgattacagg

SEQ ID NO: 672289 - DNA, 25 bp, Rattus norvegicus
ttctctctcctgagtcaatgacgga

SEQ ID NO: 672290 - DNA, 25 bp, Rattus norvegicus
ttctctctcctgtgtcaatgacgga

SEQ ID NO: 672291 - DNA, 25 bp, Rattus norvegicus
ttctctctccttatacttcttgtaa

SEQ ID NO: 672292 - DNA, 25 bp, Rattus norvegicus
ttctctctccttttacttcttgtaa

SEQ ID NO: 672293 - DNA, 25 bp, Rattus norvegicus
ttctctctctaaagcacatctctat

SEQ ID NO: 672294 - DNA, 25 bp, Rattus norvegicus
ttctctctctaaagtgcaacaagga

SEQ ID NO: 672295 - DNA, 25 bp, Rattus norvegicus
ttctctctctaatgcacatctctat

SEQ ID NO: 672296 - DNA, 25 bp, Rattus norvegicus
ttctctctctaatgtgcaacaagga

SEQ ID NO: 672297 - DNA, 25 bp, Rattus norvegicus
ttctctctctctcaaaactgctatc

SEQ ID NO: 672298 - DNA, 25 bp, Rattus norvegicus
ttctctctctctcttggaatgacaa

SEQ ID NO: 672299 - DNA, 25 bp, Rattus norvegicus
ttctctctctctgaaaactgctatc

SEQ ID NO: 672300 - DNA, 25 bp, Rattus norvegicus
ttctctctctctgttggaatgacaa

SEQ ID NO: 672301 - DNA, 25 bp, Rattus norvegicus
ttctctctctgtccccagaaaagag

SEQ ID NO: 672302 - DNA, 25 bp, Rattus norvegicus
ttctctctctgtgcccagaaaagag

SEQ ID NO: 672303 - DNA, 25 bp, Rattus norvegicus
ttctctctcttgatctttttaaaga

SEQ ID NO: 672304 - DNA, 25 bp, Rattus norvegicus
ttctctctcttgttctttttaaaga

SEQ ID NO: 672305 - DNA, 25 bp, Rattus norvegicus
ttctctctctttacctggagttaat

SEQ ID NO: 672306 - DNA, 25 bp, Rattus norvegicus
ttctctctcttttcctggagttaat

SEQ ID NO: 672307 - DNA, 25 bp, Rattus norvegicus
ttctctctgaaacctatctatcccg

SEQ ID NO: 672308 - DNA, 25 bp, Rattus norvegicus
ttctctctgaaagctatctatcccg

SEQ ID NO: 672309 - DNA, 25 bp, Rattus norvegicus
ttctctctgagcagtcgatgtggtg

SEQ ID NO: 672310 - DNA, 25 bp, Rattus norvegicus
ttctctctgagctgtcgatgtggtg

SEQ ID NO: 672311 - DNA, 25 bp, Rattus norvegicus
ttctctctgatgacctaacttgtaa

SEQ ID NO: 672312 - DNA, 25 bp, Rattus norvegicus
ttctctctgatgtcctaacttgtaa

SEQ ID NO: 672313 - DNA, 25 bp, Rattus norvegicus
ttctctctgcaaacgcttggatcta

SEQ ID NO: 672314 - DNA, 25 bp, Rattus norvegicus
ttctctctgcaatcgcttggatcta

SEQ ID NO: 672315 - DNA, 25 bp, Rattus norvegicus
ttctctctgcccactgggaatgtgg

SEQ ID NO: 672316 - DNA, 25 bp, Rattus norvegicus
ttctctctgccctctgggaatgtgg

SEQ ID NO: 672317 - DNA, 25 bp, Rattus norvegicus
ttctctctggcacctgaagatttaa

SEQ ID NO: 672318 - DNA, 25 bp, Rattus norvegicus
ttctctctggcagctgaagatttaa

SEQ ID NO: 672319 - DNA, 25 bp, Rattus norvegicus
ttctctctgggaaagccactcagct

SEQ ID NO: 672320 - DNA, 25 bp, Rattus norvegicus
ttctctctgggatagccactcagct

SEQ ID NO: 672321 - DNA, 25 bp, Rattus norvegicus
ttctctctgtaaagtatagccttag

SEQ ID NO: 672322 - DNA, 25 bp, Rattus norvegicus
ttctctctgtaatgtatagccttag

SEQ ID NO: 672323 - DNA, 25 bp, Rattus norvegicus
ttctctctgtgtacttggttttgtt

SEQ ID NO: 672324 - DNA, 25 bp, Rattus norvegicus
ttctctctgtgttcttggttttgtt

SEQ ID NO: 672325 - DNA, 25 bp, Rattus norvegicus
ttctctctgtttacaatcatgtctg

SEQ ID NO: 672326 - DNA, 25 bp, Rattus norvegicus
ttctctctgttttcaatcatgtctg

SEQ ID NO: 672327 - DNA, 25 bp, Rattus norvegicus
ttctctcttaaaccccgtgattcag

SEQ ID NO: 672328 - DNA, 25 bp, Rattus norvegicus
ttctctcttaaagcccgtgattcag

SEQ ID NO: 672329 - DNA, 25 bp, Rattus norvegicus
ttctctcttcccagtgaagacatcc

SEQ ID NO: 672330 - DNA, 25 bp, Rattus norvegicus
ttctctcttccctgtgaagacatcc

SEQ ID NO: 672331 - DNA, 25 bp, Rattus norvegicus
ttctctcttctacccatgctgtgca

SEQ ID NO: 672332 - DNA, 25 bp, Rattus norvegicus
ttctctcttctagccatgctgtgca

SEQ ID NO: 672333 - DNA, 25 bp, Rattus norvegicus
ttctctcttgagctgacttcacatg

SEQ ID NO: 672334 - DNA, 25 bp, Rattus norvegicus
ttctctcttgaggtgacttcacatg

SEQ ID NO: 672335 - DNA, 25 bp, Rattus norvegicus
ttctctcttgcacctacaattactt

SEQ ID NO: 672336 - DNA, 25 bp, Rattus norvegicus
ttctctcttgcagctacaattactt

SEQ ID NO: 672337 - DNA, 25 bp, Rattus norvegicus
ttctctcttgtaaggttgcccgaaa

SEQ ID NO: 672338 - DNA, 25 bp, Rattus norvegicus
ttctctcttgtatggttgcccgaaa

SEQ ID NO: 672339 - DNA, 25 bp, Rattus norvegicus
ttctctcttgtcagaggttcccaca

SEQ ID NO: 672340 - DNA, 25 bp, Rattus norvegicus
ttctctcttgtctgaggttcccaca

SEQ ID NO: 672341 - DNA, 25 bp, Rattus norvegicus
ttctctctttatactgttttgtaat

SEQ ID NO: 672342 - DNA, 25 bp, Rattus norvegicus
ttctctctttattctgttttgtaat

SEQ ID NO: 672343 - DNA, 25 bp, Rattus norvegicus
ttctctctttctcattgggttctat

SEQ ID NO: 672344 - DNA, 25 bp, Rattus norvegicus
ttctctctttctgattgggttctat

SEQ ID NO: 672345 - DNA, 25 bp, Rattus norvegicus
ttctctctttttaaagggttagcat

SEQ ID NO: 672346 - DNA, 25 bp, Rattus norvegicus
ttctctctttttctcttctgttctg

SEQ ID NO: 672347 - DNA, 25 bp, Rattus norvegicus
ttctctctttttgtcttctgttctg

SEQ ID NO: 672348 - DNA, 25 bp, Rattus norvegicus
ttctctcttttttaagggttagcat

SEQ ID NO: 672349 - DNA, 25 bp, Rattus norvegicus
ttctctgaagagatttgcgtcctgg

SEQ ID NO: 672350 - DNA, 25 bp, Rattus norvegicus
ttctctgaagagttttgcgtcctgg

SEQ ID NO: 672351 - DNA, 25 bp, Rattus norvegicus
ttctctgaagccaagatcctcttcc

SEQ ID NO: 672352 - DNA, 25 bp, Rattus norvegicus
ttctctgaagcctagatcctcttcc

SEQ ID NO: 672353 - DNA, 25 bp, Rattus norvegicus
ttctctgaaggacactgtgacccct

SEQ ID NO: 672354 - DNA, 25 bp, Rattus norvegicus
ttctctgaaggagactgtgacccct

SEQ ID NO: 672355 - DNA, 25 bp, Rattus norvegicus
ttctctgacactcgaagccctgtac

SEQ ID NO: 672356 - DNA, 25 bp, Rattus norvegicus
ttctctgacactggaagccctgtac

SEQ ID NO: 672357 - DNA, 25 bp, Rattus norvegicus
ttctctgacagtactatggtctctg

SEQ ID NO: 672358 - DNA, 25 bp, Rattus norvegicus
ttctctgacagtcggctcttctgaa

SEQ ID NO: 672359 - DNA, 25 bp, Rattus norvegicus
ttctctgacagtgggctcttctgaa

SEQ ID NO: 672360 - DNA, 25 bp, Rattus norvegicus
ttctctgacagttctatggtctctg

SEQ ID NO: 672361 - DNA, 25 bp, Rattus norvegicus
ttctctgaccttatccatccttggg

SEQ ID NO: 672362 - DNA, 25 bp, Rattus norvegicus
ttctctgaccttttccatccttggg

SEQ ID NO: 672363 - DNA, 25 bp, Rattus norvegicus
ttctctgacgatagtgcttcttgtt

SEQ ID NO: 672364 - DNA, 25 bp, Rattus norvegicus
ttctctgacgattgtgcttcttgtt

SEQ ID NO: 672365 - DNA, 25 bp, Rattus norvegicus
ttctctgactaacatcctggatctt

SEQ ID NO: 672366 - DNA, 25 bp, Rattus norvegicus
ttctctgactaagatcctggatctt

SEQ ID NO: 672367 - DNA, 25 bp, Rattus norvegicus
ttctctgactcaaactgcgggactg

SEQ ID NO: 672368 - DNA, 25 bp, Rattus norvegicus
ttctctgactcatactgcgggactg

SEQ ID NO: 672369 - DNA, 25 bp, Rattus norvegicus
ttctctgactgaatgctcaccaaga

SEQ ID NO: 672370 - DNA, 25 bp, Rattus norvegicus
ttctctgactgactctagaccctgc

SEQ ID NO: 672371 - DNA, 25 bp, Rattus norvegicus
ttctctgactgagtctagaccctgc

SEQ ID NO: 672372 - DNA, 25 bp, Rattus norvegicus
ttctctgactgattgctcaccaaga

SEQ ID NO: 672373 - DNA, 25 bp, Rattus norvegicus
ttctctgactgtcggcaagcactgc

SEQ ID NO: 672374 - DNA, 25 bp, Rattus norvegicus
ttctctgactgtgggcaagcactgc

SEQ ID NO: 672375 - DNA, 25 bp, Rattus norvegicus
ttctctgagcccatctaggtttggg

SEQ ID NO: 672376 - DNA, 25 bp, Rattus norvegicus
ttctctgagcccttctaggtttggg

SEQ ID NO: 672377 - DNA, 25 bp, Rattus norvegicus
ttctctgagccgcaagcactaaagc

SEQ ID NO: 672378 - DNA, 25 bp, Rattus norvegicus
ttctctgagccggaagcactaaagc

SEQ ID NO: 672379 - DNA, 25 bp, Rattus norvegicus
ttctctgagcctattcctggattaa

SEQ ID NO: 672380 - DNA, 25 bp, Rattus norvegicus
ttctctgagccttttcctggattaa

SEQ ID NO: 672381 - DNA, 25 bp, Rattus norvegicus
ttctctgagctaatggtgacctggt

SEQ ID NO: 672382 - DNA, 25 bp, Rattus norvegicus
ttctctgagctattggtgacctggt

SEQ ID NO: 672383 - DNA, 25 bp, Rattus norvegicus
ttctctgagctgcacccaatggtga

SEQ ID NO: 672384 - DNA, 25 bp, Rattus norvegicus
ttctctgagctggacccaatggtga

SEQ ID NO: 672385 - DNA, 25 bp, Rattus norvegicus
ttctctgaggtcagggaacgctgac

SEQ ID NO: 672386 - DNA, 25 bp, Rattus norvegicus
ttctctgaggtctgggaacgctgac

SEQ ID NO: 672387 - DNA, 25 bp, Rattus norvegicus
ttctctgagtgtagaatgttgccta

SEQ ID NO: 672388 - DNA, 25 bp, Rattus norvegicus
ttctctgagtgttgaatgttgccta

SEQ ID NO: 672389 - DNA, 25 bp, Rattus norvegicus
ttctctgatcaccattccatttttg

SEQ ID NO: 672390 - DNA, 25 bp, Rattus norvegicus
ttctctgatcacgattccatttttg

SEQ ID NO: 672391 - DNA, 25 bp, Rattus norvegicus
ttctctgatcatagatttgtttgtt

SEQ ID NO: 672392 - DNA, 25 bp, Rattus norvegicus
ttctctgatcattgatttgtttgtt

SEQ ID NO: 672393 - DNA, 25 bp, Rattus norvegicus
ttctctgcacagcactacttaacaa

SEQ ID NO: 672394 - DNA, 25 bp, Rattus norvegicus
ttctctgcacaggactacttaacaa

SEQ ID NO: 672395 - DNA, 25 bp, Rattus norvegicus
ttctctgcacatctcaggtacctgt

SEQ ID NO: 672396 - DNA, 25 bp, Rattus norvegicus
ttctctgcacatcttggttggctga

SEQ ID NO: 672397 - DNA, 25 bp, Rattus norvegicus
ttctctgcacatgtcaggtacctgt

SEQ ID NO: 672398 - DNA, 25 bp, Rattus norvegicus
ttctctgcacatgttggttggctga

SEQ ID NO: 672399 - DNA, 25 bp, Rattus norvegicus
ttctctgcagaaaccttttgtaagt

SEQ ID NO: 672400 - DNA, 25 bp, Rattus norvegicus
ttctctgcagaatccttttgtaagt

SEQ ID NO: 672401 - DNA, 25 bp, Rattus norvegicus
ttctctgcagctataccgggtaata

SEQ ID NO: 672402 - DNA, 25 bp, Rattus norvegicus
ttctctgcagctttaccgggtaata

SEQ ID NO: 672403 - DNA, 25 bp, Rattus norvegicus
ttctctgcagtgcaaagggatcgcc

SEQ ID NO: 672404 - DNA, 25 bp, Rattus norvegicus
ttctctgcagtggaaagggatcgcc

SEQ ID NO: 672405 - DNA, 25 bp, Rattus norvegicus
ttctctgccacccttatggaaactc

SEQ ID NO: 672406 - DNA, 25 bp, Rattus norvegicus
ttctctgccaccgttatggaaactc

SEQ ID NO: 672407 - DNA, 25 bp, Rattus norvegicus
ttctctgccatcaggtgtgtgctca

SEQ ID NO: 672408 - DNA, 25 bp, Rattus norvegicus
ttctctgccatctggtgtgtgctca

SEQ ID NO: 672409 - DNA, 25 bp, Rattus norvegicus
ttctctgcccaactagagctggcta

SEQ ID NO: 672410 - DNA, 25 bp, Rattus norvegicus
ttctctgcccaagtagagctggcta

SEQ ID NO: 672411 - DNA, 25 bp, Rattus norvegicus
ttctctgcccacagtaatcatgaaa

SEQ ID NO: 672412 - DNA, 25 bp, Rattus norvegicus
ttctctgcccactgtaatcatgaaa

SEQ ID NO: 672413 - DNA, 25 bp, Rattus norvegicus
ttctctgccccacattatatatttg

SEQ ID NO: 672414 - DNA, 25 bp, Rattus norvegicus
ttctctgccccagattatatatttg

SEQ ID NO: 672415 - DNA, 25 bp, Rattus norvegicus
ttctctgcccctagatgactcctaa

SEQ ID NO: 672416 - DNA, 25 bp, Rattus norvegicus
ttctctgccccttgatgactcctaa

SEQ ID NO: 672417 - DNA, 25 bp, Rattus norvegicus
ttctctgctaccagttttgcatgga

SEQ ID NO: 672418 - DNA, 25 bp, Rattus norvegicus
ttctctgctacctgttttgcatgga

SEQ ID NO: 672419 - DNA, 25 bp, Rattus norvegicus
ttctctgctgatatcctggtttgaa

SEQ ID NO: 672420 - DNA, 25 bp, Rattus norvegicus
ttctctgctgatttcctggtttgaa

SEQ ID NO: 672421 - DNA, 25 bp, Rattus norvegicus
ttctctgctgtcaaagaggcgacta

SEQ ID NO: 672422 - DNA, 25 bp, Rattus norvegicus
ttctctgctgtctaagaggcgacta

SEQ ID NO: 672423 - DNA, 25 bp, Rattus norvegicus
ttctctgctgtgataagtgggtgtc

SEQ ID NO: 672424 - DNA, 25 bp, Rattus norvegicus
ttctctgctgtgattcctttaggaa

SEQ ID NO: 672425 - DNA, 25 bp, Rattus norvegicus
ttctctgctgtgttaagtgggtgtc

SEQ ID NO: 672426 - DNA, 25 bp, Rattus norvegicus
ttctctgctgtgtttcctttaggaa

SEQ ID NO: 672427 - DNA, 25 bp, Rattus norvegicus
ttctctgcttcccaggcttctggaa

SEQ ID NO: 672428 - DNA, 25 bp, Rattus norvegicus
ttctctgcttccgaggcttctggaa

SEQ ID NO: 672429 - DNA, 25 bp, Rattus norvegicus
ttctctggaggaagagaccccacgc

SEQ ID NO: 672430 - DNA, 25 bp, Rattus norvegicus
ttctctggaggatgagaccccacgc

SEQ ID NO: 672431 - DNA, 25 bp, Rattus norvegicus
ttctctggattcacactgctgatat

SEQ ID NO: 672432 - DNA, 25 bp, Rattus norvegicus
ttctctggattctcactgctgatat

SEQ ID NO: 672433 - DNA, 25 bp, Rattus norvegicus
ttctctggcagcagcaaaccggtgc

SEQ ID NO: 672434 - DNA, 25 bp, Rattus norvegicus
ttctctggcagcagtgaccgttaca

SEQ ID NO: 672435 - DNA, 25 bp, Rattus norvegicus
ttctctggcagctgcaaaccggtgc

SEQ ID NO: 672436 - DNA, 25 bp, Rattus norvegicus
ttctctggcagctgtgaccgttaca

SEQ ID NO: 672437 - DNA, 25 bp, Rattus norvegicus
ttctctggccgcctgagggacatcc

SEQ ID NO: 672438 - DNA, 25 bp, Rattus norvegicus
ttctctggccgcgtgagggacatcc

SEQ ID NO: 672439 - DNA, 25 bp, Rattus norvegicus
ttctctggcggcagaccaagaagca

SEQ ID NO: 672440 - DNA, 25 bp, Rattus norvegicus
ttctctggcggctgaccaagaagca

SEQ ID NO: 672441 - DNA, 25 bp, Rattus norvegicus
ttctctggctctcgacgagtcacaa

SEQ ID NO: 672442 - DNA, 25 bp, Rattus norvegicus
ttctctggctctggacgagtcacaa

SEQ ID NO: 672443 - DNA, 25 bp, Rattus norvegicus
ttctctggcttaacggagaccgaga

SEQ ID NO: 672444 - DNA, 25 bp, Rattus norvegicus
ttctctggcttatcggagaccgaga

SEQ ID NO: 672445 - DNA, 25 bp, Rattus norvegicus
ttctctggcttgattcctacagtgg

SEQ ID NO: 672446 - DNA, 25 bp, Rattus norvegicus
ttctctggcttgtttcctacagtgg

SEQ ID NO: 672447 - DNA, 25 bp, Rattus norvegicus
ttctctgggactattctttgtgtga

SEQ ID NO: 672448 - DNA, 25 bp, Rattus norvegicus
ttctctgggacttttctttgtgtga

SEQ ID NO: 672449 - DNA, 25 bp, Rattus norvegicus
ttctctgggcaactgtcgggtgcta

SEQ ID NO: 672450 - DNA, 25 bp, Rattus norvegicus
ttctctgggcaagtgtcgggtgcta

SEQ ID NO: 672451 - DNA, 25 bp, Rattus norvegicus
ttctctgggccgatgattcctgaag

SEQ ID NO: 672452 - DNA, 25 bp, Rattus norvegicus
ttctctgggccgttgattcctgaag

SEQ ID NO: 672453 - DNA, 25 bp, Rattus norvegicus
ttctctgggctaatatgggttactt

SEQ ID NO: 672454 - DNA, 25 bp, Rattus norvegicus
ttctctgggctacgtcaaggtgttg

SEQ ID NO: 672455 - DNA, 25 bp, Rattus norvegicus
ttctctgggctaggtcaaggtgttg

SEQ ID NO: 672456 - DNA, 25 bp, Rattus norvegicus
ttctctgggctattatgggttactt

SEQ ID NO: 672457 - DNA, 25 bp, Rattus norvegicus
ttctctggtaacatggctcatgtct

SEQ ID NO: 672458 - DNA, 25 bp, Rattus norvegicus
ttctctggtaacttggctcatgtct

SEQ ID NO: 672459 - DNA, 25 bp, Rattus norvegicus
ttctctggtaataaatgtgtacctt

SEQ ID NO: 672460 - DNA, 25 bp, Rattus norvegicus
ttctctggtaattaatgtgtacctt

SEQ ID NO: 672461 - DNA, 25 bp, Rattus norvegicus
ttctctggtctgctgctaggcttct

SEQ ID NO: 672462 - DNA, 25 bp, Rattus norvegicus
ttctctggtctgcttctccttggaa

SEQ ID NO: 672463 - DNA, 25 bp, Rattus norvegicus
ttctctggtctggtgctaggcttct

SEQ ID NO: 672464 - DNA, 25 bp, Rattus norvegicus
ttctctggtctggttctccttggaa

SEQ ID NO: 672465 - DNA, 25 bp, Rattus norvegicus
ttctctggtgatctaaactgtcccc

SEQ ID NO: 672466 - DNA, 25 bp, Rattus norvegicus
ttctctggtgatgtaaactgtcccc

SEQ ID NO: 672467 - DNA, 25 bp, Rattus norvegicus
ttctctggtggactgttgccactga

SEQ ID NO: 672468 - DNA, 25 bp, Rattus norvegicus
ttctctggtggagtgttgccactga

SEQ ID NO: 672469 - DNA, 25 bp, Rattus norvegicus
ttctctggtggcagcgacaccgtgg

SEQ ID NO: 672470 - DNA, 25 bp, Rattus norvegicus
ttctctggtggctgcgacaccgtgg

SEQ ID NO: 672471 - DNA, 25 bp, Rattus norvegicus
ttctctggttttcacaccgactggg

SEQ ID NO: 672472 - DNA, 25 bp, Rattus norvegicus
ttctctggttttgacaccgactggg

SEQ ID NO: 672473 - DNA, 25 bp, Rattus norvegicus
ttctctgtaactattcttggcctat

SEQ ID NO: 672474 - DNA, 25 bp, Rattus norvegicus
ttctctgtaacttttcttggcctat

SEQ ID NO: 672475 - DNA, 25 bp, Rattus norvegicus
ttctctgtaatccaagtgcctccaa

SEQ ID NO: 672476 - DNA, 25 bp, Rattus norvegicus
ttctctgtaatcgaagtgcctccaa

SEQ ID NO: 672477 - DNA, 25 bp, Rattus norvegicus
ttctctgtacatattaagtccctca

SEQ ID NO: 672478 - DNA, 25 bp, Rattus norvegicus
ttctctgtacattttaagtccctca

SEQ ID NO: 672479 - DNA, 25 bp, Rattus norvegicus
ttctctgtagaaacggactctgtct

SEQ ID NO: 672480 - DNA, 25 bp, Rattus norvegicus
ttctctgtagaatcggactctgtct

SEQ ID NO: 672481 - DNA, 25 bp, Rattus norvegicus
ttctctgtaggcatctgtttgtttg

SEQ ID NO: 672482 - DNA, 25 bp, Rattus norvegicus
ttctctgtaggcttctgtttgtttg

SEQ ID NO: 672483 - DNA, 25 bp, Rattus norvegicus
ttctctgtcacaaaggtgtccttgg

SEQ ID NO: 672484 - DNA, 25 bp, Rattus norvegicus
ttctctgtcacataggtgtccttgg

SEQ ID NO: 672485 - DNA, 25 bp, Rattus norvegicus
ttctctgtcaccagacacggtgaac

SEQ ID NO: 672486 - DNA, 25 bp, Rattus norvegicus
ttctctgtcacctgacacggtgaac

SEQ ID NO: 672487 - DNA, 25 bp, Rattus norvegicus
ttctctgtcagtaccagcatggcta

SEQ ID NO: 672488 - DNA, 25 bp, Rattus norvegicus
ttctctgtcagttccagcatggcta

SEQ ID NO: 672489 - DNA, 25 bp, Rattus norvegicus
ttctctgtcatcactaaggtctgct

SEQ ID NO: 672490 - DNA, 25 bp, Rattus norvegicus
ttctctgtcatctctaaggtctgct

SEQ ID NO: 672491 - DNA, 25 bp, Rattus norvegicus
ttctctgtccccactgtctcttggt

SEQ ID NO: 672492 - DNA, 25 bp, Rattus norvegicus
ttctctgtcccctctgtctcttggt

SEQ ID NO: 672493 - DNA, 25 bp, Rattus norvegicus
ttctctgtccctagtaggcagtact

SEQ ID NO: 672494 - DNA, 25 bp, Rattus norvegicus
ttctctgtcccttgtaggcagtact

SEQ ID NO: 672495 - DNA, 25 bp, Rattus norvegicus
ttctctgtcctgagtgttacaaaaa

SEQ ID NO: 672496 - DNA, 25 bp, Rattus norvegicus
ttctctgtcctgtgtgttacaaaaa

SEQ ID NO: 672497 - DNA, 25 bp, Rattus norvegicus
ttctctgtccttatacacccagaag

SEQ ID NO: 672498 - DNA, 25 bp, Rattus norvegicus
ttctctgtccttttacacccagaag

SEQ ID NO: 672499 - DNA, 25 bp, Rattus norvegicus
ttctctgtcgacacgtatttattgc

SEQ ID NO: 672500 - DNA, 25 bp, Rattus norvegicus
ttctctgtcgactcgtatttattgc

SEQ ID NO: 672501 - DNA, 25 bp, Rattus norvegicus
ttctctgtcgatccttcttctgtat

SEQ ID NO: 672502 - DNA, 25 bp, Rattus norvegicus
ttctctgtcgatgcttcttctgtat

SEQ ID NO: 672503 - DNA, 25 bp, Rattus norvegicus
ttctctgtctataaagtctcccttt

SEQ ID NO: 672504 - DNA, 25 bp, Rattus norvegicus
ttctctgtctattaagtctcccttt

SEQ ID NO: 672505 - DNA, 25 bp, Rattus norvegicus
ttctctgtctcaataacccaacaag

SEQ ID NO: 672506 - DNA, 25 bp, Rattus norvegicus
ttctctgtctcattaacccaacaag

SEQ ID NO: 672507 - DNA, 25 bp, Rattus norvegicus
ttctctgtgagcctttggctattct

SEQ ID NO: 672508 - DNA, 25 bp, Rattus norvegicus
ttctctgtgagcgtttggctattct

SEQ ID NO: 672509 - DNA, 25 bp, Rattus norvegicus
ttctctgtgcagcttgtctatcagc

SEQ ID NO: 672510 - DNA, 25 bp, Rattus norvegicus
ttctctgtgcaggttgtctatcagc

SEQ ID NO: 672511 - DNA, 25 bp, Rattus norvegicus
ttctctgtgcccaaatggctcagga

SEQ ID NO: 672512 - DNA, 25 bp, Rattus norvegicus
ttctctgtgccctaatggctcagga

SEQ ID NO: 672513 - DNA, 25 bp, Rattus norvegicus
ttctctgtgctaattttccccaata

SEQ ID NO: 672514 - DNA, 25 bp, Rattus norvegicus
ttctctgtgctatttttccccaata

SEQ ID NO: 672515 - DNA, 25 bp, Rattus norvegicus
ttctctgtgctgagcagatccccag

SEQ ID NO: 672516 - DNA, 25 bp, Rattus norvegicus
ttctctgtgctgtgcagatccccag

SEQ ID NO: 672517 - DNA, 25 bp, Rattus norvegicus
ttctctgtggccactgaaatgctgt

SEQ ID NO: 672518 - DNA, 25 bp, Rattus norvegicus
ttctctgtggcctctgaaatgctgt

SEQ ID NO: 672519 - DNA, 25 bp, Rattus norvegicus
ttctctgtggtaagaatctccgcac

SEQ ID NO: 672520 - DNA, 25 bp, Rattus norvegicus
ttctctgtggtatgaatctccgcac

SEQ ID NO: 672521 - DNA, 25 bp, Rattus norvegicus
ttctctgtgtagagtcagctgacct

SEQ ID NO: 672522 - DNA, 25 bp, Rattus norvegicus
ttctctgtgtagtgtcagctgacct

SEQ ID NO: 672523 - DNA, 25 bp, Rattus norvegicus
ttctctgtgttgagttcgagtcgta

SEQ ID NO: 672524 - DNA, 25 bp, Rattus norvegicus
ttctctgtgttgtgttcgagtcgta

SEQ ID NO: 672525 - DNA, 25 bp, Rattus norvegicus
ttctctgttcatctctgcagctgaa

SEQ ID NO: 672526 - DNA, 25 bp, Rattus norvegicus
ttctctgttcatgtctgcagctgaa

SEQ ID NO: 672527 - DNA, 25 bp, Rattus norvegicus
ttctctgttggcatttcctgaggaa

SEQ ID NO: 672528 - DNA, 25 bp, Rattus norvegicus
ttctctgttggcctctcaggaaaca

SEQ ID NO: 672529 - DNA, 25 bp, Rattus norvegicus
ttctctgttggcgtctcaggaaaca

SEQ ID NO: 672530 - DNA, 25 bp, Rattus norvegicus
ttctctgttggcttttcctgaggaa

SEQ ID NO: 672531 - DNA, 25 bp, Rattus norvegicus
ttctctgttgtgattccaatttaaa

SEQ ID NO: 672532 - DNA, 25 bp, Rattus norvegicus
ttctctgttgtgtttccaatttaaa

SEQ ID NO: 672533 - DNA, 25 bp, Rattus norvegicus
ttctctgtttgacccacctgtcttg

SEQ ID NO: 672534 - DNA, 25 bp, Rattus norvegicus
ttctctgtttgagccacctgtcttg

SEQ ID NO: 672535 - DNA, 25 bp, Rattus norvegicus
ttctcttacgtgaccaggagggcat

SEQ ID NO: 672536 - DNA, 25 bp, Rattus norvegicus
ttctcttacgtgtccaggagggcat

SEQ ID NO: 672537 - DNA, 25 bp, Rattus norvegicus
ttctcttcacttcgttcttactttt

SEQ ID NO: 672538 - DNA, 25 bp, Rattus norvegicus
ttctcttcacttggttcttactttt

SEQ ID NO: 672539 - DNA, 25 bp, Rattus norvegicus
ttctcttcagagacgtgtgcacagg

SEQ ID NO: 672540 - DNA, 25 bp, Rattus norvegicus
ttctcttcagagtcgtgtgcacagg

SEQ ID NO: 672541 - DNA, 25 bp, Rattus norvegicus
ttctcttcaggtacctggtctgaat

SEQ ID NO: 672542 - DNA, 25 bp, Rattus norvegicus
ttctcttcaggttcctggtctgaat

SEQ ID NO: 672543 - DNA, 25 bp, Rattus norvegicus
ttctcttcatctccatatctctgta

SEQ ID NO: 672544 - DNA, 25 bp, Rattus norvegicus
ttctcttcatctgcatatctctgta

SEQ ID NO: 672545 - DNA, 25 bp, Rattus norvegicus
ttctcttcatgtatcaaggtcccag

SEQ ID NO: 672546 - DNA, 25 bp, Rattus norvegicus
ttctcttcatgtttcaaggtcccag

SEQ ID NO: 672547 - DNA, 25 bp, Rattus norvegicus
ttctcttccatactgcatacttttc

SEQ ID NO: 672548 - DNA, 25 bp, Rattus norvegicus
ttctcttccatagtgcatacttttc

SEQ ID NO: 672549 - DNA, 25 bp, Rattus norvegicus
ttctcttccatgacttagcagtttg

SEQ ID NO: 672550 - DNA, 25 bp, Rattus norvegicus
ttctcttccatgtcttagcagtttg

SEQ ID NO: 672551 - DNA, 25 bp, Rattus norvegicus
ttctcttcccaaactcttgcaaaaa

SEQ ID NO: 672552 - DNA, 25 bp, Rattus norvegicus
ttctcttcccaaccaatgccgtgag

SEQ ID NO: 672553 - DNA, 25 bp, Rattus norvegicus
ttctcttcccaagcaatgccgtgag

SEQ ID NO: 672554 - DNA, 25 bp, Rattus norvegicus
ttctcttcccaatctcttgcaaaaa

SEQ ID NO: 672555 - DNA, 25 bp, Rattus norvegicus
ttctcttcccctatgtagactgtaa

SEQ ID NO: 672556 - DNA, 25 bp, Rattus norvegicus
ttctcttcccctttgtagactgtaa

SEQ ID NO: 672557 - DNA, 25 bp, Rattus norvegicus
ttctcttccctaacctgttaactag

SEQ ID NO: 672558 - DNA, 25 bp, Rattus norvegicus
ttctcttccctatcctgttaactag

SEQ ID NO: 672559 - DNA, 25 bp, Rattus norvegicus
ttctcttcctgtactttcagttgaa

SEQ ID NO: 672560 - DNA, 25 bp, Rattus norvegicus
ttctcttcctgtctgatgtctggga

SEQ ID NO: 672561 - DNA, 25 bp, Rattus norvegicus
ttctcttcctgtgtgatgtctggga

SEQ ID NO: 672562 - DNA, 25 bp, Rattus norvegicus
ttctcttcctgttctttcagttgaa

SEQ ID NO: 672563 - DNA, 25 bp, Rattus norvegicus
ttctcttcggacaaagcgtgtactg

SEQ ID NO: 672564 - DNA, 25 bp, Rattus norvegicus
ttctcttcggactaagcgtgtactg

SEQ ID NO: 672565 - DNA, 25 bp, Rattus norvegicus
ttctcttcgtttcgaacctggcgtt

SEQ ID NO: 672566 - DNA, 25 bp, Rattus norvegicus
ttctcttcgtttggaacctggcgtt

SEQ ID NO: 672567 - DNA, 25 bp, Rattus norvegicus
ttctcttctatgacatggcgttcgt

SEQ ID NO: 672568 - DNA, 25 bp, Rattus norvegicus
ttctcttctatgtcatggcgttcgt

SEQ ID NO: 672569 - DNA, 25 bp, Rattus norvegicus
ttctcttctcagcttagccttctgc

SEQ ID NO: 672570 - DNA, 25 bp, Rattus norvegicus
ttctcttctcaggttagccttctgc

SEQ ID NO: 672571 - DNA, 25 bp, Rattus norvegicus
ttctcttctccaaattcaggctgaa

SEQ ID NO: 672572 - DNA, 25 bp, Rattus norvegicus
ttctcttctccatattcaggctgaa

SEQ ID NO: 672573 - DNA, 25 bp, Rattus norvegicus
ttctcttctgcacttgctttgtact

SEQ ID NO: 672574 - DNA, 25 bp, Rattus norvegicus
ttctcttctgcagttgctttgtact

SEQ ID NO: 672575 - DNA, 25 bp, Rattus norvegicus
ttctcttctgccaatctactacgat

SEQ ID NO: 672576 - DNA, 25 bp, Rattus norvegicus
ttctcttctgcctatctactacgat

SEQ ID NO: 672577 - DNA, 25 bp, Rattus norvegicus
ttctcttctgctataatgcttcttt

SEQ ID NO: 672578 - DNA, 25 bp, Rattus norvegicus
ttctcttctgctttaatgcttcttt

SEQ ID NO: 672579 - DNA, 25 bp, Rattus norvegicus
ttctcttctgttatctgtccctgtg

SEQ ID NO: 672580 - DNA, 25 bp, Rattus norvegicus
ttctcttctgttttctgtccctgtg

SEQ ID NO: 672581 - DNA, 25 bp, Rattus norvegicus
ttctcttcttccatcgggatcaaga

SEQ ID NO: 672582 - DNA, 25 bp, Rattus norvegicus
ttctcttcttccttcgggatcaaga

SEQ ID NO: 672583 - DNA, 25 bp, Rattus norvegicus
ttctcttctttaacatacaccaacc

SEQ ID NO: 672584 - DNA, 25 bp, Rattus norvegicus
ttctcttctttatcatacaccaacc

SEQ ID NO: 672585 - DNA, 25 bp, Rattus norvegicus
ttctcttgaataatctgtggcatga

SEQ ID NO: 672586 - DNA, 25 bp, Rattus norvegicus
ttctcttgaatattctgtggcatga

SEQ ID NO: 672587 - DNA, 25 bp, Rattus norvegicus
ttctcttgcaatctccactgtcctg

SEQ ID NO: 672588 - DNA, 25 bp, Rattus norvegicus
ttctcttgcaatgtccactgtcctg

SEQ ID NO: 672589 - DNA, 25 bp, Rattus norvegicus
ttctcttgccgacgagcagggtcca

SEQ ID NO: 672590 - DNA, 25 bp, Rattus norvegicus
ttctcttgccgaggagcagggtcca

SEQ ID NO: 672591 - DNA, 25 bp, Rattus norvegicus
ttctcttgccttcctatatagctcc

SEQ ID NO: 672592 - DNA, 25 bp, Rattus norvegicus
ttctcttgccttgctatatagctcc

SEQ ID NO: 672593 - DNA, 25 bp, Rattus norvegicus
ttctcttgctcccatggaccatgaa

SEQ ID NO: 672594 - DNA, 25 bp, Rattus norvegicus
ttctcttgctccgatggaccatgaa

SEQ ID NO: 672595 - DNA, 25 bp, Rattus norvegicus
ttctcttgctggaaccactcacaaa

SEQ ID NO: 672596 - DNA, 25 bp, Rattus norvegicus
ttctcttgctggtaccactcacaaa

SEQ ID NO: 672597 - DNA, 25 bp, Rattus norvegicus
ttctcttgctgtattttctgtctgg

SEQ ID NO: 672598 - DNA, 25 bp, Rattus norvegicus
ttctcttgctgttttttctgtctgg

SEQ ID NO: 672599 - DNA, 25 bp, Rattus norvegicus
ttctcttgcttcaggatggcagccc

SEQ ID NO: 672600 - DNA, 25 bp, Rattus norvegicus
ttctcttgcttctggatggcagccc

SEQ ID NO: 672601 - DNA, 25 bp, Rattus norvegicus
ttctcttggcacaactatctctaaa

SEQ ID NO: 672602 - DNA, 25 bp, Rattus norvegicus
ttctcttggcactactatctctaaa

SEQ ID NO: 672603 - DNA, 25 bp, Rattus norvegicus
ttctcttggcataacagaccctcaa

SEQ ID NO: 672604 - DNA, 25 bp, Rattus norvegicus
ttctcttggcattacagaccctcaa

SEQ ID NO: 672605 - DNA, 25 bp, Rattus norvegicus
ttctcttggctgaagtgggtgccta

SEQ ID NO: 672606 - DNA, 25 bp, Rattus norvegicus
ttctcttggctgtagtgggtgccta

SEQ ID NO: 672607 - DNA, 25 bp, Rattus norvegicus
ttctcttgggttcactgcagggcac

SEQ ID NO: 672608 - DNA, 25 bp, Rattus norvegicus
ttctcttgggttgactgcagggcac

SEQ ID NO: 672609 - DNA, 25 bp, Rattus norvegicus
ttctcttgtattccttaaagccctc

SEQ ID NO: 672610 - DNA, 25 bp, Rattus norvegicus
ttctcttgtattgcttaaagccctc

SEQ ID NO: 672611 - DNA, 25 bp, Rattus norvegicus
ttctcttgtcctccacagactgttg

SEQ ID NO: 672612 - DNA, 25 bp, Rattus norvegicus
ttctcttgtcctgcacagactgttg

SEQ ID NO: 672613 - DNA, 25 bp, Rattus norvegicus
ttctcttgtctgacacggatgctcc

SEQ ID NO: 672614 - DNA, 25 bp, Rattus norvegicus
ttctcttgtctgtcacggatgctcc

SEQ ID NO: 672615 - DNA, 25 bp, Rattus norvegicus
ttctcttgtttccttatgtaaatat

SEQ ID NO: 672616 - DNA, 25 bp, Rattus norvegicus
ttctcttgtttcgttatgtaaatat

SEQ ID NO: 672617 - DNA, 25 bp, Rattus norvegicus
ttctctttaaaacggtgcacgctgt

SEQ ID NO: 672618 - DNA, 25 bp, Rattus norvegicus
ttctctttaaaagggtgcacgctgt

SEQ ID NO: 672619 - DNA, 25 bp, Rattus norvegicus
ttctctttaattaccctagttgttg

SEQ ID NO: 672620 - DNA, 25 bp, Rattus norvegicus
ttctctttaatttccctagttgttg

SEQ ID NO: 672621 - DNA, 25 bp, Rattus norvegicus
ttctctttccccaggtttaagtcat

SEQ ID NO: 672622 - DNA, 25 bp, Rattus norvegicus
ttctctttcccctggtttaagtcat

SEQ ID NO: 672623 - DNA, 25 bp, Rattus norvegicus
ttctctttctacctctctgtgggtt

SEQ ID NO: 672624 - DNA, 25 bp, Rattus norvegicus
ttctctttctacgtctctgtgggtt

SEQ ID NO: 672625 - DNA, 25 bp, Rattus norvegicus
ttctctttctcaatctttccaggtt

SEQ ID NO: 672626 - DNA, 25 bp, Rattus norvegicus
ttctctttctcactttttacttcta

SEQ ID NO: 672627 - DNA, 25 bp, Rattus norvegicus
ttctctttctcagtttttacttcta

SEQ ID NO: 672628 - DNA, 25 bp, Rattus norvegicus
ttctctttctcattctttccaggtt

SEQ ID NO: 672629 - DNA, 25 bp, Rattus norvegicus
ttctctttctctaatgacacagaag

SEQ ID NO: 672630 - DNA, 25 bp, Rattus norvegicus
ttctctttctctcctcagattgaaa

SEQ ID NO: 672631 - DNA, 25 bp, Rattus norvegicus
ttctctttctctgctcagattgaaa

SEQ ID NO: 672632 - DNA, 25 bp, Rattus norvegicus
ttctctttctcttatgacacagaag

SEQ ID NO: 672633 - DNA, 25 bp, Rattus norvegicus
ttctctttcttgcactgtagtttct

SEQ ID NO: 672634 - DNA, 25 bp, Rattus norvegicus
ttctctttcttggactgtagtttct

SEQ ID NO: 672635 - DNA, 25 bp, Rattus norvegicus
ttctctttgacacccgggtgtttgc

SEQ ID NO: 672636 - DNA, 25 bp, Rattus norvegicus
ttctctttgacagccgggtgtttgc

SEQ ID NO: 672637 - DNA, 25 bp, Rattus norvegicus
ttctctttgcaaactatgccaggtt

SEQ ID NO: 672638 - DNA, 25 bp, Rattus norvegicus
ttctctttgcaatctatgccaggtt

SEQ ID NO: 672639 - DNA, 25 bp, Rattus norvegicus
ttctctttgccaatgcattactggg

SEQ ID NO: 672640 - DNA, 25 bp, Rattus norvegicus
ttctctttgccattgcattactggg

SEQ ID NO: 672641 - DNA, 25 bp, Rattus norvegicus
ttctctttggctactgctctcattg

SEQ ID NO: 672642 - DNA, 25 bp, Rattus norvegicus
ttctctttggcttctgctctcattg

SEQ ID NO: 672643 - DNA, 25 bp, Rattus norvegicus
ttctcttttatcactctttcctatt

SEQ ID NO: 672644 - DNA, 25 bp, Rattus norvegicus
ttctcttttatctctctttcctatt

SEQ ID NO: 672645 - DNA, 25 bp, Rattus norvegicus
ttctcttttcttccttgacactaga

SEQ ID NO: 672646 - DNA, 25 bp, Rattus norvegicus
ttctcttttcttgcttgacactaga

SEQ ID NO: 672647 - DNA, 25 bp, Rattus norvegicus
ttctcttttgacaggagagggcctt

SEQ ID NO: 672648 - DNA, 25 bp, Rattus norvegicus
ttctcttttgactggagagggcctt

SEQ ID NO: 672649 - DNA, 25 bp, Rattus norvegicus
ttctcttttgtcagatgtggacggg

SEQ ID NO: 672650 - DNA, 25 bp, Rattus norvegicus
ttctcttttgtctgatgtggacggg

SEQ ID NO: 672651 - DNA, 25 bp, Rattus norvegicus
ttctctttttacattgccaatcatg

SEQ ID NO: 672652 - DNA, 25 bp, Rattus norvegicus
ttctctttttactttgccaatcatg

SEQ ID NO: 672653 - DNA, 25 bp, Rattus norvegicus
ttctctttttcccttatcaaggctt

SEQ ID NO: 672654 - DNA, 25 bp, Rattus norvegicus
ttctctttttccgttatcaaggctt

SEQ ID NO: 672655 - DNA, 25 bp, Rattus norvegicus
ttctctttttctattgcacaacaag

SEQ ID NO: 672656 - DNA, 25 bp, Rattus norvegicus
ttctctttttcttttgcacaacaag

SEQ ID NO: 672657 - DNA, 25 bp, Rattus norvegicus
ttctgaaacaatcttagtcacaccc

SEQ ID NO: 672658 - DNA, 25 bp, Rattus norvegicus
ttctgaaacaatgttagtcacaccc

SEQ ID NO: 672659 - DNA, 25 bp, Rattus norvegicus
ttctgaaactgtacatcctccatgg

SEQ ID NO: 672660 - DNA, 25 bp, Rattus norvegicus
ttctgaaactgttcatcctccatgg

SEQ ID NO: 672661 - DNA, 25 bp, Rattus norvegicus
ttctgaaagcttcctgcacagctca

SEQ ID NO: 672662 - DNA, 25 bp, Rattus norvegicus
ttctgaaagcttgctgcacagctca

SEQ ID NO: 672663 - DNA, 25 bp, Rattus norvegicus
ttctgaaatccaaacccttctagtc

SEQ ID NO: 672664 - DNA, 25 bp, Rattus norvegicus
ttctgaaatccatacccttctagtc

SEQ ID NO: 672665 - DNA, 25 bp, Rattus norvegicus
ttctgaaatctgatttgctcggctc

SEQ ID NO: 672666 - DNA, 25 bp, Rattus norvegicus
ttctgaaatctgttttgctcggctc

SEQ ID NO: 672667 - DNA, 25 bp, Rattus norvegicus
ttctgaaatgtcacctgcaacatgt

SEQ ID NO: 672668 - DNA, 25 bp, Rattus norvegicus
ttctgaaatgtctcctgcaacatgt

SEQ ID NO: 672669 - DNA, 25 bp, Rattus norvegicus
ttctgaacaggtaaggtcaccccac

SEQ ID NO: 672670 - DNA, 25 bp, Rattus norvegicus
ttctgaacaggttaggtcaccccac

SEQ ID NO: 672671 - DNA, 25 bp, Rattus norvegicus
ttctgaaccagactctgctttcact

SEQ ID NO: 672672 - DNA, 25 bp, Rattus norvegicus
ttctgaaccagagtctgctttcact

SEQ ID NO: 672673 - DNA, 25 bp, Rattus norvegicus
ttctgaaccatgctgctgcgtgcag

SEQ ID NO: 672674 - DNA, 25 bp, Rattus norvegicus
ttctgaaccatggtgctgcgtgcag

SEQ ID NO: 672675 - DNA, 25 bp, Rattus norvegicus
ttctgaacggtgacctgagtatgat

SEQ ID NO: 672676 - DNA, 25 bp, Rattus norvegicus
ttctgaacggtgtcctgagtatgat

SEQ ID NO: 672677 - DNA, 25 bp, Rattus norvegicus
ttctgaacgtgcctttcctcagtta

SEQ ID NO: 672678 - DNA, 25 bp, Rattus norvegicus
ttctgaacgtgcgtttcctcagtta

SEQ ID NO: 672679 - DNA, 25 bp, Rattus norvegicus
ttctgaacgtgtccttctcagcatg

SEQ ID NO: 672680 - DNA, 25 bp, Rattus norvegicus
ttctgaacgtgtgcttctcagcatg

SEQ ID NO: 672681 - DNA, 25 bp, Rattus norvegicus
ttctgaactgctctcttcaagttag

SEQ ID NO: 672682 - DNA, 25 bp, Rattus norvegicus
ttctgaactgctgtcttcaagttag

SEQ ID NO: 672683 - DNA, 25 bp, Rattus norvegicus
ttctgaagacagaagtgtatatgta

SEQ ID NO: 672684 - DNA, 25 bp, Rattus norvegicus
ttctgaagacagtagtgtatatgta

SEQ ID NO: 672685 - DNA, 25 bp, Rattus norvegicus
ttctgaagacatcagacccctgtca

SEQ ID NO: 672686 - DNA, 25 bp, Rattus norvegicus
ttctgaagacatgagacccctgtca

SEQ ID NO: 672687 - DNA, 25 bp, Rattus norvegicus
ttctgaagagagaactgcccatcct

SEQ ID NO: 672688 - DNA, 25 bp, Rattus norvegicus
ttctgaagagagtactgcccatcct

SEQ ID NO: 672689 - DNA, 25 bp, Rattus norvegicus
ttctgaagagttacggtgcctcgtc

SEQ ID NO: 672690 - DNA, 25 bp, Rattus norvegicus
ttctgaagagtttcggtgcctcgtc

SEQ ID NO: 672691 - DNA, 25 bp, Rattus norvegicus
ttctgaagccttatatgtaccacta

SEQ ID NO: 672692 - DNA, 25 bp, Rattus norvegicus
ttctgaagccttttatgtaccacta

SEQ ID NO: 672693 - DNA, 25 bp, Rattus norvegicus
ttctgaagcgacaataccggcacgt

SEQ ID NO: 672694 - DNA, 25 bp, Rattus norvegicus
ttctgaagcgactataccggcacgt

SEQ ID NO: 672695 - DNA, 25 bp, Rattus norvegicus
ttctgaagctcgacactttaaccac

SEQ ID NO: 672696 - DNA, 25 bp, Rattus norvegicus
ttctgaagctcgtcactttaaccac

SEQ ID NO: 672697 - DNA, 25 bp, Rattus norvegicus
ttctgaataacccttttagcattgt

SEQ ID NO: 672698 - DNA, 25 bp, Rattus norvegicus
ttctgaataaccgttttagcattgt

SEQ ID NO: 672699 - DNA, 25 bp, Rattus norvegicus
ttctgaataagtcctgtcctctcct

SEQ ID NO: 672700 - DNA, 25 bp, Rattus norvegicus
ttctgaataagtgctgtcctctcct

SEQ ID NO: 672701 - DNA, 25 bp, Rattus norvegicus
ttctgaatcctgactcgtgtaacga

SEQ ID NO: 672702 - DNA, 25 bp, Rattus norvegicus
ttctgaatcctgtctcgtgtaacga

SEQ ID NO: 672703 - DNA, 25 bp, Rattus norvegicus
ttctgaatcgctagtgcccattgct

SEQ ID NO: 672704 - DNA, 25 bp, Rattus norvegicus
ttctgaatcgcttgtgcccattgct

SEQ ID NO: 672705 - DNA, 25 bp, Rattus norvegicus
ttctgaatctctccgtagcatggac

SEQ ID NO: 672706 - DNA, 25 bp, Rattus norvegicus
ttctgaatctctgcgtagcatggac

SEQ ID NO: 672707 - DNA, 25 bp, Rattus norvegicus
ttctgaatgacgctgctggcacggc

SEQ ID NO: 672708 - DNA, 25 bp, Rattus norvegicus
ttctgaatgacggtgctggcacggc

SEQ ID NO: 672709 - DNA, 25 bp, Rattus norvegicus
ttctgaatgcacagagagcctatga

SEQ ID NO: 672710 - DNA, 25 bp, Rattus norvegicus
ttctgaatgcactgagagcctatga

SEQ ID NO: 672711 - DNA, 25 bp, Rattus norvegicus
ttctgaatgccaacttcttggtcca

SEQ ID NO: 672712 - DNA, 25 bp, Rattus norvegicus
ttctgaatgccatcttcttggtcca

SEQ ID NO: 672713 - DNA, 25 bp, Rattus norvegicus
ttctgaatgctgaaagaggccttaa

SEQ ID NO: 672714 - DNA, 25 bp, Rattus norvegicus
ttctgaatgctgtaagaggccttaa

SEQ ID NO: 672715 - DNA, 25 bp, Rattus norvegicus
ttctgaatgtagatggtatagccac

SEQ ID NO: 672716 - DNA, 25 bp, Rattus norvegicus
ttctgaatgtagttggtatagccac

SEQ ID NO: 672717 - DNA, 25 bp, Rattus norvegicus
ttctgaatgtgcatttccagccttc

SEQ ID NO: 672718 - DNA, 25 bp, Rattus norvegicus
ttctgaatgtgcttttccagccttc

SEQ ID NO: 672719 - DNA, 25 bp, Rattus norvegicus
ttctgaattgaactggtgaccctta

SEQ ID NO: 672720 - DNA, 25 bp, Rattus norvegicus
ttctgaattgaagtggtgaccctta

SEQ ID NO: 672721 - DNA, 25 bp, Rattus norvegicus
ttctgacaagcaaggcttcaccatc

SEQ ID NO: 672722 - DNA, 25 bp, Rattus norvegicus
ttctgacaagcatggcttcaccatc

SEQ ID NO: 672723 - DNA, 25 bp, Rattus norvegicus
ttctgacacatgagtccctgacatt

SEQ ID NO: 672724 - DNA, 25 bp, Rattus norvegicus
ttctgacacatgtgtccctgacatt

SEQ ID NO: 672725 - DNA, 25 bp, Rattus norvegicus
ttctgacactctaggagcccggtta

SEQ ID NO: 672726 - DNA, 25 bp, Rattus norvegicus
ttctgacactcttggagcccggtta

SEQ ID NO: 672727 - DNA, 25 bp, Rattus norvegicus
ttctgacactttcacttttgcagat

SEQ ID NO: 672728 - DNA, 25 bp, Rattus norvegicus
ttctgacactttgacttttgcagat

SEQ ID NO: 672729 - DNA, 25 bp, Rattus norvegicus
ttctgacatggtcctcttctgaggg

SEQ ID NO: 672730 - DNA, 25 bp, Rattus norvegicus
ttctgacatggtgctcttctgaggg

SEQ ID NO: 672731 - DNA, 25 bp, Rattus norvegicus
ttctgacatgttattctcctgccta

SEQ ID NO: 672732 - DNA, 25 bp, Rattus norvegicus
ttctgacatgtttttctcctgccta

SEQ ID NO: 672733 - DNA, 25 bp, Rattus norvegicus
ttctgacattctctctggcagccag

SEQ ID NO: 672734 - DNA, 25 bp, Rattus norvegicus
ttctgacattctgtctggcagccag

SEQ ID NO: 672735 - DNA, 25 bp, Rattus norvegicus
ttctgacattgcctgacctcattta

SEQ ID NO: 672736 - DNA, 25 bp, Rattus norvegicus
ttctgacattgcgtgacctcattta

SEQ ID NO: 672737 - DNA, 25 bp, Rattus norvegicus
ttctgaccaaatcagagcatggacc

SEQ ID NO: 672738 - DNA, 25 bp, Rattus norvegicus
ttctgaccaaatgagagcatggacc

SEQ ID NO: 672739 - DNA, 25 bp, Rattus norvegicus
ttctgaccacttagtccaccaggta

SEQ ID NO: 672740 - DNA, 25 bp, Rattus norvegicus
ttctgaccactttgtccaccaggta

SEQ ID NO: 672741 - DNA, 25 bp, Rattus norvegicus
ttctgaccagatagttcccgagtac

SEQ ID NO: 672742 - DNA, 25 bp, Rattus norvegicus
ttctgaccagattgttcccgagtac

SEQ ID NO: 672743 - DNA, 25 bp, Rattus norvegicus
ttctgaccagcacgcggtgtgtgac

SEQ ID NO: 672744 - DNA, 25 bp, Rattus norvegicus
ttctgaccagcaggcggtgtgtgac

SEQ ID NO: 672745 - DNA, 25 bp, Rattus norvegicus
ttctgacccttcagacctttagcag

SEQ ID NO: 672746 - DNA, 25 bp, Rattus norvegicus
ttctgacccttctgacctttagcag

SEQ ID NO: 672747 - DNA, 25 bp, Rattus norvegicus
ttctgacctactcctgagcaggagg

SEQ ID NO: 672748 - DNA, 25 bp, Rattus norvegicus
ttctgacctactgctgagcaggagg

SEQ ID NO: 672749 - DNA, 25 bp, Rattus norvegicus
ttctgacctatcctgtcctaaagag

SEQ ID NO: 672750 - DNA, 25 bp, Rattus norvegicus
ttctgacctatcgtgtcctaaagag

SEQ ID NO: 672751 - DNA, 25 bp, Rattus norvegicus
ttctgacctatgcaacgtggacggg

SEQ ID NO: 672752 - DNA, 25 bp, Rattus norvegicus
ttctgacctatggaacgtggacggg

SEQ ID NO: 672753 - DNA, 25 bp, Rattus norvegicus
ttctgacctccaaagaacatagggc

SEQ ID NO: 672754 - DNA, 25 bp, Rattus norvegicus
ttctgacctccacatttgtaccaca

SEQ ID NO: 672755 - DNA, 25 bp, Rattus norvegicus
ttctgacctccagatttgtaccaca

SEQ ID NO: 672756 - DNA, 25 bp, Rattus norvegicus
ttctgacctccatagaacatagggc

SEQ ID NO: 672757 - DNA, 25 bp, Rattus norvegicus
ttctgacctttaccacaggatggag

SEQ ID NO: 672758 - DNA, 25 bp, Rattus norvegicus
ttctgacctttagcacaggatggag

SEQ ID NO: 672759 - DNA, 25 bp, Rattus norvegicus
ttctgacctttcctctccttcatga

SEQ ID NO: 672760 - DNA, 25 bp, Rattus norvegicus
ttctgacctttcgtctccttcatga

SEQ ID NO: 672761 - DNA, 25 bp, Rattus norvegicus
ttctgacggaacaaaaggtatctac

SEQ ID NO: 672762 - DNA, 25 bp, Rattus norvegicus
ttctgacggaactaaaggtatctac

SEQ ID NO: 672763 - DNA, 25 bp, Rattus norvegicus
ttctgacgttccagaagtttcaccc

SEQ ID NO: 672764 - DNA, 25 bp, Rattus norvegicus
ttctgacgttcctgaagtttcaccc

SEQ ID NO: 672765 - DNA, 25 bp, Rattus norvegicus
ttctgacgttggctgacgaatccac

SEQ ID NO: 672766 - DNA, 25 bp, Rattus norvegicus
ttctgacgttgggtgacgaatccac

SEQ ID NO: 672767 - DNA, 25 bp, Rattus norvegicus
ttctgactaaacatctgagggagct

SEQ ID NO: 672768 - DNA, 25 bp, Rattus norvegicus
ttctgactaaacttctgagggagct

SEQ ID NO: 672769 - DNA, 25 bp, Rattus norvegicus
ttctgactaaccagtgactggaatc

SEQ ID NO: 672770 - DNA, 25 bp, Rattus norvegicus
ttctgactaacctgtgactggaatc

SEQ ID NO: 672771 - DNA, 25 bp, Rattus norvegicus
ttctgactacttaaagccccctata

SEQ ID NO: 672772 - DNA, 25 bp, Rattus norvegicus
ttctgactactttaagccccctata

SEQ ID NO: 672773 - DNA, 25 bp, Rattus norvegicus
ttctgactataaccgtattgtacaa

SEQ ID NO: 672774 - DNA, 25 bp, Rattus norvegicus
ttctgactataagcgtattgtacaa

SEQ ID NO: 672775 - DNA, 25 bp, Rattus norvegicus
ttctgactctcgcacatcatatgca

SEQ ID NO: 672776 - DNA, 25 bp, Rattus norvegicus
ttctgactctcggacatcatatgca

SEQ ID NO: 672777 - DNA, 25 bp, Rattus norvegicus
ttctgactctgactacagctcttag

SEQ ID NO: 672778 - DNA, 25 bp, Rattus norvegicus
ttctgactctgagtacagctcttag

SEQ ID NO: 672779 - DNA, 25 bp, Rattus norvegicus
ttctgactctgcctgagatggagtg

SEQ ID NO: 672780 - DNA, 25 bp, Rattus norvegicus
ttctgactctgcgtgagatggagtg

SEQ ID NO: 672781 - DNA, 25 bp, Rattus norvegicus
ttctgactgacaactgcctttacta

SEQ ID NO: 672782 - DNA, 25 bp, Rattus norvegicus
ttctgactgacatctgcctttacta

SEQ ID NO: 672783 - DNA, 25 bp, Rattus norvegicus
ttctgactgcatccaccagtgactt

SEQ ID NO: 672784 - DNA, 25 bp, Rattus norvegicus
ttctgactgcatgcaccagtgactt

SEQ ID NO: 672785 - DNA, 25 bp, Rattus norvegicus
ttctgactgtggacgctaagggcca

SEQ ID NO: 672786 - DNA, 25 bp, Rattus norvegicus
ttctgactgtggtcgctaagggcca

SEQ ID NO: 672787 - DNA, 25 bp, Rattus norvegicus
ttctgacttcagatggaaccccaat

SEQ ID NO: 672788 - DNA, 25 bp, Rattus norvegicus
ttctgacttcagttggaaccccaat

SEQ ID NO: 672789 - DNA, 25 bp, Rattus norvegicus
ttctgacttgtgaatgtgggcctgc

SEQ ID NO: 672790 - DNA, 25 bp, Rattus norvegicus
ttctgacttgtgtatgtgggcctgc

SEQ ID NO: 672791 - DNA, 25 bp, Rattus norvegicus
ttctgactttatacaccctgggaca

SEQ ID NO: 672792 - DNA, 25 bp, Rattus norvegicus
ttctgactttattcaccctgggaca

SEQ ID NO: 672793 - DNA, 25 bp, Rattus norvegicus
ttctgactttccatgcctggtggca

SEQ ID NO: 672794 - DNA, 25 bp, Rattus norvegicus
ttctgactttccttgcctggtggca

SEQ ID NO: 672795 - DNA, 25 bp, Rattus norvegicus
ttctgagaaatgacctgaccctcct

SEQ ID NO: 672796 - DNA, 25 bp, Rattus norvegicus
ttctgagaaatgtcctgaccctcct

SEQ ID NO: 672797 - DNA, 25 bp, Rattus norvegicus
ttctgagaagagcagagaccacaca

SEQ ID NO: 672798 - DNA, 25 bp, Rattus norvegicus
ttctgagaagaggagagaccacaca

SEQ ID NO: 672799 - DNA, 25 bp, Rattus norvegicus
ttctgagaggacagattgcttattc

SEQ ID NO: 672800 - DNA, 25 bp, Rattus norvegicus
ttctgagaggactgattgcttattc

SEQ ID NO: 672801 - DNA, 25 bp, Rattus norvegicus
ttctgagaggcacgagagctcccac

SEQ ID NO: 672802 - DNA, 25 bp, Rattus norvegicus
ttctgagaggcaggagagctcccac

SEQ ID NO: 672803 - DNA, 25 bp, Rattus norvegicus
ttctgagatagcaaaacctgatttt

SEQ ID NO: 672804 - DNA, 25 bp, Rattus norvegicus
ttctgagatagctaaacctgatttt

SEQ ID NO: 672805 - DNA, 25 bp, Rattus norvegicus
ttctgagcacccatcgagcacgggc

SEQ ID NO: 672806 - DNA, 25 bp, Rattus norvegicus
ttctgagcacccttcgagcacgggc

SEQ ID NO: 672807 - DNA, 25 bp, Rattus norvegicus
ttctgagcagatctgtctcgcactg

SEQ ID NO: 672808 - DNA, 25 bp, Rattus norvegicus
ttctgagcagatgtgtctcgcactg

SEQ ID NO: 672809 - DNA, 25 bp, Rattus norvegicus
ttctgagccacccatgatggccatg

SEQ ID NO: 672810 - DNA, 25 bp, Rattus norvegicus
ttctgagccaccgatgatggccatg

SEQ ID NO: 672811 - DNA, 25 bp, Rattus norvegicus
ttctgagcccacagtatcagatggt

SEQ ID NO: 672812 - DNA, 25 bp, Rattus norvegicus
ttctgagcccactgtatcagatggt

SEQ ID NO: 672813 - DNA, 25 bp, Rattus norvegicus
ttctgagcccagctgatacacacca

SEQ ID NO: 672814 - DNA, 25 bp, Rattus norvegicus
ttctgagcccaggtgatacacacca

SEQ ID NO: 672815 - DNA, 25 bp, Rattus norvegicus
ttctgagccccaaacataccttgct

SEQ ID NO: 672816 - DNA, 25 bp, Rattus norvegicus
ttctgagccccatacataccttgct

SEQ ID NO: 672817 - DNA, 25 bp, Rattus norvegicus
ttctgagcctcgagtgcctgtggac

SEQ ID NO: 672818 - DNA, 25 bp, Rattus norvegicus
ttctgagcctcgtgtgcctgtggac

SEQ ID NO: 672819 - DNA, 25 bp, Rattus norvegicus
ttctgagcgaatagatccgaagccg

SEQ ID NO: 672820 - DNA, 25 bp, Rattus norvegicus
ttctgagcgaattgatccgaagccg

SEQ ID NO: 672821 - DNA, 25 bp, Rattus norvegicus
ttctgagctaacactgctgtagccc

SEQ ID NO: 672822 - DNA, 25 bp, Rattus norvegicus
ttctgagctaactctgctgtagccc

SEQ ID NO: 672823 - DNA, 25 bp, Rattus norvegicus
ttctgagctgccagcattgtcctat

SEQ ID NO: 672824 - DNA, 25 bp, Rattus norvegicus
ttctgagctgcctgcattgtcctat

SEQ ID NO: 672825 - DNA, 25 bp, Rattus norvegicus
ttctgagctttccattgagtgtccc

SEQ ID NO: 672826 - DNA, 25 bp, Rattus norvegicus
ttctgagctttcgattgagtgtccc

SEQ ID NO: 672827 - DNA, 25 bp, Rattus norvegicus
ttctgagcttttatccttggccctt

SEQ ID NO: 672828 - DNA, 25 bp, Rattus norvegicus
ttctgagcttttttccttggccctt

SEQ ID NO: 672829 - DNA, 25 bp, Rattus norvegicus
ttctgaggaattacagcccgggctt

SEQ ID NO: 672830 - DNA, 25 bp, Rattus norvegicus
ttctgaggaatttcagcccgggctt

SEQ ID NO: 672831 - DNA, 25 bp, Rattus norvegicus
ttctgaggacaccagtcacacggat

SEQ ID NO: 672832 - DNA, 25 bp, Rattus norvegicus
ttctgaggacacgagtcacacggat

SEQ ID NO: 672833 - DNA, 25 bp, Rattus norvegicus
ttctgaggatgccaccgtgagcagc

SEQ ID NO: 672834 - DNA, 25 bp, Rattus norvegicus
ttctgaggatgcgaccgtgagcagc

SEQ ID NO: 672835 - DNA, 25 bp, Rattus norvegicus
ttctgaggcttgaatgtatgtgtat

SEQ ID NO: 672836 - DNA, 25 bp, Rattus norvegicus
ttctgaggcttgtatgtatgtgtat

SEQ ID NO: 672837 - DNA, 25 bp, Rattus norvegicus
ttctgagggccaagtaccttgaaga

SEQ ID NO: 672838 - DNA, 25 bp, Rattus norvegicus
ttctgagggccatgtaccttgaaga

SEQ ID NO: 672839 - DNA, 25 bp, Rattus norvegicus
ttctgagggtgaatgtctggttata

SEQ ID NO: 672840 - DNA, 25 bp, Rattus norvegicus
ttctgagggtgattgtctggttata

SEQ ID NO: 672841 - DNA, 25 bp, Rattus norvegicus
ttctgaggttctaactccatcacac

SEQ ID NO: 672842 - DNA, 25 bp, Rattus norvegicus
ttctgaggttcttactccatcacac

SEQ ID NO: 672843 - DNA, 25 bp, Rattus norvegicus
ttctgaggttggatagttacactat

SEQ ID NO: 672844 - DNA, 25 bp, Rattus norvegicus
ttctgaggttggttagttacactat

SEQ ID NO: 672845 - DNA, 25 bp, Rattus norvegicus
ttctgagtatgacttatggccactt

SEQ ID NO: 672846 - DNA, 25 bp, Rattus norvegicus
ttctgagtatgagttatggccactt

SEQ ID NO: 672847 - DNA, 25 bp, Rattus norvegicus
ttctgagtcacccaagcaagttatg

SEQ ID NO: 672848 - DNA, 25 bp, Rattus norvegicus
ttctgagtcaccgaagcaagttatg

SEQ ID NO: 672849 - DNA, 25 bp, Rattus norvegicus
ttctgagtccagagctctgccgtag

SEQ ID NO: 672850 - DNA, 25 bp, Rattus norvegicus
ttctgagtccagtgctctgccgtag

SEQ ID NO: 672851 - DNA, 25 bp, Rattus norvegicus
ttctgagtcctcagcttaaagctga

SEQ ID NO: 672852 - DNA, 25 bp, Rattus norvegicus
ttctgagtcctctgcttaaagctga

SEQ ID NO: 672853 - DNA, 25 bp, Rattus norvegicus
ttctgagtcctgctcattatgtcct

SEQ ID NO: 672854 - DNA, 25 bp, Rattus norvegicus
ttctgagtcctggtcattatgtcct

SEQ ID NO: 672855 - DNA, 25 bp, Rattus norvegicus
ttctgagtctcacttgcattctgca

SEQ ID NO: 672856 - DNA, 25 bp, Rattus norvegicus
ttctgagtctcagttgcattctgca

SEQ ID NO: 672857 - DNA, 25 bp, Rattus norvegicus
ttctgagtgactccaatgccctggg

SEQ ID NO: 672858 - DNA, 25 bp, Rattus norvegicus
ttctgagtgactgcaatgccctggg

SEQ ID NO: 672859 - DNA, 25 bp, Rattus norvegicus
ttctgagtggaaaccctctcctgaa

SEQ ID NO: 672860 - DNA, 25 bp, Rattus norvegicus
ttctgagtggaatccctctcctgaa

SEQ ID NO: 672861 - DNA, 25 bp, Rattus norvegicus
ttctgagttgaaagtcgatggtgca

SEQ ID NO: 672862 - DNA, 25 bp, Rattus norvegicus
ttctgagttgaatgtcgatggtgca

SEQ ID NO: 672863 - DNA, 25 bp, Rattus norvegicus
ttctgagttgcaaccagggtgacct

SEQ ID NO: 672864 - DNA, 25 bp, Rattus norvegicus
ttctgagttgcatccagggtgacct

SEQ ID NO: 672865 - DNA, 25 bp, Rattus norvegicus
ttctgagtttacatttacagtttgt

SEQ ID NO: 672866 - DNA, 25 bp, Rattus norvegicus
ttctgagtttacttttacagtttgt

SEQ ID NO: 672867 - DNA, 25 bp, Rattus norvegicus
ttctgagtttcacccctgtaaaaga

SEQ ID NO: 672868 - DNA, 25 bp, Rattus norvegicus
ttctgagtttcagccctgtaaaaga

SEQ ID NO: 672869 - DNA, 25 bp, Rattus norvegicus
ttctgagtttctagcgtcacaggac

SEQ ID NO: 672870 - DNA, 25 bp, Rattus norvegicus
ttctgagtttcttgcgtcacaggac

SEQ ID NO: 672871 - DNA, 25 bp, Rattus norvegicus
ttctgataattcacttgaagccaag

SEQ ID NO: 672872 - DNA, 25 bp, Rattus norvegicus
ttctgataattctcttgaagccaag

SEQ ID NO: 672873 - DNA, 25 bp, Rattus norvegicus
ttctgatacagtccacgttctctgc

SEQ ID NO: 672874 - DNA, 25 bp, Rattus norvegicus
ttctgatacagtgcacgttctctgc

SEQ ID NO: 672875 - DNA, 25 bp, Rattus norvegicus
ttctgatacgaaccacactctaagt

SEQ ID NO: 672876 - DNA, 25 bp, Rattus norvegicus
ttctgatacgaagcacactctaagt

SEQ ID NO: 672877 - DNA, 25 bp, Rattus norvegicus
ttctgatactatactccgtaagaag

SEQ ID NO: 672878 - DNA, 25 bp, Rattus norvegicus
ttctgatactattctccgtaagaag

SEQ ID NO: 672879 - DNA, 25 bp, Rattus norvegicus
ttctgatagatgactgggtcctcac

SEQ ID NO: 672880 - DNA, 25 bp, Rattus norvegicus
ttctgatagatgtctgggtcctcac

SEQ ID NO: 672881 - DNA, 25 bp, Rattus norvegicus
ttctgatagattcaaactgtagtct

SEQ ID NO: 672882 - DNA, 25 bp, Rattus norvegicus
ttctgatagattgaaactgtagtct

SEQ ID NO: 672883 - DNA, 25 bp, Rattus norvegicus
ttctgatcactcaaagactgtcctc

SEQ ID NO: 672884 - DNA, 25 bp, Rattus norvegicus
ttctgatcactcaagccacaggagg

SEQ ID NO: 672885 - DNA, 25 bp, Rattus norvegicus
ttctgatcactctaagactgtcctc

SEQ ID NO: 672886 - DNA, 25 bp, Rattus norvegicus
ttctgatcactctagccacaggagg

SEQ ID NO: 672887 - DNA, 25 bp, Rattus norvegicus
ttctgatccccacaggactcgggaa

SEQ ID NO: 672888 - DNA, 25 bp, Rattus norvegicus
ttctgatccccagaggactcgggaa

SEQ ID NO: 672889 - DNA, 25 bp, Rattus norvegicus
ttctgatcctggacttccgggaaag

SEQ ID NO: 672890 - DNA, 25 bp, Rattus norvegicus
ttctgatcctggtcttccgggaaag

SEQ ID NO: 672891 - DNA, 25 bp, Rattus norvegicus
ttctgatctgctcctatgcacacac

SEQ ID NO: 672892 - DNA, 25 bp, Rattus norvegicus
ttctgatctgctgctatgcacacac

SEQ ID NO: 672893 - DNA, 25 bp, Rattus norvegicus
ttctgatgagtcctcctaccatggg

SEQ ID NO: 672894 - DNA, 25 bp, Rattus norvegicus
ttctgatgagtcgtcctaccatggg

SEQ ID NO: 672895 - DNA, 25 bp, Rattus norvegicus
ttctgatgatacatgtctgctccac

SEQ ID NO: 672896 - DNA, 25 bp, Rattus norvegicus
ttctgatgatacttgtctgctccac

SEQ ID NO: 672897 - DNA, 25 bp, Rattus norvegicus
ttctgatgcagacctccagcagtgt

SEQ ID NO: 672898 - DNA, 25 bp, Rattus norvegicus
ttctgatgcagagctccagcagtgt

SEQ ID NO: 672899 - DNA, 25 bp, Rattus norvegicus
ttctgatgctacagccggaggagtg

SEQ ID NO: 672900 - DNA, 25 bp, Rattus norvegicus
ttctgatgctactgccggaggagtg

SEQ ID NO: 672901 - DNA, 25 bp, Rattus norvegicus
ttctgatgggctctgttcctgcctc

SEQ ID NO: 672902 - DNA, 25 bp, Rattus norvegicus
ttctgatgggctgtgttcctgcctc

SEQ ID NO: 672903 - DNA, 25 bp, Rattus norvegicus
ttctgatggtctaaagcaacccctg

SEQ ID NO: 672904 - DNA, 25 bp, Rattus norvegicus
ttctgatggtcttaagcaacccctg

SEQ ID NO: 672905 - DNA, 25 bp, Rattus norvegicus
ttctgatgtcagaccaggtgtctat

SEQ ID NO: 672906 - DNA, 25 bp, Rattus norvegicus
ttctgatgtcagtccaggtgtctat

SEQ ID NO: 672907 - DNA, 25 bp, Rattus norvegicus
ttctgatgtccccaagcattgactc

SEQ ID NO: 672908 - DNA, 25 bp, Rattus norvegicus
ttctgatgtcccgaagcattgactc

SEQ ID NO: 672909 - DNA, 25 bp, Rattus norvegicus
ttctgatgtcctcaaggtctctctc

SEQ ID NO: 672910 - DNA, 25 bp, Rattus norvegicus
ttctgatgtcctgaaggtctctctc

SEQ ID NO: 672911 - DNA, 25 bp, Rattus norvegicus
ttctgattatggaaccaaaatggca

SEQ ID NO: 672912 - DNA, 25 bp, Rattus norvegicus
ttctgattatggtaccaaaatggca

SEQ ID NO: 672913 - DNA, 25 bp, Rattus norvegicus
ttctgattcaacactaaggtcctct

SEQ ID NO: 672914 - DNA, 25 bp, Rattus norvegicus
ttctgattcaactctaaggtcctct

SEQ ID NO: 672915 - DNA, 25 bp, Rattus norvegicus
ttctgattcctcatgggttgaagca

SEQ ID NO: 672916 - DNA, 25 bp, Rattus norvegicus
ttctgattcctcttgggttgaagca

SEQ ID NO: 672917 - DNA, 25 bp, Rattus norvegicus
ttctgattctggcagacctgctgga

SEQ ID NO: 672918 - DNA, 25 bp, Rattus norvegicus
ttctgattctgggagacctgctgga

SEQ ID NO: 672919 - DNA, 25 bp, Rattus norvegicus
ttctgattctgtccggctcaagtgt

SEQ ID NO: 672920 - DNA, 25 bp, Rattus norvegicus
ttctgattctgtgcggctcaagtgt

SEQ ID NO: 672921 - DNA, 25 bp, Rattus norvegicus
ttctgattctttactcttgagtcct

SEQ ID NO: 672922 - DNA, 25 bp, Rattus norvegicus
ttctgattcttttctcttgagtcct

SEQ ID NO: 672923 - DNA, 25 bp, Rattus norvegicus
ttctgattgctgacatgttactgga

SEQ ID NO: 672924 - DNA, 25 bp, Rattus norvegicus
ttctgattgctgtcatgttactgga

SEQ ID NO: 672925 - DNA, 25 bp, Rattus norvegicus
ttctgattgcttcctgcctgacctg

SEQ ID NO: 672926 - DNA, 25 bp, Rattus norvegicus
ttctgattgcttgctgcctgacctg

SEQ ID NO: 672927 - DNA, 25 bp, Rattus norvegicus
ttctgattttcgaatgtacttgctt

SEQ ID NO: 672928 - DNA, 25 bp, Rattus norvegicus
ttctgattttcgtatgtacttgctt

SEQ ID NO: 672929 - DNA, 25 bp, Rattus norvegicus
ttctgattttgaactcctcgatgct

SEQ ID NO: 672930 - DNA, 25 bp, Rattus norvegicus
ttctgattttgatctcctcgatgct

SEQ ID NO: 672931 - DNA, 25 bp, Rattus norvegicus
ttctgcaactgaagctcctcgtagt

SEQ ID NO: 672932 - DNA, 25 bp, Rattus norvegicus
ttctgcaactgatgctcctcgtagt

SEQ ID NO: 672933 - DNA, 25 bp, Rattus norvegicus
ttctgcaactttatgcacctgcgac

SEQ ID NO: 672934 - DNA, 25 bp, Rattus norvegicus
ttctgcaactttttgcacctgcgac

SEQ ID NO: 672935 - DNA, 25 bp, Rattus norvegicus
ttctgcaagagcactgtccaacttt

SEQ ID NO: 672936 - DNA, 25 bp, Rattus norvegicus
ttctgcaagagctctgtccaacttt

SEQ ID NO: 672937 - DNA, 25 bp, Rattus norvegicus
ttctgcaaggctaatgacactcggt

SEQ ID NO: 672938 - DNA, 25 bp, Rattus norvegicus
ttctgcaaggcttatgacactcggt

SEQ ID NO: 672939 - DNA, 25 bp, Rattus norvegicus
ttctgcaatcatcacctctcgatgt

SEQ ID NO: 672940 - DNA, 25 bp, Rattus norvegicus
ttctgcaatcatgacctctcgatgt

SEQ ID NO: 672941 - DNA, 25 bp, Rattus norvegicus
ttctgcaccctcctgttaggtgatt

SEQ ID NO: 672942 - DNA, 25 bp, Rattus norvegicus
ttctgcaccctcgtgttaggtgatt

SEQ ID NO: 672943 - DNA, 25 bp, Rattus norvegicus
ttctgcactaacaggaagctacggg

SEQ ID NO: 672944 - DNA, 25 bp, Rattus norvegicus
ttctgcactaactggaagctacggg

SEQ ID NO: 672945 - DNA, 25 bp, Rattus norvegicus
ttctgcactcctatccagaagtaac

SEQ ID NO: 672946 - DNA, 25 bp, Rattus norvegicus
ttctgcactcctttccagaagtaac

SEQ ID NO: 672947 - DNA, 25 bp, Rattus norvegicus
ttctgcactgccatttcaggcttgg

SEQ ID NO: 672948 - DNA, 25 bp, Rattus norvegicus
ttctgcactgccttttcaggcttgg

SEQ ID NO: 672949 - DNA, 25 bp, Rattus norvegicus
ttctgcactggcctgaggtctgatc

SEQ ID NO: 672950 - DNA, 25 bp, Rattus norvegicus
ttctgcactggcgtgaggtctgatc

SEQ ID NO: 672951 - DNA, 25 bp, Rattus norvegicus
ttctgcacttgcagatatcaccagt

SEQ ID NO: 672952 - DNA, 25 bp, Rattus norvegicus
ttctgcacttgctgatatcaccagt

SEQ ID NO: 672953 - DNA, 25 bp, Rattus norvegicus
ttctgcagaaggaacagtagtctca

SEQ ID NO: 672954 - DNA, 25 bp, Rattus norvegicus
ttctgcagaaggtacagtagtctca

SEQ ID NO: 672955 - DNA, 25 bp, Rattus norvegicus
ttctgcagactcagcaaggtcctgt

SEQ ID NO: 672956 - DNA, 25 bp, Rattus norvegicus
ttctgcagactctgcaaggtcctgt

SEQ ID NO: 672957 - DNA, 25 bp, Rattus norvegicus
ttctgcagactgctgtttggcctct

SEQ ID NO: 672958 - DNA, 25 bp, Rattus norvegicus
ttctgcagactggtgtttggcctct

SEQ ID NO: 672959 - DNA, 25 bp, Rattus norvegicus
ttctgcagaggcaaacactgtcatg

SEQ ID NO: 672960 - DNA, 25 bp, Rattus norvegicus
ttctgcagaggctaacactgtcatg

SEQ ID NO: 672961 - DNA, 25 bp, Rattus norvegicus
ttctgcagcaggataccctgagcta

SEQ ID NO: 672962 - DNA, 25 bp, Rattus norvegicus
ttctgcagcaggttaccctgagcta

SEQ ID NO: 672963 - DNA, 25 bp, Rattus norvegicus
ttctgcagcatccttaggtcacagt

SEQ ID NO: 672964 - DNA, 25 bp, Rattus norvegicus
ttctgcagcatcgttaggtcacagt

SEQ ID NO: 672965 - DNA, 25 bp, Rattus norvegicus
ttctgcagccagaacctcggtgaag

SEQ ID NO: 672966 - DNA, 25 bp, Rattus norvegicus
ttctgcagccagtacctcggtgaag

SEQ ID NO: 672967 - DNA, 25 bp, Rattus norvegicus
ttctgcagcgcgaagagtgacgagt

SEQ ID NO: 672968 - DNA, 25 bp, Rattus norvegicus
ttctgcagcgcgtagagtgacgagt

SEQ ID NO: 672969 - DNA, 25 bp, Rattus norvegicus
ttctgcagctctatttgtggcgctt

SEQ ID NO: 672970 - DNA, 25 bp, Rattus norvegicus
ttctgcagctctttttgtggcgctt

SEQ ID NO: 672971 - DNA, 25 bp, Rattus norvegicus
ttctgcaggaccagtggaaccccta

SEQ ID NO: 672972 - DNA, 25 bp, Rattus norvegicus
ttctgcaggacctgtggaaccccta

SEQ ID NO: 672973 - DNA, 25 bp, Rattus norvegicus
ttctgcaggcgccttgcaccatgca

SEQ ID NO: 672974 - DNA, 25 bp, Rattus norvegicus
ttctgcaggcgcgttgcaccatgca

SEQ ID NO: 672975 - DNA, 25 bp, Rattus norvegicus
ttctgcagggtgctcctctgtaaag

SEQ ID NO: 672976 - DNA, 25 bp, Rattus norvegicus
ttctgcagggtggtcctctgtaaag

SEQ ID NO: 672977 - DNA, 25 bp, Rattus norvegicus
ttctgcagtgcaagactatcttcaa

SEQ ID NO: 672978 - DNA, 25 bp, Rattus norvegicus
ttctgcagtgcatgactatcttcaa

SEQ ID NO: 672979 - DNA, 25 bp, Rattus norvegicus
ttctgcagtgctacattgtctcgta

SEQ ID NO: 672980 - DNA, 25 bp, Rattus norvegicus
ttctgcagtgcttcattgtctcgta

SEQ ID NO: 672981 - DNA, 25 bp, Rattus norvegicus
ttctgcagtggcagtgcctttgatc

SEQ ID NO: 672982 - DNA, 25 bp, Rattus norvegicus
ttctgcagtggctgtgcctttgatc

SEQ ID NO: 672983 - DNA, 25 bp, Rattus norvegicus
ttctgcagttagacctcagtttcag

SEQ ID NO: 672984 - DNA, 25 bp, Rattus norvegicus
ttctgcagttagtcctcagtttcag

SEQ ID NO: 672985 - DNA, 25 bp, Rattus norvegicus
ttctgcataatgagtgtttccgccc

SEQ ID NO: 672986 - DNA, 25 bp, Rattus norvegicus
ttctgcataatgtgtgtttccgccc

SEQ ID NO: 672987 - DNA, 25 bp, Rattus norvegicus
ttctgcatcatgatcctggttttta

SEQ ID NO: 672988 - DNA, 25 bp, Rattus norvegicus
ttctgcatcatgttcctggttttta

SEQ ID NO: 672989 - DNA, 25 bp, Rattus norvegicus
ttctgcatcccacagggcttaatgc

SEQ ID NO: 672990 - DNA, 25 bp, Rattus norvegicus
ttctgcatcccagagggcttaatgc

SEQ ID NO: 672991 - DNA, 25 bp, Rattus norvegicus
ttctgcatctgtcctatctctgtat

SEQ ID NO: 672992 - DNA, 25 bp, Rattus norvegicus
ttctgcatctgtgctatctctgtat

SEQ ID NO: 672993 - DNA, 25 bp, Rattus norvegicus
ttctgcatttgcaccttgggattat

SEQ ID NO: 672994 - DNA, 25 bp, Rattus norvegicus
ttctgcatttgctccttgggattat

SEQ ID NO: 672995 - DNA, 25 bp, Rattus norvegicus
ttctgccaaagaccatgacgtgtgt

SEQ ID NO: 672996 - DNA, 25 bp, Rattus norvegicus
ttctgccaaagagcatgacgtgtgt

SEQ ID NO: 672997 - DNA, 25 bp, Rattus norvegicus
ttctgccaattacatgcccattttg

SEQ ID NO: 672998 - DNA, 25 bp, Rattus norvegicus
ttctgccaattagatgcccattttg

SEQ ID NO: 672999 - DNA, 25 bp, Rattus norvegicus
ttctgccaattcctcaacatttcat

SEQ ID NO: 673000 - DNA, 25 bp, Rattus norvegicus
ttctgccaattcgtcaacatttcat

SEQ ID NO: 673001 - DNA, 25 bp, Rattus norvegicus
ttctgccacactatttcgatgtgat

SEQ ID NO: 673002 - DNA, 25 bp, Rattus norvegicus
ttctgccacactttttcgatgtgat

SEQ ID NO: 673003 - DNA, 25 bp, Rattus norvegicus
ttctgccaccttcgaagagcgaaaa

SEQ ID NO: 673004 - DNA, 25 bp, Rattus norvegicus
ttctgccaccttggaagagcgaaaa

SEQ ID NO: 673005 - DNA, 25 bp, Rattus norvegicus
ttctgccacgccaattttgcctgaa

SEQ ID NO: 673006 - DNA, 25 bp, Rattus norvegicus
ttctgccacgcctattttgcctgaa

SEQ ID NO: 673007 - DNA, 25 bp, Rattus norvegicus
ttctgccagcagctggtccgcaaag

SEQ ID NO: 673008 - DNA, 25 bp, Rattus norvegicus
ttctgccagcaggtggtccgcaaag

SEQ ID NO: 673009 - DNA, 25 bp, Rattus norvegicus
ttctgccataggaatacttctgtct

SEQ ID NO: 673010 - DNA, 25 bp, Rattus norvegicus
ttctgccataggtatacttctgtct

SEQ ID NO: 673011 - DNA, 25 bp, Rattus norvegicus
ttctgccatagtacctcactagtaa

SEQ ID NO: 673012 - DNA, 25 bp, Rattus norvegicus
ttctgccatagttcctcactagtaa

SEQ ID NO: 673013 - DNA, 25 bp, Rattus norvegicus
ttctgccatatcaggaggactcaca

SEQ ID NO: 673014 - DNA, 25 bp, Rattus norvegicus
ttctgccatatctggaggactcaca

SEQ ID NO: 673015 - DNA, 25 bp, Rattus norvegicus
ttctgccatctaccaagtgtcaggt

SEQ ID NO: 673016 - DNA, 25 bp, Rattus norvegicus
ttctgccatctagcaagtgtcaggt

SEQ ID NO: 673017 - DNA, 25 bp, Rattus norvegicus
ttctgccatgcaccatttcctgttt

SEQ ID NO: 673018 - DNA, 25 bp, Rattus norvegicus
ttctgccatgcacctatatgtgcaa

SEQ ID NO: 673019 - DNA, 25 bp, Rattus norvegicus
ttctgccatgcagcatttcctgttt

SEQ ID NO: 673020 - DNA, 25 bp, Rattus norvegicus
ttctgccatgcagctatatgtgcaa

SEQ ID NO: 673021 - DNA, 25 bp, Rattus norvegicus
ttctgccattggactgagccatttt

SEQ ID NO: 673022 - DNA, 25 bp, Rattus norvegicus
ttctgccattggtctgagccatttt

SEQ ID NO: 673023 - DNA, 25 bp, Rattus norvegicus
ttctgccattgtaagggctccctta

SEQ ID NO: 673024 - DNA, 25 bp, Rattus norvegicus
ttctgccattgttagggctccctta

SEQ ID NO: 673025 - DNA, 25 bp, Rattus norvegicus
ttctgccattttataatcgtacaaa

SEQ ID NO: 673026 - DNA, 25 bp, Rattus norvegicus
ttctgccattttttaatcgtacaaa

SEQ ID NO: 673027 - DNA, 25 bp, Rattus norvegicus
ttctgcccaccgagctttggtgaaa

SEQ ID NO: 673028 - DNA, 25 bp, Rattus norvegicus
ttctgcccaccgtgctttggtgaaa

SEQ ID NO: 673029 - DNA, 25 bp, Rattus norvegicus
ttctgcccactgaatgcatttctgt

SEQ ID NO: 673030 - DNA, 25 bp, Rattus norvegicus
ttctgcccactgtatgcatttctgt

SEQ ID NO: 673031 - DNA, 25 bp, Rattus norvegicus
ttctgcccagaaaggacatggtcgt

SEQ ID NO: 673032 - DNA, 25 bp, Rattus norvegicus
ttctgcccagaatggacatggtcgt

SEQ ID NO: 673033 - DNA, 25 bp, Rattus norvegicus
ttctgccccaccatgaacagaacat

SEQ ID NO: 673034 - DNA, 25 bp, Rattus norvegicus
ttctgccccaccttgaacagaacat

SEQ ID NO: 673035 - DNA, 25 bp, Rattus norvegicus
ttctgccccggaattctataaacat

SEQ ID NO: 673036 - DNA, 25 bp, Rattus norvegicus
ttctgccccggatttctataaacat

SEQ ID NO: 673037 - DNA, 25 bp, Rattus norvegicus
ttctgcccctcacgactgagtgaag

SEQ ID NO: 673038 - DNA, 25 bp, Rattus norvegicus
ttctgcccctcaggactgagtgaag

SEQ ID NO: 673039 - DNA, 25 bp, Rattus norvegicus
ttctgcccgtctactgagttataaa

SEQ ID NO: 673040 - DNA, 25 bp, Rattus norvegicus
ttctgcccgtcttctgagttataaa

SEQ ID NO: 673041 - DNA, 25 bp, Rattus norvegicus
ttctgccctataacctctgttgtaa

SEQ ID NO: 673042 - DNA, 25 bp, Rattus norvegicus
ttctgccctatatcctctgttgtaa

SEQ ID NO: 673043 - DNA, 25 bp, Rattus norvegicus
ttctgccctcaaatatgtagtctgt

SEQ ID NO: 673044 - DNA, 25 bp, Rattus norvegicus
ttctgccctcaattatgtagtctgt

SEQ ID NO: 673045 - DNA, 25 bp, Rattus norvegicus
ttctgccctctgacgtctgttttaa

SEQ ID NO: 673046 - DNA, 25 bp, Rattus norvegicus
ttctgccctctgtcgtctgttttaa

SEQ ID NO: 673047 - DNA, 25 bp, Rattus norvegicus
ttctgccctgcaacttgactgggaa

SEQ ID NO: 673048 - DNA, 25 bp, Rattus norvegicus
ttctgccctgcatcttgactgggaa

SEQ ID NO: 673049 - DNA, 25 bp, Rattus norvegicus
ttctgccctggactgcatgagtttc

SEQ ID NO: 673050 - DNA, 25 bp, Rattus norvegicus
ttctgccctggagtgcatgagtttc

SEQ ID NO: 673051 - DNA, 25 bp, Rattus norvegicus
ttctgcccttgaaactggatcccaa

SEQ ID NO: 673052 - DNA, 25 bp, Rattus norvegicus
ttctgcccttgaaagtacatcggtc

SEQ ID NO: 673053 - DNA, 25 bp, Rattus norvegicus
ttctgcccttgatactggatcccaa

SEQ ID NO: 673054 - DNA, 25 bp, Rattus norvegicus
ttctgcccttgatagtacatcggtc

SEQ ID NO: 673055 - DNA, 25 bp, Rattus norvegicus
ttctgcccttttctactttggaaca

SEQ ID NO: 673056 - DNA, 25 bp, Rattus norvegicus
ttctgcccttttgtactttggaaca

SEQ ID NO: 673057 - DNA, 25 bp, Rattus norvegicus
ttctgccgagtgatcataggtacca

SEQ ID NO: 673058 - DNA, 25 bp, Rattus norvegicus
ttctgccgagtgttcataggtacca

SEQ ID NO: 673059 - DNA, 25 bp, Rattus norvegicus
ttctgccggcgtctacaaagtatga

SEQ ID NO: 673060 - DNA, 25 bp, Rattus norvegicus
ttctgccggcgtgtacaaagtatga

SEQ ID NO: 673061 - DNA, 25 bp, Rattus norvegicus
ttctgccgtttgatgggatccgtct

SEQ ID NO: 673062 - DNA, 25 bp, Rattus norvegicus
ttctgccgtttgttgggatccgtct

SEQ ID NO: 673063 - DNA, 25 bp, Rattus norvegicus
ttctgcctatatcctgcctaatcta

SEQ ID NO: 673064 - DNA, 25 bp, Rattus norvegicus
ttctgcctatatgctgcctaatcta

SEQ ID NO: 673065 - DNA, 25 bp, Rattus norvegicus
ttctgcctcatcatttataaccttt

SEQ ID NO: 673066 - DNA, 25 bp, Rattus norvegicus
ttctgcctcatcttttataaccttt

SEQ ID NO: 673067 - DNA, 25 bp, Rattus norvegicus
ttctgcctcatgctttgcagtctta

SEQ ID NO: 673068 - DNA, 25 bp, Rattus norvegicus
ttctgcctcatggtttgcagtctta

SEQ ID NO: 673069 - DNA, 25 bp, Rattus norvegicus
ttctgcctcattagctttcagtgaa

SEQ ID NO: 673070 - DNA, 25 bp, Rattus norvegicus
ttctgcctcatttgctttcagtgaa

SEQ ID NO: 673071 - DNA, 25 bp, Rattus norvegicus
ttctgcctccccaggaagatatgga

SEQ ID NO: 673072 - DNA, 25 bp, Rattus norvegicus
ttctgcctcccctggaagatatgga

SEQ ID NO: 673073 - DNA, 25 bp, Rattus norvegicus
ttctgcctccttaattgacacaatc

SEQ ID NO: 673074 - DNA, 25 bp, Rattus norvegicus
ttctgcctcctttattgacacaatc

SEQ ID NO: 673075 - DNA, 25 bp, Rattus norvegicus
ttctgcctcgagatgcttactgaac

SEQ ID NO: 673076 - DNA, 25 bp, Rattus norvegicus
ttctgcctcgagttgcttactgaac

SEQ ID NO: 673077 - DNA, 25 bp, Rattus norvegicus
ttctgcctctccaaggatgacttga

SEQ ID NO: 673078 - DNA, 25 bp, Rattus norvegicus
ttctgcctctcctaggatgacttga

SEQ ID NO: 673079 - DNA, 25 bp, Rattus norvegicus
ttctgcctctggagcgcacactggt

SEQ ID NO: 673080 - DNA, 25 bp, Rattus norvegicus
ttctgcctctggtgcgcacactggt

SEQ ID NO: 673081 - DNA, 25 bp, Rattus norvegicus
ttctgcctctgtctggagttgtcag

SEQ ID NO: 673082 - DNA, 25 bp, Rattus norvegicus
ttctgcctctgtgtggagttgtcag

SEQ ID NO: 673083 - DNA, 25 bp, Rattus norvegicus
ttctgcctcttcacatgggacaaat

SEQ ID NO: 673084 - DNA, 25 bp, Rattus norvegicus
ttctgcctcttctcatgggacaaat

SEQ ID NO: 673085 - DNA, 25 bp, Rattus norvegicus
ttctgcctgaaaacagtgagtgatg

SEQ ID NO: 673086 - DNA, 25 bp, Rattus norvegicus
ttctgcctgaaatcagtgagtgatg

SEQ ID NO: 673087 - DNA, 25 bp, Rattus norvegicus
ttctgcctgcagatgtcccaaggaa

SEQ ID NO: 673088 - DNA, 25 bp, Rattus norvegicus
ttctgcctgcagttgtcccaaggaa

SEQ ID NO: 673089 - DNA, 25 bp, Rattus norvegicus
ttctgcctgcgtcaggtatccatac

SEQ ID NO: 673090 - DNA, 25 bp, Rattus norvegicus
ttctgcctgcgtgaggtatccatac

SEQ ID NO: 673091 - DNA, 25 bp, Rattus norvegicus
ttctgcctgctgctgatgctgcttc

SEQ ID NO: 673092 - DNA, 25 bp, Rattus norvegicus
ttctgcctgctggtgatgctgcttc

SEQ ID NO: 673093 - DNA, 25 bp, Rattus norvegicus
ttctgcctggacagactttgcccaa

SEQ ID NO: 673094 - DNA, 25 bp, Rattus norvegicus
ttctgcctggactgactttgcccaa

SEQ ID NO: 673095 - DNA, 25 bp, Rattus norvegicus
ttctgcctggtccatcggagtctta

SEQ ID NO: 673096 - DNA, 25 bp, Rattus norvegicus
ttctgcctggtcgatcggagtctta

SEQ ID NO: 673097 - DNA, 25 bp, Rattus norvegicus
ttctgcctgttgacttcaaaacgcc

SEQ ID NO: 673098 - DNA, 25 bp, Rattus norvegicus
ttctgcctgttgtcttcaaaacgcc

SEQ ID NO: 673099 - DNA, 25 bp, Rattus norvegicus
ttctgccttcatatttctaaagtct

SEQ ID NO: 673100 - DNA, 25 bp, Rattus norvegicus
ttctgccttcatccaatgttaacgc

SEQ ID NO: 673101 - DNA, 25 bp, Rattus norvegicus
ttctgccttcatgcaatgttaacgc

SEQ ID NO: 673102 - DNA, 25 bp, Rattus norvegicus
ttctgccttcatttttctaaagtct

SEQ ID NO: 673103 - DNA, 25 bp, Rattus norvegicus
ttctgccttgacacttttgtgaagt

SEQ ID NO: 673104 - DNA, 25 bp, Rattus norvegicus
ttctgccttgactcttttgtgaagt

SEQ ID NO: 673105 - DNA, 25 bp, Rattus norvegicus
ttctgcctttgtccttgcaaattga

SEQ ID NO: 673106 - DNA, 25 bp, Rattus norvegicus
ttctgcctttgtgcttgcaaattga

SEQ ID NO: 673107 - DNA, 25 bp, Rattus norvegicus
ttctgcctttttacacacagctgag

SEQ ID NO: 673108 - DNA, 25 bp, Rattus norvegicus
ttctgccttttttcacacagctgag

SEQ ID NO: 673109 - DNA, 25 bp, Rattus norvegicus
ttctgcgatcagcttcctgagacaa

SEQ ID NO: 673110 - DNA, 25 bp, Rattus norvegicus
ttctgcgatcaggttcctgagacaa

SEQ ID NO: 673111 - DNA, 25 bp, Rattus norvegicus
ttctgcgcattcacctttaagagct

SEQ ID NO: 673112 - DNA, 25 bp, Rattus norvegicus
ttctgcgcattctcctttaagagct

SEQ ID NO: 673113 - DNA, 25 bp, Rattus norvegicus
ttctgcgcccacagttttgattaaa

SEQ ID NO: 673114 - DNA, 25 bp, Rattus norvegicus
ttctgcgcccactgttttgattaaa

SEQ ID NO: 673115 - DNA, 25 bp, Rattus norvegicus
ttctgcgctactagatggatccatt

SEQ ID NO: 673116 - DNA, 25 bp, Rattus norvegicus
ttctgcgctacttgatggatccatt

SEQ ID NO: 673117 - DNA, 25 bp, Rattus norvegicus
ttctgcggccaacatctcgtgtgtg

SEQ ID NO: 673118 - DNA, 25 bp, Rattus norvegicus
ttctgcggccaagatctcgtgtgtg

SEQ ID NO: 673119 - DNA, 25 bp, Rattus norvegicus
ttctgcggccacatcgccaatggaa

SEQ ID NO: 673120 - DNA, 25 bp, Rattus norvegicus
ttctgcggccacttcgccaatggaa

SEQ ID NO: 673121 - DNA, 25 bp, Rattus norvegicus
ttctgcggctacagggcagccccag

SEQ ID NO: 673122 - DNA, 25 bp, Rattus norvegicus
ttctgcggctactgggcagccccag

SEQ ID NO: 673123 - DNA, 25 bp, Rattus norvegicus
ttctgcggcttcactgtagcagtgc

SEQ ID NO: 673124 - DNA, 25 bp, Rattus norvegicus
ttctgcggcttctctgtagcagtgc

SEQ ID NO: 673125 - DNA, 25 bp, Rattus norvegicus
ttctgcggtgacattgaggcttata

SEQ ID NO: 673126 - DNA, 25 bp, Rattus norvegicus
ttctgcggtgactttgaggcttata

SEQ ID NO: 673127 - DNA, 25 bp, Rattus norvegicus
ttctgcgtgtctcgatgtcttcgtc

SEQ ID NO: 673128 - DNA, 25 bp, Rattus norvegicus
ttctgcgtgtctggatgtcttcgtc

SEQ ID NO: 673129 - DNA, 25 bp, Rattus norvegicus
ttctgcgttccaagtacggttaaca

SEQ ID NO: 673130 - DNA, 25 bp, Rattus norvegicus
ttctgcgttccatgtacggttaaca

SEQ ID NO: 673131 - DNA, 25 bp, Rattus norvegicus
ttctgctacccgaccaaattggcgg

SEQ ID NO: 673132 - DNA, 25 bp, Rattus norvegicus
ttctgctacccgtccaaattggcgg

SEQ ID NO: 673133 - DNA, 25 bp, Rattus norvegicus
ttctgctactgcatgagtttctgcc

SEQ ID NO: 673134 - DNA, 25 bp, Rattus norvegicus
ttctgctactgcttgagtttctgcc

SEQ ID NO: 673135 - DNA, 25 bp, Rattus norvegicus
ttctgctacttaccacaacttctaa

SEQ ID NO: 673136 - DNA, 25 bp, Rattus norvegicus
ttctgctacttagcacaacttctaa

SEQ ID NO: 673137 - DNA, 25 bp, Rattus norvegicus
ttctgctactttctggatagtggat

SEQ ID NO: 673138 - DNA, 25 bp, Rattus norvegicus
ttctgctactttgtggatagtggat

SEQ ID NO: 673139 - DNA, 25 bp, Rattus norvegicus
ttctgctaggcgcaaatgccttgta

SEQ ID NO: 673140 - DNA, 25 bp, Rattus norvegicus
ttctgctaggcggaaatgccttgta

SEQ ID NO: 673141 - DNA, 25 bp, Rattus norvegicus
ttctgctatcttcctacagcgggaa

SEQ ID NO: 673142 - DNA, 25 bp, Rattus norvegicus
ttctgctatcttgctacagcgggaa

SEQ ID NO: 673143 - DNA, 25 bp, Rattus norvegicus
ttctgctcactgatgaaggcgactt

SEQ ID NO: 673144 - DNA, 25 bp, Rattus norvegicus
ttctgctcactgttgaaggcgactt

SEQ ID NO: 673145 - DNA, 25 bp, Rattus norvegicus
ttctgctcatgtcattggtcgccgt

SEQ ID NO: 673146 - DNA, 25 bp, Rattus norvegicus
ttctgctcatgtgattggtcgccgt

SEQ ID NO: 673147 - DNA, 25 bp, Rattus norvegicus
ttctgctcattccttaaagcttggt

SEQ ID NO: 673148 - DNA, 25 bp, Rattus norvegicus
ttctgctcattcgttaaagcttggt

SEQ ID NO: 673149 - DNA, 25 bp, Rattus norvegicus
ttctgctcccagaacttgtatgtgg

SEQ ID NO: 673150 - DNA, 25 bp, Rattus norvegicus
ttctgctcccagtacttgtatgtgg

SEQ ID NO: 673151 - DNA, 25 bp, Rattus norvegicus
ttctgctccccactgaactgtgtta

SEQ ID NO: 673152 - DNA, 25 bp, Rattus norvegicus
ttctgctccccagtgaactgtgtta

SEQ ID NO: 673153 - DNA, 25 bp, Rattus norvegicus
ttctgctcccggaggactgagcata

SEQ ID NO: 673154 - DNA, 25 bp, Rattus norvegicus
ttctgctcccggtggactgagcata

SEQ ID NO: 673155 - DNA, 25 bp, Rattus norvegicus
ttctgctcctcaaggagatggacaa

SEQ ID NO: 673156 - DNA, 25 bp, Rattus norvegicus
ttctgctcctcatggagatggacaa

SEQ ID NO: 673157 - DNA, 25 bp, Rattus norvegicus
ttctgctcctctacgcttttaatga

SEQ ID NO: 673158 - DNA, 25 bp, Rattus norvegicus
ttctgctcctcttcgcttttaatga

SEQ ID NO: 673159 - DNA, 25 bp, Rattus norvegicus
ttctgctcctgtctttttcacttaa

SEQ ID NO: 673160 - DNA, 25 bp, Rattus norvegicus
ttctgctcctgtgtttttcacttaa

SEQ ID NO: 673161 - DNA, 25 bp, Rattus norvegicus
ttctgctcgcacagcactggagtta

SEQ ID NO: 673162 - DNA, 25 bp, Rattus norvegicus
ttctgctcgcactgcactggagtta

SEQ ID NO: 673163 - DNA, 25 bp, Rattus norvegicus
ttctgctcgggacacgtttctgcaa

SEQ ID NO: 673164 - DNA, 25 bp, Rattus norvegicus
ttctgctcgggagacgtttctgcaa

SEQ ID NO: 673165 - DNA, 25 bp, Rattus norvegicus
ttctgctctgccaagtacagtgtca

SEQ ID NO: 673166 - DNA, 25 bp, Rattus norvegicus
ttctgctctgcctagtacagtgtca

SEQ ID NO: 673167 - DNA, 25 bp, Rattus norvegicus
ttctgctctggaccgtctatgctta

SEQ ID NO: 673168 - DNA, 25 bp, Rattus norvegicus
ttctgctctggagcgtctatgctta

SEQ ID NO: 673169 - DNA, 25 bp, Rattus norvegicus
ttctgctctgtaacttttttctttc

SEQ ID NO: 673170 - DNA, 25 bp, Rattus norvegicus
ttctgctctgtatcttttttctttc

SEQ ID NO: 673171 - DNA, 25 bp, Rattus norvegicus
ttctgctctgttataaccttgtggc

SEQ ID NO: 673172 - DNA, 25 bp, Rattus norvegicus
ttctgctctgttttaaccttgtggc

SEQ ID NO: 673173 - DNA, 25 bp, Rattus norvegicus
ttctgctctttccaggtatatgaca

SEQ ID NO: 673174 - DNA, 25 bp, Rattus norvegicus
ttctgctctttcgaggtatatgaca

SEQ ID NO: 673175 - DNA, 25 bp, Rattus norvegicus
ttctgctgaatcacgtttccgtatc

SEQ ID NO: 673176 - DNA, 25 bp, Rattus norvegicus
ttctgctgaatctcgtttccgtatc

SEQ ID NO: 673177 - DNA, 25 bp, Rattus norvegicus
ttctgctgagatctgaatgcccatc

SEQ ID NO: 673178 - DNA, 25 bp, Rattus norvegicus
ttctgctgagatgtgaatgcccatc

SEQ ID NO: 673179 - DNA, 25 bp, Rattus norvegicus
ttctgctgagggatgtggtgcttac

SEQ ID NO: 673180 - DNA, 25 bp, Rattus norvegicus
ttctgctgagggttgtggtgcttac

SEQ ID NO: 673181 - DNA, 25 bp, Rattus norvegicus
ttctgctgagttccagacttctggg

SEQ ID NO: 673182 - DNA, 25 bp, Rattus norvegicus
ttctgctgagttgcagacttctggg

SEQ ID NO: 673183 - DNA, 25 bp, Rattus norvegicus
ttctgctgcaggcactcacaaatgt

SEQ ID NO: 673184 - DNA, 25 bp, Rattus norvegicus
ttctgctgcagggactcacaaatgt

SEQ ID NO: 673185 - DNA, 25 bp, Rattus norvegicus
ttctgctgcagtagggtttgcccat

SEQ ID NO: 673186 - DNA, 25 bp, Rattus norvegicus
ttctgctgcagttgggtttgcccat

SEQ ID NO: 673187 - DNA, 25 bp, Rattus norvegicus
ttctgctgcctcagcttagaggtga

SEQ ID NO: 673188 - DNA, 25 bp, Rattus norvegicus
ttctgctgcctctgcttagaggtga

SEQ ID NO: 673189 - DNA, 25 bp, Rattus norvegicus
ttctgctgctgaaaattctgccggc

SEQ ID NO: 673190 - DNA, 25 bp, Rattus norvegicus
ttctgctgctgataattctgccggc

SEQ ID NO: 673191 - DNA, 25 bp, Rattus norvegicus
ttctgctggtacaaagggtcaccaa

SEQ ID NO: 673192 - DNA, 25 bp, Rattus norvegicus
ttctgctggtactaagggtcaccaa

SEQ ID NO: 673193 - DNA, 25 bp, Rattus norvegicus
ttctgctgtgacctgactcttaaaa

SEQ ID NO: 673194 - DNA, 25 bp, Rattus norvegicus
ttctgctgtgacgtgactcttaaaa

SEQ ID NO: 673195 - DNA, 25 bp, Rattus norvegicus
ttctgctgtgcccatcaatagttga

SEQ ID NO: 673196 - DNA, 25 bp, Rattus norvegicus
ttctgctgtgccgatcaatagttga

SEQ ID NO: 673197 - DNA, 25 bp, Rattus norvegicus
ttctgctgttccaatagccactggg

SEQ ID NO: 673198 - DNA, 25 bp, Rattus norvegicus
ttctgctgttcctatagccactggg

SEQ ID NO: 673199 - DNA, 25 bp, Rattus norvegicus
ttctgcttacacactttctaggtta

SEQ ID NO: 673200 - DNA, 25 bp, Rattus norvegicus
ttctgcttacactctttctaggtta

SEQ ID NO: 673201 - DNA, 25 bp, Rattus norvegicus
ttctgcttacagatggatgtatctt

SEQ ID NO: 673202 - DNA, 25 bp, Rattus norvegicus
ttctgcttacagttggatgtatctt

SEQ ID NO: 673203 - DNA, 25 bp, Rattus norvegicus
ttctgcttccccattaagatgcgaa

SEQ ID NO: 673204 - DNA, 25 bp, Rattus norvegicus
ttctgcttcccctttaagatgcgaa

SEQ ID NO: 673205 - DNA, 25 bp, Rattus norvegicus
ttctgcttctagaccattctctgct

SEQ ID NO: 673206 - DNA, 25 bp, Rattus norvegicus
ttctgcttctagtccattctctgct

SEQ ID NO: 673207 - DNA, 25 bp, Rattus norvegicus
ttctgcttctctacggagttgctcg

SEQ ID NO: 673208 - DNA, 25 bp, Rattus norvegicus
ttctgcttctcttcggagttgctcg

SEQ ID NO: 673209 - DNA, 25 bp, Rattus norvegicus
ttctgcttctgtccctgaatttaga

SEQ ID NO: 673210 - DNA, 25 bp, Rattus norvegicus
ttctgcttctgtccgagcacaggcc

SEQ ID NO: 673211 - DNA, 25 bp, Rattus norvegicus
ttctgcttctgtgcctgaatttaga

SEQ ID NO: 673212 - DNA, 25 bp, Rattus norvegicus
ttctgcttctgtgcgagcacaggcc

SEQ ID NO: 673213 - DNA, 25 bp, Rattus norvegicus
ttctgcttcttgatcttcaacgtta

SEQ ID NO: 673214 - DNA, 25 bp, Rattus norvegicus
ttctgcttcttgttcttcaacgtta

SEQ ID NO: 673215 - DNA, 25 bp, Rattus norvegicus
ttctgcttgaccctgcatcgataca

SEQ ID NO: 673216 - DNA, 25 bp, Rattus norvegicus
ttctgcttgaccgtgcatcgataca

SEQ ID NO: 673217 - DNA, 25 bp, Rattus norvegicus
ttctgcttgcgtcggcatctggcta

SEQ ID NO: 673218 - DNA, 25 bp, Rattus norvegicus
ttctgcttgcgtgggcatctggcta

SEQ ID NO: 673219 - DNA, 25 bp, Rattus norvegicus
ttctgcttgggaatctttggtcttt

SEQ ID NO: 673220 - DNA, 25 bp, Rattus norvegicus
ttctgcttgggattctttggtcttt

SEQ ID NO: 673221 - DNA, 25 bp, Rattus norvegicus
ttctgctttcttactggaccagtct

SEQ ID NO: 673222 - DNA, 25 bp, Rattus norvegicus
ttctgctttctttctggaccagtct

SEQ ID NO: 673223 - DNA, 25 bp, Rattus norvegicus
ttctgctttgtgatcatgtgtccta

SEQ ID NO: 673224 - DNA, 25 bp, Rattus norvegicus
ttctgctttgtgttcatgtgtccta

SEQ ID NO: 673225 - DNA, 25 bp, Rattus norvegicus
ttctgcttttccacaaagagcttta

SEQ ID NO: 673226 - DNA, 25 bp, Rattus norvegicus
ttctgcttttcctcaaagagcttta

SEQ ID NO: 673227 - DNA, 25 bp, Rattus norvegicus
ttctgcttttgacgcttcagcttca

SEQ ID NO: 673228 - DNA, 25 bp, Rattus norvegicus
ttctgcttttgaggcttcagcttca

SEQ ID NO: 673229 - DNA, 25 bp, Rattus norvegicus
ttctggaaaccaagagcccattcta

SEQ ID NO: 673230 - DNA, 25 bp, Rattus norvegicus
ttctggaaaccatgagcccattcta

SEQ ID NO: 673231 - DNA, 25 bp, Rattus norvegicus
ttctggaaactgatggtgtctgcaa

SEQ ID NO: 673232 - DNA, 25 bp, Rattus norvegicus
ttctggaaactgttggtgtctgcaa

SEQ ID NO: 673233 - DNA, 25 bp, Rattus norvegicus
ttctggaaagccctcatgatacctc

SEQ ID NO: 673234 - DNA, 25 bp, Rattus norvegicus
ttctggaaagccgtcatgatacctc

SEQ ID NO: 673235 - DNA, 25 bp, Rattus norvegicus
ttctggaacccaagccctggagata

SEQ ID NO: 673236 - DNA, 25 bp, Rattus norvegicus
ttctggaacccatgccctggagata

SEQ ID NO: 673237 - DNA, 25 bp, Rattus norvegicus
ttctggaagcggagtcccacagccg

SEQ ID NO: 673238 - DNA, 25 bp, Rattus norvegicus
ttctggaagcggtgtcccacagccg

SEQ ID NO: 673239 - DNA, 25 bp, Rattus norvegicus
ttctggaaggcgacgtgttgcagct

SEQ ID NO: 673240 - DNA, 25 bp, Rattus norvegicus
ttctggaaggcgtcgtgttgcagct

SEQ ID NO: 673241 - DNA, 25 bp, Rattus norvegicus
ttctggaagtcactctagccattaa

SEQ ID NO: 673242 - DNA, 25 bp, Rattus norvegicus
ttctggaagtcagtctagccattaa

SEQ ID NO: 673243 - DNA, 25 bp, Rattus norvegicus
ttctggaatcacacaagagagaaca

SEQ ID NO: 673244 - DNA, 25 bp, Rattus norvegicus
ttctggaatcactcaagagagaaca

SEQ ID NO: 673245 - DNA, 25 bp, Rattus norvegicus
ttctggaattctcagctttcaccca

SEQ ID NO: 673246 - DNA, 25 bp, Rattus norvegicus
ttctggaattctgagctttcaccca

SEQ ID NO: 673247 - DNA, 25 bp, Rattus norvegicus
ttctggacacaaccagggctggcct

SEQ ID NO: 673248 - DNA, 25 bp, Rattus norvegicus
ttctggacacaagcagggctggcct

SEQ ID NO: 673249 - DNA, 25 bp, Rattus norvegicus
ttctggacagctagcctttcggagg

SEQ ID NO: 673250 - DNA, 25 bp, Rattus norvegicus
ttctggacagcttgcctttcggagg

SEQ ID NO: 673251 - DNA, 25 bp, Rattus norvegicus
ttctggaccagcagacttaatgtca

SEQ ID NO: 673252 - DNA, 25 bp, Rattus norvegicus
ttctggaccagctgacttaatgtca

SEQ ID NO: 673253 - DNA, 25 bp, Rattus norvegicus
ttctggaccccaaggacacctgtac

SEQ ID NO: 673254 - DNA, 25 bp, Rattus norvegicus
ttctggaccccatggacacctgtac

SEQ ID NO: 673255 - DNA, 25 bp, Rattus norvegicus
ttctggacctggcacagcattttct

SEQ ID NO: 673256 - DNA, 25 bp, Rattus norvegicus
ttctggacctgggacagcattttct

SEQ ID NO: 673257 - DNA, 25 bp, Rattus norvegicus
ttctggacgcctaacaacatcgtga

SEQ ID NO: 673258 - DNA, 25 bp, Rattus norvegicus
ttctggacgccttacaacatcgtga

SEQ ID NO: 673259 - DNA, 25 bp, Rattus norvegicus
ttctggacgctgattcttctgtgat

SEQ ID NO: 673260 - DNA, 25 bp, Rattus norvegicus
ttctggacgctgtttcttctgtgat

SEQ ID NO: 673261 - DNA, 25 bp, Rattus norvegicus
ttctggacttgtaggacctgctgga

SEQ ID NO: 673262 - DNA, 25 bp, Rattus norvegicus
ttctggacttgttggacctgctgga

SEQ ID NO: 673263 - DNA, 25 bp, Rattus norvegicus
ttctggagaacgcacaggtctgcat

SEQ ID NO: 673264 - DNA, 25 bp, Rattus norvegicus
ttctggagaacggacaggtctgcat

SEQ ID NO: 673265 - DNA, 25 bp, Rattus norvegicus
ttctggagcaacaagtccgtgcact

SEQ ID NO: 673266 - DNA, 25 bp, Rattus norvegicus
ttctggagcaactagtccgtgcact

SEQ ID NO: 673267 - DNA, 25 bp, Rattus norvegicus
ttctggaggaggcacccagctctgt

SEQ ID NO: 673268 - DNA, 25 bp, Rattus norvegicus
ttctggaggagggacccagctctgt

SEQ ID NO: 673269 - DNA, 25 bp, Rattus norvegicus
ttctggaggcctcagacccaagaag

SEQ ID NO: 673270 - DNA, 25 bp, Rattus norvegicus
ttctggaggcctgagacccaagaag

SEQ ID NO: 673271 - DNA, 25 bp, Rattus norvegicus
ttctggaggcgacccatcgtggtca

SEQ ID NO: 673272 - DNA, 25 bp, Rattus norvegicus
ttctggaggcgagccatcgtggtca

SEQ ID NO: 673273 - DNA, 25 bp, Rattus norvegicus
ttctggagggttcaagcccacacta

SEQ ID NO: 673274 - DNA, 25 bp, Rattus norvegicus
ttctggagggttgaagcccacacta

SEQ ID NO: 673275 - DNA, 25 bp, Rattus norvegicus
ttctggagtcttcctaggttgtacc

SEQ ID NO: 673276 - DNA, 25 bp, Rattus norvegicus
ttctggagtcttgctaggttgtacc

SEQ ID NO: 673277 - DNA, 25 bp, Rattus norvegicus
ttctggagttccatgggcaccttgg

SEQ ID NO: 673278 - DNA, 25 bp, Rattus norvegicus
ttctggagttccttgggcaccttgg

SEQ ID NO: 673279 - DNA, 25 bp, Rattus norvegicus
ttctggatccagagaactcaccagt

SEQ ID NO: 673280 - DNA, 25 bp, Rattus norvegicus
ttctggatccagtgaactcaccagt

SEQ ID NO: 673281 - DNA, 25 bp, Rattus norvegicus
ttctggatcctcatgctgaagctgg

SEQ ID NO: 673282 - DNA, 25 bp, Rattus norvegicus
ttctggatcctcttgctgaagctgg

SEQ ID NO: 673283 - DNA, 25 bp, Rattus norvegicus
ttctggatctccaatcaggctgagt

SEQ ID NO: 673284 - DNA, 25 bp, Rattus norvegicus
ttctggatctcctatcaggctgagt

SEQ ID NO: 673285 - DNA, 25 bp, Rattus norvegicus
ttctggatctggcttatgagctgat

SEQ ID NO: 673286 - DNA, 25 bp, Rattus norvegicus
ttctggatctgggttatgagctgat

SEQ ID NO: 673287 - DNA, 25 bp, Rattus norvegicus
ttctggatgcctcctggtcaaataa

SEQ ID NO: 673288 - DNA, 25 bp, Rattus norvegicus
ttctggatgcctgctggtcaaataa

SEQ ID NO: 673289 - DNA, 25 bp, Rattus norvegicus
ttctggatgtccctgtgtttgcatc

SEQ ID NO: 673290 - DNA, 25 bp, Rattus norvegicus
ttctggatgtccgtgtgtttgcatc

SEQ ID NO: 673291 - DNA, 25 bp, Rattus norvegicus
ttctggatgtgtatggagcttcccc

SEQ ID NO: 673292 - DNA, 25 bp, Rattus norvegicus
ttctggatgtgtttggagcttcccc

SEQ ID NO: 673293 - DNA, 25 bp, Rattus norvegicus
ttctggattcacattaacgctttaa

SEQ ID NO: 673294 - DNA, 25 bp, Rattus norvegicus
ttctggattcactttaacgctttaa

SEQ ID NO: 673295 - DNA, 25 bp, Rattus norvegicus
ttctggattgtccatctctgtcaca

SEQ ID NO: 673296 - DNA, 25 bp, Rattus norvegicus
ttctggattgtcgatctctgtcaca

SEQ ID NO: 673297 - DNA, 25 bp, Rattus norvegicus
ttctggcaaacaccgcacgggaagc

SEQ ID NO: 673298 - DNA, 25 bp, Rattus norvegicus
ttctggcaaacagcgcacgggaagc

SEQ ID NO: 673299 - DNA, 25 bp, Rattus norvegicus
ttctggcaaattcctgaagtttctg

SEQ ID NO: 673300 - DNA, 25 bp, Rattus norvegicus
ttctggcaaattgctgaagtttctg

SEQ ID NO: 673301 - DNA, 25 bp, Rattus norvegicus
ttctggcaacagagtcccggagccc

SEQ ID NO: 673302 - DNA, 25 bp, Rattus norvegicus
ttctggcaacagtgtcccggagccc

SEQ ID NO: 673303 - DNA, 25 bp, Rattus norvegicus
ttctggcaagaaagacgtggtttat

SEQ ID NO: 673304 - DNA, 25 bp, Rattus norvegicus
ttctggcaagaatgacgtggtttat

SEQ ID NO: 673305 - DNA, 25 bp, Rattus norvegicus
ttctggcacggcatgccgtccttca

SEQ ID NO: 673306 - DNA, 25 bp, Rattus norvegicus
ttctggcacggcttgccgtccttca

SEQ ID NO: 673307 - DNA, 25 bp, Rattus norvegicus
ttctggcagagccttttggttctgt

SEQ ID NO: 673308 - DNA, 25 bp, Rattus norvegicus
ttctggcagagcgttttggttctgt

SEQ ID NO: 673309 - DNA, 25 bp, Rattus norvegicus
ttctggcatccacataattcttgtt

SEQ ID NO: 673310 - DNA, 25 bp, Rattus norvegicus
ttctggcatccagataattcttgtt

SEQ ID NO: 673311 - DNA, 25 bp, Rattus norvegicus
ttctggccaatgctgggttctttct

SEQ ID NO: 673312 - DNA, 25 bp, Rattus norvegicus
ttctggccaatggtgggttctttct

SEQ ID NO: 673313 - DNA, 25 bp, Rattus norvegicus
ttctggccaccaaagtcacagacat

SEQ ID NO: 673314 - DNA, 25 bp, Rattus norvegicus
ttctggccaccatagtcacagacat

SEQ ID NO: 673315 - DNA, 25 bp, Rattus norvegicus
ttctggccagctattgaagcctgac

SEQ ID NO: 673316 - DNA, 25 bp, Rattus norvegicus
ttctggccagcttttgaagcctgac

SEQ ID NO: 673317 - DNA, 25 bp, Rattus norvegicus
ttctggccagttcaaaccctacaaa

SEQ ID NO: 673318 - DNA, 25 bp, Rattus norvegicus
ttctggccagttgaaaccctacaaa

SEQ ID NO: 673319 - DNA, 25 bp, Rattus norvegicus
ttctggccatcacagatatctctct

SEQ ID NO: 673320 - DNA, 25 bp, Rattus norvegicus
ttctggccatcagagatatctctct

SEQ ID NO: 673321 - DNA, 25 bp, Rattus norvegicus
ttctggccatctaaactttagcttt

SEQ ID NO: 673322 - DNA, 25 bp, Rattus norvegicus
ttctggccatcttaactttagcttt

SEQ ID NO: 673323 - DNA, 25 bp, Rattus norvegicus
ttctggccatgtccttgtagctaca

SEQ ID NO: 673324 - DNA, 25 bp, Rattus norvegicus
ttctggccatgtgcttgtagctaca

SEQ ID NO: 673325 - DNA, 25 bp, Rattus norvegicus
ttctggccattaacggcatcctcaa

SEQ ID NO: 673326 - DNA, 25 bp, Rattus norvegicus
ttctggccattatcggcatcctcaa

SEQ ID NO: 673327 - DNA, 25 bp, Rattus norvegicus
ttctggcccaatccggaagtggaca

SEQ ID NO: 673328 - DNA, 25 bp, Rattus norvegicus
ttctggcccaatgcggaagtggaca

SEQ ID NO: 673329 - DNA, 25 bp, Rattus norvegicus
ttctggcccagaactatctgacaga

SEQ ID NO: 673330 - DNA, 25 bp, Rattus norvegicus
ttctggcccagatctatctgacaga

SEQ ID NO: 673331 - DNA, 25 bp, Rattus norvegicus
ttctggcccctaaatccagtgcaaa

SEQ ID NO: 673332 - DNA, 25 bp, Rattus norvegicus
ttctggcccctatatccagtgcaaa

SEQ ID NO: 673333 - DNA, 25 bp, Rattus norvegicus
ttctggccgtagctgtccaaagagt

SEQ ID NO: 673334 - DNA, 25 bp, Rattus norvegicus
ttctggccgtaggtgtccaaagagt

SEQ ID NO: 673335 - DNA, 25 bp, Rattus norvegicus
ttctggcctcaacatgtatctctta

SEQ ID NO: 673336 - DNA, 25 bp, Rattus norvegicus
ttctggcctcaagatgtatctctta

SEQ ID NO: 673337 - DNA, 25 bp, Rattus norvegicus
ttctggcctccaaacatatgtgcat

SEQ ID NO: 673338 - DNA, 25 bp, Rattus norvegicus
ttctggcctccatacatatgtgcat

SEQ ID NO: 673339 - DNA, 25 bp, Rattus norvegicus
ttctggcctctgagctatcttccca

SEQ ID NO: 673340 - DNA, 25 bp, Rattus norvegicus
ttctggcctctgcagttattacatg

SEQ ID NO: 673341 - DNA, 25 bp, Rattus norvegicus
ttctggcctctggagttattacatg

SEQ ID NO: 673342 - DNA, 25 bp, Rattus norvegicus
ttctggcctctgtgctatcttccca

SEQ ID NO: 673343 - DNA, 25 bp, Rattus norvegicus
ttctggcctgctctgcaaatgaact

SEQ ID NO: 673344 - DNA, 25 bp, Rattus norvegicus
ttctggcctgctgtgcaaatgaact

SEQ ID NO: 673345 - DNA, 25 bp, Rattus norvegicus
ttctggcctggtcatgacattacaa

SEQ ID NO: 673346 - DNA, 25 bp, Rattus norvegicus
ttctggcctggtgatgacattacaa

SEQ ID NO: 673347 - DNA, 25 bp, Rattus norvegicus
ttctggccttcaaggacacaggtac

SEQ ID NO: 673348 - DNA, 25 bp, Rattus norvegicus
ttctggccttcacagccatgaaagg

SEQ ID NO: 673349 - DNA, 25 bp, Rattus norvegicus
ttctggccttcagagccatgaaagg

SEQ ID NO: 673350 - DNA, 25 bp, Rattus norvegicus
ttctggccttcatggacacaggtac

SEQ ID NO: 673351 - DNA, 25 bp, Rattus norvegicus
ttctggcgcattattctccacaata

SEQ ID NO: 673352 - DNA, 25 bp, Rattus norvegicus
ttctggcgcatttttctccacaata

SEQ ID NO: 673353 - DNA, 25 bp, Rattus norvegicus
ttctggcgccacctagtggtcagaa

SEQ ID NO: 673354 - DNA, 25 bp, Rattus norvegicus
ttctggcgccacgtagtggtcagaa

SEQ ID NO: 673355 - DNA, 25 bp, Rattus norvegicus
ttctggcgtaatagaagtcatgctt

SEQ ID NO: 673356 - DNA, 25 bp, Rattus norvegicus
ttctggcgtaattgaagtcatgctt

SEQ ID NO: 673357 - DNA, 25 bp, Rattus norvegicus
ttctggcgtttcattccagcgagag

SEQ ID NO: 673358 - DNA, 25 bp, Rattus norvegicus
ttctggcgtttctttccagcgagag

SEQ ID NO: 673359 - DNA, 25 bp, Rattus norvegicus
ttctggctaaatcctcttcctgagg

SEQ ID NO: 673360 - DNA, 25 bp, Rattus norvegicus
ttctggctaaatgctcttcctgagg

SEQ ID NO: 673361 - DNA, 25 bp, Rattus norvegicus
ttctggctactaatggagctctcct

SEQ ID NO: 673362 - DNA, 25 bp, Rattus norvegicus
ttctggctactattggagctctcct

SEQ ID NO: 673363 - DNA, 25 bp, Rattus norvegicus
ttctggctactgaggcttcatggca

SEQ ID NO: 673364 - DNA, 25 bp, Rattus norvegicus
ttctggctactgatcattcactagt

SEQ ID NO: 673365 - DNA, 25 bp, Rattus norvegicus
ttctggctactgtggcttcatggca

SEQ ID NO: 673366 - DNA, 25 bp, Rattus norvegicus
ttctggctactgttcattcactagt

SEQ ID NO: 673367 - DNA, 25 bp, Rattus norvegicus
ttctggctcagcagcagaggctcct

SEQ ID NO: 673368 - DNA, 25 bp, Rattus norvegicus
ttctggctcagctgcagaggctcct

SEQ ID NO: 673369 - DNA, 25 bp, Rattus norvegicus
ttctggctcggaagcatctgcacaa

SEQ ID NO: 673370 - DNA, 25 bp, Rattus norvegicus
ttctggctcggatgcatctgcacaa

SEQ ID NO: 673371 - DNA, 25 bp, Rattus norvegicus
ttctggctcttgactacttttgtac

SEQ ID NO: 673372 - DNA, 25 bp, Rattus norvegicus
ttctggctcttgtctacttttgtac

SEQ ID NO: 673373 - DNA, 25 bp, Rattus norvegicus
ttctggctgcagactagagatgtcc

SEQ ID NO: 673374 - DNA, 25 bp, Rattus norvegicus
ttctggctgcagtctagagatgtcc

SEQ ID NO: 673375 - DNA, 25 bp, Rattus norvegicus
ttctggctgctcatgagtcgttata

SEQ ID NO: 673376 - DNA, 25 bp, Rattus norvegicus
ttctggctgctcttgagtcgttata

SEQ ID NO: 673377 - DNA, 25 bp, Rattus norvegicus
ttctggctggcaaattctcgtggga

SEQ ID NO: 673378 - DNA, 25 bp, Rattus norvegicus
ttctggctggcatattctcgtggga

SEQ ID NO: 673379 - DNA, 25 bp, Rattus norvegicus
ttctggctgggcagggaacagtcac

SEQ ID NO: 673380 - DNA, 25 bp, Rattus norvegicus
ttctggctgggctgggaacagtcac

SEQ ID NO: 673381 - DNA, 25 bp, Rattus norvegicus
ttctggctgtatcctttctctttta

SEQ ID NO: 673382 - DNA, 25 bp, Rattus norvegicus
ttctggctgtatgctttctctttta

SEQ ID NO: 673383 - DNA, 25 bp, Rattus norvegicus
ttctggctgtgaactcaggaagctc

SEQ ID NO: 673384 - DNA, 25 bp, Rattus norvegicus
ttctggctgtgatctcaggaagctc

SEQ ID NO: 673385 - DNA, 25 bp, Rattus norvegicus
ttctggctgtgcacacatgtgatca

SEQ ID NO: 673386 - DNA, 25 bp, Rattus norvegicus
ttctggctgtgctcacatgtgatca

SEQ ID NO: 673387 - DNA, 25 bp, Rattus norvegicus
ttctggcttaaaccagattcccatt

SEQ ID NO: 673388 - DNA, 25 bp, Rattus norvegicus
ttctggcttaaagcagattcccatt

SEQ ID NO: 673389 - DNA, 25 bp, Rattus norvegicus
ttctggcttagtatgttggtgacac

SEQ ID NO: 673390 - DNA, 25 bp, Rattus norvegicus
ttctggcttagtttgttggtgacac

SEQ ID NO: 673391 - DNA, 25 bp, Rattus norvegicus
ttctggcttcttctgtctaacatgt

SEQ ID NO: 673392 - DNA, 25 bp, Rattus norvegicus
ttctggcttcttgtgtctaacatgt

SEQ ID NO: 673393 - DNA, 25 bp, Rattus norvegicus
ttctggctttacaaccctaggtgat

SEQ ID NO: 673394 - DNA, 25 bp, Rattus norvegicus
ttctggctttactaccctaggtgat

SEQ ID NO: 673395 - DNA, 25 bp, Rattus norvegicus
ttctgggaacgtccagtgacctgga

SEQ ID NO: 673396 - DNA, 25 bp, Rattus norvegicus
ttctgggaacgtgcagtgacctgga

SEQ ID NO: 673397 - DNA, 25 bp, Rattus norvegicus
ttctgggaagcgaggttcagctttt

SEQ ID NO: 673398 - DNA, 25 bp, Rattus norvegicus
ttctgggaagcgtggttcagctttt

SEQ ID NO: 673399 - DNA, 25 bp, Rattus norvegicus
ttctgggacagacctttagccctgt

SEQ ID NO: 673400 - DNA, 25 bp, Rattus norvegicus
ttctgggacagagctttagccctgt

SEQ ID NO: 673401 - DNA, 25 bp, Rattus norvegicus
ttctgggactaaaaggcacttgcac

SEQ ID NO: 673402 - DNA, 25 bp, Rattus norvegicus
ttctgggactaataggcacttgcac

SEQ ID NO: 673403 - DNA, 25 bp, Rattus norvegicus
ttctgggactgtaaaaacggaggct

SEQ ID NO: 673404 - DNA, 25 bp, Rattus norvegicus
ttctgggactgttaaaacggaggct

SEQ ID NO: 673405 - DNA, 25 bp, Rattus norvegicus
ttctgggagaagagcggacgcccac

SEQ ID NO: 673406 - DNA, 25 bp, Rattus norvegicus
ttctgggagaagtgcggacgcccac

SEQ ID NO: 673407 - DNA, 25 bp, Rattus norvegicus
ttctgggagaatcacctggccttag

SEQ ID NO: 673408 - DNA, 25 bp, Rattus norvegicus
ttctgggagaatgacctggccttag

SEQ ID NO: 673409 - DNA, 25 bp, Rattus norvegicus
ttctgggagcatcctcactagtgaa

SEQ ID NO: 673410 - DNA, 25 bp, Rattus norvegicus
ttctgggagcatgctcactagtgaa

SEQ ID NO: 673411 - DNA, 25 bp, Rattus norvegicus
ttctgggagcctatgagacctggat

SEQ ID NO: 673412 - DNA, 25 bp, Rattus norvegicus
ttctgggagcctttgagacctggat

SEQ ID NO: 673413 - DNA, 25 bp, Rattus norvegicus
ttctgggatcccatgaaggtccatg

SEQ ID NO: 673414 - DNA, 25 bp, Rattus norvegicus
ttctgggatcccttgaaggtccatg

SEQ ID NO: 673415 - DNA, 25 bp, Rattus norvegicus
ttctgggatgcaccgacccctatgc

SEQ ID NO: 673416 - DNA, 25 bp, Rattus norvegicus
ttctgggatgcagcgacccctatgc

SEQ ID NO: 673417 - DNA, 25 bp, Rattus norvegicus
ttctgggattgcaaccagtgctctt

SEQ ID NO: 673418 - DNA, 25 bp, Rattus norvegicus
ttctgggattgcatgttctgtacac

SEQ ID NO: 673419 - DNA, 25 bp, Rattus norvegicus
ttctgggattgctaccagtgctctt

SEQ ID NO: 673420 - DNA, 25 bp, Rattus norvegicus
ttctgggattgcttgttctgtacac

SEQ ID NO: 673421 - DNA, 25 bp, Rattus norvegicus
ttctgggcaaccacagcagctgctg

SEQ ID NO: 673422 - DNA, 25 bp, Rattus norvegicus
ttctgggcaacctcagcagctgctg

SEQ ID NO: 673423 - DNA, 25 bp, Rattus norvegicus
ttctgggcacttacctggtacagag

SEQ ID NO: 673424 - DNA, 25 bp, Rattus norvegicus
ttctgggcactttcctggtacagag

SEQ ID NO: 673425 - DNA, 25 bp, Rattus norvegicus
ttctgggcagagctcctttgttcta

SEQ ID NO: 673426 - DNA, 25 bp, Rattus norvegicus
ttctgggcagaggtcctttgttcta

SEQ ID NO: 673427 - DNA, 25 bp, Rattus norvegicus
ttctgggcataacagaaccctccct

SEQ ID NO: 673428 - DNA, 25 bp, Rattus norvegicus
ttctgggcataagagaaccctccct

SEQ ID NO: 673429 - DNA, 25 bp, Rattus norvegicus
ttctgggccaggatgtgcctgagca

SEQ ID NO: 673430 - DNA, 25 bp, Rattus norvegicus
ttctgggccaggattggtctgcaaa

SEQ ID NO: 673431 - DNA, 25 bp, Rattus norvegicus
ttctgggccaggttgtgcctgagca

SEQ ID NO: 673432 - DNA, 25 bp, Rattus norvegicus
ttctgggccaggtttggtctgcaaa

SEQ ID NO: 673433 - DNA, 25 bp, Rattus norvegicus
ttctgggcccacatgccattgacaa

SEQ ID NO: 673434 - DNA, 25 bp, Rattus norvegicus
ttctgggcccacttgccattgacaa

SEQ ID NO: 673435 - DNA, 25 bp, Rattus norvegicus
ttctgggcccctactgtagctttct

SEQ ID NO: 673436 - DNA, 25 bp, Rattus norvegicus
ttctgggccccttctgtagctttct

SEQ ID NO: 673437 - DNA, 25 bp, Rattus norvegicus
ttctgggccctgaaaagtctgtcac

SEQ ID NO: 673438 - DNA, 25 bp, Rattus norvegicus
ttctgggccctgtaaagtctgtcac

SEQ ID NO: 673439 - DNA, 25 bp, Rattus norvegicus
ttctgggcccttatcacagtagata

SEQ ID NO: 673440 - DNA, 25 bp, Rattus norvegicus
ttctgggcccttttcacagtagata

SEQ ID NO: 673441 - DNA, 25 bp, Rattus norvegicus
ttctgggccgcaaagtagctcgcaa

SEQ ID NO: 673442 - DNA, 25 bp, Rattus norvegicus
ttctgggccgcatagtagctcgcaa

SEQ ID NO: 673443 - DNA, 25 bp, Rattus norvegicus
ttctgggcctgcatgatcgtcgtgg

SEQ ID NO: 673444 - DNA, 25 bp, Rattus norvegicus
ttctgggcctgcttgatcgtcgtgg

SEQ ID NO: 673445 - DNA, 25 bp, Rattus norvegicus
ttctgggcgggccagcctctaattt

SEQ ID NO: 673446 - DNA, 25 bp, Rattus norvegicus
ttctgggcgggcgagcctctaattt

SEQ ID NO: 673447 - DNA, 25 bp, Rattus norvegicus
ttctgggcggtcaataaccacactt

SEQ ID NO: 673448 - DNA, 25 bp, Rattus norvegicus
ttctgggcggtctataaccacactt

SEQ ID NO: 673449 - DNA, 25 bp, Rattus norvegicus
ttctgggctcaacggttcaagggca

SEQ ID NO: 673450 - DNA, 25 bp, Rattus norvegicus
ttctgggctcaagggttcaagggca

SEQ ID NO: 673451 - DNA, 25 bp, Rattus norvegicus
ttctgggctctaagctccatggaga

SEQ ID NO: 673452 - DNA, 25 bp, Rattus norvegicus
ttctgggctctatgctccatggaga

SEQ ID NO: 673453 - DNA, 25 bp, Rattus norvegicus
ttctgggctctccacggaaatcagg

SEQ ID NO: 673454 - DNA, 25 bp, Rattus norvegicus
ttctgggctctcgacggaaatcagg

SEQ ID NO: 673455 - DNA, 25 bp, Rattus norvegicus
ttctgggctggacgcttgtagttca

SEQ ID NO: 673456 - DNA, 25 bp, Rattus norvegicus
ttctgggctggaggcttgtagttca

SEQ ID NO: 673457 - DNA, 25 bp, Rattus norvegicus
ttctgggtaattaccatggtcatgg

SEQ ID NO: 673458 - DNA, 25 bp, Rattus norvegicus
ttctgggtaatttccatggtcatgg

SEQ ID NO: 673459 - DNA, 25 bp, Rattus norvegicus
ttctgggtacagaggctgccaagtt

SEQ ID NO: 673460 - DNA, 25 bp, Rattus norvegicus
ttctgggtacagtggctgccaagtt

SEQ ID NO: 673461 - DNA, 25 bp, Rattus norvegicus
ttctgggtacccacgcggtgcggaa

SEQ ID NO: 673462 - DNA, 25 bp, Rattus norvegicus
ttctgggtaccctcgcggtgcggaa

SEQ ID NO: 673463 - DNA, 25 bp, Rattus norvegicus
ttctgggtctacctaaaggactcca

SEQ ID NO: 673464 - DNA, 25 bp, Rattus norvegicus
ttctgggtctacgtaaaggactcca

SEQ ID NO: 673465 - DNA, 25 bp, Rattus norvegicus
ttctgggtctgaactcaggccttca

SEQ ID NO: 673466 - DNA, 25 bp, Rattus norvegicus
ttctgggtctgatctcaggccttca

SEQ ID NO: 673467 - DNA, 25 bp, Rattus norvegicus
ttctgggtgctgacctgggatcctt

SEQ ID NO: 673468 - DNA, 25 bp, Rattus norvegicus
ttctgggtgctgtcctgggatcctt

SEQ ID NO: 673469 - DNA, 25 bp, Rattus norvegicus
ttctgggtggaactcaatacataca

SEQ ID NO: 673470 - DNA, 25 bp, Rattus norvegicus
ttctgggtggaagtcaatacataca

SEQ ID NO: 673471 - DNA, 25 bp, Rattus norvegicus
ttctgggtggtcctcaacaggttta

SEQ ID NO: 673472 - DNA, 25 bp, Rattus norvegicus
ttctgggtggtcgtcaacaggttta

SEQ ID NO: 673473 - DNA, 25 bp, Rattus norvegicus
ttctgggtggtgagcatcttcgcgc

SEQ ID NO: 673474 - DNA, 25 bp, Rattus norvegicus
ttctgggtggtgtgcatcttcgcgc

SEQ ID NO: 673475 - DNA, 25 bp, Rattus norvegicus
ttctgggtgtggctgttcttaccat

SEQ ID NO: 673476 - DNA, 25 bp, Rattus norvegicus
ttctgggtgtgggtgttcttaccat

SEQ ID NO: 673477 - DNA, 25 bp, Rattus norvegicus
ttctgggttactcacttactgtgca

SEQ ID NO: 673478 - DNA, 25 bp, Rattus norvegicus
ttctgggttactgacttactgtgca

SEQ ID NO: 673479 - DNA, 25 bp, Rattus norvegicus
ttctgggttctcaactgcagttctt

SEQ ID NO: 673480 - DNA, 25 bp, Rattus norvegicus
ttctgggttctctactgcagttctt

SEQ ID NO: 673481 - DNA, 25 bp, Rattus norvegicus
ttctgggttctgcagactgctgttt

SEQ ID NO: 673482 - DNA, 25 bp, Rattus norvegicus
ttctgggttctggagactgctgttt

SEQ ID NO: 673483 - DNA, 25 bp, Rattus norvegicus
ttctgggtttctctctggtcataga

SEQ ID NO: 673484 - DNA, 25 bp, Rattus norvegicus
ttctgggtttctgtctggtcataga

SEQ ID NO: 673485 - DNA, 25 bp, Rattus norvegicus
ttctggtaagctcgctgtggtgaca

SEQ ID NO: 673486 - DNA, 25 bp, Rattus norvegicus
ttctggtaagctggctgtggtgaca

SEQ ID NO: 673487 - DNA, 25 bp, Rattus norvegicus
ttctggtaatgacagtaggcacgct

SEQ ID NO: 673488 - DNA, 25 bp, Rattus norvegicus
ttctggtaatgagagtaggcacgct

SEQ ID NO: 673489 - DNA, 25 bp, Rattus norvegicus
ttctggtaggagcacttccctggaa

SEQ ID NO: 673490 - DNA, 25 bp, Rattus norvegicus
ttctggtaggaggacttccctggaa

SEQ ID NO: 673491 - DNA, 25 bp, Rattus norvegicus
ttctggtatgctcctttgtgcctca

SEQ ID NO: 673492 - DNA, 25 bp, Rattus norvegicus
ttctggtatgctgctttgtgcctca

SEQ ID NO: 673493 - DNA, 25 bp, Rattus norvegicus
ttctggtcaaagatggtgccgccta

SEQ ID NO: 673494 - DNA, 25 bp, Rattus norvegicus
ttctggtcaaagttggtgccgccta

SEQ ID NO: 673495 - DNA, 25 bp, Rattus norvegicus
ttctggtcactgactcctgatgtag

SEQ ID NO: 673496 - DNA, 25 bp, Rattus norvegicus
ttctggtcactgtctcctgatgtag

SEQ ID NO: 673497 - DNA, 25 bp, Rattus norvegicus
ttctggtcagccaggatcatgcttg

SEQ ID NO: 673498 - DNA, 25 bp, Rattus norvegicus
ttctggtcagcctggatcatgcttg

SEQ ID NO: 673499 - DNA, 25 bp, Rattus norvegicus
ttctggtccgcactgtatatacctt

SEQ ID NO: 673500 - DNA, 25 bp, Rattus norvegicus
ttctggtccgcagtgtatatacctt

SEQ ID NO: 673501 - DNA, 25 bp, Rattus norvegicus
ttctggtccttaatctaacttatgg

SEQ ID NO: 673502 - DNA, 25 bp, Rattus norvegicus
ttctggtccttattctaacttatgg

SEQ ID NO: 673503 - DNA, 25 bp, Rattus norvegicus
ttctggtccttcatactgtgtctga

SEQ ID NO: 673504 - DNA, 25 bp, Rattus norvegicus
ttctggtccttcttactgtgtctga

SEQ ID NO: 673505 - DNA, 25 bp, Rattus norvegicus
ttctggtcctttaaatgtcctcgat

SEQ ID NO: 673506 - DNA, 25 bp, Rattus norvegicus
ttctggtccttttaatgtcctcgat

SEQ ID NO: 673507 - DNA, 25 bp, Rattus norvegicus
ttctggtctcacaatcagcgcttca

SEQ ID NO: 673508 - DNA, 25 bp, Rattus norvegicus
ttctggtctcactatcagcgcttca

SEQ ID NO: 673509 - DNA, 25 bp, Rattus norvegicus
ttctggtctccaagtctgtgtattt

SEQ ID NO: 673510 - DNA, 25 bp, Rattus norvegicus
ttctggtctccatgtctgtgtattt

SEQ ID NO: 673511 - DNA, 25 bp, Rattus norvegicus
ttctggtctggtacactgcttgtct

SEQ ID NO: 673512 - DNA, 25 bp, Rattus norvegicus
ttctggtctggttcactgcttgtct

SEQ ID NO: 673513 - DNA, 25 bp, Rattus norvegicus
ttctggtcttttaaacctgtgctcc

SEQ ID NO: 673514 - DNA, 25 bp, Rattus norvegicus
ttctggtctttttaacctgtgctcc

SEQ ID NO: 673515 - DNA, 25 bp, Rattus norvegicus
ttctggtgaccacacaacacagcac

SEQ ID NO: 673516 - DNA, 25 bp, Rattus norvegicus
ttctggtgaccagacaacacagcac

SEQ ID NO: 673517 - DNA, 25 bp, Rattus norvegicus
ttctggtgattgaacaaaatctgac

SEQ ID NO: 673518 - DNA, 25 bp, Rattus norvegicus
ttctggtgattgtacaaaatctgac

SEQ ID NO: 673519 - DNA, 25 bp, Rattus norvegicus
ttctggtgcagacgcgcgaggaggt

SEQ ID NO: 673520 - DNA, 25 bp, Rattus norvegicus
ttctggtgcagaggcgcgaggaggt

SEQ ID NO: 673521 - DNA, 25 bp, Rattus norvegicus
ttctggtgctgaacctgctgatcgt

SEQ ID NO: 673522 - DNA, 25 bp, Rattus norvegicus
ttctggtgctgatcctgctgatcgt

SEQ ID NO: 673523 - DNA, 25 bp, Rattus norvegicus
ttctggtgctgcctgggattataag

SEQ ID NO: 673524 - DNA, 25 bp, Rattus norvegicus
ttctggtgctgcgtgggattataag

SEQ ID NO: 673525 - DNA, 25 bp, Rattus norvegicus
ttctggtgtgcactccactaggtct

SEQ ID NO: 673526 - DNA, 25 bp, Rattus norvegicus
ttctggtgtgcagtccactaggtct

SEQ ID NO: 673527 - DNA, 25 bp, Rattus norvegicus
ttctggtgtttgagctgagctgtga

SEQ ID NO: 673528 - DNA, 25 bp, Rattus norvegicus
ttctggtgtttgtgctgagctgtga

SEQ ID NO: 673529 - DNA, 25 bp, Rattus norvegicus
ttctggttatatcggctttcttctg

SEQ ID NO: 673530 - DNA, 25 bp, Rattus norvegicus
ttctggttatatgggctttcttctg

SEQ ID NO: 673531 - DNA, 25 bp, Rattus norvegicus
ttctggttatcactctattcacggc

SEQ ID NO: 673532 - DNA, 25 bp, Rattus norvegicus
ttctggttatcagtctattcacggc

SEQ ID NO: 673533 - DNA, 25 bp, Rattus norvegicus
ttctggttcaccaattcttgttata

SEQ ID NO: 673534 - DNA, 25 bp, Rattus norvegicus
ttctggttcacctattcttgttata

SEQ ID NO: 673535 - DNA, 25 bp, Rattus norvegicus
ttctggttcagcagcgcccggagag

SEQ ID NO: 673536 - DNA, 25 bp, Rattus norvegicus
ttctggttcagctgcgcccggagag

SEQ ID NO: 673537 - DNA, 25 bp, Rattus norvegicus
ttctggttcatgaaatgcactgttt

SEQ ID NO: 673538 - DNA, 25 bp, Rattus norvegicus
ttctggttcatgtaatgcactgttt

SEQ ID NO: 673539 - DNA, 25 bp, Rattus norvegicus
ttctggttcccaagatgttgcctac

SEQ ID NO: 673540 - DNA, 25 bp, Rattus norvegicus
ttctggttcccatgatgttgcctac

SEQ ID NO: 673541 - DNA, 25 bp, Rattus norvegicus
ttctggttcgtgacctcaggaaagc

SEQ ID NO: 673542 - DNA, 25 bp, Rattus norvegicus
ttctggttcgtgtcctcaggaaagc

SEQ ID NO: 673543 - DNA, 25 bp, Rattus norvegicus
ttctggttctcgagttcgttgtaat

SEQ ID NO: 673544 - DNA, 25 bp, Rattus norvegicus
ttctggttctcgtgttcgttgtaat

SEQ ID NO: 673545 - DNA, 25 bp, Rattus norvegicus
ttctggttctgaagtgttggctctt

SEQ ID NO: 673546 - DNA, 25 bp, Rattus norvegicus
ttctggttctgatgtgttggctctt

SEQ ID NO: 673547 - DNA, 25 bp, Rattus norvegicus
ttctggttctggatcccttgaaata

SEQ ID NO: 673548 - DNA, 25 bp, Rattus norvegicus
ttctggttctggttcccttgaaata

SEQ ID NO: 673549 - DNA, 25 bp, Rattus norvegicus
ttctggttcttgctctttaacgtat

SEQ ID NO: 673550 - DNA, 25 bp, Rattus norvegicus
ttctggttcttggtctttaacgtat

SEQ ID NO: 673551 - DNA, 25 bp, Rattus norvegicus
ttctggttgccaagtcctgggtctc

SEQ ID NO: 673552 - DNA, 25 bp, Rattus norvegicus
ttctggttgccatgtcctgggtctc

SEQ ID NO: 673553 - DNA, 25 bp, Rattus norvegicus
ttctggttgggcaaggcacctttca

SEQ ID NO: 673554 - DNA, 25 bp, Rattus norvegicus
ttctggttgggctaggcacctttca

SEQ ID NO: 673555 - DNA, 25 bp, Rattus norvegicus
ttctggtttacacttccaaagagat

SEQ ID NO: 673556 - DNA, 25 bp, Rattus norvegicus
ttctggtttacagttccaaagagat

SEQ ID NO: 673557 - DNA, 25 bp, Rattus norvegicus
ttctggtttctgctagcaggcctcc

SEQ ID NO: 673558 - DNA, 25 bp, Rattus norvegicus
ttctggtttctggtagcaggcctcc

SEQ ID NO: 673559 - DNA, 25 bp, Rattus norvegicus
ttctggtttcttaaggtatccaaat

SEQ ID NO: 673560 - DNA, 25 bp, Rattus norvegicus
ttctggtttctttaggtatccaaat

SEQ ID NO: 673561 - DNA, 25 bp, Rattus norvegicus
ttctggtttttgctacaggtaactg

SEQ ID NO: 673562 - DNA, 25 bp, Rattus norvegicus
ttctggtttttggtacaggtaactg

SEQ ID NO: 673563 - DNA, 25 bp, Rattus norvegicus
ttctgtaaacaacctcttagctcaa

SEQ ID NO: 673564 - DNA, 25 bp, Rattus norvegicus
ttctgtaaacaagctcttagctcaa

SEQ ID NO: 673565 - DNA, 25 bp, Rattus norvegicus
ttctgtaaacccatgtcaggagcac

SEQ ID NO: 673566 - DNA, 25 bp, Rattus norvegicus
ttctgtaaacccttgtcaggagcac

SEQ ID NO: 673567 - DNA, 25 bp, Rattus norvegicus
ttctgtaaacctctgcttcatttca

SEQ ID NO: 673568 - DNA, 25 bp, Rattus norvegicus
ttctgtaaacctgtgcttcatttca

SEQ ID NO: 673569 - DNA, 25 bp, Rattus norvegicus
ttctgtaaataccttctccagcctc

SEQ ID NO: 673570 - DNA, 25 bp, Rattus norvegicus
ttctgtaaatacgttctccagcctc

SEQ ID NO: 673571 - DNA, 25 bp, Rattus norvegicus
ttctgtaactatacctggctgctca

SEQ ID NO: 673572 - DNA, 25 bp, Rattus norvegicus
ttctgtaactattcctggctgctca

SEQ ID NO: 673573 - DNA, 25 bp, Rattus norvegicus
ttctgtaactctaatctgtctggta

SEQ ID NO: 673574 - DNA, 25 bp, Rattus norvegicus
ttctgtaactcttatctgtctggta

SEQ ID NO: 673575 - DNA, 25 bp, Rattus norvegicus
ttctgtaaggatatataacgtgtgc

SEQ ID NO: 673576 - DNA, 25 bp, Rattus norvegicus
ttctgtaaggatttataacgtgtgc

SEQ ID NO: 673577 - DNA, 25 bp, Rattus norvegicus
ttctgtaaggttctcgccatgccac

SEQ ID NO: 673578 - DNA, 25 bp, Rattus norvegicus
ttctgtaaggttgtcgccatgccac

SEQ ID NO: 673579 - DNA, 25 bp, Rattus norvegicus
ttctgtaagtcaaagcatagccgca

SEQ ID NO: 673580 - DNA, 25 bp, Rattus norvegicus
ttctgtaagtcatagcatagccgca

SEQ ID NO: 673581 - DNA, 25 bp, Rattus norvegicus
ttctgtaagttcaggcaaggctctg

SEQ ID NO: 673582 - DNA, 25 bp, Rattus norvegicus
ttctgtaagttctggcaaggctctg

SEQ ID NO: 673583 - DNA, 25 bp, Rattus norvegicus
ttctgtaatatcatggaggaccctg

SEQ ID NO: 673584 - DNA, 25 bp, Rattus norvegicus
ttctgtaatatcttggaggaccctg

SEQ ID NO: 673585 - DNA, 25 bp, Rattus norvegicus
ttctgtaatattctctttcatgctg

SEQ ID NO: 673586 - DNA, 25 bp, Rattus norvegicus
ttctgtaatattgtctttcatgctg

SEQ ID NO: 673587 - DNA, 25 bp, Rattus norvegicus
ttctgtacaaaacaccaccggctta

SEQ ID NO: 673588 - DNA, 25 bp, Rattus norvegicus
ttctgtacaaaagaccaccggctta

SEQ ID NO: 673589 - DNA, 25 bp, Rattus norvegicus
ttctgtacagaactttccataggtt

SEQ ID NO: 673590 - DNA, 25 bp, Rattus norvegicus
ttctgtacagaagtttccataggtt

SEQ ID NO: 673591 - DNA, 25 bp, Rattus norvegicus
ttctgtacagcacggcactgggcct

SEQ ID NO: 673592 - DNA, 25 bp, Rattus norvegicus
ttctgtacagcagggcactgggcct

SEQ ID NO: 673593 - DNA, 25 bp, Rattus norvegicus
ttctgtacattcactgtgcagagca

SEQ ID NO: 673594 - DNA, 25 bp, Rattus norvegicus
ttctgtacattctctgtgcagagca

SEQ ID NO: 673595 - DNA, 25 bp, Rattus norvegicus
ttctgtacccagctgcagcgtgaga

SEQ ID NO: 673596 - DNA, 25 bp, Rattus norvegicus
ttctgtacccaggtgcagcgtgaga

SEQ ID NO: 673597 - DNA, 25 bp, Rattus norvegicus
ttctgtaccccacgattgccttgaa

SEQ ID NO: 673598 - DNA, 25 bp, Rattus norvegicus
ttctgtaccccactaatcaactagt

SEQ ID NO: 673599 - DNA, 25 bp, Rattus norvegicus
ttctgtaccccaggattgccttgaa

SEQ ID NO: 673600 - DNA, 25 bp, Rattus norvegicus
ttctgtaccccagtaatcaactagt

SEQ ID NO: 673601 - DNA, 25 bp, Rattus norvegicus
ttctgtaccgttctttacctacatt

SEQ ID NO: 673602 - DNA, 25 bp, Rattus norvegicus
ttctgtaccgttgtttacctacatt

SEQ ID NO: 673603 - DNA, 25 bp, Rattus norvegicus
ttctgtactcttcctcttcaaaagt

SEQ ID NO: 673604 - DNA, 25 bp, Rattus norvegicus
ttctgtactcttgctcttcaaaagt

SEQ ID NO: 673605 - DNA, 25 bp, Rattus norvegicus
ttctgtagaactcagcttaccaatg

SEQ ID NO: 673606 - DNA, 25 bp, Rattus norvegicus
ttctgtagaactgagcttaccaatg

SEQ ID NO: 673607 - DNA, 25 bp, Rattus norvegicus
ttctgtagcagcaccgaatgtagat

SEQ ID NO: 673608 - DNA, 25 bp, Rattus norvegicus
ttctgtagcagctccgaatgtagat

SEQ ID NO: 673609 - DNA, 25 bp, Rattus norvegicus
ttctgtagcgatcgctctggctata

SEQ ID NO: 673610 - DNA, 25 bp, Rattus norvegicus
ttctgtagcgatggctctggctata

SEQ ID NO: 673611 - DNA, 25 bp, Rattus norvegicus
ttctgtaggcacaagggaactttaa

SEQ ID NO: 673612 - DNA, 25 bp, Rattus norvegicus
ttctgtaggcactagggaactttaa

SEQ ID NO: 673613 - DNA, 25 bp, Rattus norvegicus
ttctgtaggtttcgtgtgtgtgcac

SEQ ID NO: 673614 - DNA, 25 bp, Rattus norvegicus
ttctgtaggtttggtgtgtgtgcac

SEQ ID NO: 673615 - DNA, 25 bp, Rattus norvegicus
ttctgtagtcagaccttgtcacgtt

SEQ ID NO: 673616 - DNA, 25 bp, Rattus norvegicus
ttctgtagtcagtccttgtcacgtt

SEQ ID NO: 673617 - DNA, 25 bp, Rattus norvegicus
ttctgtagtcgcagcacttggaagg

SEQ ID NO: 673618 - DNA, 25 bp, Rattus norvegicus
ttctgtagtcgctgcacttggaagg

SEQ ID NO: 673619 - DNA, 25 bp, Rattus norvegicus
ttctgtagtgttatgtttgtcctct

SEQ ID NO: 673620 - DNA, 25 bp, Rattus norvegicus
ttctgtagtgttttgtttgtcctct

SEQ ID NO: 673621 - DNA, 25 bp, Rattus norvegicus
ttctgtatagaaacgcacaagtggt

SEQ ID NO: 673622 - DNA, 25 bp, Rattus norvegicus
ttctgtatagaatcgcacaagtggt

SEQ ID NO: 673623 - DNA, 25 bp, Rattus norvegicus
ttctgtatcataagctggttttaaa

SEQ ID NO: 673624 - DNA, 25 bp, Rattus norvegicus
ttctgtatcatatgctggttttaaa

SEQ ID NO: 673625 - DNA, 25 bp, Rattus norvegicus
ttctgtatcattatcctgaggctgt

SEQ ID NO: 673626 - DNA, 25 bp, Rattus norvegicus
ttctgtatcattttcctgaggctgt

SEQ ID NO: 673627 - DNA, 25 bp, Rattus norvegicus
ttctgtatccatccgtgggcctgag

SEQ ID NO: 673628 - DNA, 25 bp, Rattus norvegicus
ttctgtatccatgcgtgggcctgag

SEQ ID NO: 673629 - DNA, 25 bp, Rattus norvegicus
ttctgtatctaactgcctcctgagt

SEQ ID NO: 673630 - DNA, 25 bp, Rattus norvegicus
ttctgtatctaagtgcctcctgagt

SEQ ID NO: 673631 - DNA, 25 bp, Rattus norvegicus
ttctgtatcttcaaccctggcattg

SEQ ID NO: 673632 - DNA, 25 bp, Rattus norvegicus
ttctgtatcttctaccctggcattg

SEQ ID NO: 673633 - DNA, 25 bp, Rattus norvegicus
ttctgtatgacgagaatgctgctca

SEQ ID NO: 673634 - DNA, 25 bp, Rattus norvegicus
ttctgtatgacgtgaatgctgctca

SEQ ID NO: 673635 - DNA, 25 bp, Rattus norvegicus
ttctgtatggaccaggcccgggaat

SEQ ID NO: 673636 - DNA, 25 bp, Rattus norvegicus
ttctgtatggacgaggcccgggaat

SEQ ID NO: 673637 - DNA, 25 bp, Rattus norvegicus
ttctgtatggcgctgtgttgacact

SEQ ID NO: 673638 - DNA, 25 bp, Rattus norvegicus
ttctgtatggcggtgtgttgacact

SEQ ID NO: 673639 - DNA, 25 bp, Rattus norvegicus
ttctgtattcctatcatcctgaaag

SEQ ID NO: 673640 - DNA, 25 bp, Rattus norvegicus
ttctgtattcctttcatcctgaaag

SEQ ID NO: 673641 - DNA, 25 bp, Rattus norvegicus
ttctgtattctgactcaagtttggg

SEQ ID NO: 673642 - DNA, 25 bp, Rattus norvegicus
ttctgtattctgtctcaagtttggg

SEQ ID NO: 673643 - DNA, 25 bp, Rattus norvegicus
ttctgtattttaagttgggtgtcct

SEQ ID NO: 673644 - DNA, 25 bp, Rattus norvegicus
ttctgtattttatgttgggtgtcct

SEQ ID NO: 673645 - DNA, 25 bp, Rattus norvegicus
ttctgtattttcatggtgggactta

SEQ ID NO: 673646 - DNA, 25 bp, Rattus norvegicus
ttctgtattttcttggtgggactta

SEQ ID NO: 673647 - DNA, 25 bp, Rattus norvegicus
ttctgtcaacaactggccaagggct

SEQ ID NO: 673648 - DNA, 25 bp, Rattus norvegicus
ttctgtcaacaagtggccaagggct

SEQ ID NO: 673649 - DNA, 25 bp, Rattus norvegicus
ttctgtcaacataagcctattccct

SEQ ID NO: 673650 - DNA, 25 bp, Rattus norvegicus
ttctgtcaacattagcctattccct

SEQ ID NO: 673651 - DNA, 25 bp, Rattus norvegicus
ttctgtcaacccatgccatattggc

SEQ ID NO: 673652 - DNA, 25 bp, Rattus norvegicus
ttctgtcaacccttgccatattggc

SEQ ID NO: 673653 - DNA, 25 bp, Rattus norvegicus
ttctgtcaagaacctgctccgacgt

SEQ ID NO: 673654 - DNA, 25 bp, Rattus norvegicus
ttctgtcaagaagctgctccgacgt

SEQ ID NO: 673655 - DNA, 25 bp, Rattus norvegicus
ttctgtcaagagaactcctatgctt

SEQ ID NO: 673656 - DNA, 25 bp, Rattus norvegicus
ttctgtcaagagcagcagccagtca

SEQ ID NO: 673657 - DNA, 25 bp, Rattus norvegicus
ttctgtcaagaggagcagccagtca

SEQ ID NO: 673658 - DNA, 25 bp, Rattus norvegicus
ttctgtcaagagtactcctatgctt

SEQ ID NO: 673659 - DNA, 25 bp, Rattus norvegicus
ttctgtcacagtccccagtcaaaga

SEQ ID NO: 673660 - DNA, 25 bp, Rattus norvegicus
ttctgtcacagtgcccagtcaaaga

SEQ ID NO: 673661 - DNA, 25 bp, Rattus norvegicus
ttctgtcaccatctcttggtatttt

SEQ ID NO: 673662 - DNA, 25 bp, Rattus norvegicus
ttctgtcaccatgtcttggtatttt

SEQ ID NO: 673663 - DNA, 25 bp, Rattus norvegicus
ttctgtcacccgaatcaaatgtaag

SEQ ID NO: 673664 - DNA, 25 bp, Rattus norvegicus
ttctgtcacccgtatcaaatgtaag

SEQ ID NO: 673665 - DNA, 25 bp, Rattus norvegicus
ttctgtcacgttcagtgtgtctgtt

SEQ ID NO: 673666 - DNA, 25 bp, Rattus norvegicus
ttctgtcacgttgagtgtgtctgtt

SEQ ID NO: 673667 - DNA, 25 bp, Rattus norvegicus
ttctgtcactgaaaagggcccttgc

SEQ ID NO: 673668 - DNA, 25 bp, Rattus norvegicus
ttctgtcactgataagggcccttgc

SEQ ID NO: 673669 - DNA, 25 bp, Rattus norvegicus
ttctgtcagcagaccactgtgtaat

SEQ ID NO: 673670 - DNA, 25 bp, Rattus norvegicus
ttctgtcagcagtccactgtgtaat

SEQ ID NO: 673671 - DNA, 25 bp, Rattus norvegicus
ttctgtcagcccagccgagccagtg

SEQ ID NO: 673672 - DNA, 25 bp, Rattus norvegicus
ttctgtcagccctgccgagccagtg

SEQ ID NO: 673673 - DNA, 25 bp, Rattus norvegicus
ttctgtcagcctcagttagcactgc

SEQ ID NO: 673674 - DNA, 25 bp, Rattus norvegicus
ttctgtcagcctgagttagcactgc

SEQ ID NO: 673675 - DNA, 25 bp, Rattus norvegicus
ttctgtcaggaccagacctgtcaga

SEQ ID NO: 673676 - DNA, 25 bp, Rattus norvegicus
ttctgtcaggacgagacctgtcaga

SEQ ID NO: 673677 - DNA, 25 bp, Rattus norvegicus
ttctgtcagtctatggtcacattca

SEQ ID NO: 673678 - DNA, 25 bp, Rattus norvegicus
ttctgtcagtctttggtcacattca

SEQ ID NO: 673679 - DNA, 25 bp, Rattus norvegicus
ttctgtcagtggaactggatcgcca

SEQ ID NO: 673680 - DNA, 25 bp, Rattus norvegicus
ttctgtcagtggtactggatcgcca

SEQ ID NO: 673681 - DNA, 25 bp, Rattus norvegicus
ttctgtcatacgaactgtgcacttt

SEQ ID NO: 673682 - DNA, 25 bp, Rattus norvegicus
ttctgtcatacgtactgtgcacttt

SEQ ID NO: 673683 - DNA, 25 bp, Rattus norvegicus
ttctgtcatgttctgggagggctaa

SEQ ID NO: 673684 - DNA, 25 bp, Rattus norvegicus
ttctgtcatgttgtgggagggctaa

SEQ ID NO: 673685 - DNA, 25 bp, Rattus norvegicus
ttctgtcattgtccttcaaccttat

SEQ ID NO: 673686 - DNA, 25 bp, Rattus norvegicus
ttctgtcattgtgcttcaaccttat

SEQ ID NO: 673687 - DNA, 25 bp, Rattus norvegicus
ttctgtccaaagaaggcttaagccc

SEQ ID NO: 673688 - DNA, 25 bp, Rattus norvegicus
ttctgtccaaagtaggcttaagccc

SEQ ID NO: 673689 - DNA, 25 bp, Rattus norvegicus
ttctgtccagacaggctgtgaacag

SEQ ID NO: 673690 - DNA, 25 bp, Rattus norvegicus
ttctgtccagactggctgtgaacag

SEQ ID NO: 673691 - DNA, 25 bp, Rattus norvegicus
ttctgtccagccatggcagtacatg

SEQ ID NO: 673692 - DNA, 25 bp, Rattus norvegicus
ttctgtccagccttggcagtacatg

SEQ ID NO: 673693 - DNA, 25 bp, Rattus norvegicus
ttctgtccatcccatttgcaaatac

SEQ ID NO: 673694 - DNA, 25 bp, Rattus norvegicus
ttctgtccatccgatttgcaaatac

SEQ ID NO: 673695 - DNA, 25 bp, Rattus norvegicus
ttctgtccatgtccctgtagatgca

SEQ ID NO: 673696 - DNA, 25 bp, Rattus norvegicus
ttctgtccatgtgcctgtagatgca

SEQ ID NO: 673697 - DNA, 25 bp, Rattus norvegicus
ttctgtcccagaaagttgtgtcttc

SEQ ID NO: 673698 - DNA, 25 bp, Rattus norvegicus
ttctgtcccagatagttgtgtcttc

SEQ ID NO: 673699 - DNA, 25 bp, Rattus norvegicus
ttctgtcccctgataacactagcaa

SEQ ID NO: 673700 - DNA, 25 bp, Rattus norvegicus
ttctgtcccctgttaacactagcaa

SEQ ID NO: 673701 - DNA, 25 bp, Rattus norvegicus
ttctgtcccgcgctaaggagaggcc

SEQ ID NO: 673702 - DNA, 25 bp, Rattus norvegicus
ttctgtcccgcggtaaggagaggcc

SEQ ID NO: 673703 - DNA, 25 bp, Rattus norvegicus
ttctgtccctcaaaccgtgcataaa

SEQ ID NO: 673704 - DNA, 25 bp, Rattus norvegicus
ttctgtccctcataccgtgcataaa

SEQ ID NO: 673705 - DNA, 25 bp, Rattus norvegicus
ttctgtccctgtcaagacctcagat

SEQ ID NO: 673706 - DNA, 25 bp, Rattus norvegicus
ttctgtccctgtgaagacctcagat

SEQ ID NO: 673707 - DNA, 25 bp, Rattus norvegicus
ttctgtccctttctgagggagcagt

SEQ ID NO: 673708 - DNA, 25 bp, Rattus norvegicus
ttctgtccctttgtgagggagcagt

SEQ ID NO: 673709 - DNA, 25 bp, Rattus norvegicus
ttctgtccggaccttaggtttgaca

SEQ ID NO: 673710 - DNA, 25 bp, Rattus norvegicus
ttctgtccggacgttaggtttgaca

SEQ ID NO: 673711 - DNA, 25 bp, Rattus norvegicus
ttctgtccgtgaaaattggcttaat

SEQ ID NO: 673712 - DNA, 25 bp, Rattus norvegicus
ttctgtccgtgataattggcttaat

SEQ ID NO: 673713 - DNA, 25 bp, Rattus norvegicus
ttctgtccgttcctaacaactttga

SEQ ID NO: 673714 - DNA, 25 bp, Rattus norvegicus
ttctgtccgttcgtaacaactttga

SEQ ID NO: 673715 - DNA, 25 bp, Rattus norvegicus
ttctgtcctccacctttactggtat

SEQ ID NO: 673716 - DNA, 25 bp, Rattus norvegicus
ttctgtcctccagctttactggtat

SEQ ID NO: 673717 - DNA, 25 bp, Rattus norvegicus
ttctgtcctctcagaggtatgcaca

SEQ ID NO: 673718 - DNA, 25 bp, Rattus norvegicus
ttctgtcctctctgaggtatgcaca

SEQ ID NO: 673719 - DNA, 25 bp, Rattus norvegicus
ttctgtcctgatataagctgcctag

SEQ ID NO: 673720 - DNA, 25 bp, Rattus norvegicus
ttctgtcctgatttaagctgcctag

SEQ ID NO: 673721 - DNA, 25 bp, Rattus norvegicus
ttctgtcctggccagactatttaag

SEQ ID NO: 673722 - DNA, 25 bp, Rattus norvegicus
ttctgtcctggcgagactatttaag

SEQ ID NO: 673723 - DNA, 25 bp, Rattus norvegicus
ttctgtcctgtcacatagatacctg

SEQ ID NO: 673724 - DNA, 25 bp, Rattus norvegicus
ttctgtcctgtctcatagatacctg

SEQ ID NO: 673725 - DNA, 25 bp, Rattus norvegicus
ttctgtcctgttcgattgtcaccaa

SEQ ID NO: 673726 - DNA, 25 bp, Rattus norvegicus
ttctgtcctgttggattgtcaccaa

SEQ ID NO: 673727 - DNA, 25 bp, Rattus norvegicus
ttctgtccttaaagtgagccactga

SEQ ID NO: 673728 - DNA, 25 bp, Rattus norvegicus
ttctgtccttaatgtgagccactga

SEQ ID NO: 673729 - DNA, 25 bp, Rattus norvegicus
ttctgtccttttcccttgggctcga

SEQ ID NO: 673730 - DNA, 25 bp, Rattus norvegicus
ttctgtccttttgccttgggctcga

SEQ ID NO: 673731 - DNA, 25 bp, Rattus norvegicus
ttctgtcgagagattgggacctcct

SEQ ID NO: 673732 - DNA, 25 bp, Rattus norvegicus
ttctgtcgagagtttgggacctcct

SEQ ID NO: 673733 - DNA, 25 bp, Rattus norvegicus
ttctgtcgcattatcagatttccac

SEQ ID NO: 673734 - DNA, 25 bp, Rattus norvegicus
ttctgtcgcattttcagatttccac

SEQ ID NO: 673735 - DNA, 25 bp, Rattus norvegicus
ttctgtcgtcttcggattatctgga

SEQ ID NO: 673736 - DNA, 25 bp, Rattus norvegicus
ttctgtcgtcttgggattatctgga

SEQ ID NO: 673737 - DNA, 25 bp, Rattus norvegicus
ttctgtcgtgataactggccggtca

SEQ ID NO: 673738 - DNA, 25 bp, Rattus norvegicus
ttctgtcgtgattactggccggtca

SEQ ID NO: 673739 - DNA, 25 bp, Rattus norvegicus
ttctgtctacagagggtgtctgcag

SEQ ID NO: 673740 - DNA, 25 bp, Rattus norvegicus
ttctgtctacagtgggtgtctgcag

SEQ ID NO: 673741 - DNA, 25 bp, Rattus norvegicus
ttctgtctactacatctatggcacc

SEQ ID NO: 673742 - DNA, 25 bp, Rattus norvegicus
ttctgtctactagatctatggcacc

SEQ ID NO: 673743 - DNA, 25 bp, Rattus norvegicus
ttctgtctatgtatcaactttacaa

SEQ ID NO: 673744 - DNA, 25 bp, Rattus norvegicus
ttctgtctatgtttcaactttacaa

SEQ ID NO: 673745 - DNA, 25 bp, Rattus norvegicus
ttctgtctcagaagccccagcaaat

SEQ ID NO: 673746 - DNA, 25 bp, Rattus norvegicus
ttctgtctcagatgccccagcaaat

SEQ ID NO: 673747 - DNA, 25 bp, Rattus norvegicus
ttctgtctccctatttacaattgtt

SEQ ID NO: 673748 - DNA, 25 bp, Rattus norvegicus
ttctgtctccctttttacaattgtt

SEQ ID NO: 673749 - DNA, 25 bp, Rattus norvegicus
ttctgtctccgtctgtaagatgctc

SEQ ID NO: 673750 - DNA, 25 bp, Rattus norvegicus
ttctgtctccgtgtgtaagatgctc

SEQ ID NO: 673751 - DNA, 25 bp, Rattus norvegicus
ttctgtctctgcctagtgtgccata

SEQ ID NO: 673752 - DNA, 25 bp, Rattus norvegicus
ttctgtctctgcgtagtgtgccata

SEQ ID NO: 673753 - DNA, 25 bp, Rattus norvegicus
ttctgtctctggaagtcactgtggg

SEQ ID NO: 673754 - DNA, 25 bp, Rattus norvegicus
ttctgtctctggtagtcactgtggg

SEQ ID NO: 673755 - DNA, 25 bp, Rattus norvegicus
ttctgtctgactagccattgttcaa

SEQ ID NO: 673756 - DNA, 25 bp, Rattus norvegicus
ttctgtctgacttgccattgttcaa

SEQ ID NO: 673757 - DNA, 25 bp, Rattus norvegicus
ttctgtctgggtcaggctgtgtaca

SEQ ID NO: 673758 - DNA, 25 bp, Rattus norvegicus
ttctgtctgggtgaggctgtgtaca

SEQ ID NO: 673759 - DNA, 25 bp, Rattus norvegicus
ttctgtctgtgaattccatcgtgga

SEQ ID NO: 673760 - DNA, 25 bp, Rattus norvegicus
ttctgtctgtgatttccatcgtgga

SEQ ID NO: 673761 - DNA, 25 bp, Rattus norvegicus
ttctgtcttaacagtgctgtcccca

SEQ ID NO: 673762 - DNA, 25 bp, Rattus norvegicus
ttctgtcttaactgtgctgtcccca

SEQ ID NO: 673763 - DNA, 25 bp, Rattus norvegicus
ttctgtcttagccttgcacagggaa

SEQ ID NO: 673764 - DNA, 25 bp, Rattus norvegicus
ttctgtcttagcgttgcacagggaa

SEQ ID NO: 673765 - DNA, 25 bp, Rattus norvegicus
ttctgtcttatgacctggagcactt

SEQ ID NO: 673766 - DNA, 25 bp, Rattus norvegicus
ttctgtcttatgtcctggagcactt

SEQ ID NO: 673767 - DNA, 25 bp, Rattus norvegicus
ttctgtcttccaaagactgtgtatg

SEQ ID NO: 673768 - DNA, 25 bp, Rattus norvegicus
ttctgtcttccatagactgtgtatg

SEQ ID NO: 673769 - DNA, 25 bp, Rattus norvegicus
ttctgtcttcccagggcagtctctg

SEQ ID NO: 673770 - DNA, 25 bp, Rattus norvegicus
ttctgtcttccctgggcagtctctg

SEQ ID NO: 673771 - DNA, 25 bp, Rattus norvegicus
ttctgtcttccgatcttagaggtac

SEQ ID NO: 673772 - DNA, 25 bp, Rattus norvegicus
ttctgtcttccgttcttagaggtac

SEQ ID NO: 673773 - DNA, 25 bp, Rattus norvegicus
ttctgtcttctgagtatgtcttgtg

SEQ ID NO: 673774 - DNA, 25 bp, Rattus norvegicus
ttctgtcttctgtgtatgtcttgtg

SEQ ID NO: 673775 - DNA, 25 bp, Rattus norvegicus
ttctgtcttgcacttcaagggtgtg

SEQ ID NO: 673776 - DNA, 25 bp, Rattus norvegicus
ttctgtcttgcagttcaagggtgtg

SEQ ID NO: 673777 - DNA, 25 bp, Rattus norvegicus
ttctgtctttgtactagtctccata

SEQ ID NO: 673778 - DNA, 25 bp, Rattus norvegicus
ttctgtctttgttctagtctccata

SEQ ID NO: 673779 - DNA, 25 bp, Rattus norvegicus
ttctgtgaaactccctgggccatag

SEQ ID NO: 673780 - DNA, 25 bp, Rattus norvegicus
ttctgtgaaactgcctgggccatag

SEQ ID NO: 673781 - DNA, 25 bp, Rattus norvegicus
ttctgtgaacacattctgcgtttgg

SEQ ID NO: 673782 - DNA, 25 bp, Rattus norvegicus
ttctgtgaacactttctgcgtttgg

SEQ ID NO: 673783 - DNA, 25 bp, Rattus norvegicus
ttctgtgaacccatgaccctgtcga

SEQ ID NO: 673784 - DNA, 25 bp, Rattus norvegicus
ttctgtgaacccttgaccctgtcga

SEQ ID NO: 673785 - DNA, 25 bp, Rattus norvegicus
ttctgtgaagagctgccgccactcc

SEQ ID NO: 673786 - DNA, 25 bp, Rattus norvegicus
ttctgtgaagaggtgccgccactcc

SEQ ID NO: 673787 - DNA, 25 bp, Rattus norvegicus
ttctgtgaagatccctttgtctctg

SEQ ID NO: 673788 - DNA, 25 bp, Rattus norvegicus
ttctgtgaagatgcctttgtctctg

SEQ ID NO: 673789 - DNA, 25 bp, Rattus norvegicus
ttctgtgaatctattgaccttgcaa

SEQ ID NO: 673790 - DNA, 25 bp, Rattus norvegicus
ttctgtgaatcttttgaccttgcaa

SEQ ID NO: 673791 - DNA, 25 bp, Rattus norvegicus
ttctgtgacaagagtgtccccgtca

SEQ ID NO: 673792 - DNA, 25 bp, Rattus norvegicus
ttctgtgacaagtgtgtccccgtca

SEQ ID NO: 673793 - DNA, 25 bp, Rattus norvegicus
ttctgtgacattaacgtctcatgta

SEQ ID NO: 673794 - DNA, 25 bp, Rattus norvegicus
ttctgtgacattacgccctggatag

SEQ ID NO: 673795 - DNA, 25 bp, Rattus norvegicus
ttctgtgacattactgctcttctga

SEQ ID NO: 673796 - DNA, 25 bp, Rattus norvegicus
ttctgtgacatttacgtctcatgta

SEQ ID NO: 673797 - DNA, 25 bp, Rattus norvegicus
ttctgtgacatttcgccctggatag

SEQ ID NO: 673798 - DNA, 25 bp, Rattus norvegicus
ttctgtgacatttctgctcttctga

SEQ ID NO: 673799 - DNA, 25 bp, Rattus norvegicus
ttctgtgacctacaatgcacgcctg

SEQ ID NO: 673800 - DNA, 25 bp, Rattus norvegicus
ttctgtgacctagaatgcacgcctg

SEQ ID NO: 673801 - DNA, 25 bp, Rattus norvegicus
ttctgtgactttcgtactactttgt

SEQ ID NO: 673802 - DNA, 25 bp, Rattus norvegicus
ttctgtgactttggtactactttgt

SEQ ID NO: 673803 - DNA, 25 bp, Rattus norvegicus
ttctgtgagcacaatgccgtttcta

SEQ ID NO: 673804 - DNA, 25 bp, Rattus norvegicus
ttctgtgagcactatgccgtttcta

SEQ ID NO: 673805 - DNA, 25 bp, Rattus norvegicus
ttctgtgagctactctgtcaggtgc

SEQ ID NO: 673806 - DNA, 25 bp, Rattus norvegicus
ttctgtgagctagtctgtcaggtgc

SEQ ID NO: 673807 - DNA, 25 bp, Rattus norvegicus
ttctgtgaggcgaagacccaggtga

SEQ ID NO: 673808 - DNA, 25 bp, Rattus norvegicus
ttctgtgaggcgtagacccaggtga

SEQ ID NO: 673809 - DNA, 25 bp, Rattus norvegicus
ttctgtgaggtaactgtgcctgcga

SEQ ID NO: 673810 - DNA, 25 bp, Rattus norvegicus
ttctgtgaggtatctgtgcctgcga

SEQ ID NO: 673811 - DNA, 25 bp, Rattus norvegicus
ttctgtgatctgactctgtctggaa

SEQ ID NO: 673812 - DNA, 25 bp, Rattus norvegicus
ttctgtgatctgcttcctgcctacc

SEQ ID NO: 673813 - DNA, 25 bp, Rattus norvegicus
ttctgtgatctggttcctgcctacc

SEQ ID NO: 673814 - DNA, 25 bp, Rattus norvegicus
ttctgtgatctgtctctgtctggaa

SEQ ID NO: 673815 - DNA, 25 bp, Rattus norvegicus
ttctgtgatgtcaccgtctgttttc

SEQ ID NO: 673816 - DNA, 25 bp, Rattus norvegicus
ttctgtgatgtctccgtctgttttc

SEQ ID NO: 673817 - DNA, 25 bp, Rattus norvegicus
ttctgtgatttaagaaacactgacc

SEQ ID NO: 673818 - DNA, 25 bp, Rattus norvegicus
ttctgtgatttatgaaacactgacc

SEQ ID NO: 673819 - DNA, 25 bp, Rattus norvegicus
ttctgtgattttccttaacgatgtc

SEQ ID NO: 673820 - DNA, 25 bp, Rattus norvegicus
ttctgtgattttgcttaacgatgtc

SEQ ID NO: 673821 - DNA, 25 bp, Rattus norvegicus
ttctgtgcaacaacaatgaaccatt

SEQ ID NO: 673822 - DNA, 25 bp, Rattus norvegicus
ttctgtgcaacatcaatgaaccatt

SEQ ID NO: 673823 - DNA, 25 bp, Rattus norvegicus
ttctgtgcacataatcctatttaat

SEQ ID NO: 673824 - DNA, 25 bp, Rattus norvegicus
ttctgtgcacatccacgtcatgaat

SEQ ID NO: 673825 - DNA, 25 bp, Rattus norvegicus
ttctgtgcacatgcacgtcatgaat

SEQ ID NO: 673826 - DNA, 25 bp, Rattus norvegicus
ttctgtgcacattatcctatttaat

SEQ ID NO: 673827 - DNA, 25 bp, Rattus norvegicus
ttctgtgcacttactcattggaggg

SEQ ID NO: 673828 - DNA, 25 bp, Rattus norvegicus
ttctgtgcactttctcattggaggg

SEQ ID NO: 673829 - DNA, 25 bp, Rattus norvegicus
ttctgtgcagacatgcttgctcctt

SEQ ID NO: 673830 - DNA, 25 bp, Rattus norvegicus
ttctgtgcagacttgcttgctcctt

SEQ ID NO: 673831 - DNA, 25 bp, Rattus norvegicus
ttctgtgcagttagtcagtctgtgc

SEQ ID NO: 673832 - DNA, 25 bp, Rattus norvegicus
ttctgtgcagtttgtcagtctgtgc

SEQ ID NO: 673833 - DNA, 25 bp, Rattus norvegicus
ttctgtgcatagacaacatagctgt

SEQ ID NO: 673834 - DNA, 25 bp, Rattus norvegicus
ttctgtgcatagtcaacatagctgt

SEQ ID NO: 673835 - DNA, 25 bp, Rattus norvegicus
ttctgtgccatgcagaagatgtttt

SEQ ID NO: 673836 - DNA, 25 bp, Rattus norvegicus
ttctgtgccatggagaagatgtttt

SEQ ID NO: 673837 - DNA, 25 bp, Rattus norvegicus
ttctgtgccccgatacatttattac

SEQ ID NO: 673838 - DNA, 25 bp, Rattus norvegicus
ttctgtgccccgttacatttattac

SEQ ID NO: 673839 - DNA, 25 bp, Rattus norvegicus
ttctgtgcctagagtctgctgaaga

SEQ ID NO: 673840 - DNA, 25 bp, Rattus norvegicus
ttctgtgcctagtgtctgctgaaga

SEQ ID NO: 673841 - DNA, 25 bp, Rattus norvegicus
ttctgtgcctgtagctgaaggctcc

SEQ ID NO: 673842 - DNA, 25 bp, Rattus norvegicus
ttctgtgcctgttgctgaaggctcc

SEQ ID NO: 673843 - DNA, 25 bp, Rattus norvegicus
ttctgtgcgagcacaggcctctgtc

SEQ ID NO: 673844 - DNA, 25 bp, Rattus norvegicus
ttctgtgcgagctcaggcctctgtc

SEQ ID NO: 673845 - DNA, 25 bp, Rattus norvegicus
ttctgtgctcataacacagtgcggg

SEQ ID NO: 673846 - DNA, 25 bp, Rattus norvegicus
ttctgtgctcattacacagtgcggg

SEQ ID NO: 673847 - DNA, 25 bp, Rattus norvegicus
ttctgtgctcctacgatccaagagg

SEQ ID NO: 673848 - DNA, 25 bp, Rattus norvegicus
ttctgtgctccttcgatccaagagg

SEQ ID NO: 673849 - DNA, 25 bp, Rattus norvegicus
ttctgtgctggcaatcctgagggtg

SEQ ID NO: 673850 - DNA, 25 bp, Rattus norvegicus
ttctgtgctggctatcctgagggtg

SEQ ID NO: 673851 - DNA, 25 bp, Rattus norvegicus
ttctgtgctgttaccatctagtgga

SEQ ID NO: 673852 - DNA, 25 bp, Rattus norvegicus
ttctgtgctgtttccatctagtgga

SEQ ID NO: 673853 - DNA, 25 bp, Rattus norvegicus
ttctgtggaacaaatgccccgatac

SEQ ID NO: 673854 - DNA, 25 bp, Rattus norvegicus
ttctgtggaacatatgccccgatac

SEQ ID NO: 673855 - DNA, 25 bp, Rattus norvegicus
ttctgtggactccagccaccagcag

SEQ ID NO: 673856 - DNA, 25 bp, Rattus norvegicus
ttctgtggactcgagccaccagcag

SEQ ID NO: 673857 - DNA, 25 bp, Rattus norvegicus
ttctgtggattcaggcctaagggct

SEQ ID NO: 673858 - DNA, 25 bp, Rattus norvegicus
ttctgtggattctggcctaagggct

SEQ ID NO: 673859 - DNA, 25 bp, Rattus norvegicus
ttctgtggcagcctgaagcaagcct

SEQ ID NO: 673860 - DNA, 25 bp, Rattus norvegicus
ttctgtggcagcgtgaagcaagcct

SEQ ID NO: 673861 - DNA, 25 bp, Rattus norvegicus
ttctgtggccaccaggcagacattt

SEQ ID NO: 673862 - DNA, 25 bp, Rattus norvegicus
ttctgtggccacgaggcagacattt

SEQ ID NO: 673863 - DNA, 25 bp, Rattus norvegicus
ttctgtggcccaagaagctggttta

SEQ ID NO: 673864 - DNA, 25 bp, Rattus norvegicus
ttctgtggcccatgaagctggttta

SEQ ID NO: 673865 - DNA, 25 bp, Rattus norvegicus
ttctgtggcctgaaagcaaagcctt

SEQ ID NO: 673866 - DNA, 25 bp, Rattus norvegicus
ttctgtggcctgtaagcaaagcctt

SEQ ID NO: 673867 - DNA, 25 bp, Rattus norvegicus
ttctgtggctcaccatccggggcaa

SEQ ID NO: 673868 - DNA, 25 bp, Rattus norvegicus
ttctgtggctcagcatccggggcaa

SEQ ID NO: 673869 - DNA, 25 bp, Rattus norvegicus
ttctgtggctgacaccttctcaatc

SEQ ID NO: 673870 - DNA, 25 bp, Rattus norvegicus
ttctgtggctgagaccttctcaatc

SEQ ID NO: 673871 - DNA, 25 bp, Rattus norvegicus
ttctgtgggaataccgttctgtgga

SEQ ID NO: 673872 - DNA, 25 bp, Rattus norvegicus
ttctgtgggaattccgttctgtgga

SEQ ID NO: 673873 - DNA, 25 bp, Rattus norvegicus
ttctgtgggagtatgccattgcctt

SEQ ID NO: 673874 - DNA, 25 bp, Rattus norvegicus
ttctgtgggagtttgccattgcctt

SEQ ID NO: 673875 - DNA, 25 bp, Rattus norvegicus
ttctgtgggcacagcatacatatgg

SEQ ID NO: 673876 - DNA, 25 bp, Rattus norvegicus
ttctgtgggcactgcatacatatgg

SEQ ID NO: 673877 - DNA, 25 bp, Rattus norvegicus
ttctgtgggcctctcatgagtgaca

SEQ ID NO: 673878 - DNA, 25 bp, Rattus norvegicus
ttctgtgggcctgtcatgagtgaca

SEQ ID NO: 673879 - DNA, 25 bp, Rattus norvegicus
ttctgtgggtcaaggattcgtttca

SEQ ID NO: 673880 - DNA, 25 bp, Rattus norvegicus
ttctgtgggtcatggattcgtttca

SEQ ID NO: 673881 - DNA, 25 bp, Rattus norvegicus
ttctgtgggttgaatgcgtatttct

SEQ ID NO: 673882 - DNA, 25 bp, Rattus norvegicus
ttctgtgggttgtatgcgtatttct

SEQ ID NO: 673883 - DNA, 25 bp, Rattus norvegicus
ttctgtggtattctcgagtgtcttt

SEQ ID NO: 673884 - DNA, 25 bp, Rattus norvegicus
ttctgtggtattgtcgagtgtcttt

SEQ ID NO: 673885 - DNA, 25 bp, Rattus norvegicus
ttctgtggtcagaccaaacttctgc

SEQ ID NO: 673886 - DNA, 25 bp, Rattus norvegicus
ttctgtggtcagtccaaacttctgc

SEQ ID NO: 673887 - DNA, 25 bp, Rattus norvegicus
ttctgtggtcccaggcctgtgaaga

SEQ ID NO: 673888 - DNA, 25 bp, Rattus norvegicus
ttctgtggtccccatcaatcggtag

SEQ ID NO: 673889 - DNA, 25 bp, Rattus norvegicus
ttctgtggtcccgatcaatcggtag

SEQ ID NO: 673890 - DNA, 25 bp, Rattus norvegicus
ttctgtggtccctggcctgtgaaga

SEQ ID NO: 673891 - DNA, 25 bp, Rattus norvegicus
ttctgtggtctcaattcagcttgag

SEQ ID NO: 673892 - DNA, 25 bp, Rattus norvegicus
ttctgtggtctctattcagcttgag

SEQ ID NO: 673893 - DNA, 25 bp, Rattus norvegicus
ttctgtggtttcacttgaaccccca

SEQ ID NO: 673894 - DNA, 25 bp, Rattus norvegicus
ttctgtggtttctcttgaaccccca

SEQ ID NO: 673895 - DNA, 25 bp, Rattus norvegicus
ttctgtggtttgagtgtctgtcatg

SEQ ID NO: 673896 - DNA, 25 bp, Rattus norvegicus
ttctgtggtttgtgtgtctgtcatg

SEQ ID NO: 673897 - DNA, 25 bp, Rattus norvegicus
ttctgtgtacatatggtgcatgaac

SEQ ID NO: 673898 - DNA, 25 bp, Rattus norvegicus
ttctgtgtacatttggtgcatgaac

SEQ ID NO: 673899 - DNA, 25 bp, Rattus norvegicus
ttctgtgtaccactccggaggagtt

SEQ ID NO: 673900 - DNA, 25 bp, Rattus norvegicus
ttctgtgtaccagtccggaggagtt

SEQ ID NO: 673901 - DNA, 25 bp, Rattus norvegicus
ttctgtgtactaaagcatgctgtgt

SEQ ID NO: 673902 - DNA, 25 bp, Rattus norvegicus
ttctgtgtactatagcatgctgtgt

SEQ ID NO: 673903 - DNA, 25 bp, Rattus norvegicus
ttctgtgtactgaccatctgccaag

SEQ ID NO: 673904 - DNA, 25 bp, Rattus norvegicus
ttctgtgtactgtccatctgccaag

SEQ ID NO: 673905 - DNA, 25 bp, Rattus norvegicus
ttctgtgtcatgacggcggttgcta

SEQ ID NO: 673906 - DNA, 25 bp, Rattus norvegicus
ttctgtgtcatgtcggcggttgcta

SEQ ID NO: 673907 - DNA, 25 bp, Rattus norvegicus
ttctgtgtcctgctcctgccgagga

SEQ ID NO: 673908 - DNA, 25 bp, Rattus norvegicus
ttctgtgtcctggtcctgccgagga

SEQ ID NO: 673909 - DNA, 25 bp, Rattus norvegicus
ttctgtgtccttaagtactgcctaa

SEQ ID NO: 673910 - DNA, 25 bp, Rattus norvegicus
ttctgtgtcctttagtactgcctaa

SEQ ID NO: 673911 - DNA, 25 bp, Rattus norvegicus
ttctgtgtctgcagcaagtgggcca

SEQ ID NO: 673912 - DNA, 25 bp, Rattus norvegicus
ttctgtgtctgctgcaagtgggcca

SEQ ID NO: 673913 - DNA, 25 bp, Rattus norvegicus
ttctgtgtctgtcaccaccattgag

SEQ ID NO: 673914 - DNA, 25 bp, Rattus norvegicus
ttctgtgtctgtgaccaccattgag

SEQ ID NO: 673915 - DNA, 25 bp, Rattus norvegicus
ttctgtgtctttactctgctatgat

SEQ ID NO: 673916 - DNA, 25 bp, Rattus norvegicus
ttctgtgtcttttctctgctatgat

SEQ ID NO: 673917 - DNA, 25 bp, Rattus norvegicus
ttctgtgtgacgctcctatgcttag

SEQ ID NO: 673918 - DNA, 25 bp, Rattus norvegicus
ttctgtgtgacggtcctatgcttag

SEQ ID NO: 673919 - DNA, 25 bp, Rattus norvegicus
ttctgtgtgccgattgtctttttgt

SEQ ID NO: 673920 - DNA, 25 bp, Rattus norvegicus
ttctgtgtgccgtttgtctttttgt

SEQ ID NO: 673921 - DNA, 25 bp, Rattus norvegicus
ttctgtgtgcctcttctaagaagca

SEQ ID NO: 673922 - DNA, 25 bp, Rattus norvegicus
ttctgtgtgcctgttctaagaagca

SEQ ID NO: 673923 - DNA, 25 bp, Rattus norvegicus
ttctgtgtgcttagatccagccttc

SEQ ID NO: 673924 - DNA, 25 bp, Rattus norvegicus
ttctgtgtgctttgatccagccttc

SEQ ID NO: 673925 - DNA, 25 bp, Rattus norvegicus
ttctgtgtgtataaatttagctgct

SEQ ID NO: 673926 - DNA, 25 bp, Rattus norvegicus
ttctgtgtgtattaatttagctgct

SEQ ID NO: 673927 - DNA, 25 bp, Rattus norvegicus
ttctgtgtgtgcagggtaactctta

SEQ ID NO: 673928 - DNA, 25 bp, Rattus norvegicus
ttctgtgtgtgctgggtaactctta

SEQ ID NO: 673929 - DNA, 25 bp, Rattus norvegicus
ttctgtgttcagaatgccacctcac

SEQ ID NO: 673930 - DNA, 25 bp, Rattus norvegicus
ttctgtgttcagtatgccacctcac

SEQ ID NO: 673931 - DNA, 25 bp, Rattus norvegicus
ttctgtgttctacgttcgttgtgct

SEQ ID NO: 673932 - DNA, 25 bp, Rattus norvegicus
ttctgtgttctaggttcgttgtgct

SEQ ID NO: 673933 - DNA, 25 bp, Rattus norvegicus
ttctgtgttctcattacggcagtgt

SEQ ID NO: 673934 - DNA, 25 bp, Rattus norvegicus
ttctgtgttctctttacggcagtgt

SEQ ID NO: 673935 - DNA, 25 bp, Rattus norvegicus
ttctgtgttgtgagcagagactgca

SEQ ID NO: 673936 - DNA, 25 bp, Rattus norvegicus
ttctgtgttgtgtgcagagactgca

SEQ ID NO: 673937 - DNA, 25 bp, Rattus norvegicus
ttctgtgtttgcctgtggtttcagt

SEQ ID NO: 673938 - DNA, 25 bp, Rattus norvegicus
ttctgtgtttgcgtgtggtttcagt

SEQ ID NO: 673939 - DNA, 25 bp, Rattus norvegicus
ttctgtgtttttagcagtccttctt

SEQ ID NO: 673940 - DNA, 25 bp, Rattus norvegicus
ttctgtgttttttgcagtccttctt

SEQ ID NO: 673941 - DNA, 25 bp, Rattus norvegicus
ttctgttaatcgattgtgaccctcc

SEQ ID NO: 673942 - DNA, 25 bp, Rattus norvegicus
ttctgttaatcgtttgtgaccctcc

SEQ ID NO: 673943 - DNA, 25 bp, Rattus norvegicus
ttctgttacagtatgtgcacttggg

SEQ ID NO: 673944 - DNA, 25 bp, Rattus norvegicus
ttctgttacagtttgtgcacttggg

SEQ ID NO: 673945 - DNA, 25 bp, Rattus norvegicus
ttctgttacgaaatcccatttccca

SEQ ID NO: 673946 - DNA, 25 bp, Rattus norvegicus
ttctgttacgaattcccatttccca

SEQ ID NO: 673947 - DNA, 25 bp, Rattus norvegicus
ttctgttaggacatcatattggcat

SEQ ID NO: 673948 - DNA, 25 bp, Rattus norvegicus
ttctgttaggacttcatattggcat

SEQ ID NO: 673949 - DNA, 25 bp, Rattus norvegicus
ttctgttatagaactttccatactc

SEQ ID NO: 673950 - DNA, 25 bp, Rattus norvegicus
ttctgttatagatctttccatactc

SEQ ID NO: 673951 - DNA, 25 bp, Rattus norvegicus
ttctgttatcagatgcagcgcatac

SEQ ID NO: 673952 - DNA, 25 bp, Rattus norvegicus
ttctgttatcagttgcagcgcatac

SEQ ID NO: 673953 - DNA, 25 bp, Rattus norvegicus
ttctgttatcccaaaatgtcatcgt

SEQ ID NO: 673954 - DNA, 25 bp, Rattus norvegicus
ttctgttatccctaaatgtcatcgt

SEQ ID NO: 673955 - DNA, 25 bp, Rattus norvegicus
ttctgttcaaatacgcatgcctggg

SEQ ID NO: 673956 - DNA, 25 bp, Rattus norvegicus
ttctgttcaaattcgcatgcctggg

SEQ ID NO: 673957 - DNA, 25 bp, Rattus norvegicus
ttctgttcagaacgacatgagacca

SEQ ID NO: 673958 - DNA, 25 bp, Rattus norvegicus
ttctgttcagaaggacatgagacca

SEQ ID NO: 673959 - DNA, 25 bp, Rattus norvegicus
ttctgttcagacatcctgcagtgat

SEQ ID NO: 673960 - DNA, 25 bp, Rattus norvegicus
ttctgttcagacattcttatccgga

SEQ ID NO: 673961 - DNA, 25 bp, Rattus norvegicus
ttctgttcagacttcctgcagtgat

SEQ ID NO: 673962 - DNA, 25 bp, Rattus norvegicus
ttctgttcagactttcttatccgga

SEQ ID NO: 673963 - DNA, 25 bp, Rattus norvegicus
ttctgttcagcgagtcagtgtctct

SEQ ID NO: 673964 - DNA, 25 bp, Rattus norvegicus
ttctgttcagcgtgtcagtgtctct

SEQ ID NO: 673965 - DNA, 25 bp, Rattus norvegicus
ttctgttcagctctctacgtcagag

SEQ ID NO: 673966 - DNA, 25 bp, Rattus norvegicus
ttctgttcagctgtctacgtcagag

SEQ ID NO: 673967 - DNA, 25 bp, Rattus norvegicus
ttctgttcaggaaccctatggccat

SEQ ID NO: 673968 - DNA, 25 bp, Rattus norvegicus
ttctgttcaggatccctatggccat

SEQ ID NO: 673969 - DNA, 25 bp, Rattus norvegicus
ttctgttcaggtcttttgttcccat

SEQ ID NO: 673970 - DNA, 25 bp, Rattus norvegicus
ttctgttcaggtgttttgttcccat

SEQ ID NO: 673971 - DNA, 25 bp, Rattus norvegicus
ttctgttcagttacaccttttcata

SEQ ID NO: 673972 - DNA, 25 bp, Rattus norvegicus
ttctgttcagtttcaccttttcata

SEQ ID NO: 673973 - DNA, 25 bp, Rattus norvegicus
ttctgttcatctcgcctggaggcag

SEQ ID NO: 673974 - DNA, 25 bp, Rattus norvegicus
ttctgttcatctggcctggaggcag

SEQ ID NO: 673975 - DNA, 25 bp, Rattus norvegicus
ttctgttcatgccataaccttctgt

SEQ ID NO: 673976 - DNA, 25 bp, Rattus norvegicus
ttctgttcatgcgataaccttctgt

SEQ ID NO: 673977 - DNA, 25 bp, Rattus norvegicus
ttctgttcccagagatttcctaggt

SEQ ID NO: 673978 - DNA, 25 bp, Rattus norvegicus
ttctgttcccagcacttctaatgct

SEQ ID NO: 673979 - DNA, 25 bp, Rattus norvegicus
ttctgttcccagctttttgtgtaat

SEQ ID NO: 673980 - DNA, 25 bp, Rattus norvegicus
ttctgttcccaggacttctaatgct

SEQ ID NO: 673981 - DNA, 25 bp, Rattus norvegicus
ttctgttcccaggtttttgtgtaat

SEQ ID NO: 673982 - DNA, 25 bp, Rattus norvegicus
ttctgttcccagtgatttcctaggt

SEQ ID NO: 673983 - DNA, 25 bp, Rattus norvegicus
ttctgttcccttactgagcatgtgg

SEQ ID NO: 673984 - DNA, 25 bp, Rattus norvegicus
ttctgttccctttctgagcatgtgg

SEQ ID NO: 673985 - DNA, 25 bp, Rattus norvegicus
ttctgttcctagctcaggcaggtgg

SEQ ID NO: 673986 - DNA, 25 bp, Rattus norvegicus
ttctgttcctaggtcaggcaggtgg

SEQ ID NO: 673987 - DNA, 25 bp, Rattus norvegicus
ttctgttcctatattgaccgttcca

SEQ ID NO: 673988 - DNA, 25 bp, Rattus norvegicus
ttctgttcctattttgaccgttcca

SEQ ID NO: 673989 - DNA, 25 bp, Rattus norvegicus
ttctgttcctctacaagtcctaaat

SEQ ID NO: 673990 - DNA, 25 bp, Rattus norvegicus
ttctgttcctctagatcatcctgga

SEQ ID NO: 673991 - DNA, 25 bp, Rattus norvegicus
ttctgttcctcttcaagtcctaaat

SEQ ID NO: 673992 - DNA, 25 bp, Rattus norvegicus
ttctgttcctcttgatcatcctgga

SEQ ID NO: 673993 - DNA, 25 bp, Rattus norvegicus
ttctgttccttcacaatgcagtagt

SEQ ID NO: 673994 - DNA, 25 bp, Rattus norvegicus
ttctgttccttctcaatgcagtagt

SEQ ID NO: 673995 - DNA, 25 bp, Rattus norvegicus
ttctgttctactattcgctcggaaa

SEQ ID NO: 673996 - DNA, 25 bp, Rattus norvegicus
ttctgttctacttttcgctcggaaa

SEQ ID NO: 673997 - DNA, 25 bp, Rattus norvegicus
ttctgttctcttctggccaagtgta

SEQ ID NO: 673998 - DNA, 25 bp, Rattus norvegicus
ttctgttctcttgtggccaagtgta

SEQ ID NO: 673999 - DNA, 25 bp, Rattus norvegicus
ttctgttctggaatgcaatgcgttg

SEQ ID NO: 674000 - DNA, 25 bp, Rattus norvegicus
ttctgttctggattgcaatgcgttg

SEQ ID NO: 674001 - DNA, 25 bp, Rattus norvegicus
ttctgttctggtacacaagttctag

SEQ ID NO: 674002 - DNA, 25 bp, Rattus norvegicus
ttctgttctggttcacaagttctag

SEQ ID NO: 674003 - DNA, 25 bp, Rattus norvegicus
ttctgttctgtcatcttagttggta

SEQ ID NO: 674004 - DNA, 25 bp, Rattus norvegicus
ttctgttctgtcttcttagttggta

SEQ ID NO: 674005 - DNA, 25 bp, Rattus norvegicus
ttctgttcttccagtctgatagctg

SEQ ID NO: 674006 - DNA, 25 bp, Rattus norvegicus
ttctgttcttcctgtctgatagctg

SEQ ID NO: 674007 - DNA, 25 bp, Rattus norvegicus
ttctgttgaactatgtgtcctcact

SEQ ID NO: 674008 - DNA, 25 bp, Rattus norvegicus
ttctgttgaactttgtgtcctcact

SEQ ID NO: 674009 - DNA, 25 bp, Rattus norvegicus
ttctgttgatacattgcccactacc

SEQ ID NO: 674010 - DNA, 25 bp, Rattus norvegicus
ttctgttgatactttgcccactacc

SEQ ID NO: 674011 - DNA, 25 bp, Rattus norvegicus
ttctgttgccagcactgagttctct

SEQ ID NO: 674012 - DNA, 25 bp, Rattus norvegicus
ttctgttgccaggactgagttctct

SEQ ID NO: 674013 - DNA, 25 bp, Rattus norvegicus
ttctgttgccctaggacgtgtgtaa

SEQ ID NO: 674014 - DNA, 25 bp, Rattus norvegicus
ttctgttgccctcattctgatttct

SEQ ID NO: 674015 - DNA, 25 bp, Rattus norvegicus
ttctgttgccctgattctgatttct

SEQ ID NO: 674016 - DNA, 25 bp, Rattus norvegicus
ttctgttgcccttggacgtgtgtaa

SEQ ID NO: 674017 - DNA, 25 bp, Rattus norvegicus
ttctgttgctagctgatgtgttcat

SEQ ID NO: 674018 - DNA, 25 bp, Rattus norvegicus
ttctgttgctaggtgatgtgttcat

SEQ ID NO: 674019 - DNA, 25 bp, Rattus norvegicus
ttctgttgctgcaatttcatcctct

SEQ ID NO: 674020 - DNA, 25 bp, Rattus norvegicus
ttctgttgctgctatttcatcctct

SEQ ID NO: 674021 - DNA, 25 bp, Rattus norvegicus
ttctgttgctttactgttctttgga

SEQ ID NO: 674022 - DNA, 25 bp, Rattus norvegicus
ttctgttgcttttctgttctttgga

SEQ ID NO: 674023 - DNA, 25 bp, Rattus norvegicus
ttctgttgtacaagaccacctactg

SEQ ID NO: 674024 - DNA, 25 bp, Rattus norvegicus
ttctgttgtacatgaccacctactg

SEQ ID NO: 674025 - DNA, 25 bp, Rattus norvegicus
ttctgttgtactatttggcctggga

SEQ ID NO: 674026 - DNA, 25 bp, Rattus norvegicus
ttctgttgtactttttggcctggga

SEQ ID NO: 674027 - DNA, 25 bp, Rattus norvegicus
ttctgtttattcatctctcccttat

SEQ ID NO: 674028 - DNA, 25 bp, Rattus norvegicus
ttctgtttattcttctctcccttat

SEQ ID NO: 674029 - DNA, 25 bp, Rattus norvegicus
ttctgtttcacacgtctctggccag

SEQ ID NO: 674030 - DNA, 25 bp, Rattus norvegicus
ttctgtttcacaggtctctggccag

SEQ ID NO: 674031 - DNA, 25 bp, Rattus norvegicus
ttctgtttcagcatctagagtctga

SEQ ID NO: 674032 - DNA, 25 bp, Rattus norvegicus
ttctgtttcagcttctagagtctga

SEQ ID NO: 674033 - DNA, 25 bp, Rattus norvegicus
ttctgtttccagaatccacgtgaaa

SEQ ID NO: 674034 - DNA, 25 bp, Rattus norvegicus
ttctgtttccagtatccacgtgaaa

SEQ ID NO: 674035 - DNA, 25 bp, Rattus norvegicus
ttctgtttcccgagagccgatggta

SEQ ID NO: 674036 - DNA, 25 bp, Rattus norvegicus
ttctgtttcccgtgagccgatggta

SEQ ID NO: 674037 - DNA, 25 bp, Rattus norvegicus
ttctgtttcctcagtccaagttgaa

SEQ ID NO: 674038 - DNA, 25 bp, Rattus norvegicus
ttctgtttcctctgtccaagttgaa

SEQ ID NO: 674039 - DNA, 25 bp, Rattus norvegicus
ttctgtttcgaacgcaatcccgtca

SEQ ID NO: 674040 - DNA, 25 bp, Rattus norvegicus
ttctgtttcgaaggcaatcccgtca

SEQ ID NO: 674041 - DNA, 25 bp, Rattus norvegicus
ttctgtttctacagttgcttcttaa

SEQ ID NO: 674042 - DNA, 25 bp, Rattus norvegicus
ttctgtttctactgttgcttcttaa

SEQ ID NO: 674043 - DNA, 25 bp, Rattus norvegicus
ttctgtttctccacgtctggaatta

SEQ ID NO: 674044 - DNA, 25 bp, Rattus norvegicus
ttctgtttctccctggtgatgcaaa

SEQ ID NO: 674045 - DNA, 25 bp, Rattus norvegicus
ttctgtttctccgtggtgatgcaaa

SEQ ID NO: 674046 - DNA, 25 bp, Rattus norvegicus
ttctgtttctcctcgtctggaatta

SEQ ID NO: 674047 - DNA, 25 bp, Rattus norvegicus
ttctgtttctgtaacgaggtccctg

SEQ ID NO: 674048 - DNA, 25 bp, Rattus norvegicus
ttctgtttctgtcgtgcctagtttt

SEQ ID NO: 674049 - DNA, 25 bp, Rattus norvegicus
ttctgtttctgtggtgcctagtttt

SEQ ID NO: 674050 - DNA, 25 bp, Rattus norvegicus
ttctgtttctgttacgaggtccctg

SEQ ID NO: 674051 - DNA, 25 bp, Rattus norvegicus
ttctgtttgagtcctaggcctcccc

SEQ ID NO: 674052 - DNA, 25 bp, Rattus norvegicus
ttctgtttgagtgctaggcctcccc

SEQ ID NO: 674053 - DNA, 25 bp, Rattus norvegicus
ttctgtttgataactcttccccaaa

SEQ ID NO: 674054 - DNA, 25 bp, Rattus norvegicus
ttctgtttgatatctcttccccaaa

SEQ ID NO: 674055 - DNA, 25 bp, Rattus norvegicus
ttctgtttgattaggcggtgagcac

SEQ ID NO: 674056 - DNA, 25 bp, Rattus norvegicus
ttctgtttgatttggcggtgagcac

SEQ ID NO: 674057 - DNA, 25 bp, Rattus norvegicus
ttctgtttgctacctgtgttgtcct

SEQ ID NO: 674058 - DNA, 25 bp, Rattus norvegicus
ttctgtttgctagctgtgttgtcct

SEQ ID NO: 674059 - DNA, 25 bp, Rattus norvegicus
ttctgtttgggtcacttaggctcat

SEQ ID NO: 674060 - DNA, 25 bp, Rattus norvegicus
ttctgtttgggtgacttaggctcat

SEQ ID NO: 674061 - DNA, 25 bp, Rattus norvegicus
ttctgtttgtctcgctcaaatctag

SEQ ID NO: 674062 - DNA, 25 bp, Rattus norvegicus
ttctgtttgtctggctcaaatctag

SEQ ID NO: 674063 - DNA, 25 bp, Rattus norvegicus
ttctgttttagtctcctgcaagcaa

SEQ ID NO: 674064 - DNA, 25 bp, Rattus norvegicus
ttctgttttagtgtcctgcaagcaa

SEQ ID NO: 674065 - DNA, 25 bp, Rattus norvegicus
ttctgttttcaacttctaccatgtg

SEQ ID NO: 674066 - DNA, 25 bp, Rattus norvegicus
ttctgttttcaagttctaccatgtg

SEQ ID NO: 674067 - DNA, 25 bp, Rattus norvegicus
ttctgttttctgctgacctttaaag

SEQ ID NO: 674068 - DNA, 25 bp, Rattus norvegicus
ttctgttttctggtgacctttaaag

SEQ ID NO: 674069 - DNA, 25 bp, Rattus norvegicus
ttctgttttcttaatgaccctacct

SEQ ID NO: 674070 - DNA, 25 bp, Rattus norvegicus
ttctgttttctttatgaccctacct

SEQ ID NO: 674071 - DNA, 25 bp, Rattus norvegicus
ttctgttttgagagctagcctccag

SEQ ID NO: 674072 - DNA, 25 bp, Rattus norvegicus
ttctgttttgagagtctttctttgc

SEQ ID NO: 674073 - DNA, 25 bp, Rattus norvegicus
ttctgttttgagtgctagcctccag

SEQ ID NO: 674074 - DNA, 25 bp, Rattus norvegicus
ttctgttttgagtgtctttctttgc

SEQ ID NO: 674075 - DNA, 25 bp, Rattus norvegicus
ttctgtttttcgacgccccgtggtg

SEQ ID NO: 674076 - DNA, 25 bp, Rattus norvegicus
ttctgtttttcgtcgccccgtggtg

SEQ ID NO: 674077 - DNA, 25 bp, Rattus norvegicus
ttcttaaactccaccagtactgtgt

SEQ ID NO: 674078 - DNA, 25 bp, Rattus norvegicus
ttcttaaactcctccagtactgtgt

SEQ ID NO: 674079 - DNA, 25 bp, Rattus norvegicus
ttcttaaaggttcgccttgtcagtc

SEQ ID NO: 674080 - DNA, 25 bp, Rattus norvegicus
ttcttaaaggttggccttgtcagtc

SEQ ID NO: 674081 - DNA, 25 bp, Rattus norvegicus
ttcttaaatgtcatcctttttggag

SEQ ID NO: 674082 - DNA, 25 bp, Rattus norvegicus
ttcttaaatgtcttcctttttggag

SEQ ID NO: 674083 - DNA, 25 bp, Rattus norvegicus
ttcttaaatgttctaccccggctct

SEQ ID NO: 674084 - DNA, 25 bp, Rattus norvegicus
ttcttaaatgttgtaccccggctct

SEQ ID NO: 674085 - DNA, 25 bp, Rattus norvegicus
ttcttaacctgcaggcacctgtcca

SEQ ID NO: 674086 - DNA, 25 bp, Rattus norvegicus
ttcttaacctgctggcacctgtcca

SEQ ID NO: 674087 - DNA, 25 bp, Rattus norvegicus
ttcttaacgcttctcacattgcaga

SEQ ID NO: 674088 - DNA, 25 bp, Rattus norvegicus
ttcttaacgcttgtcacattgcaga

SEQ ID NO: 674089 - DNA, 25 bp, Rattus norvegicus
ttcttaactagaacctccctgttgc

SEQ ID NO: 674090 - DNA, 25 bp, Rattus norvegicus
ttcttaactagatcctccctgttgc

SEQ ID NO: 674091 - DNA, 25 bp, Rattus norvegicus
ttcttaactgctactaggtggtgga

SEQ ID NO: 674092 - DNA, 25 bp, Rattus norvegicus
ttcttaactgcttctaggtggtgga

SEQ ID NO: 674093 - DNA, 25 bp, Rattus norvegicus
ttcttaactgtgctgttccttggca

SEQ ID NO: 674094 - DNA, 25 bp, Rattus norvegicus
ttcttaactgtggtgttccttggca

SEQ ID NO: 674095 - DNA, 25 bp, Rattus norvegicus
ttcttaagatccaacatgtttcctc

SEQ ID NO: 674096 - DNA, 25 bp, Rattus norvegicus
ttcttaagatcctacatgtttcctc

SEQ ID NO: 674097 - DNA, 25 bp, Rattus norvegicus
ttcttaagtgtaaccagtcctggct

SEQ ID NO: 674098 - DNA, 25 bp, Rattus norvegicus
ttcttaagtgtatccagtcctggct

SEQ ID NO: 674099 - DNA, 25 bp, Rattus norvegicus
ttcttaatgtttatcgtcttactcg

SEQ ID NO: 674100 - DNA, 25 bp, Rattus norvegicus
ttcttaatgtttttcgtcttactcg

SEQ ID NO: 674101 - DNA, 25 bp, Rattus norvegicus
ttcttaatttgacttagcggccctc

SEQ ID NO: 674102 - DNA, 25 bp, Rattus norvegicus
ttcttaatttgagttagcggccctc

SEQ ID NO: 674103 - DNA, 25 bp, Rattus norvegicus
ttcttacaaaccagagctcactcta

SEQ ID NO: 674104 - DNA, 25 bp, Rattus norvegicus
ttcttacaaacctgagctcactcta

SEQ ID NO: 674105 - DNA, 25 bp, Rattus norvegicus
ttcttacaattaacagcaaccagtt

SEQ ID NO: 674106 - DNA, 25 bp, Rattus norvegicus
ttcttacaattatcagcaaccagtt

SEQ ID NO: 674107 - DNA, 25 bp, Rattus norvegicus
ttcttacaccatcctaatagcacgc

SEQ ID NO: 674108 - DNA, 25 bp, Rattus norvegicus
ttcttacaccatgctaatagcacgc

SEQ ID NO: 674109 - DNA, 25 bp, Rattus norvegicus
ttcttacacccacttaaccgagtgg

SEQ ID NO: 674110 - DNA, 25 bp, Rattus norvegicus
ttcttacacccagttaaccgagtgg

SEQ ID NO: 674111 - DNA, 25 bp, Rattus norvegicus
ttcttacaccccagtatctctaaaa

SEQ ID NO: 674112 - DNA, 25 bp, Rattus norvegicus
ttcttacacccctgtatctctaaaa

SEQ ID NO: 674113 - DNA, 25 bp, Rattus norvegicus
ttcttacacgcgagcatttgcatca

SEQ ID NO: 674114 - DNA, 25 bp, Rattus norvegicus
ttcttacacgcgtgcatttgcatca

SEQ ID NO: 674115 - DNA, 25 bp, Rattus norvegicus
ttcttacactaaagccttagcctct

SEQ ID NO: 674116 - DNA, 25 bp, Rattus norvegicus
ttcttacactaatgccttagcctct

SEQ ID NO: 674117 - DNA, 25 bp, Rattus norvegicus
ttcttacactctacacaagcagcag

SEQ ID NO: 674118 - DNA, 25 bp, Rattus norvegicus
ttcttacactcttcacaagcagcag

SEQ ID NO: 674119 - DNA, 25 bp, Rattus norvegicus
ttcttacactgcaaatctctggatg

SEQ ID NO: 674120 - DNA, 25 bp, Rattus norvegicus
ttcttacactgctaatctctggatg

SEQ ID NO: 674121 - DNA, 25 bp, Rattus norvegicus
ttcttaccaccacagggcggtacgc

SEQ ID NO: 674122 - DNA, 25 bp, Rattus norvegicus
ttcttaccaccagagggcggtacgc

SEQ ID NO: 674123 - DNA, 25 bp, Rattus norvegicus
ttcttaccagcaattagcagccctg

SEQ ID NO: 674124 - DNA, 25 bp, Rattus norvegicus
ttcttaccagcatttagcagccctg

SEQ ID NO: 674125 - DNA, 25 bp, Rattus norvegicus
ttcttacccaacaatgctgactctt

SEQ ID NO: 674126 - DNA, 25 bp, Rattus norvegicus
ttcttacccaactatgctgactctt

SEQ ID NO: 674127 - DNA, 25 bp, Rattus norvegicus
ttcttaccccacagctaaaggctac

SEQ ID NO: 674128 - DNA, 25 bp, Rattus norvegicus
ttcttaccccactgctaaaggctac

SEQ ID NO: 674129 - DNA, 25 bp, Rattus norvegicus
ttcttaccgttaaccaatatctggg

SEQ ID NO: 674130 - DNA, 25 bp, Rattus norvegicus
ttcttaccgttatccaatatctggg

SEQ ID NO: 674131 - DNA, 25 bp, Rattus norvegicus
ttcttacctctcatgctttaagtgg

SEQ ID NO: 674132 - DNA, 25 bp, Rattus norvegicus
ttcttacctctcttgctttaagtgg

SEQ ID NO: 674133 - DNA, 25 bp, Rattus norvegicus
ttcttacctggtcggactctgaagt

SEQ ID NO: 674134 - DNA, 25 bp, Rattus norvegicus
ttcttacctggtgggactctgaagt

SEQ ID NO: 674135 - DNA, 25 bp, Rattus norvegicus
ttcttaccttctacacttcttaaag

SEQ ID NO: 674136 - DNA, 25 bp, Rattus norvegicus
ttcttaccttcttcacttcttaaag

SEQ ID NO: 674137 - DNA, 25 bp, Rattus norvegicus
ttcttaccttgactaccacttgtgt

SEQ ID NO: 674138 - DNA, 25 bp, Rattus norvegicus
ttcttaccttgagtaccacttgtgt

SEQ ID NO: 674139 - DNA, 25 bp, Rattus norvegicus
ttcttaccttttactagtctcctga

SEQ ID NO: 674140 - DNA, 25 bp, Rattus norvegicus
ttcttacctttttctagtctcctga

SEQ ID NO: 674141 - DNA, 25 bp, Rattus norvegicus
ttcttacggcataccttagggtgta

SEQ ID NO: 674142 - DNA, 25 bp, Rattus norvegicus
ttcttacggcattccttagggtgta

SEQ ID NO: 674143 - DNA, 25 bp, Rattus norvegicus
ttcttacgttgactttactctgcca

SEQ ID NO: 674144 - DNA, 25 bp, Rattus norvegicus
ttcttacgttgagtttactctgcca

SEQ ID NO: 674145 - DNA, 25 bp, Rattus norvegicus
ttcttactacagatgaaaccgtgaa

SEQ ID NO: 674146 - DNA, 25 bp, Rattus norvegicus
ttcttactacagttgaaaccgtgaa

SEQ ID NO: 674147 - DNA, 25 bp, Rattus norvegicus
ttcttactccaaagccttttaggct

SEQ ID NO: 674148 - DNA, 25 bp, Rattus norvegicus
ttcttactccaatgccttttaggct

SEQ ID NO: 674149 - DNA, 25 bp, Rattus norvegicus
ttcttactcctcacacagattcaag

SEQ ID NO: 674150 - DNA, 25 bp, Rattus norvegicus
ttcttactcctctcacagattcaag

SEQ ID NO: 674151 - DNA, 25 bp, Rattus norvegicus
ttcttactctgtacagtgcctccct

SEQ ID NO: 674152 - DNA, 25 bp, Rattus norvegicus
ttcttactctgttcagtgcctccct

SEQ ID NO: 674153 - DNA, 25 bp, Rattus norvegicus
ttcttactgaatctgatgtctttcc

SEQ ID NO: 674154 - DNA, 25 bp, Rattus norvegicus
ttcttactgaatgtgatgtctttcc

SEQ ID NO: 674155 - DNA, 25 bp, Rattus norvegicus
ttcttactggatccttttctcataa

SEQ ID NO: 674156 - DNA, 25 bp, Rattus norvegicus
ttcttactggatgcttttctcataa

SEQ ID NO: 674157 - DNA, 25 bp, Rattus norvegicus
ttcttactggctcagctcaatactg

SEQ ID NO: 674158 - DNA, 25 bp, Rattus norvegicus
ttcttactggctgagctcaatactg

SEQ ID NO: 674159 - DNA, 25 bp, Rattus norvegicus
ttcttactgttcagtttgggtgact

SEQ ID NO: 674160 - DNA, 25 bp, Rattus norvegicus
ttcttactgttctgtttgggtgact

SEQ ID NO: 674161 - DNA, 25 bp, Rattus norvegicus
ttcttacttcgtaacattggtggcg

SEQ ID NO: 674162 - DNA, 25 bp, Rattus norvegicus
ttcttacttcgttacattggtggcg

SEQ ID NO: 674163 - DNA, 25 bp, Rattus norvegicus
ttcttagatgtcagtctcccctagc

SEQ ID NO: 674164 - DNA, 25 bp, Rattus norvegicus
ttcttagatgtctgtctcccctagc

SEQ ID NO: 674165 - DNA, 25 bp, Rattus norvegicus
ttcttagattctcagcagtgtcact

SEQ ID NO: 674166 - DNA, 25 bp, Rattus norvegicus
ttcttagattctgagcagtgtcact

SEQ ID NO: 674167 - DNA, 25 bp, Rattus norvegicus
ttcttagattgtcagctccacacga

SEQ ID NO: 674168 - DNA, 25 bp, Rattus norvegicus
ttcttagattgtgagctccacacga

SEQ ID NO: 674169 - DNA, 25 bp, Rattus norvegicus
ttcttagcctccacggccttggaca

SEQ ID NO: 674170 - DNA, 25 bp, Rattus norvegicus
ttcttagcctcctcggccttggaca

SEQ ID NO: 674171 - DNA, 25 bp, Rattus norvegicus
ttcttagctagcaggcagtggccta

SEQ ID NO: 674172 - DNA, 25 bp, Rattus norvegicus
ttcttagctagctggcagtggccta

SEQ ID NO: 674173 - DNA, 25 bp, Rattus norvegicus
ttcttagctggactgtgtgctgcct

SEQ ID NO: 674174 - DNA, 25 bp, Rattus norvegicus
ttcttagctggagtgtgtgctgcct

SEQ ID NO: 674175 - DNA, 25 bp, Rattus norvegicus
ttcttaggaccacgccgaagcaggc

SEQ ID NO: 674176 - DNA, 25 bp, Rattus norvegicus
ttcttaggaccaggccgaagcaggc

SEQ ID NO: 674177 - DNA, 25 bp, Rattus norvegicus
ttcttaggcaccatccgtcagagcg

SEQ ID NO: 674178 - DNA, 25 bp, Rattus norvegicus
ttcttaggcaccttccgtcagagcg

SEQ ID NO: 674179 - DNA, 25 bp, Rattus norvegicus
ttcttaggtactcccaggcgtagag

SEQ ID NO: 674180 - DNA, 25 bp, Rattus norvegicus
ttcttaggtactgccaggcgtagag

SEQ ID NO: 674181 - DNA, 25 bp, Rattus norvegicus
ttcttagtcgctctgtgtctgtgtg

SEQ ID NO: 674182 - DNA, 25 bp, Rattus norvegicus
ttcttagtcgctgtgtgtctgtgtg

SEQ ID NO: 674183 - DNA, 25 bp, Rattus norvegicus
ttcttagtctccatcctgatggtca

SEQ ID NO: 674184 - DNA, 25 bp, Rattus norvegicus
ttcttagtctccttcctgatggtca

SEQ ID NO: 674185 - DNA, 25 bp, Rattus norvegicus
ttcttagtctctcccacacttgaca

SEQ ID NO: 674186 - DNA, 25 bp, Rattus norvegicus
ttcttagtctctgccacacttgaca

SEQ ID NO: 674187 - DNA, 25 bp, Rattus norvegicus
ttcttagtgacaaatggttccagca

SEQ ID NO: 674188 - DNA, 25 bp, Rattus norvegicus
ttcttagtgacatatggttccagca

SEQ ID NO: 674189 - DNA, 25 bp, Rattus norvegicus
ttcttagtgtccagtatcggtgcat

SEQ ID NO: 674190 - DNA, 25 bp, Rattus norvegicus
ttcttagtgtcctgtatcggtgcat

SEQ ID NO: 674191 - DNA, 25 bp, Rattus norvegicus
ttcttagtgtggagcatgtgtgtct

SEQ ID NO: 674192 - DNA, 25 bp, Rattus norvegicus
ttcttagtgtggtgcatgtgtgtct

SEQ ID NO: 674193 - DNA, 25 bp, Rattus norvegicus
ttcttagttaatctttgggcactcc

SEQ ID NO: 674194 - DNA, 25 bp, Rattus norvegicus
ttcttagttaatgtttgggcactcc

SEQ ID NO: 674195 - DNA, 25 bp, Rattus norvegicus
ttcttagttcccatcttataatggt

SEQ ID NO: 674196 - DNA, 25 bp, Rattus norvegicus
ttcttagttcccttcttataatggt

SEQ ID NO: 674197 - DNA, 25 bp, Rattus norvegicus
ttcttagtttgcctatctgccaagc

SEQ ID NO: 674198 - DNA, 25 bp, Rattus norvegicus
ttcttagtttgcgtatctgccaagc

SEQ ID NO: 674199 - DNA, 25 bp, Rattus norvegicus
ttcttagttttgaggtagggcacct

SEQ ID NO: 674200 - DNA, 25 bp, Rattus norvegicus
ttcttagttttgtggtagggcacct

SEQ ID NO: 674201 - DNA, 25 bp, Rattus norvegicus
ttcttataatggactgcagacttca

SEQ ID NO: 674202 - DNA, 25 bp, Rattus norvegicus
ttcttataatggtctgcagacttca

SEQ ID NO: 674203 - DNA, 25 bp, Rattus norvegicus
ttcttatatcctcttgctcaccaaa

SEQ ID NO: 674204 - DNA, 25 bp, Rattus norvegicus
ttcttatatcctgttgctcaccaaa

SEQ ID NO: 674205 - DNA, 25 bp, Rattus norvegicus
ttcttatcaagtaactccttctctc

SEQ ID NO: 674206 - DNA, 25 bp, Rattus norvegicus
ttcttatcaagttactccttctctc

SEQ ID NO: 674207 - DNA, 25 bp, Rattus norvegicus
ttcttatcacccatagtccttagga

SEQ ID NO: 674208 - DNA, 25 bp, Rattus norvegicus
ttcttatcacccttagtccttagga

SEQ ID NO: 674209 - DNA, 25 bp, Rattus norvegicus
ttcttatcatcaattcatcctccat

SEQ ID NO: 674210 - DNA, 25 bp, Rattus norvegicus
ttcttatcatcatttcatcctccat

SEQ ID NO: 674211 - DNA, 25 bp, Rattus norvegicus
ttcttatccccgagaggtatatctc

SEQ ID NO: 674212 - DNA, 25 bp, Rattus norvegicus
ttcttatccccgtgaggtatatctc

SEQ ID NO: 674213 - DNA, 25 bp, Rattus norvegicus
ttcttatcccgaagtcagcatcaac

SEQ ID NO: 674214 - DNA, 25 bp, Rattus norvegicus
ttcttatcccgatgtcagcatcaac

SEQ ID NO: 674215 - DNA, 25 bp, Rattus norvegicus
ttcttatcctctcttcgcttttgaa

SEQ ID NO: 674216 - DNA, 25 bp, Rattus norvegicus
ttcttatcctctgttcgcttttgaa

SEQ ID NO: 674217 - DNA, 25 bp, Rattus norvegicus
ttcttatcctgacctgaccatacta

SEQ ID NO: 674218 - DNA, 25 bp, Rattus norvegicus
ttcttatcctgagctgaccatacta

SEQ ID NO: 674219 - DNA, 25 bp, Rattus norvegicus
ttcttatcttggcttcagttctttt

SEQ ID NO: 674220 - DNA, 25 bp, Rattus norvegicus
ttcttatcttgggttcagttctttt

SEQ ID NO: 674221 - DNA, 25 bp, Rattus norvegicus
ttcttatgccgtacgatctgttttt

SEQ ID NO: 674222 - DNA, 25 bp, Rattus norvegicus
ttcttatgccgttcgatctgttttt

SEQ ID NO: 674223 - DNA, 25 bp, Rattus norvegicus
ttcttatgccttatcaatatatctg

SEQ ID NO: 674224 - DNA, 25 bp, Rattus norvegicus
ttcttatgccttttcaatatatctg

SEQ ID NO: 674225 - DNA, 25 bp, Rattus norvegicus
ttcttattcagactatttccaaaag

SEQ ID NO: 674226 - DNA, 25 bp, Rattus norvegicus
ttcttattcagagtatttccaaaag

SEQ ID NO: 674227 - DNA, 25 bp, Rattus norvegicus
ttcttattcctgagaatggcactga

SEQ ID NO: 674228 - DNA, 25 bp, Rattus norvegicus
ttcttattcctgtgaatggcactga

SEQ ID NO: 674229 - DNA, 25 bp, Rattus norvegicus
ttcttattctttctcctttggctta

SEQ ID NO: 674230 - DNA, 25 bp, Rattus norvegicus
ttcttattctttgtcctttggctta

SEQ ID NO: 674231 - DNA, 25 bp, Rattus norvegicus
ttcttattgttcatggtctgaccct

SEQ ID NO: 674232 - DNA, 25 bp, Rattus norvegicus
ttcttattgttcttggtctgaccct

SEQ ID NO: 674233 - DNA, 25 bp, Rattus norvegicus
ttcttatttgttaatccctgcttct

SEQ ID NO: 674234 - DNA, 25 bp, Rattus norvegicus
ttcttatttgtttatccctgcttct

SEQ ID NO: 674235 - DNA, 25 bp, Rattus norvegicus
ttcttcaaaggccagcagcatcagc

SEQ ID NO: 674236 - DNA, 25 bp, Rattus norvegicus
ttcttcaaaggcgagcagcatcagc

SEQ ID NO: 674237 - DNA, 25 bp, Rattus norvegicus
ttcttcaacctgactctcaaggaga

SEQ ID NO: 674238 - DNA, 25 bp, Rattus norvegicus
ttcttcaacctgtctctcaaggaga

SEQ ID NO: 674239 - DNA, 25 bp, Rattus norvegicus
ttcttcaacggcagccatttgtgca

SEQ ID NO: 674240 - DNA, 25 bp, Rattus norvegicus
ttcttcaacggctgccatttgtgca

SEQ ID NO: 674241 - DNA, 25 bp, Rattus norvegicus
ttcttcaacgtcatcgacatcccga

SEQ ID NO: 674242 - DNA, 25 bp, Rattus norvegicus
ttcttcaacgtcttcgacatcccga

SEQ ID NO: 674243 - DNA, 25 bp, Rattus norvegicus
ttcttcaactccatgagtccgctat

SEQ ID NO: 674244 - DNA, 25 bp, Rattus norvegicus
ttcttcaactccttgagtccgctat

SEQ ID NO: 674245 - DNA, 25 bp, Rattus norvegicus
ttcttcaacttgataagggttcaag

SEQ ID NO: 674246 - DNA, 25 bp, Rattus norvegicus
ttcttcaacttgttaagggttcaag

SEQ ID NO: 674247 - DNA, 25 bp, Rattus norvegicus
ttcttcaagccaaatctccgattta

SEQ ID NO: 674248 - DNA, 25 bp, Rattus norvegicus
ttcttcaagccatatctccgattta

SEQ ID NO: 674249 - DNA, 25 bp, Rattus norvegicus
ttcttcaatgtgatggaccggctcc

SEQ ID NO: 674250 - DNA, 25 bp, Rattus norvegicus
ttcttcaatgtgttggaccggctcc

SEQ ID NO: 674251 - DNA, 25 bp, Rattus norvegicus
ttcttcacagcaacagagctcggtt

SEQ ID NO: 674252 - DNA, 25 bp, Rattus norvegicus
ttcttcacagcatcagagctcggtt

SEQ ID NO: 674253 - DNA, 25 bp, Rattus norvegicus
ttcttcacaggtctcttgttttatc

SEQ ID NO: 674254 - DNA, 25 bp, Rattus norvegicus
ttcttcacaggtgtcttgttttatc

SEQ ID NO: 674255 - DNA, 25 bp, Rattus norvegicus
ttcttcacatccaaccatttccaaa

SEQ ID NO: 674256 - DNA, 25 bp, Rattus norvegicus
ttcttcacatcctaccatttccaaa

SEQ ID NO: 674257 - DNA, 25 bp, Rattus norvegicus
ttcttcacccctaaaggacaaccat

SEQ ID NO: 674258 - DNA, 25 bp, Rattus norvegicus
ttcttcaccccttaaggacaaccat

SEQ ID NO: 674259 - DNA, 25 bp, Rattus norvegicus
ttcttcaccttcagaatcttctgca

SEQ ID NO: 674260 - DNA, 25 bp, Rattus norvegicus
ttcttcaccttctgaatcttctgca

SEQ ID NO: 674261 - DNA, 25 bp, Rattus norvegicus
ttcttcacctttccagggcgggaag

SEQ ID NO: 674262 - DNA, 25 bp, Rattus norvegicus
ttcttcacctttgcagggcgggaag

SEQ ID NO: 674263 - DNA, 25 bp, Rattus norvegicus
ttcttcactaacacctgttctggtt

SEQ ID NO: 674264 - DNA, 25 bp, Rattus norvegicus
ttcttcactaactcctgttctggtt

SEQ ID NO: 674265 - DNA, 25 bp, Rattus norvegicus
ttcttcactaagagttgcagggatc

SEQ ID NO: 674266 - DNA, 25 bp, Rattus norvegicus
ttcttcactaagtgttgcagggatc

SEQ ID NO: 674267 - DNA, 25 bp, Rattus norvegicus
ttcttcactgccaaccatcagaaga

SEQ ID NO: 674268 - DNA, 25 bp, Rattus norvegicus
ttcttcactgcctaccatcagaaga

SEQ ID NO: 674269 - DNA, 25 bp, Rattus norvegicus
ttcttcactgtcagtacttgcttgg

SEQ ID NO: 674270 - DNA, 25 bp, Rattus norvegicus
ttcttcactgtctgtacttgcttgg

SEQ ID NO: 674271 - DNA, 25 bp, Rattus norvegicus
ttcttcacttagcagcagagctggc

SEQ ID NO: 674272 - DNA, 25 bp, Rattus norvegicus
ttcttcacttaggagcagagctggc

SEQ ID NO: 674273 - DNA, 25 bp, Rattus norvegicus
ttcttcagacttagaccactttctt

SEQ ID NO: 674274 - DNA, 25 bp, Rattus norvegicus
ttcttcagactttgaccactttctt

SEQ ID NO: 674275 - DNA, 25 bp, Rattus norvegicus
ttcttcagagacaccagggtggaca

SEQ ID NO: 674276 - DNA, 25 bp, Rattus norvegicus
ttcttcagagactccagggtggaca

SEQ ID NO: 674277 - DNA, 25 bp, Rattus norvegicus
ttcttcagcatgctcttctgggtaa

SEQ ID NO: 674278 - DNA, 25 bp, Rattus norvegicus
ttcttcagcatgctgcgtgacctca

SEQ ID NO: 674279 - DNA, 25 bp, Rattus norvegicus
ttcttcagcatggtcttctgggtaa

SEQ ID NO: 674280 - DNA, 25 bp, Rattus norvegicus
ttcttcagcatggtgcgtgacctca

SEQ ID NO: 674281 - DNA, 25 bp, Rattus norvegicus
ttcttcagctccagggacatccgga

SEQ ID NO: 674282 - DNA, 25 bp, Rattus norvegicus
ttcttcagctcctgggacatccgga

SEQ ID NO: 674283 - DNA, 25 bp, Rattus norvegicus
ttcttcaggaacactatcgctttgt

SEQ ID NO: 674284 - DNA, 25 bp, Rattus norvegicus
ttcttcaggaactctatcgctttgt

SEQ ID NO: 674285 - DNA, 25 bp, Rattus norvegicus
ttcttcagtctgcattcccggcggg

SEQ ID NO: 674286 - DNA, 25 bp, Rattus norvegicus
ttcttcagtctggattcccggcggg

SEQ ID NO: 674287 - DNA, 25 bp, Rattus norvegicus
ttcttcagtgacattgcatttatga

SEQ ID NO: 674288 - DNA, 25 bp, Rattus norvegicus
ttcttcagtgactttgcatttatga

SEQ ID NO: 674289 - DNA, 25 bp, Rattus norvegicus
ttcttcagtgttaggcacgagcgct

SEQ ID NO: 674290 - DNA, 25 bp, Rattus norvegicus
ttcttcagtgtttggcacgagcgct

SEQ ID NO: 674291 - DNA, 25 bp, Rattus norvegicus
ttcttcataaccagcatccacaaag

SEQ ID NO: 674292 - DNA, 25 bp, Rattus norvegicus
ttcttcataacctgcatccacaaag

SEQ ID NO: 674293 - DNA, 25 bp, Rattus norvegicus
ttcttcataacgaatgctccggctc

SEQ ID NO: 674294 - DNA, 25 bp, Rattus norvegicus
ttcttcataacgtatgctccggctc

SEQ ID NO: 674295 - DNA, 25 bp, Rattus norvegicus
ttcttcatagcccagtacaccaata

SEQ ID NO: 674296 - DNA, 25 bp, Rattus norvegicus
ttcttcatagccgagtacaccaata

SEQ ID NO: 674297 - DNA, 25 bp, Rattus norvegicus
ttcttcatctcacgaatctctcgga

SEQ ID NO: 674298 - DNA, 25 bp, Rattus norvegicus
ttcttcatctcaggaatctctcgga

SEQ ID NO: 674299 - DNA, 25 bp, Rattus norvegicus
ttcttcatctgcagagcttttgtcg

SEQ ID NO: 674300 - DNA, 25 bp, Rattus norvegicus
ttcttcatctgctgagcttttgtcg

SEQ ID NO: 674301 - DNA, 25 bp, Rattus norvegicus
ttcttcatctttagccgcctggagg

SEQ ID NO: 674302 - DNA, 25 bp, Rattus norvegicus
ttcttcatcttttgccgcctggagg

SEQ ID NO: 674303 - DNA, 25 bp, Rattus norvegicus
ttcttcatgagacctttaggtccta

SEQ ID NO: 674304 - DNA, 25 bp, Rattus norvegicus
ttcttcatgagagctttaggtccta

SEQ ID NO: 674305 - DNA, 25 bp, Rattus norvegicus
ttcttcatgcgcctggtgggcaaga

SEQ ID NO: 674306 - DNA, 25 bp, Rattus norvegicus
ttcttcatgcgcgtggtgggcaaga

SEQ ID NO: 674307 - DNA, 25 bp, Rattus norvegicus
ttcttcatggctcacgagtgtgtct

SEQ ID NO: 674308 - DNA, 25 bp, Rattus norvegicus
ttcttcatggctgacgagtgtgtct

SEQ ID NO: 674309 - DNA, 25 bp, Rattus norvegicus
ttcttcatgttaactagggacctgt

SEQ ID NO: 674310 - DNA, 25 bp, Rattus norvegicus
ttcttcatgttatctagggacctgt

SEQ ID NO: 674311 - DNA, 25 bp, Rattus norvegicus
ttcttcattcccaatttgcctctaa

SEQ ID NO: 674312 - DNA, 25 bp, Rattus norvegicus
ttcttcattccctatttgcctctaa

SEQ ID NO: 674313 - DNA, 25 bp, Rattus norvegicus
ttcttcatttcaaccagcctggcgt

SEQ ID NO: 674314 - DNA, 25 bp, Rattus norvegicus
ttcttcatttcatccagcctggcgt

SEQ ID NO: 674315 - DNA, 25 bp, Rattus norvegicus
ttcttccaaattcccactgaatcag

SEQ ID NO: 674316 - DNA, 25 bp, Rattus norvegicus
ttcttccaaattgccactgaatcag

SEQ ID NO: 674317 - DNA, 25 bp, Rattus norvegicus
ttcttccaaccacaagcaggcggca

SEQ ID NO: 674318 - DNA, 25 bp, Rattus norvegicus
ttcttccaaccagaagcaggcggca

SEQ ID NO: 674319 - DNA, 25 bp, Rattus norvegicus
ttcttccaacccattagatgctgag

SEQ ID NO: 674320 - DNA, 25 bp, Rattus norvegicus
ttcttccaaccctttagatgctgag

SEQ ID NO: 674321 - DNA, 25 bp, Rattus norvegicus
ttcttccaacggcacaagctcaagg

SEQ ID NO: 674322 - DNA, 25 bp, Rattus norvegicus
ttcttccaacgggacaagctcaagg

SEQ ID NO: 674323 - DNA, 25 bp, Rattus norvegicus
ttcttccacattatccaattcatgg

SEQ ID NO: 674324 - DNA, 25 bp, Rattus norvegicus
ttcttccacattttccaattcatgg

SEQ ID NO: 674325 - DNA, 25 bp, Rattus norvegicus
ttcttccacctcacgattttgagaa

SEQ ID NO: 674326 - DNA, 25 bp, Rattus norvegicus
ttcttccacctctcgattttgagaa

SEQ ID NO: 674327 - DNA, 25 bp, Rattus norvegicus
ttcttccacgaacggcggctgggat

SEQ ID NO: 674328 - DNA, 25 bp, Rattus norvegicus
ttcttccacgaagggcggctgggat

SEQ ID NO: 674329 - DNA, 25 bp, Rattus norvegicus
ttcttccactccatgtcttgatata

SEQ ID NO: 674330 - DNA, 25 bp, Rattus norvegicus
ttcttccactccttgtcttgatata

SEQ ID NO: 674331 - DNA, 25 bp, Rattus norvegicus
ttcttccactgaatgttctacttcc

SEQ ID NO: 674332 - DNA, 25 bp, Rattus norvegicus
ttcttccactgattgttctacttcc

SEQ ID NO: 674333 - DNA, 25 bp, Rattus norvegicus
ttcttccagactcctggtgggcaaa

SEQ ID NO: 674334 - DNA, 25 bp, Rattus norvegicus
ttcttccagactgctggtgggcaaa

SEQ ID NO: 674335 - DNA, 25 bp, Rattus norvegicus
ttcttccagtatcccagagtctcag

SEQ ID NO: 674336 - DNA, 25 bp, Rattus norvegicus
ttcttccagtatgccagagtctcag

SEQ ID NO: 674337 - DNA, 25 bp, Rattus norvegicus
ttcttccatccactgatccttatta

SEQ ID NO: 674338 - DNA, 25 bp, Rattus norvegicus
ttcttccatccagtgatccttatta

SEQ ID NO: 674339 - DNA, 25 bp, Rattus norvegicus
ttcttccatgagctgagccctggga

SEQ ID NO: 674340 - DNA, 25 bp, Rattus norvegicus
ttcttccatgaggtgagccctggga

SEQ ID NO: 674341 - DNA, 25 bp, Rattus norvegicus
ttcttcccaggaacgattcttttgg

SEQ ID NO: 674342 - DNA, 25 bp, Rattus norvegicus
ttcttcccaggaattatgtcttcag

SEQ ID NO: 674343 - DNA, 25 bp, Rattus norvegicus
ttcttcccaggatcgattcttttgg

SEQ ID NO: 674344 - DNA, 25 bp, Rattus norvegicus
ttcttcccaggatttatgtcttcag

SEQ ID NO: 674345 - DNA, 25 bp, Rattus norvegicus
ttcttcccatgcacttagattcaag

SEQ ID NO: 674346 - DNA, 25 bp, Rattus norvegicus
ttcttcccatgctcttagattcaag

SEQ ID NO: 674347 - DNA, 25 bp, Rattus norvegicus
ttcttccccaatcgttatgccttca

SEQ ID NO: 674348 - DNA, 25 bp, Rattus norvegicus
ttcttccccaatggttatgccttca

SEQ ID NO: 674349 - DNA, 25 bp, Rattus norvegicus
ttcttccccatgcatccagagtaga

SEQ ID NO: 674350 - DNA, 25 bp, Rattus norvegicus
ttcttccccatggatccagagtaga

SEQ ID NO: 674351 - DNA, 25 bp, Rattus norvegicus
ttcttcccctgaccaggcggataaa

SEQ ID NO: 674352 - DNA, 25 bp, Rattus norvegicus
ttcttcccctgagcaggcggataaa

SEQ ID NO: 674353 - DNA, 25 bp, Rattus norvegicus
ttcttccccttgaaccttctttgag

SEQ ID NO: 674354 - DNA, 25 bp, Rattus norvegicus
ttcttccccttgaactaatcgaaca

SEQ ID NO: 674355 - DNA, 25 bp, Rattus norvegicus
ttcttccccttgtaccttctttgag

SEQ ID NO: 674356 - DNA, 25 bp, Rattus norvegicus
ttcttccccttgtactaatcgaaca

SEQ ID NO: 674357 - DNA, 25 bp, Rattus norvegicus
ttcttccctctgaagtcagcttaag

SEQ ID NO: 674358 - DNA, 25 bp, Rattus norvegicus
ttcttccctctgtagtcagcttaag

SEQ ID NO: 674359 - DNA, 25 bp, Rattus norvegicus
ttcttccctgaaaactgactgaatt

SEQ ID NO: 674360 - DNA, 25 bp, Rattus norvegicus
ttcttccctgaacaaactcgccaga

SEQ ID NO: 674361 - DNA, 25 bp, Rattus norvegicus
ttcttccctgaagaaactcgccaga

SEQ ID NO: 674362 - DNA, 25 bp, Rattus norvegicus
ttcttccctgaatactgactgaatt

SEQ ID NO: 674363 - DNA, 25 bp, Rattus norvegicus
ttcttccctggcattagtaaaagat

SEQ ID NO: 674364 - DNA, 25 bp, Rattus norvegicus
ttcttccctggctttagtaaaagat

SEQ ID NO: 674365 - DNA, 25 bp, Rattus norvegicus
ttcttccctgtaataataccagatc

SEQ ID NO: 674366 - DNA, 25 bp, Rattus norvegicus
ttcttccctgtattaataccagatc

SEQ ID NO: 674367 - DNA, 25 bp, Rattus norvegicus
ttcttcccttatcccttcatggagg

SEQ ID NO: 674368 - DNA, 25 bp, Rattus norvegicus
ttcttcccttatgccttcatggagg

SEQ ID NO: 674369 - DNA, 25 bp, Rattus norvegicus
ttcttcccttcacaatgttttcgag

SEQ ID NO: 674370 - DNA, 25 bp, Rattus norvegicus
ttcttcccttcagaatgttttcgag

SEQ ID NO: 674371 - DNA, 25 bp, Rattus norvegicus
ttcttcccttccagtagatgtttcc

SEQ ID NO: 674372 - DNA, 25 bp, Rattus norvegicus
ttcttcccttcctgtagatgtttcc

SEQ ID NO: 674373 - DNA, 25 bp, Rattus norvegicus
ttcttccctttcaatgcaactgtaa

SEQ ID NO: 674374 - DNA, 25 bp, Rattus norvegicus
ttcttccctttctatgcaactgtaa

SEQ ID NO: 674375 - DNA, 25 bp, Rattus norvegicus
ttcttccgactcacatttcacaaac

SEQ ID NO: 674376 - DNA, 25 bp, Rattus norvegicus
ttcttccgactctcatttcacaaac

SEQ ID NO: 674377 - DNA, 25 bp, Rattus norvegicus
ttcttccgagccatggagatatctg

SEQ ID NO: 674378 - DNA, 25 bp, Rattus norvegicus
ttcttccgagccttggagatatctg

SEQ ID NO: 674379 - DNA, 25 bp, Rattus norvegicus
ttcttccggaagacctgaagcgctt

SEQ ID NO: 674380 - DNA, 25 bp, Rattus norvegicus
ttcttccggaagtcctgaagcgctt

SEQ ID NO: 674381 - DNA, 25 bp, Rattus norvegicus
ttcttccgggccagaatcttttctg

SEQ ID NO: 674382 - DNA, 25 bp, Rattus norvegicus
ttcttccgggcctgaatcttttctg

SEQ ID NO: 674383 - DNA, 25 bp, Rattus norvegicus
ttcttccggttcacgtgggcgcgaa

SEQ ID NO: 674384 - DNA, 25 bp, Rattus norvegicus
ttcttccggttctcgtgggcgcgaa

SEQ ID NO: 674385 - DNA, 25 bp, Rattus norvegicus
ttcttcctaactactaacttctggg

SEQ ID NO: 674386 - DNA, 25 bp, Rattus norvegicus
ttcttcctaacttctaacttctggg

SEQ ID NO: 674387 - DNA, 25 bp, Rattus norvegicus
ttcttcctagatactcagtcttatg

SEQ ID NO: 674388 - DNA, 25 bp, Rattus norvegicus
ttcttcctagattctcagtcttatg

SEQ ID NO: 674389 - DNA, 25 bp, Rattus norvegicus
ttcttcctagcacccacaggaaagt

SEQ ID NO: 674390 - DNA, 25 bp, Rattus norvegicus
ttcttcctagcagccacaggaaagt

SEQ ID NO: 674391 - DNA, 25 bp, Rattus norvegicus
ttcttcctatagatttcttttgcaa

SEQ ID NO: 674392 - DNA, 25 bp, Rattus norvegicus
ttcttcctatagttttcttttgcaa

SEQ ID NO: 674393 - DNA, 25 bp, Rattus norvegicus
ttcttcctcaagacacctgagcaga

SEQ ID NO: 674394 - DNA, 25 bp, Rattus norvegicus
ttcttcctcaagtcacctgagcaga

SEQ ID NO: 674395 - DNA, 25 bp, Rattus norvegicus
ttcttcctcagcatcaactggcagg

SEQ ID NO: 674396 - DNA, 25 bp, Rattus norvegicus
ttcttcctcagcttcaactggcagg

SEQ ID NO: 674397 - DNA, 25 bp, Rattus norvegicus
ttcttcctcatcagaaagctgaccc

SEQ ID NO: 674398 - DNA, 25 bp, Rattus norvegicus
ttcttcctcatctgaaagctgaccc

SEQ ID NO: 674399 - DNA, 25 bp, Rattus norvegicus
ttcttcctccatactacgtatttca

SEQ ID NO: 674400 - DNA, 25 bp, Rattus norvegicus
ttcttcctccattctacgtatttca

SEQ ID NO: 674401 - DNA, 25 bp, Rattus norvegicus
ttcttcctccctcattcaaatgtgt

SEQ ID NO: 674402 - DNA, 25 bp, Rattus norvegicus
ttcttcctccctgattcaaatgtgt

SEQ ID NO: 674403 - DNA, 25 bp, Rattus norvegicus
ttcttcctcctacactaagtgcggg

SEQ ID NO: 674404 - DNA, 25 bp, Rattus norvegicus
ttcttcctcctagactaagtgcggg

SEQ ID NO: 674405 - DNA, 25 bp, Rattus norvegicus
ttcttcctctccatttcatgtcata

SEQ ID NO: 674406 - DNA, 25 bp, Rattus norvegicus
ttcttcctctccttttcatgtcata

SEQ ID NO: 674407 - DNA, 25 bp, Rattus norvegicus
ttcttcctctggagtaggcccagct

SEQ ID NO: 674408 - DNA, 25 bp, Rattus norvegicus
ttcttcctctggtgtaggcccagct

SEQ ID NO: 674409 - DNA, 25 bp, Rattus norvegicus
ttcttcctcttcaaggattcaaggt

SEQ ID NO: 674410 - DNA, 25 bp, Rattus norvegicus
ttcttcctcttctaggattcaaggt

SEQ ID NO: 674411 - DNA, 25 bp, Rattus norvegicus
ttcttcctcttgattgttttgtccg

SEQ ID NO: 674412 - DNA, 25 bp, Rattus norvegicus
ttcttcctcttgtttgttttgtccg

SEQ ID NO: 674413 - DNA, 25 bp, Rattus norvegicus
ttcttcctgaagattccatgcttaa

SEQ ID NO: 674414 - DNA, 25 bp, Rattus norvegicus
ttcttcctgaagtttccatgcttaa

SEQ ID NO: 674415 - DNA, 25 bp, Rattus norvegicus
ttcttcctgactcacgttcttaata

SEQ ID NO: 674416 - DNA, 25 bp, Rattus norvegicus
ttcttcctgactgacgttcttaata

SEQ ID NO: 674417 - DNA, 25 bp, Rattus norvegicus
ttcttcctgagaccacctcatcagg

SEQ ID NO: 674418 - DNA, 25 bp, Rattus norvegicus
ttcttcctgagagcacctcatcagg

SEQ ID NO: 674419 - DNA, 25 bp, Rattus norvegicus
ttcttcctgaggagcaaggcctttt

SEQ ID NO: 674420 - DNA, 25 bp, Rattus norvegicus
ttcttcctgaggtgcaaggcctttt

SEQ ID NO: 674421 - DNA, 25 bp, Rattus norvegicus
ttcttcctgctcacttgaggcagaa

SEQ ID NO: 674422 - DNA, 25 bp, Rattus norvegicus
ttcttcctgctctcttgaggcagaa

SEQ ID NO: 674423 - DNA, 25 bp, Rattus norvegicus
ttcttcctggaacctgaaacatcaa

SEQ ID NO: 674424 - DNA, 25 bp, Rattus norvegicus
ttcttcctggaagctgaaacatcaa

SEQ ID NO: 674425 - DNA, 25 bp, Rattus norvegicus
ttcttcctggcacagcattgctatg

SEQ ID NO: 674426 - DNA, 25 bp, Rattus norvegicus
ttcttcctggcagagcattgctatg

SEQ ID NO: 674427 - DNA, 25 bp, Rattus norvegicus
ttcttcctgggaccatttttgtcat

SEQ ID NO: 674428 - DNA, 25 bp, Rattus norvegicus
ttcttcctgggagcatttttgtcat

SEQ ID NO: 674429 - DNA, 25 bp, Rattus norvegicus
ttcttcctggtaccatgtcttgagg

SEQ ID NO: 674430 - DNA, 25 bp, Rattus norvegicus
ttcttcctggtagcatgtcttgagg

SEQ ID NO: 674431 - DNA, 25 bp, Rattus norvegicus
ttcttcctgtaactcactgctgtta

SEQ ID NO: 674432 - DNA, 25 bp, Rattus norvegicus
ttcttcctgtaagtcactgctgtta

SEQ ID NO: 674433 - DNA, 25 bp, Rattus norvegicus
ttcttcctgtccacaaatcacagag

SEQ ID NO: 674434 - DNA, 25 bp, Rattus norvegicus
ttcttcctgtcctcaaatcacagag

SEQ ID NO: 674435 - DNA, 25 bp, Rattus norvegicus
ttcttccttcctaggacacgggaag

SEQ ID NO: 674436 - DNA, 25 bp, Rattus norvegicus
ttcttccttccttggacacgggaag

SEQ ID NO: 674437 - DNA, 25 bp, Rattus norvegicus
ttcttccttctcatgggctgcgtgg

SEQ ID NO: 674438 - DNA, 25 bp, Rattus norvegicus
ttcttccttctccagtgcaagcgtg

SEQ ID NO: 674439 - DNA, 25 bp, Rattus norvegicus
ttcttccttctcctttgtaagcctt

SEQ ID NO: 674440 - DNA, 25 bp, Rattus norvegicus
ttcttccttctcgagtgcaagcgtg

SEQ ID NO: 674441 - DNA, 25 bp, Rattus norvegicus
ttcttccttctcgtttgtaagcctt

SEQ ID NO: 674442 - DNA, 25 bp, Rattus norvegicus
ttcttccttctcttgggctgcgtgg

SEQ ID NO: 674443 - DNA, 25 bp, Rattus norvegicus
ttcttccttgcaagactcttgtgaa

SEQ ID NO: 674444 - DNA, 25 bp, Rattus norvegicus
ttcttccttgcatgactcttgtgaa

SEQ ID NO: 674445 - DNA, 25 bp, Rattus norvegicus
ttcttccttggtattcatttgctaa

SEQ ID NO: 674446 - DNA, 25 bp, Rattus norvegicus
ttcttccttggttttcatttgctaa

SEQ ID NO: 674447 - DNA, 25 bp, Rattus norvegicus
ttcttcctttccacattggtttaag

SEQ ID NO: 674448 - DNA, 25 bp, Rattus norvegicus
ttcttcctttccattagggactgag

SEQ ID NO: 674449 - DNA, 25 bp, Rattus norvegicus
ttcttcctttcctcattggtttaag

SEQ ID NO: 674450 - DNA, 25 bp, Rattus norvegicus
ttcttcctttcctttagggactgag

SEQ ID NO: 674451 - DNA, 25 bp, Rattus norvegicus
ttcttcgacaatatcatattttcac

SEQ ID NO: 674452 - DNA, 25 bp, Rattus norvegicus
ttcttcgacaatttcatattttcac

SEQ ID NO: 674453 - DNA, 25 bp, Rattus norvegicus
ttcttcgataagaggctggcactag

SEQ ID NO: 674454 - DNA, 25 bp, Rattus norvegicus
ttcttcgataagtggctggcactag

SEQ ID NO: 674455 - DNA, 25 bp, Rattus norvegicus
ttcttcgcagacagcaactactaag

SEQ ID NO: 674456 - DNA, 25 bp, Rattus norvegicus
ttcttcgcagactgcaactactaag

SEQ ID NO: 674457 - DNA, 25 bp, Rattus norvegicus
ttcttcgcctctccacataaatgtt

SEQ ID NO: 674458 - DNA, 25 bp, Rattus norvegicus
ttcttcgcctctgcacataaatgtt

SEQ ID NO: 674459 - DNA, 25 bp, Rattus norvegicus
ttcttcgctggcaaccaggccaagc

SEQ ID NO: 674460 - DNA, 25 bp, Rattus norvegicus
ttcttcgctggctaccaggccaagc

SEQ ID NO: 674461 - DNA, 25 bp, Rattus norvegicus
ttcttcggacctactgggtaccagc

SEQ ID NO: 674462 - DNA, 25 bp, Rattus norvegicus
ttcttcggaccttctgggtaccagc

SEQ ID NO: 674463 - DNA, 25 bp, Rattus norvegicus
ttcttcgggtgtctctaggcccgaa

SEQ ID NO: 674464 - DNA, 25 bp, Rattus norvegicus
ttcttcgggtgtgtctaggcccgaa

SEQ ID NO: 674465 - DNA, 25 bp, Rattus norvegicus
ttcttcggtgaacttcttttgtact

SEQ ID NO: 674466 - DNA, 25 bp, Rattus norvegicus
ttcttcggtgaagttcttttgtact

SEQ ID NO: 674467 - DNA, 25 bp, Rattus norvegicus
ttcttcgtcattctagttggatttc

SEQ ID NO: 674468 - DNA, 25 bp, Rattus norvegicus
ttcttcgtcattgtagttggatttc

SEQ ID NO: 674469 - DNA, 25 bp, Rattus norvegicus
ttcttcgtcctcaccaagcaggaag

SEQ ID NO: 674470 - DNA, 25 bp, Rattus norvegicus
ttcttcgtcctctccaagcaggaag

SEQ ID NO: 674471 - DNA, 25 bp, Rattus norvegicus
ttcttcgtggcaacttctcactggg

SEQ ID NO: 674472 - DNA, 25 bp, Rattus norvegicus
ttcttcgtggcatcttctcactggg

SEQ ID NO: 674473 - DNA, 25 bp, Rattus norvegicus
ttcttcgtggccatgagcagcaggg

SEQ ID NO: 674474 - DNA, 25 bp, Rattus norvegicus
ttcttcgtggccttgagcagcaggg

SEQ ID NO: 674475 - DNA, 25 bp, Rattus norvegicus
ttcttcgtggtcctcaagttgggaa

SEQ ID NO: 674476 - DNA, 25 bp, Rattus norvegicus
ttcttcgtggtcgtcaagttgggaa

SEQ ID NO: 674477 - DNA, 25 bp, Rattus norvegicus
ttcttcgtgtgtcactgacttcaca

SEQ ID NO: 674478 - DNA, 25 bp, Rattus norvegicus
ttcttcgtgtgtgactgacttcaca

SEQ ID NO: 674479 - DNA, 25 bp, Rattus norvegicus
ttcttctaaaaactcggcgcatcct

SEQ ID NO: 674480 - DNA, 25 bp, Rattus norvegicus
ttcttctaaaaagtcggcgcatcct

SEQ ID NO: 674481 - DNA, 25 bp, Rattus norvegicus
ttcttctaaaacacttggcttccta

SEQ ID NO: 674482 - DNA, 25 bp, Rattus norvegicus
ttcttctaaaactcttggcttccta

SEQ ID NO: 674483 - DNA, 25 bp, Rattus norvegicus
ttcttctaaaatcaggtcccaagtg

SEQ ID NO: 674484 - DNA, 25 bp, Rattus norvegicus
ttcttctaaaatgaggtcccaagtg

SEQ ID NO: 674485 - DNA, 25 bp, Rattus norvegicus
ttcttctacctcacagggacggtgt

SEQ ID NO: 674486 - DNA, 25 bp, Rattus norvegicus
ttcttctacctctcagggacggtgt

SEQ ID NO: 674487 - DNA, 25 bp, Rattus norvegicus
ttcttctacgaaatcactgactgct

SEQ ID NO: 674488 - DNA, 25 bp, Rattus norvegicus
ttcttctacgaattcactgactgct

SEQ ID NO: 674489 - DNA, 25 bp, Rattus norvegicus
ttcttctactttaccttcatctcta

SEQ ID NO: 674490 - DNA, 25 bp, Rattus norvegicus
ttcttctacttttccttcatctcta

SEQ ID NO: 674491 - DNA, 25 bp, Rattus norvegicus
ttcttctagggcatgttgctattcc

SEQ ID NO: 674492 - DNA, 25 bp, Rattus norvegicus
ttcttctagggcttgttgctattcc

SEQ ID NO: 674493 - DNA, 25 bp, Rattus norvegicus
ttcttctataccagcactgccagaa

SEQ ID NO: 674494 - DNA, 25 bp, Rattus norvegicus
ttcttctatacctgcactgccagaa

SEQ ID NO: 674495 - DNA, 25 bp, Rattus norvegicus
ttcttctatgcaattctgacgaggt

SEQ ID NO: 674496 - DNA, 25 bp, Rattus norvegicus
ttcttctatgcatttctgacgaggt

SEQ ID NO: 674497 - DNA, 25 bp, Rattus norvegicus
ttcttctcaactagggccgagtgac

SEQ ID NO: 674498 - DNA, 25 bp, Rattus norvegicus
ttcttctcaacttgggccgagtgac

SEQ ID NO: 674499 - DNA, 25 bp, Rattus norvegicus
ttcttctcaagcactgtggtgcagc

SEQ ID NO: 674500 - DNA, 25 bp, Rattus norvegicus
ttcttctcaagctctgtggtgcagc

SEQ ID NO: 674501 - DNA, 25 bp, Rattus norvegicus
ttcttctcacaccatatattcctgg

SEQ ID NO: 674502 - DNA, 25 bp, Rattus norvegicus
ttcttctcacacgatatattcctgg

SEQ ID NO: 674503 - DNA, 25 bp, Rattus norvegicus
ttcttctcagaactctagcacctac

SEQ ID NO: 674504 - DNA, 25 bp, Rattus norvegicus
ttcttctcagaactggatttttctt

SEQ ID NO: 674505 - DNA, 25 bp, Rattus norvegicus
ttcttctcagaagtctagcacctac

SEQ ID NO: 674506 - DNA, 25 bp, Rattus norvegicus
ttcttctcagaagtggatttttctt

SEQ ID NO: 674507 - DNA, 25 bp, Rattus norvegicus
ttcttctcattcagtacttttctag

SEQ ID NO: 674508 - DNA, 25 bp, Rattus norvegicus
ttcttctcattctgtacttttctag

SEQ ID NO: 674509 - DNA, 25 bp, Rattus norvegicus
ttcttctcatttatcatgccacagg

SEQ ID NO: 674510 - DNA, 25 bp, Rattus norvegicus
ttcttctcatttccacttcaactca

SEQ ID NO: 674511 - DNA, 25 bp, Rattus norvegicus
ttcttctcatttgcacttcaactca

SEQ ID NO: 674512 - DNA, 25 bp, Rattus norvegicus
ttcttctcatttttcatgccacagg

SEQ ID NO: 674513 - DNA, 25 bp, Rattus norvegicus
ttcttctccagtagcttgggccgca

SEQ ID NO: 674514 - DNA, 25 bp, Rattus norvegicus
ttcttctccagtagtctaggcatta

SEQ ID NO: 674515 - DNA, 25 bp, Rattus norvegicus
ttcttctccagttgcttgggccgca

SEQ ID NO: 674516 - DNA, 25 bp, Rattus norvegicus
ttcttctccagttgtctaggcatta

SEQ ID NO: 674517 - DNA, 25 bp, Rattus norvegicus
ttcttctcccatagcaagagctgta

SEQ ID NO: 674518 - DNA, 25 bp, Rattus norvegicus
ttcttctcccattgcaagagctgta

SEQ ID NO: 674519 - DNA, 25 bp, Rattus norvegicus
ttcttctccggacctgcagagatgg

SEQ ID NO: 674520 - DNA, 25 bp, Rattus norvegicus
ttcttctccggagctgcagagatgg

SEQ ID NO: 674521 - DNA, 25 bp, Rattus norvegicus
ttcttctcctacatctcttttaagt

SEQ ID NO: 674522 - DNA, 25 bp, Rattus norvegicus
ttcttctcctacttctcttttaagt

SEQ ID NO: 674523 - DNA, 25 bp, Rattus norvegicus
ttcttctcctgtacctgcaataaat

SEQ ID NO: 674524 - DNA, 25 bp, Rattus norvegicus
ttcttctcctgttcctgcaataaat

SEQ ID NO: 674525 - DNA, 25 bp, Rattus norvegicus
ttcttctcgtctcaactgcaaactt

SEQ ID NO: 674526 - DNA, 25 bp, Rattus norvegicus
ttcttctcgtctgaactgcaaactt

SEQ ID NO: 674527 - DNA, 25 bp, Rattus norvegicus
ttcttctctggtctgtttctctttc

SEQ ID NO: 674528 - DNA, 25 bp, Rattus norvegicus
ttcttctctggtgtgtttctctttc

SEQ ID NO: 674529 - DNA, 25 bp, Rattus norvegicus
ttcttctgacgtaggagaggctccc

SEQ ID NO: 674530 - DNA, 25 bp, Rattus norvegicus
ttcttctgacgttggagaggctccc

SEQ ID NO: 674531 - DNA, 25 bp, Rattus norvegicus
ttcttctgatgaatgacccctgttc

SEQ ID NO: 674532 - DNA, 25 bp, Rattus norvegicus
ttcttctgatgattgacccctgttc

SEQ ID NO: 674533 - DNA, 25 bp, Rattus norvegicus
ttcttctgcattctcatggtaccaa

SEQ ID NO: 674534 - DNA, 25 bp, Rattus norvegicus
ttcttctgcattgtcatggtaccaa

SEQ ID NO: 674535 - DNA, 25 bp, Rattus norvegicus
ttcttctgctagactggcctgactg

SEQ ID NO: 674536 - DNA, 25 bp, Rattus norvegicus
ttcttctgctagtctggcctgactg

SEQ ID NO: 674537 - DNA, 25 bp, Rattus norvegicus
ttcttctgctcaccgcgccggagag

SEQ ID NO: 674538 - DNA, 25 bp, Rattus norvegicus
ttcttctgctcagcgcgccggagag

SEQ ID NO: 674539 - DNA, 25 bp, Rattus norvegicus
ttcttctgctccatcagattcatgc

SEQ ID NO: 674540 - DNA, 25 bp, Rattus norvegicus
ttcttctgctccttcagattcatgc

SEQ ID NO: 674541 - DNA, 25 bp, Rattus norvegicus
ttcttctgcttgaatctttctctga

SEQ ID NO: 674542 - DNA, 25 bp, Rattus norvegicus
ttcttctgcttgtatctttctctga

SEQ ID NO: 674543 - DNA, 25 bp, Rattus norvegicus
ttcttctggaacaaggcaggccata

SEQ ID NO: 674544 - DNA, 25 bp, Rattus norvegicus
ttcttctggaactaggcaggccata

SEQ ID NO: 674545 - DNA, 25 bp, Rattus norvegicus
ttcttctgggacatagcggtggcca

SEQ ID NO: 674546 - DNA, 25 bp, Rattus norvegicus
ttcttctgggacttagcggtggcca

SEQ ID NO: 674547 - DNA, 25 bp, Rattus norvegicus
ttcttctggtcccatacttgagtga

SEQ ID NO: 674548 - DNA, 25 bp, Rattus norvegicus
ttcttctggtccgatacttgagtga

SEQ ID NO: 674549 - DNA, 25 bp, Rattus norvegicus
ttcttctgtcatctttcatggagcc

SEQ ID NO: 674550 - DNA, 25 bp, Rattus norvegicus
ttcttctgtcatgtttcatggagcc

SEQ ID NO: 674551 - DNA, 25 bp, Rattus norvegicus
ttcttctgtcctcacattgcctagc

SEQ ID NO: 674552 - DNA, 25 bp, Rattus norvegicus
ttcttctgtcctgacattgcctagc

SEQ ID NO: 674553 - DNA, 25 bp, Rattus norvegicus
ttcttctgttgcctgtggatctaga

SEQ ID NO: 674554 - DNA, 25 bp, Rattus norvegicus
ttcttctgttgcgtgtggatctaga

SEQ ID NO: 674555 - DNA, 25 bp, Rattus norvegicus
ttcttcttactaaaccatcctgact

SEQ ID NO: 674556 - DNA, 25 bp, Rattus norvegicus
ttcttcttactataccatcctgact

SEQ ID NO: 674557 - DNA, 25 bp, Rattus norvegicus
ttcttcttaggcctgtttaattatt

SEQ ID NO: 674558 - DNA, 25 bp, Rattus norvegicus
ttcttcttaggcgtgtttaattatt

SEQ ID NO: 674559 - DNA, 25 bp, Rattus norvegicus
ttcttcttcacgcaagtagcactca

SEQ ID NO: 674560 - DNA, 25 bp, Rattus norvegicus
ttcttcttcacggaagtagcactca

SEQ ID NO: 674561 - DNA, 25 bp, Rattus norvegicus
ttcttcttcactaagcagcagagct

SEQ ID NO: 674562 - DNA, 25 bp, Rattus norvegicus
ttcttcttcacttagcagcagagct

SEQ ID NO: 674563 - DNA, 25 bp, Rattus norvegicus
ttcttcttcattcgattcacggctc

SEQ ID NO: 674564 - DNA, 25 bp, Rattus norvegicus
ttcttcttcattggattcacggctc

SEQ ID NO: 674565 - DNA, 25 bp, Rattus norvegicus
ttcttcttgttaattttaggaccag

SEQ ID NO: 674566 - DNA, 25 bp, Rattus norvegicus
ttcttcttgttatttttaggaccag

SEQ ID NO: 674567 - DNA, 25 bp, Rattus norvegicus
ttcttctttagacgccatgggacac

SEQ ID NO: 674568 - DNA, 25 bp, Rattus norvegicus
ttcttctttagaggccatgggacac

SEQ ID NO: 674569 - DNA, 25 bp, Rattus norvegicus
ttcttctttcttacttaccccatat

SEQ ID NO: 674570 - DNA, 25 bp, Rattus norvegicus
ttcttctttctttcttaccccatat

SEQ ID NO: 674571 - DNA, 25 bp, Rattus norvegicus
ttcttcttttctattagcaagccat

SEQ ID NO: 674572 - DNA, 25 bp, Rattus norvegicus
ttcttcttttcttttagcaagccat

SEQ ID NO: 674573 - DNA, 25 bp, Rattus norvegicus
ttcttctttttcaaatgggtcacaa

SEQ ID NO: 674574 - DNA, 25 bp, Rattus norvegicus
ttcttctttttcattatctagcaaa

SEQ ID NO: 674575 - DNA, 25 bp, Rattus norvegicus
ttcttctttttctaatgggtcacaa

SEQ ID NO: 674576 - DNA, 25 bp, Rattus norvegicus
ttcttctttttctttatctagcaaa

SEQ ID NO: 674577 - DNA, 25 bp, Rattus norvegicus
ttcttgaaagcaatcgccagcggtt

SEQ ID NO: 674578 - DNA, 25 bp, Rattus norvegicus
ttcttgaaagcattcgccagcggtt

SEQ ID NO: 674579 - DNA, 25 bp, Rattus norvegicus
ttcttgaacttcctttcgttgtcat

SEQ ID NO: 674580 - DNA, 25 bp, Rattus norvegicus
ttcttgaacttcgtttcgttgtcat

SEQ ID NO: 674581 - DNA, 25 bp, Rattus norvegicus
ttcttgacacctctctaggctataa

SEQ ID NO: 674582 - DNA, 25 bp, Rattus norvegicus
ttcttgacacctgtctaggctataa

SEQ ID NO: 674583 - DNA, 25 bp, Rattus norvegicus
ttcttgacactcctgacggtgggag

SEQ ID NO: 674584 - DNA, 25 bp, Rattus norvegicus
ttcttgacactcgtgacggtgggag

SEQ ID NO: 674585 - DNA, 25 bp, Rattus norvegicus
ttcttgaccagtaccgtatgtttga

SEQ ID NO: 674586 - DNA, 25 bp, Rattus norvegicus
ttcttgaccagttccgtatgtttga

SEQ ID NO: 674587 - DNA, 25 bp, Rattus norvegicus
ttcttgacctaaaagcaccccatac

SEQ ID NO: 674588 - DNA, 25 bp, Rattus norvegicus
ttcttgacctaatagcaccccatac

SEQ ID NO: 674589 - DNA, 25 bp, Rattus norvegicus
ttcttgacttctactctcaggcctt

SEQ ID NO: 674590 - DNA, 25 bp, Rattus norvegicus
ttcttgacttcttctctcaggcctt

SEQ ID NO: 674591 - DNA, 25 bp, Rattus norvegicus
ttcttgagctgtccgtttgccacca

SEQ ID NO: 674592 - DNA, 25 bp, Rattus norvegicus
ttcttgagctgtgcgtttgccacca

SEQ ID NO: 674593 - DNA, 25 bp, Rattus norvegicus
ttcttgaggctaaggacttgggtct

SEQ ID NO: 674594 - DNA, 25 bp, Rattus norvegicus
ttcttgaggctatggacttgggtct

SEQ ID NO: 674595 - DNA, 25 bp, Rattus norvegicus
ttcttgagggctcgctgaggaaacc

SEQ ID NO: 674596 - DNA, 25 bp, Rattus norvegicus
ttcttgagggctggctgaggaaacc

SEQ ID NO: 674597 - DNA, 25 bp, Rattus norvegicus
ttcttgaggtgtatttgttatttct

SEQ ID NO: 674598 - DNA, 25 bp, Rattus norvegicus
ttcttgaggtgtttttgttatttct

SEQ ID NO: 674599 - DNA, 25 bp, Rattus norvegicus
ttcttgagtcacacccctgctgggt

SEQ ID NO: 674600 - DNA, 25 bp, Rattus norvegicus
ttcttgagtcactcccctgctgggt

SEQ ID NO: 674601 - DNA, 25 bp, Rattus norvegicus
ttcttgatattcatcctattcccta

SEQ ID NO: 674602 - DNA, 25 bp, Rattus norvegicus
ttcttgatattcttcctattcccta

SEQ ID NO: 674603 - DNA, 25 bp, Rattus norvegicus
ttcttgatcaggctgtctccttgtg

SEQ ID NO: 674604 - DNA, 25 bp, Rattus norvegicus
ttcttgatcagggtgtctccttgtg

SEQ ID NO: 674605 - DNA, 25 bp, Rattus norvegicus
ttcttgatcatcctcatccataagc

SEQ ID NO: 674606 - DNA, 25 bp, Rattus norvegicus
ttcttgatcatcgtcatccataagc

SEQ ID NO: 674607 - DNA, 25 bp, Rattus norvegicus
ttcttgatgaccaccttccctgagt

SEQ ID NO: 674608 - DNA, 25 bp, Rattus norvegicus
ttcttgatgacctccttccctgagt

SEQ ID NO: 674609 - DNA, 25 bp, Rattus norvegicus
ttcttgatgtcactacttgttggag

SEQ ID NO: 674610 - DNA, 25 bp, Rattus norvegicus
ttcttgatgtcagtacttgttggag

SEQ ID NO: 674611 - DNA, 25 bp, Rattus norvegicus
ttcttgatttaaaaactgcttatgc

SEQ ID NO: 674612 - DNA, 25 bp, Rattus norvegicus
ttcttgatttaataactgcttatgc

SEQ ID NO: 674613 - DNA, 25 bp, Rattus norvegicus
ttcttgatttgcaggcccgactaag

SEQ ID NO: 674614 - DNA, 25 bp, Rattus norvegicus
ttcttgatttgctggcccgactaag

SEQ ID NO: 674615 - DNA, 25 bp, Rattus norvegicus
ttcttgcaaagtccgttcctttctg

SEQ ID NO: 674616 - DNA, 25 bp, Rattus norvegicus
ttcttgcaaagtgcgttcctttctg

SEQ ID NO: 674617 - DNA, 25 bp, Rattus norvegicus
ttcttgcaagcaattgggcctttcc

SEQ ID NO: 674618 - DNA, 25 bp, Rattus norvegicus
ttcttgcaagcatttgggcctttcc

SEQ ID NO: 674619 - DNA, 25 bp, Rattus norvegicus
ttcttgcaaggtcccagatctgtca

SEQ ID NO: 674620 - DNA, 25 bp, Rattus norvegicus
ttcttgcaaggtgccagatctgtca

SEQ ID NO: 674621 - DNA, 25 bp, Rattus norvegicus
ttcttgcactggatgcaatcttcca

SEQ ID NO: 674622 - DNA, 25 bp, Rattus norvegicus
ttcttgcactggttgcaatcttcca

SEQ ID NO: 674623 - DNA, 25 bp, Rattus norvegicus
ttcttgcagaatcaccccgggttcg

SEQ ID NO: 674624 - DNA, 25 bp, Rattus norvegicus
ttcttgcagaatgaccccgggttcg

SEQ ID NO: 674625 - DNA, 25 bp, Rattus norvegicus
ttcttgcatgtgctgagaaggctat

SEQ ID NO: 674626 - DNA, 25 bp, Rattus norvegicus
ttcttgcatgtggtgagaaggctat

SEQ ID NO: 674627 - DNA, 25 bp, Rattus norvegicus
ttcttgccaaaaagagactcttcac

SEQ ID NO: 674628 - DNA, 25 bp, Rattus norvegicus
ttcttgccaaaatgagactcttcac

SEQ ID NO: 674629 - DNA, 25 bp, Rattus norvegicus
ttcttgccaaatccagacctctggt

SEQ ID NO: 674630 - DNA, 25 bp, Rattus norvegicus
ttcttgccaaatgcagacctctggt

SEQ ID NO: 674631 - DNA, 25 bp, Rattus norvegicus
ttcttgccaagtccgctgacacata

SEQ ID NO: 674632 - DNA, 25 bp, Rattus norvegicus
ttcttgccaagtctcctcaggataa

SEQ ID NO: 674633 - DNA, 25 bp, Rattus norvegicus
ttcttgccaagtgcgctgacacata

SEQ ID NO: 674634 - DNA, 25 bp, Rattus norvegicus
ttcttgccaagtgtcctcaggataa

SEQ ID NO: 674635 - DNA, 25 bp, Rattus norvegicus
ttcttgccaggcctgggattcacta

SEQ ID NO: 674636 - DNA, 25 bp, Rattus norvegicus
ttcttgccaggcgtgggattcacta

SEQ ID NO: 674637 - DNA, 25 bp, Rattus norvegicus
ttcttgccatcccttttcctcttag

SEQ ID NO: 674638 - DNA, 25 bp, Rattus norvegicus
ttcttgccatccgttttcctcttag

SEQ ID NO: 674639 - DNA, 25 bp, Rattus norvegicus
ttcttgcccaatatttaatcccacc

SEQ ID NO: 674640 - DNA, 25 bp, Rattus norvegicus
ttcttgcccaatttttaatcccacc

SEQ ID NO: 674641 - DNA, 25 bp, Rattus norvegicus
ttcttgcctaggcatgctcatggaa

SEQ ID NO: 674642 - DNA, 25 bp, Rattus norvegicus
ttcttgcctagggatgctcatggaa

SEQ ID NO: 674643 - DNA, 25 bp, Rattus norvegicus
ttcttgcctcgcctgcgggaaacac

SEQ ID NO: 674644 - DNA, 25 bp, Rattus norvegicus
ttcttgcctcgcgtgcgggaaacac

SEQ ID NO: 674645 - DNA, 25 bp, Rattus norvegicus
ttcttgcctggcctcacttgagagt

SEQ ID NO: 674646 - DNA, 25 bp, Rattus norvegicus
ttcttgcctggcgtcacttgagagt

SEQ ID NO: 674647 - DNA, 25 bp, Rattus norvegicus
ttcttgcgcctcagcgggacagggt

SEQ ID NO: 674648 - DNA, 25 bp, Rattus norvegicus
ttcttgcgcctctgcgggacagggt

SEQ ID NO: 674649 - DNA, 25 bp, Rattus norvegicus
ttcttgcgcgccagggcgcagtcac

SEQ ID NO: 674650 - DNA, 25 bp, Rattus norvegicus
ttcttgcgcgcctgggcgcagtcac

SEQ ID NO: 674651 - DNA, 25 bp, Rattus norvegicus
ttcttgcgcgctcaggaggactttg

SEQ ID NO: 674652 - DNA, 25 bp, Rattus norvegicus
ttcttgcgcgctgaggaggactttg

SEQ ID NO: 674653 - DNA, 25 bp, Rattus norvegicus
ttcttgcggttcagcttgaaggatc

SEQ ID NO: 674654 - DNA, 25 bp, Rattus norvegicus
ttcttgcggttctgcttgaaggatc

SEQ ID NO: 674655 - DNA, 25 bp, Rattus norvegicus
ttcttgcgttgaaccgaggcctgag

SEQ ID NO: 674656 - DNA, 25 bp, Rattus norvegicus
ttcttgcgttgatccgaggcctgag

SEQ ID NO: 674657 - DNA, 25 bp, Rattus norvegicus
ttcttgcgtttaattggagacctca

SEQ ID NO: 674658 - DNA, 25 bp, Rattus norvegicus
ttcttgcgtttatttggagacctca

SEQ ID NO: 674659 - DNA, 25 bp, Rattus norvegicus
ttcttgctaggtcccaagttctgtt

SEQ ID NO: 674660 - DNA, 25 bp, Rattus norvegicus
ttcttgctaggtgccaagttctgtt

SEQ ID NO: 674661 - DNA, 25 bp, Rattus norvegicus
ttcttgctattacgtgtgcttccgt

SEQ ID NO: 674662 - DNA, 25 bp, Rattus norvegicus
ttcttgctattaggtgtgcttccgt

SEQ ID NO: 674663 - DNA, 25 bp, Rattus norvegicus
ttcttgctcaagaagaggtcctagt

SEQ ID NO: 674664 - DNA, 25 bp, Rattus norvegicus
ttcttgctcaagtagaggtcctagt

SEQ ID NO: 674665 - DNA, 25 bp, Rattus norvegicus
ttcttgctcaatactgctgcagtgc

SEQ ID NO: 674666 - DNA, 25 bp, Rattus norvegicus
ttcttgctcaatcgaaaaacccata

SEQ ID NO: 674667 - DNA, 25 bp, Rattus norvegicus
ttcttgctcaatggaaaaacccata

SEQ ID NO: 674668 - DNA, 25 bp, Rattus norvegicus
ttcttgctcaattctgctgcagtgc

SEQ ID NO: 674669 - DNA, 25 bp, Rattus norvegicus
ttcttgctcaccaactcatgcagta

SEQ ID NO: 674670 - DNA, 25 bp, Rattus norvegicus
ttcttgctcacctactcatgcagta

SEQ ID NO: 674671 - DNA, 25 bp, Rattus norvegicus
ttcttgctcgcgaggctgtgatcaa

SEQ ID NO: 674672 - DNA, 25 bp, Rattus norvegicus
ttcttgctcgcgtggctgtgatcaa

SEQ ID NO: 674673 - DNA, 25 bp, Rattus norvegicus
ttcttgctgaaaatactgctccaat

SEQ ID NO: 674674 - DNA, 25 bp, Rattus norvegicus
ttcttgctgaaattactgctccaat

SEQ ID NO: 674675 - DNA, 25 bp, Rattus norvegicus
ttcttgctgctcacttgggattggg

SEQ ID NO: 674676 - DNA, 25 bp, Rattus norvegicus
ttcttgctgctctcttgggattggg

SEQ ID NO: 674677 - DNA, 25 bp, Rattus norvegicus
ttcttgctggctcatgctttgctgg

SEQ ID NO: 674678 - DNA, 25 bp, Rattus norvegicus
ttcttgctggctgatgctttgctgg

SEQ ID NO: 674679 - DNA, 25 bp, Rattus norvegicus
ttcttgctgggtatggagagagtac

SEQ ID NO: 674680 - DNA, 25 bp, Rattus norvegicus
ttcttgctgggtttggagagagtac

SEQ ID NO: 674681 - DNA, 25 bp, Rattus norvegicus
ttcttgctggttcttttttactcaa

SEQ ID NO: 674682 - DNA, 25 bp, Rattus norvegicus
ttcttgctggttgttttttactcaa

SEQ ID NO: 674683 - DNA, 25 bp, Rattus norvegicus
ttcttgcttggccactaggagccgc

SEQ ID NO: 674684 - DNA, 25 bp, Rattus norvegicus
ttcttgcttggcgactaggagccgc

SEQ ID NO: 674685 - DNA, 25 bp, Rattus norvegicus
ttcttgcttttgactggctgcagaa

SEQ ID NO: 674686 - DNA, 25 bp, Rattus norvegicus
ttcttgcttttgtctggctgcagaa

SEQ ID NO: 674687 - DNA, 25 bp, Rattus norvegicus
ttcttggaaagccacttcctggata

SEQ ID NO: 674688 - DNA, 25 bp, Rattus norvegicus
ttcttggaaagcgacttcctggata

SEQ ID NO: 674689 - DNA, 25 bp, Rattus norvegicus
ttcttggaacgccaaatttcctctt

SEQ ID NO: 674690 - DNA, 25 bp, Rattus norvegicus
ttcttggaacgcgaaatttcctctt

SEQ ID NO: 674691 - DNA, 25 bp, Rattus norvegicus
ttcttggaccaaatctttccttcct

SEQ ID NO: 674692 - DNA, 25 bp, Rattus norvegicus
ttcttggaccaattctttccttcct

SEQ ID NO: 674693 - DNA, 25 bp, Rattus norvegicus
ttcttggactctctctcctcagttt

SEQ ID NO: 674694 - DNA, 25 bp, Rattus norvegicus
ttcttggactctgtctcctcagttt

SEQ ID NO: 674695 - DNA, 25 bp, Rattus norvegicus
ttcttggagcctcgcgcaatgcaga

SEQ ID NO: 674696 - DNA, 25 bp, Rattus norvegicus
ttcttggagcctggcgcaatgcaga

SEQ ID NO: 674697 - DNA, 25 bp, Rattus norvegicus
ttcttggagcttaggctgtctttgt

SEQ ID NO: 674698 - DNA, 25 bp, Rattus norvegicus
ttcttggagctttggctgtctttgt

SEQ ID NO: 674699 - DNA, 25 bp, Rattus norvegicus
ttcttggaggacacttttagcacgt

SEQ ID NO: 674700 - DNA, 25 bp, Rattus norvegicus
ttcttggaggactcttttagcacgt

SEQ ID NO: 674701 - DNA, 25 bp, Rattus norvegicus
ttcttggaggctaatttctggtcta

SEQ ID NO: 674702 - DNA, 25 bp, Rattus norvegicus
ttcttggaggcttatttctggtcta

SEQ ID NO: 674703 - DNA, 25 bp, Rattus norvegicus
ttcttggatccacgtgaccacagat

SEQ ID NO: 674704 - DNA, 25 bp, Rattus norvegicus
ttcttggatccaggtgaccacagat

SEQ ID NO: 674705 - DNA, 25 bp, Rattus norvegicus
ttcttggatcgcagtcatacctggg

SEQ ID NO: 674706 - DNA, 25 bp, Rattus norvegicus
ttcttggatcgctgtcatacctggg

SEQ ID NO: 674707 - DNA, 25 bp, Rattus norvegicus
ttcttggcaaacatctctttttctc

SEQ ID NO: 674708 - DNA, 25 bp, Rattus norvegicus
ttcttggcaaacttctctttttctc

SEQ ID NO: 674709 - DNA, 25 bp, Rattus norvegicus
ttcttggcaaggatacagcagtatg

SEQ ID NO: 674710 - DNA, 25 bp, Rattus norvegicus
ttcttggcaaggttacagcagtatg

SEQ ID NO: 674711 - DNA, 25 bp, Rattus norvegicus
ttcttggcacccaaggctgacacaa

SEQ ID NO: 674712 - DNA, 25 bp, Rattus norvegicus
ttcttggcaccctaggctgacacaa

SEQ ID NO: 674713 - DNA, 25 bp, Rattus norvegicus
ttcttggcagccactggattggtca

SEQ ID NO: 674714 - DNA, 25 bp, Rattus norvegicus
ttcttggcagcctctggattggtca

SEQ ID NO: 674715 - DNA, 25 bp, Rattus norvegicus
ttcttggcatccatactgattgtta

SEQ ID NO: 674716 - DNA, 25 bp, Rattus norvegicus
ttcttggcatccttactgattgtta

SEQ ID NO: 674717 - DNA, 25 bp, Rattus norvegicus
ttcttggccaagacatgcagatagg

SEQ ID NO: 674718 - DNA, 25 bp, Rattus norvegicus
ttcttggccaagtcatgcagatagg

SEQ ID NO: 674719 - DNA, 25 bp, Rattus norvegicus
ttcttggcccctaagatgccagaga

SEQ ID NO: 674720 - DNA, 25 bp, Rattus norvegicus
ttcttggccccttagatgccagaga

SEQ ID NO: 674721 - DNA, 25 bp, Rattus norvegicus
ttcttggcccgcaaccggcaggtgt

SEQ ID NO: 674722 - DNA, 25 bp, Rattus norvegicus
ttcttggcccgctaccggcaggtgt

SEQ ID NO: 674723 - DNA, 25 bp, Rattus norvegicus
ttcttggccctgaggtactgctgtc

SEQ ID NO: 674724 - DNA, 25 bp, Rattus norvegicus
ttcttggccctgtggtactgctgtc

SEQ ID NO: 674725 - DNA, 25 bp, Rattus norvegicus
ttcttggcctccacagagcactgaa

SEQ ID NO: 674726 - DNA, 25 bp, Rattus norvegicus
ttcttggcctcctcagagcactgaa

SEQ ID NO: 674727 - DNA, 25 bp, Rattus norvegicus
ttcttggcctggctacaaaagagcc

SEQ ID NO: 674728 - DNA, 25 bp, Rattus norvegicus
ttcttggcctgggtacaaaagagcc

SEQ ID NO: 674729 - DNA, 25 bp, Rattus norvegicus
ttcttggctcccagaccaggagttt

SEQ ID NO: 674730 - DNA, 25 bp, Rattus norvegicus
ttcttggctccctgaccaggagttt

SEQ ID NO: 674731 - DNA, 25 bp, Rattus norvegicus
ttcttggctgacactgtaccttaca

SEQ ID NO: 674732 - DNA, 25 bp, Rattus norvegicus
ttcttggctgactctgtaccttaca

SEQ ID NO: 674733 - DNA, 25 bp, Rattus norvegicus
ttcttggctggccttacagagcggc

SEQ ID NO: 674734 - DNA, 25 bp, Rattus norvegicus
ttcttggctggcgttacagagcggc

SEQ ID NO: 674735 - DNA, 25 bp, Rattus norvegicus
ttcttggctttcagagacaccgact

SEQ ID NO: 674736 - DNA, 25 bp, Rattus norvegicus
ttcttggctttcagtgagacgtaac

SEQ ID NO: 674737 - DNA, 25 bp, Rattus norvegicus
ttcttggctttctgagacaccgact

SEQ ID NO: 674738 - DNA, 25 bp, Rattus norvegicus
ttcttggctttctgtgagacgtaac

SEQ ID NO: 674739 - DNA, 25 bp, Rattus norvegicus
ttcttggctttgacacaggcgatgc

SEQ ID NO: 674740 - DNA, 25 bp, Rattus norvegicus
ttcttggctttgtcacaggcgatgc

SEQ ID NO: 674741 - DNA, 25 bp, Rattus norvegicus
ttcttgggaaatcctttgatctctc

SEQ ID NO: 674742 - DNA, 25 bp, Rattus norvegicus
ttcttgggaaatgctttgatctctc

SEQ ID NO: 674743 - DNA, 25 bp, Rattus norvegicus
ttcttgggaacaacctttctctgga

SEQ ID NO: 674744 - DNA, 25 bp, Rattus norvegicus
ttcttgggaacatcctttctctgga

SEQ ID NO: 674745 - DNA, 25 bp, Rattus norvegicus
ttcttgggactcaacgggctagcta

SEQ ID NO: 674746 - DNA, 25 bp, Rattus norvegicus
ttcttgggactctacgggctagcta

SEQ ID NO: 674747 - DNA, 25 bp, Rattus norvegicus
ttcttgggactgagtgcatgacgct

SEQ ID NO: 674748 - DNA, 25 bp, Rattus norvegicus
ttcttgggactgtgtgcatgacgct

SEQ ID NO: 674749 - DNA, 25 bp, Rattus norvegicus
ttcttgggcaatacacactggcatt

SEQ ID NO: 674750 - DNA, 25 bp, Rattus norvegicus
ttcttgggcaattcacactggcatt

SEQ ID NO: 674751 - DNA, 25 bp, Rattus norvegicus
ttcttgggcactcacatttctgttt

SEQ ID NO: 674752 - DNA, 25 bp, Rattus norvegicus
ttcttgggcactgacatttctgttt

SEQ ID NO: 674753 - DNA, 25 bp, Rattus norvegicus
ttcttgggccgaccaatttctttaa

SEQ ID NO: 674754 - DNA, 25 bp, Rattus norvegicus
ttcttgggccgagcaatttctttaa

SEQ ID NO: 674755 - DNA, 25 bp, Rattus norvegicus
ttcttgggtgttcgactgtcatcag

SEQ ID NO: 674756 - DNA, 25 bp, Rattus norvegicus
ttcttgggtgttggactgtcatcag

SEQ ID NO: 674757 - DNA, 25 bp, Rattus norvegicus
ttcttgggttggactgcagtctgga

SEQ ID NO: 674758 - DNA, 25 bp, Rattus norvegicus
ttcttgggttggtctgcagtctgga

SEQ ID NO: 674759 - DNA, 25 bp, Rattus norvegicus
ttcttggtatcaaggcctgcactaa

SEQ ID NO: 674760 - DNA, 25 bp, Rattus norvegicus
ttcttggtatcatggcctgcactaa

SEQ ID NO: 674761 - DNA, 25 bp, Rattus norvegicus
ttcttggtcctcagaacttggatct

SEQ ID NO: 674762 - DNA, 25 bp, Rattus norvegicus
ttcttggtcctcagtctgcaactgg

SEQ ID NO: 674763 - DNA, 25 bp, Rattus norvegicus
ttcttggtcctctgaacttggatct

SEQ ID NO: 674764 - DNA, 25 bp, Rattus norvegicus
ttcttggtcctctgtctgcaactgg

SEQ ID NO: 674765 - DNA, 25 bp, Rattus norvegicus
ttcttggtccttcttcagctaagat

SEQ ID NO: 674766 - DNA, 25 bp, Rattus norvegicus
ttcttggtccttcttgcaatcgcct

SEQ ID NO: 674767 - DNA, 25 bp, Rattus norvegicus
ttcttggtccttgttcagctaagat

SEQ ID NO: 674768 - DNA, 25 bp, Rattus norvegicus
ttcttggtccttgttgcaatcgcct

SEQ ID NO: 674769 - DNA, 25 bp, Rattus norvegicus
ttcttggtgactcctaacgacctgt

SEQ ID NO: 674770 - DNA, 25 bp, Rattus norvegicus
ttcttggtgactgctaacgacctgt

SEQ ID NO: 674771 - DNA, 25 bp, Rattus norvegicus
ttcttggtgcccagccccaaataaa

SEQ ID NO: 674772 - DNA, 25 bp, Rattus norvegicus
ttcttggtgccctgccccaaataaa

SEQ ID NO: 674773 - DNA, 25 bp, Rattus norvegicus
ttcttggttaggatcactgaggtgg

SEQ ID NO: 674774 - DNA, 25 bp, Rattus norvegicus
ttcttggttaggttcactgaggtgg

SEQ ID NO: 674775 - DNA, 25 bp, Rattus norvegicus
ttcttggttcgccataactttagcc

SEQ ID NO: 674776 - DNA, 25 bp, Rattus norvegicus
ttcttggttcgcgataactttagcc

SEQ ID NO: 674777 - DNA, 25 bp, Rattus norvegicus
ttcttggttgcaagtgagctcacag

SEQ ID NO: 674778 - DNA, 25 bp, Rattus norvegicus
ttcttggttgcatgtgagctcacag

SEQ ID NO: 674779 - DNA, 25 bp, Rattus norvegicus
ttcttggtttacaccaggctttatc

SEQ ID NO: 674780 - DNA, 25 bp, Rattus norvegicus
ttcttggtttactccaggctttatc

SEQ ID NO: 674781 - DNA, 25 bp, Rattus norvegicus
ttcttgtacatgatacccagccaga

SEQ ID NO: 674782 - DNA, 25 bp, Rattus norvegicus
ttcttgtacatgttacccagccaga

SEQ ID NO: 674783 - DNA, 25 bp, Rattus norvegicus
ttcttgtacgcactttctttggctt

SEQ ID NO: 674784 - DNA, 25 bp, Rattus norvegicus
ttcttgtacgcagtttctttggctt

SEQ ID NO: 674785 - DNA, 25 bp, Rattus norvegicus
ttcttgtatgtaccccgtgtttata

SEQ ID NO: 674786 - DNA, 25 bp, Rattus norvegicus
ttcttgtatgtagcccgtgtttata

SEQ ID NO: 674787 - DNA, 25 bp, Rattus norvegicus
ttcttgtcaaacacacagtgcctta

SEQ ID NO: 674788 - DNA, 25 bp, Rattus norvegicus
ttcttgtcaaactcacagtgcctta

SEQ ID NO: 674789 - DNA, 25 bp, Rattus norvegicus
ttcttgtcacccacgtgcctttaag

SEQ ID NO: 674790 - DNA, 25 bp, Rattus norvegicus
ttcttgtcaccctcgtgcctttaag

SEQ ID NO: 674791 - DNA, 25 bp, Rattus norvegicus
ttcttgtcacgaagtcacctgcaaa

SEQ ID NO: 674792 - DNA, 25 bp, Rattus norvegicus
ttcttgtcacgatgtcacctgcaaa

SEQ ID NO: 674793 - DNA, 25 bp, Rattus norvegicus
ttcttgtcactgaacagcagctctc

SEQ ID NO: 674794 - DNA, 25 bp, Rattus norvegicus
ttcttgtcactgtacagcagctctc

SEQ ID NO: 674795 - DNA, 25 bp, Rattus norvegicus
ttcttgtccactccgccttgggaaa

SEQ ID NO: 674796 - DNA, 25 bp, Rattus norvegicus
ttcttgtccactgcgccttgggaaa

SEQ ID NO: 674797 - DNA, 25 bp, Rattus norvegicus
ttcttgtccattatgagccaggcca

SEQ ID NO: 674798 - DNA, 25 bp, Rattus norvegicus
ttcttgtccattttgagccaggcca

SEQ ID NO: 674799 - DNA, 25 bp, Rattus norvegicus
ttcttgtcctacatggagtggccat

SEQ ID NO: 674800 - DNA, 25 bp, Rattus norvegicus
ttcttgtcctacttggagtggccat

SEQ ID NO: 674801 - DNA, 25 bp, Rattus norvegicus
ttcttgtcctgtcatgcacgcagca

SEQ ID NO: 674802 - DNA, 25 bp, Rattus norvegicus
ttcttgtcctgtgatgcacgcagca

SEQ ID NO: 674803 - DNA, 25 bp, Rattus norvegicus
ttcttgtctcctaccactcatgcaa

SEQ ID NO: 674804 - DNA, 25 bp, Rattus norvegicus
ttcttgtctcctcagtgttcagcaa

SEQ ID NO: 674805 - DNA, 25 bp, Rattus norvegicus
ttcttgtctcctgagtgttcagcaa

SEQ ID NO: 674806 - DNA, 25 bp, Rattus norvegicus
ttcttgtctccttccactcatgcaa

SEQ ID NO: 674807 - DNA, 25 bp, Rattus norvegicus
ttcttgtctcggacaagtgtggaga

SEQ ID NO: 674808 - DNA, 25 bp, Rattus norvegicus
ttcttgtctcggtcaagtgtggaga

SEQ ID NO: 674809 - DNA, 25 bp, Rattus norvegicus
ttcttgtctctcaaggcgagccttt

SEQ ID NO: 674810 - DNA, 25 bp, Rattus norvegicus
ttcttgtctctctaggcgagccttt

SEQ ID NO: 674811 - DNA, 25 bp, Rattus norvegicus
ttcttgtctgtgactgggtgtctcc

SEQ ID NO: 674812 - DNA, 25 bp, Rattus norvegicus
ttcttgtctgtgtctgggtgtctcc

SEQ ID NO: 674813 - DNA, 25 bp, Rattus norvegicus
ttcttgtcttttctttgcacaccag

SEQ ID NO: 674814 - DNA, 25 bp, Rattus norvegicus
ttcttgtcttttgtttgcacaccag

SEQ ID NO: 674815 - DNA, 25 bp, Rattus norvegicus
ttcttgtgacccctggacgctaaga

SEQ ID NO: 674816 - DNA, 25 bp, Rattus norvegicus
ttcttgtgacccgtggacgctaaga

SEQ ID NO: 674817 - DNA, 25 bp, Rattus norvegicus
ttcttgtgctgcattgcatttcagt

SEQ ID NO: 674818 - DNA, 25 bp, Rattus norvegicus
ttcttgtgctgctttgcatttcagt

SEQ ID NO: 674819 - DNA, 25 bp, Rattus norvegicus
ttcttgtgtaaaccgcatgccttgg

SEQ ID NO: 674820 - DNA, 25 bp, Rattus norvegicus
ttcttgtgtaaagcgcatgccttgg

SEQ ID NO: 674821 - DNA, 25 bp, Rattus norvegicus
ttcttgtgtcctcaaagggccacgg

SEQ ID NO: 674822 - DNA, 25 bp, Rattus norvegicus
ttcttgtgtcctgaaagggccacgg

SEQ ID NO: 674823 - DNA, 25 bp, Rattus norvegicus
ttcttgtgtgtgaataccagagcac

SEQ ID NO: 674824 - DNA, 25 bp, Rattus norvegicus
ttcttgtgtgtgtataccagagcac

SEQ ID NO: 674825 - DNA, 25 bp, Rattus norvegicus
ttcttgtgtttaacacaccactgcc

SEQ ID NO: 674826 - DNA, 25 bp, Rattus norvegicus
ttcttgtgtttatcacaccactgcc

SEQ ID NO: 674827 - DNA, 25 bp, Rattus norvegicus
ttcttgtgtttgaatccatgctcgg

SEQ ID NO: 674828 - DNA, 25 bp, Rattus norvegicus
ttcttgtgtttgtatccatgctcgg

SEQ ID NO: 674829 - DNA, 25 bp, Rattus norvegicus
ttcttgttcctcagtagttgtacct

SEQ ID NO: 674830 - DNA, 25 bp, Rattus norvegicus
ttcttgttcctctgtagttgtacct

SEQ ID NO: 674831 - DNA, 25 bp, Rattus norvegicus
ttcttgttcttccttagctttaaat

SEQ ID NO: 674832 - DNA, 25 bp, Rattus norvegicus
ttcttgttcttcgttagctttaaat

SEQ ID NO: 674833 - DNA, 25 bp, Rattus norvegicus
ttcttgttcttgaagatctctggct

SEQ ID NO: 674834 - DNA, 25 bp, Rattus norvegicus
ttcttgttcttgtagatctctggct

SEQ ID NO: 674835 - DNA, 25 bp, Rattus norvegicus
ttcttgttctttcagttgcacccaa

SEQ ID NO: 674836 - DNA, 25 bp, Rattus norvegicus
ttcttgttctttgagttgcacccaa

SEQ ID NO: 674837 - DNA, 25 bp, Rattus norvegicus
ttcttgttgggcaggactgtacata

SEQ ID NO: 674838 - DNA, 25 bp, Rattus norvegicus
ttcttgttgggctggactgtacata

SEQ ID NO: 674839 - DNA, 25 bp, Rattus norvegicus
ttcttgtttaaactctagcaccaaa

SEQ ID NO: 674840 - DNA, 25 bp, Rattus norvegicus
ttcttgtttaaagtctagcaccaaa

SEQ ID NO: 674841 - DNA, 25 bp, Rattus norvegicus
ttcttgtttacaccacactaggaaa

SEQ ID NO: 674842 - DNA, 25 bp, Rattus norvegicus
ttcttgtttacagcacactaggaaa

SEQ ID NO: 674843 - DNA, 25 bp, Rattus norvegicus
ttcttgtttattaaccgactctttg

SEQ ID NO: 674844 - DNA, 25 bp, Rattus norvegicus
ttcttgtttatttaccgactctttg

SEQ ID NO: 674845 - DNA, 25 bp, Rattus norvegicus
ttcttgtttctgctttctctctcat

SEQ ID NO: 674846 - DNA, 25 bp, Rattus norvegicus
ttcttgtttctggtttctctctcat

SEQ ID NO: 674847 - DNA, 25 bp, Rattus norvegicus
ttcttgtttcttctgattgtcgagt

SEQ ID NO: 674848 - DNA, 25 bp, Rattus norvegicus
ttcttgtttcttgtgattgtcgagt

SEQ ID NO: 674849 - DNA, 25 bp, Rattus norvegicus
ttcttgtttgtcagagcctttgctc

SEQ ID NO: 674850 - DNA, 25 bp, Rattus norvegicus
ttcttgtttgtctgagcctttgctc

SEQ ID NO: 674851 - DNA, 25 bp, Rattus norvegicus
ttcttgttttcacggcatgtgtcag

SEQ ID NO: 674852 - DNA, 25 bp, Rattus norvegicus
ttcttgttttcagggcatgtgtcag

SEQ ID NO: 674853 - DNA, 25 bp, Rattus norvegicus
ttcttgtttttactcagtcgctcat

SEQ ID NO: 674854 - DNA, 25 bp, Rattus norvegicus
ttcttgtttttagtcagtcgctcat

SEQ ID NO: 674855 - DNA, 25 bp, Rattus norvegicus
ttctttaacaatattctctgcagtg

SEQ ID NO: 674856 - DNA, 25 bp, Rattus norvegicus
ttctttaacaattttctctgcagtg

SEQ ID NO: 674857 - DNA, 25 bp, Rattus norvegicus
ttctttaactgcctcttgcactcat

SEQ ID NO: 674858 - DNA, 25 bp, Rattus norvegicus
ttctttaactgcgtcttgcactcat

SEQ ID NO: 674859 - DNA, 25 bp, Rattus norvegicus
ttctttaacttaaaccttccattca

SEQ ID NO: 674860 - DNA, 25 bp, Rattus norvegicus
ttctttaacttataccttccattca

SEQ ID NO: 674861 - DNA, 25 bp, Rattus norvegicus
ttctttaagggcacatcctgagaac

SEQ ID NO: 674862 - DNA, 25 bp, Rattus norvegicus
ttctttaagggctcatcctgagaac

SEQ ID NO: 674863 - DNA, 25 bp, Rattus norvegicus
ttctttaagggtcgctgcagccctg

SEQ ID NO: 674864 - DNA, 25 bp, Rattus norvegicus
ttctttaagggtggctgcagccctg

SEQ ID NO: 674865 - DNA, 25 bp, Rattus norvegicus
ttctttaagtcaccgtgtcctcaca

SEQ ID NO: 674866 - DNA, 25 bp, Rattus norvegicus
ttctttaagtcagcgtgtcctcaca

SEQ ID NO: 674867 - DNA, 25 bp, Rattus norvegicus
ttctttacaacactgatcctcctgc

SEQ ID NO: 674868 - DNA, 25 bp, Rattus norvegicus
ttctttacaacagtgatcctcctgc

SEQ ID NO: 674869 - DNA, 25 bp, Rattus norvegicus
ttctttaccaacaatgccatttccc

SEQ ID NO: 674870 - DNA, 25 bp, Rattus norvegicus
ttctttaccaactatgccatttccc

SEQ ID NO: 674871 - DNA, 25 bp, Rattus norvegicus
ttctttaccattcttcctagagagg

SEQ ID NO: 674872 - DNA, 25 bp, Rattus norvegicus
ttctttaccattgttcctagagagg

SEQ ID NO: 674873 - DNA, 25 bp, Rattus norvegicus
ttctttacccagaccacggatgaat

SEQ ID NO: 674874 - DNA, 25 bp, Rattus norvegicus
ttctttacccagtccacggatgaat

SEQ ID NO: 674875 - DNA, 25 bp, Rattus norvegicus
ttctttaccctgcaatcctatgtat

SEQ ID NO: 674876 - DNA, 25 bp, Rattus norvegicus
ttctttaccctggaatcctatgtat

SEQ ID NO: 674877 - DNA, 25 bp, Rattus norvegicus
ttctttactgtgcagacgatgttct

SEQ ID NO: 674878 - DNA, 25 bp, Rattus norvegicus
ttctttactgtggagacgatgttct

SEQ ID NO: 674879 - DNA, 25 bp, Rattus norvegicus
ttctttactgttatgtaggctcagc

SEQ ID NO: 674880 - DNA, 25 bp, Rattus norvegicus
ttctttactgttttgtaggctcagc

SEQ ID NO: 674881 - DNA, 25 bp, Rattus norvegicus
ttctttagaaccatctgcagggcta

SEQ ID NO: 674882 - DNA, 25 bp, Rattus norvegicus
ttctttagaaccttctgcagggcta

SEQ ID NO: 674883 - DNA, 25 bp, Rattus norvegicus
ttctttagcagaaaaccccagcagc

SEQ ID NO: 674884 - DNA, 25 bp, Rattus norvegicus
ttctttagcagataaccccagcagc

SEQ ID NO: 674885 - DNA, 25 bp, Rattus norvegicus
ttctttagcttaccccagtttccag

SEQ ID NO: 674886 - DNA, 25 bp, Rattus norvegicus
ttctttagcttagcccagtttccag

SEQ ID NO: 674887 - DNA, 25 bp, Rattus norvegicus
ttctttagtggcataatacctgctt

SEQ ID NO: 674888 - DNA, 25 bp, Rattus norvegicus
ttctttagtggcttaatacctgctt

SEQ ID NO: 674889 - DNA, 25 bp, Rattus norvegicus
ttctttatccatcagcaccaggctt

SEQ ID NO: 674890 - DNA, 25 bp, Rattus norvegicus
ttctttatccatgagcaccaggctt

SEQ ID NO: 674891 - DNA, 25 bp, Rattus norvegicus
ttctttatttcaacaattctcaggg

SEQ ID NO: 674892 - DNA, 25 bp, Rattus norvegicus
ttctttatttcatcaattctcaggg

SEQ ID NO: 674893 - DNA, 25 bp, Rattus norvegicus
ttctttcaagaaatgaggcctcact

SEQ ID NO: 674894 - DNA, 25 bp, Rattus norvegicus
ttctttcaagaattgaggcctcact

SEQ ID NO: 674895 - DNA, 25 bp, Rattus norvegicus
ttctttcaagatagggactcaggat

SEQ ID NO: 674896 - DNA, 25 bp, Rattus norvegicus
ttctttcaagattgggactcaggat

SEQ ID NO: 674897 - DNA, 25 bp, Rattus norvegicus
ttctttcaagcacacacggcggctg

SEQ ID NO: 674898 - DNA, 25 bp, Rattus norvegicus
ttctttcaagcagacacggcggctg

SEQ ID NO: 674899 - DNA, 25 bp, Rattus norvegicus
ttctttcaagtcattacctcatgtg

SEQ ID NO: 674900 - DNA, 25 bp, Rattus norvegicus
ttctttcaagtctttacctcatgtg

SEQ ID NO: 674901 - DNA, 25 bp, Rattus norvegicus
ttctttcacagacattggcaggtta

SEQ ID NO: 674902 - DNA, 25 bp, Rattus norvegicus
ttctttcacagagattggcaggtta

SEQ ID NO: 674903 - DNA, 25 bp, Rattus norvegicus
ttctttcactcacagagggtgggac

SEQ ID NO: 674904 - DNA, 25 bp, Rattus norvegicus
ttctttcactcagagagggtgggac

SEQ ID NO: 674905 - DNA, 25 bp, Rattus norvegicus
ttctttcactctcctaacataacaa

SEQ ID NO: 674906 - DNA, 25 bp, Rattus norvegicus
ttctttcactctgctaacataacaa

SEQ ID NO: 674907 - DNA, 25 bp, Rattus norvegicus
ttctttcagtgcatcccttgagggc

SEQ ID NO: 674908 - DNA, 25 bp, Rattus norvegicus
ttctttcagtgcttcccttgagggc

SEQ ID NO: 674909 - DNA, 25 bp, Rattus norvegicus
ttctttcatagcactggctcacctg

SEQ ID NO: 674910 - DNA, 25 bp, Rattus norvegicus
ttctttcatagctctggctcacctg

SEQ ID NO: 674911 - DNA, 25 bp, Rattus norvegicus
ttctttccacctaagaatggaggct

SEQ ID NO: 674912 - DNA, 25 bp, Rattus norvegicus
ttctttccaccttagaatggaggct

SEQ ID NO: 674913 - DNA, 25 bp, Rattus norvegicus
ttctttccacgacagcagctgcgag

SEQ ID NO: 674914 - DNA, 25 bp, Rattus norvegicus
ttctttccacgagagcagctgcgag

SEQ ID NO: 674915 - DNA, 25 bp, Rattus norvegicus
ttctttccagtccttagcgctgcgg

SEQ ID NO: 674916 - DNA, 25 bp, Rattus norvegicus
ttctttccagtcgttagcgctgcgg

SEQ ID NO: 674917 - DNA, 25 bp, Rattus norvegicus
ttctttcccaagaatggtttctgtg

SEQ ID NO: 674918 - DNA, 25 bp, Rattus norvegicus
ttctttcccaagtatggtttctgtg

SEQ ID NO: 674919 - DNA, 25 bp, Rattus norvegicus
ttctttcccattctgctacaaagtc

SEQ ID NO: 674920 - DNA, 25 bp, Rattus norvegicus
ttctttcccattgtgctacaaagtc

SEQ ID NO: 674921 - DNA, 25 bp, Rattus norvegicus
ttctttcccctcagtatgatgtaat

SEQ ID NO: 674922 - DNA, 25 bp, Rattus norvegicus
ttctttcccctctgtatgatgtaat

SEQ ID NO: 674923 - DNA, 25 bp, Rattus norvegicus
ttctttccctcgacttaggtgaagt

SEQ ID NO: 674924 - DNA, 25 bp, Rattus norvegicus
ttctttccctcgtcttaggtgaagt

SEQ ID NO: 674925 - DNA, 25 bp, Rattus norvegicus
ttctttccgagccttgtaggtgtac

SEQ ID NO: 674926 - DNA, 25 bp, Rattus norvegicus
ttctttccgagcgttgtaggtgtac

SEQ ID NO: 674927 - DNA, 25 bp, Rattus norvegicus
ttctttccgcctcaggtcagtgaga

SEQ ID NO: 674928 - DNA, 25 bp, Rattus norvegicus
ttctttccgcctgaggtcagtgaga

SEQ ID NO: 674929 - DNA, 25 bp, Rattus norvegicus
ttctttcctcagaaagagcccatca

SEQ ID NO: 674930 - DNA, 25 bp, Rattus norvegicus
ttctttcctcagtaagagcccatca

SEQ ID NO: 674931 - DNA, 25 bp, Rattus norvegicus
ttctttcctccacttattatcttag

SEQ ID NO: 674932 - DNA, 25 bp, Rattus norvegicus
ttctttcctccagttattatcttag

SEQ ID NO: 674933 - DNA, 25 bp, Rattus norvegicus
ttctttccttccattagcacaaagc

SEQ ID NO: 674934 - DNA, 25 bp, Rattus norvegicus
ttctttccttcctttagcacaaagc

SEQ ID NO: 674935 - DNA, 25 bp, Rattus norvegicus
ttctttcgctcaatctttccaaata

SEQ ID NO: 674936 - DNA, 25 bp, Rattus norvegicus
ttctttcgctcattctttccaaata

SEQ ID NO: 674937 - DNA, 25 bp, Rattus norvegicus
ttctttcggtttatatctccctcag

SEQ ID NO: 674938 - DNA, 25 bp, Rattus norvegicus
ttctttcggtttttatctccctcag

SEQ ID NO: 674939 - DNA, 25 bp, Rattus norvegicus
ttctttcgttttcttttcatgtagg

SEQ ID NO: 674940 - DNA, 25 bp, Rattus norvegicus
ttctttcgttttgttttcatgtagg

SEQ ID NO: 674941 - DNA, 25 bp, Rattus norvegicus
ttctttctaagacgtttttggctat

SEQ ID NO: 674942 - DNA, 25 bp, Rattus norvegicus
ttctttctaagaggtttttggctat

SEQ ID NO: 674943 - DNA, 25 bp, Rattus norvegicus
ttctttctagggaaactcgtcttgt

SEQ ID NO: 674944 - DNA, 25 bp, Rattus norvegicus
ttctttctagggtaactcgtcttgt

SEQ ID NO: 674945 - DNA, 25 bp, Rattus norvegicus
ttctttctcaacaagcttccaggtg

SEQ ID NO: 674946 - DNA, 25 bp, Rattus norvegicus
ttctttctcaactagcttccaggtg

SEQ ID NO: 674947 - DNA, 25 bp, Rattus norvegicus
ttctttctcactccttaaccatatt

SEQ ID NO: 674948 - DNA, 25 bp, Rattus norvegicus
ttctttctcactgcttaaccatatt

SEQ ID NO: 674949 - DNA, 25 bp, Rattus norvegicus
ttctttctccagctagactttgttg

SEQ ID NO: 674950 - DNA, 25 bp, Rattus norvegicus
ttctttctccaggtagactttgttg

SEQ ID NO: 674951 - DNA, 25 bp, Rattus norvegicus
ttctttctcccactatgttttaaca

SEQ ID NO: 674952 - DNA, 25 bp, Rattus norvegicus
ttctttctcccagtatgttttaaca

SEQ ID NO: 674953 - DNA, 25 bp, Rattus norvegicus
ttctttctcctgagtcatatagcgc

SEQ ID NO: 674954 - DNA, 25 bp, Rattus norvegicus
ttctttctcctgtgtcatatagcgc

SEQ ID NO: 674955 - DNA, 25 bp, Rattus norvegicus
ttctttctcgttatctagtaagcct

SEQ ID NO: 674956 - DNA, 25 bp, Rattus norvegicus
ttctttctcgttttctagtaagcct

SEQ ID NO: 674957 - DNA, 25 bp, Rattus norvegicus
ttctttctctcaactttcacttatt

SEQ ID NO: 674958 - DNA, 25 bp, Rattus norvegicus
ttctttctctcatctttcacttatt

SEQ ID NO: 674959 - DNA, 25 bp, Rattus norvegicus
ttctttctctgcctgtttagttgta

SEQ ID NO: 674960 - DNA, 25 bp, Rattus norvegicus
ttctttctctgcgtgtttagttgta

SEQ ID NO: 674961 - DNA, 25 bp, Rattus norvegicus
ttctttctcttcactaggtgtttac

SEQ ID NO: 674962 - DNA, 25 bp, Rattus norvegicus
ttctttctcttctctaggtgtttac

SEQ ID NO: 674963 - DNA, 25 bp, Rattus norvegicus
ttctttctgagaaagctgctgcttc

SEQ ID NO: 674964 - DNA, 25 bp, Rattus norvegicus
ttctttctgagatagctgctgcttc

SEQ ID NO: 674965 - DNA, 25 bp, Rattus norvegicus
ttctttctgagtatctattgtagtg

SEQ ID NO: 674966 - DNA, 25 bp, Rattus norvegicus
ttctttctgagtttctattgtagtg

SEQ ID NO: 674967 - DNA, 25 bp, Rattus norvegicus
ttctttctgctcctactcctgcggt

SEQ ID NO: 674968 - DNA, 25 bp, Rattus norvegicus
ttctttctgctcgtactcctgcggt

SEQ ID NO: 674969 - DNA, 25 bp, Rattus norvegicus
ttctttctgctgaatgttgttctcg

SEQ ID NO: 674970 - DNA, 25 bp, Rattus norvegicus
ttctttctgctgtatgttgttctcg

SEQ ID NO: 674971 - DNA, 25 bp, Rattus norvegicus
ttctttctgttgcttccagggattt

SEQ ID NO: 674972 - DNA, 25 bp, Rattus norvegicus
ttctttctgttggttccagggattt

SEQ ID NO: 674973 - DNA, 25 bp, Rattus norvegicus
ttctttcttatcattcctgactgcg

SEQ ID NO: 674974 - DNA, 25 bp, Rattus norvegicus
ttctttcttatctttcctgactgcg

SEQ ID NO: 674975 - DNA, 25 bp, Rattus norvegicus
ttctttcttcatcgtgcccatgtgt

SEQ ID NO: 674976 - DNA, 25 bp, Rattus norvegicus
ttctttcttcatggtgcccatgtgt

SEQ ID NO: 674977 - DNA, 25 bp, Rattus norvegicus
ttctttcttcctcgtagtgccatta

SEQ ID NO: 674978 - DNA, 25 bp, Rattus norvegicus
ttctttcttcctggtagtgccatta

SEQ ID NO: 674979 - DNA, 25 bp, Rattus norvegicus
ttctttcttgttcggctgtttgtat

SEQ ID NO: 674980 - DNA, 25 bp, Rattus norvegicus
ttctttcttgttgggctgtttgtat

SEQ ID NO: 674981 - DNA, 25 bp, Rattus norvegicus
ttctttctttccatcctcagcatat

SEQ ID NO: 674982 - DNA, 25 bp, Rattus norvegicus
ttctttctttccttcctcagcatat

SEQ ID NO: 674983 - DNA, 25 bp, Rattus norvegicus
ttctttctttgcactttaaaatctg

SEQ ID NO: 674984 - DNA, 25 bp, Rattus norvegicus
ttctttctttgctctttaaaatctg

SEQ ID NO: 674985 - DNA, 25 bp, Rattus norvegicus
ttctttctttggcttctcaggcatg

SEQ ID NO: 674986 - DNA, 25 bp, Rattus norvegicus
ttctttctttgggttctcaggcatg

SEQ ID NO: 674987 - DNA, 25 bp, Rattus norvegicus
ttctttctttgtacctcttaggact

SEQ ID NO: 674988 - DNA, 25 bp, Rattus norvegicus
ttctttctttgttcctcttaggact

SEQ ID NO: 674989 - DNA, 25 bp, Rattus norvegicus
ttctttcttttcacggtctgtattc

SEQ ID NO: 674990 - DNA, 25 bp, Rattus norvegicus
ttctttcttttctcggtctgtattc

SEQ ID NO: 674991 - DNA, 25 bp, Rattus norvegicus
ttctttgaaagtacgctctgctgtt

SEQ ID NO: 674992 - DNA, 25 bp, Rattus norvegicus
ttctttgaaagttcgctctgctgtt

SEQ ID NO: 674993 - DNA, 25 bp, Rattus norvegicus
ttctttgaccatcagatagttctgt

SEQ ID NO: 674994 - DNA, 25 bp, Rattus norvegicus
ttctttgaccatgagatagttctgt

SEQ ID NO: 674995 - DNA, 25 bp, Rattus norvegicus
ttctttgacttacggtttcttgtag

SEQ ID NO: 674996 - DNA, 25 bp, Rattus norvegicus
ttctttgacttagggtttcttgtag

SEQ ID NO: 674997 - DNA, 25 bp, Rattus norvegicus
ttctttgacttcatctgtgggttga

SEQ ID NO: 674998 - DNA, 25 bp, Rattus norvegicus
ttctttgacttcttctgtgggttga

SEQ ID NO: 674999 - DNA, 25 bp, Rattus norvegicus
ttctttgagacaaggcaggctgtgg

SEQ ID NO: 675000 - DNA, 25 bp, Rattus norvegicus
ttctttgagacatggcaggctgtgg

SEQ ID NO: 675001 - DNA, 25 bp, Rattus norvegicus
ttctttgagttcatcactgtgttga

SEQ ID NO: 675002 - DNA, 25 bp, Rattus norvegicus
ttctttgagttcttcactgtgttga

SEQ ID NO: 675003 - DNA, 25 bp, Rattus norvegicus
ttctttgatcccctctgaagggaga

SEQ ID NO: 675004 - DNA, 25 bp, Rattus norvegicus
ttctttgatcccgtctgaagggaga

SEQ ID NO: 675005 - DNA, 25 bp, Rattus norvegicus
ttctttgattccaccaaactaaaca

SEQ ID NO: 675006 - DNA, 25 bp, Rattus norvegicus
ttctttgattcctccaaactaaaca

SEQ ID NO: 675007 - DNA, 25 bp, Rattus norvegicus
ttctttgcacccctactttagaaga

SEQ ID NO: 675008 - DNA, 25 bp, Rattus norvegicus
ttctttgcacccgtactttagaaga

SEQ ID NO: 675009 - DNA, 25 bp, Rattus norvegicus
ttctttgcagagcaagtagcctttg

SEQ ID NO: 675010 - DNA, 25 bp, Rattus norvegicus
ttctttgcagaggaagtagcctttg

SEQ ID NO: 675011 - DNA, 25 bp, Rattus norvegicus
ttctttgccaaaaacgggcctcaga

SEQ ID NO: 675012 - DNA, 25 bp, Rattus norvegicus
ttctttgccaaatacgggcctcaga

SEQ ID NO: 675013 - DNA, 25 bp, Rattus norvegicus
ttctttgccacgcaataaacctcga

SEQ ID NO: 675014 - DNA, 25 bp, Rattus norvegicus
ttctttgccacggaataaacctcga

SEQ ID NO: 675015 - DNA, 25 bp, Rattus norvegicus
ttctttgccgcaccagtgggagttg

SEQ ID NO: 675016 - DNA, 25 bp, Rattus norvegicus
ttctttgccgcagcagtgggagttg

SEQ ID NO: 675017 - DNA, 25 bp, Rattus norvegicus
ttctttgcctctacatttggtttca

SEQ ID NO: 675018 - DNA, 25 bp, Rattus norvegicus
ttctttgcctctcatgatcaacttt

SEQ ID NO: 675019 - DNA, 25 bp, Rattus norvegicus
ttctttgcctctgatgatcaacttt

SEQ ID NO: 675020 - DNA, 25 bp, Rattus norvegicus
ttctttgcctcttcatttggtttca

SEQ ID NO: 675021 - DNA, 25 bp, Rattus norvegicus
ttctttgcctgtaccaatagccagg

SEQ ID NO: 675022 - DNA, 25 bp, Rattus norvegicus
ttctttgcctgttccaatagccagg

SEQ ID NO: 675023 - DNA, 25 bp, Rattus norvegicus
ttctttgcctttaaaatcgccacga

SEQ ID NO: 675024 - DNA, 25 bp, Rattus norvegicus
ttctttgccttttaaatcgccacga

SEQ ID NO: 675025 - DNA, 25 bp, Rattus norvegicus
ttctttgcgctgctgaagtgaaatc

SEQ ID NO: 675026 - DNA, 25 bp, Rattus norvegicus
ttctttgcgctggtgaagtgaaatc

SEQ ID NO: 675027 - DNA, 25 bp, Rattus norvegicus
ttctttgctcccatggcaggtagga

SEQ ID NO: 675028 - DNA, 25 bp, Rattus norvegicus
ttctttgctcccttggcaggtagga

SEQ ID NO: 675029 - DNA, 25 bp, Rattus norvegicus
ttctttgctgtcatccattgtcata

SEQ ID NO: 675030 - DNA, 25 bp, Rattus norvegicus
ttctttgctgtcttccattgtcata

SEQ ID NO: 675031 - DNA, 25 bp, Rattus norvegicus
ttctttgctgttactattaacccat

SEQ ID NO: 675032 - DNA, 25 bp, Rattus norvegicus
ttctttgctgtttctattaacccat

SEQ ID NO: 675033 - DNA, 25 bp, Rattus norvegicus
ttctttggaccaattagcccattct

SEQ ID NO: 675034 - DNA, 25 bp, Rattus norvegicus
ttctttggaccatttagcccattct

SEQ ID NO: 675035 - DNA, 25 bp, Rattus norvegicus
ttctttggcaacagatcccttgtca

SEQ ID NO: 675036 - DNA, 25 bp, Rattus norvegicus
ttctttggcaactgatcccttgtca

SEQ ID NO: 675037 - DNA, 25 bp, Rattus norvegicus
ttctttggccaacctctgagcattg

SEQ ID NO: 675038 - DNA, 25 bp, Rattus norvegicus
ttctttggccaagctctgagcattg

SEQ ID NO: 675039 - DNA, 25 bp, Rattus norvegicus
ttctttggctccactctagagaaat

SEQ ID NO: 675040 - DNA, 25 bp, Rattus norvegicus
ttctttggctcctctctagagaaat

SEQ ID NO: 675041 - DNA, 25 bp, Rattus norvegicus
ttctttggctggagacgggtctcta

SEQ ID NO: 675042 - DNA, 25 bp, Rattus norvegicus
ttctttggctggtgacgggtctcta

SEQ ID NO: 675043 - DNA, 25 bp, Rattus norvegicus
ttctttggtgtcaccatttagcttc

SEQ ID NO: 675044 - DNA, 25 bp, Rattus norvegicus
ttctttggtgtctccatttagcttc

SEQ ID NO: 675045 - DNA, 25 bp, Rattus norvegicus
ttctttgtatttaagccatgcctgc

SEQ ID NO: 675046 - DNA, 25 bp, Rattus norvegicus
ttctttgtattttagccatgcctgc

SEQ ID NO: 675047 - DNA, 25 bp, Rattus norvegicus
ttctttgtcaacaacactatccctc

SEQ ID NO: 675048 - DNA, 25 bp, Rattus norvegicus
ttctttgtcaactacactatccctc

SEQ ID NO: 675049 - DNA, 25 bp, Rattus norvegicus
ttctttgtctgcatacatgggaagg

SEQ ID NO: 675050 - DNA, 25 bp, Rattus norvegicus
ttctttgtctgcttacatgggaagg

SEQ ID NO: 675051 - DNA, 25 bp, Rattus norvegicus
ttctttgtgtctatggaagttcact

SEQ ID NO: 675052 - DNA, 25 bp, Rattus norvegicus
ttctttgtgtctttggaagttcact

SEQ ID NO: 675053 - DNA, 25 bp, Rattus norvegicus
ttctttgttactcttggagaaggct

SEQ ID NO: 675054 - DNA, 25 bp, Rattus norvegicus
ttctttgttactgttggagaaggct

SEQ ID NO: 675055 - DNA, 25 bp, Rattus norvegicus
ttctttgttagtaacagggatggac

SEQ ID NO: 675056 - DNA, 25 bp, Rattus norvegicus
ttctttgttagttacagggatggac

SEQ ID NO: 675057 - DNA, 25 bp, Rattus norvegicus
ttctttgttggcatctctcatttta

SEQ ID NO: 675058 - DNA, 25 bp, Rattus norvegicus
ttctttgttggcttctctcatttta

SEQ ID NO: 675059 - DNA, 25 bp, Rattus norvegicus
ttctttgttgtcatatagcactgga

SEQ ID NO: 675060 - DNA, 25 bp, Rattus norvegicus
ttctttgttgtcttatagcactgga

SEQ ID NO: 675061 - DNA, 25 bp, Rattus norvegicus
ttcttttaaatcactttctctttgg

SEQ ID NO: 675062 - DNA, 25 bp, Rattus norvegicus
ttcttttaaatctctttctctttgg

SEQ ID NO: 675063 - DNA, 25 bp, Rattus norvegicus
ttcttttaaatgagttgttcattac

SEQ ID NO: 675064 - DNA, 25 bp, Rattus norvegicus
ttcttttaaatgtgttgttcattac

SEQ ID NO: 675065 - DNA, 25 bp, Rattus norvegicus
ttcttttacagtctagtcctggcta

SEQ ID NO: 675066 - DNA, 25 bp, Rattus norvegicus
ttcttttacagtgtagtcctggcta

SEQ ID NO: 675067 - DNA, 25 bp, Rattus norvegicus
ttcttttaccttactgtgaagcagc

SEQ ID NO: 675068 - DNA, 25 bp, Rattus norvegicus
ttcttttacctttctgtgaagcagc

SEQ ID NO: 675069 - DNA, 25 bp, Rattus norvegicus
ttcttttacttcatgtcagactcaa

SEQ ID NO: 675070 - DNA, 25 bp, Rattus norvegicus
ttcttttacttcttgtcagactcaa

SEQ ID NO: 675071 - DNA, 25 bp, Rattus norvegicus
ttcttttagcctagtcactgcctga

SEQ ID NO: 675072 - DNA, 25 bp, Rattus norvegicus
ttcttttagccttgtcactgcctga

SEQ ID NO: 675073 - DNA, 25 bp, Rattus norvegicus
ttcttttagtagctgatgctggcac

SEQ ID NO: 675074 - DNA, 25 bp, Rattus norvegicus
ttcttttagtaggtgatgctggcac

SEQ ID NO: 675075 - DNA, 25 bp, Rattus norvegicus
ttcttttatgagctgcactcacagc

SEQ ID NO: 675076 - DNA, 25 bp, Rattus norvegicus
ttcttttatgaggtgcactcacagc

SEQ ID NO: 675077 - DNA, 25 bp, Rattus norvegicus
ttcttttcaaagcaacagatttcag

SEQ ID NO: 675078 - DNA, 25 bp, Rattus norvegicus
ttcttttcaaaggaacagatttcag

SEQ ID NO: 675079 - DNA, 25 bp, Rattus norvegicus
ttcttttcaagacatggcctctcta

SEQ ID NO: 675080 - DNA, 25 bp, Rattus norvegicus
ttcttttcaagagatggcctctcta

SEQ ID NO: 675081 - DNA, 25 bp, Rattus norvegicus
ttcttttcaattctgtccctttgtt

SEQ ID NO: 675082 - DNA, 25 bp, Rattus norvegicus
ttcttttcaattgtgtccctttgtt

SEQ ID NO: 675083 - DNA, 25 bp, Rattus norvegicus
ttcttttcacttactgtgggtttga

SEQ ID NO: 675084 - DNA, 25 bp, Rattus norvegicus
ttcttttcactttctgtgggtttga

SEQ ID NO: 675085 - DNA, 25 bp, Rattus norvegicus
ttcttttcatagctctgactgtcat

SEQ ID NO: 675086 - DNA, 25 bp, Rattus norvegicus
ttcttttcataggtctgactgtcat

SEQ ID NO: 675087 - DNA, 25 bp, Rattus norvegicus
ttcttttcatttcctaggtactaat

SEQ ID NO: 675088 - DNA, 25 bp, Rattus norvegicus
ttcttttcatttgctaggtactaat

SEQ ID NO: 675089 - DNA, 25 bp, Rattus norvegicus
ttcttttcctacacatgtctctgag

SEQ ID NO: 675090 - DNA, 25 bp, Rattus norvegicus
ttcttttcctactcatgtctctgag

SEQ ID NO: 675091 - DNA, 25 bp, Rattus norvegicus
ttcttttcctcaaatggcacctatg

SEQ ID NO: 675092 - DNA, 25 bp, Rattus norvegicus
ttcttttcctcatatggcacctatg

SEQ ID NO: 675093 - DNA, 25 bp, Rattus norvegicus
ttcttttcctccctgttttaatgag

SEQ ID NO: 675094 - DNA, 25 bp, Rattus norvegicus
ttcttttcctccgtgttttaatgag

SEQ ID NO: 675095 - DNA, 25 bp, Rattus norvegicus
ttcttttcctgcaccacaacgtggg

SEQ ID NO: 675096 - DNA, 25 bp, Rattus norvegicus
ttcttttcctgctccacaacgtggg

SEQ ID NO: 675097 - DNA, 25 bp, Rattus norvegicus
ttcttttcctggctgcatttgggat

SEQ ID NO: 675098 - DNA, 25 bp, Rattus norvegicus
ttcttttcctgggtgcatttgggat

SEQ ID NO: 675099 - DNA, 25 bp, Rattus norvegicus
ttcttttccttactttcacattctt

SEQ ID NO: 675100 - DNA, 25 bp, Rattus norvegicus
ttcttttccttagtttcacattctt

SEQ ID NO: 675101 - DNA, 25 bp, Rattus norvegicus
ttcttttccttcatccatgtatttt

SEQ ID NO: 675102 - DNA, 25 bp, Rattus norvegicus
ttcttttccttcttccatgtatttt

SEQ ID NO: 675103 - DNA, 25 bp, Rattus norvegicus
ttcttttctacacccagaggttcta

SEQ ID NO: 675104 - DNA, 25 bp, Rattus norvegicus
ttcttttctacagccagaggttcta

SEQ ID NO: 675105 - DNA, 25 bp, Rattus norvegicus
ttcttttctcctatctccttccact

SEQ ID NO: 675106 - DNA, 25 bp, Rattus norvegicus
ttcttttctcctttctccttccact

SEQ ID NO: 675107 - DNA, 25 bp, Rattus norvegicus
ttcttttctgccactcagagcaaac

SEQ ID NO: 675108 - DNA, 25 bp, Rattus norvegicus
ttcttttctgcctctcagagcaaac

SEQ ID NO: 675109 - DNA, 25 bp, Rattus norvegicus
ttcttttctggcctggtgaagtaca

SEQ ID NO: 675110 - DNA, 25 bp, Rattus norvegicus
ttcttttctggcgtggtgaagtaca

SEQ ID NO: 675111 - DNA, 25 bp, Rattus norvegicus
ttcttttctgggacttgacactggg

SEQ ID NO: 675112 - DNA, 25 bp, Rattus norvegicus
ttcttttctgggtcttgacactggg

SEQ ID NO: 675113 - DNA, 25 bp, Rattus norvegicus
ttcttttcttagaatcctgcacaga

SEQ ID NO: 675114 - DNA, 25 bp, Rattus norvegicus
ttcttttcttagtatcctgcacaga

SEQ ID NO: 675115 - DNA, 25 bp, Rattus norvegicus
ttcttttcttcaacccttgtctata

SEQ ID NO: 675116 - DNA, 25 bp, Rattus norvegicus
ttcttttcttcatcccttgtctata

SEQ ID NO: 675117 - DNA, 25 bp, Rattus norvegicus
ttcttttcttctcagtgtccacaga

SEQ ID NO: 675118 - DNA, 25 bp, Rattus norvegicus
ttcttttcttctgagtgtccacaga

SEQ ID NO: 675119 - DNA, 25 bp, Rattus norvegicus
ttcttttgaatccacaggtcctatt

SEQ ID NO: 675120 - DNA, 25 bp, Rattus norvegicus
ttcttttgaatcgacaggtcctatt

SEQ ID NO: 675121 - DNA, 25 bp, Rattus norvegicus
ttcttttgatccagtcagccaatgc

SEQ ID NO: 675122 - DNA, 25 bp, Rattus norvegicus
ttcttttgatcctgtcagccaatgc

SEQ ID NO: 675123 - DNA, 25 bp, Rattus norvegicus
ttcttttgatgaagcttaccaccta

SEQ ID NO: 675124 - DNA, 25 bp, Rattus norvegicus
ttcttttgatgatgcttaccaccta

SEQ ID NO: 675125 - DNA, 25 bp, Rattus norvegicus
ttcttttgcagcatccagggtggaa

SEQ ID NO: 675126 - DNA, 25 bp, Rattus norvegicus
ttcttttgcagcttccagggtggaa

SEQ ID NO: 675127 - DNA, 25 bp, Rattus norvegicus
ttcttttgcctacgttgttagccca

SEQ ID NO: 675128 - DNA, 25 bp, Rattus norvegicus
ttcttttgcctaggttgttagccca

SEQ ID NO: 675129 - DNA, 25 bp, Rattus norvegicus
ttcttttggccccagacaaatgtgg

SEQ ID NO: 675130 - DNA, 25 bp, Rattus norvegicus
ttcttttggcccgagacaaatgtgg

SEQ ID NO: 675131 - DNA, 25 bp, Rattus norvegicus
ttcttttggcctatgcttgatgtta

SEQ ID NO: 675132 - DNA, 25 bp, Rattus norvegicus
ttcttttggcctttgcttgatgtta

SEQ ID NO: 675133 - DNA, 25 bp, Rattus norvegicus
ttcttttgtatgctgtgtccttttg

SEQ ID NO: 675134 - DNA, 25 bp, Rattus norvegicus
ttcttttgtatggtgtgtccttttg

SEQ ID NO: 675135 - DNA, 25 bp, Rattus norvegicus
ttcttttgtttccttctacaagcag

SEQ ID NO: 675136 - DNA, 25 bp, Rattus norvegicus
ttcttttgtttcgttctacaagcag

SEQ ID NO: 675137 - DNA, 25 bp, Rattus norvegicus
ttctttttaaatcgcaaccagctgc

SEQ ID NO: 675138 - DNA, 25 bp, Rattus norvegicus
ttctttttaaatggcaaccagctgc

SEQ ID NO: 675139 - DNA, 25 bp, Rattus norvegicus
ttctttttacataaccgccttgagc

SEQ ID NO: 675140 - DNA, 25 bp, Rattus norvegicus
ttctttttacattaccgccttgagc

SEQ ID NO: 675141 - DNA, 25 bp, Rattus norvegicus
ttctttttagtgctcagcctggctg

SEQ ID NO: 675142 - DNA, 25 bp, Rattus norvegicus
ttctttttagtggtcagcctggctg

SEQ ID NO: 675143 - DNA, 25 bp, Rattus norvegicus
ttctttttattccttctcatccatg

SEQ ID NO: 675144 - DNA, 25 bp, Rattus norvegicus
ttctttttattcgttctcatccatg

SEQ ID NO: 675145 - DNA, 25 bp, Rattus norvegicus
ttctttttcaagatccccatctact

SEQ ID NO: 675146 - DNA, 25 bp, Rattus norvegicus
ttctttttcaagttccccatctact

SEQ ID NO: 675147 - DNA, 25 bp, Rattus norvegicus
ttctttttcaccaacacgctcatag

SEQ ID NO: 675148 - DNA, 25 bp, Rattus norvegicus
ttctttttcacctacacgctcatag

SEQ ID NO: 675149 - DNA, 25 bp, Rattus norvegicus
ttctttttcagcaaccctctgagga

SEQ ID NO: 675150 - DNA, 25 bp, Rattus norvegicus
ttctttttcagctaccctctgagga

SEQ ID NO: 675151 - DNA, 25 bp, Rattus norvegicus
ttctttttcaggcttgtgtcctctt

SEQ ID NO: 675152 - DNA, 25 bp, Rattus norvegicus
ttctttttcagggttgtgtcctctt

SEQ ID NO: 675153 - DNA, 25 bp, Rattus norvegicus
ttctttttccaacttcatggtcctt

SEQ ID NO: 675154 - DNA, 25 bp, Rattus norvegicus
ttctttttccaagttcatggtcctt

SEQ ID NO: 675155 - DNA, 25 bp, Rattus norvegicus
ttctttttcccgattccatgtgaag

SEQ ID NO: 675156 - DNA, 25 bp, Rattus norvegicus
ttctttttcccgtttccatgtgaag

SEQ ID NO: 675157 - DNA, 25 bp, Rattus norvegicus
ttctttttcctcagtgtattgtggc

SEQ ID NO: 675158 - DNA, 25 bp, Rattus norvegicus
ttctttttcctctgtgtattgtggc

SEQ ID NO: 675159 - DNA, 25 bp, Rattus norvegicus
ttctttttcctgagttaaacccatg

SEQ ID NO: 675160 - DNA, 25 bp, Rattus norvegicus
ttctttttcctgtgttaaacccatg

SEQ ID NO: 675161 - DNA, 25 bp, Rattus norvegicus
ttctttttctaccaggtaggtctgg

SEQ ID NO: 675162 - DNA, 25 bp, Rattus norvegicus
ttctttttctacgaggtaggtctgg

SEQ ID NO: 675163 - DNA, 25 bp, Rattus norvegicus
ttctttttctccctattctcttgaa

SEQ ID NO: 675164 - DNA, 25 bp, Rattus norvegicus
ttctttttctcccttggtctagaat

SEQ ID NO: 675165 - DNA, 25 bp, Rattus norvegicus
ttctttttctccgtattctcttgaa

SEQ ID NO: 675166 - DNA, 25 bp, Rattus norvegicus
ttctttttctccgttggtctagaat

SEQ ID NO: 675167 - DNA, 25 bp, Rattus norvegicus
ttctttttctggctgctcagtattt

SEQ ID NO: 675168 - DNA, 25 bp, Rattus norvegicus
ttctttttctgggtgctcagtattt

SEQ ID NO: 675169 - DNA, 25 bp, Rattus norvegicus
ttctttttctgtatagcccttgagt

SEQ ID NO: 675170 - DNA, 25 bp, Rattus norvegicus
ttctttttctgtttagcccttgagt

SEQ ID NO: 675171 - DNA, 25 bp, Rattus norvegicus
ttctttttcttcatcctctactttt

SEQ ID NO: 675172 - DNA, 25 bp, Rattus norvegicus
ttctttttcttcttcctctactttt

SEQ ID NO: 675173 - DNA, 25 bp, Rattus norvegicus
ttctttttgctgactctggaatgta

SEQ ID NO: 675174 - DNA, 25 bp, Rattus norvegicus
ttctttttgctgtctctggaatgta

SEQ ID NO: 675175 - DNA, 25 bp, Rattus norvegicus
ttctttttggaactcttggtcacat

SEQ ID NO: 675176 - DNA, 25 bp, Rattus norvegicus
ttctttttggaagtcttggtcacat

SEQ ID NO: 675177 - DNA, 25 bp, Rattus norvegicus
ttctttttggtgaatctgatgtcat

SEQ ID NO: 675178 - DNA, 25 bp, Rattus norvegicus
ttctttttggtgtatctgatgtcat

SEQ ID NO: 675179 - DNA, 25 bp, Rattus norvegicus
ttctttttgttaagctctaccacct

SEQ ID NO: 675180 - DNA, 25 bp, Rattus norvegicus
ttctttttgttatgctctaccacct

SEQ ID NO: 675181 - DNA, 25 bp, Rattus norvegicus
ttctttttgttcaacctacagccag

SEQ ID NO: 675182 - DNA, 25 bp, Rattus norvegicus
ttctttttgttctacctacagccag

SEQ ID NO: 675183 - DNA, 25 bp, Rattus norvegicus
ttcttttttacacttgtttcctatg

SEQ ID NO: 675184 - DNA, 25 bp, Rattus norvegicus
ttcttttttacagttgtttcctatg

SEQ ID NO: 675185 - DNA, 25 bp, Rattus norvegicus
ttcttttttgagctctaacacactg

SEQ ID NO: 675186 - DNA, 25 bp, Rattus norvegicus
ttcttttttgaggtctaacacactg

SEQ ID NO: 675187 - DNA, 25 bp, Rattus norvegicus
ttcttttttgtcagtgtggatggat

SEQ ID NO: 675188 - DNA, 25 bp, Rattus norvegicus
ttcttttttgtctgtgtggatggat

SEQ ID NO: 675189 - DNA, 25 bp, Rattus norvegicus
ttgaaaaaactgaccccaactctcg

SEQ ID NO: 675190 - DNA, 25 bp, Rattus norvegicus
ttgaaaaaactgtccccaactctcg

SEQ ID NO: 675191 - DNA, 25 bp, Rattus norvegicus
ttgaaaaacaaaagccccacagact

SEQ ID NO: 675192 - DNA, 25 bp, Rattus norvegicus
ttgaaaaacaaatgccccacagact

SEQ ID NO: 675193 - DNA, 25 bp, Rattus norvegicus
ttgaaaacaaccactccgctggaga

SEQ ID NO: 675194 - DNA, 25 bp, Rattus norvegicus
ttgaaaacaacctctccgctggaga

SEQ ID NO: 675195 - DNA, 25 bp, Rattus norvegicus
ttgaaaacgcctccacttgcttctg

SEQ ID NO: 675196 - DNA, 25 bp, Rattus norvegicus
ttgaaaacgcctgcacttgcttctg

SEQ ID NO: 675197 - DNA, 25 bp, Rattus norvegicus
ttgaaaactttgatctctccagagg

SEQ ID NO: 675198 - DNA, 25 bp, Rattus norvegicus
ttgaaaactttgttctctccagagg

SEQ ID NO: 675199 - DNA, 25 bp, Rattus norvegicus
ttgaaaagcattcgagttgtctctc

SEQ ID NO: 675200 - DNA, 25 bp, Rattus norvegicus
ttgaaaagcattggagttgtctctc

SEQ ID NO: 675201 - DNA, 25 bp, Rattus norvegicus
ttgaaaagcctgctggctgcatctt

SEQ ID NO: 675202 - DNA, 25 bp, Rattus norvegicus
ttgaaaagcctggtggctgcatctt

SEQ ID NO: 675203 - DNA, 25 bp, Rattus norvegicus
ttgaaaagctgtcttaaccctgcag

SEQ ID NO: 675204 - DNA, 25 bp, Rattus norvegicus
ttgaaaagctgtgttaaccctgcag

SEQ ID NO: 675205 - DNA, 25 bp, Rattus norvegicus
ttgaaaagggcaacagtgtctgcgt

SEQ ID NO: 675206 - DNA, 25 bp, Rattus norvegicus
ttgaaaagggcatcagtgtctgcgt

SEQ ID NO: 675207 - DNA, 25 bp, Rattus norvegicus
ttgaaaagggctccgcatctatgtc

SEQ ID NO: 675208 - DNA, 25 bp, Rattus norvegicus
ttgaaaagggctgcgcatctatgtc

SEQ ID NO: 675209 - DNA, 25 bp, Rattus norvegicus
ttgaaaaggtcactctccagcctgt

SEQ ID NO: 675210 - DNA, 25 bp, Rattus norvegicus
ttgaaaaggtcagtctccagcctgt

SEQ ID NO: 675211 - DNA, 25 bp, Rattus norvegicus
ttgaaaagttcacggaccttcttgg

SEQ ID NO: 675212 - DNA, 25 bp, Rattus norvegicus
ttgaaaagttcagggaccttcttgg

SEQ ID NO: 675213 - DNA, 25 bp, Rattus norvegicus
ttgaaaatactgacctagagcttag

SEQ ID NO: 675214 - DNA, 25 bp, Rattus norvegicus
ttgaaaatactgtcctagagcttag

SEQ ID NO: 675215 - DNA, 25 bp, Rattus norvegicus
ttgaaaatcatcacttcctcctgac

SEQ ID NO: 675216 - DNA, 25 bp, Rattus norvegicus
ttgaaaatcatctcttcctcctgac

SEQ ID NO: 675217 - DNA, 25 bp, Rattus norvegicus
ttgaaaatctttattgccttaaaat

SEQ ID NO: 675218 - DNA, 25 bp, Rattus norvegicus
ttgaaaatcttttttgccttaaaat

SEQ ID NO: 675219 - DNA, 25 bp, Rattus norvegicus
ttgaaaatggaactgttctgtaccc

SEQ ID NO: 675220 - DNA, 25 bp, Rattus norvegicus
ttgaaaatggaagtgttctgtaccc

SEQ ID NO: 675221 - DNA, 25 bp, Rattus norvegicus
ttgaaaattggacacttctagctgt

SEQ ID NO: 675222 - DNA, 25 bp, Rattus norvegicus
ttgaaaattggagacttctagctgt

SEQ ID NO: 675223 - DNA, 25 bp, Rattus norvegicus
ttgaaacaggatccgtgggactctc

SEQ ID NO: 675224 - DNA, 25 bp, Rattus norvegicus
ttgaaacaggatgcgtgggactctc

SEQ ID NO: 675225 - DNA, 25 bp, Rattus norvegicus
ttgaaaccagggaccccaactcaat

SEQ ID NO: 675226 - DNA, 25 bp, Rattus norvegicus
ttgaaaccagggtccccaactcaat

SEQ ID NO: 675227 - DNA, 25 bp, Rattus norvegicus
ttgaaaccggaacccctttactgtg

SEQ ID NO: 675228 - DNA, 25 bp, Rattus norvegicus
ttgaaaccggaagccctttactgtg

SEQ ID NO: 675229 - DNA, 25 bp, Rattus norvegicus
ttgaaacctaaaaccttccatgcct

SEQ ID NO: 675230 - DNA, 25 bp, Rattus norvegicus
ttgaaacctaaatccttccatgcct

SEQ ID NO: 675231 - DNA, 25 bp, Rattus norvegicus
ttgaaacctctcatttgtccacaga

SEQ ID NO: 675232 - DNA, 25 bp, Rattus norvegicus
ttgaaacctctcttttgtccacaga

SEQ ID NO: 675233 - DNA, 25 bp, Rattus norvegicus
ttgaaacctggcaagtccggagtga

SEQ ID NO: 675234 - DNA, 25 bp, Rattus norvegicus
ttgaaacctggctagtccggagtga

SEQ ID NO: 675235 - DNA, 25 bp, Rattus norvegicus
ttgaaaccttcccttgctggctgta

SEQ ID NO: 675236 - DNA, 25 bp, Rattus norvegicus
ttgaaaccttccgttgctggctgta

SEQ ID NO: 675237 - DNA, 25 bp, Rattus norvegicus
ttgaaacgtcatactgtgccataat

SEQ ID NO: 675238 - DNA, 25 bp, Rattus norvegicus
ttgaaacgtcattctgtgccataat

SEQ ID NO: 675239 - DNA, 25 bp, Rattus norvegicus
ttgaaactcaaaattacatgcatgt

SEQ ID NO: 675240 - DNA, 25 bp, Rattus norvegicus
ttgaaactcaaatttacatgcatgt

SEQ ID NO: 675241 - DNA, 25 bp, Rattus norvegicus
ttgaaactgtggattcttgcccgcc

SEQ ID NO: 675242 - DNA, 25 bp, Rattus norvegicus
ttgaaactgtggtttcttgcccgcc

SEQ ID NO: 675243 - DNA, 25 bp, Rattus norvegicus
ttgaaactttcccttgtccatctat

SEQ ID NO: 675244 - DNA, 25 bp, Rattus norvegicus
ttgaaactttccgttgtccatctat

SEQ ID NO: 675245 - DNA, 25 bp, Rattus norvegicus
ttgaaagacctcaaggccacaacca

SEQ ID NO: 675246 - DNA, 25 bp, Rattus norvegicus
ttgaaagacctctaggccacaacca

SEQ ID NO: 675247 - DNA, 25 bp, Rattus norvegicus
ttgaaagagcagacccacacagcac

SEQ ID NO: 675248 - DNA, 25 bp, Rattus norvegicus
ttgaaagagcagtcccacacagcac

SEQ ID NO: 675249 - DNA, 25 bp, Rattus norvegicus
ttgaaagccctgctgttgtgtgtcc

SEQ ID NO: 675250 - DNA, 25 bp, Rattus norvegicus
ttgaaagccctggtgttgtgtgtcc

SEQ ID NO: 675251 - DNA, 25 bp, Rattus norvegicus
ttgaaagcttgcatccccagctgct

SEQ ID NO: 675252 - DNA, 25 bp, Rattus norvegicus
ttgaaagcttgcttccccagctgct

SEQ ID NO: 675253 - DNA, 25 bp, Rattus norvegicus
ttgaaaggacacctgccctgactac

SEQ ID NO: 675254 - DNA, 25 bp, Rattus norvegicus
ttgaaaggacacgtgccctgactac

SEQ ID NO: 675255 - DNA, 25 bp, Rattus norvegicus
ttgaaaggagtacacactatcatgt

SEQ ID NO: 675256 - DNA, 25 bp, Rattus norvegicus
ttgaaaggagtagacactatcatgt

SEQ ID NO: 675257 - DNA, 25 bp, Rattus norvegicus
ttgaaaggccggatggtgcgtccaa

SEQ ID NO: 675258 - DNA, 25 bp, Rattus norvegicus
ttgaaaggccggttggtgcgtccaa

SEQ ID NO: 675259 - DNA, 25 bp, Rattus norvegicus
ttgaaaggcctcagcattccattct

SEQ ID NO: 675260 - DNA, 25 bp, Rattus norvegicus
ttgaaaggcctctgcattccattct

SEQ ID NO: 675261 - DNA, 25 bp, Rattus norvegicus
ttgaaaggcgttctgggtctgtctt

SEQ ID NO: 675262 - DNA, 25 bp, Rattus norvegicus
ttgaaaggcgttgtgggtctgtctt

SEQ ID NO: 675263 - DNA, 25 bp, Rattus norvegicus
ttgaaagggagaccccaaagccacg

SEQ ID NO: 675264 - DNA, 25 bp, Rattus norvegicus
ttgaaagggagagcccaaagccacg

SEQ ID NO: 675265 - DNA, 25 bp, Rattus norvegicus
ttgaaaggtgcaccgtcggcatcca

SEQ ID NO: 675266 - DNA, 25 bp, Rattus norvegicus
ttgaaaggtgcagcgtcggcatcca

SEQ ID NO: 675267 - DNA, 25 bp, Rattus norvegicus
ttgaaaggttcccagcacaggcagc

SEQ ID NO: 675268 - DNA, 25 bp, Rattus norvegicus
ttgaaaggttccgagcacaggcagc

SEQ ID NO: 675269 - DNA, 25 bp, Rattus norvegicus
ttgaaagtgccaaattcctctgagt

SEQ ID NO: 675270 - DNA, 25 bp, Rattus norvegicus
ttgaaagtgccatattcctctgagt

SEQ ID NO: 675271 - DNA, 25 bp, Rattus norvegicus
ttgaaagttctgaacttacctaact

SEQ ID NO: 675272 - DNA, 25 bp, Rattus norvegicus
ttgaaagttctgtacttacctaact

SEQ ID NO: 675273 - DNA, 25 bp, Rattus norvegicus
ttgaaagtttaacctttttctgctt

SEQ ID NO: 675274 - DNA, 25 bp, Rattus norvegicus
ttgaaagtttaagctttttctgctt

SEQ ID NO: 675275 - DNA, 25 bp, Rattus norvegicus
ttgaaataaacactggctccgctct

SEQ ID NO: 675276 - DNA, 25 bp, Rattus norvegicus
ttgaaataaacagtggctccgctct

SEQ ID NO: 675277 - DNA, 25 bp, Rattus norvegicus
ttgaaataaattagccacccagata

SEQ ID NO: 675278 - DNA, 25 bp, Rattus norvegicus
ttgaaataaatttgccacccagata

SEQ ID NO: 675279 - DNA, 25 bp, Rattus norvegicus
ttgaaatacagtcttctcccgagag

SEQ ID NO: 675280 - DNA, 25 bp, Rattus norvegicus
ttgaaatacagtgttctcccgagag

SEQ ID NO: 675281 - DNA, 25 bp, Rattus norvegicus
ttgaaatagatcatggaccacttgc

SEQ ID NO: 675282 - DNA, 25 bp, Rattus norvegicus
ttgaaatagatcttggaccacttgc

SEQ ID NO: 675283 - DNA, 25 bp, Rattus norvegicus
ttgaaatattacagcctaccctagg

SEQ ID NO: 675284 - DNA, 25 bp, Rattus norvegicus
ttgaaatattactgcctaccctagg

SEQ ID NO: 675285 - DNA, 25 bp, Rattus norvegicus
ttgaaatcatctatacattctgtat

SEQ ID NO: 675286 - DNA, 25 bp, Rattus norvegicus
ttgaaatcatctttacattctgtat

SEQ ID NO: 675287 - DNA, 25 bp, Rattus norvegicus
ttgaaatcattaacacgttcccctc

SEQ ID NO: 675288 - DNA, 25 bp, Rattus norvegicus
ttgaaatcattatcacgttcccctc

SEQ ID NO: 675289 - DNA, 25 bp, Rattus norvegicus
ttgaaatccaggacatgagcccatt

SEQ ID NO: 675290 - DNA, 25 bp, Rattus norvegicus
ttgaaatccaggtcatgagcccatt

SEQ ID NO: 675291 - DNA, 25 bp, Rattus norvegicus
ttgaaatctccacctttgaccatgt

SEQ ID NO: 675292 - DNA, 25 bp, Rattus norvegicus
ttgaaatctccagctttgaccatgt

SEQ ID NO: 675293 - DNA, 25 bp, Rattus norvegicus
ttgaaatctcccaggtcaaggctga

SEQ ID NO: 675294 - DNA, 25 bp, Rattus norvegicus
ttgaaatctccctggtcaaggctga

SEQ ID NO: 675295 - DNA, 25 bp, Rattus norvegicus
ttgaaatctgacataccaccagctt

SEQ ID NO: 675296 - DNA, 25 bp, Rattus norvegicus
ttgaaatctgacttaccaccagctt

SEQ ID NO: 675297 - DNA, 25 bp, Rattus norvegicus
ttgaaatctgctactttgctgaaaa

SEQ ID NO: 675298 - DNA, 25 bp, Rattus norvegicus
ttgaaatctgcttctttgctgaaaa

SEQ ID NO: 675299 - DNA, 25 bp, Rattus norvegicus
ttgaaatgcaacaaccagctgtctg

SEQ ID NO: 675300 - DNA, 25 bp, Rattus norvegicus
ttgaaatgcaactaccagctgtctg

SEQ ID NO: 675301 - DNA, 25 bp, Rattus norvegicus
ttgaaatgccatcagcggacccaca

SEQ ID NO: 675302 - DNA, 25 bp, Rattus norvegicus
ttgaaatgccatgagcggacccaca

SEQ ID NO: 675303 - DNA, 25 bp, Rattus norvegicus
ttgaaatggcccctcctttcaaagt

SEQ ID NO: 675304 - DNA, 25 bp, Rattus norvegicus
ttgaaatggcccgtcctttcaaagt

SEQ ID NO: 675305 - DNA, 25 bp, Rattus norvegicus
ttgaaatgggccattcggcttctca

SEQ ID NO: 675306 - DNA, 25 bp, Rattus norvegicus
ttgaaatgggcctttcggcttctca

SEQ ID NO: 675307 - DNA, 25 bp, Rattus norvegicus
ttgaaatgtttcctccagttgacag

SEQ ID NO: 675308 - DNA, 25 bp, Rattus norvegicus
ttgaaatgtttcgtccagttgacag

SEQ ID NO: 675309 - DNA, 25 bp, Rattus norvegicus
ttgaaattacagaactcccgcctca

SEQ ID NO: 675310 - DNA, 25 bp, Rattus norvegicus
ttgaaattacagtactcccgcctca

SEQ ID NO: 675311 - DNA, 25 bp, Rattus norvegicus
ttgaaattgtcaacactcctgctga

SEQ ID NO: 675312 - DNA, 25 bp, Rattus norvegicus
ttgaaattgtcatcactcctgctga

SEQ ID NO: 675313 - DNA, 25 bp, Rattus norvegicus
ttgaaatttgacctgctctgcatgt

SEQ ID NO: 675314 - DNA, 25 bp, Rattus norvegicus
ttgaaatttgacgtgctctgcatgt

SEQ ID NO: 675315 - DNA, 25 bp, Rattus norvegicus
ttgaacaaaattacctctccctggg

SEQ ID NO: 675316 - DNA, 25 bp, Rattus norvegicus
ttgaacaaaatttcctctccctggg

SEQ ID NO: 675317 - DNA, 25 bp, Rattus norvegicus
ttgaacaaacgcatttcctttcttg

SEQ ID NO: 675318 - DNA, 25 bp, Rattus norvegicus
ttgaacaaacgcttttcctttcttg

SEQ ID NO: 675319 - DNA, 25 bp, Rattus norvegicus
ttgaacaacttcaccagtcagcagc

SEQ ID NO: 675320 - DNA, 25 bp, Rattus norvegicus
ttgaacaacttctccagtcagcagc

SEQ ID NO: 675321 - DNA, 25 bp, Rattus norvegicus
ttgaacaataccactgcctgcaatg

SEQ ID NO: 675322 - DNA, 25 bp, Rattus norvegicus
ttgaacaatacctctgcctgcaatg

SEQ ID NO: 675323 - DNA, 25 bp, Rattus norvegicus
ttgaacaattacctatgaagatttg

SEQ ID NO: 675324 - DNA, 25 bp, Rattus norvegicus
ttgaacaattacgtatgaagatttg

SEQ ID NO: 675325 - DNA, 25 bp, Rattus norvegicus
ttgaacacaaacctagagaaagcgt

SEQ ID NO: 675326 - DNA, 25 bp, Rattus norvegicus
ttgaacacaaacgtagagaaagcgt

SEQ ID NO: 675327 - DNA, 25 bp, Rattus norvegicus
ttgaacacacccatctattctgaga

SEQ ID NO: 675328 - DNA, 25 bp, Rattus norvegicus
ttgaacacacccttctattctgaga

SEQ ID NO: 675329 - DNA, 25 bp, Rattus norvegicus
ttgaacaccatgacagcttactctg

SEQ ID NO: 675330 - DNA, 25 bp, Rattus norvegicus
ttgaacaccatgtcagcttactctg

SEQ ID NO: 675331 - DNA, 25 bp, Rattus norvegicus
ttgaacacccagagcagtagccagt

SEQ ID NO: 675332 - DNA, 25 bp, Rattus norvegicus
ttgaacacccagtgcagtagccagt

SEQ ID NO: 675333 - DNA, 25 bp, Rattus norvegicus
ttgaacacctctagacctctgcagt

SEQ ID NO: 675334 - DNA, 25 bp, Rattus norvegicus
ttgaacacctcttgacctctgcagt

SEQ ID NO: 675335 - DNA, 25 bp, Rattus norvegicus
ttgaacactgctctgcagaagccac

SEQ ID NO: 675336 - DNA, 25 bp, Rattus norvegicus
ttgaacactgctgtgcagaagccac

SEQ ID NO: 675337 - DNA, 25 bp, Rattus norvegicus
ttgaacacttcacccatactcatgt

SEQ ID NO: 675338 - DNA, 25 bp, Rattus norvegicus
ttgaacacttcagccatactcatgt

SEQ ID NO: 675339 - DNA, 25 bp, Rattus norvegicus
ttgaacacttccatctttgctgtag

SEQ ID NO: 675340 - DNA, 25 bp, Rattus norvegicus
ttgaacacttccttctttgctgtag

SEQ ID NO: 675341 - DNA, 25 bp, Rattus norvegicus
ttgaacactttacctgtggccctaa

SEQ ID NO: 675342 - DNA, 25 bp, Rattus norvegicus
ttgaacactttagctgtggccctaa

SEQ ID NO: 675343 - DNA, 25 bp, Rattus norvegicus
ttgaacagagtgcatactaaccagg

SEQ ID NO: 675344 - DNA, 25 bp, Rattus norvegicus
ttgaacagagtggatactaaccagg

SEQ ID NO: 675345 - DNA, 25 bp, Rattus norvegicus
ttgaacagcacgagtgacgacagta

SEQ ID NO: 675346 - DNA, 25 bp, Rattus norvegicus
ttgaacagcacgtgtgacgacagta

SEQ ID NO: 675347 - DNA, 25 bp, Rattus norvegicus
ttgaacagctacagtcggataacgt

SEQ ID NO: 675348 - DNA, 25 bp, Rattus norvegicus
ttgaacagctactgtcggataacgt

SEQ ID NO: 675349 - DNA, 25 bp, Rattus norvegicus
ttgaacagtaccctctgcagaggga

SEQ ID NO: 675350 - DNA, 25 bp, Rattus norvegicus
ttgaacagtaccgtctgcagaggga

SEQ ID NO: 675351 - DNA, 25 bp, Rattus norvegicus
ttgaacagtgaacccagcctgcagc

SEQ ID NO: 675352 - DNA, 25 bp, Rattus norvegicus
ttgaacagtgaagccagcctgcagc

SEQ ID NO: 675353 - DNA, 25 bp, Rattus norvegicus
ttgaacagtttcatcctgtgtggcc

SEQ ID NO: 675354 - DNA, 25 bp, Rattus norvegicus
ttgaacagtttcttcctgtgtggcc

SEQ ID NO: 675355 - DNA, 25 bp, Rattus norvegicus
ttgaacatattcagtgccacggctg

SEQ ID NO: 675356 - DNA, 25 bp, Rattus norvegicus
ttgaacatattctgtgccacggctg

SEQ ID NO: 675357 - DNA, 25 bp, Rattus norvegicus
ttgaacatgccccatctgcctttgg

SEQ ID NO: 675358 - DNA, 25 bp, Rattus norvegicus
ttgaacatgcccgatctgcctttgg

SEQ ID NO: 675359 - DNA, 25 bp, Rattus norvegicus
ttgaacatgggtcaggtgccacgct

SEQ ID NO: 675360 - DNA, 25 bp, Rattus norvegicus
ttgaacatgggtgaggtgccacgct

SEQ ID NO: 675361 - DNA, 25 bp, Rattus norvegicus
ttgaacatgtcgcttgcatcccaga

SEQ ID NO: 675362 - DNA, 25 bp, Rattus norvegicus
ttgaacatgtcggttgcatcccaga

SEQ ID NO: 675363 - DNA, 25 bp, Rattus norvegicus
ttgaacatttgtatccccgagttgg

SEQ ID NO: 675364 - DNA, 25 bp, Rattus norvegicus
ttgaacatttgtttccccgagttgg

SEQ ID NO: 675365 - DNA, 25 bp, Rattus norvegicus
ttgaaccaaccacccagtaagtact

SEQ ID NO: 675366 - DNA, 25 bp, Rattus norvegicus
ttgaaccaaccagccagtaagtact

SEQ ID NO: 675367 - DNA, 25 bp, Rattus norvegicus
ttgaaccaactcatcttggaccctg

SEQ ID NO: 675368 - DNA, 25 bp, Rattus norvegicus
ttgaaccaactcttcttggaccctg

SEQ ID NO: 675369 - DNA, 25 bp, Rattus norvegicus
ttgaaccaagcacctcggatcctga

SEQ ID NO: 675370 - DNA, 25 bp, Rattus norvegicus
ttgaaccaagcagctcggatcctga

SEQ ID NO: 675371 - DNA, 25 bp, Rattus norvegicus
ttgaaccaagggaccatggcttagg

SEQ ID NO: 675372 - DNA, 25 bp, Rattus norvegicus
ttgaaccaagggtccatggcttagg

SEQ ID NO: 675373 - DNA, 25 bp, Rattus norvegicus
ttgaaccacaatcacctacagctgt

SEQ ID NO: 675374 - DNA, 25 bp, Rattus norvegicus
ttgaaccacaatgacctacagctgt

SEQ ID NO: 675375 - DNA, 25 bp, Rattus norvegicus
ttgaaccacagcactgagcccagat

SEQ ID NO: 675376 - DNA, 25 bp, Rattus norvegicus
ttgaaccacagctctgagcccagat

SEQ ID NO: 675377 - DNA, 25 bp, Rattus norvegicus
ttgaaccagactccgagacagcctt

SEQ ID NO: 675378 - DNA, 25 bp, Rattus norvegicus
ttgaaccagactgcgagacagcctt

SEQ ID NO: 675379 - DNA, 25 bp, Rattus norvegicus
ttgaaccatattccccacataagct

SEQ ID NO: 675380 - DNA, 25 bp, Rattus norvegicus
ttgaaccatattgcccacataagct

SEQ ID NO: 675381 - DNA, 25 bp, Rattus norvegicus
ttgaaccatggcatcgggccgaagg

SEQ ID NO: 675382 - DNA, 25 bp, Rattus norvegicus
ttgaaccatggcttcgggccgaagg

SEQ ID NO: 675383 - DNA, 25 bp, Rattus norvegicus
ttgaacccagagattcgtgcctatt

SEQ ID NO: 675384 - DNA, 25 bp, Rattus norvegicus
ttgaacccagagtttcgtgcctatt

SEQ ID NO: 675385 - DNA, 25 bp, Rattus norvegicus
ttgaacccagggacctcacatgaag

SEQ ID NO: 675386 - DNA, 25 bp, Rattus norvegicus
ttgaacccagggtcctcacatgaag

SEQ ID NO: 675387 - DNA, 25 bp, Rattus norvegicus
ttgaacccatgtacggtcgccagac

SEQ ID NO: 675388 - DNA, 25 bp, Rattus norvegicus
ttgaacccatgttcggtcgccagac

SEQ ID NO: 675389 - DNA, 25 bp, Rattus norvegicus
ttgaaccccagacctttcaaagcat

SEQ ID NO: 675390 - DNA, 25 bp, Rattus norvegicus
ttgaaccccagagctttcaaagcat

SEQ ID NO: 675391 - DNA, 25 bp, Rattus norvegicus
ttgaaccccattcagaagtcccttt

SEQ ID NO: 675392 - DNA, 25 bp, Rattus norvegicus
ttgaaccccattgagaagtcccttt

SEQ ID NO: 675393 - DNA, 25 bp, Rattus norvegicus
ttgaacccctggcatttctggagtg

SEQ ID NO: 675394 - DNA, 25 bp, Rattus norvegicus
ttgaacccctgggatttctggagtg

SEQ ID NO: 675395 - DNA, 25 bp, Rattus norvegicus
ttgaacccctgtctctcttttactt

SEQ ID NO: 675396 - DNA, 25 bp, Rattus norvegicus
ttgaacccctgtgtctcttttactt

SEQ ID NO: 675397 - DNA, 25 bp, Rattus norvegicus
ttgaacccggcaacactacaagtga

SEQ ID NO: 675398 - DNA, 25 bp, Rattus norvegicus
ttgaacccggcatcactacaagtga

SEQ ID NO: 675399 - DNA, 25 bp, Rattus norvegicus
ttgaaccctcctagggccagaagtg

SEQ ID NO: 675400 - DNA, 25 bp, Rattus norvegicus
ttgaaccctccttgggccagaagtg

SEQ ID NO: 675401 - DNA, 25 bp, Rattus norvegicus
ttgaaccgccaacggtactcaactt

SEQ ID NO: 675402 - DNA, 25 bp, Rattus norvegicus
ttgaaccgccaagggtactcaactt

SEQ ID NO: 675403 - DNA, 25 bp, Rattus norvegicus
ttgaaccggaagaggcacctctgtc

SEQ ID NO: 675404 - DNA, 25 bp, Rattus norvegicus
ttgaaccggaagtggcacctctgtc

SEQ ID NO: 675405 - DNA, 25 bp, Rattus norvegicus
ttgaacctatcaagtccgtggaagt

SEQ ID NO: 675406 - DNA, 25 bp, Rattus norvegicus
ttgaacctatcatgtccgtggaagt

SEQ ID NO: 675407 - DNA, 25 bp, Rattus norvegicus
ttgaacctcttcatttggccagccc

SEQ ID NO: 675408 - DNA, 25 bp, Rattus norvegicus
ttgaacctcttcttttggccagccc

SEQ ID NO: 675409 - DNA, 25 bp, Rattus norvegicus
ttgaacctggccacgaacttcacca

SEQ ID NO: 675410 - DNA, 25 bp, Rattus norvegicus
ttgaacctggcctcgaacttcacca

SEQ ID NO: 675411 - DNA, 25 bp, Rattus norvegicus
ttgaacctgggtcctctaggagaac

SEQ ID NO: 675412 - DNA, 25 bp, Rattus norvegicus
ttgaacctgggtgctctaggagaac

SEQ ID NO: 675413 - DNA, 25 bp, Rattus norvegicus
ttgaaccttgcaataagcctgcgtg

SEQ ID NO: 675414 - DNA, 25 bp, Rattus norvegicus
ttgaaccttgcattaagcctgcgtg

SEQ ID NO: 675415 - DNA, 25 bp, Rattus norvegicus
ttgaacgaatgacctcatcccagtt

SEQ ID NO: 675416 - DNA, 25 bp, Rattus norvegicus
ttgaacgaatgagctcatcccagtt

SEQ ID NO: 675417 - DNA, 25 bp, Rattus norvegicus
ttgaacgactttcaggaatcccact

SEQ ID NO: 675418 - DNA, 25 bp, Rattus norvegicus
ttgaacgactttgaggaatcccact

SEQ ID NO: 675419 - DNA, 25 bp, Rattus norvegicus
ttgaacgctaagatgcctcacccaa

SEQ ID NO: 675420 - DNA, 25 bp, Rattus norvegicus
ttgaacgctaagttgcctcacccaa

SEQ ID NO: 675421 - DNA, 25 bp, Rattus norvegicus
ttgaacggaagaacgcacagcccac

SEQ ID NO: 675422 - DNA, 25 bp, Rattus norvegicus
ttgaacggaagatcgcacagcccac

SEQ ID NO: 675423 - DNA, 25 bp, Rattus norvegicus
ttgaacgggactagtgcgtttgccc

SEQ ID NO: 675424 - DNA, 25 bp, Rattus norvegicus
ttgaacgggacttgtgcgtttgccc

SEQ ID NO: 675425 - DNA, 25 bp, Rattus norvegicus
ttgaacgtccgtcatgcgctcgatg

SEQ ID NO: 675426 - DNA, 25 bp, Rattus norvegicus
ttgaacgtccgtgatgcgctcgatg

SEQ ID NO: 675427 - DNA, 25 bp, Rattus norvegicus
ttgaacgtgggacggcttccttatc

SEQ ID NO: 675428 - DNA, 25 bp, Rattus norvegicus
ttgaacgtgggagggcttccttatc

SEQ ID NO: 675429 - DNA, 25 bp, Rattus norvegicus
ttgaactaattcacaaatgcgagaa

SEQ ID NO: 675430 - DNA, 25 bp, Rattus norvegicus
ttgaactaattctcaaatgcgagaa

SEQ ID NO: 675431 - DNA, 25 bp, Rattus norvegicus
ttgaactacttgacatcctctgatc

SEQ ID NO: 675432 - DNA, 25 bp, Rattus norvegicus
ttgaactacttgtcatcctctgatc

SEQ ID NO: 675433 - DNA, 25 bp, Rattus norvegicus
ttgaactatcttccggacaacatat

SEQ ID NO: 675434 - DNA, 25 bp, Rattus norvegicus
ttgaactatcttgcggacaacatat

SEQ ID NO: 675435 - DNA, 25 bp, Rattus norvegicus
ttgaactatgatagcaccccagaaa

SEQ ID NO: 675436 - DNA, 25 bp, Rattus norvegicus
ttgaactatgattgcaccccagaaa

SEQ ID NO: 675437 - DNA, 25 bp, Rattus norvegicus
ttgaactattccatggcagtgccta

SEQ ID NO: 675438 - DNA, 25 bp, Rattus norvegicus
ttgaactattccttggcagtgccta

SEQ ID NO: 675439 - DNA, 25 bp, Rattus norvegicus
ttgaactcaaagacactctgcctca

SEQ ID NO: 675440 - DNA, 25 bp, Rattus norvegicus
ttgaactcaaagtcactctgcctca

SEQ ID NO: 675441 - DNA, 25 bp, Rattus norvegicus
ttgaactcactgacattgctcacct

SEQ ID NO: 675442 - DNA, 25 bp, Rattus norvegicus
ttgaactcactgtcattgctcacct

SEQ ID NO: 675443 - DNA, 25 bp, Rattus norvegicus
ttgaactcagcgatcatctcctcgt

SEQ ID NO: 675444 - DNA, 25 bp, Rattus norvegicus
ttgaactcagcgttcatctcctcgt

SEQ ID NO: 675445 - DNA, 25 bp, Rattus norvegicus
ttgaactcaggcaagctttcttgtg

SEQ ID NO: 675446 - DNA, 25 bp, Rattus norvegicus
ttgaactcaggctagctttcttgtg

SEQ ID NO: 675447 - DNA, 25 bp, Rattus norvegicus
ttgaactcagtcaccagaacactcg

SEQ ID NO: 675448 - DNA, 25 bp, Rattus norvegicus
ttgaactcagtctccagaacactcg

SEQ ID NO: 675449 - DNA, 25 bp, Rattus norvegicus
ttgaactcatggaggtctttctgcc

SEQ ID NO: 675450 - DNA, 25 bp, Rattus norvegicus
ttgaactcatggtggtctttctgcc

SEQ ID NO: 675451 - DNA, 25 bp, Rattus norvegicus
ttgaactccattactgcctcatgct

SEQ ID NO: 675452 - DNA, 25 bp, Rattus norvegicus
ttgaactccatttctgcctcatgct

SEQ ID NO: 675453 - DNA, 25 bp, Rattus norvegicus
ttgaactccccaaaaatgtgcctgt

SEQ ID NO: 675454 - DNA, 25 bp, Rattus norvegicus
ttgaactccccataaatgtgcctgt

SEQ ID NO: 675455 - DNA, 25 bp, Rattus norvegicus
ttgaactccgtaatggcatcagcca

SEQ ID NO: 675456 - DNA, 25 bp, Rattus norvegicus
ttgaactccgtattggcatcagcca

SEQ ID NO: 675457 - DNA, 25 bp, Rattus norvegicus
ttgaactcctgcaaaccttttaaag

SEQ ID NO: 675458 - DNA, 25 bp, Rattus norvegicus
ttgaactcctgctaaccttttaaag

SEQ ID NO: 675459 - DNA, 25 bp, Rattus norvegicus
ttgaactgaagtatgggacccctga

SEQ ID NO: 675460 - DNA, 25 bp, Rattus norvegicus
ttgaactgaagtttgggacccctga

SEQ ID NO: 675461 - DNA, 25 bp, Rattus norvegicus
ttgaactgacataatcccctggtcc

SEQ ID NO: 675462 - DNA, 25 bp, Rattus norvegicus
ttgaactgacattatcccctggtcc

SEQ ID NO: 675463 - DNA, 25 bp, Rattus norvegicus
ttgaactgactgcacttgagcctaa

SEQ ID NO: 675464 - DNA, 25 bp, Rattus norvegicus
ttgaactgactggacttgagcctaa

SEQ ID NO: 675465 - DNA, 25 bp, Rattus norvegicus
ttgaactgcagaaccctgacttggc

SEQ ID NO: 675466 - DNA, 25 bp, Rattus norvegicus
ttgaactgcagatccctgacttggc

SEQ ID NO: 675467 - DNA, 25 bp, Rattus norvegicus
ttgaactgcgacaagccacgttgca

SEQ ID NO: 675468 - DNA, 25 bp, Rattus norvegicus
ttgaactgcgactagccacgttgca

SEQ ID NO: 675469 - DNA, 25 bp, Rattus norvegicus
ttgaactgcttcacggcatgcatga

SEQ ID NO: 675470 - DNA, 25 bp, Rattus norvegicus
ttgaactgcttctcggcatgcatga

SEQ ID NO: 675471 - DNA, 25 bp, Rattus norvegicus
ttgaactggattaccttcctgactc

SEQ ID NO: 675472 - DNA, 25 bp, Rattus norvegicus
ttgaactggatttccttcctgactc

SEQ ID NO: 675473 - DNA, 25 bp, Rattus norvegicus
ttgaactggtggcaacccttagctt

SEQ ID NO: 675474 - DNA, 25 bp, Rattus norvegicus
ttgaactggtgggaacccttagctt

SEQ ID NO: 675475 - DNA, 25 bp, Rattus norvegicus
ttgaactgtgttaaacttcctccct

SEQ ID NO: 675476 - DNA, 25 bp, Rattus norvegicus
ttgaactgtgtttaacttcctccct

SEQ ID NO: 675477 - DNA, 25 bp, Rattus norvegicus
ttgaacttaagcacttctccttcca

SEQ ID NO: 675478 - DNA, 25 bp, Rattus norvegicus
ttgaacttaagctcttctccttcca

SEQ ID NO: 675479 - DNA, 25 bp, Rattus norvegicus
ttgaacttattcaggctgcaaacta

SEQ ID NO: 675480 - DNA, 25 bp, Rattus norvegicus
ttgaacttattctggctgcaaacta

SEQ ID NO: 675481 - DNA, 25 bp, Rattus norvegicus
ttgaacttcagacgccttcaggtcc

SEQ ID NO: 675482 - DNA, 25 bp, Rattus norvegicus
ttgaacttcagaggccttcaggtcc

SEQ ID NO: 675483 - DNA, 25 bp, Rattus norvegicus
ttgaacttcaggctcttcgctcaaa

SEQ ID NO: 675484 - DNA, 25 bp, Rattus norvegicus
ttgaacttcagggtcttcgctcaaa

SEQ ID NO: 675485 - DNA, 25 bp, Rattus norvegicus
ttgaacttcatcctagagccgggct

SEQ ID NO: 675486 - DNA, 25 bp, Rattus norvegicus
ttgaacttcatcgtagagccgggct

SEQ ID NO: 675487 - DNA, 25 bp, Rattus norvegicus
ttgaacttcatgatcaccttgctcc

SEQ ID NO: 675488 - DNA, 25 bp, Rattus norvegicus
ttgaacttcatgttcaccttgctcc

SEQ ID NO: 675489 - DNA, 25 bp, Rattus norvegicus
ttgaacttccttacgttgtcattaa

SEQ ID NO: 675490 - DNA, 25 bp, Rattus norvegicus
ttgaacttcctttcgttgtcattaa

SEQ ID NO: 675491 - DNA, 25 bp, Rattus norvegicus
ttgaacttgggcacggtggctcctt

SEQ ID NO: 675492 - DNA, 25 bp, Rattus norvegicus
ttgaacttgggctcggtggctcctt

SEQ ID NO: 675493 - DNA, 25 bp, Rattus norvegicus
ttgaacttgtgtcattttcctccag

SEQ ID NO: 675494 - DNA, 25 bp, Rattus norvegicus
ttgaacttgtgtgattttcctccag

SEQ ID NO: 675495 - DNA, 25 bp, Rattus norvegicus
ttgaagaaccacagatccctttgcc

SEQ ID NO: 675496 - DNA, 25 bp, Rattus norvegicus
ttgaagaaccactgatccctttgcc

SEQ ID NO: 675497 - DNA, 25 bp, Rattus norvegicus
ttgaagaagcacacagcacggcagc

SEQ ID NO: 675498 - DNA, 25 bp, Rattus norvegicus
ttgaagaagcactcagcacggcagc

SEQ ID NO: 675499 - DNA, 25 bp, Rattus norvegicus
ttgaagaagcgtctctccgaacaca

SEQ ID NO: 675500 - DNA, 25 bp, Rattus norvegicus
ttgaagaagcgtgtctccgaacaca

SEQ ID NO: 675501 - DNA, 25 bp, Rattus norvegicus
ttgaagaagtctagtgcccacccaa

SEQ ID NO: 675502 - DNA, 25 bp, Rattus norvegicus
ttgaagaagtcttgtgcccacccaa

SEQ ID NO: 675503 - DNA, 25 bp, Rattus norvegicus
ttgaagacaccaaagggccacctga

SEQ ID NO: 675504 - DNA, 25 bp, Rattus norvegicus
ttgaagacaccatagggccacctga

SEQ ID NO: 675505 - DNA, 25 bp, Rattus norvegicus
ttgaagacagacctcctcactactg

SEQ ID NO: 675506 - DNA, 25 bp, Rattus norvegicus
ttgaagacagacgtcctcactactg

SEQ ID NO: 675507 - DNA, 25 bp, Rattus norvegicus
ttgaagaccagaaagtccagcctcc

SEQ ID NO: 675508 - DNA, 25 bp, Rattus norvegicus
ttgaagaccagatagtccagcctcc

SEQ ID NO: 675509 - DNA, 25 bp, Rattus norvegicus
ttgaagaccattagcaccgtccagt

SEQ ID NO: 675510 - DNA, 25 bp, Rattus norvegicus
ttgaagaccatttgcaccgtccagt

SEQ ID NO: 675511 - DNA, 25 bp, Rattus norvegicus
ttgaagacccgcctcgcaggaagca

SEQ ID NO: 675512 - DNA, 25 bp, Rattus norvegicus
ttgaagacccgcgtcgcaggaagca

SEQ ID NO: 675513 - DNA, 25 bp, Rattus norvegicus
ttgaagacccttccatgtggtgatg

SEQ ID NO: 675514 - DNA, 25 bp, Rattus norvegicus
ttgaagacccttgcatgtggtgatg

SEQ ID NO: 675515 - DNA, 25 bp, Rattus norvegicus
ttgaagacctccagattggccctga

SEQ ID NO: 675516 - DNA, 25 bp, Rattus norvegicus
ttgaagacctcctgattggccctga

SEQ ID NO: 675517 - DNA, 25 bp, Rattus norvegicus
ttgaagacgactcggccgatggcct

SEQ ID NO: 675518 - DNA, 25 bp, Rattus norvegicus
ttgaagacgactgggccgatggcct

SEQ ID NO: 675519 - DNA, 25 bp, Rattus norvegicus
ttgaagacttgaatagcgccaccac

SEQ ID NO: 675520 - DNA, 25 bp, Rattus norvegicus
ttgaagacttgattagcgccaccac

SEQ ID NO: 675521 - DNA, 25 bp, Rattus norvegicus
ttgaagacttttctcccagggacgg

SEQ ID NO: 675522 - DNA, 25 bp, Rattus norvegicus
ttgaagacttttgtcccagggacgg

SEQ ID NO: 675523 - DNA, 25 bp, Rattus norvegicus
ttgaagagacccagtagcagctctg

SEQ ID NO: 675524 - DNA, 25 bp, Rattus norvegicus
ttgaagagaccctgtagcagctctg

SEQ ID NO: 675525 - DNA, 25 bp, Rattus norvegicus
ttgaagagacttatccaggccggat

SEQ ID NO: 675526 - DNA, 25 bp, Rattus norvegicus
ttgaagagacttttccaggccggat

SEQ ID NO: 675527 - DNA, 25 bp, Rattus norvegicus
ttgaagaggatcctagttcaattcc

SEQ ID NO: 675528 - DNA, 25 bp, Rattus norvegicus
ttgaagaggatcgtagttcaattcc

SEQ ID NO: 675529 - DNA, 25 bp, Rattus norvegicus
ttgaagatgatcctgctgcacctgg

SEQ ID NO: 675530 - DNA, 25 bp, Rattus norvegicus
ttgaagatgatcgtgctgcacctgg

SEQ ID NO: 675531 - DNA, 25 bp, Rattus norvegicus
ttgaagattaccagaccacttgtgt

SEQ ID NO: 675532 - DNA, 25 bp, Rattus norvegicus
ttgaagattacctgaccacttgtgt

SEQ ID NO: 675533 - DNA, 25 bp, Rattus norvegicus
ttgaagattacgaggagctgcctcc

SEQ ID NO: 675534 - DNA, 25 bp, Rattus norvegicus
ttgaagattacgtggagctgcctcc

SEQ ID NO: 675535 - DNA, 25 bp, Rattus norvegicus
ttgaagattggacctgcctcacaag

SEQ ID NO: 675536 - DNA, 25 bp, Rattus norvegicus
ttgaagattggagctgcctcacaag

SEQ ID NO: 675537 - DNA, 25 bp, Rattus norvegicus
ttgaagcaacccaggccgcagacct

SEQ ID NO: 675538 - DNA, 25 bp, Rattus norvegicus
ttgaagcaaccctggccgcagacct

SEQ ID NO: 675539 - DNA, 25 bp, Rattus norvegicus
ttgaagcaaggaatccctcctggcc

SEQ ID NO: 675540 - DNA, 25 bp, Rattus norvegicus
ttgaagcaaggattccctcctggcc

SEQ ID NO: 675541 - DNA, 25 bp, Rattus norvegicus
ttgaagcaattaagaggtagcctct

SEQ ID NO: 675542 - DNA, 25 bp, Rattus norvegicus
ttgaagcaattatgaggtagcctct

SEQ ID NO: 675543 - DNA, 25 bp, Rattus norvegicus
ttgaagcaccttccagctgggtctg

SEQ ID NO: 675544 - DNA, 25 bp, Rattus norvegicus
ttgaagcaccttgcagctgggtctg

SEQ ID NO: 675545 - DNA, 25 bp, Rattus norvegicus
ttgaagcagaccaagtcccgtccta

SEQ ID NO: 675546 - DNA, 25 bp, Rattus norvegicus
ttgaagcagacctagtcccgtccta

SEQ ID NO: 675547 - DNA, 25 bp, Rattus norvegicus
ttgaagcaggcacatcggaaggttt

SEQ ID NO: 675548 - DNA, 25 bp, Rattus norvegicus
ttgaagcaggcagatcggaaggttt

SEQ ID NO: 675549 - DNA, 25 bp, Rattus norvegicus
ttgaagcattggatccggcgttttc

SEQ ID NO: 675550 - DNA, 25 bp, Rattus norvegicus
ttgaagcattggttccggcgttttc

SEQ ID NO: 675551 - DNA, 25 bp, Rattus norvegicus
ttgaagcccaggacccaagcgttaa

SEQ ID NO: 675552 - DNA, 25 bp, Rattus norvegicus
ttgaagcccaggtcccaagcgttaa

SEQ ID NO: 675553 - DNA, 25 bp, Rattus norvegicus
ttgaagcccctgctcatatttccag

SEQ ID NO: 675554 - DNA, 25 bp, Rattus norvegicus
ttgaagcccctggtcatatttccag

SEQ ID NO: 675555 - DNA, 25 bp, Rattus norvegicus
ttgaagcccgccagcattagctgtg

SEQ ID NO: 675556 - DNA, 25 bp, Rattus norvegicus
ttgaagcccgcctgcattagctgtg

SEQ ID NO: 675557 - DNA, 25 bp, Rattus norvegicus
ttgaagccctggcacctgtgaaaac

SEQ ID NO: 675558 - DNA, 25 bp, Rattus norvegicus
ttgaagccctgggacctgtgaaaac

SEQ ID NO: 675559 - DNA, 25 bp, Rattus norvegicus
ttgaagccctgtagcttatgtgaaa

SEQ ID NO: 675560 - DNA, 25 bp, Rattus norvegicus
ttgaagccctgttgcttatgtgaaa

SEQ ID NO: 675561 - DNA, 25 bp, Rattus norvegicus
ttgaagcctaatattcctcttattt

SEQ ID NO: 675562 - DNA, 25 bp, Rattus norvegicus
ttgaagcctaattttcctcttattt

SEQ ID NO: 675563 - DNA, 25 bp, Rattus norvegicus
ttgaagccttgaatgtgcagaccag

SEQ ID NO: 675564 - DNA, 25 bp, Rattus norvegicus
ttgaagccttgattgtgcagaccag

SEQ ID NO: 675565 - DNA, 25 bp, Rattus norvegicus
ttgaagcgctttatagacccagtgc

SEQ ID NO: 675566 - DNA, 25 bp, Rattus norvegicus
ttgaagcgctttttagacccagtgc

SEQ ID NO: 675567 - DNA, 25 bp, Rattus norvegicus
ttgaagcggcagaactatgactatg

SEQ ID NO: 675568 - DNA, 25 bp, Rattus norvegicus
ttgaagcggcagtactatgactatg

SEQ ID NO: 675569 - DNA, 25 bp, Rattus norvegicus
ttgaagctgcggctggcccaagaaa

SEQ ID NO: 675570 - DNA, 25 bp, Rattus norvegicus
ttgaagctgcgggtggcccaagaaa

SEQ ID NO: 675571 - DNA, 25 bp, Rattus norvegicus
ttgaagctggcacgcggcgactcac

SEQ ID NO: 675572 - DNA, 25 bp, Rattus norvegicus
ttgaagctggcaggcggcgactcac

SEQ ID NO: 675573 - DNA, 25 bp, Rattus norvegicus
ttgaagctgggccttttctgagcca

SEQ ID NO: 675574 - DNA, 25 bp, Rattus norvegicus
ttgaagctgggcgttttctgagcca

SEQ ID NO: 675575 - DNA, 25 bp, Rattus norvegicus
ttgaagcttcctatgttgtgttttt

SEQ ID NO: 675576 - DNA, 25 bp, Rattus norvegicus
ttgaagcttcctttgttgtgttttt

SEQ ID NO: 675577 - DNA, 25 bp, Rattus norvegicus
ttgaagctttctactatgtactgta

SEQ ID NO: 675578 - DNA, 25 bp, Rattus norvegicus
ttgaagctttcttctatgtactgta

SEQ ID NO: 675579 - DNA, 25 bp, Rattus norvegicus
ttgaagcttttcagtagcctgtact

SEQ ID NO: 675580 - DNA, 25 bp, Rattus norvegicus
ttgaagcttttctgtagcctgtact

SEQ ID NO: 675581 - DNA, 25 bp, Rattus norvegicus
ttgaaggacactcctattatttggg

SEQ ID NO: 675582 - DNA, 25 bp, Rattus norvegicus
ttgaaggacactgctattatttggg

SEQ ID NO: 675583 - DNA, 25 bp, Rattus norvegicus
ttgaaggacagcacaggccccttgt

SEQ ID NO: 675584 - DNA, 25 bp, Rattus norvegicus
ttgaaggacagctcaggccccttgt

SEQ ID NO: 675585 - DNA, 25 bp, Rattus norvegicus
ttgaaggacgacatagcccacagct

SEQ ID NO: 675586 - DNA, 25 bp, Rattus norvegicus
ttgaaggacgacttagcccacagct

SEQ ID NO: 675587 - DNA, 25 bp, Rattus norvegicus
ttgaaggagactcagctactcactg

SEQ ID NO: 675588 - DNA, 25 bp, Rattus norvegicus
ttgaaggagactgagctactcactg

SEQ ID NO: 675589 - DNA, 25 bp, Rattus norvegicus
ttgaaggaggcgcagctacttcctc

SEQ ID NO: 675590 - DNA, 25 bp, Rattus norvegicus
ttgaaggaggcggagctacttcctc

SEQ ID NO: 675591 - DNA, 25 bp, Rattus norvegicus
ttgaaggatgacaagtactgggcga

SEQ ID NO: 675592 - DNA, 25 bp, Rattus norvegicus
ttgaaggatgactagtactgggcga

SEQ ID NO: 675593 - DNA, 25 bp, Rattus norvegicus
ttgaaggcacctccaaatccggaat

SEQ ID NO: 675594 - DNA, 25 bp, Rattus norvegicus
ttgaaggcacctgcaaatccggaat

SEQ ID NO: 675595 - DNA, 25 bp, Rattus norvegicus
ttgaaggcaggtcctgtcttacctt

SEQ ID NO: 675596 - DNA, 25 bp, Rattus norvegicus
ttgaaggcaggtgctgtcttacctt

SEQ ID NO: 675597 - DNA, 25 bp, Rattus norvegicus
ttgaaggccactatgcaccaagctg

SEQ ID NO: 675598 - DNA, 25 bp, Rattus norvegicus
ttgaaggccactttgcaccaagctg

SEQ ID NO: 675599 - DNA, 25 bp, Rattus norvegicus
ttgaaggccagaacctggacgtgaa

SEQ ID NO: 675600 - DNA, 25 bp, Rattus norvegicus
ttgaaggccagatcctggacgtgaa

SEQ ID NO: 675601 - DNA, 25 bp, Rattus norvegicus
ttgaaggcccagaagcctctgctgt

SEQ ID NO: 675602 - DNA, 25 bp, Rattus norvegicus
ttgaaggcccagtagcctctgctgt

SEQ ID NO: 675603 - DNA, 25 bp, Rattus norvegicus
ttgaaggccgggataggcatcttct

SEQ ID NO: 675604 - DNA, 25 bp, Rattus norvegicus
ttgaaggccgggttaggcatcttct

SEQ ID NO: 675605 - DNA, 25 bp, Rattus norvegicus
ttgaaggctactcagcccaagcttc

SEQ ID NO: 675606 - DNA, 25 bp, Rattus norvegicus
ttgaaggctactgagcccaagcttc

SEQ ID NO: 675607 - DNA, 25 bp, Rattus norvegicus
ttgaagggaagactccactctatcc

SEQ ID NO: 675608 - DNA, 25 bp, Rattus norvegicus
ttgaagggaagagtccactctatcc

SEQ ID NO: 675609 - DNA, 25 bp, Rattus norvegicus
ttgaagggacgaacaccttggcggt

SEQ ID NO: 675610 - DNA, 25 bp, Rattus norvegicus
ttgaagggacgatcaccttggcggt

SEQ ID NO: 675611 - DNA, 25 bp, Rattus norvegicus
ttgaagggcccacgcagaaacagct

SEQ ID NO: 675612 - DNA, 25 bp, Rattus norvegicus
ttgaagggcccaggcagaaacagct

SEQ ID NO: 675613 - DNA, 25 bp, Rattus norvegicus
ttgaagggcctaacatctcgatgaa

SEQ ID NO: 675614 - DNA, 25 bp, Rattus norvegicus
ttgaagggcctatcatctcgatgaa

SEQ ID NO: 675615 - DNA, 25 bp, Rattus norvegicus
ttgaagggcctcactcgaacggcta

SEQ ID NO: 675616 - DNA, 25 bp, Rattus norvegicus
ttgaagggcctctctcgaacggcta

SEQ ID NO: 675617 - DNA, 25 bp, Rattus norvegicus
ttgaagtagaagacagccctgcctc

SEQ ID NO: 675618 - DNA, 25 bp, Rattus norvegicus
ttgaagtagaagtcagccctgcctc

SEQ ID NO: 675619 - DNA, 25 bp, Rattus norvegicus
ttgaagtagggcacactcttcacca

SEQ ID NO: 675620 - DNA, 25 bp, Rattus norvegicus
ttgaagtagggctcactcttcacca

SEQ ID NO: 675621 - DNA, 25 bp, Rattus norvegicus
ttgaagtatgtcacccagcgagcat

SEQ ID NO: 675622 - DNA, 25 bp, Rattus norvegicus
ttgaagtatgtctcccagcgagcat

SEQ ID NO: 675623 - DNA, 25 bp, Rattus norvegicus
ttgaagtcatcaagcctgctcatat

SEQ ID NO: 675624 - DNA, 25 bp, Rattus norvegicus
ttgaagtcatcatgcctgctcatat

SEQ ID NO: 675625 - DNA, 25 bp, Rattus norvegicus
ttgaagtcctaaccgagggccttga

SEQ ID NO: 675626 - DNA, 25 bp, Rattus norvegicus
ttgaagtcctaagcgagggccttga

SEQ ID NO: 675627 - DNA, 25 bp, Rattus norvegicus
ttgaagtctcctacagccactgaag

SEQ ID NO: 675628 - DNA, 25 bp, Rattus norvegicus
ttgaagtctccttcagccactgaag

SEQ ID NO: 675629 - DNA, 25 bp, Rattus norvegicus
ttgaagtctggcagtacatccttga

SEQ ID NO: 675630 - DNA, 25 bp, Rattus norvegicus
ttgaagtctggctgtacatccttga

SEQ ID NO: 675631 - DNA, 25 bp, Rattus norvegicus
ttgaagtgcaggacttcgtcatccc

SEQ ID NO: 675632 - DNA, 25 bp, Rattus norvegicus
ttgaagtgcaggtcttcgtcatccc

SEQ ID NO: 675633 - DNA, 25 bp, Rattus norvegicus
ttgaagtgccctacttctgatgggc

SEQ ID NO: 675634 - DNA, 25 bp, Rattus norvegicus
ttgaagtgcccttcttctgatgggc

SEQ ID NO: 675635 - DNA, 25 bp, Rattus norvegicus
ttgaagtggcctaggtacccagcag

SEQ ID NO: 675636 - DNA, 25 bp, Rattus norvegicus
ttgaagtggccttggtacccagcag

SEQ ID NO: 675637 - DNA, 25 bp, Rattus norvegicus
ttgaagtgtccaccagtgagcatgg

SEQ ID NO: 675638 - DNA, 25 bp, Rattus norvegicus
ttgaagtgtccaccatgaggtccct

SEQ ID NO: 675639 - DNA, 25 bp, Rattus norvegicus
ttgaagtgtccagcagtgagcatgg

SEQ ID NO: 675640 - DNA, 25 bp, Rattus norvegicus
ttgaagtgtccagcatgaggtccct

SEQ ID NO: 675641 - DNA, 25 bp, Rattus norvegicus
ttgaagtgttgcacagtctcccggc

SEQ ID NO: 675642 - DNA, 25 bp, Rattus norvegicus
ttgaagtgttgctcagtctcccggc

SEQ ID NO: 675643 - DNA, 25 bp, Rattus norvegicus
ttgaagtgttttaatcctttctcct

SEQ ID NO: 675644 - DNA, 25 bp, Rattus norvegicus
ttgaagtgtttttatcctttctcct

SEQ ID NO: 675645 - DNA, 25 bp, Rattus norvegicus
ttgaagttagccagggttacctagt

SEQ ID NO: 675646 - DNA, 25 bp, Rattus norvegicus
ttgaagttagcctgggttacctagt

SEQ ID NO: 675647 - DNA, 25 bp, Rattus norvegicus
ttgaagttcgtcagttgctgcttag

SEQ ID NO: 675648 - DNA, 25 bp, Rattus norvegicus
ttgaagttcgtctgttgctgcttag

SEQ ID NO: 675649 - DNA, 25 bp, Rattus norvegicus
ttgaagttctgcacccattgttgaa

SEQ ID NO: 675650 - DNA, 25 bp, Rattus norvegicus
ttgaagttctgcattctacccatac

SEQ ID NO: 675651 - DNA, 25 bp, Rattus norvegicus
ttgaagttctgctcccattgttgaa

SEQ ID NO: 675652 - DNA, 25 bp, Rattus norvegicus
ttgaagttctgctttctacccatac

SEQ ID NO: 675653 - DNA, 25 bp, Rattus norvegicus
ttgaagttctttcttggctccgtaa

SEQ ID NO: 675654 - DNA, 25 bp, Rattus norvegicus
ttgaagttctttgttggctccgtaa

SEQ ID NO: 675655 - DNA, 25 bp, Rattus norvegicus
ttgaagttggctcctctgtgtcctc

SEQ ID NO: 675656 - DNA, 25 bp, Rattus norvegicus
ttgaagttggctgctctgtgtcctc

SEQ ID NO: 675657 - DNA, 25 bp, Rattus norvegicus
ttgaagttggttaactttctggctt

SEQ ID NO: 675658 - DNA, 25 bp, Rattus norvegicus
ttgaagttggtttactttctggctt

SEQ ID NO: 675659 - DNA, 25 bp, Rattus norvegicus
ttgaagtttcctcttcagagtgata

SEQ ID NO: 675660 - DNA, 25 bp, Rattus norvegicus
ttgaagtttcctgttcagagtgata

SEQ ID NO: 675661 - DNA, 25 bp, Rattus norvegicus
ttgaataaccacagcccaattgtct

SEQ ID NO: 675662 - DNA, 25 bp, Rattus norvegicus
ttgaataaccactgcccaattgtct

SEQ ID NO: 675663 - DNA, 25 bp, Rattus norvegicus
ttgaataagggtcgctcacccgttg

SEQ ID NO: 675664 - DNA, 25 bp, Rattus norvegicus
ttgaataagggtggctcacccgttg

SEQ ID NO: 675665 - DNA, 25 bp, Rattus norvegicus
ttgaataagtacctcaccgccaacc

SEQ ID NO: 675666 - DNA, 25 bp, Rattus norvegicus
ttgaataagtacgtcaccgccaacc

SEQ ID NO: 675667 - DNA, 25 bp, Rattus norvegicus
ttgaatacacacaccttactcaggg

SEQ ID NO: 675668 - DNA, 25 bp, Rattus norvegicus
ttgaatacacactccttactcaggg

SEQ ID NO: 675669 - DNA, 25 bp, Rattus norvegicus
ttgaataccaggagtcttctcccct

SEQ ID NO: 675670 - DNA, 25 bp, Rattus norvegicus
ttgaataccaggtgtcttctcccct

SEQ ID NO: 675671 - DNA, 25 bp, Rattus norvegicus
ttgaatacgttcatccaatcccggg

SEQ ID NO: 675672 - DNA, 25 bp, Rattus norvegicus
ttgaatacgttcttccaatcccggg

SEQ ID NO: 675673 - DNA, 25 bp, Rattus norvegicus
ttgaatactcgacaagctgaggcag

SEQ ID NO: 675674 - DNA, 25 bp, Rattus norvegicus
ttgaatactcgagaagctgaggcag

SEQ ID NO: 675675 - DNA, 25 bp, Rattus norvegicus
ttgaatactgccagcgcctgttgga

SEQ ID NO: 675676 - DNA, 25 bp, Rattus norvegicus
ttgaatactgcctgcgcctgttgga

SEQ ID NO: 675677 - DNA, 25 bp, Rattus norvegicus
ttgaatagattaacctatcccagga

SEQ ID NO: 675678 - DNA, 25 bp, Rattus norvegicus
ttgaatagattatcctatcccagga

SEQ ID NO: 675679 - DNA, 25 bp, Rattus norvegicus
ttgaatagccaacaaccccttctta

SEQ ID NO: 675680 - DNA, 25 bp, Rattus norvegicus
ttgaatagccaagaaccccttctta

SEQ ID NO: 675681 - DNA, 25 bp, Rattus norvegicus
ttgaatagtccccaagacctccatg

SEQ ID NO: 675682 - DNA, 25 bp, Rattus norvegicus
ttgaatagtcccgaagacctccatg

SEQ ID NO: 675683 - DNA, 25 bp, Rattus norvegicus
ttgaatatccttactcttttaagaa

SEQ ID NO: 675684 - DNA, 25 bp, Rattus norvegicus
ttgaatatcctttctcttttaagaa

SEQ ID NO: 675685 - DNA, 25 bp, Rattus norvegicus
ttgaatatgcaaatactcttcgtga

SEQ ID NO: 675686 - DNA, 25 bp, Rattus norvegicus
ttgaatatgcaattactcttcgtga

SEQ ID NO: 675687 - DNA, 25 bp, Rattus norvegicus
ttgaatcagaagatggttttgccca

SEQ ID NO: 675688 - DNA, 25 bp, Rattus norvegicus
ttgaatcagaagttggttttgccca

SEQ ID NO: 675689 - DNA, 25 bp, Rattus norvegicus
ttgaatcaggatacggcctcggaca

SEQ ID NO: 675690 - DNA, 25 bp, Rattus norvegicus
ttgaatcaggattcggcctcggaca

SEQ ID NO: 675691 - DNA, 25 bp, Rattus norvegicus
ttgaatcaggccctgagtgagtgcc

SEQ ID NO: 675692 - DNA, 25 bp, Rattus norvegicus
ttgaatcaggccgtgagtgagtgcc

SEQ ID NO: 675693 - DNA, 25 bp, Rattus norvegicus
ttgaatcatctaatctttgtagtag

SEQ ID NO: 675694 - DNA, 25 bp, Rattus norvegicus
ttgaatcatctattctttgtagtag

SEQ ID NO: 675695 - DNA, 25 bp, Rattus norvegicus
ttgaatccacagagctctgcttctc

SEQ ID NO: 675696 - DNA, 25 bp, Rattus norvegicus
ttgaatccacagtgctctgcttctc

SEQ ID NO: 675697 - DNA, 25 bp, Rattus norvegicus
ttgaatccagttcccactgcagtgg

SEQ ID NO: 675698 - DNA, 25 bp, Rattus norvegicus
ttgaatccagttgccactgcagtgg

SEQ ID NO: 675699 - DNA, 25 bp, Rattus norvegicus
ttgaatcccaagagcctgagcccat

SEQ ID NO: 675700 - DNA, 25 bp, Rattus norvegicus
ttgaatcccaagtgcctgagcccat

SEQ ID NO: 675701 - DNA, 25 bp, Rattus norvegicus
ttgaatcctatccaatcccaaagat

SEQ ID NO: 675702 - DNA, 25 bp, Rattus norvegicus
ttgaatcctatcgaatcccaaagat

SEQ ID NO: 675703 - DNA, 25 bp, Rattus norvegicus
ttgaatcgaaaactctctcctcctt

SEQ ID NO: 675704 - DNA, 25 bp, Rattus norvegicus
ttgaatcgaaaagtctctcctcctt

SEQ ID NO: 675705 - DNA, 25 bp, Rattus norvegicus
ttgaatcgtgtgagctagcggccac

SEQ ID NO: 675706 - DNA, 25 bp, Rattus norvegicus
ttgaatcgtgtgtgctagcggccac

SEQ ID NO: 675707 - DNA, 25 bp, Rattus norvegicus
ttgaatctacacctaatcctctttg

SEQ ID NO: 675708 - DNA, 25 bp, Rattus norvegicus
ttgaatctacacgtaatcctctttg

SEQ ID NO: 675709 - DNA, 25 bp, Rattus norvegicus
ttgaatctctttatgcaggcagtct

SEQ ID NO: 675710 - DNA, 25 bp, Rattus norvegicus
ttgaatctctttttgcaggcagtct

SEQ ID NO: 675711 - DNA, 25 bp, Rattus norvegicus
ttgaatctgacaccaggcagtttat

SEQ ID NO: 675712 - DNA, 25 bp, Rattus norvegicus
ttgaatctgacagcaggcagtttat

SEQ ID NO: 675713 - DNA, 25 bp, Rattus norvegicus
ttgaatctggtgaggacttctgggt

SEQ ID NO: 675714 - DNA, 25 bp, Rattus norvegicus
ttgaatctggtgtggacttctgggt

SEQ ID NO: 675715 - DNA, 25 bp, Rattus norvegicus
ttgaatctgtgcatcactctcgtat

SEQ ID NO: 675716 - DNA, 25 bp, Rattus norvegicus
ttgaatctgtgcttcactctcgtat

SEQ ID NO: 675717 - DNA, 25 bp, Rattus norvegicus
ttgaatctttaccaggtgtgaccaa

SEQ ID NO: 675718 - DNA, 25 bp, Rattus norvegicus
ttgaatctttacgaggtgtgaccaa

SEQ ID NO: 675719 - DNA, 25 bp, Rattus norvegicus
ttgaatgagttccatctgcagtccc

SEQ ID NO: 675720 - DNA, 25 bp, Rattus norvegicus
ttgaatgagttcgatctgcagtccc

SEQ ID NO: 675721 - DNA, 25 bp, Rattus norvegicus
ttgaatgatccccatacatcctatc

SEQ ID NO: 675722 - DNA, 25 bp, Rattus norvegicus
ttgaatgatcccgatacatcctatc

SEQ ID NO: 675723 - DNA, 25 bp, Rattus norvegicus
ttgaatgcacaacatacctcccttc

SEQ ID NO: 675724 - DNA, 25 bp, Rattus norvegicus
ttgaatgcacaagatacctcccttc

SEQ ID NO: 675725 - DNA, 25 bp, Rattus norvegicus
ttgaatgcagggatttcttaggcct

SEQ ID NO: 675726 - DNA, 25 bp, Rattus norvegicus
ttgaatgcagggttttcttaggcct

SEQ ID NO: 675727 - DNA, 25 bp, Rattus norvegicus
ttgaatgcatacaggtctgccccaa

SEQ ID NO: 675728 - DNA, 25 bp, Rattus norvegicus
ttgaatgcatactggtctgccccaa

SEQ ID NO: 675729 - DNA, 25 bp, Rattus norvegicus
ttgaatgcatagacacttgggagtg

SEQ ID NO: 675730 - DNA, 25 bp, Rattus norvegicus
ttgaatgcatagtcacttgggagtg

SEQ ID NO: 675731 - DNA, 25 bp, Rattus norvegicus
ttgaatgccacgctgaagatgacag

SEQ ID NO: 675732 - DNA, 25 bp, Rattus norvegicus
ttgaatgccacggtgaagatgacag

SEQ ID NO: 675733 - DNA, 25 bp, Rattus norvegicus
ttgaatgccctgcttcatgtgaaca

SEQ ID NO: 675734 - DNA, 25 bp, Rattus norvegicus
ttgaatgccctggttcatgtgaaca

SEQ ID NO: 675735 - DNA, 25 bp, Rattus norvegicus
ttgaatgcccttaccacaaactgct

SEQ ID NO: 675736 - DNA, 25 bp, Rattus norvegicus
ttgaatgccctttccacaaactgct

SEQ ID NO: 675737 - DNA, 25 bp, Rattus norvegicus
ttgaatgcttataaggtgtggtcct

SEQ ID NO: 675738 - DNA, 25 bp, Rattus norvegicus
ttgaatgcttatctccctaggctgg

SEQ ID NO: 675739 - DNA, 25 bp, Rattus norvegicus
ttgaatgcttatgtccctaggctgg

SEQ ID NO: 675740 - DNA, 25 bp, Rattus norvegicus
ttgaatgcttattaggtgtggtcct

SEQ ID NO: 675741 - DNA, 25 bp, Rattus norvegicus
ttgaatggactcacttcccaggacc

SEQ ID NO: 675742 - DNA, 25 bp, Rattus norvegicus
ttgaatggactctcttcccaggacc

SEQ ID NO: 675743 - DNA, 25 bp, Rattus norvegicus
ttgaatggcaaactctgaacttttt

SEQ ID NO: 675744 - DNA, 25 bp, Rattus norvegicus
ttgaatggcaaagtctgaacttttt

SEQ ID NO: 675745 - DNA, 25 bp, Rattus norvegicus
ttgaatggcacaaacttctctgagc

SEQ ID NO: 675746 - DNA, 25 bp, Rattus norvegicus
ttgaatggcacatacttctctgagc

SEQ ID NO: 675747 - DNA, 25 bp, Rattus norvegicus
ttgaatggcagccaatgctggccca

SEQ ID NO: 675748 - DNA, 25 bp, Rattus norvegicus
ttgaatggcagcgaatgctggccca

SEQ ID NO: 675749 - DNA, 25 bp, Rattus norvegicus
ttgaatggccttctgctgtagcaat

SEQ ID NO: 675750 - DNA, 25 bp, Rattus norvegicus
ttgaatggccttgtgctgtagcaat

SEQ ID NO: 675751 - DNA, 25 bp, Rattus norvegicus
ttgaatgtaagcacaaccggttgtt

SEQ ID NO: 675752 - DNA, 25 bp, Rattus norvegicus
ttgaatgtaagctcaaccggttgtt

SEQ ID NO: 675753 - DNA, 25 bp, Rattus norvegicus
ttgaatgtagcaacagccagccagc

SEQ ID NO: 675754 - DNA, 25 bp, Rattus norvegicus
ttgaatgtagcatcagccagccagc

SEQ ID NO: 675755 - DNA, 25 bp, Rattus norvegicus
ttgaatgtattaaccgtcgtgttta

SEQ ID NO: 675756 - DNA, 25 bp, Rattus norvegicus
ttgaatgtattatccgtcgtgttta

SEQ ID NO: 675757 - DNA, 25 bp, Rattus norvegicus
ttgaatgtcattccctaacatccac

SEQ ID NO: 675758 - DNA, 25 bp, Rattus norvegicus
ttgaatgtcattgcctaacatccac

SEQ ID NO: 675759 - DNA, 25 bp, Rattus norvegicus
ttgaatgtcgtaagtccccacagaa

SEQ ID NO: 675760 - DNA, 25 bp, Rattus norvegicus
ttgaatgtcgtatgtccccacagaa

SEQ ID NO: 675761 - DNA, 25 bp, Rattus norvegicus
ttgaatgtctaccacgtgctagcac

SEQ ID NO: 675762 - DNA, 25 bp, Rattus norvegicus
ttgaatgtctacgacgtgctagcac

SEQ ID NO: 675763 - DNA, 25 bp, Rattus norvegicus
ttgaatgtctccaagcagtgctaag

SEQ ID NO: 675764 - DNA, 25 bp, Rattus norvegicus
ttgaatgtctcctagcagtgctaag

SEQ ID NO: 675765 - DNA, 25 bp, Rattus norvegicus
ttgaatgtggagctaccccggtcta

SEQ ID NO: 675766 - DNA, 25 bp, Rattus norvegicus
ttgaatgtggaggtaccccggtcta

SEQ ID NO: 675767 - DNA, 25 bp, Rattus norvegicus
ttgaatgtggccattcccatagtac

SEQ ID NO: 675768 - DNA, 25 bp, Rattus norvegicus
ttgaatgtggcctttcccatagtac

SEQ ID NO: 675769 - DNA, 25 bp, Rattus norvegicus
ttgaatgtggtcaccatgccatcca

SEQ ID NO: 675770 - DNA, 25 bp, Rattus norvegicus
ttgaatgtggtctccatgccatcca

SEQ ID NO: 675771 - DNA, 25 bp, Rattus norvegicus
ttgaatgttctgcacagcctgacct

SEQ ID NO: 675772 - DNA, 25 bp, Rattus norvegicus
ttgaatgttctggacagcctgacct

SEQ ID NO: 675773 - DNA, 25 bp, Rattus norvegicus
ttgaatgttgccagcttgcgtccac

SEQ ID NO: 675774 - DNA, 25 bp, Rattus norvegicus
ttgaatgttgcctgcttgcgtccac

SEQ ID NO: 675775 - DNA, 25 bp, Rattus norvegicus
ttgaattaagcaccgtccaggctgg

SEQ ID NO: 675776 - DNA, 25 bp, Rattus norvegicus
ttgaattaagcagcgtccaggctgg

SEQ ID NO: 675777 - DNA, 25 bp, Rattus norvegicus
ttgaattatgtcctgcttccaacca

SEQ ID NO: 675778 - DNA, 25 bp, Rattus norvegicus
ttgaattatgtcgtgcttccaacca

SEQ ID NO: 675779 - DNA, 25 bp, Rattus norvegicus
ttgaattcagcgctaccttctcaca

SEQ ID NO: 675780 - DNA, 25 bp, Rattus norvegicus
ttgaattcagcggtaccttctcaca

SEQ ID NO: 675781 - DNA, 25 bp, Rattus norvegicus
ttgaattccagtccctgttctgatg

SEQ ID NO: 675782 - DNA, 25 bp, Rattus norvegicus
ttgaattccagtgcctgttctgatg

SEQ ID NO: 675783 - DNA, 25 bp, Rattus norvegicus
ttgaattcccagcataggctctgac

SEQ ID NO: 675784 - DNA, 25 bp, Rattus norvegicus
ttgaattcccaggataggctctgac

SEQ ID NO: 675785 - DNA, 25 bp, Rattus norvegicus
ttgaattcctctctgtctagccttc

SEQ ID NO: 675786 - DNA, 25 bp, Rattus norvegicus
ttgaattcctctgtgtctagccttc

SEQ ID NO: 675787 - DNA, 25 bp, Rattus norvegicus
ttgaattcggacacagacccctacc

SEQ ID NO: 675788 - DNA, 25 bp, Rattus norvegicus
ttgaattcggactcagacccctacc

SEQ ID NO: 675789 - DNA, 25 bp, Rattus norvegicus
ttgaattctcccactgtcagtacca

SEQ ID NO: 675790 - DNA, 25 bp, Rattus norvegicus
ttgaattctccctctgtcagtacca

SEQ ID NO: 675791 - DNA, 25 bp, Rattus norvegicus
ttgaattgcatgctcattcagtgca

SEQ ID NO: 675792 - DNA, 25 bp, Rattus norvegicus
ttgaattgcatggtcattcagtgca

SEQ ID NO: 675793 - DNA, 25 bp, Rattus norvegicus
ttgaattgccaaaacgctggctgga

SEQ ID NO: 675794 - DNA, 25 bp, Rattus norvegicus
ttgaattgccaatacgctggctgga

SEQ ID NO: 675795 - DNA, 25 bp, Rattus norvegicus
ttgaattgggtgagctctccgctca

SEQ ID NO: 675796 - DNA, 25 bp, Rattus norvegicus
ttgaattgggtgtgctctccgctca

SEQ ID NO: 675797 - DNA, 25 bp, Rattus norvegicus
ttgaatttagcaccgtaatcctgtc

SEQ ID NO: 675798 - DNA, 25 bp, Rattus norvegicus
ttgaatttagcagcgtaatcctgtc

SEQ ID NO: 675799 - DNA, 25 bp, Rattus norvegicus
ttgaatttcaccatcattcaccacc

SEQ ID NO: 675800 - DNA, 25 bp, Rattus norvegicus
ttgaatttcaccttcattcaccacc

SEQ ID NO: 675801 - DNA, 25 bp, Rattus norvegicus
ttgaatttcagcacgcggagggcgc

SEQ ID NO: 675802 - DNA, 25 bp, Rattus norvegicus
ttgaatttcagctcgcggagggcgc

SEQ ID NO: 675803 - DNA, 25 bp, Rattus norvegicus
ttgaatttctacaagcctgcctcat

SEQ ID NO: 675804 - DNA, 25 bp, Rattus norvegicus
ttgaatttctactagcctgcctcat

SEQ ID NO: 675805 - DNA, 25 bp, Rattus norvegicus
ttgaatttctggacagccaaagcta

SEQ ID NO: 675806 - DNA, 25 bp, Rattus norvegicus
ttgaatttctggtcagccaaagcta

SEQ ID NO: 675807 - DNA, 25 bp, Rattus norvegicus
ttgaatttcttcctaacctgtgtta

SEQ ID NO: 675808 - DNA, 25 bp, Rattus norvegicus
ttgaatttcttcgtaacctgtgtta

SEQ ID NO: 675809 - DNA, 25 bp, Rattus norvegicus
ttgaatttgactccccaaccttagg

SEQ ID NO: 675810 - DNA, 25 bp, Rattus norvegicus
ttgaatttgactgcccaaccttagg

SEQ ID NO: 675811 - DNA, 25 bp, Rattus norvegicus
ttgaatttgccacgtagctgaggct

SEQ ID NO: 675812 - DNA, 25 bp, Rattus norvegicus
ttgaatttgccaggtagctgaggct

SEQ ID NO: 675813 - DNA, 25 bp, Rattus norvegicus
ttgaatttgggtagtgttataggtc

SEQ ID NO: 675814 - DNA, 25 bp, Rattus norvegicus
ttgaatttgggttgtgttataggtc

SEQ ID NO: 675815 - DNA, 25 bp, Rattus norvegicus
ttgaattttctgacgtcacactcta

SEQ ID NO: 675816 - DNA, 25 bp, Rattus norvegicus
ttgaattttctgtcgtcacactcta

SEQ ID NO: 675817 - DNA, 25 bp, Rattus norvegicus
ttgacaaagcacaatttcccgcctt

SEQ ID NO: 675818 - DNA, 25 bp, Rattus norvegicus
ttgacaaagcactatttcccgcctt

SEQ ID NO: 675819 - DNA, 25 bp, Rattus norvegicus
ttgacaaatgtcactgcactgttcc

SEQ ID NO: 675820 - DNA, 25 bp, Rattus norvegicus
ttgacaaatgtccacttaactgata

SEQ ID NO: 675821 - DNA, 25 bp, Rattus norvegicus
ttgacaaatgtccttcatctacccc

SEQ ID NO: 675822 - DNA, 25 bp, Rattus norvegicus
ttgacaaatgtcgacttaactgata

SEQ ID NO: 675823 - DNA, 25 bp, Rattus norvegicus
ttgacaaatgtcgttcatctacccc

SEQ ID NO: 675824 - DNA, 25 bp, Rattus norvegicus
ttgacaaatgtctctgcactgttcc

SEQ ID NO: 675825 - DNA, 25 bp, Rattus norvegicus
ttgacaacatacactaggccttcta

SEQ ID NO: 675826 - DNA, 25 bp, Rattus norvegicus
ttgacaacatactctaggccttcta

SEQ ID NO: 675827 - DNA, 25 bp, Rattus norvegicus
ttgacaaccaagaagatgctagaat

SEQ ID NO: 675828 - DNA, 25 bp, Rattus norvegicus
ttgacaaccaagtagatgctagaat

SEQ ID NO: 675829 - DNA, 25 bp, Rattus norvegicus
ttgacaaccgcaaggagtctttctt

SEQ ID NO: 675830 - DNA, 25 bp, Rattus norvegicus
ttgacaaccgcatggagtctttctt

SEQ ID NO: 675831 - DNA, 25 bp, Rattus norvegicus
ttgacaacctgtctgggtccgtctt

SEQ ID NO: 675832 - DNA, 25 bp, Rattus norvegicus
ttgacaacctgtgtgggtccgtctt

SEQ ID NO: 675833 - DNA, 25 bp, Rattus norvegicus
ttgacaagaacccttctgccggcgg

SEQ ID NO: 675834 - DNA, 25 bp, Rattus norvegicus
ttgacaagaaccgttctgccggcgg

SEQ ID NO: 675835 - DNA, 25 bp, Rattus norvegicus
ttgacaagccccacattgttccatg

SEQ ID NO: 675836 - DNA, 25 bp, Rattus norvegicus
ttgacaagcccctcattgttccatg

SEQ ID NO: 675837 - DNA, 25 bp, Rattus norvegicus
ttgacaaggattatctacaaggaat

SEQ ID NO: 675838 - DNA, 25 bp, Rattus norvegicus
ttgacaaggattttctacaaggaat

SEQ ID NO: 675839 - DNA, 25 bp, Rattus norvegicus
ttgacaagtgccagaagctccattc

SEQ ID NO: 675840 - DNA, 25 bp, Rattus norvegicus
ttgacaagtgcctgaagctccattc

SEQ ID NO: 675841 - DNA, 25 bp, Rattus norvegicus
ttgacaagtgctatggccatctcag

SEQ ID NO: 675842 - DNA, 25 bp, Rattus norvegicus
ttgacaagtgctttggccatctcag

SEQ ID NO: 675843 - DNA, 25 bp, Rattus norvegicus
ttgacaataactccccttgtttcat

SEQ ID NO: 675844 - DNA, 25 bp, Rattus norvegicus
ttgacaataactgcccttgtttcat

SEQ ID NO: 675845 - DNA, 25 bp, Rattus norvegicus
ttgacaatgataagagagaccctgg

SEQ ID NO: 675846 - DNA, 25 bp, Rattus norvegicus
ttgacaatgatatgagagaccctgg

SEQ ID NO: 675847 - DNA, 25 bp, Rattus norvegicus
ttgacaatgctgacagtgccacggc

SEQ ID NO: 675848 - DNA, 25 bp, Rattus norvegicus
ttgacaatgctgtcagtgccacggc

SEQ ID NO: 675849 - DNA, 25 bp, Rattus norvegicus
ttgacaattcagacccagggttctt

SEQ ID NO: 675850 - DNA, 25 bp, Rattus norvegicus
ttgacaattcagtcccagggttctt

SEQ ID NO: 675851 - DNA, 25 bp, Rattus norvegicus
ttgacacactctatccaggatcaag

SEQ ID NO: 675852 - DNA, 25 bp, Rattus norvegicus
ttgacacactctttccaggatcaag

SEQ ID NO: 675853 - DNA, 25 bp, Rattus norvegicus
ttgacacaggtgacgctgtggccat

SEQ ID NO: 675854 - DNA, 25 bp, Rattus norvegicus
ttgacacaggtgtcgctgtggccat

SEQ ID NO: 675855 - DNA, 25 bp, Rattus norvegicus
ttgacacagttgctggtgccatctg

SEQ ID NO: 675856 - DNA, 25 bp, Rattus norvegicus
ttgacacagttggtggtgccatctg

SEQ ID NO: 675857 - DNA, 25 bp, Rattus norvegicus
ttgacacatcgtacttgactgcatc

SEQ ID NO: 675858 - DNA, 25 bp, Rattus norvegicus
ttgacacatcgttcttgactgcatc

SEQ ID NO: 675859 - DNA, 25 bp, Rattus norvegicus
ttgacacattctcaacttgcgcctc

SEQ ID NO: 675860 - DNA, 25 bp, Rattus norvegicus
ttgacacattctgaacttgcgcctc

SEQ ID NO: 675861 - DNA, 25 bp, Rattus norvegicus
ttgacaccattaactccatccagtt

SEQ ID NO: 675862 - DNA, 25 bp, Rattus norvegicus
ttgacaccattatctccatccagtt

SEQ ID NO: 675863 - DNA, 25 bp, Rattus norvegicus
ttgacaccccacacagatagacatg

SEQ ID NO: 675864 - DNA, 25 bp, Rattus norvegicus
ttgacaccccactcagatagacatg

SEQ ID NO: 675865 - DNA, 25 bp, Rattus norvegicus
ttgacaccccagctgagaggcagaa

SEQ ID NO: 675866 - DNA, 25 bp, Rattus norvegicus
ttgacaccccaggtgagaggcagaa

SEQ ID NO: 675867 - DNA, 25 bp, Rattus norvegicus
ttgacaccgtttctgatgcccggga

SEQ ID NO: 675868 - DNA, 25 bp, Rattus norvegicus
ttgacaccgtttgtgatgcccggga

SEQ ID NO: 675869 - DNA, 25 bp, Rattus norvegicus
ttgacacctaggaagcactcctggt

SEQ ID NO: 675870 - DNA, 25 bp, Rattus norvegicus
ttgacacctaggtagcactcctggt

SEQ ID NO: 675871 - DNA, 25 bp, Rattus norvegicus
ttgacacctatacagtgcctcacaa

SEQ ID NO: 675872 - DNA, 25 bp, Rattus norvegicus
ttgacacctatagagtgcctcacaa

SEQ ID NO: 675873 - DNA, 25 bp, Rattus norvegicus
ttgacacctcttccttcatgccaag

SEQ ID NO: 675874 - DNA, 25 bp, Rattus norvegicus
ttgacacctcttgcttcatgccaag

SEQ ID NO: 675875 - DNA, 25 bp, Rattus norvegicus
ttgacacctgacagcgtgtcactca

SEQ ID NO: 675876 - DNA, 25 bp, Rattus norvegicus
ttgacacctgactgcgtgtcactca

SEQ ID NO: 675877 - DNA, 25 bp, Rattus norvegicus
ttgacaccttttacagatctgactg

SEQ ID NO: 675878 - DNA, 25 bp, Rattus norvegicus
ttgacacctttttcagatctgactg

SEQ ID NO: 675879 - DNA, 25 bp, Rattus norvegicus
ttgacacgcccaaagttgagcaagt

SEQ ID NO: 675880 - DNA, 25 bp, Rattus norvegicus
ttgacacgcccatagttgagcaagt

SEQ ID NO: 675881 - DNA, 25 bp, Rattus norvegicus
ttgacactgattcgcctttaaccat

SEQ ID NO: 675882 - DNA, 25 bp, Rattus norvegicus
ttgacactgattggcctttaaccat

SEQ ID NO: 675883 - DNA, 25 bp, Rattus norvegicus
ttgacactgcagactatagtccttc

SEQ ID NO: 675884 - DNA, 25 bp, Rattus norvegicus
ttgacactgcagtctatagtccttc

SEQ ID NO: 675885 - DNA, 25 bp, Rattus norvegicus
ttgacactgcttatggcaccatggg

SEQ ID NO: 675886 - DNA, 25 bp, Rattus norvegicus
ttgacactgcttttggcaccatggg

SEQ ID NO: 675887 - DNA, 25 bp, Rattus norvegicus
ttgacactggctatcctctagttca

SEQ ID NO: 675888 - DNA, 25 bp, Rattus norvegicus
ttgacactggctttcctctagttca

SEQ ID NO: 675889 - DNA, 25 bp, Rattus norvegicus
ttgacactgtccctcgtaggatgat

SEQ ID NO: 675890 - DNA, 25 bp, Rattus norvegicus
ttgacactgtccgtcgtaggatgat

SEQ ID NO: 675891 - DNA, 25 bp, Rattus norvegicus
ttgacacttgttaactagctagctt

SEQ ID NO: 675892 - DNA, 25 bp, Rattus norvegicus
ttgacacttgtttactagctagctt

SEQ ID NO: 675893 - DNA, 25 bp, Rattus norvegicus
ttgacagaaattcccttccagtacc

SEQ ID NO: 675894 - DNA, 25 bp, Rattus norvegicus
ttgacagaaattgccttccagtacc

SEQ ID NO: 675895 - DNA, 25 bp, Rattus norvegicus
ttgacagaactgatttcctgccttc

SEQ ID NO: 675896 - DNA, 25 bp, Rattus norvegicus
ttgacagaactgttttcctgccttc

SEQ ID NO: 675897 - DNA, 25 bp, Rattus norvegicus
ttgacagaagagagcgaagacccta

SEQ ID NO: 675898 - DNA, 25 bp, Rattus norvegicus
ttgacagaagagtgcgaagacccta

SEQ ID NO: 675899 - DNA, 25 bp, Rattus norvegicus
ttgacagacatgcttccttgggctg

SEQ ID NO: 675900 - DNA, 25 bp, Rattus norvegicus
ttgacagacatggttccttgggctg

SEQ ID NO: 675901 - DNA, 25 bp, Rattus norvegicus
ttgacagactctatccactaacagc

SEQ ID NO: 675902 - DNA, 25 bp, Rattus norvegicus
ttgacagactctttccactaacagc

SEQ ID NO: 675903 - DNA, 25 bp, Rattus norvegicus
ttgacagagcgtacagacccagagt

SEQ ID NO: 675904 - DNA, 25 bp, Rattus norvegicus
ttgacagagcgttcagacccagagt

SEQ ID NO: 675905 - DNA, 25 bp, Rattus norvegicus
ttgacagcaagtcccaccacggtta

SEQ ID NO: 675906 - DNA, 25 bp, Rattus norvegicus
ttgacagcaagtgccaccacggtta

SEQ ID NO: 675907 - DNA, 25 bp, Rattus norvegicus
ttgacagccacaagcagaggtccat

SEQ ID NO: 675908 - DNA, 25 bp, Rattus norvegicus
ttgacagccacatgcagaggtccat

SEQ ID NO: 675909 - DNA, 25 bp, Rattus norvegicus
ttgacagcgctacatctccagacct

SEQ ID NO: 675910 - DNA, 25 bp, Rattus norvegicus
ttgacagcgctagatctccagacct

SEQ ID NO: 675911 - DNA, 25 bp, Rattus norvegicus
ttgacagctgtcaggagccattcct

SEQ ID NO: 675912 - DNA, 25 bp, Rattus norvegicus
ttgacagctgtctggagccattcct

SEQ ID NO: 675913 - DNA, 25 bp, Rattus norvegicus
ttgacagctgttatggtctcacctc

SEQ ID NO: 675914 - DNA, 25 bp, Rattus norvegicus
ttgacagctgttttggtctcacctc

SEQ ID NO: 675915 - DNA, 25 bp, Rattus norvegicus
ttgacagcttgtcccaagtctagat

SEQ ID NO: 675916 - DNA, 25 bp, Rattus norvegicus
ttgacagcttgtgccaagtctagat

SEQ ID NO: 675917 - DNA, 25 bp, Rattus norvegicus
ttgacaggtgtcatcccatttggac

SEQ ID NO: 675918 - DNA, 25 bp, Rattus norvegicus
ttgacaggtgtcttcccatttggac

SEQ ID NO: 675919 - DNA, 25 bp, Rattus norvegicus
ttgacagtaaacactcgcctatggc

SEQ ID NO: 675920 - DNA, 25 bp, Rattus norvegicus
ttgacagtaaactctcgcctatggc

SEQ ID NO: 675921 - DNA, 25 bp, Rattus norvegicus
ttgacagtacatcacattctcctca

SEQ ID NO: 675922 - DNA, 25 bp, Rattus norvegicus
ttgacagtacatgacattctcctca

SEQ ID NO: 675923 - DNA, 25 bp, Rattus norvegicus
ttgacagtccttcctgtggaatgct

SEQ ID NO: 675924 - DNA, 25 bp, Rattus norvegicus
ttgacagtccttgctgtggaatgct

SEQ ID NO: 675925 - DNA, 25 bp, Rattus norvegicus
ttgacagtctgcagcatgcttgcaa

SEQ ID NO: 675926 - DNA, 25 bp, Rattus norvegicus
ttgacagtctgctgcatgcttgcaa

SEQ ID NO: 675927 - DNA, 25 bp, Rattus norvegicus
ttgacagtctggctgagctctgcct

SEQ ID NO: 675928 - DNA, 25 bp, Rattus norvegicus
ttgacagtctgggtgagctctgcct

SEQ ID NO: 675929 - DNA, 25 bp, Rattus norvegicus
ttgacagtgagtccagtcccatcct

SEQ ID NO: 675930 - DNA, 25 bp, Rattus norvegicus
ttgacagtgagtgcagtcccatcct

SEQ ID NO: 675931 - DNA, 25 bp, Rattus norvegicus
ttgacagtgcaaccccttagactag

SEQ ID NO: 675932 - DNA, 25 bp, Rattus norvegicus
ttgacagtgcaagcccttagactag

SEQ ID NO: 675933 - DNA, 25 bp, Rattus norvegicus
ttgacagtgcccacttgcaacgtgc

SEQ ID NO: 675934 - DNA, 25 bp, Rattus norvegicus
ttgacagtgccctcttgcaacgtgc

SEQ ID NO: 675935 - DNA, 25 bp, Rattus norvegicus
ttgacagtgctacttaaggccccac

SEQ ID NO: 675936 - DNA, 25 bp, Rattus norvegicus
ttgacagtgctagttaaggccccac

SEQ ID NO: 675937 - DNA, 25 bp, Rattus norvegicus
ttgacagtgctgaccggaacctttc

SEQ ID NO: 675938 - DNA, 25 bp, Rattus norvegicus
ttgacagtgctgtccggaacctttc

SEQ ID NO: 675939 - DNA, 25 bp, Rattus norvegicus
ttgacagttcaacgctttgcagaca

SEQ ID NO: 675940 - DNA, 25 bp, Rattus norvegicus
ttgacagttcaaggctttgcagaca

SEQ ID NO: 675941 - DNA, 25 bp, Rattus norvegicus
ttgacataaggtaggctggtttttt

SEQ ID NO: 675942 - DNA, 25 bp, Rattus norvegicus
ttgacataaggttggctggtttttt

SEQ ID NO: 675943 - DNA, 25 bp, Rattus norvegicus
ttgacataccccatcgtttgttttg

SEQ ID NO: 675944 - DNA, 25 bp, Rattus norvegicus
ttgacataccccttcgtttgttttg

SEQ ID NO: 675945 - DNA, 25 bp, Rattus norvegicus
ttgacatcagctcactacatgtata

SEQ ID NO: 675946 - DNA, 25 bp, Rattus norvegicus
ttgacatcagctgactacatgtata

SEQ ID NO: 675947 - DNA, 25 bp, Rattus norvegicus
ttgacatccataacaccaagaagtg

SEQ ID NO: 675948 - DNA, 25 bp, Rattus norvegicus
ttgacatccatatcaccaagaagtg

SEQ ID NO: 675949 - DNA, 25 bp, Rattus norvegicus
ttgacatcgggtactctcgtttaac

SEQ ID NO: 675950 - DNA, 25 bp, Rattus norvegicus
ttgacatcgggttctctcgtttaac

SEQ ID NO: 675951 - DNA, 25 bp, Rattus norvegicus
ttgacatctgccatgcctaatttgt

SEQ ID NO: 675952 - DNA, 25 bp, Rattus norvegicus
ttgacatctgccttgcctaatttgt

SEQ ID NO: 675953 - DNA, 25 bp, Rattus norvegicus
ttgacatgcactaagaccaggccat

SEQ ID NO: 675954 - DNA, 25 bp, Rattus norvegicus
ttgacatgcacttagaccaggccat

SEQ ID NO: 675955 - DNA, 25 bp, Rattus norvegicus
ttgacatgtatgactcagcccttgc

SEQ ID NO: 675956 - DNA, 25 bp, Rattus norvegicus
ttgacatgtatgtctcagcccttgc

SEQ ID NO: 675957 - DNA, 25 bp, Rattus norvegicus
ttgacatgtgtcaaaccctggctcc

SEQ ID NO: 675958 - DNA, 25 bp, Rattus norvegicus
ttgacatgtgtctaaccctggctcc

SEQ ID NO: 675959 - DNA, 25 bp, Rattus norvegicus
ttgacattaaatactcctcttccac

SEQ ID NO: 675960 - DNA, 25 bp, Rattus norvegicus
ttgacattaaattctcctcttccac

SEQ ID NO: 675961 - DNA, 25 bp, Rattus norvegicus
ttgacattcattaacagacaccgga

SEQ ID NO: 675962 - DNA, 25 bp, Rattus norvegicus
ttgacattcatttacagacaccgga

SEQ ID NO: 675963 - DNA, 25 bp, Rattus norvegicus
ttgacattctttcctggaccgggag

SEQ ID NO: 675964 - DNA, 25 bp, Rattus norvegicus
ttgacattctttgctggaccgggag

SEQ ID NO: 675965 - DNA, 25 bp, Rattus norvegicus
ttgacattgattagccctttcctga

SEQ ID NO: 675966 - DNA, 25 bp, Rattus norvegicus
ttgacattgatttgccctttcctga

SEQ ID NO: 675967 - DNA, 25 bp, Rattus norvegicus
ttgacattggtcctgtgcctgagag

SEQ ID NO: 675968 - DNA, 25 bp, Rattus norvegicus
ttgacattggtcgtgtgcctgagag

SEQ ID NO: 675969 - DNA, 25 bp, Rattus norvegicus
ttgacattgtagcagctccctgagg

SEQ ID NO: 675970 - DNA, 25 bp, Rattus norvegicus
ttgacattgtaggagctccctgagg

SEQ ID NO: 675971 - DNA, 25 bp, Rattus norvegicus
ttgacatttaatcccagccacagag

SEQ ID NO: 675972 - DNA, 25 bp, Rattus norvegicus
ttgacatttaatgccagccacagag

SEQ ID NO: 675973 - DNA, 25 bp, Rattus norvegicus
ttgacatttactctgcagttcaccc

SEQ ID NO: 675974 - DNA, 25 bp, Rattus norvegicus
ttgacatttactgtgcagttcaccc

SEQ ID NO: 675975 - DNA, 25 bp, Rattus norvegicus
ttgacatttagtacacaccctattt

SEQ ID NO: 675976 - DNA, 25 bp, Rattus norvegicus
ttgacatttagttcacaccctattt

SEQ ID NO: 675977 - DNA, 25 bp, Rattus norvegicus
ttgaccaaaggacaaccctgcctct

SEQ ID NO: 675978 - DNA, 25 bp, Rattus norvegicus
ttgaccaaaggagaaccctgcctct

SEQ ID NO: 675979 - DNA, 25 bp, Rattus norvegicus
ttgaccaaaggcatcgtttctcgag

SEQ ID NO: 675980 - DNA, 25 bp, Rattus norvegicus
ttgaccaaaggcttcgtttctcgag

SEQ ID NO: 675981 - DNA, 25 bp, Rattus norvegicus
ttgaccaacatgatcccagctgaac

SEQ ID NO: 675982 - DNA, 25 bp, Rattus norvegicus
ttgaccaacatgttcccagctgaac

SEQ ID NO: 675983 - DNA, 25 bp, Rattus norvegicus
ttgaccaactacaacttccacaaca

SEQ ID NO: 675984 - DNA, 25 bp, Rattus norvegicus
ttgaccaactactacttccacaaca

SEQ ID NO: 675985 - DNA, 25 bp, Rattus norvegicus
ttgaccaactgtactgccaaggaca

SEQ ID NO: 675986 - DNA, 25 bp, Rattus norvegicus
ttgaccaactgttctgccaaggaca

SEQ ID NO: 675987 - DNA, 25 bp, Rattus norvegicus
ttgaccaagcccaaagaggcaccag

SEQ ID NO: 675988 - DNA, 25 bp, Rattus norvegicus
ttgaccaagccctaagaggcaccag

SEQ ID NO: 675989 - DNA, 25 bp, Rattus norvegicus
ttgaccacacttctatgctgtaacc

SEQ ID NO: 675990 - DNA, 25 bp, Rattus norvegicus
ttgaccacacttgtatgctgtaacc

SEQ ID NO: 675991 - DNA, 25 bp, Rattus norvegicus
ttgaccacagccagcacaaagacct

SEQ ID NO: 675992 - DNA, 25 bp, Rattus norvegicus
ttgaccacagcctgcacaaagacct

SEQ ID NO: 675993 - DNA, 25 bp, Rattus norvegicus
ttgaccacagctccagaagttgtct

SEQ ID NO: 675994 - DNA, 25 bp, Rattus norvegicus
ttgaccacagctgcagaagttgtct

SEQ ID NO: 675995 - DNA, 25 bp, Rattus norvegicus
ttgaccacataacgcattctacagt

SEQ ID NO: 675996 - DNA, 25 bp, Rattus norvegicus
ttgaccacataaggcattctacagt

SEQ ID NO: 675997 - DNA, 25 bp, Rattus norvegicus
ttgaccacatccagccatggacagt

SEQ ID NO: 675998 - DNA, 25 bp, Rattus norvegicus
ttgaccacatcctgccatggacagt

SEQ ID NO: 675999 - DNA, 25 bp, Rattus norvegicus
ttgaccaccccaagaggcagcatat

SEQ ID NO: 676000 - DNA, 25 bp, Rattus norvegicus
ttgaccaccccatgaggcagcatat

SEQ ID NO: 676001 - DNA, 25 bp, Rattus norvegicus
ttgaccacctgacaccatgcatggc

SEQ ID NO: 676002 - DNA, 25 bp, Rattus norvegicus
ttgaccacctgagaccatgcatggc

SEQ ID NO: 676003 - DNA, 25 bp, Rattus norvegicus
ttgaccaccttgcttcatgatttga

SEQ ID NO: 676004 - DNA, 25 bp, Rattus norvegicus
ttgaccaccttggttcatgatttga

SEQ ID NO: 676005 - DNA, 25 bp, Rattus norvegicus
ttgaccacctttcattccattgatt

SEQ ID NO: 676006 - DNA, 25 bp, Rattus norvegicus
ttgaccacctttgattccattgatt

SEQ ID NO: 676007 - DNA, 25 bp, Rattus norvegicus
ttgaccacgtgtcggtgctgttgca

SEQ ID NO: 676008 - DNA, 25 bp, Rattus norvegicus
ttgaccacgtgtgggtgctgttgca

SEQ ID NO: 676009 - DNA, 25 bp, Rattus norvegicus
ttgaccagaacaaccgtgagcacgc

SEQ ID NO: 676010 - DNA, 25 bp, Rattus norvegicus
ttgaccagaacatccgtgagcacgc

SEQ ID NO: 676011 - DNA, 25 bp, Rattus norvegicus
ttgaccagacagagggcgtccagct

SEQ ID NO: 676012 - DNA, 25 bp, Rattus norvegicus
ttgaccagacagtgggcgtccagct

SEQ ID NO: 676013 - DNA, 25 bp, Rattus norvegicus
ttgaccagagagacagcttccttcc

SEQ ID NO: 676014 - DNA, 25 bp, Rattus norvegicus
ttgaccagagagtcagcttccttcc

SEQ ID NO: 676015 - DNA, 25 bp, Rattus norvegicus
ttgaccagcaagaggcagtttgctt

SEQ ID NO: 676016 - DNA, 25 bp, Rattus norvegicus
ttgaccagcaagtggcagtttgctt

SEQ ID NO: 676017 - DNA, 25 bp, Rattus norvegicus
ttgaccagctccaccaggataaaat

SEQ ID NO: 676018 - DNA, 25 bp, Rattus norvegicus
ttgaccagctcctccaggataaaat

SEQ ID NO: 676019 - DNA, 25 bp, Rattus norvegicus
ttgaccagctctcaggaatccttta

SEQ ID NO: 676020 - DNA, 25 bp, Rattus norvegicus
ttgaccagctctgaggaatccttta

SEQ ID NO: 676021 - DNA, 25 bp, Rattus norvegicus
ttgaccaggcctccaagaagaatct

SEQ ID NO: 676022 - DNA, 25 bp, Rattus norvegicus
ttgaccaggcctgcaagaagaatct

SEQ ID NO: 676023 - DNA, 25 bp, Rattus norvegicus
ttgaccagtcatccctgtgtgcata

SEQ ID NO: 676024 - DNA, 25 bp, Rattus norvegicus
ttgaccagtcatgcctgtgtgcata

SEQ ID NO: 676025 - DNA, 25 bp, Rattus norvegicus
ttgaccagtgccaccaggacaggaa

SEQ ID NO: 676026 - DNA, 25 bp, Rattus norvegicus
ttgaccagtgcctccaggacaggaa

SEQ ID NO: 676027 - DNA, 25 bp, Rattus norvegicus
ttgaccatccctcggcgggtgctta

SEQ ID NO: 676028 - DNA, 25 bp, Rattus norvegicus
ttgaccatccctgggcgggtgctta

SEQ ID NO: 676029 - DNA, 25 bp, Rattus norvegicus
ttgaccatcggacagtggaggattt

SEQ ID NO: 676030 - DNA, 25 bp, Rattus norvegicus
ttgaccatcggagagtggaggattt

SEQ ID NO: 676031 - DNA, 25 bp, Rattus norvegicus
ttgaccatctgcattcctgaatacc

SEQ ID NO: 676032 - DNA, 25 bp, Rattus norvegicus
ttgaccatctgctttcctgaatacc

SEQ ID NO: 676033 - DNA, 25 bp, Rattus norvegicus
ttgaccatggtcatgcgtactcacc

SEQ ID NO: 676034 - DNA, 25 bp, Rattus norvegicus
ttgaccatggtcttgcgtactcacc

SEQ ID NO: 676035 - DNA, 25 bp, Rattus norvegicus
ttgaccattgatatctacacgtaca

SEQ ID NO: 676036 - DNA, 25 bp, Rattus norvegicus
ttgaccattgatttctacacgtaca

SEQ ID NO: 676037 - DNA, 25 bp, Rattus norvegicus
ttgacccaaagacccacatatgttt

SEQ ID NO: 676038 - DNA, 25 bp, Rattus norvegicus
ttgacccaaagagccacatatgttt

SEQ ID NO: 676039 - DNA, 25 bp, Rattus norvegicus
ttgacccaagtcactggtgtgctct

SEQ ID NO: 676040 - DNA, 25 bp, Rattus norvegicus
ttgacccaagtctctggtgtgctct

SEQ ID NO: 676041 - DNA, 25 bp, Rattus norvegicus
ttgacccaatggatccccaaagttg

SEQ ID NO: 676042 - DNA, 25 bp, Rattus norvegicus
ttgacccaatggttccccaaagttg

SEQ ID NO: 676043 - DNA, 25 bp, Rattus norvegicus
ttgacccaccttagaacttaagctc

SEQ ID NO: 676044 - DNA, 25 bp, Rattus norvegicus
ttgacccacctttgaacttaagctc

SEQ ID NO: 676045 - DNA, 25 bp, Rattus norvegicus
ttgacccactcaaagctaacttgaa

SEQ ID NO: 676046 - DNA, 25 bp, Rattus norvegicus
ttgacccactcatagctaacttgaa

SEQ ID NO: 676047 - DNA, 25 bp, Rattus norvegicus
ttgacccagcacagtggaagctctt

SEQ ID NO: 676048 - DNA, 25 bp, Rattus norvegicus
ttgacccagcactgtggaagctctt

SEQ ID NO: 676049 - DNA, 25 bp, Rattus norvegicus
ttgacccagtgtagattaacccagg

SEQ ID NO: 676050 - DNA, 25 bp, Rattus norvegicus
ttgacccagtgttgattaacccagg

SEQ ID NO: 676051 - DNA, 25 bp, Rattus norvegicus
ttgacccataacatgctctccattt

SEQ ID NO: 676052 - DNA, 25 bp, Rattus norvegicus
ttgacccataacttgctctccattt

SEQ ID NO: 676053 - DNA, 25 bp, Rattus norvegicus
ttgaccccaacgcacaaggcacagt

SEQ ID NO: 676054 - DNA, 25 bp, Rattus norvegicus
ttgaccccaacggacaaggcacagt

SEQ ID NO: 676055 - DNA, 25 bp, Rattus norvegicus
ttgaccccaatcactcccatatttt

SEQ ID NO: 676056 - DNA, 25 bp, Rattus norvegicus
ttgaccccaatctctcccatatttt

SEQ ID NO: 676057 - DNA, 25 bp, Rattus norvegicus
ttgaccccaggtcttaagtctgttg

SEQ ID NO: 676058 - DNA, 25 bp, Rattus norvegicus
ttgaccccaggtgttaagtctgttg

SEQ ID NO: 676059 - DNA, 25 bp, Rattus norvegicus
ttgacccgagcccagttgataacag

SEQ ID NO: 676060 - DNA, 25 bp, Rattus norvegicus
ttgacccgagccgagttgataacag

SEQ ID NO: 676061 - DNA, 25 bp, Rattus norvegicus
ttgacccgttctaccgttatgaaat

SEQ ID NO: 676062 - DNA, 25 bp, Rattus norvegicus
ttgacccgttcttccgttatgaaat

SEQ ID NO: 676063 - DNA, 25 bp, Rattus norvegicus
ttgaccctaacgaaagacctgtgag

SEQ ID NO: 676064 - DNA, 25 bp, Rattus norvegicus
ttgaccctaacgtaagacctgtgag

SEQ ID NO: 676065 - DNA, 25 bp, Rattus norvegicus
ttgaccctactccaatttacagctc

SEQ ID NO: 676066 - DNA, 25 bp, Rattus norvegicus
ttgaccctactcgaatttacagctc

SEQ ID NO: 676067 - DNA, 25 bp, Rattus norvegicus
ttgaccctagatcctagttccagac

SEQ ID NO: 676068 - DNA, 25 bp, Rattus norvegicus
ttgaccctagatgctagttccagac

SEQ ID NO: 676069 - DNA, 25 bp, Rattus norvegicus
ttgaccctcgcaaacggaagttctc

SEQ ID NO: 676070 - DNA, 25 bp, Rattus norvegicus
ttgaccctcgcatacggaagttctc

SEQ ID NO: 676071 - DNA, 25 bp, Rattus norvegicus
ttgaccctgcatagggataaatgaa

SEQ ID NO: 676072 - DNA, 25 bp, Rattus norvegicus
ttgaccctgcattgggataaatgaa

SEQ ID NO: 676073 - DNA, 25 bp, Rattus norvegicus
ttgaccctgctaagcctgtttcctt

SEQ ID NO: 676074 - DNA, 25 bp, Rattus norvegicus
ttgaccctgctatgcctgtttcctt

SEQ ID NO: 676075 - DNA, 25 bp, Rattus norvegicus
ttgaccctgtagcacattcccatga

SEQ ID NO: 676076 - DNA, 25 bp, Rattus norvegicus
ttgaccctgtaggacattcccatga

SEQ ID NO: 676077 - DNA, 25 bp, Rattus norvegicus
ttgaccctgtcaacagaccatcagc

SEQ ID NO: 676078 - DNA, 25 bp, Rattus norvegicus
ttgaccctgtcaatcttcactactt

SEQ ID NO: 676079 - DNA, 25 bp, Rattus norvegicus
ttgaccctgtcatcagaccatcagc

SEQ ID NO: 676080 - DNA, 25 bp, Rattus norvegicus
ttgaccctgtcattcttcactactt

SEQ ID NO: 676081 - DNA, 25 bp, Rattus norvegicus
ttgacccttgatagcttcagggctg

SEQ ID NO: 676082 - DNA, 25 bp, Rattus norvegicus
ttgacccttgattgcttcagggctg

SEQ ID NO: 676083 - DNA, 25 bp, Rattus norvegicus
ttgacccttggacaccatgtggcat

SEQ ID NO: 676084 - DNA, 25 bp, Rattus norvegicus
ttgacccttggagaccatgtggcat

SEQ ID NO: 676085 - DNA, 25 bp, Rattus norvegicus
ttgacccttgtcacggttcctccaa

SEQ ID NO: 676086 - DNA, 25 bp, Rattus norvegicus
ttgacccttgtctcggttcctccaa

SEQ ID NO: 676087 - DNA, 25 bp, Rattus norvegicus
ttgaccgaaaccactgaacccatga

SEQ ID NO: 676088 - DNA, 25 bp, Rattus norvegicus
ttgaccgaaacctctgaacccatga

SEQ ID NO: 676089 - DNA, 25 bp, Rattus norvegicus
ttgaccgaaagcatctatttactta

SEQ ID NO: 676090 - DNA, 25 bp, Rattus norvegicus
ttgaccgaaagcttctatttactta

SEQ ID NO: 676091 - DNA, 25 bp, Rattus norvegicus
ttgaccgaacaacagcgctccgaaa

SEQ ID NO: 676092 - DNA, 25 bp, Rattus norvegicus
ttgaccgaacaagagcgctccgaaa

SEQ ID NO: 676093 - DNA, 25 bp, Rattus norvegicus
ttgaccgagcaaccatgcacgttac

SEQ ID NO: 676094 - DNA, 25 bp, Rattus norvegicus
ttgaccgagcaagcatgcacgttac

SEQ ID NO: 676095 - DNA, 25 bp, Rattus norvegicus
ttgaccgatactacacaccaactat

SEQ ID NO: 676096 - DNA, 25 bp, Rattus norvegicus
ttgaccgatacttcacaccaactat

SEQ ID NO: 676097 - DNA, 25 bp, Rattus norvegicus
ttgaccgattgtccctagatattga

SEQ ID NO: 676098 - DNA, 25 bp, Rattus norvegicus
ttgaccgattgtgcctagatattga

SEQ ID NO: 676099 - DNA, 25 bp, Rattus norvegicus
ttgaccgcgtttactcacagcagca

SEQ ID NO: 676100 - DNA, 25 bp, Rattus norvegicus
ttgaccgcgttttctcacagcagca

SEQ ID NO: 676101 - DNA, 25 bp, Rattus norvegicus
ttgaccgctatgaattccggagccg

SEQ ID NO: 676102 - DNA, 25 bp, Rattus norvegicus
ttgaccgctatgtattccggagccg

SEQ ID NO: 676103 - DNA, 25 bp, Rattus norvegicus
ttgaccggaaccacatagactattt

SEQ ID NO: 676104 - DNA, 25 bp, Rattus norvegicus
ttgaccggaacctcatagactattt

SEQ ID NO: 676105 - DNA, 25 bp, Rattus norvegicus
ttgaccgggagcaggcttacagtgt

SEQ ID NO: 676106 - DNA, 25 bp, Rattus norvegicus
ttgaccgggagctggcttacagtgt

SEQ ID NO: 676107 - DNA, 25 bp, Rattus norvegicus
ttgaccgtatgaaaaatctgaagtg

SEQ ID NO: 676108 - DNA, 25 bp, Rattus norvegicus
ttgaccgtatgataaatctgaagtg

SEQ ID NO: 676109 - DNA, 25 bp, Rattus norvegicus
ttgaccgtctcacagtgcacatgtg

SEQ ID NO: 676110 - DNA, 25 bp, Rattus norvegicus
ttgaccgtctcagagtgcacatgtg

SEQ ID NO: 676111 - DNA, 25 bp, Rattus norvegicus
ttgacctacgtaaccttttcctcag

SEQ ID NO: 676112 - DNA, 25 bp, Rattus norvegicus
ttgacctacgtatccttttcctcag

SEQ ID NO: 676113 - DNA, 25 bp, Rattus norvegicus
ttgacctactaaaccatacccctgc

SEQ ID NO: 676114 - DNA, 25 bp, Rattus norvegicus
ttgacctactaatccatacccctgc

SEQ ID NO: 676115 - DNA, 25 bp, Rattus norvegicus
ttgacctaggctcgctctggataga

SEQ ID NO: 676116 - DNA, 25 bp, Rattus norvegicus
ttgacctaggctggctctggataga

SEQ ID NO: 676117 - DNA, 25 bp, Rattus norvegicus
ttgacctatgatcatgtacatgtga

SEQ ID NO: 676118 - DNA, 25 bp, Rattus norvegicus
ttgacctatgatgatgtacatgtga

SEQ ID NO: 676119 - DNA, 25 bp, Rattus norvegicus
ttgacctcagttagaagggcccaac

SEQ ID NO: 676120 - DNA, 25 bp, Rattus norvegicus
ttgacctcagtttgaagggcccaac

SEQ ID NO: 676121 - DNA, 25 bp, Rattus norvegicus
ttgacctccaagagtccacaggcat

SEQ ID NO: 676122 - DNA, 25 bp, Rattus norvegicus
ttgacctccaagtgtccacaggcat

SEQ ID NO: 676123 - DNA, 25 bp, Rattus norvegicus
ttgacctccaggcatgtgcagttct

SEQ ID NO: 676124 - DNA, 25 bp, Rattus norvegicus
ttgacctccagggatgtgcagttct

SEQ ID NO: 676125 - DNA, 25 bp, Rattus norvegicus
ttgacctccggaaaagcgaggcgcc

SEQ ID NO: 676126 - DNA, 25 bp, Rattus norvegicus
ttgacctccggataagcgaggcgcc

SEQ ID NO: 676127 - DNA, 25 bp, Rattus norvegicus
ttgacctcctacactggatgatgag

SEQ ID NO: 676128 - DNA, 25 bp, Rattus norvegicus
ttgacctcctactctggatgatgag

SEQ ID NO: 676129 - DNA, 25 bp, Rattus norvegicus
ttgacctcctctccaggagtgtgga

SEQ ID NO: 676130 - DNA, 25 bp, Rattus norvegicus
ttgacctcctctgcaggagtgtgga

SEQ ID NO: 676131 - DNA, 25 bp, Rattus norvegicus
ttgacctcctgtaggctgtgtctct

SEQ ID NO: 676132 - DNA, 25 bp, Rattus norvegicus
ttgacctcctgttggctgtgtctct

SEQ ID NO: 676133 - DNA, 25 bp, Rattus norvegicus
ttgacctctcacagtcacaggtact

SEQ ID NO: 676134 - DNA, 25 bp, Rattus norvegicus
ttgacctctcactgtcacaggtact

SEQ ID NO: 676135 - DNA, 25 bp, Rattus norvegicus
ttgacctctcggactgtgctgatct

SEQ ID NO: 676136 - DNA, 25 bp, Rattus norvegicus
ttgacctctcggtctgtgctgatct

SEQ ID NO: 676137 - DNA, 25 bp, Rattus norvegicus
ttgacctctgtaagggcactcggac

SEQ ID NO: 676138 - DNA, 25 bp, Rattus norvegicus
ttgacctctgtaccagctgtatgtg

SEQ ID NO: 676139 - DNA, 25 bp, Rattus norvegicus
ttgacctctgtagcagctgtatgtg

SEQ ID NO: 676140 - DNA, 25 bp, Rattus norvegicus
ttgacctctgtatgggcactcggac

SEQ ID NO: 676141 - DNA, 25 bp, Rattus norvegicus
ttgacctctgtgaccaaccgttgga

SEQ ID NO: 676142 - DNA, 25 bp, Rattus norvegicus
ttgacctctgtgtccaaccgttgga

SEQ ID NO: 676143 - DNA, 25 bp, Rattus norvegicus
ttgacctcttgccttgtttagcaca

SEQ ID NO: 676144 - DNA, 25 bp, Rattus norvegicus
ttgacctcttgcgttgtttagcaca

SEQ ID NO: 676145 - DNA, 25 bp, Rattus norvegicus
ttgacctgaacaagggagttccgct

SEQ ID NO: 676146 - DNA, 25 bp, Rattus norvegicus
ttgacctgaacatgggagttccgct

SEQ ID NO: 676147 - DNA, 25 bp, Rattus norvegicus
ttgacctgacttaatagagcggctt

SEQ ID NO: 676148 - DNA, 25 bp, Rattus norvegicus
ttgacctgactttatagagcggctt

SEQ ID NO: 676149 - DNA, 25 bp, Rattus norvegicus
ttgacctgatatattctgcatggat

SEQ ID NO: 676150 - DNA, 25 bp, Rattus norvegicus
ttgacctgatattttctgcatggat

SEQ ID NO: 676151 - DNA, 25 bp, Rattus norvegicus
ttgacctgatccacacttgtgaaga

SEQ ID NO: 676152 - DNA, 25 bp, Rattus norvegicus
ttgacctgatcctcacttgtgaaga

SEQ ID NO: 676153 - DNA, 25 bp, Rattus norvegicus
ttgacctgcccaattgggcttttta

SEQ ID NO: 676154 - DNA, 25 bp, Rattus norvegicus
ttgacctgcccatttgggcttttta

SEQ ID NO: 676155 - DNA, 25 bp, Rattus norvegicus
ttgacctgccttcgcctatgaacaa

SEQ ID NO: 676156 - DNA, 25 bp, Rattus norvegicus
ttgacctgccttggcctatgaacaa

SEQ ID NO: 676157 - DNA, 25 bp, Rattus norvegicus
ttgacctgctccctggatccacagg

SEQ ID NO: 676158 - DNA, 25 bp, Rattus norvegicus
ttgacctgctccgtggatccacagg

SEQ ID NO: 676159 - DNA, 25 bp, Rattus norvegicus
ttgacctggaggatcccatgtggcc

SEQ ID NO: 676160 - DNA, 25 bp, Rattus norvegicus
ttgacctggaggttcccatgtggcc

SEQ ID NO: 676161 - DNA, 25 bp, Rattus norvegicus
ttgacctggatccaaagccggaagt

SEQ ID NO: 676162 - DNA, 25 bp, Rattus norvegicus
ttgacctggatcgaaagccggaagt

SEQ ID NO: 676163 - DNA, 25 bp, Rattus norvegicus
ttgacctggatgatttcacaccgca

SEQ ID NO: 676164 - DNA, 25 bp, Rattus norvegicus
ttgacctggatgttttcacaccgca

SEQ ID NO: 676165 - DNA, 25 bp, Rattus norvegicus
ttgacctgggacatgcgctgcgctg

SEQ ID NO: 676166 - DNA, 25 bp, Rattus norvegicus
ttgacctgggacttgcgctgcgctg

SEQ ID NO: 676167 - DNA, 25 bp, Rattus norvegicus
ttgacctgggtgctgttggtcccac

SEQ ID NO: 676168 - DNA, 25 bp, Rattus norvegicus
ttgacctgggtggtgttggtcccac

SEQ ID NO: 676169 - DNA, 25 bp, Rattus norvegicus
ttgacctgtgtgcacggttgcagtc

SEQ ID NO: 676170 - DNA, 25 bp, Rattus norvegicus
ttgacctgtgtggacggttgcagtc

SEQ ID NO: 676171 - DNA, 25 bp, Rattus norvegicus
ttgacctgttctcttgccagtgaca

SEQ ID NO: 676172 - DNA, 25 bp, Rattus norvegicus
ttgacctgttctgttgccagtgaca

SEQ ID NO: 676173 - DNA, 25 bp, Rattus norvegicus
ttgaccttagccagtccagataaag

SEQ ID NO: 676174 - DNA, 25 bp, Rattus norvegicus
ttgaccttagcctgtccagataaag

SEQ ID NO: 676175 - DNA, 25 bp, Rattus norvegicus
ttgaccttaggccatctgtatgcaa

SEQ ID NO: 676176 - DNA, 25 bp, Rattus norvegicus
ttgaccttaggcgatctgtatgcaa

SEQ ID NO: 676177 - DNA, 25 bp, Rattus norvegicus
ttgaccttatgtcgcaccccagaac

SEQ ID NO: 676178 - DNA, 25 bp, Rattus norvegicus
ttgaccttatgtggcaccccagaac

SEQ ID NO: 676179 - DNA, 25 bp, Rattus norvegicus
ttgaccttcaggagaagctgggcat

SEQ ID NO: 676180 - DNA, 25 bp, Rattus norvegicus
ttgaccttcaggcagtacgtgtact

SEQ ID NO: 676181 - DNA, 25 bp, Rattus norvegicus
ttgaccttcagggagtacgtgtact

SEQ ID NO: 676182 - DNA, 25 bp, Rattus norvegicus
ttgaccttcaggtgaagctgggcat

SEQ ID NO: 676183 - DNA, 25 bp, Rattus norvegicus
ttgaccttgaccataatgatctccc

SEQ ID NO: 676184 - DNA, 25 bp, Rattus norvegicus
ttgaccttgaccttaatgatctccc

SEQ ID NO: 676185 - DNA, 25 bp, Rattus norvegicus
ttgaccttgaggaactttcttccca

SEQ ID NO: 676186 - DNA, 25 bp, Rattus norvegicus
ttgaccttgaggtactttcttccca

SEQ ID NO: 676187 - DNA, 25 bp, Rattus norvegicus
ttgaccttggccatactgtaaacag

SEQ ID NO: 676188 - DNA, 25 bp, Rattus norvegicus
ttgaccttggccttactgtaaacag

SEQ ID NO: 676189 - DNA, 25 bp, Rattus norvegicus
ttgaccttgtctagttttggaacga

SEQ ID NO: 676190 - DNA, 25 bp, Rattus norvegicus
ttgaccttgtcttgttttggaacga

SEQ ID NO: 676191 - DNA, 25 bp, Rattus norvegicus
ttgacctttatcacacagtgatccg

SEQ ID NO: 676192 - DNA, 25 bp, Rattus norvegicus
ttgacctttatctcacagtgatccg

SEQ ID NO: 676193 - DNA, 25 bp, Rattus norvegicus
ttgacctttcttaagagctggccca

SEQ ID NO: 676194 - DNA, 25 bp, Rattus norvegicus
ttgacctttctttagagctggccca

SEQ ID NO: 676195 - DNA, 25 bp, Rattus norvegicus
ttgacctttgtcataaatcttcgca

SEQ ID NO: 676196 - DNA, 25 bp, Rattus norvegicus
ttgacctttgtcttaaatcttcgca

SEQ ID NO: 676197 - DNA, 25 bp, Rattus norvegicus
ttgacgacctccatgaactgtacat

SEQ ID NO: 676198 - DNA, 25 bp, Rattus norvegicus
ttgacgacctccttgaactgtacat

SEQ ID NO: 676199 - DNA, 25 bp, Rattus norvegicus
ttgacgaggcccacaagtatctgtc

SEQ ID NO: 676200 - DNA, 25 bp, Rattus norvegicus
ttgacgaggccctcaagtatctgtc

SEQ ID NO: 676201 - DNA, 25 bp, Rattus norvegicus
ttgacgagtgtgagaccggtatcca

SEQ ID NO: 676202 - DNA, 25 bp, Rattus norvegicus
ttgacgagtgtgtgaccggtatcca

SEQ ID NO: 676203 - DNA, 25 bp, Rattus norvegicus
ttgacgatttcaattggctagccca

SEQ ID NO: 676204 - DNA, 25 bp, Rattus norvegicus
ttgacgatttcatttggctagccca

SEQ ID NO: 676205 - DNA, 25 bp, Rattus norvegicus
ttgacgcaacagaccctaagacatg

SEQ ID NO: 676206 - DNA, 25 bp, Rattus norvegicus
ttgacgcaacagtccctaagacatg

SEQ ID NO: 676207 - DNA, 25 bp, Rattus norvegicus
ttgacgcacagtagactcacgcagg

SEQ ID NO: 676208 - DNA, 25 bp, Rattus norvegicus
ttgacgcacagttgactcacgcagg

SEQ ID NO: 676209 - DNA, 25 bp, Rattus norvegicus
ttgacgcaggtcattatttctataa

SEQ ID NO: 676210 - DNA, 25 bp, Rattus norvegicus
ttgacgcaggtctttatttctataa

SEQ ID NO: 676211 - DNA, 25 bp, Rattus norvegicus
ttgacgccgaagaggcccagcacct

SEQ ID NO: 676212 - DNA, 25 bp, Rattus norvegicus
ttgacgccgaagtggcccagcacct

SEQ ID NO: 676213 - DNA, 25 bp, Rattus norvegicus
ttgacgctatcgaggagggccccaa

SEQ ID NO: 676214 - DNA, 25 bp, Rattus norvegicus
ttgacgctatcgtggagggccccaa

SEQ ID NO: 676215 - DNA, 25 bp, Rattus norvegicus
ttgacgctcttcagggtggtgccca

SEQ ID NO: 676216 - DNA, 25 bp, Rattus norvegicus
ttgacgctcttctgggtggtgccca

SEQ ID NO: 676217 - DNA, 25 bp, Rattus norvegicus
ttgacgctgaggacaaggcccaaac

SEQ ID NO: 676218 - DNA, 25 bp, Rattus norvegicus
ttgacgctgaggtcaaggcccaaac

SEQ ID NO: 676219 - DNA, 25 bp, Rattus norvegicus
ttgacggacattagctctgccacgg

SEQ ID NO: 676220 - DNA, 25 bp, Rattus norvegicus
ttgacggacatttgctctgccacgg

SEQ ID NO: 676221 - DNA, 25 bp, Rattus norvegicus
ttgacggctccgatgcgacatcagg

SEQ ID NO: 676222 - DNA, 25 bp, Rattus norvegicus
ttgacggctccgttgcgacatcagg

SEQ ID NO: 676223 - DNA, 25 bp, Rattus norvegicus
ttgacggctgttacaggtctctcag

SEQ ID NO: 676224 - DNA, 25 bp, Rattus norvegicus
ttgacggctgtttcaggtctctcag

SEQ ID NO: 676225 - DNA, 25 bp, Rattus norvegicus
ttgacgtaaaacatgccagcacacc

SEQ ID NO: 676226 - DNA, 25 bp, Rattus norvegicus
ttgacgtaaaacttgccagcacacc

SEQ ID NO: 676227 - DNA, 25 bp, Rattus norvegicus
ttgacgtatgacaaatcccgactga

SEQ ID NO: 676228 - DNA, 25 bp, Rattus norvegicus
ttgacgtatgactaatcccgactga

SEQ ID NO: 676229 - DNA, 25 bp, Rattus norvegicus
ttgacgtcatgcagacacagcctgt

SEQ ID NO: 676230 - DNA, 25 bp, Rattus norvegicus
ttgacgtcatgctgacacagcctgt

SEQ ID NO: 676231 - DNA, 25 bp, Rattus norvegicus
ttgacgtcggaaagcttcgccagag

SEQ ID NO: 676232 - DNA, 25 bp, Rattus norvegicus
ttgacgtcggaatgcttcgccagag

SEQ ID NO: 676233 - DNA, 25 bp, Rattus norvegicus
ttgacgtgacacagatggcttcccc

SEQ ID NO: 676234 - DNA, 25 bp, Rattus norvegicus
ttgacgtgacactgatggcttcccc

SEQ ID NO: 676235 - DNA, 25 bp, Rattus norvegicus
ttgacgtgacgtcttacttgctgga

SEQ ID NO: 676236 - DNA, 25 bp, Rattus norvegicus
ttgacgtgacgtgttacttgctgga

SEQ ID NO: 676237 - DNA, 25 bp, Rattus norvegicus
ttgacgtggagtcgctgcactgtac

SEQ ID NO: 676238 - DNA, 25 bp, Rattus norvegicus
ttgacgtggagtggctgcactgtac

SEQ ID NO: 676239 - DNA, 25 bp, Rattus norvegicus
ttgacgtgtcctactgttctcagat

SEQ ID NO: 676240 - DNA, 25 bp, Rattus norvegicus
ttgacgtgtccttctgttctcagat

SEQ ID NO: 676241 - DNA, 25 bp, Rattus norvegicus
ttgacgtttggaagcttcttgtccc

SEQ ID NO: 676242 - DNA, 25 bp, Rattus norvegicus
ttgacgtttggatgcttcttgtccc

SEQ ID NO: 676243 - DNA, 25 bp, Rattus norvegicus
ttgacgtttttcagagccttttgcc

SEQ ID NO: 676244 - DNA, 25 bp, Rattus norvegicus
ttgacgtttttctgagccttttgcc

SEQ ID NO: 676245 - DNA, 25 bp, Rattus norvegicus
ttgactaaccagacactctggatgg

SEQ ID NO: 676246 - DNA, 25 bp, Rattus norvegicus
ttgactaaccagtcactctggatgg

SEQ ID NO: 676247 - DNA, 25 bp, Rattus norvegicus
ttgactacagcaatggacgggacat

SEQ ID NO: 676248 - DNA, 25 bp, Rattus norvegicus
ttgactacagcattggacgggacat

SEQ ID NO: 676249 - DNA, 25 bp, Rattus norvegicus
ttgactaccgtgcagaagggctatc

SEQ ID NO: 676250 - DNA, 25 bp, Rattus norvegicus
ttgactaccgtggagaagggctatc

SEQ ID NO: 676251 - DNA, 25 bp, Rattus norvegicus
ttgactacggtgcttcttgggaatt

SEQ ID NO: 676252 - DNA, 25 bp, Rattus norvegicus
ttgactacggtggttcttgggaatt

SEQ ID NO: 676253 - DNA, 25 bp, Rattus norvegicus
ttgactagtacccattaataaactg

SEQ ID NO: 676254 - DNA, 25 bp, Rattus norvegicus
ttgactagtaccgattaataaactg

SEQ ID NO: 676255 - DNA, 25 bp, Rattus norvegicus
ttgactatcatgaagagcctccacc

SEQ ID NO: 676256 - DNA, 25 bp, Rattus norvegicus
ttgactatcatgtagagcctccacc

SEQ ID NO: 676257 - DNA, 25 bp, Rattus norvegicus
ttgactatggaccttgtgacccacc

SEQ ID NO: 676258 - DNA, 25 bp, Rattus norvegicus
ttgactatggacgttgtgacccacc

SEQ ID NO: 676259 - DNA, 25 bp, Rattus norvegicus
ttgactattcacatggattccatct

SEQ ID NO: 676260 - DNA, 25 bp, Rattus norvegicus
ttgactattcacttggattccatct

SEQ ID NO: 676261 - DNA, 25 bp, Rattus norvegicus
ttgactcagagcacaggtccagcca

SEQ ID NO: 676262 - DNA, 25 bp, Rattus norvegicus
ttgactcagagcataggtcagtctt

SEQ ID NO: 676263 - DNA, 25 bp, Rattus norvegicus
ttgactcagagctcaggtccagcca

SEQ ID NO: 676264 - DNA, 25 bp, Rattus norvegicus
ttgactcagagcttaggtcagtctt

SEQ ID NO: 676265 - DNA, 25 bp, Rattus norvegicus
ttgactcagggcatgactttgtaga

SEQ ID NO: 676266 - DNA, 25 bp, Rattus norvegicus
ttgactcagggcttgactttgtaga

SEQ ID NO: 676267 - DNA, 25 bp, Rattus norvegicus
ttgactcagtcaactgtgcatcctg

SEQ ID NO: 676268 - DNA, 25 bp, Rattus norvegicus
ttgactcagtcatctgtgcatcctg

SEQ ID NO: 676269 - DNA, 25 bp, Rattus norvegicus
ttgactcatctcaaatccctgggca

SEQ ID NO: 676270 - DNA, 25 bp, Rattus norvegicus
ttgactcatctctaatccctgggca

SEQ ID NO: 676271 - DNA, 25 bp, Rattus norvegicus
ttgactcatgccaagcctgaagtgt

SEQ ID NO: 676272 - DNA, 25 bp, Rattus norvegicus
ttgactcatgcctagcctgaagtgt

SEQ ID NO: 676273 - DNA, 25 bp, Rattus norvegicus
ttgactccaagtctgatgacccgag

SEQ ID NO: 676274 - DNA, 25 bp, Rattus norvegicus
ttgactccaagtgtgatgacccgag

SEQ ID NO: 676275 - DNA, 25 bp, Rattus norvegicus
ttgactccaccaacaactgaacgtt

SEQ ID NO: 676276 - DNA, 25 bp, Rattus norvegicus
ttgactccaccatcaactgaacgtt

SEQ ID NO: 676277 - DNA, 25 bp, Rattus norvegicus
ttgactccacctcctgagtactggg

SEQ ID NO: 676278 - DNA, 25 bp, Rattus norvegicus
ttgactccacctgctgagtactggg

SEQ ID NO: 676279 - DNA, 25 bp, Rattus norvegicus
ttgactcccaagagtattgccccaa

SEQ ID NO: 676280 - DNA, 25 bp, Rattus norvegicus
ttgactcccaagtgtattgccccaa

SEQ ID NO: 676281 - DNA, 25 bp, Rattus norvegicus
ttgactcccggactagtggctccaa

SEQ ID NO: 676282 - DNA, 25 bp, Rattus norvegicus
ttgactcccggagtagtggctccaa

SEQ ID NO: 676283 - DNA, 25 bp, Rattus norvegicus
ttgactccctacatttcatggttgg

SEQ ID NO: 676284 - DNA, 25 bp, Rattus norvegicus
ttgactccctacttttcatggttgg

SEQ ID NO: 676285 - DNA, 25 bp, Rattus norvegicus
ttgactccgaatctctggcccgtgg

SEQ ID NO: 676286 - DNA, 25 bp, Rattus norvegicus
ttgactccgaatgtctggcccgtgg

SEQ ID NO: 676287 - DNA, 25 bp, Rattus norvegicus
ttgactcctagcactttcgttgggc

SEQ ID NO: 676288 - DNA, 25 bp, Rattus norvegicus
ttgactcctagctctttcgttgggc

SEQ ID NO: 676289 - DNA, 25 bp, Rattus norvegicus
ttgactcctcagatccaagaacagt

SEQ ID NO: 676290 - DNA, 25 bp, Rattus norvegicus
ttgactcctcagttccaagaacagt

SEQ ID NO: 676291 - DNA, 25 bp, Rattus norvegicus
ttgactcctccaccagcaggtgttt

SEQ ID NO: 676292 - DNA, 25 bp, Rattus norvegicus
ttgactcctccagcagcaggtgttt

SEQ ID NO: 676293 - DNA, 25 bp, Rattus norvegicus
ttgactcctcccatcaataattcag

SEQ ID NO: 676294 - DNA, 25 bp, Rattus norvegicus
ttgactcctcccttcaataattcag

SEQ ID NO: 676295 - DNA, 25 bp, Rattus norvegicus
ttgactcctgccagtctgatcataa

SEQ ID NO: 676296 - DNA, 25 bp, Rattus norvegicus
ttgactcctgcctgtctgatcataa

SEQ ID NO: 676297 - DNA, 25 bp, Rattus norvegicus
ttgactcctttgagccgttccgagg

SEQ ID NO: 676298 - DNA, 25 bp, Rattus norvegicus
ttgactcctttgtgccgttccgagg

SEQ ID NO: 676299 - DNA, 25 bp, Rattus norvegicus
ttgactcgagacagctacctgacac

SEQ ID NO: 676300 - DNA, 25 bp, Rattus norvegicus
ttgactcgagactgctacctgacac

SEQ ID NO: 676301 - DNA, 25 bp, Rattus norvegicus
ttgactcgtgagactggcgttcagc

SEQ ID NO: 676302 - DNA, 25 bp, Rattus norvegicus
ttgactcgtgagtctggcgttcagc

SEQ ID NO: 676303 - DNA, 25 bp, Rattus norvegicus
ttgactcgttgcatggcactgaaat

SEQ ID NO: 676304 - DNA, 25 bp, Rattus norvegicus
ttgactcgttgcttggcactgaaat

SEQ ID NO: 676305 - DNA, 25 bp, Rattus norvegicus
ttgactctagcaccccgagtatcat

SEQ ID NO: 676306 - DNA, 25 bp, Rattus norvegicus
ttgactctagcagcccgagtatcat

SEQ ID NO: 676307 - DNA, 25 bp, Rattus norvegicus
ttgactctcagactatggaaacaat

SEQ ID NO: 676308 - DNA, 25 bp, Rattus norvegicus
ttgactctcagagtatggaaacaat

SEQ ID NO: 676309 - DNA, 25 bp, Rattus norvegicus
ttgactctccctattgggatgacat

SEQ ID NO: 676310 - DNA, 25 bp, Rattus norvegicus
ttgactctcccttttgggatgacat

SEQ ID NO: 676311 - DNA, 25 bp, Rattus norvegicus
ttgactctgaagatctctctgtgga

SEQ ID NO: 676312 - DNA, 25 bp, Rattus norvegicus
ttgactctgaagttctctctgtgga

SEQ ID NO: 676313 - DNA, 25 bp, Rattus norvegicus
ttgactctgcctaatggtcactcgg

SEQ ID NO: 676314 - DNA, 25 bp, Rattus norvegicus
ttgactctgccttatggtcactcgg

SEQ ID NO: 676315 - DNA, 25 bp, Rattus norvegicus
ttgactcttcccactttttggaaat

SEQ ID NO: 676316 - DNA, 25 bp, Rattus norvegicus
ttgactcttccctctttttggaaat

SEQ ID NO: 676317 - DNA, 25 bp, Rattus norvegicus
ttgactcttctgcactcatgtgtga

SEQ ID NO: 676318 - DNA, 25 bp, Rattus norvegicus
ttgactcttctggactcatgtgtga

SEQ ID NO: 676319 - DNA, 25 bp, Rattus norvegicus
ttgactctttctccccagtttatca

SEQ ID NO: 676320 - DNA, 25 bp, Rattus norvegicus
ttgactctttctgcccagtttatca

SEQ ID NO: 676321 - DNA, 25 bp, Rattus norvegicus
ttgactctttgacagggcaaccaca

SEQ ID NO: 676322 - DNA, 25 bp, Rattus norvegicus
ttgactctttgagagggcaaccaca

SEQ ID NO: 676323 - DNA, 25 bp, Rattus norvegicus
ttgactgaacttcttctgttccgtt

SEQ ID NO: 676324 - DNA, 25 bp, Rattus norvegicus
ttgactgaacttgttctgttccgtt

SEQ ID NO: 676325 - DNA, 25 bp, Rattus norvegicus
ttgactgaagccagcctcatcatgg

SEQ ID NO: 676326 - DNA, 25 bp, Rattus norvegicus
ttgactgaagcctgcctcatcatgg

SEQ ID NO: 676327 - DNA, 25 bp, Rattus norvegicus
ttgactgacaggagaggccgctaat

SEQ ID NO: 676328 - DNA, 25 bp, Rattus norvegicus
ttgactgacaggtgaggccgctaat

SEQ ID NO: 676329 - DNA, 25 bp, Rattus norvegicus
ttgactgacggtcagcagcatgcct

SEQ ID NO: 676330 - DNA, 25 bp, Rattus norvegicus
ttgactgacggtgagcagcatgcct

SEQ ID NO: 676331 - DNA, 25 bp, Rattus norvegicus
ttgactgacgttacaagagcctgtc

SEQ ID NO: 676332 - DNA, 25 bp, Rattus norvegicus
ttgactgacgtttcaagagcctgtc

SEQ ID NO: 676333 - DNA, 25 bp, Rattus norvegicus
ttgactgagcttcttacgggcccga

SEQ ID NO: 676334 - DNA, 25 bp, Rattus norvegicus
ttgactgagcttgttacgggcccga

SEQ ID NO: 676335 - DNA, 25 bp, Rattus norvegicus
ttgactgcaaagatatttctaaaca

SEQ ID NO: 676336 - DNA, 25 bp, Rattus norvegicus
ttgactgcaaagttatttctaaaca

SEQ ID NO: 676337 - DNA, 25 bp, Rattus norvegicus
ttgactgcaagtctgatgcctgcca

SEQ ID NO: 676338 - DNA, 25 bp, Rattus norvegicus
ttgactgcaagtgtgatgcctgcca

SEQ ID NO: 676339 - DNA, 25 bp, Rattus norvegicus
ttgactgcagacacctgtgtgcact

SEQ ID NO: 676340 - DNA, 25 bp, Rattus norvegicus
ttgactgcagactcctgtgtgcact

SEQ ID NO: 676341 - DNA, 25 bp, Rattus norvegicus
ttgactgcagctccttgggcaggac

SEQ ID NO: 676342 - DNA, 25 bp, Rattus norvegicus
ttgactgcagctgcttgggcaggac

SEQ ID NO: 676343 - DNA, 25 bp, Rattus norvegicus
ttgactgccgctcactgagacagat

SEQ ID NO: 676344 - DNA, 25 bp, Rattus norvegicus
ttgactgccgctgactgagacagat

SEQ ID NO: 676345 - DNA, 25 bp, Rattus norvegicus
ttgactgcgtccacaaaacatgctt

SEQ ID NO: 676346 - DNA, 25 bp, Rattus norvegicus
ttgactgcgtcctcaaaacatgctt

SEQ ID NO: 676347 - DNA, 25 bp, Rattus norvegicus
ttgactgctagtactgtgcatctca

SEQ ID NO: 676348 - DNA, 25 bp, Rattus norvegicus
ttgactgctagttctgtgcatctca

SEQ ID NO: 676349 - DNA, 25 bp, Rattus norvegicus
ttgactgctgacactcttcattctc

SEQ ID NO: 676350 - DNA, 25 bp, Rattus norvegicus
ttgactgctgactctcttcattctc

SEQ ID NO: 676351 - DNA, 25 bp, Rattus norvegicus
ttgactgctggacgctgaacttcat

SEQ ID NO: 676352 - DNA, 25 bp, Rattus norvegicus
ttgactgctggaggctgaacttcat

SEQ ID NO: 676353 - DNA, 25 bp, Rattus norvegicus
ttgactggatacagctcaacagaat

SEQ ID NO: 676354 - DNA, 25 bp, Rattus norvegicus
ttgactggatactgctcaacagaat

SEQ ID NO: 676355 - DNA, 25 bp, Rattus norvegicus
ttgactggatctcggccttttaaat

SEQ ID NO: 676356 - DNA, 25 bp, Rattus norvegicus
ttgactggatctgggccttttaaat

SEQ ID NO: 676357 - DNA, 25 bp, Rattus norvegicus
ttgactggatgcctctggaacccca

SEQ ID NO: 676358 - DNA, 25 bp, Rattus norvegicus
ttgactggatgcgtctggaacccca

SEQ ID NO: 676359 - DNA, 25 bp, Rattus norvegicus
ttgactggccaaacagcccttgagg

SEQ ID NO: 676360 - DNA, 25 bp, Rattus norvegicus
ttgactggccaatcagcccttgagg

SEQ ID NO: 676361 - DNA, 25 bp, Rattus norvegicus
ttgactggcctcagcatatctgtta

SEQ ID NO: 676362 - DNA, 25 bp, Rattus norvegicus
ttgactggcctctgcatatctgtta

SEQ ID NO: 676363 - DNA, 25 bp, Rattus norvegicus
ttgactggcctgacagcggtgagat

SEQ ID NO: 676364 - DNA, 25 bp, Rattus norvegicus
ttgactggcctgtcagcggtgagat

SEQ ID NO: 676365 - DNA, 25 bp, Rattus norvegicus
ttgactgggtgcagactggagactt

SEQ ID NO: 676366 - DNA, 25 bp, Rattus norvegicus
ttgactgggtgctgactggagactt

SEQ ID NO: 676367 - DNA, 25 bp, Rattus norvegicus
ttgactggtcctaaagctgctattt

SEQ ID NO: 676368 - DNA, 25 bp, Rattus norvegicus
ttgactggtccttaagctgctattt

SEQ ID NO: 676369 - DNA, 25 bp, Rattus norvegicus
ttgactggttaaacaggctacggct

SEQ ID NO: 676370 - DNA, 25 bp, Rattus norvegicus
ttgactggttaatcaggctacggct

SEQ ID NO: 676371 - DNA, 25 bp, Rattus norvegicus
ttgactggtttcacataaccccatc

SEQ ID NO: 676372 - DNA, 25 bp, Rattus norvegicus
ttgactggtttctcataaccccatc

SEQ ID NO: 676373 - DNA, 25 bp, Rattus norvegicus
ttgactgtactaaccacatgtgtaa

SEQ ID NO: 676374 - DNA, 25 bp, Rattus norvegicus
ttgactgtactatccacatgtgtaa

SEQ ID NO: 676375 - DNA, 25 bp, Rattus norvegicus
ttgactgtagagatcaactccccca

SEQ ID NO: 676376 - DNA, 25 bp, Rattus norvegicus
ttgactgtagagttcaactccccca

SEQ ID NO: 676377 - DNA, 25 bp, Rattus norvegicus
ttgactgtatccaggtttctttttg

SEQ ID NO: 676378 - DNA, 25 bp, Rattus norvegicus
ttgactgtatcctggtttctttttg

SEQ ID NO: 676379 - DNA, 25 bp, Rattus norvegicus
ttgactgtcagcaacatgttggtta

SEQ ID NO: 676380 - DNA, 25 bp, Rattus norvegicus
ttgactgtcagctacatgttggtta

SEQ ID NO: 676381 - DNA, 25 bp, Rattus norvegicus
ttgactgtccagaaccaagagcatc

SEQ ID NO: 676382 - DNA, 25 bp, Rattus norvegicus
ttgactgtccagagtggcgaacata

SEQ ID NO: 676383 - DNA, 25 bp, Rattus norvegicus
ttgactgtccagtaccaagagcatc

SEQ ID NO: 676384 - DNA, 25 bp, Rattus norvegicus
ttgactgtccagtgtggcgaacata

SEQ ID NO: 676385 - DNA, 25 bp, Rattus norvegicus
ttgactgtgtgtcggtccagcacat

SEQ ID NO: 676386 - DNA, 25 bp, Rattus norvegicus
ttgactgtgtgtgggtccagcacat

SEQ ID NO: 676387 - DNA, 25 bp, Rattus norvegicus
ttgactgttagcagcagagctcccc

SEQ ID NO: 676388 - DNA, 25 bp, Rattus norvegicus
ttgactgttagctgcagagctcccc

SEQ ID NO: 676389 - DNA, 25 bp, Rattus norvegicus
ttgactgttcaacgcacgacgtatt

SEQ ID NO: 676390 - DNA, 25 bp, Rattus norvegicus
ttgactgttcaaggcacgacgtatt

SEQ ID NO: 676391 - DNA, 25 bp, Rattus norvegicus
ttgactgttgggagtcagccctcaa

SEQ ID NO: 676392 - DNA, 25 bp, Rattus norvegicus
ttgactgttgggtgtcagccctcaa

SEQ ID NO: 676393 - DNA, 25 bp, Rattus norvegicus
ttgactgtttatctgcttctgccta

SEQ ID NO: 676394 - DNA, 25 bp, Rattus norvegicus
ttgactgtttatgtgcttctgccta

SEQ ID NO: 676395 - DNA, 25 bp, Rattus norvegicus
ttgactgtttctatcgacagccctt

SEQ ID NO: 676396 - DNA, 25 bp, Rattus norvegicus
ttgactgtttctttcgacagccctt

SEQ ID NO: 676397 - DNA, 25 bp, Rattus norvegicus
ttgacttaactgagtctgctgtcct

SEQ ID NO: 676398 - DNA, 25 bp, Rattus norvegicus
ttgacttaactgtgtctgctgtcct

SEQ ID NO: 676399 - DNA, 25 bp, Rattus norvegicus
ttgacttaatctattcccacatctt

SEQ ID NO: 676400 - DNA, 25 bp, Rattus norvegicus
ttgacttaatcttttcccacatctt

SEQ ID NO: 676401 - DNA, 25 bp, Rattus norvegicus
ttgacttagaagagcagctccataa

SEQ ID NO: 676402 - DNA, 25 bp, Rattus norvegicus
ttgacttagaagtgcagctccataa

SEQ ID NO: 676403 - DNA, 25 bp, Rattus norvegicus
ttgacttcaaaacgcctaaaggtag

SEQ ID NO: 676404 - DNA, 25 bp, Rattus norvegicus
ttgacttcaaaaggcctaaaggtag

SEQ ID NO: 676405 - DNA, 25 bp, Rattus norvegicus
ttgacttcacaaactctccagctgt

SEQ ID NO: 676406 - DNA, 25 bp, Rattus norvegicus
ttgacttcacaatctctccagctgt

SEQ ID NO: 676407 - DNA, 25 bp, Rattus norvegicus
ttgacttcacttattaaccacgttg

SEQ ID NO: 676408 - DNA, 25 bp, Rattus norvegicus
ttgacttcactttttaaccacgttg

SEQ ID NO: 676409 - DNA, 25 bp, Rattus norvegicus
ttgacttcagagatgcgggctgcct

SEQ ID NO: 676410 - DNA, 25 bp, Rattus norvegicus
ttgacttcagagttgcgggctgcct

SEQ ID NO: 676411 - DNA, 25 bp, Rattus norvegicus
ttgacttcaggtcctacactgtgga

SEQ ID NO: 676412 - DNA, 25 bp, Rattus norvegicus
ttgacttcaggtgctacactgtgga

SEQ ID NO: 676413 - DNA, 25 bp, Rattus norvegicus
ttgacttcatataccaagcagtggg

SEQ ID NO: 676414 - DNA, 25 bp, Rattus norvegicus
ttgacttcatattccaagcagtggg

SEQ ID NO: 676415 - DNA, 25 bp, Rattus norvegicus
ttgacttccaacaagggcggcgtta

SEQ ID NO: 676416 - DNA, 25 bp, Rattus norvegicus
ttgacttccaactagggcggcgtta

SEQ ID NO: 676417 - DNA, 25 bp, Rattus norvegicus
ttgacttccaagataaaagccaact

SEQ ID NO: 676418 - DNA, 25 bp, Rattus norvegicus
ttgacttccaagttaaaagccaact

SEQ ID NO: 676419 - DNA, 25 bp, Rattus norvegicus
ttgacttcccctaccatagtcagac

SEQ ID NO: 676420 - DNA, 25 bp, Rattus norvegicus
ttgacttccccttccatagtcagac

SEQ ID NO: 676421 - DNA, 25 bp, Rattus norvegicus
ttgacttcccttatctctcataaat

SEQ ID NO: 676422 - DNA, 25 bp, Rattus norvegicus
ttgacttcccttttctctcataaat

SEQ ID NO: 676423 - DNA, 25 bp, Rattus norvegicus
ttgacttcctctatactacgcttat

SEQ ID NO: 676424 - DNA, 25 bp, Rattus norvegicus
ttgacttcctctttactacgcttat

SEQ ID NO: 676425 - DNA, 25 bp, Rattus norvegicus
ttgacttcgtctactctcccgttta

SEQ ID NO: 676426 - DNA, 25 bp, Rattus norvegicus
ttgacttcgtcttctctcccgttta

SEQ ID NO: 676427 - DNA, 25 bp, Rattus norvegicus
ttgacttctagcacttagcagccga

SEQ ID NO: 676428 - DNA, 25 bp, Rattus norvegicus
ttgacttctagctcttagcagccga

SEQ ID NO: 676429 - DNA, 25 bp, Rattus norvegicus
ttgacttctcggatgccagtcctga

SEQ ID NO: 676430 - DNA, 25 bp, Rattus norvegicus
ttgacttctcggttgccagtcctga

SEQ ID NO: 676431 - DNA, 25 bp, Rattus norvegicus
ttgacttcttcacgtggctaggtta

SEQ ID NO: 676432 - DNA, 25 bp, Rattus norvegicus
ttgacttcttcaggtggctaggtta

SEQ ID NO: 676433 - DNA, 25 bp, Rattus norvegicus
ttgacttcttccattctaatttgtg

SEQ ID NO: 676434 - DNA, 25 bp, Rattus norvegicus
ttgacttcttcctttctaatttgtg

SEQ ID NO: 676435 - DNA, 25 bp, Rattus norvegicus
ttgacttgacgaatatcatattgaa

SEQ ID NO: 676436 - DNA, 25 bp, Rattus norvegicus
ttgacttgacgattatcatattgaa

SEQ ID NO: 676437 - DNA, 25 bp, Rattus norvegicus
ttgacttgattgaccaccactggta

SEQ ID NO: 676438 - DNA, 25 bp, Rattus norvegicus
ttgacttgattgtccaccactggta

SEQ ID NO: 676439 - DNA, 25 bp, Rattus norvegicus
ttgacttgctccctgtcagtttcca

SEQ ID NO: 676440 - DNA, 25 bp, Rattus norvegicus
ttgacttgctccgtgtcagtttcca

SEQ ID NO: 676441 - DNA, 25 bp, Rattus norvegicus
ttgacttggctgcaggttggtcccc

SEQ ID NO: 676442 - DNA, 25 bp, Rattus norvegicus
ttgacttggctggaggttggtcccc

SEQ ID NO: 676443 - DNA, 25 bp, Rattus norvegicus
ttgacttgggctatgatcgggacac

SEQ ID NO: 676444 - DNA, 25 bp, Rattus norvegicus
ttgacttgggctttgatcgggacac

SEQ ID NO: 676445 - DNA, 25 bp, Rattus norvegicus
ttgacttggtcaaccctacttttat

SEQ ID NO: 676446 - DNA, 25 bp, Rattus norvegicus
ttgacttggtcatccctacttttat

SEQ ID NO: 676447 - DNA, 25 bp, Rattus norvegicus
ttgacttggtttctcgttgctccca

SEQ ID NO: 676448 - DNA, 25 bp, Rattus norvegicus
ttgacttggtttgtcgttgctccca

SEQ ID NO: 676449 - DNA, 25 bp, Rattus norvegicus
ttgacttgtatgcaagcactcccac

SEQ ID NO: 676450 - DNA, 25 bp, Rattus norvegicus
ttgacttgtatggaagcactcccac

SEQ ID NO: 676451 - DNA, 25 bp, Rattus norvegicus
ttgactttatacatcacccttgcag

SEQ ID NO: 676452 - DNA, 25 bp, Rattus norvegicus
ttgactttatacttcacccttgcag

SEQ ID NO: 676453 - DNA, 25 bp, Rattus norvegicus
ttgactttcagtcccaaacttgagg

SEQ ID NO: 676454 - DNA, 25 bp, Rattus norvegicus
ttgactttcagtgccaaacttgagg

SEQ ID NO: 676455 - DNA, 25 bp, Rattus norvegicus
ttgactttcccacgcatcatgatta

SEQ ID NO: 676456 - DNA, 25 bp, Rattus norvegicus
ttgactttcccaggcatcatgatta

SEQ ID NO: 676457 - DNA, 25 bp, Rattus norvegicus
ttgactttctgccaactctttggtt

SEQ ID NO: 676458 - DNA, 25 bp, Rattus norvegicus
ttgactttctgcgaactctttggtt

SEQ ID NO: 676459 - DNA, 25 bp, Rattus norvegicus
ttgactttcttcatccatttgtaaa

SEQ ID NO: 676460 - DNA, 25 bp, Rattus norvegicus
ttgactttcttcttccatttgtaaa

SEQ ID NO: 676461 - DNA, 25 bp, Rattus norvegicus
ttgactttgaacaggtggaccctga

SEQ ID NO: 676462 - DNA, 25 bp, Rattus norvegicus
ttgactttgaactggtggaccctga

SEQ ID NO: 676463 - DNA, 25 bp, Rattus norvegicus
ttgactttgaatacatcctcctcag

SEQ ID NO: 676464 - DNA, 25 bp, Rattus norvegicus
ttgactttgaattcatcctcctcag

SEQ ID NO: 676465 - DNA, 25 bp, Rattus norvegicus
ttgactttggaaccttccttctctc

SEQ ID NO: 676466 - DNA, 25 bp, Rattus norvegicus
ttgactttggaagcttccttctctc

SEQ ID NO: 676467 - DNA, 25 bp, Rattus norvegicus
ttgactttgggcactcatgtctcca

SEQ ID NO: 676468 - DNA, 25 bp, Rattus norvegicus
ttgactttgggcagggaaggataaa

SEQ ID NO: 676469 - DNA, 25 bp, Rattus norvegicus
ttgactttgggctctcatgtctcca

SEQ ID NO: 676470 - DNA, 25 bp, Rattus norvegicus
ttgactttgggctgggaaggataaa

SEQ ID NO: 676471 - DNA, 25 bp, Rattus norvegicus
ttgactttgtataatctaggatgta

SEQ ID NO: 676472 - DNA, 25 bp, Rattus norvegicus
ttgactttgtattatctaggatgta

SEQ ID NO: 676473 - DNA, 25 bp, Rattus norvegicus
ttgactttgtggatatcctcaccta

SEQ ID NO: 676474 - DNA, 25 bp, Rattus norvegicus
ttgactttgtggttatcctcaccta

SEQ ID NO: 676475 - DNA, 25 bp, Rattus norvegicus
ttgacttttaacacagcctcttctg

SEQ ID NO: 676476 - DNA, 25 bp, Rattus norvegicus
ttgacttttaactcagcctcttctg

SEQ ID NO: 676477 - DNA, 25 bp, Rattus norvegicus
ttgacttttaagacacgccgtctcg

SEQ ID NO: 676478 - DNA, 25 bp, Rattus norvegicus
ttgacttttaagtcacgccgtctcg

SEQ ID NO: 676479 - DNA, 25 bp, Rattus norvegicus
ttgacttttgggactccaggtttag

SEQ ID NO: 676480 - DNA, 25 bp, Rattus norvegicus
ttgacttttgggtctccaggtttag

SEQ ID NO: 676481 - DNA, 25 bp, Rattus norvegicus
ttgacttttttcctaagacagaaag

SEQ ID NO: 676482 - DNA, 25 bp, Rattus norvegicus
ttgacttttttcgtaagacagaaag

SEQ ID NO: 676483 - DNA, 25 bp, Rattus norvegicus
ttgagaaaatgaacaccaggagctg

SEQ ID NO: 676484 - DNA, 25 bp, Rattus norvegicus
ttgagaaaatgatcaccaggagctg

SEQ ID NO: 676485 - DNA, 25 bp, Rattus norvegicus
ttgagaaaccccctaaggagaagat

SEQ ID NO: 676486 - DNA, 25 bp, Rattus norvegicus
ttgagaaaccccgtaaggagaagat

SEQ ID NO: 676487 - DNA, 25 bp, Rattus norvegicus
ttgagaaaccctccagagcacttag

SEQ ID NO: 676488 - DNA, 25 bp, Rattus norvegicus
ttgagaaaccctgcagagcacttag

SEQ ID NO: 676489 - DNA, 25 bp, Rattus norvegicus
ttgagaaagacccacacttagcctg

SEQ ID NO: 676490 - DNA, 25 bp, Rattus norvegicus
ttgagaaagaccgacacttagcctg

SEQ ID NO: 676491 - DNA, 25 bp, Rattus norvegicus
ttgagaaagcacactggcgggttta

SEQ ID NO: 676492 - DNA, 25 bp, Rattus norvegicus
ttgagaaagcactctggcgggttta

SEQ ID NO: 676493 - DNA, 25 bp, Rattus norvegicus
ttgagaaagtatccccaccagatcg

SEQ ID NO: 676494 - DNA, 25 bp, Rattus norvegicus
ttgagaaagtatgcccaccagatcg

SEQ ID NO: 676495 - DNA, 25 bp, Rattus norvegicus
ttgagaacattgagtgtgaccccag

SEQ ID NO: 676496 - DNA, 25 bp, Rattus norvegicus
ttgagaacattgtgtgtgaccccag

SEQ ID NO: 676497 - DNA, 25 bp, Rattus norvegicus
ttgagaaccactcaacttgatcctc

SEQ ID NO: 676498 - DNA, 25 bp, Rattus norvegicus
ttgagaaccactcctgtgatacgac

SEQ ID NO: 676499 - DNA, 25 bp, Rattus norvegicus
ttgagaaccactgaacttgatcctc

SEQ ID NO: 676500 - DNA, 25 bp, Rattus norvegicus
ttgagaaccactgctgtgatacgac

SEQ ID NO: 676501 - DNA, 25 bp, Rattus norvegicus
ttgagaaccatcactttcacattcc

SEQ ID NO: 676502 - DNA, 25 bp, Rattus norvegicus
ttgagaaccatctctttcacattcc

SEQ ID NO: 676503 - DNA, 25 bp, Rattus norvegicus
ttgagaacccggaagctcgtcgtgg

SEQ ID NO: 676504 - DNA, 25 bp, Rattus norvegicus
ttgagaacccggtagctcgtcgtgg

SEQ ID NO: 676505 - DNA, 25 bp, Rattus norvegicus
ttgagaacctttcgtggcatccagt

SEQ ID NO: 676506 - DNA, 25 bp, Rattus norvegicus
ttgagaacctttggtggcatccagt

SEQ ID NO: 676507 - DNA, 25 bp, Rattus norvegicus
ttgagaagaccaaggagcacagcat

SEQ ID NO: 676508 - DNA, 25 bp, Rattus norvegicus
ttgagaagaccatggagcacagcat

SEQ ID NO: 676509 - DNA, 25 bp, Rattus norvegicus
ttgagaagcaatagcctggcccttg

SEQ ID NO: 676510 - DNA, 25 bp, Rattus norvegicus
ttgagaagcaattgcctggcccttg

SEQ ID NO: 676511 - DNA, 25 bp, Rattus norvegicus
ttgagaagcaccactgaccctgaag

SEQ ID NO: 676512 - DNA, 25 bp, Rattus norvegicus
ttgagaagcacctctgaccctgaag

SEQ ID NO: 676513 - DNA, 25 bp, Rattus norvegicus
ttgagaagcgagaagctggcccctt

SEQ ID NO: 676514 - DNA, 25 bp, Rattus norvegicus
ttgagaagcgagaaggcgagtacca

SEQ ID NO: 676515 - DNA, 25 bp, Rattus norvegicus
ttgagaagcgagtagctggcccctt

SEQ ID NO: 676516 - DNA, 25 bp, Rattus norvegicus
ttgagaagcgagtaggcgagtacca

SEQ ID NO: 676517 - DNA, 25 bp, Rattus norvegicus
ttgagaagcgccaacatccagagtc

SEQ ID NO: 676518 - DNA, 25 bp, Rattus norvegicus
ttgagaagcgcctacatccagagtc

SEQ ID NO: 676519 - DNA, 25 bp, Rattus norvegicus
ttgagaagctgaatgcccacggtgt

SEQ ID NO: 676520 - DNA, 25 bp, Rattus norvegicus
ttgagaagctgattgcccacggtgt

SEQ ID NO: 676521 - DNA, 25 bp, Rattus norvegicus
ttgagaagggcgagtacccacgctg

SEQ ID NO: 676522 - DNA, 25 bp, Rattus norvegicus
ttgagaagggcgtgtacccacgctg

SEQ ID NO: 676523 - DNA, 25 bp, Rattus norvegicus
ttgagaagtaccatgctccttacat

SEQ ID NO: 676524 - DNA, 25 bp, Rattus norvegicus
ttgagaagtaccttgctccttacat

SEQ ID NO: 676525 - DNA, 25 bp, Rattus norvegicus
ttgagaagtcagaacaagcagcact

SEQ ID NO: 676526 - DNA, 25 bp, Rattus norvegicus
ttgagaagtcagtacaagcagcact

SEQ ID NO: 676527 - DNA, 25 bp, Rattus norvegicus
ttgagaagtggcagaagcctcccct

SEQ ID NO: 676528 - DNA, 25 bp, Rattus norvegicus
ttgagaagtggctgaagcctcccct

SEQ ID NO: 676529 - DNA, 25 bp, Rattus norvegicus
ttgagaataccccagtgttctgcct

SEQ ID NO: 676530 - DNA, 25 bp, Rattus norvegicus
ttgagaatacccgagtgttctgcct

SEQ ID NO: 676531 - DNA, 25 bp, Rattus norvegicus
ttgagaatcatccagcttcaagcaa

SEQ ID NO: 676532 - DNA, 25 bp, Rattus norvegicus
ttgagaatcatcgagcttcaagcaa

SEQ ID NO: 676533 - DNA, 25 bp, Rattus norvegicus
ttgagaatgcttagtgtcacacaca

SEQ ID NO: 676534 - DNA, 25 bp, Rattus norvegicus
ttgagaatgctttgtgtcacacaca

SEQ ID NO: 676535 - DNA, 25 bp, Rattus norvegicus
ttgagacaaggcaggctgtggccat

SEQ ID NO: 676536 - DNA, 25 bp, Rattus norvegicus
ttgagacaaggctggctgtggccat

SEQ ID NO: 676537 - DNA, 25 bp, Rattus norvegicus
ttgagacacagcctaactttcctag

SEQ ID NO: 676538 - DNA, 25 bp, Rattus norvegicus
ttgagacacagcgtaactttcctag

SEQ ID NO: 676539 - DNA, 25 bp, Rattus norvegicus
ttgagacagaagactggaccaggct

SEQ ID NO: 676540 - DNA, 25 bp, Rattus norvegicus
ttgagacagaagtctggaccaggct

SEQ ID NO: 676541 - DNA, 25 bp, Rattus norvegicus
ttgagacagagtatgggcctgacct

SEQ ID NO: 676542 - DNA, 25 bp, Rattus norvegicus
ttgagacagagtttgggcctgacct

SEQ ID NO: 676543 - DNA, 25 bp, Rattus norvegicus
ttgagacagatgacacgctgtgtgc

SEQ ID NO: 676544 - DNA, 25 bp, Rattus norvegicus
ttgagacagatgtcacgctgtgtgc

SEQ ID NO: 676545 - DNA, 25 bp, Rattus norvegicus
ttgagacagggacctggttcttccc

SEQ ID NO: 676546 - DNA, 25 bp, Rattus norvegicus
ttgagacagggagctggttcttccc

SEQ ID NO: 676547 - DNA, 25 bp, Rattus norvegicus
ttgagaccaagaacacccaagtcct

SEQ ID NO: 676548 - DNA, 25 bp, Rattus norvegicus
ttgagaccaagatcacccaagtcct

SEQ ID NO: 676549 - DNA, 25 bp, Rattus norvegicus
ttgagaccacttcactgacacgagt

SEQ ID NO: 676550 - DNA, 25 bp, Rattus norvegicus
ttgagaccacttgactgacacgagt

SEQ ID NO: 676551 - DNA, 25 bp, Rattus norvegicus
ttgagaccagcaagggctacacaag

SEQ ID NO: 676552 - DNA, 25 bp, Rattus norvegicus
ttgagaccagcatgggctacacaag

SEQ ID NO: 676553 - DNA, 25 bp, Rattus norvegicus
ttgagaccagccagcagtcaggaat

SEQ ID NO: 676554 - DNA, 25 bp, Rattus norvegicus
ttgagaccagcctgcagtcaggaat

SEQ ID NO: 676555 - DNA, 25 bp, Rattus norvegicus
ttgagacccactctaactaactttg

SEQ ID NO: 676556 - DNA, 25 bp, Rattus norvegicus
ttgagacccactgtaactaactttg

SEQ ID NO: 676557 - DNA, 25 bp, Rattus norvegicus
ttgagaccctcaatccatatgcctg

SEQ ID NO: 676558 - DNA, 25 bp, Rattus norvegicus
ttgagaccctcattccatatgcctg

SEQ ID NO: 676559 - DNA, 25 bp, Rattus norvegicus
ttgagaccctgccttgtacaaccaa

SEQ ID NO: 676560 - DNA, 25 bp, Rattus norvegicus
ttgagaccctgcgttgtacaaccaa

SEQ ID NO: 676561 - DNA, 25 bp, Rattus norvegicus
ttgagaccctggaggacatcttcca

SEQ ID NO: 676562 - DNA, 25 bp, Rattus norvegicus
ttgagaccctggtggacatcttcca

SEQ ID NO: 676563 - DNA, 25 bp, Rattus norvegicus
ttgagacctatgctcttgagacccc

SEQ ID NO: 676564 - DNA, 25 bp, Rattus norvegicus
ttgagacctatggtcttgagacccc

SEQ ID NO: 676565 - DNA, 25 bp, Rattus norvegicus
ttgagacctcagagctttgtgcatg

SEQ ID NO: 676566 - DNA, 25 bp, Rattus norvegicus
ttgagacctcagtgctttgtgcatg

SEQ ID NO: 676567 - DNA, 25 bp, Rattus norvegicus
ttgagacctgacagttttgaacgtt

SEQ ID NO: 676568 - DNA, 25 bp, Rattus norvegicus
ttgagacctgactgttttgaacgtt

SEQ ID NO: 676569 - DNA, 25 bp, Rattus norvegicus
ttgagactaatccaggttcagcctg

SEQ ID NO: 676570 - DNA, 25 bp, Rattus norvegicus
ttgagactaatcgaggttcagcctg

SEQ ID NO: 676571 - DNA, 25 bp, Rattus norvegicus
ttgagactcaggctacagtggcctc

SEQ ID NO: 676572 - DNA, 25 bp, Rattus norvegicus
ttgagactcagggtacagtggcctc

SEQ ID NO: 676573 - DNA, 25 bp, Rattus norvegicus
ttgagactccgtagccttgaataca

SEQ ID NO: 676574 - DNA, 25 bp, Rattus norvegicus
ttgagactccgttgccttgaataca

SEQ ID NO: 676575 - DNA, 25 bp, Rattus norvegicus
ttgagactcggtaaagacttgggta

SEQ ID NO: 676576 - DNA, 25 bp, Rattus norvegicus
ttgagactcggttaagacttgggta

SEQ ID NO: 676577 - DNA, 25 bp, Rattus norvegicus
ttgagactcgtgatatgcgcggcta

SEQ ID NO: 676578 - DNA, 25 bp, Rattus norvegicus
ttgagactcgtgttatgcgcggcta

SEQ ID NO: 676579 - DNA, 25 bp, Rattus norvegicus
ttgagactctccaatccagtatctg

SEQ ID NO: 676580 - DNA, 25 bp, Rattus norvegicus
ttgagactctcctatccagtatctg

SEQ ID NO: 676581 - DNA, 25 bp, Rattus norvegicus
ttgagactgagaagcctccgccgtc

SEQ ID NO: 676582 - DNA, 25 bp, Rattus norvegicus
ttgagactgagatgcctccgccgtc

SEQ ID NO: 676583 - DNA, 25 bp, Rattus norvegicus
ttgagacttactacttggccacaac

SEQ ID NO: 676584 - DNA, 25 bp, Rattus norvegicus
ttgagacttacttcttggccacaac

SEQ ID NO: 676585 - DNA, 25 bp, Rattus norvegicus
ttgagacttcaaaccctgacatcac

SEQ ID NO: 676586 - DNA, 25 bp, Rattus norvegicus
ttgagacttcaatccctgacatcac

SEQ ID NO: 676587 - DNA, 25 bp, Rattus norvegicus
ttgagacttcatatactcgttgtaa

SEQ ID NO: 676588 - DNA, 25 bp, Rattus norvegicus
ttgagacttcatttactcgttgtaa

SEQ ID NO: 676589 - DNA, 25 bp, Rattus norvegicus
ttgagagacagccaaccagactgct

SEQ ID NO: 676590 - DNA, 25 bp, Rattus norvegicus
ttgagagacagcgaaccagactgct

SEQ ID NO: 676591 - DNA, 25 bp, Rattus norvegicus
ttgagagacagtcagtgccccgacc

SEQ ID NO: 676592 - DNA, 25 bp, Rattus norvegicus
ttgagagacagtgagtgccccgacc

SEQ ID NO: 676593 - DNA, 25 bp, Rattus norvegicus
ttgagagaccacattgacctcctga

SEQ ID NO: 676594 - DNA, 25 bp, Rattus norvegicus
ttgagagaccactttgacctcctga

SEQ ID NO: 676595 - DNA, 25 bp, Rattus norvegicus
ttgagagactgcagaccagctgtgg

SEQ ID NO: 676596 - DNA, 25 bp, Rattus norvegicus
ttgagagactgctgaccagctgtgg

SEQ ID NO: 676597 - DNA, 25 bp, Rattus norvegicus
ttgagagagcccaagctgctagccg

SEQ ID NO: 676598 - DNA, 25 bp, Rattus norvegicus
ttgagagagccctagctgctagccg

SEQ ID NO: 676599 - DNA, 25 bp, Rattus norvegicus
ttgagagaggagaacactgcagctt

SEQ ID NO: 676600 - DNA, 25 bp, Rattus norvegicus
ttgagagaggagtacactgcagctt

SEQ ID NO: 676601 - DNA, 25 bp, Rattus norvegicus
ttgagagagtcacccactcctgctt

SEQ ID NO: 676602 - DNA, 25 bp, Rattus norvegicus
ttgagagagtcagccactcctgctt

SEQ ID NO: 676603 - DNA, 25 bp, Rattus norvegicus
ttgagagagtgtccaaccccatcat

SEQ ID NO: 676604 - DNA, 25 bp, Rattus norvegicus
ttgagagagtgtgcaaccccatcat

SEQ ID NO: 676605 - DNA, 25 bp, Rattus norvegicus
ttgagagatctccttgggctgtgtt

SEQ ID NO: 676606 - DNA, 25 bp, Rattus norvegicus
ttgagagatctcgttgggctgtgtt

SEQ ID NO: 676607 - DNA, 25 bp, Rattus norvegicus
ttgagagatgctatacggtataccc

SEQ ID NO: 676608 - DNA, 25 bp, Rattus norvegicus
ttgagagatgctttacggtataccc

SEQ ID NO: 676609 - DNA, 25 bp, Rattus norvegicus
ttgagagcaatactccgcgcgtcgc

SEQ ID NO: 676610 - DNA, 25 bp, Rattus norvegicus
ttgagagcaatagtccgcgcgtcgc

SEQ ID NO: 676611 - DNA, 25 bp, Rattus norvegicus
ttgagagcagctcggtaccttgtcc

SEQ ID NO: 676612 - DNA, 25 bp, Rattus norvegicus
ttgagagcagctgggtaccttgtcc

SEQ ID NO: 676613 - DNA, 25 bp, Rattus norvegicus
ttgagagcagtgaccacgcaagcgc

SEQ ID NO: 676614 - DNA, 25 bp, Rattus norvegicus
ttgagagcagtgtccacgcaagcgc

SEQ ID NO: 676615 - DNA, 25 bp, Rattus norvegicus
ttgagagccaaaaacttcacccaac

SEQ ID NO: 676616 - DNA, 25 bp, Rattus norvegicus
ttgagagccaaaccctgtcgtcagt

SEQ ID NO: 676617 - DNA, 25 bp, Rattus norvegicus
ttgagagccaaagcctgtcgtcagt

SEQ ID NO: 676618 - DNA, 25 bp, Rattus norvegicus
ttgagagccaaatacttcacccaac

SEQ ID NO: 676619 - DNA, 25 bp, Rattus norvegicus
ttgagagccgcacctaccaggaagc

SEQ ID NO: 676620 - DNA, 25 bp, Rattus norvegicus
ttgagagccgcagctaccaggaagc

SEQ ID NO: 676621 - DNA, 25 bp, Rattus norvegicus
ttgagagccttgctacctgaagagc

SEQ ID NO: 676622 - DNA, 25 bp, Rattus norvegicus
ttgagagccttggtacctgaagagc

SEQ ID NO: 676623 - DNA, 25 bp, Rattus norvegicus
ttgagagctccacatgggtagatct

SEQ ID NO: 676624 - DNA, 25 bp, Rattus norvegicus
ttgagagctccagatgggtagatct

SEQ ID NO: 676625 - DNA, 25 bp, Rattus norvegicus
ttgagagctgctaccctgaaaagat

SEQ ID NO: 676626 - DNA, 25 bp, Rattus norvegicus
ttgagagctgcttccctgaaaagat

SEQ ID NO: 676627 - DNA, 25 bp, Rattus norvegicus
ttgagagctgggagcccgcattcag

SEQ ID NO: 676628 - DNA, 25 bp, Rattus norvegicus
ttgagagctgggtgcccgcattcag

SEQ ID NO: 676629 - DNA, 25 bp, Rattus norvegicus
ttgagagcttccaaactcctacatc

SEQ ID NO: 676630 - DNA, 25 bp, Rattus norvegicus
ttgagagcttcctaactcctacatc

SEQ ID NO: 676631 - DNA, 25 bp, Rattus norvegicus
ttgagagcttcgatgtaggcagaga

SEQ ID NO: 676632 - DNA, 25 bp, Rattus norvegicus
ttgagagcttcgttgtaggcagaga

SEQ ID NO: 676633 - DNA, 25 bp, Rattus norvegicus
ttgagaggaaggatccccagcatcc

SEQ ID NO: 676634 - DNA, 25 bp, Rattus norvegicus
ttgagaggaaggttccccagcatcc

SEQ ID NO: 676635 - DNA, 25 bp, Rattus norvegicus
ttgagaggccttcgctcttaacaaa

SEQ ID NO: 676636 - DNA, 25 bp, Rattus norvegicus
ttgagaggccttggctcttaacaaa

SEQ ID NO: 676637 - DNA, 25 bp, Rattus norvegicus
ttgagagggcaacagatccaaggaa

SEQ ID NO: 676638 - DNA, 25 bp, Rattus norvegicus
ttgagagggcaagagatccaaggaa

SEQ ID NO: 676639 - DNA, 25 bp, Rattus norvegicus
ttgagagggtcgactccttcaggcc

SEQ ID NO: 676640 - DNA, 25 bp, Rattus norvegicus
ttgagagggtcgtctccttcaggcc

SEQ ID NO: 676641 - DNA, 25 bp, Rattus norvegicus
ttgagagtcaggctcttgttgcctc

SEQ ID NO: 676642 - DNA, 25 bp, Rattus norvegicus
ttgagagtcagggtcttgttgcctc

SEQ ID NO: 676643 - DNA, 25 bp, Rattus norvegicus
ttgagagtctctacccgctgatcag

SEQ ID NO: 676644 - DNA, 25 bp, Rattus norvegicus
ttgagagtctcttcccgctgatcag

SEQ ID NO: 676645 - DNA, 25 bp, Rattus norvegicus
ttgagagtctggacacatgccacct

SEQ ID NO: 676646 - DNA, 25 bp, Rattus norvegicus
ttgagagtctggtcacatgccacct

SEQ ID NO: 676647 - DNA, 25 bp, Rattus norvegicus
ttgagagtcttcactgtaccaacca

SEQ ID NO: 676648 - DNA, 25 bp, Rattus norvegicus
ttgagagtcttctctgtaccaacca

SEQ ID NO: 676649 - DNA, 25 bp, Rattus norvegicus
ttgagagtgttgacagcggctttca

SEQ ID NO: 676650 - DNA, 25 bp, Rattus norvegicus
ttgagagtgttgtcagcggctttca

SEQ ID NO: 676651 - DNA, 25 bp, Rattus norvegicus
ttgagagttgaaacaccctgcctgt

SEQ ID NO: 676652 - DNA, 25 bp, Rattus norvegicus
ttgagagttgaatcaccctgcctgt

SEQ ID NO: 676653 - DNA, 25 bp, Rattus norvegicus
ttgagataacaaaaggagccggaag

SEQ ID NO: 676654 - DNA, 25 bp, Rattus norvegicus
ttgagataacaataggagccggaag

SEQ ID NO: 676655 - DNA, 25 bp, Rattus norvegicus
ttgagataaccaatccttcactgga

SEQ ID NO: 676656 - DNA, 25 bp, Rattus norvegicus
ttgagataaccattccttcactgga

SEQ ID NO: 676657 - DNA, 25 bp, Rattus norvegicus
ttgagataagagctctaccaactga

SEQ ID NO: 676658 - DNA, 25 bp, Rattus norvegicus
ttgagataagaggtctaccaactga

SEQ ID NO: 676659 - DNA, 25 bp, Rattus norvegicus
ttgagatactgaccctgcaagatgg

SEQ ID NO: 676660 - DNA, 25 bp, Rattus norvegicus
ttgagatactgagcctgcaagatgg

SEQ ID NO: 676661 - DNA, 25 bp, Rattus norvegicus
ttgagatagactctgtgctggccga

SEQ ID NO: 676662 - DNA, 25 bp, Rattus norvegicus
ttgagatagactgtgtgctggccga

SEQ ID NO: 676663 - DNA, 25 bp, Rattus norvegicus
ttgagatagggcacactggcccgac

SEQ ID NO: 676664 - DNA, 25 bp, Rattus norvegicus
ttgagatagggctcactggcccgac

SEQ ID NO: 676665 - DNA, 25 bp, Rattus norvegicus
ttgagatcacagagggcatgccctt

SEQ ID NO: 676666 - DNA, 25 bp, Rattus norvegicus
ttgagatcacagtgggcatgccctt

SEQ ID NO: 676667 - DNA, 25 bp, Rattus norvegicus
ttgagatccagtccatcagccacat

SEQ ID NO: 676668 - DNA, 25 bp, Rattus norvegicus
ttgagatccagtgcatcagccacat

SEQ ID NO: 676669 - DNA, 25 bp, Rattus norvegicus
ttgagatcccatattgagtccagcc

SEQ ID NO: 676670 - DNA, 25 bp, Rattus norvegicus
ttgagatcccattttgagtccagcc

SEQ ID NO: 676671 - DNA, 25 bp, Rattus norvegicus
ttgagatcctgaattcatccccaag

SEQ ID NO: 676672 - DNA, 25 bp, Rattus norvegicus
ttgagatcctgacagagtccctggg

SEQ ID NO: 676673 - DNA, 25 bp, Rattus norvegicus
ttgagatcctgagagagtccctggg

SEQ ID NO: 676674 - DNA, 25 bp, Rattus norvegicus
ttgagatcctgatttcatccccaag

SEQ ID NO: 676675 - DNA, 25 bp, Rattus norvegicus
ttgagatctcccctttgtaggactt

SEQ ID NO: 676676 - DNA, 25 bp, Rattus norvegicus
ttgagatctcccgtttgtaggactt

SEQ ID NO: 676677 - DNA, 25 bp, Rattus norvegicus
ttgagatctcctctaaactttccct

SEQ ID NO: 676678 - DNA, 25 bp, Rattus norvegicus
ttgagatctcctgtaaactttccct

SEQ ID NO: 676679 - DNA, 25 bp, Rattus norvegicus
ttgagatctgcaaccactttgtgga

SEQ ID NO: 676680 - DNA, 25 bp, Rattus norvegicus
ttgagatctgcatccactttgtgga

SEQ ID NO: 676681 - DNA, 25 bp, Rattus norvegicus
ttgagatgaaccaaccagtccaggg

SEQ ID NO: 676682 - DNA, 25 bp, Rattus norvegicus
ttgagatgaacctaccagtccaggg

SEQ ID NO: 676683 - DNA, 25 bp, Rattus norvegicus
ttgagatgcggcagcagaacaccct

SEQ ID NO: 676684 - DNA, 25 bp, Rattus norvegicus
ttgagatgcggctgcagaacaccct

SEQ ID NO: 676685 - DNA, 25 bp, Rattus norvegicus
ttgagatgctatccccattttttgt

SEQ ID NO: 676686 - DNA, 25 bp, Rattus norvegicus
ttgagatgctatgcccattttttgt

SEQ ID NO: 676687 - DNA, 25 bp, Rattus norvegicus
ttgagatggccacgagagctgctct

SEQ ID NO: 676688 - DNA, 25 bp, Rattus norvegicus
ttgagatggccaggagagctgctct

SEQ ID NO: 676689 - DNA, 25 bp, Rattus norvegicus
ttgagatggcctaaaccccagacac

SEQ ID NO: 676690 - DNA, 25 bp, Rattus norvegicus
ttgagatggccttaaccccagacac

SEQ ID NO: 676691 - DNA, 25 bp, Rattus norvegicus
ttgagatgtccacctacatggcagg

SEQ ID NO: 676692 - DNA, 25 bp, Rattus norvegicus
ttgagatgtccagctacatggcagg

SEQ ID NO: 676693 - DNA, 25 bp, Rattus norvegicus
ttgagattcaaccaggatgcacaga

SEQ ID NO: 676694 - DNA, 25 bp, Rattus norvegicus
ttgagattcaacgaggatgcacaga

SEQ ID NO: 676695 - DNA, 25 bp, Rattus norvegicus
ttgagattccgaccagcagcttcag

SEQ ID NO: 676696 - DNA, 25 bp, Rattus norvegicus
ttgagattccgagcagcagcttcag

SEQ ID NO: 676697 - DNA, 25 bp, Rattus norvegicus
ttgagattcctacccaatcagggct

SEQ ID NO: 676698 - DNA, 25 bp, Rattus norvegicus
ttgagattcctagccaatcagggct

SEQ ID NO: 676699 - DNA, 25 bp, Rattus norvegicus
ttgagattgtgacacccgggcatcc

SEQ ID NO: 676700 - DNA, 25 bp, Rattus norvegicus
ttgagattgtgagacccgggcatcc

SEQ ID NO: 676701 - DNA, 25 bp, Rattus norvegicus
ttgagatttcaacgcaaacccgcca

SEQ ID NO: 676702 - DNA, 25 bp, Rattus norvegicus
ttgagatttcaaggcaaacccgcca

SEQ ID NO: 676703 - DNA, 25 bp, Rattus norvegicus
ttgagatttgtacggcctctgaaca

SEQ ID NO: 676704 - DNA, 25 bp, Rattus norvegicus
ttgagatttgtagggcctctgaaca

SEQ ID NO: 676705 - DNA, 25 bp, Rattus norvegicus
ttgagcaaaggtaagattcgtcgtt

SEQ ID NO: 676706 - DNA, 25 bp, Rattus norvegicus
ttgagcaaaggttagattcgtcgtt

SEQ ID NO: 676707 - DNA, 25 bp, Rattus norvegicus
ttgagcaacgcgcagtcttggaacc

SEQ ID NO: 676708 - DNA, 25 bp, Rattus norvegicus
ttgagcaacgcggagtcttggaacc

SEQ ID NO: 676709 - DNA, 25 bp, Rattus norvegicus
ttgagcaagcctatagtttccatgg

SEQ ID NO: 676710 - DNA, 25 bp, Rattus norvegicus
ttgagcaagcctttagtttccatgg

SEQ ID NO: 676711 - DNA, 25 bp, Rattus norvegicus
ttgagcaattcaccggaactgtcct

SEQ ID NO: 676712 - DNA, 25 bp, Rattus norvegicus
ttgagcaattcagcggaactgtcct

SEQ ID NO: 676713 - DNA, 25 bp, Rattus norvegicus
ttgagcacacaaagcaggcagactt

SEQ ID NO: 676714 - DNA, 25 bp, Rattus norvegicus
ttgagcacacaatgcaggcagactt

SEQ ID NO: 676715 - DNA, 25 bp, Rattus norvegicus
ttgagcacactgatcaaccactgac

SEQ ID NO: 676716 - DNA, 25 bp, Rattus norvegicus
ttgagcacactgttcaaccactgac

SEQ ID NO: 676717 - DNA, 25 bp, Rattus norvegicus
ttgagcacagctcccatgcaggatg

SEQ ID NO: 676718 - DNA, 25 bp, Rattus norvegicus
ttgagcacagctgccatgcaggatg

SEQ ID NO: 676719 - DNA, 25 bp, Rattus norvegicus
ttgagcacatcgagggccagctgga

SEQ ID NO: 676720 - DNA, 25 bp, Rattus norvegicus
ttgagcacatcgtgggccagctgga

SEQ ID NO: 676721 - DNA, 25 bp, Rattus norvegicus
ttgagcacatgaacaccacgtggac

SEQ ID NO: 676722 - DNA, 25 bp, Rattus norvegicus
ttgagcacatgatcaccacgtggac

SEQ ID NO: 676723 - DNA, 25 bp, Rattus norvegicus
ttgagcacgatgacgcggcggtaat

SEQ ID NO: 676724 - DNA, 25 bp, Rattus norvegicus
ttgagcacgatgtcgcggcggtaat

SEQ ID NO: 676725 - DNA, 25 bp, Rattus norvegicus
ttgagcacgctacctagttcgtagg

SEQ ID NO: 676726 - DNA, 25 bp, Rattus norvegicus
ttgagcacgctagctagttcgtagg

SEQ ID NO: 676727 - DNA, 25 bp, Rattus norvegicus
ttgagcacggtgacacattgccatc

SEQ ID NO: 676728 - DNA, 25 bp, Rattus norvegicus
ttgagcacggtgtcacattgccatc

SEQ ID NO: 676729 - DNA, 25 bp, Rattus norvegicus
ttgagcagaggcagtggtcaccttt

SEQ ID NO: 676730 - DNA, 25 bp, Rattus norvegicus
ttgagcagaggctgtggtcaccttt

SEQ ID NO: 676731 - DNA, 25 bp, Rattus norvegicus
ttgagcagccggaatcaaaccaagc

SEQ ID NO: 676732 - DNA, 25 bp, Rattus norvegicus
ttgagcagccggtatcaaaccaagc

SEQ ID NO: 676733 - DNA, 25 bp, Rattus norvegicus
ttgagcagcctgcagacctcttaaa

SEQ ID NO: 676734 - DNA, 25 bp, Rattus norvegicus
ttgagcagcctggagacctcttaaa

SEQ ID NO: 676735 - DNA, 25 bp, Rattus norvegicus
ttgagcagcgtcatggtcttgcggc

SEQ ID NO: 676736 - DNA, 25 bp, Rattus norvegicus
ttgagcagcgtcttggtcttgcggc

SEQ ID NO: 676737 - DNA, 25 bp, Rattus norvegicus
ttgagcagctcacgaccacctataa

SEQ ID NO: 676738 - DNA, 25 bp, Rattus norvegicus
ttgagcagctcaggaccacctataa

SEQ ID NO: 676739 - DNA, 25 bp, Rattus norvegicus
ttgagcaggcaaattgtgtaacccc

SEQ ID NO: 676740 - DNA, 25 bp, Rattus norvegicus
ttgagcaggcaatttgtgtaacccc

SEQ ID NO: 676741 - DNA, 25 bp, Rattus norvegicus
ttgagcagtagaccctgtacctagc

SEQ ID NO: 676742 - DNA, 25 bp, Rattus norvegicus
ttgagcagtagagcctgtacctagc

SEQ ID NO: 676743 - DNA, 25 bp, Rattus norvegicus
ttgagcagtgcactagggccttagc

SEQ ID NO: 676744 - DNA, 25 bp, Rattus norvegicus
ttgagcagtgcagtagggccttagc

SEQ ID NO: 676745 - DNA, 25 bp, Rattus norvegicus
ttgagcatatgcctgcagtgccaca

SEQ ID NO: 676746 - DNA, 25 bp, Rattus norvegicus
ttgagcatatgcgtgcagtgccaca

SEQ ID NO: 676747 - DNA, 25 bp, Rattus norvegicus
ttgagcatccggcagcaacacagga

SEQ ID NO: 676748 - DNA, 25 bp, Rattus norvegicus
ttgagcatccgggagcaacacagga

SEQ ID NO: 676749 - DNA, 25 bp, Rattus norvegicus
ttgagcatgcttaacctgcttgctg

SEQ ID NO: 676750 - DNA, 25 bp, Rattus norvegicus
ttgagcatgcttctccatttctatc

SEQ ID NO: 676751 - DNA, 25 bp, Rattus norvegicus
ttgagcatgcttgtccatttctatc

SEQ ID NO: 676752 - DNA, 25 bp, Rattus norvegicus
ttgagcatgctttacctgcttgctg

SEQ ID NO: 676753 - DNA, 25 bp, Rattus norvegicus
ttgagcattgatctttccacccagt

SEQ ID NO: 676754 - DNA, 25 bp, Rattus norvegicus
ttgagcattgatgtttccacccagt

SEQ ID NO: 676755 - DNA, 25 bp, Rattus norvegicus
ttgagccaagacacgggacttcctg

SEQ ID NO: 676756 - DNA, 25 bp, Rattus norvegicus
ttgagccaagactcgggacttcctg

SEQ ID NO: 676757 - DNA, 25 bp, Rattus norvegicus
ttgagccacactacctaaaagcctg

SEQ ID NO: 676758 - DNA, 25 bp, Rattus norvegicus
ttgagccacacttcctaaaagcctg

SEQ ID NO: 676759 - DNA, 25 bp, Rattus norvegicus
ttgagccacataagaagatagccta

SEQ ID NO: 676760 - DNA, 25 bp, Rattus norvegicus
ttgagccacatatgaagatagccta

SEQ ID NO: 676761 - DNA, 25 bp, Rattus norvegicus
ttgagccacgcccagggttttaggc

SEQ ID NO: 676762 - DNA, 25 bp, Rattus norvegicus
ttgagccacgccgagggttttaggc

SEQ ID NO: 676763 - DNA, 25 bp, Rattus norvegicus
ttgagccagagaaaactctgcttgc

SEQ ID NO: 676764 - DNA, 25 bp, Rattus norvegicus
ttgagccagagataactctgcttgc

SEQ ID NO: 676765 - DNA, 25 bp, Rattus norvegicus
ttgagccagcgtcccagtgcatttg

SEQ ID NO: 676766 - DNA, 25 bp, Rattus norvegicus
ttgagccagcgtgccagtgcatttg

SEQ ID NO: 676767 - DNA, 25 bp, Rattus norvegicus
ttgagccagctcagtgcatcacaga

SEQ ID NO: 676768 - DNA, 25 bp, Rattus norvegicus
ttgagccagctctgtgcatcacaga

SEQ ID NO: 676769 - DNA, 25 bp, Rattus norvegicus
ttgagcccaaacagaaattcgtgta

SEQ ID NO: 676770 - DNA, 25 bp, Rattus norvegicus
ttgagcccaaactgaaattcgtgta

SEQ ID NO: 676771 - DNA, 25 bp, Rattus norvegicus
ttgagcccaagaactgtgcggacta

SEQ ID NO: 676772 - DNA, 25 bp, Rattus norvegicus
ttgagcccaagatctgtgcggacta

SEQ ID NO: 676773 - DNA, 25 bp, Rattus norvegicus
ttgagcccatgaatagttcccctga

SEQ ID NO: 676774 - DNA, 25 bp, Rattus norvegicus
ttgagcccatgattagttcccctga

SEQ ID NO: 676775 - DNA, 25 bp, Rattus norvegicus
ttgagccccataagcaagacaccat

SEQ ID NO: 676776 - DNA, 25 bp, Rattus norvegicus
ttgagccccatatgcaagacaccat

SEQ ID NO: 676777 - DNA, 25 bp, Rattus norvegicus
ttgagcccctctccagaaactagag

SEQ ID NO: 676778 - DNA, 25 bp, Rattus norvegicus
ttgagcccctctgcagaaactagag

SEQ ID NO: 676779 - DNA, 25 bp, Rattus norvegicus
ttgagcccctgactctgaagggaac

SEQ ID NO: 676780 - DNA, 25 bp, Rattus norvegicus
ttgagcccctgagtctgaagggaac

SEQ ID NO: 676781 - DNA, 25 bp, Rattus norvegicus
ttgagccctgcaaggaacccagagc

SEQ ID NO: 676782 - DNA, 25 bp, Rattus norvegicus
ttgagccctgcatggaacccagagc

SEQ ID NO: 676783 - DNA, 25 bp, Rattus norvegicus
ttgagccctgctaagtgactgacca

SEQ ID NO: 676784 - DNA, 25 bp, Rattus norvegicus
ttgagccctgcttagtgactgacca

SEQ ID NO: 676785 - DNA, 25 bp, Rattus norvegicus
ttgagcccttgcacattaggtcagc

SEQ ID NO: 676786 - DNA, 25 bp, Rattus norvegicus
ttgagcccttgctcattaggtcagc

SEQ ID NO: 676787 - DNA, 25 bp, Rattus norvegicus
ttgagccggatcattcaagtacctc

SEQ ID NO: 676788 - DNA, 25 bp, Rattus norvegicus
ttgagccggatctttcaagtacctc

SEQ ID NO: 676789 - DNA, 25 bp, Rattus norvegicus
ttgagccgtgaactactgcaggtga

SEQ ID NO: 676790 - DNA, 25 bp, Rattus norvegicus
ttgagccgtgaagtactgcaggtga

SEQ ID NO: 676791 - DNA, 25 bp, Rattus norvegicus
ttgagccgtttaagcgtctgacctg

SEQ ID NO: 676792 - DNA, 25 bp, Rattus norvegicus
ttgagccgtttatgcgtctgacctg

SEQ ID NO: 676793 - DNA, 25 bp, Rattus norvegicus
ttgagcctagagactccagtggaaa

SEQ ID NO: 676794 - DNA, 25 bp, Rattus norvegicus
ttgagcctagagtctccagtggaaa

SEQ ID NO: 676795 - DNA, 25 bp, Rattus norvegicus
ttgagcctaggacccctcaaaggct

SEQ ID NO: 676796 - DNA, 25 bp, Rattus norvegicus
ttgagcctaggagccctcaaaggct

SEQ ID NO: 676797 - DNA, 25 bp, Rattus norvegicus
ttgagcctcaagctttaccttacag

SEQ ID NO: 676798 - DNA, 25 bp, Rattus norvegicus
ttgagcctcaaggtttaccttacag

SEQ ID NO: 676799 - DNA, 25 bp, Rattus norvegicus
ttgagcctcaccctgtggtctgggt

SEQ ID NO: 676800 - DNA, 25 bp, Rattus norvegicus
ttgagcctcaccgtgtggtctgggt

SEQ ID NO: 676801 - DNA, 25 bp, Rattus norvegicus
ttgagcctccctcagttgtcaggag

SEQ ID NO: 676802 - DNA, 25 bp, Rattus norvegicus
ttgagcctccctgagttgtcaggag

SEQ ID NO: 676803 - DNA, 25 bp, Rattus norvegicus
ttgagcctcgacagccactgagaag

SEQ ID NO: 676804 - DNA, 25 bp, Rattus norvegicus
ttgagcctcgactgccactgagaag

SEQ ID NO: 676805 - DNA, 25 bp, Rattus norvegicus
ttgagcctctgcagctcagtgatgc

SEQ ID NO: 676806 - DNA, 25 bp, Rattus norvegicus
ttgagcctctgctgctcagtgatgc

SEQ ID NO: 676807 - DNA, 25 bp, Rattus norvegicus
ttgagcctgacactcaactggcagg

SEQ ID NO: 676808 - DNA, 25 bp, Rattus norvegicus
ttgagcctgacagtcaactggcagg

SEQ ID NO: 676809 - DNA, 25 bp, Rattus norvegicus
ttgagcctgcttctagcacagctta

SEQ ID NO: 676810 - DNA, 25 bp, Rattus norvegicus
ttgagcctgcttgtagcacagctta

SEQ ID NO: 676811 - DNA, 25 bp, Rattus norvegicus
ttgagcctgggcactaccagtgccc

SEQ ID NO: 676812 - DNA, 25 bp, Rattus norvegicus
ttgagcctgggctctaccagtgccc

SEQ ID NO: 676813 - DNA, 25 bp, Rattus norvegicus
ttgagcctgtggctgatgatcctct

SEQ ID NO: 676814 - DNA, 25 bp, Rattus norvegicus
ttgagcctgtgggtgatgatcctct

SEQ ID NO: 676815 - DNA, 25 bp, Rattus norvegicus
ttgagcctgttgcacccctgttaaa

SEQ ID NO: 676816 - DNA, 25 bp, Rattus norvegicus
ttgagcctgttggacccctgttaaa

SEQ ID NO: 676817 - DNA, 25 bp, Rattus norvegicus
ttgagccttcgcagtgtctgcaaac

SEQ ID NO: 676818 - DNA, 25 bp, Rattus norvegicus
ttgagccttcgctgtgtctgcaaac

SEQ ID NO: 676819 - DNA, 25 bp, Rattus norvegicus
ttgagccttgccatagactctctca

SEQ ID NO: 676820 - DNA, 25 bp, Rattus norvegicus
ttgagccttgccttagactctctca

SEQ ID NO: 676821 - DNA, 25 bp, Rattus norvegicus
ttgagccttttcactttacagagaa

SEQ ID NO: 676822 - DNA, 25 bp, Rattus norvegicus
ttgagccttttctctttacagagaa

SEQ ID NO: 676823 - DNA, 25 bp, Rattus norvegicus
ttgagcgagcccacacgcgcgaagc

SEQ ID NO: 676824 - DNA, 25 bp, Rattus norvegicus
ttgagcgagccctcacgcgcgaagc

SEQ ID NO: 676825 - DNA, 25 bp, Rattus norvegicus
ttgagcgcctcgaagatatcatctg

SEQ ID NO: 676826 - DNA, 25 bp, Rattus norvegicus
ttgagcgcctcgtagatatcatctg

SEQ ID NO: 676827 - DNA, 25 bp, Rattus norvegicus
ttgagcgttctgagtgtctaaggca

SEQ ID NO: 676828 - DNA, 25 bp, Rattus norvegicus
ttgagcgttctgtgtgtctaaggca

SEQ ID NO: 676829 - DNA, 25 bp, Rattus norvegicus
ttgagcgttgacatctcgaaccatg

SEQ ID NO: 676830 - DNA, 25 bp, Rattus norvegicus
ttgagcgttgacttctcgaaccatg

SEQ ID NO: 676831 - DNA, 25 bp, Rattus norvegicus
ttgagcgttgtaattcgcgaaaacc

SEQ ID NO: 676832 - DNA, 25 bp, Rattus norvegicus
ttgagcgttgtatttcgcgaaaacc

SEQ ID NO: 676833 - DNA, 25 bp, Rattus norvegicus
ttgagcgtttgtcccttctgccaca

SEQ ID NO: 676834 - DNA, 25 bp, Rattus norvegicus
ttgagcgtttgtgccttctgccaca

SEQ ID NO: 676835 - DNA, 25 bp, Rattus norvegicus
ttgagctaccagatgacctgctgca

SEQ ID NO: 676836 - DNA, 25 bp, Rattus norvegicus
ttgagctaccagttgacctgctgca

SEQ ID NO: 676837 - DNA, 25 bp, Rattus norvegicus
ttgagctagcctatgagactgtcct

SEQ ID NO: 676838 - DNA, 25 bp, Rattus norvegicus
ttgagctagcctttgagactgtcct

SEQ ID NO: 676839 - DNA, 25 bp, Rattus norvegicus
ttgagctatttcacggctgtggata

SEQ ID NO: 676840 - DNA, 25 bp, Rattus norvegicus
ttgagctatttctcggctgtggata

SEQ ID NO: 676841 - DNA, 25 bp, Rattus norvegicus
ttgagctcacccaggctggactgaa

SEQ ID NO: 676842 - DNA, 25 bp, Rattus norvegicus
ttgagctcaccctggctggactgaa

SEQ ID NO: 676843 - DNA, 25 bp, Rattus norvegicus
ttgagctcaggccatcttgcccttc

SEQ ID NO: 676844 - DNA, 25 bp, Rattus norvegicus
ttgagctcaggcgatcttgcccttc

SEQ ID NO: 676845 - DNA, 25 bp, Rattus norvegicus
ttgagctcccacactagagtcagga

SEQ ID NO: 676846 - DNA, 25 bp, Rattus norvegicus
ttgagctcccactctagagtcagga

SEQ ID NO: 676847 - DNA, 25 bp, Rattus norvegicus
ttgagctccgagcacacttggatga

SEQ ID NO: 676848 - DNA, 25 bp, Rattus norvegicus
ttgagctccgaggacacttggatga

SEQ ID NO: 676849 - DNA, 25 bp, Rattus norvegicus
ttgagctcctctaccaaagtttctc

SEQ ID NO: 676850 - DNA, 25 bp, Rattus norvegicus
ttgagctcctcttccaaagtttctc

SEQ ID NO: 676851 - DNA, 25 bp, Rattus norvegicus
ttgagctcgctcaggctggtggctc

SEQ ID NO: 676852 - DNA, 25 bp, Rattus norvegicus
ttgagctcgctctggctggtggctc

SEQ ID NO: 676853 - DNA, 25 bp, Rattus norvegicus
ttgagctcggctacatgacactctc

SEQ ID NO: 676854 - DNA, 25 bp, Rattus norvegicus
ttgagctcggcttcatgacactctc

SEQ ID NO: 676855 - DNA, 25 bp, Rattus norvegicus
ttgagctcgtccagcggaaaggcgt

SEQ ID NO: 676856 - DNA, 25 bp, Rattus norvegicus
ttgagctcgtcctgcggaaaggcgt

SEQ ID NO: 676857 - DNA, 25 bp, Rattus norvegicus
ttgagctctgccatcatgtttaggg

SEQ ID NO: 676858 - DNA, 25 bp, Rattus norvegicus
ttgagctctgccttcatgtttaggg

SEQ ID NO: 676859 - DNA, 25 bp, Rattus norvegicus
ttgagctcttcaccaggttttcaca

SEQ ID NO: 676860 - DNA, 25 bp, Rattus norvegicus
ttgagctcttcagcaggttttcaca

SEQ ID NO: 676861 - DNA, 25 bp, Rattus norvegicus
ttgagctcttgcatctgcctcatgc

SEQ ID NO: 676862 - DNA, 25 bp, Rattus norvegicus
ttgagctcttgcttctgcctcatgc

SEQ ID NO: 676863 - DNA, 25 bp, Rattus norvegicus
ttgagctctttactatctcgttcca

SEQ ID NO: 676864 - DNA, 25 bp, Rattus norvegicus
ttgagctctttagtatctcgttcca

SEQ ID NO: 676865 - DNA, 25 bp, Rattus norvegicus
ttgagctgcaatcccagctgagcat

SEQ ID NO: 676866 - DNA, 25 bp, Rattus norvegicus
ttgagctgcaatgccagctgagcat

SEQ ID NO: 676867 - DNA, 25 bp, Rattus norvegicus
ttgagctgccatctgtttataaagt

SEQ ID NO: 676868 - DNA, 25 bp, Rattus norvegicus
ttgagctgccatgtgtttataaagt

SEQ ID NO: 676869 - DNA, 25 bp, Rattus norvegicus
ttgagctgtcaaaatgtctgtaatt

SEQ ID NO: 676870 - DNA, 25 bp, Rattus norvegicus
ttgagctgtcaatatgtctgtaatt

SEQ ID NO: 676871 - DNA, 25 bp, Rattus norvegicus
ttgagctgtgaaagtaaccttgggc

SEQ ID NO: 676872 - DNA, 25 bp, Rattus norvegicus
ttgagctgtgaacccatgtgtccca

SEQ ID NO: 676873 - DNA, 25 bp, Rattus norvegicus
ttgagctgtgaagccatgtgtccca

SEQ ID NO: 676874 - DNA, 25 bp, Rattus norvegicus
ttgagctgtgaatgtaaccttgggc

SEQ ID NO: 676875 - DNA, 25 bp, Rattus norvegicus
ttgagctgtggtatggtggatttta

SEQ ID NO: 676876 - DNA, 25 bp, Rattus norvegicus
ttgagctgtggtttggtggatttta

SEQ ID NO: 676877 - DNA, 25 bp, Rattus norvegicus
ttgagcttaaagctgccctggtcag

SEQ ID NO: 676878 - DNA, 25 bp, Rattus norvegicus
ttgagcttaaaggtgccctggtcag

SEQ ID NO: 676879 - DNA, 25 bp, Rattus norvegicus
ttgagcttaaccaactgtctacacg

SEQ ID NO: 676880 - DNA, 25 bp, Rattus norvegicus
ttgagcttaacctactgtctacacg

SEQ ID NO: 676881 - DNA, 25 bp, Rattus norvegicus
ttgagcttcaagcagctgtcacaaa

SEQ ID NO: 676882 - DNA, 25 bp, Rattus norvegicus
ttgagcttcaaggagctgtcacaaa

SEQ ID NO: 676883 - DNA, 25 bp, Rattus norvegicus
ttgagcttctaaaggctcgtcttct

SEQ ID NO: 676884 - DNA, 25 bp, Rattus norvegicus
ttgagcttctaatggctcgtcttct

SEQ ID NO: 676885 - DNA, 25 bp, Rattus norvegicus
ttgagcttcttgaacgtggactgcg

SEQ ID NO: 676886 - DNA, 25 bp, Rattus norvegicus
ttgagcttcttgtacgtggactgcg

SEQ ID NO: 676887 - DNA, 25 bp, Rattus norvegicus
ttgagcttgctcatctaggcagatg

SEQ ID NO: 676888 - DNA, 25 bp, Rattus norvegicus
ttgagcttgctcttctaggcagatg

SEQ ID NO: 676889 - DNA, 25 bp, Rattus norvegicus
ttgagctttctcagcctctgtgcaa

SEQ ID NO: 676890 - DNA, 25 bp, Rattus norvegicus
ttgagctttctctgcctctgtgcaa

SEQ ID NO: 676891 - DNA, 25 bp, Rattus norvegicus
ttgaggaaatgtaccccacctttca

SEQ ID NO: 676892 - DNA, 25 bp, Rattus norvegicus
ttgaggaaatgttccccacctttca

SEQ ID NO: 676893 - DNA, 25 bp, Rattus norvegicus
ttgaggaacctcaccactttgtgtt

SEQ ID NO: 676894 - DNA, 25 bp, Rattus norvegicus
ttgaggaacctctccactttgtgtt

SEQ ID NO: 676895 - DNA, 25 bp, Rattus norvegicus
ttgaggaacgccactctgacatgtg

SEQ ID NO: 676896 - DNA, 25 bp, Rattus norvegicus
ttgaggaacgcctctctgacatgtg

SEQ ID NO: 676897 - DNA, 25 bp, Rattus norvegicus
ttgaggaagacaaccgagacttggc

SEQ ID NO: 676898 - DNA, 25 bp, Rattus norvegicus
ttgaggaagacatccgagacttggc

SEQ ID NO: 676899 - DNA, 25 bp, Rattus norvegicus
ttgaggacaccacccctacagggaa

SEQ ID NO: 676900 - DNA, 25 bp, Rattus norvegicus
ttgaggacaccagccctacagggaa

SEQ ID NO: 676901 - DNA, 25 bp, Rattus norvegicus
ttgaggacatgaacgccaaggcccc

SEQ ID NO: 676902 - DNA, 25 bp, Rattus norvegicus
ttgaggacatgatcgccaaggcccc

SEQ ID NO: 676903 - DNA, 25 bp, Rattus norvegicus
ttgaggaccattcccactgatgaat

SEQ ID NO: 676904 - DNA, 25 bp, Rattus norvegicus
ttgaggaccattgccactgatgaat

SEQ ID NO: 676905 - DNA, 25 bp, Rattus norvegicus
ttgaggacccagagcccacttgagg

SEQ ID NO: 676906 - DNA, 25 bp, Rattus norvegicus
ttgaggacccagcaggcacaatcga

SEQ ID NO: 676907 - DNA, 25 bp, Rattus norvegicus
ttgaggacccaggaggcacaatcga

SEQ ID NO: 676908 - DNA, 25 bp, Rattus norvegicus
ttgaggacccagtgcccacttgagg

SEQ ID NO: 676909 - DNA, 25 bp, Rattus norvegicus
ttgaggacctacatgtcacagcggt

SEQ ID NO: 676910 - DNA, 25 bp, Rattus norvegicus
ttgaggacctacttgtcacagcggt

SEQ ID NO: 676911 - DNA, 25 bp, Rattus norvegicus
ttgaggaccttcagccactgagtgg

SEQ ID NO: 676912 - DNA, 25 bp, Rattus norvegicus
ttgaggaccttctgccactgagtgg

SEQ ID NO: 676913 - DNA, 25 bp, Rattus norvegicus
ttgaggactactctcagtcactgca

SEQ ID NO: 676914 - DNA, 25 bp, Rattus norvegicus
ttgaggactactgtcagtcactgca

SEQ ID NO: 676915 - DNA, 25 bp, Rattus norvegicus
ttgaggactattacacgctctacgc

SEQ ID NO: 676916 - DNA, 25 bp, Rattus norvegicus
ttgaggactatttcacgctctacgc

SEQ ID NO: 676917 - DNA, 25 bp, Rattus norvegicus
ttgaggagcctccaaggactctggt

SEQ ID NO: 676918 - DNA, 25 bp, Rattus norvegicus
ttgaggagcctcgaaggactctggt

SEQ ID NO: 676919 - DNA, 25 bp, Rattus norvegicus
ttgaggatccacagcaaggttcagt

SEQ ID NO: 676920 - DNA, 25 bp, Rattus norvegicus
ttgaggatccactgcaaggttcagt

SEQ ID NO: 676921 - DNA, 25 bp, Rattus norvegicus
ttgaggatccctcgtcaccagtcag

SEQ ID NO: 676922 - DNA, 25 bp, Rattus norvegicus
ttgaggatccctggtcaccagtcag

SEQ ID NO: 676923 - DNA, 25 bp, Rattus norvegicus
ttgaggatcggccagacctacttgc

SEQ ID NO: 676924 - DNA, 25 bp, Rattus norvegicus
ttgaggatcggcgagacctacttgc

SEQ ID NO: 676925 - DNA, 25 bp, Rattus norvegicus
ttgaggatctaccattttaccacgc

SEQ ID NO: 676926 - DNA, 25 bp, Rattus norvegicus
ttgaggatctacgattttaccacgc

SEQ ID NO: 676927 - DNA, 25 bp, Rattus norvegicus
ttgaggatggttcccatagtctccc

SEQ ID NO: 676928 - DNA, 25 bp, Rattus norvegicus
ttgaggatggttgccatagtctccc

SEQ ID NO: 676929 - DNA, 25 bp, Rattus norvegicus
ttgaggatgtcacccctcttctggt

SEQ ID NO: 676930 - DNA, 25 bp, Rattus norvegicus
ttgaggatgtcagccctcttctggt

SEQ ID NO: 676931 - DNA, 25 bp, Rattus norvegicus
ttgaggatgtcgatgctgtgctgtt

SEQ ID NO: 676932 - DNA, 25 bp, Rattus norvegicus
ttgaggatgtcgttgctgtgctgtt

SEQ ID NO: 676933 - DNA, 25 bp, Rattus norvegicus
ttgaggattgcacagccaacacctt

SEQ ID NO: 676934 - DNA, 25 bp, Rattus norvegicus
ttgaggattgcagagccaacacctt

SEQ ID NO: 676935 - DNA, 25 bp, Rattus norvegicus
ttgaggcaagcgctaactccccagg

SEQ ID NO: 676936 - DNA, 25 bp, Rattus norvegicus
ttgaggcaagcggtaactccccagg

SEQ ID NO: 676937 - DNA, 25 bp, Rattus norvegicus
ttgaggcacggaatctactggacta

SEQ ID NO: 676938 - DNA, 25 bp, Rattus norvegicus
ttgaggcacggattctactggacta

SEQ ID NO: 676939 - DNA, 25 bp, Rattus norvegicus
ttgaggcactcgcagacttacaaga

SEQ ID NO: 676940 - DNA, 25 bp, Rattus norvegicus
ttgaggcactcggagacttacaaga

SEQ ID NO: 676941 - DNA, 25 bp, Rattus norvegicus
ttgaggcagacactgatatcgacca

SEQ ID NO: 676942 - DNA, 25 bp, Rattus norvegicus
ttgaggcagacagtgatatcgacca

SEQ ID NO: 676943 - DNA, 25 bp, Rattus norvegicus
ttgaggcagctcagtgcagtgagca

SEQ ID NO: 676944 - DNA, 25 bp, Rattus norvegicus
ttgaggcagctctgtgcagtgagca

SEQ ID NO: 676945 - DNA, 25 bp, Rattus norvegicus
ttgaggccaagcactagtacatcct

SEQ ID NO: 676946 - DNA, 25 bp, Rattus norvegicus
ttgaggccaagctctagtacatcct

SEQ ID NO: 676947 - DNA, 25 bp, Rattus norvegicus
ttgaggccacctagatttatacagg

SEQ ID NO: 676948 - DNA, 25 bp, Rattus norvegicus
ttgaggccaccttgatttatacagg

SEQ ID NO: 676949 - DNA, 25 bp, Rattus norvegicus
ttgaggccagagaggccttggctca

SEQ ID NO: 676950 - DNA, 25 bp, Rattus norvegicus
ttgaggccagagctttgagtgatat

SEQ ID NO: 676951 - DNA, 25 bp, Rattus norvegicus
ttgaggccagaggtttgagtgatat

SEQ ID NO: 676952 - DNA, 25 bp, Rattus norvegicus
ttgaggccagagtggccttggctca

SEQ ID NO: 676953 - DNA, 25 bp, Rattus norvegicus
ttgaggccatccaagtcttcagagg

SEQ ID NO: 676954 - DNA, 25 bp, Rattus norvegicus
ttgaggccatcctagtcttcagagg

SEQ ID NO: 676955 - DNA, 25 bp, Rattus norvegicus
ttgaggcccatgactgaagctgcat

SEQ ID NO: 676956 - DNA, 25 bp, Rattus norvegicus
ttgaggcccatgtctgaagctgcat

SEQ ID NO: 676957 - DNA, 25 bp, Rattus norvegicus
ttgaggccccatacaccagtgaaga

SEQ ID NO: 676958 - DNA, 25 bp, Rattus norvegicus
ttgaggccccattcaccagtgaaga

SEQ ID NO: 676959 - DNA, 25 bp, Rattus norvegicus
ttgaggccccgcagctccgttgagg

SEQ ID NO: 676960 - DNA, 25 bp, Rattus norvegicus
ttgaggccccgctgctccgttgagg

SEQ ID NO: 676961 - DNA, 25 bp, Rattus norvegicus
ttgaggccctcaactatgaagcggt

SEQ ID NO: 676962 - DNA, 25 bp, Rattus norvegicus
ttgaggccctcatctatgaagcggt

SEQ ID NO: 676963 - DNA, 25 bp, Rattus norvegicus
ttgaggcctcggacatgttcagggc

SEQ ID NO: 676964 - DNA, 25 bp, Rattus norvegicus
ttgaggcctcggtcatgttcagggc

SEQ ID NO: 676965 - DNA, 25 bp, Rattus norvegicus
ttgaggcctttcaactttgcagttc

SEQ ID NO: 676966 - DNA, 25 bp, Rattus norvegicus
ttgaggcctttctactttgcagttc

SEQ ID NO: 676967 - DNA, 25 bp, Rattus norvegicus
ttgaggcgcagtctgttaacgtcct

SEQ ID NO: 676968 - DNA, 25 bp, Rattus norvegicus
ttgaggcgcagtgtgttaacgtcct

SEQ ID NO: 676969 - DNA, 25 bp, Rattus norvegicus
ttgaggcgccggccacagcgtctct

SEQ ID NO: 676970 - DNA, 25 bp, Rattus norvegicus
ttgaggcgccgggcacagcgtctct

SEQ ID NO: 676971 - DNA, 25 bp, Rattus norvegicus
ttgaggctaagaccgctggactcct

SEQ ID NO: 676972 - DNA, 25 bp, Rattus norvegicus
ttgaggctaagagcgctggactcct

SEQ ID NO: 676973 - DNA, 25 bp, Rattus norvegicus
ttgaggctacctattgctgcatact

SEQ ID NO: 676974 - DNA, 25 bp, Rattus norvegicus
ttgaggctaccttttgctgcatact

SEQ ID NO: 676975 - DNA, 25 bp, Rattus norvegicus
ttgaggctagcgcagcatacatcat

SEQ ID NO: 676976 - DNA, 25 bp, Rattus norvegicus
ttgaggctagcggagcatacatcat

SEQ ID NO: 676977 - DNA, 25 bp, Rattus norvegicus
ttgaggctattgacctttgttcctt

SEQ ID NO: 676978 - DNA, 25 bp, Rattus norvegicus
ttgaggctattgtcctttgttcctt

SEQ ID NO: 676979 - DNA, 25 bp, Rattus norvegicus
ttgaggctcacacagctacaccaaa

SEQ ID NO: 676980 - DNA, 25 bp, Rattus norvegicus
ttgaggctcacagagctacaccaaa

SEQ ID NO: 676981 - DNA, 25 bp, Rattus norvegicus
ttgaggctcaccagatacactttgc

SEQ ID NO: 676982 - DNA, 25 bp, Rattus norvegicus
ttgaggctcacctgatacactttgc

SEQ ID NO: 676983 - DNA, 25 bp, Rattus norvegicus
ttgaggctcataaatgcttcattcc

SEQ ID NO: 676984 - DNA, 25 bp, Rattus norvegicus
ttgaggctcatatatgcttcattcc

SEQ ID NO: 676985 - DNA, 25 bp, Rattus norvegicus
ttgaggctcccgcagttggcaaaag

SEQ ID NO: 676986 - DNA, 25 bp, Rattus norvegicus
ttgaggctcccggagttggcaaaag

SEQ ID NO: 676987 - DNA, 25 bp, Rattus norvegicus
ttgaggctccttccctgaaacaaga

SEQ ID NO: 676988 - DNA, 25 bp, Rattus norvegicus
ttgaggctccttgcctgaaacaaga

SEQ ID NO: 676989 - DNA, 25 bp, Rattus norvegicus
ttgaggctgagaatcttgtcctcca

SEQ ID NO: 676990 - DNA, 25 bp, Rattus norvegicus
ttgaggctgagattcttgtcctcca

SEQ ID NO: 676991 - DNA, 25 bp, Rattus norvegicus
ttgaggctgatgatgactcccttgc

SEQ ID NO: 676992 - DNA, 25 bp, Rattus norvegicus
ttgaggctgatgttgactcccttgc

SEQ ID NO: 676993 - DNA, 25 bp, Rattus norvegicus
ttgaggcttaggatgctggtgcaat

SEQ ID NO: 676994 - DNA, 25 bp, Rattus norvegicus
ttgaggcttaggttgctggtgcaat

SEQ ID NO: 676995 - DNA, 25 bp, Rattus norvegicus
ttgaggcttcaaaagtcatccgttt

SEQ ID NO: 676996 - DNA, 25 bp, Rattus norvegicus
ttgaggcttcaatagtcatccgttt

SEQ ID NO: 676997 - DNA, 25 bp, Rattus norvegicus
ttgagggaacccctgtcagactcca

SEQ ID NO: 676998 - DNA, 25 bp, Rattus norvegicus
ttgagggaacccgtgtcagactcca

SEQ ID NO: 676999 - DNA, 25 bp, Rattus norvegicus
ttgagggaagatcctgctccagtcc

SEQ ID NO: 677000 - DNA, 25 bp, Rattus norvegicus
ttgagggaagatgctgctccagtcc

SEQ ID NO: 677001 - DNA, 25 bp, Rattus norvegicus
ttgagggacgcgcaagcaaagcccc

SEQ ID NO: 677002 - DNA, 25 bp, Rattus norvegicus
ttgagggacgcggaagcaaagcccc

SEQ ID NO: 677003 - DNA, 25 bp, Rattus norvegicus
ttgagggatctaccggtctctgcca

SEQ ID NO: 677004 - DNA, 25 bp, Rattus norvegicus
ttgagggatctagcggtctctgcca

SEQ ID NO: 677005 - DNA, 25 bp, Rattus norvegicus
ttgagggattcacccaggtggctac

SEQ ID NO: 677006 - DNA, 25 bp, Rattus norvegicus
ttgagggattcagccaggtggctac

SEQ ID NO: 677007 - DNA, 25 bp, Rattus norvegicus
ttgagggcagccagacctttgcaga

SEQ ID NO: 677008 - DNA, 25 bp, Rattus norvegicus
ttgagggcagcctgacctttgcaga

SEQ ID NO: 677009 - DNA, 25 bp, Rattus norvegicus
ttgagggccagtctcctattgtaaa

SEQ ID NO: 677010 - DNA, 25 bp, Rattus norvegicus
ttgagggccagtgtcctattgtaaa

SEQ ID NO: 677011 - DNA, 25 bp, Rattus norvegicus
ttgagggcccagatgtcttttctct

SEQ ID NO: 677012 - DNA, 25 bp, Rattus norvegicus
ttgagggcccagttgtcttttctct

SEQ ID NO: 677013 - DNA, 25 bp, Rattus norvegicus
ttgagggccgatcattagtaagata

SEQ ID NO: 677014 - DNA, 25 bp, Rattus norvegicus
ttgagggccgatgattagtaagata

SEQ ID NO: 677015 - DNA, 25 bp, Rattus norvegicus
ttgagggcctccaacatattctcag

SEQ ID NO: 677016 - DNA, 25 bp, Rattus norvegicus
ttgagggcctcctacatattctcag

SEQ ID NO: 677017 - DNA, 25 bp, Rattus norvegicus
ttgagggcgcacatcgtggagcttc

SEQ ID NO: 677018 - DNA, 25 bp, Rattus norvegicus
ttgagggcgcacttcgtggagcttc

SEQ ID NO: 677019 - DNA, 25 bp, Rattus norvegicus
ttgagggcgtgacagttccctgtcc

SEQ ID NO: 677020 - DNA, 25 bp, Rattus norvegicus
ttgagggcgtgagagttccctgtcc

SEQ ID NO: 677021 - DNA, 25 bp, Rattus norvegicus
ttgagggctcatcataaacactgtt

SEQ ID NO: 677022 - DNA, 25 bp, Rattus norvegicus
ttgagggctcatgataaacactgtt

SEQ ID NO: 677023 - DNA, 25 bp, Rattus norvegicus
ttgagggctcttatgctaggttttg

SEQ ID NO: 677024 - DNA, 25 bp, Rattus norvegicus
ttgagggctcttttgctaggttttg

SEQ ID NO: 677025 - DNA, 25 bp, Rattus norvegicus
ttgagggcttgtactgcgtggacca

SEQ ID NO: 677026 - DNA, 25 bp, Rattus norvegicus
ttgagggcttgttctgcgtggacca

SEQ ID NO: 677027 - DNA, 25 bp, Rattus norvegicus
ttgagggtagagatcctttccactc

SEQ ID NO: 677028 - DNA, 25 bp, Rattus norvegicus
ttgagggtagagttcctttccactc

SEQ ID NO: 677029 - DNA, 25 bp, Rattus norvegicus
ttgagggtcaagaagagaatctgca

SEQ ID NO: 677030 - DNA, 25 bp, Rattus norvegicus
ttgagggtcaagtagagaatctgca

SEQ ID NO: 677031 - DNA, 25 bp, Rattus norvegicus
ttgagggtctgcaatcaccggacag

SEQ ID NO: 677032 - DNA, 25 bp, Rattus norvegicus
ttgagggtctgccttactggttcct

SEQ ID NO: 677033 - DNA, 25 bp, Rattus norvegicus
ttgagggtctgcgttactggttcct

SEQ ID NO: 677034 - DNA, 25 bp, Rattus norvegicus
ttgagggtctgctatcaccggacag

SEQ ID NO: 677035 - DNA, 25 bp, Rattus norvegicus
ttgagggttagtatgttgctatgta

SEQ ID NO: 677036 - DNA, 25 bp, Rattus norvegicus
ttgagggttagtttgttgctatgta

SEQ ID NO: 677037 - DNA, 25 bp, Rattus norvegicus
ttgagggttgagatttattccatac

SEQ ID NO: 677038 - DNA, 25 bp, Rattus norvegicus
ttgagggttgagttttattccatac

SEQ ID NO: 677039 - DNA, 25 bp, Rattus norvegicus
ttgaggtacaaactctcttctgtgc

SEQ ID NO: 677040 - DNA, 25 bp, Rattus norvegicus
ttgaggtacaaagtctcttctgtgc

SEQ ID NO: 677041 - DNA, 25 bp, Rattus norvegicus
ttgaggtagtaacacccaccctgaa

SEQ ID NO: 677042 - DNA, 25 bp, Rattus norvegicus
ttgaggtagtaagacccaccctgaa

SEQ ID NO: 677043 - DNA, 25 bp, Rattus norvegicus
ttgaggtcaatcaggcctccattgt

SEQ ID NO: 677044 - DNA, 25 bp, Rattus norvegicus
ttgaggtcaatctggcctccattgt

SEQ ID NO: 677045 - DNA, 25 bp, Rattus norvegicus
ttgaggtccgctaggatccgagcta

SEQ ID NO: 677046 - DNA, 25 bp, Rattus norvegicus
ttgaggtccgcttggatccgagcta

SEQ ID NO: 677047 - DNA, 25 bp, Rattus norvegicus
ttgaggtccggaatgcaagcctgga

SEQ ID NO: 677048 - DNA, 25 bp, Rattus norvegicus
ttgaggtccggattgcaagcctgga

SEQ ID NO: 677049 - DNA, 25 bp, Rattus norvegicus
ttgaggtctttgagtccaaggaaaa

SEQ ID NO: 677050 - DNA, 25 bp, Rattus norvegicus
ttgaggtctttgtgtccaaggaaaa

SEQ ID NO: 677051 - DNA, 25 bp, Rattus norvegicus
ttgaggtgacgcacttccatgttct

SEQ ID NO: 677052 - DNA, 25 bp, Rattus norvegicus
ttgaggtgacgctcttccatgttct

SEQ ID NO: 677053 - DNA, 25 bp, Rattus norvegicus
ttgaggtgcaaacttaccagccgcc

SEQ ID NO: 677054 - DNA, 25 bp, Rattus norvegicus
ttgaggtgcaaagttaccagccgcc

SEQ ID NO: 677055 - DNA, 25 bp, Rattus norvegicus
ttgaggtggaacagctcaagattga

SEQ ID NO: 677056 - DNA, 25 bp, Rattus norvegicus
ttgaggtggaactgctcaagattga

SEQ ID NO: 677057 - DNA, 25 bp, Rattus norvegicus
ttgaggtggtttccaacgaccgtct

SEQ ID NO: 677058 - DNA, 25 bp, Rattus norvegicus
ttgaggtggtttgcaacgaccgtct

SEQ ID NO: 677059 - DNA, 25 bp, Rattus norvegicus
ttgaggtgttacaaaaccacttgag

SEQ ID NO: 677060 - DNA, 25 bp, Rattus norvegicus
ttgaggtgttactaaaccacttgag

SEQ ID NO: 677061 - DNA, 25 bp, Rattus norvegicus
ttgaggttaactactgccttcccta

SEQ ID NO: 677062 - DNA, 25 bp, Rattus norvegicus
ttgaggttaacttctgccttcccta

SEQ ID NO: 677063 - DNA, 25 bp, Rattus norvegicus
ttgaggttcttaccacagtgtatcc

SEQ ID NO: 677064 - DNA, 25 bp, Rattus norvegicus
ttgaggttcttagcacagtgtatcc

SEQ ID NO: 677065 - DNA, 25 bp, Rattus norvegicus
ttgaggttgcttcacccgctgacca

SEQ ID NO: 677066 - DNA, 25 bp, Rattus norvegicus
ttgaggttgcttgacccgctgacca

SEQ ID NO: 677067 - DNA, 25 bp, Rattus norvegicus
ttgaggtttcataccttgtcgtcat

SEQ ID NO: 677068 - DNA, 25 bp, Rattus norvegicus
ttgaggtttcattccttgtcgtcat

SEQ ID NO: 677069 - DNA, 25 bp, Rattus norvegicus
ttgaggtttccaatgctgagcagcc

SEQ ID NO: 677070 - DNA, 25 bp, Rattus norvegicus
ttgaggtttccattgctgagcagcc

SEQ ID NO: 677071 - DNA, 25 bp, Rattus norvegicus
ttgaggttttaaagcaccaccccac

SEQ ID NO: 677072 - DNA, 25 bp, Rattus norvegicus
ttgaggttttaatgcaccaccccac

SEQ ID NO: 677073 - DNA, 25 bp, Rattus norvegicus
ttgaggttttatagcctggctctat

SEQ ID NO: 677074 - DNA, 25 bp, Rattus norvegicus
ttgaggttttattgcctggctctat

SEQ ID NO: 677075 - DNA, 25 bp, Rattus norvegicus
ttgaggttttgcaacgagccccaat

SEQ ID NO: 677076 - DNA, 25 bp, Rattus norvegicus
ttgaggttttgctacgagccccaat

SEQ ID NO: 677077 - DNA, 25 bp, Rattus norvegicus
ttgagtaaccatatcctctgtggcc

SEQ ID NO: 677078 - DNA, 25 bp, Rattus norvegicus
ttgagtaaccatttcctctgtggcc

SEQ ID NO: 677079 - DNA, 25 bp, Rattus norvegicus
ttgagtaaccccctcagtagcagtg

SEQ ID NO: 677080 - DNA, 25 bp, Rattus norvegicus
ttgagtaaccccgtcagtagcagtg

SEQ ID NO: 677081 - DNA, 25 bp, Rattus norvegicus
ttgagtaccattcagaccctgtctt

SEQ ID NO: 677082 - DNA, 25 bp, Rattus norvegicus
ttgagtaccattgagaccctgtctt

SEQ ID NO: 677083 - DNA, 25 bp, Rattus norvegicus
ttgagtagcagtcatgtcccacttc

SEQ ID NO: 677084 - DNA, 25 bp, Rattus norvegicus
ttgagtagcagtgatgtcccacttc

SEQ ID NO: 677085 - DNA, 25 bp, Rattus norvegicus
ttgagtagttacctcccattggttc

SEQ ID NO: 677086 - DNA, 25 bp, Rattus norvegicus
ttgagtagttacgtcccattggttc

SEQ ID NO: 677087 - DNA, 25 bp, Rattus norvegicus
ttgagtatctcaagcagcaggttgc

SEQ ID NO: 677088 - DNA, 25 bp, Rattus norvegicus
ttgagtatctcatgcagcaggttgc

SEQ ID NO: 677089 - DNA, 25 bp, Rattus norvegicus
ttgagtatgagtactgaagcctttt

SEQ ID NO: 677090 - DNA, 25 bp, Rattus norvegicus
ttgagtatgagttctgaagcctttt

SEQ ID NO: 677091 - DNA, 25 bp, Rattus norvegicus
ttgagtatggatctgcctgcctttt

SEQ ID NO: 677092 - DNA, 25 bp, Rattus norvegicus
ttgagtatggatgtgcctgcctttt

SEQ ID NO: 677093 - DNA, 25 bp, Rattus norvegicus
ttgagtattttgaatgctattctgg

SEQ ID NO: 677094 - DNA, 25 bp, Rattus norvegicus
ttgagtattttgtatgctattctgg

SEQ ID NO: 677095 - DNA, 25 bp, Rattus norvegicus
ttgagtcaaacaaaccctaatgtat

SEQ ID NO: 677096 - DNA, 25 bp, Rattus norvegicus
ttgagtcaaacataccctaatgtat

SEQ ID NO: 677097 - DNA, 25 bp, Rattus norvegicus
ttgagtcaaagcctcttactgcacc

SEQ ID NO: 677098 - DNA, 25 bp, Rattus norvegicus
ttgagtcaaagcgtcttactgcacc

SEQ ID NO: 677099 - DNA, 25 bp, Rattus norvegicus
ttgagtcaagacaccagtctctctc

SEQ ID NO: 677100 - DNA, 25 bp, Rattus norvegicus
ttgagtcaagactccagtctctctc

SEQ ID NO: 677101 - DNA, 25 bp, Rattus norvegicus
ttgagtcacagcactgaatgaaatc

SEQ ID NO: 677102 - DNA, 25 bp, Rattus norvegicus
ttgagtcacagctctgaatgaaatc

SEQ ID NO: 677103 - DNA, 25 bp, Rattus norvegicus
ttgagtcacctcaactttctgcagt

SEQ ID NO: 677104 - DNA, 25 bp, Rattus norvegicus
ttgagtcacctctactttctgcagt

SEQ ID NO: 677105 - DNA, 25 bp, Rattus norvegicus
ttgagtcagatgctttcatttacac

SEQ ID NO: 677106 - DNA, 25 bp, Rattus norvegicus
ttgagtcagatggtttcatttacac

SEQ ID NO: 677107 - DNA, 25 bp, Rattus norvegicus
ttgagtcagcccaagaagcccagag

SEQ ID NO: 677108 - DNA, 25 bp, Rattus norvegicus
ttgagtcagccctagaagcccagag

SEQ ID NO: 677109 - DNA, 25 bp, Rattus norvegicus
ttgagtcagtcaagtgcctctgcca

SEQ ID NO: 677110 - DNA, 25 bp, Rattus norvegicus
ttgagtcagtcatgtgcctctgcca

SEQ ID NO: 677111 - DNA, 25 bp, Rattus norvegicus
ttgagtcatggcagaccatacctca

SEQ ID NO: 677112 - DNA, 25 bp, Rattus norvegicus
ttgagtcatggctgaccatacctca

SEQ ID NO: 677113 - DNA, 25 bp, Rattus norvegicus
ttgagtcatttccttctctttcaag

SEQ ID NO: 677114 - DNA, 25 bp, Rattus norvegicus
ttgagtcatttcgttctctttcaag

SEQ ID NO: 677115 - DNA, 25 bp, Rattus norvegicus
ttgagtccaagaagttggcctctga

SEQ ID NO: 677116 - DNA, 25 bp, Rattus norvegicus
ttgagtccaagatgttggcctctga

SEQ ID NO: 677117 - DNA, 25 bp, Rattus norvegicus
ttgagtccactaaatctgccttcag

SEQ ID NO: 677118 - DNA, 25 bp, Rattus norvegicus
ttgagtccactatatctgccttcag

SEQ ID NO: 677119 - DNA, 25 bp, Rattus norvegicus
ttgagtccacttagtaagcccgagt

SEQ ID NO: 677120 - DNA, 25 bp, Rattus norvegicus
ttgagtccactttgtaagcccgagt

SEQ ID NO: 677121 - DNA, 25 bp, Rattus norvegicus
ttgagtccaggaaagccaggcctct

SEQ ID NO: 677122 - DNA, 25 bp, Rattus norvegicus
ttgagtccaggatagccaggcctct

SEQ ID NO: 677123 - DNA, 25 bp, Rattus norvegicus
ttgagtccatccagggcaacacaga

SEQ ID NO: 677124 - DNA, 25 bp, Rattus norvegicus
ttgagtccatcctgggcaacacaga

SEQ ID NO: 677125 - DNA, 25 bp, Rattus norvegicus
ttgagtccattaattgggccccttt

SEQ ID NO: 677126 - DNA, 25 bp, Rattus norvegicus
ttgagtccattatttgggccccttt

SEQ ID NO: 677127 - DNA, 25 bp, Rattus norvegicus
ttgagtcccagtcgcacatccagga

SEQ ID NO: 677128 - DNA, 25 bp, Rattus norvegicus
ttgagtcccagtggcacatccagga

SEQ ID NO: 677129 - DNA, 25 bp, Rattus norvegicus
ttgagtcccattcaggacactaatt

SEQ ID NO: 677130 - DNA, 25 bp, Rattus norvegicus
ttgagtcccattgaggacactaatt

SEQ ID NO: 677131 - DNA, 25 bp, Rattus norvegicus
ttgagtccccatatgaagaagagaa

SEQ ID NO: 677132 - DNA, 25 bp, Rattus norvegicus
ttgagtccccatttgaagaagagaa

SEQ ID NO: 677133 - DNA, 25 bp, Rattus norvegicus
ttgagtccgtttagcatactgccgc

SEQ ID NO: 677134 - DNA, 25 bp, Rattus norvegicus
ttgagtccgttttgcatactgccgc

SEQ ID NO: 677135 - DNA, 25 bp, Rattus norvegicus
ttgagtcctcgacccacgcgtggat

SEQ ID NO: 677136 - DNA, 25 bp, Rattus norvegicus
ttgagtcctcgagccacgcgtggat

SEQ ID NO: 677137 - DNA, 25 bp, Rattus norvegicus
ttgagtcctctgcaaggctcctgct

SEQ ID NO: 677138 - DNA, 25 bp, Rattus norvegicus
ttgagtcctctggaaggctcctgct

SEQ ID NO: 677139 - DNA, 25 bp, Rattus norvegicus
ttgagtcctgaacctttgagcctgc

SEQ ID NO: 677140 - DNA, 25 bp, Rattus norvegicus
ttgagtcctgaagctttgagcctgc

SEQ ID NO: 677141 - DNA, 25 bp, Rattus norvegicus
ttgagtcctggactggcaaccatct

SEQ ID NO: 677142 - DNA, 25 bp, Rattus norvegicus
ttgagtcctggagtggcaaccatct

SEQ ID NO: 677143 - DNA, 25 bp, Rattus norvegicus
ttgagtcctggcacacacatcttag

SEQ ID NO: 677144 - DNA, 25 bp, Rattus norvegicus
ttgagtcctggctcacacatcttag

SEQ ID NO: 677145 - DNA, 25 bp, Rattus norvegicus
ttgagtctaattacctctgtgcggc

SEQ ID NO: 677146 - DNA, 25 bp, Rattus norvegicus
ttgagtctaatttcctctgtgcggc

SEQ ID NO: 677147 - DNA, 25 bp, Rattus norvegicus
ttgagtctcaatccttgacttctgc

SEQ ID NO: 677148 - DNA, 25 bp, Rattus norvegicus
ttgagtctcaatgcttgacttctgc

SEQ ID NO: 677149 - DNA, 25 bp, Rattus norvegicus
ttgagtctctgcagcgtgagatcca

SEQ ID NO: 677150 - DNA, 25 bp, Rattus norvegicus
ttgagtctctgctgcgtgagatcca

SEQ ID NO: 677151 - DNA, 25 bp, Rattus norvegicus
ttgagtctcttgaggcatcttcctt

SEQ ID NO: 677152 - DNA, 25 bp, Rattus norvegicus
ttgagtctcttgtggcatcttcctt

SEQ ID NO: 677153 - DNA, 25 bp, Rattus norvegicus
ttgagtcttatccagaggcctttgt

SEQ ID NO: 677154 - DNA, 25 bp, Rattus norvegicus
ttgagtcttatcgagaggcctttgt

SEQ ID NO: 677155 - DNA, 25 bp, Rattus norvegicus
ttgagtcttgggacctttcagcagc

SEQ ID NO: 677156 - DNA, 25 bp, Rattus norvegicus
ttgagtcttgggtcctttcagcagc

SEQ ID NO: 677157 - DNA, 25 bp, Rattus norvegicus
ttgagtgaacacagtacgcacggcc

SEQ ID NO: 677158 - DNA, 25 bp, Rattus norvegicus
ttgagtgaacactgtacgcacggcc

SEQ ID NO: 677159 - DNA, 25 bp, Rattus norvegicus
ttgagtgaactcctttgtgcatcag

SEQ ID NO: 677160 - DNA, 25 bp, Rattus norvegicus
ttgagtgaactcgtttgtgcatcag

SEQ ID NO: 677161 - DNA, 25 bp, Rattus norvegicus
ttgagtgaagcccacatccttgtgt

SEQ ID NO: 677162 - DNA, 25 bp, Rattus norvegicus
ttgagtgaagccgacatccttgtgt

SEQ ID NO: 677163 - DNA, 25 bp, Rattus norvegicus
ttgagtgagtagactgtctcacacg

SEQ ID NO: 677164 - DNA, 25 bp, Rattus norvegicus
ttgagtgagtagtctgtctcacacg

SEQ ID NO: 677165 - DNA, 25 bp, Rattus norvegicus
ttgagtgccatcctggtttcagcta

SEQ ID NO: 677166 - DNA, 25 bp, Rattus norvegicus
ttgagtgccatcgtggtttcagcta

SEQ ID NO: 677167 - DNA, 25 bp, Rattus norvegicus
ttgagtgcccttctcagtttagcct

SEQ ID NO: 677168 - DNA, 25 bp, Rattus norvegicus
ttgagtgcccttgtcagtttagcct

SEQ ID NO: 677169 - DNA, 25 bp, Rattus norvegicus
ttgagtgctatgatgtcccctcctg

SEQ ID NO: 677170 - DNA, 25 bp, Rattus norvegicus
ttgagtgctatgttgtcccctcctg

SEQ ID NO: 677171 - DNA, 25 bp, Rattus norvegicus
ttgagtgctccaccttcagaacaac

SEQ ID NO: 677172 - DNA, 25 bp, Rattus norvegicus
ttgagtgctccagcttcagaacaac

SEQ ID NO: 677173 - DNA, 25 bp, Rattus norvegicus
ttgagtggcaggaatctccagtcca

SEQ ID NO: 677174 - DNA, 25 bp, Rattus norvegicus
ttgagtggcaggtatctccagtcca

SEQ ID NO: 677175 - DNA, 25 bp, Rattus norvegicus
ttgagtggccggctttactagatcc

SEQ ID NO: 677176 - DNA, 25 bp, Rattus norvegicus
ttgagtggccgggtttactagatcc

SEQ ID NO: 677177 - DNA, 25 bp, Rattus norvegicus
ttgagtggtaggaataccgccattc

SEQ ID NO: 677178 - DNA, 25 bp, Rattus norvegicus
ttgagtggtaggtataccgccattc

SEQ ID NO: 677179 - DNA, 25 bp, Rattus norvegicus
ttgagtgtacaaatcctaatctatt

SEQ ID NO: 677180 - DNA, 25 bp, Rattus norvegicus
ttgagtgtacaattcctaatctatt

SEQ ID NO: 677181 - DNA, 25 bp, Rattus norvegicus
ttgagtgtacagaccatgacctccg

SEQ ID NO: 677182 - DNA, 25 bp, Rattus norvegicus
ttgagtgtacagtccatgacctccg

SEQ ID NO: 677183 - DNA, 25 bp, Rattus norvegicus
ttgagtgtactgagcctggtttgat

SEQ ID NO: 677184 - DNA, 25 bp, Rattus norvegicus
ttgagtgtactgtgcctggtttgat

SEQ ID NO: 677185 - DNA, 25 bp, Rattus norvegicus
ttgagtgtatttaatccaggtatga

SEQ ID NO: 677186 - DNA, 25 bp, Rattus norvegicus
ttgagtgtattttatccaggtatga

SEQ ID NO: 677187 - DNA, 25 bp, Rattus norvegicus
ttgagtgtccaccaagaccttgcat

SEQ ID NO: 677188 - DNA, 25 bp, Rattus norvegicus
ttgagtgtccacgaagaccttgcat

SEQ ID NO: 677189 - DNA, 25 bp, Rattus norvegicus
ttgagtgtctttacttttctgctaa

SEQ ID NO: 677190 - DNA, 25 bp, Rattus norvegicus
ttgagtgtctttccttcagtcgcag

SEQ ID NO: 677191 - DNA, 25 bp, Rattus norvegicus
ttgagtgtctttgcttcagtcgcag

SEQ ID NO: 677192 - DNA, 25 bp, Rattus norvegicus
ttgagtgtcttttcttttctgctaa

SEQ ID NO: 677193 - DNA, 25 bp, Rattus norvegicus
ttgagtgtggctcctgacctgctgc

SEQ ID NO: 677194 - DNA, 25 bp, Rattus norvegicus
ttgagtgtggctgctgacctgctgc

SEQ ID NO: 677195 - DNA, 25 bp, Rattus norvegicus
ttgagtgtgtgcacatctctcccat

SEQ ID NO: 677196 - DNA, 25 bp, Rattus norvegicus
ttgagtgtgtgctcatctctcccat

SEQ ID NO: 677197 - DNA, 25 bp, Rattus norvegicus
ttgagtgtttggacacggaactgct

SEQ ID NO: 677198 - DNA, 25 bp, Rattus norvegicus
ttgagtgtttggtcacggaactgct

SEQ ID NO: 677199 - DNA, 25 bp, Rattus norvegicus
ttgagttaagctctctcccaaccag

SEQ ID NO: 677200 - DNA, 25 bp, Rattus norvegicus
ttgagttaagctgtctcccaaccag

SEQ ID NO: 677201 - DNA, 25 bp, Rattus norvegicus
ttgagttaccaactgtgacagccat

SEQ ID NO: 677202 - DNA, 25 bp, Rattus norvegicus
ttgagttaccaagtgtgacagccat

SEQ ID NO: 677203 - DNA, 25 bp, Rattus norvegicus
ttgagttaccgaacacagcacctgc

SEQ ID NO: 677204 - DNA, 25 bp, Rattus norvegicus
ttgagttaccgatcacagcacctgc

SEQ ID NO: 677205 - DNA, 25 bp, Rattus norvegicus
ttgagttagactacaccgtcctact

SEQ ID NO: 677206 - DNA, 25 bp, Rattus norvegicus
ttgagttagacttcaccgtcctact

SEQ ID NO: 677207 - DNA, 25 bp, Rattus norvegicus
ttgagttagcccaccccatctatga

SEQ ID NO: 677208 - DNA, 25 bp, Rattus norvegicus
ttgagttagccctccccatctatga

SEQ ID NO: 677209 - DNA, 25 bp, Rattus norvegicus
ttgagttagtaaaagcaggttccat

SEQ ID NO: 677210 - DNA, 25 bp, Rattus norvegicus
ttgagttagtaatagcaggttccat

SEQ ID NO: 677211 - DNA, 25 bp, Rattus norvegicus
ttgagttatcaacacgggttcccgg

SEQ ID NO: 677212 - DNA, 25 bp, Rattus norvegicus
ttgagttatcaagacgggttcccgg

SEQ ID NO: 677213 - DNA, 25 bp, Rattus norvegicus
ttgagttattttccacctttccatt

SEQ ID NO: 677214 - DNA, 25 bp, Rattus norvegicus
ttgagttattttgcacctttccatt

SEQ ID NO: 677215 - DNA, 25 bp, Rattus norvegicus
ttgagttcaaacaggcctacggtag

SEQ ID NO: 677216 - DNA, 25 bp, Rattus norvegicus
ttgagttcaaactggcctacggtag

SEQ ID NO: 677217 - DNA, 25 bp, Rattus norvegicus
ttgagttcattacagccatttccac

SEQ ID NO: 677218 - DNA, 25 bp, Rattus norvegicus
ttgagttcattagagccatttccac

SEQ ID NO: 677219 - DNA, 25 bp, Rattus norvegicus
ttgagttcattgactgtgtcttctt

SEQ ID NO: 677220 - DNA, 25 bp, Rattus norvegicus
ttgagttcattgtctgtgtcttctt

SEQ ID NO: 677221 - DNA, 25 bp, Rattus norvegicus
ttgagttccatgagtgtccccatac

SEQ ID NO: 677222 - DNA, 25 bp, Rattus norvegicus
ttgagttccatgtgtgtccccatac

SEQ ID NO: 677223 - DNA, 25 bp, Rattus norvegicus
ttgagttcccaaaccttgtctttct

SEQ ID NO: 677224 - DNA, 25 bp, Rattus norvegicus
ttgagttcccaatccttgtctttct

SEQ ID NO: 677225 - DNA, 25 bp, Rattus norvegicus
ttgagttccccgagggcctcatgga

SEQ ID NO: 677226 - DNA, 25 bp, Rattus norvegicus
ttgagttccccgtgggcctcatgga

SEQ ID NO: 677227 - DNA, 25 bp, Rattus norvegicus
ttgagttcctatcctgactgtccaa

SEQ ID NO: 677228 - DNA, 25 bp, Rattus norvegicus
ttgagttcctatgctgactgtccaa

SEQ ID NO: 677229 - DNA, 25 bp, Rattus norvegicus
ttgagttctccaccgagacgcatga

SEQ ID NO: 677230 - DNA, 25 bp, Rattus norvegicus
ttgagttctccagcgagacgcatga

SEQ ID NO: 677231 - DNA, 25 bp, Rattus norvegicus
ttgagttctgccagaagatgcccac

SEQ ID NO: 677232 - DNA, 25 bp, Rattus norvegicus
ttgagttctgcctgaagatgcccac

SEQ ID NO: 677233 - DNA, 25 bp, Rattus norvegicus
ttgagttcttctcagcaactggtat

SEQ ID NO: 677234 - DNA, 25 bp, Rattus norvegicus
ttgagttcttctgagcaactggtat

SEQ ID NO: 677235 - DNA, 25 bp, Rattus norvegicus
ttgagttgaagtcaggctctccctg

SEQ ID NO: 677236 - DNA, 25 bp, Rattus norvegicus
ttgagttgaagtgaggctctccctg

SEQ ID NO: 677237 - DNA, 25 bp, Rattus norvegicus
ttgagttgagttcccgcccttcagg

SEQ ID NO: 677238 - DNA, 25 bp, Rattus norvegicus
ttgagttgagttgccgcccttcagg

SEQ ID NO: 677239 - DNA, 25 bp, Rattus norvegicus
ttgagttgctgcagctctagacaaa

SEQ ID NO: 677240 - DNA, 25 bp, Rattus norvegicus
ttgagttgctgctgctctagacaaa

SEQ ID NO: 677241 - DNA, 25 bp, Rattus norvegicus
ttgagttgggatacaggttggcccc

SEQ ID NO: 677242 - DNA, 25 bp, Rattus norvegicus
ttgagttgggattcaggttggcccc

SEQ ID NO: 677243 - DNA, 25 bp, Rattus norvegicus
ttgagtttaagccaattcgtgctga

SEQ ID NO: 677244 - DNA, 25 bp, Rattus norvegicus
ttgagtttaagcgaattcgtgctga

SEQ ID NO: 677245 - DNA, 25 bp, Rattus norvegicus
ttgagtttagggaacatgtaagctc

SEQ ID NO: 677246 - DNA, 25 bp, Rattus norvegicus
ttgagtttagggtacatgtaagctc

SEQ ID NO: 677247 - DNA, 25 bp, Rattus norvegicus
ttgagtttattcctccttggtgaaa

SEQ ID NO: 677248 - DNA, 25 bp, Rattus norvegicus
ttgagtttattcgtccttggtgaaa

SEQ ID NO: 677249 - DNA, 25 bp, Rattus norvegicus
ttgagtttcaccacctcatacttct

SEQ ID NO: 677250 - DNA, 25 bp, Rattus norvegicus
ttgagtttcacctcctcatacttct

SEQ ID NO: 677251 - DNA, 25 bp, Rattus norvegicus
ttgagtttcaggcaagctcctgctt

SEQ ID NO: 677252 - DNA, 25 bp, Rattus norvegicus
ttgagtttcagggaagctcctgctt

SEQ ID NO: 677253 - DNA, 25 bp, Rattus norvegicus
ttgagtttctccagtactgactgac

SEQ ID NO: 677254 - DNA, 25 bp, Rattus norvegicus
ttgagtttctcctgtactgactgac

SEQ ID NO: 677255 - DNA, 25 bp, Rattus norvegicus
ttgagtttcttccaaggcgcatgca

SEQ ID NO: 677256 - DNA, 25 bp, Rattus norvegicus
ttgagtttcttcgaaggcgcatgca

SEQ ID NO: 677257 - DNA, 25 bp, Rattus norvegicus
ttgagtttgagccactttctaccac

SEQ ID NO: 677258 - DNA, 25 bp, Rattus norvegicus
ttgagtttgagcgactttctaccac

SEQ ID NO: 677259 - DNA, 25 bp, Rattus norvegicus
ttgagtttggcactcaccaagtggg

SEQ ID NO: 677260 - DNA, 25 bp, Rattus norvegicus
ttgagtttggcagtcaccaagtggg

SEQ ID NO: 677261 - DNA, 25 bp, Rattus norvegicus
ttgagtttggtgaggttgccccgta

SEQ ID NO: 677262 - DNA, 25 bp, Rattus norvegicus
ttgagtttggtgtggttgccccgta

SEQ ID NO: 677263 - DNA, 25 bp, Rattus norvegicus
ttgagtttgtgacctgggactgaaa

SEQ ID NO: 677264 - DNA, 25 bp, Rattus norvegicus
ttgagtttgtgagctgggactgaaa

SEQ ID NO: 677265 - DNA, 25 bp, Rattus norvegicus
ttgagttttactagctgagcccatc

SEQ ID NO: 677266 - DNA, 25 bp, Rattus norvegicus
ttgagttttactctatagccctcgc

SEQ ID NO: 677267 - DNA, 25 bp, Rattus norvegicus
ttgagttttactgtatagccctcgc

SEQ ID NO: 677268 - DNA, 25 bp, Rattus norvegicus
ttgagttttacttgctgagcccatc

SEQ ID NO: 677269 - DNA, 25 bp, Rattus norvegicus
ttgagttttgctcaccctcttttga

SEQ ID NO: 677270 - DNA, 25 bp, Rattus norvegicus
ttgagttttgctgaccctcttttga

SEQ ID NO: 677271 - DNA, 25 bp, Rattus norvegicus
ttgagttttgtgatttcggcagcct

SEQ ID NO: 677272 - DNA, 25 bp, Rattus norvegicus
ttgagttttgtgttttcggcagcct

SEQ ID NO: 677273 - DNA, 25 bp, Rattus norvegicus
ttgagtttttctctgagtcctccta

SEQ ID NO: 677274 - DNA, 25 bp, Rattus norvegicus
ttgagtttttctgtgagtcctccta

SEQ ID NO: 677275 - DNA, 25 bp, Rattus norvegicus
ttgataaaagtacacccttcaggtt

SEQ ID NO: 677276 - DNA, 25 bp, Rattus norvegicus
ttgataaaagtagacccttcaggtt

SEQ ID NO: 677277 - DNA, 25 bp, Rattus norvegicus
ttgataacatgcacctcctgatgct

SEQ ID NO: 677278 - DNA, 25 bp, Rattus norvegicus
ttgataacatgctcctcctgatgct

SEQ ID NO: 677279 - DNA, 25 bp, Rattus norvegicus
ttgataacctggacatcgtggcgcg

SEQ ID NO: 677280 - DNA, 25 bp, Rattus norvegicus
ttgataacctggtcatcgtggcgcg

SEQ ID NO: 677281 - DNA, 25 bp, Rattus norvegicus
ttgataagagccactacctctgcgt

SEQ ID NO: 677282 - DNA, 25 bp, Rattus norvegicus
ttgataagagcctctacctctgcgt

SEQ ID NO: 677283 - DNA, 25 bp, Rattus norvegicus
ttgataagctgcatcttacccctca

SEQ ID NO: 677284 - DNA, 25 bp, Rattus norvegicus
ttgataagctgcttcttacccctca

SEQ ID NO: 677285 - DNA, 25 bp, Rattus norvegicus
ttgatacatgttagctctcacctga

SEQ ID NO: 677286 - DNA, 25 bp, Rattus norvegicus
ttgatacatgtttgctctcacctga

SEQ ID NO: 677287 - DNA, 25 bp, Rattus norvegicus
ttgataccaaacatgtattttcagc

SEQ ID NO: 677288 - DNA, 25 bp, Rattus norvegicus
ttgataccaaacttgtattttcagc

SEQ ID NO: 677289 - DNA, 25 bp, Rattus norvegicus
ttgataccaggcctcagattaaccc

SEQ ID NO: 677290 - DNA, 25 bp, Rattus norvegicus
ttgataccaggcgtcagattaaccc

SEQ ID NO: 677291 - DNA, 25 bp, Rattus norvegicus
ttgataccccttagtgcgatcgtgg

SEQ ID NO: 677292 - DNA, 25 bp, Rattus norvegicus
ttgatacccctttgtgcgatcgtgg

SEQ ID NO: 677293 - DNA, 25 bp, Rattus norvegicus
ttgatacccggtatattagccccat

SEQ ID NO: 677294 - DNA, 25 bp, Rattus norvegicus
ttgatacccggtttattagccccat

SEQ ID NO: 677295 - DNA, 25 bp, Rattus norvegicus
ttgataccttctccatgagcagtgg

SEQ ID NO: 677296 - DNA, 25 bp, Rattus norvegicus
ttgataccttctgcatgagcagtgg

SEQ ID NO: 677297 - DNA, 25 bp, Rattus norvegicus
ttgatacgctttaacctgttctaga

SEQ ID NO: 677298 - DNA, 25 bp, Rattus norvegicus
ttgatacgcttttacctgttctaga

SEQ ID NO: 677299 - DNA, 25 bp, Rattus norvegicus
ttgatactgcctcctgtccagccag

SEQ ID NO: 677300 - DNA, 25 bp, Rattus norvegicus
ttgatactgcctgctgtccagccag

SEQ ID NO: 677301 - DNA, 25 bp, Rattus norvegicus
ttgatacttatgctctctgtgttgg

SEQ ID NO: 677302 - DNA, 25 bp, Rattus norvegicus
ttgatacttatggtctctgtgttgg

SEQ ID NO: 677303 - DNA, 25 bp, Rattus norvegicus
ttgatagccacaccacagtcattag

SEQ ID NO: 677304 - DNA, 25 bp, Rattus norvegicus
ttgatagccacagcacagtcattag

SEQ ID NO: 677305 - DNA, 25 bp, Rattus norvegicus
ttgatagcctggactgttctggaac

SEQ ID NO: 677306 - DNA, 25 bp, Rattus norvegicus
ttgatagcctggtctgttctggaac

SEQ ID NO: 677307 - DNA, 25 bp, Rattus norvegicus
ttgatagcttccagcttccaaattg

SEQ ID NO: 677308 - DNA, 25 bp, Rattus norvegicus
ttgatagcttcctgcttccaaattg

SEQ ID NO: 677309 - DNA, 25 bp, Rattus norvegicus
ttgatagttgagcatctagccttca

SEQ ID NO: 677310 - DNA, 25 bp, Rattus norvegicus
ttgatagttgaggatctagccttca

SEQ ID NO: 677311 - DNA, 25 bp, Rattus norvegicus
ttgatatacgctccaacctgcagat

SEQ ID NO: 677312 - DNA, 25 bp, Rattus norvegicus
ttgatatacgctgcaacctgcagat

SEQ ID NO: 677313 - DNA, 25 bp, Rattus norvegicus
ttgatatccaaccagcatcatccta

SEQ ID NO: 677314 - DNA, 25 bp, Rattus norvegicus
ttgatatccaacgagcatcatccta

SEQ ID NO: 677315 - DNA, 25 bp, Rattus norvegicus
ttgatatctcggatacaatagaggc

SEQ ID NO: 677316 - DNA, 25 bp, Rattus norvegicus
ttgatatctcggttacaatagaggc

SEQ ID NO: 677317 - DNA, 25 bp, Rattus norvegicus
ttgatatgccttagttttggaacag

SEQ ID NO: 677318 - DNA, 25 bp, Rattus norvegicus
ttgatatgcctttgttttggaacag

SEQ ID NO: 677319 - DNA, 25 bp, Rattus norvegicus
ttgatatggttaaatccccacctgc

SEQ ID NO: 677320 - DNA, 25 bp, Rattus norvegicus
ttgatatggttatatccccacctgc

SEQ ID NO: 677321 - DNA, 25 bp, Rattus norvegicus
ttgatatgtttccagactccagctt

SEQ ID NO: 677322 - DNA, 25 bp, Rattus norvegicus
ttgatatgtttcgagactccagctt

SEQ ID NO: 677323 - DNA, 25 bp, Rattus norvegicus
ttgatattaactctccaccgctgta

SEQ ID NO: 677324 - DNA, 25 bp, Rattus norvegicus
ttgatattaactgtccaccgctgta

SEQ ID NO: 677325 - DNA, 25 bp, Rattus norvegicus
ttgatattgtagaaggtgaaggcct

SEQ ID NO: 677326 - DNA, 25 bp, Rattus norvegicus
ttgatattgtagtaggtgaaggcct

SEQ ID NO: 677327 - DNA, 25 bp, Rattus norvegicus
ttgatatttgtgatccagttccagt

SEQ ID NO: 677328 - DNA, 25 bp, Rattus norvegicus
ttgatatttgtgttccagttccagt

SEQ ID NO: 677329 - DNA, 25 bp, Rattus norvegicus
ttgatatttttgaccccaacagcca

SEQ ID NO: 677330 - DNA, 25 bp, Rattus norvegicus
ttgatatttttgtccccaacagcca

SEQ ID NO: 677331 - DNA, 25 bp, Rattus norvegicus
ttgatcaaaacccatcagcaccatc

SEQ ID NO: 677332 - DNA, 25 bp, Rattus norvegicus
ttgatcaaaaccgatcagcaccatc

SEQ ID NO: 677333 - DNA, 25 bp, Rattus norvegicus
ttgatcaaactgctcttcacctgct

SEQ ID NO: 677334 - DNA, 25 bp, Rattus norvegicus
ttgatcaaactggtcttcacctgct

SEQ ID NO: 677335 - DNA, 25 bp, Rattus norvegicus
ttgatcaaggtccaaatccccagct

SEQ ID NO: 677336 - DNA, 25 bp, Rattus norvegicus
ttgatcaaggtcgaaatccccagct

SEQ ID NO: 677337 - DNA, 25 bp, Rattus norvegicus
ttgatcaagtcacccgccagcgtag

SEQ ID NO: 677338 - DNA, 25 bp, Rattus norvegicus
ttgatcaagtcagccgccagcgtag

SEQ ID NO: 677339 - DNA, 25 bp, Rattus norvegicus
ttgatcaatcatacacactctctct

SEQ ID NO: 677340 - DNA, 25 bp, Rattus norvegicus
ttgatcaatcattcacactctctct

SEQ ID NO: 677341 - DNA, 25 bp, Rattus norvegicus
ttgatcaccctgctctgctatggac

SEQ ID NO: 677342 - DNA, 25 bp, Rattus norvegicus
ttgatcaccctggtctgctatggac

SEQ ID NO: 677343 - DNA, 25 bp, Rattus norvegicus
ttgatcacggagctcaacgaccgga

SEQ ID NO: 677344 - DNA, 25 bp, Rattus norvegicus
ttgatcacggaggtcaacgaccgga

SEQ ID NO: 677345 - DNA, 25 bp, Rattus norvegicus
ttgatcacttaactcccacagccat

SEQ ID NO: 677346 - DNA, 25 bp, Rattus norvegicus
ttgatcacttaagtcccacagccat

SEQ ID NO: 677347 - DNA, 25 bp, Rattus norvegicus
ttgatcagggtgactccttgtgctt

SEQ ID NO: 677348 - DNA, 25 bp, Rattus norvegicus
ttgatcagggtgtctccttgtgctt

SEQ ID NO: 677349 - DNA, 25 bp, Rattus norvegicus
ttgatcatcccaaagcccgcgggtt

SEQ ID NO: 677350 - DNA, 25 bp, Rattus norvegicus
ttgatcatcccatagcccgcgggtt

SEQ ID NO: 677351 - DNA, 25 bp, Rattus norvegicus
ttgatcatctcacagcagttacacc

SEQ ID NO: 677352 - DNA, 25 bp, Rattus norvegicus
ttgatcatctcagagcagttacacc

SEQ ID NO: 677353 - DNA, 25 bp, Rattus norvegicus
ttgatcatcttgaagtgtgcaattc

SEQ ID NO: 677354 - DNA, 25 bp, Rattus norvegicus
ttgatcatcttgtagtgtgcaattc

SEQ ID NO: 677355 - DNA, 25 bp, Rattus norvegicus
ttgatcatgcaacccctgggagtca

SEQ ID NO: 677356 - DNA, 25 bp, Rattus norvegicus
ttgatcatgcaagccctgggagtca

SEQ ID NO: 677357 - DNA, 25 bp, Rattus norvegicus
ttgatcattgttactcctttctttg

SEQ ID NO: 677358 - DNA, 25 bp, Rattus norvegicus
ttgatcattgtttctcctttctttg

SEQ ID NO: 677359 - DNA, 25 bp, Rattus norvegicus
ttgatccaaattatccaggcccttt

SEQ ID NO: 677360 - DNA, 25 bp, Rattus norvegicus
ttgatccaaattttccaggcccttt

SEQ ID NO: 677361 - DNA, 25 bp, Rattus norvegicus
ttgatccactccagctgtggtggca

SEQ ID NO: 677362 - DNA, 25 bp, Rattus norvegicus
ttgatccactcctgctgtggtggca

SEQ ID NO: 677363 - DNA, 25 bp, Rattus norvegicus
ttgatccagcggctaaccttatttg

SEQ ID NO: 677364 - DNA, 25 bp, Rattus norvegicus
ttgatccagcgggtaaccttatttg

SEQ ID NO: 677365 - DNA, 25 bp, Rattus norvegicus
ttgatccattctcccttcagggata

SEQ ID NO: 677366 - DNA, 25 bp, Rattus norvegicus
ttgatccattctgccttcagggata

SEQ ID NO: 677367 - DNA, 25 bp, Rattus norvegicus
ttgatcccaagacccacacggtgga

SEQ ID NO: 677368 - DNA, 25 bp, Rattus norvegicus
ttgatcccaagagccacacggtgga

SEQ ID NO: 677369 - DNA, 25 bp, Rattus norvegicus
ttgatcccattccaaactattccat

SEQ ID NO: 677370 - DNA, 25 bp, Rattus norvegicus
ttgatcccattcgaaactattccat

SEQ ID NO: 677371 - DNA, 25 bp, Rattus norvegicus
ttgatccccggtccaagataccgag

SEQ ID NO: 677372 - DNA, 25 bp, Rattus norvegicus
ttgatccccggtgcaagataccgag

SEQ ID NO: 677373 - DNA, 25 bp, Rattus norvegicus
ttgatcccctgactaacgtttgaca

SEQ ID NO: 677374 - DNA, 25 bp, Rattus norvegicus
ttgatcccctgagtaacgtttgaca

SEQ ID NO: 677375 - DNA, 25 bp, Rattus norvegicus
ttgatccctaacacctgcagataaa

SEQ ID NO: 677376 - DNA, 25 bp, Rattus norvegicus
ttgatccctaactcctgcagataaa

SEQ ID NO: 677377 - DNA, 25 bp, Rattus norvegicus
ttgatccgacagatctcctcaggtt

SEQ ID NO: 677378 - DNA, 25 bp, Rattus norvegicus
ttgatccgacagttctcctcaggtt

SEQ ID NO: 677379 - DNA, 25 bp, Rattus norvegicus
ttgatccggcggaataggttcttgc

SEQ ID NO: 677380 - DNA, 25 bp, Rattus norvegicus
ttgatccggcggtataggttcttgc

SEQ ID NO: 677381 - DNA, 25 bp, Rattus norvegicus
ttgatcctaacaaaaccaccgctgc

SEQ ID NO: 677382 - DNA, 25 bp, Rattus norvegicus
ttgatcctaacataaccaccgctgc

SEQ ID NO: 677383 - DNA, 25 bp, Rattus norvegicus
ttgatcctaatgatttcagcccctg

SEQ ID NO: 677384 - DNA, 25 bp, Rattus norvegicus
ttgatcctaatgttttcagcccctg

SEQ ID NO: 677385 - DNA, 25 bp, Rattus norvegicus
ttgatcctggatacacttggtgttt

SEQ ID NO: 677386 - DNA, 25 bp, Rattus norvegicus
ttgatcctggattcacttggtgttt

SEQ ID NO: 677387 - DNA, 25 bp, Rattus norvegicus
ttgatccttaaaccctgcctgaata

SEQ ID NO: 677388 - DNA, 25 bp, Rattus norvegicus
ttgatccttaaagcctgcctgaata

SEQ ID NO: 677389 - DNA, 25 bp, Rattus norvegicus
ttgatccttacacgagctgcagact

SEQ ID NO: 677390 - DNA, 25 bp, Rattus norvegicus
ttgatccttacaggagctgcagact

SEQ ID NO: 677391 - DNA, 25 bp, Rattus norvegicus
ttgatccttcctccagagtacagtt

SEQ ID NO: 677392 - DNA, 25 bp, Rattus norvegicus
ttgatccttcctgcagagtacagtt

SEQ ID NO: 677393 - DNA, 25 bp, Rattus norvegicus
ttgatccttgccctatgaaatacga

SEQ ID NO: 677394 - DNA, 25 bp, Rattus norvegicus
ttgatccttgccgtatgaaatacga

SEQ ID NO: 677395 - DNA, 25 bp, Rattus norvegicus
ttgatcgcccggagttttggagtag

SEQ ID NO: 677396 - DNA, 25 bp, Rattus norvegicus
ttgatcgcccggtgttttggagtag

SEQ ID NO: 677397 - DNA, 25 bp, Rattus norvegicus
ttgatcgtcaccacggtcatacttc

SEQ ID NO: 677398 - DNA, 25 bp, Rattus norvegicus
ttgatcgtcacctcggtcatacttc

SEQ ID NO: 677399 - DNA, 25 bp, Rattus norvegicus
ttgatctaacacatacttcttgact

SEQ ID NO: 677400 - DNA, 25 bp, Rattus norvegicus
ttgatctaacacttacttcttgact

SEQ ID NO: 677401 - DNA, 25 bp, Rattus norvegicus
ttgatctacctgaagacccagctat

SEQ ID NO: 677402 - DNA, 25 bp, Rattus norvegicus
ttgatctacctgtagacccagctat

SEQ ID NO: 677403 - DNA, 25 bp, Rattus norvegicus
ttgatctatataccacctctgtcca

SEQ ID NO: 677404 - DNA, 25 bp, Rattus norvegicus
ttgatctatatagcacctctgtcca

SEQ ID NO: 677405 - DNA, 25 bp, Rattus norvegicus
ttgatctccgtacttccaggacagc

SEQ ID NO: 677406 - DNA, 25 bp, Rattus norvegicus
ttgatctccgtagttccaggacagc

SEQ ID NO: 677407 - DNA, 25 bp, Rattus norvegicus
ttgatctctcccatgtgcatctgga

SEQ ID NO: 677408 - DNA, 25 bp, Rattus norvegicus
ttgatctctcccttgtgcatctgga

SEQ ID NO: 677409 - DNA, 25 bp, Rattus norvegicus
ttgatctctgagacgggcttctttc

SEQ ID NO: 677410 - DNA, 25 bp, Rattus norvegicus
ttgatctctgagtcgggcttctttc

SEQ ID NO: 677411 - DNA, 25 bp, Rattus norvegicus
ttgatctctgatcttttagtctatt

SEQ ID NO: 677412 - DNA, 25 bp, Rattus norvegicus
ttgatctctgatgttttagtctatt

SEQ ID NO: 677413 - DNA, 25 bp, Rattus norvegicus
ttgatctgaggacatggttcccacc

SEQ ID NO: 677414 - DNA, 25 bp, Rattus norvegicus
ttgatctgaggagatggttcccacc

SEQ ID NO: 677415 - DNA, 25 bp, Rattus norvegicus
ttgatctgcctaaggtttcctcttg

SEQ ID NO: 677416 - DNA, 25 bp, Rattus norvegicus
ttgatctgcctatggtttcctcttg

SEQ ID NO: 677417 - DNA, 25 bp, Rattus norvegicus
ttgatctgctcactctcagcgaatt

SEQ ID NO: 677418 - DNA, 25 bp, Rattus norvegicus
ttgatctgctcagtctcagcgaatt

SEQ ID NO: 677419 - DNA, 25 bp, Rattus norvegicus
ttgatctggatcatgcttcttgcct

SEQ ID NO: 677420 - DNA, 25 bp, Rattus norvegicus
ttgatctggatcttgcttcttgcct

SEQ ID NO: 677421 - DNA, 25 bp, Rattus norvegicus
ttgatctgggtcagtggccatggtt

SEQ ID NO: 677422 - DNA, 25 bp, Rattus norvegicus
ttgatctgggtctgtggccatggtt

SEQ ID NO: 677423 - DNA, 25 bp, Rattus norvegicus
ttgatctgttgtactgttaatgctg

SEQ ID NO: 677424 - DNA, 25 bp, Rattus norvegicus
ttgatctgttgttctgttaatgctg

SEQ ID NO: 677425 - DNA, 25 bp, Rattus norvegicus
ttgatcttagccaatcgcactggtg

SEQ ID NO: 677426 - DNA, 25 bp, Rattus norvegicus
ttgatcttagcctatcgcactggtg

SEQ ID NO: 677427 - DNA, 25 bp, Rattus norvegicus
ttgatcttcacaactgcttctgtgc

SEQ ID NO: 677428 - DNA, 25 bp, Rattus norvegicus
ttgatcttcacatctgcttctgtgc

SEQ ID NO: 677429 - DNA, 25 bp, Rattus norvegicus
ttgatcttcttcatcattccagcgg

SEQ ID NO: 677430 - DNA, 25 bp, Rattus norvegicus
ttgatcttcttcttcattccagcgg

SEQ ID NO: 677431 - DNA, 25 bp, Rattus norvegicus
ttgatcttgcatatggttttctccg

SEQ ID NO: 677432 - DNA, 25 bp, Rattus norvegicus
ttgatcttgcatttggttttctccg

SEQ ID NO: 677433 - DNA, 25 bp, Rattus norvegicus
ttgatcttgcctcctctctggacat

SEQ ID NO: 677434 - DNA, 25 bp, Rattus norvegicus
ttgatcttgcctgctctctggacat

SEQ ID NO: 677435 - DNA, 25 bp, Rattus norvegicus
ttgatcttgttcatctcaacctgtt

SEQ ID NO: 677436 - DNA, 25 bp, Rattus norvegicus
ttgatcttgttcttctcaacctgtt

SEQ ID NO: 677437 - DNA, 25 bp, Rattus norvegicus
ttgatctttagacctcggacccctc

SEQ ID NO: 677438 - DNA, 25 bp, Rattus norvegicus
ttgatctttagagctcggacccctc

SEQ ID NO: 677439 - DNA, 25 bp, Rattus norvegicus
ttgatctttcaaccctgcagtcctt

SEQ ID NO: 677440 - DNA, 25 bp, Rattus norvegicus
ttgatctttcaagcctgcagtcctt

SEQ ID NO: 677441 - DNA, 25 bp, Rattus norvegicus
ttgatctttccaagggtccctttaa

SEQ ID NO: 677442 - DNA, 25 bp, Rattus norvegicus
ttgatctttccatgggtccctttaa

SEQ ID NO: 677443 - DNA, 25 bp, Rattus norvegicus
ttgatgaaaggaccctgggtcctct

SEQ ID NO: 677444 - DNA, 25 bp, Rattus norvegicus
ttgatgaaaggagcctgggtcctct

SEQ ID NO: 677445 - DNA, 25 bp, Rattus norvegicus
ttgatgaacaacctgggccctgtga

SEQ ID NO: 677446 - DNA, 25 bp, Rattus norvegicus
ttgatgaacaacgtgggccctgtga

SEQ ID NO: 677447 - DNA, 25 bp, Rattus norvegicus
ttgatgaacattatcactggattct

SEQ ID NO: 677448 - DNA, 25 bp, Rattus norvegicus
ttgatgaacattttcactggattct

SEQ ID NO: 677449 - DNA, 25 bp, Rattus norvegicus
ttgatgaagccaacgccgagcttga

SEQ ID NO: 677450 - DNA, 25 bp, Rattus norvegicus
ttgatgaagccatcgccgagcttga

SEQ ID NO: 677451 - DNA, 25 bp, Rattus norvegicus
ttgatgacaagtacagccgacgtga

SEQ ID NO: 677452 - DNA, 25 bp, Rattus norvegicus
ttgatgacaagttcagccgacgtga

SEQ ID NO: 677453 - DNA, 25 bp, Rattus norvegicus
ttgatgaccaatccagctgctgctg

SEQ ID NO: 677454 - DNA, 25 bp, Rattus norvegicus
ttgatgaccaatgcagctgctgctg

SEQ ID NO: 677455 - DNA, 25 bp, Rattus norvegicus
ttgatgaccaggcttgaggctcttc

SEQ ID NO: 677456 - DNA, 25 bp, Rattus norvegicus
ttgatgaccagggttgaggctcttc

SEQ ID NO: 677457 - DNA, 25 bp, Rattus norvegicus
ttgatgacctcgattccctctgtat

SEQ ID NO: 677458 - DNA, 25 bp, Rattus norvegicus
ttgatgacctcgtttccctctgtat

SEQ ID NO: 677459 - DNA, 25 bp, Rattus norvegicus
ttgatgactacaaagcctgctgtgt

SEQ ID NO: 677460 - DNA, 25 bp, Rattus norvegicus
ttgatgactacatagcctgctgtgt

SEQ ID NO: 677461 - DNA, 25 bp, Rattus norvegicus
ttgatgactcaaccttttctttctc

SEQ ID NO: 677462 - DNA, 25 bp, Rattus norvegicus
ttgatgactcaagcttttctttctc

SEQ ID NO: 677463 - DNA, 25 bp, Rattus norvegicus
ttgatgagaggcacggttccccaaa

SEQ ID NO: 677464 - DNA, 25 bp, Rattus norvegicus
ttgatgagaggctcggttccccaaa

SEQ ID NO: 677465 - DNA, 25 bp, Rattus norvegicus
ttgatgaggcacacaagccacgggt

SEQ ID NO: 677466 - DNA, 25 bp, Rattus norvegicus
ttgatgaggcactcaagccacgggt

SEQ ID NO: 677467 - DNA, 25 bp, Rattus norvegicus
ttgatgataaaccaacccgacctgc

SEQ ID NO: 677468 - DNA, 25 bp, Rattus norvegicus
ttgatgataaacgaacccgacctgc

SEQ ID NO: 677469 - DNA, 25 bp, Rattus norvegicus
ttgatgataccccagaagctgagaa

SEQ ID NO: 677470 - DNA, 25 bp, Rattus norvegicus
ttgatgatacccgagaagctgagaa

SEQ ID NO: 677471 - DNA, 25 bp, Rattus norvegicus
ttgatgatactaaaactccggtttg

SEQ ID NO: 677472 - DNA, 25 bp, Rattus norvegicus
ttgatgatactataactccggtttg

SEQ ID NO: 677473 - DNA, 25 bp, Rattus norvegicus
ttgatgatgaatacaccgcccagtc

SEQ ID NO: 677474 - DNA, 25 bp, Rattus norvegicus
ttgatgatgaattcaccgcccagtc

SEQ ID NO: 677475 - DNA, 25 bp, Rattus norvegicus
ttgatgatgatcatctccgacgcct

SEQ ID NO: 677476 - DNA, 25 bp, Rattus norvegicus
ttgatgatgatcttctccgacgcct

SEQ ID NO: 677477 - DNA, 25 bp, Rattus norvegicus
ttgatgcatgtacttcctctctggc

SEQ ID NO: 677478 - DNA, 25 bp, Rattus norvegicus
ttgatgcatgtagttcctctctggc

SEQ ID NO: 677479 - DNA, 25 bp, Rattus norvegicus
ttgatgccaatactgccactttact

SEQ ID NO: 677480 - DNA, 25 bp, Rattus norvegicus
ttgatgccaatagtgccactttact

SEQ ID NO: 677481 - DNA, 25 bp, Rattus norvegicus
ttgatgccacctcttctgaagttaa

SEQ ID NO: 677482 - DNA, 25 bp, Rattus norvegicus
ttgatgccacctgttctgaagttaa

SEQ ID NO: 677483 - DNA, 25 bp, Rattus norvegicus
ttgatgcccatgctgtgttgactgt

SEQ ID NO: 677484 - DNA, 25 bp, Rattus norvegicus
ttgatgcccatggtgtgttgactgt

SEQ ID NO: 677485 - DNA, 25 bp, Rattus norvegicus
ttgatgcctctgcagttgaatcagt

SEQ ID NO: 677486 - DNA, 25 bp, Rattus norvegicus
ttgatgcctctggagttgaatcagt

SEQ ID NO: 677487 - DNA, 25 bp, Rattus norvegicus
ttgatgccttggagacattttaagt

SEQ ID NO: 677488 - DNA, 25 bp, Rattus norvegicus
ttgatgccttggtgacattttaagt

SEQ ID NO: 677489 - DNA, 25 bp, Rattus norvegicus
ttgatgcgcctgctttttgggtcac

SEQ ID NO: 677490 - DNA, 25 bp, Rattus norvegicus
ttgatgcgcctggtttttgggtcac

SEQ ID NO: 677491 - DNA, 25 bp, Rattus norvegicus
ttgatgcgcgcgagactgcacgttc

SEQ ID NO: 677492 - DNA, 25 bp, Rattus norvegicus
ttgatgcgcgcgtgactgcacgttc

SEQ ID NO: 677493 - DNA, 25 bp, Rattus norvegicus
ttgatgctcagacctgcttgtagtc

SEQ ID NO: 677494 - DNA, 25 bp, Rattus norvegicus
ttgatgctcagagctgcttgtagtc

SEQ ID NO: 677495 - DNA, 25 bp, Rattus norvegicus
ttgatgctcctgctctgatgataat

SEQ ID NO: 677496 - DNA, 25 bp, Rattus norvegicus
ttgatgctcctggtctgatgataat

SEQ ID NO: 677497 - DNA, 25 bp, Rattus norvegicus
ttgatgctgcatccactctgacatc

SEQ ID NO: 677498 - DNA, 25 bp, Rattus norvegicus
ttgatgctgcatgcactctgacatc

SEQ ID NO: 677499 - DNA, 25 bp, Rattus norvegicus
ttgatgctgctcaaattctgcctac

SEQ ID NO: 677500 - DNA, 25 bp, Rattus norvegicus
ttgatgctgctctaattctgcctac

SEQ ID NO: 677501 - DNA, 25 bp, Rattus norvegicus
ttgatgctggataatgccatcctct

SEQ ID NO: 677502 - DNA, 25 bp, Rattus norvegicus
ttgatgctggatagggcctgctgaa

SEQ ID NO: 677503 - DNA, 25 bp, Rattus norvegicus
ttgatgctggattatgccatcctct

SEQ ID NO: 677504 - DNA, 25 bp, Rattus norvegicus
ttgatgctggattgggcctgctgaa

SEQ ID NO: 677505 - DNA, 25 bp, Rattus norvegicus
ttgatgctgtgacgcccaggcctga

SEQ ID NO: 677506 - DNA, 25 bp, Rattus norvegicus
ttgatgctgtgaggcccaggcctga

SEQ ID NO: 677507 - DNA, 25 bp, Rattus norvegicus
ttgatgcttacgagactactttgac

SEQ ID NO: 677508 - DNA, 25 bp, Rattus norvegicus
ttgatgcttacgtgactactttgac

SEQ ID NO: 677509 - DNA, 25 bp, Rattus norvegicus
ttgatggaacaaccttcaccccaga

SEQ ID NO: 677510 - DNA, 25 bp, Rattus norvegicus
ttgatggaacaagcttcaccccaga

SEQ ID NO: 677511 - DNA, 25 bp, Rattus norvegicus
ttgatggagatcaccgctacacgga

SEQ ID NO: 677512 - DNA, 25 bp, Rattus norvegicus
ttgatggagatctccgctacacgga

SEQ ID NO: 677513 - DNA, 25 bp, Rattus norvegicus
ttgatggcaagtcagccctcctcat

SEQ ID NO: 677514 - DNA, 25 bp, Rattus norvegicus
ttgatggcaagtgagccctcctcat

SEQ ID NO: 677515 - DNA, 25 bp, Rattus norvegicus
ttgatggcacagacgagtgggcccc

SEQ ID NO: 677516 - DNA, 25 bp, Rattus norvegicus
ttgatggcacagtcgagtgggcccc

SEQ ID NO: 677517 - DNA, 25 bp, Rattus norvegicus
ttgatggctctcactgtcagaagca

SEQ ID NO: 677518 - DNA, 25 bp, Rattus norvegicus
ttgatggctctctctgtcagaagca

SEQ ID NO: 677519 - DNA, 25 bp, Rattus norvegicus
ttgatgggcactcttcagaaattta

SEQ ID NO: 677520 - DNA, 25 bp, Rattus norvegicus
ttgatgggcactgttcagaaattta

SEQ ID NO: 677521 - DNA, 25 bp, Rattus norvegicus
ttgatggtcccactggctgccacag

SEQ ID NO: 677522 - DNA, 25 bp, Rattus norvegicus
ttgatggtcccagtggctgccacag

SEQ ID NO: 677523 - DNA, 25 bp, Rattus norvegicus
ttgatggtggcaatgggctcctgct

SEQ ID NO: 677524 - DNA, 25 bp, Rattus norvegicus
ttgatggtggcattgggctcctgct

SEQ ID NO: 677525 - DNA, 25 bp, Rattus norvegicus
ttgatggttactcctccattcccta

SEQ ID NO: 677526 - DNA, 25 bp, Rattus norvegicus
ttgatggttactgctccattcccta

SEQ ID NO: 677527 - DNA, 25 bp, Rattus norvegicus
ttgatggttgcgatcagggtccgac

SEQ ID NO: 677528 - DNA, 25 bp, Rattus norvegicus
ttgatggttgcgttcagggtccgac

SEQ ID NO: 677529 - DNA, 25 bp, Rattus norvegicus
ttgatggttgtcatctctttggtca

SEQ ID NO: 677530 - DNA, 25 bp, Rattus norvegicus
ttgatggttgtcttctctttggtca

SEQ ID NO: 677531 - DNA, 25 bp, Rattus norvegicus
ttgatggtttggattgagccctgtt

SEQ ID NO: 677532 - DNA, 25 bp, Rattus norvegicus
ttgatggtttggtttgagccctgtt

SEQ ID NO: 677533 - DNA, 25 bp, Rattus norvegicus
ttgatgtaaatccaaagagggctga

SEQ ID NO: 677534 - DNA, 25 bp, Rattus norvegicus
ttgatgtaaatcgaaagagggctga

SEQ ID NO: 677535 - DNA, 25 bp, Rattus norvegicus
ttgatgtaaattcctccttttcctc

SEQ ID NO: 677536 - DNA, 25 bp, Rattus norvegicus
ttgatgtaaattgctccttttcctc

SEQ ID NO: 677537 - DNA, 25 bp, Rattus norvegicus
ttgatgtacagcagagcccactcag

SEQ ID NO: 677538 - DNA, 25 bp, Rattus norvegicus
ttgatgtacagctgagcccactcag

SEQ ID NO: 677539 - DNA, 25 bp, Rattus norvegicus
ttgatgtacatcatcagagcggccc

SEQ ID NO: 677540 - DNA, 25 bp, Rattus norvegicus
ttgatgtacatcttcagagcggccc

SEQ ID NO: 677541 - DNA, 25 bp, Rattus norvegicus
ttgatgtacattagccatggccagc

SEQ ID NO: 677542 - DNA, 25 bp, Rattus norvegicus
ttgatgtacatttgccatggccagc

SEQ ID NO: 677543 - DNA, 25 bp, Rattus norvegicus
ttgatgtactgcaagggcgagcaca

SEQ ID NO: 677544 - DNA, 25 bp, Rattus norvegicus
ttgatgtactgctagggcgagcaca

SEQ ID NO: 677545 - DNA, 25 bp, Rattus norvegicus
ttgatgtatccacgaaggctgagca

SEQ ID NO: 677546 - DNA, 25 bp, Rattus norvegicus
ttgatgtatccaggaaggctgagca

SEQ ID NO: 677547 - DNA, 25 bp, Rattus norvegicus
ttgatgtatctgcttcttctaaccc

SEQ ID NO: 677548 - DNA, 25 bp, Rattus norvegicus
ttgatgtatctggttcttctaaccc

SEQ ID NO: 677549 - DNA, 25 bp, Rattus norvegicus
ttgatgtcacccacctactggaatt

SEQ ID NO: 677550 - DNA, 25 bp, Rattus norvegicus
ttgatgtcaccctcctactggaatt

SEQ ID NO: 677551 - DNA, 25 bp, Rattus norvegicus
ttgatgtccccgaatgtgcaggcgc

SEQ ID NO: 677552 - DNA, 25 bp, Rattus norvegicus
ttgatgtccccgtatgtgcaggcgc

SEQ ID NO: 677553 - DNA, 25 bp, Rattus norvegicus
ttgatgtgatacacagggcctgacc

SEQ ID NO: 677554 - DNA, 25 bp, Rattus norvegicus
ttgatgtgatactcagggcctgacc

SEQ ID NO: 677555 - DNA, 25 bp, Rattus norvegicus
ttgatgtgcaccattgtagctcagc

SEQ ID NO: 677556 - DNA, 25 bp, Rattus norvegicus
ttgatgtgcacctttgtagctcagc

SEQ ID NO: 677557 - DNA, 25 bp, Rattus norvegicus
ttgatgtgccacctgtttgccatgg

SEQ ID NO: 677558 - DNA, 25 bp, Rattus norvegicus
ttgatgtgccacgtgtttgccatgg

SEQ ID NO: 677559 - DNA, 25 bp, Rattus norvegicus
ttgatgttccatagctgctcttgtt

SEQ ID NO: 677560 - DNA, 25 bp, Rattus norvegicus
ttgatgttccattgctgctcttgtt

SEQ ID NO: 677561 - DNA, 25 bp, Rattus norvegicus
ttgatgttttatatctccttctcct

SEQ ID NO: 677562 - DNA, 25 bp, Rattus norvegicus
ttgatgttttatttctccttctcct

SEQ ID NO: 677563 - DNA, 25 bp, Rattus norvegicus
ttgatgttttgtcacgtcggaaggt

SEQ ID NO: 677564 - DNA, 25 bp, Rattus norvegicus
ttgatgttttgtgacgtcggaaggt

SEQ ID NO: 677565 - DNA, 25 bp, Rattus norvegicus
ttgattaaggctatgcttctctcct

SEQ ID NO: 677566 - DNA, 25 bp, Rattus norvegicus
ttgattaaggctttgcttctctcct

SEQ ID NO: 677567 - DNA, 25 bp, Rattus norvegicus
ttgattaatcacagactccacacct

SEQ ID NO: 677568 - DNA, 25 bp, Rattus norvegicus
ttgattaatcactgactccacacct

SEQ ID NO: 677569 - DNA, 25 bp, Rattus norvegicus
ttgattacatccaacacgtctgctg

SEQ ID NO: 677570 - DNA, 25 bp, Rattus norvegicus
ttgattacatcctacacgtctgctg

SEQ ID NO: 677571 - DNA, 25 bp, Rattus norvegicus
ttgattaccacacaggccaatgctt

SEQ ID NO: 677572 - DNA, 25 bp, Rattus norvegicus
ttgattaccacagaggccaatgctt

SEQ ID NO: 677573 - DNA, 25 bp, Rattus norvegicus
ttgattaccctgactgcactggcca

SEQ ID NO: 677574 - DNA, 25 bp, Rattus norvegicus
ttgattaccctgtctgcactggcca

SEQ ID NO: 677575 - DNA, 25 bp, Rattus norvegicus
ttgattacccttcaatgcacctgaa

SEQ ID NO: 677576 - DNA, 25 bp, Rattus norvegicus
ttgattacccttgaatgcacctgaa

SEQ ID NO: 677577 - DNA, 25 bp, Rattus norvegicus
ttgattatcatgacttgcttttgtg

SEQ ID NO: 677578 - DNA, 25 bp, Rattus norvegicus
ttgattatcatgtcttgcttttgtg

SEQ ID NO: 677579 - DNA, 25 bp, Rattus norvegicus
ttgattattagacctcagagccgaa

SEQ ID NO: 677580 - DNA, 25 bp, Rattus norvegicus
ttgattattagagctcagagccgaa

SEQ ID NO: 677581 - DNA, 25 bp, Rattus norvegicus
ttgattattcgtctgtccctaagca

SEQ ID NO: 677582 - DNA, 25 bp, Rattus norvegicus
ttgattattcgtgtgtccctaagca

SEQ ID NO: 677583 - DNA, 25 bp, Rattus norvegicus
ttgattcaaagcagacaaatgtctg

SEQ ID NO: 677584 - DNA, 25 bp, Rattus norvegicus
ttgattcaaagctgacaaatgtctg

SEQ ID NO: 677585 - DNA, 25 bp, Rattus norvegicus
ttgattcacaacagcagtccatcca

SEQ ID NO: 677586 - DNA, 25 bp, Rattus norvegicus
ttgattcacaactgcagtccatcca

SEQ ID NO: 677587 - DNA, 25 bp, Rattus norvegicus
ttgattcagactccaggctgagcct

SEQ ID NO: 677588 - DNA, 25 bp, Rattus norvegicus
ttgattcagactgcaggctgagcct

SEQ ID NO: 677589 - DNA, 25 bp, Rattus norvegicus
ttgattcatctgaaaaagggtctag

SEQ ID NO: 677590 - DNA, 25 bp, Rattus norvegicus
ttgattcatctgtaaaagggtctag

SEQ ID NO: 677591 - DNA, 25 bp, Rattus norvegicus
ttgattcattacagtttccctttcc

SEQ ID NO: 677592 - DNA, 25 bp, Rattus norvegicus
ttgattcattactgtttccctttcc

SEQ ID NO: 677593 - DNA, 25 bp, Rattus norvegicus
ttgattccagatccacacggccaca

SEQ ID NO: 677594 - DNA, 25 bp, Rattus norvegicus
ttgattccagatgcacacggccaca

SEQ ID NO: 677595 - DNA, 25 bp, Rattus norvegicus
ttgattccagctccgtgcaaagctt

SEQ ID NO: 677596 - DNA, 25 bp, Rattus norvegicus
ttgattccagctgcgtgcaaagctt

SEQ ID NO: 677597 - DNA, 25 bp, Rattus norvegicus
ttgattcccaagaatacatgtagtg

SEQ ID NO: 677598 - DNA, 25 bp, Rattus norvegicus
ttgattcccaagtatacatgtagtg

SEQ ID NO: 677599 - DNA, 25 bp, Rattus norvegicus
ttgattcccaatccatgtgaacttt

SEQ ID NO: 677600 - DNA, 25 bp, Rattus norvegicus
ttgattcccaatgcatgtgaacttt

SEQ ID NO: 677601 - DNA, 25 bp, Rattus norvegicus
ttgattcccagccagtttgtgactt

SEQ ID NO: 677602 - DNA, 25 bp, Rattus norvegicus
ttgattcccagcgagtttgtgactt

SEQ ID NO: 677603 - DNA, 25 bp, Rattus norvegicus
ttgattcccagtccccatgtcggtg

SEQ ID NO: 677604 - DNA, 25 bp, Rattus norvegicus
ttgattcccagtgcccatgtcggtg

SEQ ID NO: 677605 - DNA, 25 bp, Rattus norvegicus
ttgattccccagctgtctttcacag

SEQ ID NO: 677606 - DNA, 25 bp, Rattus norvegicus
ttgattccccaggtgtctttcacag

SEQ ID NO: 677607 - DNA, 25 bp, Rattus norvegicus
ttgattcctcacatacacatttctt

SEQ ID NO: 677608 - DNA, 25 bp, Rattus norvegicus
ttgattcctcacttacacatttctt

SEQ ID NO: 677609 - DNA, 25 bp, Rattus norvegicus
ttgattcctgtactgacacacagtg

SEQ ID NO: 677610 - DNA, 25 bp, Rattus norvegicus
ttgattcctgtagtgacacacagtg

SEQ ID NO: 677611 - DNA, 25 bp, Rattus norvegicus
ttgattccttgtatttccgtcttag

SEQ ID NO: 677612 - DNA, 25 bp, Rattus norvegicus
ttgattccttgtttttccgtcttag

SEQ ID NO: 677613 - DNA, 25 bp, Rattus norvegicus
ttgattcctttcaaacccttgtttg

SEQ ID NO: 677614 - DNA, 25 bp, Rattus norvegicus
ttgattcctttctaacccttgtttg

SEQ ID NO: 677615 - DNA, 25 bp, Rattus norvegicus
ttgattctcaggacacaacggacat

SEQ ID NO: 677616 - DNA, 25 bp, Rattus norvegicus
ttgattctcaggtcacaacggacat

SEQ ID NO: 677617 - DNA, 25 bp, Rattus norvegicus
ttgattctgctgctcagactggact

SEQ ID NO: 677618 - DNA, 25 bp, Rattus norvegicus
ttgattctgctggtcagactggact

SEQ ID NO: 677619 - DNA, 25 bp, Rattus norvegicus
ttgattctggctactcggagagtga

SEQ ID NO: 677620 - DNA, 25 bp, Rattus norvegicus
ttgattctggcttctcggagagtga

SEQ ID NO: 677621 - DNA, 25 bp, Rattus norvegicus
ttgattctgtatcccacactgtgtg

SEQ ID NO: 677622 - DNA, 25 bp, Rattus norvegicus
ttgattctgtatgccacactgtgtg

SEQ ID NO: 677623 - DNA, 25 bp, Rattus norvegicus
ttgattctgtgtctacgttctcttc

SEQ ID NO: 677624 - DNA, 25 bp, Rattus norvegicus
ttgattctgtgtgtacgttctcttc

SEQ ID NO: 677625 - DNA, 25 bp, Rattus norvegicus
ttgattcttgttattctgtgtgtac

SEQ ID NO: 677626 - DNA, 25 bp, Rattus norvegicus
ttgattcttgtttttctgtgtgtac

SEQ ID NO: 677627 - DNA, 25 bp, Rattus norvegicus
ttgattctttctcaggcgattcgga

SEQ ID NO: 677628 - DNA, 25 bp, Rattus norvegicus
ttgattctttctcgccactgcctgg

SEQ ID NO: 677629 - DNA, 25 bp, Rattus norvegicus
ttgattctttctgaggcgattcgga

SEQ ID NO: 677630 - DNA, 25 bp, Rattus norvegicus
ttgattctttctggccactgcctgg

SEQ ID NO: 677631 - DNA, 25 bp, Rattus norvegicus
ttgattctttgaactccacatccac

SEQ ID NO: 677632 - DNA, 25 bp, Rattus norvegicus
ttgattctttgatctccacatccac

SEQ ID NO: 677633 - DNA, 25 bp, Rattus norvegicus
ttgattgaagtgatccgtccttgtt

SEQ ID NO: 677634 - DNA, 25 bp, Rattus norvegicus
ttgattgaagtgttccgtccttgtt

SEQ ID NO: 677635 - DNA, 25 bp, Rattus norvegicus
ttgattgagctaccacatgtgcatt

SEQ ID NO: 677636 - DNA, 25 bp, Rattus norvegicus
ttgattgagctagcacatgtgcatt

SEQ ID NO: 677637 - DNA, 25 bp, Rattus norvegicus
ttgattgagtctagcagagcccctg

SEQ ID NO: 677638 - DNA, 25 bp, Rattus norvegicus
ttgattgagtcttgcagagcccctg

SEQ ID NO: 677639 - DNA, 25 bp, Rattus norvegicus
ttgattgcccttaaatattagacag

SEQ ID NO: 677640 - DNA, 25 bp, Rattus norvegicus
ttgattgccctttaatattagacag

SEQ ID NO: 677641 - DNA, 25 bp, Rattus norvegicus
ttgattgccttgacgtcttcctgaa

SEQ ID NO: 677642 - DNA, 25 bp, Rattus norvegicus
ttgattgccttgtcgtcttcctgaa

SEQ ID NO: 677643 - DNA, 25 bp, Rattus norvegicus
ttgattgctgcaaagccactccatg

SEQ ID NO: 677644 - DNA, 25 bp, Rattus norvegicus
ttgattgctgcatagccactccatg

SEQ ID NO: 677645 - DNA, 25 bp, Rattus norvegicus
ttgattgcttcgacttttttcttct

SEQ ID NO: 677646 - DNA, 25 bp, Rattus norvegicus
ttgattgcttcgtcttttttcttct

SEQ ID NO: 677647 - DNA, 25 bp, Rattus norvegicus
ttgattggaccaagcccgggatggc

SEQ ID NO: 677648 - DNA, 25 bp, Rattus norvegicus
ttgattggaccatgcccgggatggc

SEQ ID NO: 677649 - DNA, 25 bp, Rattus norvegicus
ttgattggatttcccagttcaccgg

SEQ ID NO: 677650 - DNA, 25 bp, Rattus norvegicus
ttgattggatttgccagttcaccgg

SEQ ID NO: 677651 - DNA, 25 bp, Rattus norvegicus
ttgattggctgcataattgggcgtc

SEQ ID NO: 677652 - DNA, 25 bp, Rattus norvegicus
ttgattggctgcttaattgggcgtc

SEQ ID NO: 677653 - DNA, 25 bp, Rattus norvegicus
ttgattgggagccagcttcacacag

SEQ ID NO: 677654 - DNA, 25 bp, Rattus norvegicus
ttgattgggagcgagcttcacacag

SEQ ID NO: 677655 - DNA, 25 bp, Rattus norvegicus
ttgattggtagcattcatgccctcc

SEQ ID NO: 677656 - DNA, 25 bp, Rattus norvegicus
ttgattggtagctttcatgccctcc

SEQ ID NO: 677657 - DNA, 25 bp, Rattus norvegicus
ttgattgtagggaacctccagttat

SEQ ID NO: 677658 - DNA, 25 bp, Rattus norvegicus
ttgattgtagggtacctccagttat

SEQ ID NO: 677659 - DNA, 25 bp, Rattus norvegicus
ttgattgtctttactacagaggaag

SEQ ID NO: 677660 - DNA, 25 bp, Rattus norvegicus
ttgattgtcttttctacagaggaag

SEQ ID NO: 677661 - DNA, 25 bp, Rattus norvegicus
ttgattgtgcgcaaccaggaaatat

SEQ ID NO: 677662 - DNA, 25 bp, Rattus norvegicus
ttgattgtgcgctaccaggaaatat

SEQ ID NO: 677663 - DNA, 25 bp, Rattus norvegicus
ttgatttaactgagactgtctcttg

SEQ ID NO: 677664 - DNA, 25 bp, Rattus norvegicus
ttgatttaactgtgactgtctcttg

SEQ ID NO: 677665 - DNA, 25 bp, Rattus norvegicus
ttgatttacagtactgctctcgttg

SEQ ID NO: 677666 - DNA, 25 bp, Rattus norvegicus
ttgatttacagttctgctctcgttg

SEQ ID NO: 677667 - DNA, 25 bp, Rattus norvegicus
ttgatttactgaagaacgcttttgg

SEQ ID NO: 677668 - DNA, 25 bp, Rattus norvegicus
ttgatttactgatgaacgcttttgg

SEQ ID NO: 677669 - DNA, 25 bp, Rattus norvegicus
ttgatttagagaaaccatgcttaag

SEQ ID NO: 677670 - DNA, 25 bp, Rattus norvegicus
ttgatttagagataccatgcttaag

SEQ ID NO: 677671 - DNA, 25 bp, Rattus norvegicus
ttgatttatcctctgcatgtgcaaa

SEQ ID NO: 677672 - DNA, 25 bp, Rattus norvegicus
ttgatttatcctgtgcatgtgcaaa

SEQ ID NO: 677673 - DNA, 25 bp, Rattus norvegicus
ttgatttcaaccagtcaccctcaag

SEQ ID NO: 677674 - DNA, 25 bp, Rattus norvegicus
ttgatttcaacctgtcaccctcaag

SEQ ID NO: 677675 - DNA, 25 bp, Rattus norvegicus
ttgatttcacacagctgcgatctgt

SEQ ID NO: 677676 - DNA, 25 bp, Rattus norvegicus
ttgatttcacactgctgcgatctgt

SEQ ID NO: 677677 - DNA, 25 bp, Rattus norvegicus
ttgatttcactgcagattttccctc

SEQ ID NO: 677678 - DNA, 25 bp, Rattus norvegicus
ttgatttcactggagattttccctc

SEQ ID NO: 677679 - DNA, 25 bp, Rattus norvegicus
ttgatttcagacctgcccatgtgac

SEQ ID NO: 677680 - DNA, 25 bp, Rattus norvegicus
ttgatttcagacgtgcccatgtgac

SEQ ID NO: 677681 - DNA, 25 bp, Rattus norvegicus
ttgatttcagctctgcagacggatg

SEQ ID NO: 677682 - DNA, 25 bp, Rattus norvegicus
ttgatttcagctgtgcagacggatg

SEQ ID NO: 677683 - DNA, 25 bp, Rattus norvegicus
ttgatttcatatcgtattttctgca

SEQ ID NO: 677684 - DNA, 25 bp, Rattus norvegicus
ttgatttcatatggtattttctgca

SEQ ID NO: 677685 - DNA, 25 bp, Rattus norvegicus
ttgatttcccctcctgtggatgaaa

SEQ ID NO: 677686 - DNA, 25 bp, Rattus norvegicus
ttgatttcccctgctgtggatgaaa

SEQ ID NO: 677687 - DNA, 25 bp, Rattus norvegicus
ttgatttcccgcaaggctgtgatgg

SEQ ID NO: 677688 - DNA, 25 bp, Rattus norvegicus
ttgatttcccgctaggctgtgatgg

SEQ ID NO: 677689 - DNA, 25 bp, Rattus norvegicus
ttgatttcctggatcacttcgcttc

SEQ ID NO: 677690 - DNA, 25 bp, Rattus norvegicus
ttgatttcctggttcacttcgcttc

SEQ ID NO: 677691 - DNA, 25 bp, Rattus norvegicus
ttgatttcctttattcttctctctg

SEQ ID NO: 677692 - DNA, 25 bp, Rattus norvegicus
ttgatttccttttttcttctctctg

SEQ ID NO: 677693 - DNA, 25 bp, Rattus norvegicus
ttgatttctaacacagtggcctggg

SEQ ID NO: 677694 - DNA, 25 bp, Rattus norvegicus
ttgatttctaactcagtggcctggg

SEQ ID NO: 677695 - DNA, 25 bp, Rattus norvegicus
ttgatttctcccacagaccataaca

SEQ ID NO: 677696 - DNA, 25 bp, Rattus norvegicus
ttgatttctccctcagaccataaca

SEQ ID NO: 677697 - DNA, 25 bp, Rattus norvegicus
ttgatttctgctctgctttgaaccg

SEQ ID NO: 677698 - DNA, 25 bp, Rattus norvegicus
ttgatttctgctgtgctttgaaccg

SEQ ID NO: 677699 - DNA, 25 bp, Rattus norvegicus
ttgatttgcaaaatgctcttgacat

SEQ ID NO: 677700 - DNA, 25 bp, Rattus norvegicus
ttgatttgcaaattgctcttgacat

SEQ ID NO: 677701 - DNA, 25 bp, Rattus norvegicus
ttgatttgcattaccaggtgaccag

SEQ ID NO: 677702 - DNA, 25 bp, Rattus norvegicus
ttgatttgcatttccaggtgaccag

SEQ ID NO: 677703 - DNA, 25 bp, Rattus norvegicus
ttgattttatttagacccaccgctt

SEQ ID NO: 677704 - DNA, 25 bp, Rattus norvegicus
ttgattttatttagagcctggagga

SEQ ID NO: 677705 - DNA, 25 bp, Rattus norvegicus
ttgattttattttgacccaccgctt

SEQ ID NO: 677706 - DNA, 25 bp, Rattus norvegicus
ttgattttattttgagcctggagga

SEQ ID NO: 677707 - DNA, 25 bp, Rattus norvegicus
ttgattttcttgagccatttctcca

SEQ ID NO: 677708 - DNA, 25 bp, Rattus norvegicus
ttgattttcttgtgccatttctcca

SEQ ID NO: 677709 - DNA, 25 bp, Rattus norvegicus
ttgattttgatcattgctcgctgga

SEQ ID NO: 677710 - DNA, 25 bp, Rattus norvegicus
ttgattttgatctttgctcgctgga

SEQ ID NO: 677711 - DNA, 25 bp, Rattus norvegicus
ttgattttgtaaaactcccacctgc

SEQ ID NO: 677712 - DNA, 25 bp, Rattus norvegicus
ttgattttgtaatactcccacctgc

SEQ ID NO: 677713 - DNA, 25 bp, Rattus norvegicus
ttgcaaaaactcactactgtacctt

SEQ ID NO: 677714 - DNA, 25 bp, Rattus norvegicus
ttgcaaaaactctctactgtacctt

SEQ ID NO: 677715 - DNA, 25 bp, Rattus norvegicus
ttgcaaaacatgaatccaaccccac

SEQ ID NO: 677716 - DNA, 25 bp, Rattus norvegicus
ttgcaaaacatgtatccaaccccac

SEQ ID NO: 677717 - DNA, 25 bp, Rattus norvegicus
ttgcaaaactgacccaaaggcctca

SEQ ID NO: 677718 - DNA, 25 bp, Rattus norvegicus
ttgcaaaactgagccaaaggcctca

SEQ ID NO: 677719 - DNA, 25 bp, Rattus norvegicus
ttgcaaaactgtagagcctctctct

SEQ ID NO: 677720 - DNA, 25 bp, Rattus norvegicus
ttgcaaaactgttgagcctctctct

SEQ ID NO: 677721 - DNA, 25 bp, Rattus norvegicus
ttgcaaaatgctacagcccagccag

SEQ ID NO: 677722 - DNA, 25 bp, Rattus norvegicus
ttgcaaaatgcttcagcccagccag

SEQ ID NO: 677723 - DNA, 25 bp, Rattus norvegicus
ttgcaaaccgtgacgcctgcgatgt

SEQ ID NO: 677724 - DNA, 25 bp, Rattus norvegicus
ttgcaaaccgtgtcgcctgcgatgt

SEQ ID NO: 677725 - DNA, 25 bp, Rattus norvegicus
ttgcaaacctcaacagacctgtggc

SEQ ID NO: 677726 - DNA, 25 bp, Rattus norvegicus
ttgcaaacctcatcagacctgtggc

SEQ ID NO: 677727 - DNA, 25 bp, Rattus norvegicus
ttgcaaaggcctacactctgtaagc

SEQ ID NO: 677728 - DNA, 25 bp, Rattus norvegicus
ttgcaaaggccttcactctgtaagc

SEQ ID NO: 677729 - DNA, 25 bp, Rattus norvegicus
ttgcaaagtggacgccttcttccca

SEQ ID NO: 677730 - DNA, 25 bp, Rattus norvegicus
ttgcaaagtggaggccttcttccca

SEQ ID NO: 677731 - DNA, 25 bp, Rattus norvegicus
ttgcaaatactaccctcaggagagg

SEQ ID NO: 677732 - DNA, 25 bp, Rattus norvegicus
ttgcaaatactagcctcaggagagg

SEQ ID NO: 677733 - DNA, 25 bp, Rattus norvegicus
ttgcaaatcagtccttgggcacact

SEQ ID NO: 677734 - DNA, 25 bp, Rattus norvegicus
ttgcaaatcagtgcttgggcacact

SEQ ID NO: 677735 - DNA, 25 bp, Rattus norvegicus
ttgcaaatgaccattgctccttgct

SEQ ID NO: 677736 - DNA, 25 bp, Rattus norvegicus
ttgcaaatgacctttgctccttgct

SEQ ID NO: 677737 - DNA, 25 bp, Rattus norvegicus
ttgcaaatggctcttcctgtttaga

SEQ ID NO: 677738 - DNA, 25 bp, Rattus norvegicus
ttgcaaatggctgttcctgtttaga

SEQ ID NO: 677739 - DNA, 25 bp, Rattus norvegicus
ttgcaaatgtgcaccctgtatctgt

SEQ ID NO: 677740 - DNA, 25 bp, Rattus norvegicus
ttgcaaatgtgctccctgtatctgt

SEQ ID NO: 677741 - DNA, 25 bp, Rattus norvegicus
ttgcaacagactacaccccatttgt

SEQ ID NO: 677742 - DNA, 25 bp, Rattus norvegicus
ttgcaacagacttcaccccatttgt

SEQ ID NO: 677743 - DNA, 25 bp, Rattus norvegicus
ttgcaacatcttccgtttccaggct

SEQ ID NO: 677744 - DNA, 25 bp, Rattus norvegicus
ttgcaacatcttgcgtttccaggct

SEQ ID NO: 677745 - DNA, 25 bp, Rattus norvegicus
ttgcaaccaggcctttggccagaga

SEQ ID NO: 677746 - DNA, 25 bp, Rattus norvegicus
ttgcaaccaggcgtttggccagaga

SEQ ID NO: 677747 - DNA, 25 bp, Rattus norvegicus
ttgcaacctgcaccaaggaggtctc

SEQ ID NO: 677748 - DNA, 25 bp, Rattus norvegicus
ttgcaacctgcagcaaggaggtctc

SEQ ID NO: 677749 - DNA, 25 bp, Rattus norvegicus
ttgcaacgtatgagcaggaactagt

SEQ ID NO: 677750 - DNA, 25 bp, Rattus norvegicus
ttgcaacgtatgtgcaggaactagt

SEQ ID NO: 677751 - DNA, 25 bp, Rattus norvegicus
ttgcaactacagagtggcattcagt

SEQ ID NO: 677752 - DNA, 25 bp, Rattus norvegicus
ttgcaactacagtgtggcattcagt

SEQ ID NO: 677753 - DNA, 25 bp, Rattus norvegicus
ttgcaactcattatggaagccagct

SEQ ID NO: 677754 - DNA, 25 bp, Rattus norvegicus
ttgcaactcattttggaagccagct

SEQ ID NO: 677755 - DNA, 25 bp, Rattus norvegicus
ttgcaactccacatcttacaggtga

SEQ ID NO: 677756 - DNA, 25 bp, Rattus norvegicus
ttgcaactccacttcttacaggtga

SEQ ID NO: 677757 - DNA, 25 bp, Rattus norvegicus
ttgcaactctatagccactgctgga

SEQ ID NO: 677758 - DNA, 25 bp, Rattus norvegicus
ttgcaactctattgccactgctgga

SEQ ID NO: 677759 - DNA, 25 bp, Rattus norvegicus
ttgcaactgatgctgcagttccttt

SEQ ID NO: 677760 - DNA, 25 bp, Rattus norvegicus
ttgcaactgatggtgcagttccttt

SEQ ID NO: 677761 - DNA, 25 bp, Rattus norvegicus
ttgcaactgcctctgcttaatcgtt

SEQ ID NO: 677762 - DNA, 25 bp, Rattus norvegicus
ttgcaactgcctgtgcttaatcgtt

SEQ ID NO: 677763 - DNA, 25 bp, Rattus norvegicus
ttgcaactgtcacagcggcggagct

SEQ ID NO: 677764 - DNA, 25 bp, Rattus norvegicus
ttgcaactgtcagagcggcggagct

SEQ ID NO: 677765 - DNA, 25 bp, Rattus norvegicus
ttgcaacttgctatccgcggagatg

SEQ ID NO: 677766 - DNA, 25 bp, Rattus norvegicus
ttgcaacttgctttccgcggagatg

SEQ ID NO: 677767 - DNA, 25 bp, Rattus norvegicus
ttgcaagaagtcagcgaccgcatgc

SEQ ID NO: 677768 - DNA, 25 bp, Rattus norvegicus
ttgcaagaagtctgcgaccgcatgc

SEQ ID NO: 677769 - DNA, 25 bp, Rattus norvegicus
ttgcaagcctgcatctctgtagaca

SEQ ID NO: 677770 - DNA, 25 bp, Rattus norvegicus
ttgcaagcctgcttctctgtagaca

SEQ ID NO: 677771 - DNA, 25 bp, Rattus norvegicus
ttgcaagcggcaaccatatacagcg

SEQ ID NO: 677772 - DNA, 25 bp, Rattus norvegicus
ttgcaagcggcatccatatacagcg

SEQ ID NO: 677773 - DNA, 25 bp, Rattus norvegicus
ttgcaagctagacccgagtacgcgg

SEQ ID NO: 677774 - DNA, 25 bp, Rattus norvegicus
ttgcaagctagagccgagtacgcgg

SEQ ID NO: 677775 - DNA, 25 bp, Rattus norvegicus
ttgcaagtcccacatgaatgaactc

SEQ ID NO: 677776 - DNA, 25 bp, Rattus norvegicus
ttgcaagtcccagatgaatgaactc

SEQ ID NO: 677777 - DNA, 25 bp, Rattus norvegicus
ttgcaagtcctgaatttaaatgtcg

SEQ ID NO: 677778 - DNA, 25 bp, Rattus norvegicus
ttgcaagtcctgtatttaaatgtcg

SEQ ID NO: 677779 - DNA, 25 bp, Rattus norvegicus
ttgcaagtgatcacagttactgggt

SEQ ID NO: 677780 - DNA, 25 bp, Rattus norvegicus
ttgcaagtgatctcagttactgggt

SEQ ID NO: 677781 - DNA, 25 bp, Rattus norvegicus
ttgcaagttgctcaccctgtcaaaa

SEQ ID NO: 677782 - DNA, 25 bp, Rattus norvegicus
ttgcaagttgctgaccctgtcaaaa

SEQ ID NO: 677783 - DNA, 25 bp, Rattus norvegicus
ttgcaagtttgcctccagttctatg

SEQ ID NO: 677784 - DNA, 25 bp, Rattus norvegicus
ttgcaagtttgcgtccagttctatg

SEQ ID NO: 677785 - DNA, 25 bp, Rattus norvegicus
ttgcaatagcaaaatccccagttag

SEQ ID NO: 677786 - DNA, 25 bp, Rattus norvegicus
ttgcaatagcaatatccccagttag

SEQ ID NO: 677787 - DNA, 25 bp, Rattus norvegicus
ttgcaatataatcgcctccattggg

SEQ ID NO: 677788 - DNA, 25 bp, Rattus norvegicus
ttgcaatataatggcctccattggg

SEQ ID NO: 677789 - DNA, 25 bp, Rattus norvegicus
ttgcaatccttgaatacagtccctc

SEQ ID NO: 677790 - DNA, 25 bp, Rattus norvegicus
ttgcaatccttgtatacagtccctc

SEQ ID NO: 677791 - DNA, 25 bp, Rattus norvegicus
ttgcaatctactagcatcatcctcc

SEQ ID NO: 677792 - DNA, 25 bp, Rattus norvegicus
ttgcaatctacttgcatcatcctcc

SEQ ID NO: 677793 - DNA, 25 bp, Rattus norvegicus
ttgcaatcttctactactgccacca

SEQ ID NO: 677794 - DNA, 25 bp, Rattus norvegicus
ttgcaatcttcttctactgccacca

SEQ ID NO: 677795 - DNA, 25 bp, Rattus norvegicus
ttgcaatgccttctctgcagttcct

SEQ ID NO: 677796 - DNA, 25 bp, Rattus norvegicus
ttgcaatgccttgtctgcagttcct

SEQ ID NO: 677797 - DNA, 25 bp, Rattus norvegicus
ttgcaatggaaccttgctcccaaga

SEQ ID NO: 677798 - DNA, 25 bp, Rattus norvegicus
ttgcaatggaacgttgctcccaaga

SEQ ID NO: 677799 - DNA, 25 bp, Rattus norvegicus
ttgcacaaattccaactccaactga

SEQ ID NO: 677800 - DNA, 25 bp, Rattus norvegicus
ttgcacaaattcgaactccaactga

SEQ ID NO: 677801 - DNA, 25 bp, Rattus norvegicus
ttgcacaacctgaaaagcattcttg

SEQ ID NO: 677802 - DNA, 25 bp, Rattus norvegicus
ttgcacaacctgtaaagcattcttg

SEQ ID NO: 677803 - DNA, 25 bp, Rattus norvegicus
ttgcacaagggtcaaagatctgagc

SEQ ID NO: 677804 - DNA, 25 bp, Rattus norvegicus
ttgcacaagggtgaaagatctgagc

SEQ ID NO: 677805 - DNA, 25 bp, Rattus norvegicus
ttgcacacataccactggtgcgtgt

SEQ ID NO: 677806 - DNA, 25 bp, Rattus norvegicus
ttgcacacatacgactggtgcgtgt

SEQ ID NO: 677807 - DNA, 25 bp, Rattus norvegicus
ttgcacacgggcaggaggacctttt

SEQ ID NO: 677808 - DNA, 25 bp, Rattus norvegicus
ttgcacacgggctggaggacctttt

SEQ ID NO: 677809 - DNA, 25 bp, Rattus norvegicus
ttgcacacggtgaacattcccaggg

SEQ ID NO: 677810 - DNA, 25 bp, Rattus norvegicus
ttgcacacggtgtacattcccaggg

SEQ ID NO: 677811 - DNA, 25 bp, Rattus norvegicus
ttgcacacttcaatgagaccttctt

SEQ ID NO: 677812 - DNA, 25 bp, Rattus norvegicus
ttgcacacttcattgagaccttctt

SEQ ID NO: 677813 - DNA, 25 bp, Rattus norvegicus
ttgcacagagcacacttatttatga

SEQ ID NO: 677814 - DNA, 25 bp, Rattus norvegicus
ttgcacagagcagacttatttatga

SEQ ID NO: 677815 - DNA, 25 bp, Rattus norvegicus
ttgcacagcaacatggcaggtacct

SEQ ID NO: 677816 - DNA, 25 bp, Rattus norvegicus
ttgcacagcaacttggcaggtacct

SEQ ID NO: 677817 - DNA, 25 bp, Rattus norvegicus
ttgcacagccagactgagggcagcc

SEQ ID NO: 677818 - DNA, 25 bp, Rattus norvegicus
ttgcacagccagtctgagggcagcc

SEQ ID NO: 677819 - DNA, 25 bp, Rattus norvegicus
ttgcacagggctatccaagagggat

SEQ ID NO: 677820 - DNA, 25 bp, Rattus norvegicus
ttgcacagggctttccaagagggat

SEQ ID NO: 677821 - DNA, 25 bp, Rattus norvegicus
ttgcacaggtgtcagacaagaggct

SEQ ID NO: 677822 - DNA, 25 bp, Rattus norvegicus
ttgcacaggtgtgagacaagaggct

SEQ ID NO: 677823 - DNA, 25 bp, Rattus norvegicus
ttgcacaggttcatgaaaacgttat

SEQ ID NO: 677824 - DNA, 25 bp, Rattus norvegicus
ttgcacaggttcttgaaaacgttat

SEQ ID NO: 677825 - DNA, 25 bp, Rattus norvegicus
ttgcacagtgcaattcatccagcag

SEQ ID NO: 677826 - DNA, 25 bp, Rattus norvegicus
ttgcacagtgcacgtttctagaagg

SEQ ID NO: 677827 - DNA, 25 bp, Rattus norvegicus
ttgcacagtgcactataacatgcct

SEQ ID NO: 677828 - DNA, 25 bp, Rattus norvegicus
ttgcacagtgcaggtttctagaagg

SEQ ID NO: 677829 - DNA, 25 bp, Rattus norvegicus
ttgcacagtgcagtataacatgcct

SEQ ID NO: 677830 - DNA, 25 bp, Rattus norvegicus
ttgcacagtgcatttcatccagcag

SEQ ID NO: 677831 - DNA, 25 bp, Rattus norvegicus
ttgcacagttacaggactccagacc

SEQ ID NO: 677832 - DNA, 25 bp, Rattus norvegicus
ttgcacagttactggactccagacc

SEQ ID NO: 677833 - DNA, 25 bp, Rattus norvegicus
ttgcacagttcacagctactacttg

SEQ ID NO: 677834 - DNA, 25 bp, Rattus norvegicus
ttgcacagttcagagctactacttg

SEQ ID NO: 677835 - DNA, 25 bp, Rattus norvegicus
ttgcacatagttcaggagtccccag

SEQ ID NO: 677836 - DNA, 25 bp, Rattus norvegicus
ttgcacatagttgaggagtccccag

SEQ ID NO: 677837 - DNA, 25 bp, Rattus norvegicus
ttgcacatcactctcgtaactctga

SEQ ID NO: 677838 - DNA, 25 bp, Rattus norvegicus
ttgcacatcactgtcgtaactctga

SEQ ID NO: 677839 - DNA, 25 bp, Rattus norvegicus
ttgcacatccatcgaggcacctgtt

SEQ ID NO: 677840 - DNA, 25 bp, Rattus norvegicus
ttgcacatccatggaggcacctgtt

SEQ ID NO: 677841 - DNA, 25 bp, Rattus norvegicus
ttgcacatgcaccacggcgaggtga

SEQ ID NO: 677842 - DNA, 25 bp, Rattus norvegicus
ttgcacatgcacgacggcgaggtga

SEQ ID NO: 677843 - DNA, 25 bp, Rattus norvegicus
ttgcacatggcacttacctgtctct

SEQ ID NO: 677844 - DNA, 25 bp, Rattus norvegicus
ttgcacatggcagttacctgtctct

SEQ ID NO: 677845 - DNA, 25 bp, Rattus norvegicus
ttgcacatggcgctgagacgcttag

SEQ ID NO: 677846 - DNA, 25 bp, Rattus norvegicus
ttgcacatggcggtgagacgcttag

SEQ ID NO: 677847 - DNA, 25 bp, Rattus norvegicus
ttgcacatgtgtaaaccagctaatg

SEQ ID NO: 677848 - DNA, 25 bp, Rattus norvegicus
ttgcacatgtgttaaccagctaatg

SEQ ID NO: 677849 - DNA, 25 bp, Rattus norvegicus
ttgcacattcttcgctctcttcaga

SEQ ID NO: 677850 - DNA, 25 bp, Rattus norvegicus
ttgcacattcttggctctcttcaga

SEQ ID NO: 677851 - DNA, 25 bp, Rattus norvegicus
ttgcaccaaactaagagagctgtct

SEQ ID NO: 677852 - DNA, 25 bp, Rattus norvegicus
ttgcaccaaacttagagagctgtct

SEQ ID NO: 677853 - DNA, 25 bp, Rattus norvegicus
ttgcaccaatagcttttcctgacac

SEQ ID NO: 677854 - DNA, 25 bp, Rattus norvegicus
ttgcaccaataggttttcctgacac

SEQ ID NO: 677855 - DNA, 25 bp, Rattus norvegicus
ttgcaccacagccactcagaatggc

SEQ ID NO: 677856 - DNA, 25 bp, Rattus norvegicus
ttgcaccacagcgactcagaatggc

SEQ ID NO: 677857 - DNA, 25 bp, Rattus norvegicus
ttgcaccacatgataatgtcctgta

SEQ ID NO: 677858 - DNA, 25 bp, Rattus norvegicus
ttgcaccacatgttaatgtcctgta

SEQ ID NO: 677859 - DNA, 25 bp, Rattus norvegicus
ttgcaccacccaagtgtctgggaat

SEQ ID NO: 677860 - DNA, 25 bp, Rattus norvegicus
ttgcaccacccatgtgtctgggaat

SEQ ID NO: 677861 - DNA, 25 bp, Rattus norvegicus
ttgcaccacttgaagagacccaaga

SEQ ID NO: 677862 - DNA, 25 bp, Rattus norvegicus
ttgcaccacttgtagagacccaaga

SEQ ID NO: 677863 - DNA, 25 bp, Rattus norvegicus
ttgcaccatgagctttgtccgtgtt

SEQ ID NO: 677864 - DNA, 25 bp, Rattus norvegicus
ttgcaccatgaggtttgtccgtgtt

SEQ ID NO: 677865 - DNA, 25 bp, Rattus norvegicus
ttgcacccaaacacatctagctcag

SEQ ID NO: 677866 - DNA, 25 bp, Rattus norvegicus
ttgcacccaaactcatctagctcag

SEQ ID NO: 677867 - DNA, 25 bp, Rattus norvegicus
ttgcacccacaaccgggaaggctat

SEQ ID NO: 677868 - DNA, 25 bp, Rattus norvegicus
ttgcacccacaagcgggaaggctat

SEQ ID NO: 677869 - DNA, 25 bp, Rattus norvegicus
ttgcacccagcacaccaggtggtgt

SEQ ID NO: 677870 - DNA, 25 bp, Rattus norvegicus
ttgcacccagcagaccaggtggtgt

SEQ ID NO: 677871 - DNA, 25 bp, Rattus norvegicus
ttgcacccagggacatgacatacat

SEQ ID NO: 677872 - DNA, 25 bp, Rattus norvegicus
ttgcacccagggtcatgacatacat

SEQ ID NO: 677873 - DNA, 25 bp, Rattus norvegicus
ttgcacccaggtcaattctgtgaat

SEQ ID NO: 677874 - DNA, 25 bp, Rattus norvegicus
ttgcacccaggtgaattctgtgaat

SEQ ID NO: 677875 - DNA, 25 bp, Rattus norvegicus
ttgcaccccaatcttgagtgacatc

SEQ ID NO: 677876 - DNA, 25 bp, Rattus norvegicus
ttgcaccccaatgttgagtgacatc

SEQ ID NO: 677877 - DNA, 25 bp, Rattus norvegicus
ttgcacccctttctaaggacctaat

SEQ ID NO: 677878 - DNA, 25 bp, Rattus norvegicus
ttgcacccctttgtaaggacctaat

SEQ ID NO: 677879 - DNA, 25 bp, Rattus norvegicus
ttgcacccgggtaaatggagttgat

SEQ ID NO: 677880 - DNA, 25 bp, Rattus norvegicus
ttgcacccgggttaatggagttgat

SEQ ID NO: 677881 - DNA, 25 bp, Rattus norvegicus
ttgcaccgtacccaggctgatgagt

SEQ ID NO: 677882 - DNA, 25 bp, Rattus norvegicus
ttgcaccgtaccgaggctgatgagt

SEQ ID NO: 677883 - DNA, 25 bp, Rattus norvegicus
ttgcaccgtgcaatgctttcaaaca

SEQ ID NO: 677884 - DNA, 25 bp, Rattus norvegicus
ttgcaccgtgcattgctttcaaaca

SEQ ID NO: 677885 - DNA, 25 bp, Rattus norvegicus
ttgcaccgtgtcactcaagaggacc

SEQ ID NO: 677886 - DNA, 25 bp, Rattus norvegicus
ttgcaccgtgtctctcaagaggacc

SEQ ID NO: 677887 - DNA, 25 bp, Rattus norvegicus
ttgcacctaattcgtccctgctggt

SEQ ID NO: 677888 - DNA, 25 bp, Rattus norvegicus
ttgcacctaattggtccctgctggt

SEQ ID NO: 677889 - DNA, 25 bp, Rattus norvegicus
ttgcacctagatcccctgacagctt

SEQ ID NO: 677890 - DNA, 25 bp, Rattus norvegicus
ttgcacctagatgccctgacagctt

SEQ ID NO: 677891 - DNA, 25 bp, Rattus norvegicus
ttgcacctcaaaaattccacattcc

SEQ ID NO: 677892 - DNA, 25 bp, Rattus norvegicus
ttgcacctcaaatattccacattcc

SEQ ID NO: 677893 - DNA, 25 bp, Rattus norvegicus
ttgcacctgaatagttccttccatg

SEQ ID NO: 677894 - DNA, 25 bp, Rattus norvegicus
ttgcacctgaattgttccttccatg

SEQ ID NO: 677895 - DNA, 25 bp, Rattus norvegicus
ttgcacctggtgctgcgtcttcgcg

SEQ ID NO: 677896 - DNA, 25 bp, Rattus norvegicus
ttgcacctggtggtgcgtcttcgcg

SEQ ID NO: 677897 - DNA, 25 bp, Rattus norvegicus
ttgcacgagatccaagccgctttgc

SEQ ID NO: 677898 - DNA, 25 bp, Rattus norvegicus
ttgcacgagatcgaagccgctttgc

SEQ ID NO: 677899 - DNA, 25 bp, Rattus norvegicus
ttgcacgcatcacgcattgtggcac

SEQ ID NO: 677900 - DNA, 25 bp, Rattus norvegicus
ttgcacgcatcaggcattgtggcac

SEQ ID NO: 677901 - DNA, 25 bp, Rattus norvegicus
ttgcacgccaaactcggcagctttg

SEQ ID NO: 677902 - DNA, 25 bp, Rattus norvegicus
ttgcacgccaaagtcggcagctttg

SEQ ID NO: 677903 - DNA, 25 bp, Rattus norvegicus
ttgcacgccctcatcatggtgggat

SEQ ID NO: 677904 - DNA, 25 bp, Rattus norvegicus
ttgcacgccctcttcatggtgggat

SEQ ID NO: 677905 - DNA, 25 bp, Rattus norvegicus
ttgcacgggtcaagagccacaggat

SEQ ID NO: 677906 - DNA, 25 bp, Rattus norvegicus
ttgcacgggtcatgagccacaggat

SEQ ID NO: 677907 - DNA, 25 bp, Rattus norvegicus
ttgcactaccaaaattgaccactag

SEQ ID NO: 677908 - DNA, 25 bp, Rattus norvegicus
ttgcactaccaatattgaccactag

SEQ ID NO: 677909 - DNA, 25 bp, Rattus norvegicus
ttgcactatttaattgatgagcctg

SEQ ID NO: 677910 - DNA, 25 bp, Rattus norvegicus
ttgcactatttatttgatgagcctg

SEQ ID NO: 677911 - DNA, 25 bp, Rattus norvegicus
ttgcactcatttaacgggtgtccct

SEQ ID NO: 677912 - DNA, 25 bp, Rattus norvegicus
ttgcactcattttacgggtgtccct

SEQ ID NO: 677913 - DNA, 25 bp, Rattus norvegicus
ttgcactcgatgcaacgctcggcgt

SEQ ID NO: 677914 - DNA, 25 bp, Rattus norvegicus
ttgcactcgatggaacgctcggcgt

SEQ ID NO: 677915 - DNA, 25 bp, Rattus norvegicus
ttgcactcgttcctatgactgagtc

SEQ ID NO: 677916 - DNA, 25 bp, Rattus norvegicus
ttgcactcgttcgtatgactgagtc

SEQ ID NO: 677917 - DNA, 25 bp, Rattus norvegicus
ttgcactgaaggcattctgttctca

SEQ ID NO: 677918 - DNA, 25 bp, Rattus norvegicus
ttgcactgaagggattctgttctca

SEQ ID NO: 677919 - DNA, 25 bp, Rattus norvegicus
ttgcactgatgtctcaagctcttcc

SEQ ID NO: 677920 - DNA, 25 bp, Rattus norvegicus
ttgcactgatgtgtcaagctcttcc

SEQ ID NO: 677921 - DNA, 25 bp, Rattus norvegicus
ttgcactgcccacttccctgtaatg

SEQ ID NO: 677922 - DNA, 25 bp, Rattus norvegicus
ttgcactgcccagttccctgtaatg

SEQ ID NO: 677923 - DNA, 25 bp, Rattus norvegicus
ttgcactgccttctctggatctaca

SEQ ID NO: 677924 - DNA, 25 bp, Rattus norvegicus
ttgcactgccttgtctggatctaca

SEQ ID NO: 677925 - DNA, 25 bp, Rattus norvegicus
ttgcactggataagtttctggtaaa

SEQ ID NO: 677926 - DNA, 25 bp, Rattus norvegicus
ttgcactggatatgtttctggtaaa

SEQ ID NO: 677927 - DNA, 25 bp, Rattus norvegicus
ttgcactgggtgcaagcctgcacaa

SEQ ID NO: 677928 - DNA, 25 bp, Rattus norvegicus
ttgcactgggtggaagcctgcacaa

SEQ ID NO: 677929 - DNA, 25 bp, Rattus norvegicus
ttgcactggtacattggaccgtgct

SEQ ID NO: 677930 - DNA, 25 bp, Rattus norvegicus
ttgcactggtactttggaccgtgct

SEQ ID NO: 677931 - DNA, 25 bp, Rattus norvegicus
ttgcactgtaaacctttctcataaa

SEQ ID NO: 677932 - DNA, 25 bp, Rattus norvegicus
ttgcactgtaaagctttctcataaa

SEQ ID NO: 677933 - DNA, 25 bp, Rattus norvegicus
ttgcactgtcgtccttaatcttaaa

SEQ ID NO: 677934 - DNA, 25 bp, Rattus norvegicus
ttgcactgtcgtgcttaatcttaaa

SEQ ID NO: 677935 - DNA, 25 bp, Rattus norvegicus
ttgcactgtctgaatggccagggtc

SEQ ID NO: 677936 - DNA, 25 bp, Rattus norvegicus
ttgcactgtctgtatggccagggtc

SEQ ID NO: 677937 - DNA, 25 bp, Rattus norvegicus
ttgcacttagacagggacacagggt

SEQ ID NO: 677938 - DNA, 25 bp, Rattus norvegicus
ttgcacttagactgggacacagggt

SEQ ID NO: 677939 - DNA, 25 bp, Rattus norvegicus
ttgcacttctccagactttcaaata

SEQ ID NO: 677940 - DNA, 25 bp, Rattus norvegicus
ttgcacttctccatggtgatgttga

SEQ ID NO: 677941 - DNA, 25 bp, Rattus norvegicus
ttgcacttctcctgactttcaaata

SEQ ID NO: 677942 - DNA, 25 bp, Rattus norvegicus
ttgcacttctccttggtgatgttga

SEQ ID NO: 677943 - DNA, 25 bp, Rattus norvegicus
ttgcacttctgtatatagtcaaaag

SEQ ID NO: 677944 - DNA, 25 bp, Rattus norvegicus
ttgcacttctgtttatagtcaaaag

SEQ ID NO: 677945 - DNA, 25 bp, Rattus norvegicus
ttgcacttgtaaatgagaaatctgt

SEQ ID NO: 677946 - DNA, 25 bp, Rattus norvegicus
ttgcacttgtaattgagaaatctgt

SEQ ID NO: 677947 - DNA, 25 bp, Rattus norvegicus
ttgcacttttgtacatgctccaaag

SEQ ID NO: 677948 - DNA, 25 bp, Rattus norvegicus
ttgcacttttgttcatgctccaaag

SEQ ID NO: 677949 - DNA, 25 bp, Rattus norvegicus
ttgcacttttttcaccgaaagcttc

SEQ ID NO: 677950 - DNA, 25 bp, Rattus norvegicus
ttgcacttttttgaccgaaagcttc

SEQ ID NO: 677951 - DNA, 25 bp, Rattus norvegicus
ttgcagaatacaaggcccctgtcct

SEQ ID NO: 677952 - DNA, 25 bp, Rattus norvegicus
ttgcagaatacatggcccctgtcct

SEQ ID NO: 677953 - DNA, 25 bp, Rattus norvegicus
ttgcagaatcagctgtcaatttggg

SEQ ID NO: 677954 - DNA, 25 bp, Rattus norvegicus
ttgcagaatcaggtgtcaatttggg

SEQ ID NO: 677955 - DNA, 25 bp, Rattus norvegicus
ttgcagacacagatgctttccagga

SEQ ID NO: 677956 - DNA, 25 bp, Rattus norvegicus
ttgcagacacagttgctttccagga

SEQ ID NO: 677957 - DNA, 25 bp, Rattus norvegicus
ttgcagacagccctgagctgccgtc

SEQ ID NO: 677958 - DNA, 25 bp, Rattus norvegicus
ttgcagacagccgtgagctgccgtc

SEQ ID NO: 677959 - DNA, 25 bp, Rattus norvegicus
ttgcagacagtgaagaccctaactt

SEQ ID NO: 677960 - DNA, 25 bp, Rattus norvegicus
ttgcagacagtgtagaccctaactt

SEQ ID NO: 677961 - DNA, 25 bp, Rattus norvegicus
ttgcagaccacaaccctggcattgg

SEQ ID NO: 677962 - DNA, 25 bp, Rattus norvegicus
ttgcagaccacatccctggcattgg

SEQ ID NO: 677963 - DNA, 25 bp, Rattus norvegicus
ttgcagaccagaacaaaagattatg

SEQ ID NO: 677964 - DNA, 25 bp, Rattus norvegicus
ttgcagaccagatcaaaagattatg

SEQ ID NO: 677965 - DNA, 25 bp, Rattus norvegicus
ttgcagacccatctcacagatttta

SEQ ID NO: 677966 - DNA, 25 bp, Rattus norvegicus
ttgcagacccatgtcacagatttta

SEQ ID NO: 677967 - DNA, 25 bp, Rattus norvegicus
ttgcagactctcagggtgtcccctt

SEQ ID NO: 677968 - DNA, 25 bp, Rattus norvegicus
ttgcagactctctgggtgtcccctt

SEQ ID NO: 677969 - DNA, 25 bp, Rattus norvegicus
ttgcagactctgctttagcattcca

SEQ ID NO: 677970 - DNA, 25 bp, Rattus norvegicus
ttgcagactctggtttagcattcca

SEQ ID NO: 677971 - DNA, 25 bp, Rattus norvegicus
ttgcagagaaaaagttccccgccct

SEQ ID NO: 677972 - DNA, 25 bp, Rattus norvegicus
ttgcagagaaaatgttccccgccct

SEQ ID NO: 677973 - DNA, 25 bp, Rattus norvegicus
ttgcagagcttcagtaaagcaaatg

SEQ ID NO: 677974 - DNA, 25 bp, Rattus norvegicus
ttgcagagcttcctgggcgtctaga

SEQ ID NO: 677975 - DNA, 25 bp, Rattus norvegicus
ttgcagagcttcgtgggcgtctaga

SEQ ID NO: 677976 - DNA, 25 bp, Rattus norvegicus
ttgcagagcttctgtaaagcaaatg

SEQ ID NO: 677977 - DNA, 25 bp, Rattus norvegicus
ttgcagaggataagcagcacacccc

SEQ ID NO: 677978 - DNA, 25 bp, Rattus norvegicus
ttgcagaggatatgcagcacacccc

SEQ ID NO: 677979 - DNA, 25 bp, Rattus norvegicus
ttgcagaggcatcaaccttggtccc

SEQ ID NO: 677980 - DNA, 25 bp, Rattus norvegicus
ttgcagaggcatgaaccttggtccc

SEQ ID NO: 677981 - DNA, 25 bp, Rattus norvegicus
ttgcagaggcctacaagtactttgt

SEQ ID NO: 677982 - DNA, 25 bp, Rattus norvegicus
ttgcagaggcctatctggcatttat

SEQ ID NO: 677983 - DNA, 25 bp, Rattus norvegicus
ttgcagaggccttcaagtactttgt

SEQ ID NO: 677984 - DNA, 25 bp, Rattus norvegicus
ttgcagaggcctttctggcatttat

SEQ ID NO: 677985 - DNA, 25 bp, Rattus norvegicus
ttgcagaggtgcacagcaggctttt

SEQ ID NO: 677986 - DNA, 25 bp, Rattus norvegicus
ttgcagaggtgctcagcaggctttt

SEQ ID NO: 677987 - DNA, 25 bp, Rattus norvegicus
ttgcagagttgcaaaccggtcaggg

SEQ ID NO: 677988 - DNA, 25 bp, Rattus norvegicus
ttgcagagttgctaaccggtcaggg

SEQ ID NO: 677989 - DNA, 25 bp, Rattus norvegicus
ttgcagagtttgcacatcccaactg

SEQ ID NO: 677990 - DNA, 25 bp, Rattus norvegicus
ttgcagagtttggacatcccaactg

SEQ ID NO: 677991 - DNA, 25 bp, Rattus norvegicus
ttgcagatgttcaaaaagctctctt

SEQ ID NO: 677992 - DNA, 25 bp, Rattus norvegicus
ttgcagatgttctaaaagctctctt

SEQ ID NO: 677993 - DNA, 25 bp, Rattus norvegicus
ttgcagcacagacgtgtgtgacagc

SEQ ID NO: 677994 - DNA, 25 bp, Rattus norvegicus
ttgcagcacagaggtgtgtgacagc

SEQ ID NO: 677995 - DNA, 25 bp, Rattus norvegicus
ttgcagcacgtgaaccccatagaaa

SEQ ID NO: 677996 - DNA, 25 bp, Rattus norvegicus
ttgcagcacgtgtaccccatagaaa

SEQ ID NO: 677997 - DNA, 25 bp, Rattus norvegicus
ttgcagcacttacaagatacagcca

SEQ ID NO: 677998 - DNA, 25 bp, Rattus norvegicus
ttgcagcacttagaagatacagcca

SEQ ID NO: 677999 - DNA, 25 bp, Rattus norvegicus
ttgcagcagacaaagcagccacaga

SEQ ID NO: 678000 - DNA, 25 bp, Rattus norvegicus
ttgcagcagacatagcagccacaga

SEQ ID NO: 678001 - DNA, 25 bp, Rattus norvegicus
ttgcagcaggttagactacttcttc

SEQ ID NO: 678002 - DNA, 25 bp, Rattus norvegicus
ttgcagcaggtttgactacttcttc

SEQ ID NO: 678003 - DNA, 25 bp, Rattus norvegicus
ttgcagcatccccaatgctaggatt

SEQ ID NO: 678004 - DNA, 25 bp, Rattus norvegicus
ttgcagcatcccgaatgctaggatt

SEQ ID NO: 678005 - DNA, 25 bp, Rattus norvegicus
ttgcagcatgcacttgcttggcctg

SEQ ID NO: 678006 - DNA, 25 bp, Rattus norvegicus
ttgcagcatgcagttgcttggcctg

SEQ ID NO: 678007 - DNA, 25 bp, Rattus norvegicus
ttgcagcatgctctacacattcagt

SEQ ID NO: 678008 - DNA, 25 bp, Rattus norvegicus
ttgcagcatgctgtacacattcagt

SEQ ID NO: 678009 - DNA, 25 bp, Rattus norvegicus
ttgcagcccaacacagaacactgta

SEQ ID NO: 678010 - DNA, 25 bp, Rattus norvegicus
ttgcagcccaactcagaacactgta

SEQ ID NO: 678011 - DNA, 25 bp, Rattus norvegicus
ttgcagcctgttaccaatcagatcg

SEQ ID NO: 678012 - DNA, 25 bp, Rattus norvegicus
ttgcagcctgtttccaatcagatcg

SEQ ID NO: 678013 - DNA, 25 bp, Rattus norvegicus
ttgcagcgccagcattagcagcagc

SEQ ID NO: 678014 - DNA, 25 bp, Rattus norvegicus
ttgcagcgccaggattagcagcagc

SEQ ID NO: 678015 - DNA, 25 bp, Rattus norvegicus
ttgcagcggacactaagagacttgg

SEQ ID NO: 678016 - DNA, 25 bp, Rattus norvegicus
ttgcagcggacagtaagagacttgg

SEQ ID NO: 678017 - DNA, 25 bp, Rattus norvegicus
ttgcagcgtggtattgtacctcagt

SEQ ID NO: 678018 - DNA, 25 bp, Rattus norvegicus
ttgcagcgtggttttgtacctcagt

SEQ ID NO: 678019 - DNA, 25 bp, Rattus norvegicus
ttgcagctaaacatcctttcagact

SEQ ID NO: 678020 - DNA, 25 bp, Rattus norvegicus
ttgcagctaaacttcctttcagact

SEQ ID NO: 678021 - DNA, 25 bp, Rattus norvegicus
ttgcagctaaatacatcacctcatc

SEQ ID NO: 678022 - DNA, 25 bp, Rattus norvegicus
ttgcagctaaattcatcacctcatc

SEQ ID NO: 678023 - DNA, 25 bp, Rattus norvegicus
ttgcagctactgactcttcatgagg

SEQ ID NO: 678024 - DNA, 25 bp, Rattus norvegicus
ttgcagctactgtctcttcatgagg

SEQ ID NO: 678025 - DNA, 25 bp, Rattus norvegicus
ttgcagctaggtaccgagcctgtgg

SEQ ID NO: 678026 - DNA, 25 bp, Rattus norvegicus
ttgcagctaggttccgagcctgtgg

SEQ ID NO: 678027 - DNA, 25 bp, Rattus norvegicus
ttgcagctcgccattttgctgaaag

SEQ ID NO: 678028 - DNA, 25 bp, Rattus norvegicus
ttgcagctcgcctttttgctgaaag

SEQ ID NO: 678029 - DNA, 25 bp, Rattus norvegicus
ttgcagctcttgacatttctggtat

SEQ ID NO: 678030 - DNA, 25 bp, Rattus norvegicus
ttgcagctcttgtcatttctggtat

SEQ ID NO: 678031 - DNA, 25 bp, Rattus norvegicus
ttgcagctgcgtcgatgaacctggc

SEQ ID NO: 678032 - DNA, 25 bp, Rattus norvegicus
ttgcagctgcgtggatgaacctggc

SEQ ID NO: 678033 - DNA, 25 bp, Rattus norvegicus
ttgcagctggctatgggcttatgca

SEQ ID NO: 678034 - DNA, 25 bp, Rattus norvegicus
ttgcagctggctttgggcttatgca

SEQ ID NO: 678035 - DNA, 25 bp, Rattus norvegicus
ttgcagctgggcaccgtacgtgtag

SEQ ID NO: 678036 - DNA, 25 bp, Rattus norvegicus
ttgcagctgggctccgtacgtgtag

SEQ ID NO: 678037 - DNA, 25 bp, Rattus norvegicus
ttgcagcttataatttccagatgag

SEQ ID NO: 678038 - DNA, 25 bp, Rattus norvegicus
ttgcagcttatattttccagatgag

SEQ ID NO: 678039 - DNA, 25 bp, Rattus norvegicus
ttgcaggaagctatgacaaccaaga

SEQ ID NO: 678040 - DNA, 25 bp, Rattus norvegicus
ttgcaggaagctttgacaaccaaga

SEQ ID NO: 678041 - DNA, 25 bp, Rattus norvegicus
ttgcaggaatgaagtgtattgttac

SEQ ID NO: 678042 - DNA, 25 bp, Rattus norvegicus
ttgcaggaatgatgtgtattgttac

SEQ ID NO: 678043 - DNA, 25 bp, Rattus norvegicus
ttgcaggacctcaagaactcatgtt

SEQ ID NO: 678044 - DNA, 25 bp, Rattus norvegicus
ttgcaggacctctagaactcatgtt

SEQ ID NO: 678045 - DNA, 25 bp, Rattus norvegicus
ttgcaggacctgatgcccagttcag

SEQ ID NO: 678046 - DNA, 25 bp, Rattus norvegicus
ttgcaggacctgttgcccagttcag

SEQ ID NO: 678047 - DNA, 25 bp, Rattus norvegicus
ttgcaggatcccatcaaaccttctg

SEQ ID NO: 678048 - DNA, 25 bp, Rattus norvegicus
ttgcaggatcccttcaaaccttctg

SEQ ID NO: 678049 - DNA, 25 bp, Rattus norvegicus
ttgcaggatgcacagatggtctctt

SEQ ID NO: 678050 - DNA, 25 bp, Rattus norvegicus
ttgcaggatgcagagatggtctctt

SEQ ID NO: 678051 - DNA, 25 bp, Rattus norvegicus
ttgcaggcaaacatcactctttatt

SEQ ID NO: 678052 - DNA, 25 bp, Rattus norvegicus
ttgcaggcaaacttcactctttatt

SEQ ID NO: 678053 - DNA, 25 bp, Rattus norvegicus
ttgcaggcatagatgcaaagcaccc

SEQ ID NO: 678054 - DNA, 25 bp, Rattus norvegicus
ttgcaggcatagttgcaaagcaccc

SEQ ID NO: 678055 - DNA, 25 bp, Rattus norvegicus
ttgcaggcccagcaaccatagcata

SEQ ID NO: 678056 - DNA, 25 bp, Rattus norvegicus
ttgcaggcccaggaaccatagcata

SEQ ID NO: 678057 - DNA, 25 bp, Rattus norvegicus
ttgcaggctcagaatctcaacctcc

SEQ ID NO: 678058 - DNA, 25 bp, Rattus norvegicus
ttgcaggctcagtatctcaacctcc

SEQ ID NO: 678059 - DNA, 25 bp, Rattus norvegicus
ttgcaggctgccagactcattcaac

SEQ ID NO: 678060 - DNA, 25 bp, Rattus norvegicus
ttgcaggctgcctgactcattcaac

SEQ ID NO: 678061 - DNA, 25 bp, Rattus norvegicus
ttgcaggctggacgccagttctacg

SEQ ID NO: 678062 - DNA, 25 bp, Rattus norvegicus
ttgcaggctggaggccagttctacg

SEQ ID NO: 678063 - DNA, 25 bp, Rattus norvegicus
ttgcagggaagcagaggcctcctct

SEQ ID NO: 678064 - DNA, 25 bp, Rattus norvegicus
ttgcagggaagctgaggcctcctct

SEQ ID NO: 678065 - DNA, 25 bp, Rattus norvegicus
ttgcagggccagcattctggtctct

SEQ ID NO: 678066 - DNA, 25 bp, Rattus norvegicus
ttgcagggccaggattctggtctct

SEQ ID NO: 678067 - DNA, 25 bp, Rattus norvegicus
ttgcagggctatcgtcagacatcag

SEQ ID NO: 678068 - DNA, 25 bp, Rattus norvegicus
ttgcagggctatggtcagacatcag

SEQ ID NO: 678069 - DNA, 25 bp, Rattus norvegicus
ttgcaggtcatcctttggctgtcct

SEQ ID NO: 678070 - DNA, 25 bp, Rattus norvegicus
ttgcaggtcatcgtttggctgtcct

SEQ ID NO: 678071 - DNA, 25 bp, Rattus norvegicus
ttgcaggtccgcaatggtcagaaga

SEQ ID NO: 678072 - DNA, 25 bp, Rattus norvegicus
ttgcaggtccgctatggtcagaaga

SEQ ID NO: 678073 - DNA, 25 bp, Rattus norvegicus
ttgcaggtcctccagagtttttgct

SEQ ID NO: 678074 - DNA, 25 bp, Rattus norvegicus
ttgcaggtcctcgagagtttttgct

SEQ ID NO: 678075 - DNA, 25 bp, Rattus norvegicus
ttgcaggtctctacataagctctcg

SEQ ID NO: 678076 - DNA, 25 bp, Rattus norvegicus
ttgcaggtctcttcataagctctcg

SEQ ID NO: 678077 - DNA, 25 bp, Rattus norvegicus
ttgcaggtgtcaactgtcttccagt

SEQ ID NO: 678078 - DNA, 25 bp, Rattus norvegicus
ttgcaggtgtcatctgtcttccagt

SEQ ID NO: 678079 - DNA, 25 bp, Rattus norvegicus
ttgcaggttcccaggcagccgagta

SEQ ID NO: 678080 - DNA, 25 bp, Rattus norvegicus
ttgcaggttccctggcagccgagta

SEQ ID NO: 678081 - DNA, 25 bp, Rattus norvegicus
ttgcagtaacccacatgctttctta

SEQ ID NO: 678082 - DNA, 25 bp, Rattus norvegicus
ttgcagtaaccctcatgctttctta

SEQ ID NO: 678083 - DNA, 25 bp, Rattus norvegicus
ttgcagtaatgtctggcctcaacca

SEQ ID NO: 678084 - DNA, 25 bp, Rattus norvegicus
ttgcagtaatgtgtggcctcaacca

SEQ ID NO: 678085 - DNA, 25 bp, Rattus norvegicus
ttgcagtaccccagtttctagttta

SEQ ID NO: 678086 - DNA, 25 bp, Rattus norvegicus
ttgcagtacccctgtttctagttta

SEQ ID NO: 678087 - DNA, 25 bp, Rattus norvegicus
ttgcagtagctcagacttcttgtct

SEQ ID NO: 678088 - DNA, 25 bp, Rattus norvegicus
ttgcagtagctctgacttcttgtct

SEQ ID NO: 678089 - DNA, 25 bp, Rattus norvegicus
ttgcagtattagaggagagcaggct

SEQ ID NO: 678090 - DNA, 25 bp, Rattus norvegicus
ttgcagtattagtggagagcaggct

SEQ ID NO: 678091 - DNA, 25 bp, Rattus norvegicus
ttgcagtccagaagcaccttagggt

SEQ ID NO: 678092 - DNA, 25 bp, Rattus norvegicus
ttgcagtccagatgcaccttagggt

SEQ ID NO: 678093 - DNA, 25 bp, Rattus norvegicus
ttgcagtcctgtatggcttagtttc

SEQ ID NO: 678094 - DNA, 25 bp, Rattus norvegicus
ttgcagtcctgtttggcttagtttc

SEQ ID NO: 678095 - DNA, 25 bp, Rattus norvegicus
ttgcagtctgatattgtggttacac

SEQ ID NO: 678096 - DNA, 25 bp, Rattus norvegicus
ttgcagtctgattttgtggttacac

SEQ ID NO: 678097 - DNA, 25 bp, Rattus norvegicus
ttgcagtcttaaacccactacagaa

SEQ ID NO: 678098 - DNA, 25 bp, Rattus norvegicus
ttgcagtcttaatcccactacagaa

SEQ ID NO: 678099 - DNA, 25 bp, Rattus norvegicus
ttgcagtgatcccacgaacagcatc

SEQ ID NO: 678100 - DNA, 25 bp, Rattus norvegicus
ttgcagtgatccgacgaacagcatc

SEQ ID NO: 678101 - DNA, 25 bp, Rattus norvegicus
ttgcagtgcagtcttgctggcccaa

SEQ ID NO: 678102 - DNA, 25 bp, Rattus norvegicus
ttgcagtgcagtgttgctggcccaa

SEQ ID NO: 678103 - DNA, 25 bp, Rattus norvegicus
ttgcagtgcgctagccccggagccg

SEQ ID NO: 678104 - DNA, 25 bp, Rattus norvegicus
ttgcagtgcgcttgccccggagccg

SEQ ID NO: 678105 - DNA, 25 bp, Rattus norvegicus
ttgcagtggacgctggccttgatct

SEQ ID NO: 678106 - DNA, 25 bp, Rattus norvegicus
ttgcagtggacggtggccttgatct

SEQ ID NO: 678107 - DNA, 25 bp, Rattus norvegicus
ttgcagtggccaacacagaagcctt

SEQ ID NO: 678108 - DNA, 25 bp, Rattus norvegicus
ttgcagtggccatcacagaagcctt

SEQ ID NO: 678109 - DNA, 25 bp, Rattus norvegicus
ttgcagtggcctcatgggtaccgca

SEQ ID NO: 678110 - DNA, 25 bp, Rattus norvegicus
ttgcagtggcctgatgggtaccgca

SEQ ID NO: 678111 - DNA, 25 bp, Rattus norvegicus
ttgcagtggtctctagtcctggaac

SEQ ID NO: 678112 - DNA, 25 bp, Rattus norvegicus
ttgcagtggtctgtagtcctggaac

SEQ ID NO: 678113 - DNA, 25 bp, Rattus norvegicus
ttgcagtggtgcattagagatctct

SEQ ID NO: 678114 - DNA, 25 bp, Rattus norvegicus
ttgcagtggtgctttagagatctct

SEQ ID NO: 678115 - DNA, 25 bp, Rattus norvegicus
ttgcagtgtctgatcttcttattgt

SEQ ID NO: 678116 - DNA, 25 bp, Rattus norvegicus
ttgcagtgtctgttcttcttattgt

SEQ ID NO: 678117 - DNA, 25 bp, Rattus norvegicus
ttgcagtgttcaaaggtggccacag

SEQ ID NO: 678118 - DNA, 25 bp, Rattus norvegicus
ttgcagtgttcataggtggccacag

SEQ ID NO: 678119 - DNA, 25 bp, Rattus norvegicus
ttgcagttcagcacctgagtctaga

SEQ ID NO: 678120 - DNA, 25 bp, Rattus norvegicus
ttgcagttcagctcctgagtctaga

SEQ ID NO: 678121 - DNA, 25 bp, Rattus norvegicus
ttgcagttccacataccagctatga

SEQ ID NO: 678122 - DNA, 25 bp, Rattus norvegicus
ttgcagttccacttaccagctatga

SEQ ID NO: 678123 - DNA, 25 bp, Rattus norvegicus
ttgcagttgcccactgatcagatat

SEQ ID NO: 678124 - DNA, 25 bp, Rattus norvegicus
ttgcagttgccctctgatcagatat

SEQ ID NO: 678125 - DNA, 25 bp, Rattus norvegicus
ttgcagttttctcagggtcatcact

SEQ ID NO: 678126 - DNA, 25 bp, Rattus norvegicus
ttgcagttttctgagggtcatcact

SEQ ID NO: 678127 - DNA, 25 bp, Rattus norvegicus
ttgcataagtccacattctaccaca

SEQ ID NO: 678128 - DNA, 25 bp, Rattus norvegicus
ttgcataagtcctcattctaccaca

SEQ ID NO: 678129 - DNA, 25 bp, Rattus norvegicus
ttgcatactgttccacacttgccac

SEQ ID NO: 678130 - DNA, 25 bp, Rattus norvegicus
ttgcatactgttgcacacttgccac

SEQ ID NO: 678131 - DNA, 25 bp, Rattus norvegicus
ttgcatagaaacaggacttggcttt

SEQ ID NO: 678132 - DNA, 25 bp, Rattus norvegicus
ttgcatagaaactggacttggcttt

SEQ ID NO: 678133 - DNA, 25 bp, Rattus norvegicus
ttgcataggctgagtgttgacgttc

SEQ ID NO: 678134 - DNA, 25 bp, Rattus norvegicus
ttgcataggctgtgtgttgacgttc

SEQ ID NO: 678135 - DNA, 25 bp, Rattus norvegicus
ttgcatagtatgatcttggacccct

SEQ ID NO: 678136 - DNA, 25 bp, Rattus norvegicus
ttgcatagtatgttcttggacccct

SEQ ID NO: 678137 - DNA, 25 bp, Rattus norvegicus
ttgcatattattccagcactgctat

SEQ ID NO: 678138 - DNA, 25 bp, Rattus norvegicus
ttgcatattattgcagcactgctat

SEQ ID NO: 678139 - DNA, 25 bp, Rattus norvegicus
ttgcatattttaagactcgcctgaa

SEQ ID NO: 678140 - DNA, 25 bp, Rattus norvegicus
ttgcatattttatgactcgcctgaa

SEQ ID NO: 678141 - DNA, 25 bp, Rattus norvegicus
ttgcatattttcaactgtctgcctt

SEQ ID NO: 678142 - DNA, 25 bp, Rattus norvegicus
ttgcatattttctactgtctgcctt

SEQ ID NO: 678143 - DNA, 25 bp, Rattus norvegicus
ttgcatcaagagcaaccccaagggt

SEQ ID NO: 678144 - DNA, 25 bp, Rattus norvegicus
ttgcatcaagaggaaccccaagggt

SEQ ID NO: 678145 - DNA, 25 bp, Rattus norvegicus
ttgcatcactctaatcccagtaaag

SEQ ID NO: 678146 - DNA, 25 bp, Rattus norvegicus
ttgcatcactcttatcccagtaaag

SEQ ID NO: 678147 - DNA, 25 bp, Rattus norvegicus
ttgcatcaggtgactttcccgttaa

SEQ ID NO: 678148 - DNA, 25 bp, Rattus norvegicus
ttgcatcaggtgtctttcccgttaa

SEQ ID NO: 678149 - DNA, 25 bp, Rattus norvegicus
ttgcatcatcgtcacgctgtcgtag

SEQ ID NO: 678150 - DNA, 25 bp, Rattus norvegicus
ttgcatcatcgtgacgctgtcgtag

SEQ ID NO: 678151 - DNA, 25 bp, Rattus norvegicus
ttgcatccagtgaagacgtagccag

SEQ ID NO: 678152 - DNA, 25 bp, Rattus norvegicus
ttgcatccagtgtagacgtagccag

SEQ ID NO: 678153 - DNA, 25 bp, Rattus norvegicus
ttgcatccccgacctaataattgtg

SEQ ID NO: 678154 - DNA, 25 bp, Rattus norvegicus
ttgcatccccgagctaataattgtg

SEQ ID NO: 678155 - DNA, 25 bp, Rattus norvegicus
ttgcatccctctagcacctgctgag

SEQ ID NO: 678156 - DNA, 25 bp, Rattus norvegicus
ttgcatccctcttgcacctgctgag

SEQ ID NO: 678157 - DNA, 25 bp, Rattus norvegicus
ttgcatccggtacccctaacaaaga

SEQ ID NO: 678158 - DNA, 25 bp, Rattus norvegicus
ttgcatccggtagccctaacaaaga

SEQ ID NO: 678159 - DNA, 25 bp, Rattus norvegicus
ttgcatcctgatcctttgtgagttc

SEQ ID NO: 678160 - DNA, 25 bp, Rattus norvegicus
ttgcatcctgatgctttgtgagttc

SEQ ID NO: 678161 - DNA, 25 bp, Rattus norvegicus
ttgcatcctgtgaaaccatttcgtt

SEQ ID NO: 678162 - DNA, 25 bp, Rattus norvegicus
ttgcatcctgtgtaaccatttcgtt

SEQ ID NO: 678163 - DNA, 25 bp, Rattus norvegicus
ttgcatctcaatcagctctctctta

SEQ ID NO: 678164 - DNA, 25 bp, Rattus norvegicus
ttgcatctcaatgagctctctctta

SEQ ID NO: 678165 - DNA, 25 bp, Rattus norvegicus
ttgcatctgcagaagaggtcgccct

SEQ ID NO: 678166 - DNA, 25 bp, Rattus norvegicus
ttgcatctgcagtagaggtcgccct

SEQ ID NO: 678167 - DNA, 25 bp, Rattus norvegicus
ttgcatctggtgagggacagcctat

SEQ ID NO: 678168 - DNA, 25 bp, Rattus norvegicus
ttgcatctggtgtgggacagcctat

SEQ ID NO: 678169 - DNA, 25 bp, Rattus norvegicus
ttgcatcttattacccgtacacagg

SEQ ID NO: 678170 - DNA, 25 bp, Rattus norvegicus
ttgcatcttatttcccgtacacagg

SEQ ID NO: 678171 - DNA, 25 bp, Rattus norvegicus
ttgcatctttaaccctttacagcca

SEQ ID NO: 678172 - DNA, 25 bp, Rattus norvegicus
ttgcatctttaagcctttacagcca

SEQ ID NO: 678173 - DNA, 25 bp, Rattus norvegicus
ttgcatgacaagcactttccaagtg

SEQ ID NO: 678174 - DNA, 25 bp, Rattus norvegicus
ttgcatgacaaggactttccaagtg

SEQ ID NO: 678175 - DNA, 25 bp, Rattus norvegicus
ttgcatgaccaaactcaaggctgga

SEQ ID NO: 678176 - DNA, 25 bp, Rattus norvegicus
ttgcatgaccaatctcaaggctgga

SEQ ID NO: 678177 - DNA, 25 bp, Rattus norvegicus
ttgcatgcagctcaccctaggaaga

SEQ ID NO: 678178 - DNA, 25 bp, Rattus norvegicus
ttgcatgcagctgaccctaggaaga

SEQ ID NO: 678179 - DNA, 25 bp, Rattus norvegicus
ttgcatgcatgtactgacttctggt

SEQ ID NO: 678180 - DNA, 25 bp, Rattus norvegicus
ttgcatgcatgttctgacttctggt

SEQ ID NO: 678181 - DNA, 25 bp, Rattus norvegicus
ttgcatgccttcaccatgggtaaaa

SEQ ID NO: 678182 - DNA, 25 bp, Rattus norvegicus
ttgcatgccttctccatgggtaaaa

SEQ ID NO: 678183 - DNA, 25 bp, Rattus norvegicus
ttgcatgctatgcagggctgtacct

SEQ ID NO: 678184 - DNA, 25 bp, Rattus norvegicus
ttgcatgctatggagggctgtacct

SEQ ID NO: 678185 - DNA, 25 bp, Rattus norvegicus
ttgcatgcttcaacctggctaatat

SEQ ID NO: 678186 - DNA, 25 bp, Rattus norvegicus
ttgcatgcttcatcctggctaatat

SEQ ID NO: 678187 - DNA, 25 bp, Rattus norvegicus
ttgcatggatgtatttctctcttca

SEQ ID NO: 678188 - DNA, 25 bp, Rattus norvegicus
ttgcatggatgtttttctctcttca

SEQ ID NO: 678189 - DNA, 25 bp, Rattus norvegicus
ttgcatggctccagaaacaccacag

SEQ ID NO: 678190 - DNA, 25 bp, Rattus norvegicus
ttgcatggctcctgaaacaccacag

SEQ ID NO: 678191 - DNA, 25 bp, Rattus norvegicus
ttgcatggtcttaagaatttttctg

SEQ ID NO: 678192 - DNA, 25 bp, Rattus norvegicus
ttgcatggtctttagaatttttctg

SEQ ID NO: 678193 - DNA, 25 bp, Rattus norvegicus
ttgcatggtttcatggttatctttc

SEQ ID NO: 678194 - DNA, 25 bp, Rattus norvegicus
ttgcatggtttcttggttatctttc

SEQ ID NO: 678195 - DNA, 25 bp, Rattus norvegicus
ttgcatgtatttccttcttggaaat

SEQ ID NO: 678196 - DNA, 25 bp, Rattus norvegicus
ttgcatgtatttgcttcttggaaat

SEQ ID NO: 678197 - DNA, 25 bp, Rattus norvegicus
ttgcatgtccctcttgacctaagaa

SEQ ID NO: 678198 - DNA, 25 bp, Rattus norvegicus
ttgcatgtccctgttgacctaagaa

SEQ ID NO: 678199 - DNA, 25 bp, Rattus norvegicus
ttgcatgtgaatcctctccctaaaa

SEQ ID NO: 678200 - DNA, 25 bp, Rattus norvegicus
ttgcatgtgaatgctctccctaaaa

SEQ ID NO: 678201 - DNA, 25 bp, Rattus norvegicus
ttgcatgtgcaaaacggaaaccgga

SEQ ID NO: 678202 - DNA, 25 bp, Rattus norvegicus
ttgcatgtgcaatacggaaaccgga

SEQ ID NO: 678203 - DNA, 25 bp, Rattus norvegicus
ttgcattaaccaaactggcccatga

SEQ ID NO: 678204 - DNA, 25 bp, Rattus norvegicus
ttgcattaaccatactggcccatga

SEQ ID NO: 678205 - DNA, 25 bp, Rattus norvegicus
ttgcattaggctacccaaggagtgt

SEQ ID NO: 678206 - DNA, 25 bp, Rattus norvegicus
ttgcattaggcttcccaaggagtgt

SEQ ID NO: 678207 - DNA, 25 bp, Rattus norvegicus
ttgcattccaaaagactccgtgtgt

SEQ ID NO: 678208 - DNA, 25 bp, Rattus norvegicus
ttgcattccaaatgactccgtgtgt

SEQ ID NO: 678209 - DNA, 25 bp, Rattus norvegicus
ttgcattccagtattttctactaaa

SEQ ID NO: 678210 - DNA, 25 bp, Rattus norvegicus
ttgcattccagttttttctactaaa

SEQ ID NO: 678211 - DNA, 25 bp, Rattus norvegicus
ttgcattcccatatctagataccca

SEQ ID NO: 678212 - DNA, 25 bp, Rattus norvegicus
ttgcattcccatttctagataccca

SEQ ID NO: 678213 - DNA, 25 bp, Rattus norvegicus
ttgcattctcaacctcatgacctct

SEQ ID NO: 678214 - DNA, 25 bp, Rattus norvegicus
ttgcattctcaagctcatgacctct

SEQ ID NO: 678215 - DNA, 25 bp, Rattus norvegicus
ttgcattcttccacagtgttccaca

SEQ ID NO: 678216 - DNA, 25 bp, Rattus norvegicus
ttgcattcttcctcagtgttccaca

SEQ ID NO: 678217 - DNA, 25 bp, Rattus norvegicus
ttgcattctttcaacttgctgggaa

SEQ ID NO: 678218 - DNA, 25 bp, Rattus norvegicus
ttgcattctttctacttgctgggaa

SEQ ID NO: 678219 - DNA, 25 bp, Rattus norvegicus
ttgcattgaactagggaaagccctg

SEQ ID NO: 678220 - DNA, 25 bp, Rattus norvegicus
ttgcattgaacttgggaaagccctg

SEQ ID NO: 678221 - DNA, 25 bp, Rattus norvegicus
ttgcattgcatgatgtcagcgcctg

SEQ ID NO: 678222 - DNA, 25 bp, Rattus norvegicus
ttgcattgcatgttgtcagcgcctg

SEQ ID NO: 678223 - DNA, 25 bp, Rattus norvegicus
ttgcattgctgtatctggttcggga

SEQ ID NO: 678224 - DNA, 25 bp, Rattus norvegicus
ttgcattgctgtttctggttcggga

SEQ ID NO: 678225 - DNA, 25 bp, Rattus norvegicus
ttgcattggcctcggcatttggcta

SEQ ID NO: 678226 - DNA, 25 bp, Rattus norvegicus
ttgcattggcctgggcatttggcta

SEQ ID NO: 678227 - DNA, 25 bp, Rattus norvegicus
ttgcattgtagaagttgtccttaaa

SEQ ID NO: 678228 - DNA, 25 bp, Rattus norvegicus
ttgcattgtagatgttgtccttaaa

SEQ ID NO: 678229 - DNA, 25 bp, Rattus norvegicus
ttgcattgtattctcaggctgacgg

SEQ ID NO: 678230 - DNA, 25 bp, Rattus norvegicus
ttgcattgtattgtcaggctgacgg

SEQ ID NO: 678231 - DNA, 25 bp, Rattus norvegicus
ttgcatttagtaacttcctcacttt

SEQ ID NO: 678232 - DNA, 25 bp, Rattus norvegicus
ttgcatttagtatcttcctcacttt

SEQ ID NO: 678233 - DNA, 25 bp, Rattus norvegicus
ttgcatttataaaagctgtctccat

SEQ ID NO: 678234 - DNA, 25 bp, Rattus norvegicus
ttgcatttataatagctgtctccat

SEQ ID NO: 678235 - DNA, 25 bp, Rattus norvegicus
ttgcatttatttcccagctctgcca

SEQ ID NO: 678236 - DNA, 25 bp, Rattus norvegicus
ttgcatttatttgccagctctgcca

SEQ ID NO: 678237 - DNA, 25 bp, Rattus norvegicus
ttgcatttcatgcatctcccctgaa

SEQ ID NO: 678238 - DNA, 25 bp, Rattus norvegicus
ttgcatttcatggatctcccctgaa

SEQ ID NO: 678239 - DNA, 25 bp, Rattus norvegicus
ttgcatttcctacttctagcccaga

SEQ ID NO: 678240 - DNA, 25 bp, Rattus norvegicus
ttgcatttcctagttctagcccaga

SEQ ID NO: 678241 - DNA, 25 bp, Rattus norvegicus
ttgcatttcgcacccttccctaatg

SEQ ID NO: 678242 - DNA, 25 bp, Rattus norvegicus
ttgcatttcgcagccttccctaatg

SEQ ID NO: 678243 - DNA, 25 bp, Rattus norvegicus
ttgcatttctctacatggctgggta

SEQ ID NO: 678244 - DNA, 25 bp, Rattus norvegicus
ttgcatttctcttcatggctgggta

SEQ ID NO: 678245 - DNA, 25 bp, Rattus norvegicus
ttgcatttgcatatccgtttttcca

SEQ ID NO: 678246 - DNA, 25 bp, Rattus norvegicus
ttgcatttgcatttccgtttttcca

SEQ ID NO: 678247 - DNA, 25 bp, Rattus norvegicus
ttgcatttgctgacactgcagtcca

SEQ ID NO: 678248 - DNA, 25 bp, Rattus norvegicus
ttgcatttgctgtcactgcagtcca

SEQ ID NO: 678249 - DNA, 25 bp, Rattus norvegicus
ttgcattttactcccttacctgaat

SEQ ID NO: 678250 - DNA, 25 bp, Rattus norvegicus
ttgcattttactgccttacctgaat

SEQ ID NO: 678251 - DNA, 25 bp, Rattus norvegicus
ttgcattttcacagtatatagcctg

SEQ ID NO: 678252 - DNA, 25 bp, Rattus norvegicus
ttgcattttcactgtatatagcctg

SEQ ID NO: 678253 - DNA, 25 bp, Rattus norvegicus
ttgcattttctacccgtgagcggag

SEQ ID NO: 678254 - DNA, 25 bp, Rattus norvegicus
ttgcattttctagccgtgagcggag

SEQ ID NO: 678255 - DNA, 25 bp, Rattus norvegicus
ttgcattttgaaagagccgctccgg

SEQ ID NO: 678256 - DNA, 25 bp, Rattus norvegicus
ttgcattttgaatgagccgctccgg

SEQ ID NO: 678257 - DNA, 25 bp, Rattus norvegicus
ttgccaaaatccatagactccttcg

SEQ ID NO: 678258 - DNA, 25 bp, Rattus norvegicus
ttgccaaaatccttagactccttcg

SEQ ID NO: 678259 - DNA, 25 bp, Rattus norvegicus
ttgccaaacctaaaagctgctcact

SEQ ID NO: 678260 - DNA, 25 bp, Rattus norvegicus
ttgccaaacctataagctgctcact

SEQ ID NO: 678261 - DNA, 25 bp, Rattus norvegicus
ttgccaaactcacactcttttttag

SEQ ID NO: 678262 - DNA, 25 bp, Rattus norvegicus
ttgccaaactcagactcttttttag

SEQ ID NO: 678263 - DNA, 25 bp, Rattus norvegicus
ttgccaaagcctagcgactcagaga

SEQ ID NO: 678264 - DNA, 25 bp, Rattus norvegicus
ttgccaaagccttgcgactcagaga

SEQ ID NO: 678265 - DNA, 25 bp, Rattus norvegicus
ttgccaaagcttcctccagaagaga

SEQ ID NO: 678266 - DNA, 25 bp, Rattus norvegicus
ttgccaaagcttgctccagaagaga

SEQ ID NO: 678267 - DNA, 25 bp, Rattus norvegicus
ttgccaaagtatacccatgagcctc

SEQ ID NO: 678268 - DNA, 25 bp, Rattus norvegicus
ttgccaaagtattcccatgagcctc

SEQ ID NO: 678269 - DNA, 25 bp, Rattus norvegicus
ttgccaaagtcaactccctcatgca

SEQ ID NO: 678270 - DNA, 25 bp, Rattus norvegicus
ttgccaaagtcatctccctcatgca

SEQ ID NO: 678271 - DNA, 25 bp, Rattus norvegicus
ttgccaaagtgtatccaggactacc

SEQ ID NO: 678272 - DNA, 25 bp, Rattus norvegicus
ttgccaaagtgtttccaggactacc

SEQ ID NO: 678273 - DNA, 25 bp, Rattus norvegicus
ttgccaaagttactactgaaggact

SEQ ID NO: 678274 - DNA, 25 bp, Rattus norvegicus
ttgccaaagttagtactgaaggact

SEQ ID NO: 678275 - DNA, 25 bp, Rattus norvegicus
ttgccaaatacacctcattccaggt

SEQ ID NO: 678276 - DNA, 25 bp, Rattus norvegicus
ttgccaaatacagctcattccaggt

SEQ ID NO: 678277 - DNA, 25 bp, Rattus norvegicus
ttgccaaatcccactgagcatttct

SEQ ID NO: 678278 - DNA, 25 bp, Rattus norvegicus
ttgccaaatccctctgagcatttct

SEQ ID NO: 678279 - DNA, 25 bp, Rattus norvegicus
ttgccaaattcccaagacctttaca

SEQ ID NO: 678280 - DNA, 25 bp, Rattus norvegicus
ttgccaaattccgaagacctttaca

SEQ ID NO: 678281 - DNA, 25 bp, Rattus norvegicus
ttgccaacaaaaagggttctgaaca

SEQ ID NO: 678282 - DNA, 25 bp, Rattus norvegicus
ttgccaacaaaatgggttctgaaca

SEQ ID NO: 678283 - DNA, 25 bp, Rattus norvegicus
ttgccaaccttaagtcatgctgtgt

SEQ ID NO: 678284 - DNA, 25 bp, Rattus norvegicus
ttgccaaccttatgtcatgctgtgt

SEQ ID NO: 678285 - DNA, 25 bp, Rattus norvegicus
ttgccaactcgacacttagcttttc

SEQ ID NO: 678286 - DNA, 25 bp, Rattus norvegicus
ttgccaactcgagacttagcttttc

SEQ ID NO: 678287 - DNA, 25 bp, Rattus norvegicus
ttgccaactggtaaatcattccaac

SEQ ID NO: 678288 - DNA, 25 bp, Rattus norvegicus
ttgccaactggttaatcattccaac

SEQ ID NO: 678289 - DNA, 25 bp, Rattus norvegicus
ttgccaagaagcacccaattctgag

SEQ ID NO: 678290 - DNA, 25 bp, Rattus norvegicus
ttgccaagaagctcccaattctgag

SEQ ID NO: 678291 - DNA, 25 bp, Rattus norvegicus
ttgccaagcagaacgtacagaagtc

SEQ ID NO: 678292 - DNA, 25 bp, Rattus norvegicus
ttgccaagcagaccggccagtggat

SEQ ID NO: 678293 - DNA, 25 bp, Rattus norvegicus
ttgccaagcagagcggccagtggat

SEQ ID NO: 678294 - DNA, 25 bp, Rattus norvegicus
ttgccaagcagatcgtacagaagtc

SEQ ID NO: 678295 - DNA, 25 bp, Rattus norvegicus
ttgccaagccacactgagtacatta

SEQ ID NO: 678296 - DNA, 25 bp, Rattus norvegicus
ttgccaagccactctgagtacatta

SEQ ID NO: 678297 - DNA, 25 bp, Rattus norvegicus
ttgccaaggcctctttgccaccata

SEQ ID NO: 678298 - DNA, 25 bp, Rattus norvegicus
ttgccaaggcctgtttgccaccata

SEQ ID NO: 678299 - DNA, 25 bp, Rattus norvegicus
ttgccaagtctcagggcctcaagga

SEQ ID NO: 678300 - DNA, 25 bp, Rattus norvegicus
ttgccaagtctctgggcctcaagga

SEQ ID NO: 678301 - DNA, 25 bp, Rattus norvegicus
ttgccaagttccaaagcgagcgctc

SEQ ID NO: 678302 - DNA, 25 bp, Rattus norvegicus
ttgccaagttcctaagcgagcgctc

SEQ ID NO: 678303 - DNA, 25 bp, Rattus norvegicus
ttgccaagtttaacagtcttcctgt

SEQ ID NO: 678304 - DNA, 25 bp, Rattus norvegicus
ttgccaagtttatcagtcttcctgt

SEQ ID NO: 678305 - DNA, 25 bp, Rattus norvegicus
ttgccaatagccagtatgtttccca

SEQ ID NO: 678306 - DNA, 25 bp, Rattus norvegicus
ttgccaatagcctgtatgtttccca

SEQ ID NO: 678307 - DNA, 25 bp, Rattus norvegicus
ttgccaatatctctaccacatctaa

SEQ ID NO: 678308 - DNA, 25 bp, Rattus norvegicus
ttgccaatatctgtaccacatctaa

SEQ ID NO: 678309 - DNA, 25 bp, Rattus norvegicus
ttgccaatcaaacccagtctcactg

SEQ ID NO: 678310 - DNA, 25 bp, Rattus norvegicus
ttgccaatcaaagccagtctcactg

SEQ ID NO: 678311 - DNA, 25 bp, Rattus norvegicus
ttgccaatccctcaaagcttcagtg

SEQ ID NO: 678312 - DNA, 25 bp, Rattus norvegicus
ttgccaatccctgaaagcttcagtg

SEQ ID NO: 678313 - DNA, 25 bp, Rattus norvegicus
ttgccaatgattcgaatttcctctt

SEQ ID NO: 678314 - DNA, 25 bp, Rattus norvegicus
ttgccaatgattggaatttcctctt

SEQ ID NO: 678315 - DNA, 25 bp, Rattus norvegicus
ttgccaatggccaactgggtgatca

SEQ ID NO: 678316 - DNA, 25 bp, Rattus norvegicus
ttgccaatggcctactgggtgatca

SEQ ID NO: 678317 - DNA, 25 bp, Rattus norvegicus
ttgccaatgggtattccccacaaga

SEQ ID NO: 678318 - DNA, 25 bp, Rattus norvegicus
ttgccaatgggttttccccacaaga

SEQ ID NO: 678319 - DNA, 25 bp, Rattus norvegicus
ttgccaatgtgaagacagacggact

SEQ ID NO: 678320 - DNA, 25 bp, Rattus norvegicus
ttgccaatgtgatgacagacggact

SEQ ID NO: 678321 - DNA, 25 bp, Rattus norvegicus
ttgccaattctaagagccccattaa

SEQ ID NO: 678322 - DNA, 25 bp, Rattus norvegicus
ttgccaattctatgagccccattaa

SEQ ID NO: 678323 - DNA, 25 bp, Rattus norvegicus
ttgccaatttctcgactgtatgcca

SEQ ID NO: 678324 - DNA, 25 bp, Rattus norvegicus
ttgccaatttctggactgtatgcca

SEQ ID NO: 678325 - DNA, 25 bp, Rattus norvegicus
ttgccaattttgcttccctaggaat

SEQ ID NO: 678326 - DNA, 25 bp, Rattus norvegicus
ttgccaattttggttccctaggaat

SEQ ID NO: 678327 - DNA, 25 bp, Rattus norvegicus
ttgccacaccagctgggatgagtcc

SEQ ID NO: 678328 - DNA, 25 bp, Rattus norvegicus
ttgccacaccaggtgggatgagtcc

SEQ ID NO: 678329 - DNA, 25 bp, Rattus norvegicus
ttgccacaccgaccagcaatgggta

SEQ ID NO: 678330 - DNA, 25 bp, Rattus norvegicus
ttgccacaccgagcagcaatgggta

SEQ ID NO: 678331 - DNA, 25 bp, Rattus norvegicus
ttgccacacgcaaaactgttcattt

SEQ ID NO: 678332 - DNA, 25 bp, Rattus norvegicus
ttgccacacgcataactgttcattt

SEQ ID NO: 678333 - DNA, 25 bp, Rattus norvegicus
ttgccacactatccgcagactgaat

SEQ ID NO: 678334 - DNA, 25 bp, Rattus norvegicus
ttgccacactatgcgcagactgaat

SEQ ID NO: 678335 - DNA, 25 bp, Rattus norvegicus
ttgccacagcgcaggagtacgtcta

SEQ ID NO: 678336 - DNA, 25 bp, Rattus norvegicus
ttgccacagcgctggagtacgtcta

SEQ ID NO: 678337 - DNA, 25 bp, Rattus norvegicus
ttgccacaggcactaggtctagcgt

SEQ ID NO: 678338 - DNA, 25 bp, Rattus norvegicus
ttgccacaggcagtaggtctagcgt

SEQ ID NO: 678339 - DNA, 25 bp, Rattus norvegicus
ttgccacagtcccttgtttcaaaag

SEQ ID NO: 678340 - DNA, 25 bp, Rattus norvegicus
ttgccacagtccgttgtttcaaaag

SEQ ID NO: 678341 - DNA, 25 bp, Rattus norvegicus
ttgccacagtttatgcactcacgtg

SEQ ID NO: 678342 - DNA, 25 bp, Rattus norvegicus
ttgccacagtttttgcactcacgtg

SEQ ID NO: 678343 - DNA, 25 bp, Rattus norvegicus
ttgccacataggagttaagtctgct

SEQ ID NO: 678344 - DNA, 25 bp, Rattus norvegicus
ttgccacataggtgttaagtctgct

SEQ ID NO: 678345 - DNA, 25 bp, Rattus norvegicus
ttgccacatggcatcacttatttgt

SEQ ID NO: 678346 - DNA, 25 bp, Rattus norvegicus
ttgccacatggcttcacttatttgt

SEQ ID NO: 678347 - DNA, 25 bp, Rattus norvegicus
ttgccacatgttctgctgcgtattt

SEQ ID NO: 678348 - DNA, 25 bp, Rattus norvegicus
ttgccacatgttgtgctgcgtattt

SEQ ID NO: 678349 - DNA, 25 bp, Rattus norvegicus
ttgccacattccaggagtacctata

SEQ ID NO: 678350 - DNA, 25 bp, Rattus norvegicus
ttgccacattcctggagtacctata

SEQ ID NO: 678351 - DNA, 25 bp, Rattus norvegicus
ttgccaccaagcacgatgaactctt

SEQ ID NO: 678352 - DNA, 25 bp, Rattus norvegicus
ttgccaccaagctcgatgaactctt

SEQ ID NO: 678353 - DNA, 25 bp, Rattus norvegicus
ttgccaccaagtctcctttattgcc

SEQ ID NO: 678354 - DNA, 25 bp, Rattus norvegicus
ttgccaccaagtgtcctttattgcc

SEQ ID NO: 678355 - DNA, 25 bp, Rattus norvegicus
ttgccaccagagacttcatcaactg

SEQ ID NO: 678356 - DNA, 25 bp, Rattus norvegicus
ttgccaccagagctgtgacttcagt

SEQ ID NO: 678357 - DNA, 25 bp, Rattus norvegicus
ttgccaccagaggtgtgacttcagt

SEQ ID NO: 678358 - DNA, 25 bp, Rattus norvegicus
ttgccaccagagtcttcatcaactg

SEQ ID NO: 678359 - DNA, 25 bp, Rattus norvegicus
ttgccaccaggcagcattgtctgaa

SEQ ID NO: 678360 - DNA, 25 bp, Rattus norvegicus
ttgccaccaggctgcattgtctgaa

SEQ ID NO: 678361 - DNA, 25 bp, Rattus norvegicus
ttgccaccattgatgctcccaaaag

SEQ ID NO: 678362 - DNA, 25 bp, Rattus norvegicus
ttgccaccattgttgctcccaaaag

SEQ ID NO: 678363 - DNA, 25 bp, Rattus norvegicus
ttgccaccgtgccaactgcagttgc

SEQ ID NO: 678364 - DNA, 25 bp, Rattus norvegicus
ttgccaccgtgcgaactgcagttgc

SEQ ID NO: 678365 - DNA, 25 bp, Rattus norvegicus
ttgccacctttaaggtttgagctta

SEQ ID NO: 678366 - DNA, 25 bp, Rattus norvegicus
ttgccacctttatggtttgagctta

SEQ ID NO: 678367 - DNA, 25 bp, Rattus norvegicus
ttgccacctttgagcccttaaagtg

SEQ ID NO: 678368 - DNA, 25 bp, Rattus norvegicus
ttgccacctttgtgcccttaaagtg

SEQ ID NO: 678369 - DNA, 25 bp, Rattus norvegicus
ttgccacggtccactatattgtgaa

SEQ ID NO: 678370 - DNA, 25 bp, Rattus norvegicus
ttgccacggtcctctatattgtgaa

SEQ ID NO: 678371 - DNA, 25 bp, Rattus norvegicus
ttgccactactgataatacctaaag

SEQ ID NO: 678372 - DNA, 25 bp, Rattus norvegicus
ttgccactactgttaatacctaaag

SEQ ID NO: 678373 - DNA, 25 bp, Rattus norvegicus
ttgccactatgaccaaacgcacagt

SEQ ID NO: 678374 - DNA, 25 bp, Rattus norvegicus
ttgccactatgagcaaacgcacagt

SEQ ID NO: 678375 - DNA, 25 bp, Rattus norvegicus
ttgccactccctaaagacttacaaa

SEQ ID NO: 678376 - DNA, 25 bp, Rattus norvegicus
ttgccactcccttaagacttacaaa

SEQ ID NO: 678377 - DNA, 25 bp, Rattus norvegicus
ttgccactgaacctgtatctgaatg

SEQ ID NO: 678378 - DNA, 25 bp, Rattus norvegicus
ttgccactgaacgtgtatctgaatg

SEQ ID NO: 678379 - DNA, 25 bp, Rattus norvegicus
ttgccactgagaagcaggaacccat

SEQ ID NO: 678380 - DNA, 25 bp, Rattus norvegicus
ttgccactgagatgcaggaacccat

SEQ ID NO: 678381 - DNA, 25 bp, Rattus norvegicus
ttgccactgctaagaatgaatgtac

SEQ ID NO: 678382 - DNA, 25 bp, Rattus norvegicus
ttgccactgctatgaatgaatgtac

SEQ ID NO: 678383 - DNA, 25 bp, Rattus norvegicus
ttgccactgctcagctcttaggttt

SEQ ID NO: 678384 - DNA, 25 bp, Rattus norvegicus
ttgccactgctctgctcttaggttt

SEQ ID NO: 678385 - DNA, 25 bp, Rattus norvegicus
ttgccacttagaacaggaactctgt

SEQ ID NO: 678386 - DNA, 25 bp, Rattus norvegicus
ttgccacttagatcaggaactctgt

SEQ ID NO: 678387 - DNA, 25 bp, Rattus norvegicus
ttgccacttagtactcatttctttg

SEQ ID NO: 678388 - DNA, 25 bp, Rattus norvegicus
ttgccacttagttctcatttctttg

SEQ ID NO: 678389 - DNA, 25 bp, Rattus norvegicus
ttgccagacgacagcactgtgagtg

SEQ ID NO: 678390 - DNA, 25 bp, Rattus norvegicus
ttgccagacgactgcactgtgagtg

SEQ ID NO: 678391 - DNA, 25 bp, Rattus norvegicus
ttgccagagactctcggaggtccga

SEQ ID NO: 678392 - DNA, 25 bp, Rattus norvegicus
ttgccagagactgtcggaggtccga

SEQ ID NO: 678393 - DNA, 25 bp, Rattus norvegicus
ttgccagagttcctcgctgttatct

SEQ ID NO: 678394 - DNA, 25 bp, Rattus norvegicus
ttgccagagttcgtcgctgttatct

SEQ ID NO: 678395 - DNA, 25 bp, Rattus norvegicus
ttgccagcaacgcatctcgtttttt

SEQ ID NO: 678396 - DNA, 25 bp, Rattus norvegicus
ttgccagcaacggatctcgtttttt

SEQ ID NO: 678397 - DNA, 25 bp, Rattus norvegicus
ttgccagcaagtatccaaggtcgat

SEQ ID NO: 678398 - DNA, 25 bp, Rattus norvegicus
ttgccagcaagtttccaaggtcgat

SEQ ID NO: 678399 - DNA, 25 bp, Rattus norvegicus
ttgccagcaccaagccaagtgacat

SEQ ID NO: 678400 - DNA, 25 bp, Rattus norvegicus
ttgccagcaccatgccaagtgacat

SEQ ID NO: 678401 - DNA, 25 bp, Rattus norvegicus
ttgccagcacggctgctaacagact

SEQ ID NO: 678402 - DNA, 25 bp, Rattus norvegicus
ttgccagcacgggtgctaacagact

SEQ ID NO: 678403 - DNA, 25 bp, Rattus norvegicus
ttgccagcagctctcacagtcagaa

SEQ ID NO: 678404 - DNA, 25 bp, Rattus norvegicus
ttgccagcagctgtcacagtcagaa

SEQ ID NO: 678405 - DNA, 25 bp, Rattus norvegicus
ttgccagcatccatgcacaactaga

SEQ ID NO: 678406 - DNA, 25 bp, Rattus norvegicus
ttgccagcatccttgcacaactaga

SEQ ID NO: 678407 - DNA, 25 bp, Rattus norvegicus
ttgccagcccaccttgatcatgttt

SEQ ID NO: 678408 - DNA, 25 bp, Rattus norvegicus
ttgccagcccacgttgatcatgttt

SEQ ID NO: 678409 - DNA, 25 bp, Rattus norvegicus
ttgccagccctacagtgaggtgtta

SEQ ID NO: 678410 - DNA, 25 bp, Rattus norvegicus
ttgccagccctagagtgaggtgtta

SEQ ID NO: 678411 - DNA, 25 bp, Rattus norvegicus
ttgccagccggtcagcctgaggttt

SEQ ID NO: 678412 - DNA, 25 bp, Rattus norvegicus
ttgccagccggtgagcctgaggttt

SEQ ID NO: 678413 - DNA, 25 bp, Rattus norvegicus
ttgccagcctctacaaaaacctggg

SEQ ID NO: 678414 - DNA, 25 bp, Rattus norvegicus
ttgccagcctcttcaaaaacctggg

SEQ ID NO: 678415 - DNA, 25 bp, Rattus norvegicus
ttgccagcctgcacagaccatgaag

SEQ ID NO: 678416 - DNA, 25 bp, Rattus norvegicus
ttgccagcctgctcagaccatgaag

SEQ ID NO: 678417 - DNA, 25 bp, Rattus norvegicus
ttgccagcctgtctgcttgtgagaa

SEQ ID NO: 678418 - DNA, 25 bp, Rattus norvegicus
ttgccagcctgtgtgcttgtgagaa

SEQ ID NO: 678419 - DNA, 25 bp, Rattus norvegicus
ttgccagctaaacgccgtttacact

SEQ ID NO: 678420 - DNA, 25 bp, Rattus norvegicus
ttgccagctaaaggccgtttacact

SEQ ID NO: 678421 - DNA, 25 bp, Rattus norvegicus
ttgccagctagaattgagggatgtc

SEQ ID NO: 678422 - DNA, 25 bp, Rattus norvegicus
ttgccagctagatttgagggatgtc

SEQ ID NO: 678423 - DNA, 25 bp, Rattus norvegicus
ttgccagcttcaatctcagtgaaaa

SEQ ID NO: 678424 - DNA, 25 bp, Rattus norvegicus
ttgccagcttcattctcagtgaaaa

SEQ ID NO: 678425 - DNA, 25 bp, Rattus norvegicus
ttgccagctttgagggcttctacac

SEQ ID NO: 678426 - DNA, 25 bp, Rattus norvegicus
ttgccagctttgtgggcttctacac

SEQ ID NO: 678427 - DNA, 25 bp, Rattus norvegicus
ttgccaggaacacggccagtgctgt

SEQ ID NO: 678428 - DNA, 25 bp, Rattus norvegicus
ttgccaggaacagggccagtgctgt

SEQ ID NO: 678429 - DNA, 25 bp, Rattus norvegicus
ttgccaggagttatgaagtcagtct

SEQ ID NO: 678430 - DNA, 25 bp, Rattus norvegicus
ttgccaggagttttgaagtcagtct

SEQ ID NO: 678431 - DNA, 25 bp, Rattus norvegicus
ttgccaggcatcatgattcctataa

SEQ ID NO: 678432 - DNA, 25 bp, Rattus norvegicus
ttgccaggcatcctcgctgtgcgtg

SEQ ID NO: 678433 - DNA, 25 bp, Rattus norvegicus
ttgccaggcatcgtcgctgtgcgtg

SEQ ID NO: 678434 - DNA, 25 bp, Rattus norvegicus
ttgccaggcatcttgattcctataa

SEQ ID NO: 678435 - DNA, 25 bp, Rattus norvegicus
ttgccaggcattcccgtagctgagt

SEQ ID NO: 678436 - DNA, 25 bp, Rattus norvegicus
ttgccaggcattgccgtagctgagt

SEQ ID NO: 678437 - DNA, 25 bp, Rattus norvegicus
ttgccaggccaaactgattttaccc

SEQ ID NO: 678438 - DNA, 25 bp, Rattus norvegicus
ttgccaggccaatctgattttaccc

SEQ ID NO: 678439 - DNA, 25 bp, Rattus norvegicus
ttgccaggcctgactcagtgattag

SEQ ID NO: 678440 - DNA, 25 bp, Rattus norvegicus
ttgccaggcctgtctcagtgattag

SEQ ID NO: 678441 - DNA, 25 bp, Rattus norvegicus
ttgccaggctctcactacacagaag

SEQ ID NO: 678442 - DNA, 25 bp, Rattus norvegicus
ttgccaggctctgactacacagaag

SEQ ID NO: 678443 - DNA, 25 bp, Rattus norvegicus
ttgccaggctttcgtctaagttggg

SEQ ID NO: 678444 - DNA, 25 bp, Rattus norvegicus
ttgccaggctttggtctaagttggg

SEQ ID NO: 678445 - DNA, 25 bp, Rattus norvegicus
ttgccagggacgattgcatgggcta

SEQ ID NO: 678446 - DNA, 25 bp, Rattus norvegicus
ttgccagggacgtttgcatgggcta

SEQ ID NO: 678447 - DNA, 25 bp, Rattus norvegicus
ttgccagggagaatctctgccttat

SEQ ID NO: 678448 - DNA, 25 bp, Rattus norvegicus
ttgccagggagattctctgccttat

SEQ ID NO: 678449 - DNA, 25 bp, Rattus norvegicus
ttgccaggtcgcaccagtgtggaat

SEQ ID NO: 678450 - DNA, 25 bp, Rattus norvegicus
ttgccaggtcgctccagtgtggaat

SEQ ID NO: 678451 - DNA, 25 bp, Rattus norvegicus
ttgccaggtgtgctccctttctatc

SEQ ID NO: 678452 - DNA, 25 bp, Rattus norvegicus
ttgccaggtgtggtccctttctatc

SEQ ID NO: 678453 - DNA, 25 bp, Rattus norvegicus
ttgccaggttctacacgaatcccaa

SEQ ID NO: 678454 - DNA, 25 bp, Rattus norvegicus
ttgccaggttcttcacgaatcccaa

SEQ ID NO: 678455 - DNA, 25 bp, Rattus norvegicus
ttgccagtaatgacacgtggtccat

SEQ ID NO: 678456 - DNA, 25 bp, Rattus norvegicus
ttgccagtaatgtcacgtggtccat

SEQ ID NO: 678457 - DNA, 25 bp, Rattus norvegicus
ttgccagtccacactctgcaatatt

SEQ ID NO: 678458 - DNA, 25 bp, Rattus norvegicus
ttgccagtccactctctgcaatatt

SEQ ID NO: 678459 - DNA, 25 bp, Rattus norvegicus
ttgccagtcgctcctgtggagtgaa

SEQ ID NO: 678460 - DNA, 25 bp, Rattus norvegicus
ttgccagtcgctgctgtggagtgaa

SEQ ID NO: 678461 - DNA, 25 bp, Rattus norvegicus
ttgccagtcttcatttaggatcagg

SEQ ID NO: 678462 - DNA, 25 bp, Rattus norvegicus
ttgccagtcttcttttaggatcagg

SEQ ID NO: 678463 - DNA, 25 bp, Rattus norvegicus
ttgccagtctttacacttgttctca

SEQ ID NO: 678464 - DNA, 25 bp, Rattus norvegicus
ttgccagtcttttcacttgttctca

SEQ ID NO: 678465 - DNA, 25 bp, Rattus norvegicus
ttgccagtgcctagtgggtatgttt

SEQ ID NO: 678466 - DNA, 25 bp, Rattus norvegicus
ttgccagtgccttgtgggtatgttt

SEQ ID NO: 678467 - DNA, 25 bp, Rattus norvegicus
ttgccagtgctcaaggacctgaaga

SEQ ID NO: 678468 - DNA, 25 bp, Rattus norvegicus
ttgccagtgctctaggacctgaaga

SEQ ID NO: 678469 - DNA, 25 bp, Rattus norvegicus
ttgccagtggtgcagccaatgctga

SEQ ID NO: 678470 - DNA, 25 bp, Rattus norvegicus
ttgccagtggtggagccaatgctga

SEQ ID NO: 678471 - DNA, 25 bp, Rattus norvegicus
ttgccagttaatcagcccttatagc

SEQ ID NO: 678472 - DNA, 25 bp, Rattus norvegicus
ttgccagttaatgagcccttatagc

SEQ ID NO: 678473 - DNA, 25 bp, Rattus norvegicus
ttgccagttcctacagcggctatca

SEQ ID NO: 678474 - DNA, 25 bp, Rattus norvegicus
ttgccagttccttcagcggctatca

SEQ ID NO: 678475 - DNA, 25 bp, Rattus norvegicus
ttgccataccttcctacaatgattg

SEQ ID NO: 678476 - DNA, 25 bp, Rattus norvegicus
ttgccataccttgctacaatgattg

SEQ ID NO: 678477 - DNA, 25 bp, Rattus norvegicus
ttgccatactgacgcctttatagaa

SEQ ID NO: 678478 - DNA, 25 bp, Rattus norvegicus
ttgccatactgaggcctttatagaa

SEQ ID NO: 678479 - DNA, 25 bp, Rattus norvegicus
ttgccatcaacaacttctcagcgga

SEQ ID NO: 678480 - DNA, 25 bp, Rattus norvegicus
ttgccatcaacatcttctcagcgga

SEQ ID NO: 678481 - DNA, 25 bp, Rattus norvegicus
ttgccatcaaggacgtcagcagcgt

SEQ ID NO: 678482 - DNA, 25 bp, Rattus norvegicus
ttgccatcaaggtcgtcagcagcgt

SEQ ID NO: 678483 - DNA, 25 bp, Rattus norvegicus
ttgccatcacagcatgcctgttgga

SEQ ID NO: 678484 - DNA, 25 bp, Rattus norvegicus
ttgccatcacaggatgcctgttgga

SEQ ID NO: 678485 - DNA, 25 bp, Rattus norvegicus
ttgccatcacgcatgctgggaatag

SEQ ID NO: 678486 - DNA, 25 bp, Rattus norvegicus
ttgccatcacgcttgctgggaatag

SEQ ID NO: 678487 - DNA, 25 bp, Rattus norvegicus
ttgccatccaagaagcaagccttca

SEQ ID NO: 678488 - DNA, 25 bp, Rattus norvegicus
ttgccatccaagtagcaagccttca

SEQ ID NO: 678489 - DNA, 25 bp, Rattus norvegicus
ttgccatcgcatacatgtatgacct

SEQ ID NO: 678490 - DNA, 25 bp, Rattus norvegicus
ttgccatcgcattcatgtatgacct

SEQ ID NO: 678491 - DNA, 25 bp, Rattus norvegicus
ttgccatcgcctcaagtctggtgga

SEQ ID NO: 678492 - DNA, 25 bp, Rattus norvegicus
ttgccatcgcctgaagtctggtgga

SEQ ID NO: 678493 - DNA, 25 bp, Rattus norvegicus
ttgccatcggtaagccactacgtgg

SEQ ID NO: 678494 - DNA, 25 bp, Rattus norvegicus
ttgccatcggtatgccactacgtgg

SEQ ID NO: 678495 - DNA, 25 bp, Rattus norvegicus
ttgccatctatcacaggcagtgaga

SEQ ID NO: 678496 - DNA, 25 bp, Rattus norvegicus
ttgccatctatctcaggcagtgaga

SEQ ID NO: 678497 - DNA, 25 bp, Rattus norvegicus
ttgccatctcccaacggttattgag

SEQ ID NO: 678498 - DNA, 25 bp, Rattus norvegicus
ttgccatctccctacggttattgag

SEQ ID NO: 678499 - DNA, 25 bp, Rattus norvegicus
ttgccatctgcactattgaagggaa

SEQ ID NO: 678500 - DNA, 25 bp, Rattus norvegicus
ttgccatctgcagtattgaagggaa

SEQ ID NO: 678501 - DNA, 25 bp, Rattus norvegicus
ttgccatctgctcaggctcaactgt

SEQ ID NO: 678502 - DNA, 25 bp, Rattus norvegicus
ttgccatctgctgaggctcaactgt

SEQ ID NO: 678503 - DNA, 25 bp, Rattus norvegicus
ttgccatctggtactgttgcctgag

SEQ ID NO: 678504 - DNA, 25 bp, Rattus norvegicus
ttgccatctggttctgttgcctgag

SEQ ID NO: 678505 - DNA, 25 bp, Rattus norvegicus
ttgccatgagaccaagtttgccaag

SEQ ID NO: 678506 - DNA, 25 bp, Rattus norvegicus
ttgccatgagacgaagtttgccaag

SEQ ID NO: 678507 - DNA, 25 bp, Rattus norvegicus
ttgccatgatgcctgcctcattaaa

SEQ ID NO: 678508 - DNA, 25 bp, Rattus norvegicus
ttgccatgatgcgtgcctcattaaa

SEQ ID NO: 678509 - DNA, 25 bp, Rattus norvegicus
ttgccatgctgcactttgaacagga

SEQ ID NO: 678510 - DNA, 25 bp, Rattus norvegicus
ttgccatgctgctctttgaacagga

SEQ ID NO: 678511 - DNA, 25 bp, Rattus norvegicus
ttgccatggcaacagagcatcagga

SEQ ID NO: 678512 - DNA, 25 bp, Rattus norvegicus
ttgccatggcaagagagcatcagga

SEQ ID NO: 678513 - DNA, 25 bp, Rattus norvegicus
ttgccatggcagcaaagatccctcc

SEQ ID NO: 678514 - DNA, 25 bp, Rattus norvegicus
ttgccatggcaggaaagatccctcc

SEQ ID NO: 678515 - DNA, 25 bp, Rattus norvegicus
ttgccatggccactgtagacactac

SEQ ID NO: 678516 - DNA, 25 bp, Rattus norvegicus
ttgccatggccagtgtagacactac

SEQ ID NO: 678517 - DNA, 25 bp, Rattus norvegicus
ttgccatgggccacctccaggagag

SEQ ID NO: 678518 - DNA, 25 bp, Rattus norvegicus
ttgccatgggcctcctccaggagag

SEQ ID NO: 678519 - DNA, 25 bp, Rattus norvegicus
ttgccatgggctagtgactcacagg

SEQ ID NO: 678520 - DNA, 25 bp, Rattus norvegicus
ttgccatgggcttgtgactcacagg

SEQ ID NO: 678521 - DNA, 25 bp, Rattus norvegicus
ttgccatggtggaacatgcagtcac

SEQ ID NO: 678522 - DNA, 25 bp, Rattus norvegicus
ttgccatggtggtacatgcagtcac

SEQ ID NO: 678523 - DNA, 25 bp, Rattus norvegicus
ttgccatgtccgaagcccctttggc

SEQ ID NO: 678524 - DNA, 25 bp, Rattus norvegicus
ttgccatgtccgtagcccctttggc

SEQ ID NO: 678525 - DNA, 25 bp, Rattus norvegicus
ttgccatgtcttcatcaccagcaaa

SEQ ID NO: 678526 - DNA, 25 bp, Rattus norvegicus
ttgccatgtcttgatcaccagcaaa

SEQ ID NO: 678527 - DNA, 25 bp, Rattus norvegicus
ttgccatgtggaagccgggaataga

SEQ ID NO: 678528 - DNA, 25 bp, Rattus norvegicus
ttgccatgtggatgccgggaataga

SEQ ID NO: 678529 - DNA, 25 bp, Rattus norvegicus
ttgccatgtggcagcttgttcatgc

SEQ ID NO: 678530 - DNA, 25 bp, Rattus norvegicus
ttgccatgtggctgcttgttcatgc

SEQ ID NO: 678531 - DNA, 25 bp, Rattus norvegicus
ttgccattccaaaacctgggttgtt

SEQ ID NO: 678532 - DNA, 25 bp, Rattus norvegicus
ttgccattccaatacctgggttgtt

SEQ ID NO: 678533 - DNA, 25 bp, Rattus norvegicus
ttgccattcctccttaactacagtt

SEQ ID NO: 678534 - DNA, 25 bp, Rattus norvegicus
ttgccattcctcgttaactacagtt

SEQ ID NO: 678535 - DNA, 25 bp, Rattus norvegicus
ttgccattcttcacctcatatatta

SEQ ID NO: 678536 - DNA, 25 bp, Rattus norvegicus
ttgccattcttctcctcatatatta

SEQ ID NO: 678537 - DNA, 25 bp, Rattus norvegicus
ttgccattgaaaatgctcggaaccg

SEQ ID NO: 678538 - DNA, 25 bp, Rattus norvegicus
ttgccattgaaattgctcggaaccg

SEQ ID NO: 678539 - DNA, 25 bp, Rattus norvegicus
ttgccattgaggctcccaggcggtc

SEQ ID NO: 678540 - DNA, 25 bp, Rattus norvegicus
ttgccattgagggtcccaggcggtc

SEQ ID NO: 678541 - DNA, 25 bp, Rattus norvegicus
ttgccatttaagcttggttccaatc

SEQ ID NO: 678542 - DNA, 25 bp, Rattus norvegicus
ttgccatttaaggttggttccaatc

SEQ ID NO: 678543 - DNA, 25 bp, Rattus norvegicus
ttgccatttcttcttctcaaatccg

SEQ ID NO: 678544 - DNA, 25 bp, Rattus norvegicus
ttgccatttcttgttctcaaatccg

SEQ ID NO: 678545 - DNA, 25 bp, Rattus norvegicus
ttgccattttgcacgactctagaaa

SEQ ID NO: 678546 - DNA, 25 bp, Rattus norvegicus
ttgccattttgctcgactctagaaa

SEQ ID NO: 678547 - DNA, 25 bp, Rattus norvegicus
ttgcccaaacctctgattcgagtac

SEQ ID NO: 678548 - DNA, 25 bp, Rattus norvegicus
ttgcccaaacctgtgattcgagtac

SEQ ID NO: 678549 - DNA, 25 bp, Rattus norvegicus
ttgcccaaactcactgggtctgaga

SEQ ID NO: 678550 - DNA, 25 bp, Rattus norvegicus
ttgcccaaactctctgggtctgaga

SEQ ID NO: 678551 - DNA, 25 bp, Rattus norvegicus
ttgcccaaagtgagacatttacaaa

SEQ ID NO: 678552 - DNA, 25 bp, Rattus norvegicus
ttgcccaaagtgtgacatttacaaa

SEQ ID NO: 678553 - DNA, 25 bp, Rattus norvegicus
ttgcccaacaatattctttacatag

SEQ ID NO: 678554 - DNA, 25 bp, Rattus norvegicus
ttgcccaacaattttctttacatag

SEQ ID NO: 678555 - DNA, 25 bp, Rattus norvegicus
ttgcccaactgacagagaacgtgta

SEQ ID NO: 678556 - DNA, 25 bp, Rattus norvegicus
ttgcccaactgagagagaacgtgta

SEQ ID NO: 678557 - DNA, 25 bp, Rattus norvegicus
ttgcccaagggcaggaaaccatgcc

SEQ ID NO: 678558 - DNA, 25 bp, Rattus norvegicus
ttgcccaagggctggaaaccatgcc

SEQ ID NO: 678559 - DNA, 25 bp, Rattus norvegicus
ttgcccaatcatcctcccttgaaga

SEQ ID NO: 678560 - DNA, 25 bp, Rattus norvegicus
ttgcccaatcatgctcccttgaaga

SEQ ID NO: 678561 - DNA, 25 bp, Rattus norvegicus
ttgcccaatggacagagtgtgttca

SEQ ID NO: 678562 - DNA, 25 bp, Rattus norvegicus
ttgcccaatggagagagtgtgttca

SEQ ID NO: 678563 - DNA, 25 bp, Rattus norvegicus
ttgcccaatgtcattctgtaaatga

SEQ ID NO: 678564 - DNA, 25 bp, Rattus norvegicus
ttgcccaatgtctttctgtaaatga

SEQ ID NO: 678565 - DNA, 25 bp, Rattus norvegicus
ttgcccacacttcgttaggtttctt

SEQ ID NO: 678566 - DNA, 25 bp, Rattus norvegicus
ttgcccacacttggttaggtttctt

SEQ ID NO: 678567 - DNA, 25 bp, Rattus norvegicus
ttgcccacagacacccctgagtgag

SEQ ID NO: 678568 - DNA, 25 bp, Rattus norvegicus
ttgcccacagactcccctgagtgag

SEQ ID NO: 678569 - DNA, 25 bp, Rattus norvegicus
ttgcccacagccaactgtttcagat

SEQ ID NO: 678570 - DNA, 25 bp, Rattus norvegicus
ttgcccacagccagtttgcgaggtg

SEQ ID NO: 678571 - DNA, 25 bp, Rattus norvegicus
ttgcccacagcctactgtttcagat

SEQ ID NO: 678572 - DNA, 25 bp, Rattus norvegicus
ttgcccacagcctgtttgcgaggtg

SEQ ID NO: 678573 - DNA, 25 bp, Rattus norvegicus
ttgcccacagtcatacagctgagtt

SEQ ID NO: 678574 - DNA, 25 bp, Rattus norvegicus
ttgcccacagtcttacagctgagtt

SEQ ID NO: 678575 - DNA, 25 bp, Rattus norvegicus
ttgcccacagttattggtttcagtt

SEQ ID NO: 678576 - DNA, 25 bp, Rattus norvegicus
ttgcccacagtttttggtttcagtt

SEQ ID NO: 678577 - DNA, 25 bp, Rattus norvegicus
ttgcccacatctccaggtacaaatt

SEQ ID NO: 678578 - DNA, 25 bp, Rattus norvegicus
ttgcccacatctgcaggtacaaatt

SEQ ID NO: 678579 - DNA, 25 bp, Rattus norvegicus
ttgcccacattaacatgcctgtcaa

SEQ ID NO: 678580 - DNA, 25 bp, Rattus norvegicus
ttgcccacattatcatgcctgtcaa

SEQ ID NO: 678581 - DNA, 25 bp, Rattus norvegicus
ttgcccaccgttaagatccagggtt

SEQ ID NO: 678582 - DNA, 25 bp, Rattus norvegicus
ttgcccaccgtttagatccagggtt

SEQ ID NO: 678583 - DNA, 25 bp, Rattus norvegicus
ttgcccacctagagtcacatgatac

SEQ ID NO: 678584 - DNA, 25 bp, Rattus norvegicus
ttgcccacctagtgtcacatgatac

SEQ ID NO: 678585 - DNA, 25 bp, Rattus norvegicus
ttgcccacctatagtcgcatgatag

SEQ ID NO: 678586 - DNA, 25 bp, Rattus norvegicus
ttgcccacctattgtcgcatgatag

SEQ ID NO: 678587 - DNA, 25 bp, Rattus norvegicus
ttgcccacctctcatgagcagaaga

SEQ ID NO: 678588 - DNA, 25 bp, Rattus norvegicus
ttgcccacctctgatgagcagaaga

SEQ ID NO: 678589 - DNA, 25 bp, Rattus norvegicus
ttgcccacgcatccgtgtgttcaca

SEQ ID NO: 678590 - DNA, 25 bp, Rattus norvegicus
ttgcccacgcatgcgtgtgttcaca

SEQ ID NO: 678591 - DNA, 25 bp, Rattus norvegicus
ttgcccactgctcagtagctaggta

SEQ ID NO: 678592 - DNA, 25 bp, Rattus norvegicus
ttgcccactgctgagtagctaggta

SEQ ID NO: 678593 - DNA, 25 bp, Rattus norvegicus
ttgcccagcatgaataaggtctcga

SEQ ID NO: 678594 - DNA, 25 bp, Rattus norvegicus
ttgcccagcatgctggtcgtctatg

SEQ ID NO: 678595 - DNA, 25 bp, Rattus norvegicus
ttgcccagcatggtggtcgtctatg

SEQ ID NO: 678596 - DNA, 25 bp, Rattus norvegicus
ttgcccagcatgtataaggtctcga

SEQ ID NO: 678597 - DNA, 25 bp, Rattus norvegicus
ttgcccagccccatatggaaaaaat

SEQ ID NO: 678598 - DNA, 25 bp, Rattus norvegicus
ttgcccagccccttatggaaaaaat

SEQ ID NO: 678599 - DNA, 25 bp, Rattus norvegicus
ttgcccagctgcctttgacaggaag

SEQ ID NO: 678600 - DNA, 25 bp, Rattus norvegicus
ttgcccagctgcgtttgacaggaag

SEQ ID NO: 678601 - DNA, 25 bp, Rattus norvegicus
ttgcccaggcaaatctgtatcttcc

SEQ ID NO: 678602 - DNA, 25 bp, Rattus norvegicus
ttgcccaggcaattctgtatcttcc

SEQ ID NO: 678603 - DNA, 25 bp, Rattus norvegicus
ttgcccaggctcagtgttgactgcc

SEQ ID NO: 678604 - DNA, 25 bp, Rattus norvegicus
ttgcccaggctctgtgttgactgcc

SEQ ID NO: 678605 - DNA, 25 bp, Rattus norvegicus
ttgcccagggcgcttgtgtgtctaa

SEQ ID NO: 678606 - DNA, 25 bp, Rattus norvegicus
ttgcccagggcggttgtgtgtctaa

SEQ ID NO: 678607 - DNA, 25 bp, Rattus norvegicus
ttgcccagggtactgacctgctaac

SEQ ID NO: 678608 - DNA, 25 bp, Rattus norvegicus
ttgcccagggtagtgacctgctaac

SEQ ID NO: 678609 - DNA, 25 bp, Rattus norvegicus
ttgcccagggtcctgagatcagttt

SEQ ID NO: 678610 - DNA, 25 bp, Rattus norvegicus
ttgcccagggtcgtgagatcagttt

SEQ ID NO: 678611 - DNA, 25 bp, Rattus norvegicus
ttgcccagtttcacttcaatacttt

SEQ ID NO: 678612 - DNA, 25 bp, Rattus norvegicus
ttgcccagtttctcttcaatacttt

SEQ ID NO: 678613 - DNA, 25 bp, Rattus norvegicus
ttgcccatacagaggtcaagctgat

SEQ ID NO: 678614 - DNA, 25 bp, Rattus norvegicus
ttgcccatacagtggtcaagctgat

SEQ ID NO: 678615 - DNA, 25 bp, Rattus norvegicus
ttgcccatctaactacaagtcccag

SEQ ID NO: 678616 - DNA, 25 bp, Rattus norvegicus
ttgcccatctaagtacaagtcccag

SEQ ID NO: 678617 - DNA, 25 bp, Rattus norvegicus
ttgcccatctcccagaatgctttaa

SEQ ID NO: 678618 - DNA, 25 bp, Rattus norvegicus
ttgcccatctccgagaatgctttaa

SEQ ID NO: 678619 - DNA, 25 bp, Rattus norvegicus
ttgcccatcttcacccagaggatgg

SEQ ID NO: 678620 - DNA, 25 bp, Rattus norvegicus
ttgcccatcttctcccagaggatgg

SEQ ID NO: 678621 - DNA, 25 bp, Rattus norvegicus
ttgcccatgagcatcacccagaaga

SEQ ID NO: 678622 - DNA, 25 bp, Rattus norvegicus
ttgcccatgagcttcacccagaaga

SEQ ID NO: 678623 - DNA, 25 bp, Rattus norvegicus
ttgcccatggcaaggtcagtgtgga

SEQ ID NO: 678624 - DNA, 25 bp, Rattus norvegicus
ttgcccatggcatggtcagtgtgga

SEQ ID NO: 678625 - DNA, 25 bp, Rattus norvegicus
ttgcccatggctatggtaggtgtct

SEQ ID NO: 678626 - DNA, 25 bp, Rattus norvegicus
ttgcccatggctttggtaggtgtct

SEQ ID NO: 678627 - DNA, 25 bp, Rattus norvegicus
ttgcccatggtacaggtggaccaca

SEQ ID NO: 678628 - DNA, 25 bp, Rattus norvegicus
ttgcccatggtagaggtggaccaca

SEQ ID NO: 678629 - DNA, 25 bp, Rattus norvegicus
ttgcccatggttatgtttccaagct

SEQ ID NO: 678630 - DNA, 25 bp, Rattus norvegicus
ttgcccatggttttgtttccaagct

SEQ ID NO: 678631 - DNA, 25 bp, Rattus norvegicus
ttgcccatgttcaacgtgcgtacag

SEQ ID NO: 678632 - DNA, 25 bp, Rattus norvegicus
ttgcccatgttctacgtgcgtacag

SEQ ID NO: 678633 - DNA, 25 bp, Rattus norvegicus
ttgccccaaattagcctggcccatt

SEQ ID NO: 678634 - DNA, 25 bp, Rattus norvegicus
ttgccccaaatttgcctggcccatt

SEQ ID NO: 678635 - DNA, 25 bp, Rattus norvegicus
ttgccccaagacagatcacctgagt

SEQ ID NO: 678636 - DNA, 25 bp, Rattus norvegicus
ttgccccaagactgatcacctgagt

SEQ ID NO: 678637 - DNA, 25 bp, Rattus norvegicus
ttgccccaaggaattcaacaaccct

SEQ ID NO: 678638 - DNA, 25 bp, Rattus norvegicus
ttgccccaaggatttcaacaaccct

SEQ ID NO: 678639 - DNA, 25 bp, Rattus norvegicus
ttgccccaagtcagcctttcaaaat

SEQ ID NO: 678640 - DNA, 25 bp, Rattus norvegicus
ttgccccaagtctgcctttcaaaat

SEQ ID NO: 678641 - DNA, 25 bp, Rattus norvegicus
ttgccccaagtgattttctggatca

SEQ ID NO: 678642 - DNA, 25 bp, Rattus norvegicus
ttgccccaagtgtttttctggatca

SEQ ID NO: 678643 - DNA, 25 bp, Rattus norvegicus
ttgccccaatggaacgctgtttgaa

SEQ ID NO: 678644 - DNA, 25 bp, Rattus norvegicus
ttgccccaatggtacgctgtttgaa

SEQ ID NO: 678645 - DNA, 25 bp, Rattus norvegicus
ttgccccacagaaggctttcatttt

SEQ ID NO: 678646 - DNA, 25 bp, Rattus norvegicus
ttgccccacagatggctttcatttt

SEQ ID NO: 678647 - DNA, 25 bp, Rattus norvegicus
ttgccccacagcagagtcgggtaag

SEQ ID NO: 678648 - DNA, 25 bp, Rattus norvegicus
ttgccccacagctgagtcgggtaag

SEQ ID NO: 678649 - DNA, 25 bp, Rattus norvegicus
ttgccccacatgctagaaatcacgt

SEQ ID NO: 678650 - DNA, 25 bp, Rattus norvegicus
ttgccccacatggtagaaatcacgt

SEQ ID NO: 678651 - DNA, 25 bp, Rattus norvegicus
ttgccccacctaatgatacagtatt

SEQ ID NO: 678652 - DNA, 25 bp, Rattus norvegicus
ttgccccacctattgatacagtatt

SEQ ID NO: 678653 - DNA, 25 bp, Rattus norvegicus
ttgccccaccttcaaattactttgt

SEQ ID NO: 678654 - DNA, 25 bp, Rattus norvegicus
ttgccccaccttgaaattactttgt

SEQ ID NO: 678655 - DNA, 25 bp, Rattus norvegicus
ttgccccagaagatcatcttccagt

SEQ ID NO: 678656 - DNA, 25 bp, Rattus norvegicus
ttgccccagaagttcatcttccagt

SEQ ID NO: 678657 - DNA, 25 bp, Rattus norvegicus
ttgccccagacactcctgtgagatg

SEQ ID NO: 678658 - DNA, 25 bp, Rattus norvegicus
ttgccccagacagtcctgtgagatg

SEQ ID NO: 678659 - DNA, 25 bp, Rattus norvegicus
ttgccccagtttcagagtcgaatca

SEQ ID NO: 678660 - DNA, 25 bp, Rattus norvegicus
ttgccccagtttgagagtcgaatca

SEQ ID NO: 678661 - DNA, 25 bp, Rattus norvegicus
ttgccccataggctgtgttctgaca

SEQ ID NO: 678662 - DNA, 25 bp, Rattus norvegicus
ttgccccatagggtgtgttctgaca

SEQ ID NO: 678663 - DNA, 25 bp, Rattus norvegicus
ttgccccatctacacagaaaggtat

SEQ ID NO: 678664 - DNA, 25 bp, Rattus norvegicus
ttgccccatctagacagaaaggtat

SEQ ID NO: 678665 - DNA, 25 bp, Rattus norvegicus
ttgccccgatttcagcttttaagac

SEQ ID NO: 678666 - DNA, 25 bp, Rattus norvegicus
ttgccccgatttgagcttttaagac

SEQ ID NO: 678667 - DNA, 25 bp, Rattus norvegicus
ttgccccgccgaccatggatacaaa

SEQ ID NO: 678668 - DNA, 25 bp, Rattus norvegicus
ttgccccgccgagcatggatacaaa

SEQ ID NO: 678669 - DNA, 25 bp, Rattus norvegicus
ttgccccggctgagctggaattaag

SEQ ID NO: 678670 - DNA, 25 bp, Rattus norvegicus
ttgccccggctgtgctggaattaag

SEQ ID NO: 678671 - DNA, 25 bp, Rattus norvegicus
ttgccccgggaaagtctgcagaatt

SEQ ID NO: 678672 - DNA, 25 bp, Rattus norvegicus
ttgccccgggaatgtctgcagaatt

SEQ ID NO: 678673 - DNA, 25 bp, Rattus norvegicus
ttgccccggtcactctgtgtggata

SEQ ID NO: 678674 - DNA, 25 bp, Rattus norvegicus
ttgccccggtcagtctgtgtggata

SEQ ID NO: 678675 - DNA, 25 bp, Rattus norvegicus
ttgccccgtctacgtttgtaccttg

SEQ ID NO: 678676 - DNA, 25 bp, Rattus norvegicus
ttgccccgtctaggtttgtaccttg

SEQ ID NO: 678677 - DNA, 25 bp, Rattus norvegicus
ttgccccgtctgaacaatcagaatt

SEQ ID NO: 678678 - DNA, 25 bp, Rattus norvegicus
ttgccccgtctgtacaatcagaatt

SEQ ID NO: 678679 - DNA, 25 bp, Rattus norvegicus
ttgccccgtgcgatcttcagaaagt

SEQ ID NO: 678680 - DNA, 25 bp, Rattus norvegicus
ttgccccgtgcgttcttcagaaagt

SEQ ID NO: 678681 - DNA, 25 bp, Rattus norvegicus
ttgcccctcacaatagtcatgattg

SEQ ID NO: 678682 - DNA, 25 bp, Rattus norvegicus
ttgcccctcacattagtcatgattg

SEQ ID NO: 678683 - DNA, 25 bp, Rattus norvegicus
ttgcccctcagtctttcctagcagt

SEQ ID NO: 678684 - DNA, 25 bp, Rattus norvegicus
ttgcccctcagtgtttcctagcagt

SEQ ID NO: 678685 - DNA, 25 bp, Rattus norvegicus
ttgcccctccgcaggaactgaggta

SEQ ID NO: 678686 - DNA, 25 bp, Rattus norvegicus
ttgcccctccgctggaactgaggta

SEQ ID NO: 678687 - DNA, 25 bp, Rattus norvegicus
ttgcccctgagtcctatatatttca

SEQ ID NO: 678688 - DNA, 25 bp, Rattus norvegicus
ttgcccctgagtgctatatatttca

SEQ ID NO: 678689 - DNA, 25 bp, Rattus norvegicus
ttgcccctgataattttactggata

SEQ ID NO: 678690 - DNA, 25 bp, Rattus norvegicus
ttgcccctgatatttttactggata

SEQ ID NO: 678691 - DNA, 25 bp, Rattus norvegicus
ttgcccctggtgatgtcaaagattc

SEQ ID NO: 678692 - DNA, 25 bp, Rattus norvegicus
ttgcccctggtgttgtcaaagattc

SEQ ID NO: 678693 - DNA, 25 bp, Rattus norvegicus
ttgcccctgtaacttacctgtgttt

SEQ ID NO: 678694 - DNA, 25 bp, Rattus norvegicus
ttgcccctgtaagttacctgtgttt

SEQ ID NO: 678695 - DNA, 25 bp, Rattus norvegicus
ttgcccctgtgcaggtcttaaagaa

SEQ ID NO: 678696 - DNA, 25 bp, Rattus norvegicus
ttgcccctgtgctggtcttaaagaa

SEQ ID NO: 678697 - DNA, 25 bp, Rattus norvegicus
ttgcccctgtttaggagctattaaa

SEQ ID NO: 678698 - DNA, 25 bp, Rattus norvegicus
ttgcccctgttttggagctattaaa

SEQ ID NO: 678699 - DNA, 25 bp, Rattus norvegicus
ttgccccttgtactttcaacactaa

SEQ ID NO: 678700 - DNA, 25 bp, Rattus norvegicus
ttgccccttgtagtttcaacactaa

SEQ ID NO: 678701 - DNA, 25 bp, Rattus norvegicus
ttgcccctttacaaagctactgatg

SEQ ID NO: 678702 - DNA, 25 bp, Rattus norvegicus
ttgcccctttactaagctactgatg

SEQ ID NO: 678703 - DNA, 25 bp, Rattus norvegicus
ttgcccgacagcattcagtactgag

SEQ ID NO: 678704 - DNA, 25 bp, Rattus norvegicus
ttgcccgacagctttcagtactgag

SEQ ID NO: 678705 - DNA, 25 bp, Rattus norvegicus
ttgcccgagtgtcttgttcaccaac

SEQ ID NO: 678706 - DNA, 25 bp, Rattus norvegicus
ttgcccgagtgtgttgttcaccaac

SEQ ID NO: 678707 - DNA, 25 bp, Rattus norvegicus
ttgcccgctcaaaacttgcttaagt

SEQ ID NO: 678708 - DNA, 25 bp, Rattus norvegicus
ttgcccgctcaatacttgcttaagt

SEQ ID NO: 678709 - DNA, 25 bp, Rattus norvegicus
ttgcccgctcataaactggttttct

SEQ ID NO: 678710 - DNA, 25 bp, Rattus norvegicus
ttgcccgctcattaactggttttct

SEQ ID NO: 678711 - DNA, 25 bp, Rattus norvegicus
ttgcccgctgtgctttggttgtatc

SEQ ID NO: 678712 - DNA, 25 bp, Rattus norvegicus
ttgcccgctgtggtttggttgtatc

SEQ ID NO: 678713 - DNA, 25 bp, Rattus norvegicus
ttgcccggcatcagtgcaggaatct

SEQ ID NO: 678714 - DNA, 25 bp, Rattus norvegicus
ttgcccggcatctgtgcaggaatct

SEQ ID NO: 678715 - DNA, 25 bp, Rattus norvegicus
ttgcccgggaacatgataggctccg

SEQ ID NO: 678716 - DNA, 25 bp, Rattus norvegicus
ttgcccgggaacttgataggctccg

SEQ ID NO: 678717 - DNA, 25 bp, Rattus norvegicus
ttgcccgggccaagtgcgtgaagaa

SEQ ID NO: 678718 - DNA, 25 bp, Rattus norvegicus
ttgcccgggccatgtgcgtgaagaa

SEQ ID NO: 678719 - DNA, 25 bp, Rattus norvegicus
ttgcccgggcggagaagatggcggc

SEQ ID NO: 678720 - DNA, 25 bp, Rattus norvegicus
ttgcccgggcggtgaagatggcggc

SEQ ID NO: 678721 - DNA, 25 bp, Rattus norvegicus
ttgcccgggtgtctttgtgctgaac

SEQ ID NO: 678722 - DNA, 25 bp, Rattus norvegicus
ttgcccgggtgtgtttgtgctgaac

SEQ ID NO: 678723 - DNA, 25 bp, Rattus norvegicus
ttgcccggtgtgaattttttacaat

SEQ ID NO: 678724 - DNA, 25 bp, Rattus norvegicus
ttgcccggtgtgtattttttacaat

SEQ ID NO: 678725 - DNA, 25 bp, Rattus norvegicus
ttgcccgtcccacattaataattta

SEQ ID NO: 678726 - DNA, 25 bp, Rattus norvegicus
ttgcccgtcccagattaataattta

SEQ ID NO: 678727 - DNA, 25 bp, Rattus norvegicus
ttgcccgtctcaacttggaagatct

SEQ ID NO: 678728 - DNA, 25 bp, Rattus norvegicus
ttgcccgtctcatcttggaagatct

SEQ ID NO: 678729 - DNA, 25 bp, Rattus norvegicus
ttgcccgtcttcaaactgagcagtt

SEQ ID NO: 678730 - DNA, 25 bp, Rattus norvegicus
ttgcccgtcttctaactgagcagtt

SEQ ID NO: 678731 - DNA, 25 bp, Rattus norvegicus
ttgcccgtgaaacttccgctgtgaa

SEQ ID NO: 678732 - DNA, 25 bp, Rattus norvegicus
ttgcccgtgaaagttccgctgtgaa

SEQ ID NO: 678733 - DNA, 25 bp, Rattus norvegicus
ttgcccgtgcggaagtagttgagca

SEQ ID NO: 678734 - DNA, 25 bp, Rattus norvegicus
ttgcccgtgcggtagtagttgagca

SEQ ID NO: 678735 - DNA, 25 bp, Rattus norvegicus
ttgcccgtgggcatggatccatact

SEQ ID NO: 678736 - DNA, 25 bp, Rattus norvegicus
ttgcccgtgggcttggatccatact

SEQ ID NO: 678737 - DNA, 25 bp, Rattus norvegicus
ttgcccgtggtgaaagctccatgac

SEQ ID NO: 678738 - DNA, 25 bp, Rattus norvegicus
ttgcccgtggtgtaagctccatgac

SEQ ID NO: 678739 - DNA, 25 bp, Rattus norvegicus
ttgcccgtgttaccgctgtagtaag

SEQ ID NO: 678740 - DNA, 25 bp, Rattus norvegicus
ttgcccgtgttagcgctgtagtaag

SEQ ID NO: 678741 - DNA, 25 bp, Rattus norvegicus
ttgcccgttgcgcagtatatactga

SEQ ID NO: 678742 - DNA, 25 bp, Rattus norvegicus
ttgcccgttgcggagtatatactga

SEQ ID NO: 678743 - DNA, 25 bp, Rattus norvegicus
ttgccctaacctaagcttactccat

SEQ ID NO: 678744 - DNA, 25 bp, Rattus norvegicus
ttgccctaaccttagcttactccat

SEQ ID NO: 678745 - DNA, 25 bp, Rattus norvegicus
ttgccctacattatacgtgcttgct

SEQ ID NO: 678746 - DNA, 25 bp, Rattus norvegicus
ttgccctacattttacgtgcttgct

SEQ ID NO: 678747 - DNA, 25 bp, Rattus norvegicus
ttgccctactgtaaccacgttatag

SEQ ID NO: 678748 - DNA, 25 bp, Rattus norvegicus
ttgccctactgttaccacgttatag

SEQ ID NO: 678749 - DNA, 25 bp, Rattus norvegicus
ttgccctactttatgttccagtgat

SEQ ID NO: 678750 - DNA, 25 bp, Rattus norvegicus
ttgccctactttttgttccagtgat

SEQ ID NO: 678751 - DNA, 25 bp, Rattus norvegicus
ttgccctatatgcacagtgaccatc

SEQ ID NO: 678752 - DNA, 25 bp, Rattus norvegicus
ttgccctatatggacagtgaccatc

SEQ ID NO: 678753 - DNA, 25 bp, Rattus norvegicus
ttgccctatctcctggtaggcgata

SEQ ID NO: 678754 - DNA, 25 bp, Rattus norvegicus
ttgccctatctcgtggtaggcgata

SEQ ID NO: 678755 - DNA, 25 bp, Rattus norvegicus
ttgccctatgctagctactttggag

SEQ ID NO: 678756 - DNA, 25 bp, Rattus norvegicus
ttgccctatgcttgctactttggag

SEQ ID NO: 678757 - DNA, 25 bp, Rattus norvegicus
ttgccctcagagagggagctctgct

SEQ ID NO: 678758 - DNA, 25 bp, Rattus norvegicus
ttgccctcagagagtctttaaatgc

SEQ ID NO: 678759 - DNA, 25 bp, Rattus norvegicus
ttgccctcagagtgggagctctgct

SEQ ID NO: 678760 - DNA, 25 bp, Rattus norvegicus
ttgccctcagagtgtctttaaatgc

SEQ ID NO: 678761 - DNA, 25 bp, Rattus norvegicus
ttgccctccatcaaagcatggtcag

SEQ ID NO: 678762 - DNA, 25 bp, Rattus norvegicus
ttgccctccatctaagcatggtcag

SEQ ID NO: 678763 - DNA, 25 bp, Rattus norvegicus
ttgccctcctgcactgtttaagaat

SEQ ID NO: 678764 - DNA, 25 bp, Rattus norvegicus
ttgccctcctgctctgtttaagaat

SEQ ID NO: 678765 - DNA, 25 bp, Rattus norvegicus
ttgccctcgcgtcttcagaaaacag

SEQ ID NO: 678766 - DNA, 25 bp, Rattus norvegicus
ttgccctcgcgtgttcagaaaacag

SEQ ID NO: 678767 - DNA, 25 bp, Rattus norvegicus
ttgccctcgttaccccagaaggtct

SEQ ID NO: 678768 - DNA, 25 bp, Rattus norvegicus
ttgccctcgttagcccagaaggtct

SEQ ID NO: 678769 - DNA, 25 bp, Rattus norvegicus
ttgccctctaaaacttgctgcagga

SEQ ID NO: 678770 - DNA, 25 bp, Rattus norvegicus
ttgccctctaaatcttgctgcagga

SEQ ID NO: 678771 - DNA, 25 bp, Rattus norvegicus
ttgccctctcctcatggaactttgg

SEQ ID NO: 678772 - DNA, 25 bp, Rattus norvegicus
ttgccctctcctgatggaactttgg

SEQ ID NO: 678773 - DNA, 25 bp, Rattus norvegicus
ttgccctctgacaggaacatgtgta

SEQ ID NO: 678774 - DNA, 25 bp, Rattus norvegicus
ttgccctctgactggaacatgtgta

SEQ ID NO: 678775 - DNA, 25 bp, Rattus norvegicus
ttgccctgacctacaggactgtgag

SEQ ID NO: 678776 - DNA, 25 bp, Rattus norvegicus
ttgccctgaccttcaggactgtgag

SEQ ID NO: 678777 - DNA, 25 bp, Rattus norvegicus
ttgccctgacggagacttgaagctt

SEQ ID NO: 678778 - DNA, 25 bp, Rattus norvegicus
ttgccctgacggtgacttgaagctt

SEQ ID NO: 678779 - DNA, 25 bp, Rattus norvegicus
ttgccctgactgatttggaacttgc

SEQ ID NO: 678780 - DNA, 25 bp, Rattus norvegicus
ttgccctgactgttttggaacttgc

SEQ ID NO: 678781 - DNA, 25 bp, Rattus norvegicus
ttgccctgagacatcagttttctat

SEQ ID NO: 678782 - DNA, 25 bp, Rattus norvegicus
ttgccctgagacttcagttttctat

SEQ ID NO: 678783 - DNA, 25 bp, Rattus norvegicus
ttgccctgcaccactgaggaacaaa

SEQ ID NO: 678784 - DNA, 25 bp, Rattus norvegicus
ttgccctgcacctctgaggaacaaa

SEQ ID NO: 678785 - DNA, 25 bp, Rattus norvegicus
ttgccctgcaggcatagggctccag

SEQ ID NO: 678786 - DNA, 25 bp, Rattus norvegicus
ttgccctgcagggatagggctccag

SEQ ID NO: 678787 - DNA, 25 bp, Rattus norvegicus
ttgccctgctatcactgttgcatta

SEQ ID NO: 678788 - DNA, 25 bp, Rattus norvegicus
ttgccctgctatgactgttgcatta

SEQ ID NO: 678789 - DNA, 25 bp, Rattus norvegicus
ttgccctgctgtatactggtgtata

SEQ ID NO: 678790 - DNA, 25 bp, Rattus norvegicus
ttgccctgctgtctacatggtcaga

SEQ ID NO: 678791 - DNA, 25 bp, Rattus norvegicus
ttgccctgctgtgtacatggtcaga

SEQ ID NO: 678792 - DNA, 25 bp, Rattus norvegicus
ttgccctgctgtttactggtgtata

SEQ ID NO: 678793 - DNA, 25 bp, Rattus norvegicus
ttgccctgggacactaagtgcgttg

SEQ ID NO: 678794 - DNA, 25 bp, Rattus norvegicus
ttgccctgggactctaagtgcgttg

SEQ ID NO: 678795 - DNA, 25 bp, Rattus norvegicus
ttgccctgggagcaggttgttttct

SEQ ID NO: 678796 - DNA, 25 bp, Rattus norvegicus
ttgccctgggaggaggttgttttct

SEQ ID NO: 678797 - DNA, 25 bp, Rattus norvegicus
ttgccctgggctcatgtgacttgaa

SEQ ID NO: 678798 - DNA, 25 bp, Rattus norvegicus
ttgccctgggctgatgtgacttgaa

SEQ ID NO: 678799 - DNA, 25 bp, Rattus norvegicus
ttgccctggtcaagctccaagagga

SEQ ID NO: 678800 - DNA, 25 bp, Rattus norvegicus
ttgccctggtcatgctccaagagga

SEQ ID NO: 678801 - DNA, 25 bp, Rattus norvegicus
ttgccctggtgtacccatgtcagaa

SEQ ID NO: 678802 - DNA, 25 bp, Rattus norvegicus
ttgccctggtgttcccatgtcagaa

SEQ ID NO: 678803 - DNA, 25 bp, Rattus norvegicus
ttgccctgtagtcctagcttagcag

SEQ ID NO: 678804 - DNA, 25 bp, Rattus norvegicus
ttgccctgtagtgctagcttagcag

SEQ ID NO: 678805 - DNA, 25 bp, Rattus norvegicus
ttgccctgtcgcacattaaattcga

SEQ ID NO: 678806 - DNA, 25 bp, Rattus norvegicus
ttgccctgtcgctcattaaattcga

SEQ ID NO: 678807 - DNA, 25 bp, Rattus norvegicus
ttgccctgtgtcactgtatcccgta

SEQ ID NO: 678808 - DNA, 25 bp, Rattus norvegicus
ttgccctgtgtctctgtatcccgta

SEQ ID NO: 678809 - DNA, 25 bp, Rattus norvegicus
ttgcccttactgagccaagctagga

SEQ ID NO: 678810 - DNA, 25 bp, Rattus norvegicus
ttgcccttactgtgccaagctagga

SEQ ID NO: 678811 - DNA, 25 bp, Rattus norvegicus
ttgcccttagagaagcctggttcac

SEQ ID NO: 678812 - DNA, 25 bp, Rattus norvegicus
ttgcccttagagtagcctggttcac

SEQ ID NO: 678813 - DNA, 25 bp, Rattus norvegicus
ttgcccttcaaactcaaaggctgtt

SEQ ID NO: 678814 - DNA, 25 bp, Rattus norvegicus
ttgcccttcaaagtcaaaggctgtt

SEQ ID NO: 678815 - DNA, 25 bp, Rattus norvegicus
ttgcccttcaagatctacttcagtt

SEQ ID NO: 678816 - DNA, 25 bp, Rattus norvegicus
ttgcccttcaagttctacttcagtt

SEQ ID NO: 678817 - DNA, 25 bp, Rattus norvegicus
ttgcccttcataaggctaaagtagt

SEQ ID NO: 678818 - DNA, 25 bp, Rattus norvegicus
ttgcccttcatatggctaaagtagt

SEQ ID NO: 678819 - DNA, 25 bp, Rattus norvegicus
ttgcccttcctacctctgaggtaga

SEQ ID NO: 678820 - DNA, 25 bp, Rattus norvegicus
ttgcccttcctagctctgaggtaga

SEQ ID NO: 678821 - DNA, 25 bp, Rattus norvegicus
ttgcccttcctgctaacgacacgga

SEQ ID NO: 678822 - DNA, 25 bp, Rattus norvegicus
ttgcccttcctggtaacgacacgga

SEQ ID NO: 678823 - DNA, 25 bp, Rattus norvegicus
ttgcccttcttaactgggaatcctc

SEQ ID NO: 678824 - DNA, 25 bp, Rattus norvegicus
ttgcccttcttatctgggaatcctc

SEQ ID NO: 678825 - DNA, 25 bp, Rattus norvegicus
ttgcccttgaatagatgccctttga

SEQ ID NO: 678826 - DNA, 25 bp, Rattus norvegicus
ttgcccttgaattgatgccctttga

SEQ ID NO: 678827 - DNA, 25 bp, Rattus norvegicus
ttgcccttgactagactgtagcttt

SEQ ID NO: 678828 - DNA, 25 bp, Rattus norvegicus
ttgcccttgacttgactgtagcttt

SEQ ID NO: 678829 - DNA, 25 bp, Rattus norvegicus
ttgcccttgatgaagagaaactgat

SEQ ID NO: 678830 - DNA, 25 bp, Rattus norvegicus
ttgcccttgatgtagagaaactgat

SEQ ID NO: 678831 - DNA, 25 bp, Rattus norvegicus
ttgcccttggtgcaagttacccttg

SEQ ID NO: 678832 - DNA, 25 bp, Rattus norvegicus
ttgcccttggtggaagttacccttg

SEQ ID NO: 678833 - DNA, 25 bp, Rattus norvegicus
ttgcccttgtggacctgttggtgta

SEQ ID NO: 678834 - DNA, 25 bp, Rattus norvegicus
ttgcccttgtggtcctgttggtgta

SEQ ID NO: 678835 - DNA, 25 bp, Rattus norvegicus
ttgccctttaacagccttgtcatag

SEQ ID NO: 678836 - DNA, 25 bp, Rattus norvegicus
ttgccctttaactgccttgtcatag

SEQ ID NO: 678837 - DNA, 25 bp, Rattus norvegicus
ttgccctttcagaacaaaccaggaa

SEQ ID NO: 678838 - DNA, 25 bp, Rattus norvegicus
ttgccctttcagtacaaaccaggaa

SEQ ID NO: 678839 - DNA, 25 bp, Rattus norvegicus
ttgccctttcatatccagaggtagg

SEQ ID NO: 678840 - DNA, 25 bp, Rattus norvegicus
ttgccctttcatttccagaggtagg

SEQ ID NO: 678841 - DNA, 25 bp, Rattus norvegicus
ttgccctttgccaggcgcttctgag

SEQ ID NO: 678842 - DNA, 25 bp, Rattus norvegicus
ttgccctttgcctggcgcttctgag

SEQ ID NO: 678843 - DNA, 25 bp, Rattus norvegicus
ttgccctttggcagcaggcttctgt

SEQ ID NO: 678844 - DNA, 25 bp, Rattus norvegicus
ttgccctttggcatgtttgaatttc

SEQ ID NO: 678845 - DNA, 25 bp, Rattus norvegicus
ttgccctttggctgcaggcttctgt

SEQ ID NO: 678846 - DNA, 25 bp, Rattus norvegicus
ttgccctttggcttgtttgaatttc

SEQ ID NO: 678847 - DNA, 25 bp, Rattus norvegicus
ttgccctttgtcaggttatgtgtta

SEQ ID NO: 678848 - DNA, 25 bp, Rattus norvegicus
ttgccctttgtccttttgcagagct

SEQ ID NO: 678849 - DNA, 25 bp, Rattus norvegicus
ttgccctttgtcgttttgcagagct

SEQ ID NO: 678850 - DNA, 25 bp, Rattus norvegicus
ttgccctttgtctggttatgtgtta

SEQ ID NO: 678851 - DNA, 25 bp, Rattus norvegicus
ttgccgaaactgcaactgaccctgg

SEQ ID NO: 678852 - DNA, 25 bp, Rattus norvegicus
ttgccgaaactggaactgaccctgg

SEQ ID NO: 678853 - DNA, 25 bp, Rattus norvegicus
ttgccgaactctcccaacatcaatg

SEQ ID NO: 678854 - DNA, 25 bp, Rattus norvegicus
ttgccgaactctgccaacatcaatg

SEQ ID NO: 678855 - DNA, 25 bp, Rattus norvegicus
ttgccgaagctgacaaacccaacta

SEQ ID NO: 678856 - DNA, 25 bp, Rattus norvegicus
ttgccgaagctgtcaaacccaacta

SEQ ID NO: 678857 - DNA, 25 bp, Rattus norvegicus
ttgccgaatccaaactgagcgaaca

SEQ ID NO: 678858 - DNA, 25 bp, Rattus norvegicus
ttgccgaatccatactgagcgaaca

SEQ ID NO: 678859 - DNA, 25 bp, Rattus norvegicus
ttgccgactgccagtatctgcgtgg

SEQ ID NO: 678860 - DNA, 25 bp, Rattus norvegicus
ttgccgactgcctgtatctgcgtgg

SEQ ID NO: 678861 - DNA, 25 bp, Rattus norvegicus
ttgccgactgggaatagacaacctc

SEQ ID NO: 678862 - DNA, 25 bp, Rattus norvegicus
ttgccgactgggtatagacaacctc

SEQ ID NO: 678863 - DNA, 25 bp, Rattus norvegicus
ttgccgagaaagagtgtcagctcct

SEQ ID NO: 678864 - DNA, 25 bp, Rattus norvegicus
ttgccgagaaagtgtgtcagctcct

SEQ ID NO: 678865 - DNA, 25 bp, Rattus norvegicus
ttgccgagacaaacagccaagcctt

SEQ ID NO: 678866 - DNA, 25 bp, Rattus norvegicus
ttgccgagacaatcagccaagcctt

SEQ ID NO: 678867 - DNA, 25 bp, Rattus norvegicus
ttgccgagcttcagtggacgagtat

SEQ ID NO: 678868 - DNA, 25 bp, Rattus norvegicus
ttgccgagcttctgtggacgagtat

SEQ ID NO: 678869 - DNA, 25 bp, Rattus norvegicus
ttgccgataacgatgatgtcgatgc

SEQ ID NO: 678870 - DNA, 25 bp, Rattus norvegicus
ttgccgataacgttgatgtcgatgc

SEQ ID NO: 678871 - DNA, 25 bp, Rattus norvegicus
ttgccgatgagcatggcgcgcttgc

SEQ ID NO: 678872 - DNA, 25 bp, Rattus norvegicus
ttgccgatgagcttggcgcgcttgc

SEQ ID NO: 678873 - DNA, 25 bp, Rattus norvegicus
ttgccgcagcgtattttgagaacct

SEQ ID NO: 678874 - DNA, 25 bp, Rattus norvegicus
ttgccgcagcgttttttgagaacct

SEQ ID NO: 678875 - DNA, 25 bp, Rattus norvegicus
ttgccgcagctcaccggacaggaga

SEQ ID NO: 678876 - DNA, 25 bp, Rattus norvegicus
ttgccgcagctctccggacaggaga

SEQ ID NO: 678877 - DNA, 25 bp, Rattus norvegicus
ttgccgcctgtgctactttaagaag

SEQ ID NO: 678878 - DNA, 25 bp, Rattus norvegicus
ttgccgcctgtggtactttaagaag

SEQ ID NO: 678879 - DNA, 25 bp, Rattus norvegicus
ttgccgccttacactaggctgattt

SEQ ID NO: 678880 - DNA, 25 bp, Rattus norvegicus
ttgccgccttactctaggctgattt

SEQ ID NO: 678881 - DNA, 25 bp, Rattus norvegicus
ttgccggcttatacactcttgtggt

SEQ ID NO: 678882 - DNA, 25 bp, Rattus norvegicus
ttgccggcttattcactcttgtggt

SEQ ID NO: 678883 - DNA, 25 bp, Rattus norvegicus
ttgccgggctccccagaactctgta

SEQ ID NO: 678884 - DNA, 25 bp, Rattus norvegicus
ttgccgggctccgcagaactctgta

SEQ ID NO: 678885 - DNA, 25 bp, Rattus norvegicus
ttgccggtccagcacttcacaaaag

SEQ ID NO: 678886 - DNA, 25 bp, Rattus norvegicus
ttgccggtccaggacttcacaaaag

SEQ ID NO: 678887 - DNA, 25 bp, Rattus norvegicus
ttgccggtcggccatatcccgagga

SEQ ID NO: 678888 - DNA, 25 bp, Rattus norvegicus
ttgccggtcggcgatatcccgagga

SEQ ID NO: 678889 - DNA, 25 bp, Rattus norvegicus
ttgccggtggcaactgagcgaagaa

SEQ ID NO: 678890 - DNA, 25 bp, Rattus norvegicus
ttgccggtggcatctgagcgaagaa

SEQ ID NO: 678891 - DNA, 25 bp, Rattus norvegicus
ttgccgtacatgctcccacattttg

SEQ ID NO: 678892 - DNA, 25 bp, Rattus norvegicus
ttgccgtacatggtcccacattttg

SEQ ID NO: 678893 - DNA, 25 bp, Rattus norvegicus
ttgccgtagctgacggagtttgtac

SEQ ID NO: 678894 - DNA, 25 bp, Rattus norvegicus
ttgccgtagctgtcggagtttgtac

SEQ ID NO: 678895 - DNA, 25 bp, Rattus norvegicus
ttgccgtcagcgatgttctgctagg

SEQ ID NO: 678896 - DNA, 25 bp, Rattus norvegicus
ttgccgtcagcgttgttctgctagg

SEQ ID NO: 678897 - DNA, 25 bp, Rattus norvegicus
ttgccgtcaggtctagattctctgt

SEQ ID NO: 678898 - DNA, 25 bp, Rattus norvegicus
ttgccgtcaggtgtagattctctgt

SEQ ID NO: 678899 - DNA, 25 bp, Rattus norvegicus
ttgccgtctaccctttctagatatt

SEQ ID NO: 678900 - DNA, 25 bp, Rattus norvegicus
ttgccgtctaccgtttctagatatt

SEQ ID NO: 678901 - DNA, 25 bp, Rattus norvegicus
ttgccgtgagctccagtgtttcaca

SEQ ID NO: 678902 - DNA, 25 bp, Rattus norvegicus
ttgccgtgagctgcagtgtttcaca

SEQ ID NO: 678903 - DNA, 25 bp, Rattus norvegicus
ttgccgtgcacacccacagagagaa

SEQ ID NO: 678904 - DNA, 25 bp, Rattus norvegicus
ttgccgtgcacagccacagagagaa

SEQ ID NO: 678905 - DNA, 25 bp, Rattus norvegicus
ttgccgtgtatcatctcccatgaga

SEQ ID NO: 678906 - DNA, 25 bp, Rattus norvegicus
ttgccgtgtatcttctcccatgaga

SEQ ID NO: 678907 - DNA, 25 bp, Rattus norvegicus
ttgccgtttgaaaggccctgtgacg

SEQ ID NO: 678908 - DNA, 25 bp, Rattus norvegicus
ttgccgtttgaatggccctgtgacg

SEQ ID NO: 678909 - DNA, 25 bp, Rattus norvegicus
ttgccgttttctcatgtcagctgct

SEQ ID NO: 678910 - DNA, 25 bp, Rattus norvegicus
ttgccgttttctgatgtcagctgct

SEQ ID NO: 678911 - DNA, 25 bp, Rattus norvegicus
ttgcctaaacccatgagtgctcaga

SEQ ID NO: 678912 - DNA, 25 bp, Rattus norvegicus
ttgcctaaacccttgagtgctcaga

SEQ ID NO: 678913 - DNA, 25 bp, Rattus norvegicus
ttgcctaagattcgccagaattaaa

SEQ ID NO: 678914 - DNA, 25 bp, Rattus norvegicus
ttgcctaagattggccagaattaaa

SEQ ID NO: 678915 - DNA, 25 bp, Rattus norvegicus
ttgcctaatcagctggccggccaac

SEQ ID NO: 678916 - DNA, 25 bp, Rattus norvegicus
ttgcctaatcaggtggccggccaac

SEQ ID NO: 678917 - DNA, 25 bp, Rattus norvegicus
ttgcctaatttcatttcacacttgg

SEQ ID NO: 678918 - DNA, 25 bp, Rattus norvegicus
ttgcctaatttcttttcacacttgg

SEQ ID NO: 678919 - DNA, 25 bp, Rattus norvegicus
ttgcctacaatgatgagcctatcca

SEQ ID NO: 678920 - DNA, 25 bp, Rattus norvegicus
ttgcctacaatgttgagcctatcca

SEQ ID NO: 678921 - DNA, 25 bp, Rattus norvegicus
ttgcctacacttcgtgccaggagga

SEQ ID NO: 678922 - DNA, 25 bp, Rattus norvegicus
ttgcctacacttggtgccaggagga

SEQ ID NO: 678923 - DNA, 25 bp, Rattus norvegicus
ttgcctacagagatcagatttcctt

SEQ ID NO: 678924 - DNA, 25 bp, Rattus norvegicus
ttgcctacagagttcagatttcctt

SEQ ID NO: 678925 - DNA, 25 bp, Rattus norvegicus
ttgcctacaggcagatgttgagaac

SEQ ID NO: 678926 - DNA, 25 bp, Rattus norvegicus
ttgcctacaggctgatgttgagaac

SEQ ID NO: 678927 - DNA, 25 bp, Rattus norvegicus
ttgcctaccctgagaggtccaggaa

SEQ ID NO: 678928 - DNA, 25 bp, Rattus norvegicus
ttgcctaccctgtgaggtccaggaa

SEQ ID NO: 678929 - DNA, 25 bp, Rattus norvegicus
ttgcctaccgcaatgacactattac

SEQ ID NO: 678930 - DNA, 25 bp, Rattus norvegicus
ttgcctaccgcattgacactattac

SEQ ID NO: 678931 - DNA, 25 bp, Rattus norvegicus
ttgcctactgccagtggaaacgcta

SEQ ID NO: 678932 - DNA, 25 bp, Rattus norvegicus
ttgcctactgcctgtggaaacgcta

SEQ ID NO: 678933 - DNA, 25 bp, Rattus norvegicus
ttgcctactgtgagttgggaactca

SEQ ID NO: 678934 - DNA, 25 bp, Rattus norvegicus
ttgcctactgtgtgttgggaactca

SEQ ID NO: 678935 - DNA, 25 bp, Rattus norvegicus
ttgcctacttagagactgtctgtca

SEQ ID NO: 678936 - DNA, 25 bp, Rattus norvegicus
ttgcctacttagtgactgtctgtca

SEQ ID NO: 678937 - DNA, 25 bp, Rattus norvegicus
ttgcctagaccacatatcatcccag

SEQ ID NO: 678938 - DNA, 25 bp, Rattus norvegicus
ttgcctagaccagatatcatcccag

SEQ ID NO: 678939 - DNA, 25 bp, Rattus norvegicus
ttgcctagcaccagacctgggctgg

SEQ ID NO: 678940 - DNA, 25 bp, Rattus norvegicus
ttgcctagcacctgacctgggctgg

SEQ ID NO: 678941 - DNA, 25 bp, Rattus norvegicus
ttgcctagcacgcaggaagctcagg

SEQ ID NO: 678942 - DNA, 25 bp, Rattus norvegicus
ttgcctagcacggaggaagctcagg

SEQ ID NO: 678943 - DNA, 25 bp, Rattus norvegicus
ttgcctagccacagggtgtgggcat

SEQ ID NO: 678944 - DNA, 25 bp, Rattus norvegicus
ttgcctagccactgggtgtgggcat

SEQ ID NO: 678945 - DNA, 25 bp, Rattus norvegicus
ttgcctagtcttcttgccaggtgct

SEQ ID NO: 678946 - DNA, 25 bp, Rattus norvegicus
ttgcctagtcttgttgccaggtgct

SEQ ID NO: 678947 - DNA, 25 bp, Rattus norvegicus
ttgcctataaccctgacttcatggg

SEQ ID NO: 678948 - DNA, 25 bp, Rattus norvegicus
ttgcctataaccgtgacttcatggg

SEQ ID NO: 678949 - DNA, 25 bp, Rattus norvegicus
ttgcctatagtcacagccagggcca

SEQ ID NO: 678950 - DNA, 25 bp, Rattus norvegicus
ttgcctatagtctcagccagggcca

SEQ ID NO: 678951 - DNA, 25 bp, Rattus norvegicus
ttgcctatctccagacctttgaaat

SEQ ID NO: 678952 - DNA, 25 bp, Rattus norvegicus
ttgcctatctcctgacctttgaaat

SEQ ID NO: 678953 - DNA, 25 bp, Rattus norvegicus
ttgcctatgcaccagtcctacaaat

SEQ ID NO: 678954 - DNA, 25 bp, Rattus norvegicus
ttgcctatgcacgagtcctacaaat

SEQ ID NO: 678955 - DNA, 25 bp, Rattus norvegicus
ttgcctattctgacttgtctcttct

SEQ ID NO: 678956 - DNA, 25 bp, Rattus norvegicus
ttgcctattctgtcttgtctcttct

SEQ ID NO: 678957 - DNA, 25 bp, Rattus norvegicus
ttgcctattgcacagtttgaccttt

SEQ ID NO: 678958 - DNA, 25 bp, Rattus norvegicus
ttgcctattgcagagtttgaccttt

SEQ ID NO: 678959 - DNA, 25 bp, Rattus norvegicus
ttgcctattttaataagatggacgt

SEQ ID NO: 678960 - DNA, 25 bp, Rattus norvegicus
ttgcctattttattaagatggacgt

SEQ ID NO: 678961 - DNA, 25 bp, Rattus norvegicus
ttgcctcaaagcaggatttcctcct

SEQ ID NO: 678962 - DNA, 25 bp, Rattus norvegicus
ttgcctcaaagctggatttcctcct

SEQ ID NO: 678963 - DNA, 25 bp, Rattus norvegicus
ttgcctcaacatagattcgcttttt

SEQ ID NO: 678964 - DNA, 25 bp, Rattus norvegicus
ttgcctcaacattgattcgcttttt

SEQ ID NO: 678965 - DNA, 25 bp, Rattus norvegicus
ttgcctcaagtcaacgaactcatca

SEQ ID NO: 678966 - DNA, 25 bp, Rattus norvegicus
ttgcctcaagtctacgaactcatca

SEQ ID NO: 678967 - DNA, 25 bp, Rattus norvegicus
ttgcctcacagaaaagatgccggta

SEQ ID NO: 678968 - DNA, 25 bp, Rattus norvegicus
ttgcctcacagataagatgccggta

SEQ ID NO: 678969 - DNA, 25 bp, Rattus norvegicus
ttgcctcacagccttaagtatctat

SEQ ID NO: 678970 - DNA, 25 bp, Rattus norvegicus
ttgcctcacagcgttaagtatctat

SEQ ID NO: 678971 - DNA, 25 bp, Rattus norvegicus
ttgcctcactccagagaagagctgt

SEQ ID NO: 678972 - DNA, 25 bp, Rattus norvegicus
ttgcctcactcctgagaagagctgt

SEQ ID NO: 678973 - DNA, 25 bp, Rattus norvegicus
ttgcctcactgtctaagtgccctga

SEQ ID NO: 678974 - DNA, 25 bp, Rattus norvegicus
ttgcctcactgtgtaagtgccctga

SEQ ID NO: 678975 - DNA, 25 bp, Rattus norvegicus
ttgcctcactttaggcctggctatt

SEQ ID NO: 678976 - DNA, 25 bp, Rattus norvegicus
ttgcctcacttttggcctggctatt

SEQ ID NO: 678977 - DNA, 25 bp, Rattus norvegicus
ttgcctcagcctctgtacgtagcac

SEQ ID NO: 678978 - DNA, 25 bp, Rattus norvegicus
ttgcctcagcctgtgtacgtagcac

SEQ ID NO: 678979 - DNA, 25 bp, Rattus norvegicus
ttgcctcaggatcgaccctttatga

SEQ ID NO: 678980 - DNA, 25 bp, Rattus norvegicus
ttgcctcaggatggaccctttatga

SEQ ID NO: 678981 - DNA, 25 bp, Rattus norvegicus
ttgcctcagttgatcctgatatcgt

SEQ ID NO: 678982 - DNA, 25 bp, Rattus norvegicus
ttgcctcagttgttcctgatatcgt

SEQ ID NO: 678983 - DNA, 25 bp, Rattus norvegicus
ttgcctcagtttcccgaagggctta

SEQ ID NO: 678984 - DNA, 25 bp, Rattus norvegicus
ttgcctcagtttgccgaagggctta

SEQ ID NO: 678985 - DNA, 25 bp, Rattus norvegicus
ttgcctcataggaaatgggttggtc

SEQ ID NO: 678986 - DNA, 25 bp, Rattus norvegicus
ttgcctcataggtaatgggttggtc

SEQ ID NO: 678987 - DNA, 25 bp, Rattus norvegicus
ttgcctcatcatattctcctcttgt

SEQ ID NO: 678988 - DNA, 25 bp, Rattus norvegicus
ttgcctcatcattttctcctcttgt

SEQ ID NO: 678989 - DNA, 25 bp, Rattus norvegicus
ttgcctcattacatccttgttggta

SEQ ID NO: 678990 - DNA, 25 bp, Rattus norvegicus
ttgcctcattacttccttgttggta

SEQ ID NO: 678991 - DNA, 25 bp, Rattus norvegicus
ttgcctcattgcattctgtttgact

SEQ ID NO: 678992 - DNA, 25 bp, Rattus norvegicus
ttgcctcattgctttctgtttgact

SEQ ID NO: 678993 - DNA, 25 bp, Rattus norvegicus
ttgcctcattttaacagttccctac

SEQ ID NO: 678994 - DNA, 25 bp, Rattus norvegicus
ttgcctcatttttacagttccctac

SEQ ID NO: 678995 - DNA, 25 bp, Rattus norvegicus
ttgcctccaactccaagatggctgc

SEQ ID NO: 678996 - DNA, 25 bp, Rattus norvegicus
ttgcctccaactgcaagatggctgc

SEQ ID NO: 678997 - DNA, 25 bp, Rattus norvegicus
ttgcctccaaggactgaagcttcct

SEQ ID NO: 678998 - DNA, 25 bp, Rattus norvegicus
ttgcctccaaggtctgaagcttcct

SEQ ID NO: 678999 - DNA, 25 bp, Rattus norvegicus
ttgcctccactcagtgacgcagaga

SEQ ID NO: 679000 - DNA, 25 bp, Rattus norvegicus
ttgcctccactctgtgacgcagaga

SEQ ID NO: 679001 - DNA, 25 bp, Rattus norvegicus
ttgcctccagcgacattctatgtgt

SEQ ID NO: 679002 - DNA, 25 bp, Rattus norvegicus
ttgcctccagcgtcattctatgtgt

SEQ ID NO: 679003 - DNA, 25 bp, Rattus norvegicus
ttgcctccaggtatgcttttcaaga

SEQ ID NO: 679004 - DNA, 25 bp, Rattus norvegicus
ttgcctccaggtcggatctgagcta

SEQ ID NO: 679005 - DNA, 25 bp, Rattus norvegicus
ttgcctccaggtgggatctgagcta

SEQ ID NO: 679006 - DNA, 25 bp, Rattus norvegicus
ttgcctccaggtttgcttttcaaga

SEQ ID NO: 679007 - DNA, 25 bp, Rattus norvegicus
ttgcctcccactatagtctgagtga

SEQ ID NO: 679008 - DNA, 25 bp, Rattus norvegicus
ttgcctcccactttagtctgagtga

SEQ ID NO: 679009 - DNA, 25 bp, Rattus norvegicus
ttgcctcccatgctattctacacta

SEQ ID NO: 679010 - DNA, 25 bp, Rattus norvegicus
ttgcctcccatggtattctacacta

SEQ ID NO: 679011 - DNA, 25 bp, Rattus norvegicus
ttgcctccctaaagtttctgtaagt

SEQ ID NO: 679012 - DNA, 25 bp, Rattus norvegicus
ttgcctccctaatgtttctgtaagt

SEQ ID NO: 679013 - DNA, 25 bp, Rattus norvegicus
ttgcctccctggacagaaggatgtg

SEQ ID NO: 679014 - DNA, 25 bp, Rattus norvegicus
ttgcctccctggtcagaaggatgtg

SEQ ID NO: 679015 - DNA, 25 bp, Rattus norvegicus
ttgcctcccttcataaagccagcag

SEQ ID NO: 679016 - DNA, 25 bp, Rattus norvegicus
ttgcctcccttcttaaagccagcag

SEQ ID NO: 679017 - DNA, 25 bp, Rattus norvegicus
ttgcctcccttgattctaattgtgt

SEQ ID NO: 679018 - DNA, 25 bp, Rattus norvegicus
ttgcctcccttgtttctaattgtgt

SEQ ID NO: 679019 - DNA, 25 bp, Rattus norvegicus
ttgcctccgccgacagctggaggtt

SEQ ID NO: 679020 - DNA, 25 bp, Rattus norvegicus
ttgcctccgccgtcagctggaggtt

SEQ ID NO: 679021 - DNA, 25 bp, Rattus norvegicus
ttgcctccgtttactcatctgtgaa

SEQ ID NO: 679022 - DNA, 25 bp, Rattus norvegicus
ttgcctccgttttctcatctgtgaa

SEQ ID NO: 679023 - DNA, 25 bp, Rattus norvegicus
ttgcctcctcttattgggatcattg

SEQ ID NO: 679024 - DNA, 25 bp, Rattus norvegicus
ttgcctcctctttttgggatcattg

SEQ ID NO: 679025 - DNA, 25 bp, Rattus norvegicus
ttgcctccttgaatgtgtgactctg

SEQ ID NO: 679026 - DNA, 25 bp, Rattus norvegicus
ttgcctccttgattgtgtgactctg

SEQ ID NO: 679027 - DNA, 25 bp, Rattus norvegicus
ttgcctcctttaaccaagaagaaag

SEQ ID NO: 679028 - DNA, 25 bp, Rattus norvegicus
ttgcctcctttatccaagaagaaag

SEQ ID NO: 679029 - DNA, 25 bp, Rattus norvegicus
ttgcctcgaatacttaaagtcctgt

SEQ ID NO: 679030 - DNA, 25 bp, Rattus norvegicus
ttgcctcgaatagttaaagtcctgt

SEQ ID NO: 679031 - DNA, 25 bp, Rattus norvegicus
ttgcctctaattcacagggttctca

SEQ ID NO: 679032 - DNA, 25 bp, Rattus norvegicus
ttgcctctaattgacagggttctca

SEQ ID NO: 679033 - DNA, 25 bp, Rattus norvegicus
ttgcctctacttagtattgttgaga

SEQ ID NO: 679034 - DNA, 25 bp, Rattus norvegicus
ttgcctctactttgtattgttgaga

SEQ ID NO: 679035 - DNA, 25 bp, Rattus norvegicus
ttgcctctagttatccagactttgg

SEQ ID NO: 679036 - DNA, 25 bp, Rattus norvegicus
ttgcctctagttttccagactttgg

SEQ ID NO: 679037 - DNA, 25 bp, Rattus norvegicus
ttgcctctattgaaagttctgtctt

SEQ ID NO: 679038 - DNA, 25 bp, Rattus norvegicus
ttgcctctattgtaagttctgtctt

SEQ ID NO: 679039 - DNA, 25 bp, Rattus norvegicus
ttgcctctcaggaccacacatggtg

SEQ ID NO: 679040 - DNA, 25 bp, Rattus norvegicus
ttgcctctcaggtccacacatggtg

SEQ ID NO: 679041 - DNA, 25 bp, Rattus norvegicus
ttgcctctccttcactacagggatt

SEQ ID NO: 679042 - DNA, 25 bp, Rattus norvegicus
ttgcctctccttgactacagggatt

SEQ ID NO: 679043 - DNA, 25 bp, Rattus norvegicus
ttgcctctctccagattttagtgaa

SEQ ID NO: 679044 - DNA, 25 bp, Rattus norvegicus
ttgcctctctcctgattttagtgaa

SEQ ID NO: 679045 - DNA, 25 bp, Rattus norvegicus
ttgcctctgaccatcaatccaagag

SEQ ID NO: 679046 - DNA, 25 bp, Rattus norvegicus
ttgcctctgaccttcaatccaagag

SEQ ID NO: 679047 - DNA, 25 bp, Rattus norvegicus
ttgcctctgacgctagcttgtttgc

SEQ ID NO: 679048 - DNA, 25 bp, Rattus norvegicus
ttgcctctgacggtagcttgtttgc

SEQ ID NO: 679049 - DNA, 25 bp, Rattus norvegicus
ttgcctctgctgagtctcctactgt

SEQ ID NO: 679050 - DNA, 25 bp, Rattus norvegicus
ttgcctctgctgtgtctcctactgt

SEQ ID NO: 679051 - DNA, 25 bp, Rattus norvegicus
ttgcctctgcttaatcaatgctgtt

SEQ ID NO: 679052 - DNA, 25 bp, Rattus norvegicus
ttgcctctgcttcatttaatgtccc

SEQ ID NO: 679053 - DNA, 25 bp, Rattus norvegicus
ttgcctctgcttgatttaatgtccc

SEQ ID NO: 679054 - DNA, 25 bp, Rattus norvegicus
ttgcctctgctttatcaatgctgtt

SEQ ID NO: 679055 - DNA, 25 bp, Rattus norvegicus
ttgcctctggcaagcaggaagacta

SEQ ID NO: 679056 - DNA, 25 bp, Rattus norvegicus
ttgcctctggcatgcaggaagacta

SEQ ID NO: 679057 - DNA, 25 bp, Rattus norvegicus
ttgcctctgggaacatcatggactc

SEQ ID NO: 679058 - DNA, 25 bp, Rattus norvegicus
ttgcctctgggatcatcatggactc

SEQ ID NO: 679059 - DNA, 25 bp, Rattus norvegicus
ttgcctctggttaaagtctttttat

SEQ ID NO: 679060 - DNA, 25 bp, Rattus norvegicus
ttgcctctggtttaagtctttttat

SEQ ID NO: 679061 - DNA, 25 bp, Rattus norvegicus
ttgcctctgtataactttgagccag

SEQ ID NO: 679062 - DNA, 25 bp, Rattus norvegicus
ttgcctctgtattactttgagccag

SEQ ID NO: 679063 - DNA, 25 bp, Rattus norvegicus
ttgcctctgtcaccttatattctag

SEQ ID NO: 679064 - DNA, 25 bp, Rattus norvegicus
ttgcctctgtcagcttatattctag

SEQ ID NO: 679065 - DNA, 25 bp, Rattus norvegicus
ttgcctctgtgtaaagttgcttcat

SEQ ID NO: 679066 - DNA, 25 bp, Rattus norvegicus
ttgcctctgtgttaagttgcttcat

SEQ ID NO: 679067 - DNA, 25 bp, Rattus norvegicus
ttgcctctgtttctatgtacctgta

SEQ ID NO: 679068 - DNA, 25 bp, Rattus norvegicus
ttgcctctgtttgtatgtacctgta

SEQ ID NO: 679069 - DNA, 25 bp, Rattus norvegicus
ttgcctcttaaaagaacagctattg

SEQ ID NO: 679070 - DNA, 25 bp, Rattus norvegicus
ttgcctcttaaatgaacagctattg

SEQ ID NO: 679071 - DNA, 25 bp, Rattus norvegicus
ttgcctcttcgtattgatggtggtt

SEQ ID NO: 679072 - DNA, 25 bp, Rattus norvegicus
ttgcctcttcgttttgatggtggtt

SEQ ID NO: 679073 - DNA, 25 bp, Rattus norvegicus
ttgcctcttctaaactccctaagga

SEQ ID NO: 679074 - DNA, 25 bp, Rattus norvegicus
ttgcctcttctatactccctaagga

SEQ ID NO: 679075 - DNA, 25 bp, Rattus norvegicus
ttgcctcttcttacgattgagactt

SEQ ID NO: 679076 - DNA, 25 bp, Rattus norvegicus
ttgcctcttctttcgattgagactt

SEQ ID NO: 679077 - DNA, 25 bp, Rattus norvegicus
ttgcctcttgtacatccagccttaa
